United States Patent 11,332,783 (SAMPLE ANALYSIS, PRESENCE DETERMINATION OF A TARGET SEQUENCE) - sequence listing, part 16

SEQ ID NO: 319637 - DNA, 75 bp, Artificial Sequence
  Synthetic
ttgatgaaatttcaatggccactaattatgatttgagcgttgtcaatgctagactacgtgcaaagcactatgttt

SEQ ID NO: 319638 - DNA, 75 bp, Artificial Sequence
  Synthetic
acaagaaaattaatgcctatttgcatggacattagagccataatggctacaatccaacgtaagtataaaggtatt

SEQ ID NO: 319639 - DNA, 75 bp, Artificial Sequence
  Synthetic
tgcaccacgcacattgcttactaagggcacacttgagcctgaatactttaattcagtgtgcagactcatgaaaac

SEQ ID NO: 319640 - DNA, 75 bp, Artificial Sequence
  Synthetic
tggacattagagccataatggctacaatccaacgtaagtataaaggtattaagattcaagaaggaatcgttgact

SEQ ID NO: 319641 - DNA, 75 bp, Artificial Sequence
  Synthetic
tagcaaagagcctgtagcttctattattacaaaactcaattctttaaatgaaccacttatcacaatgccgatagg

SEQ ID NO: 319642 - DNA, 75 bp, Artificial Sequence
  Synthetic
attacaaaactcaattctttaaatgaaccacttatcacaatgccgataggttatgtgacacatggttttaacctg

SEQ ID NO: 319643 - DNA, 75 bp, Artificial Sequence
  Synthetic
aaagagaagtcagctcaatgcttcaaaatgttctacaagggtgtgattacacatgacgtatcatctgcaatcaac

SEQ ID NO: 319644 - DNA, 75 bp, Artificial Sequence
  Synthetic
ctcttaaagctcctgctgtagtctcagtgtcttcaccagacgcagttactacatacaatggatacctcacatcat

SEQ ID NO: 319645 - DNA, 75 bp, Artificial Sequence
  Synthetic
agtgtcttcaccagacgcagttactacatacaatggatacctcacatcatcttcaaagacacctgaggaacactt

SEQ ID NO: 319646 - DNA, 75 bp, Artificial Sequence
  Synthetic
aattccttacgcgcaaccctgcttggagaaaagctgttttcatctctccctacaattcacagaatgcggtagcat

SEQ ID NO: 319647 - DNA, 75 bp, Artificial Sequence
  Synthetic
gagaaaagctgttttcatctctccctacaattcacagaatgcggtagcatctaaaattttaggattgcctactca

SEQ ID NO: 319648 - DNA, 75 bp, Artificial Sequence
  Synthetic
acgtatagagactggtcttactctggacaacgtacagaattaggtgttgaatttctcaagcgtggagataagatt

SEQ ID NO: 319649 - DNA, 75 bp, Artificial Sequence
  Synthetic
gacaacgtacagaattaggtgttgaatttctcaagcgtggagataagattgtctaccacactattgaaaaaccca

SEQ ID NO: 319650 - DNA, 75 bp, Artificial Sequence
  Synthetic
gagtatgactatgtcatattcacgcaaaccactgaaacagcacactcctgcaatgttaaccgctttaatgtggcc

SEQ ID NO: 319651 - DNA, 75 bp, Artificial Sequence
  Synthetic
caatgttaaccgctttaatgtggccattacaagagcaaaaattggcatcttatgcataatgtctgatagagatct

SEQ ID NO: 319652 - DNA, 75 bp, Artificial Sequence
  Synthetic
tctcccacttgacaagctcaagagtcttttgtctcttcgtgaggttaagactattaaagtgtttactactgtaga

SEQ ID NO: 319653 - DNA, 75 bp, Artificial Sequence
  Synthetic
caatactaacctccacacacaacttgtggacatgtctatgacatatggacagcactttggtccaacctatttgga

SEQ ID NO: 319654 - DNA, 75 bp, Artificial Sequence
  Synthetic
tggactttttaaggactgtagcaagatcattactggccttcatcctacacaggcaccaacacacctcagtgttga

SEQ ID NO: 319655 - DNA, 75 bp, Artificial Sequence
  Synthetic
tgtgttgacataccaggcatacctaaggacatgacctatcgaagactcatctctatgatgggttttaagatgaac

SEQ ID NO: 319656 - DNA, 75 bp, Artificial Sequence
  Synthetic
aggacatgacctatcgaagactcatctctatgatgggttttaagatgaactatcaagtcaatggttaccctaaca

SEQ ID NO: 319657 - DNA, 75 bp, Artificial Sequence
  Synthetic
ttctcggtagatacatgtctgctttgaatcacacaaagaaatggaaatttcctcaagttggtggtttaacttcaa

SEQ ID NO: 319658 - DNA, 75 bp, Artificial Sequence
  Synthetic
tcgtcacgttcgtgcatggataggcttcgatgttgagggttgtcatgcgactagagatgctgtagggacaaacct

SEQ ID NO: 319659 - DNA, 75 bp, Artificial Sequence
  Synthetic
tttgtccagtgttttattagcacttcagcagattgaggtgaagtttaatgcacccgcactacaagaggcctatta

SEQ ID NO: 319660 - DNA, 75 bp, Artificial Sequence
  Synthetic
cagcagattgaggtgaagtttaatgcacccgcactacaagaggcctattatagagctcgtgctggtgatgctgct

SEQ ID NO: 319661 - DNA, 75 bp, Artificial Sequence
  Synthetic
accgctccagttaggattttcaacaggtgttaacctagtagctgtaccaactggctatgttgacactgagaacaa

SEQ ID NO: 319662 - DNA, 75 bp, Artificial Sequence
  Synthetic
acagtaataaaactgtgggtgagttgggtgatgttagggaaactatgacccatcttctacaacatgccaacttgg

SEQ ID NO: 319663 - DNA, 75 bp, Artificial Sequence
  Synthetic
aaacctcctccaggtgaccaattcaaacatcttataccactcatgtataagggcttgccctggaacgtggtgcgc

SEQ ID NO: 319664 - DNA, 75 bp, Artificial Sequence
  Synthetic
catcttctacaacatgccaacttggaatccgctaagagggttcttaatttggtgtgtaagcattgcggacagaaa

SEQ ID NO: 319665 - DNA, 75 bp, Artificial Sequence
  Synthetic
aacatcttataccactcatgtataagggcttgccctggaacgtggtgcgcattaagattgtacagatgctcagtg

SEQ ID NO: 319666 - DNA, 75 bp, Artificial Sequence
  Synthetic
tggtttgttacatcgttatgccagtacatacattgtcaatccatgatggttacacaaatgaaatcattggttaca

SEQ ID NO: 319667 - DNA, 75 bp, Artificial Sequence
  Synthetic
agttgtgtttgtcctttgggcacatggctttgaacttacatcgatgaagtactttgtcaagatcgggcctgaaag

SEQ ID NO: 319668 - DNA, 75 bp, Artificial Sequence
  Synthetic
actttgtcaagatcgggcctgaaagaacgtgttgtctgtgtgacagacgtgcgacttgtttctctacttcatctg

SEQ ID NO: 319669 - DNA, 75 bp, Artificial Sequence
  Synthetic
atgctacacaatatctagtacaacaagagtcttcttttgttatgatgtctgcacctcctgctgagtacaagttgc

SEQ ID NO: 319670 - DNA, 75 bp, Artificial Sequence
  Synthetic
ttcttgaaaatggtagacttatcattagggaaaacaatagagttgtggtttcaagtgatattcttgttaacaact

SEQ ID NO: 319671 - DNA, 75 bp, Artificial Sequence
  Synthetic
tgagtacactggtaattatcagtgtggtcattacactcacataactgccaaggaaacgctctatcgtatagatgg

SEQ ID NO: 319672 - DNA, 75 bp, Artificial Sequence
  Synthetic
ccatttatgattgatgttcagcagtggggttttacaggtaacctgcagagtaaccatgatcaacactgtcaagtg

SEQ ID NO: 319673 - DNA, 75 bp, Artificial Sequence
  Synthetic
tgcttgtcagaataaagaagtgggacctgagcatagtgttgcagactaccacaatcactcaaacattgaaactcg

SEQ ID NO: 319674 - DNA, 75 bp, Artificial Sequence
  Synthetic
gtgatgctatcatgactagatgtcttgcagtccacgagtgctttgttaagcgcgttgattggtctgttgaatacc

SEQ ID NO: 319675 - DNA, 75 bp, Artificial Sequence
  Synthetic
tataaaggaccagtgactgatgttttctataaagaaacatcttacactacaactattaagcctgtgtcatacaaa

SEQ ID NO: 319676 - DNA, 75 bp, Artificial Sequence
  Synthetic
tgcagtccacgagtgctttgttaagcgcgttgattggtctgttgaatacccgattattggagatgaactgaagat

SEQ ID NO: 319677 - DNA, 75 bp, Artificial Sequence
  Synthetic
tctataaagaaacatcttacactacaactattaagcctgtgtcatacaaactcgacggagttacttacacagaga

SEQ ID NO: 319678 - DNA, 75 bp, Artificial Sequence
  Synthetic
taaaaaggataatgcttactacactgagcagcctattgatcttgtgccaactcaaccattgccaaatgcgagttt

SEQ ID NO: 319679 - DNA, 75 bp, Artificial Sequence
  Synthetic
catatggttgttaaatctgcattgcttgctgacaaattttcagttcttcacgacattggaaatccaaaggctatt

SEQ ID NO: 319680 - DNA, 75 bp, Artificial Sequence
  Synthetic
gagcagcctattgatcttgtgccaactcaaccattgccaaatgcgagttttgacaatttcaaactcacatgctct

SEQ ID NO: 319681 - DNA, 75 bp, Artificial Sequence
  Synthetic
atcaaatgacaggctttaaaaagccagcttcacgtgagctatctgtcacattctttccagacttgaatggcgatg

SEQ ID NO: 319682 - DNA, 75 bp, Artificial Sequence
  Synthetic
ctcagcgagtttcaagaaaggtgctaaactgctacataagccaattatttggcatatcaatcagactacaaacaa

SEQ ID NO: 319683 - DNA, 75 bp, Artificial Sequence
  Synthetic
acaagcacgcattccacactccagcttttgataagagtgcatttacttatttgaaacaattgccattcttttatt

SEQ ID NO: 319684 - DNA, 75 bp, Artificial Sequence
  Synthetic
tgtttacgttgtctttggagtacaaagccagttgaaacctcaaattcatttgaagttctggaagtagaaggcaca

SEQ ID NO: 319685 - DNA, 75 bp, Artificial Sequence
  Synthetic
ttttgataagagtgcatttacttatttgaaacaattgccattcttttattactctgatagtccttgcgagtctca

SEQ ID NO: 319686 - DNA, 75 bp, Artificial Sequence
  Synthetic
gactatgttccactcaaatctgctacgtgtattacgcgatgcaacttgggtggtgctgtttgcagacgtcatgca

SEQ ID NO: 319687 - DNA, 75 bp, Artificial Sequence
  Synthetic
cgtgtattacgcgatgcaacttgggtggtgctgtttgcagacgtcatgcaaacgagtacagacagtacttagatg

SEQ ID NO: 319688 - DNA, 75 bp, Artificial Sequence
  Synthetic
attcagtctctggatttacaaacagtttgacacttacaacctatggaacactttcaccaggttgcagagtttaga

SEQ ID NO: 319689 - DNA, 75 bp, Artificial Sequence
  Synthetic
atgaagatctaatggctgcttatgtagaaaatacaagcattaccattaagaaacctaatgagctctcgttggcct

SEQ ID NO: 319690 - DNA, 75 bp, Artificial Sequence
  Synthetic
taggtttaaaaacacttgccactcatggtgctgctgcaatcaatagtgtcccttggagtaaggttttggcttatg

SEQ ID NO: 319691 - DNA, 75 bp, Artificial Sequence
  Synthetic
taatgctgtttacaccaaagtagatggcaatgatgtggagatctttgagaataagacaacacttcctgttaatgt

SEQ ID NO: 319692 - DNA, 75 bp, Artificial Sequence
  Synthetic
agtcacaacatccaactgcatgaagaaatgtgtgcagcgcatttttaacaactatatgccttatgtcattacatt

SEQ ID NO: 319693 - DNA, 75 bp, Artificial Sequence
  Synthetic
atgtttctacaataggtgtctgtacaatgactgacattgcaaagaaacctactgagagtgcttgttcatcactta

SEQ ID NO: 319694 - DNA, 75 bp, Artificial Sequence
  Synthetic
attgttcacaattgcaatgtggctattgttgttaagcatttgcttgggttcattaatctatgtgactgcagcttt

SEQ ID NO: 319695 - DNA, 75 bp, Artificial Sequence
  Synthetic
atcccttcttattgtggtggtgttagagatttgtatatcaattcctctaatgtcaccattatggacttctgtgag

SEQ ID NO: 319696 - DNA, 75 bp, Artificial Sequence
  Synthetic
gagatttgtatatcaattcctctaatgtcaccattatggacttctgtgagggctcttttccttgtagtgtttgtt

SEQ ID NO: 319697 - DNA, 75 bp, Artificial Sequence
  Synthetic
gtcaatggagtcacattaattggagaatcagtaaaaacacagtttaattattttaagaaagtagacggcattatc

SEQ ID NO: 319698 - DNA, 75 bp, Artificial Sequence
  Synthetic
ttttaagaaagtagacggcattatccaacagctgccagaaacctacttcactcaaagcagagacttagaggactt

SEQ ID NO: 319699 - DNA, 75 bp, Artificial Sequence
  Synthetic
ttaccccgctttagaaactattcaggttacgatttcatcgtataagttggacctaacatttttaggtttagcagc

SEQ ID NO: 319700 - DNA, 75 bp, Artificial Sequence
  Synthetic
gttacgatttcatcgtataagttggacctaacatttttaggtttagcagctgaatggtttttggcatacatgttg

SEQ ID NO: 319701 - DNA, 75 bp, Artificial Sequence
  Synthetic
caaacccagatcaaaaatggagactgacttcctcgagctcgcaatggatgaattcatacaacgttataagctaga

SEQ ID NO: 319702 - DNA, 75 bp, Artificial Sequence
  Synthetic
gtctctctgctataatgcaggtgttctttggctactttgctagtcatttcatcagcaattcatggcttatgtggt

SEQ ID NO: 319703 - DNA, 75 bp, Artificial Sequence
  Synthetic
ctttggctactttgctagtcatttcatcagcaattcatggcttatgtggtttatcattagcattgtacaaatggc

SEQ ID NO: 319704 - DNA, 75 bp, Artificial Sequence
  Synthetic
ttggtggacttcatctaatgattggtctagccaagcgttctcaagattcaccgcttaaactagaggattttatcc

SEQ ID NO: 319705 - DNA, 75 bp, Artificial Sequence
  Synthetic
tacattttctttgcttctttctattatatatggaaaagctatgttcatattatggatggttgcacttcttcaacg

SEQ ID NO: 319706 - DNA, 75 bp, Artificial Sequence
  Synthetic
tttcataacagatgctcagacaggttcatcaaaatgtgtgtgctctgttattgaccttttacttgatgactttgt

SEQ ID NO: 319707 - DNA, 75 bp, Artificial Sequence
  Synthetic
tgcatgatgagctacaagcgcaatcgtgctacgcgcgttgagtgtacaactatagttaatggcatgaaaagatct

SEQ ID NO: 319708 - DNA, 75 bp, Artificial Sequence
  Synthetic
tatagttaatggcatgaaaagatctttctatgtctatgcaaacggaggccgtggcttctgtaaggctcacaattg

SEQ ID NO: 319709 - DNA, 75 bp, Artificial Sequence
  Synthetic
aagtggcacttgtggcatagtagagctggaaaaaggcgtattgccccagcttgaacagccctatgtgttcattaa

SEQ ID NO: 319710 - DNA, 75 bp, Artificial Sequence
  Synthetic
ttctatgtctatgcaaacggaggccgtggcttctgtaaggctcacaattggaactgtcttaattgtgatacattc

SEQ ID NO: 319711 - DNA, 75 bp, Artificial Sequence
  Synthetic
acgatctgacgcccagggcactggtcatggccacaaggtctgcgagctagttgctgaattggatggcgttcagtt

SEQ ID NO: 319712 - DNA, 75 bp, Artificial Sequence
  Synthetic
acgaagtagctcatgatttgtcactccagtttaagagaccaattaatcctacagaccagtcttcttatgttgttg

SEQ ID NO: 319713 - DNA, 75 bp, Artificial Sequence
  Synthetic
gggtgttgcaatgcctaacttgtataagatgcaaagaatgcttcttgaaaaatgtgaccttcagaattatggtga

SEQ ID NO: 319714 - DNA, 75 bp, Artificial Sequence
  Synthetic
ccagtttaagagaccaattaatcctacagaccagtcttcttatgttgttgatagtgttgctgtgaagaacggtgc

SEQ ID NO: 319715 - DNA, 75 bp, Artificial Sequence
  Synthetic
ggtcagaagacttacgagagacacccactttctcattttgtcaatttggacaatctgagagctaacaacactaag

SEQ ID NO: 319716 - DNA, 75 bp, Artificial Sequence
  Synthetic
cactttctcattttgtcaatttggacaatctgagagctaacaacactaagggttcattacctattaatgttattg

SEQ ID NO: 319717 - DNA, 75 bp, Artificial Sequence
  Synthetic
agctgtcctcagacagtggttgccaactggcgcactacttgttgattctgatcttaatgacttcgtctctgacgc

SEQ ID NO: 319718 - DNA, 75 bp, Artificial Sequence
  Synthetic
ctctttctgaacaacttgattttattgagtcgaagagaggtgtctactgctgtcgtgaacatgagcatgaaattg

SEQ ID NO: 319719 - DNA, 75 bp, Artificial Sequence
  Synthetic
aaagagaatgactcaaaagaagggtttttcacctatctgtgtggatttattaaacaaaagctcgctctgggaggt

SEQ ID NO: 319720 - DNA, 75 bp, Artificial Sequence
  Synthetic
tttggatggtgtcttatccacatttatttcagctgcccgtcaaggcgttgttgatactgatgttgatacaaagga

SEQ ID NO: 319721 - DNA, 75 bp, Artificial Sequence
  Synthetic
attcctggaatgctgatctttacaagcttatgggacatttctcatggtggacagcttttgttacaaatgttaatg

SEQ ID NO: 319722 - DNA, 75 bp, Artificial Sequence
  Synthetic
gagctatgagcaccagacacccttcgagatcaagagtgccaagaaatttgacactttcaaaggggaatgcccaaa

SEQ ID NO: 319723 - DNA, 75 bp, Artificial Sequence
  Synthetic
acagcttttgttacaaatgttaatgcatcatcatctgaggcatttttaattggagttaattatcttggcaagcta

SEQ ID NO: 319724 - DNA, 75 bp, Artificial Sequence
  Synthetic
gtcaaagtcattcaaccacgtgttgaaaagaaaaagactgaaggtttcatggggcgtatacgctctgtgtaccct

SEQ ID NO: 319725 - DNA, 75 bp, Artificial Sequence
  Synthetic
gtgacagctgtaataacttcatgctcacctataacaaagttgaaaacatgacgcccagagatcttggtgcatgta

SEQ ID NO: 319726 - DNA, 75 bp, Artificial Sequence
  Synthetic
atttcagctgcccgtcaaggcgttgttgatactgatgttgatacaaaggacgtcattgaatgtctcaagctttct

SEQ ID NO: 319727 - DNA, 75 bp, Artificial Sequence
  Synthetic
gaacacaaatcctattcaattgtcttcctattcacttttcgacatgagcaaatttcctctcaagttaagagggac

SEQ ID NO: 319728 - DNA, 75 bp, Artificial Sequence
  Synthetic
ctattctggtgtcgttacgactatcatgtttttagctagagctatagtgtttgtgtgtgttgagtattacccatt

SEQ ID NO: 319729 - DNA, 75 bp, Artificial Sequence
  Synthetic
caaatcaatgatatgatttattcccttcttgaaaatggtagacttatcattagggaaaacaatagagttgtggtt

SEQ ID NO: 319730 - DNA, 75 bp, Artificial Sequence
  Synthetic
gcgcaagcaaattcgtggtgctgctaaaaagaacaacataccctttaggctcacttgtgctactactaggcaagt

SEQ ID NO: 319731 - DNA, 75 bp, Artificial Sequence
  Synthetic
aaattcagtccgtgaaggacccactacatgtgggtacctacctactaatgctgtactgaaaatgccttgtcctgc

SEQ ID NO: 319732 - DNA, 75 bp, Artificial Sequence
  Synthetic
aatacctgctaagaaggctggtggtactacagaaatgcttgcaaaggcattaaagaaagtgccagtgtgtgagta

SEQ ID NO: 319733 - DNA, 75 bp, Artificial Sequence
  Synthetic
tcactcaagggtggtaaggttgttagtacttggtttaaatttatgctgaaagtcacacttttgtgtgttctatct

SEQ ID NO: 319734 - DNA, 75 bp, Artificial Sequence
  Synthetic
tgctctgctcttcagtctagctaaagcacaggaaggatgtggcattattagtagaaagccacagccaaagatgga

SEQ ID NO: 319735 - DNA, 75 bp, Artificial Sequence
  Synthetic
gagcatagtgttgcagactaccacaaccactcaaacattgaaactcgactccgcaagggaggtaggattaaatgt

SEQ ID NO: 319736 - DNA, 75 bp, Artificial Sequence
  Synthetic
ttcggtgggtgtgtgtttgcctatgttggctgctataacaagcgtgcctactgggttcctcgtgctagtgccgat

SEQ ID NO: 319737 - DNA, 75 bp, Artificial Sequence
  Synthetic
ttggctgctataacaagcgtgcctactgggttcctcgtgctagtgccgatattggtgcaaaccatactggcatta

SEQ ID NO: 319738 - DNA, 75 bp, Artificial Sequence
  Synthetic
tggttatacaaatgaaatcattggatacaaagctatccaggacggtgtcactcgtgacatagtgtctactgatga

SEQ ID NO: 319739 - DNA, 75 bp, Artificial Sequence
  Synthetic
gttctgatgttttacacctcactcaagactattttttgccctttgactcaaatttaacacagtacttttctttga

SEQ ID NO: 319740 - DNA, 75 bp, Artificial Sequence
  Synthetic
gcacaggaaggatgtggcattattagtagaaagccacagccaaagatggaaaaagtctcatcctctcggcgaggt

SEQ ID NO: 319741 - DNA, 75 bp, Artificial Sequence
  Synthetic
agactattttttgccctttgactcaaatttaacacagtacttttctttgaatattgattcaaataagtatactta

SEQ ID NO: 319742 - DNA, 75 bp, Artificial Sequence
  Synthetic
gtacttggtttaaatttatgctgaaagtcacacttttgtgtgttctatctgcattattctgttacatcattatgc

SEQ ID NO: 319743 - DNA, 75 bp, Artificial Sequence
  Synthetic
gtggttcttataggaatgataagagctgccctgttgtagctgccatcattactagggagattggtttcatcgtgc

SEQ ID NO: 319744 - DNA, 75 bp, Artificial Sequence
  Synthetic
ggtgatggtgtctattttgccgccacggaaaagtctaatgttataagaggctggatttttggttcatcgtttgac

SEQ ID NO: 319745 - DNA, 75 bp, Artificial Sequence
  Synthetic
actagggagattggtttcatcgtgcctggattacctggtactgtgttaagaacaattaatggtgactttttgcat

SEQ ID NO: 319746 - DNA, 75 bp, Artificial Sequence
  Synthetic
acactgtaaagggccttgactacaagaccttcaaagccattgttgaatcctgtggaaactacaaagttaccaaag

SEQ ID NO: 319747 - DNA, 75 bp, Artificial Sequence
  Synthetic
cggaaaagtctaatgttataagaggctggatttttggttcatcgtttgacaacacaacccagtccgctattatag

SEQ ID NO: 319748 - DNA, 75 bp, Artificial Sequence
  Synthetic
tacaaagctatccaggacggtgtcactcgtgacatagtgtctactgatgattgttttgcaaacaaacatgctggt

SEQ ID NO: 319749 - DNA, 75 bp, Artificial Sequence
  Synthetic
ttggcaacatttgctacacaccatcaaaacttattgagtatagtgattttgctacttctgcttgcgtcttggctg

SEQ ID NO: 319750 - DNA, 75 bp, Artificial Sequence
  Synthetic
acgtgtgtgtaactttaacttatgtaaagaacccatgtacactgtgtcaaaaggcacacaacaatcatcttgggt

SEQ ID NO: 319751 - DNA, 75 bp, Artificial Sequence
  Synthetic
acaccgctgtgtggttttccctcacgggctgccagtgtcattagatcaatcttttctcgcacactcgatgcagca

SEQ ID NO: 319752 - DNA, 75 bp, Artificial Sequence
  Synthetic
gaccttcaaagccattgttgaatcctgtggaaactacaaagttaccaaaggaaaacctgtccaaggagcttggaa

SEQ ID NO: 319753 - DNA, 75 bp, Artificial Sequence
  Synthetic
tatgggtaagcctgtgccatattgttatgacactaacttactagagggttctatttcttacagtgagctgcgtcc

SEQ ID NO: 319754 - DNA, 75 bp, Artificial Sequence
  Synthetic
tatgatagagtagagaaaagttttcaacttgacactgctcctaaaactggaaactttaaagacctacgtgagtat

SEQ ID NO: 319755 - DNA, 75 bp, Artificial Sequence
  Synthetic
tatgacactaacttactagagggttctatttcttacagtgagctgcgtcctgacactcgttatgtgcttatggat

SEQ ID NO: 319756 - DNA, 75 bp, Artificial Sequence
  Synthetic
tatttcagagcattcattgcgtcttgttgacgccatgacttacacctcagatctgttcaccaacagtgtcattat

SEQ ID NO: 319757 - DNA, 75 bp, Artificial Sequence
  Synthetic
ttagtgtttaccaaacctatactgctgttaatttacctaggggctttccagcaggtttttcagttttgagaccaa

SEQ ID NO: 319758 - DNA, 75 bp, Artificial Sequence
  Synthetic
cctacctagaaggttctgttagagtggttacaacttttgatgcagaatactgccgtcatggcacatgtgagaggt

SEQ ID NO: 319759 - DNA, 75 bp, Artificial Sequence
  Synthetic
tgttaatttacctaggggctttccagcaggtttttcagttttgagaccaattctcaaactcccttttggaattaa

SEQ ID NO: 319760 - DNA, 75 bp, Artificial Sequence
  Synthetic
tgccgtcatggcacatgtgagaggtcagaagctggtatttgcctgtctactagtggtagatgggttcttaataat

SEQ ID NO: 319761 - DNA, 75 bp, Artificial Sequence
  Synthetic
ctaacttagtaggctctgctgctgagaagctgcgacccgtgtttgcatgggttgagtctagacttagtgatggaa

SEQ ID NO: 319762 - DNA, 75 bp, Artificial Sequence
  Synthetic
actatgtttagccaattcaactctaatttcttaccagagagtgctgcttattatgttggtaatttaaaatatact

SEQ ID NO: 319763 - DNA, 75 bp, Artificial Sequence
  Synthetic
gttgagtctagacttagtgatggaattgaatttctcaaggatgcttgggagattcttaaattcttgatcaggggt

SEQ ID NO: 319764 - DNA, 75 bp, Artificial Sequence
  Synthetic
tcttttgtggtgttgatgccatgaatcttattgctaacatcttcacacctcttgttcaacctgttggtgctttag

SEQ ID NO: 319765 - DNA, 75 bp, Artificial Sequence
  Synthetic
atttcttaccagagagtgctgcttattatgttggtaatttaaaatatactacattcatgcttagtttcaatgaga

SEQ ID NO: 319766 - DNA, 75 bp, Artificial Sequence
  Synthetic
gttgacgccatgacttacacctcagatctgttcaccaacagtgtcattattatggcatatgttacgggcggactt

SEQ ID NO: 319767 - DNA, 75 bp, Artificial Sequence
  Synthetic
ttgttcccaaaatcctcttgccgaattaaaatgcaccatcaaaaattttaatgtcagtaaaggaatctatcaaac

SEQ ID NO: 319768 - DNA, 75 bp, Artificial Sequence
  Synthetic
tggtattattgccatattggtgacttgtgctgcttactactttatgaaattcaggcgtgcatttggtgagtacaa

SEQ ID NO: 319769 - DNA, 75 bp, Artificial Sequence
  Synthetic
tacaggttacctcagataatatcaaggagtgtgtaaaaagcttcattgatgttattaataaggcacttgaaatgt

SEQ ID NO: 319770 - DNA, 75 bp, Artificial Sequence
  Synthetic
atgtcagtaaaggaatctatcaaacatctaacttcagagtcacaccgactcaagaggttgttaggtttccaaaca

SEQ ID NO: 319771 - DNA, 75 bp, Artificial Sequence
  Synthetic
cacaaagttgcgatcactcaacttaggtgagattttcatcgctcaaagcaagggactctaccgccagtgcattcg

SEQ ID NO: 319772 - DNA, 75 bp, Artificial Sequence
  Synthetic
ggtgagattttcatcgctcaaagcaagggactctaccgccagtgcattcgtggtaaagagcagctgcaattactc

SEQ ID NO: 319773 - DNA, 75 bp, Artificial Sequence
  Synthetic
ctgtttttgatgtctttcactatactctgtttggcacctgcctatagctttttgccaggagtttattctgtcttt

SEQ ID NO: 319774 - DNA, 75 bp, Artificial Sequence
  Synthetic
aaatttctgattgtgttgctgattacactgttctctacaactcgacctctttctcaacttttaaatgttatggag

SEQ ID NO: 319775 - DNA, 75 bp, Artificial Sequence
  Synthetic
tcactttcttcgagggtgatgtacacgatactgtgcttacctctgaagaggttgttcttaagaatggtgaactcg

SEQ ID NO: 319776 - DNA, 75 bp, Artificial Sequence
  Synthetic
ccttcaatggtttgctatgttttctcccattgtgcctttctggataacagccatttatgtgttctgcatctcctt

SEQ ID NO: 319777 - DNA, 75 bp, Artificial Sequence
  Synthetic
cgatactgtgcttacctctgaagaggttgttcttaagaatggtgaactcgaagcacttgagacaccagttgatag

SEQ ID NO: 319778 - DNA, 75 bp, Artificial Sequence
  Synthetic
atgctttacaagtgtgtatgcagatacattcttgataagatcttcagaagtgagacaagtagcaccaggtgaaac

SEQ ID NO: 319779 - DNA, 75 bp, Artificial Sequence
  Synthetic
acattcttgataagatcttcagaagtgagacaagtagcaccaggtgaaactggtgttattgctgattacaactac

SEQ ID NO: 319780 - DNA, 75 bp, Artificial Sequence
  Synthetic
aactaccttaagagaagagtcatgtttaatggagttacatttagcacctttgaggaggctgctttatgtaccttt

SEQ ID NO: 319781 - DNA, 75 bp, Artificial Sequence
  Synthetic
acacctgtgtgcataaatggactcatgctcttagaattaaaagacaaggagcaatattgcgctttgtctccagga

SEQ ID NO: 319782 - DNA, 75 bp, Artificial Sequence
  Synthetic
ttaatggagttacatttagcacctttgaggaggctgctttatgtacctttttacttaacaaggaaatgtacctca

SEQ ID NO: 319783 - DNA, 75 bp, Artificial Sequence
  Synthetic
gtgtaatagcttggaatactgcacaacaggaccaaggtcaatattactacagatcttacagaaaggaaaaactca

SEQ ID NO: 319784 - DNA, 75 bp, Artificial Sequence
  Synthetic
acaggaccaaggtcaatattactacagatcttacagaaaggaaaaactcaaaccttttgagagggatttgtcatc

SEQ ID NO: 319785 - DNA, 75 bp, Artificial Sequence
  Synthetic
acttacacagtacaacaggtaccttgctctctataacaagtacaagtatttcagtggggccttggacacaaccag

SEQ ID NO: 319786 - DNA, 75 bp, Artificial Sequence
  Synthetic
aggtgtaacttttggagaggacactgttgttgaagttcagggctataagaatgtgaagattacattcgagcttga

SEQ ID NO: 319787 - DNA, 75 bp, Artificial Sequence
  Synthetic
aagccgtgatgtatatgggtactttgtcttatgatgagcttaaggcaggtgtttcaattccttgtgtgtgtggtc

SEQ ID NO: 319788 - DNA, 75 bp, Artificial Sequence
  Synthetic
agtacttatgacttctaccctagtatcccagttgaataccaggcaactagggttgttgtactctcttttgaactt

SEQ ID NO: 319789 - DNA, 75 bp, Artificial Sequence
  Synthetic
gggcagtttagctgctacagtacgtcttcaggctggaaatgctacagaagtacctgccaattcaactgtgctttc

SEQ ID NO: 319790 - DNA, 75 bp, Artificial Sequence
  Synthetic
gtaactccggtgctgatgtcctctaccaaccaccacaaacttcaatcacatctgcagttttgcagagtggtttta

SEQ ID NO: 319791 - DNA, 75 bp, Artificial Sequence
  Synthetic
agtcaggtacagaagtgtctgaatttgcatgtgttgtagctgaggcggttgtgaaaacattacaacctgtctctg

SEQ ID NO: 319792 - DNA, 75 bp, Artificial Sequence
  Synthetic
tcccagttgaataccaggcaactagggttgttgtactctcttttgaacttttaaatgcacctgcaacagtttgtg

SEQ ID NO: 319793 - DNA, 75 bp, Artificial Sequence
  Synthetic
taagaatcaatgtgtcaattttaactttaatggactcaggggtactggtgtgctgaccacttcatctaagaggtt

SEQ ID NO: 319794 - DNA, 75 bp, Artificial Sequence
  Synthetic
gctctctataacaagtacaagtatttcagtggggccttggacacaaccagctatcgtgaagcagcttgctgccac

SEQ ID NO: 319795 - DNA, 75 bp, Artificial Sequence
  Synthetic
ttctacttatttgatgactctggtgaagaaaatctttcatcacgtatgtattgctccttttatcctcccgacgag

SEQ ID NO: 319796 - DNA, 75 bp, Artificial Sequence
  Synthetic
acttgtggaaccacaactcttaacggattgtggttagatgacacagtatattgtccaagacatgttatttgcaca

SEQ ID NO: 319797 - DNA, 75 bp, Artificial Sequence
  Synthetic
tgctgaccacttcatctaagaggttccagtcattccagcaatttggcagagacacgtctgacttcactgactcag

SEQ ID NO: 319798 - DNA, 75 bp, Artificial Sequence
  Synthetic
ttgctccttttatcctcccgacgaggaagaagagggtgatgcggagtgtgaggaagaagaaattgctgatgagac

SEQ ID NO: 319799 - DNA, 75 bp, Artificial Sequence
  Synthetic
acttgacatttcaccatgttcttttggtggtgttagtgtaattacaccaggaacaaatgcttcttctgaagttgc

SEQ ID NO: 319800 - DNA, 75 bp, Artificial Sequence
  Synthetic
ttgtccaagacatgttatttgcacagcagaagacatgcttaatccaaactatgaagacctgctcatccgtaagtc

SEQ ID NO: 319801 - DNA, 75 bp, Artificial Sequence
  Synthetic
ggtggtgttagtgtaattacaccaggaacaaatgcttcttctgaagttgctgttctttaccaagatgttaactgt

SEQ ID NO: 319802 - DNA, 75 bp, Artificial Sequence
  Synthetic
taggcttaaagttgatacctctaaccctaagacaccaaagtataaatttgtccgtatccaaccaggtcagacatt

SEQ ID NO: 319803 - DNA, 75 bp, Artificial Sequence
  Synthetic
cagatcaactaacacctgcttggcgtgtttattcaactggagtaaatgtgtttcaaacacaagctggctgtctta

SEQ ID NO: 319804 - DNA, 75 bp, Artificial Sequence
  Synthetic
tgtttattcaactggagtaaatgtgtttcaaacacaagctggctgtcttattggagctgaacatgtcaatgcttc

SEQ ID NO: 319805 - DNA, 75 bp, Artificial Sequence
  Synthetic
gctggcatttgtgctagctaccatacagcttcagtgttacgtagtacaggtcagaaatccattgtggcttatact

SEQ ID NO: 319806 - DNA, 75 bp, Artificial Sequence
  Synthetic
gggttctttcctcaatgggtcatgtggtagtgttggttttaacattgactatgattgcgtgtccttttgctatat

SEQ ID NO: 319807 - DNA, 75 bp, Artificial Sequence
  Synthetic
atgattgcgtgtccttttgctatatgcatcacatggagcttccaactggagtacacgctggcaccgacttagaag

SEQ ID NO: 319808 - DNA, 75 bp, Artificial Sequence
  Synthetic
tcgcttatgctaataattcaattgccatacctacaaatttctcaataagcgtcacaactgaagtgatgcctgttt

SEQ ID NO: 319809 - DNA, 75 bp, Artificial Sequence
  Synthetic
tggtgtttacgttgtctttggagtacaaagccagttgaaacctcaaattcatttgaagttctggaagtagaagac

SEQ ID NO: 319810 - DNA, 75 bp, Artificial Sequence
  Synthetic
ttttggcttggctctatgctgctgttattaatggagatagatggttccttaataggtttaccacaactctgaatg

SEQ ID NO: 319811 - DNA, 75 bp, Artificial Sequence
  Synthetic
agtatggaagcttctgcacacaactaaaccgtgccttgactggcattgctattgaacaggacaagaacacgcagg

SEQ ID NO: 319812 - DNA, 75 bp, Artificial Sequence
  Synthetic
taactactgaaatatgtcaagccaattcatttttgaagatgtaccacaacggaatgcagctacatttaacccgga

SEQ ID NO: 319813 - DNA, 75 bp, Artificial Sequence
  Synthetic
ttcatttttgaagatgtaccacaacggaatgcagctacatttaacccggaggtcgggtatgtggcatttattggt

SEQ ID NO: 319814 - DNA, 75 bp, Artificial Sequence
  Synthetic
cataagacggcacaaccaagtgtcgatcttacttttggtggggtcaaattcacagtggttaataaccattttccc

SEQ ID NO: 319815 - DNA, 75 bp, Artificial Sequence
  Synthetic
atcttacttttggtggggtcaaattcacagtggttaataaccattttccccaatatgtctcaaatcctgtgccag

SEQ ID NO: 319816 - DNA, 75 bp, Artificial Sequence
  Synthetic
caatatgtctcaaatcctgtgccagacaatgccatcacacttcacaggatgtcgggatatctagcacgatgggtt

SEQ ID NO: 319817 - DNA, 75 bp, Artificial Sequence
  Synthetic
gctgatacatgcaaggctagtgtccttaagttggctgaagcaagtgctcagattgtcatgcctcttgctgaagtt

SEQ ID NO: 319818 - DNA, 75 bp, Artificial Sequence
  Synthetic
gattgtcatgcctcttgctgaagttaaaggttgcacttgggctgatggttatacaatgtatcttggatttgcacc

SEQ ID NO: 319819 - DNA, 75 bp, Artificial Sequence
  Synthetic
cgccagagctttcttgcagcaattcggtattaacatctaaacctctccgttacatactctttaatttccgtgcaa

SEQ ID NO: 319820 - DNA, 75 bp, Artificial Sequence
  Synthetic
tctttaatttccgtgcaatatgtctatgtattgcacaccatcatactgcaaggcttctgttgaaatagttaataa

SEQ ID NO: 319821 - DNA, 75 bp, Artificial Sequence
  Synthetic
atcaaaatgcttctcaacattatcttgatatcgaacctagcctatttggcttttacactcccacttaaggaaggc

SEQ ID NO: 319822 - DNA, 75 bp, Artificial Sequence
  Synthetic
actagaggctctagatgcttcttaaatggagagttggttaagactgtcaacacatcaaaagtagtttcagagtgc

SEQ ID NO: 319823 - DNA, 75 bp, Artificial Sequence
  Synthetic
tgcgtaaaagatgatatatctatcatcaaatcaaactctgaacattataaatcaggcgatagactggctgccgta

SEQ ID NO: 319824 - DNA, 75 bp, Artificial Sequence
  Synthetic
ataaaatactatcgactgtatcaagtaaaagattggcattcatgcaatccaatttacgacgaccatggctccttc

SEQ ID NO: 319825 - DNA, 75 bp, Artificial Sequence
  Synthetic
atgatattagatatcgataacaccggcacattaatccctaaaatgcatacatgtagggctgagtgtgagatttcc

SEQ ID NO: 319826 - DNA, 75 bp, Artificial Sequence
  Synthetic
atgtagggctgagtgtgagatttccctcaataaagatacaggtgaaattttgctaaactcttatagaattaatca

SEQ ID NO: 319827 - DNA, 75 bp, Artificial Sequence
  Synthetic
ttatcgaatatctggtacaatgcatgtatcaggttggtttaaaaataaaattgaaatccctttagaaaacacatg

SEQ ID NO: 319828 - DNA, 75 bp, Artificial Sequence
  Synthetic
tgaatctattgaagtaacatgtggattgaaaaccctcagtttccatgcatgctttcatacgcacaaatcatgcat

SEQ ID NO: 319829 - DNA, 75 bp, Artificial Sequence
  Synthetic
acgttacttcaaaggatcaattcttcctgagctaatgattgaatcattttgtacaaatctcgagctgattttatt

SEQ ID NO: 319830 - DNA, 75 bp, Artificial Sequence
  Synthetic
aataacttttatattagcaggttctgttatgatgatgatactaacaaaaacatacatagtgtacatatttatccc

SEQ ID NO: 319831 - DNA, 75 bp, Artificial Sequence
  Synthetic
tatattttatccgtttgtaaaattatatgcttatatgtataataagtattttaaattatgcaaaaattgtctatt

SEQ ID NO: 319832 - DNA, 75 bp, Artificial Sequence
  Synthetic
agcagtgcatccctttacaaactgcccatcaacatgcatctgcggaatgaattacactactacagaatcacttaa

SEQ ID NO: 319833 - DNA, 75 bp, Artificial Sequence
  Synthetic
attacatcgcatgtgcaataattgttctggatataaagcattacctaagactaggaaattatgcaagagtaagct

SEQ ID NO: 319834 - DNA, 75 bp, Artificial Sequence
  Synthetic
gtccaatatagtgctatgtgtgattgcatcattgatattcttctctttcatcacacctatatcaagtcaatgcat

SEQ ID NO: 319835 - DNA, 75 bp, Artificial Sequence
  Synthetic
tgatatagagaaattaccagaagagtacacagcttgcacaagggaattagataacattaaaagcctaacaattaa

SEQ ID NO: 319836 - DNA, 75 bp, Artificial Sequence
  Synthetic
cgatacttacagttttatatattcttgtgtgtgtatagttgtactgataatgattaaaaatgcaataaaatattt

SEQ ID NO: 319837 - DNA, 75 bp, Artificial Sequence
  Synthetic
actatattgcaattgtgctttctgtggtatgatacatgaaagacgtggcttaagaataatagataatttcacaaa

SEQ ID NO: 319838 - DNA, 75 bp, Artificial Sequence
  Synthetic
taaatgtttaagttgcgtatgcgcagaaaataaaggcctgacaatccataagggttctaagaaatgcctattcag

SEQ ID NO: 319839 - DNA, 75 bp, Artificial Sequence
  Synthetic
atttgaatcaaactataaaaggattggattggtaatttttgtgattttgttaataccaacaattgtaatgtccga

SEQ ID NO: 319840 - DNA, 75 bp, Artificial Sequence
  Synthetic
taataccaacaattgtaatgtccgaagagggtagtattaattgtaaaaatataaaacctgctcaacttacaatag

SEQ ID NO: 319841 - DNA, 75 bp, Artificial Sequence
  Synthetic
atcaccttagtaagtgcatggctttttatcaaaacaaaacaaattcaccagtaggaataaatgaaataatttcag

SEQ ID NO: 319842 - DNA, 75 bp, Artificial Sequence
  Synthetic
atgcctttccagacgagcaggaattggtaaagggtctaaatttgaattgtgatgtgatagacaggtttatatctg

SEQ ID NO: 319843 - DNA, 75 bp, Artificial Sequence
  Synthetic
aagctagtgttatcgaaactcaagtctactatgaatatataaaatcacaaatgtgtcctactcaagtccatgaca

SEQ ID NO: 319844 - DNA, 75 bp, Artificial Sequence
  Synthetic
ctactatgaatatataaaatcacaaatgtgtcctactcaagtccatgacatattcactatcaagtcagcaagcaa

SEQ ID NO: 319845 - DNA, 75 bp, Artificial Sequence
  Synthetic
tatacaatggaaagcattagctcgtagctttacattaggagtatgcaacacaaaccctcataagcacatatgcag

SEQ ID NO: 319846 - DNA, 75 bp, Artificial Sequence
  Synthetic
atgcttagaatctatgcagatgtgcacatcaactaaaacagatcatgctagggagatgtcaatgtactatgatgg

SEQ ID NO: 319847 - DNA, 75 bp, Artificial Sequence
  Synthetic
ccacgcggatcgctttgagcatgacattaaaataatacttaatataatgaggtatatagtccctggacttggtcg

SEQ ID NO: 319848 - DNA, 75 bp, Artificial Sequence
  Synthetic
agtcctgcttgatcaaataaagcagtcaaaagactatcaagcattacggcatatacaagggaagctctcaccaaa

SEQ ID NO: 319849 - DNA, 75 bp, Artificial Sequence
  Synthetic
atcacaatcaaatttacaacttaaagggtttttagaatttgtcgattttattcttagtacaaatgtgacaataaa

SEQ ID NO: 319850 - DNA, 75 bp, Artificial Sequence
  Synthetic
aaaaagtcctcaaacactaacaacattatctctagtgaagggagctcataggaatttagatcaaaaagatccagg

SEQ ID NO: 319851 - DNA, 75 bp, Artificial Sequence
  Synthetic
ccagacccctatattggtgtgcaaatcacctcagaaagtgatatgttattcaccacgtggtattacacaccctgg

SEQ ID NO: 319852 - DNA, 75 bp, Artificial Sequence
  Synthetic
agattacatatcatgcgaatctaaaatatacaagtggccatcattaggagtatataggtacaataaagatcagca

SEQ ID NO: 319853 - DNA, 75 bp, Artificial Sequence
  Synthetic
gcaggcttgcagtggtgacacacactgcttagaaatgttcgagccagctgagagaacaatcagcacaaaaatatg

SEQ ID NO: 319854 - DNA, 75 bp, Artificial Sequence
  Synthetic
caaaataagcgatatagcctattcagaatcaccatatagcactggagtaccatcgtgcaatgtgaaaagatttgg

SEQ ID NO: 319855 - DNA, 75 bp, Artificial Sequence
  Synthetic
atcatgcagtgttagaggccatcaatggcagatcgcagagtgctcaaatggcttgctatattacgtttcagctaa

SEQ ID NO: 319856 - DNA, 75 bp, Artificial Sequence
  Synthetic
tggcagatcgcagagtgctcaaatggcttgctatattacgtttcagctaaatcccattcaagaactaacgatata

SEQ ID NO: 319857 - DNA, 75 bp, Artificial Sequence
  Synthetic
gtctagatttgcgctatgcattcagatctaccagctgctcagatatagtatgggacacaagctatcgaaataaat

SEQ ID NO: 319858 - DNA, 75 bp, Artificial Sequence
  Synthetic
agatattgaaaattatatagcagcacttcagtcagacattgcaaatgatttaactatgcactattttaagccatt

SEQ ID NO: 319859 - DNA, 75 bp, Artificial Sequence
  Synthetic
aaaaaatctgcccgcaataatcccacaatataaaacaatgacactaagtggagataaggtctcaaatggtattag

SEQ ID NO: 319860 - DNA, 75 bp, Artificial Sequence
  Synthetic
gaatagctatattgaatcccatatccctgcagtcaatggtctatcagcaggaatcaatatcgccacgccaaacgg

SEQ ID NO: 319861 - DNA, 75 bp, Artificial Sequence
  Synthetic
tgacaatctcttttcaattgtgatctatgtcaaaaaagtaatcaataaagcatcatatacatttttatatgagac

SEQ ID NO: 319862 - DNA, 75 bp, Artificial Sequence
  Synthetic
catcatatacatttttatatgagacaggccctacaattggaataaatgctaagcatgaggaagtttgcacaggga

SEQ ID NO: 319863 - DNA, 75 bp, Artificial Sequence
  Synthetic
aatgtccaaccccaataccacatcaagacggttggatcactttttcaaaagaaagatcgagcaattggggttgtg

SEQ ID NO: 319864 - DNA, 75 bp, Artificial Sequence
  Synthetic
aagaatggggttgtttagcaataaatgacggttgcttatatggttcatgccaagatgtgataaggccagaataca

SEQ ID NO: 319865 - DNA, 75 bp, Artificial Sequence
  Synthetic
aaatatataagaaatcaggcattgaacaaaaagatgttgaggtttgtataaccatggcacatgaatcattttgca

SEQ ID NO: 319866 - DNA, 75 bp, Artificial Sequence
  Synthetic
gcactgttgatgttctccagcccttgattagtgacaggatacaattagacattcaaacagtccagatggattcca

SEQ ID NO: 319867 - DNA, 75 bp, Artificial Sequence
  Synthetic
tgccaaatattattgcagtcaaaaatgggaaaatttatgttggagatatcaatgacttggggtcaacagcaaaaa

SEQ ID NO: 319868 - DNA, 75 bp, Artificial Sequence
  Synthetic
agtgtggctcggttcaattatattcagaaggagttattggctcaggaaatcctaaatttgattatatttgtcatg

SEQ ID NO: 319869 - DNA, 75 bp, Artificial Sequence
  Synthetic
catttaatcgtaaagatgttattcttcgaagatgttttgataattcttaccaatcttgcctcctcttagagcaag

SEQ ID NO: 319870 - DNA, 75 bp, Artificial Sequence
  Synthetic
tcgaagatgttttgataattcttaccaatcttgcctcctcttagagcaagatagtacactaaccattgcgtccac

SEQ ID NO: 319871 - DNA, 75 bp, Artificial Sequence
  Synthetic
caatcacatggaagtgcataaaaaagttgcaagtgtaggaacaatcaattacaagatcatgttaggagattttga

SEQ ID NO: 319872 - DNA, 75 bp, Artificial Sequence
  Synthetic
ttatactgcatattcaacgcaagcaacaattacaatagatgaagtcagatgtggtggatgttatggttgcccaga

SEQ ID NO: 319873 - DNA, 75 bp, Artificial Sequence
  Synthetic
aggaatggcctgttcgcttaagataaccaccaacagcattggaagctgtcctataaaaagcaattgcgatacata

SEQ ID NO: 319874 - DNA, 75 bp, Artificial Sequence
  Synthetic
cattaagataatagcagtagatccaatgcaaagtgattactccattaaattgaactgtccattagcaacagatac

SEQ ID NO: 319875 - DNA, 75 bp, Artificial Sequence
  Synthetic
tatctctataaatgtttgctcagcttctgtcagtacaaaaccatcaatatcaaaaaatcatccaaaaattgtatt

SEQ ID NO: 319876 - DNA, 75 bp, Artificial Sequence
  Synthetic
aaattccctagatgaaacttcatatattgaacagcatgacaagagatgctccacctggctatgtcgggtctatga

SEQ ID NO: 319877 - DNA, 75 bp, Artificial Sequence
  Synthetic
agaaggaattagtgtaatattccaatctctatttggcaatctttctttctactggaaattaacaatatacatcat

SEQ ID NO: 319878 - DNA, 75 bp, Artificial Sequence
  Synthetic
actttctctcttcatcctgatcttgactctatatatactaataccattatgcaaacgcttgaaaggattattaga

SEQ ID NO: 319879 - DNA, 75 bp, Artificial Sequence
  Synthetic
atataatgagagaatatatcaaatggagaacaaattcaaatgatgaattcaaaaccagtatttgattaactaaaa

SEQ ID NO: 319880 - DNA, 75 bp, Artificial Sequence
  Synthetic
gagaacaaattcaaatgatgaattcaaaaccagtatttgattaactaaaataaatttaataaataaacaaacaat

SEQ ID NO: 319881 - DNA, 75 bp, Artificial Sequence
  Synthetic
ttaataaataaacaaacaataacatatatatgtggtcacacatatatatgtcattattcagctgagaagtttttc

SEQ ID NO: 319882 - DNA, 75 bp, Artificial Sequence
  Synthetic
ggcttctgcgctcccacttaaggaaggcactagaggttctagatgcttcttaaatggagagttggttaaaactgt

SEQ ID NO: 319883 - DNA, 75 bp, Artificial Sequence
  Synthetic
caatacatcaaaagtggtttcagagtgctgcgtaaaagatgatatatctatcatcaaatcaaattctgaacatta

SEQ ID NO: 319884 - DNA, 75 bp, Artificial Sequence
  Synthetic
tcatcaaatcaaattctgaacattataaatcaggtgatagattggctgctgtaataaaatactatagattgtatc

SEQ ID NO: 319885 - DNA, 75 bp, Artificial Sequence
  Synthetic
aagtaaaggattggcattcatgcaatccaatttatgatgatcatggctcattcatgatattagatattgataaca

SEQ ID NO: 319886 - DNA, 75 bp, Artificial Sequence
  Synthetic
ccggcacattaatccctaaaatgcatacatgtagagttgagtgtgagatttccctcaataaagatacaggtgaaa

SEQ ID NO: 319887 - DNA, 75 bp, Artificial Sequence
  Synthetic
tacatgtagagttgagtgtgagatttccctcaataaagatacaggtgaaattttactaaactcttatagaattaa

SEQ ID NO: 319888 - DNA, 75 bp, Artificial Sequence
  Synthetic
atgcgaatctattgaagtaacatgcggattgaagactctcagtttctatgcatgcttccatacgcacaaatcgtg

SEQ ID NO: 319889 - DNA, 75 bp, Artificial Sequence
  Synthetic
catgcttccatacgcacaaatcgtgcatacgttacttcaaaggatcaattctccctgaattaatgattgaatcat

SEQ ID NO: 319890 - DNA, 75 bp, Artificial Sequence
  Synthetic
catacgttacttcaaaggatcaattctccctgaattaatgattgaatcattttgtacaaatcttgagctcatttt

SEQ ID NO: 319891 - DNA, 75 bp, Artificial Sequence
  Synthetic
ctccctgaattaatgattgaatcattttgtacaaatcttgagctcattttattgatcacttttatattagcaggc

SEQ ID NO: 319892 - DNA, 75 bp, Artificial Sequence
  Synthetic
tctgttatgatgatgatactcacaaaaacatacatagtgtatatatttatccctatattttatccgtttgtaaaa

SEQ ID NO: 319893 - DNA, 75 bp, Artificial Sequence
  Synthetic
ttatatgcttgtatgtataataaatattttaaattgtgcaaaaattgtctattagcagtacatccatttacaaac

SEQ ID NO: 319894 - DNA, 75 bp, Artificial Sequence
  Synthetic
attttaaattgtgcaaaaattgtctattagcagtacatccatttacaaactgcccatcaacatgtatctgcggaa

SEQ ID NO: 319895 - DNA, 75 bp, Artificial Sequence
  Synthetic
tgaactacactactacagaatcacttaaattacatcgtatgtgcaataattgttcaggatacaaagcattaccta

SEQ ID NO: 319896 - DNA, 75 bp, Artificial Sequence
  Synthetic
tgttcaggatacaaagcattacctaaaactaggaaattatgcaaaagtaagctgtccaatatagtactatgtgta

SEQ ID NO: 319897 - DNA, 75 bp, Artificial Sequence
  Synthetic
attgcatcactaatattcttttctttcattacacctatttcgagtcagtgcattgacatagagaaattaccagaa

SEQ ID NO: 319898 - DNA, 75 bp, Artificial Sequence
  Synthetic
cattgacatagagaaattaccagaagagtacacagcttgcacaagagaattaaacaacattaaaagcctaacaat

SEQ ID NO: 319899 - DNA, 75 bp, Artificial Sequence
  Synthetic
taacgatacttacagttttatatattcttgtgtttgtataattatattgatagtgattaaaaatacaatgaagta

SEQ ID NO: 319900 - DNA, 75 bp, Artificial Sequence
  Synthetic
tcttgtgtttgtataattatattgatagtgattaaaaatacaatgaagtatttgctatattgtaattgtgctttc

SEQ ID NO: 319901 - DNA, 75 bp, Artificial Sequence
  Synthetic
acaaaggttctaagaaatgcctatttagatttgaatcaaactataacaagattggattggtaatttttgtggttt

SEQ ID NO: 319902 - DNA, 75 bp, Artificial Sequence
  Synthetic
attggattggtaatttttgtggttttgttaataccaacaattgtaatgtctgaagagggtaatatcaattgtaaa

SEQ ID NO: 319903 - DNA, 75 bp, Artificial Sequence
  Synthetic
tgttaataccaacaattgtaatgtctgaagagggtaatatcaattgtaaaaacataaaaccggctcagcttgcaa

SEQ ID NO: 319904 - DNA, 75 bp, Artificial Sequence
  Synthetic
tagatcaccttagtaaatgcatggctttttatcaaaacaaaacaaattcaccagtaggaataaatgaaataattt

SEQ ID NO: 319905 - DNA, 75 bp, Artificial Sequence
  Synthetic
tttttatcaaaacaaaacaaattcaccagtaggaataaatgaaataatttctgatgcctctccagacgagcagga

SEQ ID NO: 319906 - DNA, 75 bp, Artificial Sequence
  Synthetic
ctgatgcctctccagacgagcaggaattgataaagggtctaaatttgaattgtgatataatagacaggtttatat

SEQ ID NO: 319907 - DNA, 75 bp, Artificial Sequence
  Synthetic
ctgaaactagtgttattgaaactcaagtctactacgaatatataaaatcgcaaatgtgtcctgctcaagtccatg

SEQ ID NO: 319908 - DNA, 75 bp, Artificial Sequence
  Synthetic
cagatgcttagagtctatgcagatgtgcacatcaactaagacagatcatgctagggagatgtcaatgtactatga

SEQ ID NO: 319909 - DNA, 75 bp, Artificial Sequence
  Synthetic
tgcacatcaactaagacagatcatgctagggagatgtcaatgtactatgatggccacgcagatcgctttgagcac

SEQ ID NO: 319910 - DNA, 75 bp, Artificial Sequence
  Synthetic
tggccacgcagatcgctttgagcacgacattaaaataatacttaatataatgaggtatatagtccctggactcgg

SEQ ID NO: 319911 - DNA, 75 bp, Artificial Sequence
  Synthetic
gacattaaaataatacttaatataatgaggtatatagtccctggactcggtcgagttttgcttgatcaaataaag

SEQ ID NO: 319912 - DNA, 75 bp, Artificial Sequence
  Synthetic
cagtcgaaggactatcaagcattgcggcacatacaagggaagctttcaccaaaatcacaatcaaatttacaactt

SEQ ID NO: 319913 - DNA, 75 bp, Artificial Sequence
  Synthetic
ggcacatacaagggaagctttcaccaaaatcacaatcaaatttacaacttaaagggtttttagagtttgttgatt

SEQ ID NO: 319914 - DNA, 75 bp, Artificial Sequence
  Synthetic
ttattcttagcacaaatgtgacaatagaaaaaagtcctcaaacactaacaacattatctctagtgaagggagctc

SEQ ID NO: 319915 - DNA, 75 bp, Artificial Sequence
  Synthetic
atagaaatttagatcaaaaagatcctggccaggcccccatattagtatgcaaatcaccccagaaagtgatatgtt

SEQ ID NO: 319916 - DNA, 75 bp, Artificial Sequence
  Synthetic
aaatcaccccagaaagtgatatgttattcaccacgtggcattacacatcctggagattacatatcatgcgaatct

SEQ ID NO: 319917 - DNA, 75 bp, Artificial Sequence
  Synthetic
aaaatatacaagtggccatcattaggagtatataggtataataaagatcagcaacaggcttgcaacggtgataca

SEQ ID NO: 319918 - DNA, 75 bp, Artificial Sequence
  Synthetic
cactgcttagaaatgttcgagccagctgagagaacaatcaacacaaaaatatgcaaaataagtgatatggcctat

SEQ ID NO: 319919 - DNA, 75 bp, Artificial Sequence
  Synthetic
tctgaatcaccatatagcactggagtaccatcatgcaatgtgaaaagatttggatcatgcaatgtcagaggacat

SEQ ID NO: 319920 - DNA, 75 bp, Artificial Sequence
  Synthetic
caatggcagatcgcagagtgtgcaaatggtttgctatattatgtttcagctaaatctcattcaagaactaatgat

SEQ ID NO: 319921 - DNA, 75 bp, Artificial Sequence
  Synthetic
attgtctagatttgcgctatgcattcagatctactagctgctcagatgtagtatgggacacaagctatcggaata

SEQ ID NO: 319922 - DNA, 75 bp, Artificial Sequence
  Synthetic
attgtctagatttgcgctatgcattcagatctactagctgctcagatgtagtatgggacacaagctatcggatta

SEQ ID NO: 319923 - DNA, 75 bp, Artificial Sequence
  Synthetic
attgtctagatttgcgctatgcattcagatctactagctgctcagatgtagtatgggacacaagctatcggacta

SEQ ID NO: 319924 - DNA, 75 bp, Artificial Sequence
  Synthetic
attgtctagatttgcgctatgcattcagatctactagctgctcagatgtagtatgggacacaagctatcggagta

SEQ ID NO: 319925 - DNA, 75 bp, Artificial Sequence
  Synthetic
aattaatacctagatctattagccatccagatattgaaaattatatagcagcacttcagtcagacattgcaaatg

SEQ ID NO: 319926 - DNA, 75 bp, Artificial Sequence
  Synthetic
gcacttcagtcagacattgcaaatgatttaactatgcactatttcaagccattaaaaaatctgcctgctataatc

SEQ ID NO: 319927 - DNA, 75 bp, Artificial Sequence
  Synthetic
attaaaaaatctgcctgctataatcccgcaatataaaacaatgacactaagtggagataaggtctcaaatggtat

SEQ ID NO: 319928 - DNA, 75 bp, Artificial Sequence
  Synthetic
tagaaatagctatattgaatctcatattcctgcagtcaatggtctgtcagcaggaatcaatattgccacgccaaa

SEQ ID NO: 319929 - DNA, 75 bp, Artificial Sequence
  Synthetic
cggtgataatctcttttcaattgtgatctatgtaaaaaaagtgatcaataaagcgtcatatacatttttatatga

SEQ ID NO: 319930 - DNA, 75 bp, Artificial Sequence
  Synthetic
aagcgtcatatacatttttatatgagacaggacctacaatcggaataaatgctaagcatgaagaggtctgcacag

SEQ ID NO: 319931 - DNA, 75 bp, Artificial Sequence
  Synthetic
ggaaatgtccaaccccaataccacatcaagacggttggatcactttttcaaaagaaagatcgagcaattggggtt

SEQ ID NO: 319932 - DNA, 75 bp, Artificial Sequence
  Synthetic
acaaaatatacaagaaatcgggcgttgagcaaaaagatgttgaggtttgtataaccatggcacatgaatcatttt

SEQ ID NO: 319933 - DNA, 75 bp, Artificial Sequence
  Synthetic
gcagtactgttgatgttctccagcccttgattagtgataggatacagttagatattcagacagtccaaatggatt

SEQ ID NO: 319934 - DNA, 75 bp, Artificial Sequence
  Synthetic
gatattcagacagtccaaatggattctatgccaaatgttattgcagttaaaaatgggaaaatctatgttggggat

SEQ ID NO: 319935 - DNA, 75 bp, Artificial Sequence
  Synthetic
tatcaatcttgcctccttctagagcaagatactacgttaaccattgcatccaccaatcacatggaagtgcataaa

SEQ ID NO: 319936 - DNA, 75 bp, Artificial Sequence
  Synthetic
aaagtttcaagtgtaggaacaatcaattacaagatcatgttaggagattttgattacactgcatattcaacgcag

SEQ ID NO: 319937 - DNA, 75 bp, Artificial Sequence
  Synthetic
ataactaccaatagcattggaagttgtcctataaaaagcaattgcgacacatacattaagataatagcagtggac

SEQ ID NO: 319938 - DNA, 75 bp, Artificial Sequence
  Synthetic
atacattaagataatagcagtggacccgatgcaaagtgattattccattaaattgaattgtccgttagcaacaga

SEQ ID NO: 319939 - DNA, 75 bp, Artificial Sequence
  Synthetic
tactatctccataagtgtttgctcagcttctgtcaatacaaaaccatcaatatcaaaaaatcatcccaagattgt

SEQ ID NO: 319940 - DNA, 75 bp, Artificial Sequence
  Synthetic
cttgaattccctagatgaaacttcatatattgagcagcatgacaagagatgctccacttggctatgtcgagtcta

SEQ ID NO: 319941 - DNA, 75 bp, Artificial Sequence
  Synthetic
tgaagaaggaattagtgtaatattccaacctttatttggtaatctttctttctactggaaattaacaatatacat

SEQ ID NO: 319942 - DNA, 75 bp, Artificial Sequence
  Synthetic
tctactggaaattaacaatatacataataatctcgctcctcatcttgatcttgactttatatatactaataccgt

SEQ ID NO: 319943 - DNA, 75 bp, Artificial Sequence
  Synthetic
tatgcaaacgcttaaaaggattactagaatataatgagagaatatatcagatggagaataaatttaaatgataaa

SEQ ID NO: 319944 - DNA, 75 bp, Artificial Sequence
  Synthetic
taataaatttaataaatataaaaacaataacatatatatgtggtcacacatatatatgtcattattcagctgaga

SEQ ID NO: 319945 - DNA, 75 bp, Artificial Sequence
  Synthetic
aaatataaaaacaataacatatatatgtggtcacacatatatatgtcattattcagctgagaagttttttcatgt

SEQ ID NO: 319946 - DNA, 75 bp, Artificial Sequence
  Synthetic
ggaatgcagctacatttaacccggaggtcgggtatgtggcatttattggtaagtatgggcagcaactcaacttcg

SEQ ID NO: 319947 - DNA, 75 bp, Artificial Sequence
  Synthetic
gtgttgctagagtcttcttcctcaaccagaagaaggccaagatggtcctacataagacggcacaaccaagtgtcg

SEQ ID NO: 319948 - DNA, 75 bp, Artificial Sequence
  Synthetic
tatggatgtaaatttcatgaaaaaagtccttcgccagcgctatggaacaatgactgcagaagaatggatgactca

SEQ ID NO: 319949 - DNA, 75 bp, Artificial Sequence
  Synthetic
aaaaataacagaaattaaggctgcattcaactctgttggacagcttgcttgggctaaatctggattctctcctgc

SEQ ID NO: 319950 - DNA, 75 bp, Artificial Sequence
  Synthetic
acaatcaaaatgcttctcaacaatgtcttgatattaaatctagcctatttggcttttacactcccacttaaggaa

SEQ ID NO: 319951 - DNA, 75 bp, Artificial Sequence
  Synthetic
ggcactagaggatctaggtgtttcctaaatggagagttggttaagactgttaacacatcaaaagtggtctcagag

SEQ ID NO: 319952 - DNA, 75 bp, Artificial Sequence
  Synthetic
tgctgcgtgaaggatgatatatccattatcaaatcaaactcagaacattacaggtcaggtgatcgactggctgct

SEQ ID NO: 319953 - DNA, 75 bp, Artificial Sequence
  Synthetic
gtaataaagtactatcggttataccagataaaggattggcactcatgtaatccaatttatgatgaccatggatcc

SEQ ID NO: 319954 - DNA, 75 bp, Artificial Sequence
  Synthetic
tttatggtattggatattgacaacaccggtacgctaattcccaaaatgcatacatgtagggtcgaatgtgagatc

SEQ ID NO: 319955 - DNA, 75 bp, Artificial Sequence
  Synthetic
gccctaaacaaggatacaggtgaaattttactaaactcttatagaattaatcactatcgaatctctggtacaatg

SEQ ID NO: 319956 - DNA, 75 bp, Artificial Sequence
  Synthetic
catgtatcaggttggttcaaaaataaaattgaaattcctttagaaaatacttgcgagtctattgaagtgacatgt

SEQ ID NO: 319957 - DNA, 75 bp, Artificial Sequence
  Synthetic
ggattaaaaacgctcaatttccatgcatgcttccacactcataaatcatgtatacgctattttaaaggatcaatt

SEQ ID NO: 319958 - DNA, 75 bp, Artificial Sequence
  Synthetic
cttcctgaaataatgattgagtcattttgtacaaatcttgaactaattttattaatcacctttatactagcaggt

SEQ ID NO: 319959 - DNA, 75 bp, Artificial Sequence
  Synthetic
tctgtcatgatgatgatactgacaagaacatacatagtgtacatatttatccctatattttatccatttgtgaag

SEQ ID NO: 319960 - DNA, 75 bp, Artificial Sequence
  Synthetic
ctatatgctcatatatacaataaatatttcaagttgtgtaaaaattgcttgttagcagtacatccctttacaaat

SEQ ID NO: 319961 - DNA, 75 bp, Artificial Sequence
  Synthetic
tgcccatcgacatgcatttgtggaatgaattatacgactacggaatcacttaagctacatcgcatgtgtaacaac

SEQ ID NO: 319962 - DNA, 75 bp, Artificial Sequence
  Synthetic
tgttctggttataaagcattacctaaaacaaggaaattgtgtaagaataaattatcaaatatagtactatgtata

SEQ ID NO: 319963 - DNA, 75 bp, Artificial Sequence
  Synthetic
attgcatcattgatatttttctctttcattacacctatatcaagtcaatgtatcgatatagataaactaccaggt

SEQ ID NO: 319964 - DNA, 75 bp, Artificial Sequence
  Synthetic
gaatacacagcttgcatagaaaagttaaatagtgttaacagtttaacatttgatgatgcttatggttttatatat

SEQ ID NO: 319965 - DNA, 75 bp, Artificial Sequence
  Synthetic
tcttgtgcatgcatagctatactgataataattaaaaatgcaataagatatttattatattgcaactgcggtttc

SEQ ID NO: 319966 - DNA, 75 bp, Artificial Sequence
  Synthetic
tgtggaatgatacatgaaagacgtggattggaaataatagataacttcacgaacaagtgtttaagttgcatatgc

SEQ ID NO: 319967 - DNA, 75 bp, Artificial Sequence
  Synthetic
gcagagaataagggcttgacaattcatagaggttctgagaaatgtctattcaaatttgaatcaaactataataga

SEQ ID NO: 319968 - DNA, 75 bp, Artificial Sequence
  Synthetic
gttgggctggcaatttttgtaattttattggtgccgacaatcgttatgtcagaagaaggcactataaactgcaaa

SEQ ID NO: 319969 - DNA, 75 bp, Artificial Sequence
  Synthetic
aatatacagtccactcagcttacaatagaccatctcagtaaatgcatggccttttatcaaaacaagacagattca

SEQ ID NO: 319970 - DNA, 75 bp, Artificial Sequence
  Synthetic
ccgatggagatagatgcaataatctcagatgcttctccagacgagaaagaattaataaaaggtctaaatctaaat

SEQ ID NO: 319971 - DNA, 75 bp, Artificial Sequence
  Synthetic
tgcaacgtgatagacaagtttatatctgaagccagtgttattgagactcaggtctattacgaatatataaaatca

SEQ ID NO: 319972 - DNA, 75 bp, Artificial Sequence
  Synthetic
caaatgtgccccgctcaggtccatgatatattcactattaattcagctagtaatatacaatggaaagcattagct

SEQ ID NO: 319973 - DNA, 75 bp, Artificial Sequence
  Synthetic
cgcagttttacattaggggtgtgtaacacaaacccacatgagcacatatgcaggtgtttagaatctatgcagctg

SEQ ID NO: 319974 - DNA, 75 bp, Artificial Sequence
  Synthetic
tgcacatcaaccagaacagatcatgccagggagatgtctatatattatgacggccacccagacctctttgagcat

SEQ ID NO: 319975 - DNA, 75 bp, Artificial Sequence
  Synthetic
gatattaaaataatattaaacattatgaggtatatagtccctgggctgggccgagtcttacttgatcaaataaaa

SEQ ID NO: 319976 - DNA, 75 bp, Artificial Sequence
  Synthetic
caaacaaaagattatcaggcattgcgccatatacagggcaagctttcaccaaaatcacagtcaaatttgcaactt

SEQ ID NO: 319977 - DNA, 75 bp, Artificial Sequence
  Synthetic
aaaggcttcttggaatttgtcgattttattctcagcacaaatgtgacaatagaaaaaagccctcagacattaaca

SEQ ID NO: 319978 - DNA, 75 bp, Artificial Sequence
  Synthetic
acattatcgttagtgaaaggagcccacagaagcttagatcaaaaagacccaggccagaatcctatattaatatgc

SEQ ID NO: 319979 - DNA, 75 bp, Artificial Sequence
  Synthetic
aaattaccccaaagagtgatatgttattcaccacgtggtatcacacacccaggagattatatatcatgtgagtct

SEQ ID NO: 319980 - DNA, 75 bp, Artificial Sequence
  Synthetic
aagatgtacaaatggccatcattaggagtatataagcgcaacaaggatcagcagcaagcttgtagtggtgataca

SEQ ID NO: 319981 - DNA, 75 bp, Artificial Sequence
  Synthetic
cattgtttggaaatgtttgaaccagcagagagaacaattagcacaaaaatgtgtaagataaatgacatgagctac

SEQ ID NO: 319982 - DNA, 75 bp, Artificial Sequence
  Synthetic
tcagaatcaccatacagcactggaataccatcatgcaatgtaaaaagattcggctcatgcactgttagagggcat

SEQ ID NO: 319983 - DNA, 75 bp, Artificial Sequence
  Synthetic
cagtggcagattgcagaatgttcaaatggcctattatattatgtttcagctaaaactcattcaaaatctaatgat

SEQ ID NO: 319984 - DNA, 75 bp, Artificial Sequence
  Synthetic
ataacattatactgtctctcagcaaattgcctagatttacgctatgcctttagatctaccagctgttcagatata

SEQ ID NO: 319985 - DNA, 75 bp, Artificial Sequence
  Synthetic
atatgggacacaagctatcggaataaattaatgcctaggtctatcagccacccagatattgaaaactatatagca

SEQ ID NO: 319986 - DNA, 75 bp, Artificial Sequence
  Synthetic
gcactccaatcagatattgcaaatgatctaactatgcactacttcaagccactgaaaaatcttcctgcgataatt

SEQ ID NO: 319987 - DNA, 75 bp, Artificial Sequence
  Synthetic
ccacaatataaaacaatgaccttaagcggagataaagtctcaagtggtattagaaatagctatatcgaatcgcat

SEQ ID NO: 319988 - DNA, 75 bp, Artificial Sequence
  Synthetic
attcctgcagttaatggcctatctgcaggaatcaatattgcaacaccgaatggtgacaatcttttttcaattata

SEQ ID NO: 319989 - DNA, 75 bp, Artificial Sequence
  Synthetic
atttatgtcaggaaagtaattaataaggcatcatataaatttctatatgaaacaggtcctactattgggataaat

SEQ ID NO: 319990 - DNA, 75 bp, Artificial Sequence
  Synthetic
gccaaacacgaagaagtttgcactgggaagtgtccaaacccaataccacatcaggacggttggattactttttca

SEQ ID NO: 319991 - DNA, 75 bp, Artificial Sequence
  Synthetic
agagagaggtcaagcaattggggctgtgaagaatggggttgtttagcaataaatgatggttgcttatatggctcg

SEQ ID NO: 319992 - DNA, 75 bp, Artificial Sequence
  Synthetic
tgtcaagatataataagacctgagtataaaatatataaaaaatcaggtgttgaacaaaaggatgttgaagtctgc

SEQ ID NO: 319993 - DNA, 75 bp, Artificial Sequence
  Synthetic
ataaccatggcacatgagtcattttgcagtactgtagatgttctccagcctttaattagtgacaggatacaatta

SEQ ID NO: 319994 - DNA, 75 bp, Artificial Sequence
  Synthetic
gacatccagacggtacagatggagtctatgccaaatattatagcagtcaaaaatgggaaaatttatgttggagat

SEQ ID NO: 319995 - DNA, 75 bp, Artificial Sequence
  Synthetic
attaatgacttaggatcaacagcaaaaaaatgtggctcagttcaattatattcagaaggggtcattggttcaggg

SEQ ID NO: 319996 - DNA, 75 bp, Artificial Sequence
  Synthetic
aatccaaaatttgattatatttgtcatgcattcaatcgtaaagatgtgattctgcggagatgttttgacaattca

SEQ ID NO: 319997 - DNA, 75 bp, Artificial Sequence
  Synthetic
tatcaatcttgcctccttttagaacaagatagtacactgaacattgcatctaccagccacatggaagtgcataag

SEQ ID NO: 319998 - DNA, 75 bp, Artificial Sequence
  Synthetic
aaggttacaagtgtaggcacaattaattacaagattatgctaggggattttgactacaatgcatattcaacacaa

SEQ ID NO: 319999 - DNA, 75 bp, Artificial Sequence
  Synthetic
gcagtggttgcaatagatgaaattaggtgtggtggatgctacagctgtccagaaggaatggcttgttcacttaag

SEQ ID NO: 320000 - DNA, 75 bp, Artificial Sequence
  Synthetic
ataactaccaatacaattgggagctgtcctataagaagtaattgtgatgcatacattaaaataatagcagttgac

SEQ ID NO: 320001 - DNA, 75 bp, Artificial Sequence
  Synthetic
ccaatgcaaagtgattactctattaagttaaactgcccgttagcagcagatattatctctataagtgtctgttca

SEQ ID NO: 320002 - DNA, 75 bp, Artificial Sequence
  Synthetic
gcttctaccactacaaaaccatcaatatcaaaaaatcacccaaaaattgtattaaattctctagatgaaacatca

SEQ ID NO: 320003 - DNA, 75 bp, Artificial Sequence
  Synthetic
tatattgaacagtatgacaagaagtgttctacatggttgtgccgggtctatgaagaagggattagtgtcatattc

SEQ ID NO: 320004 - DNA, 75 bp, Artificial Sequence
  Synthetic
caacctctatttggcaatctttctttctactggaaattaacaatatatatcataatttctctttttaccttaatt

SEQ ID NO: 320005 - DNA, 75 bp, Artificial Sequence
  Synthetic
ttaattttatatatattaatacctctatgtaaacgcttgaaagggctgttagaatacaatgagagaatatatcaa

SEQ ID NO: 320006 - DNA, 75 bp, Artificial Sequence
  Synthetic
atggaaaataaattaaaataataatgatcccaagtcaatatttgactaactaaacaaagaattaaacaataaaaa

SEQ ID NO: 320007 - DNA, 75 bp, Artificial Sequence
  Synthetic
aaataacataaataataacatatatatgtggttgcgcatatatatgtcattattcagcagagaagtttttcatgt

SEQ ID NO: 320008 - DNA, 75 bp, Artificial Sequence
  Synthetic
acaatcaaaatgcttctcaacattatcttagtattgaacctagcctattcggcttctgcgctcccacttaaggaa

SEQ ID NO: 320009 - DNA, 75 bp, Artificial Sequence
  Synthetic
tcatcaaatcaaattctgaacattataaatcaggtgatagattggctgctataataaaatactatcggttgtatc

SEQ ID NO: 320010 - DNA, 75 bp, Artificial Sequence
  Synthetic
ataataaaatactatcggttgtatcaagtaaaggattggcattcatgcaatccaatttatgatgatcatggctca

SEQ ID NO: 320011 - DNA, 75 bp, Artificial Sequence
  Synthetic
aaattgaaattcctttagaaaacacatgcgaatctattgaagtaacatgcggattgaaaactctcagtttccatg

SEQ ID NO: 320012 - DNA, 75 bp, Artificial Sequence
  Synthetic
ctccctgaattaatgattgaatcattttgtacaaatcttgagctcattttattaatcacttttatattagcaggt

SEQ ID NO: 320013 - DNA, 75 bp, Artificial Sequence
  Synthetic
taacgacacttacagttttatatattcttgtgcttgtataattatattaataatagttaaaaatacaatgaagta

SEQ ID NO: 320014 - DNA, 75 bp, Artificial Sequence
  Synthetic
tttactatattgtaattgtgctttctgcggtatgatacatgaaagacgtggcttaagaataatagacaacttcac

SEQ ID NO: 320015 - DNA, 75 bp, Artificial Sequence
  Synthetic
tgcggtatgatacatgaaagacgtggcttaagaataatagacaacttcacaaataaatgtttaagttgtgtatgc

SEQ ID NO: 320016 - DNA, 75 bp, Artificial Sequence
  Synthetic
tgttaataccaacaattgtaatgtctgaagagggtaatatcaattgtaaaaatataaaaccggctcaacttacaa

SEQ ID NO: 320017 - DNA, 75 bp, Artificial Sequence
  Synthetic
caaatgtgtcctgctcaagtccatgacatattcgctatcaattcagcaagcaatatacaatggaaagcattagct

SEQ ID NO: 320018 - DNA, 75 bp, Artificial Sequence
  Synthetic
caatatacaatggaaagcattagctcgtagctttacattaggagtatgcaatacaaaccctcataagcacatatg

SEQ ID NO: 320019 - DNA, 75 bp, Artificial Sequence
  Synthetic
gacattaaaataatacttaatataatgaggtatatagtccctgggctcggtcgagtcttgcttgatcaaataaag

SEQ ID NO: 320020 - DNA, 75 bp, Artificial Sequence
  Synthetic
attgtctagatttgcgctatgcattcagatctactagctgctcagatatagtatggggcacaagctatcggaata

SEQ ID NO: 320021 - DNA, 75 bp, Artificial Sequence
  Synthetic
gtggagataaggtttcaaatggtattaggaatagctatattgaatctcatattcctgcagtcaatggtctatcag

SEQ ID NO: 320022 - DNA, 75 bp, Artificial Sequence
  Synthetic
caggaatcaatattgccacgccaaacggtgataatctcttttcgattgtgatctatgtgaaaaaagtgatcaata

SEQ ID NO: 320023 - DNA, 75 bp, Artificial Sequence
  Synthetic
gtgaagaatggggatgtttagcaataaatgatggttgcttatatggttcatgccaggatgtgataagaccagaat

SEQ ID NO: 320024 - DNA, 75 bp, Artificial Sequence
  Synthetic
tgccaggatgtgataagaccagaatacaaaatatacaagaaatcaggcgttgaacaaaaagatgttgaggtttgt

SEQ ID NO: 320025 - DNA, 75 bp, Artificial Sequence
  Synthetic
ataaccatggcacatgaatcattttgcagtactgtcgatgttctccagcccttgattagcgataggatacagtta

SEQ ID NO: 320026 - DNA, 75 bp, Artificial Sequence
  Synthetic
gcagtactgtcgatgttctccagcccttgattagcgataggatacagttagatattcagacagtccaaatggatt

SEQ ID NO: 320027 - DNA, 75 bp, Artificial Sequence
  Synthetic
atcaatgacttagggtcaacagcaaaaaaatgtggctcagttcaattatattcagaaggagttattggttcaggg

SEQ ID NO: 320028 - DNA, 75 bp, Artificial Sequence
  Synthetic
aatcctaaatttgattatatttgccatgcatttaatcgtaaagatgtcattcttcgaagatgctttgataattct

SEQ ID NO: 320029 - DNA, 75 bp, Artificial Sequence
  Synthetic
attacaagatcatgttaggagattttgattacactgcgtattcaacgcaagcaacaatcacaatagatgaagtca

SEQ ID NO: 320030 - DNA, 75 bp, Artificial Sequence
  Synthetic
ataactaccaatagcattggaagttgtcctataaaaagcaattgcgatacgtacattaagataatagcagtggat

SEQ ID NO: 320031 - DNA, 75 bp, Artificial Sequence
  Synthetic
gtcctataaaaagcaattgcgatacgtacattaagataatagcagtggatccgatgcaaagtgattattccatta

SEQ ID NO: 320032 - DNA, 75 bp, Artificial Sequence
  Synthetic
cttgaattccctagatgagacttcatatattgaacagcatgacaagagatgctccacttggctatgtcgagtcta

SEQ ID NO: 320033 - DNA, 75 bp, Artificial Sequence
  Synthetic
tctactggagattaacaatatacatcatactctcgctcctcatcttgatcttgactttatatatactaataccat

SEQ ID NO: 320034 - DNA, 75 bp, Artificial Sequence
  Synthetic
gccctaattacaatcactatggagacatacaaaataaacatctttagagataggatcaatcaatgtcgaagtgct

SEQ ID NO: 320035 - DNA, 75 bp, Artificial Sequence
  Synthetic
gaagaagccaaggacattgttgctgatctactcatggctagacacgattatttcggtagagaagtatgttattat

SEQ ID NO: 320036 - DNA, 75 bp, Artificial Sequence
  Synthetic
ttggacatcgaatacaggcaagatgttccagcttatgatatacttcttgagttcctgccacctggtactgctttt

SEQ ID NO: 320037 - DNA, 75 bp, Artificial Sequence
  Synthetic
gatgtccgcaattgcacaccggacaacttcattgttcacaatgggaaactttacatcattgattataaagtctca

SEQ ID NO: 320038 - DNA, 75 bp, Artificial Sequence
  Synthetic
acagaccatacatatggtcaaaaaacatatgaaaaatatacacaaatcttcggagatgcactatcagaattacca

SEQ ID NO: 320039 - DNA, 75 bp, Artificial Sequence
  Synthetic
tttgagtttgaagttgtaattatccgtgctgatcctttaagagatacaatccatgtcaattcgaatcagtttcta

SEQ ID NO: 320040 - DNA, 75 bp, Artificial Sequence
  Synthetic
gagatattcggtccacttaacattaatcttgatttcacatggtttttcaatttgcggtcactgatatatgaaaag

SEQ ID NO: 320041 - DNA, 75 bp, Artificial Sequence
  Synthetic
tataaagatgatgatagattcctagaaattgtaaatcaaggtgagttcacaatgactggaccctggattgaagaa

SEQ ID NO: 320042 - DNA, 75 bp, Artificial Sequence
  Synthetic
gacaccccggaattgtactcgcaccctatttttttggaattctatgattctctagatgaaatggctaagttaaca

SEQ ID NO: 320043 - DNA, 75 bp, Artificial Sequence
  Synthetic
ttccatgaatctatgacgtttgatgcgacacgcggagaaaaatggaatcagaatctacaaaaggttataaataga

SEQ ID NO: 320044 - DNA, 75 bp, Artificial Sequence
  Synthetic
tatggtaatgattacaacatttttgtgaaagatgcagctgcagggatcttcaaatgtgaagggaattatcctaaa

SEQ ID NO: 320045 - DNA, 75 bp, Artificial Sequence
  Synthetic
ccagatcatgatgaaattacaattggttggaaccaaatggtccaaagagtgagtgtagaaagaaatcttactcaa

SEQ ID NO: 320046 - DNA, 75 bp, Artificial Sequence
  Synthetic
gatatcagcaagcaaaagccatctatccatttcatatggggccaacctgatgagacatcgaatgcaacaatacca

SEQ ID NO: 320047 - DNA, 75 bp, Artificial Sequence
  Synthetic
aagttaatcaaaattgccaaagcacttcaaaatatttctggtgagtccacatatataaatgcatttaaggcacta

SEQ ID NO: 320048 - DNA, 75 bp, Artificial Sequence
  Synthetic
ggctcccttatggatttttctgagaatatagccttgtatgaagcacataccagtaaattaaaaagtatggcaaga

SEQ ID NO: 320049 - DNA, 75 bp, Artificial Sequence
  Synthetic
caaacatcaaagagaatagatgccaaactagaacctataaaaataggtactgcaacaatatactgggagcaacaa

SEQ ID NO: 320050 - DNA, 75 bp, Artificial Sequence
  Synthetic
ttcaagttggatagcgagataatgaacccgaaggataaatcgcatttgctaaaggatttccttggcatagggggt

SEQ ID NO: 320051 - DNA, 75 bp, Artificial Sequence
  Synthetic
catgtacaattttcaaaaaagactattgaagatctagatactgataaacctactattctagatttcaataaaaaa

SEQ ID NO: 320052 - DNA, 75 bp, Artificial Sequence
  Synthetic
gaggttattgatttttgtaaattccaatatgagaatgtgaagaaaatattatctgaagaaaataatttagagcgt

SEQ ID NO: 320053 - DNA, 75 bp, Artificial Sequence
  Synthetic
ataggatgttatttagaagaatatggtgcaaacatttcatcatcttcaaaagatacatggaaccagatcaatcag

SEQ ID NO: 320054 - DNA, 75 bp, Artificial Sequence
  Synthetic
ataggcaaatcgagctattgggcttgcattaaagacttctcaatcctgatgaaaaatatgctagcagtatctcaa

SEQ ID NO: 320055 - DNA, 75 bp, Artificial Sequence
  Synthetic
tacaataggcacaacacattccgtgtagtatgttgtgcaaacaataatttatttggatttgtcatgccttcctct

SEQ ID NO: 320056 - DNA, 75 bp, Artificial Sequence
  Synthetic
gacatcaaggcaaaaagatcaacacttgtttatttcttggctgtattacattctggttcccaaaatataatgcat

SEQ ID NO: 320057 - DNA, 75 bp, Artificial Sequence
  Synthetic
catggtgcactgcatgcaacattcaagacaggttccaaatatctcagcatctccaaaggaattcgactggataaa

SEQ ID NO: 320058 - DNA, 75 bp, Artificial Sequence
  Synthetic
gagagatgccaacgcatagttagctcaccaggactcttcatgctgacaacactgatgtttgcaggagataaccca

SEQ ID NO: 320059 - DNA, 75 bp, Artificial Sequence
  Synthetic
acacttaatctaaatgatgttatgaattttactttccatacttcattgtctataactaaagcaatgttgtccttg

SEQ ID NO: 320060 - DNA, 75 bp, Artificial Sequence
  Synthetic
acagagccatcaagatacatgataatgaactcactagctatatctagccatgtgagagattacattgcagaaaaa

SEQ ID NO: 320061 - DNA, 75 bp, Artificial Sequence
  Synthetic
tttggaccttatacaaaaactagcttttcagtagtgatggcaaatttaattaaaagaggatgttacatggcatat

SEQ ID NO: 320062 - DNA, 75 bp, Artificial Sequence
  Synthetic
aatcagagggacaaagttgatatgcggaacatctgcttaactgattatgagataactcaaaagggtgttagggat

SEQ ID NO: 320063 - DNA, 75 bp, Artificial Sequence
  Synthetic
aatagagatttatcatcgatctggtttgatggttatgtatcattaaaggaatatatcaaccagatatatttgcca

SEQ ID NO: 320064 - DNA, 75 bp, Artificial Sequence
  Synthetic
ttttatttcaattcaaagggtttacatgagaagcaccatgttatgatagatctggctaagacaattctagacata

SEQ ID NO: 320065 - DNA, 75 bp, Artificial Sequence
  Synthetic
gagagggaccagaggctgaatatcccaggaatatggtcttcgacaccaaggaaacagactgcaaatttgaatgtg

SEQ ID NO: 320066 - DNA, 75 bp, Artificial Sequence
  Synthetic
actatctatgctgttgcaaaaaacttaataatggacactgcaagacataattatatcaggtcacggatagaaaac

SEQ ID NO: 320067 - DNA, 75 bp, Artificial Sequence
  Synthetic
acaaataacctgaatagatcaatatgcactatttctacatttactagctccaaatcgtgcatcaaagtggggaat

SEQ ID NO: 320068 - DNA, 75 bp, Artificial Sequence
  Synthetic
tttgaaaaggaaaagagtttagcagtaaaaaaagcagcagattgcatgtcaaaagagataaagaaatacactatc

SEQ ID NO: 320069 - DNA, 75 bp, Artificial Sequence
  Synthetic
gcaaacccagaatttgttgatgaggaattaatgaatgcaacaataagacactcacgttatgaagatctaaaaaag

SEQ ID NO: 320070 - DNA, 75 bp, Artificial Sequence
  Synthetic
gctatcccaaattacattgatgtcatgtcaaccaaagtatttgattctctataccagaaaataaagaagaaagaa

SEQ ID NO: 320071 - DNA, 75 bp, Artificial Sequence
  Synthetic
atagatgacaagcctactgtgcaccatatactcactactatgaaaaatcatacagatttcaaatttacatttttc

SEQ ID NO: 320072 - DNA, 75 bp, Artificial Sequence
  Synthetic
aataaaggtcagaagacagcaaaagatagagagatatttgtaggtgagtttgaagccaaaatgtgtttatattta

SEQ ID NO: 320073 - DNA, 75 bp, Artificial Sequence
  Synthetic
gtggaaaggatatccaaagaacgttgcaagttaaacccagatgagatgattagtgagccaggcgactcaaaatta

SEQ ID NO: 320074 - DNA, 75 bp, Artificial Sequence
  Synthetic
aagaaattagaagaacttgcagagtctgagatacgctttacagcagcaactatgaagcagattaaagaacgctac

SEQ ID NO: 320075 - DNA, 75 bp, Artificial Sequence
  Synthetic
ttagcagaaatgggagaagcaagccatatgatcacgtataaaccacactctgttaaaatagagatcaatgcagat

SEQ ID NO: 320076 - DNA, 75 bp, Artificial Sequence
  Synthetic
atgtcaaagtggagtgctcaagatgtcctgtttaaatatttttggttatttgctttagatcctgcactctatttg

SEQ ID NO: 320077 - DNA, 75 bp, Artificial Sequence
  Synthetic
caggagaaagaaagaatattgtatttcttatgtaattatatgcagaaaaaactgatattgcctgatgaaatgctc

SEQ ID NO: 320078 - DNA, 75 bp, Artificial Sequence
  Synthetic
tgcagtatccttgatcaacgaataaaacatgaagatgatataatatatgagatgactaatggtttgtcacagaac

SEQ ID NO: 320079 - DNA, 75 bp, Artificial Sequence
  Synthetic
tgggtcaacatcaaacgcaattggttgcaagggaatcttaattacacgagcagttatttgcattcatgctctatg

SEQ ID NO: 320080 - DNA, 75 bp, Artificial Sequence
  Synthetic
aatgtttacaaagatgtcttaaagagggcagccattctgttggaaggagaagttcttgtgaattctatggtacac

SEQ ID NO: 320081 - DNA, 75 bp, Artificial Sequence
  Synthetic
tctgatgacaatcatacttcaatagtaatgattcaagacaaattaaatgatgacgttattattgagttttctgca

SEQ ID NO: 320082 - DNA, 75 bp, Artificial Sequence
  Synthetic
aagttatttgaaaaaatatgtttgactttcggaaatcaagcaaacatgaaaaagacctatataacaaatttcata

SEQ ID NO: 320083 - DNA, 75 bp, Artificial Sequence
  Synthetic
aaggagttcgtttctcttttcaatatttatggtgagcctttttctgtttatggtcgctttatattgacatctgtt

SEQ ID NO: 320084 - DNA, 75 bp, Artificial Sequence
  Synthetic
ggagattgcgcttttcttggaccatatgaagatgttgccagtagattgtctgcaacacaaacagcaattaaacat

SEQ ID NO: 320085 - DNA, 75 bp, Artificial Sequence
  Synthetic
ggagcaccgccctcccttgcatggactgctattgctctgacacagtggataactcacagtacatataacatgctc

SEQ ID NO: 320086 - DNA, 75 bp, Artificial Sequence
  Synthetic
cctggccaaatcaatgatcccacctcagtcctgcctagccatgacaggtttgaattacctatagaattatgtggc

SEQ ID NO: 320087 - DNA, 75 bp, Artificial Sequence
  Synthetic
ttaataaattctgagttacccactatagctattgcaggcctagaatcagacaatctgagctacttagttagattg

SEQ ID NO: 320088 - DNA, 75 bp, Artificial Sequence
  Synthetic
tctaagagaatgtctcctatacatctttgccgcgaaccgatacagcatcaatatgaaaatatacatacatgggac

SEQ ID NO: 320089 - DNA, 75 bp, Artificial Sequence
  Synthetic
attaataaattgacacaatgtgatatattcaggctcaagcttcttagatatatgacgttagactcaacaatgtca

SEQ ID NO: 320090 - DNA, 75 bp, Artificial Sequence
  Synthetic
tctgatgatgggatgggtgagaccagtgagatgcgatctagatctcttctaacaccaaggaaattcactactgct

SEQ ID NO: 320091 - DNA, 75 bp, Artificial Sequence
  Synthetic
agttcgttgtccaggttgcattcatatgctgattaccaaaccacaatacaagaccagcaaaagattgaagagttg

SEQ ID NO: 320092 - DNA, 75 bp, Artificial Sequence
  Synthetic
tttgaatattttatagccaatccacaattactagtcacaaaaggtgaaacttgtgaagaattttgcatgtctgtc

SEQ ID NO: 320093 - DNA, 75 bp, Artificial Sequence
  Synthetic
ttattcagatataatagtcgaaaattcaaggaatcactgtctatccaaaacccagcccagcttttcatagaacaa

SEQ ID NO: 320094 - DNA, 75 bp, Artificial Sequence
  Synthetic
gtattgtttgcgaataaacccatgatagattatactagtattcatgaccgattatttggaatacaagatgatcca

SEQ ID NO: 320095 - DNA, 75 bp, Artificial Sequence
  Synthetic
aatataaatgatgcaacatgcattattggtaaaaagacctttattgagacatatcagcagataaaagcagacata

SEQ ID NO: 320096 - DNA, 75 bp, Artificial Sequence
  Synthetic
gaaaaattcacacttgatacagaagacataaaaacaatatttagtttctgtataatgaatgatcctatattagtt

SEQ ID NO: 320097 - DNA, 75 bp, Artificial Sequence
  Synthetic
gcctgtgcaaacaatctattaatttcaatacaaggtgtagaaatgcaacgcttaggtatgacatgctgttatatg

SEQ ID NO: 320098 - DNA, 75 bp, Artificial Sequence
  Synthetic
ccagaaattaaaagtctcaaggtaatctatcatagcccagcactcgtattgcgtgcatatgtaacagacaactat

SEQ ID NO: 320099 - DNA, 75 bp, Artificial Sequence
  Synthetic
gaacaaaaagggatggaaccagatgaaatgcggagggatatatatcatctagaagagtttattgagaagacaaaa

SEQ ID NO: 320100 - DNA, 75 bp, Artificial Sequence
  Synthetic
ttaaggacaaatatgcaagcaagaattggagctaatgagatcaaattaatgaagcgagatctgaagtttgaagtg

SEQ ID NO: 320101 - DNA, 75 bp, Artificial Sequence
  Synthetic
caagagttgactaaattttatcagatctgttatgagtatgttaaatcaacagaacataagattaaaatatttatt

SEQ ID NO: 320102 - DNA, 75 bp, Artificial Sequence
  Synthetic
cttcctaagaaagcttatacacctattgatttttgctcattggtaacaggcaatctaatatcagataataagtgg

SEQ ID NO: 320103 - DNA, 75 bp, Artificial Sequence
  Synthetic
atggttgtccactacttgaagcagattactgtgccagcaaaaaaagcacaaatagcaacatcaatagatctagaa

SEQ ID NO: 320104 - DNA, 75 bp, Artificial Sequence
  Synthetic
atacagattgcctatgagtgctttagattgatcactcattttgcagatatgttcttaagtgatgattcaaaaaaa

SEQ ID NO: 320105 - DNA, 75 bp, Artificial Sequence
  Synthetic
gcctatattaatgcaatcataagcacatacacatacaaagatgtccaagtgtcaagtctatataagaagattaaa

SEQ ID NO: 320106 - DNA, 75 bp, Artificial Sequence
  Synthetic
agctcaaaattgagatcaaaaatcataccgctattatatcatttaggcgatctgcaacaagtagatattgataga

SEQ ID NO: 320107 - DNA, 75 bp, Artificial Sequence
  Synthetic
tttgatgcagaaaaagcagaagagcaaataacatggaacaattggcaaacttcacgagagtttactaccggcccg

SEQ ID NO: 320108 - DNA, 75 bp, Artificial Sequence
  Synthetic
attgacttgtcaataaaaggatatgggcggtcaatacgaattgtgggtgaagataacaagctaacagctgcagaa

SEQ ID NO: 320109 - DNA, 75 bp, Artificial Sequence
  Synthetic
atgcaactgtctagagttcgaagcgacatagtatcacgacatgggcaagctctattgaataagcctcatggattg

SEQ ID NO: 320110 - DNA, 75 bp, Artificial Sequence
  Synthetic
aagttagaaaaaatggaaccagtaaccgacctaaatcccaagttgtggtatatagcttatcaactgagagaaaag

SEQ ID NO: 320111 - DNA, 75 bp, Artificial Sequence
  Synthetic
aagcggtatcattatggagtctttagcatgtcttacattgaagagcataattcaagaatagaagcatctcggata

SEQ ID NO: 320112 - DNA, 75 bp, Artificial Sequence
  Synthetic
cgcaagagcaataaatggataccggtctgccctattgctatatcaaaacaaacatctgatgggagacccaatctc

SEQ ID NO: 320113 - DNA, 75 bp, Artificial Sequence
  Synthetic
gctaaaatccctatgttgaatataggggaaacaaaatttacaaaattacaaattgcagtggatgaccatgcaatg

SEQ ID NO: 320114 - DNA, 75 bp, Artificial Sequence
  Synthetic
atcagaaaggctccattcagcaaaatggtgttttttgatggcccacccatacaaagtggcggtattgatattggg

SEQ ID NO: 320115 - DNA, 75 bp, Artificial Sequence
  Synthetic
aggcttatgaagaatcagaatatactcaatcttaggcttgataatatacaaaatataacattgctagatttatgc

SEQ ID NO: 320116 - DNA, 75 bp, Artificial Sequence
  Synthetic
cgtatattctcatgtcgaggcaccaagatagatcaagatgcatttgaattcctatctgatgagccactagatgaa

SEQ ID NO: 320117 - DNA, 75 bp, Artificial Sequence
  Synthetic
gatgttatagatgagttggatagttcacctgcattggtagtatcttatacaaaaaaatcaaccaaatccaatagc

SEQ ID NO: 320118 - DNA, 75 bp, Artificial Sequence
  Synthetic
tttaaaaatgtcataattagagcattgataagagagtgtgatatatttgaagatataatggatataacagatgat

SEQ ID NO: 320119 - DNA, 75 bp, Artificial Sequence
  Synthetic
ggattcacctctgatagcaatctagaagttctggagaacttgacttggatcttaaacaagctagctacaaatcaa

SEQ ID NO: 320120 - DNA, 75 bp, Artificial Sequence
  Synthetic
tggtctacagagttgttagcatgcatacatatgtgcttataccgtaatgaaatggatcacatctaccacaatttc

SEQ ID NO: 320121 - DNA, 75 bp, Artificial Sequence
  Synthetic
caaatcccagaaatatttgttgacgatccaatatcattgaatgttaagtgggatgaagtagtcatgttcttaaat

SEQ ID NO: 320122 - DNA, 75 bp, Artificial Sequence
  Synthetic
atattgcgagacagggactacaaaatcgaaccgtggatttctatactaaatcattctttaactaaagctgttgac

SEQ ID NO: 320123 - DNA, 75 bp, Artificial Sequence
  Synthetic
tatgcctataagaagctagaagaagagaggagacagaaatcaactggtattaataagttcttgaaggggaagaag

SEQ ID NO: 320124 - DNA, 75 bp, Artificial Sequence
  Synthetic
atgggtggtagatcgaagtttgatttccaatgattgaactataaataatatacaatctttgccccaaatctgtat

SEQ ID NO: 320125 - DNA, 75 bp, Artificial Sequence
  Synthetic
aactataaataatatacaatctttgccccaaatctgtattatattaatgattttaaagtagtttcatgtaattag

SEQ ID NO: 320126 - DNA, 75 bp, Artificial Sequence
  Synthetic
acaatcaaaatgcttctcaacattatcttagtattgaacctagcctattcggcttttacactcccacttaaggaa

SEQ ID NO: 320127 - DNA, 75 bp, Artificial Sequence
  Synthetic
ggcactagaggctctagatgcttcttaaatggagagttagtcaaaactgtcaatacatcaaaagtggtttcagag

SEQ ID NO: 320128 - DNA, 75 bp, Artificial Sequence
  Synthetic
tgctgtgtaaaagatgatatatctatcatcaaatcaaactctgaacattacaaatcaggtgatagattggctgcc

SEQ ID NO: 320129 - DNA, 75 bp, Artificial Sequence
  Synthetic
tcattatcgaatatctggtacaatgcatgtatcaggttggtttaaaaataaaattgaaattcctttagaaaacac

SEQ ID NO: 320130 - DNA, 75 bp, Artificial Sequence
  Synthetic
atgcgaatctattgaagtaacatgtggattgaaaactctcagtttccatgcatgcttccatacgcacaaatcatg

SEQ ID NO: 320131 - DNA, 75 bp, Artificial Sequence
  Synthetic
tctgtcatgatgatgatactaacaaaaacatacatagtgtatatatttatccctatattttatccgtttgtaaaa

SEQ ID NO: 320132 - DNA, 75 bp, Artificial Sequence
  Synthetic
aaacatacatagtgtatatatttatccctatattttatccgtttgtaaaattatatgcttatatgtacaataagt

SEQ ID NO: 320133 - DNA, 75 bp, Artificial Sequence
  Synthetic
tgaactacactactacggaatcacttaaattgcatcgtatgtgcaataattgttcaggatacagagcattaccta

SEQ ID NO: 320134 - DNA, 75 bp, Artificial Sequence
  Synthetic
agactaggaaattatgcaaaagtaaactgtccaatatagtgctatgtgtaattgcatcactgatattcttctctt

SEQ ID NO: 320135 - DNA, 75 bp, Artificial Sequence
  Synthetic
actgtccaatatagtgctatgtgtaattgcatcactgatattcttctctttcattacacctatttcaagtcaatg

SEQ ID NO: 320136 - DNA, 75 bp, Artificial Sequence
  Synthetic
taatgatacttacagttttatatattcttgtgtgtgtataattgtattgataatgattaaaaatgcaatgaagta

SEQ ID NO: 320137 - DNA, 75 bp, Artificial Sequence
  Synthetic
aaataaatgtttaagttgcgtatgcgcagaaaataaaggcctaacaatccataagggttctaagaaatgcctatt

SEQ ID NO: 320138 - DNA, 75 bp, Artificial Sequence
  Synthetic
tagatttgaatcaaattataacaggattggactgttaatttttgtggttttgttaataccgacaattgtaatgtc

SEQ ID NO: 320139 - DNA, 75 bp, Artificial Sequence
  Synthetic
tgaagagggtaatgtcaattgtaaaaatataaaacctgctcaacttacaatagaccaccttagtaaatgcatggc

SEQ ID NO: 320140 - DNA, 75 bp, Artificial Sequence
  Synthetic
ctgatgcctctccagacgagcaggaattggtaaagagtctaaatttgaattgtgatgtaatggacaggtttatat

SEQ ID NO: 320141 - DNA, 75 bp, Artificial Sequence
  Synthetic
caatatacaatggaaagcattagctcgtagctttacattgggagtatgcaatacaaatcctcataagcacatttg

SEQ ID NO: 320142 - DNA, 75 bp, Artificial Sequence
  Synthetic
cagtcaaaggactatcaagcattgcggcacatacaagggaagctctcaccaaagtcacagtcaaatttacaactt

SEQ ID NO: 320143 - DNA, 75 bp, Artificial Sequence
  Synthetic
ggcacatacaagggaagctctcaccaaagtcacagtcaaatttacaacttaaagggtttttagaatttgtcgatt

SEQ ID NO: 320144 - DNA, 75 bp, Artificial Sequence
  Synthetic
atagaaatttagatcaaaaagatcctggccaggcccccatattgatatgcaaatcaccccagaaagtgatatgtt

SEQ ID NO: 320145 - DNA, 75 bp, Artificial Sequence
  Synthetic
attcaccacgtggcattacacaccctggagattacatatcatgcaaatctaaaatatacaagtggccatcattag

SEQ ID NO: 320146 - DNA, 75 bp, Artificial Sequence
  Synthetic
gagtatataggtataacaaagatcaacaacaggcttgcaatggtgacacacactgcttagaaatgttcgaaccag

SEQ ID NO: 320147 - DNA, 75 bp, Artificial Sequence
  Synthetic
cactgcttagaaatgttcgaaccagctgagagaacaatcaacacaaaaatatgcaaaataagcgacatggcctat

SEQ ID NO: 320148 - DNA, 75 bp, Artificial Sequence
  Synthetic
caatggcagatcgcagagtgcgcaaatggcttgctatattatgtttcagctaaatctcattcaagaactaacgat

SEQ ID NO: 320149 - DNA, 75 bp, Artificial Sequence
  Synthetic
ataacattgtattgcctctcagcaaattgtctagatttgcgctatgcattcagatctactagctgctcagatata

SEQ ID NO: 320150 - DNA, 75 bp, Artificial Sequence
  Synthetic
attgtctagatttgcgctatgcattcagatctactagctgctcagatatagtatgggatacaagctatcggaata

SEQ ID NO: 320151 - DNA, 75 bp, Artificial Sequence
  Synthetic
ccgcaatataaaacaatgacactaagcggggataaggtctcaaatggtattaggaatagctatattgaatctcat

SEQ ID NO: 320152 - DNA, 75 bp, Artificial Sequence
  Synthetic
taggaatagctatattgaatctcatattcctgcagttaatggtctgtcagcgggaatcaatattgccacgccaaa

SEQ ID NO: 320153 - DNA, 75 bp, Artificial Sequence
  Synthetic
gacgggccctacaatcggaataaatgctaagcatgaagaggtctgcacaggaaaatgtccaactccaataccgca

SEQ ID NO: 320154 - DNA, 75 bp, Artificial Sequence
  Synthetic
gaaaatgtccaactccaataccgcatcaagatggttggatcactttttcaaaagaaagatcgagcaattggggtt

SEQ ID NO: 320155 - DNA, 75 bp, Artificial Sequence
  Synthetic
ataaccatggcacatgaatcgttttgcagtactgtcgatgttctccagcccttgatcagtgataggatacagtta

SEQ ID NO: 320156 - DNA, 75 bp, Artificial Sequence
  Synthetic
gcagtactgtcgatgttctccagcccttgatcagtgataggatacagttagatattcaaacagtccaaatggatt

SEQ ID NO: 320157 - DNA, 75 bp, Artificial Sequence
  Synthetic
taccaatcttgcctcctcttagagcaagatactacattaaccattgcatccaccaatcacatggaagtgcataaa

SEQ ID NO: 320158 - DNA, 75 bp, Artificial Sequence
  Synthetic
gcaacaatcacaatagatgaagtcagatgtggtggatgctatggttgtcctgaaggaatggcctgctcacttaaa

SEQ ID NO: 320159 - DNA, 75 bp, Artificial Sequence
  Synthetic
ataactaccaacagcattggaagctgtcctataaaaagcaattgcgatacgtacattaagataatagcagtggat

SEQ ID NO: 320160 - DNA, 75 bp, Artificial Sequence
  Synthetic
gtcctataaaaagcaattgcgatacgtacattaagataatagcagtggatccgatgcaaagcgattactccatca

SEQ ID NO: 320161 - DNA, 75 bp, Artificial Sequence
  Synthetic
tatcgaaaaatcatccaaagattgtcttaaattccctagatgaaacttcatatattgaacagcacgacaagaaat

SEQ ID NO: 320162 - DNA, 75 bp, Artificial Sequence
  Synthetic
cttaaattccctagatgaaacttcatatattgaacagcacgacaagaaatgctctacttggctatgtcgagtcta

SEQ ID NO: 320163 - DNA, 75 bp, Artificial Sequence
  Synthetic
tctactggaaattaacaatatacatcatactctcactccttatcctgatcttgactctatatatactaataccat

SEQ ID NO: 320164 - DNA, 75 bp, Artificial Sequence
  Synthetic
taaatatacaaacaataacatatatatgtggtcacacatatatatgtcattattcagctgagaagtttttcatgt

SEQ ID NO: 320165 - DNA, 75 bp, Artificial Sequence
  Synthetic
gctgatacgtgcaaggctagtgtccttaagttggctgaagcaagtgctcagattgtcatgcctcttgctgaggtt

SEQ ID NO: 320166 - DNA, 75 bp, Artificial Sequence
  Synthetic
gattgtcatgcctcttgctgaggttaaaggttgtacttgggctgatggttatacaatgtatcttggattcgcacc

SEQ ID NO: 320167 - DNA, 75 bp, Artificial Sequence
  Synthetic
gtccttcgccagcgctatggaacaatgactgcagaagaatggatgactcaaaaaataacagaaattaaggctgcg

SEQ ID NO: 320168 - DNA, 75 bp, Artificial Sequence
  Synthetic
tgccagagctttcttgcagcaatttggtattaacatctaaacctctccgttacacactcttaaatttccgtgcaa

SEQ ID NO: 320169 - DNA, 75 bp, Artificial Sequence
  Synthetic
tcttaaatttccgtgcaatatgtctatgtattgcacaccattatactgcaaggcttctgttgaaatagttaataa

SEQ ID NO: 320170 - DNA, 75 bp, Artificial Sequence
  Synthetic
cacaatcaaaatgcttctcaacaatgtcttgatattaaatctagcctatttggcttttacactcccacttaagga

SEQ ID NO: 320171 - DNA, 75 bp, Artificial Sequence
  Synthetic
acatatatatgtggttgcgcatatatatgtcattattcagcagagaagtttttcatgtggtagaacactactccc

SEQ ID NO: 320172 - DNA, 75 bp, Artificial Sequence
  Synthetic
ttcactactgaaatatgtcaagccaattcatttttgaagatgtaccacaacggaatgcagctacatttaacccgg

SEQ ID NO: 320173 - DNA, 75 bp, Artificial Sequence
  Synthetic
aggtcgggtatgtggcatttattggtaagtatgggcaacaactcaatttcagtgttgctagagtcttcttcctca

SEQ ID NO: 320174 - DNA, 75 bp, Artificial Sequence
  Synthetic
gacaatgccatcacactccacaggatgtcaggatacttagcgcggtgggtagctgacacatgcaaagctagtgtt

SEQ ID NO: 320175 - DNA, 75 bp, Artificial Sequence
  Synthetic
ctcaaactagctgaagcaagtgcacagattgttatgcctcttgctgaggttaagggctgcacctgggctgatggc

SEQ ID NO: 320176 - DNA, 75 bp, Artificial Sequence
  Synthetic
tatacaatgtatcttggatttgcacctggagcagaaatgttccttgatgcttttgatttttacccactggtcatt

SEQ ID NO: 320177 - DNA, 75 bp, Artificial Sequence
  Synthetic
gagatgcatagagtcctcaaagataatatggatgtgaacttcatgaagaaagtccttcgccaacgttacggcaca

SEQ ID NO: 320178 - DNA, 75 bp, Artificial Sequence
  Synthetic
atgactgcagaagaatggatgactcaaaaaataacagaaataaaggcagcattcaattctgttgggcaactggct

SEQ ID NO: 320179 - DNA, 75 bp, Artificial Sequence
  Synthetic
tgggctaaatctggattctctcctgctgctagaactttcttgcagcaattcggcatcaacatctaaacctctccg

SEQ ID NO: 320180 - DNA, 75 bp, Artificial Sequence
  Synthetic
ttataaccctttactttccgtgcaatatgtctatgtattgcacaccattatactgcaaagcttctattaaaatag

SEQ ID NO: 320181 - DNA, 75 bp, Artificial Sequence
  Synthetic
ctttccgtgcaatatgtctatgtattgcacaccattatactgcaaagcttctattaaaatagttaataagtggag

SEQ ID NO: 320182 - DNA, 75 bp, Artificial Sequence
  Synthetic
acccctaattacaatcgctatggagacatacaaaataaacatctttagagataggatcaaccaatgtcgaagtgc

SEQ ID NO: 320183 - DNA, 75 bp, Artificial Sequence
  Synthetic
tgaagaagctaaagacattgttgctgatctcctaatggctagacatgactattttggtagagaagtatgttatta

SEQ ID NO: 320184 - DNA, 75 bp, Artificial Sequence
  Synthetic
tttggacattgaattccggcaagatattccagcatatgacatactccttgaattcttgccaccgggtactgcttt

SEQ ID NO: 320185 - DNA, 75 bp, Artificial Sequence
  Synthetic
tgatgttcgcaactgtacaccagacaattttattattcataatgggaagctttatatcattgattataaagtgtc

SEQ ID NO: 320186 - DNA, 75 bp, Artificial Sequence
  Synthetic
aacagaccatacatatggtcaaaaaacatatgaaaaatatacccaaatctttggagacgcattgtcagaactacc

SEQ ID NO: 320187 - DNA, 75 bp, Artificial Sequence
  Synthetic
atttgagtttgaagtcgtaatcattcgcgctgatcctttacgagatacgatccatgtcaattcaaatcagttttt

SEQ ID NO: 320188 - DNA, 75 bp, Artificial Sequence
  Synthetic
agagatatttggcccacttaacattaatcttgattttacatggttctttaatctgcgatcattaatatatgagaa

SEQ ID NO: 320189 - DNA, 75 bp, Artificial Sequence
  Synthetic
gtataaggatgatgatagatttctagaaattgtaaatcaaggtgaatttacaatgactggaccctggattgagga

SEQ ID NO: 320190 - DNA, 75 bp, Artificial Sequence
  Synthetic
ggctactccagaattgtattcacatcctattttcttagagttctacgattctttagatgaaactgctaagctgac

SEQ ID NO: 320191 - DNA, 75 bp, Artificial Sequence
  Synthetic
attccatgaatctatgacatttgatgctacccgtggggaaaaatggaatcagaatctgcaaaaagttatgagtag

SEQ ID NO: 320192 - DNA, 75 bp, Artificial Sequence
  Synthetic
atatagcaatgattacagtaattttgtaaaagatgcggctgcaggagttttcaaatgtgatggaaactatcctaa

SEQ ID NO: 320193 - DNA, 75 bp, Artificial Sequence
  Synthetic
accagatcatgatgaaataacaattggctggaatcaaatggttcagagagtaagtatggaaagaaatcttactca

SEQ ID NO: 320194 - DNA, 75 bp, Artificial Sequence
  Synthetic
ggatatcagcaagcagaaaccatctgtccacttcatatggggtaagcctgatgagacatcaaatgcaacaatacc

SEQ ID NO: 320195 - DNA, 75 bp, Artificial Sequence
  Synthetic
aaaattgattaaaattgctagagcacttcagaacatctctggtgaatctacatatataaatgcatttaaagcatt

SEQ ID NO: 320196 - DNA, 75 bp, Artificial Sequence
  Synthetic
aggttctctcatggatttttctgaaaatacagctttatacgaagcacacactaataaattaaagagtatggcaag

SEQ ID NO: 320197 - DNA, 75 bp, Artificial Sequence
  Synthetic
acagacatcgaagagaatagacaccaagctagaacctatcaagataggtaatgcaacaatatactgggagcaaca

SEQ ID NO: 320198 - DNA, 75 bp, Artificial Sequence
  Synthetic
attcaaattagatagtgaagtaatgagcccgaaggataaatcgcatttattaaaggatttccttggcataggagg

SEQ ID NO: 320199 - DNA, 75 bp, Artificial Sequence
  Synthetic
ccatgtgcaattttcaaaaaagactattgaagatctagacactgacaaacctactatcctagattttaataaaaa

SEQ ID NO: 320200 - DNA, 75 bp, Artificial Sequence
  Synthetic
ggaagtcattgatttttgcaaattccaatatgaaaatgtgaaaaagatattgtctgaaaacaacaatctggaacg

SEQ ID NO: 320201 - DNA, 75 bp, Artificial Sequence
  Synthetic
tatagggtgctatctagaagaatatggtgcaaatattgcatcatcttcaaaggctacatgggatcaaatcaacca

SEQ ID NO: 320202 - DNA, 75 bp, Artificial Sequence
  Synthetic
agtaggtaaatcaaactattgggcttgtattaaagacttttcaatcttaatgaaaaatatgttagcagtttctca

SEQ ID NO: 320203 - DNA, 75 bp, Artificial Sequence
  Synthetic
atataatagacacaatacattccgcgtagtgtgctgtgcaaataacaatctgtttggatttgtgatgccttcttc

SEQ ID NO: 320204 - DNA, 75 bp, Artificial Sequence
  Synthetic
tgacatcaaagcaaaaagatcaacgcttgtttattttttagctgtattacattctgcccctcaaaatgtgatgca

SEQ ID NO: 320205 - DNA, 75 bp, Artificial Sequence
  Synthetic
ccacggcgctttgcatgcaacatttaagacaggctctaagtaccttagtgtctctaagggaattcgattagataa

SEQ ID NO: 320206 - DNA, 75 bp, Artificial Sequence
  Synthetic
agaaagatgccaacgtatagttagctcaccagggctcttcatgctaacaacattgatgtttgcaggagacaaccc

SEQ ID NO: 320207 - DNA, 75 bp, Artificial Sequence
  Synthetic
aacactgaatttaaatgatgtcatgaattttacattccatacctctttatctataacaaaagcaatgctgtcttt

SEQ ID NO: 320208 - DNA, 75 bp, Artificial Sequence
  Synthetic
gacagaaccatcaagatatatgataatgaactctttagctatatccagtcatgtaagagattatattgcagaaaa

SEQ ID NO: 320209 - DNA, 75 bp, Artificial Sequence
  Synthetic
attcggcccttatacaaaaactagtttctcagtagtaatggcaaatttgattaaaaggggatgctatatggcata

SEQ ID NO: 320210 - DNA, 75 bp, Artificial Sequence
  Synthetic
tagtcagagagataaagttgacatgcggaatatctgtttgactgattatgagataactcaaaaaggtgtgagaga

SEQ ID NO: 320211 - DNA, 75 bp, Artificial Sequence
  Synthetic
taatagagatttatcatcaatctggtttgaaggctatgtgtcacttaaagaatatatcaatcagatatacttacc

SEQ ID NO: 320212 - DNA, 75 bp, Artificial Sequence
  Synthetic
attttacttcaactcgaaaggtttgcatgaaaagcaccatgtcatgatagatttagctaagacaatcttagatat

SEQ ID NO: 320213 - DNA, 75 bp, Artificial Sequence
  Synthetic
agagcgggatcagaggttgaatattccagggatatggtctgcgataccaaggaagcaaactgctaatttgagtgt

SEQ ID NO: 320214 - DNA, 75 bp, Artificial Sequence
  Synthetic
gaccatctatgcagttgcaaagaacctaacaatggacactgcaagacataattacatcagatcgcggatagaaaa

SEQ ID NO: 320215 - DNA, 75 bp, Artificial Sequence
  Synthetic
cacaaataatttgaataggtcgatatgcactatttctacatttactagctctaagtcatgcattaaggtagggga

SEQ ID NO: 320216 - DNA, 75 bp, Artificial Sequence
  Synthetic
ttttgagaaagaaaaaagttcagctgtaaaaaaagcagcagattgtatgtcaaaagagataaagaaatacactat

SEQ ID NO: 320217 - DNA, 75 bp, Artificial Sequence
  Synthetic
tgcaaacccagaatttgttgatgaggaattgatgaatgcaaccataaggcattcacgctatgaagacttaaaagc

SEQ ID NO: 320218 - DNA, 75 bp, Artificial Sequence
  Synthetic
agcaatccccaattatattgatattatgtcaaccaaggtatttgactctttataccaaaaaataaagaaaaagga

SEQ ID NO: 320219 - DNA, 75 bp, Artificial Sequence
  Synthetic
aatagatgatagacctactgtacaccacatactcactgttatgaaaaatcatacagatttcaagttcacattctt

SEQ ID NO: 320220 - DNA, 75 bp, Artificial Sequence
  Synthetic
caataaaggtcagaagacagcaaaagatagagagatatttgtgggtgaatttgaagcaaaaatgtgcttatattt

SEQ ID NO: 320221 - DNA, 75 bp, Artificial Sequence
  Synthetic
agtagaaagaatatctaaagaacgatgcaagttaaacccagatgagatgattagtgaaccaggcgattcaaaact

SEQ ID NO: 320222 - DNA, 75 bp, Artificial Sequence
  Synthetic
aaagaaattagaagaactagcagaatccgagatacgctttacagcagcaaccatgaaacaaatcaaagagcgtca

SEQ ID NO: 320223 - DNA, 75 bp, Artificial Sequence
  Synthetic
cttagcagaaatgggagaagtggggcaaatgatcacatataaaccacattctgttaagatagagattaatgcaga

SEQ ID NO: 320224 - DNA, 75 bp, Artificial Sequence
  Synthetic
tatgtcaaagtggagtgctcaggatgtcttatttaagtatttttggctgttcgcactagaccctgcactctatct

SEQ ID NO: 320225 - DNA, 75 bp, Artificial Sequence
  Synthetic
gcaagaaaaagaaagaatattgtacttcctatgcaattatatgcagaagaaattgatcttacctgatgaaatgct

SEQ ID NO: 320226 - DNA, 75 bp, Artificial Sequence
  Synthetic
ttgtagcattcttgaccagcgcataaagcatgaagatgatataatatatgaaatgactaatggtttatcacagaa

SEQ ID NO: 320227 - DNA, 75 bp, Artificial Sequence
  Synthetic
ttgggttaatataaagcggaattggttgcaagggaatctcaactacacgagcagctacttgcattcatgctctat

SEQ ID NO: 320228 - DNA, 75 bp, Artificial Sequence
  Synthetic
gaatgtttataaagatgttttaaaaagagcagccactttattagaaggagaagttttggtaaactctatggtaca

SEQ ID NO: 320229 - DNA, 75 bp, Artificial Sequence
  Synthetic
ctctgatgataatcatacttcaatagtgatgatccaagacaaattagatgatgacattattattgaattttctac

SEQ ID NO: 320230 - DNA, 75 bp, Artificial Sequence
  Synthetic
aaaattatttgaaaaaatatgtctgactttcggaaaccaagcaaatatgaaaaagacatatataacaaattttat

SEQ ID NO: 320231 - DNA, 75 bp, Artificial Sequence
  Synthetic
aaaagagtttgtctccctctttaacatttatggtgaacctttttctgtctacggtcgatttattttaacatctgt

SEQ ID NO: 320232 - DNA, 75 bp, Artificial Sequence
  Synthetic
tggtgactgtgctttcctcgggccttatgaagatgttgccagcagattgtctgcaacacaaacagcaatcaagca

SEQ ID NO: 320233 - DNA, 75 bp, Artificial Sequence
  Synthetic
tggagcaccaccctctattgcctggactgctattgcgttgacacaatggataactcacagtacatacaatatgct

SEQ ID NO: 320234 - DNA, 75 bp, Artificial Sequence
  Synthetic
ccctggtcaaattaatgaccctacatcaatcctgcctagccatgacaggttcgaattacctatagaattatgtgg

SEQ ID NO: 320235 - DNA, 75 bp, Artificial Sequence
  Synthetic
cttgataaactctgaattacctactatagcgatagcaggtttagaatcagacaatttgagctacttagtcagatt

SEQ ID NO: 320236 - DNA, 75 bp, Artificial Sequence
  Synthetic
atctaagaggatgtctcctatacatctttgtcgtgaaccaatacagcatcaatatgagaatatacatgcttggga

SEQ ID NO: 320237 - DNA, 75 bp, Artificial Sequence
  Synthetic
tattactaagctgacacagtgtgacatattcagactcaagcttcttagatacatgacattagattcgacaatgtc

SEQ ID NO: 320238 - DNA, 75 bp, Artificial Sequence
  Synthetic
ttctgatgatggaatgggtgaaactagtgagatgcgatctagatctctcttgacaccgaggaagtttaccactgc

SEQ ID NO: 320239 - DNA, 75 bp, Artificial Sequence
  Synthetic
cagttcattgtctagattgcattcatatgctgattatcaagctacaatacaagatcagaaaaagatcgatgaact

SEQ ID NO: 320240 - DNA, 75 bp, Artificial Sequence
  Synthetic
gtttgaatacttcatagtcaacccgcaactattggttacaaaaggtgaaacttgcgaagaattttgtatgtctgt

SEQ ID NO: 320241 - DNA, 75 bp, Artificial Sequence
  Synthetic
cttatttagatataatagtcggaagtttaaagaatcattgtcgatccagaatccagcccagctctttatagaaca

SEQ ID NO: 320242 - DNA, 75 bp, Artificial Sequence
  Synthetic
agtgttatttgcaaataagccgatgatagattacactagtattcacgatcgcttatttgggatacaagacgatcc

SEQ ID NO: 320243 - DNA, 75 bp, Artificial Sequence
  Synthetic
aaacataaatgatgcgacatgtatcattggtaaaaagacctttgttgaaacataccagcaaataaaaacggacat

SEQ ID NO: 320244 - DNA, 75 bp, Artificial Sequence
  Synthetic
agaaaaatttacacttgatacagaagatataaagacaatattcagtttctgtataatgaacgatcctatactagt

SEQ ID NO: 320245 - DNA, 75 bp, Artificial Sequence
  Synthetic
tgcttgtgcaaataacttgttgatttcagtgcaaggtgtagaaatgcaacgcttaggtatgacatgctgttatat

SEQ ID NO: 320246 - DNA, 75 bp, Artificial Sequence
  Synthetic
gccagagattaagagtcttaaagtaatttatcacagtccagcacttgtactgcgtgcatatgtgacagataacta

SEQ ID NO: 320247 - DNA, 75 bp, Artificial Sequence
  Synthetic
cgagcaaaaagggatggagccagatgagatgcggagagatatatatcatttagaagaatttattgaaaaaacaaa

SEQ ID NO: 320248 - DNA, 75 bp, Artificial Sequence
  Synthetic
attaagggttaatatgcaagcaagaattggagctaatgaaatcaaattgatgaagcgagatttgaaatttgaggt

SEQ ID NO: 320249 - DNA, 75 bp, Artificial Sequence
  Synthetic
gcaggaattgactaaattttatcagatctgctatgaatatgtaaagtcaacggaacacaaaatcaaaatatttat

SEQ ID NO: 320250 - DNA, 75 bp, Artificial Sequence
  Synthetic
tctcccaaagaaagcttatacacctattgatttctgctcattggtaacaggtaatctgatatcagataataaatg

SEQ ID NO: 320251 - DNA, 75 bp, Artificial Sequence
  Synthetic
gatggttgtccactacttgaaacaaattactgtaccagcgaaaaaagcacaaatagctacatcaatagatttaga

SEQ ID NO: 320252 - DNA, 75 bp, Artificial Sequence
  Synthetic
aatacagattgcttatgaatgctttagactgatcgcccactttgcagatatgttcctaagtgatgattcaaaaaa

SEQ ID NO: 320253 - DNA, 75 bp, Artificial Sequence
  Synthetic
atcctacattaatgcaattatagctgcatacacatataaggatgtccaagtgtccagtttatataaaaataaaaa

SEQ ID NO: 320254 - DNA, 75 bp, Artificial Sequence
  Synthetic
ttcaaaattgagatcaaaaattataccactattgtatcacttaggtgatttacagcagttagacattgataggtt

SEQ ID NO: 320255 - DNA, 75 bp, Artificial Sequence
  Synthetic
tgatgcagaaaaagcagaagaacagataacatggaataattggcagacttcaagagagtttactactgggccaat

SEQ ID NO: 320256 - DNA, 75 bp, Artificial Sequence
  Synthetic
cgatctatcaataaaaggttatgggcgatcaatacgaattgtaggtgaagataataagctgacagctgcagaaat

SEQ ID NO: 320257 - DNA, 75 bp, Artificial Sequence
  Synthetic
gcaattatctagagttcgaagtgatatagtgtcacggcatgggcaggctctattaaataagccccatggattaaa

SEQ ID NO: 320258 - DNA, 75 bp, Artificial Sequence
  Synthetic
actagaaaaaatggaaccagtggctgacttgaatcctaaattatggtatatagcatatcagttgagagaaaagaa

SEQ ID NO: 320259 - DNA, 75 bp, Artificial Sequence
  Synthetic
acggtatcattatggagtctttagcacatcttacatagaagaacataattcaagaatagaagcatctaggatacg

SEQ ID NO: 320260 - DNA, 75 bp, Artificial Sequence
  Synthetic
aaaaagtaacaaatggataccagtttgtcccattgctatatcaaaacaagcgtctgatgggaaacctaatattgc

SEQ ID NO: 320261 - DNA, 75 bp, Artificial Sequence
  Synthetic
caaaatccctatgttaaatataggagaaataaaatttactaaattacaaattgcagtagacgaccatgcaatgat

SEQ ID NO: 320262 - DNA, 75 bp, Artificial Sequence
  Synthetic
tagaaaggctccattcagtaaaatggtattctttgatggtccacctatacaaagtggcggtattgatattggaag

SEQ ID NO: 320263 - DNA, 75 bp, Artificial Sequence
  Synthetic
gctcatgaaaaaccagaatatacttaacctcagattagacaatatacaaaatataacattgttagacttatgccg

SEQ ID NO: 320264 - DNA, 75 bp, Artificial Sequence
  Synthetic
cattttttcatgcagaggagctaaagtagatcaagatgcattcgaatttttgtctgacgaaccattggatgaaga

SEQ ID NO: 320265 - DNA, 75 bp, Artificial Sequence
  Synthetic
tgttatagatgagttggatagttcacctgcattggtagtttcttatacaaagaaatcaaccaaatctaacagctt

SEQ ID NO: 320266 - DNA, 75 bp, Artificial Sequence
  Synthetic
taaaaatgtcattattagagcattgataagggaatgtgatatattcgaggatataatggatataacagatgaggg

SEQ ID NO: 320267 - DNA, 75 bp, Artificial Sequence
  Synthetic
gttcacctctgatactaatctagaagttttggagaacttaacatggatattaaataaactagctacaaatcaatg

SEQ ID NO: 320268 - DNA, 75 bp, Artificial Sequence
  Synthetic
gtctacagaactactggcatgtatacatatgtgcttataccgtaacgaaatggatcacatataccataactttca

SEQ ID NO: 320269 - DNA, 75 bp, Artificial Sequence
  Synthetic
aatcccagagatatttgtagataacccaatatcactaaatatcaaatgggatgaggtagtcatgttcttaaacat

SEQ ID NO: 320270 - DNA, 75 bp, Artificial Sequence
  Synthetic
actgcgagacagggattacaaaattgagccatggatttctattttaaatcattctttgactaaagctgtagatta

SEQ ID NO: 320271 - DNA, 75 bp, Artificial Sequence
  Synthetic
tgcttataagaaaatagaagaagaaaggaagcaaaaatcaactaatattaataagtttttaaaggggaaaaagat

SEQ ID NO: 320272 - DNA, 75 bp, Artificial Sequence
  Synthetic
gggcggcagatcgaaattcgatttccaataatcaaagtgtaaataatgtataatcattgccccaaatctgtatta

SEQ ID NO: 320273 - DNA, 75 bp, Artificial Sequence
  Synthetic
caaagtgtaaataatgtataatcattgccccaaatctgtattatattaataattcaatagtagtttcatgtaatt

SEQ ID NO: 320274 - DNA, 75 bp, Artificial Sequence
  Synthetic
gcttaagaataatagacaacttcacaaataaatgtttaagttgtgtatgcgcagaaaataaaggcttaacaatcc

SEQ ID NO: 320275 - DNA, 75 bp, Artificial Sequence
  Synthetic
attgtctagatttgcgttatgcattcagatctactagctgctcagatatagtatggaacacgagctatcggaata

SEQ ID NO: 320276 - DNA, 75 bp, Artificial Sequence
  Synthetic
taggaatagctatattgaatctcatattcctgcagtcaatggtctgtcagcaggaatcaatattgccacgccgaa

SEQ ID NO: 320277 - DNA, 75 bp, Artificial Sequence
  Synthetic
ctatgccaaatattattgcagttaaaaatgggagaatctatgttggagatatcaatgacttagggtcaacagcta

SEQ ID NO: 320278 - DNA, 75 bp, Artificial Sequence
  Synthetic
atcaatgacttagggtcaacagctaaaaagtgcggctcagttcaattatattcagaaggagttattggttcaggg

SEQ ID NO: 320279 - DNA, 75 bp, Artificial Sequence
  Synthetic
aattgaactgtccgttagcaacagatactatctctataagtgtttgctcagcttctgtcaatacaaaaccatcaa

SEQ ID NO: 320280 - DNA, 75 bp, Artificial Sequence
  Synthetic
agaatataatgagagaatatatcagatggagaataaatttaaatgataaattcaaggccagtatctaattaacta

SEQ ID NO: 320281 - DNA, 75 bp, Artificial Sequence
  Synthetic
aggggcagaaatgttccttgatgcttttgatttctatccgctggttatcgaaatgcacagggttctcaaagacaa

SEQ ID NO: 320282 - DNA, 75 bp, Artificial Sequence
  Synthetic
ctgacatatttcagtagttaatagtggaatacactactgaaatatgtcaagccaattcatttttgaagatgtacc

SEQ ID NO: 320283 - DNA, 75 bp, Artificial Sequence
  Synthetic
gcacctggggcagaaatgttccttgatgcttttgacttctacccactggttatcgagatgcacagggttctcaaa

SEQ ID NO: 320284 - DNA, 75 bp, Artificial Sequence
  Synthetic
atgcttttgacttctacccactggttatcgagatgcacagggttctcaaagataatatggatgtaaatttcatga

SEQ ID NO: 320285 - DNA, 75 bp, Artificial Sequence
  Synthetic
ctgcgttcaactccgttggacaacttgcttgggctaaatctggattctctcctgctgccagaactttcttgcagc

SEQ ID NO: 320286 - DNA, 75 bp, Artificial Sequence
  Synthetic
cctgctgccagaactttcttgcagcaatttggtatcaacatctaaacctctccattacaaactcttaaatttccg

SEQ ID NO: 320287 - DNA, 75 bp, Artificial Sequence
  Synthetic
atttccgtgcaatatgtctatgtattgcacaccattatactgcaaggcttctgttgagatagttaataagtggag

SEQ ID NO: 320288 - DNA, 75 bp, Artificial Sequence
  Synthetic
tatataagtaaaggtagaggggaatggctgagtttttgctgctggatggccaagagagctcatgtaagtagagag

SEQ ID NO: 320289 - DNA, 75 bp, Artificial Sequence
  Synthetic
agcgctcttggagcctgggcgggtgcaggaggcctagagccggatcaaggggcttatcgggcagtgcgaccatac

SEQ ID NO: 320290 - DNA, 75 bp, Artificial Sequence
  Synthetic
agcagaaggggcaagattttttatatgggggaaaaactaccacaactaatagcggtttcctttgatctcatctat

SEQ ID NO: 320291 - DNA, 75 bp, Artificial Sequence
  Synthetic
caatctgaccatgactactgtattactcttccaggtatggacaataatcaaatacctttaattagggtgaagata

SEQ ID NO: 320292 - DNA, 75 bp, Artificial Sequence
  Synthetic
gaaggtgccgggtggtggtctggctttctgatatgtctgcagataatcacacaactggcagtcctgatctatgtc

SEQ ID NO: 320293 - DNA, 75 bp, Artificial Sequence
  Synthetic
accctaaactatataaactccaagaggccaactggaagcggcaagtgagtgctttgcacaaagaattctgccact

SEQ ID NO: 320294 - DNA, 75 bp, Artificial Sequence
  Synthetic
gttctaatttcttggatcattttaaatggcctacaggcaccggaggccattccggaggtaccggagaaggtaccc

SEQ ID NO: 320295 - DNA, 75 bp, Artificial Sequence
  Synthetic
aagatggaagggccggagggtccaccgccgacatacctggagacctttccaccattggcgccgctggaggaggag

SEQ ID NO: 320296 - DNA, 75 bp, Artificial Sequence
  Synthetic
accctacagacgaggaactgttgcagtaagatatactaacccccgtagacataaatatatttctgtgactggctg

SEQ ID NO: 320297 - DNA, 75 bp, Artificial Sequence
  Synthetic
ggagcctcttggtaactgttgtatccaagacaaggcttcagatgaagccacaccttatgaagatcttgattctga

SEQ ID NO: 320298 - DNA, 75 bp, Artificial Sequence
  Synthetic
tgtccagacttgggcaaacagaaccagaactgccgggatctggcatggcacctatggccatcattatccctggca

SEQ ID NO: 320299 - DNA, 75 bp, Artificial Sequence
  Synthetic
actactttgtcagagagcacagttttacttctgcaccttttccagtggctggaaaggttatgattatctacaatt

SEQ ID NO: 320300 - DNA, 75 bp, Artificial Sequence
  Synthetic
ttatggagggaatatttggctaccaaaactagcagctccctactttttttgggtagatccaacagtacaagaccc

SEQ ID NO: 320301 - DNA, 75 bp, Artificial Sequence
  Synthetic
aaagaaaagctcttatgaatctttatgcgaaggacaagacctggttccacccaggggtattcatgaacagaaagg

SEQ ID NO: 320302 - DNA, 75 bp, Artificial Sequence
  Synthetic
tgcacactatataccagccaacaatgaatctcataccctaaaagggtataagagaatccacataaaaaggctatc

SEQ ID NO: 320303 - DNA, 75 bp, Artificial Sequence
  Synthetic
aacatgggaaggggtctatgccatctccactgctgccgactacattttggtacactgggtctggtccaccgttac

SEQ ID NO: 320304 - DNA, 75 bp, Artificial Sequence
  Synthetic
aaaaaactgggccttctttgatggtgcttgctatcaggctggacaagcatccagcgacacctgcaattccactcc

SEQ ID NO: 320305 - DNA, 75 bp, Artificial Sequence
  Synthetic
ttggttcatgtctgcgcagaccgctgagtcaggtgtcaaaaaagaagttgatgaatacaaaaagactaatgactt

SEQ ID NO: 320306 - DNA, 75 bp, Artificial Sequence
  Synthetic
taaaaacaacctatattgctatccggatccacgagcatcatgggtaaacagacaaaaatataataaaacaattca

SEQ ID NO: 320307 - DNA, 75 bp, Artificial Sequence
  Synthetic
gcctctgactgtaacagaaaatcctgggggtccctttctcccttctcagggtgcaggcctcggactcagtagaca

SEQ ID NO: 320308 - DNA, 75 bp, Artificial Sequence
  Synthetic
atatgaccaagtctcattctggtttcgctatcgtttcaaatttaaggtctctggagactctgtctacagaagatt

SEQ ID NO: 320309 - DNA, 75 bp, Artificial Sequence
  Synthetic
accggcggtcagcaatacagacaccatccctgaagcaccaggagctcaaaaccaagtatcgcctcgctccatact

SEQ ID NO: 320310 - DNA, 75 bp, Artificial Sequence
  Synthetic
caaagctagacctctcgacactggggacatacttgaaggggacctccaggacggctgcctcacggaagagagtct

SEQ ID NO: 320311 - DNA, 75 bp, Artificial Sequence
  Synthetic
tagaagaattactggatctcatcgaagaagactcccaaccaaactggcagactcaagctcaagacgtgtccgact

SEQ ID NO: 320312 - DNA, 75 bp, Artificial Sequence
  Synthetic
tttccacgaccccggggtcagaaagcgaagaatcagacgtctcctatctgggctactggagtgatgaagagaatc

SEQ ID NO: 320313 - DNA, 75 bp, Artificial Sequence
  Synthetic
cagggggggaaggtccccccctggtaccccccaccccggggccaaaggccccggagtaccctcctcacttcctct

SEQ ID NO: 320314 - DNA, 75 bp, Artificial Sequence
  Synthetic
ttttgaccttgcaataaaccgtgaatgcggaactaaatgcaaatgtgtggtttctgtggttggtagggaaatcct

SEQ ID NO: 320315 - DNA, 75 bp, Artificial Sequence
  Synthetic
gggcggagcctgccggagcgtggttttaaacctttgttcactttcgttttcaagcagctcatgaatattcatgag

SEQ ID NO: 320316 - DNA, 75 bp, Artificial Sequence
  Synthetic
tcgttttcaagcagctcatgaatattcatgagatgctacatggtgcgcatgcgcagcatgtcatgtgactaactc

SEQ ID NO: 320317 - DNA, 75 bp, Artificial Sequence
  Synthetic
tataaaaagaagtggggtgacgaatggctgagttttctgctgctggatggccaagagagctcatgtaagtagaga

SEQ ID NO: 320318 - DNA, 75 bp, Artificial Sequence
  Synthetic
ggctgagttttctgctgctggatggccaagagagctcatgtaagtagagagagcgctcttggagccggggcgggt

SEQ ID NO: 320319 - DNA, 75 bp, Artificial Sequence
  Synthetic
gcaggaggcctagagccggatcaaggggcttatcgggccgtgcgaccatacagcaggaggggcaagattatttat

SEQ ID NO: 320320 - DNA, 75 bp, Artificial Sequence
  Synthetic
tatgggggaaagactttcacctctaatagcggtttcatttgatctcatctatcaaaccgatgatcatgactactg

SEQ ID NO: 320321 - DNA, 75 bp, Artificial Sequence
  Synthetic
tgttcgttttccaggtatggacaataatcaaatacctctcgtgagggtgaaaatagaaggagctgggtggtggtc

SEQ ID NO: 320322 - DNA, 75 bp, Artificial Sequence
  Synthetic
tggctttttgatatgtctgcagattgtgacacagctcgcggtcctgatctatgtcaccctcaactatataaattc

SEQ ID NO: 320323 - DNA, 75 bp, Artificial Sequence
  Synthetic
atgtcaccctcaactatataaattcaaagaggccaagtggaagcagcaagtaagcaaactgcacagagaattttg

SEQ ID NO: 320324 - DNA, 75 bp, Artificial Sequence
  Synthetic
tggctgcaataattttctggatcattttaaatggcctacaggcacaggaggccgttccggaggtaccggagaagg

SEQ ID NO: 320325 - DNA, 75 bp, Artificial Sequence
  Synthetic
taccgaagatggaggggccggaggggtccaccaccgacatacctggagacctttccgccgcttcggctggaggag

SEQ ID NO: 320326 - DNA, 75 bp, Artificial Sequence
  Synthetic
gaggtggagacatcccagacgaggatctgctgttgtaaggatcaccagacccaaaaacataagtacattactgtg

SEQ ID NO: 320327 - DNA, 75 bp, Artificial Sequence
  Synthetic
actgggtgggagcctcttggaaactgttgtgtgacagatagtgcgggtagtgaggccaaaccttatgatgattta

SEQ ID NO: 320328 - DNA, 75 bp, Artificial Sequence
  Synthetic
gacaaagatgtatctacctggtgtaaacaatccaataacgctgtttggcatggtacctttggacaccactatcta

SEQ ID NO: 320329 - DNA, 75 bp, Artificial Sequence
  Synthetic
acctggggtctattagttcagagggctcaatattacttttgcaagttttcaagtgactatcgtggctatgactat

SEQ ID NO: 320330 - DNA, 75 bp, Artificial Sequence
  Synthetic
ctctctttctgtggaggttatatttggctcccttatctctatgctccttacatgttctggctggatccttgtatc

SEQ ID NO: 320331 - DNA, 75 bp, Artificial Sequence
  Synthetic
attgatccacaagagaaagtgatgaacttttcactctacaacaaagattctagttggtttcacccaggtattttc

SEQ ID NO: 320332 - DNA, 75 bp, Artificial Sequence
  Synthetic
atgaatagaaaaggagctagattcatacctccttcctaccaaacctacacacatcacctctacaaaaggctaaga

SEQ ID NO: 320333 - DNA, 75 bp, Artificial Sequence
  Synthetic
gttccaagacctccaacatgggaaggtgtatacacaatacctgccgctacccaatacatcctgacacactgggcc

SEQ ID NO: 320334 - DNA, 75 bp, Artificial Sequence
  Synthetic
tggacaacagtcaccacaaatacagccttctttgatggtgcatgtaaccagtcaggacagaccagtacatgtgaa

SEQ ID NO: 320335 - DNA, 75 bp, Artificial Sequence
  Synthetic
gctgttccctggttcatgaaaggacatacgccaactggagagtttaaaaagaaactagaaacatggaaaacaaac

SEQ ID NO: 320336 - DNA, 75 bp, Artificial Sequence
  Synthetic
acaaacagtggagcagagaacttagactgttatggggaccccagaagttggtgggtaaacaggaggaaatatgat

SEQ ID NO: 320337 - DNA, 75 bp, Artificial Sequence
  Synthetic
gacaaaacatcaaccacatgtaatgaagacaactggggtccctttctaccatcaaaggggacaggcactggtgtc

SEQ ID NO: 320338 - DNA, 75 bp, Artificial Sequence
  Synthetic
atcaaaggggacaggcactggtgtcacaaagcaatatgactctatttctttttggtttcgctaccgcttcaaatt

SEQ ID NO: 320339 - DNA, 75 bp, Artificial Sequence
  Synthetic
taaggtctctggagactctatctacacaagaatccccagcaggacagcaacggaggtcatcagtgaagcgccagg

SEQ ID NO: 320340 - DNA, 75 bp, Artificial Sequence
  Synthetic
acctaagccaaaaatacaggctcgctccatactcaagaccagacctccagaccttggggacatacttgcaggaga

SEQ ID NO: 320341 - DNA, 75 bp, Artificial Sequence
  Synthetic
cctcgacgaagacggcatcctcacggatgagggtcttgaacgaattattagatctcatccaggaagacagccagc

SEQ ID NO: 320342 - DNA, 75 bp, Artificial Sequence
  Synthetic
cggagtggaagccgatccggaccagctccagcaaagacgtgtcagacttcgacacgaccccggggtcagaaagcg

SEQ ID NO: 320343 - DNA, 75 bp, Artificial Sequence
  Synthetic
aagactccgacgtctcctatctggattgggattgggaagacgaacccaagtccggggggaggcccccccctagtc

SEQ ID NO: 320344 - DNA, 75 bp, Artificial Sequence
  Synthetic
cccccacccctgggcctaaagcccaggggtacccacctcacttcctcttttgagctgtcaataaaccgtgaatgc

SEQ ID NO: 320345 - DNA, 75 bp, Artificial Sequence
  Synthetic
tgagctgtcaataaaccgtgaatgcggaactaaatgcaaatgtgtggtttctgtggttggctagggaaatcctgg

SEQ ID NO: 320346 - DNA, 75 bp, Artificial Sequence
  Synthetic
gcggagcttgccggaggcgtggtttcaactgtttttactttcattttgagcagctcatgaatattcatgaggtgc

SEQ ID NO: 320347 - DNA, 75 bp, Artificial Sequence
  Synthetic
tcattttgagcagctcatgaatattcatgaggtgctcacactctgcgcatgcgcagggtgtcacatgatcaagag

SEQ ID NO: 320348 - DNA, 75 bp, Artificial Sequence
  Synthetic
tataaaaagaaatggggtgacgaatggctgagttttctgctgctggatggccaagagagctcatgtaagtagaga

SEQ ID NO: 320349 - DNA, 75 bp, Artificial Sequence
  Synthetic
tatgggggaaagacttccacctctaatagcggtttcatttgatctcatctatcaaaccgatgatcatgactactg

SEQ ID NO: 320350 - DNA, 75 bp, Artificial Sequence
  Synthetic
tattcgttttccaggtatggacaataaccaaatacctctcgtgagggtgaaaatagaaggagctgggtggtggtc

SEQ ID NO: 320351 - DNA, 75 bp, Artificial Sequence
  Synthetic
tggctttttgatatgtctgcagattgtgactcagctcgcggtcctgatctatgtcaccctcaactatataaatac

SEQ ID NO: 320352 - DNA, 75 bp, Artificial Sequence
  Synthetic
taccgaagatggaggggccggaaggtccaccaccgacgtacctggagacctttccaccgcttcggctggaggagg

SEQ ID NO: 320353 - DNA, 75 bp, Artificial Sequence
  Synthetic
aggtggagacatcccagacgaggatctgctgttgtaaggatcaccagacccaaaaaacataagtacattactgta

SEQ ID NO: 320354 - DNA, 75 bp, Artificial Sequence
  Synthetic
actgggtgggagcctctcggaaactgttgtgtgacagatagtgcgggtgcagaggcaaaaccttatgaggattta

SEQ ID NO: 320355 - DNA, 75 bp, Artificial Sequence
  Synthetic
gacaaagatgtagctacctggtgtacacagaataacaacgctgtttggcatggtacctttggccaccactatctc

SEQ ID NO: 320356 - DNA, 75 bp, Artificial Sequence
  Synthetic
acctggggtctcctagttcaaagagctcaatattacttttgcaagttttcaagtgactatcgcggctatgactat

SEQ ID NO: 320357 - DNA, 75 bp, Artificial Sequence
  Synthetic
ctctcattttgtggaggttatatttggctcccttatctctatgctccttacatgttctggctggatccttgtatc

SEQ ID NO: 320358 - DNA, 75 bp, Artificial Sequence
  Synthetic
attgatccacaagagaaactcatgaactttcaactctacaaaaaagattcgagttggtttcacccaggtattttc

SEQ ID NO: 320359 - DNA, 75 bp, Artificial Sequence
  Synthetic
atgaatagaaaaggagctagattcatacctccttcctaccagacctacacacatcacctttacaaaaggctaaga

SEQ ID NO: 320360 - DNA, 75 bp, Artificial Sequence
  Synthetic
gttccaaggcctccaacatgggaaggtgtctacacaatacctgcagctacccaatacatcctgacacactgggcc

SEQ ID NO: 320361 - DNA, 75 bp, Artificial Sequence
  Synthetic
tggacaacagtcaccaccaacacagcctttttcgatggtgcatgcaaccagtcaggcaccacaaatacatgtgaa

SEQ ID NO: 320362 - DNA, 75 bp, Artificial Sequence
  Synthetic
gctgttccctggttcatgaagggacaccagccagcagggaaattcgctcagaaactcaccaaatggaaaacagac

SEQ ID NO: 320363 - DNA, 75 bp, Artificial Sequence
  Synthetic
acagcagatggaacaaaaaacttagactgtttcggtgaccccagaagttggtgggtgaatagaagaaaatatgat

SEQ ID NO: 320364 - DNA, 75 bp, Artificial Sequence
  Synthetic
gataaatcatcaaccacatgcaatacagacaactggggaccctttttaccatcaaaagggactggtactggtgtc

SEQ ID NO: 320365 - DNA, 75 bp, Artificial Sequence
  Synthetic
atcaaaagggactggtactggtgtcacaaagcaatatgactcaatttctttttggtttcgctatcgcttcaaatt

SEQ ID NO: 320366 - DNA, 75 bp, Artificial Sequence
  Synthetic
acctcagtcaaaaatacaggctcgctccatactcaagaccagacctccagaccttggggacatacttgcaggaga

SEQ ID NO: 320367 - DNA, 75 bp, Artificial Sequence
  Synthetic
cctcgacgaggacggcatcctcacggatgagagtcttgaacgaattattagatctcatccaggaagacagccagc

SEQ ID NO: 320368 - DNA, 75 bp, Artificial Sequence
  Synthetic
cggagtggaagccgatccggaccagctcaagcaaagacgtgtccgacttcgacacgaccccggggtcagaaagcg

SEQ ID NO: 320369 - DNA, 75 bp, Artificial Sequence
  Synthetic
aagactccgacgtctcctatctggattgggattgggaagacgaacccaatccgggggggaagggcccccccctag

SEQ ID NO: 320370 - DNA, 75 bp, Artificial Sequence
  Synthetic
ttgggattgggaagacgaacccaatccgggggggaagggcccccccctagtcccccccacccctgggcctaaagc

SEQ ID NO: 320371 - DNA, 75 bp, Artificial Sequence
  Synthetic
ttttgagctgtcaataaaccgtgaatgcggaactaaatgcaaatgtgtggtttctgtggttggctagggaaatcc

SEQ ID NO: 320372 - DNA, 75 bp, Artificial Sequence
  Synthetic
tgggcggagcctgccggaggcgtggtttcaactgctttttactttcattttgggcagctcatgaatattcatgag

SEQ ID NO: 320373 - DNA, 75 bp, Artificial Sequence
  Synthetic
tcattttgggcagctcatgaatattcatgaggtgctcactctctgcgcatgcgcagggagtcacatgaccaaagg

SEQ ID NO: 320374 - DNA, 75 bp, Artificial Sequence
  Synthetic
tataaaaacaagaggggtggggaatggctgagtttttgctgctggacaggccaagtagcggagctctgtaagtaa

SEQ ID NO: 320375 - DNA, 75 bp, Artificial Sequence
  Synthetic
gatgggcgacgcacttggagccggggcgggtgcaggaggcctagggccggatcaaggggcttatcgggccgtgcg

SEQ ID NO: 320376 - DNA, 75 bp, Artificial Sequence
  Synthetic
acctgtacagcaagatgggcaagactggagaaatttatttgaaaagtttgctgtctgttttgatctaatctatga

SEQ ID NO: 320377 - DNA, 75 bp, Artificial Sequence
  Synthetic
aacaactcatctttcaggtatggaaaatcaacctctaaatggaagaagagaagtaatttatgttaagctggtctc

SEQ ID NO: 320378 - DNA, 75 bp, Artificial Sequence
  Synthetic
cgggtggtgggagttctttatgatatgtctgcacataatagtgcaagggatcatcctgatctatgtcatcctcaa

SEQ ID NO: 320379 - DNA, 75 bp, Artificial Sequence
  Synthetic
ctttttaaacttgaagaagcacactggaaaagactagtaagtgccaaacatagagaattctgtgcctgtcctaat

SEQ ID NO: 320380 - DNA, 75 bp, Artificial Sequence
  Synthetic
tttctcgatcacttcaaatggccagacggttccggcggagattccaaagatggcggagaggcaggtaccacccga

SEQ ID NO: 320381 - DNA, 75 bp, Artificial Sequence
  Synthetic
ggagaggatacagacgctggagacctttccaccattggaggcactggaggaggagagggagatatttcagacatc

SEQ ID NO: 320382 - DNA, 75 bp, Artificial Sequence
  Synthetic
gaactgctgcggtaagatatcgcccaagtagacgccacaaagtggtagtctgcagagggtgggaaccactaggaa

SEQ ID NO: 320383 - DNA, 75 bp, Artificial Sequence
  Synthetic
atgtctgtaaagagaccctagcttctcaagaagcaacaccatataaagatattgaggcagattatgacccaacta

SEQ ID NO: 320384 - DNA, 75 bp, Artificial Sequence
  Synthetic
cttctacactggaccaatttaaaggatcttggcaaggtacatggggtcaccactattttactcttgaaaatctag

SEQ ID NO: 320385 - DNA, 75 bp, Artificial Sequence
  Synthetic
tgaagagaaatagacaactcatgaacacatttacctctgactggagaggttgggactactatcaatttttgggtg

SEQ ID NO: 320386 - DNA, 75 bp, Artificial Sequence
  Synthetic
gtgtgttttacatgcccaaaataagtggaatggactacttcatatacctagactatgacctacaagacctaaaag

SEQ ID NO: 320387 - DNA, 75 bp, Artificial Sequence
  Synthetic
ctaaaggagatgaaacagacctatataaacatatgaaatcctggatccatccaggtatttacatgaacagatatg

SEQ ID NO: 320388 - DNA, 75 bp, Artificial Sequence
  Synthetic
gtgcaaaaatgatcacgtctccacacaggacaacagcacccagattattcagaaaagtaagaataaaaccaccag

SEQ ID NO: 320389 - DNA, 75 bp, Artificial Sequence
  Synthetic
caagctgggaaggcttatacccaataaacacaggattcaaatatatattctgtcactgggcctggacagtctttg

SEQ ID NO: 320390 - DNA, 75 bp, Artificial Sequence
  Synthetic
actgggatatgccctttttcgactcttactgttacctaaaatcctgtgctacaaaacctccaaaaccaatgtgtg

SEQ ID NO: 320391 - DNA, 75 bp, Artificial Sequence
  Synthetic
aacagtgctgtaacgaaagaccatggtggtctggtctcaaagacagtcataacatgtgtaaaccaaactttgatg

SEQ ID NO: 320392 - DNA, 75 bp, Artificial Sequence
  Synthetic
acaactttaatgactcaaaagaagcctatgatgccagagcaacctgggttagaagggatcaatatcaaatgtctt

SEQ ID NO: 320393 - DNA, 75 bp, Artificial Sequence
  Synthetic
catgcgaatccaatactccagaaacaggcaaagactgtaattgttttaactggggccctttcttacctcaatgct

SEQ ID NO: 320394 - DNA, 75 bp, Artificial Sequence
  Synthetic
ttcccctgtggaattcttggggcagatccgtatggtttaaatataaactcttttttaagttctctggagactctg

SEQ ID NO: 320395 - DNA, 75 bp, Artificial Sequence
  Synthetic
tctaccgaagaacagtcagcaaagactccaaagacctcatccctgaagctccgaagggcaaatactctcaaggag

SEQ ID NO: 320396 - DNA, 75 bp, Artificial Sequence
  Synthetic
aaataccgtctagctcctctccaaggaggccgctcgatgaggcggacatcctccgaggggatcttgacccctcag

SEQ ID NO: 320397 - DNA, 75 bp, Artificial Sequence
  Synthetic
ggatcctcacggagagagcttatcgaggaattactcgacctggtggagaagagcagccaaccatgctggtgccaa

SEQ ID NO: 320398 - DNA, 75 bp, Artificial Sequence
  Synthetic
aaagagtcagattccggagaggagacatccgacgcaagcgactccgacatctcctatctcgactcatggagcgat

SEQ ID NO: 320399 - DNA, 75 bp, Artificial Sequence
  Synthetic
gaagagaatccggggggcgagggcgcccccctggtccccccgcaggggggagcacccccccgctacccctcccag

SEQ ID NO: 320400 - DNA, 75 bp, Artificial Sequence
  Synthetic
ttcctcttttagctcattagcatatacttcctcaataaaccggtgaatgcggaactaaatgcaaatgtgtggttt

SEQ ID NO: 320401 - DNA, 75 bp, Artificial Sequence
  Synthetic
tgtggttggctagggaaatcctgggcggagcctgccggaggcgtggcctgcaaggcttttcacttcctttttttt

SEQ ID NO: 320402 - DNA, 75 bp, Artificial Sequence
  Synthetic
tcctttttttttgagggcatgaatattcatgacctcacctgcagcgcgcatgcgcacaggtcacatgacttaggg

SEQ ID NO: 320403 - DNA, 75 bp, Artificial Sequence
  Synthetic
tataacaggagtgggtgacgaatggctgagttttctgctgctggatggccaagagagctcatgtaagtagagaga

SEQ ID NO: 320404 - DNA, 75 bp, Artificial Sequence
  Synthetic
gtcaccctcaactatataaatacaaagaggccaagtggaagcagcaagtaagcaaacttcacagagaattctgtg

SEQ ID NO: 320405 - DNA, 75 bp, Artificial Sequence
  Synthetic
gctgcaataactttctggatcattttaaatggccaggcaccgctttacctggagggggagacgccggcgaaggtt

SEQ ID NO: 320406 - DNA, 75 bp, Artificial Sequence
  Synthetic
cccaagatggaggagataccgccggtattggaggcctttccaccactggaggaggaggaggagattccatcaccg

SEQ ID NO: 320407 - DNA, 75 bp, Artificial Sequence
  Synthetic
acatggaactgcttcggtaagatactggagaagttccaggaataaaactatagtagtgagaggatgggaacctct

SEQ ID NO: 320408 - DNA, 75 bp, Artificial Sequence
  Synthetic
gggaaatatctgcccaggttctgatgcttcaaaagaagcgacaccctgggaggtactagacaaagactatgagga

SEQ ID NO: 320409 - DNA, 75 bp, Artificial Sequence
  Synthetic
caccaaaactaaagggaaagaaagtgactgtgctaagagctgttggtctggtacttttggcggtcactttttcac

SEQ ID NO: 320410 - DNA, 75 bp, Artificial Sequence
  Synthetic
attcaaactccttcttcagagagctaaaattaggttatgccagttttctagtgactggaatggatgggattacct

SEQ ID NO: 320411 - DNA, 75 bp, Artificial Sequence
  Synthetic
tgaatttaaaggtggctacatttggctaccgagactggcaggcctgcaatggatgtttaataaggaccacagtat

SEQ ID NO: 320412 - DNA, 75 bp, Artificial Sequence
  Synthetic
caaaaatccaacagaaactaaagaaggacaggaattggctgcagctaaatcctggacacatccaggggtctggct

SEQ ID NO: 320413 - DNA, 75 bp, Artificial Sequence
  Synthetic
gaacagacgtggacccattattatgcatgacccaaatttatttccaagtcatagaggatttagaagactcaaagt

SEQ ID NO: 320414 - DNA, 75 bp, Artificial Sequence
  Synthetic
caaaccacctaccgggtgggaaggacactattccttacctgcagtgatgaactatattttttttcaatggttctg

SEQ ID NO: 320415 - DNA, 75 bp, Artificial Sequence
  Synthetic
gactgccttagacatgcagcacgctatgtatgattattggtgtgtgaaacagaacccaactgcagaacacaccaa

SEQ ID NO: 320416 - DNA, 75 bp, Artificial Sequence
  Synthetic
gatttgttgccaagtaccttggtgggctgctcagatagatgacacctggagacctaaatatgctgatgatgatcc

SEQ ID NO: 320417 - DNA, 75 bp, Artificial Sequence
  Synthetic
tgcaaaaacttgcgggggagatgtcagagaactatggacagacagagaaaactatttgcagagtaaatgtaatac

SEQ ID NO: 320418 - DNA, 75 bp, Artificial Sequence
  Synthetic
taatcaggccagaactgatcaaaacaatataccagcgaacactcaaaactggggtcctttcctaccacagagctt

SEQ ID NO: 320419 - DNA, 75 bp, Artificial Sequence
  Synthetic
tgtcagacctggagaagcgggattttcactctggtttaaatacaaattttatttccagctctctggagactctgt

SEQ ID NO: 320420 - DNA, 75 bp, Artificial Sequence
  Synthetic
ctacagacaacagccgcacaccgacccaaaagtcgtcatccctagagctccaaaggccaaaaacacccttacagg

SEQ ID NO: 320421 - DNA, 75 bp, Artificial Sequence
  Synthetic
agaagtacaacctggtcccgagaggccgcaggatccgtgggatatcctcccaggagacctggacaggcacggaat

SEQ ID NO: 320422 - DNA, 75 bp, Artificial Sequence
  Synthetic
cctcaaagaaagagcttatagaagaattacttcaactggtccaggagacgagccagccaaagtgggaccctctcg

SEQ ID NO: 320423 - DNA, 75 bp, Artificial Sequence
  Synthetic
cgtcagattcagaagcgacccttccgtccgacgaaagcgactcagacatatcctgtctcgactactggagtgatg

SEQ ID NO: 320424 - DNA, 75 bp, Artificial Sequence
  Synthetic
aagagaacccgggggggaaggccccccctggtcccccccacacccgggcctaagcccgggtacccacctcacttc

SEQ ID NO: 320425 - DNA, 75 bp, Artificial Sequence
  Synthetic
ccctggtcccccccacacccgggcctaagcccgggtacccacctcacttcctcttttgagctgtcaataaaccgt

SEQ ID NO: 320426 - DNA, 75 bp, Artificial Sequence
  Synthetic
gaatgcggaactaaatgcaaatgtgtggtttctgtggttggctagggaaatccgggggcggagccaccagtgggc

SEQ ID NO: 320427 - DNA, 75 bp, Artificial Sequence
  Synthetic
ggagccaactgccattttaacttcctttttttggggtcatgaatattcatgactccacctacacgcgcatgcgca

SEQ ID NO: 320428 - DNA, 75 bp, Artificial Sequence
  Synthetic
ctttttttggggtcatgaatattcatgactccacctacacgcgcatgcgcagtgtaggtcacgtgacaaacacta

SEQ ID NO: 320429 - DNA, 75 bp, Artificial Sequence
  Synthetic
tctgacacatgcagctcccggagacggtcacagcttgtctgtaagcggatgccgggagcagacaagcccgtcagg

SEQ ID NO: 320430 - DNA, 75 bp, Artificial Sequence
  Synthetic
caacacctcccaggacagtgccctgcctgtgccgctacgcaatgacagcagaacggatcgcccgccttaggtcac

SEQ ID NO: 320431 - DNA, 75 bp, Artificial Sequence
  Synthetic
catgttgatattgaggctgacagcccattcatcaagtctttgcagaaggcatttccgtcgttcgaggtggagtca

SEQ ID NO: 320432 - DNA, 75 bp, Artificial Sequence
  Synthetic
cattcatcaagtctttgcagaaggcatttccgtcgttcgaggtggagtcattgcaggtcacaccaaatgaccatg

SEQ ID NO: 320433 - DNA, 75 bp, Artificial Sequence
  Synthetic
gacgaaacacacagaggaaagacccaaagtccaggtaattcaagcagcggagccattggcgaccgcttacctgtg

SEQ ID NO: 320434 - DNA, 75 bp, Artificial Sequence
  Synthetic
ctcatcttttcccctcccgaaataccatgtagatggggtgcagaaggtaaagtgcgagaaggttctcctgttcga

SEQ ID NO: 320435 - DNA, 75 bp, Artificial Sequence
  Synthetic
caaatgccagagcattttcgcacctggctaccaaattgatcgagcaggagactgacaaagacacactcatcttgg

SEQ ID NO: 320436 - DNA, 75 bp, Artificial Sequence
  Synthetic
tcggggctggcttaactatgcggcatcagagcagattgtactgagagtgcaccattcgacgctctcccttatgcg

SEQ ID NO: 320437 - DNA, 75 bp, Artificial Sequence
  Synthetic
tagtaggttgaggccgttgagcaccgccgccgcaaggaatggtgcatgcaaggagatggcgcccaacagtccccc

SEQ ID NO: 320438 - DNA, 75 bp, Artificial Sequence
  Synthetic
ggtcacagcttgtctgtaagcggatgccgggagcagacaagcccgtcagggcgcgtcagcgggtgttggcgggtg

SEQ ID NO: 320439 - DNA, 75 bp, Artificial Sequence
  Synthetic
tcagagcagattgtactgagagtgcaccattcgacgctctcccttatgcgactcctgcattaggaagcagcccag

SEQ ID NO: 320440 - DNA, 75 bp, Artificial Sequence
  Synthetic
gccgccgcaaggaatggtgcatgcaaggagatggcgcccaacagtcccccggccacggggcctgccaccataccc

SEQ ID NO: 320441 - DNA, 75 bp, Artificial Sequence
  Synthetic
acgccgaaacaagcgctcatgagcccgaagtggcgagcccgatcttccccatcggtgatgtcggcgatataggcg

SEQ ID NO: 320442 - DNA, 75 bp, Artificial Sequence
  Synthetic
cgcaaagaaactggcagcggcctccgggaaggtgctggatagagagatcgcaggaaaaatcaccgacctgcagac

SEQ ID NO: 320443 - DNA, 75 bp, Artificial Sequence
  Synthetic
cgaagtggcgagcccgatcttccccatcggtgatgtcggcgatataggcgccagcaaccgcacctgtggcgccgg

SEQ ID NO: 320444 - DNA, 75 bp, Artificial Sequence
  Synthetic
tgatgccggccacgatgcgtccggcgtagaggatctggctagcgatgaccctgctgattggttcgctgaccattt

SEQ ID NO: 320445 - DNA, 75 bp, Artificial Sequence
  Synthetic
gtagaggatctggctagcgatgaccctgctgattggttcgctgaccatttccgggtgcgggacggcgttaccaga

SEQ ID NO: 320446 - DNA, 75 bp, Artificial Sequence
  Synthetic
agtggccgtataccaggacgtgtatgctgtacatgcaccaacatcgctgtaccatcaggcgatgaaaggtgtcag

SEQ ID NO: 320447 - DNA, 75 bp, Artificial Sequence
  Synthetic
aactcagaaggttcgtccaaccaaaccgactctgacggcagtttacgagagagatgatagggtctgcttcagtaa

SEQ ID NO: 320448 - DNA, 75 bp, Artificial Sequence
  Synthetic
gctgtacatgcaccaacatcgctgtaccatcaggcgatgaaaggtgtcagaacggcgtattggattgggtttgac

SEQ ID NO: 320449 - DNA, 75 bp, Artificial Sequence
  Synthetic
tttctgactttgtttattaacactgttttgaacatcaccatagcaagcagggtactggagcagagactcactgac

SEQ ID NO: 320450 - DNA, 75 bp, Artificial Sequence
  Synthetic
accaccccgtttatgtttgacgcgctagcaggcgcgtatccaacctacgccacaaactgggccgacgagcaggtg

SEQ ID NO: 320451 - DNA, 75 bp, Artificial Sequence
  Synthetic
tacatattgtcgttagaacgcggctacaattaatacataaccttatgtatcatacacatacgatttaggtgacac

SEQ ID NO: 320452 - DNA, 75 bp, Artificial Sequence
  Synthetic
tagcaggcgcgtatccaacctacgccacaaactgggccgacgagcaggtgttacaggccaggaacataggactgt

SEQ ID NO: 320453 - DNA, 75 bp, Artificial Sequence
  Synthetic
ccgactctgacggcagtttacgagagagatgatagggtctgcttcagtaagccagatgctacacaattaggcttg

SEQ ID NO: 320454 - DNA, 75 bp, Artificial Sequence
  Synthetic
gtgcagcatccttgactgagggaagactcggcaaactgtccattctccgcaagaagcaattgaaaccttgcgaca

SEQ ID NO: 320455 - DNA, 75 bp, Artificial Sequence
  Synthetic
cgaaaaacccccatatttttgtgggggattcatagtttttgacagcgtcacacagaccgcctgccgtgtttcaga

SEQ ID NO: 320456 - DNA, 75 bp, Artificial Sequence
  Synthetic
cagtcatgttctcggtaggatctacattgtacactgagagcagaaagctactgaggagctggcacttaccctccg

SEQ ID NO: 320457 - DNA, 75 bp, Artificial Sequence
  Synthetic
ctgaggagctggcacttaccctccgtattccacctgaaaggtaaacaatcctttacctgtaggtgcgataccatc

SEQ ID NO: 320458 - DNA, 75 bp, Artificial Sequence
  Synthetic
aaattggatactgagagggagaagctgttgctgctgaaaatgcagatgcacccatcggaggctaataagagtcga

SEQ ID NO: 320459 - DNA, 75 bp, Artificial Sequence
  Synthetic
ctttacctgtaggtgcgataccatcgtatcatgtgaagggtacgtagttaagaaaatcactatgtgccccggcct

SEQ ID NO: 320460 - DNA, 75 bp, Artificial Sequence
  Synthetic
agaaaatcactatgtgccccggcctgtacggtaaaacggtagggtacgccgtgacgtatcacgcggagggattcc

SEQ ID NO: 320461 - DNA, 75 bp, Artificial Sequence
  Synthetic
tggaggtggcactaacatctaggtatgaggtagagggctgcaaaagtatcctcatagccatggccaccttggcga

SEQ ID NO: 320462 - DNA, 75 bp, Artificial Sequence
  Synthetic
gtatgcacctacgtcccctcaaccatctgtgatcaaatgactggtatattagcgactgatgtcacaccggaggac

SEQ ID NO: 320463 - DNA, 75 bp, Artificial Sequence
  Synthetic
aacacagcgaaacactaacacgatgaagaactatctgcttccggttgtggctgtcgcatttagcaagtgggcgag

SEQ ID NO: 320464 - DNA, 75 bp, Artificial Sequence
  Synthetic
gcacagaagttgttagtgggattgaatcagaggatagttgtgaacggaagaacacagcgaaacactaacacgatg

SEQ ID NO: 320465 - DNA, 75 bp, Artificial Sequence
  Synthetic
aacacagcgaaacactaacacgatgaagaactatctgcttccgattgtggccgtcgcatttagcaagtgggcgag

SEQ ID NO: 320466 - DNA, 75 bp, Artificial Sequence
  Synthetic
gacagaacgcaattgctcctgctaggcctcccaaaccaaagaagaagaagacaaccaaaccaaagccgaaaacgc

SEQ ID NO: 320467 - DNA, 75 bp, Artificial Sequence
  Synthetic
accatgtacaagaaaccagacacccagacaatagtgaaggtgccttcagagtttaactcgttcgtcatcccgagc

SEQ ID NO: 320468 - DNA, 75 bp, Artificial Sequence
  Synthetic
gtttaactcgttcgtcatcccgagcctatggtctacaggcctcgcaatcccagtcagatcacgcattaagatgct

SEQ ID NO: 320469 - DNA, 75 bp, Artificial Sequence
  Synthetic
tttggccaagaagaccaagcgagagttaatacctgttctcgacgcgtcgtcagccagggatgctgaacaagagga

SEQ ID NO: 320470 - DNA, 75 bp, Artificial Sequence
  Synthetic
ttaatacctgttctcgacgcgtcgtcagccagggatgctgaacaagaggagaaggagaggttggaggccgagctg

SEQ ID NO: 320471 - DNA, 75 bp, Artificial Sequence
  Synthetic
actagagaagccttaccacccctcgtccccatcgcgccggcggagacgggagtcgtcgacgtcgacgttgaagaa

SEQ ID NO: 320472 - DNA, 75 bp, Artificial Sequence
  Synthetic
tccccatcgcgccggcggagacgggagtcgtcgacgtcgacgttgaagaactagagtatcacgcaggtgcagggg

SEQ ID NO: 320473 - DNA, 75 bp, Artificial Sequence
  Synthetic
atgcctcaaagtacacgcatgagaagcccgagggacactataactggcaccacggggctgttcagtacagcggag

SEQ ID NO: 320474 - DNA, 75 bp, Artificial Sequence
  Synthetic
tcgtggaaacacctcgcagcgcgttgaaagtcaccgcacagccgaacgacgtactactaggaaattacgtagttc

SEQ ID NO: 320475 - DNA, 75 bp, Artificial Sequence
  Synthetic
tgtccccgcagaccgtgctcaagagctccaagttggcccccgtgcaccctctagcagagcaggtgaaaataataa

SEQ ID NO: 320476 - DNA, 75 bp, Artificial Sequence
  Synthetic
tgtatgcacatacgtcccctcaaccatctgtgatcaaatgactggcatactagcgaccgacgtcacaccggagga

SEQ ID NO: 320477 - DNA, 75 bp, Artificial Sequence
  Synthetic
ccaggtcgacggatatgacggcagggtcctactaccatgtggatcggccattccggtccctgagtttcaagcttt

SEQ ID NO: 320478 - DNA, 75 bp, Artificial Sequence
  Synthetic
ttccggtccctgagtttcaagctttgagcgagagcgccactatggtgtacaacgaaagggagttcgtcaacagga

SEQ ID NO: 320479 - DNA, 75 bp, Artificial Sequence
  Synthetic
attactgccatgtgtgtccttgccaatgctaccttcccgtgcttccagcccccgtgtgtaccttgctgctatgaa

SEQ ID NO: 320480 - DNA, 75 bp, Artificial Sequence
  Synthetic
ggcagcctttggggaaatatccagctgtcacctaccaactggcacgcgcttcaagttcggagctatgatgaaatc

SEQ ID NO: 320481 - DNA, 75 bp, Artificial Sequence
  Synthetic
aactataccatattgccgttcacggaccgtcgctgaacaccgacgaggagaactacgagaaagtcagagctgaaa

SEQ ID NO: 320482 - DNA, 75 bp, Artificial Sequence
  Synthetic
agagaggaagcgtcgggtttggtgttggtgggagagctaaccaaccccccgttccatgaattcgcctacgaaggg

SEQ ID NO: 320483 - DNA, 75 bp, Artificial Sequence
  Synthetic
tggtgggagagctaaccaaccccccgttccatgaattcgcctacgaagggctgaagatcaggccgtcggcaccat

SEQ ID NO: 320484 - DNA, 75 bp, Artificial Sequence
  Synthetic
ataagactacagtagtaggagtctttggggttccgggatcaggcaagtctgctattattaagagcctcgtgacca

SEQ ID NO: 320485 - DNA, 75 bp, Artificial Sequence
  Synthetic
aacacgatctggtcaccagcggcaagaaggagaactgccaggaaatagtcaacgacgtgaagaagcaccgcggac

SEQ ID NO: 320486 - DNA, 75 bp, Artificial Sequence
  Synthetic
gaaggagaactgccaggaaatagtcaacgacgtgaagaagcaccgcggactggacatccaggcaaaaacagtgga

SEQ ID NO: 320487 - DNA, 75 bp, Artificial Sequence
  Synthetic
tacacgaagataaggtacgcagacgggcacgccattgagaatgccgtccggtcatctttgaaggtagccacctcc

SEQ ID NO: 320488 - DNA, 75 bp, Artificial Sequence
  Synthetic
tggacatccaggcaaaaacagtggactccatcctgctaaacgggtgtcgtcgtgccgtggacatcctatatgtgg

SEQ ID NO: 320489 - DNA, 75 bp, Artificial Sequence
  Synthetic
acgaggctttcgcttgccattccggtactctgctggccctaattgctcttgttaaacctcggagcaaagtggtgt

SEQ ID NO: 320490 - DNA, 75 bp, Artificial Sequence
  Synthetic
tcatgaccctcaaccggtgggtagagaaaaatttacaattagaccacactatggaaaagagatcccttgcaccac

SEQ ID NO: 320491 - DNA, 75 bp, Artificial Sequence
  Synthetic
gtgaacttcaaccacaacatctgcactgaagtatgtcataaaagtatatccagacgttgcacgcgtccagtcacg

SEQ ID NO: 320492 - DNA, 75 bp, Artificial Sequence
  Synthetic
ggcagtggcatacgggcaagcaggcagtaatcgcagaaagaaaaatccaaccgctttctgtgctggacaatgtga

SEQ ID NO: 320493 - DNA, 75 bp, Artificial Sequence
  Synthetic
ctggctttgcctcgacgcagggtcacttggctgtcaccgctgaatgtcacaggtgccgataggtgctacgaccta

SEQ ID NO: 320494 - DNA, 75 bp, Artificial Sequence
  Synthetic
tgacagcagcagcatctcagggcctcacccgcaaaggggtatacgccgtaaggcagaaggtgaatgaaaatccct

SEQ ID NO: 320495 - DNA, 75 bp, Artificial Sequence
  Synthetic
cacccgcaaaggggtatacgccgtaaggcagaaggtgaatgaaaatcccttgtatgcccctgcgtcggagcacgt

SEQ ID NO: 320496 - DNA, 75 bp, Artificial Sequence
  Synthetic
ttggactaccgtggacacgaagtcatgacagcagcagcatctcagggcctcacccgcaaaggggtatacgccgta

SEQ ID NO: 320497 - DNA, 75 bp, Artificial Sequence
  Synthetic
gaatgtactgctgacgcgcactgaggataggctggtgtggaaaacgctggccggcgatccctggattaaggtcct

SEQ ID NO: 320498 - DNA, 75 bp, Artificial Sequence
  Synthetic
gataggctggtgtggaaaacgctggccggcgatccctggattaaggtcctatcaaacattccacagggtaacttt

SEQ ID NO: 320499 - DNA, 75 bp, Artificial Sequence
  Synthetic
cactaccagcagtgtgtcgaccacgctatgaagctgcagatgctggggggagatgcactacgactgctaaaaccc

SEQ ID NO: 320500 - DNA, 75 bp, Artificial Sequence
  Synthetic
aaacacgatctggtcaccagcggcaagaaggagaactgccaggaaatagtcaacgacgtgaagaagcaccgcggg

SEQ ID NO: 320501 - DNA, 75 bp, Artificial Sequence
  Synthetic
acggccacattggaagaatggcaagaagaacacgacaaaataatgaaggtgattgaaggaccggctgcgcctgtg

SEQ ID NO: 320502 - DNA, 75 bp, Artificial Sequence
  Synthetic
aagaacacgacaaaataatgaaggtgattgaaggaccggctgcgcctgtggacgcgttccagaacaaagcgaacg

SEQ ID NO: 320503 - DNA, 75 bp, Artificial Sequence
  Synthetic
agccgttgtttcctccttaagcagaaagttctcgtctgcaagagtactgcgcccggattgtgtcaccagcaatac

SEQ ID NO: 320504 - DNA, 75 bp, Artificial Sequence
  Synthetic
actccatcctgctaaacgggtgtcgtcgtgccgtggacatcctatatgtggacgaggctttcgcttgccattccg

SEQ ID NO: 320505 - DNA, 75 bp, Artificial Sequence
  Synthetic
tgtgttgggcgaaaagcctggtgcctgtcctggacactgccggaatcagattgacagcagaggagtggagcacca

SEQ ID NO: 320506 - DNA, 75 bp, Artificial Sequence
  Synthetic
agaagtgttcttgctgttttccaactttgacaatggaaagagaccctctacgctacaccagatgaacaccaagct

SEQ ID NO: 320507 - DNA, 75 bp, Artificial Sequence
  Synthetic
agaaggagaactgccaggaaatagtcaacgacgtgaagaagcaccgcgggaactggacatccaggaaaaacagtg

SEQ ID NO: 320508 - DNA, 75 bp, Artificial Sequence
  Synthetic
taattacagcatttaaggaggacagagcttactctccagtggtggccttgaatgaaatttgcaccaagtactatg

SEQ ID NO: 320509 - DNA, 75 bp, Artificial Sequence
  Synthetic
cgctacaccagatgaacaccaagctgagtgccgtgtatgccggagaagccatgcacacagccgggtgcgcaccat

SEQ ID NO: 320510 - DNA, 75 bp, Artificial Sequence
  Synthetic
aatgaaatttgcaccaagtactatggagttgacctggacagtggcctgttttctgccccgaaggtgtccctgtat

SEQ ID NO: 320511 - DNA, 75 bp, Artificial Sequence
  Synthetic
gagttgacctggacagtggcctgttttctgccccgaaggtgtccctgtattacgagaacaaccactgggataaca

SEQ ID NO: 320512 - DNA, 75 bp, Artificial Sequence
  Synthetic
ccccttatgctttaacaccaggagctgcagttccgtggacgctggggatactctgctgcgccccgcgggcgcacg

SEQ ID NO: 320513 - DNA, 75 bp, Artificial Sequence
  Synthetic
gacctggtggaaggatgtatggattcaatgccgcaacagctgccaggctggaagctagacataccttcctgaagg

SEQ ID NO: 320514 - DNA, 75 bp, Artificial Sequence
  Synthetic
caccacaggacagaccaagcccaagccaggagacatcgtgttaacatgcttccgaggctgggtaaagcagctgca

SEQ ID NO: 320515 - DNA, 75 bp, Artificial Sequence
  Synthetic
ctcgtatccggtcatccatgccgtagggcctaatttctctgccacgactgaagcggaaggggaccgcgaactggc

SEQ ID NO: 320516 - DNA, 75 bp, Artificial Sequence
  Synthetic
cgccctggtggctgagtacaagacggttaaaggcagtagggttgagtggctggtcaataaagtaagagggtacca

SEQ ID NO: 320517 - DNA, 75 bp, Artificial Sequence
  Synthetic
tggtcaataaagtaagagggtaccacgtcctgctggtgagtgagtacaacctggctttgcctcgacgcagggtca

SEQ ID NO: 320518 - DNA, 75 bp, Artificial Sequence
  Synthetic
atgccgaacgtggtggggttcccgtataaggctcacattgaaaggccaggatatagccccctcactttgcagatg

SEQ ID NO: 320519 - DNA, 75 bp, Artificial Sequence
  Synthetic
ctggctttgcctcgacgcagggtcacttggttgtcaccgctgaatgtcacaggcgccgataggtgctacgaccta

SEQ ID NO: 320520 - DNA, 75 bp, Artificial Sequence
  Synthetic
cactaccagcagtgtgtcgaccacgccatgaagctgcagatgcttgggggagatgcgctacgactgctaaaaccc

SEQ ID NO: 320521 - DNA, 75 bp, Artificial Sequence
  Synthetic
aacagatatgcctatacgcactgggcgaaacaatggataacatcagatccaaatgtccggtggacgattccgatt

SEQ ID NO: 320522 - DNA, 75 bp, Artificial Sequence
  Synthetic
agccgttgtttcctccttaagcagaaagttctcgtctgcaagagtgttgcgcccggattgtgtcaccagcaatac

SEQ ID NO: 320523 - DNA, 75 bp, Artificial Sequence
  Synthetic
agaagtgttcttgctgttctccaactttgacaacggaaagagaccctctacgctacaccagatgaataccaagct

SEQ ID NO: 320524 - DNA, 75 bp, Artificial Sequence
  Synthetic
taccatgtagatggggtgcagaaggtaaaatgcgagaaggttctcctgttcgacccgacagtaccttcagtggtt

SEQ ID NO: 320525 - DNA, 75 bp, Artificial Sequence
  Synthetic
cgctacaccagatgaataccaagctgagtgccgtgtatgccggagaagccatgcacacggccgggtgtgcaccat

SEQ ID NO: 320526 - DNA, 75 bp, Artificial Sequence
  Synthetic
agtccgcggaagtatgccgcctcgacgacggaccactcagaccggtcgctacgagggttcgacttggattggacc

SEQ ID NO: 320527 - DNA, 75 bp, Artificial Sequence
  Synthetic
cctacagagttaagagagcagacatagccacgtgcacagaagcggctgtggttaacgcagctaacgcccgtggaa

SEQ ID NO: 320528 - DNA, 75 bp, Artificial Sequence
  Synthetic
gcgcttcggcgacatccaaagcagaacagtggagagtaacgacctgtacgcgaacacggcactgaagctggcacg

SEQ ID NO: 320529 - DNA, 75 bp, Artificial Sequence
  Synthetic
cgtggcgaagaaatggccgtcagcctttaagggagcagcaacaccagtgggcacaattaaaacagtcatgtgcgg

SEQ ID NO: 320530 - DNA, 75 bp, Artificial Sequence
  Synthetic
gagccaatggctcccatagtagtgacggctgacgtgcaccctgaacccgcagctgtgcaccctgaacccgcagac

SEQ ID NO: 320531 - DNA, 75 bp, Artificial Sequence
  Synthetic
gaagtaaacagactgtcactgagcagcgtagccatcccgctgctgtccacaggagtgttcagcggcggaagagat

SEQ ID NO: 320532 - DNA, 75 bp, Artificial Sequence
  Synthetic
cgacgcctgccccaaggactacgtttaggaacaagctgccttttacgttcggcgactttgatgagcacgaagtcg

SEQ ID NO: 320533 - DNA, 75 bp, Artificial Sequence
  Synthetic
gcgtagccatcccgctgctgtccacaggagtgttcagcggcggaagagataggctgcagcaatccctcaaccatc

SEQ ID NO: 320534 - DNA, 75 bp, Artificial Sequence
  Synthetic
ctgtcagggccatgaactgcgccgtgggaaacatccctgtctccatgaatttgcctgacagcgcctttacccgca

SEQ ID NO: 320535 - DNA, 75 bp, Artificial Sequence
  Synthetic
tattcacagcaatggacgccacggacgctgacgtgaccatctactgcagagacaaaagttgggagaagaaaatcc

SEQ ID NO: 320536 - DNA, 75 bp, Artificial Sequence
  Synthetic
cgctgacgtgaccatctactgcagagacaaaagttgggagaagaaaatccaggaagccatagacatgaggacggc

SEQ ID NO: 320537 - DNA, 75 bp, Artificial Sequence
  Synthetic
caagaacggggactgctctgtacactcgcactctaacgtagctactctacaggaggccacagcaaaagtgaagac

SEQ ID NO: 320538 - DNA, 75 bp, Artificial Sequence
  Synthetic
tgtggagttgctcaatgatgacgtggagctgaccacagacttggtgagagtgcacccggacagcagcctggtggg

SEQ ID NO: 320539 - DNA, 75 bp, Artificial Sequence
  Synthetic
gtacgaaattcaaccaggctgctattgatatggcagagatactgacgttgtggcccagactgcaagaggcaaacg

SEQ ID NO: 320540 - DNA, 75 bp, Artificial Sequence
  Synthetic
ctgcctgtgccgctacgcaatgacagcagaacggatcgcccgccttaggtcacaccaagttaaaagcatggtggt

SEQ ID NO: 320541 - DNA, 75 bp, Artificial Sequence
  Synthetic
ttagggtaggcaatggcattgatatagcaagaaaattgaaaacagaaaaagttagggtaagcaatggcatataac

SEQ ID NO: 320542 - DNA, 75 bp, Artificial Sequence
  Synthetic
taccatgtagatggggtgcagaaggtaaagtgcgagaaggttctcctgttcgacccgacggtaccttcagtggtt

SEQ ID NO: 320543 - DNA, 75 bp, Artificial Sequence
  Synthetic
agtccgcggaagtatgccgcatctacgacggaccactcagatcggtcgttacgagggtttgacttggactggacc

SEQ ID NO: 320544 - DNA, 75 bp, Artificial Sequence
  Synthetic
accgactcgtcttccactgccagcgataccatgtcgctacccagtttgcagtcgtgtgacatcgactcgatctac

SEQ ID NO: 320545 - DNA, 75 bp, Artificial Sequence
  Synthetic
cctatccggataaccactgagaacatcactacctatgtaaccaaactgaaaggcccgaaagcagccgccttgttt

SEQ ID NO: 320546 - DNA, 75 bp, Artificial Sequence
  Synthetic
tggacctcgagaacccgattcctccaccgcgcccgaagagagctgcataccttgcctcccgcgcggcggagcgac

SEQ ID NO: 320547 - DNA, 75 bp, Artificial Sequence
  Synthetic
gcctgccccaaggactgcgtttaggaacaagctgcctttgacgttcggcgactttgacgagcacgaggtcgatgc

SEQ ID NO: 320548 - DNA, 75 bp, Artificial Sequence
  Synthetic
accgcttacctgtgtggcatccacagggaattagtaaggaggttaaacgctgtgttacgtcctaacgtgcacaca

SEQ ID NO: 320549 - DNA, 75 bp, Artificial Sequence
  Synthetic
gccgcgcgggtgcatatattttctcctcggacactggcagcggacatttacaacaaaaatccgttaggcagcaca

SEQ ID NO: 320550 - DNA, 75 bp, Artificial Sequence
  Synthetic
ggtcgaggaggagaaaatgtacccgccaaaattggatactgagagggagaagctgttgctgctgaaaatgcagat

SEQ ID NO: 320551 - DNA, 75 bp, Artificial Sequence
  Synthetic
cgataccagtctcgcaaagtggagaacatgaaagccacggtggtggacaggctcacatcgggggccagattgtac

SEQ ID NO: 320552 - DNA, 75 bp, Artificial Sequence
  Synthetic
gcggatgtgtgacatacacgacgccaaaagattttgttccagctcctgccacctccgctacgcgagagattaacc

SEQ ID NO: 320553 - DNA, 75 bp, Artificial Sequence
  Synthetic
gctcacatcgggggccagattgtacacgggagcggacgtaggccgcataccaacatacgcggttcggtacccccg

SEQ ID NO: 320554 - DNA, 75 bp, Artificial Sequence
  Synthetic
ccccgtgtactcccctaccgtgatcgaaagattctcaagccccgatgtagcaatcgcagcgtgcaacgaatacct

SEQ ID NO: 320555 - DNA, 75 bp, Artificial Sequence
  Synthetic
gaaagattctcaagccccgatgtagcaatcgcagcgtgcaacgaatacctatccagaaattacccaacagtggcg

SEQ ID NO: 320556 - DNA, 75 bp, Artificial Sequence
  Synthetic
accatagcaagcagggtactggagcagagactcactgactccgcctgtgcagcctttatcggcgacgacaatatc

SEQ ID NO: 320557 - DNA, 75 bp, Artificial Sequence
  Synthetic
ttttgacagcgtcacacagaccgcctgccgtgtttcagacccactcaaacgcttgttcaagttgggtaagccgtt

SEQ ID NO: 320558 - DNA, 75 bp, Artificial Sequence
  Synthetic
ccagccgactgtacgcagtgccgtcccgtcaccctttcagaacacactacagaacgtgctagcggccgccaccaa

SEQ ID NO: 320559 - DNA, 75 bp, Artificial Sequence
  Synthetic
actctacaggaggccacagcaaaagtgaagacagcaggtaaggtgaccttacacttctccacggcaagcgcatca

SEQ ID NO: 320560 - DNA, 75 bp, Artificial Sequence
  Synthetic
aacagctgaagacaagcaggacgaagacaggcgacgagcattgagcgacgaggtcagtaagtggttccggacagg

SEQ ID NO: 320561 - DNA, 75 bp, Artificial Sequence
  Synthetic
gacaggcgacgagcattgagcgacgaggtcagtaagtggttccggacaggcttgggggccgaactggaggtggcg

SEQ ID NO: 320562 - DNA, 75 bp, Artificial Sequence
  Synthetic
ggaaaatcaccgacctgcagaccgtcatggctacgccagacgctgaatctcctaccttttgcctgcatacagacg

SEQ ID NO: 320563 - DNA, 75 bp, Artificial Sequence
  Synthetic
gcgctatgcctgctccggagaatattgggaagaatatgctaaacaacctatccggataaccactgagaacatcac

SEQ ID NO: 320564 - DNA, 75 bp, Artificial Sequence
  Synthetic
ctaacatctaggtatgaggtagagggctgcaagagtatcctcatagccatggccaccctggcaagggacattaag

SEQ ID NO: 320565 - DNA, 75 bp, Artificial Sequence
  Synthetic
tccggataaccactgagaacatcactacctatgtgaccaaattgaaaggcccgaaagctgctgccttgttcgcta

SEQ ID NO: 320566 - DNA, 75 bp, Artificial Sequence
  Synthetic
agacccacaacttggttccgctgcaggaggttcccatggacagattcacggtcgacatgaaacgagatgtcaaag

SEQ ID NO: 320567 - DNA, 75 bp, Artificial Sequence
  Synthetic
ggaaagacccaaagtccaggtaattcaagcagcggagccattggcgaccgcttacctgtgcggcatccacaggga

SEQ ID NO: 320568 - DNA, 75 bp, Artificial Sequence
  Synthetic
cttacctgtgcggcatccacagggaattagtaaggagactaaatgctgtgttacgccctaacgtgcacacattgt

SEQ ID NO: 320569 - DNA, 75 bp, Artificial Sequence
  Synthetic
ttgatatgtcggccgaagactttgacgcgatcatcgcctctcacttccacccaggagacccggttctagagacgg

SEQ ID NO: 320570 - DNA, 75 bp, Artificial Sequence
  Synthetic
attgctcctactaggcctcccaaaccaaagaagaagaagacgaccaaaccaaagccgaaaacgcagcctaagaag

SEQ ID NO: 320571 - DNA, 75 bp, Artificial Sequence
  Synthetic
cgcgatcatcgcctctcacttccacccaggagacccggttctagagacggacattgcatcattcgacaaaagcca

SEQ ID NO: 320572 - DNA, 75 bp, Artificial Sequence
  Synthetic
atggccgccaaagtgcatgttgatattgaggctgacagcccattcatcaagtctttgcagaaggcatttccgtcg

SEQ ID NO: 320573 - DNA, 75 bp, Artificial Sequence
  Synthetic
ggacgactccttggctcttacaggtttaatgatcctcgaagatctaggggtggatcagtacctgctggacttgat

SEQ ID NO: 320574 - DNA, 75 bp, Artificial Sequence
  Synthetic
tgcgccttccaggagaatgatgtctacgcacaaataccactgcgtatgccctatgcgcagcgcagaagaccccga

SEQ ID NO: 320575 - DNA, 75 bp, Artificial Sequence
  Synthetic
attaacactgttttgaacatcaccatagcaagcagggtactggagcagagactcactgactccgcctgtgcggcc

SEQ ID NO: 320576 - DNA, 75 bp, Artificial Sequence
  Synthetic
tagcaagcagggtactggagcagagactcactgactccgcctgtgcggccttcatcggcgacgacaacatcgttc

SEQ ID NO: 320577 - DNA, 75 bp, Artificial Sequence
  Synthetic
acggagtgatctccgacaagctgatggcggagaggtgcgcgtcgtgggtcaacatggaggtgaagatcattgacg

SEQ ID NO: 320578 - DNA, 75 bp, Artificial Sequence
  Synthetic
tacacgcatgagaagcccgagggacactataactggcaccacggggccgttcagtacagcggaggcaggttcact

SEQ ID NO: 320579 - DNA, 75 bp, Artificial Sequence
  Synthetic
tcgtacggcagccgaagtggccgtataccaggacgtgtatgctgtacatgcaccaacatcgctgtaccatcaggc

SEQ ID NO: 320580 - DNA, 75 bp, Artificial Sequence
  Synthetic
tttttgtgggggattcatagtttttgacagcgtcacacagaccgcctgccgtgtttcagacccacttaagcgcct

SEQ ID NO: 320581 - DNA, 75 bp, Artificial Sequence
  Synthetic
gacagcgtcacacagaccgcctgccgtgtttcagacccacttaagcgcctgttcaagttgggtaagccgctaaca

SEQ ID NO: 320582 - DNA, 75 bp, Artificial Sequence
  Synthetic
gctgaagacaagcaggacgaagacaggcgacgagcactgagtgacgaggttagcaagtggttccggacaggcttg

SEQ ID NO: 320583 - DNA, 75 bp, Artificial Sequence
  Synthetic
gtgtgtccttaccaatgctaccttcccgtgcttccagcccccgtgtgcaccttgctgctacgaaaacaacgcaga

SEQ ID NO: 320584 - DNA, 75 bp, Artificial Sequence
  Synthetic
ttaagaaattgagaggacctgttatacacctctacggcggtcctagattggtgcgttaatacacagaattctgat

SEQ ID NO: 320585 - DNA, 75 bp, Artificial Sequence
  Synthetic
acacctctacggcggtcctagattggtgcgttaatacacagaattctgattatagcgcactattatagcaccatg

SEQ ID NO: 320586 - DNA, 75 bp, Artificial Sequence
  Synthetic
aattacatccctacgcaaacgttttacggccgccggtggcgcccgcgcccggcggcccgtccctggccgttgcag

SEQ ID NO: 320587 - DNA, 75 bp, Artificial Sequence
  Synthetic
acggccgccggtggcgcccgcgcccggcggcccgtccctggccgttgcaggccactccggtggctcccgtcgtcc

SEQ ID NO: 320588 - DNA, 75 bp, Artificial Sequence
  Synthetic
acggtagggtacgccgtgacgtatcacgcggagggattcctagtgtgcaagaccacagacactgtcaaaggagaa

SEQ ID NO: 320589 - DNA, 75 bp, Artificial Sequence
  Synthetic
ccgacttccaggcccagcagatgcagcaactcatcagcgccgtaaatgcgctgacaatgagacagaacgcaattg

SEQ ID NO: 320590 - DNA, 75 bp, Artificial Sequence
  Synthetic
gaccacagacactgtcaaaggagaaagagtctcattccctgtatgcacctacgtcccctcaaccatctgtgatca

SEQ ID NO: 320591 - DNA, 75 bp, Artificial Sequence
  Synthetic
gagaacgccgtccggtcatctttgaaggtagccacctccggagattgtttcgtccatggcacaatgggacacttc

SEQ ID NO: 320592 - DNA, 75 bp, Artificial Sequence
  Synthetic
aaggaaaaacgcagcagcaaaagaagaaagacaagcaagccgacaagaagaagaagaaacccggaaaaagagaaa

SEQ ID NO: 320593 - DNA, 75 bp, Artificial Sequence
  Synthetic
atactggcaacgtgcccaccgggtgaatttctacaggtttcgatccaggacactagaaatgcggtccgtgcctgc

SEQ ID NO: 320594 - DNA, 75 bp, Artificial Sequence
  Synthetic
gaaagacaagcaagccgacaagaagaagaagaaacccggaaaaagagaaagaatgtgcatgaagattgaaaatga

SEQ ID NO: 320595 - DNA, 75 bp, Artificial Sequence
  Synthetic
ctgtatcttcgaagtcaaacacgaaggaaaggtcactgggtacgcctgcctggtgggcgacaaagtcatgaaacc

SEQ ID NO: 320596 - DNA, 75 bp, Artificial Sequence
  Synthetic
gcagaccttgatgatgaaaaacctctgggtgtccgagagaggtcacttacttgctgctgcttgtgggcatttaaa

SEQ ID NO: 320597 - DNA, 75 bp, Artificial Sequence
  Synthetic
ggaaaggtcactgggtacgcctgcctggtgggcgacaaagtcatgaaacctgcccacgtgaaaggagtcatcgac

SEQ ID NO: 320598 - DNA, 75 bp, Artificial Sequence
  Synthetic
aacgcggacctggcaaagctagctttcaagaaatcgagcaagtatgaccttgagtgtgcccagataccagttcac

SEQ ID NO: 320599 - DNA, 75 bp, Artificial Sequence
  Synthetic
tcaagaaatcgagcaagtatgaccttgagtgtgcccagataccagttcacatgaggtcggatgcctcaaagtaca

SEQ ID NO: 320600 - DNA, 75 bp, Artificial Sequence
  Synthetic
ccggacaggacgttgctatcacagcaatctggtaacgtaaagatcacagtcggaggaaagaaggtaaaatacaac

SEQ ID NO: 320601 - DNA, 75 bp, Artificial Sequence
  Synthetic
cgacaggagcgggcaaaccgggagacagtggccggcccatctttgacaacaaggggagggtagtcgctatcgtcc

SEQ ID NO: 320602 - DNA, 75 bp, Artificial Sequence
  Synthetic
cagtggccggcccatctttgacaacaaggggagggtagtcgctatcgtcctgggcggggccaacgagggctcacg

SEQ ID NO: 320603 - DNA, 75 bp, Artificial Sequence
  Synthetic
aatggcagttcaactcaccttttgtcccgagagccgacgaaccggctagaaaaggcaaagtccatatcccgttcc

SEQ ID NO: 320604 - DNA, 75 bp, Artificial Sequence
  Synthetic
cccgagagccgacgaaccggctagaaaaggcaaagtccatatcccgttcccgttggacaatatcacatgtagagt

SEQ ID NO: 320605 - DNA, 75 bp, Artificial Sequence
  Synthetic
cacagcactgtcggtggtcacctggaacaaagatatggtgactagagtgacccccgaggggtccgaagagtggtc

SEQ ID NO: 320606 - DNA, 75 bp, Artificial Sequence
  Synthetic
aacaaagatatggtgactagagtgacccccgaggggtccgaagagtggtccgccccgctgattactgccatgtgt

SEQ ID NO: 320607 - DNA, 75 bp, Artificial Sequence
  Synthetic
acactacggatgctcgaggataacgtggataggccagggtactacgacctccttcaggcagccttgacgtgccga

SEQ ID NO: 320608 - DNA, 75 bp, Artificial Sequence
  Synthetic
tggataggccagggtactacgacctccttcaggcagccttgacgtgccgaaacggaacaagacaccggcgcagcg

SEQ ID NO: 320609 - DNA, 75 bp, Artificial Sequence
  Synthetic
gagggccggccgttaccaggtcgacggatatgacggcagggtcctactaccatgtggatcggccattccggtccc

SEQ ID NO: 320610 - DNA, 75 bp, Artificial Sequence
  Synthetic
tgtcgcaacacttcaacgtgtataaggctacacgcccttacatcgcgtactgcgccgactgcggagcagggcact

SEQ ID NO: 320611 - DNA, 75 bp, Artificial Sequence
  Synthetic
ggctacacgcccttacatcgcgtactgcgccgactgcggagcagggcactcgtgtcatagccccgtagcaattga

SEQ ID NO: 320612 - DNA, 75 bp, Artificial Sequence
  Synthetic
atccgcggtcgccgggatgagcttactggcgttgatatcgatcttcgcgtcgtgctacatgctggctgcggcccg

SEQ ID NO: 320613 - DNA, 75 bp, Artificial Sequence
  Synthetic
agcgatcaggtccgaagctaccgacgggatgctgaagattcagttctcggcacaaattggcatagataagagtga

SEQ ID NO: 320614 - DNA, 75 bp, Artificial Sequence
  Synthetic
aacaccgacgaggagaactacgagaaagtcagagctgaaagaactgacgccgagtacgtgttcgacgtagataaa

SEQ ID NO: 320615 - DNA, 75 bp, Artificial Sequence
  Synthetic
ctggcgttgatatcgatcttcgcgtcgtgctacatgctggctgcggcccgcagcaagtgtttgaccccttatgct

SEQ ID NO: 320616 - DNA, 75 bp, Artificial Sequence
  Synthetic
ttaacaccaggagctgcagttccgtggacgctggggatactctgctgcgccccacgggcgcatgcagccagtgtg

SEQ ID NO: 320617 - DNA, 75 bp, Artificial Sequence
  Synthetic
tacgcagacgggcacgccattgagaatgccgtccggtcatctttgaaggtagccacctccggagactgtttcgtc

SEQ ID NO: 320618 - DNA, 75 bp, Artificial Sequence
  Synthetic
atgccgtccggtcatctttgaaggtagccacctccggagactgtttcgtccatggcacaatgggacatttcatac

SEQ ID NO: 320619 - DNA, 75 bp, Artificial Sequence
  Synthetic
tggcaacgtgcccaccgggtgaattcctgcaggtctcgatccaggacaccagaaacgcggtccgtgcctgcagaa

SEQ ID NO: 320620 - DNA, 75 bp, Artificial Sequence
  Synthetic
aaggatcttcacctagatccttttaaattaaaaatgaagttttaaatcaatctaaagtatatatgagtaaacttg

SEQ ID NO: 320621 - DNA, 75 bp, Artificial Sequence
  Synthetic
agcggagaccgtggaggaaatcgacatgcatatgccgccagatacgccggacaggacgttgctatcacagcaatc

SEQ ID NO: 320622 - DNA, 75 bp, Artificial Sequence
  Synthetic
acaggacgttgctatcacagcaatctggcaatgtaaagatcacagtcggaggaaagaaggtgaaatacaactgca

SEQ ID NO: 320623 - DNA, 75 bp, Artificial Sequence
  Synthetic
gccctaattgctcttgttaaacctcggagcaaagtggtgttatgcggagaccccaagcaatgcggattcttcaat

SEQ ID NO: 320624 - DNA, 75 bp, Artificial Sequence
  Synthetic
gaagtgctgcggctcctcagagtgctccactaaagagaagcctgactatcaatgcaaggtttacacaggcgtgta

SEQ ID NO: 320625 - DNA, 75 bp, Artificial Sequence
  Synthetic
tactaattcggacatgacgatcaacacgtgtctaatagagcagtgccacgtctcagtgacggaccataagaaatg

SEQ ID NO: 320626 - DNA, 75 bp, Artificial Sequence
  Synthetic
gcagttcaactcacctttcgtcccgagagccgacgaaccggctagaaaaggcaaagtccatatcccattcccgtt

SEQ ID NO: 320627 - DNA, 75 bp, Artificial Sequence
  Synthetic
acgcgtccagtcacggccatcgtgtctacgttgcactacggaggcaagatgcgcacgaccaacccgtgcaacaaa

SEQ ID NO: 320628 - DNA, 75 bp, Artificial Sequence
  Synthetic
atcggacgtatgcaagcatgatcacgcatctgcttacaaagcccacacagcatcgctgaaggccaaagtgagagt

SEQ ID NO: 320629 - DNA, 75 bp, Artificial Sequence
  Synthetic
agagccgacgaaccggctagaaaaggcaaagtccatatcccattcccgttggacaacatcacatgcagagttcca

SEQ ID NO: 320630 - DNA, 75 bp, Artificial Sequence
  Synthetic
atggcgcgcgaaccaaccgtcatccacggcaaaagagaagtgacactgcaccttcacccagatcatcccacgctc

SEQ ID NO: 320631 - DNA, 75 bp, Artificial Sequence
  Synthetic
acggcaaaagagaagtgacactgcaccttcacccagatcatcccacgctcttttcctaccgcacactgggtgagg

SEQ ID NO: 320632 - DNA, 75 bp, Artificial Sequence
  Synthetic
cgtgttaacatgcttccgaggctgggtaaagcagctgcagttggactaccgtggacacgaagtcatgacagcagc

SEQ ID NO: 320633 - DNA, 75 bp, Artificial Sequence
  Synthetic
acccgcagtatcacgaggaatgggtgacagcggcggtggaacggaccatacccgtaccagtggacgggatggagt

SEQ ID NO: 320634 - DNA, 75 bp, Artificial Sequence
  Synthetic
gacagcggcggtggaacggaccatacccgtaccagtggacgggatggagtaccactggggaaacaacgacccagt

SEQ ID NO: 320635 - DNA, 75 bp, Artificial Sequence
  Synthetic
gaggctttggtctcaactcaccactgaagggaaaccgcacggctggccgcatcagatcgtacagtactactatgg

SEQ ID NO: 320636 - DNA, 75 bp, Artificial Sequence
  Synthetic
ttaggactgccggctgacgccggcagattcgacttggtctttgtgaacattcacacggaattcagaatccaccac

SEQ ID NO: 320637 - DNA, 75 bp, Artificial Sequence
  Synthetic
acatccaaagcagaacggtggagagtaatgacctgtacgcgaacacggcactgaagctggcgcgcccttcacccg

SEQ ID NO: 320638 - DNA, 75 bp, Artificial Sequence
  Synthetic
gaagggaaaccgcacggctggccgcatcagatcgtacagtactactatgggctttacccggccgctacagtatcc

SEQ ID NO: 320639 - DNA, 75 bp, Artificial Sequence
  Synthetic
gcggtcgtcgggatgagcttactggcgttgatatcgatcttcgcgtcgtgctacatgctggttgcggcccgcagt

SEQ ID NO: 320640 - DNA, 75 bp, Artificial Sequence
  Synthetic
agactatggcctacttgtgggaccaaaaccaagcgttgttctggttggagtttgcggcccctgttgcctgcatcc

SEQ ID NO: 320641 - DNA, 75 bp, Artificial Sequence
  Synthetic
ccgaccatcactgacctgacttgcacagtggctacctgtacgcactcctcggatttcggcggcgtcttgacattg

SEQ ID NO: 320642 - DNA, 75 bp, Artificial Sequence
  Synthetic
aaaccaagcgttgttctggttggagtttgcggcccctgttgcctgcatcctcatcatcacgtattgcctcagaaa

SEQ ID NO: 320643 - DNA, 75 bp, Artificial Sequence
  Synthetic
ggatttcggcggcgtcttgacattgaagtacaaaaccgacaagaacggggactgctctgtacactcacactctaa

SEQ ID NO: 320644 - DNA, 75 bp, Artificial Sequence
  Synthetic
cgtgctgtgttgctgtaagagcctttcttttttagtgctactgagcctcggggcaaccgccagagcttacgaaca

SEQ ID NO: 320645 - DNA, 75 bp, Artificial Sequence
  Synthetic
taagggctacagtaccactgacgggtcgctgtactcgtacttggaaggtacgaaattcaaccaggctgctattga

SEQ ID NO: 320646 - DNA, 75 bp, Artificial Sequence
  Synthetic
tacgggcaagcaggcagttatcgcagaaagaaaaatccaaccgctttctgtgctggacaatgtaattcctatcaa

SEQ ID NO: 320647 - DNA, 75 bp, Artificial Sequence
  Synthetic
agcctcgaaccaacccttaatttggaatacataacctgtgagtacaagacggtcgtcccgtcgccgtacgtgaag

SEQ ID NO: 320648 - DNA, 75 bp, Artificial Sequence
  Synthetic
ccgcaggctgccgcacgccctggtggctgagtacaagacggttaaaggcagtagggttgagtggctggtcaataa

SEQ ID NO: 320649 - DNA, 75 bp, Artificial Sequence
  Synthetic
tgctgcggcgcctcagagtgctccactaaagagaagcctgactaccaatgcaaggtttacacaggcgtgtacccg

SEQ ID NO: 320650 - DNA, 75 bp, Artificial Sequence
  Synthetic
gccttcgcaatcggcgctattctggtgctagttgtggtcacttgcattggactccgcagataatgagtacctcat

SEQ ID NO: 320651 - DNA, 75 bp, Artificial Sequence
  Synthetic
ttcatgtggggaggggcatattgcttctgcgactcagaaaacacgcaactcagcgaggcgtacgtcgatcgatcg

SEQ ID NO: 320652 - DNA, 75 bp, Artificial Sequence
  Synthetic
tttagcatacagggtaccaaattcttagcttaattgacagtataccaccatcataattagccaagggtactgtaa

SEQ ID NO: 320653 - DNA, 75 bp, Artificial Sequence
  Synthetic
gacgtatgcaggcatgatcacgcatctgcttacaaagcccatacagcatcgctgaaggccaaagtgagggttatg

SEQ ID NO: 320654 - DNA, 75 bp, Artificial Sequence
  Synthetic
tagcttaattgacagtataccaccatcataattagccaagggtactgtaattttattataactacttgaacagaa

SEQ ID NO: 320655 - DNA, 75 bp, Artificial Sequence
  Synthetic
cttggtctttgtgaacattcacacggaattcagaatccaccactaccagcagtgtgtcgaccacgccatgaagct

SEQ ID NO: 320656 - DNA, 75 bp, Artificial Sequence
  Synthetic
tacggcaacgtaaaccagactgtggatgtttacgtgaacggagaccatgccgtcacgatagggggtactcagttc

SEQ ID NO: 320657 - DNA, 75 bp, Artificial Sequence
  Synthetic
ggcctccgggattactttcggagacttcgacgacgtcctgtgactaggccgcgcgggtgcatatattttctcctc

SEQ ID NO: 320658 - DNA, 75 bp, Artificial Sequence
  Synthetic
aactggaaaatagaaaaagttagggtaggcaatgttagtttattatacctctactataatcacttgaactaaaaa

SEQ ID NO: 320659 - DNA, 75 bp, Artificial Sequence
  Synthetic
atgtttacgtgaacggagaccatgccgtcacgatagggggtactcagttcatattcgggccgctgtcatcggcct

SEQ ID NO: 320660 - DNA, 75 bp, Artificial Sequence
  Synthetic
ggaccccgttcgacaacaagatagtcgtgtacaaagacgaagtgttcaatcaggacttcccgccgtacggatctg

SEQ ID NO: 320661 - DNA, 75 bp, Artificial Sequence
  Synthetic
tcttgatgagagcttacggatacgccgataaaatcagcgaagccgttgtttcctccttaagcagaaagttctcgt

SEQ ID NO: 320662 - DNA, 75 bp, Artificial Sequence
  Synthetic
taccagataacagatgaatacgacgcatacttggacatggttgacgggtcggagagttgcttggacagagcgaca

SEQ ID NO: 320663 - DNA, 75 bp, Artificial Sequence
  Synthetic
catacttggacatggttgacgggtcggagagttgcttggacagagcgacattctgcccggcgaagctccggtgct

SEQ ID NO: 320664 - DNA, 75 bp, Artificial Sequence
  Synthetic
ctactataatcacttgaactaaaaactggaaaacagaaaaagttagggtaagcaatggcattaatatagcaaaga

SEQ ID NO: 320665 - DNA, 75 bp, Artificial Sequence
  Synthetic
taagcaatggcatataaccataactatataacttataacaaagatatagcaagaaaattgaaaacagaaaaagtt

SEQ ID NO: 320666 - DNA, 75 bp, Artificial Sequence
  Synthetic
cgtgtacaaagacgaagtgttcaatcaggacttcccgccgtacggatctgggcaaccagggcgcttcggcgacat

SEQ ID NO: 320667 - DNA, 75 bp, Artificial Sequence
  Synthetic
ggtccatgtaccgtacacacagacaccttcagggttcaaatattggctaaaggaaaaagggacagccctaaatac

SEQ ID NO: 320668 - DNA, 75 bp, Artificial Sequence
  Synthetic
agggtaagcactggcatataaccataactatataatttataacaaagcgcaacaagacctgcgcaattggccccg

SEQ ID NO: 320669 - DNA, 75 bp, Artificial Sequence
  Synthetic
ccttcagggttcaaatattggctaaaggaaaaagggacagccctaaatacgaaggctccttttggctgccaaatc

SEQ ID NO: 320670 - DNA, 75 bp, Artificial Sequence
  Synthetic
taagagagcagacatagccacgtgcacagaagcggctgtggttaacgcagctaacgcccgtggaactgtagggga

SEQ ID NO: 320671 - DNA, 75 bp, Artificial Sequence
  Synthetic
aaaacgaaccctgtcagggccatgaactgcgccgtgggaaacatccctgtctccatgaatttgcctgacagcgcc

SEQ ID NO: 320672 - DNA, 75 bp, Artificial Sequence
  Synthetic
gcaactcatattgacacattaattggcaataattggaagcttacataagctcagttcgacgaataattggatttt

SEQ ID NO: 320673 - DNA, 75 bp, Artificial Sequence
  Synthetic
aactatataatttataacaaagcgcaacaagacctgcgcaattggccccgtagtccgcttcacggaaactcgggg

SEQ ID NO: 320674 - DNA, 75 bp, Artificial Sequence
  Synthetic
gcaataattggaagcttacataagctcagttcgacgaataattggatttttattttattttgcaattggttttta

SEQ ID NO: 320675 - DNA, 75 bp, Artificial Sequence
  Synthetic
ccatcattgacctgacttgcacagtggctacctgtacgcactcctcggatttcggcggcgtcttgacactgacgt

SEQ ID NO: 320676 - DNA, 75 bp, Artificial Sequence
  Synthetic
atatttccactagtctgcattaatgaatcggccaacgcgcggggagaggcggtttgcgtattgggcgctcttccg

SEQ ID NO: 320677 - DNA, 75 bp, Artificial Sequence
  Synthetic
gtcatccacgctgtagcgcctaatttctctgccacgactgaagcggaaggggaccgcgaattggccgctgtctac

SEQ ID NO: 320678 - DNA, 75 bp, Artificial Sequence
  Synthetic
aatcggccaacgcgcggggagaggcggtttgcgtattgggcgctcttccgcttcctcgctcactgactcgctgcg

SEQ ID NO: 320679 - DNA, 75 bp, Artificial Sequence
  Synthetic
ctcggtcgttcggctgcggcgagcggtatcagctcactcaaaggcggtaatacggttatccacagaatcagggga

SEQ ID NO: 320680 - DNA, 75 bp, Artificial Sequence
  Synthetic
cgggcagtggccgccgaagtaaacagactgtcactgagcagcgtagccatcccgctgctgtccacaggagtgttc

SEQ ID NO: 320681 - DNA, 75 bp, Artificial Sequence
  Synthetic
gtatcagctcactcaaaggcggtaatacggttatccacagaatcaggggataacgcaggaaagaacatgtgagca

SEQ ID NO: 320682 - DNA, 75 bp, Artificial Sequence
  Synthetic
aaaggccagcaaaaggccaggaaccgtaaaaaggccgcgttgctggcgtttttccataggctccgcccccctgac

SEQ ID NO: 320683 - DNA, 75 bp, Artificial Sequence
  Synthetic
gtaaaaaggccgcgttgctggcgtttttccataggctccgcccccctgacgagcatcacaaaaatcgacgctcaa

SEQ ID NO: 320684 - DNA, 75 bp, Artificial Sequence
  Synthetic
gtcgtgtgagcccccgaaagaccacatagtcccatatgcggctagccacagtaacgtagtgtttccagacatgtc

SEQ ID NO: 320685 - DNA, 75 bp, Artificial Sequence
  Synthetic
gtcagaggtggcgaaacccgacaggactataaagataccaggcgtttccccctggaagctccctcgtgcgctctc

SEQ ID NO: 320686 - DNA, 75 bp, Artificial Sequence
  Synthetic
actataaagataccaggcgtttccccctggaagctccctcgtgcgctctcctgttccgaccctgccgcttaccgg

SEQ ID NO: 320687 - DNA, 75 bp, Artificial Sequence
  Synthetic
aaaatctcgggtggtctgggggccttcgcaatcggcgctatcctggtgctggttgtggtcacttgcattgggctc

SEQ ID NO: 320688 - DNA, 75 bp, Artificial Sequence
  Synthetic
gtggaaccggaaacgttggcactactaattcggacaagacgatcaacacgtgtctaatagagcagtgccacgtct

SEQ ID NO: 320689 - DNA, 75 bp, Artificial Sequence
  Synthetic
atacctgtccgcctttctcccttcgggaagcgtggcgctttctcatagctcacgctgtaggtatctcagttcggt

SEQ ID NO: 320690 - DNA, 75 bp, Artificial Sequence
  Synthetic
gcattgatatagcaagaaaattgaaaacagaaaaagttagggtaagcaatggcatataaccataactgtataact

SEQ ID NO: 320691 - DNA, 75 bp, Artificial Sequence
  Synthetic
aacagaaaaagttagggtaagcaatggcatataaccataactgtataacttgtaacaaagcgcaacaagacctgc

SEQ ID NO: 320692 - DNA, 75 bp, Artificial Sequence
  Synthetic
tgtgtgcacgaaccccccgttcagcccgaccgctgcgccttatccggtaactatcgtcttgagtccaacccggta

SEQ ID NO: 320693 - DNA, 75 bp, Artificial Sequence
  Synthetic
ggaagcgtggcgctttctcatagctcacgctgtaggtatctcagttcggtgtaggtcgttcgctccaagctgggc

SEQ ID NO: 320694 - DNA, 75 bp, Artificial Sequence
  Synthetic
gcaattggccccgtggtccgcctcacggaaacacggggcaactcatattgacacattaattggcaataattggaa

SEQ ID NO: 320695 - DNA, 75 bp, Artificial Sequence
  Synthetic
cctatacgcgctgggcgaaacaatggacaacatcagatccaaatgtccggtgaacgattccgattcatcaacacc

SEQ ID NO: 320696 - DNA, 75 bp, Artificial Sequence
  Synthetic
cagccactggtaacaggattagcagagcgaggtatgtaggcggtgctacagagttcttgaagtggtggcctaact

SEQ ID NO: 320697 - DNA, 75 bp, Artificial Sequence
  Synthetic
tggaagcttacataagcttaattcgacgaataattggatttttattttattttgcaattggtttttaatatttcc

SEQ ID NO: 320698 - DNA, 75 bp, Artificial Sequence
  Synthetic
cggaaacacggggcaactcatattgacacattaattggcaataattggaagcttacataagcttaattcgacgaa

SEQ ID NO: 320699 - DNA, 75 bp, Artificial Sequence
  Synthetic
ccgaccgctgcgccttatccggtaactatcgtcttgagtccaacccggtaagacacgacttatcgccactggcag

SEQ ID NO: 320700 - DNA, 75 bp, Artificial Sequence
  Synthetic
tggtatctgcgctctgctgaagccagttaccttcggaaaaagagttggtagctcttgatccggcaaacaaaccac

SEQ ID NO: 320701 - DNA, 75 bp, Artificial Sequence
  Synthetic
agcgaggtatgtaggcggtgctacagagttcttgaagtggtggcctaactacggctacactagaagaacagtatt

SEQ ID NO: 320702 - DNA, 75 bp, Artificial Sequence
  Synthetic
gttaccttcggaaaaagagttggtagctcttgatccggcaaacaaaccaccgctggtagcggtggtttttttgtt

SEQ ID NO: 320703 - DNA, 75 bp, Artificial Sequence
  Synthetic
tgcaagcagcagattacgcgcagaaaaaaaggatctcaagaagatcctttgatcttttctacggggtctgacgct

SEQ ID NO: 320704 - DNA, 75 bp, Artificial Sequence
  Synthetic
aaaaaggatctcaagaagatcctttgatcttttctacggggtctgacgctcagtggaacgaaaactcacgttaag

SEQ ID NO: 320705 - DNA, 75 bp, Artificial Sequence
  Synthetic
acacttctccacggcaagcgcatcaccttcttttgtggtgtcgctatgcagtgctaaggccacctgttcagcgtc

SEQ ID NO: 320706 - DNA, 75 bp, Artificial Sequence
  Synthetic
ggattttggtcatgagattatcaaaaaggatcttcacctagatccttttaaattaaaaatgaagttttaaatcaa

SEQ ID NO: 320707 - DNA, 75 bp, Artificial Sequence
  Synthetic
gaaggagaactgccaggaaatagttaacgacgtgaagaagcaccgcgggaaggggacaagtagggaaaacagtga

SEQ ID NO: 320708 - DNA, 75 bp, Artificial Sequence
  Synthetic
ctcccatagtagtgacggctgacgtacaccctgaacccgcaggcatcgcggacctggcggcagatgtgcatcctg

SEQ ID NO: 320709 - DNA, 75 bp, Artificial Sequence
  Synthetic
caccgcactatcatgggtgcagaaaatctcgggtggtctgggggccttcgcaatcggcgctatcctggtgctagt

SEQ ID NO: 320710 - DNA, 75 bp, Artificial Sequence
  Synthetic
gtctgacagttaccaatgcttaatcagtgaggcacctatctcagcgatctgtctatttcgttcatccatagttgc

SEQ ID NO: 320711 - DNA, 75 bp, Artificial Sequence
  Synthetic
caatcggcgctatcctggtgctagttgtggtcacttgcattgggctccgcagataatgagtacctcaccttagca

SEQ ID NO: 320712 - DNA, 75 bp, Artificial Sequence
  Synthetic
gaacccgattcctccaccgcgcccgaagagagctgcataccttgcctcccgcgcggcggagcgaccggtgccggc

SEQ ID NO: 320713 - DNA, 75 bp, Artificial Sequence
  Synthetic
tacagggtactaaactcatagcttaattgacagtatacctccatcataattagccaagggtactgtaattttatc

SEQ ID NO: 320714 - DNA, 75 bp, Artificial Sequence
  Synthetic
acgatacgggagggcttaccatctggccccagtgctgcaatgataccgcgagacccacgctcaccggctccagat

SEQ ID NO: 320715 - DNA, 75 bp, Artificial Sequence
  Synthetic
attgacagtatacctccatcataattagccaagggtactgtaattttatcataactacttgaacagaaaactgga

SEQ ID NO: 320716 - DNA, 75 bp, Artificial Sequence
  Synthetic
agtgaggcacctatctcagcgatctgtctatttcgttcatccatagttgcctgactccccgtcgtgtagataact

SEQ ID NO: 320717 - DNA, 75 bp, Artificial Sequence
  Synthetic
aaacagaaaaagttagggtaggcaatgttagtatattatacctctattataatcacttgaacgaaaactgaaaaa

SEQ ID NO: 320718 - DNA, 75 bp, Artificial Sequence
  Synthetic
gaagggccgagcgcagaagtggtcctgcaactttatccgcctccatccagtctattaattgttgccgggaagcta

SEQ ID NO: 320719 - DNA, 75 bp, Artificial Sequence
  Synthetic
aatcacttgaacgaaaactgaaaaacagaaaaagttagggtaagcaatggcattaatatagcaagaaaaccgaaa

SEQ ID NO: 320720 - DNA, 75 bp, Artificial Sequence
  Synthetic
gccccagtgctgcaatgataccgcgagacccacgctcaccggctccagatttatcagcaataaaccagccagccg

SEQ ID NO: 320721 - DNA, 75 bp, Artificial Sequence
  Synthetic
tttgcgcaacgttgttgccattgctacaggcatcgtggtgtcacgctcgtcgtttggtatggcttcattcagctc

SEQ ID NO: 320722 - DNA, 75 bp, Artificial Sequence
  Synthetic
tgcatatattttctcctcggacactggcagcggacatttacaacaaaaatccgttaggcagcacaatctccagtg

SEQ ID NO: 320723 - DNA, 75 bp, Artificial Sequence
  Synthetic
tgcaactttatccgcctccatccagtctattaattgttgccgggaagctagagtaagtagttcgccagttaatag

SEQ ID NO: 320724 - DNA, 75 bp, Artificial Sequence
  Synthetic
acaggcatcgtggtgtcacgctcgtcgtttggtatggcttcattcagctccggttcccaacgatcaaggcgagtt

SEQ ID NO: 320725 - DNA, 75 bp, Artificial Sequence
  Synthetic
acatgatcccccatgttgtgcaaaaaagcggttagctccttcggtcctccgatcgttgtcagaagtaagttggcc

SEQ ID NO: 320726 - DNA, 75 bp, Artificial Sequence
  Synthetic
aagcggttagctccttcggtcctccgatcgttgtcagaagtaagttggccgcagtgttatcactcatggttatgg

SEQ ID NO: 320727 - DNA, 75 bp, Artificial Sequence
  Synthetic
cagcactgcataattctcttactgtcatgccatccgtaagatgcttttctgtgactggtgagtactcaaccaagt

SEQ ID NO: 320728 - DNA, 75 bp, Artificial Sequence
  Synthetic
catgccatccgtaagatgcttttctgtgactggtgagtactcaaccaagtcattctgagaatagtgtatgcggcg

SEQ ID NO: 320729 - DNA, 75 bp, Artificial Sequence
  Synthetic
accgagttgctcttgcccggcgtcaatacgggataataccgcgccacatagcagaactttaaaagtgctcatcat

SEQ ID NO: 320730 - DNA, 75 bp, Artificial Sequence
  Synthetic
atacgggataataccgcgccacatagcagaactttaaaagtgctcatcattggaaaacgttcttcggggcgaaaa

SEQ ID NO: 320731 - DNA, 75 bp, Artificial Sequence
  Synthetic
ctctcaaggatcttaccgctgttgagatccagttcgatgtaacccactcgtgcacccaactgatcttcagcatct

SEQ ID NO: 320732 - DNA, 75 bp, Artificial Sequence
  Synthetic
gatccagttcgatgtaacccactcgtgcacccaactgatcttcagcatcttttactttcaccagcgtttctgggt

SEQ ID NO: 320733 - DNA, 75 bp, Artificial Sequence
  Synthetic
gagcaaaaacaggaaggcaaaatgccgcaaaaaagggaataagggcgacacggaaatgttgaatactcatactct

SEQ ID NO: 320734 - DNA, 75 bp, Artificial Sequence
  Synthetic
acatcatgcgtaccaccagccgactgtacgcagtgccgtcccgtcaccctttcagaacacactacagaacgtgct

SEQ ID NO: 320735 - DNA, 75 bp, Artificial Sequence
  Synthetic
cgcaaaaaagggaataagggcgacacggaaatgttgaatactcatactcttcctttttcaatattattgaagcat

SEQ ID NO: 320736 - DNA, 75 bp, Artificial Sequence
  Synthetic
agcggccgccaccaagagaaactgcaacgtcacgcaaatgcgagaactacccaccatggactcggcagtgttcaa

SEQ ID NO: 320737 - DNA, 75 bp, Artificial Sequence
  Synthetic
ttatcagggttattgtctcatgagcggatacatatttgaatgtatttagaaaaataaacaaataggggttccgcg

SEQ ID NO: 320738 - DNA, 75 bp, Artificial Sequence
  Synthetic
ggatacatatttgaatgtatttagaaaaataaacaaataggggttccgcgcacatttccccgaaaagtgccacct

SEQ ID NO: 320739 - DNA, 75 bp, Artificial Sequence
  Synthetic
gacgtctaagaaaccattattatcatgacattaacctataaaaataggcgtatcacgaggccctttcgtctcgcg

SEQ ID NO: 320740 - DNA, 75 bp, Artificial Sequence
  Synthetic
tgacattaacctataaaaataggcgtatcacgaggccctttcgtctcgcgcgtttcggtgatgacggtgaaaacc

SEQ ID NO: 320741 - DNA, 75 bp, Artificial Sequence
  Synthetic
accaaacaagagaaaaaacatgtatgggatatacaatgaagttagacaggattttagggtcaaagtatccaccct

SEQ ID NO: 320742 - DNA, 75 bp, Artificial Sequence
  Synthetic
attttagggtcaaagtatccaccctgaggagcaggttccagaccctttgctttgctgccaaagttcacgatggcc

SEQ ID NO: 320743 - DNA, 75 bp, Artificial Sequence
  Synthetic
tttgctgccaaagttcacgatggccgggttgttgagcaccttcgatacatttagctctaggaggagcgaaagtat

SEQ ID NO: 320744 - DNA, 75 bp, Artificial Sequence
  Synthetic
taataagtcgggaggaggtgctgttatccccggccagaggagcacagtctcagtgttcgtactaggcccaagtgt

SEQ ID NO: 320745 - DNA, 75 bp, Artificial Sequence
  Synthetic
atccccggccagaggagcacagtctcagtgttcgtactaggcccaagtgtgactgatgatgcagacaagttattc

SEQ ID NO: 320746 - DNA, 75 bp, Artificial Sequence
  Synthetic
gactgatgatgcagacaagttattcattgcaactaccttcctagctcactcattggacacagataagcagcactc

SEQ ID NO: 320747 - DNA, 75 bp, Artificial Sequence
  Synthetic
atcacaaaaactttattagaccggtttgaggatattatacatagtataacgtacagattcctcaccaaagaaata

SEQ ID NO: 320748 - DNA, 75 bp, Artificial Sequence
  Synthetic
tcagagaggagggttcctcgtctctctgcttgccatggcttacagtagtccagaattgtacttgacaacaaacgg

SEQ ID NO: 320749 - DNA, 75 bp, Artificial Sequence
  Synthetic
ccctatcgtgcagaacgatcgaagctccgcggtacctggaagtcttggactgatccatatgacaatagtaagaaa

SEQ ID NO: 320750 - DNA, 75 bp, Artificial Sequence
  Synthetic
agtaaacgccgatgtcaaatatgtgatctacaacatagagaaagaccctaagaggacgaagacagacggattcat

SEQ ID NO: 320751 - DNA, 75 bp, Artificial Sequence
  Synthetic
atctacaacatagagaaagaccctaagaggacgaagacagacggattcattgtgaaggcgagagatatggaatat

SEQ ID NO: 320752 - DNA, 75 bp, Artificial Sequence
  Synthetic
gagaggaccacagaatggctgtttggacctatggtcaacaagagcccactcttccagggtcaacgggatgctgca

SEQ ID NO: 320753 - DNA, 75 bp, Artificial Sequence
  Synthetic
gaagagcaggtttcagacctttagctttgctgccggaatttacgatggctgggctgttgagcacttttgatacat

SEQ ID NO: 320754 - DNA, 75 bp, Artificial Sequence
  Synthetic
gaccctgacacactccttcaaacctatgggtatcctgcatgcctaggagcaataattgtccaagtctggattgtg

SEQ ID NO: 320755 - DNA, 75 bp, Artificial Sequence
  Synthetic
ttagctctaggaggagtgaaagtattaataagtcagggggaggtgctgttatccctggccagaggagcacagtct

SEQ ID NO: 320756 - DNA, 75 bp, Artificial Sequence
  Synthetic
ctggtgaaggccatcacaagcagcgccggcttaaggaaagggttcttcaacaggttagaggcgttcagacaagac

SEQ ID NO: 320757 - DNA, 75 bp, Artificial Sequence
  Synthetic
cagtgttcgtactaggcccaagtgtggctgacgatgcagacaagttattcattgcaaccaccttcttagctcact

SEQ ID NO: 320758 - DNA, 75 bp, Artificial Sequence
  Synthetic
ggcaccgtgaaaggtgccttagttttcactggggagacagttgaggggataggctcggttatgagatctcagcaa

SEQ ID NO: 320759 - DNA, 75 bp, Artificial Sequence
  Synthetic
cattggacacagataagcagcactctcagagaggaggtttcctagtctccctacttgccatggcttacagtagtc

SEQ ID NO: 320760 - DNA, 75 bp, Artificial Sequence
  Synthetic
agccttgtatctctcatggttgagacccttgtgactatgaatactgcaagatctgatctcaccacattagagaag

SEQ ID NO: 320761 - DNA, 75 bp, Artificial Sequence
  Synthetic
cagaattatacctgacaacgaacggggtaaatgccgatgttaaatacgtgatctacaacatagaaaaggacccta

SEQ ID NO: 320762 - DNA, 75 bp, Artificial Sequence
  Synthetic
aacatccagatcgttgggaactacatccgagatgcagggctggcttccttcatgaacactattaaatatggggtg

SEQ ID NO: 320763 - DNA, 75 bp, Artificial Sequence
  Synthetic
agaggacaaagacagatggattcattgtgaagactagagatatggagtatgagaggaccacagaatggctgtttg

SEQ ID NO: 320764 - DNA, 75 bp, Artificial Sequence
  Synthetic
gagacaaagatggcagctctaacgttgtcaaacctgaggcccgatattaataagcttagaagcctcatagacacc

SEQ ID NO: 320765 - DNA, 75 bp, Artificial Sequence
  Synthetic
gacccatggtcaacaagagcccgcttttccagggacaacgagattctgcagatcctgatgcactccttcaaatct

SEQ ID NO: 320766 - DNA, 75 bp, Artificial Sequence
  Synthetic
tacctgtcaaaaggccccagagctccctttatctgtatcctcaaggaccctgttcatggtgaatttgctccaggc

SEQ ID NO: 320767 - DNA, 75 bp, Artificial Sequence
  Synthetic
atgggtatccggcatgcctaggagcaataattgtccaggtctggattgtgttggtgaaggcaatcacaagtagcg

SEQ ID NO: 320768 - DNA, 75 bp, Artificial Sequence
  Synthetic
aattatcctgcactatggagttacgccatgggagtcgccgtcgtacagaacaaggcaatgcagcagtacgtcaca

SEQ ID NO: 320769 - DNA, 75 bp, Artificial Sequence
  Synthetic
caaggcaatgcagcagtacgtcacagggaggacataccttgatatggaaatgttcttactaggacaagccgtggc

SEQ ID NO: 320770 - DNA, 75 bp, Artificial Sequence
  Synthetic
gggaggacataccttgatatggaaatgttcttactaggacaagccgtggcaaaggatgctgaatcgaagatcagc

SEQ ID NO: 320771 - DNA, 75 bp, Artificial Sequence
  Synthetic
ccggtctaaggaaaggatttttcaacagattagaggcgttccgacaagatgggaccgtgaaaggtgcattagttt

SEQ ID NO: 320772 - DNA, 75 bp, Artificial Sequence
  Synthetic
tcactggagagacagttgaggggataggttcggttatgagatctcagcaaagcttggtatctctcatggttgaga

SEQ ID NO: 320773 - DNA, 75 bp, Artificial Sequence
  Synthetic
agcttggtatctctcatggttgagacccttgtgactatgaacactgcgagatccgacctcactacgctagagaag

SEQ ID NO: 320774 - DNA, 75 bp, Artificial Sequence
  Synthetic
cagacatcatctggcaaacttgtccggtggggatggtgcttaccacaaaccaacaggcggtggtgcaattgaggt

SEQ ID NO: 320775 - DNA, 75 bp, Artificial Sequence
  Synthetic
atccgacctcactacgctagagaagaacatccagatcgtcgggaactacatccgagatgcagggctagcctcttt

SEQ ID NO: 320776 - DNA, 75 bp, Artificial Sequence
  Synthetic
caacaggcggtggtgcaattgaggtagctctagacaatgccgatatcgacctagaaacagaagctcatgcggacc

SEQ ID NO: 320777 - DNA, 75 bp, Artificial Sequence
  Synthetic
catgaacactatcaaatatggggtagagaccaagatggcggctctaacactatcaaacttgaggcctgatataaa

SEQ ID NO: 320778 - DNA, 75 bp, Artificial Sequence
  Synthetic
aggacgctaggggttggggtggagaaagtggtgaaagatgggcacgtcaggtgagtggtggccactttgtcacac

SEQ ID NO: 320779 - DNA, 75 bp, Artificial Sequence
  Synthetic
taagctgagaagcctcatagacacctacttgtcaaaaggtcccagagccccttttatttgtatccttaaggaccc

SEQ ID NO: 320780 - DNA, 75 bp, Artificial Sequence
  Synthetic
tacatggggctgaacggttagaggaggaaaccaatgatgaggatgtatcagacatagagagaagaatagccatga

SEQ ID NO: 320781 - DNA, 75 bp, Artificial Sequence
  Synthetic
gacatagagagaagaatagccatgagactcgcagagagacggcaagaggattctgcaacccatggagatgaaggc

SEQ ID NO: 320782 - DNA, 75 bp, Artificial Sequence
  Synthetic
tgtccatggagagtttgcaccaggcaactatccagcactctggagctatgcaatgggggtcgccgttgtacagaa

SEQ ID NO: 320783 - DNA, 75 bp, Artificial Sequence
  Synthetic
ttctgcaacccatggagatgaaggccgcaataacggtgtcgatcacgacgaagatgacgatgccgcagcagtagc

SEQ ID NO: 320784 - DNA, 75 bp, Artificial Sequence
  Synthetic
caaggcgatgcagcagtatgtcacaggaagaacataccttgatatggagatgttcctactaggacaagccgtagc

SEQ ID NO: 320785 - DNA, 75 bp, Artificial Sequence
  Synthetic
tgggataggaggaatctaggatcatacgaggcctcaaggtacttgatccgtagtaagaaaaacttagggtgaaag

SEQ ID NO: 320786 - DNA, 75 bp, Artificial Sequence
  Synthetic
aaaggacgctgaatctaagatcagcagtgctctggaggatgaactaggagtgacagatacggctaaggagagact

SEQ ID NO: 320787 - DNA, 75 bp, Artificial Sequence
  Synthetic
ggccacacccaaccccaccgaccacacccagcagtcgagacagccacggcttcggctacacttaccgcatggatc

SEQ ID NO: 320788 - DNA, 75 bp, Artificial Sequence
  Synthetic
cagacatcatttggctaatctgtctggtggagatggcgcataccacaagccgacgggtggcggtgcaatcgaagt

SEQ ID NO: 320789 - DNA, 75 bp, Artificial Sequence
  Synthetic
agctatagataatgctgacatagacctagaacctgaaactcacacagaccaggacgtcaggggttggggcgagga

SEQ ID NO: 320790 - DNA, 75 bp, Artificial Sequence
  Synthetic
cagtggtgacagatgggctcgcccggcaagcagtggtcattttatcacattacacggggcagaacggttggagga

SEQ ID NO: 320791 - DNA, 75 bp, Artificial Sequence
  Synthetic
ggaaactaaagttgaggatgtctcagacatagagaggagaatagccaggagacttgcagagagaaggcaagatgg

SEQ ID NO: 320792 - DNA, 75 bp, Artificial Sequence
  Synthetic
ctctgcccatagagccaaaagtgagggcgaaggagaagtctcaacaccgtcgacccaagataatcgatcaggtga

SEQ ID NO: 320793 - DNA, 75 bp, Artificial Sequence
  Synthetic
cactacaacccacgaagacggaggccgtaacaacgatgttgatcaggatgaagaggatgatgccgcagcagcagc

SEQ ID NO: 320794 - DNA, 75 bp, Artificial Sequence
  Synthetic
ggagagtagagtctctgggagaacaagcaagccagaggcagaagcacatgctggaaaccttgataaacaaaatat

SEQ ID NO: 320795 - DNA, 75 bp, Artificial Sequence
  Synthetic
agcaagccagaggcagaagcacatgctggaaaccttgataaacaaaatatacaccgggcctttgggggaagaact

SEQ ID NO: 320796 - DNA, 75 bp, Artificial Sequence
  Synthetic
tggaataggagggatctaagatcacactaggttccgggatacatgacctatagtaagaaaaacttagggtgaaag

SEQ ID NO: 320797 - DNA, 75 bp, Artificial Sequence
  Synthetic
ggtacaaactctgtatctcaggatctgggcgatggaggagactccggaatccttgaaaatcctccaaatgagaga

SEQ ID NO: 320798 - DNA, 75 bp, Artificial Sequence
  Synthetic
ctcatccaccgatccgcccagatcaggccacatccaaccccatcgaccacactcagcagtccagacaatcacggc

SEQ ID NO: 320799 - DNA, 75 bp, Artificial Sequence
  Synthetic
ggccacatccaaccccatcgaccacactcagcagtccagacaatcacggcttcggctacatttcccgcatggatc

SEQ ID NO: 320800 - DNA, 75 bp, Artificial Sequence
  Synthetic
ggatatccgagatcaggtattgaagatgaaaacagagagatggctgcgcaccctgataagaggggagaagaccaa

SEQ ID NO: 320801 - DNA, 75 bp, Artificial Sequence
  Synthetic
gctgaaggacttccagaagaggtacgaggaggtacatccctacctgatgaaggagaaggtggagcaagtaataat

SEQ ID NO: 320802 - DNA, 75 bp, Artificial Sequence
  Synthetic
ttatcggattcctcgatgcagtcctatcaagtgaaccaactgaaatcggaggagacagaagctggctctacaaca

SEQ ID NO: 320803 - DNA, 75 bp, Artificial Sequence
  Synthetic
ggaagaagcatggagcctggcagctcacatagtgcaagagtaactggggtcctggtgattcctagccccgaactc

SEQ ID NO: 320804 - DNA, 75 bp, Artificial Sequence
  Synthetic
ctatcgacaccctccaagggccaggctctacctacagaatcaaaagtgatggggagggagaagtctcgacatctc

SEQ ID NO: 320805 - DNA, 75 bp, Artificial Sequence
  Synthetic
gaagaggctgtgctacggaggaacaaaagaagacctaccaacagtgggtccaaacctcttactccagcaaccgtg

SEQ ID NO: 320806 - DNA, 75 bp, Artificial Sequence
  Synthetic
cgacccaagataatcgaccaggtgaggagagtagagtccctgggagaacaagcaagtcagaggcagaagcacatg

SEQ ID NO: 320807 - DNA, 75 bp, Artificial Sequence
  Synthetic
cctggcacccggtccccaccgctgaatcgttacaacagcacagggtcaccaccaggaaaacccccatctacacag

SEQ ID NO: 320808 - DNA, 75 bp, Artificial Sequence
  Synthetic
ctagagatgttgataaacaaaatatacaccggaccgctgggagaggagctggtacaaacgctgtatctcaggatc

SEQ ID NO: 320809 - DNA, 75 bp, Artificial Sequence
  Synthetic
tgggcaatggaggaaactccggaatccttgaagatcctccaaatgagggaggacatccgagatcaggtgctgaaa

SEQ ID NO: 320810 - DNA, 75 bp, Artificial Sequence
  Synthetic
gtctcagattgtccagccaacggccgcccaatccacccgggtctagagaccgactcaacaaaaaagggcatagga

SEQ ID NO: 320811 - DNA, 75 bp, Artificial Sequence
  Synthetic
ggacatccgagatcaggtgctgaaaatgaaaaccgagagatggctgcgaaccctgataagaggggagaagaccaa

SEQ ID NO: 320812 - DNA, 75 bp, Artificial Sequence
  Synthetic
gagaacacatcatctatgaaagagatggctacattgttgacgagtcttggtgtaatccagtctgctcaagaattc

SEQ ID NO: 320813 - DNA, 75 bp, Artificial Sequence
  Synthetic
gctgaaggatttccagaggaggtacgaagaagtgcacccttacctgatgaaggagaaggtagagcagataataat

SEQ ID NO: 320814 - DNA, 75 bp, Artificial Sequence
  Synthetic
gagtcatcccgagacgcgagttatgtgtttgcaagacgtgccctaaagtctgcaaactatgcagagatgacattc

SEQ ID NO: 320815 - DNA, 75 bp, Artificial Sequence
  Synthetic
aggagaaggtagagcagataataatggaagaggcatggagtctggcagcccacatagtacaagagtgaccggagt

SEQ ID NO: 320816 - DNA, 75 bp, Artificial Sequence
  Synthetic
aatgtatgcggcctgatcctttctgccgagaaatcttccgctcgtaaggtagatgagaacaaacaactgctcaaa

SEQ ID NO: 320817 - DNA, 75 bp, Artificial Sequence
  Synthetic
ccgagaaatcttccgctcgtaaggtagatgagaacaaacaactgctcaaacagatccaagagagcgtggaatcat

SEQ ID NO: 320818 - DNA, 75 bp, Artificial Sequence
  Synthetic
cttggtgatccctagtcctgagctcgaagaggctgtactacaaaggaacaagagacgacccgtcaacagtgggtc

SEQ ID NO: 320819 - DNA, 75 bp, Artificial Sequence
  Synthetic
cagacccctcacaccagcggccgcgcccggcattcagtcctcatcaccgggtcatgacaacagcacaaggtcacc

SEQ ID NO: 320820 - DNA, 75 bp, Artificial Sequence
  Synthetic
tccgggatatttacaagagattctctgagtatcagaaagaacagaactcattgctgatgtccaacctatctacac

SEQ ID NO: 320821 - DNA, 75 bp, Artificial Sequence
  Synthetic
accagggaaacccccaaccacacagggtgagtacaccaactccagaaatgcccccgctgttaggaccaaggaccg

SEQ ID NO: 320822 - DNA, 75 bp, Artificial Sequence
  Synthetic
ttcatatcatcacagatagaggtggcaagactgacaacacagactcccttacaaggtccccctccgtttttgcaa

SEQ ID NO: 320823 - DNA, 75 bp, Artificial Sequence
  Synthetic
gagactaccagcagggacccgctctgccccagaccgtccggccgacggtcatccaactcatccaggtccggagac

SEQ ID NO: 320824 - DNA, 75 bp, Artificial Sequence
  Synthetic
aatcaaaagagaacaagactaaggctaccaggtttgacccatctatggagaccctagaagatatgaagtacaaac

SEQ ID NO: 320825 - DNA, 75 bp, Artificial Sequence
  Synthetic
cgacgcaacaaaaaagggcacaggagggagcacatcatctatgaaagagatggctacattgttaaagagtcttgg

SEQ ID NO: 320826 - DNA, 75 bp, Artificial Sequence
  Synthetic
cggacctaatccgagaggatgaatttagagatgagatccgcaacccggtgtaccaagagagggacacagaaccca

SEQ ID NO: 320827 - DNA, 75 bp, Artificial Sequence
  Synthetic
gagtcatcccgagacgcgagttatgtgtttgcaaggcgtgccctaaaatctgcaaactatgcagagatgacattt

SEQ ID NO: 320828 - DNA, 75 bp, Artificial Sequence
  Synthetic
cccctccaaagagaagcacacaatgcactctctcaggctcgtcatagagagcagtcccctaagcagagctgagaa

SEQ ID NO: 320829 - DNA, 75 bp, Artificial Sequence
  Synthetic
aatgtatgcggtctaatcctttctgccgagaagtctttcgctaatagggtagatgagaataaacagctgcttaaa

SEQ ID NO: 320830 - DNA, 75 bp, Artificial Sequence
  Synthetic
agcagcatatgtgaaatcattatccaagtgcaagacagaccaagaggttaaggcagtcatggaactcgtagaaga

SEQ ID NO: 320831 - DNA, 75 bp, Artificial Sequence
  Synthetic
aggcagtcatggaactcgtagaagaggacatagagtcactgaccaactagatcccgggtgaggcatcctaccatc

SEQ ID NO: 320832 - DNA, 75 bp, Artificial Sequence
  Synthetic
cagatccaagaaagtgtggaatcatttcgggatatatacaagaggttctccgagtatcagaaggaacaaaactca

SEQ ID NO: 320833 - DNA, 75 bp, Artificial Sequence
  Synthetic
atcccgggtgaggcatcctaccatcctcagtcatagagagatccaatctattatcagcatcagccagtaaagatt

SEQ ID NO: 320834 - DNA, 75 bp, Artificial Sequence
  Synthetic
ttactgatgtccaacctatctacacttcatatcatcacagatagaggtggcaagaccgacaacacagattcccct

SEQ ID NO: 320835 - DNA, 75 bp, Artificial Sequence
  Synthetic
aagaaaaacttagggtgaaagaaatttcacctaacacggcgcaatggcagatatctatagattccctaagttctc

SEQ ID NO: 320836 - DNA, 75 bp, Artificial Sequence
  Synthetic
acaagatctccctctgtctttgcaaaaacaaaagagagcaagaacaaagtgatcaggtttgacccgtctatggag

SEQ ID NO: 320837 - DNA, 75 bp, Artificial Sequence
  Synthetic
atatgaggataacggtgctgtggagcccctgcctctgagaactggtccagataagaaagccatcccctacatcag

SEQ ID NO: 320838 - DNA, 75 bp, Artificial Sequence
  Synthetic
accttgggggatatgaagtataagccggacctactccgagaggatgaatttagggatgagatccgcaacccggtg

SEQ ID NO: 320839 - DNA, 75 bp, Artificial Sequence
  Synthetic
aaacatggagtgagatacctagatttattgctcttgggtttctttgagacaccgaaacaaacaaccaatctaggg

SEQ ID NO: 320840 - DNA, 75 bp, Artificial Sequence
  Synthetic
taccaggaaagagagaccgaatccagagcctccaacgcatcgcgtctgctcccctcaaaggagaagcctacaatg

SEQ ID NO: 320841 - DNA, 75 bp, Artificial Sequence
  Synthetic
agcgtatctgacttgacagagccgaccagctactcaatatgcggctccgggtcgttacccataggtgtggccaaa

SEQ ID NO: 320842 - DNA, 75 bp, Artificial Sequence
  Synthetic
cactccctcaggctcgttatagagagcagtcccctaagcagagctgagaaagcagcatatgtaaaattgttatcc

SEQ ID NO: 320843 - DNA, 75 bp, Artificial Sequence
  Synthetic
tactacgggactgatcaggaactcttaaaggcctgcaccgatctcagaattacggtgaggaggactgttcgagca

SEQ ID NO: 320844 - DNA, 75 bp, Artificial Sequence
  Synthetic
aagtgcaagacagatcgagaggttaaggaagtcatggagctcgtagaagaagacatagaatcactgactggttag

SEQ ID NO: 320845 - DNA, 75 bp, Artificial Sequence
  Synthetic
ggagagatgatcgtatacatggtggattcgattggtgctccactcctaccatggtcaggcaggctgagacaggga

SEQ ID NO: 320846 - DNA, 75 bp, Artificial Sequence
  Synthetic
gaactagatgaggcatctaatcatcctcagtcatggagcgacccaatcctttgttagcatcagccagtagagatt

SEQ ID NO: 320847 - DNA, 75 bp, Artificial Sequence
  Synthetic
atgatatttaatgcaaacaaggtcgcactagctccccaatgcctccctgtggacaaggacataagattcagagtg

SEQ ID NO: 320848 - DNA, 75 bp, Artificial Sequence
  Synthetic
aagaaaaacttagggtgaaagaaatttcacccaacaagacacaatggccgacatctacaaattccccaaattctc

SEQ ID NO: 320849 - DNA, 75 bp, Artificial Sequence
  Synthetic
gtgtttgtcaatgggacatctctaggggcaatcaccatagccaagatcccaaagacccttgcagaccttgcattg

SEQ ID NO: 320850 - DNA, 75 bp, Artificial Sequence
  Synthetic
atatgaggacaacggtactgtggaacctctgcctctaagaactggcccagataagaaagctatccctcacatcag

SEQ ID NO: 320851 - DNA, 75 bp, Artificial Sequence
  Synthetic
gattgtcaaggtaggagaccctccgaagcatggagtgagatacttagatttattgctcttgggcttctttgagac

SEQ ID NO: 320852 - DNA, 75 bp, Artificial Sequence
  Synthetic
tggtgacactcaagaccgggatctccacagaacaaaagggggtactcccagtacttgatgatcaaggggagaaaa

SEQ ID NO: 320853 - DNA, 75 bp, Artificial Sequence
  Synthetic
tccgaaacaaacagctagcctagggagtgtgtccgatttaacagagcacactggctactcaatctgcggatccgg

SEQ ID NO: 320854 - DNA, 75 bp, Artificial Sequence
  Synthetic
agctcaattttatggtgcacctcgggttgatcaggagaaaggtcgggaagatatactctgttgagtactgcaaga

SEQ ID NO: 320855 - DNA, 75 bp, Artificial Sequence
  Synthetic
gtcgttacccataggtgtagccaaatattacgggtctgatcaggaactcttaaaggcctgcaccgatctcaaaat

SEQ ID NO: 320856 - DNA, 75 bp, Artificial Sequence
  Synthetic
gcaagattgagagaatgcggctgattttctcacttgggttaatcggcggtataagcttccatgttcaggttactg

SEQ ID NO: 320857 - DNA, 75 bp, Artificial Sequence
  Synthetic
tacagtgaggaggactgttcgagcaggagaaatgatagtatacatggtggattcgatcggtgctccactcctacc

SEQ ID NO: 320858 - DNA, 75 bp, Artificial Sequence
  Synthetic
ggacactatctaagacattcatgagtcagctcgcatggaagagggcagtctgcttcccattaatggatgtgaatc

SEQ ID NO: 320859 - DNA, 75 bp, Artificial Sequence
  Synthetic
atggtcaggcaggctgagacagggaatgatatttaatgctaacaaggtcgcactcgcccctcagtgcctcccggt

SEQ ID NO: 320860 - DNA, 75 bp, Artificial Sequence
  Synthetic
cccatatgaacctggtgatttgggcggcatctgtagaaatcacaggcgtcgatgcggtgttccaaccggccatcc

SEQ ID NO: 320861 - DNA, 75 bp, Artificial Sequence
  Synthetic
cactcgcccctcagtgcctcccggtggataaggacataagattcagagtggtgtttgtcaatgggacatctctgg

SEQ ID NO: 320862 - DNA, 75 bp, Artificial Sequence
  Synthetic
ctcgtgatttccgctactaccctaatgttgtggctaagaacatcggaaggatcagaaagctgtaaatgtgcaccc

SEQ ID NO: 320863 - DNA, 75 bp, Artificial Sequence
  Synthetic
gggcaatcacaatagccaagatcccgaaaactcttgcagaccttgcattgcctaattctatctctgttaacctgc

SEQ ID NO: 320864 - DNA, 75 bp, Artificial Sequence
  Synthetic
tgttgtggctaagaacatcggaaggatcagaaagctgtaaatgtgcacccatcagagacctgcgacaatgcccca

SEQ ID NO: 320865 - DNA, 75 bp, Artificial Sequence
  Synthetic
agcagacaccacctggcagtcggagccaccgggtcactccttgtcttaaataagaaaaacttagggataaagtcc

SEQ ID NO: 320866 - DNA, 75 bp, Artificial Sequence
  Synthetic
tagtgacacttaagaccggaattcccacagaacaaaagggggtactcccggtacttgatgatcaaggagagaaga

SEQ ID NO: 320867 - DNA, 75 bp, Artificial Sequence
  Synthetic
cttgtgagtgcttggttgcaaaactctccccttgggaaacatgacagcatatatccagaggtcacagtgcatctc

SEQ ID NO: 320868 - DNA, 75 bp, Artificial Sequence
  Synthetic
agctcaatttcatggtgcaccttgggttgatcagaagaaaagtcgggaaaatatactccgttgagtactgcaaga

SEQ ID NO: 320869 - DNA, 75 bp, Artificial Sequence
  Synthetic
aacatcactactggttgttctcaccacattggtctcgtgtcagattcccagggataggctctctaacataggggt

SEQ ID NO: 320870 - DNA, 75 bp, Artificial Sequence
  Synthetic
gcaagattgaaaagatgcggcttattttctcccttgggttgatcggcggcataagtttccatgttcaggttactg

SEQ ID NO: 320871 - DNA, 75 bp, Artificial Sequence
  Synthetic
catagtcgatgaagggaaatcactgaagatagctggatcccacgaatcgaggtacatagtactgagtctagttcc

SEQ ID NO: 320872 - DNA, 75 bp, Artificial Sequence
  Synthetic
ggaccctatctaagacatttatgagtcagctcgcatggaagagggcggtctgcttcccattaatggacgtgaatc

SEQ ID NO: 320873 - DNA, 75 bp, Artificial Sequence
  Synthetic
ctcatatgaacttggtgatttgggctgcatctgttgagatcacagatgttgatgcggtgttccaaccggccatcc

SEQ ID NO: 320874 - DNA, 75 bp, Artificial Sequence
  Synthetic
agagcctactgaacaggctgttaatcccattgagggatgccttggatcttcaggaggctctgataactgtcacca

SEQ ID NO: 320875 - DNA, 75 bp, Artificial Sequence
  Synthetic
ctcgtgatttccgctactaccctaatgtcgtggcaaggaacataggaaggatcaggaagctataaatgtgcatct

SEQ ID NO: 320876 - DNA, 75 bp, Artificial Sequence
  Synthetic
caggaggctctgataactgtcaccaatgatacgacacaaaatgccggtgttccacagtcgagattcttcggtgct

SEQ ID NO: 320877 - DNA, 75 bp, Artificial Sequence
  Synthetic
atcagggacctgtggcactactttaagcagccaccactttgcagttggagccacagcattgctccttgtctcaaa

SEQ ID NO: 320878 - DNA, 75 bp, Artificial Sequence
  Synthetic
gtgattggtactatcgcacttggagtggcgacatcagcacagatcaccgcagggattgcactagccgaagcgagg

SEQ ID NO: 320879 - DNA, 75 bp, Artificial Sequence
  Synthetic
taagaaaaacttagggataaagtcccttgttcgtgccttattgtaaaacttctcccctgagaaacatggcgacct

SEQ ID NO: 320880 - DNA, 75 bp, Artificial Sequence
  Synthetic
gaggccaaaagagacatagcgctcatcaaagaatcgatgacaaaaacacacaagtctatagaactgctgcaaaac

SEQ ID NO: 320881 - DNA, 75 bp, Artificial Sequence
  Synthetic
cttgttcgtgccttattgtaaaacttctcccctgagaaacatggcgacctacactctgagagtacagtgcatatc

SEQ ID NO: 320882 - DNA, 75 bp, Artificial Sequence
  Synthetic
tgcattattgacaattgtgctcataaaactagcctcgtgtcaaattcctagggataagctctctaatataggggt

SEQ ID NO: 320883 - DNA, 75 bp, Artificial Sequence
  Synthetic
catagtagatgaagggaaatcactgaagattgctggatcccacgaatcgaggtacatcgtactaagtttagtccc

SEQ ID NO: 320884 - DNA, 75 bp, Artificial Sequence
  Synthetic
ttcggctcgaatttcggaaccatcggagagaagagcctcacgctgcaggcgctgtcttcactttactctgctaac

SEQ ID NO: 320885 - DNA, 75 bp, Artificial Sequence
  Synthetic
aggggttgacctcgagaatgggtgcggaactgttcaggtcatccagtataagagcctactgaaccggttgttaat

SEQ ID NO: 320886 - DNA, 75 bp, Artificial Sequence
  Synthetic
cccactaagagatgccttagaccttcaggaagcactgataactgtcactaatgacacgatgacaaatgccggtgt

SEQ ID NO: 320887 - DNA, 75 bp, Artificial Sequence
  Synthetic
ggaacggtgatagatgtggatctagagagatacatggttaccctgtctgtgaagatccctattctttctgaagtc

SEQ ID NO: 320888 - DNA, 75 bp, Artificial Sequence
  Synthetic
tccacaggcaagattcttcggtgccgtgattggtaccattgcacttggagtagcaacatcagcacagataaccgc

SEQ ID NO: 320889 - DNA, 75 bp, Artificial Sequence
  Synthetic
agagatacatggttaccctgtctgtgaagatccctattctttctgaagtcccaggagtgctcatacacaaggcat

SEQ ID NO: 320890 - DNA, 75 bp, Artificial Sequence
  Synthetic
agggatcgcgctagccgaagcgagggaagccaagagaggcatagcactcataaaagaatcaatgacaaaaacaca

SEQ ID NO: 320891 - DNA, 75 bp, Artificial Sequence
  Synthetic
cgtctatttcttacaacatagacggggaggaatggtatgtgactgtccccagccatatactcagtcgtgcttctt

SEQ ID NO: 320892 - DNA, 75 bp, Artificial Sequence
  Synthetic
gaagccaagagaggcatagcactcataaaagaatcaatgacaaaaacacacaagtccatagaactgctgcaaaac

SEQ ID NO: 320893 - DNA, 75 bp, Artificial Sequence
  Synthetic
tcttagggggtgcagacataaccgattgtgttgagtccagattgacctatatatgccccagggatcccgcacaac

SEQ ID NO: 320894 - DNA, 75 bp, Artificial Sequence
  Synthetic
ttgtgttgagtccagattgacctatatatgccccagggatcccgcacaactgatacctgacagccagcaaaagtg

SEQ ID NO: 320895 - DNA, 75 bp, Artificial Sequence
  Synthetic
gaattaggttgtgaaactgccgctctaagactggggataaaactgacacaacattactctgagttgctgactgca

SEQ ID NO: 320896 - DNA, 75 bp, Artificial Sequence
  Synthetic
tatcctgggggacacaacaaggtgtcctgtcacaaaagttgtggacagccttatccccaagtttgcttttgtgaa

SEQ ID NO: 320897 - DNA, 75 bp, Artificial Sequence
  Synthetic
ttcggatccaattttggaactatcggagaaaagagcctcacactgcaggcgctgtcttcactctactctgctaac

SEQ ID NO: 320898 - DNA, 75 bp, Artificial Sequence
  Synthetic
tgggggcgttgttgctaactgcatagcatccacatgtacctgcgggacaggccgaagaccaatcagtcaggatcg

SEQ ID NO: 320899 - DNA, 75 bp, Artificial Sequence
  Synthetic
atcactgagattatgaccactgtcaggacagggcagtctaacatctatgatgtcatttatacagaacagatcaag

SEQ ID NO: 320900 - DNA, 75 bp, Artificial Sequence
  Synthetic
ctctaaaggtgtagtattcctaacccatgacaactgtggtcttataggtgtcaatggggtagaattgtatgctaa

SEQ ID NO: 320901 - DNA, 75 bp, Artificial Sequence
  Synthetic
catgacaactgtggtcttataggtgtcaatggggtagaattgtatgctaaccggagagggcacgatgccacttgg

SEQ ID NO: 320902 - DNA, 75 bp, Artificial Sequence
  Synthetic
ggaactgtgattgatgtagacctagagagatacatggttaccctgtctgtgaagatccccattctttctgaggtc

SEQ ID NO: 320903 - DNA, 75 bp, Artificial Sequence
  Synthetic
ggggtccagaacttgacagtcggtcctgcaattgctatcagacccgttgatatttctctcaaccttgctgatgct

SEQ ID NO: 320904 - DNA, 75 bp, Artificial Sequence
  Synthetic
ccaggcgtgcttatacacaaggcatcgtctatttcttataatatagacggggaggagtggtatgtaactgtcccc

SEQ ID NO: 320905 - DNA, 75 bp, Artificial Sequence
  Synthetic
cgtctatttcttataatatagacggggaggagtggtatgtaactgtccccagtcatatactcagtcgtgcctcct

SEQ ID NO: 320906 - DNA, 75 bp, Artificial Sequence
  Synthetic
acgaatttcttgcaagactctaaggctgagcttgagaaagcacggaaaatcctctctgaggtaggtagatggtac

SEQ ID NO: 320907 - DNA, 75 bp, Artificial Sequence
  Synthetic
ggaggagtggtatgtaactgtccccagtcatatactcagtcgtgcctccttccttgggggtgcaaacatagtcga

SEQ ID NO: 320908 - DNA, 75 bp, Artificial Sequence
  Synthetic
aactcaagagagactgtgattacgatcatagtagttatggtcgtaatattggtggtcattatagtgatcgtcatc

SEQ ID NO: 320909 - DNA, 75 bp, Artificial Sequence
  Synthetic
ttgtgtagagtccaggttgacctacatatgccccagggatcctgcacaattgatacctgacagtcagcaaaaatg

SEQ ID NO: 320910 - DNA, 75 bp, Artificial Sequence
  Synthetic
tcatagtagttatggtcgtaatattggtggtcattatagtgatcgtcatcgtgctttatagactcaaaaggtcaa

SEQ ID NO: 320911 - DNA, 75 bp, Artificial Sequence
  Synthetic
tatcttgggggatacaacaaggtgtcctgtcacaagggttgtggatagcctcatccccaaatttgcctttgtgaa

SEQ ID NO: 320912 - DNA, 75 bp, Artificial Sequence
  Synthetic
cggaggtgttgtcgctaattgcatagcatcctcgtgtacctgcggaataagccgaagaccaatcagtcaagatcg

SEQ ID NO: 320913 - DNA, 75 bp, Artificial Sequence
  Synthetic
tcagatgtcttgtaaagcaggcatggtatccgttgagatctgtatataataagaaaaacttagggtgaaagtgag

SEQ ID NO: 320914 - DNA, 75 bp, Artificial Sequence
  Synthetic
gtatccgttgagatctgtatataataagaaaaacttagggtgaaagtgaggtcgcgcggtactttagctttcacc

SEQ ID NO: 320915 - DNA, 75 bp, Artificial Sequence
  Synthetic
ctctaaaggtgtggtgttcttaacccatgataactgtggtctgataggagtcaacgggatagaattgtatgctaa

SEQ ID NO: 320916 - DNA, 75 bp, Artificial Sequence
  Synthetic
ccggaaagggggtgatgccacttggggggtccagaatttgacggttggtcctgcaatcgctatcaggcccgtgga

SEQ ID NO: 320917 - DNA, 75 bp, Artificial Sequence
  Synthetic
tggtctacctctcctagtggtagcactacaaaattagcatcaggttgggagaggtcaagtaaagttgacacatgg

SEQ ID NO: 320918 - DNA, 75 bp, Artificial Sequence
  Synthetic
tatttctctcaaccttgctgctgctacggatttcctgcaagactctagagttgagcttgagagggcacgaaaaat

SEQ ID NO: 320919 - DNA, 75 bp, Artificial Sequence
  Synthetic
ttgctgattctctcattcacccagtgggctttgtcaattgccacagtgatcatctgtatcataatttctgctaga

SEQ ID NO: 320920 - DNA, 75 bp, Artificial Sequence
  Synthetic
cctatctgaagtaggtagatggtacaattcaggggcgactttgattacgatcatagtagtcgtgattgtgatatt

SEQ ID NO: 320921 - DNA, 75 bp, Artificial Sequence
  Synthetic
caagggtatagtatgaaagagtactcaatgactgtagaggcattgaacatgagcagcagggaggtgaaagagtca

SEQ ID NO: 320922 - DNA, 75 bp, Artificial Sequence
  Synthetic
agtggtcattatagtgattgtcatcgtgctctacaggctcaggagatcaatgctgacgggtaatccggctggtcg

SEQ ID NO: 320923 - DNA, 75 bp, Artificial Sequence
  Synthetic
cttaccagtctaataaggcaagaggttatcgcaagggctgtcaacattcagagctctgtgcaaaccggaatccca

SEQ ID NO: 320924 - DNA, 75 bp, Artificial Sequence
  Synthetic
ggtatcaagagacacatacacattagagccaaagataaggcatatgtataccaacggtggatttaatgctatgac

SEQ ID NO: 320925 - DNA, 75 bp, Artificial Sequence
  Synthetic
gtcttgttgaacaaaaacagcagggatgtcatccagatgattgataagtcgtgcagcagacaagagctcactcag

SEQ ID NO: 320926 - DNA, 75 bp, Artificial Sequence
  Synthetic
atgtcatccagatgattgataagtcgtgcagcagacaagagctcactcagctctgtgagagtacgatcgcagtcc

SEQ ID NO: 320927 - DNA, 75 bp, Artificial Sequence
  Synthetic
tgggaaaagatgatcacaattcttgttggatgcttgataaagtaggtatggtatttgttgaggtctgtacataat

SEQ ID NO: 320928 - DNA, 75 bp, Artificial Sequence
  Synthetic
aagaaaaacttagggtgaaagttgggccgcttaacactatagctttcacctcaaacaggtacagatcatggatgg

SEQ ID NO: 320929 - DNA, 75 bp, Artificial Sequence
  Synthetic
accatgccgagggaattgccccacttgagccacatagtttctggagatgccctgtcggagaaccgtatcttagct

SEQ ID NO: 320930 - DNA, 75 bp, Artificial Sequence
  Synthetic
tgataaacgcaagcgggattcgtattggtctacctcccctagtggtagcactacaaaattagtatcagactgggg

SEQ ID NO: 320931 - DNA, 75 bp, Artificial Sequence
  Synthetic
cagatcctaaaatctcattgctgcctggtccgagcttgttatctggttctacaacgatctctggatgtgttaggc

SEQ ID NO: 320932 - DNA, 75 bp, Artificial Sequence
  Synthetic
gaggtcaggtaaaattgacacctggttgttgattctcgcattcactcaatgggccttgtcgattgctacagtgat

SEQ ID NO: 320933 - DNA, 75 bp, Artificial Sequence
  Synthetic
tcccttcactctcaattggcgaggcaatctatgcctattcatcaaatctcattacacaaggttgtgctgacatag

SEQ ID NO: 320934 - DNA, 75 bp, Artificial Sequence
  Synthetic
catttgcatcgtgatcgttgctaggcaagggcatagtatgagaaaatattcaacaactatagaggcactgaacat

SEQ ID NO: 320935 - DNA, 75 bp, Artificial Sequence
  Synthetic
atgttccctgatcttaaccccgtagtgtcccacacttatgacatcaacgacaatcggaaatcatgctctgtggtg

SEQ ID NO: 320936 - DNA, 75 bp, Artificial Sequence
  Synthetic
aagtagcaaagaagtaaaggagtcactcaccagtctaataaggcaagaggttatcactagagccgttaacattca

SEQ ID NO: 320937 - DNA, 75 bp, Artificial Sequence
  Synthetic
gcaaccgggactaggggttatcagctttgctccatgccgactgtagacgaaagaaccgactactctagtgatggt

SEQ ID NO: 320938 - DNA, 75 bp, Artificial Sequence
  Synthetic
gagttctgtgcaaactgggatccctgtcttgttgaacaagaacagcagagatgttacccagctgattgaaaagtc

SEQ ID NO: 320939 - DNA, 75 bp, Artificial Sequence
  Synthetic
atcgaggatctggtccttgatgtcctggatctcaaagggagaactaagtctcaccggtatcgcaacagcgaggta

SEQ ID NO: 320940 - DNA, 75 bp, Artificial Sequence
  Synthetic
gtgcaacagacaggatctcacgcagctctgcgatagtacaattgcagttcatcatgctgagggaatcgccccact

SEQ ID NO: 320941 - DNA, 75 bp, Artificial Sequence
  Synthetic
tgaaccacatagcttctggagatgccctgcaggggaaccgtatctcagcccggaccctgaaatctcattgttgcc

SEQ ID NO: 320942 - DNA, 75 bp, Artificial Sequence
  Synthetic
gatcttgatcacccgttctctgcactataccccagtgtaggcaacggcattgaaacagaaggctctttgatattt

SEQ ID NO: 320943 - DNA, 75 bp, Artificial Sequence
  Synthetic
cttgggtatggtgggctaaccacccctctacagggtgatacaaaatgtaggacccgaggatgccaacaggcgtcg

SEQ ID NO: 320944 - DNA, 75 bp, Artificial Sequence
  Synthetic
tggtccaagcctattgtctggttcgacaacgatctctggatgtgttagactcccctcactttcaatcggtgaggc

SEQ ID NO: 320945 - DNA, 75 bp, Artificial Sequence
  Synthetic
caagacacatgcaatgaggctctgaaaattacatggctaggagggaaacaggtggtcaacgtgatcatccaggtc

SEQ ID NO: 320946 - DNA, 75 bp, Artificial Sequence
  Synthetic
gatctatgcctattcgtcaaacctcatcacacaaggctgtgctgacattgggaagtcatatcaggtcctgcagct

SEQ ID NO: 320947 - DNA, 75 bp, Artificial Sequence
  Synthetic
aatgactatctctcagagaggccaaagataagagtcacaaccattccaatcactcaaaactatctcggggcggaa

SEQ ID NO: 320948 - DNA, 75 bp, Artificial Sequence
  Synthetic
agggtacatatcactcaattcagatatgtttcctgacctcaacccagtagtgtctcacacttatgacatcaatga

SEQ ID NO: 320949 - DNA, 75 bp, Artificial Sequence
  Synthetic
atgtttcctgacctcaacccagtagtgtctcacacttatgacatcaatgataaccggaaatcgtgctcggtagtg

SEQ ID NO: 320950 - DNA, 75 bp, Artificial Sequence
  Synthetic
ggtagattattaaaattgggtgatcgggtgtacatctatacaagatcatcaggctggcactctcaactgcagata

SEQ ID NO: 320951 - DNA, 75 bp, Artificial Sequence
  Synthetic
gcaaccgggactaggggttatcagctttgctccatgccgaccgtagacgaaagaactgactactcaagtgatggc

SEQ ID NO: 320952 - DNA, 75 bp, Artificial Sequence
  Synthetic
aggctggcactctcaactgcagataggagtacttgatgtcagccaccctttgactatcaactggacacctcatga

SEQ ID NO: 320953 - DNA, 75 bp, Artificial Sequence
  Synthetic
tgactatcaactggacacctcatgaagccttgtctagaccaggaaataaagagtgcaattggtacaatacgtgtc

SEQ ID NO: 320954 - DNA, 75 bp, Artificial Sequence
  Synthetic
atagaagatgtggtccttgacatcctagatctcaaaggaagaaccaagtcccaccggtatagcaacagcgaggta

SEQ ID NO: 320955 - DNA, 75 bp, Artificial Sequence
  Synthetic
tagatctcaaaggaagaaccaagtcccaccggtatagcaacagcgaggtagattttgaccacccgtattctgcac

SEQ ID NO: 320956 - DNA, 75 bp, Artificial Sequence
  Synthetic
cgaaggaatgcatatcaggcgtatacactgatgcttatccattgtcccctgatgcagctaacgtcgctaccgtca

SEQ ID NO: 320957 - DNA, 75 bp, Artificial Sequence
  Synthetic
tataccccagtgtgggcagcggcattgcaacagaaggttcactgatgttcctcgggtatggtgggctaaccaccc

SEQ ID NO: 320958 - DNA, 75 bp, Artificial Sequence
  Synthetic
cgctatatgccaatacatcgcgtgtcaacccaacaatcatgtattctaacactactaacattataaatatgttaa

SEQ ID NO: 320959 - DNA, 75 bp, Artificial Sequence
  Synthetic
cattgcaaggtgacacgaagtgtaggacccaaggatgccaacaggtgtcgcaagacacatgcaatgaagccctga

SEQ ID NO: 320960 - DNA, 75 bp, Artificial Sequence
  Synthetic
ggataaaggatgttcaattagaggctgcatataccacgacatcgtgtatcacgcattttggtaaaggctactgct

SEQ ID NO: 320961 - DNA, 75 bp, Artificial Sequence
  Synthetic
agattacatggctgggggggaagcaggtggtcaatgtgctcatccaagtcaacgactatctctcagagagaccaa

SEQ ID NO: 320962 - DNA, 75 bp, Artificial Sequence
  Synthetic
ttcacatcatcgagatcaatcagaagagcctgaataccttacagccgatgctctttaagactagcatccctaaat

SEQ ID NO: 320963 - DNA, 75 bp, Artificial Sequence
  Synthetic
aacgactatctctcagagagaccaaagataagagtcacaactattccagtcactcagaactacctcggagcggag

SEQ ID NO: 320964 - DNA, 75 bp, Artificial Sequence
  Synthetic
ctctttaagactagcatccctaaattatgcaaggccgagtcttaaatttaactgactagcaggcttgtcggcctt

SEQ ID NO: 320965 - DNA, 75 bp, Artificial Sequence
  Synthetic
ggcagattattaaaattgggtgatcaagtgtacatctacacgagatcgtcaggttggcactctcaactgcagata

SEQ ID NO: 320966 - DNA, 75 bp, Artificial Sequence
  Synthetic
gctgacactagagtcatctccgaacatccacaatatctctcagtctcttacgtctctcacagtattaagaaaaac

SEQ ID NO: 320967 - DNA, 75 bp, Artificial Sequence
  Synthetic
ggggtacttgatatcagccaccccttgactatcaactggacgcctcatgaggccttgtctaggccaggaaatgga

SEQ ID NO: 320968 - DNA, 75 bp, Artificial Sequence
  Synthetic
ccagggtgaatgggaagcttgccataggtcatggatgggcaggagtcctcccaaaacccttctgacatactctat

SEQ ID NO: 320969 - DNA, 75 bp, Artificial Sequence
  Synthetic
gagtgcaattggtacaatacttgtccgagggaatgcatatcaggtgtgtataccgacgcttatcccctatcccct

SEQ ID NO: 320970 - DNA, 75 bp, Artificial Sequence
  Synthetic
ccagaatgccacctgaactctcccatagtcagggggaagatagcacagttgcacgtcttgttagatgtgaaccag

SEQ ID NO: 320971 - DNA, 75 bp, Artificial Sequence
  Synthetic
gatgcagctaatgtagccaccgtcacgttatatgccaacacttcacgtgttaatccaacgatcatgtattccaac

SEQ ID NO: 320972 - DNA, 75 bp, Artificial Sequence
  Synthetic
ccctacagactgaaggacgacagcataataaatattacaaagcacaaaattaggaacggaggattgtcccctcgt

SEQ ID NO: 320973 - DNA, 75 bp, Artificial Sequence
  Synthetic
actaccaacattataaatatgttgaggataaaagacgtccgactggaggctgcatacaccacaacatcgtgcatc

SEQ ID NO: 320974 - DNA, 75 bp, Artificial Sequence
  Synthetic
aggctcttcaacgcacaataaaggatttagaccgatacacgtttgaaccgtacccaacctactctcaggaattac

SEQ ID NO: 320975 - DNA, 75 bp, Artificial Sequence
  Synthetic
ttaggcttgatataccagagatatgtgacaaaatccgatccgtcttcgcggtctcggatcggctgaccagggagt

SEQ ID NO: 320976 - DNA, 75 bp, Artificial Sequence
  Synthetic
ctctttaagaccagcatcccgaaactatgcagggtcgagccataaacttcactaatcagcgggctggtcggcctt

SEQ ID NO: 320977 - DNA, 75 bp, Artificial Sequence
  Synthetic
tatctagtgggttccaggatctttggttgaatatcttcaagcaactaggcaatatagaaggaagagaggggtacg

SEQ ID NO: 320978 - DNA, 75 bp, Artificial Sequence
  Synthetic
gttgaatatcttcaagcaactaggcaatatagaaggaagagaggggtacgatccgttgcaggatatcagcaccat

SEQ ID NO: 320979 - DNA, 75 bp, Artificial Sequence
  Synthetic
gatggcacgggggtcatcaatgtacatccacaatatctcctggtatctcacatctcccatagtattaagaaaaac

SEQ ID NO: 320980 - DNA, 75 bp, Artificial Sequence
  Synthetic
atccacaatatctcctggtatctcacatctcccatagtattaagaaaaacccagggtgaatgggaagcctgtcat

SEQ ID NO: 320981 - DNA, 75 bp, Artificial Sequence
  Synthetic
cccggagataactgataagtacagcaggaatagatggtataggccattcctaacttggttcagcatcaaatatga

SEQ ID NO: 320982 - DNA, 75 bp, Artificial Sequence
  Synthetic
aggccatggacaggcaagagtcctcccaaaacccttctgatatactctatccagaatgtcacctgaactccccta

SEQ ID NO: 320983 - DNA, 75 bp, Artificial Sequence
  Synthetic
tagtgagggggaagattgcacagctgcacgttttgttagatgttaaccagccttatagtctgaaagacgacagca

SEQ ID NO: 320984 - DNA, 75 bp, Artificial Sequence
  Synthetic
attcacataacctcctagaatgcaaatcatacactctagtaacatacggagatcttgtcatgatactgaacaagt

SEQ ID NO: 320985 - DNA, 75 bp, Artificial Sequence
  Synthetic
taatcaatatcacaaaacacaagatcaggaatggtggactatcccctcgccaaattaagatcagatctctaggca

SEQ ID NO: 320986 - DNA, 75 bp, Artificial Sequence
  Synthetic
tgacattgacagggtatatcctaacccctgagctggtcttgatgtattgtgatgttgtagagggaaggtggaata

SEQ ID NO: 320987 - DNA, 75 bp, Artificial Sequence
  Synthetic
aggctctccaacgcacaataaaggatctggaccggtacacgtttgaaccgtacccaacctattctcaggagttat

SEQ ID NO: 320988 - DNA, 75 bp, Artificial Sequence
  Synthetic
tgtctgctgcagggcatctagataagaggtccattgggataacaagcaaaggtgaggaattatgggaactagtgg

SEQ ID NO: 320989 - DNA, 75 bp, Artificial Sequence
  Synthetic
ttagactcgatataccagagatatgtgacaagatccgatctgttttcgcagtctcggatcggctaacaaaggagt

SEQ ID NO: 320990 - DNA, 75 bp, Artificial Sequence
  Synthetic
attccctcttctcaagtcttggagaggaaatatacaatgtcatcgcactattggagcccctatcacttgctctca

SEQ ID NO: 320991 - DNA, 75 bp, Artificial Sequence
  Synthetic
tatctaatgggtttcaggatctctggttgaatatctttaagcaactaggtaatatagaaggaagagaggggtacg

SEQ ID NO: 320992 - DNA, 75 bp, Artificial Sequence
  Synthetic
atccattgcaggacattagcaccatccctgagataactgataagtatagcaggaacaaatggtataggccattcc

SEQ ID NO: 320993 - DNA, 75 bp, Artificial Sequence
  Synthetic
tctacgtggggcatttatgaggcatgtgttgacagagctacagactgttttaacaagcagagacgtgtacacaga

SEQ ID NO: 320994 - DNA, 75 bp, Artificial Sequence
  Synthetic
tgctgaagcagacactattgtggagtcgttactcgccattttccttggaacctctattgatgagaaagcagagat

SEQ ID NO: 320995 - DNA, 75 bp, Artificial Sequence
  Synthetic
taacttggttcagtatcaaatatgacatgcggtggatgcaaaaaactaggccagggggacctcttgatacctcca

SEQ ID NO: 320996 - DNA, 75 bp, Artificial Sequence
  Synthetic
cttttccttctttaggacatttggccaccccagcttagaggctgtcactgccgccgacaaggtaagggcccatat

SEQ ID NO: 320997 - DNA, 75 bp, Artificial Sequence
  Synthetic
actcacataatctcctagagtgcaaatcatacactctagtaacatatggagatcttgtcatgatactgaataagt

SEQ ID NO: 320998 - DNA, 75 bp, Artificial Sequence
  Synthetic
gtatgcacaaaaggcaataaagcttaagaccctatacgagtgtcatgcagttttttgcactatcatcataaatgg

SEQ ID NO: 320999 - DNA, 75 bp, Artificial Sequence
  Synthetic
tgacactgacagggtatattctgacacctgagctggtgttaatgtattgtgatgttgtggaagggaggtggaaca

SEQ ID NO: 321000 - DNA, 75 bp, Artificial Sequence
  Synthetic
gtatagagagaggcatggcggacagtggcccccctgtgacttccctgatcacgtgtgtctagaactaaggaacgc

SEQ ID NO: 321001 - DNA, 75 bp, Artificial Sequence
  Synthetic
tgtctgctgcagggcagttagataagaggtcctctgggataacaagcaaaggggaggagctatggaggctagtgg

SEQ ID NO: 321002 - DNA, 75 bp, Artificial Sequence
  Synthetic
tcaagggtccaatacggcaatctcttatgaatgtgctgtagacaactatacaagtttcataggcttcaagtttcg

SEQ ID NO: 321003 - DNA, 75 bp, Artificial Sequence
  Synthetic
attccctcttttcaagtctcggggaagagatatacaatgtcatcgcattactcgagcctttatcacttgctctta

SEQ ID NO: 321004 - DNA, 75 bp, Artificial Sequence
  Synthetic
ctcgagcctttatcacttgctcttatacagttaagtgatcctgttatacctctacgtggtgcattcatgaggcat

SEQ ID NO: 321005 - DNA, 75 bp, Artificial Sequence
  Synthetic
gaagtttatagaaccacaactagatgaagatctcacaatatatatgaaagacaaagcactatcccccaggaagga

SEQ ID NO: 321006 - DNA, 75 bp, Artificial Sequence
  Synthetic
tacagttaagtgatcctgttatacctctacgtggtgcattcatgaggcatgtgttgacagagcttcagactgttt

SEQ ID NO: 321007 - DNA, 75 bp, Artificial Sequence
  Synthetic
acaaagcactatcccccaggaaggaggcatgggactctgtatacccggatagtaatctgtactataaagccccgg

SEQ ID NO: 321008 - DNA, 75 bp, Artificial Sequence
  Synthetic
taacaaacaaggacgtgtatacggatcctgaggcagatgccattgtggagtcgttactggctatcttccatggaa

SEQ ID NO: 321009 - DNA, 75 bp, Artificial Sequence
  Synthetic
agtctgaagagacccggcggcttattgaagtgttcataaatgatgagaatttcaacccagaagaaattatcaatt

SEQ ID NO: 321010 - DNA, 75 bp, Artificial Sequence
  Synthetic
tcgttactggctatcttccatggaacttctattgatgagaaagcagagatcttttcattctttcggacattcggt

SEQ ID NO: 321011 - DNA, 75 bp, Artificial Sequence
  Synthetic
atgtggagtcaggagattggttgaaagacgagaagttcaacatctcgtacagtctcaaagagaaagagatcaagc

SEQ ID NO: 321012 - DNA, 75 bp, Artificial Sequence
  Synthetic
catcctagcttagaggccgtcactgcagctgacaaggtacgggctcatatgtatgcacagaaggcaataaagctt

SEQ ID NO: 321013 - DNA, 75 bp, Artificial Sequence
  Synthetic
aagagggtcgtctattcgcaaaaatgacttataagatgcgagccgtacaggtgctggcagagacactactggcta

SEQ ID NO: 321014 - DNA, 75 bp, Artificial Sequence
  Synthetic
aagaccttacacgagtgtcacgcagtattctgtacaatcatcataaatggatacagggaaaggcatggcggacag

SEQ ID NO: 321015 - DNA, 75 bp, Artificial Sequence
  Synthetic
tggcccccctgtgatttccctgaccatgtgtgcctggaacttagaaatgctcaagggtccaatacggctatctcc

SEQ ID NO: 321016 - DNA, 75 bp, Artificial Sequence
  Synthetic
aaatgggatggttaaaggagagatagacctacttaaaagattgactactctttctgtctcaggcgtccccaggac

SEQ ID NO: 321017 - DNA, 75 bp, Artificial Sequence
  Synthetic
atgtgtgcctggaacttagaaatgctcaagggtccaatacggctatctcctacgagtgtgccgtagacaattata

SEQ ID NO: 321018 - DNA, 75 bp, Artificial Sequence
  Synthetic
tttctgtctcaggcgtccccaggactgattcagtgtacaataactctaaatcatcagagaagagaaacgaaggca

SEQ ID NO: 321019 - DNA, 75 bp, Artificial Sequence
  Synthetic
tcatcagagaagagaaacgaaggcatgaaaaagaagaactctggggggtactgggacgaaaagaagaggtccagg

SEQ ID NO: 321020 - DNA, 75 bp, Artificial Sequence
  Synthetic
acaaagcattatcgcctaggagagaggcatgggactctgtgtatccagatagtaacctgtactacaaagttccag

SEQ ID NO: 321021 - DNA, 75 bp, Artificial Sequence
  Synthetic
catgaattcaaggcaacagattcatcaacagacggctatgaaacgttaagttgcttcctcacaacagacctcaag

SEQ ID NO: 321022 - DNA, 75 bp, Artificial Sequence
  Synthetic
agtctgaggagaccaggcggctcatcgaagtatttataaatgatgagaacttcaacccagaggacataatagatt

SEQ ID NO: 321023 - DNA, 75 bp, Artificial Sequence
  Synthetic
aaatactgcttaaactggagatttgagagtactgcattgtttggtcagagatgcaacgagatatttggcttcaag

SEQ ID NO: 321024 - DNA, 75 bp, Artificial Sequence
  Synthetic
acgtggaatcaggagactggttgaaagatgagaagttcaacatctcgtatagtttgaaagagaaagagatcaaac

SEQ ID NO: 321025 - DNA, 75 bp, Artificial Sequence
  Synthetic
accttctttaactggatgcatccagtccttgaaaggtgtacaatatatgttggagatccttactgtccagtcgcc

SEQ ID NO: 321026 - DNA, 75 bp, Artificial Sequence
  Synthetic
aagagggccgtctgttcgcaaagatgacttataaaatgcgggccgtacaggtactagcggagacactgctggcga

SEQ ID NO: 321027 - DNA, 75 bp, Artificial Sequence
  Synthetic
gaccggatgcatcgacaactccaggatcatgcagactctggcattttcatacataatcctagggggggcatagaa

SEQ ID NO: 321028 - DNA, 75 bp, Artificial Sequence
  Synthetic
aaggaataggagaattgttcagcgagaatggaatggtaaaaggagagatagacttacttaaaagactaactaccc

SEQ ID NO: 321029 - DNA, 75 bp, Artificial Sequence
  Synthetic
ggttactgccagaagctgtggaccttaatctcaatcagtgcaatccacctagcagctgtgagagtgggtgtcagg

SEQ ID NO: 321030 - DNA, 75 bp, Artificial Sequence
  Synthetic
gtctctgcaatggttcagggtgacaatcaagctatagccgtgacatcaagagtacctgtagctcagacttacaag

SEQ ID NO: 321031 - DNA, 75 bp, Artificial Sequence
  Synthetic
atcaagctatagccgtgacatcaagagtacctgtagctcagacttacaagcagaagaaaaatcatgtctatgagg

SEQ ID NO: 321032 - DNA, 75 bp, Artificial Sequence
  Synthetic
agtacctgtagctcagacttacaagcagaagaaaaatcatgtctatgaggaaaccaccaaatatttcgatgctct

SEQ ID NO: 321033 - DNA, 75 bp, Artificial Sequence
  Synthetic
ctgggacgaaaagaagagatcgagacatgaatttaaggcaacagattcatcaacagacggatatgagacgttaag

SEQ ID NO: 321034 - DNA, 75 bp, Artificial Sequence
  Synthetic
tgattcagtgtacaataatcctagatcatcagagaagagaaatgaaggcataaggaagaggaactcaaaggggta

SEQ ID NO: 321035 - DNA, 75 bp, Artificial Sequence
  Synthetic
aagacacgtcatgtttgatgtagggcacgagctaaaattgaacgagaccatcattagtagcaagatgtttgtcta

SEQ ID NO: 321036 - DNA, 75 bp, Artificial Sequence
  Synthetic
tagtaaaaggatatactatgatgggaagattttaccacagtgcctgaaagccttgaccaggtgtgtattctggtc

SEQ ID NO: 321037 - DNA, 75 bp, Artificial Sequence
  Synthetic
accttttttaactggatgcatccagtcctcgaaaagtgtacaatatatgttggagacccttactgtccggtcgct

SEQ ID NO: 321038 - DNA, 75 bp, Artificial Sequence
  Synthetic
gtgcaacgagatatttggcttcaagaccttttttaactggatgcatccagtcctcgaaaagtgtacaatatatgt

SEQ ID NO: 321039 - DNA, 75 bp, Artificial Sequence
  Synthetic
cgagacactggtagatgaaaacagatctgcttgttcgaacatctcaacatccatagcaaaagctatcgaaaatgg

SEQ ID NO: 321040 - DNA, 75 bp, Artificial Sequence
  Synthetic
gacaggatgcatcaacaactgcaagatcatgcagactctggcatcttcatacacaatcctagggggggaatagaa

SEQ ID NO: 321041 - DNA, 75 bp, Artificial Sequence
  Synthetic
gtattctcctatactaggctactgcattgcgttgtataagacctgtcagcaggtgtgcatatcactagggatgac

SEQ ID NO: 321042 - DNA, 75 bp, Artificial Sequence
  Synthetic
acacaatcctagggggggaatagaaggttattgccagaaactatggaccttaatctcaatcagtgctatccacct

SEQ ID NO: 321043 - DNA, 75 bp, Artificial Sequence
  Synthetic
tataaatccaactatcagcccgaccgtaagagatcaatactttaagggtaagaattggctgagatgtgcagtgtt

SEQ ID NO: 321044 - DNA, 75 bp, Artificial Sequence
  Synthetic
agcagctgtgagagtgggtgtcagggtctctgcaatggtccagggcgacaatcaagctatagcggtgacatcaag

SEQ ID NO: 321045 - DNA, 75 bp, Artificial Sequence
  Synthetic
gattccagcaaatgttggaggattcaactacatgtctacatctagatgctttgttagaaatattggagaccccgc

SEQ ID NO: 321046 - DNA, 75 bp, Artificial Sequence
  Synthetic
ggtacctgtagcccagacttataagcagaagaaaaatcatgtctatgaagagatcactcgctatttcagtgctct

SEQ ID NO: 321047 - DNA, 75 bp, Artificial Sequence
  Synthetic
agtagcagccctagctgatctcaaaagattcatcagagcggatctgttagacaagcaggtattatacagggtcat

SEQ ID NO: 321048 - DNA, 75 bp, Artificial Sequence
  Synthetic
gagacatgtcatgtttgatatagggcatgagctaaagttgaatgagactatcattagtagcaaaatgtttgtcta

SEQ ID NO: 321049 - DNA, 75 bp, Artificial Sequence
  Synthetic
catgagctaaagttgaatgagactatcattagtagcaaaatgtttgtctacagcaaaaggatatattatgatggg

SEQ ID NO: 321050 - DNA, 75 bp, Artificial Sequence
  Synthetic
gaatcaagaacccggtgactctagctttctagattgggcttcagacccttattcgtgtaacctcccgcattctca

SEQ ID NO: 321051 - DNA, 75 bp, Artificial Sequence
  Synthetic
aaaatcctaccacaatgtctaaaagccttgaccagatgtgtattctggtctgagacgttggtagatgagaacagg

SEQ ID NO: 321052 - DNA, 75 bp, Artificial Sequence
  Synthetic
gagtataactacgattataaagaatatcactgctagatctgtgctgcaggaatccccgaatcctctactgtctgg

SEQ ID NO: 321053 - DNA, 75 bp, Artificial Sequence
  Synthetic
tgagacgttggtagatgagaacaggtctgcctgctcaaatatctcaacatctatagccaaggccatagaaaatgg

SEQ ID NO: 321054 - DNA, 75 bp, Artificial Sequence
  Synthetic
gtattctcctatactgggctactgcattgcgttgtacaagacctgtcagcaggtgtgtatttcactggggatgac

SEQ ID NO: 321055 - DNA, 75 bp, Artificial Sequence
  Synthetic
gaggatctcaacctggcctcgttccttatggaccggaaagtcatcctgccgagagtggctcatgagatcctgggt

SEQ ID NO: 321056 - DNA, 75 bp, Artificial Sequence
  Synthetic
tataaatccaacaatcaacccgaccgtaagagatcagtactttaagggtaaaaactggctgagatgtgcagtatt

SEQ ID NO: 321057 - DNA, 75 bp, Artificial Sequence
  Synthetic
aattccttaactggagttagggaggcgattgcagggatgcttgatacgaccaagtctctagtgagagccagcgtt

SEQ ID NO: 321058 - DNA, 75 bp, Artificial Sequence
  Synthetic
aattccggccaatgttgggggattcaactacatgtctacatctaggtgcttcgtcaggaatatcggggatcctgc

SEQ ID NO: 321059 - DNA, 75 bp, Artificial Sequence
  Synthetic
aggaaaggaggattatcatatgggatattgaggaggcttgtcaattatgatctattgcagtacgagacactgact

SEQ ID NO: 321060 - DNA, 75 bp, Artificial Sequence
  Synthetic
agtagcggccctggccgatctcaagaggttcatcagagcggatctgctagataagcaagtgttgtacagggtcat

SEQ ID NO: 321061 - DNA, 75 bp, Artificial Sequence
  Synthetic
agaactctcaggaaaccggtgaaagacaacatcgaatatgagtatatgtgttcagttgagctagctgtcggtcta

SEQ ID NO: 321062 - DNA, 75 bp, Artificial Sequence
  Synthetic
ataagcaagtgttgtacagggtcatgaatcaagaacccggtgattctagcttcctagattgggcttcagatccct

SEQ ID NO: 321063 - DNA, 75 bp, Artificial Sequence
  Synthetic
attcatgtaaccttccgcattcccagagtataactacaattataaagaatatcactgctaggtctgtgctgcagg

SEQ ID NO: 321064 - DNA, 75 bp, Artificial Sequence
  Synthetic
agaaacaccagaccctttagagctcttgaggggaacatttatcgaaggttcagaggtgtgcaagctttgcaggtc

SEQ ID NO: 321065 - DNA, 75 bp, Artificial Sequence
  Synthetic
cagaggtgtgcaagctttgcaggtctgaaggagcagaccccatctatacatggttctatcttcctgacaatatag

SEQ ID NO: 321066 - DNA, 75 bp, Artificial Sequence
  Synthetic
aatccccgaaccccttgctgtctggtcttttcacagagtccagtggcgaagaggatctcaacctggccgcgttcc

SEQ ID NO: 321067 - DNA, 75 bp, Artificial Sequence
  Synthetic
acctggacacgcttacaaacggaagtccggctataagaatcccctattttggatcagccactgatgaaaggtcgg

SEQ ID NO: 321068 - DNA, 75 bp, Artificial Sequence
  Synthetic
ttatggaccggaaagtcatcctaccgagagtagctcatgagatcctgggcaattccttaacaggggttagagaag

SEQ ID NO: 321069 - DNA, 75 bp, Artificial Sequence
  Synthetic
aagcccaactcgggtatgtaagaaatctaagcaaacccgcaaaggcggccatccggatagctatggtgtatacgt

SEQ ID NO: 321070 - DNA, 75 bp, Artificial Sequence
  Synthetic
caattgcagggatgcttgatacaaccaagtctctggtgagggcaagcgttaagaagggagggttgtcatatggga

SEQ ID NO: 321071 - DNA, 75 bp, Artificial Sequence
  Synthetic
caagtctctggtgagggcaagcgttaagaagggagggttgtcatatgggatattgaggagacttgtcaactatga

SEQ ID NO: 321072 - DNA, 75 bp, Artificial Sequence
  Synthetic
gggcctacgggactgatgagatatcgtggatggaagccgctcttatagcccaaacaagagctaatctgagcttag

SEQ ID NO: 321073 - DNA, 75 bp, Artificial Sequence
  Synthetic
tctgttgcagtacgagacactgactagaactctcaggaagccggtgaaagataacattgagtatgagtatatgtg

SEQ ID NO: 321074 - DNA, 75 bp, Artificial Sequence
  Synthetic
agaatctaaagctgctgactcctgtttcaacctccactaatctatctcataggttgaaagatacggcaacccaga

SEQ ID NO: 321075 - DNA, 75 bp, Artificial Sequence
  Synthetic
ttccgttgagctggctgtcggtttaaggcagaaaatgtggatccacctgacgtatgggagacccatacatgggct

SEQ ID NO: 321076 - DNA, 75 bp, Artificial Sequence
  Synthetic
tgaagttctctagtgcaacactagtccgtgcaagtcggttcataacaatatcaaatgataacatggcactcaaag

SEQ ID NO: 321077 - DNA, 75 bp, Artificial Sequence
  Synthetic
agaaacaccagatcctttagagctcttgagggggacatttattgagggctcggaggtctgcaagctttgcaggtc

SEQ ID NO: 321078 - DNA, 75 bp, Artificial Sequence
  Synthetic
aagcaggggagtcgaaggatactaatctcgtgtatcagcagattatgctaactgggctaagcttgttcgagttca

SEQ ID NO: 321079 - DNA, 75 bp, Artificial Sequence
  Synthetic
tgaaggaacggaccctatctatacatggttttacctcccggacaatatagacttggatacacttacaaacgggag

SEQ ID NO: 321080 - DNA, 75 bp, Artificial Sequence
  Synthetic
atatgagatataagaaaggttccttagggaagccactgatattgcacttacatcttaataacgggtgctgtataa

SEQ ID NO: 321081 - DNA, 75 bp, Artificial Sequence
  Synthetic
cccggctataaggattccctacttcggatcagccactgatgaaagatcggaagctcaacttggatacgtaaggaa

SEQ ID NO: 321082 - DNA, 75 bp, Artificial Sequence
  Synthetic
tggagtccccacaggaggcgaatatccccccaaggtccacattagatttagagattacacaagagaacaataaat

SEQ ID NO: 321083 - DNA, 75 bp, Artificial Sequence
  Synthetic
tctaagcaaaccagcaaaggcagctatccggatagctatggtgtacacgtgggcctacgggaccgatgaggtatc

SEQ ID NO: 321084 - DNA, 75 bp, Artificial Sequence
  Synthetic
tgatctatgatcctgatccactcaaggatgtggaccttgagctatttagcaaggtcagagatgttgtacatacag

SEQ ID NO: 321085 - DNA, 75 bp, Artificial Sequence
  Synthetic
gggcctacgggaccgatgaggtatcgtggatggaagctgctctcatagcccaaacaagagctaatctgagcctgg

SEQ ID NO: 321086 - DNA, 75 bp, Artificial Sequence
  Synthetic
ttgacatgacttattggtcagatgatgaagttatcagagcaaccagcatctgtactgcaatgacgatagctgata

SEQ ID NO: 321087 - DNA, 75 bp, Artificial Sequence
  Synthetic
aaaatctaaaactgctgactcctgtttcaacatccacgaatctctctcataggttaaaggacacagcaacccaga

SEQ ID NO: 321088 - DNA, 75 bp, Artificial Sequence
  Synthetic
tgtactgcaatgacgatagctgatacaatgtctcaattagatagagataacttaaaagagatgatcgcactagta

SEQ ID NO: 321089 - DNA, 75 bp, Artificial Sequence
  Synthetic
tgaagttctccagtgcaacactggtccgtgcaagtcggttcataacaatatcaaatgacaacatggcactcaagg

SEQ ID NO: 321090 - DNA, 75 bp, Artificial Sequence
  Synthetic
aatgacgatgatgtcaacagcttgattactgagtttatggtgattgatgttcctttattttgctcaacgttcggg

SEQ ID NO: 321091 - DNA, 75 bp, Artificial Sequence
  Synthetic
aagcaggagagtcgaaggacactaatctcgtgtatcagcagattatgctaactgggctaagcttgttcgaattca

SEQ ID NO: 321092 - DNA, 75 bp, Artificial Sequence
  Synthetic
ggtatcctagtcaatcagtttgcatactcactctacggcttaaacatcagaggaagggaagaaatatggggacat

SEQ ID NO: 321093 - DNA, 75 bp, Artificial Sequence
  Synthetic
atatgaggtataagaaaggttccttagagaagccactgatattacacttacatcttaataacgggtgctgtataa

SEQ ID NO: 321094 - DNA, 75 bp, Artificial Sequence
  Synthetic
aggaagggaagaaatatggggacatgtagtccggattcttaaagatacctcccacgcagttctaaaagtcttatc

SEQ ID NO: 321095 - DNA, 75 bp, Artificial Sequence
  Synthetic
tggagtccccacaggaggcaaatatccctccaagatctacactggatttggagatcacacaggaaaacaataaat

SEQ ID NO: 321096 - DNA, 75 bp, Artificial Sequence
  Synthetic
taatgctctatcccatcccaaaatcttcaaacgattctggaatgcaggtgtcgtggaacctgtgtatgggcctaa

SEQ ID NO: 321097 - DNA, 75 bp, Artificial Sequence
  Synthetic
ttcaaacgattctggaatgcaggtgtcgtggaacctgtgtatgggcctaacctctcaaatcaggataagatactc

SEQ ID NO: 321098 - DNA, 75 bp, Artificial Sequence
  Synthetic
tgatctatgaccctgatccactcaaggatgtggaccttgagctatttagcaaggtcagagatgtcgtacatacag

SEQ ID NO: 321099 - DNA, 75 bp, Artificial Sequence
  Synthetic
ttggccctctctgtctgtgaatattctgtggatctattcatgcacgactggcaagggggtgtaccgcttgagatc

SEQ ID NO: 321100 - DNA, 75 bp, Artificial Sequence
  Synthetic
ttgacatgacttattggtcggatgacgaagtcatcagggcgaccagcatatgtactgcaatgacaatagccgaca

SEQ ID NO: 321101 - DNA, 75 bp, Artificial Sequence
  Synthetic
tttatctgtgacaatgacccagatgtggccgacatgaggaggtcctctttcttggcaagacatcttgcataccta

SEQ ID NO: 321102 - DNA, 75 bp, Artificial Sequence
  Synthetic
caatgtctcaattagatagagacaatctaaaagagatgatagcactagtaaatgatgacgatgttaacagcttga

SEQ ID NO: 321103 - DNA, 75 bp, Artificial Sequence
  Synthetic
tgcagcttggcagagatatctagggatgggccaagattagaatcaatgaactctctagagaggctcgagtcacta

SEQ ID NO: 321104 - DNA, 75 bp, Artificial Sequence
  Synthetic
ttactgagttcatggtggttgatgttcctctattttgctcaacattcgggggtatcctagtcaatcagtttgcat

SEQ ID NO: 321105 - DNA, 75 bp, Artificial Sequence
  Synthetic
aagagttacctggaactcacatttcttgatgacccggtactgaggtacagtcagttgactggcctagtcatcaaa

SEQ ID NO: 321106 - DNA, 75 bp, Artificial Sequence
  Synthetic
actcactctacggattgaacatcagagggagagaagaaatatggggacatgtagtccggattctgaaagatacct

SEQ ID NO: 321107 - DNA, 75 bp, Artificial Sequence
  Synthetic
gtattcccatctactttgacctatatccggaagtcatctataaaagtgttaaggacaagaggtataggagtccct

SEQ ID NO: 321108 - DNA, 75 bp, Artificial Sequence
  Synthetic
cccacgcagttctgaaagtcttatctaatgctttatcccatccaaagatcttcaagcgattttggaatgcaggtg

SEQ ID NO: 321109 - DNA, 75 bp, Artificial Sequence
  Synthetic
gaagtcttagaagattgggatcccgaggcagataatgcactgttagatggtatcgcggcagaaatacaacagaat

SEQ ID NO: 321110 - DNA, 75 bp, Artificial Sequence
  Synthetic
ttgtagaacctgtgtatgggcctaacctctcaaatcaggataagacactcctggccctctctgtatgtgaatatt

SEQ ID NO: 321111 - DNA, 75 bp, Artificial Sequence
  Synthetic
cctctcaaatcaggataagacactcctggccctctctgtatgtgaatattctgtagatctatttatgcatgactg

SEQ ID NO: 321112 - DNA, 75 bp, Artificial Sequence
  Synthetic
attcctttgggacatcagactagagcccctttttgggggttgagagtatccaagtcacaggtactgcgcctccgg

SEQ ID NO: 321113 - DNA, 75 bp, Artificial Sequence
  Synthetic
gacgttaccattcgatggaagatacctatctcaccagctgaggctctttggcatcaacagtactagctgcttgaa

SEQ ID NO: 321114 - DNA, 75 bp, Artificial Sequence
  Synthetic
cttggctagacatcttgcatacctgtgcagcttggcagagatatctagggatgggccaagactagaatcaatgac

SEQ ID NO: 321115 - DNA, 75 bp, Artificial Sequence
  Synthetic
agcacttgaacttacctacctattgagccccttagttgacaaggataaagataggctatatttaggggaaggagc

SEQ ID NO: 321116 - DNA, 75 bp, Artificial Sequence
  Synthetic
agccccttagttgacaaggataaagataggctatatttaggggaaggagctggggccatgctttcctgttatgac

SEQ ID NO: 321117 - DNA, 75 bp, Artificial Sequence
  Synthetic
atcccttgagaggctagactctttaaagagctatctggaactcacatttcttgatgaccctatactgaggtacag

SEQ ID NO: 321118 - DNA, 75 bp, Artificial Sequence
  Synthetic
tcaattgactggcttagtcatcaaagtattcccgtcaactctgacctacatccggaagtcatctataaaagtatt

SEQ ID NO: 321119 - DNA, 75 bp, Artificial Sequence
  Synthetic
aagaacgagaggtataggagtccccgaagtcttagaggattgggatcccgatgcggataatgcactgctagacgg

SEQ ID NO: 321120 - DNA, 75 bp, Artificial Sequence
  Synthetic
aatatatatcctgctgaggtggcactagtgggaaagaaattaaacaatgttactagtctgggtcaaagagttaaa

SEQ ID NO: 321121 - DNA, 75 bp, Artificial Sequence
  Synthetic
tactagtctgggtcaaagagttaaagtgttattcaacgggaatcctggctcgacatggattgggaatgatgagtg

SEQ ID NO: 321122 - DNA, 75 bp, Artificial Sequence
  Synthetic
catcgcggcagaaatacaacagaatattcccttaggacatcagactagggcccccttttgggggctgagagtatc

SEQ ID NO: 321123 - DNA, 75 bp, Artificial Sequence
  Synthetic
cccccttttgggggctgagagtatccaagtcacaggtactgcgtctacgggggtacgaggagatcacaaaaggag

SEQ ID NO: 321124 - DNA, 75 bp, Artificial Sequence
  Synthetic
tgaggctttgatttggaatgaattacagaatagctcgataggcctagtccactgtgacatggagggaggagatca

SEQ ID NO: 321125 - DNA, 75 bp, Artificial Sequence
  Synthetic
aggtaggcagatcaggtgttggtctgacgttaccattcgatggaaggtacctatctcaccagctgaggctctttg

SEQ ID NO: 321126 - DNA, 75 bp, Artificial Sequence
  Synthetic
taaggatgatcaagttgtactgcatgagcattacagtgtaatccggatcgcgtatctggtgggggatcgagatgt

SEQ ID NO: 321127 - DNA, 75 bp, Artificial Sequence
  Synthetic
gtattaacagcactagctgcttgaaggcgcttgaacttacctacttattaagccctttggttgacaaggataagg

SEQ ID NO: 321128 - DNA, 75 bp, Artificial Sequence
  Synthetic
tgtgcttataagcaagattgctcccaggctgggcacggattggaccaggcagctcagcctatatctgagatactg

SEQ ID NO: 321129 - DNA, 75 bp, Artificial Sequence
  Synthetic
agccctttggttgacaaggataaggacaggctgtttttaggggaaggagccggggctatgctttcctgttatgac

SEQ ID NO: 321130 - DNA, 75 bp, Artificial Sequence
  Synthetic
aagacagtgttagctagtctcctccctttgtcaaaagaagatagcatcaagatagaaaagtggatcttaatagag

SEQ ID NO: 321131 - DNA, 75 bp, Artificial Sequence
  Synthetic
aatatatatcctgctgaggtggcattagtggggaagaaactaaacaatgttactagtctgggtcagagagttaag

SEQ ID NO: 321132 - DNA, 75 bp, Artificial Sequence
  Synthetic
aaggcaaaggctcacgaatgggttactcgggaattgagagaaggaagctcttcatcagggatgcttagaccttac

SEQ ID NO: 321133 - DNA, 75 bp, Artificial Sequence
  Synthetic
gtgttgttcaacggaaatcctggctcgacatggattgggaatgatgagtgtgaggctttgatttggaatgaactg

SEQ ID NO: 321134 - DNA, 75 bp, Artificial Sequence
  Synthetic
cgacatggattgggaatgatgagtgtgaggctttgatttggaatgaactgcagaatagctcgataggtctagtcc

SEQ ID NO: 321135 - DNA, 75 bp, Artificial Sequence
  Synthetic
catcaagcactgcagacgtttggctttgaactaaacttgtataaattgagcagagatttcttgtccaccatgaac

SEQ ID NO: 321136 - DNA, 75 bp, Artificial Sequence
  Synthetic
attgcgacatggagggaggggaccataaggatgatcaagttgtactgcatgagcattacagtgtgatcaggatcg

SEQ ID NO: 321137 - DNA, 75 bp, Artificial Sequence
  Synthetic
atagctgatacacacaactgcatgatagctttcaacagggttttgaaggatacaatcttcgaatgggctagaata

SEQ ID NO: 321138 - DNA, 75 bp, Artificial Sequence
  Synthetic
cgtatctggtgggggatcgagacgttgtgctgataagcaagattgctcctaagctgggcacagattggaccaggc

SEQ ID NO: 321139 - DNA, 75 bp, Artificial Sequence
  Synthetic
actgagtcagataaaaggcttaaactaactggtaagtatgacctgtatcctgtgagagattcaggcaagttgaag

SEQ ID NO: 321140 - DNA, 75 bp, Artificial Sequence
  Synthetic
agcttagcctatacctgaggtactgggatgaggtcaacttggttgtacttaaaacatctaatcctgcttctgcag

SEQ ID NO: 321141 - DNA, 75 bp, Artificial Sequence
  Synthetic
acaatttctagaagacttgtgctatcttggatatctttatctatgtccacaagattggtaactgggtcattccct

SEQ ID NO: 321142 - DNA, 75 bp, Artificial Sequence
  Synthetic
agatgtatctactatcacggcaccctaagtctgatattatagaagatagcaagacagtgctggccagtctcaacc

SEQ ID NO: 321143 - DNA, 75 bp, Artificial Sequence
  Synthetic
gaccagaagtttgaagcaagacttcaattgggaatagtttcattatcatcccgtgagatcaggaacctgagggtt

SEQ ID NO: 321144 - DNA, 75 bp, Artificial Sequence
  Synthetic
ctctatcgaagggagatagcatcaagatagaaaagtggatcctaatagagaaagcaaaggctcacgaatgggtta

SEQ ID NO: 321145 - DNA, 75 bp, Artificial Sequence
  Synthetic
cccgagagttaagagaaggaagctcgtcgtcagggatgcttagaccttaccaccaggcgctacaaacgtttggtt

SEQ ID NO: 321146 - DNA, 75 bp, Artificial Sequence
  Synthetic
aagattttgatgaagattttaggggcagtcaagatgttcggggccaggcaaaatgaatacacgaccgtgattgat

SEQ ID NO: 321147 - DNA, 75 bp, Artificial Sequence
  Synthetic
ttgaacccaacttatataaattgagcagggatttcttgtccaccatgaacatagctgacacacacaactgcatga

SEQ ID NO: 321148 - DNA, 75 bp, Artificial Sequence
  Synthetic
cagggatttcttgtccaccatgaacatagctgacacacacaactgcatgacagctttcaatagagttttaaagga

SEQ ID NO: 321149 - DNA, 75 bp, Artificial Sequence
  Synthetic
gatggatcactgggtgatatcgagccatatgacagctcgtaataattagtccctatcgtgcagaacgatcgaagc

SEQ ID NO: 321150 - DNA, 75 bp, Artificial Sequence
  Synthetic
ccctatcgtgcagaacgatcgaagctccgcggtacctggaagtcttggacttatccatatgacaatagtaagaaa

SEQ ID NO: 321151 - DNA, 75 bp, Artificial Sequence
  Synthetic
tacaatctttgaatgggccagaataatcgagtcagacaagaggctcaaactgaccggtaagtatgacttgtaccc

SEQ ID NO: 321152 - DNA, 75 bp, Artificial Sequence
  Synthetic
tgaccggtaagtatgacttgtaccctgttagagactcaggcaagttaaagacaatctccaggagacttgtgttgt

SEQ ID NO: 321153 - DNA, 75 bp, Artificial Sequence
  Synthetic
accaaacaagagaagaaacatgtatggaatatataatgaagttagacaggattttagggtcaaagtatccaccct

SEQ ID NO: 321154 - DNA, 75 bp, Artificial Sequence
  Synthetic
cttggatatcattatctatgtctacaagactggtaaccgggtcgttccctgaccagaagtttgaggcgagacttc

SEQ ID NO: 321155 - DNA, 75 bp, Artificial Sequence
  Synthetic
gaagagcaggttccagacccttaactttgctgccaaagttcacgatggctgggttgttgagcaccttcgacacgt

SEQ ID NO: 321156 - DNA, 75 bp, Artificial Sequence
  Synthetic
tttgctgccaaagttcacgatggctgggttgttgagcaccttcgacacgtttagctctaggaggagtgagagtat

SEQ ID NO: 321157 - DNA, 75 bp, Artificial Sequence
  Synthetic
aattggggatagtctcactgtcatctcgtgaaatcaggaacttgagggttatcacaaaaactgtattagataggt

SEQ ID NO: 321158 - DNA, 75 bp, Artificial Sequence
  Synthetic
ttgagaatattatacatagtataacatatagattcctcactaaagagataaagattttgatgaagattttaggag

SEQ ID NO: 321159 - DNA, 75 bp, Artificial Sequence
  Synthetic
attgcaaccaccttcttagctcactcattagacacagataagcagcactctcagagaggagggttcctagtctcc

SEQ ID NO: 321160 - DNA, 75 bp, Artificial Sequence
  Synthetic
ctgtcaagatgttcggagccaggcataatgagtacatgaccgtggttgatgatggatcgttggatgacatcgagc

SEQ ID NO: 321161 - DNA, 75 bp, Artificial Sequence
  Synthetic
ctacttgccatggcttacagtagtccagaattatacttgacaacaaatggagtaaatgccgatgttaagtacgtg

SEQ ID NO: 321162 - DNA, 75 bp, Artificial Sequence
  Synthetic
catatgacggctcggaataagtaatcattatcatgcggggtgagttagggtgcacggtgcctagaagtcttggac

SEQ ID NO: 321163 - DNA, 75 bp, Artificial Sequence
  Synthetic
atctacaacatagagaaggaccctaagaggacgaagacggatggattcattgtgaagacaagggacatggaatat

SEQ ID NO: 321164 - DNA, 75 bp, Artificial Sequence
  Synthetic
ttatccatatgacaatagtaagaaaaacttacaaagagacaaggaaatttaaaagaataaatatctcttaaactc

SEQ ID NO: 321165 - DNA, 75 bp, Artificial Sequence
  Synthetic
tgacaatagtaagaaaaacttacaaagagacaaggaaatttaaaagaataaatatctcttaaactcttgtctggt

SEQ ID NO: 321166 - DNA, 75 bp, Artificial Sequence
  Synthetic
gagaggaccacagagtggctgtttggacctatggtcaacaagagtccgcttttccaggggcaacgagatgctgca

SEQ ID NO: 321167 - DNA, 75 bp, Artificial Sequence
  Synthetic
gaccctgatacgctccttcaaatctatgggtatccggcatgcctaggggcaattattgtccaggtctggattgtg

SEQ ID NO: 321168 - DNA, 75 bp, Artificial Sequence
  Synthetic
ctggtgaaggcaatcacgagtagtgccggcctaaggaaaggatttttcaatagattagaggctttcagacaagat

SEQ ID NO: 321169 - DNA, 75 bp, Artificial Sequence
  Synthetic
ggcactgtgaaaggtgccttagttttcactggggagacagttgaggggataggctcggtcatgcgatcccagcaa

SEQ ID NO: 321170 - DNA, 75 bp, Artificial Sequence
  Synthetic
agcttggtatctctcatggttgagacccttgtgactatgaacactgcgaggtccgatctcactacactagagaag

SEQ ID NO: 321171 - DNA, 75 bp, Artificial Sequence
  Synthetic
aacatccagatcgttgggaactacatccgagatgcaggactagcctctttcatgaataccatcaaatatggggta

SEQ ID NO: 321172 - DNA, 75 bp, Artificial Sequence
  Synthetic
caacaggcggtggtgcaattgaggtagctctagacaatgccgacatcgacctagaaacaaaagcccatgcggacc

SEQ ID NO: 321173 - DNA, 75 bp, Artificial Sequence
  Synthetic
gagacaaagatggcggccttaacgctgtcaaacctgaggcccgacatcaacaagctgagaagcctcatagacacc

SEQ ID NO: 321174 - DNA, 75 bp, Artificial Sequence
  Synthetic
tacctgtcaaaaggacccagggctccttttatttgtatcctaaaggaccctgtccatggtgagtttgcaccaggc

SEQ ID NO: 321175 - DNA, 75 bp, Artificial Sequence
  Synthetic
aactatccagcactctggagctatgcaatgggagtcgccgttgtacagaacaaggcgatgcagcagtacgtcaca

SEQ ID NO: 321176 - DNA, 75 bp, Artificial Sequence
  Synthetic
gggagaacataccttgatatggagatgttcttactaggacaagctgtagcaaaggacgctgagtccaagatcagc

SEQ ID NO: 321177 - DNA, 75 bp, Artificial Sequence
  Synthetic
tagagatgagatccgcaacccggtgtaccaagagagggacacagaacccagggcctcaaacgcatcacgtctcct

SEQ ID NO: 321178 - DNA, 75 bp, Artificial Sequence
  Synthetic
agtgctctggaggacgagctaggagtgacagatacggctaaggagaggctcagacatcatttggcaaatctgtcc

SEQ ID NO: 321179 - DNA, 75 bp, Artificial Sequence
  Synthetic
ggtggggatggcgcgtaccacaagccaacaggcggcggtgcaatcgaggtagctctagacaatgccgacatagac

SEQ ID NO: 321180 - DNA, 75 bp, Artificial Sequence
  Synthetic
gggcaatcaccatagccaaaatcccaaagacccttgcagaccttgcattgcccaactctatatctgttaatttac

SEQ ID NO: 321181 - DNA, 75 bp, Artificial Sequence
  Synthetic
ctggagcctgaagctcacacagatcaggacgccagaggttggggtggggatagcggtgacagatgggctcgctcg

SEQ ID NO: 321182 - DNA, 75 bp, Artificial Sequence
  Synthetic
aggacgccagaggttggggtggggatagcggtgacagatgggctcgctcgacgagtagtggccactttatcacac

SEQ ID NO: 321183 - DNA, 75 bp, Artificial Sequence
  Synthetic
gcaagattgagagaatgcggctgattttctcacttgggttaatcggcggtataagcttccatgttcaggttaacg

SEQ ID NO: 321184 - DNA, 75 bp, Artificial Sequence
  Synthetic
tacatggggcagaacggttggaggaggagaccaatgatgaagatgtctccgacatagagagaagaatagctagga

SEQ ID NO: 321185 - DNA, 75 bp, Artificial Sequence
  Synthetic
ggtacatagtactgagtctagttccgggggtagactttgagaatgggtgcggaacagcccaggttatccagtaca

SEQ ID NO: 321186 - DNA, 75 bp, Artificial Sequence
  Synthetic
ggcttgcagagagacggcaagaggacgctacaacccacgaagacgaaggtcgtaataacggtgttgatcatgacg

SEQ ID NO: 321187 - DNA, 75 bp, Artificial Sequence
  Synthetic
caggaggctctgataactgtcaccaatgatacgacacaaaatgccggtgctccccagtcgagattcttcggtgct

SEQ ID NO: 321188 - DNA, 75 bp, Artificial Sequence
  Synthetic
aagaggatgatgccgcggcagcagctgggatgggaggaatctaagatcacacgaggatttaggatacatgacccg

SEQ ID NO: 321189 - DNA, 75 bp, Artificial Sequence
  Synthetic
acgaggatttaggatacatgacccgtagtaagaaaaacttagggtgaaagctcatccaccgatccgcccagacca

SEQ ID NO: 321190 - DNA, 75 bp, Artificial Sequence
  Synthetic
agagatacatggtcaccctgtctgtgaagatccctattctttctgaagtcccaggtgtgctcatacacaaggcat

SEQ ID NO: 321191 - DNA, 75 bp, Artificial Sequence
  Synthetic
gagccgaagatcagacatatgtacacaaacggtgggtttgatgcaatggctgagaaaagatgatcacgaccatta

SEQ ID NO: 321192 - DNA, 75 bp, Artificial Sequence
  Synthetic
ggccacatccaactccattgactacgcccagcagtccagacaaccacggcttcggctacacttcccgcatggatc

SEQ ID NO: 321193 - DNA, 75 bp, Artificial Sequence
  Synthetic
aagatgccctcatttctaaagaagattctgaagttgagagggaggcgtcaggaggacgagagtcgctctcggatg

SEQ ID NO: 321194 - DNA, 75 bp, Artificial Sequence
  Synthetic
ttatcggattcctcgacgcagtcctatcaagtgaaccaactgacatcggaggagacagaagctggctccacaata

SEQ ID NO: 321195 - DNA, 75 bp, Artificial Sequence
  Synthetic
tggtctacttctcctagtggtagcaccacaaaaccagcatcaggttgggagaggtcaagtaaagccgacacatgg

SEQ ID NO: 321196 - DNA, 75 bp, Artificial Sequence
  Synthetic
ccatcaacaccctccaaaggccaggctctacccacagagccaaaggtgagggcgagggagaagtctcgacatcgt

SEQ ID NO: 321197 - DNA, 75 bp, Artificial Sequence
  Synthetic
cgacccaagataatcgatcaggtgaggagagtagagtctctgggggaacaagcgagccagaggcagaagcacatg

SEQ ID NO: 321198 - DNA, 75 bp, Artificial Sequence
  Synthetic
ctagaaacgttgataaacaaaatatacactgggccactgggagaggagctagtacagactctgtacctcaggatc

SEQ ID NO: 321199 - DNA, 75 bp, Artificial Sequence
  Synthetic
tgggcaatggaagagactccggaatccttgaagatcctccaaatgagggaggatatccgagatcaggtgctgaag

SEQ ID NO: 321200 - DNA, 75 bp, Artificial Sequence
  Synthetic
atgaaaaccgagagatggctgcgaaccctgataagaggggagaagaccaagctgaaggacttccagaagagatac

SEQ ID NO: 321201 - DNA, 75 bp, Artificial Sequence
  Synthetic
ggaagaggcgtggagtctggcagcccacatagtgcaagagtgactggagtcttggtgatccccagtcctgagctc

SEQ ID NO: 321202 - DNA, 75 bp, Artificial Sequence
  Synthetic
gaagaggccgtgctacaaaggaacaagagacgacccgccaacagcgggtccagatctctcaccccagtggtcgtg

SEQ ID NO: 321203 - DNA, 75 bp, Artificial Sequence
  Synthetic
cctagcactcggtctccaccaccggaccatgacaatagtacaaggtcaccaccaaggaaacccccaaccacgcag

SEQ ID NO: 321204 - DNA, 75 bp, Artificial Sequence
  Synthetic
gatgagcacaccaaccccaggaacacccccgccgtcaggatcaaggatcggagacccccaacagggactcgctcc

SEQ ID NO: 321205 - DNA, 75 bp, Artificial Sequence
  Synthetic
gccccagaccgcccgaccgacggctatccaacccacccaggtccagagaccgacgcaacaaaaaagggcatagga

SEQ ID NO: 321206 - DNA, 75 bp, Artificial Sequence
  Synthetic
tgtaatccagtctgctcaagaattcgagtcatctcgagacgcgagttatgtgtttgcaaggcgtgccctaaaatc

SEQ ID NO: 321207 - DNA, 75 bp, Artificial Sequence
  Synthetic
aatgtatgcggcttgatcctttctgctgagaaatctttcgccaatagagtagacgagaataaacagctgcttaaa

SEQ ID NO: 321208 - DNA, 75 bp, Artificial Sequence
  Synthetic
cagatccaagaaagtgtagagtcatttcgggacatatacaagagattctctgagtatcagaaggaacagaactca

SEQ ID NO: 321209 - DNA, 75 bp, Artificial Sequence
  Synthetic
ctgctgatgtctaacctatctacacttcatattatcacagacagaggtggcaagactgacaatccagattctccc

SEQ ID NO: 321210 - DNA, 75 bp, Artificial Sequence
  Synthetic
ggagagatgatcgtatacatggtggatttgattggtgctccactcctaccatggtcaggtaagctgagacaggga

SEQ ID NO: 321211 - DNA, 75 bp, Artificial Sequence
  Synthetic
acaaggtccccctctgtttttgcaaaaataaaagagaacaagaccaaagcaactaggtttgacccgtctatggag

SEQ ID NO: 321212 - DNA, 75 bp, Artificial Sequence
  Synthetic
gggcaatcaccatagccaagatcccaaagacccttgcagaccttgcattgcccaactctatatccgttaatctac

SEQ ID NO: 321213 - DNA, 75 bp, Artificial Sequence
  Synthetic
aactaggtttgacccgtctatggagaccatgggggatatgaagtataaaccagacctactccgagaggatgaatt

SEQ ID NO: 321214 - DNA, 75 bp, Artificial Sequence
  Synthetic
cagacctactccgagaggatgaatttagagatgagatccgcaacccggtgtaccaggaaagagataccgaaccca

SEQ ID NO: 321215 - DNA, 75 bp, Artificial Sequence
  Synthetic
gagcatccaatgcatcacgtctgcttccatcaagagagaagcctacaatacactccctcaggctcgtcatagaga

SEQ ID NO: 321216 - DNA, 75 bp, Artificial Sequence
  Synthetic
gcagtcccctaagcagagctgaaaaggcagcatatgtgaaatcattatccaaatgcaagacagaccaagaggtta

SEQ ID NO: 321217 - DNA, 75 bp, Artificial Sequence
  Synthetic
aggcagtcatggagcttgtagaagaagacatagaatcactgactaattaagaactaggtgaggcatctaatcatc

SEQ ID NO: 321218 - DNA, 75 bp, Artificial Sequence
  Synthetic
ctcagtagtggagcgacctaattcatcattagcatcagccagtagagattaagaaaaacttagggtgaaagaaat

SEQ ID NO: 321219 - DNA, 75 bp, Artificial Sequence
  Synthetic
ttcacctaataagatacaatggccgacatctatagattccccaagttctcatatgaggataacggtactgtagag

SEQ ID NO: 321220 - DNA, 75 bp, Artificial Sequence
  Synthetic
cctctgcctctgagaactggtccggataagaaggccatccctcatatcaggattgtcaaggtaggagaccctcca

SEQ ID NO: 321221 - DNA, 75 bp, Artificial Sequence
  Synthetic
aagcatggagtgagatacctagatttattgctcttaggcttctttgagacgccgaagcaaacggccagcttaggg

SEQ ID NO: 321222 - DNA, 75 bp, Artificial Sequence
  Synthetic
ggaaatcatatcaggtcctgcagctagggtatatatcactcaattcagatatgttccctgatcttaaccccgtag

SEQ ID NO: 321223 - DNA, 75 bp, Artificial Sequence
  Synthetic
agtgtgtccgacctgacagagcacaccggctactcaatctgtggctccggatcgttacccataggtgtagctaaa

SEQ ID NO: 321224 - DNA, 75 bp, Artificial Sequence
  Synthetic
atcgttacccataggtgtagctaaataccacgggtctgatcaggaactcttaaaggcctgcactgatctcagaat

SEQ ID NO: 321225 - DNA, 75 bp, Artificial Sequence
  Synthetic
tacagtgaggaggactgttcgagcaggggagatgatagtatacatggtggattcgatcggtgctccactcctacc

SEQ ID NO: 321226 - DNA, 75 bp, Artificial Sequence
  Synthetic
atggtcgggcaggctgagacagggaatgatatttaatgccaacaaggtcgcgcttgccccccagtgcctcccggt

SEQ ID NO: 321227 - DNA, 75 bp, Artificial Sequence
  Synthetic
ggacaaggacataagattcagagtggtgtttgtcaatgggacatccctgggggcgatcactatagccaagatccc

SEQ ID NO: 321228 - DNA, 75 bp, Artificial Sequence
  Synthetic
tacaactaaatgatcctgttatacctctacgtggggcatttatgaggcatgtgttgacagagctacaggctgttt

SEQ ID NO: 321229 - DNA, 75 bp, Artificial Sequence
  Synthetic
aaagactcttgcagaccttgcattgcctaattctatctctgttaacctactagtgacactcaagaccgggatccc

SEQ ID NO: 321230 - DNA, 75 bp, Artificial Sequence
  Synthetic
cacggagcaaaagggggtactcccagtactcgatgatcaaggagagaagaagctcaattttatggtgcatcttgg

SEQ ID NO: 321231 - DNA, 75 bp, Artificial Sequence
  Synthetic
gttgatcagaagaaaagtcgggaagatatactccgttgagtactgcaagagcaagatcgagaggatgcggctgat

SEQ ID NO: 321232 - DNA, 75 bp, Artificial Sequence
  Synthetic
cttctcacttgggttaattggcggcataagcttccatgtccaggtcactgggaccctatctaagacattcatgag

SEQ ID NO: 321233 - DNA, 75 bp, Artificial Sequence
  Synthetic
ccagctcgcatggaaaagagcggtctgcttcccattgatggacgtgaatcctcatatgaacctggtgatttgggc

SEQ ID NO: 321234 - DNA, 75 bp, Artificial Sequence
  Synthetic
ggcgtctgttgagatcacagacgttgatgcggttttccagccggccatccctcgtgatttccgctactaccctaa

SEQ ID NO: 321235 - DNA, 75 bp, Artificial Sequence
  Synthetic
tgtcgtggcaaagaacatagggaggatcaggaagctgtaaatgtgcatccatcagggacctacgacaatgcctag

SEQ ID NO: 321236 - DNA, 75 bp, Artificial Sequence
  Synthetic
agcagacaccacttggcagccggagccatagcattgctctttgtattaagtaagaaaaacttagggataaagtcc

SEQ ID NO: 321237 - DNA, 75 bp, Artificial Sequence
  Synthetic
ccatagcattgctctttgtattaagtaagaaaaacttagggataaagtcccttgcgcgtgccctgtcgtagaact

SEQ ID NO: 321238 - DNA, 75 bp, Artificial Sequence
  Synthetic
ttccttttggggaaaatggcgacttatatccagagggtacagtgcatatctgcattattgtcagttgtgctcaca

SEQ ID NO: 321239 - DNA, 75 bp, Artificial Sequence
  Synthetic
acactggtctcgtgtcaaattcctagagataggctctctaatataggggtcatagtcgacgaagggaaatcactg

SEQ ID NO: 321240 - DNA, 75 bp, Artificial Sequence
  Synthetic
aagattgccgggtcccacgaatctaggtacatcgtattaagtctggtcccaggggtagacctcgaaaatgggtgc

SEQ ID NO: 321241 - DNA, 75 bp, Artificial Sequence
  Synthetic
ggaacagctcaggttatccagtataagagcctactgaaccggttgttaatcccattgagagatgccttagatctt

SEQ ID NO: 321242 - DNA, 75 bp, Artificial Sequence
  Synthetic
caggaggctctgataactgtcactaatgacacgatgaccagtgctgatgtcccacagtcaagattcttcggcgcc

SEQ ID NO: 321243 - DNA, 75 bp, Artificial Sequence
  Synthetic
aaagagcaggtttcagacctttagctttgctgccgagatttacaatggctgggctgttgagcacttttgatacat

SEQ ID NO: 321244 - DNA, 75 bp, Artificial Sequence
  Synthetic
gtgattgggaccatagcacttggagtggcaacatcagcacagataaccgcagggatcgcgctagctgaggcgagg

SEQ ID NO: 321245 - DNA, 75 bp, Artificial Sequence
  Synthetic
ttagctctaagaggagtgaaagtattaataagtcaggaggaggtgctgttatccctggtcaaaggagcacagtct

SEQ ID NO: 321246 - DNA, 75 bp, Artificial Sequence
  Synthetic
gaggccaagagagacatagcactcataaaagaatcaatgacaaagacacacaaatctatagaactgctgcaaaac

SEQ ID NO: 321247 - DNA, 75 bp, Artificial Sequence
  Synthetic
cagtgttcgtgctaggcccgagtgtggccgatgatgcagacaagttattcattgcaaccaccttcttagctcact

SEQ ID NO: 321248 - DNA, 75 bp, Artificial Sequence
  Synthetic
gctgtgggggaacaaattcttgctctaaagacgctccaggatttcgtgaatgatgagatcaaacccgcgataagc

SEQ ID NO: 321249 - DNA, 75 bp, Artificial Sequence
  Synthetic
cattggacacagataaacagcactctcagagagggggttttttagtctctctacttgccatggcttacagtagtc

SEQ ID NO: 321250 - DNA, 75 bp, Artificial Sequence
  Synthetic
gaattgggttgtgagactgccgctttaagactggggataaaactgacacaacattactccgagctgctgactgca

SEQ ID NO: 321251 - DNA, 75 bp, Artificial Sequence
  Synthetic
cggaattatacctaacaacaaacggagtaaatgccgatgttaaatacgtgatctacaacatagaaaaggacccta

SEQ ID NO: 321252 - DNA, 75 bp, Artificial Sequence
  Synthetic
tttggctctaactttggaaccatcggagagaagagcctcacactgcaggcactgtcttcactctactctgctaac

SEQ ID NO: 321253 - DNA, 75 bp, Artificial Sequence
  Synthetic
agaggacaaaaacagatggattcattgtgaggacaagagatatggaatatgagaggaccacagaatggctgtttg

SEQ ID NO: 321254 - DNA, 75 bp, Artificial Sequence
  Synthetic
atcactgagattatgaccacgatcaggacagggcagtccaacatctatgacgtcatttatacggagcagatcaag

SEQ ID NO: 321255 - DNA, 75 bp, Artificial Sequence
  Synthetic
gacccatggtcaacaagagcccgctcttccagggacaacgagaggctgcagatcctgatgtactccttcaaatct

SEQ ID NO: 321256 - DNA, 75 bp, Artificial Sequence
  Synthetic
ggaactgtgattgatgtagatctagagagatacatggttaccctgtctgtgaaaatccccattctttctgaagtt

SEQ ID NO: 321257 - DNA, 75 bp, Artificial Sequence
  Synthetic
acgggtatccggcatgcctaggagcaataatcgtccaggtctggattgtgttagtgaaggcaatcacaagtagtg

SEQ ID NO: 321258 - DNA, 75 bp, Artificial Sequence
  Synthetic
ccaggtgtgcttatacacaaggcatcgtctatttcttacaatatagacggggaggagtggtatgtgactgtcccc

SEQ ID NO: 321259 - DNA, 75 bp, Artificial Sequence
  Synthetic
ctggtctaaggaaaggattttttaacagattagaggcgttccggcaagatgggaccgtgaagggtgcattagttt

SEQ ID NO: 321260 - DNA, 75 bp, Artificial Sequence
  Synthetic
agtcacatactcagtcgtgcctccttcctggggggtgcaaacatagctgattgtgtagagtccagattgacctac

SEQ ID NO: 321261 - DNA, 75 bp, Artificial Sequence
  Synthetic
atatgccctagggatcctgcacaattgatacctgacagccagcaaaaatgtatcttgggggacacaacaaggtgt

SEQ ID NO: 321262 - DNA, 75 bp, Artificial Sequence
  Synthetic
cctgtcacaaaggttgtggataacctcatccccaaatttgcctttgtaaatggaggtgtcgtcgcgaactgcata

SEQ ID NO: 321263 - DNA, 75 bp, Artificial Sequence
  Synthetic
gcatccacatgtacctgcgggacaggccgaaggccaatcagtcaggatcgctctaaaggtgtagtattcttaact

SEQ ID NO: 321264 - DNA, 75 bp, Artificial Sequence
  Synthetic
catgaacactatcaaatatggagtagagaccaaaatggcggctctgacactatcaaacttgaggcctgacttaaa

SEQ ID NO: 321265 - DNA, 75 bp, Artificial Sequence
  Synthetic
catgataactgtggactcataggagtcaatgggatagaattgtatgctaataggaaagggcatgatgccacttgg

SEQ ID NO: 321266 - DNA, 75 bp, Artificial Sequence
  Synthetic
ggggtccagaatttgacagtcggtcctgcaatcgctatcagacccgtggacatttctctcaaccttgccgctgct

SEQ ID NO: 321267 - DNA, 75 bp, Artificial Sequence
  Synthetic
tgtccatggggagtttgcaccaggcaactatccagcactctggagctatgcaatgggggttgctgttgtacagaa

SEQ ID NO: 321268 - DNA, 75 bp, Artificial Sequence
  Synthetic
actgacttcctgcaagactctagagctgaacttgagaaggcacgaaaaatcctctctgaagtaggtagatggtac

SEQ ID NO: 321269 - DNA, 75 bp, Artificial Sequence
  Synthetic
caaggcgatgcagcagtacgtcacaggaagaacataccttgatatggagatgttcctactggggcaagccgtagc

SEQ ID NO: 321270 - DNA, 75 bp, Artificial Sequence
  Synthetic
aattcaggggcgactttgattacgatcatagtagtcatgattgtagtattggtggtcattatagtgattgtcatt

SEQ ID NO: 321271 - DNA, 75 bp, Artificial Sequence
  Synthetic
gaaggacactgaatctaagatcagcagtgctttggaggatgaactaggagtaacagacacagctaaggaaagact

SEQ ID NO: 321272 - DNA, 75 bp, Artificial Sequence
  Synthetic
gtgctctacagactcaggagatcaatgctaatgagtaatccagccggtcggatatcaagagacacatatacatta

SEQ ID NO: 321273 - DNA, 75 bp, Artificial Sequence
  Synthetic
cagacaccatttggccaatctgtctggtggagatggcgcataccacaaaccaacaggtggcggtgcaatcgaagt

SEQ ID NO: 321274 - DNA, 75 bp, Artificial Sequence
  Synthetic
gagccgaagataaggcatatgtatactaacggtgggttcgatgctatgactgagaaaagatgaccataactcttg

SEQ ID NO: 321275 - DNA, 75 bp, Artificial Sequence
  Synthetic
agctctagataacgctgacatagatctagaacccgaaacccacacagaccaggacgccagaggctggggcgagga

SEQ ID NO: 321276 - DNA, 75 bp, Artificial Sequence
  Synthetic
ttagatatttggtaaagcaggtatggtatttgctgaggtctgtacataataagaaaaacttagggtgaaagttag

SEQ ID NO: 321277 - DNA, 75 bp, Artificial Sequence
  Synthetic
cagtgatgacagatgggctcgcccggcaagcagtggtcacttcatcacattacacggggcagaacggttggagga

SEQ ID NO: 321278 - DNA, 75 bp, Artificial Sequence
  Synthetic
gttgctcaccactatagctttcacctcaaataagtacagatcatggatggtgacagaagcaagcgggactcgtac

SEQ ID NO: 321279 - DNA, 75 bp, Artificial Sequence
  Synthetic
agaaactagtgttgaggatgtctcagacattgagaagagaatagccaagagacttgcagagagaaggcaaaatgg

SEQ ID NO: 321280 - DNA, 75 bp, Artificial Sequence
  Synthetic
tggtctacctcccctggtggtagcactacaaaattggtgtcagactcagagaggtcaggtaaagttgatacctgg

SEQ ID NO: 321281 - DNA, 75 bp, Artificial Sequence
  Synthetic
cactgcaacccacgaagatggaggccttaataacgatgttaatcaagatgaagaggatgatgtcgcagcagcagc

SEQ ID NO: 321282 - DNA, 75 bp, Artificial Sequence
  Synthetic
ctattgattctcgcattcacccaatgggctttgtcaattgccacggttatcatttgcatcgtaatcgctgctagg

SEQ ID NO: 321283 - DNA, 75 bp, Artificial Sequence
  Synthetic
tggaataggaggaatctaagatcacactaggttccaggatacatgacccatagtaagaaaaacttagggtgaaag

SEQ ID NO: 321284 - DNA, 75 bp, Artificial Sequence
  Synthetic
caagggtatagtatggaaagatattcaatgaccgtggaggcactaaacacaagcaacaaagaagtgaaggagtca

SEQ ID NO: 321285 - DNA, 75 bp, Artificial Sequence
  Synthetic
ctcatccaccgatccacccagatcaagccacatccaaccccattgaccgcacttatcagtccagacaatcacggc

SEQ ID NO: 321286 - DNA, 75 bp, Artificial Sequence
  Synthetic
ctcactagtctaataaggcaagaggttatcactagagccgttaacattcagagttctgtgcaaaccgggatccca

SEQ ID NO: 321287 - DNA, 75 bp, Artificial Sequence
  Synthetic
ttcggccacatttcccgcatggatcaagatgccctcattcctaaagaggattctgaggttgagagggaggcgtca

SEQ ID NO: 321288 - DNA, 75 bp, Artificial Sequence
  Synthetic
gtcttgttgaacaagaacagcagagatgtcatccagctgattgaaaagtcgtgcaatagacaggagctcacgcaa

SEQ ID NO: 321289 - DNA, 75 bp, Artificial Sequence
  Synthetic
ggagaacgagagtcgttctcggatgttatcggattcctcgatgcagtcctatcaagtgaaccaactgaaatcgga

SEQ ID NO: 321290 - DNA, 75 bp, Artificial Sequence
  Synthetic
ctttgcgatagcacaattgcagtccatcatgctgagggaattgccccacttgaaccgcatagcttctggagatgc

SEQ ID NO: 321291 - DNA, 75 bp, Artificial Sequence
  Synthetic
ggagacagaagctggctacacaacactatcaacaccctccaagggccaggctccacctacagaatcaaaagtgat

SEQ ID NO: 321292 - DNA, 75 bp, Artificial Sequence
  Synthetic
ggcaagagagaggtctcgacatctccgacccaagataatcgaccaggtgatgaaattagagtctctgggagaaca

SEQ ID NO: 321293 - DNA, 75 bp, Artificial Sequence
  Synthetic
tggcccaagcctgttgtctggttcgacaacgatctctggatgtgttaggctcccttcactctcaattggtgaggc

SEQ ID NO: 321294 - DNA, 75 bp, Artificial Sequence
  Synthetic
agcaagtcagaggcagaagcacatgttagagacgttgataaacaaaatatacaccggaccgctgggagaggaatt

SEQ ID NO: 321295 - DNA, 75 bp, Artificial Sequence
  Synthetic
ttagagacgttgataaacaaaatatacaccggaccgctgggagaggaattggtacaaacgttgtatctcaggatc

SEQ ID NO: 321296 - DNA, 75 bp, Artificial Sequence
  Synthetic
gatctatgcctattcgtcaaatctcattacacaaggctgtgctgacatagggaagtcatatcaggtcctgcagct

SEQ ID NO: 321297 - DNA, 75 bp, Artificial Sequence
  Synthetic
agggtatatatcactaaattcagatatgtttcctgaccttaaccccgtagtgtcccacacttatgacatcaacga

SEQ ID NO: 321298 - DNA, 75 bp, Artificial Sequence
  Synthetic
caaccggaaatcgtgctcggtagtggcaaccgggaccaggggttatcagctctgctccatgccgactgtagacga

SEQ ID NO: 321299 - DNA, 75 bp, Artificial Sequence
  Synthetic
aagaactgactactcgagtgatggtatcgaagatttggtccttgacattctggatcttaaagggaggactaaatc

SEQ ID NO: 321300 - DNA, 75 bp, Artificial Sequence
  Synthetic
cttggtgattcctagtcctgagctcgaagaggctgtactacaaaggaacaagagacgatccaccaacagtgggtc

SEQ ID NO: 321301 - DNA, 75 bp, Artificial Sequence
  Synthetic
tcatcggtatagcaacagtgagatagatcttgaccacccgttttctgcattataccctagtgtgggcagcggcat

SEQ ID NO: 321302 - DNA, 75 bp, Artificial Sequence
  Synthetic
caaacccttcaccccagaggctgcgcccggcattcagtcatcatcaccgggtcataacaacagcataaggtcacc

SEQ ID NO: 321303 - DNA, 75 bp, Artificial Sequence
  Synthetic
tgcaacagagggttcactgatattccttgggtatggtgggctaaccaccccgctacaaggtgatacgaaatgtag

SEQ ID NO: 321304 - DNA, 75 bp, Artificial Sequence
  Synthetic
accagagacacccccaaccacacagggtgagcacaccaactctagaaatgctcccgctgttagaatcaaggaccg

SEQ ID NO: 321305 - DNA, 75 bp, Artificial Sequence
  Synthetic
gatccaaggatgccaacaggtgtcgcaagacacatgcaatgaagctctgaagattacatggctgggcgggaaaca

SEQ ID NO: 321306 - DNA, 75 bp, Artificial Sequence
  Synthetic
aagaccaccagcagggacccgccctgccccagaccgtccggccgacggtcattcaactcacccaggtccggagac

SEQ ID NO: 321307 - DNA, 75 bp, Artificial Sequence
  Synthetic
ggtagtcagtgtgctcatccaggttaatgattatctttcagagagaccaagaataagagtcacaaccgttccaat

SEQ ID NO: 321308 - DNA, 75 bp, Artificial Sequence
  Synthetic
gaataagagtcacaaccgttccaatcactcagaactacctcggagcagaaggcagattactaaaattgggtgatc

SEQ ID NO: 321309 - DNA, 75 bp, Artificial Sequence
  Synthetic
cgacgcaacaaaaaagggcataggagagagcatatcatctatgaaagagatggctacattgttaacaagtcttgg

SEQ ID NO: 321310 - DNA, 75 bp, Artificial Sequence
  Synthetic
aagtgtacatctacacgagatcatcaggttggcattcccaactgcagataggggtacttgatgtcagccaccctc

SEQ ID NO: 321311 - DNA, 75 bp, Artificial Sequence
  Synthetic
tgactatcagctggacaccccatgaagccttgtctaggccaggaaacgaaggctgcaattggtacaatacttgtc

SEQ ID NO: 321312 - DNA, 75 bp, Artificial Sequence
  Synthetic
aatgtatgcggtctgatcctttctgctgagaagtctttcgctaatagggtagaggagaataaacagctacttaaa

SEQ ID NO: 321313 - DNA, 75 bp, Artificial Sequence
  Synthetic
cgaaggaatgcatatcaggtgtatataccgacgcttatcccctgtctcctgatgcagctaatgtagccaccgtta

SEQ ID NO: 321314 - DNA, 75 bp, Artificial Sequence
  Synthetic
cagatccaagaaagtgtggaatcatttcgggatatatacaaaaggttctctgagtatcagaaggaacaaaactca

SEQ ID NO: 321315 - DNA, 75 bp, Artificial Sequence
  Synthetic
cgttgtatgccaacacttcacgcgtcaatccaacaatcatgtattccaacaccactaacattataaatatgttaa

SEQ ID NO: 321316 - DNA, 75 bp, Artificial Sequence
  Synthetic
ttactgatgtccaacctatctacactccatatcatcacagatagaggtggcaagaccgataacacagatccccct

SEQ ID NO: 321317 - DNA, 75 bp, Artificial Sequence
  Synthetic
accactaacattataaatatgttaaggataaaagatgtcaaattagaggctgcatataccacgacatcatgtatc

SEQ ID NO: 321318 - DNA, 75 bp, Artificial Sequence
  Synthetic
acaagatctccctccgtctttgcaaaaacaaaagagaacaagaccaaggttatcaggtttgatccgtctatggag

SEQ ID NO: 321319 - DNA, 75 bp, Artificial Sequence
  Synthetic
acgcactttggcaaaggctactgtttccacatcatcgagatcaaccaaaagagcttgaacaccctgcaacctatg

SEQ ID NO: 321320 - DNA, 75 bp, Artificial Sequence
  Synthetic
accttgggggatatgaagtataagccggacctactcagagaggatgaatttagggatgagatctgcaacccggtg

SEQ ID NO: 321321 - DNA, 75 bp, Artificial Sequence
  Synthetic
ctctttaagaccagcattccgaagttatgcaaggccgagtcgtgaatttcaccgatcagcaggctagtcggctct

SEQ ID NO: 321322 - DNA, 75 bp, Artificial Sequence
  Synthetic
tatcaggaaagagagatcgaatccagagcctccaacgcatcgcgtctgctcccctcaaaggagaagcctacaata

SEQ ID NO: 321323 - DNA, 75 bp, Artificial Sequence
  Synthetic
gccgacacaggggtcatcactggatacccacaacatctgctagtctctcacattctccacagtattaagaaaaac

SEQ ID NO: 321324 - DNA, 75 bp, Artificial Sequence
  Synthetic
cactccctcaagcttgttatagagagtagtcctttaagcagatctgagaaggcggcatacataaaattattatcc

SEQ ID NO: 321325 - DNA, 75 bp, Artificial Sequence
  Synthetic
cattctccacagtattaagaaaaacccagggtgaatgggaagcctgtcattggctatggacgggcaagagtcctc

SEQ ID NO: 321326 - DNA, 75 bp, Artificial Sequence
  Synthetic
aagtgcaagacagaccgagaggttaaggaagtcatggatcttgtagaagaagacatagaatcactgactggttag

SEQ ID NO: 321327 - DNA, 75 bp, Artificial Sequence
  Synthetic
ccaaaacccttctgacatactctatccagaatgtcacctgaactcccctatagtgaggggaaagatagcacaatt

SEQ ID NO: 321328 - DNA, 75 bp, Artificial Sequence
  Synthetic
gaaccagacgatgcgcacaatcatattcaatcatggagcaacccaatccttcattagtatcagctagtagagatt

SEQ ID NO: 321329 - DNA, 75 bp, Artificial Sequence
  Synthetic
acacgttttgttagatgttaaccagccctacattctgaaagacgacagtataattaatatcacaaagcacaaaat

SEQ ID NO: 321330 - DNA, 75 bp, Artificial Sequence
  Synthetic
aagaaaaacttagggtgaaagaaatttcacccaacaagtcacaatggccgacatctacagattccccaagttctc

SEQ ID NO: 321331 - DNA, 75 bp, Artificial Sequence
  Synthetic
caggaatgggggtttgtcccctcgtcagattaagatcagatctctaggcaaggctcttcaacgcacaataaagga

SEQ ID NO: 321332 - DNA, 75 bp, Artificial Sequence
  Synthetic
atatgaggacaatggtgctgtggaacctctgcctctgagaacgggcccagataagaaagctatcccccacatcag

SEQ ID NO: 321333 - DNA, 75 bp, Artificial Sequence
  Synthetic
tctagaccggtacacgtttgaaccgtacccaacctactcccaggagttacttaggctcgatataccagagatatg

SEQ ID NO: 321334 - DNA, 75 bp, Artificial Sequence
  Synthetic
tgacaagatccgatctgttttcgcggtctcggatcggctgactaaggagctgtctaatgggttccaggatctctg

SEQ ID NO: 321335 - DNA, 75 bp, Artificial Sequence
  Synthetic
gccgaagcaaacagccagcctagggagtgtgtctgatttaacagaacacaccggctactcaatctgcggatccgg

SEQ ID NO: 321336 - DNA, 75 bp, Artificial Sequence
  Synthetic
gtcgttgcccataggtgtagccaaatatcacgggtctgatcaggaactcctaaaggcctgtaccgatctcaaaat

SEQ ID NO: 321337 - DNA, 75 bp, Artificial Sequence
  Synthetic
cccagagataactgagaggtatagcaggaacaaatggtataggccattcctaacttggttcagtatcaaatatga

SEQ ID NO: 321338 - DNA, 75 bp, Artificial Sequence
  Synthetic
tatgcggtggatgcagaaaactagaccagggggacctctagatacctctaactcacataaccttctagaatgcaa

SEQ ID NO: 321339 - DNA, 75 bp, Artificial Sequence
  Synthetic
actcacataaccttctagaatgcaaatcatacactctagtaacatatggagaccttgtcatgatactgaacaagt

SEQ ID NO: 321340 - DNA, 75 bp, Artificial Sequence
  Synthetic
atggtcaagcaggctgaggcagggaatgatatttaatgcaaacaaggtcgcactcgctccccagtgcctcccggt

SEQ ID NO: 321341 - DNA, 75 bp, Artificial Sequence
  Synthetic
cactcgctccccagtgcctcccggtagataaagacacaagattcagagtggtgtttgtcaatgggacatctctag

SEQ ID NO: 321342 - DNA, 75 bp, Artificial Sequence
  Synthetic
tgacattgacagggtatatcctaacacctgagctggttctgatgtattgtgatgttgtggaagggaggtggaata

SEQ ID NO: 321343 - DNA, 75 bp, Artificial Sequence
  Synthetic
tgtctgctgcagggcagttagataaaaggtctactgggataacaagcaaaggagaggagttgtgggagttagtgg

SEQ ID NO: 321344 - DNA, 75 bp, Artificial Sequence
  Synthetic
attccctcttttcgagtctcggggaggaaatatacaatgtcatcgcattactcgagcctctatcacttgctctca

SEQ ID NO: 321345 - DNA, 75 bp, Artificial Sequence
  Synthetic
agctcaatttcatggtgcaccttgggttgatcagaagaaaagtagggagaatatactctgttgagtattgcaaga

SEQ ID NO: 321346 - DNA, 75 bp, Artificial Sequence
  Synthetic
tacaattaagtgatcctgttatacctctacgtggagcatttatgaggcatgtgttgacagagctacagactgttt

SEQ ID NO: 321347 - DNA, 75 bp, Artificial Sequence
  Synthetic
tgacgagtaaagacgtgtatacggacccggaggcagatgctattgtggagtcgttactagctatatttcatggga

SEQ ID NO: 321348 - DNA, 75 bp, Artificial Sequence
  Synthetic
ggactctatctaagacatttatgggtcagcttgcatggaagagggcggtctgcttcccattaatggacgtgaatc

SEQ ID NO: 321349 - DNA, 75 bp, Artificial Sequence
  Synthetic
cttctattgatgagaaagcagagatcttttcattctttcggacattcggtcatcctagcttggaagctgtcaccg

SEQ ID NO: 321350 - DNA, 75 bp, Artificial Sequence
  Synthetic
cccatatgaatttggtgatttgggctgcatctgttgagatcacagacgttgatgcggtgttacaaccagccatcc

SEQ ID NO: 321351 - DNA, 75 bp, Artificial Sequence
  Synthetic
ctgccgacaaggtgagagctcatatgtatgcacaaaaggcaataaagcttaagaccctacacgagtgtcatgcag

SEQ ID NO: 321352 - DNA, 75 bp, Artificial Sequence
  Synthetic
ctcgtgatttccgctactaccctaatgttgtggcaaagaacataggaaggatcaggaagctataaatgtgcatct

SEQ ID NO: 321353 - DNA, 75 bp, Artificial Sequence
  Synthetic
tgttctgcacaatcatcataaatggatatagagagaggcatggcgggcagtggcccccttgcgacttccctgatc

SEQ ID NO: 321354 - DNA, 75 bp, Artificial Sequence
  Synthetic
atcaaggacccgtggcactattctaagcagtcaccactttgcagccggagctacagcatttctccttgtcttaag

SEQ ID NO: 321355 - DNA, 75 bp, Artificial Sequence
  Synthetic
acgtgtgcctggaacttagaaatgctcaagggtccaatacggccatctcttacgagtgtgcagtagacaactata

SEQ ID NO: 321356 - DNA, 75 bp, Artificial Sequence
  Synthetic
taagaaaaacttagggataaagtcccttgttcgtgccccattgtaaaacttcctctttgagaaacatggcgacct

SEQ ID NO: 321357 - DNA, 75 bp, Artificial Sequence
  Synthetic
cttgttcgtgccccattgtaaaacttcctctttgagaaacatggcgacctatactttaagagtacagtgcgtatc

SEQ ID NO: 321358 - DNA, 75 bp, Artificial Sequence
  Synthetic
acaaagcattatcgcccaggaaggaagcatgggactctgtgtatccagacagtaacctgtactataaagttccag

SEQ ID NO: 321359 - DNA, 75 bp, Artificial Sequence
  Synthetic
agtctgaagagaccaggaggctcatcgaagtgttcataaatgatgagaatttcaacccagaagacatcatcgatt

SEQ ID NO: 321360 - DNA, 75 bp, Artificial Sequence
  Synthetic
cgaagtgttcataaatgatgagaatttcaacccagaagacatcatcgattacgtggagtcaggagactggttaaa

SEQ ID NO: 321361 - DNA, 75 bp, Artificial Sequence
  Synthetic
aggggtagacctcgagaatggatgcgggactgttcaggtcatccaatataagaacctactgaatcggttgttaat

SEQ ID NO: 321362 - DNA, 75 bp, Artificial Sequence
  Synthetic
agatgagaagttcaacatctcgtatagtttgaaagagaaagagatcaagcaagagggccgtctgttcgcaaagat

SEQ ID NO: 321363 - DNA, 75 bp, Artificial Sequence
  Synthetic
cccactaagagatgccttagatcttcaggaagcactgataactgtcactaatgacacgatgacaaatatcggtgt

SEQ ID NO: 321364 - DNA, 75 bp, Artificial Sequence
  Synthetic
gacttacaaaatgcgagctgtacaggtcctagcagagacactgttggcgaaaggaataggagagttgttcagcga

SEQ ID NO: 321365 - DNA, 75 bp, Artificial Sequence
  Synthetic
aaggaataggagagttgttcagcgaaaatggaatggtgaaaggagagatagacttacttaaaagactaactactc

SEQ ID NO: 321366 - DNA, 75 bp, Artificial Sequence
  Synthetic
gctgtgggggaacaaatccttgccctaaagacgctccaagattttgtgaatgatgaaatcagacccgcaataagc

SEQ ID NO: 321367 - DNA, 75 bp, Artificial Sequence
  Synthetic
tgaagaagagaaactcaaaagggtactgggacgaaaagaagaggtcgagacatgaatttaaagcaacagattcat

SEQ ID NO: 321368 - DNA, 75 bp, Artificial Sequence
  Synthetic
gaattaggttgtgagactgccgctctcagactggggataaaactgacacaacattactctgagttgctgactgca

SEQ ID NO: 321369 - DNA, 75 bp, Artificial Sequence
  Synthetic
catgaatttaaagcaacagattcatccacagacggttatgagacgttaagttgtttcctaacaacagacctcaag

SEQ ID NO: 321370 - DNA, 75 bp, Artificial Sequence
  Synthetic
tttggatctaattttgaaacaattggagaaaggagcctcacattgcaggcactgtcttcactctactctgctaac

SEQ ID NO: 321371 - DNA, 75 bp, Artificial Sequence
  Synthetic
aagtactgcttaaattggagatttgagagcactgcacttttcgggcagaggtgcaacgagatatttggcttcaag

SEQ ID NO: 321372 - DNA, 75 bp, Artificial Sequence
  Synthetic
ataactgagataatgaccactatcaggacagggcagtctaacatctatgatgtcatttatacagaacagatcaag

SEQ ID NO: 321373 - DNA, 75 bp, Artificial Sequence
  Synthetic
acctttttcaattggatgcatccagtccttgaaaagtgtacaatatatgttggagacccttactgtccggtcgcc

SEQ ID NO: 321374 - DNA, 75 bp, Artificial Sequence
  Synthetic
ggaactgtgatcgatgtagatctagagagatacatgattaccctgtctgtgaaaatccccattctttctgaagtc

SEQ ID NO: 321375 - DNA, 75 bp, Artificial Sequence
  Synthetic
gacaggatgcatcgacaactgcaagatcatgcagactctggtattttcatacacaatcctaggggaggaatagaa

SEQ ID NO: 321376 - DNA, 75 bp, Artificial Sequence
  Synthetic
ccaggcgtgcttatacacaaggcatcgtctatttcttataatatagacggggaagaatggtatgtgactgtcccc

SEQ ID NO: 321377 - DNA, 75 bp, Artificial Sequence
  Synthetic
ggttattgccagaaactatggaccttaatctcaatcagtgcgatccacctagcagctgtgagggtaggtgtcagg

SEQ ID NO: 321378 - DNA, 75 bp, Artificial Sequence
  Synthetic
agtcatatactcagtcgtgcctcctttattggaggtgcaaacatagccgattgtgtagagtccagattgacctac

SEQ ID NO: 321379 - DNA, 75 bp, Artificial Sequence
  Synthetic
gtctctgcaatggttcaaggcgacaatcaagctatagcagtaacatcaagagtacccgtagcccagacttacaag

SEQ ID NO: 321380 - DNA, 75 bp, Artificial Sequence
  Synthetic
ttgtgtagagtccagattgacctacatatgccccagagatcctgcacaattaatccctgacagtcaacaaaaatg

SEQ ID NO: 321381 - DNA, 75 bp, Artificial Sequence
  Synthetic
cagaagaaaaatcatgtctatgaagagatcactcgttatttcggtgctctaagacatgtcatgtttgatatagga

SEQ ID NO: 321382 - DNA, 75 bp, Artificial Sequence
  Synthetic
catgagctaaaattgaacgagaccatcattagtagtaaaatgtttgtctatagtaaaaggatatattatgatgga

SEQ ID NO: 321383 - DNA, 75 bp, Artificial Sequence
  Synthetic
cggaggcgttgtcgccaattgtatagcatcctcatgtacctgcggaacaggccgaagaccaatcagtcaggatcg

SEQ ID NO: 321384 - DNA, 75 bp, Artificial Sequence
  Synthetic
aagatcctaccgcaatgtctgaaggccttgactagatgtgtattctggtccgagacattggttgatgagaacaga

SEQ ID NO: 321385 - DNA, 75 bp, Artificial Sequence
  Synthetic
ctctaaaggtgtggttttcttaacccatgataactgtggtctgataggagtcaacgggatagaactgtatgctaa

SEQ ID NO: 321386 - DNA, 75 bp, Artificial Sequence
  Synthetic
tctgcttgttccaatatctcaacatccatagcaaaggccatcgagaatgggtattctcctatactaggctactgc

SEQ ID NO: 321387 - DNA, 75 bp, Artificial Sequence
  Synthetic
caggaagggggatgatgccacttggagggtccagaatttgacagttggtcctgcaatcgctctcaggcccgtgga

SEQ ID NO: 321388 - DNA, 75 bp, Artificial Sequence
  Synthetic
attgcgttgtacaagacctgtcagcaagtgtgtatatcattagggatgactataaatccaacaatcagcccgacc

SEQ ID NO: 321389 - DNA, 75 bp, Artificial Sequence
  Synthetic
catttctctcaatcttgctgctgctacagatttcctgcaagattctagagctgagcttgaaagggcacgaaaaat

SEQ ID NO: 321390 - DNA, 75 bp, Artificial Sequence
  Synthetic
gtaagagatcaatactttaagggtaaaaattggctgagatgtgcagtgttaattccggccaatgttgggggattc

SEQ ID NO: 321391 - DNA, 75 bp, Artificial Sequence
  Synthetic
cctatctgaagtaggcagatggtacaattcaggagcgactctgattacaatcatagtagtcatgattgtgatatt

SEQ ID NO: 321392 - DNA, 75 bp, Artificial Sequence
  Synthetic
aactacatgtctacatctaggtgctttgtcaggaatattggggatccggcagtcgcagccctagctgatctcaag

SEQ ID NO: 321393 - DNA, 75 bp, Artificial Sequence
  Synthetic
ttgtcaggaatattggggatccggcagtcgcagccctagctgatctcaagagattcatcagagcagatcttctag

SEQ ID NO: 321394 - DNA, 75 bp, Artificial Sequence
  Synthetic
agtggtcattgtagtgattatcatcgtgctctacaggctcagaagatcaatgctgatgggtaatccagcaggtcg

SEQ ID NO: 321395 - DNA, 75 bp, Artificial Sequence
  Synthetic
ataaacaggtgttgtatagggtcatgaatcaagagcctggtgattctagttttctagattgggcttcagatcctt

SEQ ID NO: 321396 - DNA, 75 bp, Artificial Sequence
  Synthetic
aatatcgagagactcatacacactagagccaaagataaggcatatgtataccaacggtggatttgatgctatgac

SEQ ID NO: 321397 - DNA, 75 bp, Artificial Sequence
  Synthetic
attcatgcaaccttccgcactctcagagtataactacaattataaagaatatcactgctaggtctgtgctgcagg

SEQ ID NO: 321398 - DNA, 75 bp, Artificial Sequence
  Synthetic
tgagaaaagatgatcacaagtcttgttggatgtctgataaaataggtatagtatttgttgaggtctgtatataat

SEQ ID NO: 321399 - DNA, 75 bp, Artificial Sequence
  Synthetic
aatctccgaatcctctactgtctggtctttttacagagaccagtggcgaagaggatctcaacctggcctcgtttc

SEQ ID NO: 321400 - DNA, 75 bp, Artificial Sequence
  Synthetic
aagaaaaacttagggtgaaagttgggccactcaacactacagccttcacttcaaacgggtacagatcatggatgg

SEQ ID NO: 321401 - DNA, 75 bp, Artificial Sequence
  Synthetic
gaggatctcaacctggcctcgtttcttatggaccggaaagtcatcctacctagagtggctcatgagatcttgggt

SEQ ID NO: 321402 - DNA, 75 bp, Artificial Sequence
  Synthetic
cgataaacgtaagtgtgatttgtattggtctacctcctctagtggtagcactacaaaattagtatcagactgggg

SEQ ID NO: 321403 - DNA, 75 bp, Artificial Sequence
  Synthetic
aattccttaacaggggttagagaagcaattgcagggatgcttgatacaaccaagtctctagtgagagcgagtgtt

SEQ ID NO: 321404 - DNA, 75 bp, Artificial Sequence
  Synthetic
gaggtcaggtaaaattggctcttggttgttgattctagcatttactcaatgggccttgtcgattactacagtgat

SEQ ID NO: 321405 - DNA, 75 bp, Artificial Sequence
  Synthetic
aagaggggaggattgtcatatgggatattgaggagacttgtcaattatgatctgttgcagtacgagacactgact

SEQ ID NO: 321406 - DNA, 75 bp, Artificial Sequence
  Synthetic
catttgcatcgtaatcattgctaagcaaggacatagtatgagagaatattcaacaactatagaggtactgaacat

SEQ ID NO: 321407 - DNA, 75 bp, Artificial Sequence
  Synthetic
aggactctcaggaagccggtgaaagacaacattgagtatgagtatatgtgctcagttgagctggctgtcggttta

SEQ ID NO: 321408 - DNA, 75 bp, Artificial Sequence
  Synthetic
aagtagcagagaagtaagggagtcactcaccagtctaataaggcaagaggttgtcactagagccgttaacattca

SEQ ID NO: 321409 - DNA, 75 bp, Artificial Sequence
  Synthetic
aggcagaagatgtggatccacctgacgtatgggagacctatacacgggctagaaacaccagaccctttagagctc

SEQ ID NO: 321410 - DNA, 75 bp, Artificial Sequence
  Synthetic
cgtatgggagacctatacacgggctagaaacaccagaccctttagagctcttgaggggaacatttattgaaggct

SEQ ID NO: 321411 - DNA, 75 bp, Artificial Sequence
  Synthetic
gagttccgtgcaaaccgggatccctgtcttgttgaacaagaacagcagagatgttattcagctgattgaaaagtc

SEQ ID NO: 321412 - DNA, 75 bp, Artificial Sequence
  Synthetic
cagaggtgtgtaagctttgcaggtctgagggagcggaccccatctatacatggttttacctcccagacaatatag

SEQ ID NO: 321413 - DNA, 75 bp, Artificial Sequence
  Synthetic
gtgcaatagaaaagatctcacgcagctctgcgatagtacaattgcagtccatcatgctgaaggaatcgccccact

SEQ ID NO: 321414 - DNA, 75 bp, Artificial Sequence
  Synthetic
acctggatacacttacaaacgggtgtccagctatacggattccctattttggatcagcaactgatgaaagatcag

SEQ ID NO: 321415 - DNA, 75 bp, Artificial Sequence
  Synthetic
tgaaccacatagtttctggagatgccctgcaggggaaccgtatctcagcccggatcctgaaatctcattgctgcc

SEQ ID NO: 321416 - DNA, 75 bp, Artificial Sequence
  Synthetic
aagctcaactcggatatgtaaggaatctgagtaaaccagcaaaggcggctatacggatagctatggtgtacacgt

SEQ ID NO: 321417 - DNA, 75 bp, Artificial Sequence
  Synthetic
tctgagtaaaccagcaaaggcggctatacggatagctatggtgtacacgtgggcttacgggaccgatgagatatc

SEQ ID NO: 321418 - DNA, 75 bp, Artificial Sequence
  Synthetic
tggtccaagcctattgtctggttcgacaacgatctctggatgtgttaggctcccctcactttcaatcggtgaagc

SEQ ID NO: 321419 - DNA, 75 bp, Artificial Sequence
  Synthetic
gatctatgcttactcgtcaaacctcatcacacagggctgtactgacattgggaagtcataccaggtcctacagct

SEQ ID NO: 321420 - DNA, 75 bp, Artificial Sequence
  Synthetic
gtggatggaagctgctctcatagcccagacaagggctaatctgagcttagaaaatctaaagctgctgactcctgt

SEQ ID NO: 321421 - DNA, 75 bp, Artificial Sequence
  Synthetic
ggggtacatatcactcaattcagatttatttcctgaccttaaccctgtagtgtctcacacttatgacatcaatga

SEQ ID NO: 321422 - DNA, 75 bp, Artificial Sequence
  Synthetic
ttcaacatcaactaatctctctcataggttaaaagacacggcaacccagatgaagttctccagtgcaacactagt

SEQ ID NO: 321423 - DNA, 75 bp, Artificial Sequence
  Synthetic
ttatttcctgaccttaaccctgtagtgtctcacacttatgacatcaatgacaaccggaaatcatgctcagtagtg

SEQ ID NO: 321424 - DNA, 75 bp, Artificial Sequence
  Synthetic
ccgtgcaagtcggttcataacaatatcaaatgacaacatggcactcaaagaagcaggggagtcgaaggacactaa

SEQ ID NO: 321425 - DNA, 75 bp, Artificial Sequence
  Synthetic
aagcaggggagtcgaaggacactaatctcgtatatcagcagattatgctcactgggctaagcttgtttgagttca

SEQ ID NO: 321426 - DNA, 75 bp, Artificial Sequence
  Synthetic
atcgaagatgtggtccttgacatcctagatctcaaaggaaggaccaagtctcatcggtatagtaacagcgagata

SEQ ID NO: 321427 - DNA, 75 bp, Artificial Sequence
  Synthetic
tagatctcaaaggaaggaccaagtctcatcggtatagtaacagcgagatagatcttgaccacccgtattctgcac

SEQ ID NO: 321428 - DNA, 75 bp, Artificial Sequence
  Synthetic
atatgaggtataagaaaggttccttagagaagccactgatattacacctacatcttaataacgggtgctgtataa

SEQ ID NO: 321429 - DNA, 75 bp, Artificial Sequence
  Synthetic
tggaatctccacaggaagcaaatatccccccaagatccactttggatttggaaatcacacaagaaaacaacaaat

SEQ ID NO: 321430 - DNA, 75 bp, Artificial Sequence
  Synthetic
cattgcaaggtgatacgaagtgtaggactcaaggatgccaacaggtgtcgcaagacacatgcaatgaagccttga

SEQ ID NO: 321431 - DNA, 75 bp, Artificial Sequence
  Synthetic
tgatctatgatcccgatccactcagggatgtagacctagagctatttagcaaggtcagagatgtcgtacatacag

SEQ ID NO: 321432 - DNA, 75 bp, Artificial Sequence
  Synthetic
agattacatggctgggggggaagcaggtggtcaatgtgctcatccaagtaaatgactatctctcagagagaccaa

SEQ ID NO: 321433 - DNA, 75 bp, Artificial Sequence
  Synthetic
ttgacatgacctattggtcagacgatgaagttatcagggctactagtatatgtactgcaatgacaatagctgata

SEQ ID NO: 321434 - DNA, 75 bp, Artificial Sequence
  Synthetic
aatgactatctctcagagagaccaaagataagagtcacaaccattccagtcactcagaattacctcggagcggaa

SEQ ID NO: 321435 - DNA, 75 bp, Artificial Sequence
  Synthetic
caatgtctcaattagatagagacaacttaaaggagatgatagcactggtaaatgatgatgatgtcaacagcctga

SEQ ID NO: 321436 - DNA, 75 bp, Artificial Sequence
  Synthetic
ttactgagtttatggtgattgatgttcctctattttgctcaacattcggaggtatcctagtcaatcagtttgcat

SEQ ID NO: 321437 - DNA, 75 bp, Artificial Sequence
  Synthetic
ggggtacttgatgtcagccaccctttgactatcaactggacgcctcatgaggtcttgtctaggcctggaaatgga

SEQ ID NO: 321438 - DNA, 75 bp, Artificial Sequence
  Synthetic
actcactctacggcttgaatatcagaggaagggaagaaatatggggacacgtagtccggattctgaaagatacct

SEQ ID NO: 321439 - DNA, 75 bp, Artificial Sequence
  Synthetic
cccacgcagtcttgaaagtcttatccaatgctctgtcccatcccaagatcttcaaacgattctggaatgcaggtg

SEQ ID NO: 321440 - DNA, 75 bp, Artificial Sequence
  Synthetic
gatgcagctaatgtagccacagtcacgttatatgcaaacacttcacgtgctaatccaacgatcatgtactccaac

SEQ ID NO: 321441 - DNA, 75 bp, Artificial Sequence
  Synthetic
ttgtagaacctgtgtatgggcctaacctttcaaatcaggataagacactactagccctctctgtatgtgagtatt

SEQ ID NO: 321442 - DNA, 75 bp, Artificial Sequence
  Synthetic
cctttcaaatcaggataagacactactagccctctctgtatgtgagtattctgtggacctattcatgcacgactg

SEQ ID NO: 321443 - DNA, 75 bp, Artificial Sequence
  Synthetic
actaccaacattataaatatgttgaggataaaagacgtactactggaggctgcatacaccacaacatcgtgtatc

SEQ ID NO: 321444 - DNA, 75 bp, Artificial Sequence
  Synthetic
gcaaggaggtgtaccgcttgaggtctttatctgtgataatgacccagatgtggctgacatgaggaggtcctcttt

SEQ ID NO: 321445 - DNA, 75 bp, Artificial Sequence
  Synthetic
acgcactttggcaaaggctactgtttccatatcgtcgagatcaaccaaaagagtttgaacaccctgcaaccaatg

SEQ ID NO: 321446 - DNA, 75 bp, Artificial Sequence
  Synthetic
cttggctagacaccttgcatacctgtgcagcttggcagagatatctagggatgggccaagactagagtcaatgaa

SEQ ID NO: 321447 - DNA, 75 bp, Artificial Sequence
  Synthetic
ctcttcaagaccagcatcccgaaattatgcaaggtcgagtcataaatttcactaatcagcgggctagtcagcctt

SEQ ID NO: 321448 - DNA, 75 bp, Artificial Sequence
  Synthetic
ctctcttgagaggctagagacattaaagagttatctggaactcacgttccttgatgaccctgtactgaggtacag

SEQ ID NO: 321449 - DNA, 75 bp, Artificial Sequence
  Synthetic
ggtggcacaagggccatcactgtacatccacaatatctcctagtatctcacatcccccatggtattaagaaaaac

SEQ ID NO: 321450 - DNA, 75 bp, Artificial Sequence
  Synthetic
atccacaatatctcctagtatctcacatcccccatggtattaagaaaaacccagggcgaatgggaagtctgtcat

SEQ ID NO: 321451 - DNA, 75 bp, Artificial Sequence
  Synthetic
tcaattgactggcttagtcatcaaagtattcccgtcaactttgacctacatccggaagtcatctataaaggtatt

SEQ ID NO: 321452 - DNA, 75 bp, Artificial Sequence
  Synthetic
aagaacaagaggaataggagtccccgaagttttagaagattgggaccccgaggcggataatgcactgctagacgg

SEQ ID NO: 321453 - DNA, 75 bp, Artificial Sequence
  Synthetic
catcgcagcagaaatacaacagaatattcccttaggacatcagactagagcccctttttgggggctgagggtatc

SEQ ID NO: 321454 - DNA, 75 bp, Artificial Sequence
  Synthetic
taatcaatatcacaaaacacaaaatcaggaatggtggactatctcctcgtcaaattaagatcagatctctaggta

SEQ ID NO: 321455 - DNA, 75 bp, Artificial Sequence
  Synthetic
cccctttttgggggctgagggtatccaagtcacaggtactgcgtctccgggggtacgaggagatcacaagaggtg

SEQ ID NO: 321456 - DNA, 75 bp, Artificial Sequence
  Synthetic
aggctcttcaacgcacaattaaagacttggaccggtacacatttgaaccgtacccaacctactcccaggagttat

SEQ ID NO: 321457 - DNA, 75 bp, Artificial Sequence
  Synthetic
aggtaggcagatcaggtgttggtctgacgttaccattcgatggaaggtatctatctcaccagctgaggctctttg

SEQ ID NO: 321458 - DNA, 75 bp, Artificial Sequence
  Synthetic
ttagactcgatataccggagatatgtgacaagatccgatctgttttctcagtctcagatcggctaacaaaggagt

SEQ ID NO: 321459 - DNA, 75 bp, Artificial Sequence
  Synthetic
tagctaatggattccaggatctatggttgaatatctttaagcaactaggtaatatagagggaagagaggggtatg

SEQ ID NO: 321460 - DNA, 75 bp, Artificial Sequence
  Synthetic
ataggctgtttttaggggaaggagctggggctatgctctcctgttatgacgctactcttggcccatgcatcaact

SEQ ID NO: 321461 - DNA, 75 bp, Artificial Sequence
  Synthetic
gctactcttggcccatgcatcaactattataactcgggggtatactcttgtgatgtcaatgggcagagagagtta

SEQ ID NO: 321462 - DNA, 75 bp, Artificial Sequence
  Synthetic
taacctggttcagtatcaaatatgacatgcggtggatacagaaaactaggccagggggaccccttgatacctcca

SEQ ID NO: 321463 - DNA, 75 bp, Artificial Sequence
  Synthetic
aatatatatcctgctgaagtggcattagtgggaaagaaattaaataatgttaccagtctaggtcagagggttaag

SEQ ID NO: 321464 - DNA, 75 bp, Artificial Sequence
  Synthetic
actcacacaatctcctagagtgcaaatcatacactctagtaacatatggagaccttgtcatgatactgaataagt

SEQ ID NO: 321465 - DNA, 75 bp, Artificial Sequence
  Synthetic
gtgttgttcaacgggaatcctggctcgacatggatcgggaatgatgaatgtgaggctttgatttggaatgaacta

SEQ ID NO: 321466 - DNA, 75 bp, Artificial Sequence
  Synthetic
tgacattgacagggtatattctgacacctgagctggttttgatgtattgtgatgttgtggaagggaggtggaaca

SEQ ID NO: 321467 - DNA, 75 bp, Artificial Sequence
  Synthetic
cagaatagttcgataggcctagtccactgtgacatggaaggaggagatcataaggatgatcaagttgtactgcat

SEQ ID NO: 321468 - DNA, 75 bp, Artificial Sequence
  Synthetic
tgtctgctgcagggcatttagataagaggtcctcggggataacaagcaaaggggaggagctatggaagctagtgg

SEQ ID NO: 321469 - DNA, 75 bp, Artificial Sequence
  Synthetic
gagcattacagtgtgatcaggattgcgtatctggtgggggatagagacgttgtgctgataagtaagattgctccc

SEQ ID NO: 321470 - DNA, 75 bp, Artificial Sequence
  Synthetic
attccctctttccaagtctcggggaggagatatataatgtcatcgcgttactcgagcctttatcacttgctctta

SEQ ID NO: 321471 - DNA, 75 bp, Artificial Sequence
  Synthetic
aggctgggcacagattggaccaggcagcttagcctttacctgaggtactgggatgaggtcaacctggtagtgctt

SEQ ID NO: 321472 - DNA, 75 bp, Artificial Sequence
  Synthetic
tacagctaagtgatcctgtcatgcctctacgtggcgcatttatgagacatgtgttgacagagctacagactgttt

SEQ ID NO: 321473 - DNA, 75 bp, Artificial Sequence
  Synthetic
aaaacatctaatcctgcttctacagagatgtatctcctctcaaggcatcccaaatctgacatcatagaagatagc

SEQ ID NO: 321474 - DNA, 75 bp, Artificial Sequence
  Synthetic
gtgttgacagagctacagactgttttaacaaataaggacgtgtatacggatcttgaggcagatgtcattgtggag

SEQ ID NO: 321475 - DNA, 75 bp, Artificial Sequence
  Synthetic
aagacagtgctggccagtcttcaccctctgtcaaaggaagacagcatcaagatagaaaagtggatcttgatagag

SEQ ID NO: 321476 - DNA, 75 bp, Artificial Sequence
  Synthetic
aaagcaaaggctcacgaatgggttacccgggagttgagagaaggaagctcgtcgtcagggatgcttagaccttac

SEQ ID NO: 321477 - DNA, 75 bp, Artificial Sequence
  Synthetic
catccaagcttagaggccgtcactgcagcagacaaggtccgggctcatatgtatgcacaaaaggcaataaagctt

SEQ ID NO: 321478 - DNA, 75 bp, Artificial Sequence
  Synthetic
caccaggcactgcagacgtttggttttgaacccaatttatataaactgagcagggatttcctgtccactatgaac

SEQ ID NO: 321479 - DNA, 75 bp, Artificial Sequence
  Synthetic
aagaccttacacgagtgtcacgcagtgttctgtacaatcatcataaatggatacagggaaagacatggcggacag

SEQ ID NO: 321480 - DNA, 75 bp, Artificial Sequence
  Synthetic
atagctgacactcacaactgcatgacagccttcaacagagttttaaaggatacaatctttgagtgggctagaata

SEQ ID NO: 321481 - DNA, 75 bp, Artificial Sequence
  Synthetic
tggcccccctgtgacttccctgatcatgtgtgcctggaacttagaaatgctcaggggtccaatacggctatctct

SEQ ID NO: 321482 - DNA, 75 bp, Artificial Sequence
  Synthetic
accgagtcagacaaaaggctcaaactaactggtaagtatgacctgtaccctgttagagactcaggcaagttgaag

SEQ ID NO: 321483 - DNA, 75 bp, Artificial Sequence
  Synthetic
tatgagtgtgctgtagacaattatacaagtttcataggcttcaagtttcggaagtttatagaaccacagctagat

SEQ ID NO: 321484 - DNA, 75 bp, Artificial Sequence
  Synthetic
acaatttctagaagacttgtactgtcttgggtatcattatctatgtctacaagactggtaactgggtctttcccc

SEQ ID NO: 321485 - DNA, 75 bp, Artificial Sequence
  Synthetic
gaagatctcacgatatacatgaaggacaaagcattatcacctaggagagaagcatgggattccgtgtatccagat

SEQ ID NO: 321486 - DNA, 75 bp, Artificial Sequence
  Synthetic
gaccaaaagtttgaggcaagactccaattagggatagtttcactgtcatctcgtgaaatcaggaacctgagggtt

SEQ ID NO: 321487 - DNA, 75 bp, Artificial Sequence
  Synthetic
agtaatctgtactacaaagttccagagtctgaggagaccaggcggctcatcgaagtatttataaatgataaaaac

SEQ ID NO: 321488 - DNA, 75 bp, Artificial Sequence
  Synthetic
agtctgaggagaccaggcggctcatcgaagtatttataaatgataaaaactttaacccagaggacataatagatt

SEQ ID NO: 321489 - DNA, 75 bp, Artificial Sequence
  Synthetic
atcacaaaaactatattagataggtttgagaatactatacatagtataacatatagatttctcaccaaagaaata

SEQ ID NO: 321490 - DNA, 75 bp, Artificial Sequence
  Synthetic
aagattttgatgaagattttaggagctgtcaagatgttcggggctaggcagaatgaatacacaaccgtggttgat

SEQ ID NO: 321491 - DNA, 75 bp, Artificial Sequence
  Synthetic
aagagggccgcctgttcgcaaaaatgacttataaaatgcgagctgtacaggtactggcggagacactactggcga

SEQ ID NO: 321492 - DNA, 75 bp, Artificial Sequence
  Synthetic
gatggatcattagatgacatcgagccatatgacagcttgtgataagtaatcattatcatgcagggttatttaaaa

SEQ ID NO: 321493 - DNA, 75 bp, Artificial Sequence
  Synthetic
tctctgtctcaggagtccctaggactgattcagtgtacaataatcctagatcatcagagaaaagaaatgaagaca

SEQ ID NO: 321494 - DNA, 75 bp, Artificial Sequence
  Synthetic
ttcacggtgtctagaagtcttggacttatccatatggcaatagtaagaaaaacttacaaggagacaagaaaattt

SEQ ID NO: 321495 - DNA, 75 bp, Artificial Sequence
  Synthetic
tgattcagtgtacaataatcctagatcatcagagaaaagaaatgaagacataaagaagaggaatgcaaaggggta

SEQ ID NO: 321496 - DNA, 75 bp, Artificial Sequence
  Synthetic
tggcaatagtaagaaaaacttacaaggagacaagaaaatttgaaagaataaatatctcttaaactcttgtctggt

SEQ ID NO: 321497 - DNA, 75 bp, Artificial Sequence
  Synthetic
accaaacaagagaaaaaacatgtatgggatatgtaatgaagttatacaggattttagggtcaaagtatccaccct

SEQ ID NO: 321498 - DNA, 75 bp, Artificial Sequence
  Synthetic
ttgcttcctaacaacagaccttaaaaagtattgcttaaattggagatttgaaagcactgcacttttcgggcagag

SEQ ID NO: 321499 - DNA, 75 bp, Artificial Sequence
  Synthetic
gataggacgcatcaacaactgcaggatcatgcagactctggcatcttcatacacaatcctagagggggaatagaa

SEQ ID NO: 321500 - DNA, 75 bp, Artificial Sequence
  Synthetic
acacaatcctagagggggaatagaaggttattgccaaaagctatggaccttaatctcaatcagtgctatccactt

SEQ ID NO: 321501 - DNA, 75 bp, Artificial Sequence
  Synthetic
gggaggacataccttgatatggaaatgttcttactaggacaagccgtggcaaaggatgctgaatcgaagatcacg

SEQ ID NO: 321502 - DNA, 75 bp, Artificial Sequence
  Synthetic
gagacatgtcatgtttgacatagggcatgagctaaaattgaatgagactatcattagtagcaaaatgttcgtcta

SEQ ID NO: 321503 - DNA, 75 bp, Artificial Sequence
  Synthetic
catgagctaaaattgaatgagactatcattagtagcaaaatgttcgtctacagtaaaagaatatattatgatggg

SEQ ID NO: 321504 - DNA, 75 bp, Artificial Sequence
  Synthetic
atattctcctatactgggctactgcattgcgttgtacaagacttgtcagcaggtatgcatttcactggggatgac

SEQ ID NO: 321505 - DNA, 75 bp, Artificial Sequence
  Synthetic
cgcaataacggtgtcgatcacgacgaagatgacgataccgcagcagtagctggggtaggaggaatctaggatcat

SEQ ID NO: 321506 - DNA, 75 bp, Artificial Sequence
  Synthetic
tataaatccaacaattaacccgaccgtaagagatcaatactttaaaggtaaaaattggctgagatgtgcagtatt

SEQ ID NO: 321507 - DNA, 75 bp, Artificial Sequence
  Synthetic
aatcccggccaatgttgggggattcaactacatgtctacatctaggtgcttcgtcaggaacatcggggatcccgc

SEQ ID NO: 321508 - DNA, 75 bp, Artificial Sequence
  Synthetic
ttcatccaccgatcggctcaggcaaggccacacccaaccccaccgaccacacccagcagtcgagacagccacggc

SEQ ID NO: 321509 - DNA, 75 bp, Artificial Sequence
  Synthetic
aagatgccttcattcttaaagaagattctgaagttgagagggaggcgccaggaggacgagagtcgctctcggatg

SEQ ID NO: 321510 - DNA, 75 bp, Artificial Sequence
  Synthetic
agtagcagccttggccgatctcaagaggttcatcagggcggatcttctagataagcaagtgttgtacagagtcat

SEQ ID NO: 321511 - DNA, 75 bp, Artificial Sequence
  Synthetic
ttatcggattcctcgatgctgtcctgtcgagtgaaccaactgacatcggaggggacagaagctggctccacaaca

SEQ ID NO: 321512 - DNA, 75 bp, Artificial Sequence
  Synthetic
gtcgagtgaaccaactgacatcggaggggacagaagctggctccacaacaccatcaacactccccaaggaccagg

SEQ ID NO: 321513 - DNA, 75 bp, Artificial Sequence
  Synthetic
ataagcaagtgttgtacagagtcatgaatcaagaacctggtgattctagctttttggattgggcttcagatcctt

SEQ ID NO: 321514 - DNA, 75 bp, Artificial Sequence
  Synthetic
aatccccgaatcccttgctgtctggtcttttcacagagtccagtggtgaggaggatctcaacctggcctcgttcc

SEQ ID NO: 321515 - DNA, 75 bp, Artificial Sequence
  Synthetic
ttatggaccggaaagttatcctaccgagagtagctcatgagatcttgggcaattctttaacaggagttagagaag

SEQ ID NO: 321516 - DNA, 75 bp, Artificial Sequence
  Synthetic
caattgcagggatgcttgatacaactaagtctctggtgagggcaagcattaagaagggagggctgtcatatggga

SEQ ID NO: 321517 - DNA, 75 bp, Artificial Sequence
  Synthetic
taagtctctggtgagggcaagcattaagaagggagggctgtcatatgggatattgaggagacttgtcaattatga

SEQ ID NO: 321518 - DNA, 75 bp, Artificial Sequence
  Synthetic
ttctgttgagctagctgtcggtttaaggcagaaaatgtggatccatctgacgtatgggagacccatacatgggct

SEQ ID NO: 321519 - DNA, 75 bp, Artificial Sequence
  Synthetic
ggaaacaccggatcccttagagctcttgagggggacattcattgagggctcggaggtctgcaaactctgtaggtc

SEQ ID NO: 321520 - DNA, 75 bp, Artificial Sequence
  Synthetic
atcccgggtgaggcatcctaccatcctcagtcatagagagatccaatctaccatcagcatcagccagtaaagatt

SEQ ID NO: 321521 - DNA, 75 bp, Artificial Sequence
  Synthetic
cgagggagcggaccctatctatacgtggttttaccttccggacaatatagacttggatactcttacaaatgggag

SEQ ID NO: 321522 - DNA, 75 bp, Artificial Sequence
  Synthetic
atatgaggataacggtactgtggagcccctgcctctgagaactggtccggataagaaagccatcccccacatcag

SEQ ID NO: 321523 - DNA, 75 bp, Artificial Sequence
  Synthetic
cccagctataaggattccctacttcggatcagccactgatgaaaggtcagaagctcaacttggatatgtaaggaa

SEQ ID NO: 321524 - DNA, 75 bp, Artificial Sequence
  Synthetic
tctaagcaaaccagcaaaagcagctatccggatagccatggtgtacacatgggcctacgggacagatgaggtatc

SEQ ID NO: 321525 - DNA, 75 bp, Artificial Sequence
  Synthetic
gggcctacgggacagatgaggtatcttggatggaagcagctctcatagcccaaacaagagctaatcttagcttgg

SEQ ID NO: 321526 - DNA, 75 bp, Artificial Sequence
  Synthetic
tggagtccccacaggaggcgaatatccccccaagatccaccctagatttggagatcacacaggagaacaataaat

SEQ ID NO: 321527 - DNA, 75 bp, Artificial Sequence
  Synthetic
tgatctatgatcctaacccactcagggatgtggaccttgagctatttagcaaggtcagagatgtcgtacatacag

SEQ ID NO: 321528 - DNA, 75 bp, Artificial Sequence
  Synthetic
ttgacatgacctattggtcagatgatgaagtcatcagggcgaccagcatatgtactgcaatgacaatagccgata

SEQ ID NO: 321529 - DNA, 75 bp, Artificial Sequence
  Synthetic
caatgtctcaattagatagagacaatctaaaggagatgatagcactagtaaatgatgatgatgttaatagcttaa

SEQ ID NO: 321530 - DNA, 75 bp, Artificial Sequence
  Synthetic
ttactgagtttatggtggttgatgttcctctattttgctcaacattcggaggtatactagtcaatcagtttgcat

SEQ ID NO: 321531 - DNA, 75 bp, Artificial Sequence
  Synthetic
caggaggctctgataactgtcaccagtgatacgacacaaaatgccggtgctccacagtcgaaattcttcggtgct

SEQ ID NO: 321532 - DNA, 75 bp, Artificial Sequence
  Synthetic
actcactctacggtttgaacatcagaggaagagaagaaatatggggacatatagtccggattctgaaagatacct

SEQ ID NO: 321533 - DNA, 75 bp, Artificial Sequence
  Synthetic
cccacgcagttctgaaagtcttgtctaacgctttatcccatccaaagatcttcaagcgattttggaatgcaggtg

SEQ ID NO: 321534 - DNA, 75 bp, Artificial Sequence
  Synthetic
gaattaggctgtgagactgctgccttaagactgggtataaaattgacacagcattactccgagctgttaactgcg

SEQ ID NO: 321535 - DNA, 75 bp, Artificial Sequence
  Synthetic
ttttagaacctgtgtacgggcctaacctctcaaatcaggataagacactcctggccctctctgtatgtgagtatt

SEQ ID NO: 321536 - DNA, 75 bp, Artificial Sequence
  Synthetic
attactgagattatgaccacaatcaggacagggcagtctaacatctatgatgtcatttatacagaacagatcaaa

SEQ ID NO: 321537 - DNA, 75 bp, Artificial Sequence
  Synthetic
ggacagggcagtctaacatctatgatgtcatttatacagaacagatcaaaggaacggtgatagatgtggatctaa

SEQ ID NO: 321538 - DNA, 75 bp, Artificial Sequence
  Synthetic
ctgtagatctttttatgcatgactggcaagggggtgtaccgcttgaggtctttatctgtgataatgacccggatg

SEQ ID NO: 321539 - DNA, 75 bp, Artificial Sequence
  Synthetic
gcaagggggtgtaccgcttgaggtctttatctgtgataatgacccggatgtggctgacatgaggaagtcctcttt

SEQ ID NO: 321540 - DNA, 75 bp, Artificial Sequence
  Synthetic
ctcccttgagaggctagactcattaaaaagctatctggaactcacatttcttgatgaccctatgctgagatacag

SEQ ID NO: 321541 - DNA, 75 bp, Artificial Sequence
  Synthetic
tcaattgactggcttagtcatcaaagtattcccgtcaactctgacctatatcaggaagtcatctataaaagtatt

SEQ ID NO: 321542 - DNA, 75 bp, Artificial Sequence
  Synthetic
tcatagtagttatggtcgtaatattggtggtcattatagtgatcatcatcgtgctttatagactcagaaggtcaa

SEQ ID NO: 321543 - DNA, 75 bp, Artificial Sequence
  Synthetic
aaggacaagaggtataggagtccctgaagtcttagaggattgggatcctgatgcagataatgcactgctagacgg

SEQ ID NO: 321544 - DNA, 75 bp, Artificial Sequence
  Synthetic
tgctaatgggtaatccagatgaccgtataccgagggacacatacacattagagccgaagatcagacatatgtaca

SEQ ID NO: 321545 - DNA, 75 bp, Artificial Sequence
  Synthetic
cattgcggcagaaatacaacagaatattcccctaggacatcagattagggcccccttttgggggttgagagtatc

SEQ ID NO: 321546 - DNA, 75 bp, Artificial Sequence
  Synthetic
cccccttttgggggttgagagtatctaagtcacaggtactgcgtctacgggggtacaaggagatcacaagaggag

SEQ ID NO: 321547 - DNA, 75 bp, Artificial Sequence
  Synthetic
gtattaacagtactagctgcttgaaggcgcttgagcttacctacttattaagccctttggtcgacaaggataagg

SEQ ID NO: 321548 - DNA, 75 bp, Artificial Sequence
  Synthetic
ataggctgtttttaggggaaggggccggggctatgctttcttgttatgacgctactcttggcccatgcatcaact

SEQ ID NO: 321549 - DNA, 75 bp, Artificial Sequence
  Synthetic
attataactcgggcgtatattcttgtgatgttaatgggcagagagagttaaatatatatcctgctgaggtggcat

SEQ ID NO: 321550 - DNA, 75 bp, Artificial Sequence
  Synthetic
tagtgggaaagaaactaaacaatgttactagtctgagtcagagagttaaggtgttgtttaacggaaatcctggct

SEQ ID NO: 321551 - DNA, 75 bp, Artificial Sequence
  Synthetic
gatcttgatcacccgttctctgcactataccccagtgtaggcaacggcattgcaacagaaggctcattgatattt

SEQ ID NO: 321552 - DNA, 75 bp, Artificial Sequence
  Synthetic
cgacatggatcgggaatgatgaatgtgaggctttgatttggaatgaactgcagaatagctcaataggcttagtcc

SEQ ID NO: 321553 - DNA, 75 bp, Artificial Sequence
  Synthetic
cttgggtatggtggactaaccacccctctgcagggtgatacaaaatgtaggacccaaggatgccaacaggtgtcg

SEQ ID NO: 321554 - DNA, 75 bp, Artificial Sequence
  Synthetic
catatctggtgggggatcgagacgttgtgctaataagtaagattgctcctaggctgggcacagattggaccaggc

SEQ ID NO: 321555 - DNA, 75 bp, Artificial Sequence
  Synthetic
agcttagcttatacctgaggtactgggatgaggttaacttggttgtgcttaaaacatctaatcctgcttctgcag

SEQ ID NO: 321556 - DNA, 75 bp, Artificial Sequence
  Synthetic
agatgtatctactatcacggcaccctaaatctgatattatggaagatagtaagacagtgctggccagtctcaaac

SEQ ID NO: 321557 - DNA, 75 bp, Artificial Sequence
  Synthetic
taataaatattacaaagcacaaaattaggaacggaggattgtcccctcgtcaaattaagatcaggtctctgggta

SEQ ID NO: 321558 - DNA, 75 bp, Artificial Sequence
  Synthetic
ctctgtcgagggaagacagcatcaagatagaaaagtggatcctgatagaaaaagcaaaggctcatgaatgggtta

SEQ ID NO: 321559 - DNA, 75 bp, Artificial Sequence
  Synthetic
cccgagagttaagagagggaagttcgtcgtcagggatgcttagaccttaccaccaggcgttacaaacgtttggct

SEQ ID NO: 321560 - DNA, 75 bp, Artificial Sequence
  Synthetic
ttgaacccaacctatataaattaagcagggatttcctgtctaccatgaacatagctgatacacacaactgcatga

SEQ ID NO: 321561 - DNA, 75 bp, Artificial Sequence
  Synthetic
cagggatttcctgtctaccatgaacatagctgatacacacaactgcatgacagcttttaatagagttttaaaaga

SEQ ID NO: 321562 - DNA, 75 bp, Artificial Sequence
  Synthetic
tgaccggtaagtatgacttgtaccctattagagactcaggcaagttaaagacaatatctaggagacttgtattgt

SEQ ID NO: 321563 - DNA, 75 bp, Artificial Sequence
  Synthetic
aattggggatagtctcactgtcgtctcgtgaaatcaggaacttgagagttatcacaaagactatattagataagt

SEQ ID NO: 321564 - DNA, 75 bp, Artificial Sequence
  Synthetic
taacaagtagagacgtgtacacagatgctgaagcagacactattgtggagtcgttactcgccattttccatggaa

SEQ ID NO: 321565 - DNA, 75 bp, Artificial Sequence
  Synthetic
ctgtcaagatgttcggagccaggcataatgaatacatgatcgtagttgatgatggatcgctggatgacatcgagc

SEQ ID NO: 321566 - DNA, 75 bp, Artificial Sequence
  Synthetic
catatgacagctcggaataagtaatcattatcatgcggggtgatttaaggtgcacggtgcctagaagtcttggac

SEQ ID NO: 321567 - DNA, 75 bp, Artificial Sequence
  Synthetic
ttacccatatgacaatagtaagaaaaacttacaaagagacaagaaaatttgaaagaatacatatctcttaaactc

SEQ ID NO: 321568 - DNA, 75 bp, Artificial Sequence
  Synthetic
tgacaatagtaagaaaaacttacaaagagacaagaaaatttgaaagaatacatatctcttaaactcttgtctggt

SEQ ID NO: 321569 - DNA, 75 bp, Artificial Sequence
  Synthetic
tcatcagagaagagaaacgaaggcatgggaaataagaactctggggggtactgggacgaaaagaagaggtccaga

SEQ ID NO: 321570 - DNA, 75 bp, Artificial Sequence
  Synthetic
agatcaccaaatatttcggtgctctaagacacgtcatgtttgatgtagggcacgagctaaaattgaacgagacca

SEQ ID NO: 321571 - DNA, 75 bp, Artificial Sequence
  Synthetic
acgaggcttcaaggtacttgatccgtagtaagaaaaacttagggtgaaagttcatccactgatcggctcaggcaa

SEQ ID NO: 321572 - DNA, 75 bp, Artificial Sequence
  Synthetic
ttcagttgagctagctgtcggtctaaggcagaaaatgtggatccacctgacttacgggagacccatacatgggct

SEQ ID NO: 321573 - DNA, 75 bp, Artificial Sequence
  Synthetic
atcactgctagatctgtgctgcaggaatccccgaatcctctactgtctggtctcttcaccgagactagtggcgaa

SEQ ID NO: 321574 - DNA, 75 bp, Artificial Sequence
  Synthetic
ggaaaccaatgatgaggatgtatcagacatagagagaagaatagccatgagactcgcaggaagacggcaagagga

SEQ ID NO: 321575 - DNA, 75 bp, Artificial Sequence
  Synthetic
accaaacaagagaagaaacatgtttggaatatataatgaagttagacaggattttagggtcaaagtatccaccct

SEQ ID NO: 321576 - DNA, 75 bp, Artificial Sequence
  Synthetic
caagtcacaggtactgcgtctccgggggtacaaggagatcacaagaggtgagataggcagatcaggtgttggtct

SEQ ID NO: 321577 - DNA, 75 bp, Artificial Sequence
  Synthetic
ggacgaggttaacctaatagtgcttaaaacatctaaccctgcttccacagagatgtatctcctatcgaggcaccc

SEQ ID NO: 321578 - DNA, 75 bp, Artificial Sequence
  Synthetic
aaaacatctaaccctgcttccacagagatgtatctcctatcgaggcaccccaaatctgacattatagaggacagc

SEQ ID NO: 321579 - DNA, 75 bp, Artificial Sequence
  Synthetic
atcacaaaaactttattagacaggtttgaggatattatacatagtataacgtatagattcctcaccaaagaaata

SEQ ID NO: 321580 - DNA, 75 bp, Artificial Sequence
  Synthetic
tgacaatagtaagaaaaacttacaagaagacaagaaaatttaaaaggatacatatctcttaaactcttgtctggt

SEQ ID NO: 321581 - DNA, 75 bp, Artificial Sequence
  Synthetic
gctgtgggggaacaaattcttgctctaaagacactccaggattttgtgaatgatgagatcaaacccgcaataagc

SEQ ID NO: 321582 - DNA, 75 bp, Artificial Sequence
  Synthetic
atccccggccagaggagcacagtctcagtgttcgtactaggcccaagtgttactgatgatgcagacaagttatcc

SEQ ID NO: 321583 - DNA, 75 bp, Artificial Sequence
  Synthetic
ggaggagtggtatgtaactgtccccagtcatatactcagtcgtgcctccttccttgggggtgcgaacatagccga

SEQ ID NO: 321584 - DNA, 75 bp, Artificial Sequence
  Synthetic
tacagttaagtgatcctgttatacctctacgtggtgcattcatgaggcgtgtgttgacagagctacagactgttt

SEQ ID NO: 321585 - DNA, 75 bp, Artificial Sequence
  Synthetic
aggacgccagaggttggggtggggatagcggtgacagatgggctcgctcgatgggtagtggccactttatcacac

SEQ ID NO: 321586 - DNA, 75 bp, Artificial Sequence
  Synthetic
gctgaaggacttccagaagagatacgaagaagtgcacccctacctgatgaaagagaaggtagagcagataataat

SEQ ID NO: 321587 - DNA, 75 bp, Artificial Sequence
  Synthetic
gccccagaccgcccgaccgacggctatccaacccacccaagtccagagaccgatgcaacaaaaaagggcatagaa

SEQ ID NO: 321588 - DNA, 75 bp, Artificial Sequence
  Synthetic
gagtcgtcccgagacgcgagttatgtgtttgcaaagcgtgccctaaaatctgcaaactatgcagagatggcattt

SEQ ID NO: 321589 - DNA, 75 bp, Artificial Sequence
  Synthetic
gcagtcccctaagcagagctgaaaaggcagcatatgtgaaatcattatccaagtgcaagacagaccaagaagtta

SEQ ID NO: 321590 - DNA, 75 bp, Artificial Sequence
  Synthetic
ggaactgtgattgatgtagatctagagagatacatggttaccctgtctgtaaaaatccccattctttctgaagtc

SEQ ID NO: 321591 - DNA, 75 bp, Artificial Sequence
  Synthetic
cctgtcacaaaggttgtggataacatcatccccaaatttgcctttgtaaatggaggtgtcgttgcgaactgcata

SEQ ID NO: 321592 - DNA, 75 bp, Artificial Sequence
  Synthetic
gttgctcaccactatagctttcacctcaagtaagtacagatcatggatggtgacaggagcaagcgggactcgtac

SEQ ID NO: 321593 - DNA, 75 bp, Artificial Sequence
  Synthetic
tggtctacctcccctggtggtagcactacaaaattagtgtcagactcagagagatcaggtaaagttgatacctgg

SEQ ID NO: 321594 - DNA, 75 bp, Artificial Sequence
  Synthetic
caaccggaaatcgtgctcggtagtggcaactgggaccaggggttatcagctctgctccatgccgattgtagacga

SEQ ID NO: 321595 - DNA, 75 bp, Artificial Sequence
  Synthetic
gaataagagtcacaaccattccaatcactcagaactacctcggagcagaaggcagattactaaaattaggtgatc

SEQ ID NO: 321596 - DNA, 75 bp, Artificial Sequence
  Synthetic
gccgacacaggggtcattactggatatcctcaacatctcctagtctctcacattctccacagtattaagaaaaac

SEQ ID NO: 321597 - DNA, 75 bp, Artificial Sequence
  Synthetic
cattctccacagtattaagaaaaacccagggtgaatgggaagcctgtcattggctatggacgggcaagagtctac

SEQ ID NO: 321598 - DNA, 75 bp, Artificial Sequence
  Synthetic
acacgttttgttagatgttaaccagccctacattctgaaagatgacagtataataaatatcacaaagcacaaaat

SEQ ID NO: 321599 - DNA, 75 bp, Artificial Sequence
  Synthetic
cccctttttgggggctgagggtatccaagtcacaggtactgcgtctccgggggtacgaagagatcacaaggggtg

SEQ ID NO: 321600 - DNA, 75 bp, Artificial Sequence
  Synthetic
gatggatcattagatgacattgagccatatgacagcttgtgataagtaatcattatcatgcagggttatttaaac

SEQ ID NO: 321601 - DNA, 75 bp, Artificial Sequence
  Synthetic
tgaaccgcatagcttctggagatgccctgcaggagaaccgtatctaagttcagaccctgaagtctcattgctgcc

SEQ ID NO: 321602 - DNA, 75 bp, Artificial Sequence
  Synthetic
tgactatcagctggacaccccatgaagccttgtctaggccaggaaacgaagactgcaattggtacaatacttgtc

SEQ ID NO: 321603 - DNA, 75 bp, Artificial Sequence
  Synthetic
gttgaatatctttaagcaactaggtaacatagaagggagagaggggtacgacccattgcaggatattagcaccat

SEQ ID NO: 321604 - DNA, 75 bp, Artificial Sequence
  Synthetic
caagtttcataggcttcaagtttcggaagtttatagaaccacaactggatgaagatctcacgatatatatgaagg

SEQ ID NO: 321605 - DNA, 75 bp, Artificial Sequence
  Synthetic
tctctgtctcaggagttcctaggactgattcagtgtacaataatcctagatcatcagagaagagaaatgaaggca

SEQ ID NO: 321606 - DNA, 75 bp, Artificial Sequence
  Synthetic
ttgcttcctaacaacagacctcaagaagtactgcttaaattggagatttgagagcactgcacttttcgggcagag

SEQ ID NO: 321607 - DNA, 75 bp, Artificial Sequence
  Synthetic
gtgttaacagtactagctgcttaaaagcacttgaacttacctacttattaagccccttggttgacaaggataagg

SEQ ID NO: 321608 - DNA, 75 bp, Artificial Sequence
  Synthetic
accaaacaagagaagaaacatgtatggaatatacaatgaagttagataggattttagggtcaaagtatccaccct

SEQ ID NO: 321609 - DNA, 75 bp, Artificial Sequence
  Synthetic
attttagggtcaaagtatccaccctgaggagcaggttccagatccttttctttgctgccaaagttcacgatggcc

SEQ ID NO: 321610 - DNA, 75 bp, Artificial Sequence
  Synthetic
agtgccttggaagatgagttaggagtgacggatacagccaaggagaggctcagacatcatctggcaaacttgtcc

SEQ ID NO: 321611 - DNA, 75 bp, Artificial Sequence
  Synthetic
ttctgcaacccatggagatgaaggccgcaataacggtgttgatcacgaagaagatgacgatgccgcagcagcagc

SEQ ID NO: 321612 - DNA, 75 bp, Artificial Sequence
  Synthetic
agcaagccagaggcagaagcacatgctagaaaccttgataaacaaaatatacactgggcctttaggggaagaact

SEQ ID NO: 321613 - DNA, 75 bp, Artificial Sequence
  Synthetic
gatgagcacatcaactctggggacacccccgccgtcagggtcaaagaccggaaaccaccaatagggactcgctct

SEQ ID NO: 321614 - DNA, 75 bp, Artificial Sequence
  Synthetic
gtctcagattgtccagccaacggccgcccaatccatccgggtatagagaccgactcaacaaaaaagggcatagga

SEQ ID NO: 321615 - DNA, 75 bp, Artificial Sequence
  Synthetic
atcccgggtgaggcatcccaccatcctcagtcacagagagacccaatctaccatcagcatcagccagtaaagatt

SEQ ID NO: 321616 - DNA, 75 bp, Artificial Sequence
  Synthetic
gattgtcaaggtaggagaccctcctaaacatggagtgagatacctagatttattgctcttgggtttctttgagac

SEQ ID NO: 321617 - DNA, 75 bp, Artificial Sequence
  Synthetic
tactacgggactgatcaggaactcttaaaggcctgcaccgatctcagaatcacggtgaggagggctgttcgagca

SEQ ID NO: 321618 - DNA, 75 bp, Artificial Sequence
  Synthetic
ggagaaatgatcgtatacatggtggattcgattggtgctccactcctaccatggtcaggtaggctgagacaggga

SEQ ID NO: 321619 - DNA, 75 bp, Artificial Sequence
  Synthetic
tgttgtggctaagaacatcggaaggatcagaaagctgtaaatgtgcacccatcagagacctgcaacaatgtctca

SEQ ID NO: 321620 - DNA, 75 bp, Artificial Sequence
  Synthetic
ggtacatagtactgagtctagttccgggggtagaccttgagaatggatgcggaacagctcaggttatccagtaca

SEQ ID NO: 321621 - DNA, 75 bp, Artificial Sequence
  Synthetic
ggacagggcagtctaacatctatgatgtcatttatacagaacagatcaaaggaacggtgatagatgtagatctgg

SEQ ID NO: 321622 - DNA, 75 bp, Artificial Sequence
  Synthetic
tcatagtagttatggtcgtaatattggtggtcattatagtgatcgtcatcatgctttatagactcagaaggtcaa

SEQ ID NO: 321623 - DNA, 75 bp, Artificial Sequence
  Synthetic
aagaaaaacttagggtgaaagtgaggttgcgcggtattttagctttcatctcaaacaagcacagatcatggatgg

SEQ ID NO: 321624 - DNA, 75 bp, Artificial Sequence
  Synthetic
tcaaacaagcacagatcatggatggtgataggggcaaacgtgactcgtactggtctacctctcctagtggtagca

SEQ ID NO: 321625 - DNA, 75 bp, Artificial Sequence
  Synthetic
cttgggtatggtggactaaccactcctctgcagggtgatacaaaatgtaggactaaaggatgccaacaggtgtcg

SEQ ID NO: 321626 - DNA, 75 bp, Artificial Sequence
  Synthetic
ggataaaggatgttcgattagaggctgcatataccacgacatcgtgtatcacgcattttggtaggggctactgct

SEQ ID NO: 321627 - DNA, 75 bp, Artificial Sequence
  Synthetic
taacttggttcagcatcaaatatgacatgcggtggatgcagaagaccagaccggggggacccctcgatacctcta

SEQ ID NO: 321628 - DNA, 75 bp, Artificial Sequence
  Synthetic
gacttataagatgcgagccgtacaggtgctggcagagacactactggctaaaggaataggagagctgttcagcga

SEQ ID NO: 321629 - DNA, 75 bp, Artificial Sequence
  Synthetic
agtagcagccctagctgatctcaaaagattcatcagagcggatctgttagacaagcaggtactatacagggtcat

SEQ ID NO: 321630 - DNA, 75 bp, Artificial Sequence
  Synthetic
cagaggtgtgcaagctttgcaggtctgagggagcagaccccatctatacatggttctatctccctgacaatatag

SEQ ID NO: 321631 - DNA, 75 bp, Artificial Sequence
  Synthetic
tgtactgcaatgacgatagctgatacaatgtctcaattagatagagacaacctaaaagagatgatcgcgctagta

SEQ ID NO: 321632 - DNA, 75 bp, Artificial Sequence
  Synthetic
tagtagtagactccgcaagaaacagcagttaaataacagcaggatcatgtggagtttgctattactggccgcttt

SEQ ID NO: 321633 - DNA, 75 bp, Artificial Sequence
  Synthetic
cattaaaggagttgaaagcacataacctatcatgtgttcaaggggaatgcccatattgctttactcactgtgaac

SEQ ID NO: 321634 - DNA, 75 bp, Artificial Sequence
  Synthetic
cagttaaataacagcaggatcatgtggagtttgctattactggccgctttagttggccaaggctttgcattaaaa

SEQ ID NO: 321635 - DNA, 75 bp, Artificial Sequence
  Synthetic
gagttagaaaatgaaaaggtttatgatgatggtgcacctgcatgtggtatcacttgttggttcaagaaatcaggt

SEQ ID NO: 321636 - DNA, 75 bp, Artificial Sequence
  Synthetic
tgccatggtaaagagtgctcagcaaatggccttcaggcaagtgccccacatttggataaagtgaacggtatttct

SEQ ID NO: 321637 - DNA, 75 bp, Artificial Sequence
  Synthetic
atgatggtgcacctgcatgtggtatcacttgttggttcaagaaatcaggtgaatgggttatgggtatcattaatg

SEQ ID NO: 321638 - DNA, 75 bp, Artificial Sequence
  Synthetic
cctggctcagatcctgattgaccagaaagtgaaggaaatctcaaaccaggaacctatgaaattataagtacataa

SEQ ID NO: 321639 - DNA, 75 bp, Artificial Sequence
  Synthetic
gaaactgggttgtgttaattgtgttgtgtgtgttacttttgttttcacttattttgctaagcatattgtgtcctg

SEQ ID NO: 321640 - DNA, 75 bp, Artificial Sequence
  Synthetic
cagaacagctagtgccagagagctcatgcaacatggacaaccaccaatcactctcaacaataaataaattaacca

SEQ ID NO: 321641 - DNA, 75 bp, Artificial Sequence
  Synthetic
aacctatgaaattataagtacataattatgtaatcaatactaactataggttaagaaatactaatcattagttaa

SEQ ID NO: 321642 - DNA, 75 bp, Artificial Sequence
  Synthetic
gtgtgtgttacttttgttttcacttattttgctaagcatattgtgtcctgttagaaagcataagaagtcatgagc

SEQ ID NO: 321643 - DNA, 75 bp, Artificial Sequence
  Synthetic
tcgacctgagaatactcattcaatgtatatagttctaaacatcttataactctgaactttacctgattttattac

SEQ ID NO: 321644 - DNA, 75 bp, Artificial Sequence
  Synthetic
ctattatttagttaagttagctaattgatttatatgattatcacaattgaatgtaatcataagcacaatcactgc

SEQ ID NO: 321645 - DNA, 75 bp, Artificial Sequence
  Synthetic
atgcaacatggacaaccaccaatcactctcaacaataaataaattaaccaaggtcgtatggcgaaaaaaagcaaa

SEQ ID NO: 321646 - DNA, 75 bp, Artificial Sequence
  Synthetic
tatatagttctaaacatcttataactctgaactttacctgattttattacctaatacctaacttttacttttatt

SEQ ID NO: 321647 - DNA, 75 bp, Artificial Sequence
  Synthetic
ttttatatgtattaactactaaaaaaaatactctcttctatctcccaatcttctattgattcaccggggtgttgt

SEQ ID NO: 321648 - DNA, 75 bp, Artificial Sequence
  Synthetic
ggttttcatatggggaacagggtgggcttagggccaggtcaccttaagtgacctttttttgtatatatggatgta

SEQ ID NO: 321649 - DNA, 75 bp, Artificial Sequence
  Synthetic
atcaaaaaaagatggagaaatatagagaaatacacagggatctgaaggagtttactattaactcattgacagccg

SEQ ID NO: 321650 - DNA, 75 bp, Artificial Sequence
  Synthetic
atgatctagcctgtaatagtacattctgtaagccaactgtttacatgattgttcctatacatgcttgcaacatga

SEQ ID NO: 321651 - DNA, 75 bp, Artificial Sequence
  Synthetic
cttgtggagtatatctagatcaactaaagccggtaggaacagccttcaaaattgtaagtgtgagatacagcagaa

SEQ ID NO: 321652 - DNA, 75 bp, Artificial Sequence
  Synthetic
tggaatgcatggattacttggataggctctatgctgttcggcatgacattgttgaccagatgataaaacatgaat

SEQ ID NO: 321653 - DNA, 75 bp, Artificial Sequence
  Synthetic
ccccgacacggctgttgtcagtgcattgaagagaggcatgtatgccatagcaagcatagagacaatctgcttctt

SEQ ID NO: 321654 - DNA, 75 bp, Artificial Sequence
  Synthetic
caatgggctccaagtgcaataatacagatactaaggtccaaggatattatatctgtattattggtggaaactctg

SEQ ID NO: 321655 - DNA, 75 bp, Artificial Sequence
  Synthetic
gaaaggacatactgcactacgggtatattgacagaaggaaaatgctttgtccccgacaaggctgttgtcagtgca

SEQ ID NO: 321656 - DNA, 75 bp, Artificial Sequence
  Synthetic
agatactaaggtccaaggatattatatctgtattattggtggaaactctgctcctgtgtatgcccccgctggtga

SEQ ID NO: 321657 - DNA, 75 bp, Artificial Sequence
  Synthetic
tgtaactttgccacaactccggtttgtgaatatgatgggaacattatttcaggatataaaaaagttcttgcaaca

SEQ ID NO: 321658 - DNA, 75 bp, Artificial Sequence
  Synthetic
ttgcccccactctcattacaagaggcagaacagctagtgccagagagctcatgcaacatggacaaccaccaatca

SEQ ID NO: 321659 - DNA, 75 bp, Artificial Sequence
  Synthetic
gatggatcaaatatttcaacacaatggcccagtacaaggaatgatggtgtagttcaatacatgaggttggtacag

SEQ ID NO: 321660 - DNA, 75 bp, Artificial Sequence
  Synthetic
gtattaattcctgcatgtacattagctattcttttagttctcaagttttttgcaaatatccttcatacaagcaat

SEQ ID NO: 321661 - DNA, 75 bp, Artificial Sequence
  Synthetic
aaattcaacataagttctctaaaaacacagccttattttatccctgaatataaagggattgatctgatcggacct

SEQ ID NO: 321662 - DNA, 75 bp, Artificial Sequence
  Synthetic
gagatctgtaagtacgagtgtgaaacattaaaggaattaaaggcacataatctatcatgtgttcaaggggagtgc

SEQ ID NO: 321663 - DNA, 75 bp, Artificial Sequence
  Synthetic
tcacgtcaattaaggcttgtgacatggcaatctgctatggtgcagaaagtgtaacactctcacgaggacaaaata

SEQ ID NO: 321664 - DNA, 75 bp, Artificial Sequence
  Synthetic
tagaaggtgcctggggttcaggtgttgggtttacacttacatgccaggtgtctctcacagaatgcccaacgtttc

SEQ ID NO: 321665 - DNA, 75 bp, Artificial Sequence
  Synthetic
ggcaatctgctatggtgcagaaagtgtaacactctcacgaggacaaaatactgtcaagattactggaaaaggtgg

SEQ ID NO: 321666 - DNA, 75 bp, Artificial Sequence
  Synthetic
ccatagtggttcttcatttaaatgttgccacggaaaagaatgttcatcaactggcctccaagccagcgcaccgca

SEQ ID NO: 321667 - DNA, 75 bp, Artificial Sequence
  Synthetic
ctggcctccaagccagcgcaccgcatctagataaagtaaacggtatctctgaattagaaaatgagaaagtttatg

SEQ ID NO: 321668 - DNA, 75 bp, Artificial Sequence
  Synthetic
tcaaaaaaagacaatattaacaaaaacattagttataggccagtgcatttatactattacaagtctcttttcact

SEQ ID NO: 321669 - DNA, 75 bp, Artificial Sequence
  Synthetic
agccgtagggcttgcattcaatctttaaacctcatcccagaaactcctgcgtctattcttgcacatgatatggca

SEQ ID NO: 321670 - DNA, 75 bp, Artificial Sequence
  Synthetic
tacttgttggtttaaaaaatcaagtgaatgggtcatgggtataatcaatggaaactgggttgtcctaattgtttt

SEQ ID NO: 321671 - DNA, 75 bp, Artificial Sequence
  Synthetic
cacagatatatcaatctgactagagacgacttattagcatattatgctcctagaatccaatttaaccctacccaa

SEQ ID NO: 321672 - DNA, 75 bp, Artificial Sequence
  Synthetic
gtgtgtcttattactcttctctcttatcctgttgagcattttatgtcctgttaggaagcataaaaaatcataaat

SEQ ID NO: 321673 - DNA, 75 bp, Artificial Sequence
  Synthetic
tagaatccaatttaaccctacccaaaatattaaagaaccaggtacctttaaattaacattaaatatgatgcgacc

SEQ ID NO: 321674 - DNA, 75 bp, Artificial Sequence
  Synthetic
ttaggaagcataaaaaatcataaatctaaccgattgatcttcacatcatttatagagcttaaaacactttaccat

SEQ ID NO: 321675 - DNA, 75 bp, Artificial Sequence
  Synthetic
gtattgattcctgcatgcacattggctattcttttagtcctaaagttttttgcaaatatccttcatacaagcaat

SEQ ID NO: 321676 - DNA, 75 bp, Artificial Sequence
  Synthetic
ctaagtcaacatgaacctcgagaaaatctgggaaagtcaatagaaagtttaaacatcagtagtcatattgtacaa

SEQ ID NO: 321677 - DNA, 75 bp, Artificial Sequence
  Synthetic
cattaaaggaattaaaggcacataatttatcatgtgtgcaaggggagtgcccatattgctttacgcactgtgaac

SEQ ID NO: 321678 - DNA, 75 bp, Artificial Sequence
  Synthetic
cgacagaaactgcaattcaggcacattacaaagtttgtcaagccacccaccgattcagagaagatttaaaaaaga

SEQ ID NO: 321679 - DNA, 75 bp, Artificial Sequence
  Synthetic
attgatattctaaagaagactacagcatggcatatcgggcatttggttagggatattactgagagcttgattgca

SEQ ID NO: 321680 - DNA, 75 bp, Artificial Sequence
  Synthetic
ttacaaagtttgtcaagccacccaccgattcagagaagatttaaaaaagactgtaactcctcaaaatattgggcc

SEQ ID NO: 321681 - DNA, 75 bp, Artificial Sequence
  Synthetic
tcaaaacgagactcagaagtatttaattgatattctaaagaagactacagcatggcatatcgggcatttggttag

SEQ ID NO: 321682 - DNA, 75 bp, Artificial Sequence
  Synthetic
cattctggtttgaggaggtctaaatattggtcaatccatgcctacaataatggaaatgtaatactgttcatactc

SEQ ID NO: 321683 - DNA, 75 bp, Artificial Sequence
  Synthetic
actgcagatgtagataaaggtatcagggaaaagaaaatgaaatatgagctaggtttgaaatacttggagcaagaa

SEQ ID NO: 321684 - DNA, 75 bp, Artificial Sequence
  Synthetic
cgattcagagaagatttaaaaaagactgtaactcctcaaaatattgggccaggctgttaccgaacattaaatctt

SEQ ID NO: 321685 - DNA, 75 bp, Artificial Sequence
  Synthetic
tttaggtataaaagtaggtgttatattctaacaatgtggactcttcttctcattattgaatccatcctctgggcg

SEQ ID NO: 321686 - DNA, 75 bp, Artificial Sequence
  Synthetic
ttttaaattaggtccaggactagttgataaagacaatttggattcaatacttgcagatggtgatatcttatgggg

SEQ ID NO: 321687 - DNA, 75 bp, Artificial Sequence
  Synthetic
tccctctctggacagataatgctcatggcgttgggagcgttcctatgcatacggatcttgaattagacttttctt

SEQ ID NO: 321688 - DNA, 75 bp, Artificial Sequence
  Synthetic
tgccatctagctctaagtacacatataaaaggcatctcacaaacccagtcaatgaccaacagagtgtctcattgc

SEQ ID NO: 321689 - DNA, 75 bp, Artificial Sequence
  Synthetic
tagcttttgaaaaagcactacttgcaacagctacatggttccaatattacactgaggatcaatcacaatttccat

SEQ ID NO: 321690 - DNA, 75 bp, Artificial Sequence
  Synthetic
atatagaaattgaaagtcaaggcattggtgctgatgtccaccatcttggacattggtatggtgcaaggttaaatc

SEQ ID NO: 321691 - DNA, 75 bp, Artificial Sequence
  Synthetic
tagtagtagactccctaaagagctactacactaacaagaaaaatggcactatgtgaagaaatccagagagaaatc

SEQ ID NO: 321692 - DNA, 75 bp, Artificial Sequence
  Synthetic
taaagggatcgatctgattggacctgacatagatgggttagtgaactatgctcaaagctggatgtcaaagagcca

SEQ ID NO: 321693 - DNA, 75 bp, Artificial Sequence
  Synthetic
aacagctacatggttccaatattacactgaggatcaatcacaatttccattgcaacattctacccggtcagtgtt

SEQ ID NO: 321694 - DNA, 75 bp, Artificial Sequence
  Synthetic
ggttcagctgtttttgattgttttaatgaaaatgaacaagggcatattgtaaaatacccaatttcccggcaccca

SEQ ID NO: 321695 - DNA, 75 bp, Artificial Sequence
  Synthetic
tagtagtagactccctaaagagctactacaataatagataaaatggcaactatggaagagatccagagggaaatc

SEQ ID NO: 321696 - DNA, 75 bp, Artificial Sequence
  Synthetic
taaacctcattccagaaacccctgcatctattcttgcacatgatatggcacacagatatattaatctaactagag

SEQ ID NO: 321697 - DNA, 75 bp, Artificial Sequence
  Synthetic
aatgattgctttgtgactaggcatgccaaaatatgtataattgggactgtatctaagttttctcaaggtgacact

SEQ ID NO: 321698 - DNA, 75 bp, Artificial Sequence
  Synthetic
aagagtttaatttcagaagttacaacttgcttttttctattcgaaaaaggtttgcatgggaatgtaaatgaagag

SEQ ID NO: 321699 - DNA, 75 bp, Artificial Sequence
  Synthetic
tagaatccaatttagccctactcaaaatattaaggaaccaggtacatttaaattaacatcaaacatgatgcggcc

SEQ ID NO: 321700 - DNA, 75 bp, Artificial Sequence
  Synthetic
tgagtcaaaaatcatgctggacatgctaagtcaacatgaacctagagaaaatttgggcaagttaatagaaagttt

SEQ ID NO: 321701 - DNA, 75 bp, Artificial Sequence
  Synthetic
ggaggataagtatggtgagatgttagttgaaaatggttatacaataggagagcttgtagaatctagtgaactagc

SEQ ID NO: 321702 - DNA, 75 bp, Artificial Sequence
  Synthetic
gttgaaaatggttatacaataggagagcttgtagaatctagtgaactagcagtccaacaactatattgtcaagat

SEQ ID NO: 321703 - DNA, 75 bp, Artificial Sequence
  Synthetic
attcccagggcaattcaggaaaaaatgtaactttgccacaactccaatttgtgaatatgatgggaacattatctc

SEQ ID NO: 321704 - DNA, 75 bp, Artificial Sequence
  Synthetic
atttgggcaagttaatagaaagtttaaacatcagtagtcatattgtacagtcagattgtgtcagtctcatcacaa

SEQ ID NO: 321705 - DNA, 75 bp, Artificial Sequence
  Synthetic
taaaccgaattcttatcacaaagtctcaggtggttgctaacagcatcttaaataagtattgggaagagccatact

SEQ ID NO: 321706 - DNA, 75 bp, Artificial Sequence
  Synthetic
caagcaatatacacttcactgatgagagaattgaatggagagaccctgatggtatgcttcgggatcatattaata

SEQ ID NO: 321707 - DNA, 75 bp, Artificial Sequence
  Synthetic
attgattctttccaatcatttaacacaagcaatatacacttcactgatgagagaattgaatggagagaccctgat

SEQ ID NO: 321708 - DNA, 75 bp, Artificial Sequence
  Synthetic
tcgttatttctaaagatattgattttgaaaatttggctgagaatccttgtaaagtagggctccaggcagcaaaca

SEQ ID NO: 321709 - DNA, 75 bp, Artificial Sequence
  Synthetic
tagaaggtgcttggggttcaggtgtcgggtttacactcacatgccaggtgtctctcacagaatgcccaacatttc

SEQ ID NO: 321710 - DNA, 75 bp, Artificial Sequence
  Synthetic
attggtcaatccatgcttataataatggaagtgtaatattgttcatactcccttcaaaatcccttgaagttgcag

SEQ ID NO: 321711 - DNA, 75 bp, Artificial Sequence
  Synthetic
tctctcacagaatgcccaacatttcttacgtcaataaaggcctgtgacatggcaatttgttatggtgcagaaagt

SEQ ID NO: 321712 - DNA, 75 bp, Artificial Sequence
  Synthetic
aacgttcttcagctatatgaagaaactagacatcagaaggcacaagctagaattgtaagaaagtttcagaggaca

SEQ ID NO: 321713 - DNA, 75 bp, Artificial Sequence
  Synthetic
ccatagtggttcttcatttaaatgctgtcatgggaaagaatgttcatcaactggccttcaagccagtgcaccaca

SEQ ID NO: 321714 - DNA, 75 bp, Artificial Sequence
  Synthetic
ttactaacaacaacaagctacctcaaaatatactacctcattaagttgtttccttttgtctttttagggagcata

SEQ ID NO: 321715 - DNA, 75 bp, Artificial Sequence
  Synthetic
tagcttttgagaaagcactacttgcaacagctacatggttccaatattacactgaggatcaatcccaattcccat

SEQ ID NO: 321716 - DNA, 75 bp, Artificial Sequence
  Synthetic
ctggagagagctttattgagctcagtaacggaaaattcataaggatgaagagaaaacttatgtatgtcagtgctg

SEQ ID NO: 321717 - DNA, 75 bp, Artificial Sequence
  Synthetic
caattcagcaaaattcaggcgattcactgctgcccttcataatggattgcctgatgacaggttgaaaaactgtgt

SEQ ID NO: 321718 - DNA, 75 bp, Artificial Sequence
  Synthetic
gtgtgtcctgttactcttttctcttatcctgttaagcattttgtgtcctgttagaaagcataaaaaatcataaat

SEQ ID NO: 321719 - DNA, 75 bp, Artificial Sequence
  Synthetic
acctgctgtgacatctctgtattctggatttccttctttggttgaaaaattatttgagagaccttttaagagtgc

SEQ ID NO: 321720 - DNA, 75 bp, Artificial Sequence
  Synthetic
atcctgttaagcattttgtgtcctgttagaaagcataaaaaatcataaatcctacccattaatcttcacaccatg

SEQ ID NO: 321721 - DNA, 75 bp, Artificial Sequence
  Synthetic
tatcgaattttaaacactttaccattaaacaacttaacctggctctaatatctaataactaactttcatttttat

SEQ ID NO: 321722 - DNA, 75 bp, Artificial Sequence
  Synthetic
taaacaacttaacctggctctaatatctaataactaactttcatttttatttttatatggactaattactaaaaa

SEQ ID NO: 321723 - DNA, 75 bp, Artificial Sequence
  Synthetic
tgtgtcaatgccaaacgcccaatccagcatgaaagctgaagagataacacctggaagattccgcacggcagtatg

SEQ ID NO: 321724 - DNA, 75 bp, Artificial Sequence
  Synthetic
ggcatcatggggaggtaccaggcaattggttgcagggtaacttgaacaagtgttcatcattattcggtgtggcta

SEQ ID NO: 321725 - DNA, 75 bp, Artificial Sequence
  Synthetic
tagtagtagactccctaaagagctactacactaacaagaaaaatggcaactatggaagaaatccagagagaaatc

SEQ ID NO: 321726 - DNA, 75 bp, Artificial Sequence
  Synthetic
gacaaggttatttccagaattagactgcttttttgaatttgctcaccattcagatgatgcacttttcatatatgg

SEQ ID NO: 321727 - DNA, 75 bp, Artificial Sequence
  Synthetic
ctacactaacaagaaaaatggcaactatggaagaaatccagagagaaatcagtgctcacgaggggcagcttgtga

SEQ ID NO: 321728 - DNA, 75 bp, Artificial Sequence
  Synthetic
cagatgatgcacttttcatatatggctacttggaaccagctgatgacggaactgattggttcttatttgtatccc

SEQ ID NO: 321729 - DNA, 75 bp, Artificial Sequence
  Synthetic
tgtccttattatttaaagaaatctggacaaggttatttccagaattagactgcttttttgaatttgctcaccatt

SEQ ID NO: 321730 - DNA, 75 bp, Artificial Sequence
  Synthetic
tggaaaagcatgtttaacctgcatgagcatattcttttgctagggtcaattaaaatttccccaaagaagacaaca

SEQ ID NO: 321731 - DNA, 75 bp, Artificial Sequence
  Synthetic
agcatattcttttgctagggtcaattaaaatttccccaaagaagacaacattatcaccgacaaatgctgagtttc

SEQ ID NO: 321732 - DNA, 75 bp, Artificial Sequence
  Synthetic
cttcttggctcactatctgacctaccaggtcttggatatttcgatgatcttgcagctgcccagacacggtgtgtc

SEQ ID NO: 321733 - DNA, 75 bp, Artificial Sequence
  Synthetic
cctacaggacagacagctgattggttgaccataattgtctatctgacttcatttgtggtcccgatcatcttaaag

SEQ ID NO: 321734 - DNA, 75 bp, Artificial Sequence
  Synthetic
aaagcaatggatttgggagcatcgcctcaaatctcacaacttgcagtctcacttagtacgagtaaggttgagaga

SEQ ID NO: 321735 - DNA, 75 bp, Artificial Sequence
  Synthetic
ccttctacctcgatatatactacctcattaagttgtttccttttgtctttttggggagtcagggagtctactact

SEQ ID NO: 321736 - DNA, 75 bp, Artificial Sequence
  Synthetic
agggatgaggatcagattcaaggatgacagctcatatgaggatgtcaatggaatcagaaagcccaaacatctgta

SEQ ID NO: 321737 - DNA, 75 bp, Artificial Sequence
  Synthetic
ttaattatcctggcacatatttaaggacaaaacactctgaaactccaattccactgggaggaagtggtgcaatgt

SEQ ID NO: 321738 - DNA, 75 bp, Artificial Sequence
  Synthetic
gaatcagaaagcccaaacatctgtatgtgtcaatgccaaacgcccaatccagcatgaaggctgaagagataacac

SEQ ID NO: 321739 - DNA, 75 bp, Artificial Sequence
  Synthetic
gacagctcatatgaggatgtcaatggaatcagaaagcccaaacatctgtatgtgtcaatgccaaacgcccaatcc

SEQ ID NO: 321740 - DNA, 75 bp, Artificial Sequence
  Synthetic
tgtgtcaatgccaaacgcccaatccagcatgaaggctgaagagataacacctggaagattccgcactgcagtatg

SEQ ID NO: 321741 - DNA, 75 bp, Artificial Sequence
  Synthetic
agcatgaaggctgaagagataacacctggaagattccgcactgcagtatgtgggctatatcctgcacagataaag

SEQ ID NO: 321742 - DNA, 75 bp, Artificial Sequence
  Synthetic
tgggctatatcctgcacagataaaggcaaggaacatggtgagccctgtcatgagtgtggttgggtttttagcact

SEQ ID NO: 321743 - DNA, 75 bp, Artificial Sequence
  Synthetic
ttacatcctggggctcttcaagtttttaatggatctttctggtgagacatttcagcatgaaaggctaggccagtt

SEQ ID NO: 321744 - DNA, 75 bp, Artificial Sequence
  Synthetic
ttcatttatagggaaagttcaatggaaaatatttacacccaaatcagagtttgaattttctgatatgtattctca

SEQ ID NO: 321745 - DNA, 75 bp, Artificial Sequence
  Synthetic
cctgataggtgtccaccaacatgtttgtttgtcggagggatggctgagttaggtgccttcttttctatacttcag

SEQ ID NO: 321746 - DNA, 75 bp, Artificial Sequence
  Synthetic
tgtttgtcggagggatggctgagttaggtgccttcttttctatacttcaggatatgaggaacacaatcatggctt

SEQ ID NO: 321747 - DNA, 75 bp, Artificial Sequence
  Synthetic
aggtgccttcttttctatacttcaggatatgaggaacacaatcatggcttcaaaaactgtgggcacagctgatga

SEQ ID NO: 321748 - DNA, 75 bp, Artificial Sequence
  Synthetic
atttaggatgcaagcaaaacagcatatgaaggtttgcagactagatggggactgggtaacatttagagaggtact

SEQ ID NO: 321749 - DNA, 75 bp, Artificial Sequence
  Synthetic
ctgtacattttctaaagagtatgcatggaaagattttttgaataatgtacactgtgatgtgataccaacaaagca

SEQ ID NO: 321750 - DNA, 75 bp, Artificial Sequence
  Synthetic
gaggataattgttatgtttatggttgcctggggaaaggaggcagtggacaactttcatctcggtgatgacatgga

SEQ ID NO: 321751 - DNA, 75 bp, Artificial Sequence
  Synthetic
tggaaaagcatgtttaacttgcatgaacacattcttttgctaggttcaatcaaaatctccccaaagaagacgaca

SEQ ID NO: 321752 - DNA, 75 bp, Artificial Sequence
  Synthetic
agtacaacgtgcgaaggttgcacgtacattcacagtgagagaaaaagaccaaattactcaaaatagcattccagc

SEQ ID NO: 321753 - DNA, 75 bp, Artificial Sequence
  Synthetic
aacacattcttttgctaggttcaatcaaaatctccccaaagaagacgacattgtcaccaacaaatgctgagtttc

SEQ ID NO: 321754 - DNA, 75 bp, Artificial Sequence
  Synthetic
atcctgattgaccagaaagtaaaagaaatctcgaaccaggaacctatgaaattataagtatatcattatgtaatc

SEQ ID NO: 321755 - DNA, 75 bp, Artificial Sequence
  Synthetic
catactaactataggttaagagatactaattattagttaataagaatacagattttttaaataatcacattaaat

SEQ ID NO: 321756 - DNA, 75 bp, Artificial Sequence
  Synthetic
caggccttggctattttgatgatcttgctgctgcccagacaaggtgtgttaaagcaatggatttgggagcatcgc

SEQ ID NO: 321757 - DNA, 75 bp, Artificial Sequence
  Synthetic
tgctgctgcccagacaaggtgtgttaaagcaatggatttgggagcatcgcctcaaatctcgcaacttgcagtctc

SEQ ID NO: 321758 - DNA, 75 bp, Artificial Sequence
  Synthetic
aattaggtaagttaactattagttagttaagttagctaattgatttatatgattatcacaattgaatataatcat

SEQ ID NO: 321759 - DNA, 75 bp, Artificial Sequence
  Synthetic
tataggcatgtctgacaaaaatttattgaaacaagcacttattggttatatgcataaacaccaaaaacaaatgag

SEQ ID NO: 321760 - DNA, 75 bp, Artificial Sequence
  Synthetic
tggttgagaaatatgtcattaattaagacaattaaagttaaaccccataaagaagtgctccaggctgtatccata

SEQ ID NO: 321761 - DNA, 75 bp, Artificial Sequence
  Synthetic
aggtcaccttaagtgacctttttttgtatatatggatgtagatttcaattgatcaaatactaatcatactatcct

SEQ ID NO: 321762 - DNA, 75 bp, Artificial Sequence
  Synthetic
cttttcttttcctttctccttctttactaacaacaacaaactacctcacaaccttctacctcaatatatactacc

SEQ ID NO: 321763 - DNA, 75 bp, Artificial Sequence
  Synthetic
ttgaattctctgacatgtattctcaaaagtttctaaaagtttggagtgaacagcaccctacatatgattacatta

SEQ ID NO: 321764 - DNA, 75 bp, Artificial Sequence
  Synthetic
cagttaaataacagcaggatcatgtggagtttgctattactggccgctttagttggtcaaggctttgcattaaaa

SEQ ID NO: 321765 - DNA, 75 bp, Artificial Sequence
  Synthetic
gatatgaggaacacaatcatggcttctaaaactgtgggcacagctgatgaaaagcttcgaaagaaatcatcattc

SEQ ID NO: 321766 - DNA, 75 bp, Artificial Sequence
  Synthetic
gtccccactcagtcaacttcggggaaacaagtgtgtcaggctatacagaactgcccccactctcattacaggagg

SEQ ID NO: 321767 - DNA, 75 bp, Artificial Sequence
  Synthetic
ctctcaacaataaataaattaaccaaggtcatatggcggaaaaaagcaaatcaggaatcagcaaaccagaattca

SEQ ID NO: 321768 - DNA, 75 bp, Artificial Sequence
  Synthetic
tcaggaatcagcaaaccagaattcatttgaagttgtggagagtgaagtcagctttaaagggttgtgtatgttaaa

SEQ ID NO: 321769 - DNA, 75 bp, Artificial Sequence
  Synthetic
atccatcacacagaaacatgttttaaaaatcatgatggaggaggtttcgaaagagctagttaggtgtgggatgcg

SEQ ID NO: 321770 - DNA, 75 bp, Artificial Sequence
  Synthetic
tgttattggctataagtttgcagtaacagtggatgaaatgtctgatgtgctagatacagcaaagtttccagattc

SEQ ID NO: 321771 - DNA, 75 bp, Artificial Sequence
  Synthetic
agaaataggagatcagtaatctattatgatctagctggtaatagtacattctgtaagccaactgtttacatgatc

SEQ ID NO: 321772 - DNA, 75 bp, Artificial Sequence
  Synthetic
gttcctatacatgcatgcaacatgatgaaaagctgcttaattggccttggtccctacagaatccaggttgtctat

SEQ ID NO: 321773 - DNA, 75 bp, Artificial Sequence
  Synthetic
cagattcaggttttgaatggggtaagcctaatattccatgtattgtgtacaaaaattgtgcattgaggacaggtt

SEQ ID NO: 321774 - DNA, 75 bp, Artificial Sequence
  Synthetic
gaaaggacatactgcactacaggtatattgacagaaggaaaatgctttgttcctgacaaggctgttgtcagtgca

SEQ ID NO: 321775 - DNA, 75 bp, Artificial Sequence
  Synthetic
ttattgtccaagggaatgtggaaggaactgcagaggcgatctgtgcatactggttgaagaacatgtcattaatta

SEQ ID NO: 321776 - DNA, 75 bp, Artificial Sequence
  Synthetic
agacaatcaaagttaagccccataaagaagtgcttcaggctgtgtccatatttaataggaaggaagatatcggtc

SEQ ID NO: 321777 - DNA, 75 bp, Artificial Sequence
  Synthetic
agcagaaggatttgtcagcactaaagttatgtattgaagtttggaggtgggctaaagcaaataatgcaccatata

SEQ ID NO: 321778 - DNA, 75 bp, Artificial Sequence
  Synthetic
atgcagtaagtaatgtgtggttcacacataaaggaataaagctatacctgaatccgatcatttcatcaggactgc

SEQ ID NO: 321779 - DNA, 75 bp, Artificial Sequence
  Synthetic
aatccgatcatttcatcaggactgctagagaactttatgaaaaatatacctgctgctattccaccagctgcttat

SEQ ID NO: 321780 - DNA, 75 bp, Artificial Sequence
  Synthetic
cccctgtatatgcccctgctggtgaagactttagggcaatggaggttttttctgggattattacatcaccacatg

SEQ ID NO: 321781 - DNA, 75 bp, Artificial Sequence
  Synthetic
tcattaataatgaatcgtgcaaaaatttctgtggacctttttatgtttaatgacttacttagactgataaaccca

SEQ ID NO: 321782 - DNA, 75 bp, Artificial Sequence
  Synthetic
tgacttacttagactgataaacccaggtaacacacttgacttgtctggtcttgaaataacaggtgaaggttatag

SEQ ID NO: 321783 - DNA, 75 bp, Artificial Sequence
  Synthetic
ttcagggaaacagtatgatgcatattgcgtacagacttataatgaagatacaaaactttatgaaggggatttaag

SEQ ID NO: 321784 - DNA, 75 bp, Artificial Sequence
  Synthetic
gaggcagtccacccttgtaatgtattctgtgtcttatcaggaccaggtgcttcatgtgaagccttttcagaagga

SEQ ID NO: 321785 - DNA, 75 bp, Artificial Sequence
  Synthetic
tctgtgtcttatcaggaccaggtgcttcatgtgaagccttttcagaaggaggtattttcaatattacttctccaa

SEQ ID NO: 321786 - DNA, 75 bp, Artificial Sequence
  Synthetic
tatctattgaaaaggtatacaacccagttaacatcatattaatgactagatacatatcaaaaaactttaatcttt

SEQ ID NO: 321787 - DNA, 75 bp, Artificial Sequence
  Synthetic
tgaggacaaaccaggctatcaaccacaagtttatgatcacaattaaagatgatggtctcagggcaattgcacagt

SEQ ID NO: 321788 - DNA, 75 bp, Artificial Sequence
  Synthetic
gtttagagcagctgagcagcagatcagctttgtctgccaaagggttgatatggatattatagtgtactgtaatgg

SEQ ID NO: 321789 - DNA, 75 bp, Artificial Sequence
  Synthetic
agttaacatcatattaatgactagatacatatcaaaaaactttaatctttcaggtaagcaggtatccttattaga

SEQ ID NO: 321790 - DNA, 75 bp, Artificial Sequence
  Synthetic
tttggcacatgcttttcatactatccgtgatgttcgctatcaagcagttgatgcagtaagtaatgtgtggttcac

SEQ ID NO: 321791 - DNA, 75 bp, Artificial Sequence
  Synthetic
cgtgatgttcgctatcaagcagttgatgcagtaagtaatgtgtggttcacacataagggaataaagctatacctg

SEQ ID NO: 321792 - DNA, 75 bp, Artificial Sequence
  Synthetic
atactattacaagtctcttttcactgttaccaggggttgcccattctattgctattgagttgtgtgttccagggt

SEQ ID NO: 321793 - DNA, 75 bp, Artificial Sequence
  Synthetic
gctattgagttgtgtgttccagggtttcatggctgggccacagctgcacttttgatcacattctgctttggctgg

SEQ ID NO: 321794 - DNA, 75 bp, Artificial Sequence
  Synthetic
ttcatggctgggccacagctgcacttttgatcacattctgctttggctgggtattgattcctgcatgtacattag

SEQ ID NO: 321795 - DNA, 75 bp, Artificial Sequence
  Synthetic
gtattgattcctgcatgtacattagctattcttttagttcttaagttttttgcaaatatccttcatacaagcaat

SEQ ID NO: 321796 - DNA, 75 bp, Artificial Sequence
  Synthetic
tgcaaatatccttcatacaagcaatcaagagaaccgattcaaagccattctacggaaaataaaggaggagtttga

SEQ ID NO: 321797 - DNA, 75 bp, Artificial Sequence
  Synthetic
tctatcatgtgttcaaggagagtgcccatattgctttacccactgtgaaccgacagaaactgcaattcaggcaca

SEQ ID NO: 321798 - DNA, 75 bp, Artificial Sequence
  Synthetic
ataaaaagctgggtgtcaaggggattgtctattgagaaggtatacaatcccgtcaacatcatactaatgactaga

SEQ ID NO: 321799 - DNA, 75 bp, Artificial Sequence
  Synthetic
ttacaaagtttgtcaggccacccaccgattcagagaagatttaaaaaagactgtaactcctcaaaacattgggcc

SEQ ID NO: 321800 - DNA, 75 bp, Artificial Sequence
  Synthetic
cgattcagagaagatttaaaaaagactgtaactcctcaaaacattgggcctggctgttaccgcacattaaatctt

SEQ ID NO: 321801 - DNA, 75 bp, Artificial Sequence
  Synthetic
caggcaagcaggtatccttattggacccgtatgatttaactgagcttgagagtgttgttaagggatggggtgaat

SEQ ID NO: 321802 - DNA, 75 bp, Artificial Sequence
  Synthetic
ggcaaaagattggacatctagaattgaagaatggcttggtgcaccctgcaagtttatggcggaatctccaattgc

SEQ ID NO: 321803 - DNA, 75 bp, Artificial Sequence
  Synthetic
tgccatccagttctaagtacacatataaaagacatctcacaaacccagttaatgaccaacagagtgtctcattgc

SEQ ID NO: 321804 - DNA, 75 bp, Artificial Sequence
  Synthetic
tggcacactgcaaaatgccattttgagaaagattatgagtatgaaaatagctgggcatgcaaccccccagattgc

SEQ ID NO: 321805 - DNA, 75 bp, Artificial Sequence
  Synthetic
agaaagattatgagtatgaaaatagctgggcatgcaaccccccagattgcccaggggttggtacaggttgtactg

SEQ ID NO: 321806 - DNA, 75 bp, Artificial Sequence
  Synthetic
tggggaacagggtgggcttagggccaggtcaccttaagtgacctttttttgtatatatggatatagatttcaatt

SEQ ID NO: 321807 - DNA, 75 bp, Artificial Sequence
  Synthetic
gcactgtacatgttaacaacaagaggcaggcagacttcaaaggacaacaaggggatgaggatcagattcaaggat

SEQ ID NO: 321808 - DNA, 75 bp, Artificial Sequence
  Synthetic
actacctcacacctcaatatatactacctcattaagttgtttcctcttgtctttttagggagaatactactacta

SEQ ID NO: 321809 - DNA, 75 bp, Artificial Sequence
  Synthetic
ctactgttcctagggcctatggaaggaggtggtataatctttaaacactggtgcacatcaacctgtcattttgga

SEQ ID NO: 321810 - DNA, 75 bp, Artificial Sequence
  Synthetic
gtgaatatgatggaaacattatctcaggttataagaaagttcttgcaacaattgattctttccaatcatttaata

SEQ ID NO: 321811 - DNA, 75 bp, Artificial Sequence
  Synthetic
attgattctttccaatcatttaatacaagcaacatacacttcactgatgagagaattgaatggagagaccctgat

SEQ ID NO: 321812 - DNA, 75 bp, Artificial Sequence
  Synthetic
caaaaactgtgggtacagctgatgaaaagcttcggaagaaatcatcattctatcaatcataccttagacgcacac

SEQ ID NO: 321813 - DNA, 75 bp, Artificial Sequence
  Synthetic
aaagcttcggaagaaatcatcattctatcaatcataccttagacgcacacagtcaatgggaatacaactggatca

SEQ ID NO: 321814 - DNA, 75 bp, Artificial Sequence
  Synthetic
tctctcacagaatgcccaacatttctcacatcaataaaggcctgtgacatggcaatttgttacggtgcagaaagt

SEQ ID NO: 321815 - DNA, 75 bp, Artificial Sequence
  Synthetic
ctgtcaaaattactgggaaaggtggccatagtggttcttcatttaaatgctgtcatgggaaagaatgttcatcaa

SEQ ID NO: 321816 - DNA, 75 bp, Artificial Sequence
  Synthetic
attcgtggtcccgatcatcttgaaggcactgtacatgttaacaacaagaggtaggcagacttcaaaggacaacaa

SEQ ID NO: 321817 - DNA, 75 bp, Artificial Sequence
  Synthetic
ctggcctccaagccagtgcaccacatctggataaggtaaatggtatctctgagttagaaaacgagaaagtttatg

SEQ ID NO: 321818 - DNA, 75 bp, Artificial Sequence
  Synthetic
atgatggtgcacctgaatgtggcgttacttgttggtttaaaaaatcaggtgaatgggttatgggtataatcaatg

SEQ ID NO: 321819 - DNA, 75 bp, Artificial Sequence
  Synthetic
gtaggcagacttcaaaggacaacaaggggatgagaatcaggttcaaggatgacagctcatatgaggatgtcaacg

SEQ ID NO: 321820 - DNA, 75 bp, Artificial Sequence
  Synthetic
gacagctcatatgaggatgtcaacggaatcagaaagcccaaacatttgtatgtgtcaatgccaaacgcccagtcc

SEQ ID NO: 321821 - DNA, 75 bp, Artificial Sequence
  Synthetic
gaatgggttatgggtataatcaatggaaactgggttgtcctaattgtcttgtgtgtcctgctgctcttttctctt

SEQ ID NO: 321822 - DNA, 75 bp, Artificial Sequence
  Synthetic
gtgtgtcctgctgctcttttctcttatcctgttgagcatcttgtgtcctgttagaaagcataaaaaatcataaat

SEQ ID NO: 321823 - DNA, 75 bp, Artificial Sequence
  Synthetic
ctggaagattccgcactgcagtatgtgggctatatcctgcacagataaaggcaaggaacatggtaagccctgtca

SEQ ID NO: 321824 - DNA, 75 bp, Artificial Sequence
  Synthetic
atcctgttgagcatcttgtgtcctgttagaaagcataaaaaatcataaatcctacctattattcttcacagcatg

SEQ ID NO: 321825 - DNA, 75 bp, Artificial Sequence
  Synthetic
ctgataactaactttcatttttatttttatatggattaattactaaaaaaaatactctcttctatctcccaatct

SEQ ID NO: 321826 - DNA, 75 bp, Artificial Sequence
  Synthetic
tttatatggattaattactaaaaaaaatactctcttctatctcccaatcttttattgattcaccggggtgttgtc

SEQ ID NO: 321827 - DNA, 75 bp, Artificial Sequence
  Synthetic
aggaactttttacttatccagtgcactgtcttaacagcatacaaacctgcaactatactttctgatcaacttgat

SEQ ID NO: 321828 - DNA, 75 bp, Artificial Sequence
  Synthetic
tagtagtagactccgcaagaaacagcagttaaagaacaataggatcatgtggagtttgctattactggccgcttt

SEQ ID NO: 321829 - DNA, 75 bp, Artificial Sequence
  Synthetic
ccttcaaaatcccttgaggttgcaggttcatttgtgcgatttatgactgcttttaaattaggtcctggactagtt

SEQ ID NO: 321830 - DNA, 75 bp, Artificial Sequence
  Synthetic
atcctgattgatcaaaaagtgaaggaaatctcgaaccaggaacctatgaaattataagtatataattatataatc

SEQ ID NO: 321831 - DNA, 75 bp, Artificial Sequence
  Synthetic
gatttattgaataatcatattaaataattaggtaagttaactattatttagttaagttagctaattgatttatat

SEQ ID NO: 321832 - DNA, 75 bp, Artificial Sequence
  Synthetic
gctttaaagggttgtgtatgttaaagcatagaatggttgaagaatcatatagaaataggagatcagtaatctgtt

SEQ ID NO: 321833 - DNA, 75 bp, Artificial Sequence
  Synthetic
tgatcgaatactaatcctactgtcctcttttcttttcctttctccttctttactaacaacaacaaactacctcac

SEQ ID NO: 321834 - DNA, 75 bp, Artificial Sequence
  Synthetic
cttcttggctcactatctgacctaccaggtcttggctacttcgatgatcttgctgctgcccagacaaggtgcgtc

SEQ ID NO: 321835 - DNA, 75 bp, Artificial Sequence
  Synthetic
tgctgctgcccagacaaggtgcgtcaaagcaatggatttgggagcatcgcctcaaatctcacaacttgcagtctc

SEQ ID NO: 321836 - DNA, 75 bp, Artificial Sequence
  Synthetic
ctcacaaccttctacctcaatatatactacctcattaagttgtttccttttgtctttttagggagcatactacta

SEQ ID NO: 321837 - DNA, 75 bp, Artificial Sequence
  Synthetic
cagcattggaaaaaaaggttatccctgatcatccgagtggcaaaacactgcggtctttttttaagatgacacctg

SEQ ID NO: 321838 - DNA, 75 bp, Artificial Sequence
  Synthetic
aattgagtttgtggaggtaactgtgaccgcagatgtagataaaggtattagggagaagaaaatgaaatatgagct

SEQ ID NO: 321839 - DNA, 75 bp, Artificial Sequence
  Synthetic
accgcagatgtagataaaggtattagggagaagaaaatgaaatatgagctaggtctgagatatctcgagcaagaa

SEQ ID NO: 321840 - DNA, 75 bp, Artificial Sequence
  Synthetic
aagatagtgactgccattacatcagcaatgggctccaaatgtaataatacagatactaaagttcaaggatattat

SEQ ID NO: 321841 - DNA, 75 bp, Artificial Sequence
  Synthetic
tctgggattattacatcaccacatggagaagaccatgacctacccggcgaagaaatcgcaacgtaccagatttca

SEQ ID NO: 321842 - DNA, 75 bp, Artificial Sequence
  Synthetic
gcagaaatcagttatgtgagggaacatctggttaaaactgaagaaagagctgcattagaagcaatgtttaacttg

SEQ ID NO: 321843 - DNA, 75 bp, Artificial Sequence
  Synthetic
gggcagatagaggcaaaaatccctcatacagtgagctccaaaaacttaaaattgactgcttttgcaggtattcca

SEQ ID NO: 321844 - DNA, 75 bp, Artificial Sequence
  Synthetic
tgcattagaagcaatgtttaacttgaaattcaatataagttctctaaagacacagccttattttatccctgaata

SEQ ID NO: 321845 - DNA, 75 bp, Artificial Sequence
  Synthetic
attgactgcttttgcaggtattccatcatactcatcaactagtatattggctgcttcagaagatggtcgtttcat

SEQ ID NO: 321846 - DNA, 75 bp, Artificial Sequence
  Synthetic
aaattcaatataagttctctaaagacacagccttattttatccctgaatataaaggaattgatctgattggacct

SEQ ID NO: 321847 - DNA, 75 bp, Artificial Sequence
  Synthetic
atttagtcctggtttatttcctaacctaaatcagtcagtctgtgacaacaatgcactccctttaatctggagggg

SEQ ID NO: 321848 - DNA, 75 bp, Artificial Sequence
  Synthetic
ctaaatcagtcagtctgtgacaacaatgcactccctttaatctggaggggcctaattgatttaacgggatactat

SEQ ID NO: 321849 - DNA, 75 bp, Artificial Sequence
  Synthetic
agagttctctttctttgaagtaaagggttcagctgtttttgattgttttaatgaaaatgagcaagggcacattgt

SEQ ID NO: 321850 - DNA, 75 bp, Artificial Sequence
  Synthetic
aggaactttctactcatccagtgcactgtattaacagcatacaaacctgcaactatactttctgatcaacttgat

SEQ ID NO: 321851 - DNA, 75 bp, Artificial Sequence
  Synthetic
taaacctcatcccagaaaccccagcatctattcttgcacatgatatggcacataggtacattaacctaactagag

SEQ ID NO: 321852 - DNA, 75 bp, Artificial Sequence
  Synthetic
atgatttattagcatactatgcacctagaatccaatttagccctactcaaaatattaaggaaccgggtacattta

SEQ ID NO: 321853 - DNA, 75 bp, Artificial Sequence
  Synthetic
acattagttataggccaatgtatttatactattacaagtctcttttcactgttaccaggggttgcccattctatt

SEQ ID NO: 321854 - DNA, 75 bp, Artificial Sequence
  Synthetic
aatattaaggaaccgggtacatttaaattgacatcaaatatgatgcggcctgaatcaaaaatcatgctggatatg

SEQ ID NO: 321855 - DNA, 75 bp, Artificial Sequence
  Synthetic
gactccgcaagaaacagcagttaaataacagcaggatcatgtggagtttgctattactggccgctttagctggcc

SEQ ID NO: 321856 - DNA, 75 bp, Artificial Sequence
  Synthetic
atttgggcaagtcaatagaaagtttaaacatcagtagtcatattgtacaatcagattgtgtcagcctaatcacaa

SEQ ID NO: 321857 - DNA, 75 bp, Artificial Sequence
  Synthetic
tacggaaaataaaggaggagtttgaaaaaacaaagggttccatggtttgtgagatctgtaagtatgagtgtgaaa

SEQ ID NO: 321858 - DNA, 75 bp, Artificial Sequence
  Synthetic
aaattttatcagatctagaacttaatatttctgaacctagtagccatgaacaaattacagctaaacatacacatg

SEQ ID NO: 321859 - DNA, 75 bp, Artificial Sequence
  Synthetic
aaaaacaaagggttccatggtttgtgagatctgtaagtatgagtgtgaaacattaaaggaattgaaggcacataa

SEQ ID NO: 321860 - DNA, 75 bp, Artificial Sequence
  Synthetic
gagatctgtaagtatgagtgtgaaacattaaaggaattgaaggcacataacctatcatgtgttcaaggagagtgc

SEQ ID NO: 321861 - DNA, 75 bp, Artificial Sequence
  Synthetic
ctagtgccagagagctcatgtaacatggacaaccaccaatcactctcaacaataaataaattaaccaaggtcata

SEQ ID NO: 321862 - DNA, 75 bp, Artificial Sequence
  Synthetic
ttgatactgtattggataaattctttcaaaacgagactcagaagtatttaattgatattctaaagaagactacag

SEQ ID NO: 321863 - DNA, 75 bp, Artificial Sequence
  Synthetic
cgattcagagaagatttaaaaaagactgtaactcctcaaaatattgggccaggctgttaccgaacactaaatctt

SEQ ID NO: 321864 - DNA, 75 bp, Artificial Sequence
  Synthetic
tcaaaacgagactcagaagtatttaattgatattctaaagaagactacagcttggcatatcgggcatttggttag

SEQ ID NO: 321865 - DNA, 75 bp, Artificial Sequence
  Synthetic
ggatattactgagagcttgattgcacattctggattaaggaggtctaaatattggtcaatccatgcttataataa

SEQ ID NO: 321866 - DNA, 75 bp, Artificial Sequence
  Synthetic
tttaggtataaaagtaggtgttatattctgacaatgtggactcttcttctcattattgaatccatcctctgggca

SEQ ID NO: 321867 - DNA, 75 bp, Artificial Sequence
  Synthetic
gcaagtgcagcagaaatcccccttgtccctctctggacagataatgctcatggcgttgggagtgttcctatgcat

SEQ ID NO: 321868 - DNA, 75 bp, Artificial Sequence
  Synthetic
gataaagacaatttggattcaatacttgcagatggtgatattttatggggtgtctcaaaagttatgagtctagat

SEQ ID NO: 321869 - DNA, 75 bp, Artificial Sequence
  Synthetic
ttgcagatggtgatattttatggggtgtctcaaaagttatgagtctagatctgaacagattgcttgctctaaata

SEQ ID NO: 321870 - DNA, 75 bp, Artificial Sequence
  Synthetic
aggcatgtatgccatagcaagcatagagacaatctgcttttttattcatcagaaagggaatacatataagatagt

SEQ ID NO: 321871 - DNA, 75 bp, Artificial Sequence
  Synthetic
tgcttatcattttttgcttgctatttgccagaagatgaaattatgtgcaatctttgacaacctaaggtatctgat

SEQ ID NO: 321872 - DNA, 75 bp, Artificial Sequence
  Synthetic
cattggtatgatgcaagattgaatctaaaaacctcatttcattgttatggtgcctgcacaaaatatcaataccca

SEQ ID NO: 321873 - DNA, 75 bp, Artificial Sequence
  Synthetic
tgccagaagatgaaattatgtgcaatctttgacaacctaaggtatctgatacctgctgtgacatctttatattct

SEQ ID NO: 321874 - DNA, 75 bp, Artificial Sequence
  Synthetic
agaaagattatgagtatgaaaatagctgggcttgcaaccccccagattgcccaggggttggtacaggttgtactg

SEQ ID NO: 321875 - DNA, 75 bp, Artificial Sequence
  Synthetic
ggctttccgtctttggttgaaaagctgtttgagagaccttttaagagtgctttagaggtttatgtgtattataac

SEQ ID NO: 321876 - DNA, 75 bp, Artificial Sequence
  Synthetic
tttagaggtttatgtgtattataacatcaaaagtctgcttgttgcactggctcaaaataataaggctagatttta

SEQ ID NO: 321877 - DNA, 75 bp, Artificial Sequence
  Synthetic
gaagccggtaggaacagcctttaaaattataagtgtaagatacagtagaaaagtgtgcgtgcagtttggtgaaga

SEQ ID NO: 321878 - DNA, 75 bp, Artificial Sequence
  Synthetic
catgacctccctggcgaagaaattgcaacataccagatttcagggcagatagaggcaaaaatccctcatacagtg

SEQ ID NO: 321879 - DNA, 75 bp, Artificial Sequence
  Synthetic
atctaagttttctcaaggtgacactctactatttctggggcccatggaaggaggtggtataatctttaaacactg

SEQ ID NO: 321880 - DNA, 75 bp, Artificial Sequence
  Synthetic
gtgtacatctacctgtcactttggagaccctggtgatgtcatgggtccaaaagataaaccatttatttgccctga

SEQ ID NO: 321881 - DNA, 75 bp, Artificial Sequence
  Synthetic
caagcggtatttatccatcttttatgtcacgagttgtttataaacattacaagagtttgatttcagaagtgacaa

SEQ ID NO: 321882 - DNA, 75 bp, Artificial Sequence
  Synthetic
aagataaaccatttatttgccctgaattcccagggcaatttaggaaaaaatgtaactttgccacaactccagttt

SEQ ID NO: 321883 - DNA, 75 bp, Artificial Sequence
  Synthetic
agctccaaaaacttgaaattgactgcttttgcaggtattccatcatactcatcaactagtatattagctgcttca

SEQ ID NO: 321884 - DNA, 75 bp, Artificial Sequence
  Synthetic
attcccagggcaatttaggaaaaaatgtaactttgccacaactccagtttgtgaatatgatggaaacattatatc

SEQ ID NO: 321885 - DNA, 75 bp, Artificial Sequence
  Synthetic
gaccctggtgatgtcatgggtccaaaagataaaccatttatttgccctgaattcccagggcaatttaggaaaaaa

SEQ ID NO: 321886 - DNA, 75 bp, Artificial Sequence
  Synthetic
atttaacgggatactatgaggcagtccacccttgcaatgtattctgtgtcttatcaggaccaggtgcttcatgtg

SEQ ID NO: 321887 - DNA, 75 bp, Artificial Sequence
  Synthetic
agcttgtagaatctagtgaattagcagcccaacaactatattgtcaagatgcagttgaactggctgccaatgaat

SEQ ID NO: 321888 - DNA, 75 bp, Artificial Sequence
  Synthetic
ttgttatttctaaagatattgattttgaaaatttggctgagaatccttgtaaagtagggctccaggcagcaaaca

SEQ ID NO: 321889 - DNA, 75 bp, Artificial Sequence
  Synthetic
agcccaacaactatattgtcaagatgcagttgaactggctgccaatgaattaaaccgaattcttatcacaaagtc

SEQ ID NO: 321890 - DNA, 75 bp, Artificial Sequence
  Synthetic
cagctgagcagcagatcagctttgtctgccaaagggttgatatggatattatagtgtactgtaatggtcagaaaa

SEQ ID NO: 321891 - DNA, 75 bp, Artificial Sequence
  Synthetic
ctgccaaagggttgatatggatattatagtgtactgtaatggtcagaaaaagacaatcttaacaaaaacattagt

SEQ ID NO: 321892 - DNA, 75 bp, Artificial Sequence
  Synthetic
gggttgcccattctattgctattgagttgtgtgttccagggtttcatggctgggccacagctgcacttttgatca

SEQ ID NO: 321893 - DNA, 75 bp, Artificial Sequence
  Synthetic
aacgtgcttcagctatatgaagaaactagacaccagaaggcacaagctagaattgtgaggaaatttcagaggact

SEQ ID NO: 321894 - DNA, 75 bp, Artificial Sequence
  Synthetic
tccagcatgtacattagctattcttttagttctcaagttttttgcaaatatccttcatacaagcaatcaagagaa

SEQ ID NO: 321895 - DNA, 75 bp, Artificial Sequence
  Synthetic
cccacctaacaatcttcacatcatgtatcgattttcaaacactttatcatttagaacttaacttggcactactat

SEQ ID NO: 321896 - DNA, 75 bp, Artificial Sequence
  Synthetic
actgctgcccttcataatggattacctgatgacaggttaaaaaactgtgttattgatgctctgcgccatgtatat

SEQ ID NO: 321897 - DNA, 75 bp, Artificial Sequence
  Synthetic
tttgtcaagctacccaccgattcagagaagatttaaaaaagactgtaactcctcagaatattgggccaggttgtt

SEQ ID NO: 321898 - DNA, 75 bp, Artificial Sequence
  Synthetic
aatactctcttctatctcccaatcttttattgattcaccggggtgctgtcttgacatctggcggcgtctactact

SEQ ID NO: 321899 - DNA, 75 bp, Artificial Sequence
  Synthetic
aacttagacactatattgattctatggacacttatgaacctcatgtcagagacttcttgaatttttttccagatg

SEQ ID NO: 321900 - DNA, 75 bp, Artificial Sequence
  Synthetic
tgctcatcattatttggtgtggcaatgtctttactatttaaagaaatctggacgaggttatttccagaattggac

SEQ ID NO: 321901 - DNA, 75 bp, Artificial Sequence
  Synthetic
atctcacaaacccagttaatgaccaacagagtgtctcattgcacatagaaattgaaagtcaaggcattggtgctg

SEQ ID NO: 321902 - DNA, 75 bp, Artificial Sequence
  Synthetic
actgattggtttctatttgtatcccaacagattcaggctggaaaattgcactggtttaatgtaaatacagagatg

SEQ ID NO: 321903 - DNA, 75 bp, Artificial Sequence
  Synthetic
tggaagagtatgtttaacctgcatgaacacattcttttgctagggtcgattaaaatttccccaaagaagacaaca

SEQ ID NO: 321904 - DNA, 75 bp, Artificial Sequence
  Synthetic
aacacattcttttgctagggtcgattaaaatttccccaaagaagacaacattatcaccaacgaatgctgagtttt

SEQ ID NO: 321905 - DNA, 75 bp, Artificial Sequence
  Synthetic
tcatttcattgttatggtgcctgcacaaaataccaatatccatggcacactgcaaaatgccattttgagaaagat

SEQ ID NO: 321906 - DNA, 75 bp, Artificial Sequence
  Synthetic
tgtctacatttttcgagggttgtgctgtatcaatcccctttattaaaatcctacttggctcactatctgacctac

SEQ ID NO: 321907 - DNA, 75 bp, Artificial Sequence
  Synthetic
ctgtaagccaactgtttacatgattgttcctatacatgcttgcaacatgatgaaaagctgtttgattggccttgg

SEQ ID NO: 321908 - DNA, 75 bp, Artificial Sequence
  Synthetic
ctacttggctcactatctgacctaccaggccttggctatttcgatgatcttgctgctgcccagacaaggtgtgtc

SEQ ID NO: 321909 - DNA, 75 bp, Artificial Sequence
  Synthetic
tatgagtatgaaaatagttgggcatgcaaccccccagattgcccaggggttggtacaggttgtactgcttgtgga

SEQ ID NO: 321910 - DNA, 75 bp, Artificial Sequence
  Synthetic
acttagtacgagtaaggttgagagattatatgggacatcaataggcatggttaattatcctggcacatatttaag

SEQ ID NO: 321911 - DNA, 75 bp, Artificial Sequence
  Synthetic
gacaaaacactctgaaactccaattccactaggaggaagtggtgcaatgtcaataatggagctttcaacggccgg

SEQ ID NO: 321912 - DNA, 75 bp, Artificial Sequence
  Synthetic
tgcataaacaccaaaaacaaatgagttacatcctggggctattcaaatttttaatggatctttctggtgagacat

SEQ ID NO: 321913 - DNA, 75 bp, Artificial Sequence
  Synthetic
atacagtgagctctaaaaacttaaaattgactgcttttgcaggtatcccatcatactcatcaactagtatattag

SEQ ID NO: 321914 - DNA, 75 bp, Artificial Sequence
  Synthetic
ttaatggatctttctggtgagacatttcagcatgaaaggctgggccagttttcatttataggaaaagttcaatgg

SEQ ID NO: 321915 - DNA, 75 bp, Artificial Sequence
  Synthetic
tgccacaactccagtttgtgaatatgatgggaacatcatctcaggctacaagaaagttcttgcaacaattgattc

SEQ ID NO: 321916 - DNA, 75 bp, Artificial Sequence
  Synthetic
ctgcttcagaagatggtcgtttcatatttagtcctggtttatttcctaacctaaatcagtcagtctgtgataaca

SEQ ID NO: 321917 - DNA, 75 bp, Artificial Sequence
  Synthetic
ttgaattctctgacatgtattctcagaagtttctaaaggtttggagtgaacagcatcctacatatgattacatta

SEQ ID NO: 321918 - DNA, 75 bp, Artificial Sequence
  Synthetic
tttccaatcattcaacacaagcaatatacacttcactgatgaaagaattgaatggagggaccctgatggtatgct

SEQ ID NO: 321919 - DNA, 75 bp, Artificial Sequence
  Synthetic
atgcactccctttaatctggaggggcctaattgatttaacgggatactatgaggcagtccacccttgcaatgtat

SEQ ID NO: 321920 - DNA, 75 bp, Artificial Sequence
  Synthetic
ttcctaaaggtcgcgacaatcttcttatttatcttgtgagaaaattaaatgacccaagcattataacagctatga

SEQ ID NO: 321921 - DNA, 75 bp, Artificial Sequence
  Synthetic
tatttatcttgtgagaaaattaaatgacccaagcattataacagctatgactatgcaatcacccttacaactcag

SEQ ID NO: 321922 - DNA, 75 bp, Artificial Sequence
  Synthetic
gtttaggatgcaagcaaaacaacatatgaaggtctgcagattagacggagagtgggtaacatttagagaggtact

SEQ ID NO: 321923 - DNA, 75 bp, Artificial Sequence
  Synthetic
tgtgtttggtgtccaagcaaaataggttcagagcagctgagcagcagatcagctttgtctgccaaagggtcgata

SEQ ID NO: 321924 - DNA, 75 bp, Artificial Sequence
  Synthetic
tcaaaaaaagacaatcctaacaaaaacattagttataggccaatgtatttatactattacaagtctcttttcact

SEQ ID NO: 321925 - DNA, 75 bp, Artificial Sequence
  Synthetic
ctgcacgttttctaaagagtatgcgtggaaagatttcttgaataatgtacactgtgatgtgataccaataaagca

SEQ ID NO: 321926 - DNA, 75 bp, Artificial Sequence
  Synthetic
ctcacgagggcaaaatactgtcaaaattaccgggaaaggtggccatagtggttcttcatttaaatgctgtcatgg

SEQ ID NO: 321927 - DNA, 75 bp, Artificial Sequence
  Synthetic
gctattgagttgtgtgtcccagggtttcatggctgggccacagctgcacttttgatcacattctgctttggctgg

SEQ ID NO: 321928 - DNA, 75 bp, Artificial Sequence
  Synthetic
cgttattggctacaagtttgcagtaacggtggatgaaatgtctgatgtgctagatacagcaaagtttccagactc

SEQ ID NO: 321929 - DNA, 75 bp, Artificial Sequence
  Synthetic
tagatacagcaaagtttccagactccctggcagttgacctgaagacaatgaaagatggcgtctatagggagttgg

SEQ ID NO: 321930 - DNA, 75 bp, Artificial Sequence
  Synthetic
tacggaaaataaaggaggagtttgaaaaaacaaagggttccatggtttgtgagatctgtaagtacgagtgtgaaa

SEQ ID NO: 321931 - DNA, 75 bp, Artificial Sequence
  Synthetic
aaaaacaaagggttccatggtttgtgagatctgtaagtacgagtgtgaaacattaaaggaattgaaggcacataa

SEQ ID NO: 321932 - DNA, 75 bp, Artificial Sequence
  Synthetic
ttttgctcttttctcttatcctgttgagcattttgtgtcctgtgagaaagcataaaaaatcatagatcctaccta

SEQ ID NO: 321933 - DNA, 75 bp, Artificial Sequence
  Synthetic
ttaatcttcacatcatgtatcaagtttaaaacactttaccattaaaaaacttaacctgactctaatatctgataa

SEQ ID NO: 321934 - DNA, 75 bp, Artificial Sequence
  Synthetic
agacaattaaagttaaaccccataaagaagtgctccaggctgtatcaatatttaatagaaaggaagatattggtc

SEQ ID NO: 321935 - DNA, 75 bp, Artificial Sequence
  Synthetic
aggctgttaccgaacattgaatcttttcaggtataaaagtaggtgttatattctaacaatgtggactcttcttct

SEQ ID NO: 321936 - DNA, 75 bp, Artificial Sequence
  Synthetic
aaaaaaatactctcttctatctcccaatcttttattgattcaccggggtgttgtcttgacatcctgcggagcata

SEQ ID NO: 321937 - DNA, 75 bp, Artificial Sequence
  Synthetic
ctccggaagagacaaatcaaaaaaagatggagaaatatagagaaatacacagggatctgaaggagtttactatta

SEQ ID NO: 321938 - DNA, 75 bp, Artificial Sequence
  Synthetic
ttcaggtataaaagtaggtgttatattctaacaatgtggactcttcttctcattattgaatccatcctctgggca

SEQ ID NO: 321939 - DNA, 75 bp, Artificial Sequence
  Synthetic
taaaaacctcatttcattgctatggtgcctgcacaaaataccaatacccatggcacactgcaaaatgccattttg

SEQ ID NO: 321940 - DNA, 75 bp, Artificial Sequence
  Synthetic
agtaacctttaattttggattagattgtgcacggcttgagattttttgggataaaaaaacttatattcttgagac

SEQ ID NO: 321941 - DNA, 75 bp, Artificial Sequence
  Synthetic
tatctagagcaagaactcatgacatttttccataggggagaattacaaaacccttataaaattacatttaaagta

SEQ ID NO: 321942 - DNA, 75 bp, Artificial Sequence
  Synthetic
aaggaatgacggtgtagttcaatacatgagattggtacaggcagaaatcagttatgtaagggaacatctggtcaa

SEQ ID NO: 321943 - DNA, 75 bp, Artificial Sequence
  Synthetic
ccaaaatatgtattattgggactgtatctaagttctctcaaggtgacactctactatttcttgggcccatggaag

SEQ ID NO: 321944 - DNA, 75 bp, Artificial Sequence
  Synthetic
cgtgatgttcgttatcaagcagttgatgccgtaagtaatgtgtggttcacacataggggaataaagctataccta

SEQ ID NO: 321945 - DNA, 75 bp, Artificial Sequence
  Synthetic
gatttgattaaacctgatatagatgggttagtgaactatgcccaaagctggatgtcaaagacccaagaattctct

SEQ ID NO: 321946 - DNA, 75 bp, Artificial Sequence
  Synthetic
ggttagtgaactatgcccaaagctggatgtcaaagacccaagaattctctttctttgaagtaaagggttcagctg

SEQ ID NO: 321947 - DNA, 75 bp, Artificial Sequence
  Synthetic
tttctgtggatcttttcatgtttaatgacttacttagactgataaacccagctaacacacttgacttgtctggcc

SEQ ID NO: 321948 - DNA, 75 bp, Artificial Sequence
  Synthetic
atgtcccggcacccaaggaactttttactcatccagtgcactgtattaacagcatacaaacctgcaactatactt

SEQ ID NO: 321949 - DNA, 75 bp, Artificial Sequence
  Synthetic
agcatacaaacctgcaactatactttctgatcaacttgatagccgtagggcctgcattcaatttttaaacctcat

SEQ ID NO: 321950 - DNA, 75 bp, Artificial Sequence
  Synthetic
aaagtagggctccaggcagcaaacatagaaggtgcttggggttcaggtgttgggtttacactcacatgccaggtg

SEQ ID NO: 321951 - DNA, 75 bp, Artificial Sequence
  Synthetic
gtagattttgaaaatattgatatagaagctgatgtagagcattttttacaggatgagagtgcttatacaggtgat

SEQ ID NO: 321952 - DNA, 75 bp, Artificial Sequence
  Synthetic
cccagaaacccctacatctatccttgcacatgatatggcacatagatacatcaatttgactagagatgatttatt

SEQ ID NO: 321953 - DNA, 75 bp, Artificial Sequence
  Synthetic
tcacgtcaataaaggcctgtgacatggcaatttgttatggtgcagaaagtgtgacactctcacgaggacaaaata

SEQ ID NO: 321954 - DNA, 75 bp, Artificial Sequence
  Synthetic
tttaaccctacccaaaatattaaagaaccaggtacctttaaattaacatcaaatatgatgaggcctgagtcaaag

SEQ ID NO: 321955 - DNA, 75 bp, Artificial Sequence
  Synthetic
gtgacactctcacgaggacaaaatactgtcaaaattaccgggaaaggtggccatagtggttcttcatttaaatgc

SEQ ID NO: 321956 - DNA, 75 bp, Artificial Sequence
  Synthetic
aagtaaaaaagatgagagggataattaagcttctagaacctgtaaaattaataaagagctgggtgtcaagggggt

SEQ ID NO: 321957 - DNA, 75 bp, Artificial Sequence
  Synthetic
aaatatgatgaggcctgagtcaaagatcatgctggatatgttaagtcaacatgaacctcgagaaaatctagggaa

SEQ ID NO: 321958 - DNA, 75 bp, Artificial Sequence
  Synthetic
tatatatcaaaaaactttaacttttcaggcaagcaggtatccttattagacccgtatgatttaactgagcttgag

SEQ ID NO: 321959 - DNA, 75 bp, Artificial Sequence
  Synthetic
gaatgggttatgggtataatcaatgggaactgggttgtcttaattgttttgtgtatcctgctgctcttctctctt

SEQ ID NO: 321960 - DNA, 75 bp, Artificial Sequence
  Synthetic
agatttagagcttaacatttctgaacctagtggccatgagcagattacagctaaacacacacatgttgatactgt

SEQ ID NO: 321961 - DNA, 75 bp, Artificial Sequence
  Synthetic
ctgttgtggatcagtttgcctcccttgacttggaggcccaaaatctagttcaaaagcagggtattatacctgagg

SEQ ID NO: 321962 - DNA, 75 bp, Artificial Sequence
  Synthetic
ctaaacacacacatgttgatactgtattggataaattctttcaaaacgagactcagaagtatttaattgatattc

SEQ ID NO: 321963 - DNA, 75 bp, Artificial Sequence
  Synthetic
atcctgttgagcattttgtgtcctgttagaaagcataaaaaatcataaatcctacctattaatcttaacatcatg

SEQ ID NO: 321964 - DNA, 75 bp, Artificial Sequence
  Synthetic
attggataaattctttcaaaacgagactcagaagtatttaattgatattctaaagaagactacagcgtggcatat

SEQ ID NO: 321965 - DNA, 75 bp, Artificial Sequence
  Synthetic
ggagtttgctattactggccgctttagttggccaaggctttgcattaaaaaatgtgtttgacatgagaattcagt

SEQ ID NO: 321966 - DNA, 75 bp, Artificial Sequence
  Synthetic
gcgatttatgactgcttttaaattaggtcctgggctagttgataaagacaatctggattctatacttgcagatgg

SEQ ID NO: 321967 - DNA, 75 bp, Artificial Sequence
  Synthetic
tgatatcttatggggtgtctcaaaagttatgagtctagatttgaataggttacttgctttgaatatagcttttga

SEQ ID NO: 321968 - DNA, 75 bp, Artificial Sequence
  Synthetic
gaaagcactacttgcaacagctacatggttccagtattacactgaagatcaatcacaatttccattgcaacattc

SEQ ID NO: 321969 - DNA, 75 bp, Artificial Sequence
  Synthetic
acatctttgtattctggctttccttctttggttgaaaaactgtttgagagaccttttaaaagtgctttagaagtt

SEQ ID NO: 321970 - DNA, 75 bp, Artificial Sequence
  Synthetic
attataagtgtaagatacagtagaaaagtgtgcgtgcagtttggtgaagaatacctttgtaaaacaattgatatg

SEQ ID NO: 321971 - DNA, 75 bp, Artificial Sequence
  Synthetic
ctttggttgaaaaactgtttgagagaccttttaaaagtgctttagaagtttatgtgtattataacatcaaaagtt

SEQ ID NO: 321972 - DNA, 75 bp, Artificial Sequence
  Synthetic
gttcctatacatgcatgcaacatgatgaaaagctgtttgattggtcttggtccttacagagtccaggtcgtttat

SEQ ID NO: 321973 - DNA, 75 bp, Artificial Sequence
  Synthetic
accttttaaaagtgctttagaagtttatgtgtattataacatcaaaagtttgcttgttgcattagcacagaataa

SEQ ID NO: 321974 - DNA, 75 bp, Artificial Sequence
  Synthetic
taaggctagattttattcaaaagttaaacttcttggattaactgtcgatcaatctacagttggtgcaagcggtat

SEQ ID NO: 321975 - DNA, 75 bp, Artificial Sequence
  Synthetic
tctttttgaaaagggtttgcatgggaatgtaaatgaagaggctaaaatacatctggaaactgtagaatgggcaac

SEQ ID NO: 321976 - DNA, 75 bp, Artificial Sequence
  Synthetic
cccccgtatatgcccctgctggtgaagactttagggcaatggaggttttttccgggattattacatcaccgcatg

SEQ ID NO: 321977 - DNA, 75 bp, Artificial Sequence
  Synthetic
ctatattgtcaagatgcagttgagttggctgccaatgaattaaaccgaattcttatcacaaagtctcaggtggtt

SEQ ID NO: 321978 - DNA, 75 bp, Artificial Sequence
  Synthetic
gagaagaccatgatctccctggcgaagaaattgcaacataccagatttcagggcagatagaggcaaaaatccctc

SEQ ID NO: 321979 - DNA, 75 bp, Artificial Sequence
  Synthetic
aagtttcagaggacagaagctgatcgaggtttcttcattacgacactaccaacaagatgtcgccttgagattatt

SEQ ID NO: 321980 - DNA, 75 bp, Artificial Sequence
  Synthetic
gaggtttcttcattacgacactaccaacaagatgtcgccttgagattattgaggactattatgatgcaatatcaa

SEQ ID NO: 321981 - DNA, 75 bp, Artificial Sequence
  Synthetic
gtttagagcagctgagcagcagatcagctttgtttgccaaagggttgatatggatattatagtgtactgtaatgg

SEQ ID NO: 321982 - DNA, 75 bp, Artificial Sequence
  Synthetic
aaaatgtggcagaagagtatatctcatatggtggagaaaggaagattctctgtatccaggcagcccttgagaaag

SEQ ID NO: 321983 - DNA, 75 bp, Artificial Sequence
  Synthetic
cgattcagagaagatttaaaaaagactgtgactcctcaaaatattgggcctggttgttaccgaacattaaatctt

SEQ ID NO: 321984 - DNA, 75 bp, Artificial Sequence
  Synthetic
ctatattgattctatggatacctatgaacctcatgtcagggatttcttgaatttcttcccagacgggcatcatgg

SEQ ID NO: 321985 - DNA, 75 bp, Artificial Sequence
  Synthetic
agaggtgcgaggcaattggttgcagggtaacttgaataagtgctcatcgttatttggtgtagcaatgtctttatt

SEQ ID NO: 321986 - DNA, 75 bp, Artificial Sequence
  Synthetic
tgtttaacctacatgaacacattcttctgctagggtcaatcaaaatatccccaaagaagacaacattgtcgccga

SEQ ID NO: 321987 - DNA, 75 bp, Artificial Sequence
  Synthetic
ccaaagaagacaacattgtcgccgacaaatgctgagttcttgtctacattttttgaaggttgtgctgtatcgatt

SEQ ID NO: 321988 - DNA, 75 bp, Artificial Sequence
  Synthetic
atttgggagcatcgcctcagatctcacaacttgcagtctcacttagtacaagtaaggttgagagattatatggga

SEQ ID NO: 321989 - DNA, 75 bp, Artificial Sequence
  Synthetic
gtgaatatgatgggaatattatctcaggctataagaaagttcttgcaacaattgattctttccaatcatttaaca

SEQ ID NO: 321990 - DNA, 75 bp, Artificial Sequence
  Synthetic
gggctcttcaagtttctaatggacctttctggtgagacatttcagcatgagaggctaggtcagttttcatttatt

SEQ ID NO: 321991 - DNA, 75 bp, Artificial Sequence
  Synthetic
ccatagtggttcctcatttaagtgctgtcatgggaaagaatgttcattaactggcctccaagccagtgcaccaca

SEQ ID NO: 321992 - DNA, 75 bp, Artificial Sequence
  Synthetic
atgatggtgcacctgaatgtggcattacttgttggtttaaaaaatcaggtgaatgggttatgggtataatcaatg

SEQ ID NO: 321993 - DNA, 75 bp, Artificial Sequence
  Synthetic
atcctgttgagcatcctgtgtcctgttagaaagcataaaaaatcataaatcctgcttattaatcttcatagcatg

SEQ ID NO: 321994 - DNA, 75 bp, Artificial Sequence
  Synthetic
gcagactggatggggactgggtaacattcagagaggtacttgcagcagctaacagcttcgctgagagctatgagc

SEQ ID NO: 321995 - DNA, 75 bp, Artificial Sequence
  Synthetic
attcagagaggtacttgcagcagctaacagcttcgctgagagctatgagcctagtcaaaatgatattgatttatt

SEQ ID NO: 321996 - DNA, 75 bp, Artificial Sequence
  Synthetic
tatcgagttttaaacactttaccattaaaaacttaacctggctctaatatctgataactaactttcatttttatt

SEQ ID NO: 321997 - DNA, 75 bp, Artificial Sequence
  Synthetic
agaaattgcaacataccagatttcagggcagatagaggcaaaaatccctcatacagtgagctctaaaaacttgaa

SEQ ID NO: 321998 - DNA, 75 bp, Artificial Sequence
  Synthetic
tagtagtagactccgcaagaaacagcagttaaataacagcaggatcatgtggagtttgctattattggccgcttt

SEQ ID NO: 321999 - DNA, 75 bp, Artificial Sequence
  Synthetic
aaacagcattccagctgttattggttacaagtttgcagtaacggttgatgaaatgtctgatgtgctagacacagc

SEQ ID NO: 322000 - DNA, 75 bp, Artificial Sequence
  Synthetic
ttgcccccactctcattacaggaggcagaacagctagtgccagagagctcatgcaacatggacaaccaccaatca

SEQ ID NO: 322001 - DNA, 75 bp, Artificial Sequence
  Synthetic
gacctgaagacaatgaaagatggagtctatagggaattgggtttagatatctcttccccagatgttatgaagaaa

SEQ ID NO: 322002 - DNA, 75 bp, Artificial Sequence
  Synthetic
caaaatcacgggttgtcattgtccaggggaatgtggaaggaactgcagaggcaatctgtgcatactggttgagga

SEQ ID NO: 322003 - DNA, 75 bp, Artificial Sequence
  Synthetic
agttaaaccccataaagaagtgctccaggctgtatccatatttaacaggaaagaagatatcggtcagcagaagga

SEQ ID NO: 322004 - DNA, 75 bp, Artificial Sequence
  Synthetic
tgaaggggatctaagagtaacctttaattttggattagattgtgcacggcttgagattttttgggataaaaaaac

SEQ ID NO: 322005 - DNA, 75 bp, Artificial Sequence
  Synthetic
aatgtttttgacatgagaatccagtgtcctcactcagtcaactttggggaaacaagtgtgtcaggctatacggaa

SEQ ID NO: 322006 - DNA, 75 bp, Artificial Sequence
  Synthetic
taggtgtgggatgcgatttaatactgagcaagttaatggtgtaaagcaccttgttttgttcaagacagattcagg

SEQ ID NO: 322007 - DNA, 75 bp, Artificial Sequence
  Synthetic
gagcaagttaatggtgtaaagcaccttgttttgttcaagacagattcaggttttgaatggggtaagcctaatatt

SEQ ID NO: 322008 - DNA, 75 bp, Artificial Sequence
  Synthetic
ttcatgtgaagccttttcagaaggaggtattttcaatattacttctccaatgtgtctggtgtccaagcaaaatag

SEQ ID NO: 322009 - DNA, 75 bp, Artificial Sequence
  Synthetic
ccatgtattgtatacaaaaactgtgcattgaggacaggtttgaggacaaaccaggctatcaaccataagtttatg

SEQ ID NO: 322010 - DNA, 75 bp, Artificial Sequence
  Synthetic
ggtattttcaatattacttctccaatgtgtctggtgtccaagcaaaataggtttagagcagctgagcagcagatc

SEQ ID NO: 322011 - DNA, 75 bp, Artificial Sequence
  Synthetic
gggcaattgcacagcatgatgaagatagcccacggtttcttttagcacatgcttttcatactatccgtgatgttc

SEQ ID NO: 322012 - DNA, 75 bp, Artificial Sequence
  Synthetic
tccctatagaatccaggttgtctatgaaaggacatactgcactacaggtatattgacagaaggaaaatgctttgt

SEQ ID NO: 322013 - DNA, 75 bp, Artificial Sequence
  Synthetic
ttgaagaggggtatgtatgccatagcaagcatagagacaatctgcttttttgttcatcagaaagggaatacatat

SEQ ID NO: 322014 - DNA, 75 bp, Artificial Sequence
  Synthetic
tgaatcgtgcaaaaatttctgtggacctttttatgtttaatgatttacttagactgattaacccaggtaacacac

SEQ ID NO: 322015 - DNA, 75 bp, Artificial Sequence
  Synthetic
ttcaggtataaaagtaggtgttatattctgacaatgtggactcttcttctcattattgaatccatcctctgggca

SEQ ID NO: 322016 - DNA, 75 bp, Artificial Sequence
  Synthetic
gggcaaatagaggcaaaaatccctcatacagtgagctctaaaaacttaaagttaactgcttttgcaggtattcca

SEQ ID NO: 322017 - DNA, 75 bp, Artificial Sequence
  Synthetic
tgccatctagttctaagtacacatataaaagacatcttacaaacccagttaatgaccaacagagtgtctcattgc

SEQ ID NO: 322018 - DNA, 75 bp, Artificial Sequence
  Synthetic
tgtcagaagaaacagaagtaaaaaagatgagagggataattaagcttttagaacctgtaaagttaataaagagct

SEQ ID NO: 322019 - DNA, 75 bp, Artificial Sequence
  Synthetic
tcatactcatcaaccagtatactggctgcttcagaagatggtcgtttcatatttagtcctggtctatttcctaac

SEQ ID NO: 322020 - DNA, 75 bp, Artificial Sequence
  Synthetic
aaaggtatacaacccagttaacatcatactaatgactagatatatatcaaaaaactttaacttttcaggcaagca

SEQ ID NO: 322021 - DNA, 75 bp, Artificial Sequence
  Synthetic
ttcatgtgaagccttttcagaaggaggtatttttaatattacttctccaatgtgtctggtgtcaaaacaaaatag

SEQ ID NO: 322022 - DNA, 75 bp, Artificial Sequence
  Synthetic
gcccaaaatctagttcaaaagcagggtattgtacctgaggatgtgattccagattctttgttttcttttagacac

SEQ ID NO: 322023 - DNA, 75 bp, Artificial Sequence
  Synthetic
attacgacggctttttccacaggattcagtttctacattttattaatcatttacttcattttcattttccggagc

SEQ ID NO: 322024 - DNA, 75 bp, Artificial Sequence
  Synthetic
agtagactccctaaagagctactatactaacaagaaaaatggcaactatggaggaaatccagagagaaatcagtg

SEQ ID NO: 322025 - DNA, 75 bp, Artificial Sequence
  Synthetic
tgtaattttgccacaactccagtttgtgaatatgatgggaacattatttcaggctataagaaagttcttgcgaca

SEQ ID NO: 322026 - DNA, 75 bp, Artificial Sequence
  Synthetic
gagatctgtaagtacgagtgtgaaacattaaaagaattgaaggcacataacctatcatgcattcaaggggaatgc

SEQ ID NO: 322027 - DNA, 75 bp, Artificial Sequence
  Synthetic
attgattctttccaatcatttaacacaagcaatatacacttcactgatgagagaattgaatggagagatcctgat

SEQ ID NO: 322028 - DNA, 75 bp, Artificial Sequence
  Synthetic
gcaagtgcagcagaaatcccccttgtccctctctggacagataatgcacacggcgttggtagtgttcctatgcat

SEQ ID NO: 322029 - DNA, 75 bp, Artificial Sequence
  Synthetic
acagatcttgaattagacttttccttgccatctagctctaagtatacatataaaagacatctcacaaacccagtt

SEQ ID NO: 322030 - DNA, 75 bp, Artificial Sequence
  Synthetic
tgccatctagctctaagtatacatataaaagacatctcacaaacccagttaatgaccaacagagtgtttcattgc

SEQ ID NO: 322031 - DNA, 75 bp, Artificial Sequence
  Synthetic
atatagaaattgaaagccaaggcattggtgctgatgttcatcatcttggacattggtatgatgcaagattaaatc

SEQ ID NO: 322032 - DNA, 75 bp, Artificial Sequence
  Synthetic
gagttagaaaacgagaaagtttatgatgatggtgcacctgaatgtggcattacttgttggtttaaaaaatcaggt

SEQ ID NO: 322033 - DNA, 75 bp, Artificial Sequence
  Synthetic
tacttgttggtttaaaaaatcaggtgaatgggttatgggtataatcaatgggaactgggttgtcctaattgtttt

SEQ ID NO: 322034 - DNA, 75 bp, Artificial Sequence
  Synthetic
tgtagttgggtttttggcactggcaaaagactggacatctagaattgaagaatggcttggcgcaccctgcaagtt

SEQ ID NO: 322035 - DNA, 75 bp, Artificial Sequence
  Synthetic
ttagaaagcataaaaaatcataaatcctacctattaatctcaacatcatgtgttaagttttaaacactttatcat

SEQ ID NO: 322036 - DNA, 75 bp, Artificial Sequence
  Synthetic
aatgattgctttgtgactaggcatgccaaaatatgtataattgggactgtatctaagttctctcaaggtgacact

SEQ ID NO: 322037 - DNA, 75 bp, Artificial Sequence
  Synthetic
gaagccagtaggaacagccttcaagattataagtgtgagatacagtagaaaagtgtgcgtgcagtttggtgaaga

SEQ ID NO: 322038 - DNA, 75 bp, Artificial Sequence
  Synthetic
gagcttcgtagcctggctcagatcctgattgaccagaaagtgaaggaaatctcgaaccaggaacctatgaaatta

SEQ ID NO: 322039 - DNA, 75 bp, Artificial Sequence
  Synthetic
tatggaagaaatccagagagaaatcagtgctcacgaggggcagcttgtgatagcacgccagaaggtcaaggatgc

SEQ ID NO: 322040 - DNA, 75 bp, Artificial Sequence
  Synthetic
agtgctcacgaggggcagcttgtgatagcacgccagaaggtcaaggatgcagaaaagcagtatgagaaggatcct

SEQ ID NO: 322041 - DNA, 75 bp, Artificial Sequence
  Synthetic
ctaactataggttaagaaatactaatcagtagttaataagaatacagatttattgaataatcatattaaataatt

SEQ ID NO: 322042 - DNA, 75 bp, Artificial Sequence
  Synthetic
agaaaagcagtatgagaaggatcctgatgacttaaacaagagggcactgcatgatcgggagagtgtcgcagcttc

SEQ ID NO: 322043 - DNA, 75 bp, Artificial Sequence
  Synthetic
ccatagtggttcttcatttaaatgctgtcacgggaaagaatgttcatcaaatggtctccaagccagtgcaccgca

SEQ ID NO: 322044 - DNA, 75 bp, Artificial Sequence
  Synthetic
cctgaatagtcttgacattgatgaacctacaggacagacagctgattggttgaccataattgtctatctgacatc

SEQ ID NO: 322045 - DNA, 75 bp, Artificial Sequence
  Synthetic
tgaccataattgtctatctgacatcattcgtggtcccgatcatcttgaaggcactgtacatgttaacaacaagag

SEQ ID NO: 322046 - DNA, 75 bp, Artificial Sequence
  Synthetic
ttaggaagcataaaaaatcataaatttaaccgattaatcttcacatcttttatagagtttaaaacactttaccat

SEQ ID NO: 322047 - DNA, 75 bp, Artificial Sequence
  Synthetic
gcaaggaacatggtaagccctgtcatgagtgtagttgggtttttggcactggcaaaagactggacatctagaatt

SEQ ID NO: 322048 - DNA, 75 bp, Artificial Sequence
  Synthetic
aatcgtgactatatcagacagagacaaggtgcacttgcaggaatggagccaaaggaatttcaagccctcaggcaa

SEQ ID NO: 322049 - DNA, 75 bp, Artificial Sequence
  Synthetic
gtatatatggatgtagattttaattgatcaaatactaatcctactgtcctcttttcttttcctttctccttcttt

SEQ ID NO: 322050 - DNA, 75 bp, Artificial Sequence
  Synthetic
tagtagtagacaccgcaagaaacagcggttaaatcacagcaggatcatgtggagtttgctattactggccgcttt

SEQ ID NO: 322051 - DNA, 75 bp, Artificial Sequence
  Synthetic
cgattcagagaagatttaaagaagactgtcactcctcaaaatatcgggccaggctgttaccgaacactaaatctt

SEQ ID NO: 322052 - DNA, 75 bp, Artificial Sequence
  Synthetic
agactttagggcaatggaggttttttctgggattattacgtcaccgcatggagaagaccatgacctccctggcga

SEQ ID NO: 322053 - DNA, 75 bp, Artificial Sequence
  Synthetic
agctttatttgccaaagggttgatatggatattatagtgtactgtaatggtcaaaaaaagacaatattaacaaaa

SEQ ID NO: 322054 - DNA, 75 bp, Artificial Sequence
  Synthetic
gtattgattcctgcatgtacattagctattcttttagttctcaagttttttgcaaatatccttcatacaagcaat

SEQ ID NO: 322055 - DNA, 75 bp, Artificial Sequence
  Synthetic
tgccatctagctctaagtacacatataaaaggcatctcacaaacccagttaatgaccaacagagtgtctcattgc

SEQ ID NO: 322056 - DNA, 75 bp, Artificial Sequence
  Synthetic
tgcctgcacaaaataccaatatccatggcacactgcaaaatgccattttgagaaagattatgagtatgaaaatag

SEQ ID NO: 322057 - DNA, 75 bp, Artificial Sequence
  Synthetic
aagtgtgcgtgcagtttggtgaagaatacctttgcaaaacaattgatatgaatgattgctttgtgactaggcatg

SEQ ID NO: 322058 - DNA, 75 bp, Artificial Sequence
  Synthetic
cctacctatcaatcttcacatcatgtattgattttcaaacactttaccatttagaactcaacttggctctactat

SEQ ID NO: 322059 - DNA, 75 bp, Artificial Sequence
  Synthetic
aagcgccaacttgccgacagattgcagcagggaagaacatccgggcaggaccgggatcctacaggggtagagcca

SEQ ID NO: 322060 - DNA, 75 bp, Artificial Sequence
  Synthetic
aggctacaagaaagttcttgcaacaattgattcattccaatcatttaacacaagcaatatacacttcactgatga

SEQ ID NO: 322061 - DNA, 75 bp, Artificial Sequence
  Synthetic
ggcaaaagactggacatcgagaattgaagaatggctcggtgcaccctgcaaattcatggcggagtctcttattgc

SEQ ID NO: 322062 - DNA, 75 bp, Artificial Sequence
  Synthetic
cgggagtttatctgggaatcctgtgaatcgtgactatatcagacagagacaaggtgcacttgcagggatggagcc

SEQ ID NO: 322063 - DNA, 75 bp, Artificial Sequence
  Synthetic
aaggtgcacttgcagggatggagccaaaggaatttcaagccctcaggcaacattcaaaggatgctggatgtacac

SEQ ID NO: 322064 - DNA, 75 bp, Artificial Sequence
  Synthetic
cattcaaaggatgctggatgtacactagttgaacatattgagtcaccatcatcaatatgggtgtttgctggggcc

SEQ ID NO: 322065 - DNA, 75 bp, Artificial Sequence
  Synthetic
ggaactgggttgtcctaattgttttgtgtgtcttgttgctcttttctcttatcctgttgagcattttgtgtcctg

SEQ ID NO: 322066 - DNA, 75 bp, Artificial Sequence
  Synthetic
aaagcttcgaaagaaatcatcattctatcaatcatacctcagacgcacacaatcaatgggaatacaactggacca

SEQ ID NO: 322067 - DNA, 75 bp, Artificial Sequence
  Synthetic
atcctgttgagcattttgtgtcctgtaagaaagcataaaaaatcataaatcctacctattaatcttcacatcatg

SEQ ID NO: 322068 - DNA, 75 bp, Artificial Sequence
  Synthetic
agaaaagcagtatgagaaggatcctgatgacttaaacaagagggcactgcatgatcgggagagtgttgcagcttc

SEQ ID NO: 322069 - DNA, 75 bp, Artificial Sequence
  Synthetic
atgatcgggagagtgttgcagcttcaatacaatcaaaaattgatgaattgaagcgccaacttgccgacaggattg

SEQ ID NO: 322070 - DNA, 75 bp, Artificial Sequence
  Synthetic
ctcacaccttaatatatactactttattaagttgttaagttgtgtctttttggggagtaagggagtctactacta

SEQ ID NO: 322071 - DNA, 75 bp, Artificial Sequence
  Synthetic
gccaataagtaaggtattgctgtttgctgggatacctaataatgtcataacagcattggaaaaaaaggttatccc

SEQ ID NO: 322072 - DNA, 75 bp, Artificial Sequence
  Synthetic
ttaaatcagtcagtctgtgacaacaatgcactccctttaatctggaggggcctaattgacttaacgggatactat

SEQ ID NO: 322073 - DNA, 75 bp, Artificial Sequence
  Synthetic
ggcaaaagactggacatctagaattgaagaatggcttggcgcaccctgcaagttcatggcagagtctcccattgc

SEQ ID NO: 322074 - DNA, 75 bp, Artificial Sequence
  Synthetic
actgcagatgtagataagggtatcagagagaagaaaatgaaatatgagctaggtctgaaatatctagagcaagaa

SEQ ID NO: 322075 - DNA, 75 bp, Artificial Sequence
  Synthetic
gaccctggtgatgtcatgggtccaaaagataaaccatttatttgccctgaattcccagggcaattcaggaaaaaa

SEQ ID NO: 322076 - DNA, 75 bp, Artificial Sequence
  Synthetic
gtgtgtcctgttgctcttttctcttatcctgttaagcattttgtgtcctgttagaaagcataaaaaatcataaat

SEQ ID NO: 322077 - DNA, 75 bp, Artificial Sequence
  Synthetic
cagttaaaaaacagcaggatcatgtggagtttgctattactggccgctttggttggccgaggctttacattaaaa

SEQ ID NO: 322078 - DNA, 75 bp, Artificial Sequence
  Synthetic
aatgtttttgacatgagaatccggtgtccccactcagtcaattttggggaaacaagtgtgtcaggctatacggaa

SEQ ID NO: 322079 - DNA, 75 bp, Artificial Sequence
  Synthetic
gtccccactcagtcaattttggggaaacaagtgtgtcaggctatacggaactgcccccactctcattgcaagagg

SEQ ID NO: 322080 - DNA, 75 bp, Artificial Sequence
  Synthetic
aagatattcacacccaaatcagagtttgaattctctgacatgtattctcagaagtttctaaaggtttggagtgaa

SEQ ID NO: 322081 - DNA, 75 bp, Artificial Sequence
  Synthetic
tagtagtagactccgcaagaaacagcagttgaataacagcaggatcatgtggggtttactattgctagccgctct

SEQ ID NO: 322082 - DNA, 75 bp, Artificial Sequence
  Synthetic
catggcatatcgggcatttagttagggatattactgagagcttgattgcacattctggattgaggaggtctaaat

SEQ ID NO: 322083 - DNA, 75 bp, Artificial Sequence
  Synthetic
gggcagatagaggcaaaaatccctcatacagtgagctctaaaaacttaaaattgactgcttttgcaggtattcca

SEQ ID NO: 322084 - DNA, 75 bp, Artificial Sequence
  Synthetic
gataaagacaatttggattcaatacttgcagatggtgatatcttatggggagtctcaaaaattatgagtctagat

SEQ ID NO: 322085 - DNA, 75 bp, Artificial Sequence
  Synthetic
tcatactcatcaaccagtgtactgattgcttcagaagatggtcgtttcatatttagccctggcctattccctaac

SEQ ID NO: 322086 - DNA, 75 bp, Artificial Sequence
  Synthetic
ctgaacaggttacttgctttgaatatagcttttgagaaagcactacttgcaacagctacatggttccaatattac

SEQ ID NO: 322087 - DNA, 75 bp, Artificial Sequence
  Synthetic
ttcatgcgaagccttttcagaaggaggtatttttaatattacttctccaatgtgtctggtgtccaaacagaatag

SEQ ID NO: 322088 - DNA, 75 bp, Artificial Sequence
  Synthetic
caagcggtatctatccatcctttatgtcacgagttgtttataaacattataagagtttaatttcagaagtgacaa

SEQ ID NO: 322089 - DNA, 75 bp, Artificial Sequence
  Synthetic
attataagtgtaagatacagcagaaaagtgtgcgtgcagtttggtgaagaatacctttgtaaaacgattgatatg

SEQ ID NO: 322090 - DNA, 75 bp, Artificial Sequence
  Synthetic
tttgatcacattctgctttggctgggtattaattcctgcatgtacattagctattcttttagtcctcaagttttt

SEQ ID NO: 322091 - DNA, 75 bp, Artificial Sequence
  Synthetic
ctattcttttagtcctcaagttttttgcaaatatccttcatacaagcaatcaagaaaaccgattcaaagccatct

SEQ ID NO: 322092 - DNA, 75 bp, Artificial Sequence
  Synthetic
agtccaacaactatattgtcaagatgcagttgagctggctgccaatgaattgaaccgagttcttatcgcaaagtc

SEQ ID NO: 322093 - DNA, 75 bp, Artificial Sequence
  Synthetic
cattaaaggaattgaaggcccataatctgtcatgtgttcaaggggagtgcccatattgttttacccactgtgaac

SEQ ID NO: 322094 - DNA, 75 bp, Artificial Sequence
  Synthetic
caacagaaactgcaattcaggcacattataaagtttgtcaagctacccaccgattcagagaagatttaaaaaaga

SEQ ID NO: 322095 - DNA, 75 bp, Artificial Sequence
  Synthetic
aaaaggcatgtcaggccaagtacaagaggatggacatttgtcgtcatccactacaataattgaagctataagata

SEQ ID NO: 322096 - DNA, 75 bp, Artificial Sequence
  Synthetic
tctgtctaattcaaggaacaatcctaacgttcttcaactatatgaagaaactagacatcagaaggcacaagctag

SEQ ID NO: 322097 - DNA, 75 bp, Artificial Sequence
  Synthetic
aacgttcttcaactatatgaagaaactagacatcagaaggcacaagctagaattgtgaggaagtttcagaggaca

SEQ ID NO: 322098 - DNA, 75 bp, Artificial Sequence
  Synthetic
ttctaagaatgtggactctccttctcattattgaatccatcctctgggcagcaagtgcaacagaaattccccttg

SEQ ID NO: 322099 - DNA, 75 bp, Artificial Sequence
  Synthetic
cattattgaatccatcctctgggcagcaagtgcaacagaaattccccttgtccctctctggacagataatacaca

SEQ ID NO: 322100 - DNA, 75 bp, Artificial Sequence
  Synthetic
cggcgtcgggagtgtacctatgcatacagatcttgaattagacttttctttaccatctagctctaagtacacata

SEQ ID NO: 322101 - DNA, 75 bp, Artificial Sequence
  Synthetic
agaaaacttatgtatgtcagtgctgatgccactaaatggtctccaggtgataattcagcaaaattcaggcgattc

SEQ ID NO: 322102 - DNA, 75 bp, Artificial Sequence
  Synthetic
taattcagcaaaattcaggcgattcactgctgcccttcataatggactgcctgatgacaggttgaaaaactgtgt

SEQ ID NO: 322103 - DNA, 75 bp, Artificial Sequence
  Synthetic
tggcacactgcaaaatgtcattttgagaaagattatgagtatgaaaatagctgggcgtgcaaccccccagattgc

SEQ ID NO: 322104 - DNA, 75 bp, Artificial Sequence
  Synthetic
agaaagattatgagtatgaaaatagctgggcgtgcaaccccccagattgcccagggattggtacaggctgtactg

SEQ ID NO: 322105 - DNA, 75 bp, Artificial Sequence
  Synthetic
cttgtggattatatctagatcaactgaagccggtaggaacagccttcaaaattataagtgtaagatacagcagaa

SEQ ID NO: 322106 - DNA, 75 bp, Artificial Sequence
  Synthetic
tggaaaagtatgtttaatctgcatgaacacattcttctgttaggatcaattaaaatatccccaaagaagacaaca

SEQ ID NO: 322107 - DNA, 75 bp, Artificial Sequence
  Synthetic
gtgaatatgatgggaacattatttcaggatataagaaagttcttgcaacaattgattctttccagtcattcaaca

SEQ ID NO: 322108 - DNA, 75 bp, Artificial Sequence
  Synthetic
tataggtatgtctgacaaaaatttactgaaacaagcacttattggttatatgcataaacaccaaaagcaaatgag

SEQ ID NO: 322109 - DNA, 75 bp, Artificial Sequence
  Synthetic
ccatagtggttcttcatttaactgctgtcatgggaaagaatggtcatcaactggcctccaagctagtgcaccgca

SEQ ID NO: 322110 - DNA, 75 bp, Artificial Sequence
  Synthetic
ctggcctccaagctagtgcaccgcatctggataaggtaaacggtatctctgatttagaaaacgagaaagtttatg

SEQ ID NO: 322111 - DNA, 75 bp, Artificial Sequence
  Synthetic
atttaggatgcaagcaaaacaacatatgaaggtttgcagactagatggggactgggtaacatttagagaggtact

SEQ ID NO: 322112 - DNA, 75 bp, Artificial Sequence
  Synthetic
tgcagcagcaaacagttttgctgagagctatgaacctagtcaaaatgatattgatttatttcaaacattgactag

SEQ ID NO: 322113 - DNA, 75 bp, Artificial Sequence
  Synthetic
ttaggaagcataaaaaatcataaatccaaccgattaatcttcacaccatttatcaagtttaaaacactttaccat

SEQ ID NO: 322114 - DNA, 75 bp, Artificial Sequence
  Synthetic
atcctgttgagcatcttatgtcctgttagaaagcataaaaaatcataaatcctacctattaatcttaacatcatg

SEQ ID NO: 322115 - DNA, 75 bp, Artificial Sequence
  Synthetic
gctctatgctgtccggcatgacattgttgaccagatgataaaacatgaatggtcagacaataaagacagcgagga

SEQ ID NO: 322116 - DNA, 75 bp, Artificial Sequence
  Synthetic
cgatctttttttaagatgacacctgacaattatcgaataacaggttccttaattgagtttgtggaggtaactgtg

SEQ ID NO: 322117 - DNA, 75 bp, Artificial Sequence
  Synthetic
aattgagtttgtggaggtaactgtgaccgcagatgtagataaaggcatcagagagaagaaaatgaaatatgagct

SEQ ID NO: 322118 - DNA, 75 bp, Artificial Sequence
  Synthetic
acaactatcgaataacaggttccttaattgagtttgtggaggtaactgtgactgcagatgtagataagggtatca

SEQ ID NO: 322119 - DNA, 75 bp, Artificial Sequence
  Synthetic
ctcatgacattcttccataggggagaattacaaaacccttataaaattacatttaaagtagttgcagtccggaca

SEQ ID NO: 322120 - DNA, 75 bp, Artificial Sequence
  Synthetic
gggactggttccatgcattatggtttgaagacaaaacattttcagagtggctagatagatttatcagagtaggtg

SEQ ID NO: 322121 - DNA, 75 bp, Artificial Sequence
  Synthetic
atttaaagtagttgcagtccggacagatggatcaaatatttcaacacaatggcccagtacaaggaatgatggtgt

SEQ ID NO: 322122 - DNA, 75 bp, Artificial Sequence
  Synthetic
aattacaaaacccttataaaattacatttaaagtagttgcagtccggacagatggatcaaatatttcaacacaat

SEQ ID NO: 322123 - DNA, 75 bp, Artificial Sequence
  Synthetic
gatggatcaaatatttcaacacaatggcccagtacaaggaatgatggtgtagttcaatacatgagattggtacag

SEQ ID NO: 322124 - DNA, 75 bp, Artificial Sequence
  Synthetic
ggcctagtacgaggaatgatggtgtagttcaatacatgaggttggtgcaggcagaaatcagttatgtaagggaac

SEQ ID NO: 322125 - DNA, 75 bp, Artificial Sequence
  Synthetic
atctggttaaaactgaagaaagagctgcattagaagcaatgtttaacttgaaattcaacataagttctttaaaga

SEQ ID NO: 322126 - DNA, 75 bp, Artificial Sequence
  Synthetic
cacagccttatttcatccctgaatataaagggattgatttgattggacctgatatagatgggttagtgaactatg

SEQ ID NO: 322127 - DNA, 75 bp, Artificial Sequence
  Synthetic
taaagggattgatttgattggacctgatatagatgggttagtgaactatgcccaaaactggatgtcaaagaccca

SEQ ID NO: 322128 - DNA, 75 bp, Artificial Sequence
  Synthetic
aaaatacccaatatcccggcacccaaggaacttcttgctcatccagtgcactgtgttaacagcatacaaacctgc

SEQ ID NO: 322129 - DNA, 75 bp, Artificial Sequence
  Synthetic
ggagttctctttctttgaagtaaaaggttcagctgtgtttgattgttttaacgagaatgaacaagggcacattgt

SEQ ID NO: 322130 - DNA, 75 bp, Artificial Sequence
  Synthetic
ggttcagctgtgtttgattgttttaacgagaatgaacaagggcacattgtaagatacccaatgtcccggcaccca

SEQ ID NO: 322131 - DNA, 75 bp, Artificial Sequence
  Synthetic
atgatttattagcatattatgcgcctagaatccaatttagccctactcaaaatattaaagaaccaggtaccttta

SEQ ID NO: 322132 - DNA, 75 bp, Artificial Sequence
  Synthetic
atctattcttgcacatgatatggcacacagatacatcaatctgactagagatgatttattagcatattatgcgcc

SEQ ID NO: 322133 - DNA, 75 bp, Artificial Sequence
  Synthetic
tgagtcaaaaatcatgctggatctgctaagtcaacatgaacctcgagaaaatttgggcaagtcaatagaaagctt

SEQ ID NO: 322134 - DNA, 75 bp, Artificial Sequence
  Synthetic
atgatttattagcatattatgcgcctagaattcaatttaaccctacccagaatattaaagaaccaggtaccttta

SEQ ID NO: 322135 - DNA, 75 bp, Artificial Sequence
  Synthetic
aattaacatcaaatatgatgaggcctgagtcaaaaatcatgctggatatgctaagtcaacatgaacctcgagaaa

SEQ ID NO: 322136 - DNA, 75 bp, Artificial Sequence
  Synthetic
aaacatcagtagccatattgtacaatcagattgtgtcagtctaatcacaaaaattttgtcagatttagaacttaa

SEQ ID NO: 322137 - DNA, 75 bp, Artificial Sequence
  Synthetic
tcagattgtgtcagtctaatcacaaaaattttgtcagatttagaacttaatatttctgaacctagtagccatgag

SEQ ID NO: 322138 - DNA, 75 bp, Artificial Sequence
  Synthetic
aaacatcagcagtcatattgtacagtcagattgtgttagcctaatcacaaaaattttgtcagatttagagcttaa

SEQ ID NO: 322139 - DNA, 75 bp, Artificial Sequence
  Synthetic
tcagattgtgttagcctaatcacaaaaattttgtcagatttagagcttaacatttctgaacctagtagccatgag

SEQ ID NO: 322140 - DNA, 75 bp, Artificial Sequence
  Synthetic
cagattacagctacacatacacatgttgatactgtattggataaattctttcaaaatgagactcagaagtattta

SEQ ID NO: 322141 - DNA, 75 bp, Artificial Sequence
  Synthetic
tcaaaatgagactcagaagtatttaattgatattttgaagaagactacagcatggcatattgggcacttggttag

SEQ ID NO: 322142 - DNA, 75 bp, Artificial Sequence
  Synthetic
caaaagcagggtattgtacctgaggatgtgattccagactcgttgttttcctttagacatactatggtcctatta

SEQ ID NO: 322143 - DNA, 75 bp, Artificial Sequence
  Synthetic
ccttcaaaatcccttgaagttgcaggttcatttgtacgatttatgactgcttttaaattaggccccgggctagtt

SEQ ID NO: 322144 - DNA, 75 bp, Artificial Sequence
  Synthetic
cgccggctgtttggacaggattcagtttctacattctattaatcattcacttcattttcattttgcggagtctac

SEQ ID NO: 322145 - DNA, 75 bp, Artificial Sequence
  Synthetic
cactctggattgaggaggtctaaatattggtcaatccatgcttataacaatggaagtgtaatattattcatactc

SEQ ID NO: 322146 - DNA, 75 bp, Artificial Sequence
  Synthetic
gataaagacaatttggattcaatacttgcagatggtgatatcttgtggggtgtctcaaaggttatgagtctagat

SEQ ID NO: 322147 - DNA, 75 bp, Artificial Sequence
  Synthetic
tagcttttgagaaagcactacttgcaacagctacatggttccaatattatactgaggatcaatcgcaatttccac

SEQ ID NO: 322148 - DNA, 75 bp, Artificial Sequence
  Synthetic
tgcaacattccattcgatcagtatttgcctatcattttttgcttgctatttgccagaagatgaaattatgtgcaa

SEQ ID NO: 322149 - DNA, 75 bp, Artificial Sequence
  Synthetic
tgcctatcattttttgcttgctatttgccagaagatgaaattatgtgcaatctttgataacctaaggtatctaat

SEQ ID NO: 322150 - DNA, 75 bp, Artificial Sequence
  Synthetic
actgaggatcaatcacaatttccattgcagcattctatccggtcagtatttgcttatcattttttgcttgctatt

SEQ ID NO: 322151 - DNA, 75 bp, Artificial Sequence
  Synthetic
acctgctgtgacatccctgtattctggcttcccttctttggttgaaaaactatttgaaagaccttttaagagtgc

SEQ ID NO: 322152 - DNA, 75 bp, Artificial Sequence
  Synthetic
ggcttcccttctttggttgaaaaactatttgaaagaccttttaagagtgccttagaggtttatgtatattataac

SEQ ID NO: 322153 - DNA, 75 bp, Artificial Sequence
  Synthetic
ctcaaaataataaggctagattttattcgaaagttaaacttcttggattgactgttgaccaatctacagttggtg

SEQ ID NO: 322154 - DNA, 75 bp, Artificial Sequence
  Synthetic
tgtttgagagaccttttaaaagtgctttagaagtttatgtgtactataatattaaaagtttgcttgttgcattgg

SEQ ID NO: 322155 - DNA, 75 bp, Artificial Sequence
  Synthetic
ttcgaaagttaaacttcttggattgactgttgaccaatctacagttggtgcaagcggtatttatccatcctttat

SEQ ID NO: 322156 - DNA, 75 bp, Artificial Sequence
  Synthetic
gaagaatggcttggcgcaccctgcaagttcatggcggagtctcccattgccgggagtttatctgggaatcctgtg

SEQ ID NO: 322157 - DNA, 75 bp, Artificial Sequence
  Synthetic
gtcacgaattgtctacaaacattataagagtttgatttcagaagtgacaacttgcttctttctttttgaaaaggg

SEQ ID NO: 322158 - DNA, 75 bp, Artificial Sequence
  Synthetic
cttgcttctttctttttgaaaagggtttgcatgggaatgtgaatgaagaggctaaaattcatttggaaactgtag

SEQ ID NO: 322159 - DNA, 75 bp, Artificial Sequence
  Synthetic
gtcacgagttgtttacaaacattataagagtttaatttcagaagtgacaacttgtttttttctttttgaaaaggg

SEQ ID NO: 322160 - DNA, 75 bp, Artificial Sequence
  Synthetic
aatgggcaacaaagttcaaagaaaaggaggataagtatggtgagatgttagttgaaaatggttatacattaggag

SEQ ID NO: 322161 - DNA, 75 bp, Artificial Sequence
  Synthetic
aagagtttaatttcagaagtgacaacttgtttttttctttttgaaaagggtttacatgggaatgtgaatgaagag

SEQ ID NO: 322162 - DNA, 75 bp, Artificial Sequence
  Synthetic
gctaaaatacatctggaaactgtagaatgggcaacaaagtttaaagaaaaggaggataagtatggtgagatgtta

SEQ ID NO: 322163 - DNA, 75 bp, Artificial Sequence
  Synthetic
tcaggtggttgctaatagtatcttaaataagtattgggaagagccatattttagccaaacaaggaatattagttt

SEQ ID NO: 322164 - DNA, 75 bp, Artificial Sequence
  Synthetic
gaggatgggcatttatcgtcatccactacaataatcgaggctataagatatctgtctaattcaaggaataatcct

SEQ ID NO: 322165 - DNA, 75 bp, Artificial Sequence
  Synthetic
ttagccaaacaaggaatattagtttaaaaggtatgtcaggccaagtacaagaggatgggcatttgtcgtcatcca

SEQ ID NO: 322166 - DNA, 75 bp, Artificial Sequence
  Synthetic
gatttattgaataatcatattaaataattaggtaagttaactattattagttaagttagctaattgatttatatg

SEQ ID NO: 322167 - DNA, 75 bp, Artificial Sequence
  Synthetic
aaaaggtatgtcaggccaagtacaagaggatgggcatttatcgtcatccactacaataatcgaggctataagata

SEQ ID NO: 322168 - DNA, 75 bp, Artificial Sequence
  Synthetic
gaagctgatcggggtttctttattacgacactaccaacaagatgtcgtcttgagattattgaggactattatgat

SEQ ID NO: 322169 - DNA, 75 bp, Artificial Sequence
  Synthetic
gcaatatcaaaaaatgtagcagaggaatatatctcatatggtggagaaaggaaaattctctgtatccaggcagcc

SEQ ID NO: 322170 - DNA, 75 bp, Artificial Sequence
  Synthetic
aatatatctcatatggtggagaaaggaaaattctctgtatccaggcagcccttgaaaaagctctccgctgggctt

SEQ ID NO: 322171 - DNA, 75 bp, Artificial Sequence
  Synthetic
cttgaaaaagctctccgctgggcttctggagagagctttattgagctcagtaacggaaaattcattaggatgaag

SEQ ID NO: 322172 - DNA, 75 bp, Artificial Sequence
  Synthetic
gttcctatacatgcttgcaacatgatgaaaagctgtttgattggccttggtccctacagaatccaggttgtctat

SEQ ID NO: 322173 - DNA, 75 bp, Artificial Sequence
  Synthetic
agaaaacttatgtatgtcagtgctgatgccaccaagtggtccccaggtgacaattcagctaaattcaggcgattc

SEQ ID NO: 322174 - DNA, 75 bp, Artificial Sequence
  Synthetic
tattgatgccttgcgccatgtatataagactgatttttatatgtctagaaaacttagacactatattgattctat

SEQ ID NO: 322175 - DNA, 75 bp, Artificial Sequence
  Synthetic
aagactgatttttatatgtctagaaaacttagacactatattgattctatggatacttatgaacctcatgtcaga

SEQ ID NO: 322176 - DNA, 75 bp, Artificial Sequence
  Synthetic
actgctgctcttcataatggattgcctgatgacaggttgaaaaattgtgttattgatgccttacgccatgtatac

SEQ ID NO: 322177 - DNA, 75 bp, Artificial Sequence
  Synthetic
aacttagacactatattgattctatggatacttatgaacctcatgtcagagacttcttaaatttctttccagatg

SEQ ID NO: 322178 - DNA, 75 bp, Artificial Sequence
  Synthetic
ggatacttatgaacctcatgtcagggacttcttgaatttctttccagatgggcatcatggagaggtacgaggcaa

SEQ ID NO: 322179 - DNA, 75 bp, Artificial Sequence
  Synthetic
gacgaggttatttccagaattagactgcttttttgaatttgctcaccactcagatgatgcacttttcatatatgg

SEQ ID NO: 322180 - DNA, 75 bp, Artificial Sequence
  Synthetic
tgcttttttgaatttgctcaccactcagatgatgcacttttcatatatggttatttggaaccagctgatgatggg

SEQ ID NO: 322181 - DNA, 75 bp, Artificial Sequence
  Synthetic
actgattggtttttatttgtatcccagcagattcaagctggaaaattgcattggtttaatgtaaatacagagatg

SEQ ID NO: 322182 - DNA, 75 bp, Artificial Sequence
  Synthetic
agcagattcaagctggaaaattgcattggtttaatgtaaatacagagatgtggaaaagtatgtttaacctgcatg

SEQ ID NO: 322183 - DNA, 75 bp, Artificial Sequence
  Synthetic
aacacattcttttgctagggtcaattaaaatctccccaaaaaagacaacattgtcaccaacaaatgctgagtttt

SEQ ID NO: 322184 - DNA, 75 bp, Artificial Sequence
  Synthetic
taaaatctccccaaaaaagacaacattgtcaccaacaaatgctgagtttttgtctacatttttcgagggttgtgc

SEQ ID NO: 322185 - DNA, 75 bp, Artificial Sequence
  Synthetic
tgtatcgatcccctttattaaaatcctccttggctcactatctgacctgccaggccttggctattttgatgatct

SEQ ID NO: 322186 - DNA, 75 bp, Artificial Sequence
  Synthetic
ctccttggctcactatctgacctgccaggccttggctattttgatgatcttgctgctgcccagacaaggtgcgtc

SEQ ID NO: 322187 - DNA, 75 bp, Artificial Sequence
  Synthetic
ttaactatcctggcacatatttaaggacaaaacactctgaaactccaatcccactgggaggaagtggtgcaatgt

SEQ ID NO: 322188 - DNA, 75 bp, Artificial Sequence
  Synthetic
caataatggaactttcaacagccggtataggcatgtctgacaaaaatttattgaaacaagcacttattggttata

SEQ ID NO: 322189 - DNA, 75 bp, Artificial Sequence
  Synthetic
ttgaaacaagcacttattggttatatacataaacaccaaaaacaaatgagttacattctggggctctttaagttt

SEQ ID NO: 322190 - DNA, 75 bp, Artificial Sequence
  Synthetic
ttgaaacaggcacttattggttatatgcataaacaccagaaacaaatgagttgcatcctggggctcttcaagttt

SEQ ID NO: 322191 - DNA, 75 bp, Artificial Sequence
  Synthetic
ttcagcatgagaggctaggccagttttcatttataggaaaagttcaatggaagatattcacaccaaaatcagagt

SEQ ID NO: 322192 - DNA, 75 bp, Artificial Sequence
  Synthetic
ttgaattctctgacatgtattctcagaaatttctaaaggtttggagtgaacagcatcctacatatgattatatta

SEQ ID NO: 322193 - DNA, 75 bp, Artificial Sequence
  Synthetic
ttcctaaaggtcgtgacaaccttcttatttatctcgtgagaaaattaaatgacccaagcattataacagctatga

SEQ ID NO: 322194 - DNA, 75 bp, Artificial Sequence
  Synthetic
gacccaagcattataacagctatgactatgcaatcacccttacaacttagatttaggatgcaagcaaaacaacat

SEQ ID NO: 322195 - DNA, 75 bp, Artificial Sequence
  Synthetic
tgcagcagcaaacagctttgctgagagttatgagcctagtcaaaatgacattgatctatttcagacattaactag

SEQ ID NO: 322196 - DNA, 75 bp, Artificial Sequence
  Synthetic
agctatgagcctagtcaaaatgatattgatttatttcagactttgactagctgcacattttctaaggagtatgca

SEQ ID NO: 322197 - DNA, 75 bp, Artificial Sequence
  Synthetic
actgtgatgtgataccaacaaagcaagtacaacgtgcgaaagttgcacgtacattcacagtgagagaaaaagacc

SEQ ID NO: 322198 - DNA, 75 bp, Artificial Sequence
  Synthetic
agtacaacgtgcgaaagttgcacgtacattcacagtgagagaaaaagaccaaattattcaaaacagtattccagc

SEQ ID NO: 322199 - DNA, 75 bp, Artificial Sequence
  Synthetic
agtacaacgtgcgaaagttgcacgtacattcacagtgagagaaaaagaccagattattcaaaacagcatcccagc

SEQ ID NO: 322200 - DNA, 75 bp, Artificial Sequence
  Synthetic
aaattattcaaaacagtattccagccgttattggctacaagtttgcagtcacagtggatgaaatgtctgatgtgc

SEQ ID NO: 322201 - DNA, 75 bp, Artificial Sequence
  Synthetic
agattattcaaaacagcatcccagctgttattggttacaagtttgctgttacggttgatgaaatgtctgatgtgc

SEQ ID NO: 322202 - DNA, 75 bp, Artificial Sequence
  Synthetic
aaagatggagtctatagggagttgggtttagatatctcttcgccagatgttatgaagaaagtggcacctatgttg

SEQ ID NO: 322203 - DNA, 75 bp, Artificial Sequence
  Synthetic
gtttagatatctcttcgccagatgttatgaagaaagtggcacctatgttgtataaaagtgccaaatcacgggttg

SEQ ID NO: 322204 - DNA, 75 bp, Artificial Sequence
  Synthetic
tataaaagtgccaaatcacgggttgtcattgtccaggggaatgtagaagggactgcagaggctatctgtgcatac

SEQ ID NO: 322205 - DNA, 75 bp, Artificial Sequence
  Synthetic
aaacaattaaagttaaaccccataaagaagtgctccaggctgtatccatatttaataggaaagaagatatcggtc

SEQ ID NO: 322206 - DNA, 75 bp, Artificial Sequence
  Synthetic
tttaataggaaagaagatattggtcagcaaaaagatttgtcagcactaaagttatgtattgaagtttggaggtgg

SEQ ID NO: 322207 - DNA, 75 bp, Artificial Sequence
  Synthetic
gttatgtattgaagtttggaggtgggcaaaagcaaataacgcaccatatagggactggttccatgcattatggtt

SEQ ID NO: 322208 - DNA, 75 bp, Artificial Sequence
  Synthetic
gggactggttccatgcattatggtttgaagacaaaacattttcagaatggctagatagatttatcagagtaggtg

SEQ ID NO: 322209 - DNA, 75 bp, Artificial Sequence
  Synthetic
ctagatagatttatcagagtaggtgtgcctcctattgatccagaaattcagtgtgcagcattgatgattgcagat

SEQ ID NO: 322210 - DNA, 75 bp, Artificial Sequence
  Synthetic
tgcctcctattgatccagaaattcagtgtgcagcattgatgattgcagatgttaaaggtgacaggtcagtgttac

SEQ ID NO: 322211 - DNA, 75 bp, Artificial Sequence
  Synthetic
ataaaaaaacttatattcttgagacatctatcacacagaaacatgttttaaaaatcatgatggaagaagtttcaa

SEQ ID NO: 322212 - DNA, 75 bp, Artificial Sequence
  Synthetic
attcaataccgagcaagttaatggcgtaaagcaccttgttttgtttaagacagattcaggttttgaatggggtaa

SEQ ID NO: 322213 - DNA, 75 bp, Artificial Sequence
  Synthetic
aaaaactgtgcattgcggacaggtttgaggacaaaccaggctatcaaccacaagtttatgatcacaattaaggat

SEQ ID NO: 322214 - DNA, 75 bp, Artificial Sequence
  Synthetic
caagtttatgatcacaattaaggatgatggtctcagggcaattgcacaatatgatgaagatagcccacggtttct

SEQ ID NO: 322215 - DNA, 75 bp, Artificial Sequence
  Synthetic
acataaggggataaagctatacctaaatccgataatttcatcagggctgctagagaatttcatgaaaaatatacc

SEQ ID NO: 322216 - DNA, 75 bp, Artificial Sequence
  Synthetic
tagagaattttatgaaaaatatacctgctgctattccaccagctgcttattcattaataatgaatcgtgcaaaaa

SEQ ID NO: 322217 - DNA, 75 bp, Artificial Sequence
  Synthetic
tgctgctattcccccagctgcttattcattaataatgaatcgtgctaaaatttctgtggatcttttcatgttcaa

SEQ ID NO: 322218 - DNA, 75 bp, Artificial Sequence
  Synthetic
tttctgtggatcttttcatgttcaacgacttacttagactggtaaacccaggtaacacacttgacttgtctggcc

SEQ ID NO: 322219 - DNA, 75 bp, Artificial Sequence
  Synthetic
ttgaaataacaggtgaaggttatagtacagtgagtagtctttctagtagattatggtcagaagaaatgagccttg

SEQ ID NO: 322220 - DNA, 75 bp, Artificial Sequence
  Synthetic
tacagtgagtagtctttctagtagattatggtcagaagaaatgagccttgttgatgatgaagaggagatggatga

SEQ ID NO: 322221 - DNA, 75 bp, Artificial Sequence
  Synthetic
cccgtatgatttaactgagcttgagagtattgttaagggatggggtgagtctgttgtggatcagtttgattccct

SEQ ID NO: 322222 - DNA, 75 bp, Artificial Sequence
  Synthetic
tgtctattgaaaaggtatacaacccagttaacatcatactaatgactagatatatatcaaaaaactttaactttt

SEQ ID NO: 322223 - DNA, 75 bp, Artificial Sequence
  Synthetic
agtattgttaagggatggggtgagtctgttgtggatcagtttgattcccttgacttagaagcccaaaatctagtt

SEQ ID NO: 322224 - DNA, 75 bp, Artificial Sequence
  Synthetic
tgacttagaggcccaaaatctagttcaaaagcagggtattgtacctgaggatgtgattccagattctttgttttc

SEQ ID NO: 322225 - DNA, 75 bp, Artificial Sequence
  Synthetic
caaaagcagggtattgtacctgaggatgtgattccagattctttgttttcttttaggcatactatggtattatta

SEQ ID NO: 322226 - DNA, 75 bp, Artificial Sequence
  Synthetic
cgacggctatttccacaggattcagtttctactttctattaatcatttacttcattttcattttgcggagtctac

SEQ ID NO: 322227 - DNA, 75 bp, Artificial Sequence
  Synthetic
gatgacctaaacaagagggcactgcatgatcgggagagtgtcgcagcttcgatacaatcaaaaatcgatgaattg

SEQ ID NO: 322228 - DNA, 75 bp, Artificial Sequence
  Synthetic
tagcacgccagaaggtcaaggatgcagaaaaacaatatgagaaggatcctgatgacttaaataagagggcactgc

SEQ ID NO: 322229 - DNA, 75 bp, Artificial Sequence
  Synthetic
gcaggcagacttcaaaggacaacaaggggataaggatcagattcaaggatgacagctcatatgaaaatgtcaatg

SEQ ID NO: 322230 - DNA, 75 bp, Artificial Sequence
  Synthetic
tagtagtagactccctaaagagcgactacaataatagataaaatggcaactaaggaagagatccagagggaaatc

SEQ ID NO: 322231 - DNA, 75 bp, Artificial Sequence
  Synthetic
ctacaataatagataaaatggcaactaaggaagagatccagagggaaatcagtgcacacgaggggcagcttgtga

SEQ ID NO: 322232 - DNA, 75 bp, Artificial Sequence
  Synthetic
taaggaagagatccagagggaaatcagtgcacacgaggggcagcttgtgatagcacgacaaaaggtcaaggatgc

SEQ ID NO: 322233 - DNA, 75 bp, Artificial Sequence
  Synthetic
agaaaagcagtacgaaaaggatcctgatgttctaaacaagagggcactgcatgaccgggaaagtgtggcagcttc

SEQ ID NO: 322234 - DNA, 75 bp, Artificial Sequence
  Synthetic
gatgttctaaacaagagggcactgcatgaccgggaaagtgtggcagcttcaatccaatcaaagattgatgagttg

SEQ ID NO: 322235 - DNA, 75 bp, Artificial Sequence
  Synthetic
ggcaaaagactggacatctagaattgaagaatggcttgacacaccctgtaagttcatggtagagtctcccattgc

SEQ ID NO: 322236 - DNA, 75 bp, Artificial Sequence
  Synthetic
aagcgccagcttgccgataggattgcagcagggaagagcatcgggcaggatcgggatcctacgggagtagagcca

SEQ ID NO: 322237 - DNA, 75 bp, Artificial Sequence
  Synthetic
cagcagggaagagcatcgggcaggatcgggatcctacgggagtagagccaggtgaccacctcaaagagagatcag

SEQ ID NO: 322238 - DNA, 75 bp, Artificial Sequence
  Synthetic
aggtcaccttaagtgacctttttttgtatatatggatgtagatttcaattgatcgaatactaatcttgctgttct

SEQ ID NO: 322239 - DNA, 75 bp, Artificial Sequence
  Synthetic
cactaagctatgggaatacactggatctgaacagccttgacattgatgagccaacaggacagacagctgattggt

SEQ ID NO: 322240 - DNA, 75 bp, Artificial Sequence
  Synthetic
tctgaacagccttgacattgatgagccaacaggacagacagctgattggttgactataattgtttacctaacatc

SEQ ID NO: 322241 - DNA, 75 bp, Artificial Sequence
  Synthetic
attcgtcgtcccaatcatcttgaaggcactttatatgttaacaacaagaggccggcagacttcaaaagacaacag

SEQ ID NO: 322242 - DNA, 75 bp, Artificial Sequence
  Synthetic
gcactttatatgttaacaacaagaggccggcagacttcaaaagacaacagagggatgagaattagatttaaagat

SEQ ID NO: 322243 - DNA, 75 bp, Artificial Sequence
  Synthetic
gacagctcatatgaagatgttaacgggattcggaaaccaaagcatttgtatgtgtcaatgcctaatgcccaatct

SEQ ID NO: 322244 - DNA, 75 bp, Artificial Sequence
  Synthetic
ggattcggaaaccaaagcatttgtatgtgtcaatgcctaatgcccaatctagcatgaaggctgaagagatcacac

SEQ ID NO: 322245 - DNA, 75 bp, Artificial Sequence
  Synthetic
ctgggaggttccgcactgcagtttgtgggctatatcctgcacaaataaaagcaaggaatatggtgagtcctgtta

SEQ ID NO: 322246 - DNA, 75 bp, Artificial Sequence
  Synthetic
tgggctatatcctgcacaaataaaagcaaggaatatggtgagtcctgttatgagtgtagttgggttcctggcact

SEQ ID NO: 322247 - DNA, 75 bp, Artificial Sequence
  Synthetic
ggcaaaggattggacatcaaggattgaagattggctcggggccccatgcaagtttatggctgagtctcccattgc

SEQ ID NO: 322248 - DNA, 75 bp, Artificial Sequence
  Synthetic
gaagattggctcggggccccatgcaagtttatggctgagtctcccattgccgggagcttatccgggaatcctgta

SEQ ID NO: 322249 - DNA, 75 bp, Artificial Sequence
  Synthetic
gttaagttagctgattgatttatatgattatcataattgaatataatcataagcacaatcattaccatgtataat

SEQ ID NO: 322250 - DNA, 75 bp, Artificial Sequence
  Synthetic
aaccgtgattacatccgacaaaggcaaggtgcactggcagggatggagcctaaagagtttcaagccctcaggcag

SEQ ID NO: 322251 - DNA, 75 bp, Artificial Sequence
  Synthetic
aaggtgcactggcagggatggagcctaaagagtttcaagccctcaggcagcattcaaaagatgccggttgtacac

SEQ ID NO: 322252 - DNA, 75 bp, Artificial Sequence
  Synthetic
aggtcaccttaagtgacctttttttgtatatatggatgtagatttcaattgatcaggtactaatcctactgtcct

SEQ ID NO: 322253 - DNA, 75 bp, Artificial Sequence
  Synthetic
tggtggaacatatcgaatcaccatcatcgatatgggtgtttgccggggcccctgatcggtgcccaccaacatgtt

SEQ ID NO: 322254 - DNA, 75 bp, Artificial Sequence
  Synthetic
atcgatatgggtgtttgccggggcccctgatcggtgcccaccaacatgtttgtttgttgggggaatggctgagct

SEQ ID NO: 322255 - DNA, 75 bp, Artificial Sequence
  Synthetic
cttttcttttcctttctctttctttactaacaacaacaaactacctcacaaccttctacctcgacacatactacc

SEQ ID NO: 322256 - DNA, 75 bp, Artificial Sequence
  Synthetic
aggtgccttcttctccatacttcaagacatgaggaacacaattatggcttctaagactgtgggcactgctgatga

SEQ ID NO: 322257 - DNA, 75 bp, Artificial Sequence
  Synthetic
ctcacaaccttctacctcgacacatactacctcattaagttgttcccttttagctctttagggagtctactacta

SEQ ID NO: 322258 - DNA, 75 bp, Artificial Sequence
  Synthetic
tagtagtagacaccgcaaaagaaacagcagttaaaaaacagcaggatcatgtggagtttgctattactggccgct

SEQ ID NO: 322259 - DNA, 75 bp, Artificial Sequence
  Synthetic
gacatgaggaacacaattatggcttctaagactgtgggcactgctgatgagaagctgcgaaagaaatcatcattc

SEQ ID NO: 322260 - DNA, 75 bp, Artificial Sequence
  Synthetic
taccaatcttacctccggcgcacacaatcaatgggaattcaactggatcagagaataattgttatgttcatggtt

SEQ ID NO: 322261 - DNA, 75 bp, Artificial Sequence
  Synthetic
aatcaatgggaattcaactggatcagagaataattgttatgttcatggttgcctggggcaaagaggcagtagata

SEQ ID NO: 322262 - DNA, 75 bp, Artificial Sequence
  Synthetic
actttcatcttggtgatgatatggatccagagcttcgtagcctggctcagatcctgattgatcaaaaggtgaagg

SEQ ID NO: 322263 - DNA, 75 bp, Artificial Sequence
  Synthetic
tccagagcttcgtagcctggctcagatcctgattgatcaaaaggtgaaggagatatcaaaccaggagcccatgaa

SEQ ID NO: 322264 - DNA, 75 bp, Artificial Sequence
  Synthetic
gttataagcatataattaagtaatcaacactaactataggttgagtaatactaatcaatagataaaaatatatag

SEQ ID NO: 322265 - DNA, 75 bp, Artificial Sequence
  Synthetic
atttaatgaataatcatattaaataattaggtaagttaactatctagttagttaaattaactaattgatttatat

SEQ ID NO: 322266 - DNA, 75 bp, Artificial Sequence
  Synthetic
tagtagtagactccctaaagagctactacactaacaagaaaaatggcaactatggaggaaatccagagagaaatc

SEQ ID NO: 322267 - DNA, 75 bp, Artificial Sequence
  Synthetic
atcacgggtatacgggtggttttcatatggggaacagggtgggcttagggccaggtcaccttaagtgaccttttt

SEQ ID NO: 322268 - DNA, 75 bp, Artificial Sequence
  Synthetic
ttgtatatatggatgtagatttcaattgatcgagtactaatcctgctgtctttccttcttttccttttcttttct

SEQ ID NO: 322269 - DNA, 75 bp, Artificial Sequence
  Synthetic
tttccttcttttccttttcttttctttactaaccctcattaagttgtttccttttgtctttttagggagcatact

SEQ ID NO: 322270 - DNA, 75 bp, Artificial Sequence
  Synthetic
aattggtcagggctttgcattagaaaatgcgtttgacatgagaattcggtgtccccattcggtccactttgggga

SEQ ID NO: 322271 - DNA, 75 bp, Artificial Sequence
  Synthetic
catcatactcatcaactagtatattggctgcttcagaagatggtcgtttcatattcagccctggtttgtttccca

SEQ ID NO: 322272 - DNA, 75 bp, Artificial Sequence
  Synthetic
gaagaatggcttggcgcaccctgcaagttcatggcagagtctcctattgctgggagtttatctgggaatcctgtg

SEQ ID NO: 322273 - DNA, 75 bp, Artificial Sequence
  Synthetic
tcaggaatcagcgaaccaaaattcatttgaagttgtggagagtgcactcaaaattaaagggttgtgtatgttaaa

SEQ ID NO: 322274 - DNA, 75 bp, Artificial Sequence
  Synthetic
aatgtgtctggtgtccaagcaaaataggtttcgagcagctgagcagcggattagctttgtctgtcaaagggttga

SEQ ID NO: 322275 - DNA, 75 bp, Artificial Sequence
  Synthetic
atcttgattgaccagaaagtgaaggaaatctcgaaccaggaacctatgaaattataagtacataaatatgtaatc

SEQ ID NO: 322276 - DNA, 75 bp, Artificial Sequence
  Synthetic
ttgctattgagttgtgtgttccaggtttccatggctgggccacagctgcacttttaactacattctgctttggct

SEQ ID NO: 322277 - DNA, 75 bp, Artificial Sequence
  Synthetic
atcaagagaaccgattcaaagccattctacgtaaaataaaggaggagtttgaaaaaacaaagggttccgtggttt

SEQ ID NO: 322278 - DNA, 75 bp, Artificial Sequence
  Synthetic
accttctacctcaatatatactacctcattaagttgtttccttttgtcttgttagtgtagtagctctttagggag

SEQ ID NO: 322279 - DNA, 75 bp, Artificial Sequence
  Synthetic
gactgtaactcctcaaaatatcgggccgggctgttaccgaacattaaatctttttaggtataatagtaggcctga

SEQ ID NO: 322280 - DNA, 75 bp, Artificial Sequence
  Synthetic
attggtgctgatgttcatcatcttggacattggtatgatgcaagattgaatctaaaaacctcatttcattgttat

SEQ ID NO: 322281 - DNA, 75 bp, Artificial Sequence
  Synthetic
tcaggttataagaaagttcttgcaacaattgattctttccaatcatttaacacaagcaatatacacttcactgat

SEQ ID NO: 322282 - DNA, 75 bp, Artificial Sequence
  Synthetic
taaaaacttcatttcactgctacggtgcctgcacaaaataccaatatccgtggcacaccgcaaaatgtcattttg

SEQ ID NO: 322283 - DNA, 75 bp, Artificial Sequence
  Synthetic
cacactaactataggttaagaaatactaactattagttaataagaatacagatttttttaataatcatattaaat

SEQ ID NO: 322284 - DNA, 75 bp, Artificial Sequence
  Synthetic
gctgtcatggaaaagaatgttcatcaactggcctccaagccagtgcaccgcatctggataaggtaaatggtatat

SEQ ID NO: 322285 - DNA, 75 bp, Artificial Sequence
  Synthetic
gagaattgaatggagagaccctgatggtatgcttcgggatcatattaatattgttatttctaaagatattgattt

SEQ ID NO: 322286 - DNA, 75 bp, Artificial Sequence
  Synthetic
attacttgttggtttaagaaatcaggtgagtgggttatgggtataatcaatggaaactgggttgtcctaattgct

SEQ ID NO: 322287 - DNA, 75 bp, Artificial Sequence
  Synthetic
aaggatggtttttttttttttccgcaagaaagaacagttaaataacagcaggatcatgtggagtttgctattatt

SEQ ID NO: 322288 - DNA, 75 bp, Artificial Sequence
  Synthetic
tgttagaaagcataaaaaatcatgaatcctacctattaatcttcacatcatgtatcgagttttaaacactttacc

SEQ ID NO: 322289 - DNA, 75 bp, Artificial Sequence
  Synthetic
gcattaaaaaatgtgtttgacatgagaattcagtgtccccactcagtcaactttggggaaacaagtgtgtcaggc

SEQ ID NO: 322290 - DNA, 75 bp, Artificial Sequence
  Synthetic
ctttggggaaacaagtgtgtcaggctatacagaattgccaccactctcattacaggaggcagaacagctagtgcc

SEQ ID NO: 322291 - DNA, 75 bp, Artificial Sequence
  Synthetic
aaaatactctcttctatctcccaatcttttattgattcaccggggtgttgtcttgacatcttgcggagtctacta

SEQ ID NO: 322292 - DNA, 75 bp, Artificial Sequence
  Synthetic
gaatgggttatgggtataatcaatgggaactgggttgtcctaattgttttgtgtgtcctgctgctcttttctctt

SEQ ID NO: 322293 - DNA, 75 bp, Artificial Sequence
  Synthetic
atcctgttgagcatcttgtgtcctgttagaaagcataaaaaatcataaatcctgcctatcaatcttaacatcatg

SEQ ID NO: 322294 - DNA, 75 bp, Artificial Sequence
  Synthetic
ttagaaagcataaaaaatcataaatcctgcctatcaatcttaacatcatgtattaagctttaaacactttaccat

SEQ ID NO: 322295 - DNA, 75 bp, Artificial Sequence
  Synthetic
cagaattcatttgaagttgtggagagtgaagtcagctttaaagggttgtgtatgttaaagcatagaatggttgaa

SEQ ID NO: 322296 - DNA, 75 bp, Artificial Sequence
  Synthetic
aagcgccaacttgccgacaggattgcagcagggaagaacatcgggcaagaccgggatcctacaggggtagagccg

SEQ ID NO: 322297 - DNA, 75 bp, Artificial Sequence
  Synthetic
gtgaagtcagctttaaagggttgtgtatgttaaagcatagaatggttgaagaatcatatagaaacaggagatcag

SEQ ID NO: 322298 - DNA, 75 bp, Artificial Sequence
  Synthetic
tatatgattgttcctatacatgcatgcaatatgatgaaaagctgtttgattggtcttggtccctacagaatccag

SEQ ID NO: 322299 - DNA, 75 bp, Artificial Sequence
  Synthetic
attcgtggtcccgatcatattgaaggcactgtatatgttaacaacaagaggtaggcagacctcaaaggacaacaa

SEQ ID NO: 322300 - DNA, 75 bp, Artificial Sequence
  Synthetic
gccaataagtaaggtgttgctatttgctgggatacctaataatgtcataacagcattggaaaaaaaggttatccc

SEQ ID NO: 322301 - DNA, 75 bp, Artificial Sequence
  Synthetic
ggatattatatctgtattattggtggaaactctgcccctgtatatgcccctgctggtgaagactttagggcaatg

SEQ ID NO: 322302 - DNA, 75 bp, Artificial Sequence
  Synthetic
gaagaatggcttggcgcaccctgcaagttcatggcggagtctcccattgccgggagcctatctgggaatcctgtg

SEQ ID NO: 322303 - DNA, 75 bp, Artificial Sequence
  Synthetic
ggtattccatcatactcatcaactagtatattggctgcttcagaagatggtcgtttcatatttagtcctggttta

SEQ ID NO: 322304 - DNA, 75 bp, Artificial Sequence
  Synthetic
tccagagcttcgtagcctggctcagatcctgattgaccagaaagtgaaggaaatctcaaaccaggaacctatgaa

SEQ ID NO: 322305 - DNA, 75 bp, Artificial Sequence
  Synthetic
taaagggattgacttgattggacctgatatagatgggttagtgaactatgcccaagtctggatgtcaaagaccca

SEQ ID NO: 322306 - DNA, 75 bp, Artificial Sequence
  Synthetic
ggttcagctgtgtttgattgttttaatgagaatgaacaagggcacattgtaaaatacccaatgtcccggcaccca

SEQ ID NO: 322307 - DNA, 75 bp, Artificial Sequence
  Synthetic
gattatcacaattgaatgtaatcataagcacaatcactgccatgtataatcacgggtatacgggtggttttcata

SEQ ID NO: 322308 - DNA, 75 bp, Artificial Sequence
  Synthetic
aactatactttctgatcaacttgatagtcgtagggcctgcattcaatttttaaacctcatcccagaaacccctgc

SEQ ID NO: 322309 - DNA, 75 bp, Artificial Sequence
  Synthetic
aggtcaccttaagtgaccttttttgtatatatggatgtagatttcaattgatcgaatactaatcctactgtcctc

SEQ ID NO: 322310 - DNA, 75 bp, Artificial Sequence
  Synthetic
ctaacaacaacaaactacctcacaaccttctacctcaatacatactacctcattaagttgtttccttttgtcttt

SEQ ID NO: 322311 - DNA, 75 bp, Artificial Sequence
  Synthetic
caagttttttgcaaatatccttcatacaagcaatcaagagaatcgattcaaagccattctacggaaaataaaaga

SEQ ID NO: 322312 - DNA, 75 bp, Artificial Sequence
  Synthetic
tgagtcaaagatcatgctggacatgctaagtcaacatgaacctcgagaaaatctgggaaagtcaatagaaagttt

SEQ ID NO: 322313 - DNA, 75 bp, Artificial Sequence
  Synthetic
tcagattgtgttagcctaatcacaaaaattttgtcagaattagagcttaacatttctgaacctagtaaccctgaa

SEQ ID NO: 322314 - DNA, 75 bp, Artificial Sequence
  Synthetic
ctctcaacaataaataaattaactaaggtaatatggcgaaaaaaagcaaatcaggaatcagcaaaccaaaattca

SEQ ID NO: 322315 - DNA, 75 bp, Artificial Sequence
  Synthetic
gcatagaatggttgaagaatcatatagaaacaggagatcagtaatctgttatgatctagcctgtaatagtacatt

SEQ ID NO: 322316 - DNA, 75 bp, Artificial Sequence
  Synthetic
ggatattactgagagcttgattgcacattctggattgaggaggtctaaatattggtcaatccatgcttataataa

SEQ ID NO: 322317 - DNA, 75 bp, Artificial Sequence
  Synthetic
tcttcttctcattattgaatccatcctctgggcagcaagtgcagcagaaatcccccttgtccctctctggacaga

SEQ ID NO: 322318 - DNA, 75 bp, Artificial Sequence
  Synthetic
tcccccttgtccctctctggacagataatgctcatggcgttgggagtgttcctatgcatacagatcttgaattag

SEQ ID NO: 322319 - DNA, 75 bp, Artificial Sequence
  Synthetic
taatgctcatggcgttgggagtgttcctatgcatacagatcttgaattagacttttctttgccatctagttctaa

SEQ ID NO: 322320 - DNA, 75 bp, Artificial Sequence
  Synthetic
tctcattgcatatagaaattgaaagtcaaggcattggtgctgatgttcatcatcttggacattggtatgatgcaa

SEQ ID NO: 322321 - DNA, 75 bp, Artificial Sequence
  Synthetic
tagcttttgagaaatcactacttgcaacagctacatggttccaatattatactgaggatcaatcacaatttccat

SEQ ID NO: 322322 - DNA, 75 bp, Artificial Sequence
  Synthetic
atcaaaagtctgcttgttgcattggctcaaaataataaggctagattttattcgaaagttaaacttcttggattg

SEQ ID NO: 322323 - DNA, 75 bp, Artificial Sequence
  Synthetic
gttgtactgcttgtggattatatctagatcaattgaagccggtaggaacagcctttaaaattataagtgtaagat

SEQ ID NO: 322324 - DNA, 75 bp, Artificial Sequence
  Synthetic
ttcgaaagttaaacttcttggattgactgttgaccagtctacagttggtgcaagtggtatctatccatcttttat

SEQ ID NO: 322325 - DNA, 75 bp, Artificial Sequence
  Synthetic
tggtgaagaatacctttgtaaaacaattgatatgaatgattgctttgtgactaggcatgccaaaatatgtataat

SEQ ID NO: 322326 - DNA, 75 bp, Artificial Sequence
  Synthetic
tgggactgtatctaagttttctcaaggtgacactctactatttcttgggcccatggaaggaggtggtataatctt

SEQ ID NO: 322327 - DNA, 75 bp, Artificial Sequence
  Synthetic
ggtgacactctactatttcttgggcccatggaaggaggtggtataatctttaaacactggtgtacatctacctgt

SEQ ID NO: 322328 - DNA, 75 bp, Artificial Sequence
  Synthetic
cactttggagaccctggtgatgttatgggtccaaaagataaaccatttatttgccctgaattcccagggcaattc

SEQ ID NO: 322329 - DNA, 75 bp, Artificial Sequence
  Synthetic
tctgtctaactcaaggaacaatcctaacgttcttcaattatatgaagaaactagacatcagaaggcacaagctag

SEQ ID NO: 322330 - DNA, 75 bp, Artificial Sequence
  Synthetic
caattcagcaaaattcaggcgattcactgctgcccttcataatggattgcctgatgacaggttaaaaaactgtgt

SEQ ID NO: 322331 - DNA, 75 bp, Artificial Sequence
  Synthetic
aatccttgtaaagtagggctccaggcagcaaacatagaaggtgcttggggttcaggtgttgggtttacactcaca

SEQ ID NO: 322332 - DNA, 75 bp, Artificial Sequence
  Synthetic
ttagaaagcataaaaaatcataaatcctacctattaatcttaacatcatgtatcaagttttaaacactttaccat

SEQ ID NO: 322333 - DNA, 75 bp, Artificial Sequence
  Synthetic
ttaaaacttaacctggctctaatatctgataactaactttcatttttatttttatatggattaattactaaaaaa

SEQ ID NO: 322334 - DNA, 75 bp, Artificial Sequence
  Synthetic
ggcatcatggagaggtacgaggcaattggttgcagggtaacttgaacaagtgctcatcattatttggtgtggcaa

SEQ ID NO: 322335 - DNA, 75 bp, Artificial Sequence
  Synthetic
caacatttctcacgtcaataaaggcttgtgacatggcaatttgttatggtgcagaaagtgtgacactctcacgag

SEQ ID NO: 322336 - DNA, 75 bp, Artificial Sequence
  Synthetic
atgtggagtttgctattacttgccgctttagttggccaaggctttgcattaaaaaatgtgtttgacatgaaaatc

SEQ ID NO: 322337 - DNA, 75 bp, Artificial Sequence
  Synthetic
gaaaggtggccatagtggttcttcatttaaatgctgtcatgggaaagaatgttcatcaactggccttcaagccag

SEQ ID NO: 322338 - DNA, 75 bp, Artificial Sequence
  Synthetic
ttggttgcagggtaacttgaacaagtgctcatcattatttggtgtggcaatgtctttattattcaaagaaatctg

SEQ ID NO: 322339 - DNA, 75 bp, Artificial Sequence
  Synthetic
ttgtgacatggcaatttgttatggtgcagaaagtgtgacactctcacgaggacaaaatactgtcaaaattaccgg

SEQ ID NO: 322340 - DNA, 75 bp, Artificial Sequence
  Synthetic
tgcaccacatctggataaggtaaatggtatctctgagttagaaaacgagaaagtttatgatgatggtgcacctga

SEQ ID NO: 322341 - DNA, 75 bp, Artificial Sequence
  Synthetic
ggtatctctgagttagaaaacgagaaagtttatgatgatggtgcacctgaatgtggcattacttgttggtttaaa

SEQ ID NO: 322342 - DNA, 75 bp, Artificial Sequence
  Synthetic
atcactctcaacaataaataaattgaccaaagtcatatggcgaaagaaagcaaatcaggaatcagcaaaccagaa

SEQ ID NO: 322343 - DNA, 75 bp, Artificial Sequence
  Synthetic
ttgtcgccgacaaatgctgagttcttgtctacattttttgagggttgtgctgtatcaattccctttattaaaatc

SEQ ID NO: 322344 - DNA, 75 bp, Artificial Sequence
  Synthetic
tgtctacattttttgagggttgtgctgtatcaattccctttattaaaatccttcttggctcactatctgacctac

SEQ ID NO: 322345 - DNA, 75 bp, Artificial Sequence
  Synthetic
ctttaccattttaaacttaacctggctctaatatctgataactaactttcatttttatttttatatggattaatt

SEQ ID NO: 322346 - DNA, 75 bp, Artificial Sequence
  Synthetic
ctctaatatctgataactaactttcatttttatttttatatggattaattactaaaaaaaatactctcttccatc

SEQ ID NO: 322347 - DNA, 75 bp, Artificial Sequence
  Synthetic
ttgaaacaagcacttattggttatatgcataaacaccagaaacaaatgagttacatcttggggctcttcaagttt

SEQ ID NO: 322348 - DNA, 75 bp, Artificial Sequence
  Synthetic
gaagtttttaaaggtttggagtgaacagcatcctacatatgattacattattcctaaaggtcgtgacaatcttct

SEQ ID NO: 322349 - DNA, 75 bp, Artificial Sequence
  Synthetic
actgcagatgtagataagggtattagagagaagaaaatgaaatatgagctaggtctgaaatatctagagcaagaa

SEQ ID NO: 322350 - DNA, 75 bp, Artificial Sequence
  Synthetic
tgcagcagcaaacagctttgctgagagctatgagcctagtcaaaatgatattgatttatttcagacattgactag

SEQ ID NO: 322351 - DNA, 75 bp, Artificial Sequence
  Synthetic
tggaaagattttttgaataatgtgcactgtgatgtgataccaacaaagcaagtacaacgtgcgaaagttgcacgt

SEQ ID NO: 322352 - DNA, 75 bp, Artificial Sequence
  Synthetic
ctggctgcttcagaagatggtcgcttcatatttagtcctggtctatttcctaacctaaatcaatcagtctgtgac

SEQ ID NO: 322353 - DNA, 75 bp, Artificial Sequence
  Synthetic
tgttattggttacaagtttgcagtaacggttgatgaaatgtctgatgtgctagatacagcaaagttcccagattc

SEQ ID NO: 322354 - DNA, 75 bp, Artificial Sequence
  Synthetic
tagatacagcaaagttcccagattccctggcagttgacctgaagacaatgaaagatggagtctatagggagttgg

SEQ ID NO: 322355 - DNA, 75 bp, Artificial Sequence
  Synthetic
gatatggatattatagtgtactgtaatggtcaaaaaaagacaatcctaacaaaaacattagttataggccaatgt

SEQ ID NO: 322356 - DNA, 75 bp, Artificial Sequence
  Synthetic
tttttgcaaatatccttcatacaagtaatcaagaaaaccgattcaaagccattctacgaaaaataaaggaagagt

SEQ ID NO: 322357 - DNA, 75 bp, Artificial Sequence
  Synthetic
gtcaaaggtgacaggtcagtgttacaactccaagccaatagaagagcatattcagggaaacaatatgatgcatat

SEQ ID NO: 322358 - DNA, 75 bp, Artificial Sequence
  Synthetic
aactccaagccaatagaagagcatattcagggaaacaatatgatgcatattgtgtacagacttataatgaagaga

SEQ ID NO: 322359 - DNA, 75 bp, Artificial Sequence
  Synthetic
ataaaaaaacttatattcttgagacatccatcacacagaaacatgttttaaaaatcatgatggaggaggtttcga

SEQ ID NO: 322360 - DNA, 75 bp, Artificial Sequence
  Synthetic
gtgcccatattgcttcacccactgtgaaccaacagagactgcaattcaggcacattataaagtttgtcaagccac

SEQ ID NO: 322361 - DNA, 75 bp, Artificial Sequence
  Synthetic
ccaccggttcagggaagatttaaaaaagactgtaactcctcaaaatattgggccgggctgttaccgaacactaaa

SEQ ID NO: 322362 - DNA, 75 bp, Artificial Sequence
  Synthetic
ccttcaaaatcccttgaggttgcaggctcatttgtgcgatttatgactgcttttaaattaggtcctggattagtt

SEQ ID NO: 322363 - DNA, 75 bp, Artificial Sequence
  Synthetic
ttgcagatggtgatatcttgtggggtgtctcaaaagttatgagtctagatctaaacaggttacttgctttaaata

SEQ ID NO: 322364 - DNA, 75 bp, Artificial Sequence
  Synthetic
aatccgatcatttcatcaggactgctagagaattttatgaaaaatatacctgctgctattccaccagctgcttat

SEQ ID NO: 322365 - DNA, 75 bp, Artificial Sequence
  Synthetic
ttgatgatgaagaggaaatggatgatgagtttacaatagacctacaggatgtagattttgaaaatattgatatag

SEQ ID NO: 322366 - DNA, 75 bp, Artificial Sequence
  Synthetic
tttgagaaagattatgagtatgaaaatagctgggcttgcaaccccccggattgccccggggttggcacaggttgt

SEQ ID NO: 322367 - DNA, 75 bp, Artificial Sequence
  Synthetic
agtccaacaactatattgtcaagatgcagttgagctggctgctaatgaattaaatcgaattcttattacaaagtc

SEQ ID NO: 322368 - DNA, 75 bp, Artificial Sequence
  Synthetic
agaaaagtgtgcttgcagtttggtgaagaatacctctgtaaaacgattgatatgaatgattgctttgtgacaagg

SEQ ID NO: 322369 - DNA, 75 bp, Artificial Sequence
  Synthetic
aaaaggtatgtcaggccaagtacaagaggatgggcatttgtcatcatctactacaataattgaggctataagata

SEQ ID NO: 322370 - DNA, 75 bp, Artificial Sequence
  Synthetic
cttgaaaaagctctccgctgggcatctggagagagctttattgagctcagtaacggaaaatttataaggatgaag

SEQ ID NO: 322371 - DNA, 75 bp, Artificial Sequence
  Synthetic
gtggccatagtggttcttcatttaaatgctgtcatgggaaggaatgttcatcaactggcctacaagccagtgcac

SEQ ID NO: 322372 - DNA, 75 bp, Artificial Sequence
  Synthetic
gcattacttgttggtttaaaaagtcaggtgaatgggttatgggtataattaatgggaattgggttgtcttaattg

SEQ ID NO: 322373 - DNA, 75 bp, Artificial Sequence
  Synthetic
aaagcttcgaaagaaatcatcattctatcaatcatacctcagacgccaacaatcaatggggatacaactggacca

SEQ ID NO: 322374 - DNA, 75 bp, Artificial Sequence
  Synthetic
ctcaaatctcacaacttgcagtttcactcagtacaagtaaggttgagaggttatatgggacatcaataggcatgg

SEQ ID NO: 322375 - DNA, 75 bp, Artificial Sequence
  Synthetic
ttttgtgtgtcctcttacttttttctcttatcctgttgagcattttgtgtcctgttaggaagcataaaaaatcat

SEQ ID NO: 322376 - DNA, 75 bp, Artificial Sequence
  Synthetic
cagttgaataacagcaggatcatgtggggtttactattgctagccgctctggttggccaaggtttagcattaaaa

SEQ ID NO: 322377 - DNA, 75 bp, Artificial Sequence
  Synthetic
ttaatggatctttctggtgagacatttcagcatgagaggctaggccagttttcatttataggaaaagttcaatgg

SEQ ID NO: 322378 - DNA, 75 bp, Artificial Sequence
  Synthetic
ggggtttactattgctagccgctctggttggccaaggtttagcattaaaaaatgtctttgacatgaagatacagt

SEQ ID NO: 322379 - DNA, 75 bp, Artificial Sequence
  Synthetic
ggttggccaaggtttagcattaaaaaatgtctttgacatgaagatacagtgccctcattcagtaaactttgggga

SEQ ID NO: 322380 - DNA, 75 bp, Artificial Sequence
  Synthetic
aatactaactataggttaagaaatactaatcattagttaataagaatacagatttattgaataatcatattaaat

SEQ ID NO: 322381 - DNA, 75 bp, Artificial Sequence
  Synthetic
aacaagtgtgtcaggatatacagagttgcccccactcccactacaggaggcagaacagcttgtgccggaaagctc

SEQ ID NO: 322382 - DNA, 75 bp, Artificial Sequence
  Synthetic
ttgcccccactcccactacaggaggcagaacagcttgtgccggaaagctcttgtaacatggacaatcaccaatca

SEQ ID NO: 322383 - DNA, 75 bp, Artificial Sequence
  Synthetic
tatttatcttgtgagaaaattaaatgacccaagtattataacagctatgactatgcaatcacccttacagctcag

SEQ ID NO: 322384 - DNA, 75 bp, Artificial Sequence
  Synthetic
ctctcaaccatcaataaactgaccaaggtaatatggagaaaaaaggcaaatcaggaatcagcaagtcagaattca

SEQ ID NO: 322385 - DNA, 75 bp, Artificial Sequence
  Synthetic
aggtaatatggagaaaaaaggcaaatcaggaatcagcaagtcagaattcatttgaggttgtggaaaatgaggtga

SEQ ID NO: 322386 - DNA, 75 bp, Artificial Sequence
  Synthetic
aggtcaccttaagtgacctttttttgtatatatggatgtaaatttcaattgatcaaatactaattctactgtcct

SEQ ID NO: 322387 - DNA, 75 bp, Artificial Sequence
  Synthetic
gctttaaaggtttatgtatgctaaaacacagaatggtcgaggaatcatatagaaataggaggtcagtaatttgtt

SEQ ID NO: 322388 - DNA, 75 bp, Artificial Sequence
  Synthetic
cttttcttttcctttctccttctttactaacaaccttctacctcaatatatactacctcattaagttgtttccga

SEQ ID NO: 322389 - DNA, 75 bp, Artificial Sequence
  Synthetic
actaacaaccttctacctcaatatatactacctcattaagttgtttccgattgtctttttagggagcatactact

SEQ ID NO: 322390 - DNA, 75 bp, Artificial Sequence
  Synthetic
acacagaatggtcgaggaatcatatagaaataggaggtcagtaatttgttatgatctggcatgtaatacaacatt

SEQ ID NO: 322391 - DNA, 75 bp, Artificial Sequence
  Synthetic
ttgtaagccaactgtctacatgattgtcccaattcatgcttgcaacatgatgaaaagctgtttgatcggacttgg

SEQ ID NO: 322392 - DNA, 75 bp, Artificial Sequence
  Synthetic
gtcccaattcatgcttgcaacatgatgaaaagctgtttgatcggacttgggccctacagaatccaggtaatttat

SEQ ID NO: 322393 - DNA, 75 bp, Artificial Sequence
  Synthetic
tgttattggttacaagtttgcagtaacagttgatgaaatgtccgatgtgctagatacagcaaagttcccagattc

SEQ ID NO: 322394 - DNA, 75 bp, Artificial Sequence
  Synthetic
gagagaacttattgtactacagggatactgacagaagggaagtgttttgtccctgataaggctgttgttagtgct

SEQ ID NO: 322395 - DNA, 75 bp, Artificial Sequence
  Synthetic
tactgacagaagggaagtgttttgtccctgataaggctgttgttagtgctttaaagagaggtatgtgtgcaatag

SEQ ID NO: 322396 - DNA, 75 bp, Artificial Sequence
  Synthetic
ctagcatagaaacaatttgtttctttgttcatcaaaaaggaaacacatacaaaatagtatcagcaatcacatcag

SEQ ID NO: 322397 - DNA, 75 bp, Artificial Sequence
  Synthetic
aaaatagtatcagcaatcacatcagcaatgggctccaaatgcaataatacagattctaaggtccaaggatactac

SEQ ID NO: 322398 - DNA, 75 bp, Artificial Sequence
  Synthetic
agattctaaggtccaaggatactacatatgcattattggtgggaattcagctcctgtttatgctcctgctggtga

SEQ ID NO: 322399 - DNA, 75 bp, Artificial Sequence
  Synthetic
agacaattaaagttaaaccccataaagaagtgctccaggctgtttccatatttaataggaaagaagatattggtc

SEQ ID NO: 322400 - DNA, 75 bp, Artificial Sequence
  Synthetic
atatgcattattggtgggaattcagctcctgtttatgctcctgctggtgaagatttcagggcaatggaagttttt

SEQ ID NO: 322401 - DNA, 75 bp, Artificial Sequence
  Synthetic
tcaggaattattacatcaccacatggggaagatcatgacctcccaggtgaagagatagcaacataccagatctca

SEQ ID NO: 322402 - DNA, 75 bp, Artificial Sequence
  Synthetic
gggaagatcatgacctcccaggtgaagagatagcaacataccagatctcaggtcaaatagaggctaagatccccc

SEQ ID NO: 322403 - DNA, 75 bp, Artificial Sequence
  Synthetic
atactgtgagctctaaaaatctaaagcttactgcttttgcaggcattccatcttactcatcaacaagtatcttgg

SEQ ID NO: 322404 - DNA, 75 bp, Artificial Sequence
  Synthetic
gcttactgcttttgcaggcattccatcttactcatcaacaagtatcttggctgcatcagaggatggcaggtttat

SEQ ID NO: 322405 - DNA, 75 bp, Artificial Sequence
  Synthetic
attcagtccgggtttatttccaaatcttaatcagtctgtgtgtgataacaatgcacttcccttaatctggagggg

SEQ ID NO: 322406 - DNA, 75 bp, Artificial Sequence
  Synthetic
cttaatcagtctgtgtgtgataacaatgcacttcccttaatctggaggggtttaatagatttgacaggttactat

SEQ ID NO: 322407 - DNA, 75 bp, Artificial Sequence
  Synthetic
atccatcacacagaaacatgttttaaaaatcatgatggaggaggttccgaaaaaactagttaaatgcgggatgcg

SEQ ID NO: 322408 - DNA, 75 bp, Artificial Sequence
  Synthetic
gaagcaattcatccttgcaatgttttttgtgttttatcaggaccaggtgcatcatgtgaagctttttcagaaggt

SEQ ID NO: 322409 - DNA, 75 bp, Artificial Sequence
  Synthetic
tttgtgttttatcaggaccaggtgcatcatgtgaagctttttcagaaggtggtattttaaatatcacttctccga

SEQ ID NO: 322410 - DNA, 75 bp, Artificial Sequence
  Synthetic
tgaggacaaaccaggctatcaaccacaagtttatgatcacaattaaggatgatggtctcagggcaattgcacagt

SEQ ID NO: 322411 - DNA, 75 bp, Artificial Sequence
  Synthetic
tgtgcctagtgtcaaaacaaaacagatttagggcagcagaacagcaaattagctttatttgtcaaagagtggata

SEQ ID NO: 322412 - DNA, 75 bp, Artificial Sequence
  Synthetic
atttagggcagcagaacagcaaattagctttatttgtcaaagagtggatatggatatagttgtgtactgtaatgg

SEQ ID NO: 322413 - DNA, 75 bp, Artificial Sequence
  Synthetic
atgatgaagatagtccacggtttcttctggcacatgcttttcatactatccgtgatgttcgctatcaagcagttg

SEQ ID NO: 322414 - DNA, 75 bp, Artificial Sequence
  Synthetic
aggtgctttcttttctatacttcaggatatgaggaacacaatcatggcttcaaagactgtgggaacagctgatga

SEQ ID NO: 322415 - DNA, 75 bp, Artificial Sequence
  Synthetic
gcaaaaaaagacaattctgaccaaaacactagttattggccagtgcatatatactataacaagtctattttcttt

SEQ ID NO: 322416 - DNA, 75 bp, Artificial Sequence
  Synthetic
acactagttattggccagtgcatatatactataacaagtctattttctttattacctggggttgcacattctatt

SEQ ID NO: 322417 - DNA, 75 bp, Artificial Sequence
  Synthetic
gctattgaactatgtgtaccaggtttccatggctgggctacagcagcacttctagttaccttctgttttggttgg

SEQ ID NO: 322418 - DNA, 75 bp, Artificial Sequence
  Synthetic
tccatggctgggctacagcagcacttctagttaccttctgttttggttgggttttaatccctgcatgtacattag

SEQ ID NO: 322419 - DNA, 75 bp, Artificial Sequence
  Synthetic
ctgttctattattcttaaagttttttgcaaatatcttacatacaagcaaccaagaaaacagattcaaggctatcc

SEQ ID NO: 322420 - DNA, 75 bp, Artificial Sequence
  Synthetic
tgcaaatatcttacatacaagcaaccaagaaaacagattcaaggctatcctacgaaaaataaaggaggaatttga

SEQ ID NO: 322421 - DNA, 75 bp, Artificial Sequence
  Synthetic
tatatatggatgtagatttcaattgatcgagtactaatcctactgttctcttttcctttcctttctccttcttta

SEQ ID NO: 322422 - DNA, 75 bp, Artificial Sequence
  Synthetic
aaaaacaaagggctcaatggtgtgtgaaatttgtaaatatgaatgtgaaacactaaaggaattaaaagctcacaa

SEQ ID NO: 322423 - DNA, 75 bp, Artificial Sequence
  Synthetic
ctcacaaccttctacctcaacacatactacctcattcagttgtttccttttgtctttttagggagcatactacta

SEQ ID NO: 322424 - DNA, 75 bp, Artificial Sequence
  Synthetic
gaaatttgtaaatatgaatgtgaaacactaaaggaattaaaagctcacaatttgtcctgtgttcaaggggagtgc

SEQ ID NO: 322425 - DNA, 75 bp, Artificial Sequence
  Synthetic
cagttaaataacagcagaatcatgtggagtttgctattactggccgctttggttggccaaggctctgcattaaaa

SEQ ID NO: 322426 - DNA, 75 bp, Artificial Sequence
  Synthetic
ccatattgattcacccattgcgagccaactgaaacagcaattcaggcccattataaagtctgtcaagctacccat

SEQ ID NO: 322427 - DNA, 75 bp, Artificial Sequence
  Synthetic
ccatattgtttcacccattgcgagccaactgaaacagcaattcaggcccattataaagtctgtcaagctacccat

SEQ ID NO: 322428 - DNA, 75 bp, Artificial Sequence
  Synthetic
ccatattgcttcacccattgcgagccaactgaaacagcaattcaggcccattataaagtctgtcaagctacccat

SEQ ID NO: 322429 - DNA, 75 bp, Artificial Sequence
  Synthetic
ccatattggttcacccattgcgagccaactgaaacagcaattcaggcccattataaagtctgtcaagctacccat

SEQ ID NO: 322430 - DNA, 75 bp, Artificial Sequence
  Synthetic
caactgaaacagcaattcaggcccattataaagtctgtcaagctacccatcggttcagggaagatttaaaaaaga

SEQ ID NO: 322431 - DNA, 75 bp, Artificial Sequence
  Synthetic
aatgtgtttgacatgagaatccagtgtccccactcagttaactttggggaaacaagcgtgtcaggctatacggaa

SEQ ID NO: 322432 - DNA, 75 bp, Artificial Sequence
  Synthetic
ctgtaacccctcaaaatattgggccaggttgttaccgtacactaaatctttttaggtacaagagcaggtgttata

SEQ ID NO: 322433 - DNA, 75 bp, Artificial Sequence
  Synthetic
aggttgttaccgtacactaaatctttttaggtacaagagcaggtgttatatcctgacaatgtggattctccttct

SEQ ID NO: 322434 - DNA, 75 bp, Artificial Sequence
  Synthetic
atgcaacatggacaaccaccaatcactctcaacgataaataaattgaccaaggttatatggcgaaagaaagcaaa

SEQ ID NO: 322435 - DNA, 75 bp, Artificial Sequence
  Synthetic
tgtcattgaatctatattgtgggcagctagtgcagcagagattccccttgtccctatatggacagataatgccca

SEQ ID NO: 322436 - DNA, 75 bp, Artificial Sequence
  Synthetic
tgtcattgaatctatattgtgggcagctagtgcagcagagattccccttgtccctttatggacagataatgccca

SEQ ID NO: 322437 - DNA, 75 bp, Artificial Sequence
  Synthetic
tgtcattgaatctatattgtgggcagctagtgcagcagagattccccttgtccctctatggacagataatgccca

SEQ ID NO: 322438 - DNA, 75 bp, Artificial Sequence
  Synthetic
tgtcattgaatctatattgtgggcagctagtgcagcagagattccccttgtccctgtatggacagataatgccca

SEQ ID NO: 322439 - DNA, 75 bp, Artificial Sequence
  Synthetic
gctagtgcagcagagattccccttgtccctatatggacagataatgcccatggagttggcagtgttccaatgcat

SEQ ID NO: 322440 - DNA, 75 bp, Artificial Sequence
  Synthetic
gctagtgcagcagagattccccttgtccctttatggacagataatgcccatggagttggcagtgttccaatgcat

SEQ ID NO: 322441 - DNA, 75 bp, Artificial Sequence
  Synthetic
gctagtgcagcagagattccccttgtccctctatggacagataatgcccatggagttggcagtgttccaatgcat

SEQ ID NO: 322442 - DNA, 75 bp, Artificial Sequence
  Synthetic
gctagtgcagcagagattccccttgtccctgtatggacagataatgcccatggagttggcagtgttccaatgcat

SEQ ID NO: 322443 - DNA, 75 bp, Artificial Sequence
  Synthetic
tagtagtagactccctaaagaggcctaaagagctcctacactaacaagaaaaatggcaactatggaagaaatcca

SEQ ID NO: 322444 - DNA, 75 bp, Artificial Sequence
  Synthetic
acagatctagagctcgacttttccttaccatctagctctaaatacacatataaaaggcatcttacaaatccagtg

SEQ ID NO: 322445 - DNA, 75 bp, Artificial Sequence
  Synthetic
acagatcttgagctcgacttttccttaccatctagctctaaatacacatataaaaggcatcttacaaatccagtg

SEQ ID NO: 322446 - DNA, 75 bp, Artificial Sequence
  Synthetic
acagatctcgagctcgacttttccttaccatctagctctaaatacacatataaaaggcatcttacaaatccagtg

SEQ ID NO: 322447 - DNA, 75 bp, Artificial Sequence
  Synthetic
acagatctggagctcgacttttccttaccatctagctctaaatacacatataaaaggcatcttacaaatccagtg

SEQ ID NO: 322448 - DNA, 75 bp, Artificial Sequence
  Synthetic
taccatctagctctaaatacacatataaaaggcatcttacaaatccagtgaatgatcaacaaagtgtatcattac

SEQ ID NO: 322449 - DNA, 75 bp, Artificial Sequence
  Synthetic
atattgaaatcgaaagccagggcattggtgctgatgttcaccatctcggacactggtatgatgcaagattaaact

SEQ ID NO: 322450 - DNA, 75 bp, Artificial Sequence
  Synthetic
gaaggatcctgatgacttaaacaagagggcactgcatgatcgggagagtgtcgcagcttcaatacaatcaaaaat

SEQ ID NO: 322451 - DNA, 75 bp, Artificial Sequence
  Synthetic
tggtgctgatgttcaccatctcggacactggtatgatgcaagattaaacttaaagacatcatttcactgttatgg

SEQ ID NO: 322452 - DNA, 75 bp, Artificial Sequence
  Synthetic
tgcctgcacaaagtatcagtacccatggcatacagcaaaatgccacttcgagaaggattatgaatatgagaatag

SEQ ID NO: 322453 - DNA, 75 bp, Artificial Sequence
  Synthetic
tggcatacagcaaaatgccacttcgagaaggattatgaatatgagaatagttgggcatgtaatccacctgattgc

SEQ ID NO: 322454 - DNA, 75 bp, Artificial Sequence
  Synthetic
gaaagatcagcactaagctatgggaatacactggacctgaatagtcttgacattgatgaacctacaggacagaca

SEQ ID NO: 322455 - DNA, 75 bp, Artificial Sequence
  Synthetic
caatgggctccaaatgtaataatacagatactaaagttcaaggatattatatctgtattattggtggaaactctg

SEQ ID NO: 322456 - DNA, 75 bp, Artificial Sequence
  Synthetic
cctggtgttgggacaggctgtactgcctgtgggctttacttagaacaattaaagccagtaggaacagcttttaaa

SEQ ID NO: 322457 - DNA, 75 bp, Artificial Sequence
  Synthetic
cctggtgttgggacaggctgtactgcctgtgggctttacttagatcaattaaagccagtaggaacagcttttaaa

SEQ ID NO: 322458 - DNA, 75 bp, Artificial Sequence
  Synthetic
cctggtgttgggacaggctgtactgcctgtgggctttacttagaccaattaaagccagtaggaacagcttttaaa

SEQ ID NO: 322459 - DNA, 75 bp, Artificial Sequence
  Synthetic
cctggtgttgggacaggctgtactgcctgtgggctttacttagagcaattaaagccagtaggaacagcttttaaa

SEQ ID NO: 322460 - DNA, 75 bp, Artificial Sequence
  Synthetic
cctgtgggctttacttagaacaattaaagccagtaggaacagcttttaaaattataagcgtcagatatagtagga

SEQ ID NO: 322461 - DNA, 75 bp, Artificial Sequence
  Synthetic
cctgtgggctttacttagatcaattaaagccagtaggaacagcttttaaaattataagcgtcagatatagtagga

SEQ ID NO: 322462 - DNA, 75 bp, Artificial Sequence
  Synthetic
cctgtgggctttacttagaccaattaaagccagtaggaacagcttttaaaattataagcgtcagatatagtagga

SEQ ID NO: 322463 - DNA, 75 bp, Artificial Sequence
  Synthetic
cctgtgggctttacttagagcaattaaagccagtaggaacagcttttaaaattataagcgtcagatatagtagga

SEQ ID NO: 322464 - DNA, 75 bp, Artificial Sequence
  Synthetic
aagtttgtgtccaatttggtgaagagtacctttgtaaaacaattgatatgaatgattgttttgtgactaggcatg

SEQ ID NO: 322465 - DNA, 75 bp, Artificial Sequence
  Synthetic
gtacctttgtaaaacaattgatatgaatgattgttttgtgactaggcatgccaagatctgtataatcgggactgt

SEQ ID NO: 322466 - DNA, 75 bp, Artificial Sequence
  Synthetic
acaacaagaggtaggcagacttcaaaggacaacaaggggatgaggatcagattcaaggatgacagctcatatgag

SEQ ID NO: 322467 - DNA, 75 bp, Artificial Sequence
  Synthetic
gtccaagttttctcaaggtgacactttattatttcttggacctatggaaggaggcggaattatcttcaaacattg

SEQ ID NO: 322468 - DNA, 75 bp, Artificial Sequence
  Synthetic
ttattatttcttggacctatggaaggaggcggaattatcttcaaacattggtgcacatcaacctgccattttgga

SEQ ID NO: 322469 - DNA, 75 bp, Artificial Sequence
  Synthetic
gaccctggcgatgtcatgggcccaaaagataagccatttatatgtcccgaatttccaggccagttcagaaaaaaa

SEQ ID NO: 322470 - DNA, 75 bp, Artificial Sequence
  Synthetic
aagataagccatttatatgtcccgaatttccaggccagttcagaaaaaaatgtaattttgctacgactccagtct

SEQ ID NO: 322471 - DNA, 75 bp, Artificial Sequence
  Synthetic
acagataaaggcaaggaacatggtaagccctgtcatgagtgtagttgggtttttggcactggcaaaagactggac

SEQ ID NO: 322472 - DNA, 75 bp, Artificial Sequence
  Synthetic
gtgagtatgatggaaatgtcatttctggttatcggaaagttctggcaacaattgattcttttcaatcatttaata

SEQ ID NO: 322473 - DNA, 75 bp, Artificial Sequence
  Synthetic
tggttatcggaaagttctggcaacaattgattcttttcaatcatttaatactagcaatgttcactttacagatga

SEQ ID NO: 322474 - DNA, 75 bp, Artificial Sequence
  Synthetic
gaggattgaatggaaagatcctgacggtatgcttcgagaccatattaatattgtcatctctaaagatattgattt

SEQ ID NO: 322475 - DNA, 75 bp, Artificial Sequence
  Synthetic
ggtatgcttcgagaccatattaatattgtcatctctaaagatattgattttgaaaacttggctgaaaacccttgt

SEQ ID NO: 322476 - DNA, 75 bp, Artificial Sequence
  Synthetic
ggatgtacactggttgaacatattgagtcaccatcatcaatatgggtgtttgctggggcccctgataggtgtcca

SEQ ID NO: 322477 - DNA, 75 bp, Artificial Sequence
  Synthetic
aaagtaggcctacaagcagctaatatagaaggtgcctggggctcaggtgttggttttacacttacttgtcaagta

SEQ ID NO: 322478 - DNA, 75 bp, Artificial Sequence
  Synthetic
aaagtaggccttcaagcagctaatatagaaggtgcctggggctcaggtgttggttttacacttacttgtcaagta

SEQ ID NO: 322479 - DNA, 75 bp, Artificial Sequence
  Synthetic
aaagtaggcctccaagcagctaatatagaaggtgcctggggctcaggtgttggttttacacttacttgtcaagta

SEQ ID NO: 322480 - DNA, 75 bp, Artificial Sequence
  Synthetic
aaagtaggcctgcaagcagctaatatagaaggtgcctggggctcaggtgttggttttacacttacttgtcaagta

SEQ ID NO: 322481 - DNA, 75 bp, Artificial Sequence
  Synthetic
tgctggggcccctgataggtgtccaccaacatgcttgtttgtcggagggatggctgagttaggtgccttcttttc

SEQ ID NO: 322482 - DNA, 75 bp, Artificial Sequence
  Synthetic
tagaaggtgcctggggctcaggtgttggttttacacttacttgtcaagtatcgcttacagaatgcccaacatttc

SEQ ID NO: 322483 - DNA, 75 bp, Artificial Sequence
  Synthetic
taacatctataaaggcttgtgacatggcaatttgttatggagcagaaagtgtaacactatcacggggccaaaaca

SEQ ID NO: 322484 - DNA, 75 bp, Artificial Sequence
  Synthetic
ggcaatttgttatggagcagaaagtgtaacactatcacggggccaaaacactataaaaatcacaggaaagggagg

SEQ ID NO: 322485 - DNA, 75 bp, Artificial Sequence
  Synthetic
tcacagtggttcttccttcaaatgttgccatggtaaagagtgctcagcaaatggccttcaggcaagtgccccaca

SEQ ID NO: 322486 - DNA, 75 bp, Artificial Sequence
  Synthetic
atggcaacaagaggagcaagcaagtctcgggtcacgacccggggcgtcaatatggtgacggccaaggccaagagt

SEQ ID NO: 322487 - DNA, 75 bp, Artificial Sequence
  Synthetic
ctggccgtcaaaataaaaaacaaaacaaaacaaaacacaagaggactgcgggggttcctcttgtttttagtggct

SEQ ID NO: 322488 - DNA, 75 bp, Artificial Sequence
  Synthetic
caaattttttgggcacggaaattgaccccgcaagtcaaaaaactgtggaggatggtggacaaggtgcaagggctc

SEQ ID NO: 322489 - DNA, 75 bp, Artificial Sequence
  Synthetic
aagattctgaagaaactgcgaaacatagtgacaaacttgatgaagggattgtccggacgcaggaaaagaagaagc

SEQ ID NO: 322490 - DNA, 75 bp, Artificial Sequence
  Synthetic
ccaccagcctcaatcattttgctactgctccccctaatggcatactcagctagtgtgacacgtcagcatggagct

SEQ ID NO: 322491 - DNA, 75 bp, Artificial Sequence
  Synthetic
ggattgttattgaatgtgacctttgctgatgtcggaaagacctttgaggtacaagggggtaactgttcagtcaat

SEQ ID NO: 322492 - DNA, 75 bp, Artificial Sequence
  Synthetic
accttggaagccggaaaatggtgtgatgactatgtggaatacgcttgtgtcactctgactgagggtgaggaacct

SEQ ID NO: 322493 - DNA, 75 bp, Artificial Sequence
  Synthetic
gatgacctagactgttggtgctatggggtggacaatgtgagagtgacatatgggagatgtaaaggcggtgggtcc

SEQ ID NO: 322494 - DNA, 75 bp, Artificial Sequence
  Synthetic
cgcaggtctcggcgctcagctttgataacgcctcatgtcgacaaaggactcacaacaagacaagagaaatggctt

SEQ ID NO: 322495 - DNA, 75 bp, Artificial Sequence
  Synthetic
ccttccaagattggagaacagcagctgcagaaggtggaaaaatggatcattcgtaacccattatatgccctgggg

SEQ ID NO: 322496 - DNA, 75 bp, Artificial Sequence
  Synthetic
gcgatagctctggcatatttcattggaacatcagtagtccagaaagtagtcatcgccatactgctgctaggaatt

SEQ ID NO: 322497 - DNA, 75 bp, Artificial Sequence
  Synthetic
ggaccagcttattccacacattgccttggtatccccaaaagagacttcatacggggacttgatggaaacacatgg

SEQ ID NO: 322498 - DNA, 75 bp, Artificial Sequence
  Synthetic
gtctcagttgtgttggagcaaggaggctgtgtgaccctgattgcagacaacaaaccatcagttgacgtgtggctc

SEQ ID NO: 322499 - DNA, 75 bp, Artificial Sequence
  Synthetic
agttcaattgtggtcgacacgccaacacttgtccggaaaatctgctatgaaagttcagtcacaggttcaaaagct

SEQ ID NO: 322500 - DNA, 75 bp, Artificial Sequence
  Synthetic
gaaggagcttgtcctactatgggtgatgcgcacttgactgaggaaggaaatgaagaatgggaatgcaaaagatcc

SEQ ID NO: 322501 - DNA, 75 bp, Artificial Sequence
  Synthetic
ttctctgacagaggttggggcaacggctgtggtctttttggtaaaggcagcatagttgcttgcgcaaagttctca

SEQ ID NO: 322502 - DNA, 75 bp, Artificial Sequence
  Synthetic
tgcaccaaagagatggaagtgtaccaaattgactctacaaaaatagaatacactatcagtgctcaagttcattct

SEQ ID NO: 322503 - DNA, 75 bp, Artificial Sequence
  Synthetic
ggagccaaaaaagaggattgggttaaccacaccaaactcatcaagtttgttcccacaacaggaacatccacagtg

SEQ ID NO: 322504 - DNA, 75 bp, Artificial Sequence
  Synthetic
acttttacaggttatggtaactttggccttgaatgtcatgttcaaatgatggtagatcttggtaactcttaccta

SEQ ID NO: 322505 - DNA, 75 bp, Artificial Sequence
  Synthetic
gtcaaagtgggtacagacgcatggctagttaacaagcagtgggctcatgatatcacattgccttggcagagtggg

SEQ ID NO: 322506 - DNA, 75 bp, Artificial Sequence
  Synthetic
actggaggacactggagagacaagcatttcatggtagactttgagcaaccacatgctgtgaccatgaaagcttta

SEQ ID NO: 322507 - DNA, 75 bp, Artificial Sequence
  Synthetic
gtgctcggaagccaagaaggtgcattgaggactgcattgtctggggccatggttgtggaagttagctcaaacaga

SEQ ID NO: 322508 - DNA, 75 bp, Artificial Sequence
  Synthetic
tacactctcaaaggtggccatgtcacatgtaaagcttacatgaatgacctaacgctgaaaggatctacatatcca

SEQ ID NO: 322509 - DNA, 75 bp, Artificial Sequence
  Synthetic
atgtgcaagaagggaatgtcttttgtcaaacaaccagtggagacagaccatgggacagctgtgatgcaggtgaag

SEQ ID NO: 322510 - DNA, 75 bp, Artificial Sequence
  Synthetic
gtgacaaatggagctccatgcaggattccagtcatagcatcagattcgatggctggcactgaaaatcgtggcagc

SEQ ID NO: 322511 - DNA, 75 bp, Artificial Sequence
  Synthetic
gtcatcacaactaatccaatagctgcattgaacaatgatgaagtgctggttgagatcagtcccccttttggggaa

SEQ ID NO: 322512 - DNA, 75 bp, Artificial Sequence
  Synthetic
agctacatcatagttggttcaggggatgacaaactgacctaccactggcaaagatcgggcagcacaattggtaat

SEQ ID NO: 322513 - DNA, 75 bp, Artificial Sequence
  Synthetic
ctcttcacagaaaccatgaaaggagcccaaagaatgataataactggtgaacactcatgggactttggctctact

SEQ ID NO: 322514 - DNA, 75 bp, Artificial Sequence
  Synthetic
gggggattttttgcctctgtcggaaaagcaatacacacagtttttgggactgcattccatgccatgttcggaggg

SEQ ID NO: 322515 - DNA, 75 bp, Artificial Sequence
  Synthetic
ttgagctggatgaccaagattttgatcggtggcctcatggtttggctgggactgaactcaaggagtagctcactt

SEQ ID NO: 322516 - DNA, 75 bp, Artificial Sequence
  Synthetic
tccatggccttcatatgccttggggcactccttctggttctagcaactggagtaggagctgaagtgggttgttca

SEQ ID NO: 322517 - DNA, 75 bp, Artificial Sequence
  Synthetic
ctcaattggaaacagcgtgaggtgaaatgtggagatggaatgtttgtcttcaaagacacagatgattggttcacg

SEQ ID NO: 322518 - DNA, 75 bp, Artificial Sequence
  Synthetic
aaataccagtatattccagaagatcccaagacaatggccgggttaattgcccaggcccacgaggaaggactatgt

SEQ ID NO: 322519 - DNA, 75 bp, Artificial Sequence
  Synthetic
ggactcaactcagttggagacttggaacatcgaatgtgggtgtcccgtgtggatgaaatcaatgccattttggaa

SEQ ID NO: 322520 - DNA, 75 bp, Artificial Sequence
  Synthetic
gaaaatgacattgacctgacagttgttgtccaggactcagcttcaatataccagcgtggatcacatgcgtttcca

SEQ ID NO: 322521 - DNA, 75 bp, Artificial Sequence
  Synthetic
cgtcctaagggagagctcaagtatggatggaagacatggggaaaaaacatcatttttagtccatccagaaagaac

SEQ ID NO: 322522 - DNA, 75 bp, Artificial Sequence
  Synthetic
ggcacctttataattgacggaaagagcaaatcagaatgtcctttcaataagagggtctggaactcaatcaaagtg

SEQ ID NO: 322523 - DNA, 75 bp, Artificial Sequence
  Synthetic
gaagaatttggcacaggaatctatcaaacaagagtgtttatgcgccctgactatgattactccaagttgtgtgac

SEQ ID NO: 322524 - DNA, 75 bp, Artificial Sequence
  Synthetic
accggaatgctaggggctgccgcaaagggagatgcctctgtgcacggagaccctctgttctggatggaatctcaa

SEQ ID NO: 322525 - DNA, 75 bp, Artificial Sequence
  Synthetic
aacgtcaatgacacctggacaataacatctctggaagccttgaattatcgtgagtgtgagtggcctagttcacac

SEQ ID NO: 322526 - DNA, 75 bp, Artificial Sequence
  Synthetic
acattggatggttcgagagtgatagaatctgacatgttcatgccacgcagtctagccgggcccgttagccgccac

SEQ ID NO: 322527 - DNA, 75 bp, Artificial Sequence
  Synthetic
aatcacatacccggatacaaagtgcagtctagtggtccatggcacaacactccattggaagtaaaaagagaagaa

SEQ ID NO: 322528 - DNA, 75 bp, Artificial Sequence
  Synthetic
tgccctggaactcacgtcactgtggaagaaacatgtgatgatagggggaagtcagtccgctcaacgacggatagt

SEQ ID NO: 322529 - DNA, 75 bp, Artificial Sequence
  Synthetic
gggaaaatcattccagagtggtgctgccggagctgcaccatgccccctgttagtttctggggaccagatgggtgc

SEQ ID NO: 322530 - DNA, 75 bp, Artificial Sequence
  Synthetic
tggtactcaatggaagtaagaccaaaacacaccaatgagggtcacttggtgaaatcttgggttgtggcctccaag

SEQ ID NO: 322531 - DNA, 75 bp, Artificial Sequence
  Synthetic
ggcgatgttgatcctttctctttgggactcctcatgctttttctttgtagtgacatgttcctgatgaagaggttt

SEQ ID NO: 322532 - DNA, 75 bp, Artificial Sequence
  Synthetic
tcgatgcgtgctctcattgctgggagcatcatcatgctgggagccatgacattaggaagcttgacatatcttgac

SEQ ID NO: 322533 - DNA, 75 bp, Artificial Sequence
  Synthetic
ctcttacgctatgtggtcacggttgggatgtacatggctgaagccaatagtggaggagatgtgacacacctggct

SEQ ID NO: 322534 - DNA, 75 bp, Artificial Sequence
  Synthetic
ctcatagcggtttttcgggtgcgggctggctttgttagcgtgctggccctaaaacaaatgtggagccctagagag

SEQ ID NO: 322535 - DNA, 75 bp, Artificial Sequence
  Synthetic
agatttgtcgcagcttgtggaatagttatggttcagatagcactgggagacatcatgaatactaatctcatggag

SEQ ID NO: 322536 - DNA, 75 bp, Artificial Sequence
  Synthetic
tggctgaatgcagctggcatgtcaatactcgtcatcaagtcaatagtcgatccgagaaagtgcaatgtggtgctc

SEQ ID NO: 322537 - DNA, 75 bp, Artificial Sequence
  Synthetic
cctttactctgtcttctcacaccacttacgacgacagaaattcaaagggctgtgatgctattctgttctgtggtc

SEQ ID NO: 322538 - DNA, 75 bp, Artificial Sequence
  Synthetic
atttccgtgaccgtactgcaaaccgacagcgtctcaacaagaaagtctatccctcttatagccttgaccatttgt

SEQ ID NO: 322539 - DNA, 75 bp, Artificial Sequence
  Synthetic
tcattctttaaatggacaagccctttccttggcctggtgtgttacttagcttttacacgcattccccagcgctca

SEQ ID NO: 322540 - DNA, 75 bp, Artificial Sequence
  Synthetic
tggccattgggagaaacgatggctgccgtgggactggtaggagtattggctggaatgggtttgaaagacatgaat

SEQ ID NO: 322541 - DNA, 75 bp, Artificial Sequence
  Synthetic
gggatgctaggtccggttgcagtgggaggagtcctgctcatcgtcatgagcttatcagggaaggtggatggcctg

SEQ ID NO: 322542 - DNA, 75 bp, Artificial Sequence
  Synthetic
gtgataaaaaagatatcagatatcggctgggacgaagacgctgagataagtggagcctctcatagatatgatgtt

SEQ ID NO: 322543 - DNA, 75 bp, Artificial Sequence
  Synthetic
gagcagacagaaactggagaattcaaaataagaaatgaagaacccgctccatggacccaggtgatgattttaaca

SEQ ID NO: 322544 - DNA, 75 bp, Artificial Sequence
  Synthetic
atagccattgtcagtgcagcagttcacccagcatgtctagctgtggttactcttggatggttcttctggcagaag

SEQ ID NO: 322545 - DNA, 75 bp, Artificial Sequence
  Synthetic
acagccacacgcagcggtgttctctgggatatccctactgtagttccaccagaagaggtaggttaccttgaagat

SEQ ID NO: 322546 - DNA, 75 bp, Artificial Sequence
  Synthetic
ggggtatacaccataaaccagaaaaacgtccttgggatggcacagaagggtgttggagtggttaaagatggagtg

SEQ ID NO: 322547 - DNA, 75 bp, Artificial Sequence
  Synthetic
ttccataccatgtggcatgtgacaaggggagcctttttgctgtttgagggcaaaaggctgacgccagcatgggcg

SEQ ID NO: 322548 - DNA, 75 bp, Artificial Sequence
  Synthetic
aatgtcaaagaggacctgatctcatatggtggaggctggaaactggaagctaaatgggatggaacagaggaggta

SEQ ID NO: 322549 - DNA, 75 bp, Artificial Sequence
  Synthetic
caactaatagcagtggccccagggaagaatcccatgaacatccaaactacgccaagcattttccaactcaccaat

SEQ ID NO: 322550 - DNA, 75 bp, Artificial Sequence
  Synthetic
ggtaaagagataggagctgtaaatttggacttccctagtggaacttctgggtccccaatcgttaataaaaacggt

SEQ ID NO: 322551 - DNA, 75 bp, Artificial Sequence
  Synthetic
gaagtcatcgggttgtatggaaatggaatcctgatagggaacaacacatacgtttccgccataacccaaagtgaa

SEQ ID NO: 322552 - DNA, 75 bp, Artificial Sequence
  Synthetic
agctccctggaacaagacaatgaccaactacaagacatacccaacatgctcagaaaaggaatgctgacagtgttg

SEQ ID NO: 322553 - DNA, 75 bp, Artificial Sequence
  Synthetic
gatttccatcccggggctggcaaaacacgcgtctatctgccgcaaatactgaaagagtgcgaacgattgagattg

SEQ ID NO: 322554 - DNA, 75 bp, Artificial Sequence
  Synthetic
aaaacccttgtgttggcccccacccgggtagtcctcagtgaaatgaaggaagccatgcctaaaatgagcatcaaa

SEQ ID NO: 322555 - DNA, 75 bp, Artificial Sequence
  Synthetic
ttccacacccaagcattttcaaacactgctacaggaaaagaaatcattgatgcaatgtgtcatgctacgttaacc

SEQ ID NO: 322556 - DNA, 75 bp, Artificial Sequence
  Synthetic
catagaatgttggagcctactcgggtgactaactgggaagtagttatcatggatgaagcccactttatggaccca

SEQ ID NO: 322557 - DNA, 75 bp, Artificial Sequence
  Synthetic
gctagcattgccgcaagaggatgggcagcacatagatcaagagcgagggaatgtgccaccatcttcatgtctgct

SEQ ID NO: 322558 - DNA, 75 bp, Artificial Sequence
  Synthetic
acacctcctggaaccagcaatgaattccctgagtccaatggaaccatagaggacattaggaaagatattccctca

SEQ ID NO: 322559 - DNA, 75 bp, Artificial Sequence
  Synthetic
gaaccatggacgaaagggcatgaatggattcttgaagacaggagaccaacggcttggtttctgccttctatcaga

SEQ ID NO: 322560 - DNA, 75 bp, Artificial Sequence
  Synthetic
gtggccaactcaattgccaattgtctccgcaaagccgagagaacggttgtggttctcaatagaaagacattcgag

SEQ ID NO: 322561 - DNA, 75 bp, Artificial Sequence
  Synthetic
aaggaatatccaacaataaaatcaaaaagaccagactttattttagctactgacatagccgagatgggtgctaat

SEQ ID NO: 322562 - DNA, 75 bp, Artificial Sequence
  Synthetic
ctgagagttgaaagggtcattgactgccgaacagcttacaaaccattcttggttgacgatggaacgaaggtcatg

SEQ ID NO: 322563 - DNA, 75 bp, Artificial Sequence
  Synthetic
gtgaaaggacccttgaagatatcagcgtcatcagcggcccagaggagaggcagagtcggtagggatcccaaccgt

SEQ ID NO: 322564 - DNA, 75 bp, Artificial Sequence
  Synthetic
gatactgacacctatgtttatggcgattcaacaacagaggacaatggacactatgtttgctggacagaaggctct

SEQ ID NO: 322565 - DNA, 75 bp, Artificial Sequence
  Synthetic
atgttgctagacaacatggagataaagaatggaatgattgccccactctatggcatagagggtaccaagacaacc

SEQ ID NO: 322566 - DNA, 75 bp, Artificial Sequence
  Synthetic
actgtcccgggtgagaccagattgcgagatgaacaacgtaaagtgttccgtgaactggtaaagagacttgacatg

SEQ ID NO: 322567 - DNA, 75 bp, Artificial Sequence
  Synthetic
cctgtttggctatcatggcatgttgcaaaagctggacttaaagttcaagatagatcatggtgctttgatggagag

SEQ ID NO: 322568 - DNA, 75 bp, Artificial Sequence
  Synthetic
gatgacaataccttgttaaatgacaatggcgagccaatatttgcccgcagtccaggaggaggaaagaaaccactg

SEQ ID NO: 322569 - DNA, 75 bp, Artificial Sequence
  Synthetic
aaaccacgttgggttgacaccagagtatgcagtgacaactcagccctaatagacttcatcaagttcgctgagggg

SEQ ID NO: 322570 - DNA, 75 bp, Artificial Sequence
  Synthetic
agaagatccatcaatgggttattaattgggctgcaaggctttccaaaatacctgtcaggaagaatgaaagaggct

SEQ ID NO: 322571 - DNA, 75 bp, Artificial Sequence
  Synthetic
gttgacacgctcacagtactgtacaacagtgaagctggaagtcgtgcttataaacacgccctagccatgatgcct

SEQ ID NO: 322572 - DNA, 75 bp, Artificial Sequence
  Synthetic
gaagctgttaccatttttctcttaatcatgctgaccattatttgcacctcaggcattgtcatgttctttttggca

SEQ ID NO: 322573 - DNA, 75 bp, Artificial Sequence
  Synthetic
cccaaagggctcagccgcatgtcgatggcaatgatgaccatgttggtgtctgcttacttgatgtctttgggaggt

SEQ ID NO: 322574 - DNA, 75 bp, Artificial Sequence
  Synthetic
atgaacccagtgcaggtgtcctgtgtaatgctggtattcttcatattcatggtggtgttgatacctgaaccaggg

SEQ ID NO: 322575 - DNA, 75 bp, Artificial Sequence
  Synthetic
acacagcgatcaacatatgacaaccagctcatctatctgcttgttggagtgatgagtgtcatcctcatggtcaca

SEQ ID NO: 322576 - DNA, 75 bp, Artificial Sequence
  Synthetic
aaagtcatgcgaccggggaccaggaggcctaactttcatggacatcatatccaggcgtaccagagaggatccgga

SEQ ID NO: 322577 - DNA, 75 bp, Artificial Sequence
  Synthetic
gccaatgagatgggtatgctggaaaaaaccaagagagacatctttggcacaaccgtcgtggaagagggaaagaag

SEQ ID NO: 322578 - DNA, 75 bp, Artificial Sequence
  Synthetic
tggacctttccagaactagacctccatccgggggcagcttggacggtatacgttggcttagtcacgctagtgact

SEQ ID NO: 322579 - DNA, 75 bp, Artificial Sequence
  Synthetic
cccatgttgcaccattggattaaagttgattatggcaatatctccctgtcaggcatcacccaaaatgcccaagtg

SEQ ID NO: 322580 - DNA, 75 bp, Artificial Sequence
  Synthetic
ttagggttgatggacaaaggaattccatttatcaaaatgaacatgtctgtcgtcatactcttgctgagtgcttgg

SEQ ID NO: 322581 - DNA, 75 bp, Artificial Sequence
  Synthetic
aatggaataacactgcttcccctgtttgcaggaatgggagctgcagccctgcactggggatttatcctaccagga

SEQ ID NO: 322582 - DNA, 75 bp, Artificial Sequence
  Synthetic
ctgcgtgcccaagctgccaaggccgctcaaaaaagagtgtaccatggagtggcgaagaatcctgtggtcgatgga

SEQ ID NO: 322583 - DNA, 75 bp, Artificial Sequence
  Synthetic
aatccaactgctgacatcgacgatgctcccggcatgcccgccatgtatgaaaagaagttggccttgataattctc

SEQ ID NO: 322584 - DNA, 75 bp, Artificial Sequence
  Synthetic
ttcattctggccacggtaaacttgatcctcactagaacgcctttctccattgcagagttggtggtgttgggctcg

SEQ ID NO: 322585 - DNA, 75 bp, Artificial Sequence
  Synthetic
gcagccttaggacctttgttggaaggaaatacaaatgcatactggaatgggccgattgctgtagcattcactggg

SEQ ID NO: 322586 - DNA, 75 bp, Artificial Sequence
  Synthetic
ctgatgagaggcaattattatgcgaccattggcttgatgtacaatggatggctagcaaaacagaccaggagagga

SEQ ID NO: 322587 - DNA, 75 bp, Artificial Sequence
  Synthetic
agggctgcaggagttactcttggtgaagtgtggaaaaggcagctaaacatgatggggaaacaagagtttgaaaaa

SEQ ID NO: 322588 - DNA, 75 bp, Artificial Sequence
  Synthetic
tacaagatatcagacatcatggaggtggatagatcagtggctcagagatacctgaaggaaggtaggaatgatgtt

SEQ ID NO: 322589 - DNA, 75 bp, Artificial Sequence
  Synthetic
ggcatcagtgtttctagggggactgcaaaaatgagatggcttcatgaacggggttatgtgaaattgtcaggaaga

SEQ ID NO: 322590 - DNA, 75 bp, Artificial Sequence
  Synthetic
ctttggtagacagactgacacaaaataagtgaccagaatgggactaaaccacctactatatgtaaaaccgggata

SEQ ID NO: 322591 - DNA, 75 bp, Artificial Sequence
  Synthetic
gtaattgacctggggtgtggacgaggtggctggagctattattcggctgcgcaaaaagaagtcatgagcgtcaaa

SEQ ID NO: 322592 - DNA, 75 bp, Artificial Sequence
  Synthetic
aaaaccacggagaggaccggacctctcactatgtaaaaccggtatacaaaccaaaacagacaggaccggacctgc

SEQ ID NO: 322593 - DNA, 75 bp, Artificial Sequence
  Synthetic
ggttacacgctgggaatcaatggacatgaaaaacccgtgcacatgcaaaccctaggctggaacattatcaaattc

SEQ ID NO: 322594 - DNA, 75 bp, Artificial Sequence
  Synthetic
ctgatgtcagcccgtcataatgacgccatggctaagctgtgaggccatgctggctgggatagccgcgaccacccg

SEQ ID NO: 322595 - DNA, 75 bp, Artificial Sequence
  Synthetic
aaggataaatctgatgtcttcaccatgccagctgaaccatgtgagacacttctttgtgacataggggaatcatca

SEQ ID NO: 322596 - DNA, 75 bp, Artificial Sequence
  Synthetic
cgtaatggggttcctggattgctcgatccggggtaaaaaatttttagggagcctccgcctgctgcgtccgcgcgc

SEQ ID NO: 322597 - DNA, 75 bp, Artificial Sequence
  Synthetic
tcaaattttcttattgaaaaagatagaactctcaaagtcctggaaaattttgaaaggtggaaacacgtcaatact

SEQ ID NO: 322598 - DNA, 75 bp, Artificial Sequence
  Synthetic
agcaggaaagaaggggtctagaggttagaggagaccctcccgagcactatagcggaccatattgacgcctgggaa

SEQ ID NO: 322599 - DNA, 75 bp, Artificial Sequence
  Synthetic
gagaacttctgtgttaaagtcttgtgcccttaccatccggacgtgattgaaaaattagaaaggatgcaactcaga

SEQ ID NO: 322600 - DNA, 75 bp, Artificial Sequence
  Synthetic
agaccggagacactccttgattctcacctttctcacccttaagcacagattgcttgaatgcagggtggggaagtt

SEQ ID NO: 322601 - DNA, 75 bp, Artificial Sequence
  Synthetic
tttggaggaggattggtgaggatcccattttcacgtaactcgacccatgaaatgtattacatatctggggctagg

SEQ ID NO: 322602 - DNA, 75 bp, Artificial Sequence
  Synthetic
gattctcacctttctcacccttaagcacagattgcttgaatgcagggtggggaagttgggaaccaactagtgtct

SEQ ID NO: 322603 - DNA, 75 bp, Artificial Sequence
  Synthetic
aacaacatcactcatatggttaacaccacctccagaagtctattgagaagaatgttcaggcctacgggcaaagct

SEQ ID NO: 322604 - DNA, 75 bp, Artificial Sequence
  Synthetic
ttagtggagagtgatgtcttccttcccacaggcaccaggagtgtcgcgagtgaagccggacctgttgatcatgat

SEQ ID NO: 322605 - DNA, 75 bp, Artificial Sequence
  Synthetic
gcgttacaattgagggttgaccagataaagcatgaatacagcaaaacctggaccattgatttgaaccacccatat

SEQ ID NO: 322606 - DNA, 75 bp, Artificial Sequence
  Synthetic
cggacttggcattacttgggtagctacttgtgtaaagccactggcagttcttcatccatgctgaatggcattgtt

SEQ ID NO: 322607 - DNA, 75 bp, Artificial Sequence
  Synthetic
aaaatgctatccatgccttgggacaagtttgaatccgtgacattactggctatgactgatacaaccccctttgga

SEQ ID NO: 322608 - DNA, 75 bp, Artificial Sequence
  Synthetic
caacagcgcgtcttcaaagagaaggttgacacaagagccccttctccaccacctggcaccagagccatcatgaga

SEQ ID NO: 322609 - DNA, 75 bp, Artificial Sequence
  Synthetic
gttgtcaactcctggctgtttaaacacctggctagagagatgcgacctaggatctgcacaaaagaagagttcatt

SEQ ID NO: 322610 - DNA, 75 bp, Artificial Sequence
  Synthetic
tccaaggtcaggagtcatgctgcaattggtgcatacttggaagaacatgaaaattggagaagcgctagcgaagct

SEQ ID NO: 322611 - DNA, 75 bp, Artificial Sequence
  Synthetic
gtccaagacccacggttttggaagcttgtggatgaagaacggaaactccacctacaaggcaaatgcaggacctgt

SEQ ID NO: 322612 - DNA, 75 bp, Artificial Sequence
  Synthetic
gtttacaacatgatgggcaagagagagaaaaaacctgctgagttcggaaaagccaaaggaagtagagccatctgg

SEQ ID NO: 322613 - DNA, 75 bp, Artificial Sequence
  Synthetic
tacatgtggcttggagcccggttcctggagtttgaagccctcggttttctgaatgaagatcattgggtgtcaaga

SEQ ID NO: 322614 - DNA, 75 bp, Artificial Sequence
  Synthetic
ggcaactccggtggaggggttgaaggaacaggcctgcagtacctagggtacatcctgaaaagacttggcgaaaaa

SEQ ID NO: 322615 - DNA, 75 bp, Artificial Sequence
  Synthetic
cctggagggcgtatgtatgcagatgacacagctggatgggacacgcgcataacagaagaggacttagaagatgaa

SEQ ID NO: 322616 - DNA, 75 bp, Artificial Sequence
  Synthetic
caggaaattttaaagtatatgacaaaagatcataaaaaactggcctgggcggtcaccgagctggcatacaagaac

SEQ ID NO: 322617 - DNA, 75 bp, Artificial Sequence
  Synthetic
aagatcataaaaaactggcctgggcggtcaccgagctggcatacaagaacaaagttgtcaaagtcatgcgaccgg

SEQ ID NO: 322618 - DNA, 75 bp, Artificial Sequence
  Synthetic
aaagttgtcaaagtcatgcgaccgggaccaggaggcctaactttcatggacatcatatccaggcgtgaccagaga

SEQ ID NO: 322619 - DNA, 75 bp, Artificial Sequence
  Synthetic
ggatccggacaagtcgtgacatatgctctgaacacagtaacaaacttgaaggttcaactcatccgcatggcagag

SEQ ID NO: 322620 - DNA, 75 bp, Artificial Sequence
  Synthetic
tcagagcacgtcatcacaagacatgatgtggaatcggtgagtccaagcaccttgcgcggcctagaagactggctg

SEQ ID NO: 322621 - DNA, 75 bp, Artificial Sequence
  Synthetic
gaaagatttggaactgatagattgtccagaatggctgtgagtggtgacgactgcgtggtgaagcccattgatgac

SEQ ID NO: 322622 - DNA, 75 bp, Artificial Sequence
  Synthetic
cagtttgcagacgctttgtaccacctgaatgccatgtccaagatcaggaaagacatagatgactggaaaccatca

SEQ ID NO: 322623 - DNA, 75 bp, Artificial Sequence
  Synthetic
actggctgggattcatgggaggcagtaccattctgctcccaccactttcatgagataatcttgaaagacgggaga

SEQ ID NO: 322624 - DNA, 75 bp, Artificial Sequence
  Synthetic
accatcatagctccatgccgggaccaagatgagctaataggaagagcccgtgtgtcaccaggaaatgggtggatg

SEQ ID NO: 322625 - DNA, 75 bp, Artificial Sequence
  Synthetic
ataagggaaacggcatgtcttagcaaggcatatgctcagatgtggttattgatgtactttcacagaagagatttg

SEQ ID NO: 322626 - DNA, 75 bp, Artificial Sequence
  Synthetic
agggtgatggggaatgccatttgctcagccgtccctgttgattgggtgcctactgggagaaccacttggtctata

SEQ ID NO: 322627 - DNA, 75 bp, Artificial Sequence
  Synthetic
catggaaaaggggaatggatgactacagaaaacatgttagatgtgtggaaccgggtgtggatcatggagaatcct

SEQ ID NO: 322628 - DNA, 75 bp, Artificial Sequence
  Synthetic
tatcaggctgacaagacccctgtcactgagtggagagatgttccctacctgcccaagtctattgacaaaacctgc

SEQ ID NO: 322629 - DNA, 75 bp, Artificial Sequence
  Synthetic
aactcattggtcggaacaacacaacgtgccacctgggcgcgtgatgtgaagcatactgttcaccgcatccggaag

SEQ ID NO: 322630 - DNA, 75 bp, Artificial Sequence
  Synthetic
ttggttggaaatgagaaattctatgattatatgtctaccatggaccgatatagagagctagacgaagaaggtcca

SEQ ID NO: 322631 - DNA, 75 bp, Artificial Sequence
  Synthetic
ttctatgattatatgtctaccatggaccgatatagagagctagacgaagaaggtccaggagaaatcctttggtag

SEQ ID NO: 322632 - DNA, 75 bp, Artificial Sequence
  Synthetic
agtatattctgcgtgctaatcgttcaacgttagtccgtggagtgagcttctgttaagttgttaacacgtttgaat

SEQ ID NO: 322633 - DNA, 75 bp, Artificial Sequence
  Synthetic
tgttaagttgttaacacgtttgaataatttctactgaaagggtagagaaaaggagttttgcttctcatggcaaca

SEQ ID NO: 322634 - DNA, 75 bp, Artificial Sequence
  Synthetic
ccacaaagaggcccaaatatggaaaaaatccttaaaaaacaaccaccaacaacgtcgaatttgacgattcgtcag

SEQ ID NO: 322635 - DNA, 75 bp, Artificial Sequence
  Synthetic
aaatccttaaaaaacaaccaccaacaacgtcgaatttgacgattcgtcagttggaaaggttggattgtagcctct

SEQ ID NO: 322636 - DNA, 75 bp, Artificial Sequence
  Synthetic
aacgtcgaatttgacgattcgtcagttggaaaggttggattgtagcctctttgatgcacaaataccaacttacat

SEQ ID NO: 322637 - DNA, 75 bp, Artificial Sequence
  Synthetic
gacattgatataatgacagcaggcattgaggaaggaatgtcagggtcttcaatcaatccttttgagactattcca

SEQ ID NO: 322638 - DNA, 75 bp, Artificial Sequence
  Synthetic
ttgaggaaggaatgtcagggtcttcaatcaatccttttgagactattccagcaaacaacctgacattattcaaac

SEQ ID NO: 322639 - DNA, 75 bp, Artificial Sequence
  Synthetic
ccacaccactgaccggaaattcattgaggtgtttggagttcttgagaacagagctgatgatgcagattaccagtc

SEQ ID NO: 322640 - DNA, 75 bp, Artificial Sequence
  Synthetic
gaggtgtttggagttcttgagaacagagctgatgatgcagattaccagtctccagacatgattatagaaacagaa

SEQ ID NO: 322641 - DNA, 75 bp, Artificial Sequence
  Synthetic
tcacgaccacgatgggggaccacaacactgccttcattgcagctttaaacaaaatagcaaagtacgagatagctt

SEQ ID NO: 322642 - DNA, 75 bp, Artificial Sequence
  Synthetic
cactgccttcattgcagctttaaacaaaatagcaaagtacgagatagcttgtcttaatcggtctgctacaaagcc

SEQ ID NO: 322643 - DNA, 75 bp, Artificial Sequence
  Synthetic
cattttaatggagttgtcacaaacttagaactgactgatgaagaagttaatgaaattgtattcaggttcagatta

SEQ ID NO: 322644 - DNA, 75 bp, Artificial Sequence
  Synthetic
tagaactgactgatgaagaagttaatgaaattgtattcaggttcagattagccagagacatttatgaagaactga

SEQ ID NO: 322645 - DNA, 75 bp, Artificial Sequence
  Synthetic
ctctgatgaaactgtaagtaagttagaaagagagatcaacagtattatgtcttccataaaaatcgactgggaaaa

SEQ ID NO: 322646 - DNA, 75 bp, Artificial Sequence
  Synthetic
gaaagagagatcaacagtattatgtcttccataaaaatcgactgggaaaagacagagtcaaaatttccaagtttt

SEQ ID NO: 322647 - DNA, 75 bp, Artificial Sequence
  Synthetic
gacaaactgaagttgatgaggattacatatcaaagataatctcaaaatgcactagcaaggcattggaagaaatac

SEQ ID NO: 322648 - DNA, 75 bp, Artificial Sequence
  Synthetic
catatcaaagataatctcaaaatgcactagcaaggcattggaagaaatacaagaagagaattatcacaatgagga

SEQ ID NO: 322649 - DNA, 75 bp, Artificial Sequence
  Synthetic
aggaacaagtcaaagaccaaagcaagaattctaaacaaaattgcagagatgatggctgtagattttctaagggac

SEQ ID NO: 322650 - DNA, 75 bp, Artificial Sequence
  Synthetic
gaattctaaacaaaattgcagagatgatggctgtagattttctaagggacattgatgatcataagtcaacaattc

SEQ ID NO: 322651 - DNA, 75 bp, Artificial Sequence
  Synthetic
gggcccaaaaggcaaagacttgaaccccctgaaatctgtaaatgtgagtggaggtcaccctatggccttaatatg

SEQ ID NO: 322652 - DNA, 75 bp, Artificial Sequence
  Synthetic
cccctgaaatctgtaaatgtgagtggaggtcaccctatggccttaatatggtataaggtcgccacaagtgccgtt

SEQ ID NO: 322653 - DNA, 75 bp, Artificial Sequence
  Synthetic
atgatccagaggcggaactgcagtatgctctatcaggcaatctagagaggtctgttgagagaaataaatatcata

SEQ ID NO: 322654 - DNA, 75 bp, Artificial Sequence
  Synthetic
tgctctatcaggcaatctagagaggtctgttgagagaaataaatatcatagaacatctataatcctgaacagaga

SEQ ID NO: 322655 - DNA, 75 bp, Artificial Sequence
  Synthetic
ggtgtttgtgggaagaaaaattctcatctgacaaaagttcaagatgcaaggacacggagcaagaaaggattctct

SEQ ID NO: 322656 - DNA, 75 bp, Artificial Sequence
  Synthetic
atctgacaaaagttcaagatgcaaggacacggagcaagaaaggattctctatagaacatgacatctcaaggataa

SEQ ID NO: 322657 - DNA, 75 bp, Artificial Sequence
  Synthetic
aaaagacttcaccgtgacagatggcctttatgcacctatacgagaagactttgacctgagactacaggcattggc

SEQ ID NO: 322658 - DNA, 75 bp, Artificial Sequence
  Synthetic
ctttatgcacctatacgagaagactttgacctgagactacaggcattggcaactcatcagccgggactggtgtac

SEQ ID NO: 322659 - DNA, 75 bp, Artificial Sequence
  Synthetic
tgatgtgtcatgataaattctcaagaactccaattggctcttggctacagatggtttcagtgattggtgctgagc

SEQ ID NO: 322660 - DNA, 75 bp, Artificial Sequence
  Synthetic
aactccaattggctcttggctacagatggtttcagtgattggtgctgagctatcagcctcagtaaagcaacatgt

SEQ ID NO: 322661 - DNA, 75 bp, Artificial Sequence
  Synthetic
cgactgcttaattctgggatttacctcttgatcaaaccaacttcatcaaaaggccacatctttgtctcaatagca

SEQ ID NO: 322662 - DNA, 75 bp, Artificial Sequence
  Synthetic
tcttgatcaaaccaacttcatcaaaaggccacatctttgtctcaatagcagttgataaagagtacttagaaggag

SEQ ID NO: 322663 - DNA, 75 bp, Artificial Sequence
  Synthetic
gactgctatagatgctggtggcttattggtcactgactttgtctctttcaagctaagcaagattactaatctgtg

SEQ ID NO: 322664 - DNA, 75 bp, Artificial Sequence
  Synthetic
ttggtcactgactttgtctctttcaagctaagcaagattactaatctgtgtaaatgcttctcagttatggaagca

SEQ ID NO: 322665 - DNA, 75 bp, Artificial Sequence
  Synthetic
gcggcatagaaccatggatgatgatggatgaaatgacaaccacacaggctcgagaggcaatcagcatgtttaaat

SEQ ID NO: 322666 - DNA, 75 bp, Artificial Sequence
  Synthetic
ggatgaaatgacaaccacacaggctcgagaggcaatcagcatgtttaaattatctcttatgaccactcttgaaga

SEQ ID NO: 322667 - DNA, 75 bp, Artificial Sequence
  Synthetic
accatgcaaagatatatcatcatggaaggcttcgtatcactccctgaactccctaacccctccaagatgttgtca

SEQ ID NO: 322668 - DNA, 75 bp, Artificial Sequence
  Synthetic
aaggcttcgtatcactccctgaactccctaacccctccaagatgttgtcaaagctaccaaaggtgcttcgctcag

SEQ ID NO: 322669 - DNA, 75 bp, Artificial Sequence
  Synthetic
ccagtttgactcaatgatgaggatctctgagtcaccctttgggattgtaaagtctaatggacagataaagtggaa

SEQ ID NO: 322670 - DNA, 75 bp, Artificial Sequence
  Synthetic
tctgagtcaccctttgggattgtaaagtctaatggacagataaagtggaaaaatctgtttaatccatacacagga

SEQ ID NO: 322671 - DNA, 75 bp, Artificial Sequence
  Synthetic
tcataagttgctgctacaatggatattttaaaaataaagaggaagaaacagaaccatcagcactatctgccatgt

SEQ ID NO: 322672 - DNA, 75 bp, Artificial Sequence
  Synthetic
ttttaaaaataaagaggaagaaacagaaccatcagcactatctgccatgtacaagaaaatcatcgagttggaaca

SEQ ID NO: 322673 - DNA, 75 bp, Artificial Sequence
  Synthetic
ttgggttatggagaccctttagagccagcgatgcatgagttcagcagaagctatctaaaattaatttgccaacat

SEQ ID NO: 322674 - DNA, 75 bp, Artificial Sequence
  Synthetic
cagcgatgcatgagttcagcagaagctatctaaaattaatttgccaacatgcaaaggctaaactaaagaaacagt

SEQ ID NO: 322675 - DNA, 75 bp, Artificial Sequence
  Synthetic
cgaaaattcaataataagagaggtatcccatgttactttagaacgacttgcaacactcaaagctaccagcaactt

SEQ ID NO: 322676 - DNA, 75 bp, Artificial Sequence
  Synthetic
tcccatgttactttagaacgacttgcaacactcaaagctaccagcaacttcaataagaattggtatgtatacaaa

SEQ ID NO: 322677 - DNA, 75 bp, Artificial Sequence
  Synthetic
gggataaacttctggtcaagatgactgaatttgcaaacagaggaaaaacactggctattgagatgtttgatgagt

SEQ ID NO: 322678 - DNA, 75 bp, Artificial Sequence
  Synthetic
tgaatttgcaaacagaggaaaaacactggctattgagatgtttgatgagtccatgaccagagttgaaaataaagg

SEQ ID NO: 322679 - DNA, 75 bp, Artificial Sequence
  Synthetic
aagcaacagcatggagggctgagagaaatttatgttatgggagcagatgagagaattgtacagtcaatcatagag

SEQ ID NO: 322680 - DNA, 75 bp, Artificial Sequence
  Synthetic
aaatttatgttatgggagcagatgagagaattgtacagtcaatcatagaggccatctctagagctattggcagat

SEQ ID NO: 322681 - DNA, 75 bp, Artificial Sequence
  Synthetic
cccttcaaataagacccgaattccagagacccatggccagagagctaaaagaaggtgtggcagatcagtttggac

SEQ ID NO: 322682 - DNA, 75 bp, Artificial Sequence
  Synthetic
gagacccatggccagagagctaaaagaaggtgtggcagatcagtttggaccactgcaacatctgatgatgcaaga

SEQ ID NO: 322683 - DNA, 75 bp, Artificial Sequence
  Synthetic
ccaaatttgctttaatgttgtgtgagttcacaccaagagaatggtggcctttaattattagaggctgctcaatgt

SEQ ID NO: 322684 - DNA, 75 bp, Artificial Sequence
  Synthetic
gttcacaccaagagaatggtggcctttaattattagaggctgctcaatgttcactaacaagttcatgatgatgaa

SEQ ID NO: 322685 - DNA, 75 bp, Artificial Sequence
  Synthetic
ggccacaaagagctggaaatacaagatgattttgtgactgatttgttcaaggcttatcatggagaaaaggaggta

SEQ ID NO: 322686 - DNA, 75 bp, Artificial Sequence
  Synthetic
atgattttgtgactgatttgttcaaggcttatcatggagaaaaggaggtaagctggctggatcaaggtaagacat

SEQ ID NO: 322687 - DNA, 75 bp, Artificial Sequence
  Synthetic
gcaagggatcttgcattttacttcatcaatgttgcactcactccatcaggagttcatcaaaacgaccagtaatca

SEQ ID NO: 322688 - DNA, 75 bp, Artificial Sequence
  Synthetic
tcaatgttgcactcactccatcaggagttcatcaaaacgaccagtaatcaaatattcaccatgaagatggggtct

SEQ ID NO: 322689 - DNA, 75 bp, Artificial Sequence
  Synthetic
acatgatgcagggctctgatgatagtagcatgataataagcttcccaaatgaaaatgaaaagcaaaggctgcgat

SEQ ID NO: 322690 - DNA, 75 bp, Artificial Sequence
  Synthetic
tagcatgataataagcttcccaaatgaaaatgaaaagcaaaggctgcgatacaagctagtagcagccatatgctt

SEQ ID NO: 322691 - DNA, 75 bp, Artificial Sequence
  Synthetic
tatgctggcatatatccttcagaaaagtcaacacctaatacagactttgtcatggaatataactcagagttcttt

SEQ ID NO: 322692 - DNA, 75 bp, Artificial Sequence
  Synthetic
agtcaacacctaatacagactttgtcatggaatataactcagagttcttttttcactcccaacacataagaccaa

SEQ ID NO: 322693 - DNA, 75 bp, Artificial Sequence
  Synthetic
ttcattgccagaggttgagaccttggttgcaagacaagaagaagcagcaaatctgctaacatccataactgaagg

SEQ ID NO: 322694 - DNA, 75 bp, Artificial Sequence
  Synthetic
gttgcaagacaagaagaagcagcaaatctgctaacatccataactgaaggaggaggctcattctctttggctgct

SEQ ID NO: 322695 - DNA, 75 bp, Artificial Sequence
  Synthetic
tccattacatgttaatgggcttaggagttagtgacctctttaaacagtttaaggtcgctatctctaaatggaaag

SEQ ID NO: 322696 - DNA, 75 bp, Artificial Sequence
  Synthetic
agttagtgacctctttaaacagtttaaggtcgctatctctaaatggaaagatcctggtctaggattttttctgtt

SEQ ID NO: 322697 - DNA, 75 bp, Artificial Sequence
  Synthetic
tctggtttcaagtacaatctatatagaaccattctcgactccaatctgaagtatgtgtattcattctttttaaag

SEQ ID NO: 322698 - DNA, 75 bp, Artificial Sequence
  Synthetic
gaaccattctcgactccaatctgaagtatgtgtattcattctttttaaagaaggttaagggtcaaggactagcta

SEQ ID NO: 322699 - DNA, 75 bp, Artificial Sequence
  Synthetic
tagtgtgagcccaggtggtgccattgtgatgagttcaactctacgatggggttcagttgagaagtttaagaggct

SEQ ID NO: 322700 - DNA, 75 bp, Artificial Sequence
  Synthetic
gtgatgagttcaactctacgatggggttcagttgagaagtttaagaggctaagagcaaggctgaacattccagaa

SEQ ID NO: 322701 - DNA, 75 bp, Artificial Sequence
  Synthetic
taccagaaattttatacagagcaccagcaacaggtaaagagataatgcttagaatagcagagaaggtacatagtc

SEQ ID NO: 322702 - DNA, 75 bp, Artificial Sequence
  Synthetic
agcaacaggtaaagagataatgcttagaatagcagagaaggtacatagtccaggtgtagtttcttctttaagtac

SEQ ID NO: 322703 - DNA, 75 bp, Artificial Sequence
  Synthetic
gcctcttcagtctatttcttgtcagcttgcatctttgaagatgctggtaaccaggaatataaagtaacaaatgat

SEQ ID NO: 322704 - DNA, 75 bp, Artificial Sequence
  Synthetic
cttgcatctttgaagatgctggtaaccaggaatataaagtaacaaatgatgataagtacagcttacttcaaaaat

SEQ ID NO: 322705 - DNA, 75 bp, Artificial Sequence
  Synthetic
tggggatgatataagccaagaagacatgctgtttttgtttcccaatcttgaggaatttgaggcttttgactctat

SEQ ID NO: 322706 - DNA, 75 bp, Artificial Sequence
  Synthetic
atgctgtttttgtttcccaatcttgaggaatttgaggcttttgactctattatcttcaataaagggaaattcagt

SEQ ID NO: 322707 - DNA, 75 bp, Artificial Sequence
  Synthetic
aggctacacagacaaggattgttgtttttgagcatcattcatcagcaagggtagccccagagaagttggtcagtg

SEQ ID NO: 322708 - DNA, 75 bp, Artificial Sequence
  Synthetic
ttttgagcatcattcatcagcaagggtagccccagagaagttggtcagtgataagtggtttggcacaagaaagag

SEQ ID NO: 322709 - DNA, 75 bp, Artificial Sequence
  Synthetic
caggagtggtcaagactgaaggctattgtgagatggcttcgtgacactccagaagaaacacttgaagcctctcca

SEQ ID NO: 322710 - DNA, 75 bp, Artificial Sequence
  Synthetic
ttgtgagatggcttcgtgacactccagaagaaacacttgaagcctctccattcaccaatcacatccagataagga

SEQ ID NO: 322711 - DNA, 75 bp, Artificial Sequence
  Synthetic
accaagaatcataagagttactggagcaccagttaaaaaaagatcaggaatgagtaaaatagcaatggccatcag

SEQ ID NO: 322712 - DNA, 75 bp, Artificial Sequence
  Synthetic
gcaccagttaaaaaaagatcaggaatgagtaaaatagcaatggccatcagagacaacttctgcaaaactggatat

SEQ ID NO: 322713 - DNA, 75 bp, Artificial Sequence
  Synthetic
gattcagcagggccatgcagattgagaaaataaaacattatctcttctctatactgatggggccatatactgatg

SEQ ID NO: 322714 - DNA, 75 bp, Artificial Sequence
  Synthetic
gaaaataaaacattatctcttctctatactgatggggccatatactgatgaagctaaattaagacttacttgtga

SEQ ID NO: 322715 - DNA, 75 bp, Artificial Sequence
  Synthetic
gtggttaactacaatgatgtgaagtccagggccaacacaataagcatactacagaaattcatcaagcatgaaact

SEQ ID NO: 322716 - DNA, 75 bp, Artificial Sequence
  Synthetic
ccagggccaacacaataagcatactacagaaattcatcaagcatgaaactggtgttgctaggctcattgaagact

SEQ ID NO: 322717 - DNA, 75 bp, Artificial Sequence
  Synthetic
tgtcaagacacaagcatttagcacctcagtggtcaataataagtattatgggccaggagtctggagaggaatcat

SEQ ID NO: 322718 - DNA, 75 bp, Artificial Sequence
  Synthetic
tcagtggtcaataataagtattatgggccaggagtctggagaggaatcatggatggataccaggttcagattgag

SEQ ID NO: 322719 - DNA, 75 bp, Artificial Sequence
  Synthetic
gttatttgtcaaaaataactattgcccactgcacaaagccctggcttatatcacaatgcataaaagcatggtgtg

SEQ ID NO: 322720 - DNA, 75 bp, Artificial Sequence
  Synthetic
ccactgcacaaagccctggcttatatcacaatgcataaaagcatggtgtgaggacatgaatgtctctaatagtac

SEQ ID NO: 322721 - DNA, 75 bp, Artificial Sequence
  Synthetic
gatgctaactactggatttttcagcacaagatgtatggatcatcgtatccatatggttgcccaatatacctggtt

SEQ ID NO: 322722 - DNA, 75 bp, Artificial Sequence
  Synthetic
acaagatgtatggatcatcgtatccatatggttgcccaatatacctggttaacagtgacattactgagattggac

SEQ ID NO: 322723 - DNA, 75 bp, Artificial Sequence
  Synthetic
taaagtgagaaggaacactataaacttgtatgttaaaagtaaagataaaagaccacgagatttgcatattctgtc

SEQ ID NO: 322724 - DNA, 75 bp, Artificial Sequence
  Synthetic
ttgtatgttaaaagtaaagataaaagaccacgagatttgcatattctgtcatacaccccaagtgactcagacata

SEQ ID NO: 322725 - DNA, 75 bp, Artificial Sequence
  Synthetic
ttaaagatgaatactttagggataaaggagcattttcagttgaaccaacaaggtcctggatgttatgccagtctc

SEQ ID NO: 322726 - DNA, 75 bp, Artificial Sequence
  Synthetic
aggagcattttcagttgaaccaacaaggtcctggatgttatgccagtctctcccatggcgatatgtgccagctgt

SEQ ID NO: 322727 - DNA, 75 bp, Artificial Sequence
  Synthetic
aggtgccccactcagatcaatagatgcaggctatctgagatcattagattatgcactgaatcatccttgcgaaat

SEQ ID NO: 322728 - DNA, 75 bp, Artificial Sequence
  Synthetic
gcaggctatctgagatcattagattatgcactgaatcatccttgcgaaataaagttggcaccatctacagtcaaa

SEQ ID NO: 322729 - DNA, 75 bp, Artificial Sequence
  Synthetic
tgaaccaatagacatgagtgaaatgcttgacatgatgatgatggatgatgaaaatgacatgttcgaagaaatagc

SEQ ID NO: 322730 - DNA, 75 bp, Artificial Sequence
  Synthetic
cttgacatgatgatgatggatgatgaaaatgacatgttcgaagaaatagcaggcaacttgacagtagatgaggat

SEQ ID NO: 322731 - DNA, 75 bp, Artificial Sequence
  Synthetic
ttgaagaggaagacttacagttatttgggccagcacattacaaagaaatgcagagtttgacaatattatctcacc

SEQ ID NO: 322732 - DNA, 75 bp, Artificial Sequence
  Synthetic
tgggccagcacattacaaagaaatgcagagtttgacaatattatctcaccctatgatggatgactttatcataag

SEQ ID NO: 322733 - DNA, 75 bp, Artificial Sequence
  Synthetic
agaatcagaaggttgttggagaaaaactatgtcacaagtaattttaaagatatctccattattttatttaaagcc

SEQ ID NO: 322734 - DNA, 75 bp, Artificial Sequence
  Synthetic
actatgtcacaagtaattttaaagatatctccattattttatttaaagcccttgaacgagacccaaatagcatta

SEQ ID NO: 322735 - DNA, 75 bp, Artificial Sequence
  Synthetic
tcctgtagacatagccgatgatttattaggttaattttcaggtcacactcaagagggcacgtttacaggctagga

SEQ ID NO: 322736 - DNA, 75 bp, Artificial Sequence
  Synthetic
ttaggttaattttcaggtcacactcaagagggcacgtttacaggctaggattagggattactttaaacatataat

SEQ ID NO: 322737 - DNA, 75 bp, Artificial Sequence
  Synthetic
cccgtattgctaaaccagagctaataatagacttctagacagccatgcaatccagagctgtcatcttgaagcata

SEQ ID NO: 322738 - DNA, 75 bp, Artificial Sequence
  Synthetic
tttgcccaggttctacatagactgtgatttggacacctttgattttgagaagggttgctctctgattgagaatga

SEQ ID NO: 322739 - DNA, 75 bp, Artificial Sequence
  Synthetic
ggagtttcctgctgtactggggcctggcatgatcagtgcagttcgaaccagactttacgagccaaccatgagaga

SEQ ID NO: 322740 - DNA, 75 bp, Artificial Sequence
  Synthetic
gctctaccaggaatcgattcaccaactaaagaggaacaacaagaaatatctcttgtctgctctcaggtggcccac

SEQ ID NO: 322741 - DNA, 75 bp, Artificial Sequence
  Synthetic
tatccagagatacctgaaattactggttaaggcctctgggctttacaactccactattgaggagcagatagtgga

SEQ ID NO: 322742 - DNA, 75 bp, Artificial Sequence
  Synthetic
tctatgtgtgctgctaggtcttatgactatttcatgagaactgacttgggatttagagagactgctctttccacc

SEQ ID NO: 322743 - DNA, 75 bp, Artificial Sequence
  Synthetic
actatttcatgagaactgacttgggatttagagagactgctctttccaccttttgggctaaggactggcctaccc

SEQ ID NO: 322744 - DNA, 75 bp, Artificial Sequence
  Synthetic
cccaatcctaattcccctaaccccctggcagctcacttgccaaccttagcgcgatacttctcagcactcctcacc

SEQ ID NO: 322745 - DNA, 75 bp, Artificial Sequence
  Synthetic
tggcagctcacttgccaaccttagcgcgatacttctcagcactcctcaccactgcagacgccagaacaagatcct

SEQ ID NO: 322746 - DNA, 75 bp, Artificial Sequence
  Synthetic
aagaatcgtccactcatggcggccatgttgggcttttcaaatgtggcagccacttcattagcctgttttgttctc

SEQ ID NO: 322747 - DNA, 75 bp, Artificial Sequence
  Synthetic
tgttgggcttttcaaatgtggcagccacttcattagcctgttttgttctcagagatggatttatggtctttgaga

SEQ ID NO: 322748 - DNA, 75 bp, Artificial Sequence
  Synthetic
cacttcattagcctgttttgttctcagagatggatttatggtctttgagaactcaatcatgaatagcccatgagc

SEQ ID NO: 322749 - DNA, 75 bp, Artificial Sequence
  Synthetic
gcatccatggtggtcccagacacaggcagggattctgacaggacacgtagtgcctgaacagtccacggaacaaat

SEQ ID NO: 322750 - DNA, 75 bp, Artificial Sequence
  Synthetic
tggtgtccctgccagggttcccttctttcagctgatagactgaaatcaggttggccacaatagaagcacccttct

SEQ ID NO: 322751 - DNA, 75 bp, Artificial Sequence
  Synthetic
tggcttgtttcccctaacaaggttcagcacaatcatcatcttcacatctttcttccagtccctgccctttgccgt

SEQ ID NO: 322752 - DNA, 75 bp, Artificial Sequence
  Synthetic
agcacaatcatcatcttcacatctttcttccagtccctgccctttgccgttcctctctccttgaccaactgaaca

SEQ ID NO: 322753 - DNA, 75 bp, Artificial Sequence
  Synthetic
atgcgctttgggtcaaacccttgataagcaaactcattcacccatgcattgatggtcccagaatctgcagactca

SEQ ID NO: 322754 - DNA, 75 bp, Artificial Sequence
  Synthetic
aagcaaactcattcacccatgcattgatggtcccagaatctgcagactcatcaagaaaagcaagagcaatatcgc

SEQ ID NO: 322755 - DNA, 75 bp, Artificial Sequence
  Synthetic
taacaatgcaatcatctctggtttttttgaaaccaaagtcttcaaaagacaagaatcggaaatttccaaggttct

SEQ ID NO: 322756 - DNA, 75 bp, Artificial Sequence
  Synthetic
tttgaaaccaaagtcttcaaaagacaagaatcggaaatttccaaggttctatgtcaatgtgaggatgggagagtt

SEQ ID NO: 322757 - DNA, 75 bp, Artificial Sequence
  Synthetic
ctggagagtgaaattccgatatatgtggataaatacaaagttgtgcttgactcaagaccaactctgtcgcatttt

SEQ ID NO: 322758 - DNA, 75 bp, Artificial Sequence
  Synthetic
tggataaatacaaagttgtgcttgactcaagaccaactctgtcgcattttctgtcaaagagggaatttcctgcct

SEQ ID NO: 322759 - DNA, 75 bp, Artificial Sequence
  Synthetic
tcaaagaactaaactgtatgatcccactattcaagagctctttggagaatctattaatagcttgaaaagacatag

SEQ ID NO: 322760 - DNA, 75 bp, Artificial Sequence
  Synthetic
actattcaagagctctttggagaatctattaatagcttgaaaagacatagggttgacttcctcgtatcagccctg

SEQ ID NO: 322761 - DNA, 75 bp, Artificial Sequence
  Synthetic
tagagtttattgagtattatcttgatgatcatattttcctctctgatgaacctgatttagttatgagtaagtatc

SEQ ID NO: 322762 - DNA, 75 bp, Artificial Sequence
  Synthetic
tgatcatattttcctctctgatgaacctgatttagttatgagtaagtatctaaaacttctggtcaaggcatctgg

SEQ ID NO: 322763 - DNA, 75 bp, Artificial Sequence
  Synthetic
cagatagtagaagttcacagaaggacacttttagaaggaatgaagcatggactcacaaaagaggacctacctggg

SEQ ID NO: 322764 - DNA, 75 bp, Artificial Sequence
  Synthetic
cacttttagaaggaatgaagcatggactcacaaaagaggacctacctgggaatgaccttataggagagttgtgtg

SEQ ID NO: 322765 - DNA, 75 bp, Artificial Sequence
  Synthetic
tcatgtggcaaagtctgctcatcggaggattagtgatctgcggtttcacatttatttttctgtcagcccggtaga

SEQ ID NO: 322766 - DNA, 75 bp, Artificial Sequence
  Synthetic
aaggttgatgtgactaagggtttggctaggatgaattgcgaggattcatacaggtacttcttgcataatagtgaa

SEQ ID NO: 322767 - DNA, 75 bp, Artificial Sequence
  Synthetic
ctaggatgaattgcgaggattcatacaggtacttcttgcataatagtgaatcttttagggaagatgccctttcca

SEQ ID NO: 322768 - DNA, 75 bp, Artificial Sequence
  Synthetic
caggtacttcttgcataatagtgaatcttttagggaagatgccctttccacagtgtggacaaaagactggcctac

SEQ ID NO: 322769 - DNA, 75 bp, Artificial Sequence
  Synthetic
aagccctgcagcagcctgcggttgtggctgcccaacccccctacattccccccaatttagaaccccacccaaatc

SEQ ID NO: 322770 - DNA, 75 bp, Artificial Sequence
  Synthetic
ggctgcccaacccccctacattccccccaatttagaaccccacccaaatcaatgaccaattattcacccttaccc

SEQ ID NO: 322771 - DNA, 75 bp, Artificial Sequence
  Synthetic
ttgcccaccttagagcagtacttctcggcacacttaactatggctggtgttagcacaaggtcttcattgagtatc

SEQ ID NO: 322772 - DNA, 75 bp, Artificial Sequence
  Synthetic
cggcacacttaactatggctggtgttagcacaaggtcttcattgagtatcccaacagccattaagagcttctttt

SEQ ID NO: 322773 - DNA, 75 bp, Artificial Sequence
  Synthetic
actcatagcagccatgtttggtttttcaaatgtagccgctatctcattgggctgcttggttctcagagatgggtt

SEQ ID NO: 322774 - DNA, 75 bp, Artificial Sequence
  Synthetic
tcaaatgtagccgctatctcattgggctgcttggttctcagagatgggttgatagtcttagaaaactctagcatg

SEQ ID NO: 322775 - DNA, 75 bp, Artificial Sequence
  Synthetic
cttcaccagccctgttaggaaggtccaggtcaatgataccagcgaagctagggtgcatcatggctctcggataag

SEQ ID NO: 322776 - DNA, 75 bp, Artificial Sequence
  Synthetic
caggtcaatgataccagcgaagctagggtgcatcatggctctcggataagttacaccagcaatagcatccattgt

SEQ ID NO: 322777 - DNA, 75 bp, Artificial Sequence
  Synthetic
gaaagtaccctaagtgcctgaatggtccaaggaacaaaagcagcagagactctagacaatgtgatagtgtctctg

SEQ ID NO: 322778 - DNA, 75 bp, Artificial Sequence
  Synthetic
tccaaggaacaaaagcagcagagactctagacaatgtgatagtgtctctgccagggtttccttccttgagctggt

SEQ ID NO: 322779 - DNA, 75 bp, Artificial Sequence
  Synthetic
tccagcacctttctctgacatcttcttcatcatggcctcaggcttgttgcctctcacaaggttgaggactatcat

SEQ ID NO: 322780 - DNA, 75 bp, Artificial Sequence
  Synthetic
ttcatcatggcctcaggcttgttgcctctcacaaggttgaggactatcatcattttaacgtctttcttccagtct

SEQ ID NO: 322781 - DNA, 75 bp, Artificial Sequence
  Synthetic
tcaccagctggacgatcctctttgggtcgaacccctggtaagcaaactcattcacccaggcagtaatagtgcctg

SEQ ID NO: 322782 - DNA, 75 bp, Artificial Sequence
  Synthetic
aaggctaaggcaatctcacgatagttctcctcagacatgttgttttgtttagttaaataacgggattctttgtgt

SEQ ID NO: 322783 - DNA, 75 bp, Artificial Sequence
  Synthetic
gaatccttaaaaaacaaccagctcctgtaagagcattaaccattcatcccctgaggaggtatgaatcatcaattt

SEQ ID NO: 322784 - DNA, 75 bp, Artificial Sequence
  Synthetic
gatcaagcatagctcagatggtgttaccatagacatagcaacttctgagcttgctgatgggcaatctggatcaac

SEQ ID NO: 322785 - DNA, 75 bp, Artificial Sequence
  Synthetic
accatagacatagcaacttctgagcttgctgatgggcaatctggatcaacgatccaaccttttgagagtgttcct

SEQ ID NO: 322786 - DNA, 75 bp, Artificial Sequence
  Synthetic
atgacttcacttttggacatctagcagacactactgacaagaagtttgttgaagtctttggagttctggagaaca

SEQ ID NO: 322787 - DNA, 75 bp, Artificial Sequence
  Synthetic
agacactactgacaagaagtttgttgaagtctttggagttctggagaacagggctgatgactcagattttcagtc

SEQ ID NO: 322788 - DNA, 75 bp, Artificial Sequence
  Synthetic
actggccatgtctatgttgttgaattcaccacaacaatgggtgatgccaattcagctgacctagctgcgaggaac

SEQ ID NO: 322789 - DNA, 75 bp, Artificial Sequence
  Synthetic
tcaccacaacaatgggtgatgccaattcagctgacctagctgcgaggaacaagattgccaagtatgagatagctt

SEQ ID NO: 322790 - DNA, 75 bp, Artificial Sequence
  Synthetic
gatctctctgtacataattgctgtgcattttaatggggtggtatcaaatcttgatctatcagatgaggaggtcaa

SEQ ID NO: 322791 - DNA, 75 bp, Artificial Sequence
  Synthetic
cattttaatggggtggtatcaaatcttgatctatcagatgaggaggtcaatgagattgtatttagattcaggctg

SEQ ID NO: 322792 - DNA, 75 bp, Artificial Sequence
  Synthetic
gagagatcaacccagcactatttgactcagatgagactgtcagcagactggagagggaggtgaatagtgtcatgt

SEQ ID NO: 322793 - DNA, 75 bp, Artificial Sequence
  Synthetic
ctcagatgagactgtcagcagactggagagggaggtgaatagtgtcatgtctgccatacaaatagattggaagac

SEQ ID NO: 322794 - DNA, 75 bp, Artificial Sequence
  Synthetic
agaaaggagctatttgacaacttcagaagtaaagaggttgatgaagaatacatgtccaagatcattaaggagtgc

SEQ ID NO: 322795 - DNA, 75 bp, Artificial Sequence
  Synthetic
gaagtaaagaggttgatgaagaatacatgtccaagatcattaaggagtgcactgatgaagccttaaaggggattg

SEQ ID NO: 322796 - DNA, 75 bp, Artificial Sequence
  Synthetic
tataaccaacaaagagaggtttgaaatgaactcaaaaagggcaacttctgacataaagaacaagatggcagagat

SEQ ID NO: 322797 - DNA, 75 bp, Artificial Sequence
  Synthetic
atgaactcaaaaagggcaacttctgacataaagaacaagatggcagagatgatgagttatgagttcttaagagat

SEQ ID NO: 322798 - DNA, 75 bp, Artificial Sequence
  Synthetic
agttcccaccctgggtgacaagaactggcccctcagggaaggacctagagtcccttaaatctgtgaatgtggaag

SEQ ID NO: 322799 - DNA, 75 bp, Artificial Sequence
  Synthetic
tggcccctcagggaaggacctagagtcccttaaatctgtgaatgtggaaggttctcatcccatgtgtaagatctg

SEQ ID NO: 322800 - DNA, 75 bp, Artificial Sequence
  Synthetic
atcgagaagatagagagaatgcacgatgatccagtgctagaacttgaatatgctatgtcagggtctacagagcgg

SEQ ID NO: 322801 - DNA, 75 bp, Artificial Sequence
  Synthetic
atgatccagtgctagaacttgaatatgctatgtcagggtctacagagcggtcagttgaaagaaataagtaccacc

SEQ ID NO: 322802 - DNA, 75 bp, Artificial Sequence
  Synthetic
ggaaagagaatatgctgcagtcttaggggtttgtggcaagaaaaacgcaaacctgggagctgtcaaagaggccag

SEQ ID NO: 322803 - DNA, 75 bp, Artificial Sequence
  Synthetic
ggggtttgtggcaagaaaaacgcaaacctgggagctgtcaaagaggccagggtgaggagtaagaaaggcttctct

SEQ ID NO: 322804 - DNA, 75 bp, Artificial Sequence
  Synthetic
aagaattcttgtctgacagctgtgttgacgacctcacccctactgaaggcctttacaacccactctcagaggaca

SEQ ID NO: 322805 - DNA, 75 bp, Artificial Sequence
  Synthetic
tgacgacctcacccctactgaaggcctttacaacccactctcagaggacaaatcattgagactactggctatggg

SEQ ID NO: 322806 - DNA, 75 bp, Artificial Sequence
  Synthetic
atggatgaggaaaatccagagaccctagactgtcatctaaaatttctgagttcaccaattgggagctggctgcaa

SEQ ID NO: 322807 - DNA, 75 bp, Artificial Sequence
  Synthetic
tagactgtcatctaaaatttctgagttcaccaattgggagctggctgcaaatggtttccatcattggcgctgagt

SEQ ID NO: 322808 - DNA, 75 bp, Artificial Sequence
  Synthetic
gaagcccaaccagttcattgtgaagaggctgctggactcggctgtgttcctgctgattaagcccacaacatctaa

SEQ ID NO: 322809 - DNA, 75 bp, Artificial Sequence
  Synthetic
aggctgctggactcggctgtgttcctgctgattaagcccacaacatctaagggccacatatttgtctctcttgct

SEQ ID NO: 322810 - DNA, 75 bp, Artificial Sequence
  Synthetic
agctgagcaagtctagtgtattcaagcagtctattgatgctggtgacctcctggtgaccgactttgtctctttca

SEQ ID NO: 322811 - DNA, 75 bp, Artificial Sequence
  Synthetic
gcagtctattgatgctggtgacctcctggtgaccgactttgtctctttcaagctcagtaagatcactaatctatg

SEQ ID NO: 322812 - DNA, 75 bp, Artificial Sequence
  Synthetic
gcatcttgcttctgggctgagacatacggctttgaaccctggaagtttgtggaccaggcaagtgcagcaaagttc

SEQ ID NO: 322813 - DNA, 75 bp, Artificial Sequence
  Synthetic
acggctttgaaccctggaagtttgtggaccaggcaagtgcagcaaagttctcagatgcttggttcatgatcaagt

SEQ ID NO: 322814 - DNA, 75 bp, Artificial Sequence
  Synthetic
taaagcgacaacagaagagctccagactatgcaaagatatgtgataatggaagggtttgtatcgctcccagaaat

SEQ ID NO: 322815 - DNA, 75 bp, Artificial Sequence
  Synthetic
actatgcaaagatatgtgataatggaagggtttgtatcgctcccagaaatccccaagccccacaagatgttgtca

SEQ ID NO: 322816 - DNA, 75 bp, Artificial Sequence
  Synthetic
agttgcaagtatttcttactcatagattgttcaacacaatgcagaggatttcagccactccattccagcttcata

SEQ ID NO: 322817 - DNA, 75 bp, Artificial Sequence
  Synthetic
attgttcaacacaatgcagaggatttcagccactccattccagcttcataaagttggtggaaatatccgttggaa

SEQ ID NO: 322818 - DNA, 75 bp, Artificial Sequence
  Synthetic
aatagcattgatgagctacaaactttgatcagctgctgctacaatggctacttcaagaacaaggaggaagatact

SEQ ID NO: 322819 - DNA, 75 bp, Artificial Sequence
  Synthetic
tgatcagctgctgctacaatggctacttcaagaacaaggaggaagatactgagccatcggcactatcagccatgt

SEQ ID NO: 322820 - DNA, 75 bp, Artificial Sequence
  Synthetic
tctgcgacctccaactgacaagtacctagggtatgaagacccgactgatcctaagatgcatgagtttagcaggag

SEQ ID NO: 322821 - DNA, 75 bp, Artificial Sequence
  Synthetic
ctagggtatgaagacccgactgatcctaagatgcatgagtttagcaggagctatctaaagctgctatgcaatcat

SEQ ID NO: 322822 - DNA, 75 bp, Artificial Sequence
  Synthetic
atggaagaggagtgatgagccaaattgagagcagtatcgtgagagaggttcaatcaataaccttggagcggctgg

SEQ ID NO: 322823 - DNA, 75 bp, Artificial Sequence
  Synthetic
tgagagcagtatcgtgagagaggttcaatcaataaccttggagcggctggccactctcaaggccaccagcaactt

SEQ ID NO: 322824 - DNA, 75 bp, Artificial Sequence
  Synthetic
gaggtgaaggacaagaactacacaagagataagcttctggttaagatgactaagtttgctcatagagggaagacc

SEQ ID NO: 322825 - DNA, 75 bp, Artificial Sequence
  Synthetic
gagataagcttctggttaagatgactaagtttgctcatagagggaagaccctggccatagaagtgtttgaggagt

SEQ ID NO: 322826 - DNA, 75 bp, Artificial Sequence
  Synthetic
ttgcatggaaatatgcttgttcaaaaagcagcagcatggtggtctcagagagatctatgtcatgggagctgatga

SEQ ID NO: 322827 - DNA, 75 bp, Artificial Sequence
  Synthetic
aagcagcagcatggtggtctcagagagatctatgtcatgggagctgatgagaggatagttcaatctgtaatagaa

SEQ ID NO: 322828 - DNA, 75 bp, Artificial Sequence
  Synthetic
tttttgactctgatactttgtgcaaccctactaacaaaatcaggattccagaaacacatgggcagagagctaaaa

SEQ ID NO: 322829 - DNA, 75 bp, Artificial Sequence
  Synthetic
ccctactaacaaaatcaggattccagaaacacatgggcagagagctaaaagaagatgtggtcggtctgtatggac

SEQ ID NO: 322830 - DNA, 75 bp, Artificial Sequence
  Synthetic
aagtggaatcagggacactatgtgacgaaattcgcactgatgctctgcgagttcacaccccaggaatggtggcct

SEQ ID NO: 322831 - DNA, 75 bp, Artificial Sequence
  Synthetic
cgaaattcgcactgatgctctgcgagttcacaccccaggaatggtggcctttaattattagaggctgctcaatgt

SEQ ID NO: 322832 - DNA, 75 bp, Artificial Sequence
  Synthetic
tcttgacttcttgaggataattgatagccacaaagaactacagatagaagatgaatttgtgagcaagctgttcaa

SEQ ID NO: 322833 - DNA, 75 bp, Artificial Sequence
  Synthetic
agccacaaagaactacagatagaagatgaatttgtgagcaagctgttcaaagcctaccatggagaaagtgttgag

SEQ ID NO: 322834 - DNA, 75 bp, Artificial Sequence
  Synthetic
acctcaaaacaagcactgggatgatgcaagggattctacacttcacctcctccttgttacactctctacatcagg

SEQ ID NO: 322835 - DNA, 75 bp, Artificial Sequence
  Synthetic
gcaagggattctacacttcacctcctccttgttacactctctacatcaggagtttgtaaagaccacggctattca

SEQ ID NO: 322836 - DNA, 75 bp, Artificial Sequence
  Synthetic
gatgcttcctcaaaagtggtgtgtgatatgatgcaaggctcagatgatagcagcatgatcattagcttccctgct

SEQ ID NO: 322837 - DNA, 75 bp, Artificial Sequence
  Synthetic
atatgatgcaaggctcagatgatagcagcatgatcattagcttccctgctgatagtgagaaagttaagatgaggt

SEQ ID NO: 322838 - DNA, 75 bp, Artificial Sequence
  Synthetic
caggattaagaagagtcttggcatttacattggcatctatccatcagaaaagtccactcctaacaccgactttgt

SEQ ID NO: 322839 - DNA, 75 bp, Artificial Sequence
  Synthetic
tacattggcatctatccatcagaaaagtccactcctaacaccgactttgtgatggagtacaactcagaattcttc

SEQ ID NO: 322840 - DNA, 75 bp, Artificial Sequence
  Synthetic
ccatcaggtggatagctgcctcctgctcacttcctgaggtggaaaccttagtcgcaagacaggaggaggctgcaa

SEQ ID NO: 322841 - DNA, 75 bp, Artificial Sequence
  Synthetic
ctcacttcctgaggtggaaaccttagtcgcaagacaggaggaggctgcaaatctactcactgctataactgaggg

SEQ ID NO: 322842 - DNA, 75 bp, Artificial Sequence
  Synthetic
atgatacaacattgtcagtgctcaatacattacatgcttatgggattgggagtgagtgccctgttctcagagttt

SEQ ID NO: 322843 - DNA, 75 bp, Artificial Sequence
  Synthetic
tacattacatgcttatgggattgggagtgagtgccctgttctcagagttttcgaaggccatctccaagtggcttg

SEQ ID NO: 322844 - DNA, 75 bp, Artificial Sequence
  Synthetic
tgataatccatactctgctggtctatcagggttcaagtacaacctttacagagctataatgaactcaagtctaaa

SEQ ID NO: 322845 - DNA, 75 bp, Artificial Sequence
  Synthetic
tcagggttcaagtacaacctttacagagctataatgaactcaagtctaaagtcaatttactcgttcttcatgaaa

SEQ ID NO: 322846 - DNA, 75 bp, Artificial Sequence
  Synthetic
cagatggtatcataagtgaatcatgcagtgttagccctggaggagctatagtcatgagctccaccctaaggtggg

SEQ ID NO: 322847 - DNA, 75 bp, Artificial Sequence
  Synthetic
cagtgttagccctggaggagctatagtcatgagctccaccctaaggtgggggtcggtggagaaattcaagaggtt

SEQ ID NO: 322848 - DNA, 75 bp, Artificial Sequence
  Synthetic
acctggaaggagatgatcaatgaaagtcctgaagtcctgtatagggcaccgcagactggaaccgagatcatgtta

SEQ ID NO: 322849 - DNA, 75 bp, Artificial Sequence
  Synthetic
gtcctgaagtcctgtatagggcaccgcagactggaaccgagatcatgttaagaatagcagagaaggtgcatagcc

SEQ ID NO: 322850 - DNA, 75 bp, Artificial Sequence
  Synthetic
tggcaatgcagtatgcaaggtcatggcatcatcagtgtactttctgtcagcctgtatctttgaagatgcaggatc

SEQ ID NO: 322851 - DNA, 75 bp, Artificial Sequence
  Synthetic
gcatcatcagtgtactttctgtcagcctgtatctttgaagatgcaggatcacaagagtataaggttgtcaataat

SEQ ID NO: 322852 - DNA, 75 bp, Artificial Sequence
  Synthetic
taatagcctttgatcaaataggctatagtgatgagattagccaagaggacctgctatttctgtttcctaatctag

SEQ ID NO: 322853 - DNA, 75 bp, Artificial Sequence
  Synthetic
tagtgatgagattagccaagaggacctgctatttctgtttcctaatctagctgagttcgaggcattcgactcaat

SEQ ID NO: 322854 - DNA, 75 bp, Artificial Sequence
  Synthetic
gttattcccagggcaagtcagagggaagcaactcaaactcggattatcgtttttgagcaccactcctctgccaga

SEQ ID NO: 322855 - DNA, 75 bp, Artificial Sequence
  Synthetic
aagcaactcaaactcggattatcgtttttgagcaccactcctctgccagagttgccccagaaaagctagtgagtg

SEQ ID NO: 322856 - DNA, 75 bp, Artificial Sequence
  Synthetic
taagataggatctcctggatttagacaagagtgggacaggctcaaggcaatcgtccgttggctaagagacacacc

SEQ ID NO: 322857 - DNA, 75 bp, Artificial Sequence
  Synthetic
caagagtgggacaggctcaaggcaatcgtccgttggctaagagacacaccagaggagactcttgaagcatcacct

SEQ ID NO: 322858 - DNA, 75 bp, Artificial Sequence
  Synthetic
acttctttgctaggatggaaggtaggccgagggtcattaaggtcactggtgcacccgtcaaaaagaggtctggga

SEQ ID NO: 322859 - DNA, 75 bp, Artificial Sequence
  Synthetic
gccgagggtcattaaggtcactggtgcacccgtcaaaaagaggtctgggatgagcaaaattgccatggctataag

SEQ ID NO: 322860 - DNA, 75 bp, Artificial Sequence
  Synthetic
ttgcaagggttggaggacgaagttggtcatagcagagctatgcaggtggaaaagataaagcattatctattctca

SEQ ID NO: 322861 - DNA, 75 bp, Artificial Sequence
  Synthetic
gtcatagcagagctatgcaggtggaaaagataaagcattatctattctcagtacttatgggcccgtactctgaag

SEQ ID NO: 322862 - DNA, 75 bp, Artificial Sequence
  Synthetic
gattctgaaggaagagccgcaagtcattcttaattacaacgacaagagatcaagagccaacataatcagcctact

SEQ ID NO: 322863 - DNA, 75 bp, Artificial Sequence
  Synthetic
attcttaattacaacgacaagagatcaagagccaacataatcagcctactgcagagattcataaaaagtgaaatt

SEQ ID NO: 322864 - DNA, 75 bp, Artificial Sequence
  Synthetic
tgaaggcaggggtctttggcgcttttgtgaaagcacagcagttcagccagtcctccattaacaataaatactatg

SEQ ID NO: 322865 - DNA, 75 bp, Artificial Sequence
  Synthetic
tgtgaaagcacagcagttcagccagtcctccattaacaataaatactatggaaaaggcatctggaagggggtggt

SEQ ID NO: 322866 - DNA, 75 bp, Artificial Sequence
  Synthetic
attgatgggaaggaagggatgccatctcatttatccagcatcaccatctcaaactgttcgaaaccatgggtcctg

SEQ ID NO: 322867 - DNA, 75 bp, Artificial Sequence
  Synthetic
ctcatttatccagcatcaccatctcaaactgttcgaaaccatgggtcctgactcagagcctgaaggcatggtgtg

SEQ ID NO: 322868 - DNA, 75 bp, Artificial Sequence
  Synthetic
ggatgtttcaaaagccaacccaaaggccaattactggatgtatggtttcaaaatgtatggatcttcttatccata

SEQ ID NO: 322869 - DNA, 75 bp, Artificial Sequence
  Synthetic
gccaattactggatgtatggtttcaaaatgtatggatcttcttatccatatggttgccctatataccttgtccgc

SEQ ID NO: 322870 - DNA, 75 bp, Artificial Sequence
  Synthetic
tgcatgatgatgacattgatattaaagtgaggaggaataccatcaatctatttgtgaggagtaaagataaaaggc

SEQ ID NO: 322871 - DNA, 75 bp, Artificial Sequence
  Synthetic
agtgaggaggaataccatcaatctatttgtgaggagtaaagataaaaggcccagagatctgcacatcctttctta

SEQ ID NO: 322872 - DNA, 75 bp, Artificial Sequence
  Synthetic
tctgtcagttcaaagcacataatggaggatgagtacttcatatacaaaggggccttctctgtcgaaccaaccaga

SEQ ID NO: 322873 - DNA, 75 bp, Artificial Sequence
  Synthetic
aggatgagtacttcatatacaaaggggccttctctgtcgaaccaaccagatcttggatgctatgccagccactac

SEQ ID NO: 322874 - DNA, 75 bp, Artificial Sequence
  Synthetic
acaagttgccactggaagcagaagaagccccagacaactagatcttgaaagattgagggagataatcaggctttg

SEQ ID NO: 322875 - DNA, 75 bp, Artificial Sequence
  Synthetic
agccccagacaactagatcttgaaagattgagggagataatcaggctttgcacagaatcctcaataaggaacaaa

SEQ ID NO: 322876 - DNA, 75 bp, Artificial Sequence
  Synthetic
ggccagagaagttcatagaggctgaacctatagatatgagtgagatgtttgacatgatgttagatgaaggaatgg

SEQ ID NO: 322877 - DNA, 75 bp, Artificial Sequence
  Synthetic
acctatagatatgagtgagatgtttgacatgatgttagatgaaggaatggatgacgcatttgaggagctagcaga

SEQ ID NO: 322878 - DNA, 75 bp, Artificial Sequence
  Synthetic
gactatatggatgaagtgaatttcgacgatgacagtctcaacctctttgggccagcacattacaaggaattacag

SEQ ID NO: 322879 - DNA, 75 bp, Artificial Sequence
  Synthetic
acgatgacagtctcaacctctttgggccagcacattacaaggaattacagagtcttacagtattagcacaccctc

SEQ ID NO: 322880 - DNA, 75 bp, Artificial Sequence
  Synthetic
ggtaggcaagatgggtagacctcagattaggaggttactggaaaaaaatgtgacgaccagagacctaagagaact

SEQ ID NO: 322881 - DNA, 75 bp, Artificial Sequence
  Synthetic
attaggaggttactggaaaaaaatgtgacgaccagagacctaagagaactatcagagctgttattcatggctctt

SEQ ID NO: 322882 - DNA, 75 bp, Artificial Sequence
  Synthetic
aggaattgattcttggagatagcccaactgaagttcctgacgaccttcttggctaacaactttgacacttagaga

SEQ ID NO: 322883 - DNA, 75 bp, Artificial Sequence
  Synthetic
aactaagaaggataaagggttaggggagtgttcctttgttatgtctataaattatttaagaattgggcggtcttt

SEQ ID NO: 322884 - DNA, 75 bp, Artificial Sequence
  Synthetic
acacaaagaccgcccgtattgctaaaccagaactaacaatagacttctagacagccatgcaatccagagctgtca

SEQ ID NO: 322885 - DNA, 75 bp, Artificial Sequence
  Synthetic
ttgattttgaaaaggactgctctttaattgagaatgagttccctatttacataaaaaattatgaggtagtataca

SEQ ID NO: 322886 - DNA, 75 bp, Artificial Sequence
  Synthetic
cctcataaatggagaattccctgcagttctgggaccaggcatgatcagtgctgttcgaactagactttatgagcc

SEQ ID NO: 322887 - DNA, 75 bp, Artificial Sequence
  Synthetic
gttctgggaccaggcatgatcagtgctgttcgaactagactttatgagccaacaatgagggagctttaccaggaa

SEQ ID NO: 322888 - DNA, 75 bp, Artificial Sequence
  Synthetic
aacaatgagggagctttaccaggaatctattcatcagctaaaaaggagcaataagaaatatctcttgtctgccct

SEQ ID NO: 322889 - DNA, 75 bp, Artificial Sequence
  Synthetic
tctattcatcagctaaaaaggagcaataagaaatatctcttgtctgccctcagatggccaacaggaatcccctct

SEQ ID NO: 322890 - DNA, 75 bp, Artificial Sequence
  Synthetic
aggagctcctgttcttgtctgagtttgatccaggatctattcagagatatctcaaattactggtcaaggcttctg

SEQ ID NO: 322891 - DNA, 75 bp, Artificial Sequence
  Synthetic
tgatccaggatctattcagagatatctcaaattactggtcaaggcttctggactctactgttcaaccattgagga

SEQ ID NO: 322892 - DNA, 75 bp, Artificial Sequence
  Synthetic
gttctcctagaaggcaagaagcatggattaactgcttttgatctcccaggaaatgacatcctcggagacatatgt

SEQ ID NO: 322893 - DNA, 75 bp, Artificial Sequence
  Synthetic
atatacttttcaataagcccagtggaattagttctgagcaagcttgataggaaagatgacaagaaggctaaggca

SEQ ID NO: 322894 - DNA, 75 bp, Artificial Sequence
  Synthetic
aacagacctgagatttagagaaactgctctttccaccttctgggctaaggactggcccacaatacatgagtctgt

SEQ ID NO: 322895 - DNA, 75 bp, Artificial Sequence
  Synthetic
gaagacaagagagtgacgaagtggctgcctagtcccccccaccacccacccctgtgaacccacccctcagattcc

SEQ ID NO: 322896 - DNA, 75 bp, Artificial Sequence
  Synthetic
tgcctagtcccccccaccacccacccctgtgaacccacccctcagattccctaggtcccccttcccccaatccca

SEQ ID NO: 322897 - DNA, 75 bp, Artificial Sequence
  Synthetic
ttacccaccttggcccgatacttctctgcgcttctcactactgctgatgccaaaaccaggtcctcatcaataatt

SEQ ID NO: 322898 - DNA, 75 bp, Artificial Sequence
  Synthetic
tgtcctccctagtgaagaaccgtccactcatggcagccatgttgggcttttcaaacgtagcagccacctcattag

SEQ ID NO: 322899 - DNA, 75 bp, Artificial Sequence
  Synthetic
gggtgcatcatggctcttgggtaagtcacgccggcaatggcatccatagtggtcccagaaacaggcagcgattct

SEQ ID NO: 322900 - DNA, 75 bp, Artificial Sequence
  Synthetic
ttcatcatagcctcaggcttattccctctgacaaggttcagcacaatcatcatcttcacgtccttcttccagtcc

SEQ ID NO: 322901 - DNA, 75 bp, Artificial Sequence
  Synthetic
ttcacccatgcattgatggtcccagaatctgcagactcatcaagaaaagcaagagcaatgtcgcgataattctcg

SEQ ID NO: 322902 - DNA, 75 bp, Artificial Sequence
  Synthetic
atgtttattgcaaagttgttattaatttcctgtttagtgcagcaggcctatctgaaatatactattatttcagag

SEQ ID NO: 322903 - DNA, 75 bp, Artificial Sequence
  Synthetic
tttcctgtttagtgcagcaggcctatctgaaatatactattatttcagagatagggaacggcactagaacttcct

SEQ ID NO: 322904 - DNA, 75 bp, Artificial Sequence
  Synthetic
tctgaaatatactattatttcagagatagggaacggcactagaacttccttttgctacagttcaagaactagctt

SEQ ID NO: 322905 - DNA, 75 bp, Artificial Sequence
  Synthetic
aacgtgactgagtcaattggtctgatttctggcacttgcaaagtggggtcactggagaacagggactgcaggaaa

SEQ ID NO: 322906 - DNA, 75 bp, Artificial Sequence
  Synthetic
tttctggcacttgcaaagtggggtcactggagaacagggactgcaggaaagacataatgtccaactacgttgctg

SEQ ID NO: 322907 - DNA, 75 bp, Artificial Sequence
  Synthetic
gggagctatgatgcacaactacgctgatgacaagagggttgagatcctcaatgatgtcataccagatgagctcaa

SEQ ID NO: 322908 - DNA, 75 bp, Artificial Sequence
  Synthetic
gatgacaagagggttgagatcctcaatgatgtcataccagatgagctcaatcctggacaccacaactgtagtgac

SEQ ID NO: 322909 - DNA, 75 bp, Artificial Sequence
  Synthetic
agtttattaatgtggcaaagccattgagtgaaatagtcccaatgtcagtgattccaccaccagttgtgaagctcc

SEQ ID NO: 322910 - DNA, 75 bp, Artificial Sequence
  Synthetic
gagtgaaatagtcccaatgtcagtgattccaccaccagttgtgaagctccagccacctgcagaaccatcctccaa

SEQ ID NO: 322911 - DNA, 75 bp, Artificial Sequence
  Synthetic
ttatcagaagctgagaaggagctaaaccagacgaagattagactggaagatgagagaaagtccaatgcagaagag

SEQ ID NO: 322912 - DNA, 75 bp, Artificial Sequence
  Synthetic
accagacgaagattagactggaagatgagagaaagtccaatgcagaagagacagcaaaggagagggctaggatga

SEQ ID NO: 322913 - DNA, 75 bp, Artificial Sequence
  Synthetic
ggagtgggagctggaacggaagaggaaggacgcaatggcagatgatttagcaaaagaaacagcaagaaggaggga

SEQ ID NO: 322914 - DNA, 75 bp, Artificial Sequence
  Synthetic
aaggacgcaatggcagatgatttagcaaaagaaacagcaagaaggagggagatagaaaggaaggcccatgagctt

SEQ ID NO: 322915 - DNA, 75 bp, Artificial Sequence
  Synthetic
gcgaaagcctgattgcaaaagagaaagcagatgaggacatgagaagccatgtgtataaaccaaacacgactagag

SEQ ID NO: 322916 - DNA, 75 bp, Artificial Sequence
  Synthetic
agcagatgaggacatgagaagccatgtgtataaaccaaacacgactagagccccagcacccacaattatcaccac

SEQ ID NO: 322917 - DNA, 75 bp, Artificial Sequence
  Synthetic
gcgggacccctggagaacagggagacaaatcatttgctcaacaggccaggaaatggggcttacactctaagcgac

SEQ ID NO: 322918 - DNA, 75 bp, Artificial Sequence
  Synthetic
caaatcatttgctcaacaggccaggaaatggggcttacactctaagcgactttgctgaatcaacctgcacactgg

SEQ ID NO: 322919 - DNA, 75 bp, Artificial Sequence
  Synthetic
ggagcaccttctgaatgaggagctgttccccttcttccattctaatcttgacaagtacagcatgctagaagctgc

SEQ ID NO: 322920 - DNA, 75 bp, Artificial Sequence
  Synthetic
ttccccttcttccattctaatcttgacaagtacagcatgctagaagctgcaacagagacagtacctatactcaat

SEQ ID NO: 322921 - DNA, 75 bp, Artificial Sequence
  Synthetic
ctccttccacacattcatcgaatgcctgtgggagagaggctagtgtcattaggaagaaatgttatagcaacatgt

SEQ ID NO: 322922 - DNA, 75 bp, Artificial Sequence
  Synthetic
ctgtgggagagaggctagtgtcattaggaagaaatgttatagcaacatgtcagccttcttctacattaacctggc

SEQ ID NO: 322923 - DNA, 75 bp, Artificial Sequence
  Synthetic
gaaacaaaccacgtcctttctagtgattgtggaaattgcatctctaagagcttgagtggccaaaaggtgtacacc

SEQ ID NO: 322924 - DNA, 75 bp, Artificial Sequence
  Synthetic
attgtggaaattgcatctctaagagcttgagtggccaaaaggtgtacaccccagtgcaagatgtgttctgtcaga

SEQ ID NO: 322925 - DNA, 75 bp, Artificial Sequence
  Synthetic
cacaaagtattcaaaagacatctgttctattggtttgcacaccgtgaaggaatgcaagataggaatcactagctt

SEQ ID NO: 322926 - DNA, 75 bp, Artificial Sequence
  Synthetic
tctattggtttgcacaccgtgaaggaatgcaagataggaatcactagctttgagagggtgggtttcatagttgtg

SEQ ID NO: 322927 - DNA, 75 bp, Artificial Sequence
  Synthetic
agatgaagatgagatcaaggcaggaatacagcgaagatcaatttttgtgctataaatcagaaagcagctctggct

SEQ ID NO: 322928 - DNA, 75 bp, Artificial Sequence
  Synthetic
atacagcgaagatcaatttttgtgctataaatcagaaagcagctctggctcatctgtcaagctaaagaagttcaa

SEQ ID NO: 322929 - DNA, 75 bp, Artificial Sequence
  Synthetic
acatcatcagcctctaagtgctctggcgatgagtatttctgcagcaggtatccatgtgaaacagccaacgttgaa

SEQ ID NO: 322930 - DNA, 75 bp, Artificial Sequence
  Synthetic
gcgatgagtatttctgcagcaggtatccatgtgaaacagccaacgttgaagcccactgcattctaaggaggcata

SEQ ID NO: 322931 - DNA, 75 bp, Artificial Sequence
  Synthetic
cggcgtgtgggttgtgcctaggtgtattggctatgaggaggttctggtcaaaaggacatcactcaaggttgaaga

SEQ ID NO: 322932 - DNA, 75 bp, Artificial Sequence
  Synthetic
attggctatgaggaggttctggtcaaaaggacatcactcaaggttgaagatacgacaggaagggaatgtgattcc

SEQ ID NO: 322933 - DNA, 75 bp, Artificial Sequence
  Synthetic
agctgattgtcaagactcatggtcccaaagtggtttatgcaacagcatgcagccatggatcctgtaaaagtgtga

SEQ ID NO: 322934 - DNA, 75 bp, Artificial Sequence
  Synthetic
caaagtggtttatgcaacagcatgcagccatggatcctgtaaaagtgtgatgcagaagccagcaacctttgtgta

SEQ ID NO: 322935 - DNA, 75 bp, Artificial Sequence
  Synthetic
attgttgggggtgacatagggattcacatgacagaagagtcatcaccctcgaatatacacttagtagcacactgc

SEQ ID NO: 322936 - DNA, 75 bp, Artificial Sequence
  Synthetic
acatgacagaagagtcatcaccctcgaatatacacttagtagcacactgccctgcaagggactcatgtgatgtca

SEQ ID NO: 322937 - DNA, 75 bp, Artificial Sequence
  Synthetic
actccttaattatcagtgccacaccttgttttcagcattgctcatatcaactactgtgatgtcaattctcacatt

SEQ ID NO: 322938 - DNA, 75 bp, Artificial Sequence
  Synthetic
ttgttttcagcattgctcatatcaactactgtgatgtcaattctcacattgctgctcttgcttgtgaaaggggca

SEQ ID NO: 322939 - DNA, 75 bp, Artificial Sequence
  Synthetic
actggctgatcactcctttatgctggctatcagtcttttgctgctgggtggttaaaagctggaagagaagagtgg

SEQ ID NO: 322940 - DNA, 75 bp, Artificial Sequence
  Synthetic
gctatcagtcttttgctgctgggtggttaaaagctggaagagaagagtgggttcagcaatttctaggacaaacga

SEQ ID NO: 322941 - DNA, 75 bp, Artificial Sequence
  Synthetic
cggcatgctcaagacattgagagagcacagtacacaggaggggctccaggggccaaatattcattttatggggtt

SEQ ID NO: 322942 - DNA, 75 bp, Artificial Sequence
  Synthetic
cacagtacacaggaggggctccaggggccaaatattcattttatggggttatgattctaggattactgagtagtg

SEQ ID NO: 322943 - DNA, 75 bp, Artificial Sequence
  Synthetic
agcagactccaagatcatgcaatgcacaacctcagggagttccaccctttgcaaggcaagcgggacagtaatcat

SEQ ID NO: 322944 - DNA, 75 bp, Artificial Sequence
  Synthetic
acaacctcagggagttccaccctttgcaaggcaagcgggacagtaatcatgagagtgggacccataggctcagag

SEQ ID NO: 322945 - DNA, 75 bp, Artificial Sequence
  Synthetic
aggacagtgaaaagcagttcatatctatcaagaccatatcaagtgaactcacgtgccgagaaggagaatccttct

SEQ ID NO: 322946 - DNA, 75 bp, Artificial Sequence
  Synthetic
tatcaagaccatatcaagtgaactcacgtgccgagaaggagaatccttctggactaccctatacacacctatctg

SEQ ID NO: 322947 - DNA, 75 bp, Artificial Sequence
  Synthetic
atgggagaatgtgtctctgatcgctgcctcaagtggaagactaatcaaacatccgcagaattcacagggaaagca

SEQ ID NO: 322948 - DNA, 75 bp, Artificial Sequence
  Synthetic
gcctcaagtggaagactaatcaaacatccgcagaattcacagggaaagcacatggtgacgttatgcacgagaaca

SEQ ID NO: 322949 - DNA, 75 bp, Artificial Sequence
  Synthetic
aggctacggatgttttaatgtaaacccttcttgtctctatgtccactcttatctcaagtctgtttacaggaacgg

SEQ ID NO: 322950 - DNA, 75 bp, Artificial Sequence
  Synthetic
ccttcttgtctctatgtccactcttatctcaagtctgtttacaggaacgggttcaaagttttcaggtgtgtggca

SEQ ID NO: 322951 - DNA, 75 bp, Artificial Sequence
  Synthetic
tgacgacacactcccgaaagttccctatggttttgatggccatgagtacacagcccactgactggggatccattg

SEQ ID NO: 322952 - DNA, 75 bp, Artificial Sequence
  Synthetic
tatggttttgatggccatgagtacacagcccactgactggggatccattggtttgattcttgactcagaaggggt

SEQ ID NO: 322953 - DNA, 75 bp, Artificial Sequence
  Synthetic
atgaaacatggctcaggaagttttgctataatagatgacccatattctccagagcctcgaaaagggttcctggga

SEQ ID NO: 322954 - DNA, 75 bp, Artificial Sequence
  Synthetic
ctataatagatgacccatattctccagagcctcgaaaagggttcctgggagaagtgcggtgtcctacagaagaga

SEQ ID NO: 322955 - DNA, 75 bp, Artificial Sequence
  Synthetic
caagatggctccaaacttgattgagtaccagcctgaaatggacacagcagagtgtaccacaaatatgatagaccc

SEQ ID NO: 322956 - DNA, 75 bp, Artificial Sequence
  Synthetic
taccagcctgaaatggacacagcagagtgtaccacaaatatgatagaccctatggctatattcaatcgaggatct

SEQ ID NO: 322957 - DNA, 75 bp, Artificial Sequence
  Synthetic
ctttcacgcagtcaatagaaaagaacactgttcaggcattaacaacaggggaagttaaggcatccatccgcctca

SEQ ID NO: 322958 - DNA, 75 bp, Artificial Sequence
  Synthetic
cactgttcaggcattaacaacaggggaagttaaggcatccatccgcctcacattagatgattatgatgtggtgta

SEQ ID NO: 322959 - DNA, 75 bp, Artificial Sequence
  Synthetic
gccacatttaagaacctcactggttgttactcatgtgatgaaggatccagactatgctatcaagtgaaggcagaa

SEQ ID NO: 322960 - DNA, 75 bp, Artificial Sequence
  Synthetic
gttactcatgtgatgaaggatccagactatgctatcaagtgaaggcagaaggcgagactatttttcactttatca

SEQ ID NO: 322961 - DNA, 75 bp, Artificial Sequence
  Synthetic
caataaggtaagcccgggagtgagcgactactgcaccgttctccatttctcaaggcctgttatttctattgaggg

SEQ ID NO: 322962 - DNA, 75 bp, Artificial Sequence
  Synthetic
gactactgcaccgttctccatttctcaaggcctgttatttctattgagggaacatatgactgcgggctaagcaag

SEQ ID NO: 322963 - DNA, 75 bp, Artificial Sequence
  Synthetic
taattgccactgctccacatgatgatagaaagcatgaaggaggttcttctttagtagtcaaccccaaaggtggtt

SEQ ID NO: 322964 - DNA, 75 bp, Artificial Sequence
  Synthetic
tagaaagcatgaaggaggttcttctttagtagtcaaccccaaaggtggttcagttgacttctttggatggttgtc

SEQ ID NO: 322965 - DNA, 75 bp, Artificial Sequence
  Synthetic
cctctcaaaacatttctgactattcttggattcctagctgtgggcttactgttagtggtgataattatcatcatc

SEQ ID NO: 322966 - DNA, 75 bp, Artificial Sequence
  Synthetic
tgaagaagaagataaaataaaataatccatcttctttctattattctcatgtatctttcactcaggggttggggg

SEQ ID NO: 322967 - DNA, 75 bp, Artificial Sequence
  Synthetic
cccgtattgctaaaccagagctaacaacagacttctagacagccatgcaatccagagctgtcatcttgaagcata

SEQ ID NO: 322968 - DNA, 75 bp, Artificial Sequence
  Synthetic
agggttgctctctgattgagaatgagttccctatctacataaataattatgaggtggtctataagtcaaagccaa

SEQ ID NO: 322969 - DNA, 75 bp, Artificial Sequence
  Synthetic
ggcatgatcagtgcagttagaaccagactttacgagccaaccatgagagaactctaccaggaatcgattcaccaa

SEQ ID NO: 322970 - DNA, 75 bp, Artificial Sequence
  Synthetic
tcctgtcagagtttgacccgggatctatccagagatacctgaaattactggttaaggcctctgggctatacaact

SEQ ID NO: 322971 - DNA, 75 bp, Artificial Sequence
  Synthetic
ttgatctcccaggaaatgacatcctcggagacatctgtgtggttcaagcagcgcgggtgacaagactagttgcta

SEQ ID NO: 322972 - DNA, 75 bp, Artificial Sequence
  Synthetic
agacattctccaagatgaccagagacacccatctgatgatatatttctcaataagcccagttgagttggttttga

SEQ ID NO: 322973 - DNA, 75 bp, Artificial Sequence
  Synthetic
atttagagagactgctctttccaccttttgggctaaggactggcctaccccacaagagatcattctatctgacaa

SEQ ID NO: 322974 - DNA, 75 bp, Artificial Sequence
  Synthetic
cccaatcctaattcccctaaccccctggcagctcacttgccaaccttggcgcgatacttctcagcactcctcacc

SEQ ID NO: 322975 - DNA, 75 bp, Artificial Sequence
  Synthetic
tcctctctccttgaccaactgaacaatgcgctttgggtcaaacccttggtaagcaaactcattcacccatgcatt

SEQ ID NO: 322976 - DNA, 75 bp, Artificial Sequence
  Synthetic
acacagagaggcccaaatatggaaagaatccttaaaaaacaaccagctcctgtaagagcattaaccattcatcca

SEQ ID NO: 322977 - DNA, 75 bp, Artificial Sequence
  Synthetic
gaatccttaaaaaacaaccagctcctgtaagagcattaaccattcatccactgaggaggtatgaatcatcaatct

SEQ ID NO: 322978 - DNA, 75 bp, Artificial Sequence
  Synthetic
gatcaagcatagctcagatggtgtcaccatagatattgcaacctccgagcttgctgatggacaatctgggtctac

SEQ ID NO: 322979 - DNA, 75 bp, Artificial Sequence
  Synthetic
accatagatattgcaacctccgagcttgctgatggacaatctgggtctactattcagccttttgaaagtgtccct

SEQ ID NO: 322980 - DNA, 75 bp, Artificial Sequence
  Synthetic
atgacttcacttttggtcatctagcagacacaactgataaaaagtttgttgaggtgtttggggttttagagaaca

SEQ ID NO: 322981 - DNA, 75 bp, Artificial Sequence
  Synthetic
gggctgatgattctgattttcagtcccctgacatgatcatagagacagagactggccatgtttatgtggttgaat

SEQ ID NO: 322982 - DNA, 75 bp, Artificial Sequence
  Synthetic
ctcagcagatctggctgccagaaacaagatcgcgaaatatgagatagcttgcctcaacaggtctgctataaagcc

SEQ ID NO: 322983 - DNA, 75 bp, Artificial Sequence
  Synthetic
gcctcaacaggtctgctataaagcctatctctctatacataattgctgtgcattttaatggagtgatctcaaacc

SEQ ID NO: 322984 - DNA, 75 bp, Artificial Sequence
  Synthetic
tatctctctatacataattgctgtgcattttaatggagtgatctcaaacctcgacctgtcagacgaagaagtcaa

SEQ ID NO: 322985 - DNA, 75 bp, Artificial Sequence
  Synthetic
gcaagggacatctttgaggaattgagagaaattaatccagctctatttgactcagatgagactattagtagacta

SEQ ID NO: 322986 - DNA, 75 bp, Artificial Sequence
  Synthetic
gagaaattaatccagctctatttgactcagatgagactattagtagactagaaagagaggttaacagtgtcatgt

SEQ ID NO: 322987 - DNA, 75 bp, Artificial Sequence
  Synthetic
caccgagaagaaattcccgagctttaggagggagctctttgagaacttcaggagtaaggaagttgatgatgagta

SEQ ID NO: 322988 - DNA, 75 bp, Artificial Sequence
  Synthetic
aggagggagctctttgagaacttcaggagtaaggaagttgatgatgagtatatctccaagatcatcaaaagatgt

SEQ ID NO: 322989 - DNA, 75 bp, Artificial Sequence
  Synthetic
agagagatagtctctacactgaggacatcaccaataaagagagatttgagctaaactcaaagagagctgcttctg

SEQ ID NO: 322990 - DNA, 75 bp, Artificial Sequence
  Synthetic
gatgagttatgagttcttaagggacacagaggatcacaagtcgactgtacagtttcctccctgggtgacaaggac

SEQ ID NO: 322991 - DNA, 75 bp, Artificial Sequence
  Synthetic
acagaggatcacaagtcgactgtacagtttcctccctgggtgacaaggacaggcccagctggtaaagacctggag

SEQ ID NO: 322992 - DNA, 75 bp, Artificial Sequence
  Synthetic
gttctcatcccatgtgtaagatttggaataaggtgtgcacaaatgcttcaatagagaaaatagagagaatgcatg

SEQ ID NO: 322993 - DNA, 75 bp, Artificial Sequence
  Synthetic
gaataaggtgtgcacaaatgcttcaatagagaaaatagagagaatgcatgatgacccagttttggagcttgaata

SEQ ID NO: 322994 - DNA, 75 bp, Artificial Sequence
  Synthetic
tcagttgagaggaacaagtaccaccgcaccgtgctcactttgtccccagaggagagagagtatgctgcagtccta

SEQ ID NO: 322995 - DNA, 75 bp, Artificial Sequence
  Synthetic
ggagtttgtgggaagagaaatgcaaatctgggagctgtcaaagaagccagggtgaggagcaagaagggcttctcc

SEQ ID NO: 322996 - DNA, 75 bp, Artificial Sequence
  Synthetic
aagagttcttgtctgatagctgtgtagaggatctcatcccaacagaaggtctgtacaacccgctctctgaggaca

SEQ ID NO: 322997 - DNA, 75 bp, Artificial Sequence
  Synthetic
agaggatctcatcccaacagaaggtctgtacaacccgctctctgaggacaaatccctgagactactggcaatggg

SEQ ID NO: 322998 - DNA, 75 bp, Artificial Sequence
  Synthetic
atggatgatgagaccccagagactctggattgccatttaaaattcttgagttcaccgataggaagctggctgcaa

SEQ ID NO: 322999 - DNA, 75 bp, Artificial Sequence
  Synthetic
atggtctccatagttggtgcagagttgtctgcttcagtaaagcagcacgtcaagcctaatcagttcattgtgaag

SEQ ID NO: 323000 - DNA, 75 bp, Artificial Sequence
  Synthetic
tactgattaagccaacaacttctaagggtcacatatttgtctctcttgctgtcaacaagaagttcttacatggtg

SEQ ID NO: 323001 - DNA, 75 bp, Artificial Sequence
  Synthetic
gggtcacatatttgtctctcttgctgtcaacaagaagttcttacatggtgagttaagcaaatctagtgtcttcaa

SEQ ID NO: 323002 - DNA, 75 bp, Artificial Sequence
  Synthetic
ctggtcacagactttgtttcatttaagctaagtaagatcactaacctttgtaaggctctatgtgtattagaggca

SEQ ID NO: 323003 - DNA, 75 bp, Artificial Sequence
  Synthetic
agctaagtaagatcactaacctttgtaaggctctatgtgtattagaggcagcttcttgcttctgggctgagacat

SEQ ID NO: 323004 - DNA, 75 bp, Artificial Sequence
  Synthetic
ggaccaggccagtgctgtgaagtttttagatgcatggtttatgataaaactatctctcctgactatgttagagga

SEQ ID NO: 323005 - DNA, 75 bp, Artificial Sequence
  Synthetic
ttagatgcatggtttatgataaaactatctctcctgactatgttagaggacaaggcaacaacagaagagcttcag

SEQ ID NO: 323006 - DNA, 75 bp, Artificial Sequence
  Synthetic
aggggtttgtgtcactccctgaaattcccaagccacacaagatgttgtcaaaaatcccaaaagtgctcaggtctg

SEQ ID NO: 323007 - DNA, 75 bp, Artificial Sequence
  Synthetic
tcccaagccacacaagatgttgtcaaaaatcccaaaagtgctcaggtctgagctacaagtatttctaacccacag

SEQ ID NO: 323008 - DNA, 75 bp, Artificial Sequence
  Synthetic
tcagccacccctttccagctccacaaggtaggagggaacatccgctggaagggacttttcaatccttactctgga

SEQ ID NO: 323009 - DNA, 75 bp, Artificial Sequence
  Synthetic
aggtaggagggaacatccgctggaagggacttttcaatccttactctggaaacagtattgatgagctgcagactt

SEQ ID NO: 323010 - DNA, 75 bp, Artificial Sequence
  Synthetic
tttcaagaacaaagaggaagacactgagccatcagcattatcagccatgtacaagaagattatagagctagaaca

SEQ ID NO: 323011 - DNA, 75 bp, Artificial Sequence
  Synthetic
gagccatcagcattatcagccatgtacaagaagattatagagctagaacatctccgacccccaacagacacatac

SEQ ID NO: 323012 - DNA, 75 bp, Artificial Sequence
  Synthetic
ctaagatgcacgagttcagcaggagctatctgaagctgctgtgcaaccatgcaaagaccaaactaagaaagcaat

SEQ ID NO: 323013 - DNA, 75 bp, Artificial Sequence
  Synthetic
ctatctgaagctgctgtgcaaccatgcaaagaccaaactaagaaagcaatatggcagaggagtaatgaatcagat

SEQ ID NO: 323014 - DNA, 75 bp, Artificial Sequence
  Synthetic
cagtcaataactttggaacggctagctactcttaaagctactagcaacttcgatgattcatggtacactttcaag

SEQ ID NO: 323015 - DNA, 75 bp, Artificial Sequence
  Synthetic
gagataaacttctagtcaagatgacccagtttgctcatagaggaaagactttggctatagaggtgtttgaagaat

SEQ ID NO: 323016 - DNA, 75 bp, Artificial Sequence
  Synthetic
ccagtttgctcatagaggaaagactttggctatagaggtgtttgaagaatgcatgtcaaggattgaagagaaagg

SEQ ID NO: 323017 - DNA, 75 bp, Artificial Sequence
  Synthetic
aaacaacagcatggtggtctcagagagatttatgtcatgggtgcagatgaaagaatagttcaatcagtgatagag

SEQ ID NO: 323018 - DNA, 75 bp, Artificial Sequence
  Synthetic
agatttatgtcatgggtgcagatgaaagaatagttcaatcagtgatagaggccatagcgcgggcaattggaaggt

SEQ ID NO: 323019 - DNA, 75 bp, Artificial Sequence
  Synthetic
tccatccaacaaaataaggattccagaaacacacgggcagagagccaaaagaaggtgtggtcgatctgtctggac

SEQ ID NO: 323020 - DNA, 75 bp, Artificial Sequence
  Synthetic
gaaacacacgggcagagagccaaaagaaggtgtggtcgatctgtctggacttgtgccacctcagatgatgctaga

SEQ ID NO: 323021 - DNA, 75 bp, Artificial Sequence
  Synthetic
caaaatttgccctgatgctatgtgaattcactcctcaagagtggtggcctttaatcatcagaggttgctcgatgt

SEQ ID NO: 323022 - DNA, 75 bp, Artificial Sequence
  Synthetic
tcacaaacaagtttatgatgatgaatcttgatttcttgaggataattgatagtcacaaggagctacagattgagg

SEQ ID NO: 323023 - DNA, 75 bp, Artificial Sequence
  Synthetic
ggcataccacggtgagagtgtggagccatggatatctcaggggtgcacatacctcaagacaagcactgggatgat

SEQ ID NO: 323024 - DNA, 75 bp, Artificial Sequence
  Synthetic
ccatggatatctcaggggtgcacatacctcaagacaagcactgggatgatgcaggggattctgcacttcacttcc

SEQ ID NO: 323025 - DNA, 75 bp, Artificial Sequence
  Synthetic
acctcaagacaagcactgggatgatgcaggggattctgcacttcacttcctccttgcttcattccctgcatcagg

SEQ ID NO: 323026 - DNA, 75 bp, Artificial Sequence
  Synthetic
actgttcactctaaagctaggctctgatgcgtcttcaaaagtagtgtgcgatatgatgcagggctcagatgacag

SEQ ID NO: 323027 - DNA, 75 bp, Artificial Sequence
  Synthetic
tataatgagaagattaaaatgagatacaagctggttgctgctatgtgttttaggattaagaagagccttggcatt

SEQ ID NO: 323028 - DNA, 75 bp, Artificial Sequence
  Synthetic
acaagctggttgctgctatgtgttttaggattaagaagagccttggcatttatattggcatttacccgtccgaaa

SEQ ID NO: 323029 - DNA, 75 bp, Artificial Sequence
  Synthetic
gatggagtacaactctgagttcttcttccattctcagcatgtgaggcctaccatcaggtggatagctgcttcttg

SEQ ID NO: 323030 - DNA, 75 bp, Artificial Sequence
  Synthetic
ttccattctcagcatgtgaggcctaccatcaggtggatagctgcttcttgctctctccctgaggttgagacattg

SEQ ID NO: 323031 - DNA, 75 bp, Artificial Sequence
  Synthetic
atctgctcactgccataacagaaggaggaggatcattctccctggcagccatgatacagcactgccagtcgtcaa

SEQ ID NO: 323032 - DNA, 75 bp, Artificial Sequence
  Synthetic
ttcattacatgctcatggggttgggtgtaagtgctctattctcagaattctcaaaggccatttccaagtggctcg

SEQ ID NO: 323033 - DNA, 75 bp, Artificial Sequence
  Synthetic
tgataacccgtactctgctggtctgtcgggattcaagtataatctgtacagagccataatgaattcaagcctgaa

SEQ ID NO: 323034 - DNA, 75 bp, Artificial Sequence
  Synthetic
tcgggattcaagtataatctgtacagagccataatgaattcaagcctgaagtccatctactcatttttcatgaag

SEQ ID NO: 323035 - DNA, 75 bp, Artificial Sequence
  Synthetic
cagatggcattataagtgaatcctgcagtgtcagtcctggtggagctatagtcatgagctccactctgaggtggg

SEQ ID NO: 323036 - DNA, 75 bp, Artificial Sequence
  Synthetic
gatcagtagagaagtttaagaggctaagaaatagactaaacatacctgaaacctggaaagagatgatcaatgaga

SEQ ID NO: 323037 - DNA, 75 bp, Artificial Sequence
  Synthetic
aagaaatagactaaacatacctgaaacctggaaagagatgatcaatgagagtcctgaggtcttgtacagagcccc

SEQ ID NO: 323038 - DNA, 75 bp, Artificial Sequence
  Synthetic
agaatagctgaaaaggtgcatagtcctggagtggtttcgtcattaagcaccgggaatgctgtctgtaaagtcatg

SEQ ID NO: 323039 - DNA, 75 bp, Artificial Sequence
  Synthetic
ctggagtggtttcgtcattaagcaccgggaatgctgtctgtaaagtcatggcatcttcagtgtactttctttcag

SEQ ID NO: 323040 - DNA, 75 bp, Artificial Sequence
  Synthetic
acaagagtacaaggttgtcaataatgacaaatacagtctgatgcaaaagatcatagcttttgatcagatcggctg

SEQ ID NO: 323041 - DNA, 75 bp, Artificial Sequence
  Synthetic
tcatagcttttgatcagatcggctgcaacgatgaaattagccaagaggacttgttgtttttgttccctaatctgg

SEQ ID NO: 323042 - DNA, 75 bp, Artificial Sequence
  Synthetic
catctatgataaggggaggtttaatgttatcccaagagcaagccagagggaagcaacccagactcggattgttgt

SEQ ID NO: 323043 - DNA, 75 bp, Artificial Sequence
  Synthetic
ttttgaacaccactcttcagccagagttgctccagagaaactagtgagtgacaagtggtttggcactagaaagag

SEQ ID NO: 323044 - DNA, 75 bp, Artificial Sequence
  Synthetic
caagagtgggatagactcaaggccatcgtccgctggcttagagatactccagaagaaactcttgattcatcacca

SEQ ID NO: 323045 - DNA, 75 bp, Artificial Sequence
  Synthetic
tcgtccgctggcttagagatactccagaagaaactcttgattcatcaccattctctaaccacatccaaattcgca

SEQ ID NO: 323046 - DNA, 75 bp, Artificial Sequence
  Synthetic
gccaagggtcatcaaagtcactggcgcacctgtaaaaagagatcttggcatgagcaagattgccatggctataag

SEQ ID NO: 323047 - DNA, 75 bp, Artificial Sequence
  Synthetic
ttacaagggctggaagacgaagttggccacagcagggccatgcaagtagagaaaataaagcattacctgttttca

SEQ ID NO: 323048 - DNA, 75 bp, Artificial Sequence
  Synthetic
aggccaagctagaatatgtggtcaagattctgaaggaggagccacaagtcattcttaattacaatgacaagaggt

SEQ ID NO: 323049 - DNA, 75 bp, Artificial Sequence
  Synthetic
gattctgaaggaggagccacaagtcattcttaattacaatgacaagaggtcaagagccaacatcatcagcttgct

SEQ ID NO: 323050 - DNA, 75 bp, Artificial Sequence
  Synthetic
ggcatagcaacactcatagaagatatgaaggcaggggtctttggcgcatttgtgaaggcacagcagtttagccag

SEQ ID NO: 323051 - DNA, 75 bp, Artificial Sequence
  Synthetic
tgaaggcaggggtctttggcgcatttgtgaaggcacagcagtttagccagtcctcagtcaataataagtattatg

SEQ ID NO: 323052 - DNA, 75 bp, Artificial Sequence
  Synthetic
ggatggctaccaagttcagatagatattgatgggaaggagggtatgccatctcatttgtctggaatcactatctc

SEQ ID NO: 323053 - DNA, 75 bp, Artificial Sequence
  Synthetic
ctcatttgtctggaatcactatctcaaattgctctaaaacatggatcctgacccagagtttgaaggcatggtgtg

SEQ ID NO: 323054 - DNA, 75 bp, Artificial Sequence
  Synthetic
ggatgtctccaaggccaacccaaaggccaattactggatgtatggtttcaagatgtatgggtcttcatatccata

SEQ ID NO: 323055 - DNA, 75 bp, Artificial Sequence
  Synthetic
tgggtgcccaatatatcttgtccgccatgacatcacaaatctaggcttgctccatgatgatgacatagatattaa

SEQ ID NO: 323056 - DNA, 75 bp, Artificial Sequence
  Synthetic
tttgtgagaagcaaagataaaagaccaagagatctgcatatcttatcgtacactccttcagattcagatataagt

SEQ ID NO: 323057 - DNA, 75 bp, Artificial Sequence
  Synthetic
caagagatctgcatatcttatcgtacactccttcagattcagatataagttctgttagttcaaagcacataatgg

SEQ ID NO: 323058 - DNA, 75 bp, Artificial Sequence
  Synthetic
agccttttctgtagaaccaaccagatcatggatgttatgccagcccttgccgtggagctttgtcagacctgtact

SEQ ID NO: 323059 - DNA, 75 bp, Artificial Sequence
  Synthetic
tcatggatgttatgccagcccttgccgtggagctttgtcagacctgtactgcaggttgcgacagggagtaggagg

SEQ ID NO: 323060 - DNA, 75 bp, Artificial Sequence
  Synthetic
ggctgagagagataatcagactttgcactgagtcctcaattagaaataaggttgggactgtgtatggtcagaata

SEQ ID NO: 323061 - DNA, 75 bp, Artificial Sequence
  Synthetic
cactgagtcctcaattagaaataaggttgggactgtgtatggtcagaatagacctgagaagttcattgaagcaga

SEQ ID NO: 323062 - DNA, 75 bp, Artificial Sequence
  Synthetic
gacatgatgttggacgagggaatggacgatgcctttgaggagctggctgactacttaactgtggaagaggatcct

SEQ ID NO: 323063 - DNA, 75 bp, Artificial Sequence
  Synthetic
acgatgcctttgaggagctggctgactacttaactgtggaagaggatcctgattatatggatgaagtcagctttg

SEQ ID NO: 323064 - DNA, 75 bp, Artificial Sequence
  Synthetic
accagcacactacaaggagttacagagtctcacagtgttggcacaccctttaatggacgactttgtgacaaggtt

SEQ ID NO: 323065 - DNA, 75 bp, Artificial Sequence
  Synthetic
ggtgggtaaaatgggtaggccacagatcaggagattgctagaaaagaatgtcacaaccagagatttgagagaact

SEQ ID NO: 323066 - DNA, 75 bp, Artificial Sequence
  Synthetic
gacagagacccatctcaaataagagaggaattgattcttggagacagtccaactgaggttcctgatgaccttctt

SEQ ID NO: 323067 - DNA, 75 bp, Artificial Sequence
  Synthetic
aactgagggagagaataggtgtggggggtgttcctttgttatatctataagttatttaagaattgggcggtcttt

SEQ ID NO: 323068 - DNA, 75 bp, Artificial Sequence
  Synthetic
ttagtgcagcaggcctatctgaaatacactattatttcagaaatagggaacggcactagaacttctttttgttat

SEQ ID NO: 323069 - DNA, 75 bp, Artificial Sequence
  Synthetic
agctcaaggaccagcttggggagcctcctggaagcttgggacaacataactgagtctattggtctgacatctggc

SEQ ID NO: 323070 - DNA, 75 bp, Artificial Sequence
  Synthetic
tgagtctattggtctgacatctggcacttgtaaagtgggatcactggaaaacagggattgcaaaagagacatcat

SEQ ID NO: 323071 - DNA, 75 bp, Artificial Sequence
  Synthetic
acttgtaaagtgggatcactggaaaacagggattgcaaaagagacatcatgtcaaattatgttgcagaagtgcat

SEQ ID NO: 323072 - DNA, 75 bp, Artificial Sequence
  Synthetic
aatgtggcaaagccagcaaacaaaatagctcctatatcagtgatcccaccaccaattgtgaagcccataccaatt

SEQ ID NO: 323073 - DNA, 75 bp, Artificial Sequence
  Synthetic
tcccatttgataaactcctatctgaagcagaaaaggagttgaaccaaacaaaaatcagattggaaaccgaaagaa

SEQ ID NO: 323074 - DNA, 75 bp, Artificial Sequence
  Synthetic
ggtctaatgcggaagaggctgcaagagaaagggccaggatgagagaaattgaagacaagctgagaaagaattggg

SEQ ID NO: 323075 - DNA, 75 bp, Artificial Sequence
  Synthetic
agtggcagacgacctggcaaaagaaatagcgagaagaagagagatagagagaaaagctcatgaattagataagat

SEQ ID NO: 323076 - DNA, 75 bp, Artificial Sequence
  Synthetic
caggtggcaatagaaagggtgagtgaggatatgagaaaccatgtgcgtagaccaaatacaaccatagcccctgct

SEQ ID NO: 323077 - DNA, 75 bp, Artificial Sequence
  Synthetic
cttccactctaaccttgacaagtacagcatgctagaggctgcaacagagacaataccgatactcaacaagagctc

SEQ ID NO: 323078 - DNA, 75 bp, Artificial Sequence
  Synthetic
agctgtctgcacaatttccccatccacgcattcatcaaatgcatgtggcagggaagctagcctcataaagaagaa

SEQ ID NO: 323079 - DNA, 75 bp, Artificial Sequence
  Synthetic
atgtggaaacaatatgtctgctttcttctatgttaacctagccggccagataactgttgtcaagtgtgatacaaa

SEQ ID NO: 323080 - DNA, 75 bp, Artificial Sequence
  Synthetic
ccatgttttgtctaacgactgtgggaattgtatctcaaaaaccttgagcggtcagaagatttatactccagttca

SEQ ID NO: 323081 - DNA, 75 bp, Artificial Sequence
  Synthetic
actcaaaagacctctgttctattggcttgcacactgtgaaggaatgcaagactggtaccaccaactttgagagag

SEQ ID NO: 323082 - DNA, 75 bp, Artificial Sequence
  Synthetic
atgagatcaagacaagaattcagcgaagaccagttcttatgctacaaatcagagagcagttctggctcttctgta

SEQ ID NO: 323083 - DNA, 75 bp, Artificial Sequence
  Synthetic
catgcaaaggtgttacaacatcatcagcctctaagtgctctggggatgaatatttctgcagcaggtacccatgtg

SEQ ID NO: 323084 - DNA, 75 bp, Artificial Sequence
  Synthetic
atagaagtgaatgtcaatggcgtgtgggttgtgccgagatgcattggttatgaagaggttcttgttagaaggact

SEQ ID NO: 323085 - DNA, 75 bp, Artificial Sequence
  Synthetic
gtagagaatgtgatacctgcttatgggaatgcggaaaaaataaactaattgtcaaaactcatggccccaaaatag

SEQ ID NO: 323086 - DNA, 75 bp, Artificial Sequence
  Synthetic
gtcaaaactcatggccccaaaatagtttatgcaacagcatgtagccatgggtcttgcaagagtgtgatgcaaaag

SEQ ID NO: 323087 - DNA, 75 bp, Artificial Sequence
  Synthetic
acccaggaaacagcgagattgttggaggtgatataggggtccacatgacagaggaatcatcaccttcaaacatac

SEQ ID NO: 323088 - DNA, 75 bp, Artificial Sequence
  Synthetic
atgtccattcttacattgctacttcttcttgtgaagggggctaaagatcttgtcaagaaattattctactggcta

SEQ ID NO: 323089 - DNA, 75 bp, Artificial Sequence
  Synthetic
attcattttatggagtgatgatccttggcctattaggtaatgtgcatagttgctctgagagtgtcatagccgact

SEQ ID NO: 323090 - DNA, 75 bp, Artificial Sequence
  Synthetic
tggcctattaggtaatgtgcatagttgctctgagagtgtcatagccgactccaaagtcatgcaatgcacaacttc

SEQ ID NO: 323091 - DNA, 75 bp, Artificial Sequence
  Synthetic
gggaagttctaccctctgcaaggctagtgggactgtgattatgaagctagggcctataggctcagagtcctgcct

SEQ ID NO: 323092 - DNA, 75 bp, Artificial Sequence
  Synthetic
agtgggactgtgattatgaagctagggcctataggctcagagtcctgcctgattttgaagggtcttaaggacaat

SEQ ID NO: 323093 - DNA, 75 bp, Artificial Sequence
  Synthetic
aattcactgggaaggcacatggagaagttatgcatgagaatagatgctttgagcagagcggtggaataggctatg

SEQ ID NO: 323094 - DNA, 75 bp, Artificial Sequence
  Synthetic
agttatgcatgagaatagatgctttgagcagagcggtggaataggctatggatgctttaatgtgaacccttcttg

SEQ ID NO: 323095 - DNA, 75 bp, Artificial Sequence
  Synthetic
tctgtctacaagaatggattcaagatctttagatgtgtggcatggaaccacaggattagacttgaagttactacc

SEQ ID NO: 323096 - DNA, 75 bp, Artificial Sequence
  Synthetic
tgatggctatgagcacacaacccactgactggggttctattgggttaatcctagattcagaagggataacaggga

SEQ ID NO: 323097 - DNA, 75 bp, Artificial Sequence
  Synthetic
gatgacccatattccccagagcctcgtaaaggctttttaggagaagtgcgatgtccaacagaagagacagctatt

SEQ ID NO: 323098 - DNA, 75 bp, Artificial Sequence
  Synthetic
gtaaaggctttttaggagaagtgcgatgtccaacagaagagacagctattcgggcgtcaccctcatgtaagatgg

SEQ ID NO: 323099 - DNA, 75 bp, Artificial Sequence
  Synthetic
atgtccaacagaagagacagctattcgggcgtcaccctcatgtaagatggctcctaacttgattgagtaccagcc

SEQ ID NO: 323100 - DNA, 75 bp, Artificial Sequence
  Synthetic
accaggtgaaggcagaaggagaaactatctttcactttgtcaatgaggatgaatctatcaatgttattaacaagg

SEQ ID NO: 323101 - DNA, 75 bp, Artificial Sequence
  Synthetic
tgagcccagacgtaagtgactactgcactgttctccacttctcaagacctgtcatctctattgaagggaggtatg

SEQ ID NO: 323102 - DNA, 75 bp, Artificial Sequence
  Synthetic
aaaaacaagtaatgtatatcatttatatcttttacacattatttaatcgggggttagggggggaataggcagtgc

SEQ ID NO: 323103 - DNA, 75 bp, Artificial Sequence
  Synthetic
tatcttttacacattatttaatcgggggttagggggggaataggcagtgcatgtgtgtggcccagttagacaaaa

SEQ ID NO: 323104 - DNA, 75 bp, Artificial Sequence
  Synthetic
ataagcccagttgagttggttttgagcaaacttgataagaaggaggacaagagggctaaagcaaaagggttgatg

SEQ ID NO: 323105 - DNA, 75 bp, Artificial Sequence
  Synthetic
tttggaaggtccagatcaatgattccagcaaagctaggatgcatcatggctcttgggtaggtcacaccagcaatg

SEQ ID NO: 323106 - DNA, 75 bp, Artificial Sequence
  Synthetic
tgcctgaacagtccacggaacaaatgcagctgacacccttgacagagtgatagtgtccctgccaggattcccttc

SEQ ID NO: 323107 - DNA, 75 bp, Artificial Sequence
  Synthetic
ttggccacaatagaagcacccttctctgacattttcttcatcatggcctctggcttgttccccctgacaaggttc

SEQ ID NO: 323108 - DNA, 75 bp, Artificial Sequence
  Synthetic
ctgacattttcttcatcatggcctctggcttgttccccctgacaaggttcagcacaatcatcatcttcacatctt

SEQ ID NO: 323109 - DNA, 75 bp, Artificial Sequence
  Synthetic
aaaccagaactaataatagacttctagacagccatgcaatccagagctgtcattctgaagcacaagtctggttca

SEQ ID NO: 323110 - DNA, 75 bp, Artificial Sequence
  Synthetic
tctacatagactgtgacctggacacctttgattttgaaaaggactgctctttaatcgagaatgagttccctattt

SEQ ID NO: 323111 - DNA, 75 bp, Artificial Sequence
  Synthetic
caataagaaatatcttttgtctgccctcagatggccaacaggaatcccctctctagagtttatagattactattt

SEQ ID NO: 323112 - DNA, 75 bp, Artificial Sequence
  Synthetic
tttgatccaggatctattcagagatatctcaaattactggtcaaagcctctggactctacagctcaaccattgaa

SEQ ID NO: 323113 - DNA, 75 bp, Artificial Sequence
  Synthetic
tgaattagttctgagcaagcttgataggaaagatgacaagaaggctaaggcaaagggtttactatcaatgagcgc

SEQ ID NO: 323114 - DNA, 75 bp, Artificial Sequence
  Synthetic
agaacagacctgagatttagagaaactgctctttccaccttttgggctaaagattggcctacaatacatgagtct

SEQ ID NO: 323115 - DNA, 75 bp, Artificial Sequence
  Synthetic
ctgctctttccaccttttgggctaaagattggcctacaatacatgagtctatgctgtctgttagacgatgcccca

SEQ ID NO: 323116 - DNA, 75 bp, Artificial Sequence
  Synthetic
gctgcctagtcccccccactacccacccctgtaaacccacccctcagattccccaggtttcccttcccctaatcc

SEQ ID NO: 323117 - DNA, 75 bp, Artificial Sequence
  Synthetic
tttattgtcttagagaactcaatcatgaacaatccatgagcatcagcaatggtggccccagctccatttggcaga

SEQ ID NO: 323118 - DNA, 75 bp, Artificial Sequence
  Synthetic
agtccatggaacaaaagcagccgacactctggacagagtgatggtgtctctgccaggatttccctccttcagctg

SEQ ID NO: 323119 - DNA, 75 bp, Artificial Sequence
  Synthetic
gtaacaaagtggctgcctagtcccccccactacccacccttgtgatcccacccctcagattcccccaatccccat

SEQ ID NO: 323120 - DNA, 75 bp, Artificial Sequence
  Synthetic
acacagagaaggtgcccatgtttattgcaaagttgttattaatttcctgtttagtgcagcaggcctatctgaaat

SEQ ID NO: 323121 - DNA, 75 bp, Artificial Sequence
  Synthetic
tcagagtgcaaatcctgggagcaccaattggatgagctgtcttttcccttcttccactctaaccttgacaagtac

SEQ ID NO: 323122 - DNA, 75 bp, Artificial Sequence
  Synthetic
caatatcaagtgaactcacatgccgagagggagagtccttctggactactctatatactcctgtctgtctaagtt

SEQ ID NO: 323123 - DNA, 75 bp, Artificial Sequence
  Synthetic
tggagacatctgtgtggttcaagcagcacgggtgacaagactagttgctaaaacattctctaagatgaccagaga

SEQ ID NO: 323124 - DNA, 75 bp, Artificial Sequence
  Synthetic
ataagcccagttgagctggttttgaataaacttgataagaaggaggacaagagggctaaagcaaaagggttgatg

SEQ ID NO: 323125 - DNA, 75 bp, Artificial Sequence
  Synthetic
gtgacaaagtggctgcctagtcccccccactacccacccttgtgatcccacccctcagattcccctaatccccat

SEQ ID NO: 323126 - DNA, 75 bp, Artificial Sequence
  Synthetic
actgcagacgccagaacaagatcctcatcaatgatccccactgctatgagcagcttcttcttatcttctctggtg

SEQ ID NO: 323127 - DNA, 75 bp, Artificial Sequence
  Synthetic
gcagggattctgacaggacacgtagtgcctgaacagtccacggaacaaatgcggctgacacccttgacagagtga

SEQ ID NO: 323128 - DNA, 75 bp, Artificial Sequence
  Synthetic
tggtgtccctgccagggttcccttctttcaactggtagactgaaatcaggttggccacaatagaagcacccttct

SEQ ID NO: 323129 - DNA, 75 bp, Artificial Sequence
  Synthetic
aaaacagacctgagatttagagaaactgctctttccaccttctgggctaaagattggcccacaatacatgagtct

SEQ ID NO: 323130 - DNA, 75 bp, Artificial Sequence
  Synthetic
aggaagacaagagagtgacaaagtggctgcctagtcccccccactacccacccctatgaacccacccctcagatt

SEQ ID NO: 323131 - DNA, 75 bp, Artificial Sequence
  Synthetic
ggtccatggaacaaaagcagccgacactctagacagagtgatggtgtctctgccaggatttccctccttcagctg

SEQ ID NO: 323132 - DNA, 75 bp, Artificial Sequence
  Synthetic
atagacgcacccttctctgacatcttcttcatcatagcctcaggcttattccctctgacaaggttcagcacaatc

SEQ ID NO: 323133 - DNA, 75 bp, Artificial Sequence
  Synthetic
gtcaagaccaacactctcacacttcctcatgaatggagaattccctgcagttctggggccaggcatgattagtgc

SEQ ID NO: 323134 - DNA, 75 bp, Artificial Sequence
  Synthetic
gatcctggatctattcagagatatctcaaattactggtcaaggcctctggactctacagttcaaccattgaggag

SEQ ID NO: 323135 - DNA, 75 bp, Artificial Sequence
  Synthetic
caagtcttatgactacttcatgaaaacagacctgagatttagagaaactgctctttccaccttctgggctaaaga

SEQ ID NO: 323136 - DNA, 75 bp, Artificial Sequence
  Synthetic
aggtcaataatcccagcaaagctggggtgcatcatggctcttgggtaggtcacgccggcaatggcatccatagtg

SEQ ID NO: 323137 - DNA, 75 bp, Artificial Sequence
  Synthetic
aatcaaagccaactctctcacatttcctcattgagaaggagtttcctgctgtactggggcctggcatgatcagtg

SEQ ID NO: 323138 - DNA, 75 bp, Artificial Sequence
  Synthetic
acaagaaatatctcttgtctgctctcaggtggcccacagggattcctactctagagtttatagactattacttcg

SEQ ID NO: 323139 - DNA, 75 bp, Artificial Sequence
  Synthetic
ggctttacaactccactattgaggagcagatagtggagattcacagacgagtgctcatagaaggcaaaaagcacg

SEQ ID NO: 323140 - DNA, 75 bp, Artificial Sequence
  Synthetic
gccccagccccattcggaaggtccagatcaatgattccagcaaagctaggatgcatcatggctcttgggtaggtc

SEQ ID NO: 323141 - DNA, 75 bp, Artificial Sequence
  Synthetic
aagcaagagcaatgtcgcgataattctcgtctgacatgttgatagcttttgtttaatacacgggaatctctgtgt

SEQ ID NO: 323142 - DNA, 75 bp, Artificial Sequence
  Synthetic
acactattatttcagaaatagggaacggcactagaacttctttctgttatagctcaagaaccagtttggggagcc

SEQ ID NO: 323143 - DNA, 75 bp, Artificial Sequence
  Synthetic
tgagtctattggtctgacgtctggcacttgtaaagtgggatcactggagaacagagagtgcaaaagagacatcat

SEQ ID NO: 323144 - DNA, 75 bp, Artificial Sequence
  Synthetic
gtctaattatgttgcagaagtgcattccaacttacatggcttaggagctatgatgcacaactatggtgatgacaa

SEQ ID NO: 323145 - DNA, 75 bp, Artificial Sequence
  Synthetic
tgatgcacaactatggtgatgacaagaggattgaggtcctcaatgatgtcatcccagatgagctcaatccaggac

SEQ ID NO: 323146 - DNA, 75 bp, Artificial Sequence
  Synthetic
atcccagatgagctcaatccaggacgccacaactgcagtgacctagaccggaagccattttggacagagtttatt

SEQ ID NO: 323147 - DNA, 75 bp, Artificial Sequence
  Synthetic
gccacaactgcagtgacctagaccggaagccattttggacagagtttattaatgtggcaaaaccagcgaatgaaa

SEQ ID NO: 323148 - DNA, 75 bp, Artificial Sequence
  Synthetic
tggctcctatgtcagttatcccaccaccaattgtgaagcccataccagttgcagaatcaaccactaagaaaacca

SEQ ID NO: 323149 - DNA, 75 bp, Artificial Sequence
  Synthetic
accaattgtgaagcccataccagttgcagaatcaaccactaagaaaaccatcccatttgataaactcctatctga

SEQ ID NO: 323150 - DNA, 75 bp, Artificial Sequence
  Synthetic
aagatcatgttggaaaccgaaagaagatctaatgcggaagaggctgctaaagaaagggccaggatgagagagatt

SEQ ID NO: 323151 - DNA, 75 bp, Artificial Sequence
  Synthetic
gatctaatgcggaagaggctgctaaagaaagggccaggatgagagagattgaagacaagctgagaaaggattggg

SEQ ID NO: 323152 - DNA, 75 bp, Artificial Sequence
  Synthetic
agtggcagaggacctagcaaaagaaatagcgaggagaagagaaatagagaggaaagctcatgaattagataagat

SEQ ID NO: 323153 - DNA, 75 bp, Artificial Sequence
  Synthetic
ccctaagtgactttgctgagtccacctgcacgctagcttatggctcagagtgcaaatcctgggagcaccaattgg

SEQ ID NO: 323154 - DNA, 75 bp, Artificial Sequence
  Synthetic
ctgcacaatctccccatccacgcattcatcgaatgcatgtggtagggaagccagcctcataaagaagaaatgtgg

SEQ ID NO: 323155 - DNA, 75 bp, Artificial Sequence
  Synthetic
gttaacctggctggtcagataactgttgtcaaatgtgacacaaaccatgtcttgtctaacgactgtgggaattgt

SEQ ID NO: 323156 - DNA, 75 bp, Artificial Sequence
  Synthetic
atctcaaaaaccctgagcggccagaaaatttacactccagttcaggatatgttctgtcagaaaggctggtcagag

SEQ ID NO: 323157 - DNA, 75 bp, Artificial Sequence
  Synthetic
gttctgtcagaaaggctggtcagagtccatcccaagcacaaggtactcaaaagacctctgttctattggcttgca

SEQ ID NO: 323158 - DNA, 75 bp, Artificial Sequence
  Synthetic
aagacctctgttctattggcttgcacactgtgaaggaatgtaagattggtaccaccaactttgagagagtgggtt

SEQ ID NO: 323159 - DNA, 75 bp, Artificial Sequence
  Synthetic
tcattgttgtgaagggtcgaaagatgtacattgagcagatgaagatgagatcgaggcaagaattcagcgaagacc

SEQ ID NO: 323160 - DNA, 75 bp, Artificial Sequence
  Synthetic
gtacattgagcagatgaagatgagatcgaggcaagaattcagcgaagaccagttcttatgctacaaatcagaggg

SEQ ID NO: 323161 - DNA, 75 bp, Artificial Sequence
  Synthetic
aagaaggttaaggttgagtcatgcaaaggtgttactacatcatcagcctctaagtgctctggggatgaatatttc

SEQ ID NO: 323162 - DNA, 75 bp, Artificial Sequence
  Synthetic
aaggtgttactacatcatcagcctctaagtgctctggggatgaatatttctgcagtaggtacccatgtgagactg

SEQ ID NO: 323163 - DNA, 75 bp, Artificial Sequence
  Synthetic
acgaaggcatagtgcagtcatagaagtgaatgttaatggtgtatgggttgtgccgagatgcattggttatgaaga

SEQ ID NO: 323164 - DNA, 75 bp, Artificial Sequence
  Synthetic
aaagtggaagatacatctagtagagaatgtgatacctgcttatgggaatgcgggaaaaataaactaattgtcaaa

SEQ ID NO: 323165 - DNA, 75 bp, Artificial Sequence
  Synthetic
tgtgtgcacggactgcttaactaccagtgccacaccttgttctctgcactactaatatccaccactgtgatgtcc

SEQ ID NO: 323166 - DNA, 75 bp, Artificial Sequence
  Synthetic
tgaagggagctaaggatcttgttaagagattgttctactggctaatcacacccctgtgctggctatcagtattct

SEQ ID NO: 323167 - DNA, 75 bp, Artificial Sequence
  Synthetic
gtggctggatgatcagaagctggaaaaagagagtgggctcagctatctctagaaccaatgacactattggttggc

SEQ ID NO: 323168 - DNA, 75 bp, Artificial Sequence
  Synthetic
cattgagagagcacagtacacaggaggagctccaggggctaaatattcattttatggagtgatgatccttggcct

SEQ ID NO: 323169 - DNA, 75 bp, Artificial Sequence
  Synthetic
gagagtatcatagccgattccaaaatcatgcaatgtacaacttcgggaagttctaccctctgcaaggctagtggg

SEQ ID NO: 323170 - DNA, 75 bp, Artificial Sequence
  Synthetic
actgtgattatgaagctagggcctataggctcagagtcctgcctaattctgaagggtcttaaggacagcgaaaag

SEQ ID NO: 323171 - DNA, 75 bp, Artificial Sequence
  Synthetic
caagtgagctcacatgccgagagggagagtccttctggactactctatatactcctgtctgtctaagctcgcgaa

SEQ ID NO: 323172 - DNA, 75 bp, Artificial Sequence
  Synthetic
tacaagaatggatttaagatctttagatgtgtggcatggaaccataggattagacttgaagtcactacccactcc

SEQ ID NO: 323173 - DNA, 75 bp, Artificial Sequence
  Synthetic
gatgtgtggcatggaaccataggattagacttgaagtcactacccactcccggaaattcccaatggttctgatgg

SEQ ID NO: 323174 - DNA, 75 bp, Artificial Sequence
  Synthetic
ccatgagcacacaacccaccgactggggttccattgggttaatcctagattcagaagggataacagggactaacg

SEQ ID NO: 323175 - DNA, 75 bp, Artificial Sequence
  Synthetic
aacagaagagacagctattcgggcgtcaccctcatgtaagatggctcctaacttgatcgagtaccagcctgaaat

SEQ ID NO: 323176 - DNA, 75 bp, Artificial Sequence
  Synthetic
atgatagatcccatggccatattcaatcgagggtccttgccacaagtccgggatggaatgacattcacacaatca

SEQ ID NO: 323177 - DNA, 75 bp, Artificial Sequence
  Synthetic
tgacaacaggggaggttagagcttccatacgcctcacattagatgactatgatgtggtgtaccaaaatagccagt

SEQ ID NO: 323178 - DNA, 75 bp, Artificial Sequence
  Synthetic
tgaaggcagaaggagaaaccatcttccactttgtcaatgaggatgaatccatcaatgtcatcaacaaggtgagcc

SEQ ID NO: 323179 - DNA, 75 bp, Artificial Sequence
  Synthetic
tctccacttctcaagacctgtcatctctattgaagggaggtatgactgcgggcttagcaaaaggccaatggtaat

SEQ ID NO: 323180 - DNA, 75 bp, Artificial Sequence
  Synthetic
aaaaagcactctaattgccactgccccgcatgatgataggaagcatgaaggaggctcctcattggttgtcaaccc

SEQ ID NO: 323181 - DNA, 75 bp, Artificial Sequence
  Synthetic
cttgaccatccttggattcctagctctgggcctacttttagtagtgataatcatcatcattgctcgcactggggt

SEQ ID NO: 323182 - DNA, 75 bp, Artificial Sequence
  Synthetic
tcatcatcattgctcgcactggggtgcaacaggccctgaaaaagaaaaacaagtaatctatatcatttctatctt

SEQ ID NO: 323183 - DNA, 75 bp, Artificial Sequence
  Synthetic
gggggggaataggcagtgcatgtgtgtggcccagttaggcaaaactaaatcttagggaaaatatggaaaacagta

SEQ ID NO: 323184 - DNA, 75 bp, Artificial Sequence
  Synthetic
cttagggaaaatatggaaaacagtacacattggtggtattttggacatgttttgtattgttctttaaagcaccgg

SEQ ID NO: 323185 - DNA, 75 bp, Artificial Sequence
  Synthetic
tcccatttgataaactcctatctgaagcagagaaggagttgaaccaaacaaagatcaggttggaaaccgaaagaa

SEQ ID NO: 323186 - DNA, 75 bp, Artificial Sequence
  Synthetic
ctggtggccagagaaagggtggatgaggatatgagaaaccatgtacgcagaccaaatacaaccatagcccctaca

SEQ ID NO: 323187 - DNA, 75 bp, Artificial Sequence
  Synthetic
atcataactactctgctcatggccagtgcagtaatggcaggacctttggagaacagggaaacaaaccacttacta

SEQ ID NO: 323188 - DNA, 75 bp, Artificial Sequence
  Synthetic
agcggtggaataggctatggatgctttaatgtgaacccttcttgtctctacgtccattcctatctcaaatctgtc

SEQ ID NO: 323189 - DNA, 75 bp, Artificial Sequence
  Synthetic
gggttccattgggttaatcctagattcaggagggataacagggactaacgcatattcctttatgaagcatgggtt

SEQ ID NO: 323190 - DNA, 75 bp, Artificial Sequence
  Synthetic
tctcaccggctgttattcatgtgatgagggttccagaatgtgctaccaggtgaaggccgaaggagaaaccatctt

SEQ ID NO: 323191 - DNA, 75 bp, Artificial Sequence
  Synthetic
ctgggcctacttttagtagtgataatcatcatcattgctcgcactggggtcgaacaggccctaaaaaagaaaaac

SEQ ID NO: 323192 - DNA, 75 bp, Artificial Sequence
  Synthetic
cttaggaagaatatggaaagcagtgcacattggtggtattttggacatattttgttttgttctttaaagcaccgg

SEQ ID NO: 323193 - DNA, 75 bp, Artificial Sequence
  Synthetic
gattcacagacgagtgctcatagaaggcaaaaagcacggattgactgcttttgatctcccaggaaatgacatcct

SEQ ID NO: 323194 - DNA, 75 bp, Artificial Sequence
  Synthetic
ggcaaaaagcacggattgactgcttttgatctcccaggaaatgacatccttggagacatctgtgtggttcaagca

SEQ ID NO: 323195 - DNA, 75 bp, Artificial Sequence
  Synthetic
ccctgtattgcgataagacaaagtctaaacaaactgccttaacaatgcaatcatctttagtttttttgaaaccaa

SEQ ID NO: 323196 - DNA, 75 bp, Artificial Sequence
  Synthetic
taaacaaactgccttaacaatgcaatcatctttagtttttttgaaaccaaaatcctcaaaggacaaaaaacggac

SEQ ID NO: 323197 - DNA, 75 bp, Artificial Sequence
  Synthetic
tcatctttagtttttttgaaaccaaaatcctcaaaggacaaaaaacggacatttcctaggttttatgttgctgcg

SEQ ID NO: 323198 - DNA, 75 bp, Artificial Sequence
  Synthetic
gaaggttttgcttactggagagcgagatcccaatttatgtggataagtacaaggttgtacttgactcaaggccaa

SEQ ID NO: 323199 - DNA, 75 bp, Artificial Sequence
  Synthetic
gatcccaatttatgtggataagtacaaggttgtacttgactcaaggccaactctatctcattttctgtcaaaaaa

SEQ ID NO: 323200 - DNA, 75 bp, Artificial Sequence
  Synthetic
gattcaataacatctcagagaactaagttgtatgatccaattattcaggaactctttagtgagtctattaacagt

SEQ ID NO: 323201 - DNA, 75 bp, Artificial Sequence
  Synthetic
agttgtatgatccaattattcaggaactctttagtgagtctattaacagtttaaaaagacacaaggttgactacc

SEQ ID NO: 323202 - DNA, 75 bp, Artificial Sequence
  Synthetic
aggtgttccttctcttgagtttatcgagtactatcttgacgatcatatttttctctctgatgaacctaactcaat

SEQ ID NO: 323203 - DNA, 75 bp, Artificial Sequence
  Synthetic
gagtactatcttgacgatcatatttttctctctgatgaacctaactcaatcatgagtaggtacttaaagcttctg

SEQ ID NO: 323204 - DNA, 75 bp, Artificial Sequence
  Synthetic
cctcaattgaagaccagatagtagagattcacaggaagactctcttggaaggaatgaagcttggactcacgaagg

SEQ ID NO: 323205 - DNA, 75 bp, Artificial Sequence
  Synthetic
gattcacaggaagactctcttggaaggaatgaagcttggactcacgaaggaagacttgcctgggaatgacctcat

SEQ ID NO: 323206 - DNA, 75 bp, Artificial Sequence
  Synthetic
gctagagtagcaagttctgtggcaaaatcggctcatcggcgaatcaatgatttgcaattccacatctacttctct

SEQ ID NO: 323207 - DNA, 75 bp, Artificial Sequence
  Synthetic
aatcggctcatcggcgaatcaatgatttgcaattccacatctacttctctgtcagcccagtcgaactgcacctag

SEQ ID NO: 323208 - DNA, 75 bp, Artificial Sequence
  Synthetic
aactaagggcttggccaaaatgagttgtaacgactcatttaagttctttttgtacaatgatgagtctttcaggga

SEQ ID NO: 323209 - DNA, 75 bp, Artificial Sequence
  Synthetic
tgtaacgactcatttaagttctttttgtacaatgatgagtctttcagggaggatgctctctccactgtgtggact

SEQ ID NO: 323210 - DNA, 75 bp, Artificial Sequence
  Synthetic
agctctcaaagaacaagtcccttagtggcttgcgattgtggctgcccaacccccccaaatttcccccaatttaga

SEQ ID NO: 323211 - DNA, 75 bp, Artificial Sequence
  Synthetic
tggcttgcgattgtggctgcccaacccccccaaatttcccccaatttagaaacccacccaaattagtaaccaatt

SEQ ID NO: 323212 - DNA, 75 bp, Artificial Sequence
  Synthetic
ctttggcagcttacttgcccactttagagcgatacttctcagcacacttgattatagctggagtcagcacaaggt

SEQ ID NO: 323213 - DNA, 75 bp, Artificial Sequence
  Synthetic
agagcgatacttctcagcacacttgattatagctggagtcagcacaaggtcttcattgagtattccaacagccat

SEQ ID NO: 323214 - DNA, 75 bp, Artificial Sequence
  Synthetic
gtaaagaaccggccgctcattgctgccatgtttggtttttcaaatgtggccgcaatctcattaggctgcttggtt

SEQ ID NO: 323215 - DNA, 75 bp, Artificial Sequence
  Synthetic
ccatgtttggtttttcaaatgtggccgcaatctcattaggctgcttggttctcaaggatggattgatggttttag

SEQ ID NO: 323216 - DNA, 75 bp, Artificial Sequence
  Synthetic
tgcatcagcaatggcttcaccagccctgtttggaagatccaaatcaatgatgcctgcaaagctaggatgcatcat

SEQ ID NO: 323217 - DNA, 75 bp, Artificial Sequence
  Synthetic
ctgtttggaagatccaaatcaatgatgcctgcaaagctaggatgcatcatagcccgtgggtacatcacaccagca

SEQ ID NO: 323218 - DNA, 75 bp, Artificial Sequence
  Synthetic
cagggagggaatcagagagcactttcagagcctgaatggtccaaggaacaaaggcagctgagactctagataatg

SEQ ID NO: 323219 - DNA, 75 bp, Artificial Sequence
  Synthetic
cagagcctgaatggtccaaggaacaaaggcagctgagactctagataatgtgatggtatctctaccaggattccc

SEQ ID NO: 323220 - DNA, 75 bp, Artificial Sequence
  Synthetic
agctgggcaacaattccagcacccttctccgacatcttcttcatcatagcctcaggtttgttgccccttactagg

SEQ ID NO: 323221 - DNA, 75 bp, Artificial Sequence
  Synthetic
tctccgacatcttcttcatcatagcctcaggtttgttgccccttactaggttaaggactatcatcatcttaacat

SEQ ID NO: 323222 - DNA, 75 bp, Artificial Sequence
  Synthetic
agttcccctctcttttactagctggacaatcctttttgggtcaaatccctgataagcaaactcattcacccaggc

SEQ ID NO: 323223 - DNA, 75 bp, Artificial Sequence
  Synthetic
tcatcaaggaaagccaaggcaatctcacgataattctcctcagacatgatgttttgtttagttaaataacgggat

SEQ ID NO: 323224 - DNA, 75 bp, Artificial Sequence
  Synthetic
acacaaagaagccctctataatggatgaaattctaaaaaaacaaacctatgataatgatggtttcttttctcctg

SEQ ID NO: 323225 - DNA, 75 bp, Artificial Sequence
  Synthetic
tgaaattctaaaaaaacaaacctatgataatgatggtttcttttctcctgagcttaaacattatgatcatgacct

SEQ ID NO: 323226 - DNA, 75 bp, Artificial Sequence
  Synthetic
gataatgatggtttcttttctcctgagcttaaacattatgatcatgacctgtttgctgctgatcttccaagcttc

SEQ ID NO: 323227 - DNA, 75 bp, Artificial Sequence
  Synthetic
tctctatagagatagatttagggtctatgaatccatcttcaactgttggatcgactttaacttcttctgtgagca

SEQ ID NO: 323228 - DNA, 75 bp, Artificial Sequence
  Synthetic
tatgaatccatcttcaactgttggatcgactttaacttcttctgtgagcattaaggataaagacttattaaatct

SEQ ID NO: 323229 - DNA, 75 bp, Artificial Sequence
  Synthetic
ttatgtgacagcacagacataaaatttcacaaaaagtttggaatcaaaggagacgggtatgataatttaagccca

SEQ ID NO: 323230 - DNA, 75 bp, Artificial Sequence
  Synthetic
ttcacaaaaagtttggaatcaaaggagacgggtatgataatttaagcccagatatgattgttgaactgccttctg

SEQ ID NO: 323231 - DNA, 75 bp, Artificial Sequence
  Synthetic
tacttttagaggtggtgaaaagggttgttatagtgctgctcgagataaagtatctaagtacagtctagcttgtga

SEQ ID NO: 323232 - DNA, 75 bp, Artificial Sequence
  Synthetic
tgttatagtgctgctcgagataaagtatctaagtacagtctagcttgtgaaaatcggagttctaggtgcccagtg

SEQ ID NO: 323233 - DNA, 75 bp, Artificial Sequence
  Synthetic
aagatggtgtctggactaatcttgacttgtctgatcaagatgtcaatgagattgtttttagatttagaatgtcta

SEQ ID NO: 323234 - DNA, 75 bp, Artificial Sequence
  Synthetic
cttgtctgatcaagatgtcaatgagattgtttttagatttagaatgtctatctcaattcatgaggaagtcagaaa

SEQ ID NO: 323235 - DNA, 75 bp, Artificial Sequence
  Synthetic
gactcagaactatccaagacagagagagagttgataggcacacttagtatgatctcaatgaattgggaagaaaca

SEQ ID NO: 323236 - DNA, 75 bp, Artificial Sequence
  Synthetic
gagagttgataggcacacttagtatgatctcaatgaattgggaagaaacagaaaagaggtttcctcacttcagta

SEQ ID NO: 323237 - DNA, 75 bp, Artificial Sequence
  Synthetic
agagcccatcaatgaggaatatattagctcaataatatcgaaatcattaagtgatgctcagaatggaattcttaa

SEQ ID NO: 323238 - DNA, 75 bp, Artificial Sequence
  Synthetic
agctcaataatatcgaaatcattaagtgatgctcagaatggaattcttaaggactcatatttccaagaaggatta

SEQ ID NO: 323239 - DNA, 75 bp, Artificial Sequence
  Synthetic
atgtttctgaatgtgatcttgcagtgaagaaatatgttgaggagtatgataggcatgagagcataagagacatat

SEQ ID NO: 323240 - DNA, 75 bp, Artificial Sequence
  Synthetic
gaagaaatatgttgaggagtatgataggcatgagagcataagagacatatttgattcaaagtcaacagtgcaatt

SEQ ID NO: 323241 - DNA, 75 bp, Artificial Sequence
  Synthetic
aatgcaggaaaatcattggagtctctgaagtctttaaatatagatggagaacaccctatgattaagatatggcat

SEQ ID NO: 323242 - DNA, 75 bp, Artificial Sequence
  Synthetic
tgaagtctttaaatatagatggagaacaccctatgattaagatatggcataaagtagtacagagtgcaactattg

SEQ ID NO: 323243 - DNA, 75 bp, Artificial Sequence
  Synthetic
tcctcaggctgagttagaatttgcattgtcgggcagcatcactagagctgaacaaaaaaacaagtatcatagagt

SEQ ID NO: 323244 - DNA, 75 bp, Artificial Sequence
  Synthetic
ttgtcgggcagcatcactagagctgaacaaaaaaacaagtatcatagagtgagaataaacttaagctctgaagaa

SEQ ID NO: 323245 - DNA, 75 bp, Artificial Sequence
  Synthetic
ttggaggaaagaaaaacaaagatacacaagcatctaaagatgctaggaaaagaagtaaactggccttttctttaa

SEQ ID NO: 323246 - DNA, 75 bp, Artificial Sequence
  Synthetic
acaagcatctaaagatgctaggaaaagaagtaaactggccttttctttaagacatgatatctctcaattagagga

SEQ ID NO: 323247 - DNA, 75 bp, Artificial Sequence
  Synthetic
ctcttcacatatgatgactctctatggtgccctttagctgaagattatgaactgagactttcagctcaatcaatc

SEQ ID NO: 323248 - DNA, 75 bp, Artificial Sequence
  Synthetic
ggtgccctttagctgaagattatgaactgagactttcagctcaatcaatccatcagccaacattaacatcaaagc

SEQ ID NO: 323249 - DNA, 75 bp, Artificial Sequence
  Synthetic
tcatgttaacctgttaaagacaccatttatgtcatggtgccagttggtctccataacaggggcagaattgtcagc

SEQ ID NO: 323250 - DNA, 75 bp, Artificial Sequence
  Synthetic
tttatgtcatggtgccagttggtctccataacaggggcagaattgtcagcatctgtaaaacaacacgtgaaacaa

SEQ ID NO: 323251 - DNA, 75 bp, Artificial Sequence
  Synthetic
taaactcaccagtttatctgcttataagacctacttcttccaaaagtcacatttttgtgtcattcgccattgaga

SEQ ID NO: 323252 - DNA, 75 bp, Artificial Sequence
  Synthetic
aagacctacttcttccaaaagtcacatttttgtgtcattcgccattgagaagagcttccacataatggatttaga

SEQ ID NO: 323253 - DNA, 75 bp, Artificial Sequence
  Synthetic
tatgatgcaggtgatatgtttgttactgattttgtttcatttaaattgagtaaactcacaaatctatgcaaatgt

SEQ ID NO: 323254 - DNA, 75 bp, Artificial Sequence
  Synthetic
ctgattttgtttcatttaaattgagtaaactcacaaatctatgcaaatgtcaaccgctaatggagtcagcagtct

SEQ ID NO: 323255 - DNA, 75 bp, Artificial Sequence
  Synthetic
caatccttgggattctagcaaattactcagtacagacagaagtagcagcattcgtgaatctactttgatgataaa

SEQ ID NO: 323256 - DNA, 75 bp, Artificial Sequence
  Synthetic
ctcagtacagacagaagtagcagcattcgtgaatctactttgatgataaaattatctttactaacattgatggaa

SEQ ID NO: 323257 - DNA, 75 bp, Artificial Sequence
  Synthetic
agacattgcaaagatatgttgtgatggagggatttgtgtctcagcctgagatgcctaagcctcataaaatgctta

SEQ ID NO: 323258 - DNA, 75 bp, Artificial Sequence
  Synthetic
ggagggatttgtgtctcagcctgagatgcctaagcctcataaaatgcttaataagataccaggagtactgagatc

SEQ ID NO: 323259 - DNA, 75 bp, Artificial Sequence
  Synthetic
aggcttgttcattcaatgaagagaatatcacagaaaccatttttgatctcaaaaaaacagggtcagatatcctgg

SEQ ID NO: 323260 - DNA, 75 bp, Artificial Sequence
  Synthetic
tatcacagaaaccatttttgatctcaaaaaaacagggtcagatatcctggtctaatttgttcaaccctctttcag

SEQ ID NO: 323261 - DNA, 75 bp, Artificial Sequence
  Synthetic
actgataagctcatgttataacggatattttaagaacaaagaagaggaaactgagccatcctctctctctaaaat

SEQ ID NO: 323262 - DNA, 75 bp, Artificial Sequence
  Synthetic
tattttaagaacaaagaagaggaaactgagccatcctctctctctaaaatgtataaaaagataatagagctagaa

SEQ ID NO: 323263 - DNA, 75 bp, Artificial Sequence
  Synthetic
acttgggttttgaagatccacttgagccaaaaatgcatgagtttagcagaagttacctcaaacaatgtatagatc

SEQ ID NO: 323264 - DNA, 75 bp, Artificial Sequence
  Synthetic
gccaaaaatgcatgagtttagcagaagttacctcaaacaatgtatagatcatgcaaagcagtgtttaaggaaaat

SEQ ID NO: 323265 - DNA, 75 bp, Artificial Sequence
  Synthetic
atcgataaccaaataacaagagatgttgcatcaattacattagagcgccttgctacgttaaaagcatcaagtaat

SEQ ID NO: 323266 - DNA, 75 bp, Artificial Sequence
  Synthetic
ttgcatcaattacattagagcgccttgctacgttaaaagcatcaagtaatttcaatgaatcctggtataattaca

SEQ ID NO: 323267 - DNA, 75 bp, Artificial Sequence
  Synthetic
gagagataaggtgattgtaaagatgtcggagatggcttcttcaggaaagacactagcaattcagtgctttgaaga

SEQ ID NO: 323268 - DNA, 75 bp, Artificial Sequence
  Synthetic
tcggagatggcttcttcaggaaagacactagcaattcagtgctttgaagaatgtatgtcaaaaatagaatccaga

SEQ ID NO: 323269 - DNA, 75 bp, Artificial Sequence
  Synthetic
agaaacagcagcatgggggattgagagagatctatgtgatgggagctgaagagaggattgttcagtcaataatag

SEQ ID NO: 323270 - DNA, 75 bp, Artificial Sequence
  Synthetic
agagatctatgtgatgggagctgaagagaggattgttcagtcaataatagaatcaattgctaaaagcatcggcag

SEQ ID NO: 323271 - DNA, 75 bp, Artificial Sequence
  Synthetic
aacccaggaaataagaccaaaattccagaatctcatggtatgagagcaagatctcactgcaagggctctgtatgg

SEQ ID NO: 323272 - DNA, 75 bp, Artificial Sequence
  Synthetic
cagaatctcatggtatgagagcaagatctcactgcaagggctctgtatggacatgtgctacttctgatgatgcta

SEQ ID NO: 323273 - DNA, 75 bp, Artificial Sequence
  Synthetic
gactaagtttgcactgatgctatgtgaatttacacaaccaaaatggtggccaataataattagaggttgctcaat

SEQ ID NO: 323274 - DNA, 75 bp, Artificial Sequence
  Synthetic
gaatttacacaaccaaaatggtggccaataataattagaggttgctcaatgtttacaaataagtacatgatgatg

SEQ ID NO: 323275 - DNA, 75 bp, Artificial Sequence
  Synthetic
ataaacacagggagatactggttgaagatgattttgttaacgacttgtttctagcatatcatggtgagaaaccac

SEQ ID NO: 323276 - DNA, 75 bp, Artificial Sequence
  Synthetic
agatgattttgttaacgacttgtttctagcatatcatggtgagaaaccacagcagtggatagacactgggtcaac

SEQ ID NO: 323277 - DNA, 75 bp, Artificial Sequence
  Synthetic
atgcagggaatactccatttcacctcttctctgcttcacacaattcatcaagaattcataagatctttgtccttt

SEQ ID NO: 323278 - DNA, 75 bp, Artificial Sequence
  Synthetic
cttctctgcttcacacaattcatcaagaattcataagatctttgtcctttaaaatcttcaatttaaaagttcatc

SEQ ID NO: 323279 - DNA, 75 bp, Artificial Sequence
  Synthetic
tgatatgatgcaaggttctgatgatagtagcatgataataagctttccagctaaggacgatatattcttttctaa

SEQ ID NO: 323280 - DNA, 75 bp, Artificial Sequence
  Synthetic
agtagcatgataataagctttccagctaaggacgatatattcttttctaagtgcaaaatggctgcagctctatgc

SEQ ID NO: 323281 - DNA, 75 bp, Artificial Sequence
  Synthetic
tatacctggctatatatccatctgagaagtccacttcaaacactgactttgtgatggagtacaattctgaattct

SEQ ID NO: 323282 - DNA, 75 bp, Artificial Sequence
  Synthetic
gaagtccacttcaaacactgactttgtgatggagtacaattctgaattctattttcattctcagcatattaggcc

SEQ ID NO: 323283 - DNA, 75 bp, Artificial Sequence
  Synthetic
tgcagcttgcctgaagttgaaacattggttgctagacaagaggaggcaacaaacctaatgacatcagttacagaa

SEQ ID NO: 323284 - DNA, 75 bp, Artificial Sequence
  Synthetic
tggttgctagacaagaggaggcaacaaacctaatgacatcagttacagaaggaggtggctcattttcactagctc

SEQ ID NO: 323285 - DNA, 75 bp, Artificial Sequence
  Synthetic
tctccactatatgctaatgggtatgggactgagcagtctttttggtgaattcaaaaaggctattttaaaatggaa

SEQ ID NO: 323286 - DNA, 75 bp, Artificial Sequence
  Synthetic
ggactgagcagtctttttggtgaattcaaaaaggctattttaaaatggaaagatcctggattaggcttcttcttg

SEQ ID NO: 323287 - DNA, 75 bp, Artificial Sequence
  Synthetic
taggtgggtttaggttcaacctattcaaggcaataacacagactaatttgaagcagctatacgcatattttatga

SEQ ID NO: 323288 - DNA, 75 bp, Artificial Sequence
  Synthetic
caaggcaataacacagactaatttgaagcagctatacgcatattttatgaaaaaagtcagaaaaggagatgagga

SEQ ID NO: 323289 - DNA, 75 bp, Artificial Sequence
  Synthetic
gttagtccaggaggagcaatcattctcagttctgcactaaaatggggttcaaagcaaaaatttataaagctacga

SEQ ID NO: 323290 - DNA, 75 bp, Artificial Sequence
  Synthetic
tcagttctgcactaaaatggggttcaaagcaaaaatttataaagctacgatccagactggatataccagatgatt

SEQ ID NO: 323291 - DNA, 75 bp, Artificial Sequence
  Synthetic
atctatactatacagggccccaagaacaggtgaggagattaagttaagaatagccgagaaagtgcatagtccagg

SEQ ID NO: 323292 - DNA, 75 bp, Artificial Sequence
  Synthetic
acaggtgaggagattaagttaagaatagccgagaaagtgcatagtccaggtgttgtttcatcactttccactgga

SEQ ID NO: 323293 - DNA, 75 bp, Artificial Sequence
  Synthetic
catctgtttatttcttatcagccagcatctttcaagattcaggacgacaagaattttctgtcattgaggatagta

SEQ ID NO: 323294 - DNA, 75 bp, Artificial Sequence
  Synthetic
catctttcaagattcaggacgacaagaattttctgtcattgaggatagtaagtatagcttactacaaaagatgtt

SEQ ID NO: 323295 - DNA, 75 bp, Artificial Sequence
  Synthetic
cagagactgcaggatgatgagatgctcttcttatttccaaacatggatgagcttctttccctggatcagcttgtg

SEQ ID NO: 323296 - DNA, 75 bp, Artificial Sequence
  Synthetic
tcttcttatttccaaacatggatgagcttctttccctggatcagcttgtgtttgacagaggacagatagatattg

SEQ ID NO: 323297 - DNA, 75 bp, Artificial Sequence
  Synthetic
tactcagacaaagataacagtgtttgagggacaccataatctccgaattgcagcagagaacttagtttctgacaa

SEQ ID NO: 323298 - DNA, 75 bp, Artificial Sequence
  Synthetic
gagggacaccataatctccgaattgcagcagagaacttagtttctgacaagtggtttggaacccttaaaagcaag

SEQ ID NO: 323299 - DNA, 75 bp, Artificial Sequence
  Synthetic
aatggaacaggttgaagtcaattattagctggctaagagatgattcccaagagagtcttgaatcctcaccactca

SEQ ID NO: 323300 - DNA, 75 bp, Artificial Sequence
  Synthetic
tagctggctaagagatgattcccaagagagtcttgaatcctcaccactcacaaatcatattcaaataaggaactt

SEQ ID NO: 323301 - DNA, 75 bp, Artificial Sequence
  Synthetic
agaactgtgcgagtgacaggagctcctgtgcgtaagagatcaggttcaagtaagctgtccatggttatccgagac

SEQ ID NO: 323302 - DNA, 75 bp, Artificial Sequence
  Synthetic
ctgtgcgtaagagatcaggttcaagtaagctgtccatggttatccgagacaatttctgcaagacaggacatataa

SEQ ID NO: 323303 - DNA, 75 bp, Artificial Sequence
  Synthetic
gaacagaagttttatggtagaactgctcaagcatttctgtttctgtgtcttgcaggggccctacaccaatgagac

SEQ ID NO: 323304 - DNA, 75 bp, Artificial Sequence
  Synthetic
ctcaagcatttctgtttctgtgtcttgcaggggccctacaccaatgagacaaaagaaacattgataatcagagta

SEQ ID NO: 323305 - DNA, 75 bp, Artificial Sequence
  Synthetic
caaaggagtcagatggcaagtcaaggactaatatcctctcaataatacagaatttcttaaactcagattcaaata

SEQ ID NO: 323306 - DNA, 75 bp, Artificial Sequence
  Synthetic
gactaatatcctctcaataatacagaatttcttaaactcagattcaaatattatcaggcaggtggaagaacttgg

SEQ ID NO: 323307 - DNA, 75 bp, Artificial Sequence
  Synthetic
ttaccacagaaaagcaaagaaatagaagggaaagtccactattttgggaaaggcatatggagaggagtcatggat

SEQ ID NO: 323308 - DNA, 75 bp, Artificial Sequence
  Synthetic
aagggaaagtccactattttgggaaaggcatatggagaggagtcatggatggatctcaagttcaagtggagttgt

SEQ ID NO: 323309 - DNA, 75 bp, Artificial Sequence
  Synthetic
agtcactagcataactactgatgaaaaaataggaatatgggatttggccaaaagcgtgaagatttggtgtgaaga

SEQ ID NO: 323310 - DNA, 75 bp, Artificial Sequence
  Synthetic
aaaataggaatatgggatttggccaaaagcgtgaagatttggtgtgaagatattggtgcaaaaaatgatatagac

SEQ ID NO: 323311 - DNA, 75 bp, Artificial Sequence
  Synthetic
caaaatattggcttcatggttttagagcatatacctctgacaaaccttatggatgtcctgtgcatgtttcaaaag

SEQ ID NO: 323312 - DNA, 75 bp, Artificial Sequence
  Synthetic
agcatatacctctgacaaaccttatggatgtcctgtgcatgtttcaaaagccagaatgacagatttcagactgag

SEQ ID NO: 323313 - DNA, 75 bp, Artificial Sequence
  Synthetic
gtgagaaaatctacaatgaacctctatgtgaagaactctggaagagatgtccacattgtttcttacactgctcat

SEQ ID NO: 323314 - DNA, 75 bp, Artificial Sequence
  Synthetic
atgtgaagaactctggaagagatgtccacattgtttcttacactgctcatgacaatgatttaagcactaactgcc

SEQ ID NO: 323315 - DNA, 75 bp, Artificial Sequence
  Synthetic
ggtgatgagagagatattctgcaaggaaccaagctcatcatgggctttttgccagtcgctgccacacgcatttat

SEQ ID NO: 323316 - DNA, 75 bp, Artificial Sequence
  Synthetic
gaaccaagctcatcatgggctttttgccagtcgctgccacacgcatttatacacaaaattcttgatctttgtgaa

SEQ ID NO: 323317 - DNA, 75 bp, Artificial Sequence
  Synthetic
ataatgagagactagccaatctggtaagaatatgtactgaaaactctctcagagtaaaagttggaacaatatatt

SEQ ID NO: 323318 - DNA, 75 bp, Artificial Sequence
  Synthetic
aagaatatgtactgaaaactctctcagagtaaaagttggaacaatatattctgccctcccttcatattctgatgc

SEQ ID NO: 323319 - DNA, 75 bp, Artificial Sequence
  Synthetic
ttagttgatttaatgatagaggacatgacaaaatctaactttgaagaggctgtacaaatgatgagagaggagtca

SEQ ID NO: 323320 - DNA, 75 bp, Artificial Sequence
  Synthetic
tgacaaaatctaactttgaagaggctgtacaaatgatgagagaggagtcaaacacagaatatgatattgaagagt

SEQ ID NO: 323321 - DNA, 75 bp, Artificial Sequence
  Synthetic
tggaccagctcactataaggaaacttctgatctaacaatgatatcacatcccctgatggatgactttatgaatca

SEQ ID NO: 323322 - DNA, 75 bp, Artificial Sequence
  Synthetic
tctgatctaacaatgatatcacatcccctgatggatgactttatgaatcatttaattgcaaaatgctcaaggaaa

SEQ ID NO: 323323 - DNA, 75 bp, Artificial Sequence
  Synthetic
atagatgtcaacaaagattcttaagtttatttaaggatttatacagagcattgaggcgagatcctgaagacctaa

SEQ ID NO: 323324 - DNA, 75 bp, Artificial Sequence
  Synthetic
tttatttaaggatttatacagagcattgaggcgagatcctgaagacctaaaggttgatgatcttctttctgacag

SEQ ID NO: 323325 - DNA, 75 bp, Artificial Sequence
  Synthetic
attggctagaataattgtaggtttagtcaaagtttaaagtgtcaatataaatcccaaccatcaatatagtgaaaa

SEQ ID NO: 323326 - DNA, 75 bp, Artificial Sequence
  Synthetic
atacacttaaacttaaaaacaaaatctcaagcataatagaatagattttaatttagtataaaagggcggtctttg

SEQ ID NO: 323327 - DNA, 75 bp, Artificial Sequence
  Synthetic
acacaaagctccctgaagatttaataacgaagaaaacaaacatgtcttacgaagagattgcggttaattttgcct

SEQ ID NO: 323328 - DNA, 75 bp, Artificial Sequence
  Synthetic
aacgaagaaaacaaacatgtcttacgaagagattgcggttaattttgcctctgagtcaattgatgagtcgacaat

SEQ ID NO: 323329 - DNA, 75 bp, Artificial Sequence
  Synthetic
gaagagattgcggttaattttgcctctgagtcaattgatgagtcgacaatatctgcttgggtttctgactttgct

SEQ ID NO: 323330 - DNA, 75 bp, Artificial Sequence
  Synthetic
taattgctctcattaaagaaagaggaggtgagaactggaaggaagatgtcaagaaaatgattgttttgtcattga

SEQ ID NO: 323331 - DNA, 75 bp, Artificial Sequence
  Synthetic
aggtgagaactggaaggaagatgtcaagaaaatgattgttttgtcattgacccgaggaaacaagcctgctaagat

SEQ ID NO: 323332 - DNA, 75 bp, Artificial Sequence
  Synthetic
aagaaggaagtcaatgatctcataactcggtacaaactgaaatctggcaatccctctcgtgatgacttaactttg

SEQ ID NO: 323333 - DNA, 75 bp, Artificial Sequence
  Synthetic
ctcggtacaaactgaaatctggcaatccctctcgtgatgacttaactttgtcaagagttgctgctgcttttgctg

SEQ ID NO: 323334 - DNA, 75 bp, Artificial Sequence
  Synthetic
tgtgcaggaatatttacctgtgacaggaagagcaatggatgctttctctgcagactttcctagagctctaatgca

SEQ ID NO: 323335 - DNA, 75 bp, Artificial Sequence
  Synthetic
ggaagagcaatggatgctttctctgcagactttcctagagctctaatgcatcctagttttgctggtctgattgat

SEQ ID NO: 323336 - DNA, 75 bp, Artificial Sequence
  Synthetic
cagatattgtccatgcccattgcctgttcatgatacaattttcaaagacaattaatcctacaattcgttctgcca

SEQ ID NO: 323337 - DNA, 75 bp, Artificial Sequence
  Synthetic
gttcatgatacaattttcaaagacaattaatcctacaattcgttctgccagtaaggatgagattgtagcaagttt

SEQ ID NO: 323338 - DNA, 75 bp, Artificial Sequence
  Synthetic
aacagcaccttcttaacctctgcccagcgcagagccatgttgaagacacttggggtcataaatgacaacctcaag

SEQ ID NO: 323339 - DNA, 75 bp, Artificial Sequence
  Synthetic
agcgcagagccatgttgaagacacttggggtcataaatgacaacctcaaggtttcaactgctgtgtctagtgctg

SEQ ID NO: 323340 - DNA, 75 bp, Artificial Sequence
  Synthetic
aaatatccactccactcctcagaactcttccataacccatcccaccacccaaaaaaagagaaaaacaaaacaaaa

SEQ ID NO: 323341 - DNA, 75 bp, Artificial Sequence
  Synthetic
tcttccataacccatcccaccacccaaaaaaagagaaaaacaaaacaaaaaaatcaaaaaacaaaaaaagctcaa

SEQ ID NO: 323342 - DNA, 75 bp, Artificial Sequence
  Synthetic
cccatcccctacaacccacctaataccccctcccaccactaggcagagactatcttactgatttagcatagtaat

SEQ ID NO: 323343 - DNA, 75 bp, Artificial Sequence
  Synthetic
ccccctcccaccactaggcagagactatcttactgatttagcatagtaataggagcccatttagcattccccaga

SEQ ID NO: 323344 - DNA, 75 bp, Artificial Sequence
  Synthetic
gtaattggattatgttaaataagggtgattgacaacaatcatctttaagatcgaagggcaaagctgtcatcattc

SEQ ID NO: 323345 - DNA, 75 bp, Artificial Sequence
  Synthetic
tgattgacaacaatcatctttaagatcgaagggcaaagctgtcatcattctgatgatttgaatgtaagcaatttc

SEQ ID NO: 323346 - DNA, 75 bp, Artificial Sequence
  Synthetic
atcaaagatgagatctctctgtctgatagttcattcagcatgaatttatacaaattgcgcaaggaatcatctaag

SEQ ID NO: 323347 - DNA, 75 bp, Artificial Sequence
  Synthetic
atagttcattcagcatgaatttatacaaattgcgcaaggaatcatctaagccaagtccctggcctatcctcatga

SEQ ID NO: 323348 - DNA, 75 bp, Artificial Sequence
  Synthetic
aagccagttgtgctcatatgacttcagcatagaaagttggaagaatttgaaagatgggtagcctagaggccaaga

SEQ ID NO: 323349 - DNA, 75 bp, Artificial Sequence
  Synthetic
agcatagaaagttggaagaatttgaaagatgggtagcctagaggccaagaaagggctttctttatgtttggctca

SEQ ID NO: 323350 - DNA, 75 bp, Artificial Sequence
  Synthetic
ttaagtcagacagtctttcaattgttgtatcaaagaactctggagacttcatcagtacaaatgagttagtaaaac

SEQ ID NO: 323351 - DNA, 75 bp, Artificial Sequence
  Synthetic
tgtatcaaagaactctggagacttcatcagtacaaatgagttagtaaaaccccatgatttaggaagtagaccctc

SEQ ID NO: 323352 - DNA, 75 bp, Artificial Sequence
  Synthetic
ctctctacagcagattgactcagactatgaacaggaatttcagcccctttatacaaactcacagggcaatcatat

SEQ ID NO: 323353 - DNA, 75 bp, Artificial Sequence
  Synthetic
ctgaaactctgtgaagaggacccactgagtgcgagattatgggtatctctcgagcaaaatggttagttttataca

SEQ ID NO: 323354 - DNA, 75 bp, Artificial Sequence
  Synthetic
tgagtgcgagattatgggtatctctcgagcaaaatggttagttttatacatttcgaaataagtcagggggtcttt

SEQ ID NO: 323355 - DNA, 75 bp, Artificial Sequence
  Synthetic
acacaaagacggcgaaaatgtttcagattatatacttactaaccaagctgtacctggtatcatccatgtatagca

SEQ ID NO: 323356 - DNA, 75 bp, Artificial Sequence
  Synthetic
gattatatacttactaaccaagctgtacctggtatcatccatgtatagcattatgttttgggagaatgaaaatat

SEQ ID NO: 323357 - DNA, 75 bp, Artificial Sequence
  Synthetic
tacctggtatcatccatgtatagcattatgttttgggagaatgaaaatatatccaagctatgtcttagtaacaat

SEQ ID NO: 323358 - DNA, 75 bp, Artificial Sequence
  Synthetic
actgggagaatgtgatgaaagagggagactttaaggaagaaaagagaaaaaaatgtagaattggtccttctgatc

SEQ ID NO: 323359 - DNA, 75 bp, Artificial Sequence
  Synthetic
agactttaaggaagaaaagagaaaaaaatgtagaattggtccttctgatctgaagagggtaactaatcaaacatt

SEQ ID NO: 323360 - DNA, 75 bp, Artificial Sequence
  Synthetic
aaaagcccctccgagatccaactactgtgtgaagaagatggcaataagacgggaatatcaatgttttttgatgga

SEQ ID NO: 323361 - DNA, 75 bp, Artificial Sequence
  Synthetic
tgtgtgaagaagatggcaataagacgggaatatcaatgttttttgatggattgtcagatgacatctcaaccccaa

SEQ ID NO: 323362 - DNA, 75 bp, Artificial Sequence
  Synthetic
caggatttcagatctaagggttcaggtgggaagaggtcattttgaaaaggagaatgagataagaaagatagaaga

SEQ ID NO: 323363 - DNA, 75 bp, Artificial Sequence
  Synthetic
gtgggaagaggtcattttgaaaaggagaatgagataagaaagatagaagaaatagtgactttagaagatgatctt

SEQ ID NO: 323364 - DNA, 75 bp, Artificial Sequence
  Synthetic
tgctacaggatttgaataagaaggatgcagaggagagaagaattattgaacatgagctaaccaatatgagagagc

SEQ ID NO: 323365 - DNA, 75 bp, Artificial Sequence
  Synthetic
tgcagaggagagaagaattattgaacatgagctaaccaatatgagagagcagctgcagagagaaagagagaggag

SEQ ID NO: 323366 - DNA, 75 bp, Artificial Sequence
  Synthetic
aagattgaagtgaataaccacaaagagcctgcaactcatttaaatgtgtcaaaactcttaacaattgggctcctg

SEQ ID NO: 323367 - DNA, 75 bp, Artificial Sequence
  Synthetic
agcctgcaactcatttaaatgtgtcaaaactcttaacaattgggctcctggctcaacaggttggacaagtaatag

SEQ ID NO: 323368 - DNA, 75 bp, Artificial Sequence
  Synthetic
ctggatccatgcaaagaataggataggaaaggggttatacaaaacagaagacactgatgaggatggatgtagagg

SEQ ID NO: 323369 - DNA, 75 bp, Artificial Sequence
  Synthetic
ggaaaggggttatacaaaacagaagacactgatgaggatggatgtagaggcttggattatggtgtcagttgctta

SEQ ID NO: 323370 - DNA, 75 bp, Artificial Sequence
  Synthetic
atatatatccctttttcaattcttttgttagtcacttatcaatgcttgaggctagcacagaagatctaattgaga

SEQ ID NO: 323371 - DNA, 75 bp, Artificial Sequence
  Synthetic
tgttagtcacttatcaatgcttgaggctagcacagaagatctaattgagaaagagggaacatcttgtgagataga

SEQ ID NO: 323372 - DNA, 75 bp, Artificial Sequence
  Synthetic
gaagaaagagcattcataaaaggctcttgtcctcatttagttaattcagcacattttctagataacaaggggaag

SEQ ID NO: 323373 - DNA, 75 bp, Artificial Sequence
  Synthetic
cttgtcctcatttagttaattcagcacattttctagataacaaggggaagctcagaatagtcaaatgcaagacag

SEQ ID NO: 323374 - DNA, 75 bp, Artificial Sequence
  Synthetic
attctgcaggaaaattaaaaagaaaaatagccaacacaagcaggtttttaagacatctattgctctgcaagatgc

SEQ ID NO: 323375 - DNA, 75 bp, Artificial Sequence
  Synthetic
aatagccaacacaagcaggtttttaagacatctattgctctgcaagatgctgtatgccagaacaactcagatcta

SEQ ID NO: 323376 - DNA, 75 bp, Artificial Sequence
  Synthetic
gtaatgtgtgtaaaattggaatggtttcctacaagcagtgtaagtctaagaccagtagttatgagtctgttggct

SEQ ID NO: 323377 - DNA, 75 bp, Artificial Sequence
  Synthetic
ttcctacaagcagtgtaagtctaagaccagtagttatgagtctgttggctttgttattctgaaagggaaagggaa

SEQ ID NO: 323378 - DNA, 75 bp, Artificial Sequence
  Synthetic
aaaaatatcgaagtgatcgctaatgtttctttcatttgtcatcagtatcaaggtcaagatggaacagaaaaggag

SEQ ID NO: 323379 - DNA, 75 bp, Artificial Sequence
  Synthetic
tttctttcatttgtcatcagtatcaaggtcaagatggaacagaaaaggagcagagatctctcaagagaattagtg

SEQ ID NO: 323380 - DNA, 75 bp, Artificial Sequence
  Synthetic
tcagaagacaaagcactgcacaggtgatcatgtgttctgtgagaaatatgactgcactaaatcctatcctgaagt

SEQ ID NO: 323381 - DNA, 75 bp, Artificial Sequence
  Synthetic
gatcatgtgttctgtgagaaatatgactgcactaaatcctatcctgaagtgacctgcttaatggcacctggttct

SEQ ID NO: 323382 - DNA, 75 bp, Artificial Sequence
  Synthetic
gttcttggattaaaccacagtgtgttggttatgaaaaagtgctagttgagagagaggtgaaatcgccaactctca

SEQ ID NO: 323383 - DNA, 75 bp, Artificial Sequence
  Synthetic
tggttatgaaaaagtgctagttgagagagaggtgaaatcgccaactctcactgaagagagagactgtgacacttg

SEQ ID NO: 323384 - DNA, 75 bp, Artificial Sequence
  Synthetic
atattgataaaatcaacaggcttcaagatgatctctgctgtggcatgctcacatggcatgtgtgtatcatcacat

SEQ ID NO: 323385 - DNA, 75 bp, Artificial Sequence
  Synthetic
agatgatctctgctgtggcatgctcacatggcatgtgtgtatcatcacatcaggagccttctacattcttgtaca

SEQ ID NO: 323386 - DNA, 75 bp, Artificial Sequence
  Synthetic
aataggaggagagattggactgcacttgtcacacactgatgactctctaagccttcacaaggtgatatcgtgtcc

SEQ ID NO: 323387 - DNA, 75 bp, Artificial Sequence
  Synthetic
ttgtcacacactgatgactctctaagccttcacaaggtgatatcgtgtccatcacgaaacccttgtgatgtacat

SEQ ID NO: 323388 - DNA, 75 bp, Artificial Sequence
  Synthetic
taatcaattatcaatgtcatacagctcttagttacacaattgttgcattttctttcatatcttttctttatctga

SEQ ID NO: 323389 - DNA, 75 bp, Artificial Sequence
  Synthetic
tcttagttacacaattgttgcattttctttcatatcttttctttatctgacattcaaagtgatcagtcaactact

SEQ ID NO: 323390 - DNA, 75 bp, Artificial Sequence
  Synthetic
aaattaaaaggccccttctactggatgggatacctgattaaatggatagtgaagaccattttgggagttgtaaga

SEQ ID NO: 323391 - DNA, 75 bp, Artificial Sequence
  Synthetic
tgggatacctgattaaatggatagtgaagaccattttgggagttgtaagaaataccttctttactatgagcaata

SEQ ID NO: 323392 - DNA, 75 bp, Artificial Sequence
  Synthetic
aatccatgaggatatagaagcaaatccaagacggcacttgcagagatttaagaccacatttgtattaaccatgtt

SEQ ID NO: 323393 - DNA, 75 bp, Artificial Sequence
  Synthetic
ccaagacggcacttgcagagatttaagaccacatttgtattaaccatgttaatgatcaatggaggtttatgttgc

SEQ ID NO: 323394 - DNA, 75 bp, Artificial Sequence
  Synthetic
agcaaactcgatgtgttcagtcaggaaacgaggttaagtgctctgttagtgctacagtagtcttgaaagcaggag

SEQ ID NO: 323395 - DNA, 75 bp, Artificial Sequence
  Synthetic
aaacgaggttaagtgctctgttagtgctacagtagtcttgaaagcaggagttataggggcagaatcttgttttat

SEQ ID NO: 323396 - DNA, 75 bp, Artificial Sequence
  Synthetic
cacaagatgataagtgttcgaacactttctagtgaaactgtttgtagggaaggagcaagcttttggacaggccat

SEQ ID NO: 323397 - DNA, 75 bp, Artificial Sequence
  Synthetic
tttctagtgaaactgtttgtagggaaggagcaagcttttggacaggccatttctcaccctcctgtgtaagttcta

SEQ ID NO: 323398 - DNA, 75 bp, Artificial Sequence
  Synthetic
ccatggaaatagatgtcagtcttggagggatgatcagatttctcgagagttcgggggcgtaaaagataataatag

SEQ ID NO: 323399 - DNA, 75 bp, Artificial Sequence
  Synthetic
agggatgatcagatttctcgagagttcgggggcgtaaaagataataataggatgtcagagaataagtgttttgag

SEQ ID NO: 323400 - DNA, 75 bp, Artificial Sequence
  Synthetic
gttttaatatgaatccatcatgcttgtacgtacacaccactcttaagagtgctaggaatgaagcagttcgagtgt

SEQ ID NO: 323401 - DNA, 75 bp, Artificial Sequence
  Synthetic
gtacgtacacaccactcttaagagtgctaggaatgaagcagttcgagtgttcaaatgtaatgattggattcaccg

SEQ ID NO: 323402 - DNA, 75 bp, Artificial Sequence
  Synthetic
tctggagagaaggatgtagtaaccctgaatagcatgagcactaaatttttgcaatggggcactatatcactcagt

SEQ ID NO: 323403 - DNA, 75 bp, Artificial Sequence
  Synthetic
tgaatagcatgagcactaaatttttgcaatggggcactatatcactcagtcttgatgcagagggaattactggaa

SEQ ID NO: 323404 - DNA, 75 bp, Artificial Sequence
  Synthetic
tagtaagggtggatttgctatccatgatgaggagttctcagacatcccaagggaaggctatttaggggaaattcg

SEQ ID NO: 323405 - DNA, 75 bp, Artificial Sequence
  Synthetic
gatgaggagttctcagacatcccaagggaaggctatttaggggaaattcgatgctcatcagaatctgctgtaata

SEQ ID NO: 323406 - DNA, 75 bp, Artificial Sequence
  Synthetic
ctcctgacttgataaagtataagccaatgacagatcaaattgagtgcacatcaactttaatagatccatttgcca

SEQ ID NO: 323407 - DNA, 75 bp, Artificial Sequence
  Synthetic
aatgacagatcaaattgagtgcacatcaactttaatagatccatttgccattttcatgaaaggatcactacccca

SEQ ID NO: 323408 - DNA, 75 bp, Artificial Sequence
  Synthetic
agctccaaggataagaaaaccattcaggctttcaatacaaattctattaaggctctgatatccttaaatttagac

SEQ ID NO: 323409 - DNA, 75 bp, Artificial Sequence
  Synthetic
aggctttcaatacaaattctattaaggctctgatatccttaaatttagacgaccatgaaattgtctttgtgtctg

SEQ ID NO: 323410 - DNA, 75 bp, Artificial Sequence
  Synthetic
tctaaacctcacaggttgttactcctgtgattatggagcacatgtgtgttttagaatcaaatctgacaaaaaggg

SEQ ID NO: 323411 - DNA, 75 bp, Artificial Sequence
  Synthetic
tgtgattatggagcacatgtgtgttttagaatcaaatctgacaaaaagggtgtctttgttagcaatacagaggca

SEQ ID NO: 323412 - DNA, 75 bp, Artificial Sequence
  Synthetic
ttttaacaggtactcatgactattgtcaaatacaacattttaacagcccatcagtgtacaaaactttaagttaca

SEQ ID NO: 323413 - DNA, 75 bp, Artificial Sequence
  Synthetic
tcaaatacaacattttaacagcccatcagtgtacaaaactttaagttacagttgcgggggagaatcaaaattact

SEQ ID NO: 323414 - DNA, 75 bp, Artificial Sequence
  Synthetic
ataggtcctcatgattacagaaacaagacaggaggggcttccactgttgtgaatccctctgaggaaggatggagt

SEQ ID NO: 323415 - DNA, 75 bp, Artificial Sequence
  Synthetic
agacaggaggggcttccactgttgtgaatccctctgaggaaggatggagtgtgaccaactggattggtggcttta

SEQ ID NO: 323416 - DNA, 75 bp, Artificial Sequence
  Synthetic
ggccttactaaaaatagccgtgacaatactagccggagtagtgatatttctcatcatatatttcttcttaaggct

SEQ ID NO: 323417 - DNA, 75 bp, Artificial Sequence
  Synthetic
atactagccggagtagtgatatttctcatcatatatttcttcttaaggctaattgcaacaaatatcttgatgaag

SEQ ID NO: 323418 - DNA, 75 bp, Artificial Sequence
  Synthetic
ctggatctcattagttgtttaatttataatcaccaactcttaaaataagtaagaaatatcaactttagccttcaa

SEQ ID NO: 323419 - DNA, 75 bp, Artificial Sequence
  Synthetic
ataatcaccaactcttaaaataagtaagaaatatcaactttagccttcaaaaaaatcagaccaaagataacgcac

SEQ ID NO: 323420 - DNA, 75 bp, Artificial Sequence
  Synthetic
acacttccagggctagataaagaaaacaaaataaaatccataaaaaaagagaaaaaataccaaaacactaaaatt

SEQ ID NO: 323421 - DNA, 75 bp, Artificial Sequence
  Synthetic
acaaaataaaatccataaaaaaagagaaaaaataccaaaacactaaaattaacacataaaatttataaaggattt

SEQ ID NO: 323422 - DNA, 75 bp, Artificial Sequence
  Synthetic
gggtaagggtgagaggcagtgattatttcttggtgtgaattagaatcaaccactatatatcaaagcagtgatcca

SEQ ID NO: 323423 - DNA, 75 bp, Artificial Sequence
  Synthetic
tgtgtaagaccaagttcctaagcgctgtattcaatttagtagtgtaatttggataaatatcgccggtctttgtgt

SEQ ID NO: 323424 - DNA, 75 bp, Artificial Sequence
  Synthetic
aaactaaaccgagatgcaatcgcggcttgttttccttaagcctaaaccaggcaagaagaggtctttgcccaggtt

SEQ ID NO: 323425 - DNA, 75 bp, Artificial Sequence
  Synthetic
cttgttttccttaagcctaaaccaggcaagaagaggtctttgcccaggttctatgtcgaggccaatccggactca

SEQ ID NO: 323426 - DNA, 75 bp, Artificial Sequence
  Synthetic
gcaagaagaggtctttgcccaggttctatgtcgaggccaatccggactcaaactatgatggagctcagtgtctta

SEQ ID NO: 323427 - DNA, 75 bp, Artificial Sequence
  Synthetic
tgagaagtacaaagttgcttatgatcagagacccaccttgtctcattttctttccaagaacgagtttccagctat

SEQ ID NO: 323428 - DNA, 75 bp, Artificial Sequence
  Synthetic
cagagacccaccttgtctcattttctttccaagaacgagtttccagctattcttggattcagcatggtttccaag

SEQ ID NO: 323429 - DNA, 75 bp, Artificial Sequence
  Synthetic
ccatgcttgagctgtacagggaatcaatacatcatctcaagcgcaacaggattgattacctcctttctgcattac

SEQ ID NO: 323430 - DNA, 75 bp, Artificial Sequence
  Synthetic
aatacatcatctcaagcgcaacaggattgattacctcctttctgcattacgatggccaacaggaataccaacttt

SEQ ID NO: 323431 - DNA, 75 bp, Artificial Sequence
  Synthetic
gagttgatatatctgtctgaaactgacttaggcactgtcaataagtatctgaaactgcttatcaaagcttctgga

SEQ ID NO: 323432 - DNA, 75 bp, Artificial Sequence
  Synthetic
acttaggcactgtcaataagtatctgaaactgcttatcaaagcttctggattgtacttttctagtgttgaggacc

SEQ ID NO: 323433 - DNA, 75 bp, Artificial Sequence
  Synthetic
cctactagaaggaaagaagtatggattaaatcactatgatttgactggaaatgacataattgctgacatttgtgt

SEQ ID NO: 323434 - DNA, 75 bp, Artificial Sequence
  Synthetic
ttaaatcactatgatttgactggaaatgacataattgctgacatttgtgtggtccaggctgccagagttacccac

SEQ ID NO: 323435 - DNA, 75 bp, Artificial Sequence
  Synthetic
gttagcatgatatgagactagcatgctacatagctcaccgccctatcgagttagctatcctaaagagaactaagc

SEQ ID NO: 323436 - DNA, 75 bp, Artificial Sequence
  Synthetic
ctacatagctcaccgccctatcgagttagctatcctaaagagaactaagccatccagcatgctagacagtagctt

SEQ ID NO: 323437 - DNA, 75 bp, Artificial Sequence
  Synthetic
tatgagaagtttatgaaagaagatattacatttagagaggacgccttatccactaaatggggaaaagattggcca

SEQ ID NO: 323438 - DNA, 75 bp, Artificial Sequence
  Synthetic
ttacatttagagaggacgccttatccactaaatggggaaaagattggccaacagcatcagaggcttccaagcaag

SEQ ID NO: 323439 - DNA, 75 bp, Artificial Sequence
  Synthetic
aaagagactgacaaaatggctgccaaagtcccctgattacccacccctctgattacccacccactattaacccaa

SEQ ID NO: 323440 - DNA, 75 bp, Artificial Sequence
  Synthetic
aagtcccctgattacccacccctctgattacccacccactattaacccaattcaagaccctaaccccaaacccaa

SEQ ID NO: 323441 - DNA, 75 bp, Artificial Sequence
  Synthetic
cccatcccttaacccccctttacagcttacctgtcttggctctgtacttttcagcacacttgacaacactagctg

SEQ ID NO: 323442 - DNA, 75 bp, Artificial Sequence
  Synthetic
cttacctgtcttggctctgtacttttcagcacacttgacaacactagctgtcagaagcaagtcatcattgataat

SEQ ID NO: 323443 - DNA, 75 bp, Artificial Sequence
  Synthetic
ttgtcttctctggagaagaatttcccagacatggcagccatgttgggtttctcaaatgttgtggcgatctcattt

SEQ ID NO: 323444 - DNA, 75 bp, Artificial Sequence
  Synthetic
cagacatggcagccatgttgggtttctcaaatgttgtggcgatctcatttggctgtttggttctcagagacggat

SEQ ID NO: 323445 - DNA, 75 bp, Artificial Sequence
  Synthetic
gaacaatccatgagcatcagcaatcatttctcctgtcttccttggaagctccagatcaactattcctgcaaagct

SEQ ID NO: 323446 - DNA, 75 bp, Artificial Sequence
  Synthetic
atttctcctgtcttccttggaagctccagatcaactattcctgcaaagcttggatgcatcatagctcttgggtaa

SEQ ID NO: 323447 - DNA, 75 bp, Artificial Sequence
  Synthetic
tggttccagtcacaggcaagtgatctgagagcactcttagggcttgaacagtccatggcacaaaagcagcagaga

SEQ ID NO: 323448 - DNA, 75 bp, Artificial Sequence
  Synthetic
tgagagcactcttagggcttgaacagtccatggcacaaaagcagcagagactcgtgagagagtgatagtgtccct

SEQ ID NO: 323449 - DNA, 75 bp, Artificial Sequence
  Synthetic
tagactgagataagctgggcaacaatggcagcacctttctctgacatctttttcatcatcgcttctggcttgttc

SEQ ID NO: 323450 - DNA, 75 bp, Artificial Sequence
  Synthetic
tggcagcacctttctctgacatctttttcatcatcgcttctggcttgttccccctcactagattgagaacaatca

SEQ ID NO: 323451 - DNA, 75 bp, Artificial Sequence
  Synthetic
tctgcctttggcagtccctctttccttaaccagctggactatacgtcttggatcaaatccttggtacgcaaaatc

SEQ ID NO: 323452 - DNA, 75 bp, Artificial Sequence
  Synthetic
acgtcagctgactcttcggcaaaggccaaagcaatcttatgatagtcgtcctcagacattttgctatttgttagt

SEQ ID NO: 323453 - DNA, 75 bp, Artificial Sequence
  Synthetic
ccaaagcaatcttatgatagtcgtcctcagacattttgctatttgttagttaataaacgggaatctctgtgtccc

SEQ ID NO: 323454 - DNA, 75 bp, Artificial Sequence
  Synthetic
ctagaggctgcaacagagacaataccgatactcaacaagagctcagctgtctgcacaatctccccatccacgcat

SEQ ID NO: 323455 - DNA, 75 bp, Artificial Sequence
  Synthetic
gtggctggatgatcagaagctggaaaaagagagtgggctcagctatttctagaaccaatgacactattggttggc

SEQ ID NO: 323456 - DNA, 75 bp, Artificial Sequence
  Synthetic
acaaagaccgcccaattcttacaaaacctaaaacaactaaacactcacacaacgttgacccatgaacacgaacaa

SEQ ID NO: 323457 - DNA, 75 bp, Artificial Sequence
  Synthetic
acctaaaacaactaaacactcacacaacgttgacccatgaacacgaacaaatatactatttctcacacgcactac

SEQ ID NO: 323458 - DNA, 75 bp, Artificial Sequence
  Synthetic
aacgttgacccatgaacacgaacaaatatactatttctcacacgcactacccaagaaggtcgtcaggaacgtcag

SEQ ID NO: 323459 - DNA, 75 bp, Artificial Sequence
  Synthetic
atcctttatttgagatggatccctctccagagccaaaaagagtaactcagcaacctctctacagtcagaggtaat

SEQ ID NO: 323460 - DNA, 75 bp, Artificial Sequence
  Synthetic
tccagagccaaaaagagtaactcagcaacctctctacagtcagaggtaatgattgatttttctaatagccttctg

SEQ ID NO: 323461 - DNA, 75 bp, Artificial Sequence
  Synthetic
caagtctggttacaaacccatccatcagtggatgtgctaatatcgtcagactctgaagttctttgtaatgcgctg

SEQ ID NO: 323462 - DNA, 75 bp, Artificial Sequence
  Synthetic
cagtggatgtgctaatatcgtcagactctgaagttctttgtaatgcgctggcccaaagaggttcaagctctcctc

SEQ ID NO: 323463 - DNA, 75 bp, Artificial Sequence
  Synthetic
tcagggtcttcatcaactgtgaggaaatcagccagatcctcaaaagtttcatccataccttcttctatcatcatg

SEQ ID NO: 323464 - DNA, 75 bp, Artificial Sequence
  Synthetic
aatcagccagatcctcaaaagtttcatccataccttcttctatcatcatgtcaaacatatcactcatatcaattg

SEQ ID NO: 323465 - DNA, 75 bp, Artificial Sequence
  Synthetic
tcttgtctggctgtaaactgtgcctatcttgttcctgatggatgattctgtgcacagcctgattatttctctcag

SEQ ID NO: 323466 - DNA, 75 bp, Artificial Sequence
  Synthetic
atcttgttcctgatggatgattctgtgcacagcctgattatttctctcagtcttgtggtgtcaatctgctttggt

SEQ ID NO: 323467 - DNA, 75 bp, Artificial Sequence
  Synthetic
gcactactggtctaacgaatttccatggcagtggctgacagagcatccaggatcttgttggctcaacagaaaaca

SEQ ID NO: 323468 - DNA, 75 bp, Artificial Sequence
  Synthetic
tggcagtggctgacagagcatccaggatcttgttggctcaacagaaaacagacccttgtacacaaagaattcatc

SEQ ID NO: 323469 - DNA, 75 bp, Artificial Sequence
  Synthetic
gagcttatatctgaatctgaaggagtgtatgataagatgtgcagatcacgaggtctcttatctttgctcttcaca

SEQ ID NO: 323470 - DNA, 75 bp, Artificial Sequence
  Synthetic
tgtatgataagatgtgcagatcacgaggtctcttatctttgctcttcacataaagattgactgtattgcgtctca

SEQ ID NO: 323471 - DNA, 75 bp, Artificial Sequence
  Synthetic
taataagccaaggtctgtgatgtcacccctgactatgtagattgggcacccatatggataagatgatccatacat

SEQ ID NO: 323472 - DNA, 75 bp, Artificial Sequence
  Synthetic
cccctgactatgtagattgggcacccatatggataagatgatccatacatcttaaaaccataaatccagtaattt

SEQ ID NO: 323473 - DNA, 75 bp, Artificial Sequence
  Synthetic
cagtactgttagagacttgcatgtcctcacaccatgccttcagactctgagtcaacacccagggttttgagcagt

SEQ ID NO: 323474 - DNA, 75 bp, Artificial Sequence
  Synthetic
ctcacaccatgccttcagactctgagtcaacacccagggttttgagcagttagatatcgttatggagctcaaata

SEQ ID NO: 323475 - DNA, 75 bp, Artificial Sequence
  Synthetic
acttctatctgcagctgatagccatccattatccctttccagatccctttgccatagtacttatgattgatagat

SEQ ID NO: 323476 - DNA, 75 bp, Artificial Sequence
  Synthetic
ccattatccctttccagatccctttgccatagtacttatgattgatagatgactgactgaattgctgtaccttcg

SEQ ID NO: 323477 - DNA, 75 bp, Artificial Sequence
  Synthetic
catgtcttctataagagctgctatacccacatcgttcttgatgaatctttgaagtaggctgatcgtgtttgctct

SEQ ID NO: 323478 - DNA, 75 bp, Artificial Sequence
  Synthetic
cccacatcgttcttgatgaatctttgaagtaggctgatcgtgtttgctcttgacctcttgtcattataattcaat

SEQ ID NO: 323479 - DNA, 75 bp, Artificial Sequence
  Synthetic
tcctcactatgtattccagcttagcactctcagtataggggcccattagtactgagaataagtaatgcttaattt

SEQ ID NO: 323480 - DNA, 75 bp, Artificial Sequence
  Synthetic
actctcagtataggggcccattagtactgagaataagtaatgcttaattttctccacctgcattgctctgctatg

SEQ ID NO: 323481 - DNA, 75 bp, Artificial Sequence
  Synthetic
atataaccaaccttgcaaaagttgtcccgtattgccatggcaatcttactcattcctgaccttttcttcactgga

SEQ ID NO: 323482 - DNA, 75 bp, Artificial Sequence
  Synthetic
cccgtattgccatggcaatcttactcattcctgaccttttcttcactggagcccctgtgactttgattactcgtg

SEQ ID NO: 323483 - DNA, 75 bp, Artificial Sequence
  Synthetic
gtttctgatttggacatgattagagaaaggagaactctccaatgtatctgaaggagcatctctcagccacctcac

SEQ ID NO: 323484 - DNA, 75 bp, Artificial Sequence
  Synthetic
aaaggagaactctccaatgtatctgaaggagcatctctcagccacctcacaattgttttcaatctgtcccactcc

SEQ ID NO: 323485 - DNA, 75 bp, Artificial Sequence
  Synthetic
tgcttttccttgttccgaaccacttatcactaaccaatttctctggagcaacacgagctgatgaatgatgctcaa

SEQ ID NO: 323486 - DNA, 75 bp, Artificial Sequence
  Synthetic
atcactaaccaatttctctggagcaacacgagctgatgaatgatgctcaaacacgacaatcctggtttgagttgc

SEQ ID NO: 323487 - DNA, 75 bp, Artificial Sequence
  Synthetic
acattaaagctccccttatcataaatgttggaatcaaaagcctcaaattctgacaggtttggaaagagaaatagc

SEQ ID NO: 323488 - DNA, 75 bp, Artificial Sequence
  Synthetic
tgttggaatcaaaagcctcaaattctgacaggtttggaaagagaaatagcagatcctcctgactgatgctatcac

SEQ ID NO: 323489 - DNA, 75 bp, Artificial Sequence
  Synthetic
tatcttctgtaataagctgtacttgtcactgttcatgactttatattcttggtttcccgcatcttcaaatatgca

SEQ ID NO: 323490 - DNA, 75 bp, Artificial Sequence
  Synthetic
tcactgttcatgactttatattcttggtttcccgcatcttcaaatatgcatgcagataagaaatagacagaggat

SEQ ID NO: 323491 - DNA, 75 bp, Artificial Sequence
  Synthetic
ctgtgctcagagatgagacaactcctgggctatggaccttttctgctatgcgtagcattatctctgttcctgtct

SEQ ID NO: 323492 - DNA, 75 bp, Artificial Sequence
  Synthetic
tgggctatggaccttttctgctatgcgtagcattatctctgttcctgtctgaggtgccctgtataacacttccgg

SEQ ID NO: 323493 - DNA, 75 bp, Artificial Sequence
  Synthetic
tcctctgggatattcaacctgttcctcaacttcttgaatttctcaactgaaccccatcttagtgttgaactcatc

SEQ ID NO: 323494 - DNA, 75 bp, Artificial Sequence
  Synthetic
tcaacttcttgaatttctcaactgaaccccatcttagtgttgaactcatcactattgcacctcctgggctgacac

SEQ ID NO: 323495 - DNA, 75 bp, Artificial Sequence
  Synthetic
agctttctctgacgagcctttaacccttttcatgaagaaggagtatactgacttaagacttgacccaaggatagc

SEQ ID NO: 323496 - DNA, 75 bp, Artificial Sequence
  Synthetic
cttttcatgaagaaggagtatactgacttaagacttgacccaaggatagctctgtacaagttatacttaaaccct

SEQ ID NO: 323497 - DNA, 75 bp, Artificial Sequence
  Synthetic
caaacaagaagaatccaagacctggatccagccactttgagattgccttttcaaactctccaaaaagagcactca

SEQ ID NO: 323498 - DNA, 75 bp, Artificial Sequence
  Synthetic
atccagccactttgagattgccttttcaaactctccaaaaagagcactcactccaagacccatcaacatgtagtg

SEQ ID NO: 323499 - DNA, 75 bp, Artificial Sequence
  Synthetic
atagctgcaagtgagaaagaccctcccccttcagttattgatgttaaaaggtttgcagcttcctcctgcctggca

SEQ ID NO: 323500 - DNA, 75 bp, Artificial Sequence
  Synthetic
ccccttcagttattgatgttaaaaggtttgcagcttcctcctgcctggcaacaagagtttctacttctggtagag

SEQ ID NO: 323501 - DNA, 75 bp, Artificial Sequence
  Synthetic
tgtaggcctaacatgctgcgagtggaagaaaaattctgagttgtattccatcacaaagtccgtgttcgaggtaga

SEQ ID NO: 323502 - DNA, 75 bp, Artificial Sequence
  Synthetic
aagaaaaattctgagttgtattccatcacaaagtccgtgttcgaggtagacttttcagatgggtagattcccaca

SEQ ID NO: 323503 - DNA, 75 bp, Artificial Sequence
  Synthetic
tgaagcacattgctgcaaccaatttgtaccgcattctcatcctttcattgtctgctgggaagctgattatcatgc

SEQ ID NO: 323504 - DNA, 75 bp, Artificial Sequence
  Synthetic
gtaccgcattctcatcctttcattgtctgctgggaagctgattatcatgctgctatcatctgagccctgcatcat

SEQ ID NO: 323505 - DNA, 75 bp, Artificial Sequence
  Synthetic
tctgaacccattctttgtgtgaagagctgtaaggaagctgttcttataaactcttggtgtagagagtgcagcaga

SEQ ID NO: 323506 - DNA, 75 bp, Artificial Sequence
  Synthetic
gctgtaaggaagctgttcttataaactcttggtgtagagagtgcagcagagaagaagtaaaatgaagaattcctt

SEQ ID NO: 323507 - DNA, 75 bp, Artificial Sequence
  Synthetic
ataagttctcccaggttcaatccatggctcagtagtctcaccatgatatgctttgaaaagcttagtgacaaagtc

SEQ ID NO: 323508 - DNA, 75 bp, Artificial Sequence
  Synthetic
ggctcagtagtctcaccatgatatgctttgaaaagcttagtgacaaagtcatcctctatgttaagctccttatga

SEQ ID NO: 323509 - DNA, 75 bp, Artificial Sequence
  Synthetic
aattcatcatcataaacttgttggtgaacattgaacaacctctgataattaaaggccaccattcttctggagtga

SEQ ID NO: 323510 - DNA, 75 bp, Artificial Sequence
  Synthetic
gaacattgaacaacctctgataattaaaggccaccattcttctggagtgaactggcatagcatcaaggcaaactt

SEQ ID NO: 323511 - DNA, 75 bp, Artificial Sequence
  Synthetic
ttcctagcatcatctgatgttgcacaagtccaaacggatcttccacacctcttttttgctctctgaccatgagtc

SEQ ID NO: 323512 - DNA, 75 bp, Artificial Sequence
  Synthetic
aagtccaaacggatcttccacacctcttttttgctctctgaccatgagtctctggtattctcatcttgttggtag

SEQ ID NO: 323513 - DNA, 75 bp, Artificial Sequence
  Synthetic
gaatctgccaattgcgcgagctattgcttcaattacagactgcacaattctctcatcagcccccatcacataaat

SEQ ID NO: 323514 - DNA, 75 bp, Artificial Sequence
  Synthetic
gcttcaattacagactgcacaattctctcatcagcccccatcacataaatttccctcaaacctccatgctgctgc

SEQ ID NO: 323515 - DNA, 75 bp, Artificial Sequence
  Synthetic
agcccttcccctcaatcctgttcatgcactcatcaaacatctcaattgctagagtctttcctctatgggcaaact

SEQ ID NO: 323516 - DNA, 75 bp, Artificial Sequence
  Synthetic
gcactcatcaaacatctcaattgctagagtctttcctctatgggcaaacttagtcatcttaactaagagtttgtc

SEQ ID NO: 323517 - DNA, 75 bp, Artificial Sequence
  Synthetic
tctttgtagacataccaaccatcattaaaattactagttgcctttagagtggccagtctttcgagagtaattgag

SEQ ID NO: 323518 - DNA, 75 bp, Artificial Sequence
  Synthetic
taaaattactagttgcctttagagtggccagtctttcgagagtaattgaggagacttctcttattatgctgttct

SEQ ID NO: 323519 - DNA, 75 bp, Artificial Sequence
  Synthetic
atactgccttctgagcttagcttttgcatggtcacacagaatcttcagataacttctgctgaattcatgcatttt

SEQ ID NO: 323520 - DNA, 75 bp, Artificial Sequence
  Synthetic
gcatggtcacacagaatcttcagataacttctgctgaattcatgcattttgggctgctctgggtcattgtaccct

SEQ ID NO: 323521 - DNA, 75 bp, Artificial Sequence
  Synthetic
agtgctcaagctctataatcttcttgtacattgctgacaaggctgacggttctgattcttcttctttatttttga

SEQ ID NO: 323522 - DNA, 75 bp, Artificial Sequence
  Synthetic
gtacattgctgacaaggctgacggttctgattcttcttctttatttttgaagtaaccattgtaacagcagctgat

SEQ ID NO: 323523 - DNA, 75 bp, Artificial Sequence
  Synthetic
tctcccgagaaaggattaaacatccccttccatcttattgtgcttcccatcttatgaagagcaaaaggctgtctt

SEQ ID NO: 323524 - DNA, 75 bp, Artificial Sequence
  Synthetic
ccttccatcttattgtgcttcccatcttatgaagagcaaaaggctgtcttgcaatgcgctgaatggctgagaaga

SEQ ID NO: 323525 - DNA, 75 bp, Artificial Sequence
  Synthetic
ttctgacctcagtactttgggcactttagatagcatcttctgtggacgtggaatctcaggtagagacacaaagcc

SEQ ID NO: 323526 - DNA, 75 bp, Artificial Sequence
  Synthetic
ttagatagcatcttctgtggacgtggaatctcaggtagagacacaaagccttccataaccacatatctctgcatt

SEQ ID NO: 323527 - DNA, 75 bp, Artificial Sequence
  Synthetic
tgtcttctagcatggtgagtagtgacagcttcatcataaaccacgcctccttgaatcttctctcctccacatgct

SEQ ID NO: 323528 - DNA, 75 bp, Artificial Sequence
  Synthetic
cagcttcatcataaaccacgcctccttgaatcttctctcctccacatgcttcaagaacttccatggctcatatcc

SEQ ID NO: 323529 - DNA, 75 bp, Artificial Sequence
  Synthetic
gaggcttccataaccgacgcagccttgcaaagattagttatcttgctcagtttgaaagaaacaaagtcagtaaca

SEQ ID NO: 323530 - DNA, 75 bp, Artificial Sequence
  Synthetic
tgcaaagattagttatcttgctcagtttgaaagaaacaaagtcagtaacaaccatgtcccctgaatcaattcctg

SEQ ID NO: 323531 - DNA, 75 bp, Artificial Sequence
  Synthetic
ctctccagcgaggacttttttgtcaacagccaaggagacaaatatatgacccttagaagtagttggcttgatcag

SEQ ID NO: 323532 - DNA, 75 bp, Artificial Sequence
  Synthetic
acagccaaggagacaaatatatgacccttagaagtagttggcttgatcagtaagtagacgcctgaatccatgagc

SEQ ID NO: 323533 - DNA, 75 bp, Artificial Sequence
  Synthetic
taacatgttgttttactgaagcagatagctctgcaccaatcagtgaaaccatttgcaaccagctcccaactggtg

SEQ ID NO: 323534 - DNA, 75 bp, Artificial Sequence
  Synthetic
tagctctgcaccaatcagtgaaaccatttgcaaccagctcccaactggtgtgctcagtagatccatgtgacagga

SEQ ID NO: 323535 - DNA, 75 bp, Artificial Sequence
  Synthetic
gcatggacaagagttggctggtgtagtcccattgccagctttctcaggttgaagtctttacttagtggattatac

SEQ ID NO: 323536 - DNA, 75 bp, Artificial Sequence
  Synthetic
gtcccattgccagctttctcaggttgaagtctttacttagtggattatacaattcatctgatggctttagagcag

SEQ ID NO: 323537 - DNA, 75 bp, Artificial Sequence
  Synthetic
agaaactctgctaatatcatgctctattgaaaatccttttttgctccttatcctggcttccttaacagctccaag

SEQ ID NO: 323538 - DNA, 75 bp, Artificial Sequence
  Synthetic
attgaaaatccttttttgctccttatcctggcttccttaacagctccaagagatgagttcttcttcccacacacc

SEQ ID NO: 323539 - DNA, 75 bp, Artificial Sequence
  Synthetic
catcctggtttaaggtcaatactgttctgtgatatttgttcctctcaacagatctttctgtgctcccagacatgg

SEQ ID NO: 323540 - DNA, 75 bp, Artificial Sequence
  Synthetic
tctgtgatatttgttcctctcaacagatctttctgtgctcccagacatggcatactccaattcttgtacaggatc

SEQ ID NO: 323541 - DNA, 75 bp, Artificial Sequence
  Synthetic
atcgtggcgttggtacagaccttggcccatattctactcatgggatgagagccttctacactgacagatttcaaa

SEQ ID NO: 323542 - DNA, 75 bp, Artificial Sequence
  Synthetic
cccatattctactcatgggatgagagccttctacactgacagatttcaaaggttccagacccttcccaggtgatc

SEQ ID NO: 323543 - DNA, 75 bp, Artificial Sequence
  Synthetic
ctgaactgttgacttatggtcattgggatctctaagaaactcatagctgatcatctctgcaatcttgttgttgat

SEQ ID NO: 323544 - DNA, 75 bp, Artificial Sequence
  Synthetic
ggatctctaagaaactcatagctgatcatctctgcaatcttgttgttgatttctgctgttgcagtgtgtgaattt

SEQ ID NO: 323545 - DNA, 75 bp, Artificial Sequence
  Synthetic
tgtcgtcagtatagtaattgtccctttcaatgccttttatggcctcatccgtgcacttcttcacaattcttgcaa

SEQ ID NO: 323546 - DNA, 75 bp, Artificial Sequence
  Synthetic
ttcaatgccttttatggcctcatccgtgcacttcttcacaattcttgcaatgtaatcattatctgcttccatctg

SEQ ID NO: 323547 - DNA, 75 bp, Artificial Sequence
  Synthetic
ctgaagcttggaaactttgcctcagtcactttccaatctattttgattgatgacattatgctgttaacttccctg

SEQ ID NO: 323548 - DNA, 75 bp, Artificial Sequence
  Synthetic
tcactttccaatctattttgattgatgacattatgctgttaacttccctgtcaagcctgctaattgtttcgtcag

SEQ ID NO: 323549 - DNA, 75 bp, Artificial Sequence
  Synthetic
tcttagttcttcaaaaatgtccctggcaagtctaaatcggaagacaatctcattcacatcatcatctgacagctc

SEQ ID NO: 323550 - DNA, 75 bp, Artificial Sequence
  Synthetic
gcaagtctaaatcggaagacaatctcattcacatcatcatctgacagctccagattagaaaccactccattaaaa

SEQ ID NO: 323551 - DNA, 75 bp, Artificial Sequence
  Synthetic
ttggctttattgctgacctatttagacaggcaatctcatactttgctatcttgttcctagctgcaagatcggctg

SEQ ID NO: 323552 - DNA, 75 bp, Artificial Sequence
  Synthetic
acaggcaatctcatactttgctatcttgttcctagctgcaagatcggctgagttggcatcacccattgtagtggt

SEQ ID NO: 323553 - DNA, 75 bp, Artificial Sequence
  Synthetic
gtctctgattcaataatcatgtcaggagtcaagaagtcagcatcatcagctctgttctcaagaacaccaaacact

SEQ ID NO: 323554 - DNA, 75 bp, Artificial Sequence
  Synthetic
gagtcaagaagtcagcatcatcagctctgttctcaagaacaccaaacacttccacaaaccttctgtcagtcgtgt

SEQ ID NO: 323555 - DNA, 75 bp, Artificial Sequence
  Synthetic
atgcttaaataaagtgaggttttgggctggtattgtctcaaagggctggatagtagaaccagactgcccatctgc

SEQ ID NO: 323556 - DNA, 75 bp, Artificial Sequence
  Synthetic
gctggtattgtctcaaagggctggatagtagaaccagactgcccatctgctagctctgctgttgctatgtctatc

SEQ ID NO: 323557 - DNA, 75 bp, Artificial Sequence
  Synthetic
taacataggcagggatcggggaatcatagatcgtagactcataacgtctcaactgatgaattgttaagctcccct

SEQ ID NO: 323558 - DNA, 75 bp, Artificial Sequence
  Synthetic
aactgatgaattgttaagctcccctcaggatttggttgttttctcaggattctttccatatttgggcctctctgt

SEQ ID NO: 323559 - DNA, 75 bp, Artificial Sequence
  Synthetic
acacaaaaggactcccgtattgcgaaatatctactactcatcaaactagcaatgctttctagagtggtatatctc

SEQ ID NO: 323560 - DNA, 75 bp, Artificial Sequence
  Synthetic
aatatctactactcatcaaactagcaatgctttctagagtggtatatctccgcaagaggtctagtgacaggagga

SEQ ID NO: 323561 - DNA, 75 bp, Artificial Sequence
  Synthetic
aatgctttctagagtggtatatctccgcaagaggtctagtgacaggaggaagggcaggacacagagaaggttctt

SEQ ID NO: 323562 - DNA, 75 bp, Artificial Sequence
  Synthetic
gctctctttgggccattcagcctggcaggaggagaggtccccttcacagtgtataaaaactcagtggtgtttgac

SEQ ID NO: 323563 - DNA, 75 bp, Artificial Sequence
  Synthetic
caggaggagaggtccccttcacagtgtataaaaactcagtggtgtttgactcacgacctacccttaaccattacc

SEQ ID NO: 323564 - DNA, 75 bp, Artificial Sequence
  Synthetic
cttgagtggagaaatgataaatctccagagtaccaccctgtacgatcctatcatgagagagctgtatcatgagtc

SEQ ID NO: 323565 - DNA, 75 bp, Artificial Sequence
  Synthetic
cagagtaccaccctgtacgatcctatcatgagagagctgtatcatgagtcaatccaccagattaagagatcaaat

SEQ ID NO: 323566 - DNA, 75 bp, Artificial Sequence
  Synthetic
gatggcctacaggacttgcttcgttggaatacatagacttttactttgaagatttcatattcttatcagtgactg

SEQ ID NO: 323567 - DNA, 75 bp, Artificial Sequence
  Synthetic
ggaatacatagacttttactttgaagatttcatattcttatcagtgactgactcatatgctaccaataaactctt

SEQ ID NO: 323568 - DNA, 75 bp, Artificial Sequence
  Synthetic
gaccagtcatgtgatattgagaaacagattaaaatcatatacaggaagattctcctagaagggtcaaaatttgga

SEQ ID NO: 323569 - DNA, 75 bp, Artificial Sequence
  Synthetic
agattaaaatcatatacaggaagattctcctagaagggtcaaaatttggaatgaactgctatcatttaactggtg

SEQ ID NO: 323570 - DNA, 75 bp, Artificial Sequence
  Synthetic
tattcagtctgcaagggttgctaagctagcacaaaagacacggaagagcccctctagagatgttgtcagaatgat

SEQ ID NO: 323571 - DNA, 75 bp, Artificial Sequence
  Synthetic
ctagcacaaaagacacggaagagcccctctagagatgttgtcagaatgatatatcagtctctttcccctaatgat

SEQ ID NO: 323572 - DNA, 75 bp, Artificial Sequence
  Synthetic
gtgctgacactgaggcatccaagctggctgcgatgagtgcagaagagtcatttaatttcttcatggctgaaaatg

SEQ ID NO: 323573 - DNA, 75 bp, Artificial Sequence
  Synthetic
ggctgcgatgagtgcagaagagtcatttaatttcttcatggctgaaaatgctgagttcagggccatggctttgtc

SEQ ID NO: 323574 - DNA, 75 bp, Artificial Sequence
  Synthetic
actgcagcagagactttgacaagccttaggcagaaatcaaaaagagggtcaggaaacacgcagttgcactgccag

SEQ ID NO: 323575 - DNA, 75 bp, Artificial Sequence
  Synthetic
ttaggcagaaatcaaaaagagggtcaggaaacacgcagttgcactgccagtttcccctgattacccacccctcta

SEQ ID NO: 323576 - DNA, 75 bp, Artificial Sequence
  Synthetic
accccaataatttcccctagccccacccccaggcagctcaaaccttcccaaccttagccttatacttctcagcac

SEQ ID NO: 323577 - DNA, 75 bp, Artificial Sequence
  Synthetic
cccccaggcagctcaaaccttcccaaccttagccttatacttctcagcacacttctcaatggctggatttggcac

SEQ ID NO: 323578 - DNA, 75 bp, Artificial Sequence
  Synthetic
gcaatgagtagctttttcttgtcatctctggtgaagaatcgtccagtcatggcagccatgttgggcttctcaaat

SEQ ID NO: 323579 - DNA, 75 bp, Artificial Sequence
  Synthetic
ctctggtgaagaatcgtccagtcatggcagccatgttgggcttctcaaatgttgcagcaatctcattaggctgct

SEQ ID NO: 323580 - DNA, 75 bp, Artificial Sequence
  Synthetic
ctttgagaattccagcatgaacagcccatgtgcgtcagccagcatagcaccagtgttgtttggaagttcaagatc

SEQ ID NO: 323581 - DNA, 75 bp, Artificial Sequence
  Synthetic
ccatgtgcgtcagccagcatagcaccagtgttgtttggaagttcaagatcaattatgccagcaaagcttggatgc

SEQ ID NO: 323582 - DNA, 75 bp, Artificial Sequence
  Synthetic
cagcaatgctgtccattgttgtcccggtcacaggcagagattctgacaaggtcttcaaagcctgaacagtccatg

SEQ ID NO: 323583 - DNA, 75 bp, Artificial Sequence
  Synthetic
ggtcacaggcagagattctgacaaggtcttcaaagcctgaacagtccatggcacgaaagcagcggaaactctaga

SEQ ID NO: 323584 - DNA, 75 bp, Artificial Sequence
  Synthetic
ttcccctccttcagctgataggtggagatcagttgagttacaatggcagcccccttctcagacatcttcttcatc

SEQ ID NO: 323585 - DNA, 75 bp, Artificial Sequence
  Synthetic
agatcagttgagttacaatggcagcccccttctcagacatcttcttcatcatgctttcaggcttgttgcctctca

SEQ ID NO: 323586 - DNA, 75 bp, Artificial Sequence
  Synthetic
aacatccttcttccaatctctgccctttgcagttcctctctccttcaccaattgcacaatccttttagggtcaaa

SEQ ID NO: 323587 - DNA, 75 bp, Artificial Sequence
  Synthetic
tttgcagttcctctctccttcaccaattgcacaatccttttagggtcaaacccttggtaagcaaactcattgacc

SEQ ID NO: 323588 - DNA, 75 bp, Artificial Sequence
  Synthetic
cagactcgtccaaaaacgctagggcgattgttctgtagttatcctcagacattttttaatagtcagctaatacac

SEQ ID NO: 323589 - DNA, 75 bp, Artificial Sequence
  Synthetic
tacacaaagaccggtgctttaacgtaataaaaaaacacttcaacccacacaacatgttcattcaataaataggct

SEQ ID NO: 323590 - DNA, 75 bp, Artificial Sequence
  Synthetic
aataaaaaaacacttcaacccacacaacatgttcattcaataaataggctttattgttgttctacacacacacct

SEQ ID NO: 323591 - DNA, 75 bp, Artificial Sequence
  Synthetic
aacatgttcattcaataaataggctttattgttgttctacacacacacctgaggcacatactaaagacatactgg

SEQ ID NO: 323592 - DNA, 75 bp, Artificial Sequence
  Synthetic
ccaattattgattaaattacctttaattttaaaattgtgtaactctccaatgctacttaaatttcttggctagag

SEQ ID NO: 323593 - DNA, 75 bp, Artificial Sequence
  Synthetic
attttaaaattgtgtaactctccaatgctacttaaatttcttggctagagcctgttgtagtcctattcgaatcag

SEQ ID NO: 323594 - DNA, 75 bp, Artificial Sequence
  Synthetic
acaccaatcataaggaatcccattaccattaaaaaagtcttcagagggcctccaaaccaagaacttaatcctgat

SEQ ID NO: 323595 - DNA, 75 bp, Artificial Sequence
  Synthetic
ccattaaaaaagtcttcagagggcctccaaaccaagaacttaatcctgatagccagcccaagaagtccactccat

SEQ ID NO: 323596 - DNA, 75 bp, Artificial Sequence
  Synthetic
tgagcccccattgattactctgtcatcatgaggagccatagctatcagggttcccttgattagcataggcttctt

SEQ ID NO: 323597 - DNA, 75 bp, Artificial Sequence
  Synthetic
tcatgaggagccatagctatcagggttcccttgattagcataggcttcttgttcttgccacaatcgtacttcccc

SEQ ID NO: 323598 - DNA, 75 bp, Artificial Sequence
  Synthetic
aatgcagaatggtgcagtagtcatgtacactaggagtcaccttgaacaggacattcacactgaagcttgagtcag

SEQ ID NO: 323599 - DNA, 75 bp, Artificial Sequence
  Synthetic
tacactaggagtcaccttgaacaggacattcacactgaagcttgagtcagtaaaatggtatattgcctcacttga

SEQ ID NO: 323600 - DNA, 75 bp, Artificial Sequence
  Synthetic
gcgccttcatcacaggagtagcaccctgttatattcacaaatgtggaatcacaatcattacttgtcactttgtat

SEQ ID NO: 323601 - DNA, 75 bp, Artificial Sequence
  Synthetic
ctgttatattcacaaatgtggaatcacaatcattacttgtcactttgtattcaatctcatactcatctagaacaa

SEQ ID NO: 323602 - DNA, 75 bp, Artificial Sequence
  Synthetic
tgtggttagagcctgaactgaatttttctctatggattgtgtgaaagtctttccttctctgacttgtggcaacga

SEQ ID NO: 323603 - DNA, 75 bp, Artificial Sequence
  Synthetic
ttctctatggattgtgtgaaagtctttccttctctgacttgtggcaacgatcctctattgaagattgccatggga

SEQ ID NO: 323604 - DNA, 75 bp, Artificial Sequence
  Synthetic
ccgtgtccatttctggctgatactctatgagccctggggcgactttgcatgaaggtgaagccttaatggcagttt

SEQ ID NO: 323605 - DNA, 75 bp, Artificial Sequence
  Synthetic
tatgagccctggggcgactttgcatgaaggtgaagccttaatggcagtttcttctgttgggcatctcacttcacc

SEQ ID NO: 323606 - DNA, 75 bp, Artificial Sequence
  Synthetic
gaatatggttcatccactatggcaaaactccctaatccatgcttcatgaatgagtaagcatttgtcccttctatc

SEQ ID NO: 323607 - DNA, 75 bp, Artificial Sequence
  Synthetic
aactccctaatccatgcttcatgaatgagtaagcatttgtcccttctatcccttcagaatctagaatcaggccaa

SEQ ID NO: 323608 - DNA, 75 bp, Artificial Sequence
  Synthetic
gctcatagccattaaagtgatctcaaacttcctcttatgtgtagttaccccaaggcgcactctatgattccaagc

SEQ ID NO: 323609 - DNA, 75 bp, Artificial Sequence
  Synthetic
aacttcctcttatgtgtagttaccccaaggcgcactctatgattccaagctatacatctgaagaccctgaaagca

SEQ ID NO: 323610 - DNA, 75 bp, Artificial Sequence
  Synthetic
agtgaaccatcaggcaagaggggttaacattgaagcatccataacctattcctccactctgctcaaagcatttat

SEQ ID NO: 323611 - DNA, 75 bp, Artificial Sequence
  Synthetic
aacattgaagcatccataacctattcctccactctgctcaaagcatttattttcatggatgacctcactgtgtgc

SEQ ID NO: 323612 - DNA, 75 bp, Artificial Sequence
  Synthetic
ttgttggacttccacttaaggcagatatccccagtgcactcacccatcagatggcatcgtcgagaacttaggcac

SEQ ID NO: 323613 - DNA, 75 bp, Artificial Sequence
  Synthetic
tatccccagtgcactcacccatcagatggcatcgtcgagaacttaggcacaccggggtgtataatgaggtccaaa

SEQ ID NO: 323614 - DNA, 75 bp, Artificial Sequence
  Synthetic
ttcacttgagatagtcttgatggagataaattgcttctcattgtctctgagacctttgagaatcaaacatgactc

SEQ ID NO: 323615 - DNA, 75 bp, Artificial Sequence
  Synthetic
ataaattgcttctcattgtctctgagacctttgagaatcaaacatgactcagaacctatcggccctaacttcaac

SEQ ID NO: 323616 - DNA, 75 bp, Artificial Sequence
  Synthetic
ttgttgagctatcctctgtggtgcattgcattatgctagattcagcaatcaaactctcagtacagcacagcccgg

SEQ ID NO: 323617 - DNA, 75 bp, Artificial Sequence
  Synthetic
ttgcattatgctagattcagcaatcaaactctcagtacagcacagcccggaacccaaaatagaaaggatggtggt

SEQ ID NO: 323618 - DNA, 75 bp, Artificial Sequence
  Synthetic
ggttgaggccttctggctgcattttccactctgacctgctcaaggccattatcccaaccaatagcattgtttgta

SEQ ID NO: 323619 - DNA, 75 bp, Artificial Sequence
  Synthetic
ccactctgacctgctcaaggccattatcccaaccaatagcattgtttgtagccctaatggctgttgcaattcttg

SEQ ID NO: 323620 - DNA, 75 bp, Artificial Sequence
  Synthetic
gactaataaggacacccacctgaacgggatggctactgcagaagccaagaatctcacagcaaatttagacctaga

SEQ ID NO: 323621 - DNA, 75 bp, Artificial Sequence
  Synthetic
gggatggctactgcagaagccaagaatctcacagcaaatttagacctagatataatcacaccagtgagtgccaga

SEQ ID NO: 323622 - DNA, 75 bp, Artificial Sequence
  Synthetic
ggatcgctgatgctacgctatggcactgataatttaatatgccatgtctacagaaaatacaatctgaaacatcac

SEQ ID NO: 323623 - DNA, 75 bp, Artificial Sequence
  Synthetic
ctgataatttaatatgccatgtctacagaaaatacaatctgaaacatcacaagagtcttttggaggacaatgtat

SEQ ID NO: 323624 - DNA, 75 bp, Artificial Sequence
  Synthetic
ccccgctcgctcatatggattcctatgtctccgcctataatttcactattgccaggatacgggaggtcaaggaaa

SEQ ID NO: 323625 - DNA, 75 bp, Artificial Sequence
  Synthetic
tgtctccgcctataatttcactattgccaggatacgggaggtcaaggaaagttgatggtttctgcatcacacttt

SEQ ID NO: 323626 - DNA, 75 bp, Artificial Sequence
  Synthetic
agcagaaacaatcttgggcccatgggtctttataacaatcttgttcttctcacattcccagaggcagctggtgca

SEQ ID NO: 323627 - DNA, 75 bp, Artificial Sequence
  Synthetic
gtctttataacaatcttgttcttctcacattcccagaggcagctggtgcattccctgacagagagatcttcagtt

SEQ ID NO: 323628 - DNA, 75 bp, Artificial Sequence
  Synthetic
ctttttcatagcctacacatttgggttttacccatgcccctccaacattgacctcaacaactgcagcatgtcttc

SEQ ID NO: 323629 - DNA, 75 bp, Artificial Sequence
  Synthetic
ttttacccatgcccctccaacattgacctcaacaactgcagcatgtcttctcaaagaacagtgagcatctgggtt

SEQ ID NO: 323630 - DNA, 75 bp, Artificial Sequence
  Synthetic
caaaagtattcatctccattacatttctgatcttttgagccaactcccttacattttgatggtgacaccttctga

SEQ ID NO: 323631 - DNA, 75 bp, Artificial Sequence
  Synthetic
tctgatcttttgagccaactcccttacattttgatggtgacaccttctgatactgcaattgagatgttgtcttgg

SEQ ID NO: 323632 - DNA, 75 bp, Artificial Sequence
  Synthetic
atcatactcttgtcgatacctcatcttcaattcttccaggtatagctttttccgacccacaacaatgaaccccat

SEQ ID NO: 323633 - DNA, 75 bp, Artificial Sequence
  Synthetic
ttcaattcttccaggtatagctttttccgacccacaacaatgaaccccatcctttcatacctggacgtgctctta

SEQ ID NO: 323634 - DNA, 75 bp, Artificial Sequence
  Synthetic
ctatggagcagatgtccttggaatatctaatcactggaagtgattcagatcctcctctttgacagaatgcatctt

SEQ ID NO: 323635 - DNA, 75 bp, Artificial Sequence
  Synthetic
tctaatcactggaagtgattcagatcctcctctttgacagaatgcatcttgtataggcataaagattttctggcc

SEQ ID NO: 323636 - DNA, 75 bp, Artificial Sequence
  Synthetic
aagttgcaatcctcagagagtatgttgttgtttgagcagtgtacaattgagaggttgccttctaagtcaacaaag

SEQ ID NO: 323637 - DNA, 75 bp, Artificial Sequence
  Synthetic
tgttgtttgagcagtgtacaattgagaggttgccttctaagtcaacaaagaaataagctctagcatcatcagtgc

SEQ ID NO: 323638 - DNA, 75 bp, Artificial Sequence
  Synthetic
tttctggcattgcttctgtgagccagggctagttgttagctcacaagagttgttgtttttgatcagtatgggcga

SEQ ID NO: 323639 - DNA, 75 bp, Artificial Sequence
  Synthetic
gggctagttgttagctcacaagagttgttgtttttgatcagtatgggcgatgcttgagttatggactctaggaga

SEQ ID NO: 323640 - DNA, 75 bp, Artificial Sequence
  Synthetic
agaaggggtaatgtagtgggctgacttgtagttcccaggccttgcactctttcccataatcaagagaacagtcat

SEQ ID NO: 323641 - DNA, 75 bp, Artificial Sequence
  Synthetic
ttgtagttcccaggccttgcactctttcccataatcaagagaacagtcattttcagttaaggttggtgaagccat

SEQ ID NO: 323642 - DNA, 75 bp, Artificial Sequence
  Synthetic
agtatgtggttagtgtttctgtcttcaattggttcaattgcagcaagccctgtggccagcagagatgtgagtacc

SEQ ID NO: 323643 - DNA, 75 bp, Artificial Sequence
  Synthetic
caattggttcaattgcagcaagccctgtggccagcagagatgtgagtaccacagtcgctagagttgtggacacat

SEQ ID NO: 323644 - DNA, 75 bp, Artificial Sequence
  Synthetic
catcttttcatccgactccttccttcttttgttatggtactctctcagcctctcagcctcatcttctgactgccg

SEQ ID NO: 323645 - DNA, 75 bp, Artificial Sequence
  Synthetic
cttttgttatggtactctctcagcctctcagcctcatcttctgactgccgtaattttttattcagatcatgcagt

SEQ ID NO: 323646 - DNA, 75 bp, Artificial Sequence
  Synthetic
cccgttctttctcaagatctgacttggctaactctttggcctcccgttcagctagccatccatttcttagctcat

SEQ ID NO: 323647 - DNA, 75 bp, Artificial Sequence
  Synthetic
ggctaactctttggcctcccgttcagctagccatccatttcttagctcatcctccagggccctcatctttgtacg

SEQ ID NO: 323648 - DNA, 75 bp, Artificial Sequence
  Synthetic
cgtgctttttctgcagcaagttctctctgaatcacttcaagtctctcattggccttttttactttgagactaaag

SEQ ID NO: 323649 - DNA, 75 bp, Artificial Sequence
  Synthetic
tctgaatcacttcaagtctctcattggccttttttactttgagactaaagtcagattctgttgcagaagggagaa

SEQ ID NO: 323650 - DNA, 75 bp, Artificial Sequence
  Synthetic
agagccgttctttgcaggaatcaaatctgaccagaatggtgccttctcaaagctactgcaattgtgggctccggg

SEQ ID NO: 323651 - DNA, 75 bp, Artificial Sequence
  Synthetic
tctgaccagaatggtgccttctcaaagctactgcaattgtgggctccgggcgtgaagctgtctggactggcgtca

SEQ ID NO: 323652 - DNA, 75 bp, Artificial Sequence
  Synthetic
cgattatatctaggaatctgcagcttgaagggtgagtagtcccgtacatgttggcaatgtaattggagaacacat

SEQ ID NO: 323653 - DNA, 75 bp, Artificial Sequence
  Synthetic
tgaagggtgagtagtcccgtacatgttggcaatgtaattggagaacacatccggagaacagtcctccctcttcaa

SEQ ID NO: 323654 - DNA, 75 bp, Artificial Sequence
  Synthetic
tggatatttattgtatccatctccccactagagagttctagaactttatcaatgtcagtggaatgacttaaacag

SEQ ID NO: 323655 - DNA, 75 bp, Artificial Sequence
  Synthetic
actttgaaataatcgtgtatttcaaagaaaagccttgcactaagcagaggattattacaaactttgcataaaaca

SEQ ID NO: 323656 - DNA, 75 bp, Artificial Sequence
  Synthetic
cccgtattgctaaaccagagctaataatagacttctagacagccatgcaatccagagctgtcatcttgaagtata

SEQ ID NO: 323657 - DNA, 75 bp, Artificial Sequence
  Synthetic
aggattgctctctgattgagaatgagttccccatttacataaacaattataaggtggtctataagtcaaagccaa

SEQ ID NO: 323658 - DNA, 75 bp, Artificial Sequence
  Synthetic
ctctctcacatttcctcattgagaaggagtttcctgctgtgctggggcctggtatgatcagtgcagttcgaacca

SEQ ID NO: 323659 - DNA, 75 bp, Artificial Sequence
  Synthetic
ttttgtctgctctcaggtggcccacagggattcctactctagagtttatagactattacttcgaggagctcctgt

SEQ ID NO: 323660 - DNA, 75 bp, Artificial Sequence
  Synthetic
tggagacatctgtgtggtccaagcagcacgggtgacaagactggttgctaagacattctctaagatgaccagaga

SEQ ID NO: 323661 - DNA, 75 bp, Artificial Sequence
  Synthetic
agacattctctaagatgaccagagacacccatctgatgatatacttctcgataagcccagttgagttggttttga

SEQ ID NO: 323662 - DNA, 75 bp, Artificial Sequence
  Synthetic
ataagcccagttgagttggttttgagtaaacttgataagaaaggggacaagagggctaaagcaaaagggttgatg

SEQ ID NO: 323663 - DNA, 75 bp, Artificial Sequence
  Synthetic
gtgacaaagtggctgcctagtcccccccactacccacccttatgatcccacccctcagatttccccaatccccat

SEQ ID NO: 323664 - DNA, 75 bp, Artificial Sequence
  Synthetic
aggtgcttatgtttattgcaaagttgttattaatttcctgtttagtgcagcaggcctatctgaaatacactatta

SEQ ID NO: 323665 - DNA, 75 bp, Artificial Sequence
  Synthetic
ttggacagagtttattaatgtggcaaagccagcaaacaaaatagctcctatatcagtgatcccaccaccaattgt

SEQ ID NO: 323666 - DNA, 75 bp, Artificial Sequence
  Synthetic
atcccaagcacaaggtactcaaaagacctctgttctattggcttgcacactgtgaaggaatgcaagactggtacc

SEQ ID NO: 323667 - DNA, 75 bp, Artificial Sequence
  Synthetic
catagagcagatgaagatgagatcaagacaagaattcagcgaagaccagttcttatgctacaaatcagagagcag

SEQ ID NO: 323668 - DNA, 75 bp, Artificial Sequence
  Synthetic
aaggcatagtgcagttatagaagtgaatgtcaatggcgtgtgggttgtgccgagatgcattggttatgaagaggt

SEQ ID NO: 323669 - DNA, 75 bp, Artificial Sequence
  Synthetic
tgaggttagcagctgcctattctgtgtgcacggactgcttaattaccagtgccacaccttgttctctgcactact

SEQ ID NO: 323670 - DNA, 75 bp, Artificial Sequence
  Synthetic
gctggatgatcaaaagctggaaaaagagagtgggctcagctatttctagaaccaatgacaccattggttggcgtg

SEQ ID NO: 323671 - DNA, 75 bp, Artificial Sequence
  Synthetic
accaatgacaccattggttggcgtgacaatagacgatatgggcgagacgttgagagagcacagtacacaggagga

SEQ ID NO: 323672 - DNA, 75 bp, Artificial Sequence
  Synthetic
gctccaggggctaaatattcattttatggagtgatgatccttggcctattaggtaatgtgcatagttgctctgag

SEQ ID NO: 323673 - DNA, 75 bp, Artificial Sequence
  Synthetic
gtccttctggactactctatatacccctgtctgtctaagttcgcgaaggtgccacctaatgggagaatgtgtctc

SEQ ID NO: 323674 - DNA, 75 bp, Artificial Sequence
  Synthetic
aatgaaacatctgcagaattcactgggaaggcacatggagaagttatgcatgagaatagatgctttgagcagagc

SEQ ID NO: 323675 - DNA, 75 bp, Artificial Sequence
  Synthetic
aagctttgccattatagatgacccatattccccagagcctcgtaaaggctttttaggagaagtgcgatgtccaac

SEQ ID NO: 323676 - DNA, 75 bp, Artificial Sequence
  Synthetic
tggaatgacattcacacaatcaattgagaagaacacagttcaagcactgacaacaggggaggttagagcttccat

SEQ ID NO: 323677 - DNA, 75 bp, Artificial Sequence
  Synthetic
gtggtgtatcagaatagccagtccgactgctcagctacatttaagaatctcaccggctgttattcatgtgatgag

SEQ ID NO: 323678 - DNA, 75 bp, Artificial Sequence
  Synthetic
actgctcagctacatttaagaatctcaccggctgttattcatgtgatgagggttcaagaatgtgctaccaggtga

SEQ ID NO: 323679 - DNA, 75 bp, Artificial Sequence
  Synthetic
ccacttctcaagacctgtcatctctattgaagggaggtatgactgcgggcttagcaaaagaccaatggtaataaa

SEQ ID NO: 323680 - DNA, 75 bp, Artificial Sequence
  Synthetic
tcgattcaccaactaaagaggagcaacaagaaataccttttgtctgctctcaggtggcccacagggattcctact

SEQ ID NO: 323681 - DNA, 75 bp, Artificial Sequence
  Synthetic
gctccagctccattcggaaggtccagatcaatgatcccagcaaagctagggtgcatcatggctcttgggtaggtt

SEQ ID NO: 323682 - DNA, 75 bp, Artificial Sequence
  Synthetic
acgatacttctcagcactcctcaccactgcagacgccagaacaagatcctcatcaatgatccccactgctatgag

SEQ ID NO: 323683 - DNA, 75 bp, Artificial Sequence
  Synthetic
atgacttcacttttggtcatctagcagacacaactgataaaaagtttgttgaggtattcggggttctggagaaca

SEQ ID NO: 323684 - DNA, 75 bp, Artificial Sequence
  Synthetic
gggctgatgattctgactttcaatctcctgacatgatcatagagacagagactggccatgtttatgtagttgaat

SEQ ID NO: 323685 - DNA, 75 bp, Artificial Sequence
  Synthetic
tatctctctatacataattgctgtgcattttaatggagtgatttcaaacctcgacctgtcagacgaggaagtcaa

SEQ ID NO: 323686 - DNA, 75 bp, Artificial Sequence
  Synthetic
gagaaattaatccagctctatttgactcagatgagactattagtagactagaaagggaggtcaacagtgtcatgt

SEQ ID NO: 323687 - DNA, 75 bp, Artificial Sequence
  Synthetic
caccgagaagaaattcccgagcttcaggagggagctttttgagaacttcaggagtaaggaagttgatgaagagta

SEQ ID NO: 323688 - DNA, 75 bp, Artificial Sequence
  Synthetic
aggagggagctttttgagaacttcaggagtaaggaagttgatgaagagtatatctctaagatcatcaaaagatgc

SEQ ID NO: 323689 - DNA, 75 bp, Artificial Sequence
  Synthetic
agagagatagtctctacactgaagacatcaccaataaagagagatttgagctgaactcaaagagagctgcttctg

SEQ ID NO: 323690 - DNA, 75 bp, Artificial Sequence
  Synthetic
gatgagttatgagttcttaagagacacagaggaccacaagtcgactgtgcagtttcctccctgggtgacaaggac

SEQ ID NO: 323691 - DNA, 75 bp, Artificial Sequence
  Synthetic
acagaggaccacaagtcgactgtgcagtttcctccctgggtgacaaggacaggcccggctggtaaagacctagag

SEQ ID NO: 323692 - DNA, 75 bp, Artificial Sequence
  Synthetic
gaataaggtatgcacaaatgcttcaatagagaaaatagagagaatgcatgatgatccagttttggagcttgaata

SEQ ID NO: 323693 - DNA, 75 bp, Artificial Sequence
  Synthetic
ggagtttgtgggaagagaaatgcaaatctgggagctgttaaagaggccagagtgagaagtaagaagggcttttcc

SEQ ID NO: 323694 - DNA, 75 bp, Artificial Sequence
  Synthetic
agaggatctcatcccaacagagggtctgtacaacccgctctctgaggacaaacccttaagactgctggcaatggg

SEQ ID NO: 323695 - DNA, 75 bp, Artificial Sequence
  Synthetic
atggatgatgagaccccggagactctggactgccatttaaaattcttgagttcaccgataggaagctggctgcaa

SEQ ID NO: 323696 - DNA, 75 bp, Artificial Sequence
  Synthetic
atggtatccataatcggtgcagagctgtctgcttcagtaaagcagcacgtcaagcctaatcaattcattgtgaag

SEQ ID NO: 323697 - DNA, 75 bp, Artificial Sequence
  Synthetic
ctggtcacagactttgtttcatttaagcttagcaagatcactaatctttgcaaggctctatgtgtattagaggca

SEQ ID NO: 323698 - DNA, 75 bp, Artificial Sequence
  Synthetic
agcttagcaagatcactaatctttgcaaggctctatgtgtattagaggcagcttcttgcttctgggctgaaacat

SEQ ID NO: 323699 - DNA, 75 bp, Artificial Sequence
  Synthetic
ggaccaggccggtgctgtgaagttttcagatgcatggtttatgataaaactatctctcctgactatgttagagga

SEQ ID NO: 323700 - DNA, 75 bp, Artificial Sequence
  Synthetic
tcagatgcatggtttatgataaaactatctctcctgactatgttagaggacaaggcaacaacagaagagctccag

SEQ ID NO: 323701 - DNA, 75 bp, Artificial Sequence
  Synthetic
aggggtttgtgtcactccctgaaattcccaaaccacacaagatgttgtcaaaaatcccaaaagtgcttaggtctg

SEQ ID NO: 323702 - DNA, 75 bp, Artificial Sequence
  Synthetic
tcccaaaccacacaagatgttgtcaaaaatcccaaaagtgcttaggtctgagctacaagtattcctagctcacag

SEQ ID NO: 323703 - DNA, 75 bp, Artificial Sequence
  Synthetic
aggtaggagggaacatccgttggaagggacttttcaatccttactctggaaacagtattgatgagctgcaaacat

SEQ ID NO: 323704 - DNA, 75 bp, Artificial Sequence
  Synthetic
ttttaaaaacaaggaggaagacaccgagccttcagcattatcagccatgtacaagaagattatagagctggaaca

SEQ ID NO: 323705 - DNA, 75 bp, Artificial Sequence
  Synthetic
gagccttcagcattatcagccatgtacaagaagattatagagctggaacatctccgacctccgacagacacatac

SEQ ID NO: 323706 - DNA, 75 bp, Artificial Sequence
  Synthetic
ctaagatgcacgagttcagcaggagttatctgaaactgctatgcaaccatgctaagaccaaactaagaaagcaat

SEQ ID NO: 323707 - DNA, 75 bp, Artificial Sequence
  Synthetic
ttatctgaaactgctatgcaaccatgctaagaccaaactaagaaagcaatatggcaggggagtgatgaatcagat

SEQ ID NO: 323708 - DNA, 75 bp, Artificial Sequence
  Synthetic
cagtcaataactttagaacggttagccactctcaaagctactagcaacttcgacagttcatggtacactttcaag

SEQ ID NO: 323709 - DNA, 75 bp, Artificial Sequence
  Synthetic
gagataaacttctggttaagatgactcagtttgctcatagaggaaagactctggctatagaggtgtttgaagaat

SEQ ID NO: 323710 - DNA, 75 bp, Artificial Sequence
  Synthetic
tcagtttgctcatagaggaaagactctggctatagaggtgtttgaagaatgcatgtcaaggattgaagagaaagg

SEQ ID NO: 323711 - DNA, 75 bp, Artificial Sequence
  Synthetic
agatttatgtcatgggtgctgatgaaagaatagttcaatcagtgatagaggccatagcgcgggctattggaagat

SEQ ID NO: 323712 - DNA, 75 bp, Artificial Sequence
  Synthetic
tccctccaacaaaataaggattccagagacacacgggcagagagccaaaaaaaggtgtggtcgatctgtctggac

SEQ ID NO: 323713 - DNA, 75 bp, Artificial Sequence
  Synthetic
gagacacacgggcagagagccaaaaaaaggtgtggtcgatctgtctggacttgtgccacctcagatgatgctaga

SEQ ID NO: 323714 - DNA, 75 bp, Artificial Sequence
  Synthetic
caaaatttgccctgatgctatgtgaattcacccctcaagagtggtggcccttaatcattagaggttgctcgatgt

SEQ ID NO: 323715 - DNA, 75 bp, Artificial Sequence
  Synthetic
tcacaaacaagtttatgatgatgaatcttgatttcctaaggataattgatagtcacaaggagctacagattgagg

SEQ ID NO: 323716 - DNA, 75 bp, Artificial Sequence
  Synthetic
acctcaagacaagcactgggatgatgcaggggattctgcacttcacctcctccttgcttcactccctgcatcagg

SEQ ID NO: 323717 - DNA, 75 bp, Artificial Sequence
  Synthetic
gataatgagaagattaaaatgaggtacaagctggttgctgctatgtgtttcaggatcaaaaagagccttggcatt

SEQ ID NO: 323718 - DNA, 75 bp, Artificial Sequence
  Synthetic
acaagctggttgctgctatgtgtttcaggatcaaaaagagccttggcatttacataggcatctacccgtccgaga

SEQ ID NO: 323719 - DNA, 75 bp, Artificial Sequence
  Synthetic
atctgctcactgctataacagaaggaggaggatcattctccctggcagccatgatacagcactgccagtgctcaa

SEQ ID NO: 323720 - DNA, 75 bp, Artificial Sequence
  Synthetic
ttcattacatgctcatgggattgggtgtgagtgctctgttctcagaattttcaaaggctatttccaagtggctcg

SEQ ID NO: 323721 - DNA, 75 bp, Artificial Sequence
  Synthetic
tcgggattcaagtataatctatacagagccataatgaattcaagcctgaaatccatctactcgtttttcatgaag

SEQ ID NO: 323722 - DNA, 75 bp, Artificial Sequence
  Synthetic
aagaaatagactaaacatacctgaaacctggaaagaaatgatcaatgagagtcctgagatcttgtacagggcgcc

SEQ ID NO: 323723 - DNA, 75 bp, Artificial Sequence
  Synthetic
agaatagctgaaaaggtgcatagtcctggagtggtatcatcattaagcaccggaaatgctgtctgtaaagtcatg

SEQ ID NO: 323724 - DNA, 75 bp, Artificial Sequence
  Synthetic
ctggagtggtatcatcattaagcaccggaaatgctgtctgtaaagtcatggcatcttcagtatactttctctcag

SEQ ID NO: 323725 - DNA, 75 bp, Artificial Sequence
  Synthetic
tcatagcttttgaccagatcggctgcaacgatgaaatcagccaagaggacttgttgtttctgttccctaatctgg

SEQ ID NO: 323726 - DNA, 75 bp, Artificial Sequence
  Synthetic
ctttgaacaccactcttcagccagagttgctccagaaaaacttgtgagtgataagtggtttggcactagaaagag

SEQ ID NO: 323727 - DNA, 75 bp, Artificial Sequence
  Synthetic
ttacaggggctggaagacgaagttggtcacagcagggctatgcaagtagagaaaataaagcattacctgttttca

SEQ ID NO: 323728 - DNA, 75 bp, Artificial Sequence
  Synthetic
ggatggctaccaagttcagatagacattgatgggaaggaggggatgccatctcatttgtctggaatcactatctc

SEQ ID NO: 323729 - DNA, 75 bp, Artificial Sequence
  Synthetic
ctcatttgtctggaatcactatctcaaattgctccaaaccatgggtcctgactcagagtttgaaggcatggtgtg

SEQ ID NO: 323730 - DNA, 75 bp, Artificial Sequence
  Synthetic
tggatgcccaatatatcttgtccgccatgacattacaaatctaggcttgctccatgatgatgacatagatattaa

SEQ ID NO: 323731 - DNA, 75 bp, Artificial Sequence
  Synthetic
caagagatctgcatatcttatcgtacactccttcagattcagatataagttctgtcagctcaaagcacataatgg

SEQ ID NO: 323732 - DNA, 75 bp, Artificial Sequence
  Synthetic
ggccttttctgtagaaccaactagatcatggatgttgtgccagcccttgccgtggagctttgtaagacctgtgct

SEQ ID NO: 323733 - DNA, 75 bp, Artificial Sequence
  Synthetic
tcatggatgttgtgccagcccttgccgtggagctttgtaagacctgtgctgcaggttgcgacagggagtaggagg

SEQ ID NO: 323734 - DNA, 75 bp, Artificial Sequence
  Synthetic
gactgagagaaatcatcagactttgcactgagtcctcaattagaaataaggttgggactgtgtatggtcagaata

SEQ ID NO: 323735 - DNA, 75 bp, Artificial Sequence
  Synthetic
cactgagtcctcaattagaaataaggttgggactgtgtatggtcagaatagaccagaaaagttcattgaagcaga

SEQ ID NO: 323736 - DNA, 75 bp, Artificial Sequence
  Synthetic
gacatgatgttagatgagggaatggacgatgcctttgaggaactggctgactacttaactgtggaagaggatcct

SEQ ID NO: 323737 - DNA, 75 bp, Artificial Sequence
  Synthetic
acgatgcctttgaggaactggctgactacttaactgtggaagaggatcctgattatatggatgaggttagctttg

SEQ ID NO: 323738 - DNA, 75 bp, Artificial Sequence
  Synthetic
accagcacactacaaggagttacagagtctcacagtgttagcacaccctctaatggatgactttgtaacaaggtt

SEQ ID NO: 323739 - DNA, 75 bp, Artificial Sequence
  Synthetic
agtgggcaaaatgggtaggccacagatcaggagattgctagaaaagaatgtcacaaccagagacttaagagaact

SEQ ID NO: 323740 - DNA, 75 bp, Artificial Sequence
  Synthetic
acaagaaatatcttttgtctgccctcaggtggcccacagggattcccactctagagtttatagactattacttcg

SEQ ID NO: 323741 - DNA, 75 bp, Artificial Sequence
  Synthetic
gatgaccagagacacccatctgatgatatacttctcaataagtccagttgagttggttttgagtaaacttgataa

SEQ ID NO: 323742 - DNA, 75 bp, Artificial Sequence
  Synthetic
aagcacccttctctgacatcttcttcatcatggcttccggcttgtttcccctgacaaggttcagcacaatcatca

SEQ ID NO: 323743 - DNA, 75 bp, Artificial Sequence
  Synthetic
gaagccattctggacagagtttattaatgtggcaaagccaacgaataaaatagctcccatatcagtgatcccacc

SEQ ID NO: 323744 - DNA, 75 bp, Artificial Sequence
  Synthetic
aatgtggcaaagccaacgaataaaatagctcccatatcagtgatcccaccaccaattgtgaagcctataccaatt

SEQ ID NO: 323745 - DNA, 75 bp, Artificial Sequence
  Synthetic
ggtctaatgcggaagaggctgcaaaagagagggccaggatgagagaaattgaagacaagctgagaaaggattggg

SEQ ID NO: 323746 - DNA, 75 bp, Artificial Sequence
  Synthetic
ctggtggcaatagaaaaggtgagtgaggatatgagaaaccatgtacgtagaccaaatacaaccatagcccctgct

SEQ ID NO: 323747 - DNA, 75 bp, Artificial Sequence
  Synthetic
tggccagtgcagtaatggcaggacctttggagaacagggaaacaaaccacttactaaacaggccagggaatggag

SEQ ID NO: 323748 - DNA, 75 bp, Artificial Sequence
  Synthetic
acgcattcatcaaatgcatgtggcagggaagccagcctcataaagaagaaatgtggaagcaatatgtcggctttc

SEQ ID NO: 323749 - DNA, 75 bp, Artificial Sequence
  Synthetic
taactgttgtcaagtgtgatacaaaccatgtcttgtctaacgactgtgggaattgtatctcgaaaaccttgagcg

SEQ ID NO: 323750 - DNA, 75 bp, Artificial Sequence
  Synthetic
gttggcgtgacaatagacgatatgggcaagacgttgagagagcacagtacacaggaggagctccagggactaaat

SEQ ID NO: 323751 - DNA, 75 bp, Artificial Sequence
  Synthetic
tctgtctacaagaacggattcaagatctttagatgtgtggcatggaaccataggatcagacttgaagttaccact

SEQ ID NO: 323752 - DNA, 75 bp, Artificial Sequence
  Synthetic
caatcaattgagaagaacacagttcaagcactgacaacaggggaggttagagcttccatacgcctcacattggac

SEQ ID NO: 323753 - DNA, 75 bp, Artificial Sequence
  Synthetic
gtcatctctattgaagggaggtatgactgcgggcttagcaaaagaccaatggtaataaaaggtactctaattgct

SEQ ID NO: 323754 - DNA, 75 bp, Artificial Sequence
  Synthetic
atgaaggaggttcctcattggttgtcaaccccaaaggcggcacagttgacttcttcggatgggtgtctggactaa

SEQ ID NO: 323755 - DNA, 75 bp, Artificial Sequence
  Synthetic
caaccccaaaggcggcacagttgacttcttcggatgggtgtctggactaacctcgtggctaggtggacctctgaa

SEQ ID NO: 323756 - DNA, 75 bp, Artificial Sequence
  Synthetic
ctagctctgggcctactcttagtagtggtgatcatcatcattgctcgtactggggtgcagcaggccctgaaaaag

SEQ ID NO: 323757 - DNA, 75 bp, Artificial Sequence
  Synthetic
aaaaacaagtaatatatatcatttctatcttttacacatcattaaattaggggttagggggggaataggcagtgc

SEQ ID NO: 323758 - DNA, 75 bp, Artificial Sequence
  Synthetic
acacaaagaaggtgcttatgttgaatacaaaatctataattttaataacctgtctagtgcagcaggtccatctga

SEQ ID NO: 323759 - DNA, 75 bp, Artificial Sequence
  Synthetic
tacaaaatctataattttaataacctgtctagtgcagcaggtccatctgaaatacacgattatttcagaggtgac

SEQ ID NO: 323760 - DNA, 75 bp, Artificial Sequence
  Synthetic
tgtctagtgcagcaggtccatctgaaatacacgattatttcagaggtgactaagggtgctagggaggtgagctgc

SEQ ID NO: 323761 - DNA, 75 bp, Artificial Sequence
  Synthetic
agctcttggaggcttgggagaataagagtgccctaatgggacttagaaaaggcaattgcaaacttggagctatgg

SEQ ID NO: 323762 - DNA, 75 bp, Artificial Sequence
  Synthetic
gagtgccctaatgggacttagaaaaggcaattgcaaacttggagctatggagcaggtggattgtaaccttgatct

SEQ ID NO: 323763 - DNA, 75 bp, Artificial Sequence
  Synthetic
tatgataatccacacggtttaggagcaatgatgtacaatgataagaggattgaggttctaaatgaccagattcct

SEQ ID NO: 323764 - DNA, 75 bp, Artificial Sequence
  Synthetic
caatgatgtacaatgataagaggattgaggttctaaatgaccagattcctgattctatgatccctggaggacaca

SEQ ID NO: 323765 - DNA, 75 bp, Artificial Sequence
  Synthetic
attctgggctgatctcataccatcaaaaaaggagaatcccaggccatctctgatttcccttgttccaactccaag

SEQ ID NO: 323766 - DNA, 75 bp, Artificial Sequence
  Synthetic
aaaaaggagaatcccaggccatctctgatttcccttgttccaactccaagaagtgatttcaaaaggaaattcgaa

SEQ ID NO: 323767 - DNA, 75 bp, Artificial Sequence
  Synthetic
taaggaaagaattacaagatgagcgtcaggcgcaattaagtgttattgaagaaggcaggaaaaggatgagggact

SEQ ID NO: 323768 - DNA, 75 bp, Artificial Sequence
  Synthetic
tcaggcgcaattaagtgttattgaagaaggcaggaaaaggatgagggacttagaggacaaacttatgaggcagtg

SEQ ID NO: 323769 - DNA, 75 bp, Artificial Sequence
  Synthetic
ctgcttgaggaaactttggagaagaaaaggcaactgaaaaacaaggctcttcttgatgcacataatctagacaag

SEQ ID NO: 323770 - DNA, 75 bp, Artificial Sequence
  Synthetic
aaaggcaactgaaaaacaaggctcttcttgatgcacataatctagacaagcagttgaaggaaaaggacagagaat

SEQ ID NO: 323771 - DNA, 75 bp, Artificial Sequence
  Synthetic
gaatgagagacatagaatcaacagtaatatgatcagacctcctatcaccactcccgcagctgtgatcttgacttc

SEQ ID NO: 323772 - DNA, 75 bp, Artificial Sequence
  Synthetic
aatatgatcagacctcctatcaccactcccgcagctgtgatcttgacttctcttttatctgccagtgtggttcta

SEQ ID NO: 323773 - DNA, 75 bp, Artificial Sequence
  Synthetic
ctaatcatgcactaaacagacctgggaatggtggttactctattagtgataacaatctgatagaggctaaatgca

SEQ ID NO: 323774 - DNA, 75 bp, Artificial Sequence
  Synthetic
gaatggtggttactctattagtgataacaatctgatagaggctaaatgcatgatcacctatggcaacaagtgtcc

SEQ ID NO: 323775 - DNA, 75 bp, Artificial Sequence
  Synthetic
gtgtcataccccttcttctcttccaattttgagaagtacagtctgctagagtctatttcagaaacctcaccgata

SEQ ID NO: 323776 - DNA, 75 bp, Artificial Sequence
  Synthetic
attttgagaagtacagtctgctagagtctatttcagaaacctcaccgataatagggaagttctcagaagtctgtg

SEQ ID NO: 323777 - DNA, 75 bp, Artificial Sequence
  Synthetic
gaaaacatgtgccaaagaagcaagcttaatcaagaagcaatgttctgatgacatgagagcctacttctacattaa

SEQ ID NO: 323778 - DNA, 75 bp, Artificial Sequence
  Synthetic
ttaatcaagaagcaatgttctgatgacatgagagcctacttctacattaactctttagggaaacttgcaattgtc

SEQ ID NO: 323779 - DNA, 75 bp, Artificial Sequence
  Synthetic
cacaagactgcaatttctgtctacgaaaagccaaaggagagcagtatgtttacaaacccattcaagatggctttt

SEQ ID NO: 323780 - DNA, 75 bp, Artificial Sequence
  Synthetic
aaaagccaaaggagagcagtatgtttacaaacccattcaagatggcttttgtcagaatggaggtgtttcttctgt

SEQ ID NO: 323781 - DNA, 75 bp, Artificial Sequence
  Synthetic
atctgctccataggaccaacaaaggttaaaaattgtcacaaaggcacttctaggtacgaaaggacagcattcata

SEQ ID NO: 323782 - DNA, 75 bp, Artificial Sequence
  Synthetic
ttaaaaattgtcacaaaggcacttctaggtacgaaaggacagcattcatatccactggagacaaaaaagtatatt

SEQ ID NO: 323783 - DNA, 75 bp, Artificial Sequence
  Synthetic
gcaagagtatgagcctgatcagttcttatgctacaaggtaaaggacagctcttcatcgcctcttgcctacgagaa

SEQ ID NO: 323784 - DNA, 75 bp, Artificial Sequence
  Synthetic
ttatgctacaaggtaaaggacagctcttcatcgcctcttgcctacgagaaggtccaagtgtccaaatgtaaaggc

SEQ ID NO: 323785 - DNA, 75 bp, Artificial Sequence
  Synthetic
gcacaggagatgaatacttctgcagcaagtacccttgtgagtcaaccagccctgaggcaaactgtttcctcagaa

SEQ ID NO: 323786 - DNA, 75 bp, Artificial Sequence
  Synthetic
caagtacccttgtgagtcaaccagccctgaggcaaactgtttcctcagaaagcacagtgcaatactagaggtcaa

SEQ ID NO: 323787 - DNA, 75 bp, Artificial Sequence
  Synthetic
aaatgtattggttatgagatggccctagttaagagggttggtctcaggtctgaagatgtctcatcaaaggagtgt

SEQ ID NO: 323788 - DNA, 75 bp, Artificial Sequence
  Synthetic
tagttaagagggttggtctcaggtctgaagatgtctcatcaaaggagtgtgccacttgcttatgggagtgctcca

SEQ ID NO: 323789 - DNA, 75 bp, Artificial Sequence
  Synthetic
tgggcctaagatttcttatgcaactgcatgtagtcatggatcttgcaagagtattgttcaaaacccatcaacatc

SEQ ID NO: 323790 - DNA, 75 bp, Artificial Sequence
  Synthetic
gcatgtagtcatggatcttgcaagagtattgttcaaaacccatcaacatccattagaattagttatccaggaaac

SEQ ID NO: 323791 - DNA, 75 bp, Artificial Sequence
  Synthetic
ggatccacttaactgaggactcatctcctatcaacctccatctgaagatccactgttcacctaaggattcttgtg

SEQ ID NO: 323792 - DNA, 75 bp, Artificial Sequence
  Synthetic
tcctatcaacctccatctgaagatccactgttcacctaaggattcttgtgaagtgagtgattgcattttttgcgt

SEQ ID NO: 323793 - DNA, 75 bp, Artificial Sequence
  Synthetic
cattccgtggcttctgctctccttttgtccactatcacagcatctcttattgtgttaatgatttacatgctttct

SEQ ID NO: 323794 - DNA, 75 bp, Artificial Sequence
  Synthetic
tgtccactatcacagcatctcttattgtgttaatgatttacatgctttctaaaactaagtttgtaatgaaaaagc

SEQ ID NO: 323795 - DNA, 75 bp, Artificial Sequence
  Synthetic
ctgctggtgttttgtactgctagcttggttaactaagtcttggaaagggaaaatgaggaatgcaattcagtcagc

SEQ ID NO: 323796 - DNA, 75 bp, Artificial Sequence
  Synthetic
tggttaactaagtcttggaaagggaaaatgaggaatgcaattcagtcagctaactccacaattgggtggacagaa

SEQ ID NO: 323797 - DNA, 75 bp, Artificial Sequence
  Synthetic
gaccaaggagcaggaataccgtaaggtattctttctatggggttgttatactagccatgttagaatctgcctttg

SEQ ID NO: 323798 - DNA, 75 bp, Artificial Sequence
  Synthetic
gtattctttctatggggttgttatactagccatgttagaatctgcctttggctgctctgaaagcctcattgcaga

SEQ ID NO: 323799 - DNA, 75 bp, Artificial Sequence
  Synthetic
gcaaatgggaaaacaagctgtagagcctctgggacaattattatgaaattagggccgataggatcagaagcttgt

SEQ ID NO: 323800 - DNA, 75 bp, Artificial Sequence
  Synthetic
cctctgggacaattattatgaaattagggccgataggatcagaagcttgtctgattctcaagggacttagggata

SEQ ID NO: 323801 - DNA, 75 bp, Artificial Sequence
  Synthetic
aactgaatctagtgagctgatctgcagagaaggagagtcattctggacctccttgtatactccagtttgcttaag

SEQ ID NO: 323802 - DNA, 75 bp, Artificial Sequence
  Synthetic
agagaaggagagtcattctggacctccttgtatactccagtttgcttaagctcaaggaggtgtcatttaatggga

SEQ ID NO: 323803 - DNA, 75 bp, Artificial Sequence
  Synthetic
agtggaagtcaaacaaaacttctttagagtttgctggcaagacacgtagtgatgtcataaatgaaaacaagtgtt

SEQ ID NO: 323804 - DNA, 75 bp, Artificial Sequence
  Synthetic
agagtttgctggcaagacacgtagtgatgtcataaatgaaaacaagtgttttgagcagagtggtgggctaggata

SEQ ID NO: 323805 - DNA, 75 bp, Artificial Sequence
  Synthetic
tgtctctatactcatgcttatttgaagtcagtttacaggaatggttttagagtgttcaagtgtgcttcttggact

SEQ ID NO: 323806 - DNA, 75 bp, Artificial Sequence
  Synthetic
agtcagtttacaggaatggttttagagtgttcaagtgtgcttcttggactcatagagttaagttaaccattacca

SEQ ID NO: 323807 - DNA, 75 bp, Artificial Sequence
  Synthetic
cctagcagcaatgagcactcaacccacagactggggctcaattggtctaattctcgactcagaggggatctcagg

SEQ ID NO: 323808 - DNA, 75 bp, Artificial Sequence
  Synthetic
acagactggggctcaattggtctaattctcgactcagaggggatctcagggacaaattccttttccttcatgaag

SEQ ID NO: 323809 - DNA, 75 bp, Artificial Sequence
  Synthetic
tagatgagccctattcaatggaacccaggaaggggttcattggagaagtcaggtgtccaacagaagaagcagcta

SEQ ID NO: 323810 - DNA, 75 bp, Artificial Sequence
  Synthetic
caggaaggggttcattggagaagtcaggtgtccaacagaagaagcagctataaaagcctctactctgtgtaagac

SEQ ID NO: 323811 - DNA, 75 bp, Artificial Sequence
  Synthetic
cctgaaatggacagtgccgaatgcaccacaaatatgattgatccaatgagcgtattcaacagaggctcccttccc

SEQ ID NO: 323812 - DNA, 75 bp, Artificial Sequence
  Synthetic
ccacaaatatgattgatccaatgagcgtattcaacagaggctcccttccccaggttagagaaggaatgactttta

SEQ ID NO: 323813 - DNA, 75 bp, Artificial Sequence
  Synthetic
tcaggccatgaccacaggggaagttcatgctagcattaggatagttctcgacgactatgaggttgaatatctttc

SEQ ID NO: 323814 - DNA, 75 bp, Artificial Sequence
  Synthetic
catgctagcattaggatagttctcgacgactatgaggttgaatatctttcaagtcaggttgattgtgatgctaca

SEQ ID NO: 323815 - DNA, 75 bp, Artificial Sequence
  Synthetic
catgcgatgagggtgcaagagtgtgtatgcagattatagcacatggggatactatattccactttagaaatccag

SEQ ID NO: 323816 - DNA, 75 bp, Artificial Sequence
  Synthetic
tatgcagattatagcacatggggatactatattccactttagaaatccagatgtgagtataaatattctacaaaa

SEQ ID NO: 323817 - DNA, 75 bp, Artificial Sequence
  Synthetic
tgctctgtagtgcacttttcaaagcctgttataaaagaggaaggaacatatgattgtggagcaggagagaagcca

SEQ ID NO: 323818 - DNA, 75 bp, Artificial Sequence
  Synthetic
ctgttataaaagaggaaggaacatatgattgtggagcaggagagaagccaatgattctcaaggggacattggtgg

SEQ ID NO: 323819 - DNA, 75 bp, Artificial Sequence
  Synthetic
ggaacagggaggttcctcaattgtgattaatccaaaagggggtggagttgacttccttggctggctttctggatt

SEQ ID NO: 323820 - DNA, 75 bp, Artificial Sequence
  Synthetic
attaatccaaaagggggtggagttgacttccttggctggctttctggatttagctcttggtttgggggacctctt

SEQ ID NO: 323821 - DNA, 75 bp, Artificial Sequence
  Synthetic
tccttctcctgggcctcatcttgtttgtgacaattgcgatcggccttaagtttgcactcagacaaatgatagtta

SEQ ID NO: 323822 - DNA, 75 bp, Artificial Sequence
  Synthetic
tgtgacaattgcgatcggccttaagtttgcactcagacaaatgatagttaaaaggatgaaatgattagcaaatgt

SEQ ID NO: 323823 - DNA, 75 bp, Artificial Sequence
  Synthetic
gcaaatacagtctggattctatagtttaattagtgggttcaactgggggggtatgggcagcagttcaatccagca

SEQ ID NO: 323824 - DNA, 75 bp, Artificial Sequence
  Synthetic
aaaatcatttaaaagatcagctaaattggtctattgattgcttgttttgcaatttgttgttttattaataaagca

SEQ ID NO: 323825 - DNA, 75 bp, Artificial Sequence
  Synthetic
acacaaagaaacccgttatttaactaaacaaaacatcatgtctgaggagaattatcgtgagattgccttggcttt

SEQ ID NO: 323826 - DNA, 75 bp, Artificial Sequence
  Synthetic
aaacaaaacatcatgtctgaggagaattatcgtgagattgccttggctttccttgatgaagctgcagactcaggt

SEQ ID NO: 323827 - DNA, 75 bp, Artificial Sequence
  Synthetic
attatcgtgagattgccttggctttccttgatgaagctgcagactcaggtaccatcactgcctgggtgaatgagt

SEQ ID NO: 323828 - DNA, 75 bp, Artificial Sequence
  Synthetic
aaggattgtccagctagtaaaagagaggggaactgccaaaggaagggactggaagaaagatgttaagatgatgat

SEQ ID NO: 323829 - DNA, 75 bp, Artificial Sequence
  Synthetic
aggggaactgccaaaggaagggactggaagaaagatgttaagatgatgatagtccttaacctagtaaggggcaac

SEQ ID NO: 323830 - DNA, 75 bp, Artificial Sequence
  Synthetic
tgtcggagaagggtgctggaattgttgcccagctaatttctgtatatcagcttagagaagggaatcctggtagag

SEQ ID NO: 323831 - DNA, 75 bp, Artificial Sequence
  Synthetic
tgcccagctaatttctgtatatcagcttagagaagggaatcctggtagagataccatcacattatctagagtctc

SEQ ID NO: 323832 - DNA, 75 bp, Artificial Sequence
  Synthetic
caggctctgaaagtgctctctgattccctccctgtcacagggacaacaatggatgccattgctggtgtgatgtac

SEQ ID NO: 323833 - DNA, 75 bp, Artificial Sequence
  Synthetic
ccctccctgtcacagggacaacaatggatgccattgctggtgtgatgtacccacgggctatgatgcatcctagct

SEQ ID NO: 323834 - DNA, 75 bp, Artificial Sequence
  Synthetic
tccaaacagggctggtgaagccattgctgatgcacatggtctattcatgttggagttctctaaaaccatcaatcc

SEQ ID NO: 323835 - DNA, 75 bp, Artificial Sequence
  Synthetic
gctgatgcacatggtctattcatgttggagttctctaaaaccatcaatccatccttgagaaccaagcagcctaat

SEQ ID NO: 323836 - DNA, 75 bp, Artificial Sequence
  Synthetic
caaacatggcagcaatgagcggccggttctttactagggaggacaagaagaagctcttgatggctgttggaatac

SEQ ID NO: 323837 - DNA, 75 bp, Artificial Sequence
  Synthetic
gttctttactagggaggacaagaagaagctcttgatggctgttggaatactcaatgaagaccttgtgctgactcc

SEQ ID NO: 323838 - DNA, 75 bp, Artificial Sequence
  Synthetic
tatcgctctaaagtgggcaagtaagctgccaaagtggggagggaagggtgaaggtggataattggttactaattt

SEQ ID NO: 323839 - DNA, 75 bp, Artificial Sequence
  Synthetic
ctgccaaagtggggagggaagggtgaaggtggataattggttactaatttgggtgggtttctaaattgggggaaa

SEQ ID NO: 323840 - DNA, 75 bp, Artificial Sequence
  Synthetic
cgcaagccactaagggacttgttctttgagagctgctccttcggggttggccagtctttagtccacacagtggag

SEQ ID NO: 323841 - DNA, 75 bp, Artificial Sequence
  Synthetic
ttgagagctgctccttcggggttggccagtctttagtccacacagtggagagagcatcctccctgaaagactcat

SEQ ID NO: 323842 - DNA, 75 bp, Artificial Sequence
  Synthetic
gtcgttacaactcattttggccaagcccttagttacatcaattttccgtgatttcttggctaggtgcagttcgac

SEQ ID NO: 323843 - DNA, 75 bp, Artificial Sequence
  Synthetic
cccttagttacatcaattttccgtgatttcttggctaggtgcagttcgactgggctgacagagaagtagatgtgg

SEQ ID NO: 323844 - DNA, 75 bp, Artificial Sequence
  Synthetic
gagccgattttgccacagaacttgctactctagctgcttgaaccacgcatagctcacctatgaggtcattcccag

SEQ ID NO: 323845 - DNA, 75 bp, Artificial Sequence
  Synthetic
tactctagctgcttgaaccacgcatagctcacctatgaggtcattcccaggcaagtcttccttcgtgagtccaag

SEQ ID NO: 323846 - DNA, 75 bp, Artificial Sequence
  Synthetic
ctgtgaatctctactatctggtcttcaattgaggtgttgaatagcccagatgccttaaccagaagctttaagtac

SEQ ID NO: 323847 - DNA, 75 bp, Artificial Sequence
  Synthetic
caattgaggtgttgaatagcccagatgccttaaccagaagctttaagtacctactcatgattgagttaggttcat

SEQ ID NO: 323848 - DNA, 75 bp, Artificial Sequence
  Synthetic
atagtactcgataaactcaagagaaggaacacctgttggccagcgcagagcagataggaggtagtcaaccttgtg

SEQ ID NO: 323849 - DNA, 75 bp, Artificial Sequence
  Synthetic
ggaacacctgttggccagcgcagagcagataggaggtagtcaaccttgtgtctttttaaactgttaatagactca

SEQ ID NO: 323850 - DNA, 75 bp, Artificial Sequence
  Synthetic
catacaacttagttctctgagatgttattgaatcatatccaatgaaagcagggaattctttttttgacagaaaat

SEQ ID NO: 323851 - DNA, 75 bp, Artificial Sequence
  Synthetic
tattgaatcatatccaatgaaagcagggaattctttttttgacagaaaatgagatagagttggccttgagtcaag

SEQ ID NO: 323852 - DNA, 75 bp, Artificial Sequence
  Synthetic
attgggatctcgctctccagtaagcaaaaccttctagaagggtcaaattcacccattctcgcagcaacataaaac

SEQ ID NO: 323853 - DNA, 75 bp, Artificial Sequence
  Synthetic
ttgaggattttggtttcaaaaaaactaaagatgattgcattgttaaggcagtttgtttagactttgtcttatcgc

SEQ ID NO: 323854 - DNA, 75 bp, Artificial Sequence
  Synthetic
acacaaagaggcccaaatatggaaagaatccttaagaaacaaccagctcctgatggagccctaaccattcatcca

SEQ ID NO: 323855 - DNA, 75 bp, Artificial Sequence
  Synthetic
tgatggagccctaaccattcatccactgagacggtacgactcaactatctatgaaacacctattcctgcttatgt

SEQ ID NO: 323856 - DNA, 75 bp, Artificial Sequence
  Synthetic
actattgacattgcaacgtcagaattggctgattaccagtcagggtcaacaatacagccttttgaatcaatccct

SEQ ID NO: 323857 - DNA, 75 bp, Artificial Sequence
  Synthetic
tggctgattaccagtcagggtcaacaatacagccttttgaatcaatccctgcacaaaatctaacattgttcaagc

SEQ ID NO: 323858 - DNA, 75 bp, Artificial Sequence
  Synthetic
agagacgacagacagaagatttgtggaggtgtttggagtgcttgaaaacagagccgatgattctgactaccaatc

SEQ ID NO: 323859 - DNA, 75 bp, Artificial Sequence
  Synthetic
tctggtcatgttcatgtcatagagtttacaaccaccatgggagacctgggttcagcagaggtggcagctagaaat

SEQ ID NO: 323860 - DNA, 75 bp, Artificial Sequence
  Synthetic
gcttgaaccggtcggcaatcaagcccatttcattacacataattgcagtgcatttcaatggtgtggtatcaaact

SEQ ID NO: 323861 - DNA, 75 bp, Artificial Sequence
  Synthetic
catttcattacacataattgcagtgcatttcaatggtgtggtatcaaacttagagctgaacgatgaggaggtcaa

SEQ ID NO: 323862 - DNA, 75 bp, Artificial Sequence
  Synthetic
gccagagacatctttgaggaacttagagaaatcaatccttcgctatttgattcagatgaaacaattagtaggctt

SEQ ID NO: 323863 - DNA, 75 bp, Artificial Sequence
  Synthetic
gagaaatcaatccttcgctatttgattcagatgaaacaattagtaggcttgagagagaagtgaacagtgtgatgt

SEQ ID NO: 323864 - DNA, 75 bp, Artificial Sequence
  Synthetic
gacgagtaagaaattccctagcttcaaggaggaactattcctaaattacaacaacaatgatgctaatcaagaata

SEQ ID NO: 323865 - DNA, 75 bp, Artificial Sequence
  Synthetic
aaggaggaactattcctaaattacaacaacaatgatgctaatcaagaatatctagcccgaatcattaagaagtgc

SEQ ID NO: 323866 - DNA, 75 bp, Artificial Sequence
  Synthetic
aaaaggacagcttatttgatgaagacttgtcacattctgagagaatgaatcgaaatgcaatcaaggtgagcttga

SEQ ID NO: 323867 - DNA, 75 bp, Artificial Sequence
  Synthetic
cttgtcacattctgagagaatgaatcgaaatgcaatcaaggtgagcttgaacattaagaacaagattgcagagat

SEQ ID NO: 323868 - DNA, 75 bp, Artificial Sequence
  Synthetic
gctgatgatcataagtcaactgtccagatcccaccttgggtgacacttgaagggcacaagggtaaggatctagaa

SEQ ID NO: 323869 - DNA, 75 bp, Artificial Sequence
  Synthetic
agatcccaccttgggtgacacttgaagggcacaagggtaaggatctagaacctttaaaatcattgtcagttgagg

SEQ ID NO: 323870 - DNA, 75 bp, Artificial Sequence
  Synthetic
gaataaggtgtgcacaaatgcttctatagacaagattgaaaggatgcatgatgatcctcaagctgaattggagta

SEQ ID NO: 323871 - DNA, 75 bp, Artificial Sequence
  Synthetic
atagacaagattgaaaggatgcatgatgatcctcaagctgaattggagtatgctatgtctgggtcaactgaaagg

SEQ ID NO: 323872 - DNA, 75 bp, Artificial Sequence
  Synthetic
ggactgttctaactttgtctagtgatgagaaggaatacgcagcagttttaggagtgtgtggcaagaagaatagta

SEQ ID NO: 323873 - DNA, 75 bp, Artificial Sequence
  Synthetic
tgagaaggaatacgcagcagttttaggagtgtgtggcaagaagaatagtaaccttggggctgtcaaggaggctag

SEQ ID NO: 323874 - DNA, 75 bp, Artificial Sequence
  Synthetic
atagagcatgatgtgagcaaagttgaggagtatctgtatgatattaatgtaattgacttaaagccagcagaaggc

SEQ ID NO: 323875 - DNA, 75 bp, Artificial Sequence
  Synthetic
aggagtatctgtatgatattaatgtaattgacttaaagccagcagaaggcctctacaatcctttgtctgaagata

SEQ ID NO: 323876 - DNA, 75 bp, Artificial Sequence
  Synthetic
actccatcaaccaacactaatacatgtggatgaacagcttcctgagacacttgagtgtcatagagacttcctaat

SEQ ID NO: 323877 - DNA, 75 bp, Artificial Sequence
  Synthetic
gtggatgaacagcttcctgagacacttgagtgtcatagagacttcctaatgacaccattaggtagctgggcacag

SEQ ID NO: 323878 - DNA, 75 bp, Artificial Sequence
  Synthetic
tgtcagcatccgttaagcagcatgtaaagcctaaccagttcattgttaagaggcttttagggtcttcagtttacc

SEQ ID NO: 323879 - DNA, 75 bp, Artificial Sequence
  Synthetic
aaagcctaaccagttcattgttaagaggcttttagggtcttcagtttacctactaataaaacccaccacgtccaa

SEQ ID NO: 323880 - DNA, 75 bp, Artificial Sequence
  Synthetic
gttgacagaaagtacctggtaagggacttgagtaaatcttcaatcttcaagccctctatcccagcaggggacctt

SEQ ID NO: 323881 - DNA, 75 bp, Artificial Sequence
  Synthetic
acttgagtaaatcttcaatcttcaagccctctatcccagcaggggaccttatggtgaccgattttgtttcattta

SEQ ID NO: 323882 - DNA, 75 bp, Artificial Sequence
  Synthetic
cagatccttgtgtatggtggaggcagcagcatgtttctggtcagagacatatggatacgaaccctggaggatgtt

SEQ ID NO: 323883 - DNA, 75 bp, Artificial Sequence
  Synthetic
aaagatacttggtttatgattaagttgtctttactcacgatgatggaagacaaagcaaccactgaggaactacag

SEQ ID NO: 323884 - DNA, 75 bp, Artificial Sequence
  Synthetic
aaggctttgtgtccttaccagagttgccaaatccctcaaaaatgctctctaagattccaaaagtgcttaggtctg

SEQ ID NO: 323885 - DNA, 75 bp, Artificial Sequence
  Synthetic
gccaaatccctcaaaaatgctctctaagattccaaaagtgcttaggtctgaactacaggtttttctgactcacag

SEQ ID NO: 323886 - DNA, 75 bp, Artificial Sequence
  Synthetic
tccaaaaacccattccaattacatagaattggggcaaatataaagtggaaatcactgttcaacccattttctgga

SEQ ID NO: 323887 - DNA, 75 bp, Artificial Sequence
  Synthetic
gaattggggcaaatataaagtggaaatcactgttcaacccattttctggaaacagtgtggatgagttgcaaacac

SEQ ID NO: 323888 - DNA, 75 bp, Artificial Sequence
  Synthetic
cttcaaaaataaggaggaagaaactgagccatcagcactgtctgcaatgtacaagaagattatagaacttgaaca

SEQ ID NO: 323889 - DNA, 75 bp, Artificial Sequence
  Synthetic
gagccatcagcactgtctgcaatgtacaagaagattatagaacttgaacatctgaggcccaatgctgaccaatac

SEQ ID NO: 323890 - DNA, 75 bp, Artificial Sequence
  Synthetic
ctaaaatgcatgagtttagtagaagttatttaaagcttatatgtgatcatgctaggagcaagttgaggaagcaat

SEQ ID NO: 323891 - DNA, 75 bp, Artificial Sequence
  Synthetic
ttatttaaagcttatatgtgatcatgctaggagcaagttgaggaagcaatacggcaggggtgttatgagtcagat

SEQ ID NO: 323892 - DNA, 75 bp, Artificial Sequence
  Synthetic
tcttcaatcacactggagagactcgccaccttgaaagcaaccagcaactttaataatgcctggtatgtttataag

SEQ ID NO: 323893 - DNA, 75 bp, Artificial Sequence
  Synthetic
ccaccttgaaagcaaccagcaactttaataatgcctggtatgtttataaggatgtgcgagacaaaaattacacaa

SEQ ID NO: 323894 - DNA, 75 bp, Artificial Sequence
  Synthetic
tcaatttgctaaaagaggcaaaactctagcaatagagatgtttgaggagtgcatgagcaggatcgaagagaaggg

SEQ ID NO: 323895 - DNA, 75 bp, Artificial Sequence
  Synthetic
ctagcaatagagatgtttgaggagtgcatgagcaggatcgaagagaagggttgtatggagatttgcttattcaaa

SEQ ID NO: 323896 - DNA, 75 bp, Artificial Sequence
  Synthetic
aaatttatgtgatgggtgccgatgaaaggattgttcagtcagtgattgaggcaatagcaagagccatagggaggt

SEQ ID NO: 323897 - DNA, 75 bp, Artificial Sequence
  Synthetic
aaggattgttcagtcagtgattgaggcaatagcaagagccatagggaggttctttgactcagacacactttgtaa

SEQ ID NO: 323898 - DNA, 75 bp, Artificial Sequence
  Synthetic
gagactcatggccagagagctaagagaagatgtggaaggtcagtatggacctgtgcgacttcagatgatgcgaga

SEQ ID NO: 323899 - DNA, 75 bp, Artificial Sequence
  Synthetic
gaagatgtggaaggtcagtatggacctgtgcgacttcagatgatgcgagaaaatggaatcaggggcattttgtga

SEQ ID NO: 323900 - DNA, 75 bp, Artificial Sequence
  Synthetic
gtttacacctgaagaatggtggccactcatcattagaggctgctcaatgtttacaaacaagtatatgatgatgaa

SEQ ID NO: 323901 - DNA, 75 bp, Artificial Sequence
  Synthetic
ctcatcattagaggctgctcaatgtttacaaacaagtatatgatgatgaatcttgacttcatgagaatcatagac

SEQ ID NO: 323902 - DNA, 75 bp, Artificial Sequence
  Synthetic
atgagtttgtaacaaaattgttttcagcctaccatggggagactgtggagccatggatagaccaagggaaaacat

SEQ ID NO: 323903 - DNA, 75 bp, Artificial Sequence
  Synthetic
atctaaagacaagtactggtatgatgcaagggatactccacttcacatcttcattattgcattccctgcaccaag

SEQ ID NO: 323904 - DNA, 75 bp, Artificial Sequence
  Synthetic
gcttttcactaataaaatgggctcagaagcctcatcaaaagtagtatgtgatgttatgcaaggctctgatgacag

SEQ ID NO: 323905 - DNA, 75 bp, Artificial Sequence
  Synthetic
cagcatgataattagtttcccagcagagaatgagaaaatgaagatgagatataaattgatagcagcaatgtgctt

SEQ ID NO: 323906 - DNA, 75 bp, Artificial Sequence
  Synthetic
tatataggaatctacccttctgaaaaatcaacacctaacactgattttgtcatggaatataattctgagttcttt

SEQ ID NO: 323907 - DNA, 75 bp, Artificial Sequence
  Synthetic
aatcaacacctaacactgattttgtcatggaatataattctgagttcttttttcattctcaacacatcagaccaa

SEQ ID NO: 323908 - DNA, 75 bp, Artificial Sequence
  Synthetic
ctccctcccagaggttgagactttggtagctagacaagaggaagcagcaaatctgctgactgctgtcacagaagg

SEQ ID NO: 323909 - DNA, 75 bp, Artificial Sequence
  Synthetic
tgggggctcattctccttagcagcaatggtgcaacagtgtcagtgcacaatccattatatgctgatgggaatggg

SEQ ID NO: 323910 - DNA, 75 bp, Artificial Sequence
  Synthetic
tcaaaagcaatctctaaatggatggacccaggattaggctttttcttatttgataacccgtattcagctggcttg

SEQ ID NO: 323911 - DNA, 75 bp, Artificial Sequence
  Synthetic
acccaggattaggctttttcttatttgataacccgtattcagctggcttgtctggtttcaagtataatctctata

SEQ ID NO: 323912 - DNA, 75 bp, Artificial Sequence
  Synthetic
gtatgtttactcattttttatgaggagagtcaaaggatcatctaccaaggaagatgcaatcataagtgagtcttg

SEQ ID NO: 323913 - DNA, 75 bp, Artificial Sequence
  Synthetic
agagtcaaaggatcatctaccaaggaagatgcaatcataagtgagtcttgtagtgtgagccctggtggagccata

SEQ ID NO: 323914 - DNA, 75 bp, Artificial Sequence
  Synthetic
gctcagttgagaaattcaaaagacttagaaacaggcttgacattcctgaggactggaaggacatgattaataata

SEQ ID NO: 323915 - DNA, 75 bp, Artificial Sequence
  Synthetic
tagaaacaggcttgacattcctgaggactggaaggacatgattaataatagtcctgaagtgctatacagggctcc

SEQ ID NO: 323916 - DNA, 75 bp, Artificial Sequence
  Synthetic
aggattgctgagaaagttcatagccctggggttgtctcctctcttagcactgggaatgcagtatgtaaagtgatg

SEQ ID NO: 323917 - DNA, 75 bp, Artificial Sequence
  Synthetic
ctggggttgtctcctctcttagcactgggaatgcagtatgtaaagtgatggcttcatcagtttattttctttcag

SEQ ID NO: 323918 - DNA, 75 bp, Artificial Sequence
  Synthetic
tcaagagtataaaatcctgaataatgacaagtacagcctccttcagaagattgtggcttttgaccaattctcagg

SEQ ID NO: 323919 - DNA, 75 bp, Artificial Sequence
  Synthetic
gacaagtacagcctccttcagaagattgtggcttttgaccaattctcaggtggggaagatatcagtcaggaagat

SEQ ID NO: 323920 - DNA, 75 bp, Artificial Sequence
  Synthetic
tggaatttgaggcttttgattctattatttatgacaaaggaaaatttaacattgttccaagagctagccagagag

SEQ ID NO: 323921 - DNA, 75 bp, Artificial Sequence
  Synthetic
tatttatgacaaaggaaaatttaacattgttccaagagctagccagagagaagctacccagaccaggatagtggt

SEQ ID NO: 323922 - DNA, 75 bp, Artificial Sequence
  Synthetic
gtggctccagagaaattagttagtgacaagtggtttgggacaagaaaaagcaagattggttcccctggctttagg

SEQ ID NO: 323923 - DNA, 75 bp, Artificial Sequence
  Synthetic
acaagtggtttgggacaagaaaaagcaagattggttcccctggctttaggcaggagtggactagattaaaggctg

SEQ ID NO: 323924 - DNA, 75 bp, Artificial Sequence
  Synthetic
agaagaaaccctagatgcctctccattctcaaatcatgtccaaattcggaactttttcgcaagaatggagggaaa

SEQ ID NO: 323925 - DNA, 75 bp, Artificial Sequence
  Synthetic
ttctcaaatcatgtccaaattcggaactttttcgcaagaatggagggaaagccaagagtcataaaggtgacaggg

SEQ ID NO: 323926 - DNA, 75 bp, Artificial Sequence
  Synthetic
tgagcaagattgcaatggcaataagggacaacttttgtaagactggttttttacaagggttggaggatgaaattg

SEQ ID NO: 323927 - DNA, 75 bp, Artificial Sequence
  Synthetic
ggacaacttttgtaagactggttttttacaagggttggaggatgaaattggtcatagtagagccatgcaagtaga

SEQ ID NO: 323928 - DNA, 75 bp, Artificial Sequence
  Synthetic
attctgctaggcccatacacagaagatgcgaaactagagtatgttgtaaaaattctcagagaagagccgcaagtc

SEQ ID NO: 323929 - DNA, 75 bp, Artificial Sequence
  Synthetic
atgcgaaactagagtatgttgtaaaaattctcagagaagagccgcaagtcattctaaattataacgataaaaggt

SEQ ID NO: 323930 - DNA, 75 bp, Artificial Sequence
  Synthetic
gcagagatttattaaaagtgaggtggggatagcaaatttaattgaagagatgaaagctggagtttttggagcatt

SEQ ID NO: 323931 - DNA, 75 bp, Artificial Sequence
  Synthetic
tgttaagacccaacactttagtcacagctctatcaataataagtattatggtaaggggatctggaaaggtgtgat

SEQ ID NO: 323932 - DNA, 75 bp, Artificial Sequence
  Synthetic
atagatggaaaagagggcatgccatctcacttgaccggaatcaccatctctaactgttcaaagccatgggtgtta

SEQ ID NO: 323933 - DNA, 75 bp, Artificial Sequence
  Synthetic
taactgttcaaagccatgggtgttaacacaaagcataaaagcatggtgtgatgacatgcttgtgaacaataatgt

SEQ ID NO: 323934 - DNA, 75 bp, Artificial Sequence
  Synthetic
gccaactattggatgtacgggtttaagatgtatggagcgtcttacccctatggttgtccgataaccttagtgagg

SEQ ID NO: 323935 - DNA, 75 bp, Artificial Sequence
  Synthetic
catgacataacaaatcttggtttgctacatgacgatgacattgatataaaagtcaggagaaacacaataaattta

SEQ ID NO: 323936 - DNA, 75 bp, Artificial Sequence
  Synthetic
tacatgacgatgacattgatataaaagtcaggagaaacacaataaatttatttgtgaggagtacagatagaaggc

SEQ ID NO: 323937 - DNA, 75 bp, Artificial Sequence
  Synthetic
caccccgtctgactctgatataagctctgttagctccaaacatatcatgagagatgaatatttttcaaataaagg

SEQ ID NO: 323938 - DNA, 75 bp, Artificial Sequence
  Synthetic
tcttggatgctctgccagcctctatcatggatgtttgtgaagcctgtactgcaggtgatgtcaggaaagaggaca

SEQ ID NO: 323939 - DNA, 75 bp, Artificial Sequence
  Synthetic
catggatgtttgtgaagcctgtactgcaggtgatgtcaggaaagaggacaagccccagacaattggacacagaaa

SEQ ID NO: 323940 - DNA, 75 bp, Artificial Sequence
  Synthetic
cactgaatctgccatcaggaacaaggtgggaactgtctatagccagaataaaccagagaagttgattgagtctga

SEQ ID NO: 323941 - DNA, 75 bp, Artificial Sequence
  Synthetic
gccaattgatatgagcgagatgtttgatatgatgctagaggaggggatagatgatgtgttcgaagacattgctga

SEQ ID NO: 323942 - DNA, 75 bp, Artificial Sequence
  Synthetic
gatatgatgctagaggaggggatagatgatgtgttcgaagacattgctgattgcctagcagtggatgaggatcct

SEQ ID NO: 323943 - DNA, 75 bp, Artificial Sequence
  Synthetic
atgatgaaagtctcaacctctttggtcctgctcattataaggagatccagagcatgacagttctcgcccacccgt

SEQ ID NO: 323944 - DNA, 75 bp, Artificial Sequence
  Synthetic
tcctgctcattataaggagatccagagcatgacagttctcgcccacccgttgatggacgaattcgttactaagtt

SEQ ID NO: 323945 - DNA, 75 bp, Artificial Sequence
  Synthetic
atcaggagattgctagaaaaatcaatagtcactacagaacacagggccctggctgaactcttatttttggctttg

SEQ ID NO: 323946 - DNA, 75 bp, Artificial Sequence
  Synthetic
tagtcactacagaacacagggccctggctgaactcttatttttggctttgggcagagatccgtcacagattaaag

SEQ ID NO: 323947 - DNA, 75 bp, Artificial Sequence
  Synthetic
aacagacatccctgatgatctccttgggtaatctttaattgaattgtgataagggagaagaatagtgaaccaaca

SEQ ID NO: 323948 - DNA, 75 bp, Artificial Sequence
  Synthetic
aagggagaagaatagtgaaccaacaatgcatgacagaaacacggttttaggttttcagaaaattgggcggtcttt

SEQ ID NO: 323949 - DNA, 75 bp, Artificial Sequence
  Synthetic
acgatgccttaaagaagatatgagagtgacaaagtggctgcctagtcccccccactacccacccttatgatccca

SEQ ID NO: 323950 - DNA, 75 bp, Artificial Sequence
  Synthetic
gaagatatgagagtgacaaaatggctgcctggtcccccccactacccacccttgtgatcccacccctcagatttc

SEQ ID NO: 323951 - DNA, 75 bp, Artificial Sequence
  Synthetic
atcataactactctgctcatgggcagtgcagtaatggcagggcctttggagaacagggaaccaacccacttatta

SEQ ID NO: 323952 - DNA, 75 bp, Artificial Sequence
  Synthetic
tcatcatcattgctcgcactggggtcgaacaggccctaaaaaagaaaaacaagtaatccataccatttctatctt

SEQ ID NO: 323953 - DNA, 75 bp, Artificial Sequence
  Synthetic
tagctcctatgtcagttatcccaccaccaattgtgaagcctataccagttgcagaatcaaccattaagaaaacca

SEQ ID NO: 323954 - DNA, 75 bp, Artificial Sequence
  Synthetic
gctcaaaaagaaggagcgtgaggatctggtggccagagaaagggtgaatgaggatatgaggaaccatgtgcgcag

SEQ ID NO: 323955 - DNA, 75 bp, Artificial Sequence
  Synthetic
atgagctgtcttttcccttcttccactctaaccttgacaagtacagcatgttagaggctgcaacagagacaatac

SEQ ID NO: 323956 - DNA, 75 bp, Artificial Sequence
  Synthetic
ctccgaccgctgcctcaaatggaagaccaatgaaacatctgcagaattcactgggaaggcacatggagaagttat

SEQ ID NO: 323957 - DNA, 75 bp, Artificial Sequence
  Synthetic
tgatggagccttaaccattcatccactgaggcggtacgattcaaccatttatgaaacacctattcctgcttatgt

SEQ ID NO: 323958 - DNA, 75 bp, Artificial Sequence
  Synthetic
tggctgattaccagtcagggtcaacaatacagccctttgaatcaatccctgcacaaaacctaacattattcaagc

SEQ ID NO: 323959 - DNA, 75 bp, Artificial Sequence
  Synthetic
agagacgacggatagaaaatttgtggaggtgtttggagtgcttgaaaacagagccgatgattctgactaccaatc

SEQ ID NO: 323960 - DNA, 75 bp, Artificial Sequence
  Synthetic
tctggtcatgttcatgtcatagagttcacaactaccatgggagacctgggttcagctgaggtggcagctagaaat

SEQ ID NO: 323961 - DNA, 75 bp, Artificial Sequence
  Synthetic
gctagagacatctttgaggagcttagagaaattaatccttctcttttcgattcagatgaaacaattagtaggctt

SEQ ID NO: 323962 - DNA, 75 bp, Artificial Sequence
  Synthetic
gagaaattaatccttctcttttcgattcagatgaaacaattagtaggcttgagagagaagtgaacagtgtgatgt

SEQ ID NO: 323963 - DNA, 75 bp, Artificial Sequence
  Synthetic
gacaagtgagaaattccctagtttcaaggaggaactattctcaaattacaataataatgatgctaaccaagaata

SEQ ID NO: 323964 - DNA, 75 bp, Artificial Sequence
  Synthetic
aaggaggaactattctcaaattacaataataatgatgctaaccaagaatatctagttcggatcattaagaagtgc

SEQ ID NO: 323965 - DNA, 75 bp, Artificial Sequence
  Synthetic
aaaaggacagcttatttgatgaagatctgtcacattctgagagaatgaatcgaaatgcagataaggtgagcttaa

SEQ ID NO: 323966 - DNA, 75 bp, Artificial Sequence
  Synthetic
tctgtcacattctgagagaatgaatcgaaatgcagataaggtgagcttaaacattaagagcaagattgcagagat

SEQ ID NO: 323967 - DNA, 75 bp, Artificial Sequence
  Synthetic
actgatgatcacaagtcaactgtccagatcccaccttgggtgacacttgaagggcacaagggtaaagatctagaa

SEQ ID NO: 323968 - DNA, 75 bp, Artificial Sequence
  Synthetic
agatcccaccttgggtgacacttgaagggcacaagggtaaagatctagaacctttgaaatcattgtcagttgaag

SEQ ID NO: 323969 - DNA, 75 bp, Artificial Sequence
  Synthetic
gaataaggtgtgcacaaatgcttctatagataagattgaaaggatgcatgatgatcctcaagctgagttggagta

SEQ ID NO: 323970 - DNA, 75 bp, Artificial Sequence
  Synthetic
atagataagattgaaaggatgcatgatgatcctcaagctgagttggagtatgctatgtctggatcaactgaaagg

SEQ ID NO: 323971 - DNA, 75 bp, Artificial Sequence
  Synthetic
gaactgttctaactttgtctagtgatgagaaagaatacgcagcggttttaggagtgtgtggtaagaagaacagca

SEQ ID NO: 323972 - DNA, 75 bp, Artificial Sequence
  Synthetic
tgagaaagaatacgcagcggttttaggagtgtgtggtaagaagaacagcaaccttggagctgtcaaggaggctag

SEQ ID NO: 323973 - DNA, 75 bp, Artificial Sequence
  Synthetic
atagagcatgatgtgagcaaagttgaggagtatctgtatgacatcaatgtaattgacttaaagccaacagaaggc

SEQ ID NO: 323974 - DNA, 75 bp, Artificial Sequence
  Synthetic
aggagtatctgtatgacatcaatgtaattgacttaaagccaacagaaggcctctacaatcctttgtccgaagata

SEQ ID NO: 323975 - DNA, 75 bp, Artificial Sequence
  Synthetic
gctccatcaaccaacactaatacatgtggatggacagcttcctgagacacttgagtgtcatagggacttcctaat

SEQ ID NO: 323976 - DNA, 75 bp, Artificial Sequence
  Synthetic
gtggatggacagcttcctgagacacttgagtgtcatagggacttcctaatgacgccgttaggtagctgggcacag

SEQ ID NO: 323977 - DNA, 75 bp, Artificial Sequence
  Synthetic
tgtcagcatctgttaagcagcatgtaaagcctaaccagctcatcgtgaagaggcttttagggtcttcagtttacc

SEQ ID NO: 323978 - DNA, 75 bp, Artificial Sequence
  Synthetic
aaagcctaaccagctcatcgtgaagaggcttttagggtcttcagtttacctactaataaaacccaccacatctaa

SEQ ID NO: 323979 - DNA, 75 bp, Artificial Sequence
  Synthetic
gttgacagaaggtacttgataagggacttgagtaagtcttcaatcttcaagccctctattccagcaggagacctt

SEQ ID NO: 323980 - DNA, 75 bp, Artificial Sequence
  Synthetic
acttgagtaagtcttcaatcttcaagccctctattccagcaggagaccttatggtgaccgattttgtttcattta

SEQ ID NO: 323981 - DNA, 75 bp, Artificial Sequence
  Synthetic
aaagatacttggtttatgattaagttgtctttacttacgatgatggaagacaaagcgaccactgaggaattacag

SEQ ID NO: 323982 - DNA, 75 bp, Artificial Sequence
  Synthetic
gccaaatccctcaaaaatgctctctaaaattccaaaagtgcttaggtctgaactacaggttttcctgactcacag

SEQ ID NO: 323983 - DNA, 75 bp, Artificial Sequence
  Synthetic
tccaagaatccattccaattacatagaattggggcaaatataaagtggaaatcactgttcaatccattttctgga

SEQ ID NO: 323984 - DNA, 75 bp, Artificial Sequence
  Synthetic
gaattggggcaaatataaagtggaaatcactgttcaatccattttctggaaatggtgtagatgagttgcaaacac

SEQ ID NO: 323985 - DNA, 75 bp, Artificial Sequence
  Synthetic
tttcaaaaataaggaggaagaaactgagccatcagcactgtctgcaatgtacaagaagattatagaacttgagca

SEQ ID NO: 323986 - DNA, 75 bp, Artificial Sequence
  Synthetic
gagccatcagcactgtctgcaatgtacaagaagattatagaacttgagcatctgagacccaatactgatcagtac

SEQ ID NO: 323987 - DNA, 75 bp, Artificial Sequence
  Synthetic
ccaaaatgcatgaattcagcagaagttatttaaagctcatatgtgaccatgctaagggtaagttgagaaagcaat

SEQ ID NO: 323988 - DNA, 75 bp, Artificial Sequence
  Synthetic
ttatttaaagctcatatgtgaccatgctaagggtaagttgagaaagcaatatggcaggggtgttatgagtcagat

SEQ ID NO: 323989 - DNA, 75 bp, Artificial Sequence
  Synthetic
tcttcaatcacattggaaagactcgccaccttgaaagcaaccagtaactttaatagtaactggtatgtttataag

SEQ ID NO: 323990 - DNA, 75 bp, Artificial Sequence
  Synthetic
ccaccttgaaagcaaccagtaactttaatagtaactggtatgtttataaggatgtgcgagacaagaattatacaa

SEQ ID NO: 323991 - DNA, 75 bp, Artificial Sequence
  Synthetic
tcaatttgctaagagaggtaaaactctagcaatagagatgtttgaggagtgcatgagcaggatcgaggagaaggg

SEQ ID NO: 323992 - DNA, 75 bp, Artificial Sequence
  Synthetic
ctagcaatagagatgtttgaggagtgcatgagcaggatcgaggagaagggttgcatggagatttgcttatttaaa

SEQ ID NO: 323993 - DNA, 75 bp, Artificial Sequence
  Synthetic
aaatttatgtgatgggtgctgatgaaaggattgttcagtcaataattgaggcaatagcaagagccatagggaggt

SEQ ID NO: 323994 - DNA, 75 bp, Artificial Sequence
  Synthetic
aaggattgttcagtcaataattgaggcaatagcaagagccatagggaggttttttgactcagacacactttgtaa

SEQ ID NO: 323995 - DNA, 75 bp, Artificial Sequence
  Synthetic
gagactcatggccagagagccaagagaagatgtggaaggtcagtatggacctgtgcaacttcagatgatgcgaga

SEQ ID NO: 323996 - DNA, 75 bp, Artificial Sequence
  Synthetic
gaagatgtggaaggtcagtatggacctgtgcaacttcagatgatgcgagaaaatggaatcaggggcattttgtaa

SEQ ID NO: 323997 - DNA, 75 bp, Artificial Sequence
  Synthetic
gttcacacctgaggaatggtggccacttatcattagaggctgttcaatgttcacaaataagtatatgatgatgaa

SEQ ID NO: 323998 - DNA, 75 bp, Artificial Sequence
  Synthetic
cttatcattagaggctgttcaatgttcacaaataagtatatgatgatgaatcttgacttcatgagaatcatagac

SEQ ID NO: 323999 - DNA, 75 bp, Artificial Sequence
  Synthetic
atgaatttgtaacaaaattgttttcagcctaccatggagagacagtggagccatggatagaccaagggaaaacat

SEQ ID NO: 324000 - DNA, 75 bp, Artificial Sequence
  Synthetic
atctgaagacaagtacaggtatgatgcaagggatactccacttcacatcttcattattgcactcactacaccaag

SEQ ID NO: 324001 - DNA, 75 bp, Artificial Sequence
  Synthetic
cagcatgattattagttttccagcagaaaatgagaaaatgaagatgagatataagttaatagcagcaatgtgctt

SEQ ID NO: 324002 - DNA, 75 bp, Artificial Sequence
  Synthetic
aatcaacacctaacactgattttgtcatggaatataattctgagttcttcttccattctcagcatatcaggccaa

SEQ ID NO: 324003 - DNA, 75 bp, Artificial Sequence
  Synthetic
tgggggttcattctccttagcggcaatggtgcaacagtgtcaatgcacaatccattatatgctaatgggaatggg

SEQ ID NO: 324004 - DNA, 75 bp, Artificial Sequence
  Synthetic
gtatgtttactcatttttcatgaggagagtcaaaggatcatccaccaaggaagatgcaattataagtgagtcatg

SEQ ID NO: 324005 - DNA, 75 bp, Artificial Sequence
  Synthetic
agagtcaaaggatcatccaccaaggaagatgcaattataagtgagtcatgtagtgtgagccctggtggagccata

SEQ ID NO: 324006 - DNA, 75 bp, Artificial Sequence
  Synthetic
gttcagttgagaaattcaaaaggcttagaaacaggcttgacattcctgaggactggaaagacatgattaacaata

SEQ ID NO: 324007 - DNA, 75 bp, Artificial Sequence
  Synthetic
tagaaacaggcttgacattcctgaggactggaaagacatgattaacaatagtcctgaagtgctatacagggctcc

SEQ ID NO: 324008 - DNA, 75 bp, Artificial Sequence
  Synthetic
aggattgctgagaaagttcatagtcctggggttgtctcttctcttagcactgggaatgcagtgtgtaaagtgatg

SEQ ID NO: 324009 - DNA, 75 bp, Artificial Sequence
  Synthetic
ctggggttgtctcttctcttagcactgggaatgcagtgtgtaaagtgatggcgtcatcggtttattttctttcag

SEQ ID NO: 324010 - DNA, 75 bp, Artificial Sequence
  Synthetic
tcaagagtataaaatcttgaataatgacaagtacagccttcttcagaagattgtggcttttgaccaattctcagg

SEQ ID NO: 324011 - DNA, 75 bp, Artificial Sequence
  Synthetic
gacaagtacagccttcttcagaagattgtggcttttgaccaattctcaggtggggaggatattagtcaggaagat

SEQ ID NO: 324012 - DNA, 75 bp, Artificial Sequence
  Synthetic
tggaatttgaggcctttgactctattatttatgataaagggaaattcaacattgttccaagagccagccagagag

SEQ ID NO: 324013 - DNA, 75 bp, Artificial Sequence
  Synthetic
tatttatgataaagggaaattcaacattgttccaagagccagccagagagaagctacccagaccaggatagtggt

SEQ ID NO: 324014 - DNA, 75 bp, Artificial Sequence
  Synthetic
gtggctccagagaaattagttagtgacaagtggtttggaacaagaaagagcaaaatcggttcccctggcttcagg

SEQ ID NO: 324015 - DNA, 75 bp, Artificial Sequence
  Synthetic
acaagtggtttggaacaagaaagagcaaaatcggttcccctggcttcaggcaggaatggactagattgaaggcta

SEQ ID NO: 324016 - DNA, 75 bp, Artificial Sequence
  Synthetic
tgagcaagatcgcaatggcaataagagataacttttgcaagactggttttttgcaagggctggaggatgaaattg

SEQ ID NO: 324017 - DNA, 75 bp, Artificial Sequence
  Synthetic
agataacttttgcaagactggttttttgcaagggctggaggatgaaattggtcatagtagagccatgcaagtaga

SEQ ID NO: 324018 - DNA, 75 bp, Artificial Sequence
  Synthetic
attctgttaggcccatatacagaagatgcgaaactagagtatgttgtgaaaattctcagagaagagccgcaggtc

SEQ ID NO: 324019 - DNA, 75 bp, Artificial Sequence
  Synthetic
atgcgaaactagagtatgttgtgaaaattctcagagaagagccgcaggtcattctaaattataacgacaaaaggt

SEQ ID NO: 324020 - DNA, 75 bp, Artificial Sequence
  Synthetic
gcaaagatttatcaaaagtgaggtggggatagcaaatttaattgaagagatgaaagctggagtctttggagcatt

SEQ ID NO: 324021 - DNA, 75 bp, Artificial Sequence
  Synthetic
tgtcaaaacccaacactttagtcacagctctatcaacaataagtactatggtagggggatctggaaaggtgtaat

SEQ ID NO: 324022 - DNA, 75 bp, Artificial Sequence
  Synthetic
tacatgacgatgacattgatataaaagtcaggagaaacacaataaatttatttgtaaggagcacagataaaaggc

SEQ ID NO: 324023 - DNA, 75 bp, Artificial Sequence
  Synthetic
caccccatctgactctgacattagctctgccagctccaaacatatcatgagagatgaatatttttcaaataaagg

SEQ ID NO: 324024 - DNA, 75 bp, Artificial Sequence
  Synthetic
tcctggatgctttgccagcctctgtcatggatgttcgtgaagcctgtactgcaagtgatgtcgggaaagaggaca

SEQ ID NO: 324025 - DNA, 75 bp, Artificial Sequence
  Synthetic
catggatgttcgtgaagcctgtactgcaagtgatgtcgggaaagaggacaagtcccagacaattggacacagaaa

SEQ ID NO: 324026 - DNA, 75 bp, Artificial Sequence
  Synthetic
gatatgatgctagaggaggggatagatgatgtgtttgaagacattgctgattgcctaacagtggatgaggatcct

SEQ ID NO: 324027 - DNA, 75 bp, Artificial Sequence
  Synthetic
atgatgaaagtctcaacctttttggtcctgcccactataaggagatccagagcatgacagttctcgcccacccat

SEQ ID NO: 324028 - DNA, 75 bp, Artificial Sequence
  Synthetic
tcctgcccactataaggagatccagagcatgacagttctcgcccacccattgatggacgaattcattaccaagtt

SEQ ID NO: 324029 - DNA, 75 bp, Artificial Sequence
  Synthetic
attaggaggttgctagaaaaatcaatagtcactacagagcacagggctctggctgaactcctatttttggctttg

SEQ ID NO: 324030 - DNA, 75 bp, Artificial Sequence
  Synthetic
tagtcactacagagcacagggctctggctgaactcctatttttggctttgggcagagatccgtcacagattaaag

SEQ ID NO: 324031 - DNA, 75 bp, Artificial Sequence
  Synthetic
aacagacatccctgacgatctccttgggtaatcattaaatgaattgcgataaaggagaagaatagtgtaccaaca

SEQ ID NO: 324032 - DNA, 75 bp, Artificial Sequence
  Synthetic
aaaggagaagaatagtgtaccaacaatgcatgacagaaacacggttttaggttttccaaaaattgggcggtcttt

SEQ ID NO: 324033 - DNA, 75 bp, Artificial Sequence
  Synthetic
attattttatgagaactgacttgggattcagagagactgctctttccaccttttgggctaaggactggcctaccc

SEQ ID NO: 324034 - DNA, 75 bp, Artificial Sequence
  Synthetic
tgcgaaaagataaagtctagacaagccggcctaacaatgcaatcatctctggtttttttgaaaccaaagtcttca

SEQ ID NO: 324035 - DNA, 75 bp, Artificial Sequence
  Synthetic
aggaagctttgccatcatagatgacccatattctccagagcctcgtaaaggctttttaggagaagtgcgatgtcc

SEQ ID NO: 324036 - DNA, 75 bp, Artificial Sequence
  Synthetic
tcccgtactgcgataagacaaagtctaaacaagctgcctcaacaatgcaatcatcattggttttcttgaaaccaa

SEQ ID NO: 324037 - DNA, 75 bp, Artificial Sequence
  Synthetic
taaacaagctgcctcaacaatgcaatcatcattggttttcttgaaaccaaaatcctcaaaggataaaaatcggac

SEQ ID NO: 324038 - DNA, 75 bp, Artificial Sequence
  Synthetic
tcatcattggttttcttgaaaccaaaatcctcaaaggataaaaatcggacatttcctaggttttatgttgctgct

SEQ ID NO: 324039 - DNA, 75 bp, Artificial Sequence
  Synthetic
gaagattttgcttactggagagcgagatcccaatttatgtggataagtacaaggttgtactcgactcaaggccaa

SEQ ID NO: 324040 - DNA, 75 bp, Artificial Sequence
  Synthetic
gatcccaatttatgtggataagtacaaggttgtactcgactcaaggccaaccctatctcattttctgtcaaagaa

SEQ ID NO: 324041 - DNA, 75 bp, Artificial Sequence
  Synthetic
gactcaataacaagccagagaactaagttatatgattcaaccattcaggagcttttttgtgagtctattaacagc

SEQ ID NO: 324042 - DNA, 75 bp, Artificial Sequence
  Synthetic
agttatatgattcaaccattcaggagcttttttgtgagtctattaacagcctgaagaggcacaaggttgactttc

SEQ ID NO: 324043 - DNA, 75 bp, Artificial Sequence
  Synthetic
aggtgttccttctcttgaattcattgagtattatcttgatgatcatattttcctctccgatgagcccaactcaat

SEQ ID NO: 324044 - DNA, 75 bp, Artificial Sequence
  Synthetic
gagtattatcttgatgatcatattttcctctccgatgagcccaactcaattatgaataggtacctaaaacttcta

SEQ ID NO: 324045 - DNA, 75 bp, Artificial Sequence
  Synthetic
cttcaattgaagaccagatagtagaaattcacaggaagactcttttagaaggcatgaagtatggactcacaaagg

SEQ ID NO: 324046 - DNA, 75 bp, Artificial Sequence
  Synthetic
aattcacaggaagactcttttagaaggcatgaagtatggactcacaaaggaagacttgcctgggaatgaccttat

SEQ ID NO: 324047 - DNA, 75 bp, Artificial Sequence
  Synthetic
gccagggtagcaagttccgtggccaaatctgctcatcgacgaattaatgatttgcggttccacatctacttctct

SEQ ID NO: 324048 - DNA, 75 bp, Artificial Sequence
  Synthetic
aatctgctcatcgacgaattaatgatttgcggttccacatctacttctctgtctgtccagtcgaactgcacctag

SEQ ID NO: 324049 - DNA, 75 bp, Artificial Sequence
  Synthetic
aaccagaggcttggctagaatgagttgtgacgactcgtttaagttctttttatacaacaatgagtctttcaggga

SEQ ID NO: 324050 - DNA, 75 bp, Artificial Sequence
  Synthetic
tgtgacgactcgtttaagttctttttatacaacaatgagtctttcagggaggatgctctctccacagtgtggaca

SEQ ID NO: 324051 - DNA, 75 bp, Artificial Sequence
  Synthetic
agtctgccaaaaataagtcctctagaggcttgcgattgtggctgcccaaccccccagtattccccccaatttaaa

SEQ ID NO: 324052 - DNA, 75 bp, Artificial Sequence
  Synthetic
aggcttgcgattgtggctgcccaaccccccagtattccccccaatttaaaacccacccaaattattagccaatta

SEQ ID NO: 324053 - DNA, 75 bp, Artificial Sequence
  Synthetic
tgtggcagctcacttgcccactttggagcgatacttctcagcacacttgactatagctggggtcagcacaaggtc

SEQ ID NO: 324054 - DNA, 75 bp, Artificial Sequence
  Synthetic
gagcgatacttctcagcacacttgactatagctggggtcagcacaaggtcttcattgagtattccaacagccatc

SEQ ID NO: 324055 - DNA, 75 bp, Artificial Sequence
  Synthetic
taaagaaccggccactcattgctgccatgtttggtttttcaaatgtggctgcaatttcattgggctgcttggttc

SEQ ID NO: 324056 - DNA, 75 bp, Artificial Sequence
  Synthetic
catgtttggtttttcaaatgtggctgcaatttcattgggctgcttggttctcagagatggattaatggtcttaga

SEQ ID NO: 324057 - DNA, 75 bp, Artificial Sequence
  Synthetic
gcatcagcaatggcctcaccagccctgtttggaagatccaagtcaatgatacctgcaaagctaggatgcatcatg

SEQ ID NO: 324058 - DNA, 75 bp, Artificial Sequence
  Synthetic
tgtttggaagatccaagtcaatgatacctgcaaagctaggatgcatcatggctcttgggtacaccacaccagcaa

SEQ ID NO: 324059 - DNA, 75 bp, Artificial Sequence
  Synthetic
agggagagagtcagagagcaccttcagggcctgaatagtccaaggaacaaatgcagctgagactctagacaatgt

SEQ ID NO: 324060 - DNA, 75 bp, Artificial Sequence
  Synthetic
agggcctgaatagtccaaggaacaaatgcagctgagactctagacaatgtaatggtgtctctaccaggattccct

SEQ ID NO: 324061 - DNA, 75 bp, Artificial Sequence
  Synthetic
gctgggcaacaattccagcacccttctctgacatcttcttcatcatggcctcaggcttgttgccccgtactaggt

SEQ ID NO: 324062 - DNA, 75 bp, Artificial Sequence
  Synthetic
ctctgacatcttcttcatcatggcctcaggcttgttgccccgtactaggttaaggactatcatcatcttgacatc

SEQ ID NO: 324063 - DNA, 75 bp, Artificial Sequence
  Synthetic
gtccctctctcttttactagctggactattctttttgggtcaaatccttgataagcaaactcattcacccaagcg

SEQ ID NO: 324064 - DNA, 75 bp, Artificial Sequence
  Synthetic
catcaagaaaagccaaggcaatctcacggtaattctcctctgacatgttgttttgtctagttaaataacgggttt

SEQ ID NO: 324065 - DNA, 75 bp, Artificial Sequence
  Synthetic
aatagacttctagacagccatgcaatccagagctgtcatcctgaagcacaagtctggttcaagccataagaggtc

SEQ ID NO: 324066 - DNA, 75 bp, Artificial Sequence
  Synthetic
ttgatctcccaggaaatgacatcctcggagacatatgtgtggttcaagcagcacgggtgactaaattggttgcaa

SEQ ID NO: 324067 - DNA, 75 bp, Artificial Sequence
  Synthetic
gtgacaaagtggctgcctagtcccccccactacccacccctgtgaacccacccctcagattccctaggttcccct

SEQ ID NO: 324068 - DNA, 75 bp, Artificial Sequence
  Synthetic
cagcaaagctggggtgcatcatggctcttgggtaggtcacgccggcaatggcatccatagtggtcccagaaactg

SEQ ID NO: 324069 - DNA, 75 bp, Artificial Sequence
  Synthetic
cctcccgtattgcgataaatcatagtctagacaagctgatctaacaatgcaatcatccctggttttcttaaaacc

SEQ ID NO: 324070 - DNA, 75 bp, Artificial Sequence
  Synthetic
tctagacaagctgatctaacaatgcaatcatccctggttttcttaaaaccaaagtcttcaaaagacaggaatcga

SEQ ID NO: 324071 - DNA, 75 bp, Artificial Sequence
  Synthetic
aatcatccctggttttcttaaaaccaaagtcttcaaaagacaggaatcgaaagtttcccagattctatgtcaatg

SEQ ID NO: 324072 - DNA, 75 bp, Artificial Sequence
  Synthetic
aaaaaggttctgcctgttggagagtgaaatcccaatttatgtggataaatacaaggtcgttctagactcaagacc

SEQ ID NO: 324073 - DNA, 75 bp, Artificial Sequence
  Synthetic
gaaatcccaatttatgtggataaatacaaggtcgttctagactcaagacccactctgtcacattttttatcaaag

SEQ ID NO: 324074 - DNA, 75 bp, Artificial Sequence
  Synthetic
atgactcaataaccggccaaagaaccaagttgtatgacccaactattcaggagctctttggggagtctataaaca

SEQ ID NO: 324075 - DNA, 75 bp, Artificial Sequence
  Synthetic
caagttgtatgacccaactattcaggagctctttggggagtctataaacagcttaaaaagacataaggttgattt

SEQ ID NO: 324076 - DNA, 75 bp, Artificial Sequence
  Synthetic
acaggagtgccttctttggagttcattgaatattatcttgatgatcacatcttcttatctgatgaacctgatctt

SEQ ID NO: 324077 - DNA, 75 bp, Artificial Sequence
  Synthetic
ttgaatattatcttgatgatcacatcttcttatctgatgaacctgatcttgttatgagcaagtatctcaagcttt

SEQ ID NO: 324078 - DNA, 75 bp, Artificial Sequence
  Synthetic
cacatcaattgaagatcagatagtagaagtgcatagaaagactctcatggaaggcatgaagtatggactcacaaa

SEQ ID NO: 324079 - DNA, 75 bp, Artificial Sequence
  Synthetic
gaagtgcatagaaagactctcatggaaggcatgaagtatggactcacaaaagaggacctgcctgggaatgacctt

SEQ ID NO: 324080 - DNA, 75 bp, Artificial Sequence
  Synthetic
ctgctagagtggcaagttctgtggcaaagtctgttaatcgtgggatcaatgatttgaggttccaaatttattttt

SEQ ID NO: 324081 - DNA, 75 bp, Artificial Sequence
  Synthetic
aaagtctgttaatcgtgggatcaatgatttgaggttccaaatttatttttctgttagtccagtcgagcttcactt

SEQ ID NO: 324082 - DNA, 75 bp, Artificial Sequence
  Synthetic
aagactagaggcttggccagaatgagtagtgatgagtcatatagattctttcttaacaacagtgagtcttttagg

SEQ ID NO: 324083 - DNA, 75 bp, Artificial Sequence
  Synthetic
gtagtgatgagtcatatagattctttcttaacaacagtgagtcttttaggaaaaatgctctttccacaacgtgga

SEQ ID NO: 324084 - DNA, 75 bp, Artificial Sequence
  Synthetic
acagctctataaaggaaagtccagcagcaaattgcggttgtggctgcccagccccccaacattccccccaatcta

SEQ ID NO: 324085 - DNA, 75 bp, Artificial Sequence
  Synthetic
agcaaattgcggttgtggctgcccagccccccaacattccccccaatctaaaacccacccaaatcatcatctaat

SEQ ID NO: 324086 - DNA, 75 bp, Artificial Sequence
  Synthetic
aatcccacccaaatcaacaatcaacaacccaccctcaacccgataacccaccctcaccctaatccccacactggc

SEQ ID NO: 324087 - DNA, 75 bp, Artificial Sequence
  Synthetic
aacccaccctcaacccgataacccaccctcaccctaatccccacactggcagtctatttgcctaccttggagcga

SEQ ID NO: 324088 - DNA, 75 bp, Artificial Sequence
  Synthetic
ctggtgtcaacacaaggtcctcgttgagcactccaacagccatcagaagtttctttttgtcttccctggtgaaaa

SEQ ID NO: 324089 - DNA, 75 bp, Artificial Sequence
  Synthetic
gagcactccaacagccatcagaagtttctttttgtcttccctggtgaaaaaccggccactcattgctgccatatt

SEQ ID NO: 324090 - DNA, 75 bp, Artificial Sequence
  Synthetic
tcattaggctgtttagttctaagggatgggttgatggtcttggagaactctagcatgaagagaccatgtgcgtca

SEQ ID NO: 324091 - DNA, 75 bp, Artificial Sequence
  Synthetic
atgggttgatggtcttggagaactctagcatgaagagaccatgtgcgtcagcaatggtttcaccagctctattag

SEQ ID NO: 324092 - DNA, 75 bp, Artificial Sequence
  Synthetic
gaagctggggtgcatcatagcccttggatatgtcacacctgcgatggcatccatagtggtcccagttacagggag

SEQ ID NO: 324093 - DNA, 75 bp, Artificial Sequence
  Synthetic
ggatatgtcacacctgcgatggcatccatagtggtcccagttacagggagagaatcagaaagcacccttagagcc

SEQ ID NO: 324094 - DNA, 75 bp, Artificial Sequence
  Synthetic
ctgagaccctggataacgtgatggtgtccctgccaggatttccctctttcagctggtaaacagaaatcagttgag

SEQ ID NO: 324095 - DNA, 75 bp, Artificial Sequence
  Synthetic
gtccctgccaggatttccctctttcagctggtaaacagaaatcagttgagcaacaatcccagctcccttctctga

SEQ ID NO: 324096 - DNA, 75 bp, Artificial Sequence
  Synthetic
ttgtttcctcttacaagattgaggacaatcatcatcttaacatcctttttccagtcccttcctttagcagttcct

SEQ ID NO: 324097 - DNA, 75 bp, Artificial Sequence
  Synthetic
caatcatcatcttaacatcctttttccagtcccttcctttagcagttcctctctcttttaccagttgaacgattc

SEQ ID NO: 324098 - DNA, 75 bp, Artificial Sequence
  Synthetic
aaattcattaacccaggcagtgatagtgcccgagtctgctgcttcattaaggaaggccaaggcaatctcacgata

SEQ ID NO: 324099 - DNA, 75 bp, Artificial Sequence
  Synthetic
ggaaggccaaggcaatctcacgataattctcctcagacatgttgttatgtttggttaaataacgggattctttgt

SEQ ID NO: 324100 - DNA, 75 bp, Artificial Sequence
  Synthetic
acacaaagaggcccaaatatggaaagaatccttaagaaacaacctgctcctgaaggagccttaaccattcatcca

SEQ ID NO: 324101 - DNA, 75 bp, Artificial Sequence
  Synthetic
gaatccttaagaaacaacctgctcctgaaggagccttaaccattcatccactaaggtgttatgattccacaatct

SEQ ID NO: 324102 - DNA, 75 bp, Artificial Sequence
  Synthetic
tgaaggagccttaaccattcatccactaaggtgttatgattccacaatctatgacaccccaatacctgcttatgt

SEQ ID NO: 324103 - DNA, 75 bp, Artificial Sequence
  Synthetic
acaatagatatagcaacatcagaactagcagactatcaatcaggatcaacgatacaaccttttgagtctgtccca

SEQ ID NO: 324104 - DNA, 75 bp, Artificial Sequence
  Synthetic
tagcagactatcaatcaggatcaacgatacaaccttttgagtctgtcccagcgcaaaatctcactttgttcaaac

SEQ ID NO: 324105 - DNA, 75 bp, Artificial Sequence
  Synthetic
tgaaacaacagataggaaatttgtagaagtctttggggtattagagaatagagcagatgactcagattatcaatc

SEQ ID NO: 324106 - DNA, 75 bp, Artificial Sequence
  Synthetic
gaagtctttggggtattagagaatagagcagatgactcagattatcaatcaccagatgttatcattgagactgag

SEQ ID NO: 324107 - DNA, 75 bp, Artificial Sequence
  Synthetic
tcacaaccactatgggagacttaggatctgctgaggttgcagctaggaacaaaatagcaaagtatgagattgcat

SEQ ID NO: 324108 - DNA, 75 bp, Artificial Sequence
  Synthetic
atctgctgaggttgcagctaggaacaaaatagcaaagtatgagattgcatgtctaaatcgttcagcaataaaacc

SEQ ID NO: 324109 - DNA, 75 bp, Artificial Sequence
  Synthetic
cactttaatggtgtagtgtccaacctagagttaaatgatgaggaagttaatgagatagtctttagattcagactg

SEQ ID NO: 324110 - DNA, 75 bp, Artificial Sequence
  Synthetic
tagagttaaatgatgaggaagttaatgagatagtctttagattcagactggccaaggacatctttgaagagctta

SEQ ID NO: 324111 - DNA, 75 bp, Artificial Sequence
  Synthetic
ctcagatgagactgttagcaggcttgagagagaggtgaatagcataatgtcatcaataagacttaactgggactt

SEQ ID NO: 324112 - DNA, 75 bp, Artificial Sequence
  Synthetic
gagagagaggtgaatagcataatgtcatcaataagacttaactgggacttaactagccaaaagttccctagtttt

SEQ ID NO: 324113 - DNA, 75 bp, Artificial Sequence
  Synthetic
gtaacactgatgcagatcaggaatatttagcccgcatcattaaaaaatgcactgatgatgcaattaagggtattg

SEQ ID NO: 324114 - DNA, 75 bp, Artificial Sequence
  Synthetic
tttagcccgcatcattaaaaaatgcactgatgatgcaattaagggtattgagagggacagcatgttcaatgaaga

SEQ ID NO: 324115 - DNA, 75 bp, Artificial Sequence
  Synthetic
aggaatgcaataagagtaagctcaaacattagaaataaaattgtagaaatgttatcttatgacttcctcagagat

SEQ ID NO: 324116 - DNA, 75 bp, Artificial Sequence
  Synthetic
acattagaaataaaattgtagaaatgttatcttatgacttcctcagagatgttgatgaccacaaatcaacagtcc

SEQ ID NO: 324117 - DNA, 75 bp, Artificial Sequence
  Synthetic
aggtccagaaggcaaagaccttgagcctctaaagtcagtatcagtagagggctcacacccaatgtgtaaaatctg

SEQ ID NO: 324118 - DNA, 75 bp, Artificial Sequence
  Synthetic
cctctaaagtcagtatcagtagagggctcacacccaatgtgtaaaatctggaacaaagtgtgcactaatgcctct

SEQ ID NO: 324119 - DNA, 75 bp, Artificial Sequence
  Synthetic
atgaccctcagtctgaattggagtatgccatgtctggctctaccgagagggctgttgaaagaaataagtatcatc

SEQ ID NO: 324120 - DNA, 75 bp, Artificial Sequence
  Synthetic
tgccatgtctggctctaccgagagggctgttgaaagaaataagtatcatcgcactgtccttactttatctagcga

SEQ ID NO: 324121 - DNA, 75 bp, Artificial Sequence
  Synthetic
ggagtgtgtgggaagaaaaacagcaatctaggagctgtgaaagaagccagagtaagaagcaagaaaggtttttca

SEQ ID NO: 324122 - DNA, 75 bp, Artificial Sequence
  Synthetic
atctaggagctgtgaaagaagccagagtaagaagcaagaaaggtttttcaatagagcatgacgtgagtaaagttg

SEQ ID NO: 324123 - DNA, 75 bp, Artificial Sequence
  Synthetic
ttctgatttgagaccaatggaagggctctatagtcctctatctgatgacttgaagttgagagaactagcaatggg

SEQ ID NO: 324124 - DNA, 75 bp, Artificial Sequence
  Synthetic
ctctatagtcctctatctgatgacttgaagttgagagaactagcaatggggcttcatcagcccacactaattcat

SEQ ID NO: 324125 - DNA, 75 bp, Artificial Sequence
  Synthetic
ttaagtgtcacagggatttcttgacaacaccattaggaagctggatgcaaatggtttcagtaattggtgcagaat

SEQ ID NO: 324126 - DNA, 75 bp, Artificial Sequence
  Synthetic
aacaccattaggaagctggatgcaaatggtttcagtaattggtgcagaattgtcagcttcagttaaacaacacgt

SEQ ID NO: 324127 - DNA, 75 bp, Artificial Sequence
  Synthetic
cgactactagggtccttaatatatttactaattaaaccaaccacatcaaaaggacatatatttgtctcctttgca

SEQ ID NO: 324128 - DNA, 75 bp, Artificial Sequence
  Synthetic
tactaattaaaccaaccacatcaaaaggacatatatttgtctcctttgcagttgacaaaagatgtttacttaagg

SEQ ID NO: 324129 - DNA, 75 bp, Artificial Sequence
  Synthetic
gccctcaattccagcaggagatctcatggtgacagactttgtttcctttaaactgagcaagatcaccaacctatg

SEQ ID NO: 324130 - DNA, 75 bp, Artificial Sequence
  Synthetic
atggtgacagactttgtttcctttaaactgagcaagatcaccaacctatgcaagtctctatgtatgggagaagca

SEQ ID NO: 324131 - DNA, 75 bp, Artificial Sequence
  Synthetic
acggctatgagccctggaagatgctggatcatgtggatgaaccaaaattcaaggatacttggtttatgatcaaac

SEQ ID NO: 324132 - DNA, 75 bp, Artificial Sequence
  Synthetic
ggatcatgtggatgaaccaaaattcaaggatacttggtttatgatcaaactatccttactcacattaatggagga

SEQ ID NO: 324133 - DNA, 75 bp, Artificial Sequence
  Synthetic
actattcaaaggtatgttgtaatggaaggctttgtttctctaccagagatccccaatccttctaaaatgctctca

SEQ ID NO: 324134 - DNA, 75 bp, Artificial Sequence
  Synthetic
aaggctttgtttctctaccagagatccccaatccttctaaaatgctctcaaaaatcccaaaagttcttaggtcag

SEQ ID NO: 324135 - DNA, 75 bp, Artificial Sequence
  Synthetic
agttttggatacaatgcaggtgatatcaaaaaacccttttcagctacataggataggggccaatgtgaaatggaa

SEQ ID NO: 324136 - DNA, 75 bp, Artificial Sequence
  Synthetic
tcaaaaaacccttttcagctacataggataggggccaatgtgaaatggaagtctttatttaatcccttttcaggg

SEQ ID NO: 324137 - DNA, 75 bp, Artificial Sequence
  Synthetic
ttattagctgttgttataatggttacttcaaaaacaaagaggaggagactgagccatcagctttatcagcaatgt

SEQ ID NO: 324138 - DNA, 75 bp, Artificial Sequence
  Synthetic
cttcaaaaacaaagaggaggagactgagccatcagctttatcagcaatgtataaaaagatcatagagcttgagca

SEQ ID NO: 324139 - DNA, 75 bp, Artificial Sequence
  Synthetic
ttaggctatgaagacccagaagagcctaaaatgcatgaatttagtaggagttatttgaagctgttatgtgatcat

SEQ ID NO: 324140 - DNA, 75 bp, Artificial Sequence
  Synthetic
ctaaaatgcatgaatttagtaggagttatttgaagctgttatgtgatcatgctaaaggaagattaaaaaaacagt

SEQ ID NO: 324141 - DNA, 75 bp, Artificial Sequence
  Synthetic
tgaaaacagtatcataagagaagtttcttcaatcacacttgaaagacttgctactctgaaggcaactagcaattt

SEQ ID NO: 324142 - DNA, 75 bp, Artificial Sequence
  Synthetic
tcttcaatcacacttgaaagacttgctactctgaaggcaactagcaatttcaatagtagctggtacgtctacaaa

SEQ ID NO: 324143 - DNA, 75 bp, Artificial Sequence
  Synthetic
gggacaagctgctggttaagatgactcagtttgcgaaaagagggaaaaccctagcaatagaaatgtttgaggagt

SEQ ID NO: 324144 - DNA, 75 bp, Artificial Sequence
  Synthetic
tcagtttgcgaaaagagggaaaaccctagcaatagaaatgtttgaggagtgcatgagcagaatagaagaaaaggg

SEQ ID NO: 324145 - DNA, 75 bp, Artificial Sequence
  Synthetic
aagcaacaacatggaggattgagagaaatttatgtgatgggggcagacgagagagtagttcagtctataattgaa

SEQ ID NO: 324146 - DNA, 75 bp, Artificial Sequence
  Synthetic
aaatttatgtgatgggggcagacgagagagtagttcagtctataattgaagcaatagcgagggccattgggagat

SEQ ID NO: 324147 - DNA, 75 bp, Artificial Sequence
  Synthetic
tccagcaaacaagacaaaaatccctgagactcatggtcaaagagctaaaagaaggtgtggaagatcagtatggac

SEQ ID NO: 324148 - DNA, 75 bp, Artificial Sequence
  Synthetic
gagactcatggtcaaagagctaaaagaaggtgtggaagatcagtatggacctgtgccacctcagatgatgccaga

SEQ ID NO: 324149 - DNA, 75 bp, Artificial Sequence
  Synthetic
ccaagtttgctcttatgctgtgtgaatttactcctgaggagtggtggcctttaattgtaagaggctgctcaatgt

SEQ ID NO: 324150 - DNA, 75 bp, Artificial Sequence
  Synthetic
atttactcctgaggagtggtggcctttaattgtaagaggctgctcaatgtttaccaataaatacatgatgatgaa

SEQ ID NO: 324151 - DNA, 75 bp, Artificial Sequence
  Synthetic
agccacaaagagttaaacatagaagatgactttgtgacaaaattgttttcagcctatcatggagaaacagtggaa

SEQ ID NO: 324152 - DNA, 75 bp, Artificial Sequence
  Synthetic
atgactttgtgacaaaattgttttcagcctatcatggagaaacagtggaaccttggatcgatcaggggaagacat

SEQ ID NO: 324153 - DNA, 75 bp, Artificial Sequence
  Synthetic
gcaagggatccttcatttcacttcatctttattgcactctctgcaccaagaattcataaagacaacctctatgca

SEQ ID NO: 324154 - DNA, 75 bp, Artificial Sequence
  Synthetic
tctttattgcactctctgcaccaagaattcataaagacaacctctatgcaactattcgtgagtaagatgggttca

SEQ ID NO: 324155 - DNA, 75 bp, Artificial Sequence
  Synthetic
atgtgatgcaaggatctgatgatagcagcatgattatcagctttcctgctgacaatgaaaggacaaaaatgagat

SEQ ID NO: 324156 - DNA, 75 bp, Artificial Sequence
  Synthetic
cagcatgattatcagctttcctgctgacaatgaaaggacaaaaatgagatacaaactaatagctgctatgtgctt

SEQ ID NO: 324157 - DNA, 75 bp, Artificial Sequence
  Synthetic
tacattggaatttacccctctgagaaatctacacctaatactgactttgttatggaatataattctgaattcttt

SEQ ID NO: 324158 - DNA, 75 bp, Artificial Sequence
  Synthetic
aatctacacctaatactgactttgttatggaatataattctgaattcttttttcactctcagcatgtcaggccta

SEQ ID NO: 324159 - DNA, 75 bp, Artificial Sequence
  Synthetic
ttctcttccagaggttgaaacattggtggctaggcaagaagaagcagcaaatcttctgactgcagttactgaagg

SEQ ID NO: 324160 - DNA, 75 bp, Artificial Sequence
  Synthetic
gtggctaggcaagaagaagcagcaaatcttctgactgcagttactgaaggtggaggatcattttctctagcagcc

SEQ ID NO: 324161 - DNA, 75 bp, Artificial Sequence
  Synthetic
tccactatatgctgatgggtctgggtgtaagcaccatatttaagcagtttgcaaaggcaatctccaaatggatgg

SEQ ID NO: 324162 - DNA, 75 bp, Artificial Sequence
  Synthetic
tgtaagcaccatatttaagcagtttgcaaaggcaatctccaaatggatggatcctggattaggcttcttcctctt

SEQ ID NO: 324163 - DNA, 75 bp, Artificial Sequence
  Synthetic
tctggctttaaatacaacttgtacagagctataatgaattcagacctaaagtacgtgtactctttctttatgaga

SEQ ID NO: 324164 - DNA, 75 bp, Artificial Sequence
  Synthetic
gagctataatgaattcagacctaaagtacgtgtactctttctttatgagaagggttaaagggtcaactagcaaag

SEQ ID NO: 324165 - DNA, 75 bp, Artificial Sequence
  Synthetic
cagtgtgagtccaggtggtgctatagtaatgagctctacattaagatgggggtcagtggaaaaatttaagaggct

SEQ ID NO: 324166 - DNA, 75 bp, Artificial Sequence
  Synthetic
gtaatgagctctacattaagatgggggtcagtggaaaaatttaagaggcttaggaataggttggatatccctgag

SEQ ID NO: 324167 - DNA, 75 bp, Artificial Sequence
  Synthetic
gccctgagattctgtatagagcccctcagactggtactgaaatcatgcttaggattgctgagaaagtccatagcc

SEQ ID NO: 324168 - DNA, 75 bp, Artificial Sequence
  Synthetic
tcagactggtactgaaatcatgcttaggattgctgagaaagtccatagccctggagttgtctcttctcttagtac

SEQ ID NO: 324169 - DNA, 75 bp, Artificial Sequence
  Synthetic
gcttcatctgtctactttctctcagcttgcatctttgaggatgctggaaatcaggaatatagagttgtgaataac

SEQ ID NO: 324170 - DNA, 75 bp, Artificial Sequence
  Synthetic
cttgcatctttgaggatgctggaaatcaggaatatagagttgtgaataacgacaagtacagtcttcttcaaaaga

SEQ ID NO: 324171 - DNA, 75 bp, Artificial Sequence
  Synthetic
tggagaaaatataagccaagaggatctactgtttttgttccccaacttggttgaatttgaagcatttgattccat

SEQ ID NO: 324172 - DNA, 75 bp, Artificial Sequence
  Synthetic
ctactgtttttgttccccaacttggttgaatttgaagcatttgattccataatttatgataaggggaggtttaac

SEQ ID NO: 324173 - DNA, 75 bp, Artificial Sequence
  Synthetic
aagctacacaaaccaggatagtagtatttgagcatcactcttctgccagagtagctccagaaaagttggtcagtg

SEQ ID NO: 324174 - DNA, 75 bp, Artificial Sequence
  Synthetic
atttgagcatcactcttctgccagagtagctccagaaaagttggtcagtgataaatggtttggcactagaaagag

SEQ ID NO: 324175 - DNA, 75 bp, Artificial Sequence
  Synthetic
caggaatgggcaaggctgaaggctgttgtcagatggttgagagacactccagaggaaactctggacgcctctcca

SEQ ID NO: 324176 - DNA, 75 bp, Artificial Sequence
  Synthetic
ttgtcagatggttgagagacactccagaggaaactctggacgcctctccattctcaaatcatgttcaaattagga

SEQ ID NO: 324177 - DNA, 75 bp, Artificial Sequence
  Synthetic
acctagagtcataaaagtcactggggcaccagtaaagaaacgatctggaatgagtaaaattgcaatggcaataag

SEQ ID NO: 324178 - DNA, 75 bp, Artificial Sequence
  Synthetic
gcaccagtaaagaaacgatctggaatgagtaaaattgcaatggcaataagggataatttttgcaaaacaggattt

SEQ ID NO: 324179 - DNA, 75 bp, Artificial Sequence
  Synthetic
gtcatagtagagcaatgcaggtggaaaagctaaagcattatctcttctccatcttattgggcccatacactgagg

SEQ ID NO: 324180 - DNA, 75 bp, Artificial Sequence
  Synthetic
aaagctaaagcattatctcttctccatcttattgggcccatacactgaggatgccaaattagagtatgttgtgaa

SEQ ID NO: 324181 - DNA, 75 bp, Artificial Sequence
  Synthetic
atactaaattataatgataagaggtcaagagctaacataattagcctccttcaaaggttcatcaaaagtgaggtg

SEQ ID NO: 324182 - DNA, 75 bp, Artificial Sequence
  Synthetic
caagagctaacataattagcctccttcaaaggttcatcaaaagtgaggtggggattgcaaaccttattgaagaga

SEQ ID NO: 324183 - DNA, 75 bp, Artificial Sequence
  Synthetic
tgttaagactcagcactatagtcacaattcaatcaacaataagtactatggtagagggatctggaaaggagtaat

SEQ ID NO: 324184 - DNA, 75 bp, Artificial Sequence
  Synthetic
aattcaatcaacaataagtactatggtagagggatctggaaaggagtaatggatggatatcagatccagattgac

SEQ ID NO: 324185 - DNA, 75 bp, Artificial Sequence
  Synthetic
cacatttagtgggaattaccatttcaaactgttcaaagccctggattctcactcaaagcataaaagcctggtgtg

SEQ ID NO: 324186 - DNA, 75 bp, Artificial Sequence
  Synthetic
aaactgttcaaagccctggattctcactcaaagcataaaagcctggtgtgatgacatgcttgtaaacaatagcat

SEQ ID NO: 324187 - DNA, 75 bp, Artificial Sequence
  Synthetic
gctaattattggatgtttggttttaaaatgtatggagcatcatatccctacggatgccctataactttagtaaga

SEQ ID NO: 324188 - DNA, 75 bp, Artificial Sequence
  Synthetic
aaatgtatggagcatcatatccctacggatgccctataactttagtaagacatgacataacaaatcttggactac

SEQ ID NO: 324189 - DNA, 75 bp, Artificial Sequence
  Synthetic
ggtcagaagaaccacagtcaacttatttgtaagaagtacagataagagacctagagatttgcacatcctgtcata

SEQ ID NO: 324190 - DNA, 75 bp, Artificial Sequence
  Synthetic
tttgtaagaagtacagataagagacctagagatttgcacatcctgtcatacactccttcggactctgacataagc

SEQ ID NO: 324191 - DNA, 75 bp, Artificial Sequence
  Synthetic
gagacagttatttctctaacaaaggatcattcactgtggagcctacgagatcttggatgctctgccaacctcttc

SEQ ID NO: 324192 - DNA, 75 bp, Artificial Sequence
  Synthetic
atcattcactgtggagcctacgagatcttggatgctctgccaacctcttccatgggagtttattaagcctgtgct

SEQ ID NO: 324193 - DNA, 75 bp, Artificial Sequence
  Synthetic
aaccccagacagttggatatagacaggcttaaagagatagttaagttatgtactgaatctgcaatcaggaacaag

SEQ ID NO: 324194 - DNA, 75 bp, Artificial Sequence
  Synthetic
ggcttaaagagatagttaagttatgtactgaatctgcaatcaggaacaaggtgggcactgtatatagccagaata

SEQ ID NO: 324195 - DNA, 75 bp, Artificial Sequence
  Synthetic
accaattgacatgagtgagatgtttgatatgatgttagaagaagggatagatgatgtgtttgaggatattgcaga

SEQ ID NO: 324196 - DNA, 75 bp, Artificial Sequence
  Synthetic
gatatgatgttagaagaagggatagatgatgtgtttgaggatattgcagactgtctcacagtggaggaggatcct

SEQ ID NO: 324197 - DNA, 75 bp, Artificial Sequence
  Synthetic
atgatgaaagtctaaatctctttgggcctgctcattataaggagattcagagtatgacagttcttgcccaccctc

SEQ ID NO: 324198 - DNA, 75 bp, Artificial Sequence
  Synthetic
gcctgctcattataaggagattcagagtatgacagttcttgcccaccctctcatggacgaatttgtaactaaatt

SEQ ID NO: 324199 - DNA, 75 bp, Artificial Sequence
  Synthetic
attagaaggctactagaaaagtcaataataaccacagatcacagagcactagctgaactcttgttcttagctctg

SEQ ID NO: 324200 - DNA, 75 bp, Artificial Sequence
  Synthetic
taataaccacagatcacagagcactagctgaactcttgttcttagctctgggcaaggacccatctcagattagag

SEQ ID NO: 324201 - DNA, 75 bp, Artificial Sequence
  Synthetic
cacagacatccctgatgaccttcttggctagcttacttctgagtgatgtcagagtggaaggttgatgagaaaata

SEQ ID NO: 324202 - DNA, 75 bp, Artificial Sequence
  Synthetic
gtatgtggaaaaagcacatttttagattatccaaaaattgggcggtctttgtgtgtactctgcgttgataaccac

SEQ ID NO: 324203 - DNA, 75 bp, Artificial Sequence
  Synthetic
gtatgtggaaaaagcacatttttagattatccaaaaattgggcggtctttgtgtgtactctgcgttgatatccac

SEQ ID NO: 324204 - DNA, 75 bp, Artificial Sequence
  Synthetic
gtatgtggaaaaagcacatttttagattatccaaaaattgggcggtctttgtgtgtactctgcgttgatacccac

SEQ ID NO: 324205 - DNA, 75 bp, Artificial Sequence
  Synthetic
gtatgtggaaaaagcacatttttagattatccaaaaattgggcggtctttgtgtgtactctgcgttgatagccac

SEQ ID NO: 324206 - DNA, 75 bp, Artificial Sequence
  Synthetic
acacaaagaatcccgttatttaaccaaacataacaacatgtctgaggagaattatcgtgagattgccttggcctt

SEQ ID NO: 324207 - DNA, 75 bp, Artificial Sequence
  Synthetic
aaacataacaacatgtctgaggagaattatcgtgagattgccttggccttccttaatgaagcagcagactcgggc

SEQ ID NO: 324208 - DNA, 75 bp, Artificial Sequence
  Synthetic
attatcgtgagattgccttggccttccttaatgaagcagcagactcgggcactatcactgcctgggttaatgaat

SEQ ID NO: 324209 - DNA, 75 bp, Artificial Sequence
  Synthetic
aagaatcgttcaactggtaaaagagagaggaactgctaaaggaagggactggaaaaaggatgttaagatgatgat

SEQ ID NO: 324210 - DNA, 75 bp, Artificial Sequence
  Synthetic
agaggaactgctaaaggaagggactggaaaaaggatgttaagatgatgattgtcctcaatcttgtaagaggaaac

SEQ ID NO: 324211 - DNA, 75 bp, Artificial Sequence
  Synthetic
tgtcagagaagggagctgggattgttgctcaactgatttctgtttaccagctgaaagagggaaatcctggcaggg

SEQ ID NO: 324212 - DNA, 75 bp, Artificial Sequence
  Synthetic
tgctcaactgatttctgtttaccagctgaaagagggaaatcctggcagggacaccatcacgttatccagggtctc

SEQ ID NO: 324213 - DNA, 75 bp, Artificial Sequence
  Synthetic
caggctctaagggtgctttctgattctctccctgtaactgggaccactatggatgccatcgcaggtgtgacatat

SEQ ID NO: 324214 - DNA, 75 bp, Artificial Sequence
  Synthetic
ctctccctgtaactgggaccactatggatgccatcgcaggtgtgacatatccaagggctatgatgcaccctagct

SEQ ID NO: 324215 - DNA, 75 bp, Artificial Sequence
  Synthetic
gcctaatagagctggtgaaaccattgctgacgcacatggtctcttcatgctagagttctccaagaccatcaaccc

SEQ ID NO: 324216 - DNA, 75 bp, Artificial Sequence
  Synthetic
gctgacgcacatggtctcttcatgctagagttctccaagaccatcaacccatcccttagaactaaacagcctaat

SEQ ID NO: 324217 - DNA, 75 bp, Artificial Sequence
  Synthetic
caaatatggcagcaatgagtggccggtttttcaccagggaagacaaaaagaaacttctgatggctgttggagtgc

SEQ ID NO: 324218 - DNA, 75 bp, Artificial Sequence
  Synthetic
gtttttcaccagggaagacaaaaagaaacttctgatggctgttggagtgctcaacgaggaccttgtgttgacacc

SEQ ID NO: 324219 - DNA, 75 bp, Artificial Sequence
  Synthetic
tatcgctccaaggtaggcaaatagactgccagtgtggggattagggtgagggtgggttatcgggttgagggtggg

SEQ ID NO: 324220 - DNA, 75 bp, Artificial Sequence
  Synthetic
ctgccagtgtggggattagggtgagggtgggttatcgggttgagggtgggttgttgattgttgatttgggtggga

SEQ ID NO: 324221 - DNA, 75 bp, Artificial Sequence
  Synthetic
tgattagatgatgatttgggtgggttttagattggggggaatgttggggggctgggcagccacaaccgcaatttg

SEQ ID NO: 324222 - DNA, 75 bp, Artificial Sequence
  Synthetic
tttagattggggggaatgttggggggctgggcagccacaaccgcaatttgctgctggactttcctttatagagct

SEQ ID NO: 324223 - DNA, 75 bp, Artificial Sequence
  Synthetic
ggtccacgttgtggaaagagcatttttcctaaaagactcactgttgttaagaaagaatctatatgactcatcact

SEQ ID NO: 324224 - DNA, 75 bp, Artificial Sequence
  Synthetic
ttcctaaaagactcactgttgttaagaaagaatctatatgactcatcactactcattctggccaagcctctagtc

SEQ ID NO: 324225 - DNA, 75 bp, Artificial Sequence
  Synthetic
ctaagtgaagctcgactggactaacagaaaaataaatttggaacctcaaatcattgatcccacgattaacagact

SEQ ID NO: 324226 - DNA, 75 bp, Artificial Sequence
  Synthetic
agaaaaataaatttggaacctcaaatcattgatcccacgattaacagactttgccacagaacttgccactctagc

SEQ ID NO: 324227 - DNA, 75 bp, Artificial Sequence
  Synthetic
ataaggtcattcccaggcaggtcctcttttgtgagtccatacttcatgccttccatgagagtctttctatgcact

SEQ ID NO: 324228 - DNA, 75 bp, Artificial Sequence
  Synthetic
cttttgtgagtccatacttcatgccttccatgagagtctttctatgcacttctactatctgatcttcaattgatg

SEQ ID NO: 324229 - DNA, 75 bp, Artificial Sequence
  Synthetic
taaaagcttgagatacttgctcataacaagatcaggttcatcagataagaagatgtgatcatcaagataatattc

SEQ ID NO: 324230 - DNA, 75 bp, Artificial Sequence
  Synthetic
acaagatcaggttcatcagataagaagatgtgatcatcaagataatattcaatgaactccaaagaaggcactcct

SEQ ID NO: 324231 - DNA, 75 bp, Artificial Sequence
  Synthetic
gaaaatcaaccttatgtctttttaagctgtttatagactccccaaagagctcctgaatagttgggtcatacaact

SEQ ID NO: 324232 - DNA, 75 bp, Artificial Sequence
  Synthetic
gctgtttatagactccccaaagagctcctgaatagttgggtcatacaacttggttctttggccggttattgagtc

SEQ ID NO: 324233 - DNA, 75 bp, Artificial Sequence
  Synthetic
ttctttgataaaaaatgtgacagagtgggtcttgagtctagaacgaccttgtatttatccacataaattgggatt

SEQ ID NO: 324234 - DNA, 75 bp, Artificial Sequence
  Synthetic
tgggtcttgagtctagaacgaccttgtatttatccacataaattgggatttcactctccaacaggcagaaccttt

SEQ ID NO: 324235 - DNA, 75 bp, Artificial Sequence
  Synthetic
cacattgacatagaatctgggaaactttcgattcctgtcttttgaagactttggttttaagaaaaccagggatga

SEQ ID NO: 324236 - DNA, 75 bp, Artificial Sequence
  Synthetic
ttggttttaagaaaaccagggatgattgcattgttagatcagcttgtctagactatgatttatcgcaatacggga

SEQ ID NO: 324237 - DNA, 75 bp, Artificial Sequence
  Synthetic
acacaaagaaggtgcctatgttgaacgtaaaatctgtaattttaataacctgtctagtgcagcaggcccatctga

SEQ ID NO: 324238 - DNA, 75 bp, Artificial Sequence
  Synthetic
cgtaaaatctgtaattttaataacctgtctagtgcagcaggcccatctgaaatacacaattatttcagaggtggc

SEQ ID NO: 324239 - DNA, 75 bp, Artificial Sequence
  Synthetic
tgtctagtgcagcaggcccatctgaaatacacaattatttcagaggtggctaagggtgctagagaggtgagctgc

SEQ ID NO: 324240 - DNA, 75 bp, Artificial Sequence
  Synthetic
agttactagaagcctgggagaacaagagtgctctaatagggctcaagaggggcaactgcaaacttggtgctatgg

SEQ ID NO: 324241 - DNA, 75 bp, Artificial Sequence
  Synthetic
gagtgctctaatagggctcaagaggggcaactgcaaacttggtgctatggagcagataaactgcaaccttgatct

SEQ ID NO: 324242 - DNA, 75 bp, Artificial Sequence
  Synthetic
tatgacaacccacatggccttggggctatgatgtataatacagacagtgataagaggattgaggtgttgaatgac

SEQ ID NO: 324243 - DNA, 75 bp, Artificial Sequence
  Synthetic
ctatgatgtataatacagacagtgataagaggattgaggtgttgaatgaccagattcctgattctatgatccctg

SEQ ID NO: 324244 - DNA, 75 bp, Artificial Sequence
  Synthetic
gagaaaaccattttgggctgacctcataccaccaaaaaaagaaaaagaattggatcctaaaccatctttaatctc

SEQ ID NO: 324245 - DNA, 75 bp, Artificial Sequence
  Synthetic
ataccaccaaaaaaagaaaaagaattggatcctaaaccatctttaatctctcttgttcctactccaagggatgat

SEQ ID NO: 324246 - DNA, 75 bp, Artificial Sequence
  Synthetic
aggaggaaatgaagaaaataaggaaggagttacagaatgaacgtcaggcacagttgagtgttatggaagacagta

SEQ ID NO: 324247 - DNA, 75 bp, Artificial Sequence
  Synthetic
ggagttacagaatgaacgtcaggcacagttgagtgttatggaagacagtaggaagaaaatgagggacttagaaga

SEQ ID NO: 324248 - DNA, 75 bp, Artificial Sequence
  Synthetic
gagaaacaaaagaagggactacttgaggaaactctagagaaagaaaggcaactaaagaataaggcccttcttgat

SEQ ID NO: 324249 - DNA, 75 bp, Artificial Sequence
  Synthetic
aggaaactctagagaaagaaaggcaactaaagaataaggcccttcttgatgcacatgatttagataaacagttga

SEQ ID NO: 324250 - DNA, 75 bp, Artificial Sequence
  Synthetic
agctatggaagaacatcagaacgagaggcgcaggataaacagcaacatgattaggccttatgtcactactccagc

SEQ ID NO: 324251 - DNA, 75 bp, Artificial Sequence
  Synthetic
aggcgcaggataaacagcaacatgattaggccttatgtcactactccagcagctataatattaacttccctacta

SEQ ID NO: 324252 - DNA, 75 bp, Artificial Sequence
  Synthetic
agctggaaaacaggaacactaatcatgtgttgaatagacctggaaatggtggctactccattagtgataataatc

SEQ ID NO: 324253 - DNA, 75 bp, Artificial Sequence
  Synthetic
tgtgttgaatagacctggaaatggtggctactccattagtgataataatctaatagaagctaagtgcatgattac

SEQ ID NO: 324254 - DNA, 75 bp, Artificial Sequence
  Synthetic
gagatgcaattaaaccctgtttcttaccccttcttctcttctaattttgagaaatacagtttattggaatctgtt

SEQ ID NO: 324255 - DNA, 75 bp, Artificial Sequence
  Synthetic
accccttcttctcttctaattttgagaaatacagtttattggaatctgtttcagagactacaccaataataggga

SEQ ID NO: 324256 - DNA, 75 bp, Artificial Sequence
  Synthetic
aaatttatcaggggctcagaaaacatgtgctaaggaggcaagtctcatcaagaaacagtgcccagatgatatcag

SEQ ID NO: 324257 - DNA, 75 bp, Artificial Sequence
  Synthetic
tgtgctaaggaggcaagtctcatcaagaaacagtgcccagatgatatcagagcctacttctacattaattccttg

SEQ ID NO: 324258 - DNA, 75 bp, Artificial Sequence
  Synthetic
ctgagaataatgttttatctcaagactgtaatttctgtgtgcctaaagctaaaggagaacgatatatttacaaac

SEQ ID NO: 324259 - DNA, 75 bp, Artificial Sequence
  Synthetic
ctgtaatttctgtgtgcctaaagctaaaggagaacgatatatttacaaacctatccaggatggcttctgtcagaa

SEQ ID NO: 324260 - DNA, 75 bp, Artificial Sequence
  Synthetic
gttcgatattctaaagacatttgttctatagggccattaaaggttaaaaactgtcataaaggaacttctaggtac

SEQ ID NO: 324261 - DNA, 75 bp, Artificial Sequence
  Synthetic
ctatagggccattaaaggttaaaaactgtcataaaggaacttctaggtacgaaaggacagcctttatatcaacag

SEQ ID NO: 324262 - DNA, 75 bp, Artificial Sequence
  Synthetic
ggttaaaataaggtccaggcaagagtacgagcctgatcaatttctgtgctacaaagtgaaggatggatcttcatc

SEQ ID NO: 324263 - DNA, 75 bp, Artificial Sequence
  Synthetic
tacgagcctgatcaatttctgtgctacaaagtgaaggatggatcttcatcacctcttgtctatgagaaagtccaa

SEQ ID NO: 324264 - DNA, 75 bp, Artificial Sequence
  Synthetic
caaatagtcctaaaaaatgcacaggagatgagtatttttgtagtaagtatccttgtgaatcaaccagccctgagg

SEQ ID NO: 324265 - DNA, 75 bp, Artificial Sequence
  Synthetic
agatgagtatttttgtagtaagtatccttgtgaatcaaccagccctgaggcgaattgttatctcaggaagcacag

SEQ ID NO: 324266 - DNA, 75 bp, Artificial Sequence
  Synthetic
gggatgtgggtcaaaccgaagtgtgtgggctatgagatggctctagttaagagagttggtcttagatctgaagat

SEQ ID NO: 324267 - DNA, 75 bp, Artificial Sequence
  Synthetic
tgggctatgagatggctctagttaagagagttggtcttagatctgaagatgtctctctgaaggagtgtgccactt

SEQ ID NO: 324268 - DNA, 75 bp, Artificial Sequence
  Synthetic
cataagtattaccacacatgggcctaagatttcttatgcaactgcctgtagtcatgggtcttgcaagagtgtagt

SEQ ID NO: 324269 - DNA, 75 bp, Artificial Sequence
  Synthetic
aagatttcttatgcaactgcctgtagtcatgggtcttgcaagagtgtagtccaaagtccatcaacttccattaaa

SEQ ID NO: 324270 - DNA, 75 bp, Artificial Sequence
  Synthetic
ttgttggaggagacattggaatacacttaactgaagactcatcccctgttaatctccatttaaagattcactgtc

SEQ ID NO: 324271 - DNA, 75 bp, Artificial Sequence
  Synthetic
cttaactgaagactcatcccctgttaatctccatttaaagattcactgtccacctaaagattcttgtgaagtaag

SEQ ID NO: 324272 - DNA, 75 bp, Artificial Sequence
  Synthetic
ttactaaattaccagtgtcattctgtggcttctgcgctccttctatccaccataatagcatctctaatagcgtta

SEQ ID NO: 324273 - DNA, 75 bp, Artificial Sequence
  Synthetic
tggcttctgcgctccttctatccaccataatagcatctctaatagcgttagttgtctacatgctttccaaaacta

SEQ ID NO: 324274 - DNA, 75 bp, Artificial Sequence
  Synthetic
aattatgttcatcccattctgctggtgttttgtattgttggcctggttaaccagatcttggaaaggaaaggtaag

SEQ ID NO: 324275 - DNA, 75 bp, Artificial Sequence
  Synthetic
tgttttgtattgttggcctggttaaccagatcttggaaaggaaaggtaagaaatgcaattcaatcagccaataat

SEQ ID NO: 324276 - DNA, 75 bp, Artificial Sequence
  Synthetic
agagagtcatagcagagagaccaggaggcaggaatacaataaggtactcattttatggggttgttatactagcaa

SEQ ID NO: 324277 - DNA, 75 bp, Artificial Sequence
  Synthetic
aggcaggaatacaataaggtactcattttatggggttgttatactagcaatattggaatctgctttcggatgctc

SEQ ID NO: 324278 - DNA, 75 bp, Artificial Sequence
  Synthetic
ataatgcaatgcaatattgccaatgggaaaacaagctgtagggcttctgggacaatcatcatgaagctgggacca

SEQ ID NO: 324279 - DNA, 75 bp, Artificial Sequence
  Synthetic
ggaaaacaagctgtagggcttctgggacaatcatcatgaagctgggaccaataggatcagaggcttgtctaatcc

SEQ ID NO: 324280 - DNA, 75 bp, Artificial Sequence
  Synthetic
gcagtacatatctgtgaaaactgaatctagtgagctaatctgcagagaaggagaatcattttggacttccttata

SEQ ID NO: 324281 - DNA, 75 bp, Artificial Sequence
  Synthetic
tctagtgagctaatctgcagagaaggagaatcattttggacttccttatacaccccagtctgcttgagctcaagg

SEQ ID NO: 324282 - DNA, 75 bp, Artificial Sequence
  Synthetic
cgggagacttatgcttgaagtggaaatctaataaaacatctttagaatttgctggtaagactcatagcgaagtca

SEQ ID NO: 324283 - DNA, 75 bp, Artificial Sequence
  Synthetic
atctaataaaacatctttagaatttgctggtaagactcatagcgaagtcatgaatgagaataggtgctttgagca

SEQ ID NO: 324284 - DNA, 75 bp, Artificial Sequence
  Synthetic
ttcaacatcaatccctcatgcctttatactcatgcttatctgaagtcagtctacagaaatggtttcagagtattc

SEQ ID NO: 324285 - DNA, 75 bp, Artificial Sequence
  Synthetic
atactcatgcttatctgaagtcagtctacagaaatggtttcagagtattcaagtgtgcttcttggacacatagag

SEQ ID NO: 324286 - DNA, 75 bp, Artificial Sequence
  Synthetic
tagaacattcccaatgaccttagcagcaatgagcacccagcctactgactggggctcgattggcctcattctaga

SEQ ID NO: 324287 - DNA, 75 bp, Artificial Sequence
  Synthetic
gcaatgagcacccagcctactgactggggctcgattggcctcattctagactcagaagggatttcaggaacaaat

SEQ ID NO: 324288 - DNA, 75 bp, Artificial Sequence
  Synthetic
tagggagctttgctataatagatgaaccgtattcaatggagcccaggaagggttttattggtgaagttagatgcc

SEQ ID NO: 324289 - DNA, 75 bp, Artificial Sequence
  Synthetic
accgtattcaatggagcccaggaagggttttattggtgaagttagatgcccaacagaggaggcagccattaaggc

SEQ ID NO: 324290 - DNA, 75 bp, Artificial Sequence
  Synthetic
caattgatagaataccaacctgagatggacagtgttgagtgcaccacaaacatgattgatccaatgagtatcttc

SEQ ID NO: 324291 - DNA, 75 bp, Artificial Sequence
  Synthetic
tggacagtgttgagtgcaccacaaacatgattgatccaatgagtatcttcaacagaggctctcttccacaagtta

SEQ ID NO: 324292 - DNA, 75 bp, Artificial Sequence
  Synthetic
aatggagaagaacactgttcaagctatgactacaggagaggttcatgccagcataaggttagtgcttgatgacta

SEQ ID NO: 324293 - DNA, 75 bp, Artificial Sequence
  Synthetic
atgactacaggagaggttcatgccagcataaggttagtgcttgatgactatgaagtagaatacctctcaaatcag

SEQ ID NO: 324294 - DNA, 75 bp, Artificial Sequence
  Synthetic
atctgactggttgttattcatgtgatgagggtgctagagtgtgtatgcagattaaagcacacggagacactatat

SEQ ID NO: 324295 - DNA, 75 bp, Artificial Sequence
  Synthetic
tgagggtgctagagtgtgtatgcagattaaagcacacggagacactatattccacttcaaaaactctgatatgag

SEQ ID NO: 324296 - DNA, 75 bp, Artificial Sequence
  Synthetic
acgaacactctgatctactgctctgtcgtacacttctcaaaaccagtcataaaagaggaaggggtatatgactgt

SEQ ID NO: 324297 - DNA, 75 bp, Artificial Sequence
  Synthetic
tcgtacacttctcaaaaccagtcataaaagaggaaggggtatatgactgtggagcaggagaaaaacctatgattc

SEQ ID NO: 324298 - DNA, 75 bp, Artificial Sequence
  Synthetic
tcctcacaatgataggctagagcaaggaggttcatcaatcgttatcaacccaaaaggaagtggagttgatttctt

SEQ ID NO: 324299 - DNA, 75 bp, Artificial Sequence
  Synthetic
ggaggttcatcaatcgttatcaacccaaaaggaagtggagttgatttcttgggctggctttcagggtttagttcc

SEQ ID NO: 324300 - DNA, 75 bp, Artificial Sequence
  Synthetic
tcttaacagtaattggtttcctcctactaggattccttctattcatgttagtaacaattggccttagatatgctc

SEQ ID NO: 324301 - DNA, 75 bp, Artificial Sequence
  Synthetic
actaggattccttctattcatgttagtaacaattggccttagatatgctcttagtcaagtggtgaccaaaaagat

SEQ ID NO: 324302 - DNA, 75 bp, Artificial Sequence
  Synthetic
atttgtagttaagttaatgggttcaacagggggggctctaggcagtaactcaatctagcaatcaagcaatcctag

SEQ ID NO: 324303 - DNA, 75 bp, Artificial Sequence
  Synthetic
aaatcagttggttctgctaatttgttgattattttgtggtatgttgttttgtttatgaggcaccggtctttgtgt

SEQ ID NO: 324304 - DNA, 75 bp, Artificial Sequence
  Synthetic
cacacatgatgaacagccagtacatgttcgattatccggcaatcaacattgatgtgaggtgtcacagactcctct

SEQ ID NO: 324305 - DNA, 75 bp, Artificial Sequence
  Synthetic
ctagtgtttcttacattgcctacaataaatttcacacccacgatgtctcaacttatgagcactgtgagataccat

SEQ ID NO: 324306 - DNA, 75 bp, Artificial Sequence
  Synthetic
tggaaaagttgagacttggggttggacgcagaagctcgctgtctgacttttattcccttggagagttaccagctt

SEQ ID NO: 324307 - DNA, 75 bp, Artificial Sequence
  Synthetic
catggggcccagcatgctacataagctctgtaaagcccatggtttacaccttccagggcatggcgagtgatctct

SEQ ID NO: 324308 - DNA, 75 bp, Artificial Sequence
  Synthetic
ctagatttgacctcactagtttctccaggagaggaatgccaaatgtcttgaaagctctcagctggccattgggca

SEQ ID NO: 324309 - DNA, 75 bp, Artificial Sequence
  Synthetic
tccctgactgtgagatttttagtatatgtagtgaagggtttgtgagagggctccaaacaagagaccaattaatgt

SEQ ID NO: 324310 - DNA, 75 bp, Artificial Sequence
  Synthetic
cttatatcctcagaatgggagattcacataatctagatgaatgtatagtccaagcacacaagaagataacacaag

SEQ ID NO: 324311 - DNA, 75 bp, Artificial Sequence
  Synthetic
aggccaggagattgggccttagtaatgagcattataacgggtatgacctgtttagagagataggatctctagtct

SEQ ID NO: 324312 - DNA, 75 bp, Artificial Sequence
  Synthetic
gcctcagactcatcaatgcagagccatatgatactgcttcttctggggaggcacttgagatcaggacagtgatta

SEQ ID NO: 324313 - DNA, 75 bp, Artificial Sequence
  Synthetic
ggtcctatagagcaagtgatccctctgctggtttaaatgaatatggtaactccctttgggtcccgatacatagcc

SEQ ID NO: 324314 - DNA, 75 bp, Artificial Sequence
  Synthetic
atgtggatgaaaatgacgagagctcatctgactccgacttctgatttccgctgcccaaccccaaatgcccacccc

SEQ ID NO: 324315 - DNA, 75 bp, Artificial Sequence
  Synthetic
cctccccaagccccacccagaccaccccaccctgtcccgcacccctagtctgacccaacccaccccccacatctg

SEQ ID NO: 324316 - DNA, 75 bp, Artificial Sequence
  Synthetic
tcccacccaactaccccaagcccaaaagtccctcacccatctcaagttggcagcagcttactccagcttcctgta

SEQ ID NO: 324317 - DNA, 75 bp, Artificial Sequence
  Synthetic
gacttctgcaatctttttcacgactgcagtagctcttgctccagaggttaagatcccaaactttgtcaggaaagc

SEQ ID NO: 324318 - DNA, 75 bp, Artificial Sequence
  Synthetic
tctcctctgagtgttgtctataaaagagctgttgatagcagcaagcattggctgagagaatgactcctcaatatc

SEQ ID NO: 324319 - DNA, 75 bp, Artificial Sequence
  Synthetic
tcttttctgtgcaccacgtaggctgacattgattgttttggaaaacatatacaagaataacttgtgagcatccag

SEQ ID NO: 324320 - DNA, 75 bp, Artificial Sequence
  Synthetic
aactgcattgaaatcctcttggtcgaggcttgggtcaatgagaccagcaaagcttggatgcatcatctgcctagg

SEQ ID NO: 324321 - DNA, 75 bp, Artificial Sequence
  Synthetic
atacgtttgtccacacatgcgatccattgtgctcccaggaactggaagaaagttctcaaccacttctacagcctg

SEQ ID NO: 324322 - DNA, 75 bp, Artificial Sequence
  Synthetic
aacggtccatccagccagagctgcagctacccttgatagagttattccgtttctgccaggtcttccttcaactat

SEQ ID NO: 324323 - DNA, 75 bp, Artificial Sequence
  Synthetic
cttatacttcgaaaccaggcttttaacctctctggctccctctggagacattctctcaaccatcttcttgggctt

SEQ ID NO: 324324 - DNA, 75 bp, Artificial Sequence
  Synthetic
gttaccacgagtcagagataagataatcattttcttagcatcctcttcccagccttttcctccaagctggatgag

SEQ ID NO: 324325 - DNA, 75 bp, Artificial Sequence
  Synthetic
gttctggatgatcgttctggcatcaaacccctgataagcaaaagcttgtagccattcctgaaccacagtctcatc

SEQ ID NO: 324326 - DNA, 75 bp, Artificial Sequence
  Synthetic
aattgcctgctctccaaactcaacagcaatcttctgatactcgtccatctcgaattcagctcactttgattttct

SEQ ID NO: 324327 - DNA, 75 bp, Artificial Sequence
  Synthetic
cagcaatcttctgatactcgtccatctcgaattcagctcactttgattttctagggaactttgtgtccccccccc

SEQ ID NO: 324328 - DNA, 75 bp, Artificial Sequence
  Synthetic
acacaaaggtccctagttaatctgagtgagctaagtttgaaatggacgagtaccagaaaattgctgttgagtttg

SEQ ID NO: 324329 - DNA, 75 bp, Artificial Sequence
  Synthetic
gagagcaggctattgatgagactgtgatccaggattggctacaagcatttgcgtatcaaggatttgatgccagaa

SEQ ID NO: 324330 - DNA, 75 bp, Artificial Sequence
  Synthetic
caattatacacaaccttgtgcagcttggagggaagagttgggaagaggatgccaagaagatgatcatcctatccc

SEQ ID NO: 324331 - DNA, 75 bp, Artificial Sequence
  Synthetic
taactcgtggcaacaagcccaagaagatggatgagagaatgtctccagagggagcaagagaagttaagagcctgg

SEQ ID NO: 324332 - DNA, 75 bp, Artificial Sequence
  Synthetic
ggagcaagagaagttaagagcctggttgcaaagtataagatagtagagggcagaccaggcaggaatggaattacc

SEQ ID NO: 324333 - DNA, 75 bp, Artificial Sequence
  Synthetic
ctgtcaagggtggctgcagccctggctgggtggacagtccaagctgtggaagtggttgaaaacttcttaccagtc

SEQ ID NO: 324334 - DNA, 75 bp, Artificial Sequence
  Synthetic
ctgggtggacagtccaagctgtggaagtggttgaaaacttcttaccagtcccagggagcacaatggaccgcatgt

SEQ ID NO: 324335 - DNA, 75 bp, Artificial Sequence
  Synthetic
gtggacaaacataccccaggcagatgatgcatccaagctttgccggtctcattgacccaagcctcgaccaggagg

SEQ ID NO: 324336 - DNA, 75 bp, Artificial Sequence
  Synthetic
attttaatgcagtattggatgctcacaaacttttcttgtccatgttttccaaaacaatcaatgtcagcctccgcg

SEQ ID NO: 324337 - DNA, 75 bp, Artificial Sequence
  Synthetic
gtgcgcagaggagagacattgaggaatcattctctcaaccaatgcttgctgctatcaatagctcattcattgaca

SEQ ID NO: 324338 - DNA, 75 bp, Artificial Sequence
  Synthetic
acactcagaggagggcattcttgactaagtttgggatcctaacttctggagcaagagctacagcagttgtaaaga

SEQ ID NO: 324339 - DNA, 75 bp, Artificial Sequence
  Synthetic
taagtttgggatcctaacttctggagcaagagctacagcagttgtaaagaaggttgcagaagtttacaggaaact

SEQ ID NO: 324340 - DNA, 75 bp, Artificial Sequence
  Synthetic
agagtaagctgctgctagcgtggggtgggatggggattctgggttgggggttctggggtggagggtggctaggtg

SEQ ID NO: 324341 - DNA, 75 bp, Artificial Sequence
  Synthetic
ggggggtggcaagggtggattcggtttgggttggggtcatggggtggggtgggtctgggggctgggcagcggaga

SEQ ID NO: 324342 - DNA, 75 bp, Artificial Sequence
  Synthetic
tcaaaagtcagagtcagacgagctctcatcattttcatccacatgactgtgtattggggtccaaagagaattgcc

SEQ ID NO: 324343 - DNA, 75 bp, Artificial Sequence
  Synthetic
atactcggtgaggccagtagaagggtcacttgctctataggatctaatcactgttcttacatcaagtgcctcccc

SEQ ID NO: 324344 - DNA, 75 bp, Artificial Sequence
  Synthetic
agaggaggcagtgtcaaaaggctctgcattgataagtctgagacaaaccagagatcctatctctctaaatagatc

SEQ ID NO: 324345 - DNA, 75 bp, Artificial Sequence
  Synthetic
gtatccattgtaatgctcatcactaagacccaacctcctagcttcttgtagtatctttttgtgtgcctgaactat

SEQ ID NO: 324346 - DNA, 75 bp, Artificial Sequence
  Synthetic
gcactcatccaagctatgtgaatcccccattctcagaatgtaagacattagctgatcccttgtttgtagccctct

SEQ ID NO: 324347 - DNA, 75 bp, Artificial Sequence
  Synthetic
cacaaatctatcactgcatatgctaaagatctcacaatcagggatacctagtggccagctaagagccttcaggac

SEQ ID NO: 324348 - DNA, 75 bp, Artificial Sequence
  Synthetic
atttggcagcccctttctagagaaacctgtgaggtcaaacctggagaggtcacttgccataccttggaaggtata

SEQ ID NO: 324349 - DNA, 75 bp, Artificial Sequence
  Synthetic
catcataggcttgacagaactaaaatagcatgctgggccccaagaagctggcaactctccaagggaataaaagtc

SEQ ID NO: 324350 - DNA, 75 bp, Artificial Sequence
  Synthetic
agccagtgagtttctgcgtccatacccaagtcttaacttctctagtggtatttcacaatgctcataagttgaaac

SEQ ID NO: 324351 - DNA, 75 bp, Artificial Sequence
  Synthetic
ccaagtcttaacttctctagtggtatttcacaatgctcataagttgaaacgtcatgagtgtgaaatttattgtag

SEQ ID NO: 324352 - DNA, 75 bp, Artificial Sequence
  Synthetic
gcaacataagacacactggagaggagtctatgacacctcacatcaatgttaattgccgggtagtcaaacatgtac

SEQ ID NO: 324353 - DNA, 75 bp, Artificial Sequence
  Synthetic
ttaattgccgggtagtcaaacatgtactggctgttcatcatgttgttgttgatcattactagggggtctttgtgt

SEQ ID NO: 324354 - DNA, 75 bp, Artificial Sequence
  Synthetic
acacaaagctggtgcatcatgtttgaaataacaattttgttgatagtccttgccaccttgtttatactagtggtt

SEQ ID NO: 324355 - DNA, 75 bp, Artificial Sequence
  Synthetic
gggaatctcaaacttgagtccaaaatggggaacagtcttacatcaacttgtttctctcagaccactgggccaggg

SEQ ID NO: 324356 - DNA, 75 bp, Artificial Sequence
  Synthetic
ataattgagaggtactgggggtttgaaatggccaaaatgccaggctttgacttgcattgccgctttaatgaggaa

SEQ ID NO: 324357 - DNA, 75 bp, Artificial Sequence
  Synthetic
ggtgacttcaagtacatgacacacgagaatgctatgaagcagatcaagattgtcacaacagctccagacaccatg

SEQ ID NO: 324358 - DNA, 75 bp, Artificial Sequence
  Synthetic
aagttctcctgtggagatgaaacaaagtctctggggctatccataacaaatgatgggacaaacaacatgatgggg

SEQ ID NO: 324359 - DNA, 75 bp, Artificial Sequence
  Synthetic
cctgctattatttactgtgacaccaatgacttcattaggaatataactacaggtgagcagtccccaagagttgat

SEQ ID NO: 324360 - DNA, 75 bp, Artificial Sequence
  Synthetic
tatgagaagctaaagaagaatgcagaagagaaggatgctactattcagaggaagaccaaagagatggaggaggtg

SEQ ID NO: 324361 - DNA, 75 bp, Artificial Sequence
  Synthetic
agagctgttctagattccaggaaccaaattgcacaccatgaaatccagcagaaggagaatgagatccaaaaacta

SEQ ID NO: 324362 - DNA, 75 bp, Artificial Sequence
  Synthetic
agaaatgatctcagagatgccattaagaagggccaagagcatgagtcaatgaaactcagggttgaagagtctgat

SEQ ID NO: 324363 - DNA, 75 bp, Artificial Sequence
  Synthetic
gctagggtgaagggtctaaaggaagagctgaagcagttgacttacaagatctttgaccaccaagcgacaaaagat

SEQ ID NO: 324364 - DNA, 75 bp, Artificial Sequence
  Synthetic
gagctccaacatgctaaatcagaaatgcagtctctgagaaagaagatcaaagactttgaatctattcctcaagca

SEQ ID NO: 324365 - DNA, 75 bp, Artificial Sequence
  Synthetic
aagaaatccagcaacagctctgttacacttatgaccacagcagtgttgtcactattagggtcctcaatggctgcc

SEQ ID NO: 324366 - DNA, 75 bp, Artificial Sequence
  Synthetic
tctcctgaagcaggaatgaatgcagccacacacataaataatagaccaggtcttggaaagtttgccctgctaaca

SEQ ID NO: 324367 - DNA, 75 bp, Artificial Sequence
  Synthetic
acaggaactgaggatgagcattgcaaaaagatcgattatggcgtcacctgcagtaggtttgaccatctgaagtct

SEQ ID NO: 324368 - DNA, 75 bp, Artificial Sequence
  Synthetic
ctggacaggtaccccttcttcaattcgcactatcatcacagggcactgttagaggcgcactatgacaacattgtg

SEQ ID NO: 324369 - DNA, 75 bp, Artificial Sequence
  Synthetic
aaggtgagttctactatctcctgtaatgagacaaaattcaagaatgctgagtgctccaaggaaatcaggaagttg

SEQ ID NO: 324370 - DNA, 75 bp, Artificial Sequence
  Synthetic
gcttacaagtgcccgagaggagtttcaggggtaatatatgctgactctcaaggagaaattgggggcatctactgt

SEQ ID NO: 324371 - DNA, 75 bp, Artificial Sequence
  Synthetic
aaggaaaatgaggaattgatggagaactgcatccagtgcaggaaagtgcagagaaagaagcctcaaaaaggtcta

SEQ ID NO: 324372 - DNA, 75 bp, Artificial Sequence
  Synthetic
ttgatacagctgcaagacatggtgtgccagccaaactcgactgattacactggccccaaacaagttctaaaaggt

SEQ ID NO: 324373 - DNA, 75 bp, Artificial Sequence
  Synthetic
tattgcaagataggaatggttgattacaggcattgtgagcatttcgccagcatggaggaagttgtcccttttgcg

SEQ ID NO: 324374 - DNA, 75 bp, Artificial Sequence
  Synthetic
atattcaagaacaaagggaagctatacatggatagtatgagaattaggaataaagatgtcctagaaaaagagaac

SEQ ID NO: 324375 - DNA, 75 bp, Artificial Sequence
  Synthetic
ttcatttgttatggagcaaaggagaatgcagatgctgactcctcaaaccatgggggtaaggtttcagtgaaggtc

SEQ ID NO: 324376 - DNA, 75 bp, Artificial Sequence
  Synthetic
acggagtgtaaaaatgtggatccatcacaaaacaagatctgctctggtgataacactttttgttccaagtttgca

SEQ ID NO: 324377 - DNA, 75 bp, Artificial Sequence
  Synthetic
cacaaaacaagatctgctctggtgataacactttttgttccaagtttgcatgtcataatgagttgcctgaggtcc

SEQ ID NO: 324378 - DNA, 75 bp, Artificial Sequence
  Synthetic
attgtgaagtggctccgggagctggcccaattgaggtctattacggaggagtctggatacagcccatgtgcttag

SEQ ID NO: 324379 - DNA, 75 bp, Artificial Sequence
  Synthetic
ggtatgaaagggctatggtgttaagagagatgccacctccagtcgaaacttctgaagacacttgtgacagttgct

SEQ ID NO: 324380 - DNA, 75 bp, Artificial Sequence
  Synthetic
actctgagtgcttagatagtcacatacttgtcaggtctaccggatttatgatatccggtgcagtggcatgctctc

SEQ ID NO: 324381 - DNA, 75 bp, Artificial Sequence
  Synthetic
atggagcatgtgcttcactaacgatagtgccttcaactgagataatgatcccttatcctggaatggcatcatcaa

SEQ ID NO: 324382 - DNA, 75 bp, Artificial Sequence
  Synthetic
ttggtggtgacataggaatacacttgtctcatgatgaggtccaagttagttcacattatagagttcactgtgagc

SEQ ID NO: 324383 - DNA, 75 bp, Artificial Sequence
  Synthetic
ctaaagatccatgtgttgctcactcctgtgtcatctgtgctgaggggatcatcaattaccagtgtcacacagctc

SEQ ID NO: 324384 - DNA, 75 bp, Artificial Sequence
  Synthetic
tgagtgcatttgttgttgtaacattggtagtgctagcagtcttaatgtttctaattgtgttgaaaaggtgcttgg

SEQ ID NO: 324385 - DNA, 75 bp, Artificial Sequence
  Synthetic
tgttattcagggtggcacctgccatcttgctggtccctttttcatggatagtcaagctggcattctggacatcta

SEQ ID NO: 324386 - DNA, 75 bp, Artificial Sequence
  Synthetic
gaaaactgaaaataagtactgagagaacaatagccaggatcaatgaagaaattgggtggagaccagagggagcta

SEQ ID NO: 324387 - DNA, 75 bp, Artificial Sequence
  Synthetic
gggctgcacatagaatgagagacagagacaggaggcccatacctaggtcagcagtatacctggcaatcctattac

SEQ ID NO: 324388 - DNA, 75 bp, Artificial Sequence
  Synthetic
ttatcagtgtgacaagtgcttgttcagatcacaccattgctagctcaaagatagttaaatgtgttgctaagggtt

SEQ ID NO: 324389 - DNA, 75 bp, Artificial Sequence
  Synthetic
ccaaaagtgtttgcaccatctcaggactgattaatgtgaaagcaggccctattggctctgaaacttgtgtcacct

SEQ ID NO: 324390 - DNA, 75 bp, Artificial Sequence
  Synthetic
tgaaaggacctgactcagctgacaaaaaattcctaaccatcaagaccattgccagtgaattgatttgctcagaag

SEQ ID NO: 324391 - DNA, 75 bp, Artificial Sequence
  Synthetic
gccagtcttactggacaagtcagtatggagttgagtgtctaagttcgagaagatgccgtggggtcgccgagtgca

SEQ ID NO: 324392 - DNA, 75 bp, Artificial Sequence
  Synthetic
aaggtgatgcttgccagagatggaacagcactcttgtctcaagagaatttcaaggaataaccaacaattcagtca

SEQ ID NO: 324393 - DNA, 75 bp, Artificial Sequence
  Synthetic
tttctgaaaatagatgcatcgaacagtgcggaggggttggctgtgcttgcttcaatgtttatgcctcatgtctat

SEQ ID NO: 324394 - DNA, 75 bp, Artificial Sequence
  Synthetic
ttgtccatgccagactaagggcaacaaagagagaagcaatcaaagtctttaattgcattgactggagccatagac

SEQ ID NO: 324395 - DNA, 75 bp, Artificial Sequence
  Synthetic
tagtccttgaaatcacagatttcaatgggaaaaaggagaaggtctcaatgacaggcatgacaacacagttcttta

SEQ ID NO: 324396 - DNA, 75 bp, Artificial Sequence
  Synthetic
gctggggttccatgactctagctctagactttgaaggtataaccggcacaaactcatacagctttctcaggtctt

SEQ ID NO: 324397 - DNA, 75 bp, Artificial Sequence
  Synthetic
cctcaggaaccttctccttggttgatgaggccatgtctatggaacctagaaaaggcttcctaggggaaatcaggt

SEQ ID NO: 324398 - DNA, 75 bp, Artificial Sequence
  Synthetic
gttcctcagaggcagctgctctcacagctcacaaaagctgtgttgtagcacctgacatcatccgttacaaaccaa

SEQ ID NO: 324399 - DNA, 75 bp, Artificial Sequence
  Synthetic
tgactgacattgtggactgttctacttctctcatagatccatttgcagtattcctgcgaggggctttaccacaga

SEQ ID NO: 324400 - DNA, 75 bp, Artificial Sequence
  Synthetic
ccaggaacgggaaaacatttagtagctccatagataaaaagactatacaagcattcacctctggcattgtgcacg

SEQ ID NO: 324401 - DNA, 75 bp, Artificial Sequence
  Synthetic
cctctatgtctttgagctttgacaactttgaagttgagttcgaagaagagagggtttcctgtttggccagctttg

SEQ ID NO: 324402 - DNA, 75 bp, Artificial Sequence
  Synthetic
ttaacatcacaggctgctattcttgcaatgagggtgccagagtatgcatacaggcagcagcaaacaagaacacaa

SEQ ID NO: 324403 - DNA, 75 bp, Artificial Sequence
  Synthetic
cactccacgtacacactctggacaactcactaactatagtgatggatgttcttagtcctaagtccactgactgca

SEQ ID NO: 324404 - DNA, 75 bp, Artificial Sequence
  Synthetic
gagttgtccacctttctacacctcaagtcaaaatggatgtggtgtacagttgcgacgggtactacaaagccatgt

SEQ ID NO: 324405 - DNA, 75 bp, Artificial Sequence
  Synthetic
ctatagctggaaccttagtggcaatgaacccttttgatgacaggaggcatgaagagacaaattctgttgttgtca

SEQ ID NO: 324406 - DNA, 75 bp, Artificial Sequence
  Synthetic
accctaaaactggcaggtgggacctctccagttgggcatctggtttagtggactggcttggggggccactaagaa

SEQ ID NO: 324407 - DNA, 75 bp, Artificial Sequence
  Synthetic
cagcaggcgtcatactcggctacataattctagctattgtatttctaattatgctggtactgtgtgtgccaaagt

SEQ ID NO: 324408 - DNA, 75 bp, Artificial Sequence
  Synthetic
tggtgggaatgattagagctgccctgctcaagaaaaagctataaacaactttatatccagagtgataggacattt

SEQ ID NO: 324409 - DNA, 75 bp, Artificial Sequence
  Synthetic
gtcatgcgatagaaaaccaaaacaaaaaaaccaaaataataaaacaaaacagcaaaacaacaaacaaaaacaaaa

SEQ ID NO: 324410 - DNA, 75 bp, Artificial Sequence
  Synthetic
aaacaaaaaagacagcaaaataaggggagatgggaaattactggtgatataccctgatctctcaaattaggaatg

SEQ ID NO: 324411 - DNA, 75 bp, Artificial Sequence
  Synthetic
gtggtgggtttggggtgggtgagcagcgggatagtctgattggcattgccaagcgcagtgcccaatgtctttaaa

SEQ ID NO: 324412 - DNA, 75 bp, Artificial Sequence
  Synthetic
tacaacatgagagtgaggattgtctttcagcttcataattgatcaaaattgttgttggtagtttagtttgtcatt

SEQ ID NO: 324413 - DNA, 75 bp, Artificial Sequence
  Synthetic
cagcttcataattgatcaaaattgttgttggtagtttagtttgtcattagggaaaacatgcaccggtctttgtgt

SEQ ID NO: 324414 - DNA, 75 bp, Artificial Sequence
  Synthetic
ctgatcacacacatgatgaacagccagtacatgtttgactacccggcaattaacattgatgtgaggtgtcataga

SEQ ID NO: 324415 - DNA, 75 bp, Artificial Sequence
  Synthetic
agtacatgtttgactacccggcaattaacattgatgtgaggtgtcatagactcctctccagtgtgtcttatgttg

SEQ ID NO: 324416 - DNA, 75 bp, Artificial Sequence
  Synthetic
cctacaataaatttcacactcatgacgtttcaacttatgagcattgtgaaataccactagagaagttaagacttg

SEQ ID NO: 324417 - DNA, 75 bp, Artificial Sequence
  Synthetic
ggtttggacgcagaaactcactggctgacttttattcccttggagagttgccagcttcttggggcccagcatgct

SEQ ID NO: 324418 - DNA, 75 bp, Artificial Sequence
  Synthetic
attttagttctgtcaagcctatgatgtataccttccaaggtatggcaagtgacctctccaggtttgacctcacaa

SEQ ID NO: 324419 - DNA, 75 bp, Artificial Sequence
  Synthetic
gtttctctagaaaggggctgccaaatgtcctgaaggctcttagctggccactaggtatccctgattgtgagatct

SEQ ID NO: 324420 - DNA, 75 bp, Artificial Sequence
  Synthetic
ttagcatatgcagtgatagatttgtgagagggctacaaacaagggatcagctaatgtcttacattctgagaatgg

SEQ ID NO: 324421 - DNA, 75 bp, Artificial Sequence
  Synthetic
gggattcacatagcttggatgagtgcatagttcaggcacacaaaaagatactacaagaagctaggaggttgggtc

SEQ ID NO: 324422 - DNA, 75 bp, Artificial Sequence
  Synthetic
ttagtgatgagcattacaatggatacgatctatttagagagataggatctctggtttgtctcagacttatcaatg

SEQ ID NO: 324423 - DNA, 75 bp, Artificial Sequence
  Synthetic
cagagccttttgacactgcctcctctggggaggcacttgatgtaagaacagtgattagatcctatagagcaagtg

SEQ ID NO: 324424 - DNA, 75 bp, Artificial Sequence
  Synthetic
tggggaggcacttgatgtaagaacagtgattagatcctatagagcaagtgacccttctactggcctcaccgagta

SEQ ID NO: 324425 - DNA, 75 bp, Artificial Sequence
  Synthetic
tggcaattctctttggaccccaatacacagtcatgtggatgaaaatgatgagagctcgtctgactctgacttttg

SEQ ID NO: 324426 - DNA, 75 bp, Artificial Sequence
  Synthetic
atctccgctgcccagcccccagacccacccctccccatgaccccaacccaaaccgaatccacccttgccaccccc

SEQ ID NO: 324427 - DNA, 75 bp, Artificial Sequence
  Synthetic
ccacctagccaccctccaccccagaacccccaacccagaatccccatcccaccccacactagcagcagcttactc

SEQ ID NO: 324428 - DNA, 75 bp, Artificial Sequence
  Synthetic
tagtttcctgtaaacttctgcaatcttctttacaactgctgtagctcttgctccagaagttaggatcccaaactt

SEQ ID NO: 324429 - DNA, 75 bp, Artificial Sequence
  Synthetic
ttctttacaactgctgtagctcttgctccagaagttaggatcccaaacttagtcaagaatgccctcctctgagtg

SEQ ID NO: 324430 - DNA, 75 bp, Artificial Sequence
  Synthetic
ttgtcaatgaatgagctattgatagcagcaagcattggttgagagaatgattcctcaatgtctctcttctgcgca

SEQ ID NO: 324431 - DNA, 75 bp, Artificial Sequence
  Synthetic
ccgcggaggctgacattgattgttttggaaaacatgaacaagaaaagtttgtgagcatccaatactgcattaaaa

SEQ ID NO: 324432 - DNA, 75 bp, Artificial Sequence
  Synthetic
tcctcctggtcgaggcttgggtcaatgagaccggcaaagcttggatgcatcatctgcctggggtatgtttgtcca

SEQ ID NO: 324433 - DNA, 75 bp, Artificial Sequence
  Synthetic
tgagaccggcaaagcttggatgcatcatctgcctggggtatgtttgtccacacatgcggtccattgtgctccctg

SEQ ID NO: 324434 - DNA, 75 bp, Artificial Sequence
  Synthetic
ggactggtaagaagttttcaaccacttccacagcttggactgtccacccagccagggctgcagccacccttgaca

SEQ ID NO: 324435 - DNA, 75 bp, Artificial Sequence
  Synthetic
ttccacagcttggactgtccacccagccagggctgcagccacccttgacagggtaattccattcctgcctggtct

SEQ ID NO: 324436 - DNA, 75 bp, Artificial Sequence
  Synthetic
gccctctactatcttatactttgcaaccaggctcttaacttctcttgctccctctggagacattctctcaaccat

SEQ ID NO: 324437 - DNA, 75 bp, Artificial Sequence
  Synthetic
accaggctcttaacttctcttgctccctctggagacattctctcaaccatcttcttgggcttgttgccacgagtt

SEQ ID NO: 324438 - DNA, 75 bp, Artificial Sequence
  Synthetic
cttcttgggcttgttgccacgagttagggataggatgatcatcttcttggcatcctcttcccaactcttccctcc

SEQ ID NO: 324439 - DNA, 75 bp, Artificial Sequence
  Synthetic
aagctgcacaaggttgtgtataattgttctggcatcaaatccttgatacgcaaatgcttgtagccaatcctggat

SEQ ID NO: 324440 - DNA, 75 bp, Artificial Sequence
  Synthetic
cacagtctcatcaatagcctgctctccaaactcaacagcaattttctggtactcgtccatttcaaacttagctca

SEQ ID NO: 324441 - DNA, 75 bp, Artificial Sequence
  Synthetic
gcaattttctggtactcgtccatttcaaacttagctcactcagattaactagggacctttgtgtcccccccccca

SEQ ID NO: 324442 - DNA, 75 bp, Artificial Sequence
  Synthetic
acacaaaggcgcctgtacaaaatgaattccataatagaacgtcaagaacctctaggagaaggtttcacaagacgt

SEQ ID NO: 324443 - DNA, 75 bp, Artificial Sequence
  Synthetic
cagctaacacattgcagtgactcattgatgaatgcctatctgcctcaatttgtgatcttacctgataaagatgga

SEQ ID NO: 324444 - DNA, 75 bp, Artificial Sequence
  Synthetic
gtttcaatagagattgacagggagagctttgacttgaactcaaccactggcaacagcatgaagaacgagagatat

SEQ ID NO: 324445 - DNA, 75 bp, Artificial Sequence
  Synthetic
cagttttcagcattgcctaactttgtccatgatttcacatttgggcatttaactcctcttacagatgtccccttt

SEQ ID NO: 324446 - DNA, 75 bp, Artificial Sequence
  Synthetic
gtcagtgcttttggcaaattcagagatggttatgaccatttgagccccgatgtgatcttcaagacaaccgcaaat

SEQ ID NO: 324447 - DNA, 75 bp, Artificial Sequence
  Synthetic
agcttttttattgtggaattcacaacctttagaggaggggaacggggttgcagagcagctgcaaataacaagtta

SEQ ID NO: 324448 - DNA, 75 bp, Artificial Sequence
  Synthetic
ataaagtatgaagttgcctgtgagtctagatcagcacgagagagacttggtttgtttgtgatagctgtacacaga

SEQ ID NO: 324449 - DNA, 75 bp, Artificial Sequence
  Synthetic
aatggcatctggacaaacctctctctagaagacactgaggtcaatgagctagtattcaggtatagaactgctcta

SEQ ID NO: 324450 - DNA, 75 bp, Artificial Sequence
  Synthetic
gacatctttgaagacctcaaaagaaggtaccctgagctatctgtggacaatgaagatctaactagagcagaaagt

SEQ ID NO: 324451 - DNA, 75 bp, Artificial Sequence
  Synthetic
gaactgaggggcattgtgtcttcaatacagctggattggaaaaaaacttcatctgctttcccacattttaagaga

SEQ ID NO: 324452 - DNA, 75 bp, Artificial Sequence
  Synthetic
gaggtcatcgagagctttagaaacttctctcctgatgaggaatacttgtcaagaattgtttctggtgtaattgac

SEQ ID NO: 324453 - DNA, 75 bp, Artificial Sequence
  Synthetic
aaagcacagaaggatctggttagggaaacattttctggcatgcttggtgaacatgaggatagattcactatgaat

SEQ ID NO: 324454 - DNA, 75 bp, Artificial Sequence
  Synthetic
gaaaaggaatgtggggccatccttgagaagagcgtggagggctactacacagggagggagttcaggcacactaat

SEQ ID NO: 324455 - DNA, 75 bp, Artificial Sequence
  Synthetic
gactgcaaatcgactgttcagatccctgcatgggtgacagtcccagggcaacctggaaaatctcttgatgcacta

SEQ ID NO: 324456 - DNA, 75 bp, Artificial Sequence
  Synthetic
gcagagctcaatgttgatggagatggtgtcatggcatcaatatggtcaaaggtagcctatgaagcaaaagttgaa

SEQ ID NO: 324457 - DNA, 75 bp, Artificial Sequence
  Synthetic
ggaatagaaagaatgatggatgacaaggaagcagaacttgagcaggctctagaagggagccttgacagacctgat

SEQ ID NO: 324458 - DNA, 75 bp, Artificial Sequence
  Synthetic
cttcgaaataagtatcatcgtgtccacctcagcttgactgctaacgagcaagcatatatagctgctcttggtgtt

SEQ ID NO: 324459 - DNA, 75 bp, Artificial Sequence
  Synthetic
ggagggaagaagagaaaagattcccctagtgtgacacaagctcgagcaaagagcaagttgcccttttcactgtat

SEQ ID NO: 324460 - DNA, 75 bp, Artificial Sequence
  Synthetic
cacaatacaagagatttggagtcatttctcaactctgatgacatgagcttgtttgagcatgagatgggtttgtat

SEQ ID NO: 324461 - DNA, 75 bp, Artificial Sequence
  Synthetic
agtcccctcactgaagatctaccccttagaactgctgctgctgctattcatcaacccacgctgattggtagagaa

SEQ ID NO: 324462 - DNA, 75 bp, Artificial Sequence
  Synthetic
ggaaggaatgagattattcaagcacaccaaaacttcatggaatcacagtttgggtcctggacgcagatggttagt

SEQ ID NO: 324463 - DNA, 75 bp, Artificial Sequence
  Synthetic
ttgataggggctgagctttcagcatcagtaaaacagcatgtgaaacccaaccactttgttataaagaggctcctg

SEQ ID NO: 324464 - DNA, 75 bp, Artificial Sequence
  Synthetic
aattctggaatttacctgttgattaagccaacctcctcaaagagccatatttttgtgtcttttgctgtagagaaa

SEQ ID NO: 324465 - DNA, 75 bp, Artificial Sequence
  Synthetic
tctaggctgatacacaccttctgtgacagtcatgtattcaggaattgtgaggatgcaggtgacctcttagtcact

SEQ ID NO: 324466 - DNA, 75 bp, Artificial Sequence
  Synthetic
gattttgtctcctacaaattaagcaaaataactaatctttgcaagacaaactctttggcagaggcctcattcttc

SEQ ID NO: 324467 - DNA, 75 bp, Artificial Sequence
  Synthetic
ttttggtctgagtgctacggttataacgtttgggaggcccagaatagcttgcaagttaacactagtatgtcaagg

SEQ ID NO: 324468 - DNA, 75 bp, Artificial Sequence
  Synthetic
gacatatccttcatgactaaacttagcactctaacactgctggaggacaaagcaacaacagaagagattcagaca

SEQ ID NO: 324469 - DNA, 75 bp, Artificial Sequence
  Synthetic
atgcttcgatatgtcatgatggagggttttgtctcacagcctgaaatccccaagccacaaaaaatgtgcaagaag

SEQ ID NO: 324470 - DNA, 75 bp, Artificial Sequence
  Synthetic
tttcctaaggttctgagaactgagctacaagtgtttattatgaacaaggtcatagacagtatcatgagaattgct

SEQ ID NO: 324471 - DNA, 75 bp, Artificial Sequence
  Synthetic
aggtgtcctttcactcttcagaagagagatgggaagatctcatggtcgggaatgtttaatcccttctcggggaga

SEQ ID NO: 324472 - DNA, 75 bp, Artificial Sequence
  Synthetic
cccactaaggagcttcaagtgattattagctgctgttataatggttactttaagaataaagaggaggaaacagag

SEQ ID NO: 324473 - DNA, 75 bp, Artificial Sequence
  Synthetic
ccttcatctctatcaaatctgtacaagaaaatcatagaattagaagatcaaaaaccagacaatgacaacttcctt

SEQ ID NO: 324474 - DNA, 75 bp, Artificial Sequence
  Synthetic
ggagcaggtgatcctgagtccccccaaatgcatgagttcagcaggagttacttgaagaaggtttgtgatcatggc

SEQ ID NO: 324475 - DNA, 75 bp, Artificial Sequence
  Synthetic
aaacttctgctcacacgagtatttggtcaaaattttaaagaccaaatagattctagcataatgagagaaatcaat

SEQ ID NO: 324476 - DNA, 75 bp, Artificial Sequence
  Synthetic
tctatcaccttagagagattggcaaccctaaaagccactagtaactttggggagtcatggtatgtttacaaagat

SEQ ID NO: 324477 - DNA, 75 bp, Artificial Sequence
  Synthetic
gtcaaagacaaatcctatagtagagatagactactagttaagatggcctcatttgccagagaggggaaggcactt

SEQ ID NO: 324478 - DNA, 75 bp, Artificial Sequence
  Synthetic
gcaattgagaaatttgaggattgcatgtcaataatagaggaaaggggggcaatgcatatctgtcttttcaaaaaa

SEQ ID NO: 324479 - DNA, 75 bp, Artificial Sequence
  Synthetic
caacaacacggtgggttgagagaaatctatgtgttgggagctgaagagagagtcgttcaatcaataattgaggca

SEQ ID NO: 324480 - DNA, 75 bp, Artificial Sequence
  Synthetic
attgccagatcaatagggaggttttttcattcagacactctctgcaacccagcaaacaagatgaagatcccagaa

SEQ ID NO: 324481 - DNA, 75 bp, Artificial Sequence
  Synthetic
agtcatgggaggagggccaggtctcattgtaaaggtccagtgtggactactgctacatcagacgatgccagaaaa

SEQ ID NO: 324482 - DNA, 75 bp, Artificial Sequence
  Synthetic
tggaaccaagggcactttgtcacaaagtttgcaatgatgctatgtgagttcacacatccaaggtggcatcctata

SEQ ID NO: 324483 - DNA, 75 bp, Artificial Sequence
  Synthetic
ataataagaggatgttctatgttcacaaacaagtacatgatgatgaacctccaattcatttcaatcctagatggc

SEQ ID NO: 324484 - DNA, 75 bp, Artificial Sequence
  Synthetic
agaaaagaactgcctgttgaggatgaatttgtgcaggatttatttgaaggctatcatgggaacaaaacacttcct

SEQ ID NO: 324485 - DNA, 75 bp, Artificial Sequence
  Synthetic
tgggtaaaacctgggtgcacttatttgcagacgacaacagggatgatgcaggggattcttcactacacttcctca

SEQ ID NO: 324486 - DNA, 75 bp, Artificial Sequence
  Synthetic
ctcctacacaccctacaccaggaatttattagaacacttagcttcagaatatttgatatgaaggtgagggaagat

SEQ ID NO: 324487 - DNA, 75 bp, Artificial Sequence
  Synthetic
atgagcactagagtggtagtggatatgatgcaggggtccgatgatagcgccatgttgtgtagtttcccatgttcg

SEQ ID NO: 324488 - DNA, 75 bp, Artificial Sequence
  Synthetic
gatgagcacctcttatcaaagtgcaaggtggcagccacaatttgcttcagggttaaaaaactgctaggaatttat

SEQ ID NO: 324489 - DNA, 75 bp, Artificial Sequence
  Synthetic
ctggcaatctacccttcagaaaagagcacacaaaacacggactttgttttggaatataattctgaattcttcttc

SEQ ID NO: 324490 - DNA, 75 bp, Artificial Sequence
  Synthetic
cactcacagcacataagacctacaattaggtgggttgctgctagctgtagtcttcctgaggtggagaccctggtg

SEQ ID NO: 324491 - DNA, 75 bp, Artificial Sequence
  Synthetic
gcaagacaagaggaagcctcaaatttgatgacctccatttctgaaggaggaggaacattctccctatctgccatg

SEQ ID NO: 324492 - DNA, 75 bp, Artificial Sequence
  Synthetic
attcagcagagccagtgtacattgcactatatgctcatgggaatgggtgtctctgacctattctcagaatacaaa

SEQ ID NO: 324493 - DNA, 75 bp, Artificial Sequence
  Synthetic
agagccattctcaagtggagagatcctggccttggattctttcttctcgacaaccctttctgtgcaggtctagga

SEQ ID NO: 324494 - DNA, 75 bp, Artificial Sequence
  Synthetic
gggttcagacacaatttgtataatgctgtgacaaaaacaaaccttgggaaagtgtatgcttattatctgaggaag

SEQ ID NO: 324495 - DNA, 75 bp, Artificial Sequence
  Synthetic
gttgtaggcaagtcccaagacgatgaattcaatgatgaagagaggtgtagtgtgagtgcaggcggggcgatagtc

SEQ ID NO: 324496 - DNA, 75 bp, Artificial Sequence
  Synthetic
ctgagctcatctctcaagtggggttcgaggaagaagtttcaacaacttcgagacagactggatatccctgacgac

SEQ ID NO: 324497 - DNA, 75 bp, Artificial Sequence
  Synthetic
tggatagaccagattaatgacaaccctgaagtcttataccgagcccccaagacaggagcggagataatactaagg

SEQ ID NO: 324498 - DNA, 75 bp, Artificial Sequence
  Synthetic
atttctgaaaagctacacagtcctggggttgtctcctctctatcaacaggcaatgcaatctgtaaggtcatggca

SEQ ID NO: 324499 - DNA, 75 bp, Artificial Sequence
  Synthetic
tcctctgtctacttcttatcagctgcaatttttgaggacactggtaagccagagtttagacccttcaatgaatct

SEQ ID NO: 324500 - DNA, 75 bp, Artificial Sequence
  Synthetic
agatatagtctcttacaaaggatgatgaagtatgaaatttatgaagaaggagacagtgtcactaatgaagatctg

SEQ ID NO: 324501 - DNA, 75 bp, Artificial Sequence
  Synthetic
attttcttattcccaaacattgaagacttgtctcagttgaacactattgttcacgacaggaggaggattgaagtg

SEQ ID NO: 324502 - DNA, 75 bp, Artificial Sequence
  Synthetic
atcaggaggcagggtgggagagaagccactcagactagagttgtggtctttgacaccccccagatcaggatgtct

SEQ ID NO: 324503 - DNA, 75 bp, Artificial Sequence
  Synthetic
cctgagaagctagtttctgacaagtggtttgcaacccaaaagtcaaaaatagggaaaacaggttttgagactgaa

SEQ ID NO: 324504 - DNA, 75 bp, Artificial Sequence
  Synthetic
tgggcaaagctgaggcaagtggttaagtggttggatgacaccccatctgacaccttactcaaaagcccattgctt

SEQ ID NO: 324505 - DNA, 75 bp, Artificial Sequence
  Synthetic
aatcacatacagataaagaatttctttgcaagaatggagatcaggcctaggacagtcagagtcacaggagcaccc

SEQ ID NO: 324506 - DNA, 75 bp, Artificial Sequence
  Synthetic
gtgaagaagagatctggattaagcaagttgtcagtagtgatccgtgataacttctgcagaggtggctatgtgaag

SEQ ID NO: 324507 - DNA, 75 bp, Artificial Sequence
  Synthetic
gggatagaggacgtaagcggagctcataggagtatgtgggcagagctgattaaacatttgttgttttgtgttttg

SEQ ID NO: 324508 - DNA, 75 bp, Artificial Sequence
  Synthetic
caagggcctttttcacaagacatgaagatacagctgattcaaaagacactgtacgactccccggtcattgatcta

SEQ ID NO: 324509 - DNA, 75 bp, Artificial Sequence
  Synthetic
aaggagtctgatgggaaaacaaagaccaatctgatatctataatgcaaagatacatacatggcgagaaagatgtc

SEQ ID NO: 324510 - DNA, 75 bp, Artificial Sequence
  Synthetic
ctcgatgtgattgagaatgttggggcagggattgttggcgggtttgtggttaggcagaaaacaaaggtggacaat

SEQ ID NO: 324511 - DNA, 75 bp, Artificial Sequence
  Synthetic
ggaagggtcctctactacggtcatggaatctggagaggggttatggatggggttcaggtccaaattgatgttgac

SEQ ID NO: 324512 - DNA, 75 bp, Artificial Sequence
  Synthetic
aatcacataggtgctcccactaacattgttgcagtctatatggccaggtctagtgttgggccctgggagctgttg

SEQ ID NO: 324513 - DNA, 75 bp, Artificial Sequence
  Synthetic
aggactattaaggcttgggcagaggatcagaacataagaaatacagatgatgtatcaagaacatccaggaggggt

SEQ ID NO: 324514 - DNA, 75 bp, Artificial Sequence
  Synthetic
gcccactactggatgcaccagttcaagctaacagcttcaaaccttcaatttggggcgccagtgatcatggttgag

SEQ ID NO: 324515 - DNA, 75 bp, Artificial Sequence
  Synthetic
gggagaatggaggcaatatgggacagagagtctgagaacctcgaaatgacaatcacaaggtctactgtcaacatt

SEQ ID NO: 324516 - DNA, 75 bp, Artificial Sequence
  Synthetic
ggaattgttaatgagggtaatgaaagaaggatgaacatcttgtcctatactgcaacagatggagatctcagtcca

SEQ ID NO: 324517 - DNA, 75 bp, Artificial Sequence
  Synthetic
gagataattgatatattgccgtcagtagaaacaggaaatgtcttaagacactactcaggacggctaatcaatgct

SEQ ID NO: 324518 - DNA, 75 bp, Artificial Sequence
  Synthetic
tgggtctactgcagggaactagaattgagggacattcgcagactctccaagatgtacgagagtggccatgaaggc

SEQ ID NO: 324519 - DNA, 75 bp, Artificial Sequence
  Synthetic
tctataatagatgtagacaggatgaaggatattgttaagacatgtatagagagctctctcaagtcaaaaatagga

SEQ ID NO: 324520 - DNA, 75 bp, Artificial Sequence
  Synthetic
gcatcattctcttctgtagtgcaaaaggacgacttagaccccaactttgatatgagtgccattgtggagatgatg

SEQ ID NO: 324521 - DNA, 75 bp, Artificial Sequence
  Synthetic
atagaggacaccagtacagatatgttcagatgtatagcccaaagactagaggaagatatcaaagtgtcatatgat

SEQ ID NO: 324522 - DNA, 75 bp, Artificial Sequence
  Synthetic
gatgctgagtttgataaagatgacattgacctttttgggccttctcattatagggaagttaccaatctagctatg

SEQ ID NO: 324523 - DNA, 75 bp, Artificial Sequence
  Synthetic
gtgtctcaccccttaatggataaatttgtggaccacttagttgacaagatggggaggaaggacctaagaagactc

SEQ ID NO: 324524 - DNA, 75 bp, Artificial Sequence
  Synthetic
attagcacctgctgtgtgtcagaaaaaaacctagataaagctaaattactattcacatttctacagagagacttg

SEQ ID NO: 324525 - DNA, 75 bp, Artificial Sequence
  Synthetic
tccttaattgaggtagatagttcagaagatgagctactgagtggcagtgattcagatgggtttatttaagaagaa

SEQ ID NO: 324526 - DNA, 75 bp, Artificial Sequence
  Synthetic
acattgaactgatacaataagattaagcaatggctatctgactggccagccagagagaagaccctttattgtacg

SEQ ID NO: 324527 - DNA, 75 bp, Artificial Sequence
  Synthetic
tttattgtacgccacattctaaatgaacttgattgtgtcattattccattattacattacaggcggtctttgtgt

SEQ ID NO: 324528 - DNA, 75 bp, Artificial Sequence
  Synthetic
acacaaagctggtgcatcaaatgtttgaaataacaatcttgttgatagtccttgccaccttgtttatactggtgg

SEQ ID NO: 324529 - DNA, 75 bp, Artificial Sequence
  Synthetic
ttgggaatcttaaacttgagtccaaaatggggaacagccttacatcaacttgcttctcccagaacactgggccag

SEQ ID NO: 324530 - DNA, 75 bp, Artificial Sequence
  Synthetic
ggataattgagagatactgggggtttgagatggccaaaatgccaggctttgacttgcattgccgctttaatgaag

SEQ ID NO: 324531 - DNA, 75 bp, Artificial Sequence
  Synthetic
aaggtgactccagatacatgacacatgagaatgccatgaaacagattaagattgtcacaacagctccagacacca

SEQ ID NO: 324532 - DNA, 75 bp, Artificial Sequence
  Synthetic
tgaagttctcctgcagagatgagacagagtctttagggctatccataacaaatgatgggacaaaaaatatgatgg

SEQ ID NO: 324533 - DNA, 75 bp, Artificial Sequence
  Synthetic
ggcctgccattatttactgtgataccaaagaatttattaggaatataactacaggtgagcagcctccaagagttg

SEQ ID NO: 324534 - DNA, 75 bp, Artificial Sequence
  Synthetic
attatgagaagctaaagaagaacgcagaagagaaagatgctactattcagagaaagaccaaagagatggaggagg

SEQ ID NO: 324535 - DNA, 75 bp, Artificial Sequence
  Synthetic
tgagagccgttctagattccaggatccaaatagcacaccatgagatccagcagaaggagaatgaaatccaaaagc

SEQ ID NO: 324536 - DNA, 75 bp, Artificial Sequence
  Synthetic
taagaaatgaccttagagatgctattaagaagggccaagagcatgagtcaatgaaactcagagttgaggagtctg

SEQ ID NO: 324537 - DNA, 75 bp, Artificial Sequence
  Synthetic
atgctagggtgaggggtctgaaggaagagctgaagcaattgacttacaaaatctttgaccaccaagcgacaaaag

SEQ ID NO: 324538 - DNA, 75 bp, Artificial Sequence
  Synthetic
atgagcttcaacgtgctaaatcagagatgcaatccctgagaaagaagattaaggactttgagtctgttccccagg

SEQ ID NO: 324539 - DNA, 75 bp, Artificial Sequence
  Synthetic
caaaaaaaccaagcaacagctctgttgcacttgtaaccacagcagtgttgtcactattaggatcctcaatggctg

SEQ ID NO: 324540 - DNA, 75 bp, Artificial Sequence
  Synthetic
cttctcctgaagcaggtatgaatgcagctatacacataaataatagaccaggccttgggaagtttgccctgctaa

SEQ ID NO: 324541 - DNA, 75 bp, Artificial Sequence
  Synthetic
caacaggaactgaggatgagcattgtaaaaagatcgattatggcgtcacctgcagtagatttgaccatttgaagt

SEQ ID NO: 324542 - DNA, 75 bp, Artificial Sequence
  Synthetic
ctctggataggtaccctttcttcaattcacactatcatcacagagcactattagaagcacactatgataacattg

SEQ ID NO: 324543 - DNA, 75 bp, Artificial Sequence
  Synthetic
tgaaggtgagttctactacctcctgtaatgagacaaaattcaaagatgctgagtgctccaaagaaatcaggaaat

SEQ ID NO: 324544 - DNA, 75 bp, Artificial Sequence
  Synthetic
tggcttacaagtgcccaagaggagtttcagggataatatatgctgactctaaaggggaaattggaggcatctact

SEQ ID NO: 324545 - DNA, 75 bp, Artificial Sequence
  Synthetic
gtaaggaaaatgaggaattaatggagaactgcatccaatgcaggaaagtgcagaggaagaagccccagaaaggtc

SEQ ID NO: 324546 - DNA, 75 bp, Artificial Sequence
  Synthetic
ttctgatgcagctgcaagatatggtgtgccagccagactcaattgattacactggccccaaacaaattctaaaag

SEQ ID NO: 324547 - DNA, 75 bp, Artificial Sequence
  Synthetic
gttactgcaagataggaatggttaattacaggcattgtgagcatttcgccagcatggaggaggttgttcctttcg

SEQ ID NO: 324548 - DNA, 75 bp, Artificial Sequence
  Synthetic
cgatattcaagaacaaagggaagctatacatggatagtatgagaattaggaataaggatgtcctagagaaagaga

SEQ ID NO: 324549 - DNA, 75 bp, Artificial Sequence
  Synthetic
acttcatttgttatggagcaaaggagaatgcagatgctgattcttcaaatcatgggggcaaagtttcagtgaagg

SEQ ID NO: 324550 - DNA, 75 bp, Artificial Sequence
  Synthetic
tcacagagtgtaagaatgttgatccatcacaaagcaagatctgctctggtgatagcactttctgttccaagtttg

SEQ ID NO: 324551 - DNA, 75 bp, Artificial Sequence
  Synthetic
gatagcactttctgttccaagtttgcatgtgacaatgagttgcctgaggtccattgtgaagtggctccgggagct

SEQ ID NO: 324552 - DNA, 75 bp, Artificial Sequence
  Synthetic
ggcccaatcgaggtctattacggaggagtctggatacagcccatgtgcttagggtatgagagggctgtggtgttg

SEQ ID NO: 324553 - DNA, 75 bp, Artificial Sequence
  Synthetic
agagaaatgccacctccagtcgaaacctcagaagacacttgtgacagctgctactctgagtgcttagacagtcat

SEQ ID NO: 324554 - DNA, 75 bp, Artificial Sequence
  Synthetic
atacttgtcaggtctaccgggttcatgatatctggtgcagtggcatgctctcacggagcatgcacttcgctaact

SEQ ID NO: 324555 - DNA, 75 bp, Artificial Sequence
  Synthetic
ataatgccttcaactgagataatgatcccttatcctggtatggcgtcatcaattggtggtgacattgggatacac

SEQ ID NO: 324556 - DNA, 75 bp, Artificial Sequence
  Synthetic
ttgtctcatgatgaggttcaagtcagttcacattatagagttcactgtgagcctaaagatccatgtgttgctcac

SEQ ID NO: 324557 - DNA, 75 bp, Artificial Sequence
  Synthetic
tcttgtgtcatttgtgctgagggagtcatcaactaccagtgccacacagccctaagcgcattcgttgttgtaaca

SEQ ID NO: 324558 - DNA, 75 bp, Artificial Sequence
  Synthetic
ttggtagtgctagttgtcttgatgtctctaattgtgttgaagaggtgtttagtgttgttcagggtggcacctgcc

SEQ ID NO: 324559 - DNA, 75 bp, Artificial Sequence
  Synthetic
gtcttgctgattcccttttcatggataatcaagctggcatgctggacatctaggaagttgaaattaagtactgaa

SEQ ID NO: 324560 - DNA, 75 bp, Artificial Sequence
  Synthetic
agaagaatagccagaataaatgaagaaattggatggaggccagaggaagccagggctacacataggatgagagac

SEQ ID NO: 324561 - DNA, 75 bp, Artificial Sequence
  Synthetic
agagacagaaggcctatacctaggtcagcagtttacctggcaatcctgttccttatcagtgtgacaagcgcatgt

SEQ ID NO: 324562 - DNA, 75 bp, Artificial Sequence
  Synthetic
tcggatcacaccattgcgagctcaaagatagtcaaatgtgttgctaagggttctaaaagtgtttgcactatctca

SEQ ID NO: 324563 - DNA, 75 bp, Artificial Sequence
  Synthetic
ggactggtcaatgtaaaggcaggtcctattggctctgagacttgtgttactttaaaaggacctgactcagctgac

SEQ ID NO: 324564 - DNA, 75 bp, Artificial Sequence
  Synthetic
aagaaattcctgaccatcaagaccattgccagtgagttgatctgctcagaaggtcagtcttactggacaagtcag

SEQ ID NO: 324565 - DNA, 75 bp, Artificial Sequence
  Synthetic
tatggagttgaatgtttaagctcaagaagatgccatggggtcgccgaatgcaaaggtgatgcttgccagaggtgg

SEQ ID NO: 324566 - DNA, 75 bp, Artificial Sequence
  Synthetic
aacaacactcttgtctcaagagaatttcaggggataaccaacaattcagtcatttctgaaaacagatgcatcgaa

SEQ ID NO: 324567 - DNA, 75 bp, Artificial Sequence
  Synthetic
caatgcggaggggttggctgtgcttgcttcagtgtttatgcctcatgtctatttgtccatgctagactaagagca

SEQ ID NO: 324568 - DNA, 75 bp, Artificial Sequence
  Synthetic
acaaagagagaagcaataaaagtcttcaattgcattgactggagccatagactggtccttgaaatcaccgacttc

SEQ ID NO: 324569 - DNA, 75 bp, Artificial Sequence
  Synthetic
aatgggaaaaaggaaaaagtctcaatgacgggcatgacaacacaattcttcagctggggttccatgactctagcc

SEQ ID NO: 324570 - DNA, 75 bp, Artificial Sequence
  Synthetic
ctagattttgagggtataaccggaacaaactcatacagctttctcaggtcttcttcaggagccttctccctggtt

SEQ ID NO: 324571 - DNA, 75 bp, Artificial Sequence
  Synthetic
gatgaggccatgtctatggaacctagaagaggcttcctaggggaaattagatgttcttcagaagcagccgctctc

SEQ ID NO: 324572 - DNA, 75 bp, Artificial Sequence
  Synthetic
acagctcacaaaagctgtattgtagcacctgacattatccggtacaaaccaatgactgacattgtggattgttcc

SEQ ID NO: 324573 - DNA, 75 bp, Artificial Sequence
  Synthetic
acttctctcattgatccatttgcagtgttcttgcgaggggctttaccacagaccaggaatgggaagacatttagt

SEQ ID NO: 324574 - DNA, 75 bp, Artificial Sequence
  Synthetic
agctctatagacaaaaagactatacaggcattcacctctggcattgtgcatgcctctatgtctctgagctttgac

SEQ ID NO: 324575 - DNA, 75 bp, Artificial Sequence
  Synthetic
aactttgaagttgagttcgaagaggagagggtttcttgcctggccagctttgtcaacatcacaggctgctattct

SEQ ID NO: 324576 - DNA, 75 bp, Artificial Sequence
  Synthetic
tgtaatgagggtgccagagtgtgtatacaggcagcagcagacaaaaacacaacactccacgtacatactttggac

SEQ ID NO: 324577 - DNA, 75 bp, Artificial Sequence
  Synthetic
aactcactaactatagtgatggatgtttttagtcctaagtccactgactgtagagttgtccacctttctacacct

SEQ ID NO: 324578 - DNA, 75 bp, Artificial Sequence
  Synthetic
caagtcaaaatggatgtggtttatagttgcgatggttactacaaggccatgtctattgttggaaccttggtagca

SEQ ID NO: 324579 - DNA, 75 bp, Artificial Sequence
  Synthetic
atgaacccttttgatgatagaagacatgaagagacaaattctgttgttgtcaaccctaaaactggcagatgggac

SEQ ID NO: 324580 - DNA, 75 bp, Artificial Sequence
  Synthetic
ttctccaattgggcatctggcttggtagactggcttggggggccactaaggacagcaggcgtaatacttggctat

SEQ ID NO: 324581 - DNA, 75 bp, Artificial Sequence
  Synthetic
ataatactggcaattgtattcttagttgtgctggtgctgtgtgtgccaaaattggtggggttgattagaactgcc

SEQ ID NO: 324582 - DNA, 75 bp, Artificial Sequence
  Synthetic
ctgctcaagaaaaagctgtaagtaaacttgcatccaaagagatggaacatttatcttgcaacagaaaaccaaaat

SEQ ID NO: 324583 - DNA, 75 bp, Artificial Sequence
  Synthetic
aaaaacagaaaaccaaaaaacaaaataagataataaaatatcaaaaaaacaaaaaaacaaaagacaacaagatgg

SEQ ID NO: 324584 - DNA, 75 bp, Artificial Sequence
  Synthetic
tgggaggtgaggggtaattggtggtgtgctcagatttctcaaattaggattggtggtgggtttagggtgggtgag

SEQ ID NO: 324585 - DNA, 75 bp, Artificial Sequence
  Synthetic
cagcgggatagtctgagtggcattgccaaccgcagtgcccaacagttttgattacaacatgagagtgaggactgt

SEQ ID NO: 324586 - DNA, 75 bp, Artificial Sequence
  Synthetic
ctttcagctgcataattgatcgaaaatgttgttggtggtttagtttatcattagggaatcatgcaccagtctttg

SEQ ID NO: 324587 - DNA, 75 bp, Artificial Sequence
  Synthetic
tcagctgcataattgatcgaaaatgttgttggtggtttagtttatcattagggaatcatgcaccagtctttgtgt

SEQ ID NO: 324588 - DNA, 75 bp, Artificial Sequence
  Synthetic
acacaaaggtccctagttaatctgagtgagctgagtttgaaatggacgagtaccagaaaattgctgttgaatttg

SEQ ID NO: 324589 - DNA, 75 bp, Artificial Sequence
  Synthetic
gagagcaggctattgatgaggctgtgatccaggattggctgcaagcatttgcatatcaagggtttgatgccagaa

SEQ ID NO: 324590 - DNA, 75 bp, Artificial Sequence
  Synthetic
caatcattcaaaaccttgtacaacttggaggaaaaagctgggaagaggatgcaaaaaagatgatcatcctgtccc

SEQ ID NO: 324591 - DNA, 75 bp, Artificial Sequence
  Synthetic
taactcgtggcaataagcccaagaagatggttgagagaatgtctccagaaggagcaagagaagttaagagcctgg

SEQ ID NO: 324592 - DNA, 75 bp, Artificial Sequence
  Synthetic
ttgcaaagtataaaatagtagagggcaggccaggcaggaatggcatcaccctgtcacgggtggctgcagccctgg

SEQ ID NO: 324593 - DNA, 75 bp, Artificial Sequence
  Synthetic
ctgggtggacagttcaagccgtagaagtggtagagaacttcttgccagtcccagggagcacaatggaccgtatgt

SEQ ID NO: 324594 - DNA, 75 bp, Artificial Sequence
  Synthetic
gtgggcaaacataccccaggcagatgatgcatccaagctttgccggtctcattgacccaagccttgaccaggagg

SEQ ID NO: 324595 - DNA, 75 bp, Artificial Sequence
  Synthetic
acttcaatgcagtgttggatgctcacaagcttttcttgctcatgttctccaagacaatcaatgtcagccttcgtg

SEQ ID NO: 324596 - DNA, 75 bp, Artificial Sequence
  Synthetic
gtgcgcagaagagagacattgaggaatcattttctcaaccaatgcttgctgccatcaatagctcattcattgaca

SEQ ID NO: 324597 - DNA, 75 bp, Artificial Sequence
  Synthetic
acacccagaggagggcatttttgacaaaatttgggatcctaacttctggagcaagagccacagcagttgtgaaga

SEQ ID NO: 324598 - DNA, 75 bp, Artificial Sequence
  Synthetic
agattgcagaagcttataggaaactggagtaagctgctgctaatgtggggtgggatggggattctaggtagaggg

SEQ ID NO: 324599 - DNA, 75 bp, Artificial Sequence
  Synthetic
ttctggggtggggggtagctgggtggggagggtagcaagggtgggttgggtctgggattgggtctggggtggggt

SEQ ID NO: 324600 - DNA, 75 bp, Artificial Sequence
  Synthetic
tgtagggaggggtgggtttggggctgggcagcggaaatcaaaagtcagagtcagatgagctctcatcattttcat

SEQ ID NO: 324601 - DNA, 75 bp, Artificial Sequence
  Synthetic
ctacatgactatgtattggggtccaaagagaattgccatattcagtaagactagcagaagggtcacttgctctat

SEQ ID NO: 324602 - DNA, 75 bp, Artificial Sequence
  Synthetic
aagatctaatcactgttctgatgtcaagtgcctccccagagaaggcagtgtcaaaaggctctgcattgataagcc

SEQ ID NO: 324603 - DNA, 75 bp, Artificial Sequence
  Synthetic
tgagacaaaccagagatcctatctctctaaacagatcgtacccattataatgctcatcactgagacccaaccttc

SEQ ID NO: 324604 - DNA, 75 bp, Artificial Sequence
  Synthetic
tagcttcttgcagtatcttcttatgtgcctgaactatacactcatccaggctgtgtgaatctcccattctcagaa

SEQ ID NO: 324605 - DNA, 75 bp, Artificial Sequence
  Synthetic
tgtaagacattagttgatctcttgtttgtagacctcttacaaacctatcactgcatatgctgaaaatctcacagt

SEQ ID NO: 324606 - DNA, 75 bp, Artificial Sequence
  Synthetic
cggggatacctagtggccagctgagagctttcagaacatttggcaaccctctcctagaaaagcttgtaagatcaa

SEQ ID NO: 324607 - DNA, 75 bp, Artificial Sequence
  Synthetic
atctagagaggtcacttgccatgccttggaaggtgtacaccataggctttacagaactgatgtagcatgctgggc

SEQ ID NO: 324608 - DNA, 75 bp, Artificial Sequence
  Synthetic
cccaagaagctggcaactctccaagagagtaaaagtcagacagtgagcttctgcgtccaaacccaagtcttaact

SEQ ID NO: 324609 - DNA, 75 bp, Artificial Sequence
  Synthetic
tctctagtggtatttcacaatgctcatacgttgaaacgtcatgagtgtggaacttattgtgagcaacataagaca

SEQ ID NO: 324610 - DNA, 75 bp, Artificial Sequence
  Synthetic
taattgccgggtagtcaaacatgtactggctgttcatcatgttgttgttgatcattgactagggggtctttgtgt

SEQ ID NO: 324611 - DNA, 75 bp, Artificial Sequence
  Synthetic
tgatacacacatgatgaacagccaatacatgtttgactacccggcaattaacattgatgtgaggtgtcatagact

SEQ ID NO: 324612 - DNA, 75 bp, Artificial Sequence
  Synthetic
tacatgtttgactacccggcaattaacattgatgtgaggtgtcatagactcctctccagtgtgtcttatgttgct

SEQ ID NO: 324613 - DNA, 75 bp, Artificial Sequence
  Synthetic
cacaataagttccacactcatgacgtttcaacgtatgagcattgtgaaataccactagagaagttaagacttggg

SEQ ID NO: 324614 - DNA, 75 bp, Artificial Sequence
  Synthetic
accactagagaagttaagacttgggtttggacgcagaagctcactgtctgacttttactctcttggagagttacc

SEQ ID NO: 324615 - DNA, 75 bp, Artificial Sequence
  Synthetic
agcttcttggggcccagcatgctacatcagttctgttaagcctatggtgtacaccttccaaggcatggcaagtga

SEQ ID NO: 324616 - DNA, 75 bp, Artificial Sequence
  Synthetic
acaccttccaaggcatggcaagtgacctctctagatttgatcttacaagcttctctaggagagggttgccaaatg

SEQ ID NO: 324617 - DNA, 75 bp, Artificial Sequence
  Synthetic
ttctctaggagagggttgccaaatgttttgaaagcactcagctggccactaggtatccccgactgtgagatcttc

SEQ ID NO: 324618 - DNA, 75 bp, Artificial Sequence
  Synthetic
gagggctacaaacaagagatcagctaatgtcttacattctaagaatgggagattcacacagcctggatgagtgca

SEQ ID NO: 324619 - DNA, 75 bp, Artificial Sequence
  Synthetic
tagttcaggcacataagaagatactgcaagaagctagaaggttgggtctcagtgatgagcattataatggatacg

SEQ ID NO: 324620 - DNA, 75 bp, Artificial Sequence
  Synthetic
atctgtttagagagataggatctctggtttgtctcaggcttatcaatgcagagccttttgacactgccttttctg

SEQ ID NO: 324621 - DNA, 75 bp, Artificial Sequence
  Synthetic
gggaggcacttgatgtcagaacagtgattagatcttatagagcaagtgacccttctgctaccccaccccagatcc

SEQ ID NO: 324622 - DNA, 75 bp, Artificial Sequence
  Synthetic
aatcccagacccaacccacccttgctaccctccccacccagctaccccccaccccagaaccctctacctagaacc

SEQ ID NO: 324623 - DNA, 75 bp, Artificial Sequence
  Synthetic
cccatcccaccccacattagcagcagcttactctagtttcctataagcttctgcaatcttcttcacaactgctgt

SEQ ID NO: 324624 - DNA, 75 bp, Artificial Sequence
  Synthetic
ggctcttgctccagaagttaggatcccaaattttgtcaaaaatgccctcctctgggtgttgtcaatgaatgagct

SEQ ID NO: 324625 - DNA, 75 bp, Artificial Sequence
  Synthetic
gattgttttggaaaacatgagcaagaaaagcttgtgagcatccaacactgcattgaaatcctcctggtcaaggct

SEQ ID NO: 324626 - DNA, 75 bp, Artificial Sequence
  Synthetic
tgggtcaatgagaccggcaaaacttggatgcatcatctgcctggggtatgtttgcccacacatacggtccattgt

SEQ ID NO: 324627 - DNA, 75 bp, Artificial Sequence
  Synthetic
gctccctgggactggcaagaagttctcgaccacttctacggcttgaactgtccacccagccagggctgcagccac

SEQ ID NO: 324628 - DNA, 75 bp, Artificial Sequence
  Synthetic
tccacccagccagggctgcagccacccgtgacagggtgatgccattcctgcctggtctgccctctactattttat

SEQ ID NO: 324629 - DNA, 75 bp, Artificial Sequence
  Synthetic
cacgagttagggacaggatgatcatcttttttgcatcctcttcccagctttttcctccaagctgtacaaggtttt

SEQ ID NO: 324630 - DNA, 75 bp, Artificial Sequence
  Synthetic
tttcctccaagctgtacaaggttttgaatgattgttctggcatcaaacccttgatatgcaaatgcttgcagccaa

SEQ ID NO: 324631 - DNA, 75 bp, Artificial Sequence
  Synthetic
tcctggattacagcctcatcaatagcctgctctccaaattcaacagcaattttctggtactcgtccatttcaaac

SEQ ID NO: 324632 - DNA, 75 bp, Artificial Sequence
  Synthetic
agcaattttctggtactcgtccatttcaaactcagctcactcagattaactagggaactttgtgtcccccccccc

SEQ ID NO: 324633 - DNA, 75 bp, Artificial Sequence
  Synthetic
atacacacatgatgaacagccaatacatgtttgactacccggcaattaacattgatgtgaggtgtcatagactcc

SEQ ID NO: 324634 - DNA, 75 bp, Artificial Sequence
  Synthetic
gccttttgacactgccttttctggggaggcacttgatgtcagaacagtgattagatcttatagagcaagtgaccc

SEQ ID NO: 324635 - DNA, 75 bp, Artificial Sequence
  Synthetic
gaggcacttgatgtcagaacagtgattagatcttatagagcaagtgacccttctgctagtcttactgagtatggc

SEQ ID NO: 324636 - DNA, 75 bp, Artificial Sequence
  Synthetic
gtcatgtagatgaaaatgatgagagctcgtctgactctgacttttgatttccgctgcccagccccaaacccaccc

SEQ ID NO: 324637 - DNA, 75 bp, Artificial Sequence
  Synthetic
ctcgtctgactctgacttttgatttccgctgcccagccccaaacccacccctccctacaaccccaccccagaccc

SEQ ID NO: 324638 - DNA, 75 bp, Artificial Sequence
  Synthetic
caacagcaattttctggtactcgtccatttcaaactcagctcactcagattaactagggaactttgtgtcccccc

SEQ ID NO: 324639 - DNA, 75 bp, Artificial Sequence
  Synthetic
cacatgatgaacagccagtacatgtttgactacccggcaattaacattgatgtaaggtgtcatagactcctctcc

SEQ ID NO: 324640 - DNA, 75 bp, Artificial Sequence
  Synthetic
gagaagttgagacttgggtttggacgcagaaactcactgtctgacttttactctcttggagagctgccagcttct

SEQ ID NO: 324641 - DNA, 75 bp, Artificial Sequence
  Synthetic
aggtttgatcttacaagcttctctaggagagggttgccaaatgtcctgaaagctcttagctggccactaggtgtc

SEQ ID NO: 324642 - DNA, 75 bp, Artificial Sequence
  Synthetic
cccgactgtgagatcttcagcatatgcagtgatgggtttgtaagagggctacaaacaagagatcagctaatgtct

SEQ ID NO: 324643 - DNA, 75 bp, Artificial Sequence
  Synthetic
acaaacaagagatcagctaatgtcttacattctgagaatgggagattcacacagcctggatgagtgcatagttca

SEQ ID NO: 324644 - DNA, 75 bp, Artificial Sequence
  Synthetic
ggcacataaaaagatactgcaagaagctaggaggttgggtctcagtgatgagcattacaatggatacgatctgtt

SEQ ID NO: 324645 - DNA, 75 bp, Artificial Sequence
  Synthetic
cagagagataggatctctggtttgtctcaggctcattaatgcagagccttttgacactgccctctctggggaggc

SEQ ID NO: 324646 - DNA, 75 bp, Artificial Sequence
  Synthetic
acttgatgtcagaacagtgattagatcttatagagcaagagacccttctgctggtcttactgagtatggcaattc

SEQ ID NO: 324647 - DNA, 75 bp, Artificial Sequence
  Synthetic
gcccagccccaaacccacccctccccacaaccccatcccagatccaatcccagaccctacccacccttgctaccc

SEQ ID NO: 324648 - DNA, 75 bp, Artificial Sequence
  Synthetic
cagaccctacccacccttgctaccctccccacccagctatcccccaccccagaactctctacctagaatccccat

SEQ ID NO: 324649 - DNA, 75 bp, Artificial Sequence
  Synthetic
cccaccccacattagcagcagcttactctagtttcctataaacttctgcaatcttcttcacaactgctgtggctc

SEQ ID NO: 324650 - DNA, 75 bp, Artificial Sequence
  Synthetic
ttgctccagaagttaagatcccaaactttgtcaaaaatgccctcctctgggtgttgtcaataaatgagctattga

SEQ ID NO: 324651 - DNA, 75 bp, Artificial Sequence
  Synthetic
tagcagcaagcattggttgagagaatgattcctcaatatctctcttctgcgcaccacgaaggctgacattgattg

SEQ ID NO: 324652 - DNA, 75 bp, Artificial Sequence
  Synthetic
gcaccacgaaggctgacattgattgttttggaaaacatgagcaagaaaagcttgtgagcatccaacactgcattg

SEQ ID NO: 324653 - DNA, 75 bp, Artificial Sequence
  Synthetic
caatgagaccggcaaagcttggatgcatcatctgcctggggtatgtttgtccacacatgcgatccattgtgctcc

SEQ ID NO: 324654 - DNA, 75 bp, Artificial Sequence
  Synthetic
ctgggactggcaagaagttctcgaccacttccacggcttgaactgtccacccagccagggctgcagccacccgtg

SEQ ID NO: 324655 - DNA, 75 bp, Artificial Sequence
  Synthetic
ataaggtgatgccattcctgcctggtctgccctctactattttgtactttgcaaccaggctcttaacttcccttg

SEQ ID NO: 324656 - DNA, 75 bp, Artificial Sequence
  Synthetic
ccccctctggagacattctctcaaccatctttttgggcttattgccacgagttagggacaggatgatcatctttt

SEQ ID NO: 324657 - DNA, 75 bp, Artificial Sequence
  Synthetic
ttgcatcctcctcccagcttttccctccaagctgtacaaggttttgaatgattgttctggcatcaaacccttgat

SEQ ID NO: 324658 - DNA, 75 bp, Artificial Sequence
  Synthetic
tccaagctgtacaaggttttgaatgattgttctggcatcaaacccttgatatgcaaatgcttgtagccattcctg

SEQ ID NO: 324659 - DNA, 75 bp, Artificial Sequence
  Synthetic
caaattcaacagcaattttctggtactcgtccatttcaaactcagctcactcagattaactagggaactttgtgt

SEQ ID NO: 324660 - DNA, 75 bp, Artificial Sequence
  Synthetic
cccaaacgatgaatagccagtacatgttcgattatccgtcgatcaagatcgatgtgaggtgtcacagactcctgt

SEQ ID NO: 324661 - DNA, 75 bp, Artificial Sequence
  Synthetic
ccagtgtaacatacatggcctataacaaatttcactccacagatgtgatcacttatgagcactgtgagatcccac

SEQ ID NO: 324662 - DNA, 75 bp, Artificial Sequence
  Synthetic
caaatttcactccacagatgtgatcacttatgagcactgtgagatcccactagagaggtacaggattgggcacgg

SEQ ID NO: 324663 - DNA, 75 bp, Artificial Sequence
  Synthetic
acttatgagcactgtgagatcccactagagaggtacaggattgggcacggtagaaggagttccctgtctgaattc

SEQ ID NO: 324664 - DNA, 75 bp, Artificial Sequence
  Synthetic
tactccctgggtgaattgccgtcagcatggggtccagcttgctacatcagctctgtcaagcctatggtctacact

SEQ ID NO: 324665 - DNA, 75 bp, Artificial Sequence
  Synthetic
ttccaagggatggctagtgacttgtctcggtttgatatggctagtttctctaagagaggactgcctaacattctt

SEQ ID NO: 324666 - DNA, 75 bp, Artificial Sequence
  Synthetic
aaggcactcagctggcctttggagtgccctgattgtgagatttttgagatctgcaattcagagtacaggcgtggc

SEQ ID NO: 324667 - DNA, 75 bp, Artificial Sequence
  Synthetic
ttgcaaacaagagatcagctcatgtcttacttgcttagagttggggattccccaaatctggatgagtgtgttgtg

SEQ ID NO: 324668 - DNA, 75 bp, Artificial Sequence
  Synthetic
caggctcacaagaaggtcctactggaggctagaagactgggcctcagtgatgaacactataatggctatgatctt

SEQ ID NO: 324669 - DNA, 75 bp, Artificial Sequence
  Synthetic
aggctagaagactgggcctcagtgatgaacactataatggctatgatctttttaaagagattgggtctttagtat

SEQ ID NO: 324670 - DNA, 75 bp, Artificial Sequence
  Synthetic
gtcttagactcatcaatgctgagccctatgacactgctacatcaggagaacctcttgagataagaactattatca

SEQ ID NO: 324671 - DNA, 75 bp, Artificial Sequence
  Synthetic
cctcttgagataagaactattatcagatcctatcggatggatgacccttcactgagccttgatgcatatggaaac

SEQ ID NO: 324672 - DNA, 75 bp, Artificial Sequence
  Synthetic
tcccgatgggtgccaatagatagtcatattgatgagaatgatgacagttcttctgactcagacttctgattgccg

SEQ ID NO: 324673 - DNA, 75 bp, Artificial Sequence
  Synthetic
ctgccaaagaggcccccttatcattatccccccacccttctccccccaattaaccccttaaccccttaccattaa

SEQ ID NO: 324674 - DNA, 75 bp, Artificial Sequence
  Synthetic
ccccaaccccacgcccccaattaaccccaattacccccttaccattacccccctcccctcacccaccaatcactc

SEQ ID NO: 324675 - DNA, 75 bp, Artificial Sequence
  Synthetic
cccaattacccccttaccattacccccctcccctcacccaccaatcactcatccccaccatcaccaagcctaccc

SEQ ID NO: 324676 - DNA, 75 bp, Artificial Sequence
  Synthetic
caatgtggcagctactcactccagcttcctgtacacttctgcaatcttcttgaccactgcagtggcccttgctcc

SEQ ID NO: 324677 - DNA, 75 bp, Artificial Sequence
  Synthetic
ttcctgtacacttctgcaatcttcttgaccactgcagtggcccttgctccagaagtaattattccaaacttggtc

SEQ ID NO: 324678 - DNA, 75 bp, Artificial Sequence
  Synthetic
aggaaagccctcctctgtgtgttgtcaatgaaggagctgttgattgcggcaagcattggctgagagaatgattcc

SEQ ID NO: 324679 - DNA, 75 bp, Artificial Sequence
  Synthetic
tcaatgtctctcttggaggcccctcggaggttcacgttaatcgttttcgagaacatgtacaaaaacaatttgtgg

SEQ ID NO: 324680 - DNA, 75 bp, Artificial Sequence
  Synthetic
ggaggttcacgttaatcgttttcgagaacatgtacaaaaacaatttgtgggcatccagaattgcattaaagtctt

SEQ ID NO: 324681 - DNA, 75 bp, Artificial Sequence
  Synthetic
gcatccagaattgcattaaagtcttcctgatcaagagtggggtcaatcaggcctgcaaagcttgggtgcatcatc

SEQ ID NO: 324682 - DNA, 75 bp, Artificial Sequence
  Synthetic
tgtctggggtaggcttgcccgcacatcctgtccattgcactcccagggactggcaggaagttctccacgacctcg

SEQ ID NO: 324683 - DNA, 75 bp, Artificial Sequence
  Synthetic
acagcttggacagtccatcccgcaagggcagcagccaccctggatagagtgatgccatttctcccgggtctgcct

SEQ ID NO: 324684 - DNA, 75 bp, Artificial Sequence
  Synthetic
tccacgatcttgtacttcgctacgagactcttgacatcgcgggctccctcgggagacatcctctcaaccatcttc

SEQ ID NO: 324685 - DNA, 75 bp, Artificial Sequence
  Synthetic
tttggcttgtttccacgagtcaaggagagaattatcatcttcttagcatcttcctcccagcctttgcctcccagt

SEQ ID NO: 324686 - DNA, 75 bp, Artificial Sequence
  Synthetic
tgaaccaggttctggattattgtcctggcatcaaacccctgataagcaaaagcctgcaaccagtcctggatcaca

SEQ ID NO: 324687 - DNA, 75 bp, Artificial Sequence
  Synthetic
gtctcatcaatggcctgttctccaaactcaacggcaattttctggtactcgtccatttcagattttactaactca

SEQ ID NO: 324688 - DNA, 75 bp, Artificial Sequence
  Synthetic
ggcaattttctggtactcgtccatttcagattttactaactcagattaactagggacctttgtgtcccccccccc

SEQ ID NO: 324689 - DNA, 75 bp, Artificial Sequence
  Synthetic
ctgtcaagggtgctgcagccctggctgggtggacagtccaagctgtggaagtggttgaaaacttcttaccagtcc

SEQ ID NO: 324690 - DNA, 75 bp, Artificial Sequence
  Synthetic
tgggtggacagtccaagctgtggaagtggttgaaaacttcttaccagtcccagggagcacaatggaccgcattgt

SEQ ID NO: 324691 - DNA, 75 bp, Artificial Sequence
  Synthetic
gggggtggcaagggtggattcggtttgggttggggtcatggggaggggtgggtctggggctgggcagcggagatc

SEQ ID NO: 324692 - DNA, 75 bp, Artificial Sequence
  Synthetic
acttatgagcactgtgagatcccactagagaggtacaggatcgggcacggtagaaggagttccctgtctgaattt

SEQ ID NO: 324693 - DNA, 75 bp, Artificial Sequence
  Synthetic
aaggcactcagttggcctttggagtgccctgattgtgagatttttgagatctgcaactcagagtacaggcgtggt

SEQ ID NO: 324694 - DNA, 75 bp, Artificial Sequence
  Synthetic
aggctagaagactgggcctcagtgatgaacactataatggctatgatctttttaaagagattggatctttagtgt

SEQ ID NO: 324695 - DNA, 75 bp, Artificial Sequence
  Synthetic
cctcttgagataagaactattatcagatcctatcggatggatgacccctcactaagccttaatgcatatggaaac

SEQ ID NO: 324696 - DNA, 75 bp, Artificial Sequence
  Synthetic
ttctgactcagacttctgattgccgctgccaatcacccatccccaccatcaccaagcccaccccaatgtggcagc

SEQ ID NO: 324697 - DNA, 75 bp, Artificial Sequence
  Synthetic
tgctcactccagcttcctgtacacttctgcaatcttcttgaccactgcagtggcccttgctccagaagtaattac

SEQ ID NO: 324698 - DNA, 75 bp, Artificial Sequence
  Synthetic
cccaaacttggtcaggaaagccctcctctgtgtgttgtcaatgaaggagctgttgattgcggcaagcattggctg

SEQ ID NO: 324699 - DNA, 75 bp, Artificial Sequence
  Synthetic
gcgttaaagtcttcctgatcaagagtgggatcaatcaggcctgcaaagcttgggtgcatcatctgtctggggtag

SEQ ID NO: 324700 - DNA, 75 bp, Artificial Sequence
  Synthetic
gcttgtccacacatcctgtccattgcactcccagggactggtaggaagttctccacaacctcgacagcttggaca

SEQ ID NO: 324701 - DNA, 75 bp, Artificial Sequence
  Synthetic
cagcaattttctggtactcgtccatttcagattttactaactcagattaactagggaactttgtgtccccccccc

SEQ ID NO: 324702 - DNA, 75 bp, Artificial Sequence
  Synthetic
acacaaagaacccccaaaaaaggaaagacgcaaaggagtgatcatgtcagagtggtccaggattgcagtggagtt

SEQ ID NO: 324703 - DNA, 75 bp, Artificial Sequence
  Synthetic
agacgcaaaggagtgatcatgtcagagtggtccaggattgcagtggagtttggtgagcagcagctcaatttgact

SEQ ID NO: 324704 - DNA, 75 bp, Artificial Sequence
  Synthetic
agtggtccaggattgcagtggagtttggtgagcagcagctcaatttgactgagcttgaagattttgcgagagagc

SEQ ID NO: 324705 - DNA, 75 bp, Artificial Sequence
  Synthetic
atctccacctgtctccttcagcttcttgatgatcaaagcaggatcaaggccttcataggccagctctctcgcgaa

SEQ ID NO: 324706 - DNA, 75 bp, Artificial Sequence
  Synthetic
tggtgagcagcagctcaatttgactgagcttgaagattttgcgagagagctggcctatgaaggccttgatcctgc

SEQ ID NO: 324707 - DNA, 75 bp, Artificial Sequence
  Synthetic
ccatgcacatcatctcagggggataattctcgaccttcaggttcatgacggctggccccacagggagatactcct

SEQ ID NO: 324708 - DNA, 75 bp, Artificial Sequence
  Synthetic
atcctcaagctcagtcaaattgagctgctgctcaccaaactccactgcaatcctggaccactctgacatgatcac

SEQ ID NO: 324709 - DNA, 75 bp, Artificial Sequence
  Synthetic
tgctgctcaccaaactccactgcaatcctggaccactctgacatgatcactcctttgcgtctttccttttttggg

SEQ ID NO: 324710 - DNA, 75 bp, Artificial Sequence
  Synthetic
tggcctatgaaggccttgatcctgctttgatcatcaagaagctgaaggagacaggtggagatgattgggtgaggg

SEQ ID NO: 324711 - DNA, 75 bp, Artificial Sequence
  Synthetic
actggaggtgaacccaccagagcaaaggattggtcaatgcactggctgccatctagaatgcataaatgggggtgt

SEQ ID NO: 324712 - DNA, 75 bp, Artificial Sequence
  Synthetic
cacttgtgcacaagcctggggaagtcgttgtgtcatatggagggatgcgtgtcagaccaaagtgctatggtttct

SEQ ID NO: 324713 - DNA, 75 bp, Artificial Sequence
  Synthetic
aaccaaactacaggtatacctcctcaggaagcatctggattgcatggtgcgaattgcatctcagccattcagcct

SEQ ID NO: 324714 - DNA, 75 bp, Artificial Sequence
  Synthetic
ccaagagaaatatgggctggttgagagggcagaaaccaggctctcaatcactcctgtgagggttgcacagagcct

SEQ ID NO: 324715 - DNA, 75 bp, Artificial Sequence
  Synthetic
ttagaccctgagtttgacatcttccctgatgccttgacgatcttattgcctcgagtcagggcaaagacaatgatg

SEQ ID NO: 324716 - DNA, 75 bp, Artificial Sequence
  Synthetic
ctcctgtgagggttgcacagagccttcccacttggacatgtgctgcagcagcagccctaaaggagtatctcccag

SEQ ID NO: 324717 - DNA, 75 bp, Artificial Sequence
  Synthetic
tgctcaccaaactccactgcaatcctggaccactctgacatgatcactcctttgcgtctttccttttttgggggt

SEQ ID NO: 324718 - DNA, 75 bp, Artificial Sequence
  Synthetic
tccatgtcaaaggggcattggtagatggaactgaattcacatttgagggtagttgcatgttcccagatggatgta

SEQ ID NO: 324719 - DNA, 75 bp, Artificial Sequence
  Synthetic
tggggccagctgtcatgaacctgaaggtcgagaattatccccctgagatgatgtgcatggcctttgggtccctga

SEQ ID NO: 324720 - DNA, 75 bp, Artificial Sequence
  Synthetic
ggtcgagaattatccccctgagatgatgtgcatggcctttgggtccctgattccaactgcaggggtatctgaagc

SEQ ID NO: 324721 - DNA, 75 bp, Artificial Sequence
  Synthetic
ctgctcaccaaactccactgcaattctggaccactctgacatgatcactcctttgcgtctttccttttttggggg

SEQ ID NO: 324722 - DNA, 75 bp, Artificial Sequence
  Synthetic
agggcagaaaccaggctctcaatcactcctgtgagggttgcacagagccttcccacttggacatgtgctgcagca

SEQ ID NO: 324723 - DNA, 75 bp, Artificial Sequence
  Synthetic
atgtgcatggcctttgggtccctgattccaactgcaggggtatctgaagccacaacgaagaccctgatggaggcc

SEQ ID NO: 324724 - DNA, 75 bp, Artificial Sequence
  Synthetic
atgagactgttgccaaccctaggctcaagaattctatcatagagaaccatgggctgaagtcagcccgcagtcttg

SEQ ID NO: 324725 - DNA, 75 bp, Artificial Sequence
  Synthetic
tgtagtctcgtcaggaggggttctgtccaacatgcccttgactcaggatgaggcagaggagctcatgtacaggtt

SEQ ID NO: 324726 - DNA, 75 bp, Artificial Sequence
  Synthetic
caatgatgttcgggtgaagtggctgaaggccaagggaatccttggcccagatggggtccccagcagagctgctga

SEQ ID NO: 324727 - DNA, 75 bp, Artificial Sequence
  Synthetic
aaggccaagggaatccttggcccagatggggtccccagcagagctgctgaggttgctgctgctgcttacagaaac

SEQ ID NO: 324728 - DNA, 75 bp, Artificial Sequence
  Synthetic
atggggtccccagcagagctgctgaggttgctgctgctgcttacagaaacctgtaagcagcaatttgacatatcc

SEQ ID NO: 324729 - DNA, 75 bp, Artificial Sequence
  Synthetic
taggggaaggcaagtgatccatgaggaaataggggagaatggggagggcaaccaagatgatgttaggattgagat

SEQ ID NO: 324730 - DNA, 75 bp, Artificial Sequence
  Synthetic
ccattctagcaatagggcttgctgagggctgtgatgagatggtccatgctgattctaaacttgtttcatgcagac

SEQ ID NO: 324731 - DNA, 75 bp, Artificial Sequence
  Synthetic
gattctaaacttgtttcatgcagacaagggagcggaaatatgaaggaatgcatcacaactgggagggcgcttctt

SEQ ID NO: 324732 - DNA, 75 bp, Artificial Sequence
  Synthetic
cagttctcagctcttcatcaaacctgatgaggttgtggaatgggcacctattcaaatagtgtgccatcagatatg

SEQ ID NO: 324733 - DNA, 75 bp, Artificial Sequence
  Synthetic
tgggagggcgcttcttccttcggtgaatccaggacaagaggcgtgtctgcacttcacggcacctgggagtccgga

SEQ ID NO: 324734 - DNA, 75 bp, Artificial Sequence
  Synthetic
gatgaggttgtggaatgggcacctattcaaatagtgtgccatcagatatgggtaaccttgaaggaccccaggctc

SEQ ID NO: 324735 - DNA, 75 bp, Artificial Sequence
  Synthetic
ttcaaatagtgtgccatcagatatgggtaaccttgaaggaccccaggctcatcatcctcatccaggacactgtat

SEQ ID NO: 324736 - DNA, 75 bp, Artificial Sequence
  Synthetic
atcatcctcatccaggacactgtatgagccatctgtcttctttttgcggatgggaataaagaagtcccaacagtc

SEQ ID NO: 324737 - DNA, 75 bp, Artificial Sequence
  Synthetic
ttcatcaccaagaccctcaaagcaaaagaggtagaggcctatgctgatctttgtgacagccactacctaaagcct

SEQ ID NO: 324738 - DNA, 75 bp, Artificial Sequence
  Synthetic
acaggtggagatgattgggtgagggacacaaagttcatcattgtctttgccctgactcgaggcaacaagatcgtc

SEQ ID NO: 324739 - DNA, 75 bp, Artificial Sequence
  Synthetic
acatcagtgaggagatgtcgttgggcgggagactgccagtctgggtgcccccctcatttcacatccaactccttt

SEQ ID NO: 324740 - DNA, 75 bp, Artificial Sequence
  Synthetic
gagccatctgtcttctttttgcggatgggaataaagaagtcccaacagtctaacagaggcttgcgcaatgaggaa

SEQ ID NO: 324741 - DNA, 75 bp, Artificial Sequence
  Synthetic
tcatgcctcttagccttgcaagtgactctatctggaggagggccacatccagaattggggatagtccagttatta

SEQ ID NO: 324742 - DNA, 75 bp, Artificial Sequence
  Synthetic
gaggcagaggagctcatgtacaggttctgcatagccaatgagatctacactaaggctagatctatggatgcagac

SEQ ID NO: 324743 - DNA, 75 bp, Artificial Sequence
  Synthetic
tgcccggtccaggtgtacatcagtgaggagatgtcgttgggcgggagactgccagtctgggtgcccccctcattt

SEQ ID NO: 324744 - DNA, 75 bp, Artificial Sequence
  Synthetic
ccttcgcttctctatggcttcaagagaatccaatatcatgtccccttcaaaaagatacttttggccttttgttat

SEQ ID NO: 324745 - DNA, 75 bp, Artificial Sequence
  Synthetic
ggtggagaatccacatgggatcatctggaaagtgtctccatgcgccgcatgggtcccatcagcagttatagagct

SEQ ID NO: 324746 - DNA, 75 bp, Artificial Sequence
  Synthetic
tccctaattcagaaatcgagatgctggaacagtttctctcaacaccagctgatgttgacttcatcaccaagaccc

SEQ ID NO: 324747 - DNA, 75 bp, Artificial Sequence
  Synthetic
tctctaccggtttccattgcccagctgttcttgatggagaagaacatgtgagctgcctgtaggaaccatacagat

SEQ ID NO: 324748 - DNA, 75 bp, Artificial Sequence
  Synthetic
cagtgaccctgcaaaagaacttgacattgccatctctgatgatccagaaaaagatacccccaaagaggcaaagat

SEQ ID NO: 324749 - DNA, 75 bp, Artificial Sequence
  Synthetic
ggcttcccactaggccacctaagagcactcagctctctctgggagtagcacctcatgtccttgtagtacatgtcc

SEQ ID NO: 324750 - DNA, 75 bp, Artificial Sequence
  Synthetic
tgttcttgatggagaagaacatgtgagctgcctgtaggaaccatacagatggcttcccactaggccacctaagag

SEQ ID NO: 324751 - DNA, 75 bp, Artificial Sequence
  Synthetic
cactctgtcaagttcttgaaccctttgtttgggatttactcatcagagaaatcaacagtgaacacagtgtattgt

SEQ ID NO: 324752 - DNA, 75 bp, Artificial Sequence
  Synthetic
tctgtgcaaccctcacaggagtgattgagagcctggtttctgccctctcaaccagcccatatttctcttggagtg

SEQ ID NO: 324753 - DNA, 75 bp, Artificial Sequence
  Synthetic
gccaaataaccatactgtgttggtcatcttgcccatcctcttgaccattgatagagtcaacacactacaagagca

SEQ ID NO: 324754 - DNA, 75 bp, Artificial Sequence
  Synthetic
atcttgcccatcctcttgaccattgatagagtcaacacactacaagagcattcaacgaggtctctcctaagagtg

SEQ ID NO: 324755 - DNA, 75 bp, Artificial Sequence
  Synthetic
aggttggagagatacagtgcagtagcgaggagagtgcccgtaccataaaaaaagatgggtgcatatggaatgcag

SEQ ID NO: 324756 - DNA, 75 bp, Artificial Sequence
  Synthetic
ttcaacgaggtctctcctaagagtggggtactctcctagagatggctcaagcctgacagtgttggcattcattgc

SEQ ID NO: 324757 - DNA, 75 bp, Artificial Sequence
  Synthetic
aggaagcatctggattgcatggtgcgaattgcgtctcagccattcagcctaatccctagagaggggagggtagag

SEQ ID NO: 324758 - DNA, 75 bp, Artificial Sequence
  Synthetic
gggtactctcctagagatggctcaagcctgacagtgttggcattcattgcaacagatttgaggtcaacgttggag

SEQ ID NO: 324759 - DNA, 75 bp, Artificial Sequence
  Synthetic
aagtcatctggttctcctctctgatctgcttagtcattcgatgcagtgggggcacgggcccaatcatatgcgcag

SEQ ID NO: 324760 - DNA, 75 bp, Artificial Sequence
  Synthetic
tgagtaaagggcatgtggtgcctcgggtggtggcagcaggagtataccttctctcacgccactgctttcgcttta

SEQ ID NO: 324761 - DNA, 75 bp, Artificial Sequence
  Synthetic
agaggccttcgattaagtctctcagaaattactgctacttgcacaggggaggtgacaaatgtgagtgggtgttat

SEQ ID NO: 324762 - DNA, 75 bp, Artificial Sequence
  Synthetic
ggcccatccactcaaacaagagtgccaacataccccacctgcttggttactctgagaagatttgtcagatagatc

SEQ ID NO: 324763 - DNA, 75 bp, Artificial Sequence
  Synthetic
gtataagaagattgtggagatggaagaggacaagcccagcagccctgagtttctagggtggggggacacagattc

SEQ ID NO: 324764 - DNA, 75 bp, Artificial Sequence
  Synthetic
ccctaagaagcatgaattctcacggagcttcctcagagctgcttgctcatctctagagagagaaattgctcagcg

SEQ ID NO: 324765 - DNA, 75 bp, Artificial Sequence
  Synthetic
ccatcaagttgcatagcagcaaaaatagcactgcccatgttagatgcaaaggggatgagactgcattcagtgtct

SEQ ID NO: 324766 - DNA, 75 bp, Artificial Sequence
  Synthetic
ggtggtggcagcaggagtataccttctctcacgccactgctttcgctttagctcaagcattcatggcaggggctc

SEQ ID NO: 324767 - DNA, 75 bp, Artificial Sequence
  Synthetic
ccctaatcaggagcgaatgctcttccctcaggctcaagagtatgacagagtatgcacattgcttgaggaagttga

SEQ ID NO: 324768 - DNA, 75 bp, Artificial Sequence
  Synthetic
ttttccaaagactgggagctctactcagaagtccagaccaaagagtaccataggtccaaactgctggagaagatg

SEQ ID NO: 324769 - DNA, 75 bp, Artificial Sequence
  Synthetic
aggatgggccttcctgaagactgggtagaacagatagacgagaatcctggagtcctttacaggagggctgctaac

SEQ ID NO: 324770 - DNA, 75 bp, Artificial Sequence
  Synthetic
aaactcttactcaaggtggagtggacttctaagcccctgtgatgctgattggcttgggatgcttgtcgtgaagaa

SEQ ID NO: 324771 - DNA, 75 bp, Artificial Sequence
  Synthetic
tagcactgcccatgttagatgcaaaggggatgagactgcattcagtgtcttggagggagtccatagctacattgt

SEQ ID NO: 324772 - DNA, 75 bp, Artificial Sequence
  Synthetic
ggctgatacatgtttcgtcatggctgagaaaccattcacaatttcagggctacgtggggcagcgaggtggacgct

SEQ ID NO: 324773 - DNA, 75 bp, Artificial Sequence
  Synthetic
caacctcatcttcctggatgtcccaaaatttgtggatggcagctacatgcagacatatcacagtactgtgcccac

SEQ ID NO: 324774 - DNA, 75 bp, Artificial Sequence
  Synthetic
tcttaaaggcaacctcatcttcctggatgtcccaaaatttgtggatggcagctacatgcagacatatcacagtac

SEQ ID NO: 324775 - DNA, 75 bp, Artificial Sequence
  Synthetic
tggatacgtaggctggggctgtggcagtgggaagtcaaggactgagtcaggagagctctgcagctcagactcagg

SEQ ID NO: 324776 - DNA, 75 bp, Artificial Sequence
  Synthetic
gggtctcctgtttagcacaggagctagctagtgccctgaagcagcactgcagggctggtgagttcatcatcaaga

SEQ ID NO: 324777 - DNA, 75 bp, Artificial Sequence
  Synthetic
agaccatggctaggtgtgtctgtgagctgagcccacatgagactgttgctaaccctcggctcaagaattccatca

SEQ ID NO: 324778 - DNA, 75 bp, Artificial Sequence
  Synthetic
gattggctgaatgccttgtttggcaatgggctgagtaggtggatcctgggggtgataggggttctactgggggga

SEQ ID NO: 324779 - DNA, 75 bp, Artificial Sequence
  Synthetic
ggtgataggggttctactggggggattggctctctttttcttgatcatgtttttgttcaagctgggaacaaaaca

SEQ ID NO: 324780 - DNA, 75 bp, Artificial Sequence
  Synthetic
tacaggtatacctcctcaggaagcatctggattgtatggtgcgaattgcttctcagccattcagcctaatcccta

SEQ ID NO: 324781 - DNA, 75 bp, Artificial Sequence
  Synthetic
tctcatggatggacaaagggcgaacttacataaagacagagacaggaatgatgcagggcatactgcacttcacat

SEQ ID NO: 324782 - DNA, 75 bp, Artificial Sequence
  Synthetic
tctcagccattcagcctaatccctagagaggggagggtagaatggggaggaacattccatgccatctcaggccgg

SEQ ID NO: 324783 - DNA, 75 bp, Artificial Sequence
  Synthetic
ctaaggattttgtgtgctacaaggaagggactgggccgtgttctgaatcagaagaaaagacttgcaagaccagtg

SEQ ID NO: 324784 - DNA, 75 bp, Artificial Sequence
  Synthetic
ggggaagaggcatctgaagccaaatgcagatgctcactagtgcacaagcccggggaagttgttgtgtcatatgga

SEQ ID NO: 324785 - DNA, 75 bp, Artificial Sequence
  Synthetic
cagattgagagggcacagtcaggaactctaggaggctttagcaagccccagaagacattcattaggccaggaggt

SEQ ID NO: 324786 - DNA, 75 bp, Artificial Sequence
  Synthetic
cactcagctctctttgggagtagcacctcatgtccttgtagtacatgtccaacagctgctcgagtccaggctcaa

SEQ ID NO: 324787 - DNA, 75 bp, Artificial Sequence
  Synthetic
ccattctggaccagattgagagggcacagtcaggcactcttggcggcttcagcaagccccagaagacattcatca

SEQ ID NO: 324788 - DNA, 75 bp, Artificial Sequence
  Synthetic
aggattggccaatgcactggctgccatctagaatgcataaatgggggtgtgaggctaatcactctaactagtgag

SEQ ID NO: 324789 - DNA, 75 bp, Artificial Sequence
  Synthetic
agatcaggctcagtagtgatgccaggctttatgatgtcattgaatccatccgaaggttatgtgatgaccttggga

SEQ ID NO: 324790 - DNA, 75 bp, Artificial Sequence
  Synthetic
gctttatgatgtcattgaatccatccgaaggttatgtgatgaccttgggatcaacaacagggtggcatctgcata

SEQ ID NO: 324791 - DNA, 75 bp, Artificial Sequence
  Synthetic
actggactgtccccaattctggatgtggccctcctccagatagagtcacttgcaaggctaagaggcatgagcttg

SEQ ID NO: 324792 - DNA, 75 bp, Artificial Sequence
  Synthetic
gattgagaaaggggtcatgtggtacattgatgctgtaggccaggcatggaaggcagttctagatgatgggtgcat

SEQ ID NO: 324793 - DNA, 75 bp, Artificial Sequence
  Synthetic
tcaacaacagggtggcatctgcatatagaggtcattgcatggttaggctgagtggattcaagatcaagccagcat

SEQ ID NO: 324794 - DNA, 75 bp, Artificial Sequence
  Synthetic
agagaaattgctcagcgacatggaagacaatggaagcagaaccttgaggagcgtgtcctgagagagattgggacc

SEQ ID NO: 324795 - DNA, 75 bp, Artificial Sequence
  Synthetic
tttgagggtagttgcatgttcccagatggttgtgacgcagtggactgcacattctgtcgtgagtttctaaaaaat

SEQ ID NO: 324796 - DNA, 75 bp, Artificial Sequence
  Synthetic
tcaagatgagagtgaggggcgacatcctcaacctctctgtcacaatacaagaaggaagggtcatgaacattctga

SEQ ID NO: 324797 - DNA, 75 bp, Artificial Sequence
  Synthetic
gctaggtgtgtctgtgagctgagcccacatgagactgttgccaaccctaggctcaagaattccatcatagagaac

SEQ ID NO: 324798 - DNA, 75 bp, Artificial Sequence
  Synthetic
catcagaggtcatcaggaaatcaaggaccatgactttatgcctcttatcgaattacttgtctagtaggggtgggt

SEQ ID NO: 324799 - DNA, 75 bp, Artificial Sequence
  Synthetic
ccttggatatgcaggcctcatgctactcaccaatgtccttaaggcaatcggggtttgggggtcatgggtcatagc

SEQ ID NO: 324800 - DNA, 75 bp, Artificial Sequence
  Synthetic
aattgggcctggtcacatgcctcagttctcctggcaaatgataggaagacccaaggcattgacaatagagctatg

SEQ ID NO: 324801 - DNA, 75 bp, Artificial Sequence
  Synthetic
gggaacattttcagggactgtcttgaaggttctcttagaaagcaagggctgatgaggtcaaagctcacagagatg

SEQ ID NO: 324802 - DNA, 75 bp, Artificial Sequence
  Synthetic
tgtgacttacttgggctcagatatggaggtgtctggcttgactgacctgtgtgagatagaagagctcaagtccaa

SEQ ID NO: 324803 - DNA, 75 bp, Artificial Sequence
  Synthetic
tggatgtactcacctgtcatcctgactattctagcaattgggcttgctgagggctgcgatgagatggtccatgca

SEQ ID NO: 324804 - DNA, 75 bp, Artificial Sequence
  Synthetic
ttagggaagcaatgacagacgccttccatggtaatagggaagtctcatggatggacaaaggccgaacctacataa

SEQ ID NO: 324805 - DNA, 75 bp, Artificial Sequence
  Synthetic
agaagagatgcatggcagccatacgagaacaagtacggccattcctaatattcctgcaaattccggaggacagca

SEQ ID NO: 324806 - DNA, 75 bp, Artificial Sequence
  Synthetic
tgtcacaactgggagggcgctccttcctgcggtgaacccaggacaagaggcatgtctgcacttcacggcaccagg

SEQ ID NO: 324807 - DNA, 75 bp, Artificial Sequence
  Synthetic
gagtccggactcaaaatgtctcaaaatcaaagttaagaggattaacctgaaatgcaagaagtcatcatcatattt

SEQ ID NO: 324808 - DNA, 75 bp, Artificial Sequence
  Synthetic
cacaatgtgtgcgatcatgggtaaggaaggctgtagagggctccttactgagaagagatgcatggcagccatacg

SEQ ID NO: 324809 - DNA, 75 bp, Artificial Sequence
  Synthetic
agttgatgtgtctgtgggtgactagggaaagttggttttagaaggatttccttaagatctgggcgcttttggtgt

SEQ ID NO: 324810 - DNA, 75 bp, Artificial Sequence
  Synthetic
cgtccctgatgctcggtccaggtgtacatctgtgaggagatgccgctgggcaggagactgtcagtctgggtgccc

SEQ ID NO: 324811 - DNA, 75 bp, Artificial Sequence
  Synthetic
caggagactgtcagtctgggtgcccctctcatttcacgtccaactccttttctgacgattgggcaggtaaaatgg

SEQ ID NO: 324812 - DNA, 75 bp, Artificial Sequence
  Synthetic
taactctgaattccatttccacaggcacttggttagacccacactgagatggatagcagcgtctcaccaaatctc

SEQ ID NO: 324813 - DNA, 75 bp, Artificial Sequence
  Synthetic
agttgatgtgtctgtgggtgactagggaatgttggttttagaaggatttccttaagatctgggcggtctttgtgt

SEQ ID NO: 324814 - DNA, 75 bp, Artificial Sequence
  Synthetic
gtggggttaactttgaaacacggttggaacgcagttgatgtgtctgtgggtggctagggagtgttggttttagaa

SEQ ID NO: 324815 - DNA, 75 bp, Artificial Sequence
  Synthetic
cagacatatgtaaaattgatggcattgtgtttaaccagtgtgagagtgagagtctacctcaaccctttgatgttg

SEQ ID NO: 324816 - DNA, 75 bp, Artificial Sequence
  Synthetic
aactccactgcaatcctggaccactctgacatgatcactcctttgcgtctttccttttttgggggttctttgtgt

SEQ ID NO: 324817 - DNA, 75 bp, Artificial Sequence
  Synthetic
tacaatgccctcaggggaagtgaggacattccaccccatgagcggcatccctacacaagtcttcaagggtgtgag

SEQ ID NO: 324818 - DNA, 75 bp, Artificial Sequence
  Synthetic
acattccaccccatgagcggcatccctacacaagtcttcaagggtgtgagtgtgacttacttgggctcagatatg

SEQ ID NO: 324819 - DNA, 75 bp, Artificial Sequence
  Synthetic
cataccccacctgcttggttactctgagaagatttgtcagatagatcggctgatacatgtttcgtcatggctcag

SEQ ID NO: 324820 - DNA, 75 bp, Artificial Sequence
  Synthetic
ttacatcccttgtttggaaccttcatggggatgctgatatcagacccagatccagccctaggattcttcctcatg

SEQ ID NO: 324821 - DNA, 75 bp, Artificial Sequence
  Synthetic
attctctcttacctacctcatacagtgcgctcagctcctgcaccactacatgcttctaggactatgcttacatcc

SEQ ID NO: 324822 - DNA, 75 bp, Artificial Sequence
  Synthetic
tgcattcgcagggggagcaggatttagattcaatctgtggagagcctgcaagacaacagaccttgggcggaagta

SEQ ID NO: 324823 - DNA, 75 bp, Artificial Sequence
  Synthetic
caggctggcatgggggttgtaggcaaggttggagagatacagtgcagtagcgaggaaagtgcccgtaccataaaa

SEQ ID NO: 324824 - DNA, 75 bp, Artificial Sequence
  Synthetic
aggttggagagatacagtgcagtagcgaggaaagtgcccgtaccataaaaaaagatgggtgtatatggaatgctg

SEQ ID NO: 324825 - DNA, 75 bp, Artificial Sequence
  Synthetic
gaagctggcattagctccctgcaatcaggctggcatgggggttgtaggcaaggttggagagatacagtgcagtag

SEQ ID NO: 324826 - DNA, 75 bp, Artificial Sequence
  Synthetic
aaagatgggtgtatatggaatgctgacctcgtgggcatcgagctacgagtggatgacgctgtatgctactctaag

SEQ ID NO: 324827 - DNA, 75 bp, Artificial Sequence
  Synthetic
tcaaggcgtgttgacatcatggagaacccaagggtcttctttggcgttattgtagtctcgtcaggaggggttctg

SEQ ID NO: 324828 - DNA, 75 bp, Artificial Sequence
  Synthetic
gtagccccttggacatcacagccataagagggtctttttcagttaattatagaggccttcgactgagcctctcag

SEQ ID NO: 324829 - DNA, 75 bp, Artificial Sequence
  Synthetic
aagagggtctttttcagttaattatagaggccttcgactgagcctctcagaaattactgctacttgcacagggga

SEQ ID NO: 324830 - DNA, 75 bp, Artificial Sequence
  Synthetic
gttcattcacctggtgtgactagcagcctgagtaaagggcatgtggtgcctcgggtggtggcagcaggagtatac

SEQ ID NO: 324831 - DNA, 75 bp, Artificial Sequence
  Synthetic
agaggccttcgactgagcctctcagaaattactgctacttgcacaggggaggtgacaaatgtgagtgggtgttac

SEQ ID NO: 324832 - DNA, 75 bp, Artificial Sequence
  Synthetic
ggtgacaaatgtgagtgggtgttactcttgcatgacaggcgccaaagtctccatcaaactgcatagcagcaaaaa

SEQ ID NO: 324833 - DNA, 75 bp, Artificial Sequence
  Synthetic
tcgggtggtggcagcaggagtatacctcctctcacgtcactgctttcgctttagttcaagcatccatggcagggg

SEQ ID NO: 324834 - DNA, 75 bp, Artificial Sequence
  Synthetic
gctgatctttgtgacagccactacctaaagcctgagaaaaccattcaggagcggctagagatcaatagatgtgag

SEQ ID NO: 324835 - DNA, 75 bp, Artificial Sequence
  Synthetic
tagcactgcacatgtaaggtgcaaaggggatgagactgcgttcagtgtcctggagggagttcatagctatactgt

SEQ ID NO: 324836 - DNA, 75 bp, Artificial Sequence
  Synthetic
tggagggagttcatagctatactgtcagcctcagttttgaccatgcagtggtcgatgagcagtgccagctgaact

SEQ ID NO: 324837 - DNA, 75 bp, Artificial Sequence
  Synthetic
gtgagctgtgggcaaagtgccttctagatgtctcgctgggcaatgtggagggggtagtcagtgaccctgcaaaag

SEQ ID NO: 324838 - DNA, 75 bp, Artificial Sequence
  Synthetic
agatgtctcgctgggcaatgtggagggggtagtcagtgaccctgcaaaagaacttgacattgccatctctgatga

SEQ ID NO: 324839 - DNA, 75 bp, Artificial Sequence
  Synthetic
gtcgatgagcagtgccagctgaactgtggggggcatgagagtcaagtgactctaaaaggcaacctcatcttcctg

SEQ ID NO: 324840 - DNA, 75 bp, Artificial Sequence
  Synthetic
gtggggggcatgagagtcaagtgactctaaaaggcaacctcatcttcctggatgtcccaaaattcgtagatggca

SEQ ID NO: 324841 - DNA, 75 bp, Artificial Sequence
  Synthetic
tccagaaaaagatacccccaaagaggcaaagataacctataggcgattcaagcctgccttaagttcaagtgcccg

SEQ ID NO: 324842 - DNA, 75 bp, Artificial Sequence
  Synthetic
caagaaggaactgctcttaaagctggcagagaaggttcattcacctggtgtgactagcagcctgagtaaagggca

SEQ ID NO: 324843 - DNA, 75 bp, Artificial Sequence
  Synthetic
atggaggacacccatgttcaaattctgatagatggagatggtactagtaactggcttgaggagatcaggctcagt

SEQ ID NO: 324844 - DNA, 75 bp, Artificial Sequence
  Synthetic
tgtttggcaatgggctgagtaggtggattctgggggtgataggggttctactggggggattggctctctttttct

SEQ ID NO: 324845 - DNA, 75 bp, Artificial Sequence
  Synthetic
tgtgcccacaggagcaaatatcccaagccctacagactggctgaatgccctgtttggcaatgggctgagtaggtg

SEQ ID NO: 324846 - DNA, 75 bp, Artificial Sequence
  Synthetic
tggcaggggctcaacacagaaggctagccttataaaattgctgatgatgtcttctatttctgccatgaagcatgg

SEQ ID NO: 324847 - DNA, 75 bp, Artificial Sequence
  Synthetic
gtgcagtttaggaacttcatagcccacgttgatgccaaatcaagatcagtcaggctcctaggtgcccccgtgaag

SEQ ID NO: 324848 - DNA, 75 bp, Artificial Sequence
  Synthetic
aacaaaacaggtatttcgatcaaggacgaagctggcttagatgggcaaatttctggtctaatgaccctctgggag

SEQ ID NO: 324849 - DNA, 75 bp, Artificial Sequence
  Synthetic
acttttgcagttctgccacaagtggtaagaaaagcacggagattcatttccactcaggatcattggttgggaaaa

SEQ ID NO: 324850 - DNA, 75 bp, Artificial Sequence
  Synthetic
acgaagctggcttagatgggcaaatttctggtctaatgaccctctgggagcagtgctctcaggggagttggctca

SEQ ID NO: 324851 - DNA, 75 bp, Artificial Sequence
  Synthetic
atagagctatggggaacattttcagggactgcctcgagggttctcttagaaagcaagggttgatgaggtcaaagc

SEQ ID NO: 324852 - DNA, 75 bp, Artificial Sequence
  Synthetic
ctgtcgtgagtttctaaaaaatcctcagtgctaccctgcaaagaagtggctgttcatcattattgtcatcctcct

SEQ ID NO: 324853 - DNA, 75 bp, Artificial Sequence
  Synthetic
tagggaaactggatggacctctgagaactaagctacaggtatacctcctcaggaagcatctggattgcatggtgc

SEQ ID NO: 324854 - DNA, 75 bp, Artificial Sequence
  Synthetic
aactaagctacaggtatacctcctcaggaagcatctggattgcatggtgcgaattgcttctcagccattcagcct

SEQ ID NO: 324855 - DNA, 75 bp, Artificial Sequence
  Synthetic
gtctagtaggggtgggtccattctagaccagattgagagggcacagtcaggcactctaggaggattcagcaagcc

SEQ ID NO: 324856 - DNA, 75 bp, Artificial Sequence
  Synthetic
aagaaactaatgagaactgtgagctgcttggtggggaaattgatggataggggaaggcaagtgatccatgaggaa

SEQ ID NO: 324857 - DNA, 75 bp, Artificial Sequence
  Synthetic
ccccttcatttggaaaccatgtcactgagcaaatgctccaacgttgacctcaaatctgtagcaatgaatgctaac

SEQ ID NO: 324858 - DNA, 75 bp, Artificial Sequence
  Synthetic
gcagccctaaaggagtatctcccagtagggccagctgtcatgaacctgaaggttgagaattatccccctgagatg

SEQ ID NO: 324859 - DNA, 75 bp, Artificial Sequence
  Synthetic
gtgtgtggactggagtgatggaggacacccatgtccaaattctgatagatggagatgggactagtaactggcttg

SEQ ID NO: 324860 - DNA, 75 bp, Artificial Sequence
  Synthetic
ggtggtgttggctacaagggaaaaggtgtgtggactggagtgatggaggacacccatgtccaaattctgatagat

SEQ ID NO: 324861 - DNA, 75 bp, Artificial Sequence
  Synthetic
ccgtagtcttggccctggctctataaacataaactcatccaatgacgccaagaagtggaatcaggggcactacac

SEQ ID NO: 324862 - DNA, 75 bp, Artificial Sequence
  Synthetic
tgggcaagatgaccaacacagtatggttgtttggcaaccctaaaaatcctcttcatcagcttgagcctggacttg

SEQ ID NO: 324863 - DNA, 75 bp, Artificial Sequence
  Synthetic
aactctttcagggatcctctccatgctgctgtgaactctgtcttctttcccaatgatgttcgggtgaagtggctg

SEQ ID NO: 324864 - DNA, 75 bp, Artificial Sequence
  Synthetic
gacctaaggtttttagctcacctcagttctaaatctgagtctaggtcatctgatccatttagggaagcaatgaca

SEQ ID NO: 324865 - DNA, 75 bp, Artificial Sequence
  Synthetic
gtgggaagccatctgtatggttcctacaggcagctcatatgttcttctccatcaagaacagctgggcaatggaaa

SEQ ID NO: 324866 - DNA, 75 bp, Artificial Sequence
  Synthetic
tttgacaaaattagacctccttcgggaggtcaccaatggctggccaatctttcccccagatagtgtttagggctg

SEQ ID NO: 324867 - DNA, 75 bp, Artificial Sequence
  Synthetic
gcgatcatgatcagcatacgccctaagtcagacatggatgaagtccgatcaaggttctttgttgctaacttactc

SEQ ID NO: 324868 - DNA, 75 bp, Artificial Sequence
  Synthetic
ctctgatggatgtggaggagcagcctgcggctgctttaatgcggccccttcatgcatcttctggaggaaatgggt

SEQ ID NO: 324869 - DNA, 75 bp, Artificial Sequence
  Synthetic
gagccatctgtcttctttttgcggataggaataaagaagtcccaacagtccaacagaggcttacgcaatgaggaa

SEQ ID NO: 324870 - DNA, 75 bp, Artificial Sequence
  Synthetic
atggttaggctgagtggattcaagatcaagccagcatcaaggactgacggctgtccagtcaggattatggaaagg

SEQ ID NO: 324871 - DNA, 75 bp, Artificial Sequence
  Synthetic
acctcgtgggtatagagctacgagtggatgacgctgtgtgctactctaagatcactagtgtggaggcagttgcaa

SEQ ID NO: 324872 - DNA, 75 bp, Artificial Sequence
  Synthetic
gaagtgaataagtggtggttcaagctcatgcctcttagccttgcaagtgactctatctggaggagggccacatcc

SEQ ID NO: 324873 - DNA, 75 bp, Artificial Sequence
  Synthetic
ccccaattctggatgtggccctcctccagatagagtcacttgcaaggctaagaggcatgagcttgaaccaccact

SEQ ID NO: 324874 - DNA, 75 bp, Artificial Sequence
  Synthetic
ggatctcaggtaacccaagtctaagccttcgcttctctatggcttcaagagaatccaatatcatgtccccttcaa

SEQ ID NO: 324875 - DNA, 75 bp, Artificial Sequence
  Synthetic
gaatccaatatcatgtccccttcaaaaagatacttttggccttttgttatcctgtggaagaggccccgccagttc

SEQ ID NO: 324876 - DNA, 75 bp, Artificial Sequence
  Synthetic
ccatgtcactgagcaaatgctccaacgttgacctcaaatctgtggcattgaatgccaacactgtcaggcttgagc

SEQ ID NO: 324877 - DNA, 75 bp, Artificial Sequence
  Synthetic
cctgtggaagaggccccgccagttctctctaccggtttccattgcccagctgttcttgatggagaagaacatgtg

SEQ ID NO: 324878 - DNA, 75 bp, Artificial Sequence
  Synthetic
actagaggaggacattgacttttcagatgtcatagctgtagagctctcagagggatcgcttgatattgaatccat

SEQ ID NO: 324879 - DNA, 75 bp, Artificial Sequence
  Synthetic
acacaaagacccccttcatttggaaaccatgtcactgagcaaatgctccaacgttgatctcaaatctgttgcaat

SEQ ID NO: 324880 - DNA, 75 bp, Artificial Sequence
  Synthetic
tttggggaagagattggccagccattggtgacctcccgaaggaggtctaattttgtcgaattggatcatggaatt

SEQ ID NO: 324881 - DNA, 75 bp, Artificial Sequence
  Synthetic
tagagggctccttactgagaagagatgcatggcagccatacgagagcaggtgcggccattcctcatattcctgca

SEQ ID NO: 324882 - DNA, 75 bp, Artificial Sequence
  Synthetic
agaggccttcgactgagtctctcagaaattactgctacgtgtacaggggaagtgacaaatgtgagtgggtgttat

SEQ ID NO: 324883 - DNA, 75 bp, Artificial Sequence
  Synthetic
caagagccagtggacttgcggtgcaaggcagaagatctggtgtctgaggtgtggtttggcctgaaaaggactaag

SEQ ID NO: 324884 - DNA, 75 bp, Artificial Sequence
  Synthetic
ggtggcctagtggaaaaccatctgtatggttcctgcaggcagctcacatgttcttctccatcaagaacagctggg

SEQ ID NO: 324885 - DNA, 75 bp, Artificial Sequence
  Synthetic
acacaaaggaccccttcatttggaaaccatgtcgctgagcaaatgctccaacgttgacctcaaatctgtagcaat

SEQ ID NO: 324886 - DNA, 75 bp, Artificial Sequence
  Synthetic
ttcttctccatcaagaacagctgggcaatggaaaccggaagagagaactggcggggcctcttccacaggataaca

SEQ ID NO: 324887 - DNA, 75 bp, Artificial Sequence
  Synthetic
gacaaatgtgagtgggtgttattcctgcatgacaggcgccaaagtctccatcaagttgcatagcagcaaaaatag

SEQ ID NO: 324888 - DNA, 75 bp, Artificial Sequence
  Synthetic
gctggcacgcagttattgtgtctgtgggtgactagggaatgttggctttagaaggatttccttaagtttgggggc

SEQ ID NO: 324889 - DNA, 75 bp, Artificial Sequence
  Synthetic
aaaaagaagacagatggctcatacagtgtcttggatgaggatgatgagcctggggtcctccaaggttacccatat

SEQ ID NO: 324890 - DNA, 75 bp, Artificial Sequence
  Synthetic
cggccaacaatgatgaaagtcatctggttctcctctctgatctgcttagtcattcaatgcggtggggatacgggc

SEQ ID NO: 324891 - DNA, 75 bp, Artificial Sequence
  Synthetic
ggttctcctctctgatctgcttagtcattcaatgcggtggggatacgggcccaatcatctgcgcaggacccatcc

SEQ ID NO: 324892 - DNA, 75 bp, Artificial Sequence
  Synthetic
cactataagccaagtagtcagaatgaacttcttcccaggttttagcctagaagctgagaagagcttagacaacca

SEQ ID NO: 324893 - DNA, 75 bp, Artificial Sequence
  Synthetic
aagccatagagaagcgaaggcttagacttgggttacctgatatcctaataactggactgtccccaattctggatg

SEQ ID NO: 324894 - DNA, 75 bp, Artificial Sequence
  Synthetic
ggggacatgagagtcaagtgactcttaaaggcaacctcatcttcctggatgtcccaaaatttgtggatggcagct

SEQ ID NO: 324895 - DNA, 75 bp, Artificial Sequence
  Synthetic
gtgcatgtttcgtggtcctggctcacattcttagaacatggaggttctattgaagtgttggccgtctttgtgtta

SEQ ID NO: 324896 - DNA, 75 bp, Artificial Sequence
  Synthetic
aaccaccacttgttcacttcttcctcattgcgtaagcctctgttggactgttgggacttctttatccctatccgc

SEQ ID NO: 324897 - DNA, 75 bp, Artificial Sequence
  Synthetic
tagggaatgttggctttagaaggatttccttaagatctgggcggtctttggtggagacctactgggaaacaatcg

SEQ ID NO: 324898 - DNA, 75 bp, Artificial Sequence
  Synthetic
tcatgaaatttagcctaattggatatgtcaaattgctgcttacaggttcctgtaagcagcagcagcaacctcagc

SEQ ID NO: 324899 - DNA, 75 bp, Artificial Sequence
  Synthetic
tgtaagcagcagcagcaacctcagcagctctgctggggaccccatctgggccaaggattcccttggccttcagcc

SEQ ID NO: 324900 - DNA, 75 bp, Artificial Sequence
  Synthetic
ctacgtagggcagcgaggtggacgctctcaggtgagctactacccagctgaaaattcttactcaaggtggagtgg

SEQ ID NO: 324901 - DNA, 75 bp, Artificial Sequence
  Synthetic
acttgcaagaccagtggatcatgcaggggggacatgcagttttgcaaggtggcaggttgtgaacatggggaagag

SEQ ID NO: 324902 - DNA, 75 bp, Artificial Sequence
  Synthetic
atcaatcaatgctgggttgatcacaatccagctctctgaagcatataagatcaatcatgacttcacgttttctgg

SEQ ID NO: 324903 - DNA, 75 bp, Artificial Sequence
  Synthetic
ggggggacatgcagttttgcaaggtggcaggttgtgaacatggggaagaggcatctgaagccaagtgtagatgct

SEQ ID NO: 324904 - DNA, 75 bp, Artificial Sequence
  Synthetic
ggaaccatagtggtggttgaattttcaaccactaggagccataacattgggggcctggaggcagcatataggaca

SEQ ID NO: 324905 - DNA, 75 bp, Artificial Sequence
  Synthetic
ccagacatatgcaaaattgatggcattgtgttcaaccagtgtgagggtgagagtctacctcagccctttgatgtt

SEQ ID NO: 324906 - DNA, 75 bp, Artificial Sequence
  Synthetic
ttggaacgcagttgatgtgtctgtgggtggctagggaatgttggttttagaaggatttccttaagcttggggggg

SEQ ID NO: 324907 - DNA, 75 bp, Artificial Sequence
  Synthetic
acacagtcaggcttgagccatctctaggagagtaccccactcttaggagggacctcgttgaatgctcttgcagtg

SEQ ID NO: 324908 - DNA, 75 bp, Artificial Sequence
  Synthetic
aggagagtaccccactcttaggagggacctcgttgaatgctcttgcagtgtgttgactctgtcaatggtcaagag

SEQ ID NO: 324909 - DNA, 75 bp, Artificial Sequence
  Synthetic
aaggattggtcaatgcactggctgccatctggaatgcataaatgggggtgtgaggctaataactctaaccagtga

SEQ ID NO: 324910 - DNA, 75 bp, Artificial Sequence
  Synthetic
gacctcgttgaatgctcttgcagtgtgttgactctgtcaatggtcaagaggatgggcaagatgaccaacacagta

SEQ ID NO: 324911 - DNA, 75 bp, Artificial Sequence
  Synthetic
tcttcaagggtgtgagtgtaacttacttgggctcagatatggaggtgtctggcttgactgacctgtgtgagatag

SEQ ID NO: 324912 - DNA, 75 bp, Artificial Sequence
  Synthetic
aaggatatgaggtgctactcccagagagagctgagtgctcttaggtggcccagtgggaagccatctgtatggttc

SEQ ID NO: 324913 - DNA, 75 bp, Artificial Sequence
  Synthetic
aacccagggcaagaggcgtgtctgcacttcacggcacctggaagtccggactcaaaatgtctcaaaattaaggtt

SEQ ID NO: 324914 - DNA, 75 bp, Artificial Sequence
  Synthetic
tgccatgcaccatgctgaactcaatagctttctggagagagaaactaggcgtggctccatggctggttcggaagc

SEQ ID NO: 324915 - DNA, 75 bp, Artificial Sequence
  Synthetic
tcttcaagggtgtgagtgtaacttacttgggctcagatatggaggtgtcaggcttgactgatctgtgtgagatag

SEQ ID NO: 324916 - DNA, 75 bp, Artificial Sequence
  Synthetic
cacaacctcatcaggtttgatgaggagctgagaactgcagccctgaacaccatctggggaagagattggccagcc

SEQ ID NO: 324917 - DNA, 75 bp, Artificial Sequence
  Synthetic
tgatcatgtctttgtttaagctgggaacaaaacagatatttcgatcgaggacaaagctggcttagatgggtatat

SEQ ID NO: 324918 - DNA, 75 bp, Artificial Sequence
  Synthetic
aagctgaagttctggcctatctatgtcattatcaagccgaccaaatcatcatcccatatcttctacagcttaggg

SEQ ID NO: 324919 - DNA, 75 bp, Artificial Sequence
  Synthetic
agatacagtgcagtagcgaggaaagtgcccgtaccataaaaaaagatgggtgcatatggaatgctgacctagtgg

SEQ ID NO: 324920 - DNA, 75 bp, Artificial Sequence
  Synthetic
attgatcatcaagaagctgaaggagacaggtggagatgattgggtgagggacacaaagttcatcattgtctttgc

SEQ ID NO: 324921 - DNA, 75 bp, Artificial Sequence
  Synthetic
gcagcagcaacctcagcagctctgctggggaccccatctgggccaaggatccccttggccttcagccacttcacc

SEQ ID NO: 324922 - DNA, 75 bp, Artificial Sequence
  Synthetic
ctcagaggtattccccattacccatgatggttctgatgggatgacccctgatgtgattcacaccagattggatgg

SEQ ID NO: 324923 - DNA, 75 bp, Artificial Sequence
  Synthetic
cctgaaggagttgtaaacttctgtcttgctggctccgcgcatcttcacattgatagtcttggtgaaggcatcttg

SEQ ID NO: 324924 - DNA, 75 bp, Artificial Sequence
  Synthetic
gcggctagagatcaatagatgtgaggctattgacaaaactcaggacctcctagctggcctgcatgcaaggagcaa

SEQ ID NO: 324925 - DNA, 75 bp, Artificial Sequence
  Synthetic
cttcataggctagctctctcgcgaaatcctcaagctcagtcaaattgagctgctgctcaccaaactccactgcaa

SEQ ID NO: 324926 - DNA, 75 bp, Artificial Sequence
  Synthetic
agcctgccttaagttcaagtgcccgtcaggaattttctctccaaggagtggaggggaagaagtggaagagaatgg

SEQ ID NO: 324927 - DNA, 75 bp, Artificial Sequence
  Synthetic
tggagaaggcatctgccatgcaagacacagagctaactcatgccctcaatgactcattcaagaggaacctaagca

SEQ ID NO: 324928 - DNA, 75 bp, Artificial Sequence
  Synthetic
ctgtctcttggagaaccaggcctgtacgaccaaatctacgacaggccagggctcccagacctagatgtgactgtc

SEQ ID NO: 324929 - DNA, 75 bp, Artificial Sequence
  Synthetic
atgctgcctaagccccaaaagatgctagggaaactggatgggcctttgagaactaagctacaggtatacctcctc

SEQ ID NO: 324930 - DNA, 75 bp, Artificial Sequence
  Synthetic
aagcatataagatcaatcatgacttcacgttttctggtctgtcaaagacaacagaccgacgcctctcagaggtat

SEQ ID NO: 324931 - DNA, 75 bp, Artificial Sequence
  Synthetic
acagaccgacgcctctcagaggtattccccattacccatgatggctctgatgggatgacccctgatgtgatccac

SEQ ID NO: 324932 - DNA, 75 bp, Artificial Sequence
  Synthetic
gacgcccagatgaacttggaagtgctttgtggtaggataaacgtggagaatgggctgtctcttggagaaccaggc

SEQ ID NO: 324933 - DNA, 75 bp, Artificial Sequence
  Synthetic
ttgtttggcaatgggctgagtaggtggatcctgggggtgataggggttctgcttgggggattggctctctttttg

SEQ ID NO: 324934 - DNA, 75 bp, Artificial Sequence
  Synthetic
ttgtttggcaatgggctgagtaggtggatcctgggggtgataggggttctgcttgggggtttggctctctttttg

SEQ ID NO: 324935 - DNA, 75 bp, Artificial Sequence
  Synthetic
ttgtttggcaatgggctgagtaggtggatcctgggggtgataggggttctgcttgggggcttggctctctttttg

SEQ ID NO: 324936 - DNA, 75 bp, Artificial Sequence
  Synthetic
ttgtttggcaatgggctgagtaggtggatcctgggggtgataggggttctgcttggggggttggctctctttttg

SEQ ID NO: 324937 - DNA, 75 bp, Artificial Sequence
  Synthetic
ttgtttggcaatgggctgagtaggtggatcctgggggtgattggggttctgcttgggggattggctctctttttg

SEQ ID NO: 324938 - DNA, 75 bp, Artificial Sequence
  Synthetic
ttgtttggcaatgggctgagtaggtggatcctgggggtgattggggttctgcttgggggtttggctctctttttg

SEQ ID NO: 324939 - DNA, 75 bp, Artificial Sequence
  Synthetic
ttgtttggcaatgggctgagtaggtggatcctgggggtgattggggttctgcttgggggcttggctctctttttg

SEQ ID NO: 324940 - DNA, 75 bp, Artificial Sequence
  Synthetic
ttgtttggcaatgggctgagtaggtggatcctgggggtgattggggttctgcttggggggttggctctctttttg

SEQ ID NO: 324941 - DNA, 75 bp, Artificial Sequence
  Synthetic
ttgtttggcaatgggctgagtaggtggatcctgggggtgatcggggttctgcttgggggattggctctctttttg

SEQ ID NO: 324942 - DNA, 75 bp, Artificial Sequence
  Synthetic
ttgtttggcaatgggctgagtaggtggatcctgggggtgatcggggttctgcttgggggtttggctctctttttg

SEQ ID NO: 324943 - DNA, 75 bp, Artificial Sequence
  Synthetic
ttgtttggcaatgggctgagtaggtggatcctgggggtgatcggggttctgcttgggggcttggctctctttttg

SEQ ID NO: 324944 - DNA, 75 bp, Artificial Sequence
  Synthetic
ttgtttggcaatgggctgagtaggtggatcctgggggtgatcggggttctgcttggggggttggctctctttttg

SEQ ID NO: 324945 - DNA, 75 bp, Artificial Sequence
  Synthetic
ttgtttggcaatgggctgagtaggtggatcctgggggtgatgggggttctgcttgggggattggctctctttttg

SEQ ID NO: 324946 - DNA, 75 bp, Artificial Sequence
  Synthetic
ttgtttggcaatgggctgagtaggtggatcctgggggtgatgggggttctgcttgggggtttggctctctttttg

SEQ ID NO: 324947 - DNA, 75 bp, Artificial Sequence
  Synthetic
ttgtttggcaatgggctgagtaggtggatcctgggggtgatgggggttctgcttgggggcttggctctctttttg

SEQ ID NO: 324948 - DNA, 75 bp, Artificial Sequence
  Synthetic
ttgtttggcaatgggctgagtaggtggatcctgggggtgatgggggttctgcttggggggttggctctctttttg

SEQ ID NO: 324949 - DNA, 75 bp, Artificial Sequence
  Synthetic
ttgtttggcaatgggctgagtaggtggttcctgggggtgataggggttctgcttgggggattggctctctttttg

SEQ ID NO: 324950 - DNA, 75 bp, Artificial Sequence
  Synthetic
ttgtttggcaatgggctgagtaggtggttcctgggggtgataggggttctgcttgggggtttggctctctttttg

SEQ ID NO: 324951 - DNA, 75 bp, Artificial Sequence
  Synthetic
ttgtttggcaatgggctgagtaggtggttcctgggggtgataggggttctgcttgggggcttggctctctttttg

SEQ ID NO: 324952 - DNA, 75 bp, Artificial Sequence
  Synthetic
ttgtttggcaatgggctgagtaggtggttcctgggggtgataggggttctgcttggggggttggctctctttttg

SEQ ID NO: 324953 - DNA, 75 bp, Artificial Sequence
  Synthetic
ttgtttggcaatgggctgagtaggtggttcctgggggtgattggggttctgcttgggggattggctctctttttg

SEQ ID NO: 324954 - DNA, 75 bp, Artificial Sequence
  Synthetic
ttgtttggcaatgggctgagtaggtggttcctgggggtgattggggttctgcttgggggtttggctctctttttg

SEQ ID NO: 324955 - DNA, 75 bp, Artificial Sequence
  Synthetic
ttgtttggcaatgggctgagtaggtggttcctgggggtgattggggttctgcttgggggcttggctctctttttg

SEQ ID NO: 324956 - DNA, 75 bp, Artificial Sequence
  Synthetic
ttgtttggcaatgggctgagtaggtggttcctgggggtgattggggttctgcttggggggttggctctctttttg

SEQ ID NO: 324957 - DNA, 75 bp, Artificial Sequence
  Synthetic
ttgtttggcaatgggctgagtaggtggttcctgggggtgatcggggttctgcttgggggattggctctctttttg

SEQ ID NO: 324958 - DNA, 75 bp, Artificial Sequence
  Synthetic
ttgtttggcaatgggctgagtaggtggttcctgggggtgatcggggttctgcttgggggtttggctctctttttg

SEQ ID NO: 324959 - DNA, 75 bp, Artificial Sequence
  Synthetic
ttgtttggcaatgggctgagtaggtggttcctgggggtgatcggggttctgcttgggggcttggctctctttttg

SEQ ID NO: 324960 - DNA, 75 bp, Artificial Sequence
  Synthetic
ttgtttggcaatgggctgagtaggtggttcctgggggtgatcggggttctgcttggggggttggctctctttttg

SEQ ID NO: 324961 - DNA, 75 bp, Artificial Sequence
  Synthetic
ttgtttggcaatgggctgagtaggtggttcctgggggtgatgggggttctgcttgggggattggctctctttttg

SEQ ID NO: 324962 - DNA, 75 bp, Artificial Sequence
  Synthetic
ttgtttggcaatgggctgagtaggtggttcctgggggtgatgggggttctgcttgggggtttggctctctttttg

SEQ ID NO: 324963 - DNA, 75 bp, Artificial Sequence
  Synthetic
ttgtttggcaatgggctgagtaggtggttcctgggggtgatgggggttctgcttgggggcttggctctctttttg

SEQ ID NO: 324964 - DNA, 75 bp, Artificial Sequence
  Synthetic
ttgtttggcaatgggctgagtaggtggttcctgggggtgatgggggttctgcttggggggttggctctctttttg

SEQ ID NO: 324965 - DNA, 75 bp, Artificial Sequence
  Synthetic
ttgtttggcaatgggctgagtaggtggctcctgggggtgataggggttctgcttgggggattggctctctttttg

SEQ ID NO: 324966 - DNA, 75 bp, Artificial Sequence
  Synthetic
ttgtttggcaatgggctgagtaggtggctcctgggggtgataggggttctgcttgggggtttggctctctttttg

SEQ ID NO: 324967 - DNA, 75 bp, Artificial Sequence
  Synthetic
ttgtttggcaatgggctgagtaggtggctcctgggggtgataggggttctgcttgggggcttggctctctttttg

SEQ ID NO: 324968 - DNA, 75 bp, Artificial Sequence
  Synthetic
ttgtttggcaatgggctgagtaggtggctcctgggggtgataggggttctgcttggggggttggctctctttttg

SEQ ID NO: 324969 - DNA, 75 bp, Artificial Sequence
  Synthetic
ttgtttggcaatgggctgagtaggtggctcctgggggtgattggggttctgcttgggggattggctctctttttg

SEQ ID NO: 324970 - DNA, 75 bp, Artificial Sequence
  Synthetic
ttgtttggcaatgggctgagtaggtggctcctgggggtgattggggttctgcttgggggtttggctctctttttg

SEQ ID NO: 324971 - DNA, 75 bp, Artificial Sequence
  Synthetic
ttgtttggcaatgggctgagtaggtggctcctgggggtgattggggttctgcttgggggcttggctctctttttg

SEQ ID NO: 324972 - DNA, 75 bp, Artificial Sequence
  Synthetic
ttgtttggcaatgggctgagtaggtggctcctgggggtgattggggttctgcttggggggttggctctctttttg

SEQ ID NO: 324973 - DNA, 75 bp, Artificial Sequence
  Synthetic
ttgtttggcaatgggctgagtaggtggctcctgggggtgatcggggttctgcttgggggattggctctctttttg

SEQ ID NO: 324974 - DNA, 75 bp, Artificial Sequence
  Synthetic
ttgtttggcaatgggctgagtaggtggctcctgggggtgatcggggttctgcttgggggtttggctctctttttg

SEQ ID NO: 324975 - DNA, 75 bp, Artificial Sequence
  Synthetic
ttgtttggcaatgggctgagtaggtggctcctgggggtgatcggggttctgcttgggggcttggctctctttttg

SEQ ID NO: 324976 - DNA, 75 bp, Artificial Sequence
  Synthetic
ttgtttggcaatgggctgagtaggtggctcctgggggtgatcggggttctgcttggggggttggctctctttttg

SEQ ID NO: 324977 - DNA, 75 bp, Artificial Sequence
  Synthetic
ttgtttggcaatgggctgagtaggtggctcctgggggtgatgggggttctgcttgggggattggctctctttttg

SEQ ID NO: 324978 - DNA, 75 bp, Artificial Sequence
  Synthetic
ttgtttggcaatgggctgagtaggtggctcctgggggtgatgggggttctgcttgggggtttggctctctttttg

SEQ ID NO: 324979 - DNA, 75 bp, Artificial Sequence
  Synthetic
ttgtttggcaatgggctgagtaggtggctcctgggggtgatgggggttctgcttgggggcttggctctctttttg

SEQ ID NO: 324980 - DNA, 75 bp, Artificial Sequence
  Synthetic
ttgtttggcaatgggctgagtaggtggctcctgggggtgatgggggttctgcttggggggttggctctctttttg

SEQ ID NO: 324981 - DNA, 75 bp, Artificial Sequence
  Synthetic
ttgtttggcaatgggctgagtaggtgggtcctgggggtgataggggttctgcttgggggattggctctctttttg

SEQ ID NO: 324982 - DNA, 75 bp, Artificial Sequence
  Synthetic
ttgtttggcaatgggctgagtaggtgggtcctgggggtgataggggttctgcttgggggtttggctctctttttg

SEQ ID NO: 324983 - DNA, 75 bp, Artificial Sequence
  Synthetic
ttgtttggcaatgggctgagtaggtgggtcctgggggtgataggggttctgcttgggggcttggctctctttttg

SEQ ID NO: 324984 - DNA, 75 bp, Artificial Sequence
  Synthetic
ttgtttggcaatgggctgagtaggtgggtcctgggggtgataggggttctgcttggggggttggctctctttttg

SEQ ID NO: 324985 - DNA, 75 bp, Artificial Sequence
  Synthetic
ttgtttggcaatgggctgagtaggtgggtcctgggggtgattggggttctgcttgggggattggctctctttttg

SEQ ID NO: 324986 - DNA, 75 bp, Artificial Sequence
  Synthetic
ttgtttggcaatgggctgagtaggtgggtcctgggggtgattggggttctgcttgggggtttggctctctttttg

SEQ ID NO: 324987 - DNA, 75 bp, Artificial Sequence
  Synthetic
ttgtttggcaatgggctgagtaggtgggtcctgggggtgattggggttctgcttgggggcttggctctctttttg

SEQ ID NO: 324988 - DNA, 75 bp, Artificial Sequence
  Synthetic
ttgtttggcaatgggctgagtaggtgggtcctgggggtgattggggttctgcttggggggttggctctctttttg

SEQ ID NO: 324989 - DNA, 75 bp, Artificial Sequence
  Synthetic
ttgtttggcaatgggctgagtaggtgggtcctgggggtgatcggggttctgcttgggggattggctctctttttg

SEQ ID NO: 324990 - DNA, 75 bp, Artificial Sequence
  Synthetic
ttgtttggcaatgggctgagtaggtgggtcctgggggtgatcggggttctgcttgggggtttggctctctttttg

SEQ ID NO: 324991 - DNA, 75 bp, Artificial Sequence
  Synthetic
ttgtttggcaatgggctgagtaggtgggtcctgggggtgatcggggttctgcttgggggcttggctctctttttg

SEQ ID NO: 324992 - DNA, 75 bp, Artificial Sequence
  Synthetic
ttgtttggcaatgggctgagtaggtgggtcctgggggtgatcggggttctgcttggggggttggctctctttttg

SEQ ID NO: 324993 - DNA, 75 bp, Artificial Sequence
  Synthetic
ttgtttggcaatgggctgagtaggtgggtcctgggggtgatgggggttctgcttgggggattggctctctttttg

SEQ ID NO: 324994 - DNA, 75 bp, Artificial Sequence
  Synthetic
ttgtttggcaatgggctgagtaggtgggtcctgggggtgatgggggttctgcttgggggtttggctctctttttg

SEQ ID NO: 324995 - DNA, 75 bp, Artificial Sequence
  Synthetic
ttgtttggcaatgggctgagtaggtgggtcctgggggtgatgggggttctgcttgggggcttggctctctttttg

SEQ ID NO: 324996 - DNA, 75 bp, Artificial Sequence
  Synthetic
ttgtttggcaatgggctgagtaggtgggtcctgggggtgatgggggttctgcttggggggttggctctctttttg

SEQ ID NO: 324997 - DNA, 75 bp, Artificial Sequence
  Synthetic
tcacaccagattggatggaaccattgtggtggttgaattttcaaccactaggagccataacattgggggcctgga

SEQ ID NO: 324998 - DNA, 75 bp, Artificial Sequence
  Synthetic
tttgtttgagcctaacattgaaagagtggaaggaacattccctaattcagaaatcgagatgctggaacagtttct

SEQ ID NO: 324999 - DNA, 75 bp, Artificial Sequence
  Synthetic
gattcatttgggctgccatttccatgttccggagaaaaaagatgatggtggacctaaggtttttagctcacctca

SEQ ID NO: 325000 - DNA, 75 bp, Artificial Sequence
  Synthetic
ctcaacaccagctgatgttgacttcatcaccaagaccctcaaagcaaaagaagtggaagcctatgctgatctttg

SEQ ID NO: 325001 - DNA, 75 bp, Artificial Sequence
  Synthetic
atcaccaagaccctcaaagcaaaagaagtggaagcctatgctgatctttgtgacagccactacctaaagcctgag

SEQ ID NO: 325002 - DNA, 75 bp, Artificial Sequence
  Synthetic
aaaacagggctggcacgcagttattgtgtctgtgggtgactagggaatgttggctttagaaggatttccttaaga

SEQ ID NO: 325003 - DNA, 75 bp, Artificial Sequence
  Synthetic
acaaaactcaggacctcctagctggcctgcatgcaaggagcaacaagcaaacatcattgaatcgagggacagtca

SEQ ID NO: 325004 - DNA, 75 bp, Artificial Sequence
  Synthetic
catgcaaggagcaacaagcaaacatcattgaatcgagggacagtcaaactcccgccctggctaccaaagccatca

SEQ ID NO: 325005 - DNA, 75 bp, Artificial Sequence
  Synthetic
atgcagggcatactgcactttacatccagcctccttcactcttgtgttcagagcttttacaagtcttatttcgtc

SEQ ID NO: 325006 - DNA, 75 bp, Artificial Sequence
  Synthetic
accatgtcgctgagcaaatgctccaacgttgacctcaaatctgttgcaatgaatgccaacactgtcaggcttgag

SEQ ID NO: 325007 - DNA, 75 bp, Artificial Sequence
  Synthetic
agatacagggtaaaacaaagggagatgaggactacagagctctggacgccacatcgggaggaactctcagccact

SEQ ID NO: 325008 - DNA, 75 bp, Artificial Sequence
  Synthetic
agttcaagtgcccgtcaggaattttctctccaaggagtggaagggaagaagtggaagagaatggcagcaaatcag

SEQ ID NO: 325009 - DNA, 75 bp, Artificial Sequence
  Synthetic
cttggtcctggctctataaacataaactcatccaatgatgccaagaagtggaatcaggggcactacacaacaaag

SEQ ID NO: 325010 - DNA, 75 bp, Artificial Sequence
  Synthetic
aaaaagaagacagatggctcgtacagtgtcttggatgaggatgatgagcctggggccctgcaaggttaccctcat

SEQ ID NO: 325011 - DNA, 75 bp, Artificial Sequence
  Synthetic
ggaaggggctcagcacagaaggctagtcttataaaactgctgatgatgtcttctatttctgccatgaagcacggg

SEQ ID NO: 325012 - DNA, 75 bp, Artificial Sequence
  Synthetic
cagtggtctctttgggtctcctgtttagcacaggagctagctagtgccctgaagcagcactgcagggctggcgag

SEQ ID NO: 325013 - DNA, 75 bp, Artificial Sequence
  Synthetic
gaaggctctgacgactcagcgatcatgattagcatacgccctaagtcagacatggatgaagttcgatccaggttc

SEQ ID NO: 325014 - DNA, 75 bp, Artificial Sequence
  Synthetic
gaaataggggagaatggagagggcaaccaagatgatgttaggatcgagatggccaggcccagaagggtaaggcac

SEQ ID NO: 325015 - DNA, 75 bp, Artificial Sequence
  Synthetic
gttcatgacggctggccccactgggagatactcctttaaggctgctgctgcagcacatgtccaagtgggaaggct

SEQ ID NO: 325016 - DNA, 75 bp, Artificial Sequence
  Synthetic
agtgggacaaacttagggcctcatttgcatggctgagcacagacccatctgaaacattgagggatggtccttttc

SEQ ID NO: 325017 - DNA, 75 bp, Artificial Sequence
  Synthetic
gaaaacagagttcacagcagcatgaagagggtccctgaaggagttgtaaacttctgtcttgctggctccgcgcat

SEQ ID NO: 325018 - DNA, 75 bp, Artificial Sequence
  Synthetic
acaaggtacacccagatggagggctttgtctctcctcccatgctgcctaagccccaaaagatgctagggaaactg

SEQ ID NO: 325019 - DNA, 75 bp, Artificial Sequence
  Synthetic
tgtccagtcaggattatggaaaggggcttcaggatcagggaacttcaaaacccagatgaggtcaagatgagagtg

SEQ ID NO: 325020 - DNA, 75 bp, Artificial Sequence
  Synthetic
gaaatgatcatagaggccttctctactcttgtgataccacagccatcagaggtcatcaggaaatcaaggaccatg

SEQ ID NO: 325021 - DNA, 75 bp, Artificial Sequence
  Synthetic
gatgggcctttgagaactaagctacaggtatatctccttaggaagcatctggactgcatggtgcgaattgcatct

SEQ ID NO: 325022 - DNA, 75 bp, Artificial Sequence
  Synthetic
ctcttgtgataccacagccatcagaggtcatcaggaaatcaaggaccatgactttatgcctcttatcgaattact

SEQ ID NO: 325023 - DNA, 75 bp, Artificial Sequence
  Synthetic
tctaaaaggcaacctcatcttcctggatgtcccaaaatttgtagatggcagctacatgcagacatatcatagttc

SEQ ID NO: 325024 - DNA, 75 bp, Artificial Sequence
  Synthetic
attccatgccatctcaggccggtccacaaaccttgagaacatggtgaacagctggtacattgggtactacaagaa

SEQ ID NO: 325025 - DNA, 75 bp, Artificial Sequence
  Synthetic
gattctgggggtgataggggttctgctgggggggttggctctctttttcttaatcatgtccttgttcaaactggg

SEQ ID NO: 325026 - DNA, 75 bp, Artificial Sequence
  Synthetic
ttgtggagatggaagaggacaagcccagcagccctgagtttctagggtggggggacacagattcccctaagaagc

SEQ ID NO: 325027 - DNA, 75 bp, Artificial Sequence
  Synthetic
aatggaagcagaaccttgaggagcgtgtcctgagagagattgggaccaagaacatcctggaccttgcatccatga

SEQ ID NO: 325028 - DNA, 75 bp, Artificial Sequence
  Synthetic
gatggaccaagctgccatcacaatgtgtgcgatcatgggtaaggaaggctgtagagggctccttactgagaagag

SEQ ID NO: 325029 - DNA, 75 bp, Artificial Sequence
  Synthetic
tctgatcatcaagaagctgaaggagacaggtggagatgactgggtgagggatacaaagttcatcattgtctttgc

SEQ ID NO: 325030 - DNA, 75 bp, Artificial Sequence
  Synthetic
accaaagagtaccataggtccaaactgctggagaagatggccacattgattgagaagggggttatgtggtacatt

SEQ ID NO: 325031 - DNA, 75 bp, Artificial Sequence
  Synthetic
taggccaggaggtggtgttggctacaagggaaaaggtgtgtggactggagtgatggaggacacccatgttcaaat

SEQ ID NO: 325032 - DNA, 75 bp, Artificial Sequence
  Synthetic
aaggcatcagggaaaatgtcaaactcagggtctaagaggttgatggcactccaagagaaatatggactggttgag

SEQ ID NO: 325033 - DNA, 75 bp, Artificial Sequence
  Synthetic
gcagccttaaaggagtacctcccagtggggcctgctgtcatgaacctgaaggtcgagaattatcccccagagatg

SEQ ID NO: 325034 - DNA, 75 bp, Artificial Sequence
  Synthetic
tggggcctgctgtcatgaacctgaaggtcgagaattatcccccagagatgatgtgcatggcctttgggtccttga

SEQ ID NO: 325035 - DNA, 75 bp, Artificial Sequence
  Synthetic
gccctggctctataaacataaactcatccaatgatgccaagaagtggaatcaggggcactacacaacaaagctag

SEQ ID NO: 325036 - DNA, 75 bp, Artificial Sequence
  Synthetic
aggagccagcaaaacagaggtttacaactccttcagggatcctctccatgctgctgtgaactctgtcttctttcc

SEQ ID NO: 325037 - DNA, 75 bp, Artificial Sequence
  Synthetic
aactccttcagggatcctctccatgctgctgtgaactctgtcttctttcccaatgatgttcgggtgaagtggctg

SEQ ID NO: 325038 - DNA, 75 bp, Artificial Sequence
  Synthetic
gcggctagagatcaatagatgtgaggctattgacaaaactcaggacctactagctggcctgcatgcgaggagcaa

SEQ ID NO: 325039 - DNA, 75 bp, Artificial Sequence
  Synthetic
gagacactgatatatcagagtcagccgcagcatacctctggagcaatcgagacctcttctcctttgggaagaagg

SEQ ID NO: 325040 - DNA, 75 bp, Artificial Sequence
  Synthetic
aagggagcggaaatatgaaggaatgtgtcacaactgggagggcgctccttcctgcggtgaacccaggacaagagg

SEQ ID NO: 325041 - DNA, 75 bp, Artificial Sequence
  Synthetic
cactcttgtgttcagagcttctacaagtcttatttcgtctcgaaactcaaggagggctacatgggggaaagcatc

SEQ ID NO: 325042 - DNA, 75 bp, Artificial Sequence
  Synthetic
agtggggtggtggatgtcatagaaggctctgacgactcagcgatcatgattagcatacgccctaagtcagacatg

SEQ ID NO: 325043 - DNA, 75 bp, Artificial Sequence
  Synthetic
gagctctcagagggatcacttgacattgaatccatctttgatggggcacctatcttgtggtctgctgaggtggaa

SEQ ID NO: 325044 - DNA, 75 bp, Artificial Sequence
  Synthetic
acacagtgtattgtgtcgagtataattctgaattccatttccacaggcacttggttagacccacactgagatgga

SEQ ID NO: 325045 - DNA, 75 bp, Artificial Sequence
  Synthetic
agaattggggatagtccagttattaggatctcaggtaacccaagtctaagccttcgcttctctatggcttcaaga

SEQ ID NO: 325046 - DNA, 75 bp, Artificial Sequence
  Synthetic
ctctatctggaggagggccacatccagaattggggatagtccagttattaggatctcaggtaacccaagtctaag

SEQ ID NO: 325047 - DNA, 75 bp, Artificial Sequence
  Synthetic
atgaaggctacaagcaacttttccaaagactgggagctctactcagaagtccagaccaaagagtaccataggtcc

SEQ ID NO: 325048 - DNA, 75 bp, Artificial Sequence
  Synthetic
aaagatacttttggccttttgttattctgtggaagaggccccgccagttctctctaccggtttccattgcccagc

SEQ ID NO: 325049 - DNA, 75 bp, Artificial Sequence
  Synthetic
agtgcttggaaggaggggcctcattctctcttacctacctcatacagtgcgctcagctcctgcaccactacatgc

SEQ ID NO: 325050 - DNA, 75 bp, Artificial Sequence
  Synthetic
tctaaaaggcaacctcatcttcctggatgtcccaaaattcgtagatggcagctacatgcagacatatcatagttc

SEQ ID NO: 325051 - DNA, 75 bp, Artificial Sequence
  Synthetic
tgttcttgatggagaagaacatatgagctgcctgcaggaaccacacagatggcttcccactaggccacctaagag

SEQ ID NO: 325052 - DNA, 75 bp, Artificial Sequence
  Synthetic
gtttggaaccttcatggggatgctgatatcagacccagatccagccctagggttcttcctcatggacaaccctgc

SEQ ID NO: 325053 - DNA, 75 bp, Artificial Sequence
  Synthetic
atatcagacccagatccagccctagggttcttcctcatggacaaccctgcattcgcagggggagcaggatttaga

SEQ ID NO: 325054 - DNA, 75 bp, Artificial Sequence
  Synthetic
ctggggggattggctctctttttcttaatcatgtctttgttcaaactgggaacaaaacaggtatttcgatcaagg

SEQ ID NO: 325055 - DNA, 75 bp, Artificial Sequence
  Synthetic
cggccaacaatgatgaaagtcatctggttctcctctctggtctgcttagtcattcaatgcagtggggattcgggc

SEQ ID NO: 325056 - DNA, 75 bp, Artificial Sequence
  Synthetic
ttctggtctaatgaccctctgggagcagtgctctcaggggagttggctcacagtgtgcatgtttcgtagtcctgg

SEQ ID NO: 325057 - DNA, 75 bp, Artificial Sequence
  Synthetic
ggttcttcctcatggacaaccctgcattcgcagggggagcaggatttagattcaatctgtggagagcctgcaaga

SEQ ID NO: 325058 - DNA, 75 bp, Artificial Sequence
  Synthetic
acgcagttaatgtgtctgtgggtgactagggaatgttggttttagaaggatttccttaagctggggggcggtaaa

SEQ ID NO: 325059 - DNA, 75 bp, Artificial Sequence
  Synthetic
ttgccacagacttgaggtcaatgttggagcatttgctcagcgacatggtttccaaatgaagggggttctttgtgt

SEQ ID NO: 325060 - DNA, 75 bp, Artificial Sequence
  Synthetic
acacagagacggccaacaatgatgaaagtcatctggttctcctctctgatctgcttagtcattcaatgcagtggg

SEQ ID NO: 325061 - DNA, 75 bp, Artificial Sequence
  Synthetic
agggcagaaaccaggctctcaatcactccggtgagggtagcacagagccttcccacttggacatgtgctgcagca

SEQ ID NO: 325062 - DNA, 75 bp, Artificial Sequence
  Synthetic
cagcgaggtggacgctctcaggtgagctactacccagctgagaattcttactcgaggtggagtggacttctaagc

SEQ ID NO: 325063 - DNA, 75 bp, Artificial Sequence
  Synthetic
tactggggggacaggaagaagtatcaggccttattgaacaggatgggccttcctgaagactgggtggagcagata

SEQ ID NO: 325064 - DNA, 75 bp, Artificial Sequence
  Synthetic
aggccttattgaacaggatgggccttcctgaagactgggtggagcagatagatgagaatcctggagtcctctaca

SEQ ID NO: 325065 - DNA, 75 bp, Artificial Sequence
  Synthetic
gtctgatatgatagttcctgggccttcatacaaggggaaagtcttttttgaacggccaacttttgatggatacgt

SEQ ID NO: 325066 - DNA, 75 bp, Artificial Sequence
  Synthetic
gagaaaccattcacaatttcagggctacgtggggcagcgaggtgggcgctcacaggtaagctactacccagctga

SEQ ID NO: 325067 - DNA, 75 bp, Artificial Sequence
  Synthetic
ggtggtggcagcaggagtgtacctcctctcacgtcattgctttcgctttagttcaagcatccatggcaggggctc

SEQ ID NO: 325068 - DNA, 75 bp, Artificial Sequence
  Synthetic
gcagttcagactcagggactagttctggtctactgccctcggatagggttctctggataggtgatgttgcttgtc

SEQ ID NO: 325069 - DNA, 75 bp, Artificial Sequence
  Synthetic
aaggcatcagggaaaatgtcaaactcagggtctaagaggttgatggcactccaagagaaatatgggctggttgag

SEQ ID NO: 325070 - DNA, 75 bp, Artificial Sequence
  Synthetic
ctctggataggtgatgttgcttgtcagcctatgacacccatccctgaagagacatttctggagctgaagagtttt

SEQ ID NO: 325071 - DNA, 75 bp, Artificial Sequence
  Synthetic
cagccctttgatgttgcatggatggatgttggccactctcataaaatcatcatgagggagcacaagaccaaatgg

SEQ ID NO: 325072 - DNA, 75 bp, Artificial Sequence
  Synthetic
agggagagaaacattgttaggagccgcatagacttgttccaagagccagtggacttgcggtgcaaggcagaagat

SEQ ID NO: 325073 - DNA, 75 bp, Artificial Sequence
  Synthetic
ctttcgctttagttcaagcatccatggcaggggctcaacacagaaggctagccttataaaactgctgatgatgtc

SEQ ID NO: 325074 - DNA, 75 bp, Artificial Sequence
  Synthetic
ggacttgcggtgcaaggcagaagatctggtgtcagaggtgtggtttggcctgaaaaggactaagcttggaccccg

SEQ ID NO: 325075 - DNA, 75 bp, Artificial Sequence
  Synthetic
cactcagctctctctgggagtagcacctcatgtccttgtagtacatgtccaacagctgctcaagtccaggctcaa

SEQ ID NO: 325076 - DNA, 75 bp, Artificial Sequence
  Synthetic
gtagttctgccacaagtggcaagaaaagcacggagattcaattccactcaggatcattggttgggaaaacagcaa

SEQ ID NO: 325077 - DNA, 75 bp, Artificial Sequence
  Synthetic
aacagctgctcaagtccaggctcaagctggtgaagaggattttttggattgccaaataaccatactgtgttggtc

SEQ ID NO: 325078 - DNA, 75 bp, Artificial Sequence
  Synthetic
tcaggtggggtcaccaccataagccaagtggtcagaatgaacttcttccctggttttagcctagaagctgagaag

SEQ ID NO: 325079 - DNA, 75 bp, Artificial Sequence
  Synthetic
gcctgacagtgttggcattcattgccacagatttgaggtcaacgttggagcatttgctcagcgacatggtttcca

SEQ ID NO: 325080 - DNA, 75 bp, Artificial Sequence
  Synthetic
agagtatctccatcctcaagcatgtcttgttcatggtcttgaatggcccatacactgaggagtacaagctggaaa

SEQ ID NO: 325081 - DNA, 75 bp, Artificial Sequence
  Synthetic
ctcaaaatgtctcaaaattaaggttaagaggatcaacctaaaatgtaagaagtcatcatcatattttgttcctga

SEQ ID NO: 325082 - DNA, 75 bp, Artificial Sequence
  Synthetic
atggtttctccagaatgatggcaacactagaggtgaacccaccagagcaaaggattggccaatgcactggctgcc

SEQ ID NO: 325083 - DNA, 75 bp, Artificial Sequence
  Synthetic
aggattggccaatgcactggctgccatctagaatgtgtaaatgggggtgtgaggctaatcactctaactagtgag

SEQ ID NO: 325084 - DNA, 75 bp, Artificial Sequence
  Synthetic
tgtgtttaaccagtgtgagagtgagagtctacctcaaccctttgatgttgcatggatggatgtaggccactctca

SEQ ID NO: 325085 - DNA, 75 bp, Artificial Sequence
  Synthetic
ctctaggaggcttcagcaagccccagaagacatttattaggccaggaggtggtgttggctacaagggaaaaggtg

SEQ ID NO: 325086 - DNA, 75 bp, Artificial Sequence
  Synthetic
tggcaagaaaaacacagagattcaattccactcagggtcattagttgggaaaacagcaatacacgtcaaaggggc

SEQ ID NO: 325087 - DNA, 75 bp, Artificial Sequence
  Synthetic
ggtgttggctacaagggaaaaggtgtgtggactggagtgatggaggacacccatgttcaaattctgatagatgga

SEQ ID NO: 325088 - DNA, 75 bp, Artificial Sequence
  Synthetic
cctcagtgctaccctgcaaagaaatggttgttcatcattattgtcatcctccttggatatgcaggcctcatgcta

SEQ ID NO: 325089 - DNA, 75 bp, Artificial Sequence
  Synthetic
tttggtggatggaactgaattcacatttgagggcagttgcatgttcccagatggttgtgacgcagtggactgcac

SEQ ID NO: 325090 - DNA, 75 bp, Artificial Sequence
  Synthetic
ataaagaaactgatgagatctgtgagctgcttgatggggaaattgatggataggggaaggcaagtgatccatgaa

SEQ ID NO: 325091 - DNA, 75 bp, Artificial Sequence
  Synthetic
taggggaaggcaagtgatccatgaagaaataggggagaatagagagggcaaccaagatgatgttaggatcgagat

SEQ ID NO: 325092 - DNA, 75 bp, Artificial Sequence
  Synthetic
ttgggaagaaggagccatcctgcagctggatctgcttgaaaactctagataattgggcctggtcacatgcctcag

SEQ ID NO: 325093 - DNA, 75 bp, Artificial Sequence
  Synthetic
caaccttatcttcctggatgtcccaaaatttgtggatggcagctacatgcagacatatcatagcactgtgcccac

SEQ ID NO: 325094 - DNA, 75 bp, Artificial Sequence
  Synthetic
accaagatgatgttaggatcgagatggcaagacccagaagggtgaggcattggatgtactcacctgtcatcctga

SEQ ID NO: 325095 - DNA, 75 bp, Artificial Sequence
  Synthetic
ccaaggtattgacaatagagctatggggaacattttcagggactgtctcgagggttctcttagaaagcaagggtt

SEQ ID NO: 325096 - DNA, 75 bp, Artificial Sequence
  Synthetic
ctttgttcaagctgggaacaaaacaggtatttcgatcaaggacgaagctggcttagatgggcaaatttctggtct

SEQ ID NO: 325097 - DNA, 75 bp, Artificial Sequence
  Synthetic
acatctgtgaggagatgtcgctgggcaggagactgccagtctgggtgcccctctcatttcacgtccaactccttt

SEQ ID NO: 325098 - DNA, 75 bp, Artificial Sequence
  Synthetic
ggaggaggacattgacttttcagatgtcatagctgtagagctctcagagggatcacttgacattgaatccatctt

SEQ ID NO: 325099 - DNA, 75 bp, Artificial Sequence
  Synthetic
acacaaagacccccttcatttggaaaccatgtcgctgagcaaatgctccaacgttgacctcaaatctgttgcaat

SEQ ID NO: 325100 - DNA, 75 bp, Artificial Sequence
  Synthetic
gcctgcggctgctttaatgcagccccttcatgcatcttttggaggaaatgggtagagaacccacatgggatcatc

SEQ ID NO: 325101 - DNA, 75 bp, Artificial Sequence
  Synthetic
ggtagagaacccacatgggatcatctggaaagtatctccatgtgctgcatgggtcccatcagcagtcatagagct

SEQ ID NO: 325102 - DNA, 75 bp, Artificial Sequence
  Synthetic
agggctccttactgagaagagatgcatggcagccatacgagagcaggtgcggccattccttatattcttgcaaat

SEQ ID NO: 325103 - DNA, 75 bp, Artificial Sequence
  Synthetic
gggtcccatcagcagtcatagagctaacaatgccctcaggggaagtgaggacattccaccccatgagcggcatcc

SEQ ID NO: 325104 - DNA, 75 bp, Artificial Sequence
  Synthetic
acattccaccccatgagcggcatccctacacaggtcttcaagggtgtgagtgtgacttacttaggctcagatatg

SEQ ID NO: 325105 - DNA, 75 bp, Artificial Sequence
  Synthetic
ctacacaggtcttcaagggtgtgagtgtgacttacttaggctcagatatggaggtgtctggcttgactgacctgt

SEQ ID NO: 325106 - DNA, 75 bp, Artificial Sequence
  Synthetic
acatgcctcagttctcctggcaaatgataggaaaacccaaggcattgataatagatctatggggaatattttcag

SEQ ID NO: 325107 - DNA, 75 bp, Artificial Sequence
  Synthetic
gaggtgtctggcttgactgacctgtgtgagatagaagagctcaagtctaagaaactggcattagccccctgcaat

SEQ ID NO: 325108 - DNA, 75 bp, Artificial Sequence
  Synthetic
cggccaacaatgatgaaagtcatctggttctcctctctgatctgctttgtcattcaatgcagtggggactcgggc

SEQ ID NO: 325109 - DNA, 75 bp, Artificial Sequence
  Synthetic
gatctaaggtttttagctcacctcagttctaaatctgagtctaggtcatctgacccgtttagggaagcaatgaca

SEQ ID NO: 325110 - DNA, 75 bp, Artificial Sequence
  Synthetic
tcacctgctgggttactctgagaagatatgtcagatagatcggctgatacatgtttcgtcatggctcagaaacca

SEQ ID NO: 325111 - DNA, 75 bp, Artificial Sequence
  Synthetic
gatgtcccaaaatttgtagatggcagctatatgcagacatatcatagttctgtacccacaggggctaatatccca

SEQ ID NO: 325112 - DNA, 75 bp, Artificial Sequence
  Synthetic
aagagggtccttttcagttaattatagaggccttcgactaagcctctcagaaattactgcaacatgcacaggaga

SEQ ID NO: 325113 - DNA, 75 bp, Artificial Sequence
  Synthetic
ccctgtgatgctgattggcttgggatgcttgtcgtgaagaaggccaaggggtctgatatgatagttcctgggcct

SEQ ID NO: 325114 - DNA, 75 bp, Artificial Sequence
  Synthetic
gacatttctggagctgaagagttttagccaaagtgaattcccagacatatgcaaaattgatggcattgtgttcaa

SEQ ID NO: 325115 - DNA, 75 bp, Artificial Sequence
  Synthetic
ttccaactgcgggggtatctgaagccacaaccaagaccctgatggaggcctactctctgtggcaagatgccttca

SEQ ID NO: 325116 - DNA, 75 bp, Artificial Sequence
  Synthetic
agccctacagactggctgaatgccttgtttggcaatgggctgagtaggtggattctgggggtgataggggttcta

SEQ ID NO: 325117 - DNA, 75 bp, Artificial Sequence
  Synthetic
ctgatggcacactatttaaataggtgcccattccacaacctcatcaggtttgatgaagagctgagaactgcagcc

SEQ ID NO: 325118 - DNA, 75 bp, Artificial Sequence
  Synthetic
taatcatgtctctgttcaaattgggaactaaacaggtatttcgatcaaggacgaagctggcctagatgggtaaat

SEQ ID NO: 325119 - DNA, 75 bp, Artificial Sequence
  Synthetic
gtacaagagagctcatccaaggattttgtgtgctacaaggaagggactgggccttgttctgaatcagaagaaaag

SEQ ID NO: 325120 - DNA, 75 bp, Artificial Sequence
  Synthetic
agcaggttgtgaacatggggaagaggcatctgaagccaagtgtagatgctcacttgtgcacaagcccggagaagt

SEQ ID NO: 325121 - DNA, 75 bp, Artificial Sequence
  Synthetic
tggcctatgaaggcctcgatcctgcattgatcatcaagaagctgaaggagacaggtggggatgattgggtgagag

SEQ ID NO: 325122 - DNA, 75 bp, Artificial Sequence
  Synthetic
tcattgcgtaagcctctgttagactgttgggacttctttattcctatccgcaaaaagaagacagatggctcatac

SEQ ID NO: 325123 - DNA, 75 bp, Artificial Sequence
  Synthetic
tacacgtcaaaggggcattggtagatggaactgaattcacatttgagggtagttgcatgttcccagatggttgtg

SEQ ID NO: 325124 - DNA, 75 bp, Artificial Sequence
  Synthetic
taccctgcaaagaagtggctgttcatcattattgtcatcctccttggatatgcaggcctcatgctactcaccaat

SEQ ID NO: 325125 - DNA, 75 bp, Artificial Sequence
  Synthetic
tgcaggcctcatgctactcaccaatgtcctcaaggcaattgggatttggggatcatgggtcatagctccagtgaa

SEQ ID NO: 325126 - DNA, 75 bp, Artificial Sequence
  Synthetic
gaggtcaccaatggctggccaatctcttccccagatggtgtttagggctgcagttctcagctcttcatcaaacct

SEQ ID NO: 325127 - DNA, 75 bp, Artificial Sequence
  Synthetic
ttgctacagatttgaggtcaacgttggagcatttgctcagcgacatggtttccaaatgaagggggttctttgtgt

SEQ ID NO: 325128 - DNA, 75 bp, Artificial Sequence
  Synthetic
ctctatctggaggagggccacatccagaattggggatagtccagttattaggatctcaggcaaccctagtctaag

SEQ ID NO: 325129 - DNA, 75 bp, Artificial Sequence
  Synthetic
tgggagggcgcttcttcctgcggtgaacccaggtcaagaggcatgtctgcacttcacggcacctgggagtccgga

SEQ ID NO: 325130 - DNA, 75 bp, Artificial Sequence
  Synthetic
gacataggggctgtgccagactcagcatcacaactgggttcatcaatcaatgctgggttgatcacaatccagctc

SEQ ID NO: 325131 - DNA, 75 bp, Artificial Sequence
  Synthetic
tcatcaccttgacaaggtacacccagatggagggctttgtctctccccctatgctgcctaagccccaaaagatgc

SEQ ID NO: 325132 - DNA, 75 bp, Artificial Sequence
  Synthetic
acgttgacctcaaatctgttgcaatgaatgccaacacagtcaggcttgagccatctctaggagagtaccccactc

SEQ ID NO: 325133 - DNA, 75 bp, Artificial Sequence
  Synthetic
aactaagctacaggtatacctcctcaggaagcatctggattgcatggtgcgaattgcttctcagccattcagctt

SEQ ID NO: 325134 - DNA, 75 bp, Artificial Sequence
  Synthetic
gccagtctgggtgcccccctcatttcacatccaactccttttctaatgattgggcaggtaagatggacagggctg

SEQ ID NO: 325135 - DNA, 75 bp, Artificial Sequence
  Synthetic
tgggcaggtaagatggacagggctggtctagggttcagtggttgctctgatggatgtggaggagcagcctgcggc

SEQ ID NO: 325136 - DNA, 75 bp, Artificial Sequence
  Synthetic
tggatgtggaggagcagcctgcggctgctttaatgcagccccttcatgcatcttctggaggaaatgggtagagaa

SEQ ID NO: 325137 - DNA, 75 bp, Artificial Sequence
  Synthetic
cctcagtgctaccctgcaaagaagtggctgttcatcattattgtcatcctccttggatatgcaggcctcatgcta

SEQ ID NO: 325138 - DNA, 75 bp, Artificial Sequence
  Synthetic
tcttctggaggaaatgggtagagaatccacatgggatcatctggaaagtatctccttgtgccgcatgggtcccat

SEQ ID NO: 325139 - DNA, 75 bp, Artificial Sequence
  Synthetic
tctccttgtgccgcatgggtcccatcggcagtcatagagttaacaatgccctcaggggaggtgaggacattccac

SEQ ID NO: 325140 - DNA, 75 bp, Artificial Sequence
  Synthetic
gtgttgatatcatggagaacccgagggtcttctttggcgtaattgtagtctcgtcaggaggggttctgtccaaca

SEQ ID NO: 325141 - DNA, 75 bp, Artificial Sequence
  Synthetic
ctcaggggaggtgaggacattccaccccatgagtggcatccccacacaagtcttcaagggtgtgagtgtgactta

SEQ ID NO: 325142 - DNA, 75 bp, Artificial Sequence
  Synthetic
ggggacatgatattggattctcttgaagccatagagaagcgaaggcttagacttgggttacctgatatcctaata

SEQ ID NO: 325143 - DNA, 75 bp, Artificial Sequence
  Synthetic
ggcttgactgacctatgtgagatagaggagctcaggtccaagaagctggcattagctccctgcaaccaggctggc

SEQ ID NO: 325144 - DNA, 75 bp, Artificial Sequence
  Synthetic
attagctccctgcaaccaggctggcatgggggttgtaggcaaggttggagagatacagtgcagtagcgaggaaag

SEQ ID NO: 325145 - DNA, 75 bp, Artificial Sequence
  Synthetic
gctattagcagggcactatcattcttcagtttgtttgagcctaacattgaaagagtggaaggaacattccctaat

SEQ ID NO: 325146 - DNA, 75 bp, Artificial Sequence
  Synthetic
ttgggacttctttattcctatccgcaaaaagaagacagatggctcatacagtgtcttggatgaggatgatgagcc

SEQ ID NO: 325147 - DNA, 75 bp, Artificial Sequence
  Synthetic
tgtgtgctactctaagatcactagtgtggaagcagttgcaaactactctgccatacccaccactattggggggct

SEQ ID NO: 325148 - DNA, 75 bp, Artificial Sequence
  Synthetic
gaggctaataactctaaccagtgagctcaagtcagctactgtctgtgcttcccacttttgtagttctgccacaag

SEQ ID NO: 325149 - DNA, 75 bp, Artificial Sequence
  Synthetic
ccatacccaccactattggggggctgaggtttgagagaagccatgacagccagggtaaaatatctggtagccccc

SEQ ID NO: 325150 - DNA, 75 bp, Artificial Sequence
  Synthetic
gaggtttgagagaagccatgacagccagggtaaaatatctggtagccccctggacatcacagctataagaggatc

SEQ ID NO: 325151 - DNA, 75 bp, Artificial Sequence
  Synthetic
cagggtaaaatatctggtagccccctggacatcacagctataagaggatctttttctgttaattatagaggcctt

SEQ ID NO: 325152 - DNA, 75 bp, Artificial Sequence
  Synthetic
tttttctgttaattatagaggccttcgactgagcctctcagaaattactgctacctgcacaggggaggtgacaaa

SEQ ID NO: 325153 - DNA, 75 bp, Artificial Sequence
  Synthetic
acatcattgaatcgagggacagtcaaactcccgccctggctaccaaagccatcaagtgagtcaatagacatcaag

SEQ ID NO: 325154 - DNA, 75 bp, Artificial Sequence
  Synthetic
tgcatagcagcaaaaatagtactgcccatgtaagatgcaaaggggatgagactgcattcagtgtcttggagggag

SEQ ID NO: 325155 - DNA, 75 bp, Artificial Sequence
  Synthetic
ccatgtaagatgcaaaggggatgagactgcattcagtgtcttggagggagtccatagctacactgtcagtctcag

SEQ ID NO: 325156 - DNA, 75 bp, Artificial Sequence
  Synthetic
tccatagctacactgtcagtctcagttttgaccatgcagtagtcgatgagcagtgccaactgaactgtgggggac

SEQ ID NO: 325157 - DNA, 75 bp, Artificial Sequence
  Synthetic
ttttgaccatgcagtagtcgatgagcagtgccaactgaactgtgggggacatgagagtcaagtgactctaaaagg

SEQ ID NO: 325158 - DNA, 75 bp, Artificial Sequence
  Synthetic
cttaagttcaagtgcccgtcaggaattttctctccaaggagtggaggggaagaagtggaagagaatggcagcaaa

SEQ ID NO: 325159 - DNA, 75 bp, Artificial Sequence
  Synthetic
ttttctctccaaggagtggaggggaagaagtggaagagaatggcagcaaatcagaagaaagagaaggagtcccat

SEQ ID NO: 325160 - DNA, 75 bp, Artificial Sequence
  Synthetic
tgtttggcaatgggctgagtaggtggatcctgggggtgataggggttctgcttgggggattggctctctttttca

SEQ ID NO: 325161 - DNA, 75 bp, Artificial Sequence
  Synthetic
gaatgccaacactgtcaggcttgagccatctctaggagagtaccccactcttaggagagacctcgttgaatgctc

SEQ ID NO: 325162 - DNA, 75 bp, Artificial Sequence
  Synthetic
ggcatctgccatgcaagacacagagctcactcatgccctcaacgactcatttaagaggaatctaagcagcaatgt

SEQ ID NO: 325163 - DNA, 75 bp, Artificial Sequence
  Synthetic
ttgtagtgtgttgactctgtcaatggtcaagaggatgggcaagatgaccaacacagtttggttatttggcaaccc

SEQ ID NO: 325164 - DNA, 75 bp, Artificial Sequence
  Synthetic
acacaaagaacccccaaaaaaggaaagacgcaaaggagtgatcatgtcagagtggtccggagttgcagtggagtt

SEQ ID NO: 325165 - DNA, 75 bp, Artificial Sequence
  Synthetic
gtcaagaggatgggcaagatgaccaacacagtttggttatttggcaacccaaaaaatcctcttcaccagcttgag

SEQ ID NO: 325166 - DNA, 75 bp, Artificial Sequence
  Synthetic
atgtactacaaggacatgaggtgctactcccagagagagctgagtgctcttaggtggcctagtgggaagccatct

SEQ ID NO: 325167 - DNA, 75 bp, Artificial Sequence
  Synthetic
gcagagtcttctctgacaccattgatgctggggaatgggaactaacagagttcaaaagcctgaagacatgcaagc

SEQ ID NO: 325168 - DNA, 75 bp, Artificial Sequence
  Synthetic
caccatgctgaactcaatagctttctggagagagaagctgggcgtggctccatggctggttcgaaagccctgttc

SEQ ID NO: 325169 - DNA, 75 bp, Artificial Sequence
  Synthetic
gccaaggattcccttggccttcagccacttcacccgaacatcattgggaaagaagacagagttcacagcagcatg

SEQ ID NO: 325170 - DNA, 75 bp, Artificial Sequence
  Synthetic
ggcggggcctcttccacaggataacaaaaggccaaaagtatctttttgaaggggacatgatattggattctcttg

SEQ ID NO: 325171 - DNA, 75 bp, Artificial Sequence
  Synthetic
ggggacatgatattggattctcttgaagccatagagaagcgaagacttagacttgggttgcctgagattctgata

SEQ ID NO: 325172 - DNA, 75 bp, Artificial Sequence
  Synthetic
gcccattccacaacctcatcaggtttgatgaagagctgagaactgcagccctgaacaccatctggggaagagatt

SEQ ID NO: 325173 - DNA, 75 bp, Artificial Sequence
  Synthetic
agttaatgtatctgtgggtgactaggggatgttggttttagaaggatttccttaagatctgggcggtctttgtgt

SEQ ID NO: 325174 - DNA, 75 bp, Artificial Sequence
  Synthetic
tgcccattccacaacctcatcaggtttgatgaagagctgagaactgcagccctaaacaccatctggggaagagat

SEQ ID NO: 325175 - DNA, 75 bp, Artificial Sequence
  Synthetic
ttgatgaagagctgagaactgcagccctaaacaccatctggggaagagattggccagccattggtgacctcccga

SEQ ID NO: 325176 - DNA, 75 bp, Artificial Sequence
  Synthetic
tggccagccattggtgacctcccgaaggaggtctaattttgtcgaattggatcatgaaatttagcctaattggat

SEQ ID NO: 325177 - DNA, 75 bp, Artificial Sequence
  Synthetic
aaatgccctcggagaaatgtataagaagattgtggagatggaagaggacaagcccagcagccctgagtttctagg

SEQ ID NO: 325178 - DNA, 75 bp, Artificial Sequence
  Synthetic
agcccagcagccctgagtttctagggtggggggacacagattcccctaagaagcatgaattctcacggagcttcc

SEQ ID NO: 325179 - DNA, 75 bp, Artificial Sequence
  Synthetic
cagggggataattctcgaccttcaggttcatgacggctggccccactgggagatactcttttaaggctgctgctg

SEQ ID NO: 325180 - DNA, 75 bp, Artificial Sequence
  Synthetic
tgggaataaagaagtcccaacagtctaacagaggcttacgcaatgaggaagaagtgaataagtggtggttcaagc

SEQ ID NO: 325181 - DNA, 75 bp, Artificial Sequence
  Synthetic
tcttcacattgatagtcttggtgaaggcatcttgccacagagagtaggcctccatcagggtcttcgttgtggctt

SEQ ID NO: 325182 - DNA, 75 bp, Artificial Sequence
  Synthetic
gacaatgatgaactttgtgtccttcacccaatcatctccacctgtctccttcagcttcttgatgatcaaagcagg

SEQ ID NO: 325183 - DNA, 75 bp, Artificial Sequence
  Synthetic
tccatcagggtcttcgttgtggcttcagatacccctgcagttggaatcagggacccaaaggccatgcacatcatc

SEQ ID NO: 325184 - DNA, 75 bp, Artificial Sequence
  Synthetic
acactgtatggttgtttggcaacccgaaaaatcctcttcaccagcttgagcctgggcttgagcaactattggaca

SEQ ID NO: 325185 - DNA, 75 bp, Artificial Sequence
  Synthetic
gcagcacatgtccaagtgggaaggctctgtgcaaccctcacaggagtgattgagagcctggtttctgccctctca

SEQ ID NO: 325186 - DNA, 75 bp, Artificial Sequence
  Synthetic
tcagcatggtggcctcagagagatctacgttatggatgcgaatgcccggcttgtgcagtttggggttgagaccat

SEQ ID NO: 325187 - DNA, 75 bp, Artificial Sequence
  Synthetic
gttcttctccatcaagaacagctgggcaatggaaaccgggagagagaactggcggggcctcttccacaggataac

SEQ ID NO: 325188 - DNA, 75 bp, Artificial Sequence
  Synthetic
ccataagggtcttggttgtggcttcagatactcccgcagttggaatcagggatccaaaggccatgcacatcatct

SEQ ID NO: 325189 - DNA, 75 bp, Artificial Sequence
  Synthetic
gaccagttctggtcttctgccctcagatagggttctctggataggtgatgttgcttgccagcctatgacacccat

SEQ ID NO: 325190 - DNA, 75 bp, Artificial Sequence
  Synthetic
ccatcaacctcttagacccagagtttgacattttccctgatgccttgacgatcttgttgcctcgagtcagggcaa

SEQ ID NO: 325191 - DNA, 75 bp, Artificial Sequence
  Synthetic
tgcaaggctaagaggcatgagcttgaaccaccacttattcacttcttcctcattgcgtaagcctctgttagactg

SEQ ID NO: 325192 - DNA, 75 bp, Artificial Sequence
  Synthetic
ccatgggctgaagtcagcccgtagtcttggccctggctctataaacataaactcatccaatgatgccaagaagtg

SEQ ID NO: 325193 - DNA, 75 bp, Artificial Sequence
  Synthetic
caaatctcagagactgaagcccttgcaagcaggcaagaggattactccaaccttctgacccagtgcttggaagga

SEQ ID NO: 325194 - DNA, 75 bp, Artificial Sequence
  Synthetic
ctgcgctaccctcacaggagtgattgagagcctggtttctgccctctcaaccagtccatatttctcttggagtgc

SEQ ID NO: 325195 - DNA, 75 bp, Artificial Sequence
  Synthetic
ttgggacttctttattcctgtccgcaaaaagaagacagatggctcttacggtgtcttggatgaggatgatgagcc

SEQ ID NO: 325196 - DNA, 75 bp, Artificial Sequence
  Synthetic
gacccaaaggccatgcacatcatctcagggggataattctcgaccttcaggttcatgacggctggccccactggg

SEQ ID NO: 325197 - DNA, 75 bp, Artificial Sequence
  Synthetic
aatcatgacttcacgttttctggcctgtcaaagacaacagaccgacgcctctcagaggtattccccattacccat

SEQ ID NO: 325198 - DNA, 75 bp, Artificial Sequence
  Synthetic
gagagcctggtttctgccctctcaaccagtccatatttctcttggagtgccatcaacctcttagaccctgagtta

SEQ ID NO: 325199 - DNA, 75 bp, Artificial Sequence
  Synthetic
tcattcttcagtttgtttgagcctaacattgaaagagtggaaggaacattccccaattcagaaatcgagatgctg

SEQ ID NO: 325200 - DNA, 75 bp, Artificial Sequence
  Synthetic
aaattgagctgctgctcaccaaactccactgcaatcctggaccactctgacatgatcactcctttgcgtctttcc

SEQ ID NO: 325201 - DNA, 75 bp, Artificial Sequence
  Synthetic
acccaatcatctccacctgtctccttcagcttcttgatgatcaaagcaggatcaaggccttcataggccagctct

SEQ ID NO: 325202 - DNA, 75 bp, Artificial Sequence
  Synthetic
gaagtgctttgtggtaggataaacgtggagaatgggctgtctcttggagaaccaggcctgtacgaccaaatctac

SEQ ID NO: 325203 - DNA, 75 bp, Artificial Sequence
  Synthetic
tgtcaaagacaacagaccgacgcctctcagaggtattccccattacccatgatggttcagatgggatgacccctg

SEQ ID NO: 325204 - DNA, 75 bp, Artificial Sequence
  Synthetic
aaggctagatctatggatgcagacattgagctacagaagagtgaagaagagcttgaggctattagcagggcacta

SEQ ID NO: 325205 - DNA, 75 bp, Artificial Sequence
  Synthetic
atgtgattcacaccagattggatgggaccattgtggtggttgaattttcaaccactaggagccataacattgggg

SEQ ID NO: 325206 - DNA, 75 bp, Artificial Sequence
  Synthetic
gaacagtttctttcaacaccagctgatgttgacttcatcaccaagaccctcaaagcaaaagaggtggaggcctat

SEQ ID NO: 325207 - DNA, 75 bp, Artificial Sequence
  Synthetic
gtgcgctcagctcctgcaccactacatgcttctaggactatgcttacatcccttgtttggaaccttcatggggat

SEQ ID NO: 325208 - DNA, 75 bp, Artificial Sequence
  Synthetic
tggaaaaggcatctgccatgcaagacacagagctcactcatgccctcaacgactcatttaagaggaacctaagca

SEQ ID NO: 325209 - DNA, 75 bp, Artificial Sequence
  Synthetic
gactcatttaagaggaacctaagcagtaatgtggtccagtggtctctttgggtctcctgcctagcacaggagcta

SEQ ID NO: 325210 - DNA, 75 bp, Artificial Sequence
  Synthetic
tagctagcctgcatgcaaggagcaacaaacaaacatcactgaatcgagggacagtcaaactcccgccctggctac

SEQ ID NO: 325211 - DNA, 75 bp, Artificial Sequence
  Synthetic
aagactacagaccttgggcggaagtatgcatattattttaatgagatacagggtaaaacaaagggagatgaggac

SEQ ID NO: 325212 - DNA, 75 bp, Artificial Sequence
  Synthetic
taaagcctgagaaaaccattcaagagcggctggaaatcaatagatgtgaggctattgacaaaactcaggatctcc

SEQ ID NO: 325213 - DNA, 75 bp, Artificial Sequence
  Synthetic
taatcatgtctttgttcaaactgggaacgaaacaagtatttcgatcaaggacgaagctggcttagatgggcaaat

SEQ ID NO: 325214 - DNA, 75 bp, Artificial Sequence
  Synthetic
taaagcctgaaaaaaccattcaggagcggctagagatcaatagatgtgaggctattgacaaaactcaggacctcc

SEQ ID NO: 325215 - DNA, 75 bp, Artificial Sequence
  Synthetic
tcaggaattttctctccaaggggtggagggaaagaagtggaagagaatggcagcaaaccagaagaaagagaagga

SEQ ID NO: 325216 - DNA, 75 bp, Artificial Sequence
  Synthetic
catcaagaccgactcaggctatggatccttaatggatcatggcgcatatggtgaactgtgggcaaagtgcctcct

SEQ ID NO: 325217 - DNA, 75 bp, Artificial Sequence
  Synthetic
catcaagaccgactcaggctttggttccttaatggatcatggcgcatatggtgagctgtgggcaaagtgccttct

SEQ ID NO: 325218 - DNA, 75 bp, Artificial Sequence
  Synthetic
ttggatgttgaggacattggggatttcctaacattcaacaatcttcttgcagattcgaggtatggagatgagtcc

SEQ ID NO: 325219 - DNA, 75 bp, Artificial Sequence
  Synthetic
gaggggaagaagtggaagagaatggcagcaaaccagaagaaagaaaaagagtcccatgagacattgagcccttac

SEQ ID NO: 325220 - DNA, 75 bp, Artificial Sequence
  Synthetic
gagcttttacaagtcttatttcgtctcgaagctcaaggagggctacatgggggaaagcatcagtggggtggtgga

SEQ ID NO: 325221 - DNA, 75 bp, Artificial Sequence
  Synthetic
ttggatgttgaagacattggggatttcctaacattcaacaatcttcttgcagattcgaggtatggagatgagtcc

SEQ ID NO: 325222 - DNA, 75 bp, Artificial Sequence
  Synthetic
gtccagagagcagtgtcaatcttgttggaaaaggcatctgccatgcaagacacagagctcactcatgccctcaac

SEQ ID NO: 325223 - DNA, 75 bp, Artificial Sequence
  Synthetic
gatggagggctttgtctctcctcccatgctgcctaagccccaaaagatgctagggaaactggatggacctttgag

SEQ ID NO: 325224 - DNA, 75 bp, Artificial Sequence
  Synthetic
attatcaagccgaccaaatcatcatcccatatcttctacagcttagggattcgcaaggctgacgtgacaaggagg

SEQ ID NO: 325225 - DNA, 75 bp, Artificial Sequence
  Synthetic
tggttcatgccagccaaattccacagattcatttgggctgccatttccatgtttcggaggaaaaagatgatggtg

SEQ ID NO: 325226 - DNA, 75 bp, Artificial Sequence
  Synthetic
tcgcaaggctgacgtgacaaggaggctcactggcagagtcttctctgataccattgatgctggggaatgggagct

SEQ ID NO: 325227 - DNA, 75 bp, Artificial Sequence
  Synthetic
aggaagcatctagattgcatggtgcgaattgcttctcagccgttcagcctaatccccagagagggaagggttgag

SEQ ID NO: 325228 - DNA, 75 bp, Artificial Sequence
  Synthetic
gacctaaggtttttagctcacctcagttctaaatctgagtctaggtcatctgatccgttcagggaagcaatgaca

SEQ ID NO: 325229 - DNA, 75 bp, Artificial Sequence
  Synthetic
ccattgatgctggggaatgggagctaacagagttcaaaagcctgaagacatgcaagcttacaaaccttgtcaact

SEQ ID NO: 325230 - DNA, 75 bp, Artificial Sequence
  Synthetic
gacgccttccatggtaatagggaagtctcatggatggacaaagggcgaacttacataaagacagagacaggaatg

SEQ ID NO: 325231 - DNA, 75 bp, Artificial Sequence
  Synthetic
agaccaaattgagagggcacagtcaggcactctaggaggcttcagcaagccccagaagacatttattaggccagg

SEQ ID NO: 325232 - DNA, 75 bp, Artificial Sequence
  Synthetic
gggcctgaccttcctgatcagtctggaggacaagtctaagactgaggagatcatcaccttgacaaggtacaccca

SEQ ID NO: 325233 - DNA, 75 bp, Artificial Sequence
  Synthetic
tcatcaccttgacaaggtacacccagatggagggctttgtctctccccccatgctgcctaagccccaaaagatgc

SEQ ID NO: 325234 - DNA, 75 bp, Artificial Sequence
  Synthetic
gctgagtggattcaagatcaagccagcatcaaggactgacggctgtccagtcaggattatggaaaggggcttcag

SEQ ID NO: 325235 - DNA, 75 bp, Artificial Sequence
  Synthetic
atctagaatgcataaatgggggtgtgaggctaatcactctaaccagtgagctcaagtcagctactgtctgtgctt

SEQ ID NO: 325236 - DNA, 75 bp, Artificial Sequence
  Synthetic
tggggaggaacattccatgccatctcaggccggtccacaaaccttgagaatatggtgaacagctggtacattggg

SEQ ID NO: 325237 - DNA, 75 bp, Artificial Sequence
  Synthetic
aaaagaatcagcatggtggcctcagagagatctacgttatggatgcaaatgcccggctcgtgcagtttggggttg

SEQ ID NO: 325238 - DNA, 75 bp, Artificial Sequence
  Synthetic
gaggctaatcactctaaccagtgagctcaagtcagctactgtctgtgcttcccacttttgcagttctgccacaag

SEQ ID NO: 325239 - DNA, 75 bp, Artificial Sequence
  Synthetic
cctctggagcaatcgagacctcttctcctttgggaagaaggagccatcctgcagctggatctgcttgaaaactct

SEQ ID NO: 325240 - DNA, 75 bp, Artificial Sequence
  Synthetic
agcttcctcagagctgcttgctcatctctggagagagaaattgctcagcgacatggaagacaatggaagcagaac

SEQ ID NO: 325241 - DNA, 75 bp, Artificial Sequence
  Synthetic
ggcaagacccagaagggtgaggcattggatgtactcacctgtcatcctgaccattctagcaatagggcttgctga

SEQ ID NO: 325242 - DNA, 75 bp, Artificial Sequence
  Synthetic
cttggggggttggctctctttttcatgatcatgtctttgttcaagctgggaacaaaacaggtatttcgatcaagg

SEQ ID NO: 325243 - DNA, 75 bp, Artificial Sequence
  Synthetic
cagagctgaatgctctcggagaaatgtataagaagattgtggagatggaagaggacaagcccagcagccctgagt

SEQ ID NO: 325244 - DNA, 75 bp, Artificial Sequence
  Synthetic
aaacagcaatacacgtcaaaggggcattggtagatggaactgaattcacatttgagggcagttgcatgttcccag

SEQ ID NO: 325245 - DNA, 75 bp, Artificial Sequence
  Synthetic
atgcagggcatactgcactttacatccagcctccttcactcttgtgtccagagcttttacaagtcttatttcgtc

SEQ ID NO: 325246 - DNA, 75 bp, Artificial Sequence
  Synthetic
actgagatggatagcagcgtctcaccaaatctcagagactgaagcccttgcaagcaggcaagaggattactccaa

SEQ ID NO: 325247 - DNA, 75 bp, Artificial Sequence
  Synthetic
tgtgcccacaggggcaaatatcccaagccctacagattggctgaatgccttgtttggcaatgggctgagtaggtg

SEQ ID NO: 325248 - DNA, 75 bp, Artificial Sequence
  Synthetic
ggctggcacgcagttattgtgtctgtgggtgactagggaatgttggctttagaaggatttccttaagacttgggg

SEQ ID NO: 325249 - DNA, 75 bp, Artificial Sequence
  Synthetic
gttctaaatctgagtctaggtcatctgatccgtttagggaagcaatgacagatgccttccatggtaatagggaag

SEQ ID NO: 325250 - DNA, 75 bp, Artificial Sequence
  Synthetic
atgcagggcatactgcactttacatccagtctcctccactcttgtgttcagagcttttacaagtcttatttcgtc

SEQ ID NO: 325251 - DNA, 75 bp, Artificial Sequence
  Synthetic
aattacttgtctagtaggggtgggtccattctagaccagattgagagggcacagtcaggaactctaggaggcttc

SEQ ID NO: 325252 - DNA, 75 bp, Artificial Sequence
  Synthetic
gatgtcccaaaatttgtggatggcagctacatgcagacatatcatagtactgtgcccacaggggcaaatatccca

SEQ ID NO: 325253 - DNA, 75 bp, Artificial Sequence
  Synthetic
tcaaagctcaaagagggctacatgggggaaagcatcagtggggtggtggacgtcatagaaggttctgacgactct

SEQ ID NO: 325254 - DNA, 75 bp, Artificial Sequence
  Synthetic
gactagcagcctgagtaaagggcatgtagtgcctcgggtggtggcagcaggagtataccttctctcacgccactg

SEQ ID NO: 325255 - DNA, 75 bp, Artificial Sequence
  Synthetic
gtcaagaggatgggcaagatgaccaacacagtatggttgtttggcaacccaaaaaatcctcttcaccagcttgag

SEQ ID NO: 325256 - DNA, 75 bp, Artificial Sequence
  Synthetic
gagtataccttctctcacgccactgctttcgctttagctcaagtatccatggaaggggctcagcacagaaggcta

SEQ ID NO: 325257 - DNA, 75 bp, Artificial Sequence
  Synthetic
ttttccactcttgtgatacctcaaccatcagaggtcatcaggaaatcaaggaccatgactctatgcctcttgtcg

SEQ ID NO: 325258 - DNA, 75 bp, Artificial Sequence
  Synthetic
ggaaggggctcagcacagaaggctagtctcataaaactgctgatgatgtcttctatttctgccatgaagcacggg

SEQ ID NO: 325259 - DNA, 75 bp, Artificial Sequence
  Synthetic
cactctgtcaagttcttaaaccctttgtttgggatttattcatcagagaaatcaacagtgaacacagtgtattgt

SEQ ID NO: 325260 - DNA, 75 bp, Artificial Sequence
  Synthetic
ccattctagaccagattgagagggcacagtcaggcactctaggaggcttcagcaagccccagaagacattcatta

SEQ ID NO: 325261 - DNA, 75 bp, Artificial Sequence
  Synthetic
gacccatccactcaaacaagagtgctgacatacctcacctgcttggttactctgagaagatttgtcagatagatc

SEQ ID NO: 325262 - DNA, 75 bp, Artificial Sequence
  Synthetic
catagcccatgttgatgccaaatcaagatcagtcaggctcctaggtgcccccgtaaagaagtcaggtggggtcac

SEQ ID NO: 325263 - DNA, 75 bp, Artificial Sequence
  Synthetic
ggactgtctcgagggttctcttaggaagcagggactgatgaggtcaaagctcacagagatggtggagaagaatgt

SEQ ID NO: 325264 - DNA, 75 bp, Artificial Sequence
  Synthetic
gtcgacatcctggaggaggacattgacttttcagatgtcatagctgtggagctctcagagggatcacttgacatt

SEQ ID NO: 325265 - DNA, 75 bp, Artificial Sequence
  Synthetic
acagtcaggcactctagggggcttcagcaagccccagaagacattcaataggccaggaggtggtattggctacaa

SEQ ID NO: 325266 - DNA, 75 bp, Artificial Sequence
  Synthetic
cagagaaggtccattcacctggtgtgactagcagcctgagtaaagggcatgtggtgcctcgggtggtggcagcag

SEQ ID NO: 325267 - DNA, 75 bp, Artificial Sequence
  Synthetic
gcatctgcatatagaggtcattgcatggttaggctgagtgggttcaaaatcaagccagcatcaaggactgacggc

SEQ ID NO: 325268 - DNA, 75 bp, Artificial Sequence
  Synthetic
tcaccatacaagaaggaagggtcatgaacattctaagctacaggccgagagacactgatatatcagagtcagccg

SEQ ID NO: 325269 - DNA, 75 bp, Artificial Sequence
  Synthetic
tctgagaagatttgtcagatagatcggctgatacatgtttcgtcatggctcagaaaccactcacaatttcagggc

SEQ ID NO: 325270 - DNA, 75 bp, Artificial Sequence
  Synthetic
acatgcctcagttctcctggcaaatgataggaagacccaaggcattgataatagagccatggggaacattttcag

SEQ ID NO: 325271 - DNA, 75 bp, Artificial Sequence
  Synthetic
ggactgtctcgagggctctcttagaaagcaagggctgatgaggtcaaaactcacagagatggtggagaagaatgt

SEQ ID NO: 325272 - DNA, 75 bp, Artificial Sequence
  Synthetic
ttagccatgtgcagtttagaaacttcatagcccacgttgatgccaaatcaagatcagtcaggctcctaggtgccc

SEQ ID NO: 325273 - DNA, 75 bp, Artificial Sequence
  Synthetic
caagcaggcaagaagattactccaaccttctaacgcagtgcttggaaggaggggcctcattctctcttacctacc

SEQ ID NO: 325274 - DNA, 75 bp, Artificial Sequence
  Synthetic
ccttggatatgcaggcctcatgctactcaccaatgtccttaaggcaattggggtttggggatcatgggtcatagc

SEQ ID NO: 325275 - DNA, 75 bp, Artificial Sequence
  Synthetic
ctcaagcatgtcttgttcatggtcttgaatggcccatacactgaggagtacaagctggaaatgatcatagaggcc

SEQ ID NO: 325276 - DNA, 75 bp, Artificial Sequence
  Synthetic
agctattccagtaagtactatcatctaaccctgatggaccaagctgccatcacaatgtgtgcgatcatgggtaag

SEQ ID NO: 325277 - DNA, 75 bp, Artificial Sequence
  Synthetic
gaaggctgtagagggctccttactgagaagagatgcatggcagccatacgagagcaggtacggccattcctcata

SEQ ID NO: 325278 - DNA, 75 bp, Artificial Sequence
  Synthetic
aagggagcggaaatatgaaggaatgtgtcacaactgggagggcgcttcttcctgcggtgaacccaggacaagagg

SEQ ID NO: 325279 - DNA, 75 bp, Artificial Sequence
  Synthetic
tgtcacaactgggagggcgcttcttcctgcggtgaacccaggacaagaggcgtgtctgcacttcacggcacctgg

SEQ ID NO: 325280 - DNA, 75 bp, Artificial Sequence
  Synthetic
agttgatgtatctgtgggtgactagggagtgttggttttagaaggatttccttaagatctgggcggtctttgtgt

SEQ ID NO: 325281 - DNA, 75 bp, Artificial Sequence
  Synthetic
cggggaagtcgttgtgtcttatggagggatgcgtgtcagaccaaagtgctatggattctctagaatgatggcaac

SEQ ID NO: 325282 - DNA, 75 bp, Artificial Sequence
  Synthetic
ctggcttgaggagatcaggctcagtagtgatgccaggctttatgatgtcattgaatccatccgaaggttatgtga

SEQ ID NO: 325283 - DNA, 75 bp, Artificial Sequence
  Synthetic
cccacttttgtagttctgccacaagtggtaagaaaagcacggaaattcaattccactcaggatcattggtcggga

SEQ ID NO: 325284 - DNA, 75 bp, Artificial Sequence
  Synthetic
ggtggagaatccacatgggatcatctggaaagtatctccatgtgccgcatgggtcccatcagcagttatagagct

SEQ ID NO: 325285 - DNA, 75 bp, Artificial Sequence
  Synthetic
gcatctgcatatagaggtcattgcatggttaggctgagtggattcaagatcaagccagcatcaaggactgacggc

SEQ ID NO: 325286 - DNA, 75 bp, Artificial Sequence
  Synthetic
acattccaccccatgagtggcatccccacacaagtcttcaagggtgtgagtgtaacttacttgggctcagatatg

SEQ ID NO: 325287 - DNA, 75 bp, Artificial Sequence
  Synthetic
aagagttttagccagagtgaattcccagacatatgcaaaattgatggcattgtgttcaaccagtgtgagagtgag

SEQ ID NO: 325288 - DNA, 75 bp, Artificial Sequence
  Synthetic
cttaggagagacctcgttgaatgctcttgtagtgtgttgactctgtcaatggtcaagaggatgggcaagatgacc

SEQ ID NO: 325289 - DNA, 75 bp, Artificial Sequence
  Synthetic
taaaatcatcatgagggagcacaagaccaaatgggtacaagagagctcatctaaggattttgtgtgctacaagga

SEQ ID NO: 325290 - DNA, 75 bp, Artificial Sequence
  Synthetic
tggggggctgaggtttgagagaagccatgacagccagggtaaaatatctggtagccccctggacatcacagccat

SEQ ID NO: 325291 - DNA, 75 bp, Artificial Sequence
  Synthetic
cagcctcagctttgaccatgcagtagtcgatgagcagtgccagctgaactgtgggggacatgagagtcaagtgac

SEQ ID NO: 325292 - DNA, 75 bp, Artificial Sequence
  Synthetic
gctgcttgatggggaaattgatggataggggaaggcaagtgatccatgaggaaataggggagaatagagagggca

SEQ ID NO: 325293 - DNA, 75 bp, Artificial Sequence
  Synthetic
ttgggggggttggctctctttttcttgatcatgtctttgttcaagctgggaacaaaacaagtatttcgatcgagg

SEQ ID NO: 325294 - DNA, 75 bp, Artificial Sequence
  Synthetic
tggatgtactcacctgtcatcctgactattctagcaatagggcttgctgagggctgtgatgagatggtccatgct

SEQ ID NO: 325295 - DNA, 75 bp, Artificial Sequence
  Synthetic
ctcaccaatgtccttaaggcaattggggtctggggatcatgggtaatagctccagtgaagctaatgtttgccatc

SEQ ID NO: 325296 - DNA, 75 bp, Artificial Sequence
  Synthetic
ggtcaagaggatgggcaagatgaccaacacagtatggttatttggtaacccaaaaaatcctctccaccagcttga

SEQ ID NO: 325297 - DNA, 75 bp, Artificial Sequence
  Synthetic
gataggaagacccaaggcattgacaatagagctatggggaacatcttcagggactgtctcgagggttctctaaga

SEQ ID NO: 325298 - DNA, 75 bp, Artificial Sequence
  Synthetic
tgtgcccacaggggcaaatatcccaagccctacagactggctgaatgccttgtttggcaatgggctgagtaggtg

SEQ ID NO: 325299 - DNA, 75 bp, Artificial Sequence
  Synthetic
gtggccctcctccagatagagtcacttgcaaggctaagaggcatgagcttgaaccaccacttattcacttcttcc

SEQ ID NO: 325300 - DNA, 75 bp, Artificial Sequence
  Synthetic
gggtttgggggtcatgggtcatagctccagtgaagctaatgtttgccatcataaagaaactgatgagatctgtga

SEQ ID NO: 325301 - DNA, 75 bp, Artificial Sequence
  Synthetic
acacaaagttcatcattgtctttgccctgactcgaggcaacaagatcgtcaaggcatcagggaaaatgtcaaact

SEQ ID NO: 325302 - DNA, 75 bp, Artificial Sequence
  Synthetic
cctgactcgaggcaacaagatcgtcaaggcatcagggaaaatgtcaaactctgggtctaagaggttgatggcact

SEQ ID NO: 325303 - DNA, 75 bp, Artificial Sequence
  Synthetic
tccagtgaagctaatgtttgccatcataaagaaactgatgagatctgtgagttgcttgatggggaaattgatgga

SEQ ID NO: 325304 - DNA, 75 bp, Artificial Sequence
  Synthetic
gttgcttgatggggaaattgatggataggggaaggcaagtgatccatgaagaaataggagaggtcagagagggca

SEQ ID NO: 325305 - DNA, 75 bp, Artificial Sequence
  Synthetic
accaagatgatgttaggatcgagatggcaaggcctagaagggtaaggcactggatgtactcacctgtcatcctga

SEQ ID NO: 325306 - DNA, 75 bp, Artificial Sequence
  Synthetic
ggtgacaaatgtgagtgggtgttattcctgcatgacaggcgccaaagtctccatcaaattgcatagcagcaaaaa

SEQ ID NO: 325307 - DNA, 75 bp, Artificial Sequence
  Synthetic
ccacacaagtcttcaagggtgtgagtgtaacttacttgggttcagatatggaggtgtctggcttgacagatcttt

SEQ ID NO: 325308 - DNA, 75 bp, Artificial Sequence
  Synthetic
gattctaaacttgtttcgtgcaagcaagggagcggaaatatgaaggaatgtgtcacaactgggagggcgctcctt

SEQ ID NO: 325309 - DNA, 75 bp, Artificial Sequence
  Synthetic
aaaacacggttggtacgcagccgatgtgtctgtgggtgactagggaatgttggttttagaaggatttccttaaga

SEQ ID NO: 325310 - DNA, 75 bp, Artificial Sequence
  Synthetic
ccaagactatcaatgtgaagatgcgcggagccagcaagacagaggtttacaactctttcagggatcctctccatg

SEQ ID NO: 325311 - DNA, 75 bp, Artificial Sequence
  Synthetic
gtagccccctggacatcacagctataagaggatctttttctgtcaattatagaggccttcgactgagcctctcag

SEQ ID NO: 325312 - DNA, 75 bp, Artificial Sequence
  Synthetic
acacaaagacccccttcatctggaaaccatgtcactgagcaaactctctaacgttgatctcaaatctgttgcaat

SEQ ID NO: 325313 - DNA, 75 bp, Artificial Sequence
  Synthetic
gtagccccctagacatcacagctataagaggatctttttctgttaattatagaggccttcgtctgagtctctcag

SEQ ID NO: 325314 - DNA, 75 bp, Artificial Sequence
  Synthetic
atcaaagttaagaggattaacctgaaatgcaagaagtcatcatcatatttcgttcctgatgctcggtccaggtgt

SEQ ID NO: 325315 - DNA, 75 bp, Artificial Sequence
  Synthetic
gatacaggcccaatcatctgcgcaggacccatccactcaaacaagagtgctgacataccccacctgcttggctac

SEQ ID NO: 325316 - DNA, 75 bp, Artificial Sequence
  Synthetic
taacagaggcttacgcaatgaggaagaagtgaataagtggtggttcaagctcatgcctcttagccttgcaagtga

SEQ ID NO: 325317 - DNA, 75 bp, Artificial Sequence
  Synthetic
aaattcttactcaaggtggagtggacttctaagcccctgtgatgctgattggcttgggatgcttgtcgtgaagaa

SEQ ID NO: 325318 - DNA, 75 bp, Artificial Sequence
  Synthetic
ctgatacccctgcagttggaatcagggacccaaaggccatgcacatcatctctggggggtaattctcgaccttca

SEQ ID NO: 325319 - DNA, 75 bp, Artificial Sequence
  Synthetic
cctcatgtccttgtagtacatgtccaacagctgctcgagtccaggctcaagctggtgaagagggttctttgggtt

SEQ ID NO: 325320 - DNA, 75 bp, Artificial Sequence
  Synthetic
gagatactcctttaaggctgctgctgcagcacatgtccaagtgggaaggctctgtgctaccctcacaggggtgat

SEQ ID NO: 325321 - DNA, 75 bp, Artificial Sequence
  Synthetic
agtgggaagtctaggactgagtcaggtgagctctgcagttcagactccgggactagttctggtcttctgccctca

SEQ ID NO: 325322 - DNA, 75 bp, Artificial Sequence
  Synthetic
tgagagcctggtttctgccttctcaaccagtccatatttctcttgaagtgccatcagcctcttggaccctgagtt

SEQ ID NO: 325323 - DNA, 75 bp, Artificial Sequence
  Synthetic
cagtgtgcatgtttcgtagttccggctcacattcttagaacatggaggttctattgaagtgttggccggtctttg

SEQ ID NO: 325324 - DNA, 75 bp, Artificial Sequence
  Synthetic
tgacattttccctgaagccttgacgatcttattgcctcgggtcaaggcaaagacaatgatgaactttgtatctct

SEQ ID NO: 325325 - DNA, 75 bp, Artificial Sequence
  Synthetic
ccctgaggagacatttctggagctgaagagctttagccaaagtgaattcccagacatatgcaaaattgatggcat

SEQ ID NO: 325326 - DNA, 75 bp, Artificial Sequence
  Synthetic
tgtgttcaaccagtgtgagggtgagagtctacctcagccctttgatgttgcatggatggatgttggccactctca

SEQ ID NO: 325327 - DNA, 75 bp, Artificial Sequence
  Synthetic
tgtcaaagacaacagatcgacgcctctcagaggtgttccccatcacccatgatggttctgatgggatgacccctg

SEQ ID NO: 325328 - DNA, 75 bp, Artificial Sequence
  Synthetic
agtctacctcagccctttgatgttgcatggatggatgttggccactctcataaaatcatcatgagggagcacaag

SEQ ID NO: 325329 - DNA, 75 bp, Artificial Sequence
  Synthetic
gacaggccagggctgccagacctagatgtgactgtcgatgccacaggtgtgacagtggacataggggctgtgcca

SEQ ID NO: 325330 - DNA, 75 bp, Artificial Sequence
  Synthetic
gatgtcccaaaattcgtagatggcagctacatgcagacatatcatagttctgtgcccacaggagcaaatatccca

SEQ ID NO: 325331 - DNA, 75 bp, Artificial Sequence
  Synthetic
gaagaaaagacttgcaagaccagtggatcatgcaggggggacatgcagttttgcaaggtggcaggttgtgaacat

SEQ ID NO: 325332 - DNA, 75 bp, Artificial Sequence
  Synthetic
gcagatgctcacttgtgcacaagcccggggaagtcgttgtgtcatatggagggatgcgtgtcagaccaaagtgct

SEQ ID NO: 325333 - DNA, 75 bp, Artificial Sequence
  Synthetic
cggggaagtcgttgtgtcatatggagggatgcgtgtcagaccaaagtgctatggtttctccagaatgatggcaac

SEQ ID NO: 325334 - DNA, 75 bp, Artificial Sequence
  Synthetic
cagtgtgcatgtttcgtggtcctggctcacattcttagagcatggaggttctattgaagtgttggccggtctttg

SEQ ID NO: 325335 - DNA, 75 bp, Artificial Sequence
  Synthetic
aggattggtcaatgcactggctgccatctagaatgcataagtgggggtgtgaggctaatcactctaaccagtgag

SEQ ID NO: 325336 - DNA, 75 bp, Artificial Sequence
  Synthetic
gaggctaatcactctaaccagtgagctcaagtcagctactgtctgcgcttctcacttctgtagttctgccacaag

SEQ ID NO: 325337 - DNA, 75 bp, Artificial Sequence
  Synthetic
agatgaccaacacagtatggttgtttggcaaccctaaaaatcctcttcaccagcttgagcctggacttgagcagc

SEQ ID NO: 325338 - DNA, 75 bp, Artificial Sequence
  Synthetic
tttgagggtagttgcatgttcccagatggttgtgatgcagtggactgcacattctgtcgtgagtttctaaaaaat

SEQ ID NO: 325339 - DNA, 75 bp, Artificial Sequence
  Synthetic
agccaatgtgtctgtgggtgactagggaatgttggttttagaaggatttccttaagatctgggcggtctttgtgt

SEQ ID NO: 325340 - DNA, 75 bp, Artificial Sequence
  Synthetic
gaggtgctactcccagagagagctgagtgctcttaggtggcccagtgggaagccatctgtatggttcttgcaggc

SEQ ID NO: 325341 - DNA, 75 bp, Artificial Sequence
  Synthetic
ctcaccaatgttcttaaggcaattggggtttggggatcatgggtcatagctccagtgaagctagtgtttgccatc

SEQ ID NO: 325342 - DNA, 75 bp, Artificial Sequence
  Synthetic
cacaacgaagaccctgatggaggcctactctctgtggcaagatgccttcaccaagactatcaatgtgaagatgcg

SEQ ID NO: 325343 - DNA, 75 bp, Artificial Sequence
  Synthetic
gggtttggggatcatgggtcatagctccagtgaagctagtgtttgccatcataaagaaactaatgagagctgtga

SEQ ID NO: 325344 - DNA, 75 bp, Artificial Sequence
  Synthetic
caggataacaaaaggccgaaggtatctttttgaaggggacatgatattggattctcttgaagccatagagaagcg

SEQ ID NO: 325345 - DNA, 75 bp, Artificial Sequence
  Synthetic
aattaggctaaatttcatgatccaattcgacaaaattagacctccttcgggaggtcaccaatggctggccaatct

SEQ ID NO: 325346 - DNA, 75 bp, Artificial Sequence
  Synthetic
gaaataggggagaatagagagggcaaccaagatgatgttaggattgagatggccagacccaggagggtaaggcat

SEQ ID NO: 325347 - DNA, 75 bp, Artificial Sequence
  Synthetic
gggctgtgatgagatggtccatgctgattctaaacttgtttcgtgcaggcaagggagcggaaatatgaaggaatg

SEQ ID NO: 325348 - DNA, 75 bp, Artificial Sequence
  Synthetic
aacagtggacataggggctgtgccagactcagcatcacaattgggctcatcaatcaatgctgggttgatcacaat

SEQ ID NO: 325349 - DNA, 75 bp, Artificial Sequence
  Synthetic
agattcgaggtatggagatgagtccgtccagagagctgtgtcaatcttgttggaaaaggcatctgccatgcaaga

SEQ ID NO: 325350 - DNA, 75 bp, Artificial Sequence
  Synthetic
gaatccaatatcatgtctccttcaaaaagatacttttggcctcttgttatcctgtggaagaggccccgccagttc

SEQ ID NO: 325351 - DNA, 75 bp, Artificial Sequence
  Synthetic
aatgtaaaaagtcatcatcatattttgttcctgatgcccggtccaggtgtacatcagtgaggagatgtcgttggg

SEQ ID NO: 325352 - DNA, 75 bp, Artificial Sequence
  Synthetic
actgagatggatagcagcatctcaccaaatctcagagactgaagcccttgcaagcaggcaagaggattactccaa

SEQ ID NO: 325353 - DNA, 75 bp, Artificial Sequence
  Synthetic
ttatacagtgcgctcagctcctgcatcactacatgctcctaggactatgcttacatccgttgtttggaactttca

SEQ ID NO: 325354 - DNA, 75 bp, Artificial Sequence
  Synthetic
atagagtcaacacactacaagagcactcaacgaggtctctcctaagtgtggggtactctccaagagaaggctcaa

SEQ ID NO: 325355 - DNA, 75 bp, Artificial Sequence
  Synthetic
gcctgtggttgctttaatgcggccccttcttgcattttctggaggaaatgggtagagaatccacatgggatcatc

SEQ ID NO: 325356 - DNA, 75 bp, Artificial Sequence
  Synthetic
gggtcccatcagcggttatagagctaacaatgccctcaggggaggtgaggacattccaccccatgagcggaatcc

SEQ ID NO: 325357 - DNA, 75 bp, Artificial Sequence
  Synthetic
ggatgacgctgtgtgctactctaagatcactagtgtggaggcagttgcaaactactccgccatacccaccactat

SEQ ID NO: 325358 - DNA, 75 bp, Artificial Sequence
  Synthetic
aaattactgctacttgcacaggggaagtgacaaatgtgagtgggtgttattcttgcatgacaggcgccaaagtct

SEQ ID NO: 325359 - DNA, 75 bp, Artificial Sequence
  Synthetic
gacattttccctgatgccttgacgatcttattgcctcgagtcagggcaaagacaatgatgaacttagtatccttc

SEQ ID NO: 325360 - DNA, 75 bp, Artificial Sequence
  Synthetic
ccagatgaacttggaagtgctttgtggtaggataaacgtggagaatgggctgtctcttggagaaccaggcctgta

SEQ ID NO: 325361 - DNA, 75 bp, Artificial Sequence
  Synthetic
tagcactgcccatgtaagatgcaaaggggatgagactgcattcagtgtcttggagggagtccatagctactctgt

SEQ ID NO: 325362 - DNA, 75 bp, Artificial Sequence
  Synthetic
gcaaagataacctataggcgattcaagcctgccttaagttcaagtgcccgtcaggaattttctctccaaggagtg

SEQ ID NO: 325363 - DNA, 75 bp, Artificial Sequence
  Synthetic
ctggggggattggctctctttttcttgatcatgtctttgttcaagctgggaacaaaacaggtatttcgatcgagg

SEQ ID NO: 325364 - DNA, 75 bp, Artificial Sequence
  Synthetic
gactcattcaagaggaacctaagcagtaatgtggttcagtggtccctttgggtctcctgtttagcacaggagcta

SEQ ID NO: 325365 - DNA, 75 bp, Artificial Sequence
  Synthetic
tgatcatgtctttgttcaagctgggaacaaaacaggtatttcgatcgaggacgaagctggcttaaatgggcatat

SEQ ID NO: 325366 - DNA, 75 bp, Artificial Sequence
  Synthetic
cccatatcttctacagcttagggatccgcaaggctgatgtgacaaggaggctcactggcagagtcttctctgaca

SEQ ID NO: 325367 - DNA, 75 bp, Artificial Sequence
  Synthetic
tcatgtacaggttctgcatagccaatgagatctacactaaggctagatctatggatgcagacattgagctacaga

SEQ ID NO: 325368 - DNA, 75 bp, Artificial Sequence
  Synthetic
ccttccctgggagagtaccccactcttaggagagacctcgttgaatgctcttgtagtgtgttgactttgtcaatg

SEQ ID NO: 325369 - DNA, 75 bp, Artificial Sequence
  Synthetic
aaccctaggcttaagaattcgatcatagagaaccatgggctgaagtcagcccgcagtcttggccctggctctatt

SEQ ID NO: 325370 - DNA, 75 bp, Artificial Sequence
  Synthetic
ccatcaagaacagctgggcaatggaaactgggagggagaactggcggggcctcttccacaggataacaaaaggcc

SEQ ID NO: 325371 - DNA, 75 bp, Artificial Sequence
  Synthetic
tgtcatagaaggctctgacgactcagcgatcatgatcagcatacgccctaagtcagacatggatgaagtccgatc

SEQ ID NO: 325372 - DNA, 75 bp, Artificial Sequence
  Synthetic
tggccctcctccagatagagtcacttgcaaggctaagaggcatgagcttgaaccaccacttgttcacttcttcct

SEQ ID NO: 325373 - DNA, 75 bp, Artificial Sequence
  Synthetic
tctttattcctatccgcaaaaagaagacagatggctcatacagtgtcttggatgaggatgatgagcctggggtcc

SEQ ID NO: 325374 - DNA, 75 bp, Artificial Sequence
  Synthetic
gtagtgcctcgggtggtggcagcaggagtataccttctctcacgccactgctttcgctttagctcaagcatccat

SEQ ID NO: 325375 - DNA, 75 bp, Artificial Sequence
  Synthetic
gagtataccttctctcacgccactgctttcgctttagctcaagcatccatggaaggggctcagcacagaaggcta

SEQ ID NO: 325376 - DNA, 75 bp, Artificial Sequence
  Synthetic
tggagacgagtccatccagagagctgtgtcaatattgttggaaaaggcatctgccatgcaagacacagagctcac

SEQ ID NO: 325377 - DNA, 75 bp, Artificial Sequence
  Synthetic
gagctgctgctcaccaaactccactgcaattctggaccactctgacatgatcactcctttgccctttttccttta

SEQ ID NO: 325378 - DNA, 75 bp, Artificial Sequence
  Synthetic
caccataagtcaggttgtcagaatgaacttcttccctgggtttagcctagaagctgagaagagcttagacaatca

SEQ ID NO: 325379 - DNA, 75 bp, Artificial Sequence
  Synthetic
ctcccagacctagatgtgactgtcgatgccacaggtgtgacagtggacataggggctgtgccagactcagcatca

SEQ ID NO: 325380 - DNA, 75 bp, Artificial Sequence
  Synthetic
aagcagcactgcagggctggtgagttcatcatcaagaagctgaagttctggcctatctatgtcattatcaagccg

SEQ ID NO: 325381 - DNA, 75 bp, Artificial Sequence
  Synthetic
catcaacctcttagaccctgagtttgacattttccctgatgccttgacgatcttattgcctcgagtcagggcaaa

SEQ ID NO: 325382 - DNA, 75 bp, Artificial Sequence
  Synthetic
aaggttctttgttgctaacttgctccactctgtcaagttcttgaaccctttgtttggtatttactcatcagagaa

SEQ ID NO: 325383 - DNA, 75 bp, Artificial Sequence
  Synthetic
gtctcatgagacgttgagccctttcttggatgttgaagacattggggatttcttaacattcaacaatcttcttac

SEQ ID NO: 325384 - DNA, 75 bp, Artificial Sequence
  Synthetic
ttgaatccatccggaggttatgtgatgaccttgggatcaacaacagggtggcatcagcatatagaggtcattgca

SEQ ID NO: 325385 - DNA, 75 bp, Artificial Sequence
  Synthetic
aatcttgtcaacttgccatgcaccatgctgaactcaatagctttctggagagagaagctgggcgtggctccatgg

SEQ ID NO: 325386 - DNA, 75 bp, Artificial Sequence
  Synthetic
gcttcaggatcagagagcttcaaaacccagatgaggtcaagatgagagtgaggggtgacatcctcaacctctctg

SEQ ID NO: 325387 - DNA, 75 bp, Artificial Sequence
  Synthetic
ttctctactcttgtgatgccacagccatcagaggtcatcaggaaatctaggaccatgaccttatgcctcttatcg

SEQ ID NO: 325388 - DNA, 75 bp, Artificial Sequence
  Synthetic
ctggtacattgggtactacaagaacaaagaggagtcaacagagctaaatgccctcggagaaatgtataagaagat

SEQ ID NO: 325389 - DNA, 75 bp, Artificial Sequence
  Synthetic
aaattgctcagcgacatggaagacaatggaagcagaaccttgaggagcgtgtcctgagagagattgggaccaaga

SEQ ID NO: 325390 - DNA, 75 bp, Artificial Sequence
  Synthetic
gtcccatgaggcattgagccctttcttggatgttgatgacattggggatttcctaacatttaacaatctccttgc

SEQ ID NO: 325391 - DNA, 75 bp, Artificial Sequence
  Synthetic
gtggtttggcctgaaaaggactaagcttggaccccgtctcctcaaggaagagtgggacaaacttagggcctcatt

SEQ ID NO: 325392 - DNA, 75 bp, Artificial Sequence
  Synthetic
aattacttgtctagtaggggtgggtccattctagaccagattgagagggcacagtcaggcactctagggggcttc

SEQ ID NO: 325393 - DNA, 75 bp, Artificial Sequence
  Synthetic
gagaagggggttatgtggtacattgatgctgtgggccaggcatggaaggcagttctagatgacgggtgcatgcga

SEQ ID NO: 325394 - DNA, 75 bp, Artificial Sequence
  Synthetic
attatcaagccgaccaaatcatcatcccatatcttctacagcttagggatccgcaaggctgacgtgacaaggagg

SEQ ID NO: 325395 - DNA, 75 bp, Artificial Sequence
  Synthetic
tacgtggggcagcgaggtggacgctctcaggtgagttactacccagctgaaaactcttactcaaggtggagtgga

SEQ ID NO: 325396 - DNA, 75 bp, Artificial Sequence
  Synthetic
agagcaggtacggccattcctcatattcctgcaaattcctgaggacagcatttcttgggtgtctgatcagttctg

SEQ ID NO: 325397 - DNA, 75 bp, Artificial Sequence
  Synthetic
cgaccttgggatcaataacagggtggcatctgcatatagaggtcattgcatggttaggctgagtgggttcaagat

SEQ ID NO: 325398 - DNA, 75 bp, Artificial Sequence
  Synthetic
tggttagacccacactgagatggatagcagcgtctcatcaaatctcagagactgaagcccttgcaagcaggcaag

SEQ ID NO: 325399 - DNA, 75 bp, Artificial Sequence
  Synthetic
agtgggaagtcaaggacagagtcaggtgagctctgcagctcagactcagggaccagttctggtcttctgccctca

SEQ ID NO: 325400 - DNA, 75 bp, Artificial Sequence
  Synthetic
tggttaggctgagtgggttcaagatcaagccagcatcaaggactgacggctgtccagtcaggattatggaaaggg

SEQ ID NO: 325401 - DNA, 75 bp, Artificial Sequence
  Synthetic
tccaatgatgccaagaagtggaatcaggggcactacacaacaaagctagctctagttctttgttggttcatgcca

SEQ ID NO: 325402 - DNA, 75 bp, Artificial Sequence
  Synthetic
gatttatttgggctgccatttccatgtttcggaggaaaaagatgatggtggatctgaggtttttgtcccacctca

SEQ ID NO: 325403 - DNA, 75 bp, Artificial Sequence
  Synthetic
tgtgttcaaccagtgtgagagtgagagtctacctcagccctttgatgtcgcatggatggatgtaggtcactctca

SEQ ID NO: 325404 - DNA, 75 bp, Artificial Sequence
  Synthetic
tcttttttgaacggccaacttttgatggatacgtaggctggggctgtggcagtgggaagtctaggacagagtcag

SEQ ID NO: 325405 - DNA, 75 bp, Artificial Sequence
  Synthetic
agtctaggtcatctgatccgtttagggaagcaatgacagatgccttccatggtaatagggatgtctcatggatgg

SEQ ID NO: 325406 - DNA, 75 bp, Artificial Sequence
  Synthetic
agaagaatcagcatggtggcctcagagagatctacgttatggatgcgaatgcccgacttgtgcagtttggggttg

SEQ ID NO: 325407 - DNA, 75 bp, Artificial Sequence
  Synthetic
ttccattctgggtcattagttgggaaagcagcaatacacgtcaaaggggctttggtggatggtacagaattcaca

SEQ ID NO: 325408 - DNA, 75 bp, Artificial Sequence
  Synthetic
tgctaacttgctccactctgtcaagttcttgaatccattgtttgggatttattcatcagagaaatcaacagtgaa

SEQ ID NO: 325409 - DNA, 75 bp, Artificial Sequence
  Synthetic
tttgagggcagttgcatgttcccagatggttgtgatgcagtggactgcacattctgtcgtgagtttctaaaaaat

SEQ ID NO: 325410 - DNA, 75 bp, Artificial Sequence
  Synthetic
gtttcggagaaaaaagatgatggtggacctaaggtttttagctcacctcagttctaaatctgagtctaggtcatc

SEQ ID NO: 325411 - DNA, 75 bp, Artificial Sequence
  Synthetic
cagcacatgtccaagtggggaggctctgcgctacccttacaggagtgattgagagcctggtctctgccctctcaa

SEQ ID NO: 325412 - DNA, 75 bp, Artificial Sequence
  Synthetic
gttctaaatctgagtctaggtcatctgatccgtttagggaagcaatgacagacgccttccatggtaatagggaag

SEQ ID NO: 325413 - DNA, 75 bp, Artificial Sequence
  Synthetic
ggtaagacccagaagggtgaggcattggatgtactctcctgtcatcctgactattctagcaattgggcttactga

SEQ ID NO: 325414 - DNA, 75 bp, Artificial Sequence
  Synthetic
gcacgcagttattgtgtctgtgggtgactagggaatgttggctttagaaggatttccttaaactggggggggtaa

SEQ ID NO: 325415 - DNA, 75 bp, Artificial Sequence
  Synthetic
ggctgttcatcattattgtcatcctccttggatatgcaggcctcatgctactcaccaatgtccttaaggcaattg

SEQ ID NO: 325416 - DNA, 75 bp, Artificial Sequence
  Synthetic
ctcacaatttcagggctacgtagggcagcgaggtggacgctctcaggtgagctactacccagctgaaaattctta

SEQ ID NO: 325417 - DNA, 75 bp, Artificial Sequence
  Synthetic
aagaaggagctactcttaaaactggcagagaaggtacattcacctggtgtgactagcagcctgagtaagggacat

SEQ ID NO: 325418 - DNA, 75 bp, Artificial Sequence
  Synthetic
agctctggacgccacatcgggaggaactctcagccactctgttatggtgtactggggggacaggaagaagtatca

SEQ ID NO: 325419 - DNA, 75 bp, Artificial Sequence
  Synthetic
gggctgtgatgagatggtccatgctgattctaaacttgtttcatgcaggcaagggagcggaaatatgaaggaatg

SEQ ID NO: 325420 - DNA, 75 bp, Artificial Sequence
  Synthetic
acatcgggaggaactctcagccactctgttatggtgtactggggggacaggaagaagtatcaggccttattgaac

SEQ ID NO: 325421 - DNA, 75 bp, Artificial Sequence
  Synthetic
gaagaagtatcaggccttattgaacaggatgggccttcctgaagactgggtggagcagatagatgagaatcctgg

SEQ ID NO: 325422 - DNA, 75 bp, Artificial Sequence
  Synthetic
ctcaagtcagctactgtctgtgcttcccacttttgtagttctgccacaagtggcaagaaaagcacggagattcaa

SEQ ID NO: 325423 - DNA, 75 bp, Artificial Sequence
  Synthetic
aggatgggccttcctgaagactgggtggagcagatagatgagaatcctggagtcctttacaggagagctgccaac

SEQ ID NO: 325424 - DNA, 75 bp, Artificial Sequence
  Synthetic
agtcctttacaggagagctgccaacaagaaggaactactcttaaagctggcagagaaggttcattcacctggtgt

SEQ ID NO: 325425 - DNA, 75 bp, Artificial Sequence
  Synthetic
cctaaccaggagcgaatgctcttccctcaggctcaagagtatgacagagtatgcacattgcttgaggaagttgaa

SEQ ID NO: 325426 - DNA, 75 bp, Artificial Sequence
  Synthetic
attggtggatggaactgaattcacatttgagggcagttgcatgttcccagatggttgtgacgcagtggactgcac

SEQ ID NO: 325427 - DNA, 75 bp, Artificial Sequence
  Synthetic
atgcacattgcttgaggaagttgaacacctaacagggaaatttgttgttagggagagaaacattgtcaggagccg

SEQ ID NO: 325428 - DNA, 75 bp, Artificial Sequence
  Synthetic
cactataagccaagtagtcagaatgaacttcttccctggatttagtctagaagctgagaagagtttagacaatca

SEQ ID NO: 325429 - DNA, 75 bp, Artificial Sequence
  Synthetic
gtagccccctagacatcacagccataagagggtctttttcagttaattatagaggccttcgactgagcctctcag

SEQ ID NO: 325430 - DNA, 75 bp, Artificial Sequence
  Synthetic
ttctatttctgccatgaagcacgggggctcactaaaccctaatcaggagcgaatgctcttccctcaggctcaaga

SEQ ID NO: 325431 - DNA, 75 bp, Artificial Sequence
  Synthetic
agaggccttcgactgagcctctcagaaatcactgctacttgcacaggagaggtgacgaatgtgagtggatgttac

SEQ ID NO: 325432 - DNA, 75 bp, Artificial Sequence
  Synthetic
ctcctcaaggaagagtgggataaacttagggcctcatttgcatggctgagcacagacccatctgaaacattgagg

SEQ ID NO: 325433 - DNA, 75 bp, Artificial Sequence
  Synthetic
acaggcgccaaagtctctatcaaactgcatagcagcaaaaatagcactgcccatgtaagatgcaaaggggatgag

SEQ ID NO: 325434 - DNA, 75 bp, Artificial Sequence
  Synthetic
aaattactgctacttgcacaggggaggtgacaaatgtgagtgggtgttattcttgcatgacaggcgccaaagtct

SEQ ID NO: 325435 - DNA, 75 bp, Artificial Sequence
  Synthetic
ggggatgagaccgcgttcagtgtactggagggggttcatagctatactgtcagtctcagctttgaccatgcagtg

SEQ ID NO: 325436 - DNA, 75 bp, Artificial Sequence
  Synthetic
gtggggggcatgagagtcaagtgactctaaaaggcaacctcatcttcctggatgtcccaaaatttgtagatggca

SEQ ID NO: 325437 - DNA, 75 bp, Artificial Sequence
  Synthetic
cactataagccaagtagtcagaatgaacttcttccctggttttagcctagaagctgagaagagcttagacaatca

SEQ ID NO: 325438 - DNA, 75 bp, Artificial Sequence
  Synthetic
gtgataccacagccatcagaggtcatcaggaaatcaaggaccatgactttatgcctcttatcgaattacttgtct

SEQ ID NO: 325439 - DNA, 75 bp, Artificial Sequence
  Synthetic
ggaaagacttgagagcatctccatcctcaagcatgtcttgttcatggtcttgaatggcccatacactgaggagta

SEQ ID NO: 325440 - DNA, 75 bp, Artificial Sequence
  Synthetic
acacaaagacccccgttcattggaaaccatgtcactgagcaaatgctccaacgttgacctcaaatctgttgcaat

SEQ ID NO: 325441 - DNA, 75 bp, Artificial Sequence
  Synthetic
catgacagccagggcaaaatatctggtagccccttggacatcacagccataagagggtctttttcagttaattat

SEQ ID NO: 325442 - DNA, 75 bp, Artificial Sequence
  Synthetic
cagtgtgtttgtttcgtggtcctggctcacattcttagaacatggaggttctattgaagtgttggccggtctttg

SEQ ID NO: 325443 - DNA, 75 bp, Artificial Sequence
  Synthetic
ggactgtctcgagggttctcttagaaagcaagggctgatgaggtcaaagctcacagagatggtggagaagaatgt

SEQ ID NO: 325444 - DNA, 75 bp, Artificial Sequence
  Synthetic
aatgtaagaagtcatcatcatattttgttcctgatgctcggtccaggtgtacatctgtgaggagatgtcgctggg

SEQ ID NO: 325445 - DNA, 75 bp, Artificial Sequence
  Synthetic
gcctggacttgagcagttgttggacatgtactacaaggacatgaggtgctactcccagagagagctgagtgctct

SEQ ID NO: 325446 - DNA, 75 bp, Artificial Sequence
  Synthetic
tgactccaggggtcttgatgaagagagcaccatcatgtggggttaactttaaaacacggttgacatgcagttgat

SEQ ID NO: 325447 - DNA, 75 bp, Artificial Sequence
  Synthetic
gagcttgaggatttcgcgagagagctggcctatgaaggccttgatcctgctttgatcatcaagaagctgaaggag

SEQ ID NO: 325448 - DNA, 75 bp, Artificial Sequence
  Synthetic
agttgatgtatccgtgggcgactagggaatgttgggtttagaaggatttccttaagatctgggcggtctttgtgt

SEQ ID NO: 325449 - DNA, 75 bp, Artificial Sequence
  Synthetic
tgttcttctccatcaagaacagctgggcaatggaaaccggaaaagagaactggcggggcctcttccacaggataa

SEQ ID NO: 325450 - DNA, 75 bp, Artificial Sequence
  Synthetic
tctcctggcaaatgataggaagacccaaggtattgacaatagagctatggggaacattttcagggactgtctcga

SEQ ID NO: 325451 - DNA, 75 bp, Artificial Sequence
  Synthetic
acacgaagttcatcattgtctttgccctgactcgaggcaataagatcgtcaaggcatcagggaaaatgtcgaact

SEQ ID NO: 325452 - DNA, 75 bp, Artificial Sequence
  Synthetic
gcagccttaaaggagtatctcccagtggggcctgccgtcatgaatctgaaggtcgagaattatccccctgagatg

SEQ ID NO: 325453 - DNA, 75 bp, Artificial Sequence
  Synthetic
agtggtggctgtgagctattccagcaagtactatcatctaaccctgatggaccaagctgccatcacaatgtgtgc

SEQ ID NO: 325454 - DNA, 75 bp, Artificial Sequence
  Synthetic
tactctctgtggcaagatgccttcaccaagactatcaatgtgaagatgcgtggagccagcaagacagaagtttac

SEQ ID NO: 325455 - DNA, 75 bp, Artificial Sequence
  Synthetic
gcacgcagttattgtgtctgtgggtgactagggaatgttggctttagaaggatttccttaagatctgggcggtct

SEQ ID NO: 325456 - DNA, 75 bp, Artificial Sequence
  Synthetic
cttccccaaatggtgttcagggctgcagttctcagctcttcatcaaacctgatgaggttgtggaatgggcaccta

SEQ ID NO: 325457 - DNA, 75 bp, Artificial Sequence
  Synthetic
atcatcctcatccaaaacactgtatgagccatctgccttctttttgcggatgggaatgaagaagtcccaacagtc

SEQ ID NO: 325458 - DNA, 75 bp, Artificial Sequence
  Synthetic
tggcaagaaaaacacggagattcaattccactcaggatcgctggttgggaaaacagcaatacatgtcaagggggc

SEQ ID NO: 325459 - DNA, 75 bp, Artificial Sequence
  Synthetic
ttccactcaggatcgctggttgggaaaacagcaatacatgtcaagggggcattggtagatggaactgacttcact

SEQ ID NO: 325460 - DNA, 75 bp, Artificial Sequence
  Synthetic
agggactgggccttgttctgaatcagaagaaaagacttgcaagaccagtggatcatgcaggggggacatgcagtt

SEQ ID NO: 325461 - DNA, 75 bp, Artificial Sequence
  Synthetic
aaaggtacttctggccttttgttatcctgtggaagaggccccgccagttctctcttccggtttccattgcccaac

SEQ ID NO: 325462 - DNA, 75 bp, Artificial Sequence
  Synthetic
aacagctgctcaagtccaggctcaagctgatgaagaggattttttgggttgccaaataaccacactgtgttggtc

SEQ ID NO: 325463 - DNA, 75 bp, Artificial Sequence
  Synthetic
atcttgcccatcctcttgaccattgacaaagtcaacacactacaagagcattcaacgaggtctctcctaagagtg

SEQ ID NO: 325464 - DNA, 75 bp, Artificial Sequence
  Synthetic
acaaagtcaacacactacaagagcattcaacgaggtctctcctaagagtggggtactcccccagagaaggctcaa

SEQ ID NO: 325465 - DNA, 75 bp, Artificial Sequence
  Synthetic
ccattctagaccagattgagagggcacagtcaggcactctagggggcttcagcaagcctcagaagacattcatta

SEQ ID NO: 325466 - DNA, 75 bp, Artificial Sequence
  Synthetic
gcttcaggatcagggaacttcaaaacccagatgaggtcaagatgagagtgaggggcgacatcctcaacctttcag

SEQ ID NO: 325467 - DNA, 75 bp, Artificial Sequence
  Synthetic
aaactcttgacaattgggcctggtcacatgcctcagttctcctggcaaatgataggaggacccaaggcattgata

SEQ ID NO: 325468 - DNA, 75 bp, Artificial Sequence
  Synthetic
accactaggagccataacattgggggtctggaggcagcatataggacaaagatagaaaaatatagggacccaatc

SEQ ID NO: 325469 - DNA, 75 bp, Artificial Sequence
  Synthetic
tgacataccacacctgcttggttactctgagaagatctgtcagatagatcggctgattcatgtatcgtcatggct

SEQ ID NO: 325470 - DNA, 75 bp, Artificial Sequence
  Synthetic
aacaatgccctcaggggaggtgaggacattccaccccatgagcggcatccccacacaagtcttcaagggtgtgag

SEQ ID NO: 325471 - DNA, 75 bp, Artificial Sequence
  Synthetic
tcttttttgaacggccaacttttgatgggtatgtaggatggggctgtggcagtgggaagtctaggtctgagtcag

SEQ ID NO: 325472 - DNA, 75 bp, Artificial Sequence
  Synthetic
gagagctctgcagttcagactcagggactagttctggtcttctgccctcggatagggttctctggataggtgatg

SEQ ID NO: 325473 - DNA, 75 bp, Artificial Sequence
  Synthetic
gaagcttgcattagctccctgcaaccaggctggtatgggggttgtaggcaaggttggagagatacagtgcagtag

SEQ ID NO: 325474 - DNA, 75 bp, Artificial Sequence
  Synthetic
cgaggaaagtgcccgtaccataaaaaaagatgggtgcatatggaatgctgacctcgtgggcatagagctacgagt

SEQ ID NO: 325475 - DNA, 75 bp, Artificial Sequence
  Synthetic
cagcaatacacgtcaaaggggcattggtagatggaactgaattcacatttgagggtagttgcatgttcccagatg

SEQ ID NO: 325476 - DNA, 75 bp, Artificial Sequence
  Synthetic
taagatcatcatgagggagcacaaaaccaaatgggtacaagagagctcatccaaggatttcgtgtgttacaagga

SEQ ID NO: 325477 - DNA, 75 bp, Artificial Sequence
  Synthetic
accaaatgggtacaagagagctcatccaaggatttcgtgtgttacaaggaagggactgggccttgttctgaatct

SEQ ID NO: 325478 - DNA, 75 bp, Artificial Sequence
  Synthetic
catgacagccagggcaaaatatctggtagccccctagacatcacagccataagagggtctttttctgtcaattat

SEQ ID NO: 325479 - DNA, 75 bp, Artificial Sequence
  Synthetic
aacttgacattgctatctctgatgatccagaaaaggatacccccaaagaggcaaagataacctataggcgattca

SEQ ID NO: 325480 - DNA, 75 bp, Artificial Sequence
  Synthetic
acaggtggagatgattgggtgagagatacaaagttcatcattgtctttgccttgacccgaggcaataaaatcgtc

SEQ ID NO: 325481 - DNA, 75 bp, Artificial Sequence
  Synthetic
gcatataggacaaagatagaaaaatatagggacccaatctcaaggcgtgttgatatcatggagaacccgagggtc

SEQ ID NO: 325482 - DNA, 75 bp, Artificial Sequence
  Synthetic
tagcactgcccatgtaagatgcaaaggggatgagactgcattcagtgtcttggagggagtccatagctacactgt

SEQ ID NO: 325483 - DNA, 75 bp, Artificial Sequence
  Synthetic
cttaagtcagcaactgtctgtgcttcccacttttgcagttctgccacaagtggtaagaaaagcacagagattcaa

SEQ ID NO: 325484 - DNA, 75 bp, Artificial Sequence
  Synthetic
tgggcccagctgtcatgaacctgaaggtcgagaattaccccccagagatgatgtgcatggcctttgggtccctga

SEQ ID NO: 325485 - DNA, 75 bp, Artificial Sequence
  Synthetic
aaaacacggttggaacgcagttgatgtgtctgtgggtggctagggaatgttggttttagaaggatttccttaaga

SEQ ID NO: 325486 - DNA, 75 bp, Artificial Sequence
  Synthetic
gttgatgagcagtgccaactgaactgtggggggcatgagagtcatgttactctgaaaggtaacctcatcttcctg

SEQ ID NO: 325487 - DNA, 75 bp, Artificial Sequence
  Synthetic
agttgatgtgtctgtgggtggctagggaatgttggttttagaaggatttccttaagatctgggcggtctttgtgt

SEQ ID NO: 325488 - DNA, 75 bp, Artificial Sequence
  Synthetic
ggtcgagaattaccccccagagatgatgtgcatggcctttgggtccctgattcctactgcaggggtatcagaagc

SEQ ID NO: 325489 - DNA, 75 bp, Artificial Sequence
  Synthetic
agctattcaagcaagtactatcatctgaccctgatggaccaagctgccatcacaatgtgtgcaatcatgggcaag

SEQ ID NO: 325490 - DNA, 75 bp, Artificial Sequence
  Synthetic
cagtgtgcatgtttcgtggtcctggttcacattcatagagcatggaggttccattgaagtgttggccggtctttg

SEQ ID NO: 325491 - DNA, 75 bp, Artificial Sequence
  Synthetic
tccagtgaagctaatgtttgccatcataaagaaactaatgagaactgtgagctgcttgatggggaaattgatgga

SEQ ID NO: 325492 - DNA, 75 bp, Artificial Sequence
  Synthetic
tccggactcaaaatgtctcagaattaaggttaagaggatcaacctaaaatgtaagaagtcatcatcatattttgt

SEQ ID NO: 325493 - DNA, 75 bp, Artificial Sequence
  Synthetic
ggctgatacatgtttcgtcatggttgagaaaccattcacaatttcagggctacgtggggcagcgaggtggacgct

SEQ ID NO: 325494 - DNA, 75 bp, Artificial Sequence
  Synthetic
cttccccagatggtgtttagggctgcagttctcagttcctcatcaaacctcatgaggttgtggaatgggcacctg

SEQ ID NO: 325495 - DNA, 75 bp, Artificial Sequence
  Synthetic
gaaataggggagaatagagagggaaaccgagatgatattagaatcgagatggcaaggcccagaagggtaaggcat

SEQ ID NO: 325496 - DNA, 75 bp, Artificial Sequence
  Synthetic
tcagtgaggagatgtcgttgggctggagactgccagtctgggtgcccccctcatttcacatccaactccttttct

SEQ ID NO: 325497 - DNA, 75 bp, Artificial Sequence
  Synthetic
gagactgccagtctgggtgcccccctcatttcacatccaactccttttctgatgattgggcaggtaagatggaca

SEQ ID NO: 325498 - DNA, 75 bp, Artificial Sequence
  Synthetic
ttcaaatagtgtgccatcagatatgggtaaccctgaaggaccccaggctcatcatcctcatccaaaacactatat

SEQ ID NO: 325499 - DNA, 75 bp, Artificial Sequence
  Synthetic
ggtaaccctgaaggaccccaggctcatcatcctcatccaaaacactatatgagccatctatcttctttttacgga

SEQ ID NO: 325500 - DNA, 75 bp, Artificial Sequence
  Synthetic
ttcttgggtggggggacacagactcccctaagaagcatgagttctctcggagcttcctcagagctgcttgctcat

SEQ ID NO: 325501 - DNA, 75 bp, Artificial Sequence
  Synthetic
gtcgatgagcagtgccagctgaactgtgggggacatgagagtcaagtgactctaaaaggcaacctcatcttcctg

SEQ ID NO: 325502 - DNA, 75 bp, Artificial Sequence
  Synthetic
acctcgtgggcatagagctacgagtggatgacgctgtgtgctactctaagatcactagtgtggaagcagttgcaa

SEQ ID NO: 325503 - DNA, 75 bp, Artificial Sequence
  Synthetic
ccttcgcttctctatggcttccagagaatccaatatcatgtccccttcaaagagatacttttggccttttgttat

SEQ ID NO: 325504 - DNA, 75 bp, Artificial Sequence
  Synthetic
cacaagtcttcaagggtgtgagtgtgacttacttgggctcagatatggaggtgtctggcttgactgacctatgtg

SEQ ID NO: 325505 - DNA, 75 bp, Artificial Sequence
  Synthetic
acagggctggtctaggattcagtggctgctctgatggatgtggaggagcagcctgcggctgctttaatgcggccc

SEQ ID NO: 325506 - DNA, 75 bp, Artificial Sequence
  Synthetic
gcccggctcgtgcagtttggggttgagaccatggctaggtgtgtctgtgagctaagcccacatgagactgttgcc

SEQ ID NO: 325507 - DNA, 75 bp, Artificial Sequence
  Synthetic
aggttggagagatacagtgcagcagcgaggaaagtgcccgtaccataaagaaagatgggtgcatatggaatgctg

SEQ ID NO: 325508 - DNA, 75 bp, Artificial Sequence
  Synthetic
agggcagaaaccaggctctccatcactcctgtgagggtagcacagagccttcccacctggacatgtgcagcagct

SEQ ID NO: 325509 - DNA, 75 bp, Artificial Sequence
  Synthetic
ttactgctacctgcacaggggaggtgacaaatgtgagtggatgttattcttgcatgacaggcgccaaagtctcta

SEQ ID NO: 325510 - DNA, 75 bp, Artificial Sequence
  Synthetic
gcagccttaaaggagtatctcccagtggggcctgctgtcatgaacctgaaggttgagaattacccacctgagatg

SEQ ID NO: 325511 - DNA, 75 bp, Artificial Sequence
  Synthetic
tggggcctgctgtcatgaacctgaaggttgagaattacccacctgagatgatgtgcatggcctttggatccctga

SEQ ID NO: 325512 - DNA, 75 bp, Artificial Sequence
  Synthetic
catgacagccaaggtaaaatatctggtagccccctggacatcacagctataagagggtcgttttctgttaattat

SEQ ID NO: 325513 - DNA, 75 bp, Artificial Sequence
  Synthetic
cctggaccatcatacaaggggaaagtcttttttgagcggccaacttttgatggatacgtgggctggggctgtggt

SEQ ID NO: 325514 - DNA, 75 bp, Artificial Sequence
  Synthetic
ccaacagactggctgaatgccttgtttggcaatgggctgagtaggtgggtcctgggggtgatgggggttctgctt

SEQ ID NO: 325515 - DNA, 75 bp, Artificial Sequence
  Synthetic
tttaaatagtgtgccatcagatatgggtaaccttgaaggaccccaggctcatcatcctcgtccaaaatgctgtat

SEQ ID NO: 325516 - DNA, 75 bp, Artificial Sequence
  Synthetic
gatcatgcagaggggacatgcagttttgcaaggtggcaggttgcgaacatggagaggaggcatctgaggccaagt

SEQ ID NO: 325517 - DNA, 75 bp, Artificial Sequence
  Synthetic
tgctctcaggggagttggctcacagtgtgcatgtttcgtggtcctggctcacattcttagaacatggaggttcta

SEQ ID NO: 325518 - DNA, 75 bp, Artificial Sequence
  Synthetic
tgtgcatgtttcgtggtcctggctcacattcttagaacatggaggttctattgaagtgttggccggtctttgtgt

SEQ ID NO: 325519 - DNA, 75 bp, Artificial Sequence
  Synthetic
actgagatggatagcagcgtctcaccaaatctcagagactgaagcccttgcaagcaggcaagaggattactctaa

SEQ ID NO: 325520 - DNA, 75 bp, Artificial Sequence
  Synthetic
ttctatttctgccatgaagcatgggggctcactaaaccctaatcaggagcgaatgctcttccctcaggctcaaga

SEQ ID NO: 325521 - DNA, 75 bp, Artificial Sequence
  Synthetic
tggcaagaaaagcacggagattcaattccactcagggtcattagttgggaaagcagcaatacacgtcaaaggggc

SEQ ID NO: 325522 - DNA, 75 bp, Artificial Sequence
  Synthetic
ttgtgtctgtaggtgactagggaatgttggctttagaaggatttccttaagatctgggcggtcctttggtgaaac

SEQ ID NO: 325523 - DNA, 75 bp, Artificial Sequence
  Synthetic
acacaaagaacccccttcatttggaaaccatgtcgctgagcaaatgctccaacgttgacctcaaatctgttgcaa

SEQ ID NO: 325524 - DNA, 75 bp, Artificial Sequence
  Synthetic
aacagctgctcaagtccaggctcaagctgatgaagagggttcttcgggttgccaaataaccatactgtgttagtc

SEQ ID NO: 325525 - DNA, 75 bp, Artificial Sequence
  Synthetic
cccaacaatgatgaaagtcatctggttctcctctctgatctgctttgtcattcaatgcagtggggactcgggccc

SEQ ID NO: 325526 - DNA, 75 bp, Artificial Sequence
  Synthetic
ctcaacgaggtctctcctaagagtggggtactctcccagagatggctcaagcctaacagtgttggcattcattgc

SEQ ID NO: 325527 - DNA, 75 bp, Artificial Sequence
  Synthetic
gggctgcgatgagatggtccatgctgattctaaacttgtttcgtgcaggcaagggagtgggaacatgaaagaatg

SEQ ID NO: 325528 - DNA, 75 bp, Artificial Sequence
  Synthetic
tcttgtggtctgctgaggtggaagagtttggagaaggagtggtggctgtgagctattccagtaagtactatcatc

SEQ ID NO: 325529 - DNA, 75 bp, Artificial Sequence
  Synthetic
ggggacatgatattggattctcttgaagccatagagaagcgaaggcttagacttgggttacctgagatcctaata

SEQ ID NO: 325530 - DNA, 75 bp, Artificial Sequence
  Synthetic
gctggggctgtggcagtgggaagtctaggacagagtcaggagagctctgcagttcagactcagggactagctctg

SEQ ID NO: 325531 - DNA, 75 bp, Artificial Sequence
  Synthetic
ctctcatttcacgtccaactccttctctgatgattgggcaggtaaaatggacagggctggtctaggattcagtgg

SEQ ID NO: 325532 - DNA, 75 bp, Artificial Sequence
  Synthetic
gggtgcatgcgaatctgtctcttcaaaaagaatcagcatggtggcctcagagagatctacgttatggatgcgaat

SEQ ID NO: 325533 - DNA, 75 bp, Artificial Sequence
  Synthetic
gtcaagaggatgggtaagatgaccaacactgtttggttgtttggcaacccaaaaaatcctcttcaccagcttgag

SEQ ID NO: 325534 - DNA, 75 bp, Artificial Sequence
  Synthetic
ccctaattcagaaatcgagatgctggaacagttcctctcaacaccagctgatgttgacttcatcaccaagaccct

SEQ ID NO: 325535 - DNA, 75 bp, Artificial Sequence
  Synthetic
cgaggaaagcgcccgtactataaagaaagatgggtgcatatggaatgctgaccttgtaggcatagagctacgggt

SEQ ID NO: 325536 - DNA, 75 bp, Artificial Sequence
  Synthetic
gtcccatgagacattgagcccgttcttggatgttgaagacataggagatttcctaacattcaacaatcttcttgc

SEQ ID NO: 325537 - DNA, 75 bp, Artificial Sequence
  Synthetic
ttgtgtcatatggagggatgcgtgtcagaccaaagtgctatggtttctccagaatgatggcaacactggaggtga

SEQ ID NO: 325538 - DNA, 75 bp, Artificial Sequence
  Synthetic
atcactagtgtggaggcagttgcaaactactctgccatacccaccactattggggggctgaggtttgagagaagc

SEQ ID NO: 325539 - DNA, 75 bp, Artificial Sequence
  Synthetic
gccttataaaactgctgatgatgtcttctatttctgccatgaagcacgggggctcactaaaccctaatcaggagc

SEQ ID NO: 325540 - DNA, 75 bp, Artificial Sequence
  Synthetic
tcttgcatgacaggcgccaaagtctccatcaaactgcatagcagcaaaaatagcactgcccatgtaagatgcaaa

SEQ ID NO: 325541 - DNA, 75 bp, Artificial Sequence
  Synthetic
ataaatgggggtgtgaggctaataactctaaccagtgagctcaagtcagctactgtctgtgcttcccacttttgt

SEQ ID NO: 325542 - DNA, 75 bp, Artificial Sequence
  Synthetic
cagtctcagttttgatcatgcagtagttgatgagcagtgccaactgaactgtgggggacatgagagtcaagtgac

SEQ ID NO: 325543 - DNA, 75 bp, Artificial Sequence
  Synthetic
caaaaaatcctcttcaccagcttgagcctggactcgagcagctgttggacatgtactacaaggacatgaggtgct

SEQ ID NO: 325544 - DNA, 75 bp, Artificial Sequence
  Synthetic
gcacggagattcaattccactcaggatcattggttgggaaaacagcaatacacgtcaaaggggcattggtagatg

SEQ ID NO: 325545 - DNA, 75 bp, Artificial Sequence
  Synthetic
ggcaatggaaaccggcagagagaattggcggggcctcttccacaggataacaaaaggcaaaaaatatctatttga

SEQ ID NO: 325546 - DNA, 75 bp, Artificial Sequence
  Synthetic
tgtgcccacaggggctaatatcccaagcccgacagactggctgaatgccttgtttggcaatgggctgagtagatg

SEQ ID NO: 325547 - DNA, 75 bp, Artificial Sequence
  Synthetic
agcccgacagactggctgaatgccttgtttggcaatgggctgagtagatggattctgggggtgatgggggttctg

SEQ ID NO: 325548 - DNA, 75 bp, Artificial Sequence
  Synthetic
cagtgtgcatgtttcgtggtcctggctcacattcttagagcatagaggttctgttgaagtgttggccggtctttg

SEQ ID NO: 325549 - DNA, 75 bp, Artificial Sequence
  Synthetic
ttccactcaggatcattggttgggaaaacagcaatccatgtcaaaggggcattggtagatggaactgaattcaca

SEQ ID NO: 325550 - DNA, 75 bp, Artificial Sequence
  Synthetic
gttgggacttctttattcctatcaggaaaaagaagacagatggctcatacagtgtcttggatgatgatgatgaac

SEQ ID NO: 325551 - DNA, 75 bp, Artificial Sequence
  Synthetic
aagtgatccatgaggagataggggagaatagagagggcaaccaagatgatgttaggattgagatggcaagaccca

SEQ ID NO: 325552 - DNA, 75 bp, Artificial Sequence
  Synthetic
ctggggtccttcaaggttacccatatctgatggcacactatttgaataggtgcccattccacaacctcatcaggt

SEQ ID NO: 325553 - DNA, 75 bp, Artificial Sequence
  Synthetic
atcaccaatgtccttaaggcaattggggtttgggggtcatgggtaatagctccagtgaagctaatgtttgccatt

SEQ ID NO: 325554 - DNA, 75 bp, Artificial Sequence
  Synthetic
gaattgcttctcagccattcagcttaatccctagggaggggagggtagagtggggaggaacattccatgccatct

SEQ ID NO: 325555 - DNA, 75 bp, Artificial Sequence
  Synthetic
ttgggatttcttcattcctatccgcaaaaagaagacagatggctcatacagtgtcttggatgaggatgatgggcc

SEQ ID NO: 325556 - DNA, 75 bp, Artificial Sequence
  Synthetic
gtgtcttggatgaggatgatgggcctggggtcctccatggttacccatatctgatggcacactatttaaataggt

SEQ ID NO: 325557 - DNA, 75 bp, Artificial Sequence
  Synthetic
agaagacagagttcacagcagcatggagaggatccctgaaggagttgtaaacctctgtcttgctggctccgcgca

SEQ ID NO: 325558 - DNA, 75 bp, Artificial Sequence
  Synthetic
ggcatcttgccacagagagtaggcctccatcagggtcttcgttgtggcttctgaaacccccgcggttggaatcag

SEQ ID NO: 325559 - DNA, 75 bp, Artificial Sequence
  Synthetic
ggacccaaaggccatgcacatcatctctggagggtaattctcaaccttcaggttcatgacagctggcccaactgg

SEQ ID NO: 325560 - DNA, 75 bp, Artificial Sequence
  Synthetic
tctggagggtaattctcaaccttcaggttcatgacagctggcccaactgggagatactcctttaaggctgctgca

SEQ ID NO: 325561 - DNA, 75 bp, Artificial Sequence
  Synthetic
aaaacagggctggcacgcagttattgtgtctgtgggtgactagggaatgttggttttagaaggatttccttaaga

SEQ ID NO: 325562 - DNA, 75 bp, Artificial Sequence
  Synthetic
acacaaagacggccaacaatgatgaaagtcatctggttctcctctctgatctgctttgtcattcaatgcagtggg

SEQ ID NO: 325563 - DNA, 75 bp, Artificial Sequence
  Synthetic
ctgctttgtcattcaatgcagtggggactcgggcccaatcatctgcgcaggacccatccactcaaacaagagtgc

SEQ ID NO: 325564 - DNA, 75 bp, Artificial Sequence
  Synthetic
gttcatgacggctggccccactgggagatactcctttaaggctgctgctgctgcacatgtccaggtgggaagact

SEQ ID NO: 325565 - DNA, 75 bp, Artificial Sequence
  Synthetic
ccatgtcactgagcaaatgctccaacgttgatctcaaatctgttgcaatgaatgccaacacagtcaggcttgagc

SEQ ID NO: 325566 - DNA, 75 bp, Artificial Sequence
  Synthetic
accaggcctgtacgaccaaatctacgacaggcctgggctgccagacctagatgtgactgtcgatgccacaggtgt

SEQ ID NO: 325567 - DNA, 75 bp, Artificial Sequence
  Synthetic
ggagatgagactgcattcagtgtcttggagggagtccatagctatactgtcagcctcagcttcgaccatgctgta

SEQ ID NO: 325568 - DNA, 75 bp, Artificial Sequence
  Synthetic
gtcgatgagcagtgccaactgaactgtgggggacatgagagtcaagtgactctaaaaggcaacctcatcttcctg

SEQ ID NO: 325569 - DNA, 75 bp, Artificial Sequence
  Synthetic
tggaaagtatctccatgtgccgcatgggtcccatcagcagttatagagctaacaatgccctcaggggaggtgagg

SEQ ID NO: 325570 - DNA, 75 bp, Artificial Sequence
  Synthetic
tgtcttggatgaggatgatgagcctggggtccttcaaggttacccatatctgatggcacactatttaaacaggtg

SEQ ID NO: 325571 - DNA, 75 bp, Artificial Sequence
  Synthetic
tgaccctctgggagcagtgctctcaggggagttggctcacagtgtgcatgtttcgtggtcctggctcacattctt

SEQ ID NO: 325572 - DNA, 75 bp, Artificial Sequence
  Synthetic
atatagggacccaatctcaaggcgtgttgatatcatggagaacccgagggtcttctttggcgttattgtagtctc

SEQ ID NO: 325573 - DNA, 75 bp, Artificial Sequence
  Synthetic
tcttcatttggaaaccatgtcactgagcaaatgctccaacgttgacctcaaatctgtggcattgaatgccaacac

SEQ ID NO: 325574 - DNA, 75 bp, Artificial Sequence
  Synthetic
cagcaaaccagaagaaagagaaggagtcccatgagacattgagccctttcttggatgttgaagacattggggatt

SEQ ID NO: 325575 - DNA, 75 bp, Artificial Sequence
  Synthetic
gtcaggaggggttctgtccaacatgcccctgactcaggatgaggcagaggagctcatgtacaggttctgcatagc

SEQ ID NO: 325576 - DNA, 75 bp, Artificial Sequence
  Synthetic
caatgagatctacaccaaggctagatctatggatgcagacattgagctacagaagagtgaagaagagcttgaggc

SEQ ID NO: 325577 - DNA, 75 bp, Artificial Sequence
  Synthetic
agattcgaggtatggagatgagtccatccagagagctgtgtcaatcttgttggaaaaggcatctgccatgcaaga

SEQ ID NO: 325578 - DNA, 75 bp, Artificial Sequence
  Synthetic
agaagagtgaagaagagcttgaggctattagcagggcactatcattcttcagtttgtttgagcctaacattgaaa

SEQ ID NO: 325579 - DNA, 75 bp, Artificial Sequence
  Synthetic
acagtcaaactcccgccctggctaccaaagccatcaagtgagtcaatagacatcaagaccgactcaggctttggt

SEQ ID NO: 325580 - DNA, 75 bp, Artificial Sequence
  Synthetic
catcagggtcttggtcgtggcttcagatacccctgcagttggaatcagggacccgaaggccatgcacatcatctc

SEQ ID NO: 325581 - DNA, 75 bp, Artificial Sequence
  Synthetic
caaagccatcaagtgagtcaatagacatcaagaccgactcaggctttggttccttaatggatcatggcgcatatg

SEQ ID NO: 325582 - DNA, 75 bp, Artificial Sequence
  Synthetic
tgcgctacccttacaggggtgattgagagcctggtctctgccctctcaaccagcccatatttctcctggagtgcc

SEQ ID NO: 325583 - DNA, 75 bp, Artificial Sequence
  Synthetic
gtacctttttgaaggggacatgatattggattctcttgaagccattgaaaagcgaaaacttaaacttgggttacc

SEQ ID NO: 325584 - DNA, 75 bp, Artificial Sequence
  Synthetic
gctcagtcaaattgagctgctgctcaccaaactccactgcaatcctggaccactctgacatgatcactcctttgc

SEQ ID NO: 325585 - DNA, 75 bp, Artificial Sequence
  Synthetic
ccatctctaggagagtaccccactctcaggagagacctcgttgagtgctcttgtagtgtgttgactctgtcaatg

SEQ ID NO: 325586 - DNA, 75 bp, Artificial Sequence
  Synthetic
aggttacccacatctgatggcacactatttaaataggtgccctttccacaacctcatcaggtttgatgaagagct

SEQ ID NO: 325587 - DNA, 75 bp, Artificial Sequence
  Synthetic
gagaactgcagccctgaacaccatctggggaagagattggccagccattggtgacctcccgaaggaggtctaatt

SEQ ID NO: 325588 - DNA, 75 bp, Artificial Sequence
  Synthetic
aagggagcggaaatatgaaggaatgtgtcacaactgggagggcgcttcttcctgcggtgaacccagggcaagagg

SEQ ID NO: 325589 - DNA, 75 bp, Artificial Sequence
  Synthetic
ttgtcgaattggatcatgaaatttagcctaattggatatgtcaaattgctgcttacaggtttctgtaagcagcag

SEQ ID NO: 325590 - DNA, 75 bp, Artificial Sequence
  Synthetic
tcaacaatcttcttgcagattcgaggtatggagatgagtccgtccagagagctgtgtcaatcctgttggaaaagg

SEQ ID NO: 325591 - DNA, 75 bp, Artificial Sequence
  Synthetic
gtatggagatgagtccgtccagagagctgtgtcaatcctgttggaaaaggcatctgccatgcaagacacagagct

SEQ ID NO: 325592 - DNA, 75 bp, Artificial Sequence
  Synthetic
tgccatgcaccatgctgaactcaatagctttctggagagagaagctgggcgtggctccatggctggttcgaaagc

SEQ ID NO: 325593 - DNA, 75 bp, Artificial Sequence
  Synthetic
aactcatgctctcaacgactcattcaagaggaacctaagcagtaatgtggttcagtggtccctttgggtctcctg

SEQ ID NO: 325594 - DNA, 75 bp, Artificial Sequence
  Synthetic
aagaggaacctaagcagtaatgtggttcagtggtccctttgggtctcctgtttagcacaggagctagctagtgct

SEQ ID NO: 325595 - DNA, 75 bp, Artificial Sequence
  Synthetic
gaggacaagcccagcagccctgagtttctggggtggggggacactgattccccaaagaagcatgaattctcacgg

SEQ ID NO: 325596 - DNA, 75 bp, Artificial Sequence
  Synthetic
tggttgtggcttcagatacccccgcagttggaatcagggatccaaaggccatgcacatcatctcagggggataat

SEQ ID NO: 325597 - DNA, 75 bp, Artificial Sequence
  Synthetic
taggcaatgtggagggggtagtcagtgaccctgcaaaagaacttgacattgccatctctgatgatccagaaaaag

SEQ ID NO: 325598 - DNA, 75 bp, Artificial Sequence
  Synthetic
tgattatgtctttgttcaagctgggaacaaaacaggtatttcgatcaaggacaaagctggcttagatgggcaaat

SEQ ID NO: 325599 - DNA, 75 bp, Artificial Sequence
  Synthetic
ccatgctgaactcaatagctttctggagagagaagctgggcgtggctccatggctggttcggaagccttgttcag

SEQ ID NO: 325600 - DNA, 75 bp, Artificial Sequence
  Synthetic
agctcagagagcaggtgggcctgaccttcctgatcagtctggaggacaagtctaagactgaggagatcatcacct

SEQ ID NO: 325601 - DNA, 75 bp, Artificial Sequence
  Synthetic
cgcccagatgaacttggaagtgctttgtggtaggattaacgtggagaatgggctgtctcttggagaaccaggcct

SEQ ID NO: 325602 - DNA, 75 bp, Artificial Sequence
  Synthetic
gggcttccagacctagatgtgactgtcgatgccacaggtgtaacagtggacataggggctgtgccagactcagca

SEQ ID NO: 325603 - DNA, 75 bp, Artificial Sequence
  Synthetic
tagcctatgaaggccttgatcccgctttgatcatcaagaagctgaaggaaacaggtggagatgactgggtgaagg

SEQ ID NO: 325604 - DNA, 75 bp, Artificial Sequence
  Synthetic
tttgatcatcaagaagctgaaggaaacaggtggagatgactgggtgaaggatactaagttcatcattgtctttgc

SEQ ID NO: 325605 - DNA, 75 bp, Artificial Sequence
  Synthetic
cagcacatgtccaagtgggaaggctctgcgcaaccctcactggagtgattgagagcctggtctctgccctctcaa

SEQ ID NO: 325606 - DNA, 75 bp, Artificial Sequence
  Synthetic
gctgagccctcatgagactgttgctaaccctcggctcaagaattccatcatagagaaccatggactgaagtcagc

SEQ ID NO: 325607 - DNA, 75 bp, Artificial Sequence
  Synthetic
agggcagagaccaggctctcaatcacccctgtaagggttgcacagagcctccccacttggacatgtgctgcagca

SEQ ID NO: 325608 - DNA, 75 bp, Artificial Sequence
  Synthetic
aggatgggccttcctgaagactgggtggagcagatagatgagaatcccggtatcctttacaggcgagctgccaac

SEQ ID NO: 325609 - DNA, 75 bp, Artificial Sequence
  Synthetic
ttccaactgcaggggtatctgaagccacgaccaagaccctgatggaggcttactctttatggcaagatgccttca

SEQ ID NO: 325610 - DNA, 75 bp, Artificial Sequence
  Synthetic
aagaaggaactactcttaaaactggcagagaaggttcattcacctggtgtgactagcagcctgagtaaagggcat

SEQ ID NO: 325611 - DNA, 75 bp, Artificial Sequence
  Synthetic
aaactccactgcaatcctggaccactccgacatgatcactcctttgcgtctttccttttttgggggtctttgtgt

SEQ ID NO: 325612 - DNA, 75 bp, Artificial Sequence
  Synthetic
ttacattaagacagagacaggaatgatgcagggcatactgcacttcacatccagtctcctccactcttgtgttca

SEQ ID NO: 325613 - DNA, 75 bp, Artificial Sequence
  Synthetic
ctctcaacaccagctgatgttgacttcatcaccaagaccctcaaagcaaaagaggtggaggcctatgctgatctt

SEQ ID NO: 325614 - DNA, 75 bp, Artificial Sequence
  Synthetic
ggggtcaccaatggctggccaatctcctccccagatggtgttcagggctgcagttctcagctcctcatcaaacat

SEQ ID NO: 325615 - DNA, 75 bp, Artificial Sequence
  Synthetic
agatcagtcaggctcctaggtgcccccgtgaagaagtcaggtggggtcaccactataagccaagtagtcagaatg

SEQ ID NO: 325616 - DNA, 75 bp, Artificial Sequence
  Synthetic
agctctagttctttgttggttcatgccagccaaattccacagattcatttgggctgccatttccatgtttcggag

SEQ ID NO: 325617 - DNA, 75 bp, Artificial Sequence
  Synthetic
tggacaaagggcgaacttacataaagacagagacaggaatgatgcagggcatactgcactttacatccagcctcc

SEQ ID NO: 325618 - DNA, 75 bp, Artificial Sequence
  Synthetic
acagtcaggcactctagggggctttagcaagcctcagaagacattcataaggccaggaggtgaaatcggctacaa

SEQ ID NO: 325619 - DNA, 75 bp, Artificial Sequence
  Synthetic
acagtcaggcactctagggggctttagcaagcctcagaagacattcataaggccaggaggtgtaatcggctacaa

SEQ ID NO: 325620 - DNA, 75 bp, Artificial Sequence
  Synthetic
acagtcaggcactctagggggctttagcaagcctcagaagacattcataaggccaggaggtgcaatcggctacaa

SEQ ID NO: 325621 - DNA, 75 bp, Artificial Sequence
  Synthetic
acagtcaggcactctagggggctttagcaagcctcagaagacattcataaggccaggaggtggaatcggctacaa

SEQ ID NO: 325622 - DNA, 75 bp, Artificial Sequence
  Synthetic
caaagcaaaagaggtagaggcctatgctgatctttgcgacagtcactacctaaagcctgagaaaactattcagga

SEQ ID NO: 325623 - DNA, 75 bp, Artificial Sequence
  Synthetic
aaggagggctacatgggggaaagcatcagtggggtggtggatgtcatagaaggctctgacgactctgcgatcatg

SEQ ID NO: 325624 - DNA, 75 bp, Artificial Sequence
  Synthetic
ggggcctcattctctcttacctacctcatacagtgcgctcagctcctgcaccactacatgcttctaggactatgc

SEQ ID NO: 325625 - DNA, 75 bp, Artificial Sequence
  Synthetic
aaagataccttcggccttttgttatcctgtggaagaggccccgccagttctctctcccagtttccattgcccagc

SEQ ID NO: 325626 - DNA, 75 bp, Artificial Sequence
  Synthetic
aagtggaagagaatggcagcaaaccagaagaaagagaaggagtcccatgagacattgagccctttcttggatgtt

SEQ ID NO: 325627 - DNA, 75 bp, Artificial Sequence
  Synthetic
caagcaaacatcattgaatcgagggacagtcaaactcccaccctggctaccaaagccatcaagtgaatcaataga

SEQ ID NO: 325628 - DNA, 75 bp, Artificial Sequence
  Synthetic
agcctgcaagactacagaccttgggcggaagtatgcatattattttaatgagatacagggtaagacaaagggaga

SEQ ID NO: 325629 - DNA, 75 bp, Artificial Sequence
  Synthetic
tttactcatcagagaaatcaacagtgaacacagtgtattgtgtcgagtataactctgaattccacttccacaggc

SEQ ID NO: 325630 - DNA, 75 bp, Artificial Sequence
  Synthetic
cctcatgtccttgtagtacatgtccaatagctgctcaagtccaggctcaagctggtgaagaggatttttagggtt

SEQ ID NO: 325631 - DNA, 75 bp, Artificial Sequence
  Synthetic
gccaaacaaccatactgtgttggtcatcttgctcatcctcttgaccattgacagagtcaacacactgcaagagca

SEQ ID NO: 325632 - DNA, 75 bp, Artificial Sequence
  Synthetic
atcttgctcatcctcttgaccattgacagagtcaacacactgcaagagcattcaacgaggtccctcctaagagtg

SEQ ID NO: 325633 - DNA, 75 bp, Artificial Sequence
  Synthetic
ggggtagtcagtgaccctgcaaaagagcttgacattgctatctctgatgatccagaaaaagatacccccaaagag

SEQ ID NO: 325634 - DNA, 75 bp, Artificial Sequence
  Synthetic
acacaaagacccccttcatttggaaatcatgtcgctgagcaaatgctccaacgttgacctcaaatctgtagcaat

SEQ ID NO: 325635 - DNA, 75 bp, Artificial Sequence
  Synthetic
cagagaaggttcattcacctggtgtgactagcagcctgagtaaagggcatgtagtgcctcgggtggtggcagcag

SEQ ID NO: 325636 - DNA, 75 bp, Artificial Sequence
  Synthetic
acacaaagacccccaaaaaaggaaagacgcaaaggagtgatcatgtcggagtggtccaggattgcagtggagttt

SEQ ID NO: 325637 - DNA, 75 bp, Artificial Sequence
  Synthetic
gtcccatgagacattgagccctttcttggatgttgaagacattggagatttcctaacattcaacaatcttcttgc

SEQ ID NO: 325638 - DNA, 75 bp, Artificial Sequence
  Synthetic
aagcaagggctgatgaggtcaaagctcacagagatggtggagaagaatgtagttcctttaacaactcaagagctt

SEQ ID NO: 325639 - DNA, 75 bp, Artificial Sequence
  Synthetic
acttttcagatgtcatagctgtggaactctcagagggatcgcttgatattgagtccatctttgatggggcaccta

SEQ ID NO: 325640 - DNA, 75 bp, Artificial Sequence
  Synthetic
aatttgttgttagggagagaaacattgtcaggagccgcatagacttgttccaagagccagtggacttgcggtgca

SEQ ID NO: 325641 - DNA, 75 bp, Artificial Sequence
  Synthetic
gggcagagaccaggctctcaatcactccagtgagggttgcgcagagccttcccacttggacatgtgctgctgcag

SEQ ID NO: 325642 - DNA, 75 bp, Artificial Sequence
  Synthetic
aagccccaaaagatgctagggaaactggaaggacctttgagaactaagctacaggtatacctcttcaggaagcat

SEQ ID NO: 325643 - DNA, 75 bp, Artificial Sequence
  Synthetic
agggccagccgtcatgaacctgaaggttgagaattatccccctgagatgatgtgcatggcctttggatccctgat

SEQ ID NO: 325644 - DNA, 75 bp, Artificial Sequence
  Synthetic
ggagccagcaagacagaagtttacaactccttcagggaccctcttcatgctgctgtgaactctgtcttctttccc

SEQ ID NO: 325645 - DNA, 75 bp, Artificial Sequence
  Synthetic
gatacgggcccaatcatatgcgcagggcccatccactcaaacaagagtgccaacataccccacctgcttggttac

SEQ ID NO: 325646 - DNA, 75 bp, Artificial Sequence
  Synthetic
gagcacagacccatctgaaacattgagggatggtccttttcttagccatgtgcagtttagaaacttcatagccca

SEQ ID NO: 325647 - DNA, 75 bp, Artificial Sequence
  Synthetic
atgtgtctgtgggtgactagagaatgttggttttagaaggatttccttaagatctgggcggtctttggtgaataa

SEQ ID NO: 325648 - DNA, 75 bp, Artificial Sequence
  Synthetic
atttggaaaccatgtcgctgagcaaatgctccaacgttgacctcaaatctgtagcaatgaatgccaacactgtca

SEQ ID NO: 325649 - DNA, 75 bp, Artificial Sequence
  Synthetic
ttaaatagtgtgccatcagatgtgggtaaccatgaaggactccaggctcatcatcctcatccaagacactgtaag

SEQ ID NO: 325650 - DNA, 75 bp, Artificial Sequence
  Synthetic
agccatctgtcttctttttgcggacaggaataaagaagtcccaacagtccaatagaggcttacgcaatgagggag

SEQ ID NO: 325651 - DNA, 75 bp, Artificial Sequence
  Synthetic
gatctcaggtaacccaagtctaagcctccgcttctcaatggcttcaagagaatctaatatcatgtccccttcaaa

SEQ ID NO: 325652 - DNA, 75 bp, Artificial Sequence
  Synthetic
cccagatgaggtcaagatgagagtgaggggcgacatcctcaacctctctgtcaccatacaagaaggaagggtcat

SEQ ID NO: 325653 - DNA, 75 bp, Artificial Sequence
  Synthetic
agagatctacgttatggatgctaatgcccggcttgtgcagtttggggtcgagaccatggccaggtgtgtctgtga

SEQ ID NO: 325654 - DNA, 75 bp, Artificial Sequence
  Synthetic
gtagatgctcactagtgcacaagcccggggaagttgttgtgtcatatggagggatgcgtgtcagaccaaagtgtt

SEQ ID NO: 325655 - DNA, 75 bp, Artificial Sequence
  Synthetic
gttcttgatggagaagaacatgtgagctgcctgtaggaaccatacagatggttttccactaggccacctgagagc

SEQ ID NO: 325656 - DNA, 75 bp, Artificial Sequence
  Synthetic
tttttgaaggggacatgatattggattctcttgaagccattgagaagcgaaggcttagacttgggttacctgaga

SEQ ID NO: 325657 - DNA, 75 bp, Artificial Sequence
  Synthetic
ctggtgaagaggattttttgggttgccaaataaccaaacagtgttggtcatcttacccatcctcttgaccattga

SEQ ID NO: 325658 - DNA, 75 bp, Artificial Sequence
  Synthetic
ccaaataaccaaacagtgttggtcatcttacccatcctcttgaccattgacagagtcaacacactacaagagcac

SEQ ID NO: 325659 - DNA, 75 bp, Artificial Sequence
  Synthetic
tcacagagatggtggagaagaatgtagttcctttaacaactcaagagcttgtcgacatcctggaggaggacattg

SEQ ID NO: 325660 - DNA, 75 bp, Artificial Sequence
  Synthetic
ttggactgttgggacttctttattcctgtccgcaaaaagaagacagatggctcttacagtgtcttggatgaggat

SEQ ID NO: 325661 - DNA, 75 bp, Artificial Sequence
  Synthetic
atgcagggcatactgcactttacatctagtctcctccactcttgtgttcagagcttctacaagtcctatttcgtc

SEQ ID NO: 325662 - DNA, 75 bp, Artificial Sequence
  Synthetic
tccagtgaagctaatgtttgccatcataaagaaactgatgagatccgtgagctgcttgatggggaagttaatgga

SEQ ID NO: 325663 - DNA, 75 bp, Artificial Sequence
  Synthetic
attgctacagatttgaggtcaacgttggagcatttgctcagcgacatggtttccaaatgaagggggtctttgtgt

SEQ ID NO: 325664 - DNA, 75 bp, Artificial Sequence
  Synthetic
aggctctgacgactcagcgatcatgatcagcatacgccctaagtcagacatggatgaagtccgatcaaggttctt

SEQ ID NO: 325665 - DNA, 75 bp, Artificial Sequence
  Synthetic
tgtttgggatttattcttcagagaaatcaacagtgaacacagtgtattgtgtcgagtataactctgaattccatt

SEQ ID NO: 325666 - DNA, 75 bp, Artificial Sequence
  Synthetic
tgttgctaacttgctccactctgtcaagttcttgaaccctttgtttgggatttattcatcagagaaatcaacagt

SEQ ID NO: 325667 - DNA, 75 bp, Artificial Sequence
  Synthetic
aagctacaggccgagagacactgatatatcagagtcagccgcagcatacctctggagcaatcgagacctcttctc

SEQ ID NO: 325668 - DNA, 75 bp, Artificial Sequence
  Synthetic
caagcaggcaagaagattactccaaccttctaacacagtgcttggaaggaggggcctcattctctcttacctacc

SEQ ID NO: 325669 - DNA, 75 bp, Artificial Sequence
  Synthetic
agctggatctgcttgaaaactcttgacaattgggcctggtcacatgcctcagttctcctggcaaatgataggaag

SEQ ID NO: 325670 - DNA, 75 bp, Artificial Sequence
  Synthetic
cctgcggtgaacccaggacaagaggcatgtctgcacttcacggcacctgggagtccggactcaaaatgtctcaaa

SEQ ID NO: 325671 - DNA, 75 bp, Artificial Sequence
  Synthetic
ttgcagtgtgctgactctatcaatggtcaagaggatgggcaagatgaccaacactgtatggttatttggcaatcc

SEQ ID NO: 325672 - DNA, 75 bp, Artificial Sequence
  Synthetic
tttcttgggtgtctgatcagttctgcgactccaggggtcttgatgaagagagcaccattatgtggggttaacttt

SEQ ID NO: 325673 - DNA, 75 bp, Artificial Sequence
  Synthetic
agagcaggtgcggccattcctcatattcctgcaaattcctgaggacagcatttcttgggtgtctgatcagttctg

SEQ ID NO: 325674 - DNA, 75 bp, Artificial Sequence
  Synthetic
ctattctagcaattgggcttgccgaaggctgcgatgagatggtccatgcagactccaaacttgtttcgtgcaagc

SEQ ID NO: 325675 - DNA, 75 bp, Artificial Sequence
  Synthetic
aggggcaaatatcccaagcccaacagactggctgaatgccttgtttggcaatgggctgagtaggtggatcctggg

SEQ ID NO: 325676 - DNA, 75 bp, Artificial Sequence
  Synthetic
gttgtaaacttctgtcttgctggctccgcgcatcttcacattgatagtcttggtgaaggcatcttgccacagaga

SEQ ID NO: 325677 - DNA, 75 bp, Artificial Sequence
  Synthetic
tggtgaaggcatcttgccacagagagtaggcctccatcagggtcttggttgtggcttcagatacccccgcagttg

SEQ ID NO: 325678 - DNA, 75 bp, Artificial Sequence
  Synthetic
aacaactcaagaacttgtcgacatcttggaggaggacatagacttttcagatgtcatagctgtggagctctcaga

SEQ ID NO: 325679 - DNA, 75 bp, Artificial Sequence
  Synthetic
tggagtgccatcaacctcttggaccctgagtttgacattttccctgatgccttgacgatcttattgcctcgagtc

SEQ ID NO: 325680 - DNA, 75 bp, Artificial Sequence
  Synthetic
cttcctgaagactgggtggagcagatagatgagaatcctggagtcctttacaggagagctgccaacaagaaggaa

SEQ ID NO: 325681 - DNA, 75 bp, Artificial Sequence
  Synthetic
gaggtgtctggcttgactgacctgtgtgaaatagaagagctcaagtccaagaagctggcattagctccctgcaat

SEQ ID NO: 325682 - DNA, 75 bp, Artificial Sequence
  Synthetic
ggccaaggggtctgatatgatagttcctgggccttcatacaaggggaaagtcttttttgagcggccaacttttga

SEQ ID NO: 325683 - DNA, 75 bp, Artificial Sequence
  Synthetic
gggtcttgatgaagagagcaccattatgtggggttgactttaaaacatggttggcacgcagttgatgtatctgtg

SEQ ID NO: 325684 - DNA, 75 bp, Artificial Sequence
  Synthetic
aaagatgggtgtatatggaatgctgaccttgtgggcatagagctacgagtggatgacgctgtgtgctactctaag

SEQ ID NO: 325685 - DNA, 75 bp, Artificial Sequence
  Synthetic
tagatgagaatcctggagtcctttacaggagagctgccaacaagaaggaactactcttaaaactggcagagaagg

SEQ ID NO: 325686 - DNA, 75 bp, Artificial Sequence
  Synthetic
agggcaaagacaatgatgaactttgtatccttcacccaatcatctccacctgtctccttcagcttcttgatgatc

SEQ ID NO: 325687 - DNA, 75 bp, Artificial Sequence
  Synthetic
gatagggttctctggataggtgatgttgcttgtcagcctatgacacccatccctgaagagacatttctggagctg

SEQ ID NO: 325688 - DNA, 75 bp, Artificial Sequence
  Synthetic
agaggccttcgactgagcctctcagaagttactgctacttgcacaggagaggtaacgaatgtgagtgggtgttac

SEQ ID NO: 325689 - DNA, 75 bp, Artificial Sequence
  Synthetic
taaaatcatcatgagggagcacaagaccaaatgggtgcaagagagctcatccaaggattttgtgtgctacaagga

SEQ ID NO: 325690 - DNA, 75 bp, Artificial Sequence
  Synthetic
gacccaaaggccatgcacatcatctctgggggataattctcgaccttcaggttcatgacagcaggccccactggg

SEQ ID NO: 325691 - DNA, 75 bp, Artificial Sequence
  Synthetic
ctgggggataattctcgaccttcaggttcatgacagcaggccccactgggaggtactcctttaaggctgctgctg

SEQ ID NO: 325692 - DNA, 75 bp, Artificial Sequence
  Synthetic
ggggatgagacagcgttcagtgtactagagggagttcatagctatactgtaagtctcagctttgaccatgctgtg

SEQ ID NO: 325693 - DNA, 75 bp, Artificial Sequence
  Synthetic
agtcaggtggggtcaccaccataagccaagtagtcagaatgaacttcttccctggttttagcctagaagctgaga

SEQ ID NO: 325694 - DNA, 75 bp, Artificial Sequence
  Synthetic
agtgatgccaggctttatgatgtcattgaatccatccgaaggttatgtgatgaccttgggatcaacaacagggtg

SEQ ID NO: 325695 - DNA, 75 bp, Artificial Sequence
  Synthetic
cagtgtgcatgtttcatagtcctggctcacaatcttagagcatggaggttctattggagtgttggccggtctttg

SEQ ID NO: 325696 - DNA, 75 bp, Artificial Sequence
  Synthetic
actgagcaaatgctccaacgttgacctcaaatctgtagcaatgaatgctaacactgttaggcttgagccttccct

SEQ ID NO: 325697 - DNA, 75 bp, Artificial Sequence
  Synthetic
caagccagcatcaaggactgacgggtgtccagtcaggatcatggaaaggggcttcaggattagggaacttcaaaa

SEQ ID NO: 325698 - DNA, 75 bp, Artificial Sequence
  Synthetic
ataaagaaactaatgagaactgtgagctgcttgatggggaaattgatggataggggaaggcaagtgatccatgag

SEQ ID NO: 325699 - DNA, 75 bp, Artificial Sequence
  Synthetic
accaagatgatgttaggattgagatggcaagacccagaagggtaaggcattggatgtactcacctgtcatcctga

SEQ ID NO: 325700 - DNA, 75 bp, Artificial Sequence
  Synthetic
tggatgtactcacctgtcatcctgactattttagcaatagggcttgctgagagctgtgatgagatggtccatgct

SEQ ID NO: 325701 - DNA, 75 bp, Artificial Sequence
  Synthetic
ctattttagcaatagggcttgctgagagctgtgatgagatggtccatgctgattctaagcttgtttcatgcaggc

SEQ ID NO: 325702 - DNA, 75 bp, Artificial Sequence
  Synthetic
ggggatgagactgcgttcagtgtcctggagggagttcatagctatactgtcagcctcagctttgaccatgcagtg

SEQ ID NO: 325703 - DNA, 75 bp, Artificial Sequence
  Synthetic
acatgcctcagttctcctggcaaatgataggaagacccaaggcattgacaatagagctatggggaacattttcag

SEQ ID NO: 325704 - DNA, 75 bp, Artificial Sequence
  Synthetic
ccccttcatttggaaaccatgtcactgagcaaatgctccaacgttgacctcaaatctgttgcaatgaatgccaac

SEQ ID NO: 325705 - DNA, 75 bp, Artificial Sequence
  Synthetic
tgtttcccagtaggtctcaaagaacccccttcatttggaaaccatgtcactgagcaaatgctccaacgttgacct

SEQ ID NO: 325706 - DNA, 75 bp, Artificial Sequence
  Synthetic
catgtctgcacttcacggcacctgggagtccggactcaaaatgtctcaaaattaaggttaagaggatcaacctaa

SEQ ID NO: 325707 - DNA, 75 bp, Artificial Sequence
  Synthetic
aagaaagagaaggagtcccatgagacattgagccctttcttggatgttgaagacattggagatttcctaacattc

SEQ ID NO: 325708 - DNA, 75 bp, Artificial Sequence
  Synthetic
acagggctggtctagggttcagtggctgctctgatggatgtggaggagcagcctgcggctgctttaatgcagccc

SEQ ID NO: 325709 - DNA, 75 bp, Artificial Sequence
  Synthetic
gaaacacggttggaacgcagttgatgtgtctgtgggtgactagggaatgttggttttagaaggatttccttaaga

SEQ ID NO: 325710 - DNA, 75 bp, Artificial Sequence
  Synthetic
aagtcatctggttctcctctctgatctgcttagtcattcaatgcagtggggattcgggcccaatcatctgcgcag

SEQ ID NO: 325711 - DNA, 75 bp, Artificial Sequence
  Synthetic
tttgatggggcacctatcttgtggtctgctgaagtggaagagtttggagaaggagttgtggctgtgagctattcc

SEQ ID NO: 325712 - DNA, 75 bp, Artificial Sequence
  Synthetic
ggtcttctctgacaccattgatgctggggaatgggagctaacagagttcaaaagcctgaagacatgcaagctcac

SEQ ID NO: 325713 - DNA, 75 bp, Artificial Sequence
  Synthetic
gaagctggcattagctccctgcaaccaggctggcatgggggttgtaggcaaggttggagagatacagtgcagtag

SEQ ID NO: 325714 - DNA, 75 bp, Artificial Sequence
  Synthetic
caggaaccactcgcaatttcaaggctacgttgggcagcgaggtggacgctctcaggttagctactacccagctga

SEQ ID NO: 325715 - DNA, 75 bp, Artificial Sequence
  Synthetic
gtgagatagaggagctcaagtccaagaagctggcattagctccctgcaaccaggctggcatgggggttgtaggca

SEQ ID NO: 325716 - DNA, 75 bp, Artificial Sequence
  Synthetic
tctgagaagatttgtcagatagatcggctgatacatgtttcgtcatggctcaggaaccactcgcaatttcaaggc

SEQ ID NO: 325717 - DNA, 75 bp, Artificial Sequence
  Synthetic
acaaggtacacccagatggagggctttgtctccccccctatgctgcctaagccccaaaagatgctagggaaactg

SEQ ID NO: 325718 - DNA, 75 bp, Artificial Sequence
  Synthetic
ggccatgcacatcatctcagggggataattctcaaccttcaggttcatgacggctggccccactgggagatactc

SEQ ID NO: 325719 - DNA, 75 bp, Artificial Sequence
  Synthetic
aggggagggtagagtggggaggaacattccatgccatctcaggccggtccacaaaccttgagaatatggtgaaca

SEQ ID NO: 325720 - DNA, 75 bp, Artificial Sequence
  Synthetic
acaaaccttgagaatatggtgaacagctggtacattgggtactacaagaacaaagaggagtcaacagagctaaat

SEQ ID NO: 325721 - DNA, 75 bp, Artificial Sequence
  Synthetic
gtggtgtactaccacatataacgttttaacaatgaactttttccttttgtttattatcttgcctcttgcactgtc

SEQ ID NO: 325722 - DNA, 75 bp, Artificial Sequence
  Synthetic
agtgccacctaaaaatacaaaaggtggaaagtgcttttatggaggcgagaagtttaaagaagtcaatgcgacaat

SEQ ID NO: 325723 - DNA, 75 bp, Artificial Sequence
  Synthetic
gaatatggcagaagtctgtctgagagatgatatatcattaattaaatctattggtcatcatgccctctctaacga

SEQ ID NO: 325724 - DNA, 75 bp, Artificial Sequence
  Synthetic
ccgttctaaaattgaatcaagtgtatcatattaccgactattctttgtaaaagattggttcaattgtaatcctat

SEQ ID NO: 325725 - DNA, 75 bp, Artificial Sequence
  Synthetic
tgaagatacagcaggtacctttttggtactagacgttgatcatgcaggcaatataattgctaaggtctatgcatg

SEQ ID NO: 325726 - DNA, 75 bp, Artificial Sequence
  Synthetic
cagggcaacatgtgagatcacaactgagcaagatacagggagtgtattgattaaatctgaagaacttaaccatta

SEQ ID NO: 325727 - DNA, 75 bp, Artificial Sequence
  Synthetic
tagtatacaaggaactacaataaaaaatggctggtttaaaggggcaattgaagtaagcttggaagctacatgtga

SEQ ID NO: 325728 - DNA, 75 bp, Artificial Sequence
  Synthetic
acacattcatgttacatgcgggcataaaactgttgaatttaatgcatgctttcgaacccataaaaagtgtattag

SEQ ID NO: 325729 - DNA, 75 bp, Artificial Sequence
  Synthetic
atattttaaaaaatctatactaccggagctaataatagaatctttctgtactaatatggagttgattatcttgct

SEQ ID NO: 325730 - DNA, 75 bp, Artificial Sequence
  Synthetic
aatatttggaattgttagcgttataatgtcaattatattaacaaaaacatacttagtttaccttctgataccggt

SEQ ID NO: 325731 - DNA, 75 bp, Artificial Sequence
  Synthetic
attttatccatttgttaaagcttatggtgttttttatgaaagatgtatgaggaaatgcaaaaattgtggactagc

SEQ ID NO: 325732 - DNA, 75 bp, Artificial Sequence
  Synthetic
agtgcatccattttcaaaatgtcctatatcttgtatttgtggaatgcaatataactccactgaagcccttaaagt

SEQ ID NO: 325733 - DNA, 75 bp, Artificial Sequence
  Synthetic
ccacaggcaatgcaaaaactgtaccggttttaaatctctaacccatacaaggtcactatgcaagaaaaaactccc

SEQ ID NO: 325734 - DNA, 75 bp, Artificial Sequence
  Synthetic
taatgcagcattagcaataatggtgacaatcttgtttttttcttttattacccctatcagttctaaatgctatga

SEQ ID NO: 325735 - DNA, 75 bp, Artificial Sequence
  Synthetic
agaagagcaacttgttgatgaattccgatctgctttaaaagatttacaagaaaccacaatcagaaataatgtata

SEQ ID NO: 325736 - DNA, 75 bp, Artificial Sequence
  Synthetic
tatctgtgtattagcaggtataattgtattgatatgcatgcggttgataattatgagatattatgtaaaaattcg

SEQ ID NO: 325737 - DNA, 75 bp, Artificial Sequence
  Synthetic
ttatgtggtatgcaattattgcggattgattcatctaaaacaaggcttaattttggaacagggttttactaataa

SEQ ID NO: 325738 - DNA, 75 bp, Artificial Sequence
  Synthetic
atgcttgacgtgcatatgtgcaaacaagaatatacataaagctacacaagattgtttgtcacacagtcatatgaa

SEQ ID NO: 325739 - DNA, 75 bp, Artificial Sequence
  Synthetic
atcatataagtattcacatatcttaattttatcattaatagcattatccctgctatccccggtctatagctcacc

SEQ ID NO: 325740 - DNA, 75 bp, Artificial Sequence
  Synthetic
atgcttacagccagaagacttaagtggtttagaagaaatatcactttgtctagctttatatcaaaatcaaagtca

SEQ ID NO: 325741 - DNA, 75 bp, Artificial Sequence
  Synthetic
gaacatagaatacagtcaattgatgactaaattaaaatcacatatccacgaagatgagttaaatatgttgttgcc

SEQ ID NO: 325742 - DNA, 75 bp, Artificial Sequence
  Synthetic
tacaaccaagcccacttttaaagaaatgatcaaaaaaattgagactgcaaatgattaccatatgtctactatata

SEQ ID NO: 325743 - DNA, 75 bp, Artificial Sequence
  Synthetic
tgaatatgtaaatggatttatgtacccagaaactttaaaagcgctactgaaacctgcaggtgaaacaaccattga

SEQ ID NO: 325744 - DNA, 75 bp, Artificial Sequence
  Synthetic
atggagaacttattttaagaacactggtcttcatgcatgtgataagaatataaaaaaaatgatatgcaggtgtgt

SEQ ID NO: 325745 - DNA, 75 bp, Artificial Sequence
  Synthetic
attagaacagaaagaatgcgacaacacaaaagttgatgcagcaaaaactttggaaaactattatacttcaaaacc

SEQ ID NO: 325746 - DNA, 75 bp, Artificial Sequence
  Synthetic
tggagagctaaaggaagatatgacgattttagcaaaaggcttaagcaaagcatttccagggttgacaacaatttt

SEQ ID NO: 325747 - DNA, 75 bp, Artificial Sequence
  Synthetic
actaaatcaaattgttagttcagaaaaatatgaactattccctcatatcacatcgaaaatgaagttagcatctgc

SEQ ID NO: 325748 - DNA, 75 bp, Artificial Sequence
  Synthetic
agaaaacaggcaactgactggaattttgaatttcctagaatttgttgctgacaaaaatatgacaaagaaggagaa

SEQ ID NO: 325749 - DNA, 75 bp, Artificial Sequence
  Synthetic
gcagcttagatcattaccctctatacgtcatttgggtgataaattcacccataaaaatgctggggaaaagaatat

SEQ ID NO: 325750 - DNA, 75 bp, Artificial Sequence
  Synthetic
aaagacatgcacagatcctaaaacggtaagatgtacagggaaacggttgagaagtttaataatagagttccaagc

SEQ ID NO: 325751 - DNA, 75 bp, Artificial Sequence
  Synthetic
atgtaatagtaatggaataagattatataagcagcctaaatatcctagggtgatggttgggtctgtactatgtct

SEQ ID NO: 325752 - DNA, 75 bp, Artificial Sequence
  Synthetic
tgcagataggcactgtttgcaggattttatacctatatctactgaagatagtgtagaaaaactccaatgctatgc

SEQ ID NO: 325753 - DNA, 75 bp, Artificial Sequence
  Synthetic
ctcacaatcagcagatgaatcaaatggtatgctagtagcaaaaagcgatatcagactaaaaaagattggcaaatg

SEQ ID NO: 325754 - DNA, 75 bp, Artificial Sequence
  Synthetic
tattgttaattctgggaggaagcaaattgtaaaatctaaagatgggaaatattatgagtataagacactgcaaca

SEQ ID NO: 325755 - DNA, 75 bp, Artificial Sequence
  Synthetic
caagaaaacagctttagttgatgaatattgcctatcacctgagtgtgatgaacaattttacccttatcatcttga

SEQ ID NO: 325756 - DNA, 75 bp, Artificial Sequence
  Synthetic
caatttaaaatcttgcacttggcgtgaattaacgcataatacagttagccaaactaaagttgtccataatgatat

SEQ ID NO: 325757 - DNA, 75 bp, Artificial Sequence
  Synthetic
tgaatcatttgcctctgcaattaagttatctttacataatgatttaactactcatcacttcaagcctactgatag

SEQ ID NO: 325758 - DNA, 75 bp, Artificial Sequence
  Synthetic
tctaccgcatgtagtgccaaattataaaggcatatcaatcaagggaacagaaaatgaaaatgggatccagaatgc

SEQ ID NO: 325759 - DNA, 75 bp, Artificial Sequence
  Synthetic
ttttgttttgttcaatatgccacttcaaagtggccactcacagggctatacattagttgccactaatggtatcaa

SEQ ID NO: 325760 - DNA, 75 bp, Artificial Sequence
  Synthetic
aatatttgacattgtagtatatgtaaagcaagccaaaattaaagcacaatatgtataccagtactctacagggcc

SEQ ID NO: 325761 - DNA, 75 bp, Artificial Sequence
  Synthetic
aacaataggaataaatgtaaaacatgaagaactgtgtacaggatcatgtccacatgacatacccaaagatcaaaa

SEQ ID NO: 325762 - DNA, 75 bp, Artificial Sequence
  Synthetic
ctggctaacattctctaaagagcataccagtgcttggggttgtgaatcatggggatgtctagctattgggacagg

SEQ ID NO: 325763 - DNA, 75 bp, Artificial Sequence
  Synthetic
gtgtgtttatggttcttgtcaggatatcattagagaagaaggctatgtttataaaaaattaggatcagaagaaat

SEQ ID NO: 325764 - DNA, 75 bp, Artificial Sequence
  Synthetic
agagacagaaatatgtattagtgatccatatgaaacattatgcaataaaattgatgtgttagaaccaattttaac

SEQ ID NO: 325765 - DNA, 75 bp, Artificial Sequence
  Synthetic
agacactatgcaagtggaaatcacatctcagcagacaaaccttttaaaagaaatagtgtttgtaaaagataaaaa

SEQ ID NO: 325766 - DNA, 75 bp, Artificial Sequence
  Synthetic
tatttactcaggcgacattaatccaaaagggacatatgcaaagaaatgtggttcagttcaaaaagttggtggcct

SEQ ID NO: 325767 - DNA, 75 bp, Artificial Sequence
  Synthetic
catttctggaataggtaatccaaaatttgattatcattgccatgcaatgtctagaaaagatataattcttagaag

SEQ ID NO: 325768 - DNA, 75 bp, Artificial Sequence
  Synthetic
atgttatgacaatgagtatatctcttgttcaactctacaatcagaaccagatctgaaaattataaaagataatga

SEQ ID NO: 325769 - DNA, 75 bp, Artificial Sequence
  Synthetic
taagacatatatattaaatgacggacagttgttagggagtgcagcaataagattaaatttgggcgatatcaaata

SEQ ID NO: 325770 - DNA, 75 bp, Artificial Sequence
  Synthetic
taaaagtgtctcagctgctgaaattcaaatatcaggctttggtacttgtgggggatgtatacaatgttttacaga

SEQ ID NO: 325771 - DNA, 75 bp, Artificial Sequence
  Synthetic
tatagcatgcaagttagagataacatcaacggggatcaagcagtgtgaaattaccagtaattgttatgtttatac

SEQ ID NO: 325772 - DNA, 75 bp, Artificial Sequence
  Synthetic
aaataatatattaattcaagaaggggtaaacacgttaagtatcaaattaaaatgtttatctaaagagttcaaagt

SEQ ID NO: 325773 - DNA, 75 bp, Artificial Sequence
  Synthetic
ctcgatatgtaaaacaaatatagatctaaagtcactagttgtagaggatcatagtgtactagatttaacatcatc

SEQ ID NO: 325774 - DNA, 75 bp, Artificial Sequence
  Synthetic
agaccagacctcctatataaaggaatatgataaaaagtgttctacatggttatgcagagtatatgatgaaggctt

SEQ ID NO: 325775 - DNA, 75 bp, Artificial Sequence
  Synthetic
aggttttatattcaagcctttttggtctgagattaatttatggggaaaatatatactgatcattgtaggattatg

SEQ ID NO: 325776 - DNA, 75 bp, Artificial Sequence
  Synthetic
cttacttatagttatagtagccaaattgatagcaccatttgtaaagtatgtaatctcaacattaaaatacaatga

SEQ ID NO: 325777 - DNA, 75 bp, Artificial Sequence
  Synthetic
ttatatctataaaatagaaaataaaatgcattaaactataaacaaactgggtgggtggggggcaatagcagccga

SEQ ID NO: 325778 - DNA, 75 bp, Artificial Sequence
  Synthetic
aaacaaactgggtgggtggggggcaatagcagccgaatctatgttcattgtctgaagtatataaacgtttttatg

SEQ ID NO: 325779 - DNA, 75 bp, Artificial Sequence
  Synthetic
gtgtactccactatagaacaaagcttttaaatggcaaaccaattcattttccaagatgttcctcaacggaatctc

SEQ ID NO: 325780 - DNA, 75 bp, Artificial Sequence
  Synthetic
ccaagatgttcctcaacggaatctcgctacgtttaacccggaggttgggtatgtggcatttattgctaaatatgg

SEQ ID NO: 325781 - DNA, 75 bp, Artificial Sequence
  Synthetic
gctacgtttaacccggaggttgggtatgtggcatttattgctaaatatggggcccaactcaattttgataccgtt

SEQ ID NO: 325782 - DNA, 75 bp, Artificial Sequence
  Synthetic
agagtcttcttcctcaatcagaagaaggccaagatggtgctcagtaagacggcacaaccgagtgttgatcttaca

SEQ ID NO: 325783 - DNA, 75 bp, Artificial Sequence
  Synthetic
tttggaggcatcaaatttacattggttaataaccattttccccaatacacagcaaatcctgtgccagacactgcc

SEQ ID NO: 325784 - DNA, 75 bp, Artificial Sequence
  Synthetic
ctcactctccaccgcctctcaggctatctagctaaatgggttgcagaccaatgcaaaacaaaccaaatcaaacta

SEQ ID NO: 325785 - DNA, 75 bp, Artificial Sequence
  Synthetic
gcggaagctatggaaaaaatcgtcatgccacttgctgaagtgaaaggctgcacttggactgaagggctgactatg

SEQ ID NO: 325786 - DNA, 75 bp, Artificial Sequence
  Synthetic
tatctgggatttgcacctggtgcagaaatgttcctggaaacatttgaattctaccctttggttattgacatgcat

SEQ ID NO: 325787 - DNA, 75 bp, Artificial Sequence
  Synthetic
agagtgctaaaggacggaatggatgtcaactttatgagaaaagtcctccgtcagcgttacggcacattgactgca

SEQ ID NO: 325788 - DNA, 75 bp, Artificial Sequence
  Synthetic
gagcaatggatgactcaaaaaatagatgctgttcgcgcagcttttaatgctgttggccaattgagctgggccaaa

SEQ ID NO: 325789 - DNA, 75 bp, Artificial Sequence
  Synthetic
tctggattctcaccagcagccaggaccttccttgcccaatttggtatcaatatctaaattcataaaagaatccca

SEQ ID NO: 325790 - DNA, 75 bp, Artificial Sequence
  Synthetic
ccctttcccccagtatggtgtttcaaaacaccatacgccatttctgcagcattgtttattcatctctattgattg

SEQ ID NO: 325791 - DNA, 75 bp, Artificial Sequence
  Synthetic
tatggtgtttcaaaacaccatacgccatttctgcagcattgtttattcatctctattgattgttctatgtggagc

SEQ ID NO: 325792 - DNA, 75 bp, Artificial Sequence
  Synthetic
cccctagagaaaacaattcaacatggatccttatcgcattgatatcttccgtaaccggatcttgaattgcaatga

SEQ ID NO: 325793 - DNA, 75 bp, Artificial Sequence
  Synthetic
tcccgaagatgcaaaagacattatgtctgatctactaatggaacgccacaactattttggtagggaggtgtgcca

SEQ ID NO: 325794 - DNA, 75 bp, Artificial Sequence
  Synthetic
attcctagatatagaatttaggaatgacacacctgctcaggacattctcctcgatttcttaccacctggatctgt

SEQ ID NO: 325795 - DNA, 75 bp, Artificial Sequence
  Synthetic
tttcaatattcgaaattgcagtccagataactacgttatcttgaacgggaagctttacataatagattacaaggt

SEQ ID NO: 325796 - DNA, 75 bp, Artificial Sequence
  Synthetic
ttctgtcgatgctacatacggtcagtctacaaaagttaagtatgaagaaatttttggtgatgctcttgcaccttt

SEQ ID NO: 325797 - DNA, 75 bp, Artificial Sequence
  Synthetic
tggactagactttgaggtggttatcatacgggcagacccaatacgtgaaatggtgcatgttgacagcttagattt

SEQ ID NO: 325798 - DNA, 75 bp, Artificial Sequence
  Synthetic
tgttaatgtatatggtaacatatacattgatttggactttacatggtttttcaatctacgtgctctgctatatga

SEQ ID NO: 325799 - DNA, 75 bp, Artificial Sequence
  Synthetic
tcgattcaaggataatgatagatttcttgaaattgtcaatcaaggggaattcaccatgacatcaccttggataga

SEQ ID NO: 325800 - DNA, 75 bp, Artificial Sequence
  Synthetic
agaaaatacaccagagttgtatactcatccaatatttagagaattctataattcactaaacgatgaggagaaaaa

SEQ ID NO: 325801 - DNA, 75 bp, Artificial Sequence
  Synthetic
tacatttaatataagcttagaatttgatgctaccaagtctgaaaaatggaatcaaaacctagttactatcttaca

SEQ ID NO: 325802 - DNA, 75 bp, Artificial Sequence
  Synthetic
aaggtatgaacctttttacaaaaaattctgcaatattgctgcatctggcatattcaaatgtacaggtaattaccc

SEQ ID NO: 325803 - DNA, 75 bp, Artificial Sequence
  Synthetic
ggcaccaaataaggatcagatttcaaaaggctgggatgatatgtatgaacggattaagacagagagagatttaac

SEQ ID NO: 325804 - DNA, 75 bp, Artificial Sequence
  Synthetic
tgaggacttgtccaaacaaaagcctagtttccatttcatatggtctcccccagatgtgagccgacccaatgaaaa

SEQ ID NO: 325805 - DNA, 75 bp, Artificial Sequence
  Synthetic
tatatcaaaaatcttaaccttggccaaagcattacagaaaattcagggagattcgacatttactaatagttttag

SEQ ID NO: 325806 - DNA, 75 bp, Artificial Sequence
  Synthetic
atcgctagggttattaatggatttctcatctaatataggattgtatgaatctcatgtaagtaaactgaaaaacac

SEQ ID NO: 325807 - DNA, 75 bp, Artificial Sequence
  Synthetic
agcaagacaaacatctaagaaaattgaccaaaaattggaagaagtagaaataggtacatctactgtattatggga

SEQ ID NO: 325808 - DNA, 75 bp, Artificial Sequence
  Synthetic
gcaacagttcaaattcaattcaaaaataatgaacacacaagataaatcacacttgtttaaggattttttaggtat

SEQ ID NO: 325809 - DNA, 75 bp, Artificial Sequence
  Synthetic
cgggggtcataaaccatttagtaaaaaattgtctgatgatgtagatatagaaaagcctaaaatattggactttaa

SEQ ID NO: 325810 - DNA, 75 bp, Artificial Sequence
  Synthetic
ttcaaaaaatgtaatggatgcatgcaatagaatatataggcaagtaaggaacacactaggtacaaccaatacact

SEQ ID NO: 325811 - DNA, 75 bp, Artificial Sequence
  Synthetic
gcaaaaaatgggttgttacctagaagagtatggatttaatatatcaagtgcatctcctgatatgtggcagagaat

SEQ ID NO: 325812 - DNA, 75 bp, Artificial Sequence
  Synthetic
acaggaggtttgcgcaacaaattactgggctgcaatattagattattctactcttatgaaaaatatgcttgctgc

SEQ ID NO: 325813 - DNA, 75 bp, Artificial Sequence
  Synthetic
atcacagtacaacaggcacaacaccttcagggttgtaacctgtgcaaacaataatctgtatggcatagtcatgcc

SEQ ID NO: 325814 - DNA, 75 bp, Artificial Sequence
  Synthetic
gtcatcagatatcaaaacaaaaaggtctacattgtgctactttataattgcattgcatgatgagaagcaaaatgt

SEQ ID NO: 325815 - DNA, 75 bp, Artificial Sequence
  Synthetic
tgcacattctggttcaatgcatgcaacattccagtcaggttctaaatacttgtctatttcaaagggatttagatt

SEQ ID NO: 325816 - DNA, 75 bp, Artificial Sequence
  Synthetic
agataaagagcggtgccaaaggatagtatcagctccagggctttttttaatgacttcatgcttatttctgtctga

SEQ ID NO: 325817 - DNA, 75 bp, Artificial Sequence
  Synthetic
taataaaactctgaatatcaatgatgtattgaacttcagtttccacacatctgtctcaatcacaaaagcaatgct

SEQ ID NO: 325818 - DNA, 75 bp, Artificial Sequence
  Synthetic
ctctctaacagaaccatctagatatatgattatgaattccctggcgatatctagccatgttcgtgaatatatggc

SEQ ID NO: 325819 - DNA, 75 bp, Artificial Sequence
  Synthetic
tgaaaagtttagcccttacactaaaactgctttttctgtagttatgacacagactataaagcgtgcgtgttatga

SEQ ID NO: 325820 - DNA, 75 bp, Artificial Sequence
  Synthetic
ggcatttgatcagaaagagaagatagaacttaaaaatatacatctgacagattatgaaataactcagaagggagt

SEQ ID NO: 325821 - DNA, 75 bp, Artificial Sequence
  Synthetic
taaaccacagcgagatttaaaatctatatggtttcctggtcaggtaaatctgaaagaatatattaaccaagttta

SEQ ID NO: 325822 - DNA, 75 bp, Artificial Sequence
  Synthetic
tatgccattctatttcaattcaaaaggtctgcatgagaagcatcatgtaatgatagatttggcaaaaactatact

SEQ ID NO: 325823 - DNA, 75 bp, Artificial Sequence
  Synthetic
agatattgaaagggatcaaagattaaacatacctggcatatggtctgatataccaaaaaaacagacagtaaattt

SEQ ID NO: 325824 - DNA, 75 bp, Artificial Sequence
  Synthetic
aagagttttaatatattcacttgcaaaagcactgaatatggatacatcgagacataattatatacgatctagaat

SEQ ID NO: 325825 - DNA, 75 bp, Artificial Sequence
  Synthetic
agaaaatagtaataatctgaaacgatctatcaccactatatctacttttaccagttcgaaatcttgtattaaaat

SEQ ID NO: 325826 - DNA, 75 bp, Artificial Sequence
  Synthetic
aggtgattttagtgatctaaagatccgcaaagaaaagaaaacgcttgaaaatatgagaaaagaaataaaaaaata

SEQ ID NO: 325827 - DNA, 75 bp, Artificial Sequence
  Synthetic
taccgttgcaaatccagaatttgctgatgagctagacatatcttgtgccgtacatcatgcagattacaatgatgt

SEQ ID NO: 325828 - DNA, 75 bp, Artificial Sequence
  Synthetic
tagaaaggctatacccaactatgctgattgcatgtcaactaaagtttttgatgcattatatgaaaaaataaaaaa

SEQ ID NO: 325829 - DNA, 75 bp, Artificial Sequence
  Synthetic
tcatgagattgatgatagaccaactgtaatacatatacttgacacaatgaaaaaacacaaacaattttattttag

SEQ ID NO: 325830 - DNA, 75 bp, Artificial Sequence
  Synthetic
cttctttaataaaggtcaaaaaacagcaaaagatagagaaatatttgtgggagagtttgaagccaagatgtgcct

SEQ ID NO: 325831 - DNA, 75 bp, Artificial Sequence
  Synthetic
atacctagttgagcgtatttcaaaggaaaggtgccgcttaaatcctgaggagatgatcagtgaaccaggagattc

SEQ ID NO: 325832 - DNA, 75 bp, Artificial Sequence
  Synthetic
aaaattaaagaagttggaagatctagctgaatctgaaattaggtatacagctcaaaccttgaaaaatcttaatag

SEQ ID NO: 325833 - DNA, 75 bp, Artificial Sequence
  Synthetic
gaaaattcaaaatgatatgtttggttcagaaatagatatggatatgaagttgcatgccttaaaaattgagataaa

SEQ ID NO: 325834 - DNA, 75 bp, Artificial Sequence
  Synthetic
tgctgatatgtcaaagtggagcgctcaggatgtcttgtacaaatacttctggttatttgctttagatccagtctt

SEQ ID NO: 325835 - DNA, 75 bp, Artificial Sequence
  Synthetic
gtataagcatgagaaggaaagaattctttattttctatgcaattatatgcaaaaacgcctcatattaccggatga

SEQ ID NO: 325836 - DNA, 75 bp, Artificial Sequence
  Synthetic
tttgatcgcaagtattttagaccagagagtccagcgtcaaaatgatattatatatgagatgacaaatggcttagc

SEQ ID NO: 325837 - DNA, 75 bp, Artificial Sequence
  Synthetic
ccaaaactgggtagaaatcaagcgaaattggctacaaggtaatctaaactatactagcagttatctacacacatg

SEQ ID NO: 325838 - DNA, 75 bp, Artificial Sequence
  Synthetic
ctctatgaatgtttataaagatattgtaaaacgttctattgacttgctagaaggtgaagctttaatcaattctat

SEQ ID NO: 325839 - DNA, 75 bp, Artificial Sequence
  Synthetic
ggttcactcagatgacaaccatacatctttagtaatagttcagaataaactggatgataatgtgcttatagaatt

SEQ ID NO: 325840 - DNA, 75 bp, Artificial Sequence
  Synthetic
ttctattaagctatttgagaaagtatgcctaacatttggaaaccaagcaaatatgaagaaaacatacttaacaaa

SEQ ID NO: 325841 - DNA, 75 bp, Artificial Sequence
  Synthetic
ttttataaaagaatttgtttctctattcaatatatatggtgaacctttctcagtttatgggcgtttcctattgac

SEQ ID NO: 325842 - DNA, 75 bp, Artificial Sequence
  Synthetic
atcagtcggagattgtgcatatctagggccttatgaagattgtgcaagtagactatcagcaactcaaactgcaat

SEQ ID NO: 325843 - DNA, 75 bp, Artificial Sequence
  Synthetic
taaacatggttgcccaccatcacttgcatggatcagtatagcattaaatcagtggatcacgcataatacatacaa

SEQ ID NO: 325844 - DNA, 75 bp, Artificial Sequence
  Synthetic
tatgctacctgggcaaaataatgacccttgcagtattctgccaacttacaatcgatttgaaataccaattgagtt

SEQ ID NO: 325845 - DNA, 75 bp, Artificial Sequence
  Synthetic
gtgtggtctactaaacagttcattacctagtatagcaatagcaggcttagaagcagataatttagagtttttagt

SEQ ID NO: 325846 - DNA, 75 bp, Artificial Sequence
  Synthetic
taggacatcacgaaaactgtcaccggtgatccaccaaagagagccaatccaaactcagtatgagcatattgcaga

SEQ ID NO: 325847 - DNA, 75 bp, Artificial Sequence
  Synthetic
atgggatatatcacaattaacagaaatggaggtaattaggttcaagatgctaagatttatggcattagattcttc

SEQ ID NO: 325848 - DNA, 75 bp, Artificial Sequence
  Synthetic
aatgtcctcagatgatggcatgggagaaacaagtgacatgagatcccgatctttactcacacctaggaaatttac

SEQ ID NO: 325849 - DNA, 75 bp, Artificial Sequence
  Synthetic
tacgcaagcttctttgaatagacttgtttcttataatgattatcagcagataatccaagaccaggcaagcataga

SEQ ID NO: 325850 - DNA, 75 bp, Artificial Sequence
  Synthetic
tgaattattgggttattttatacagtatccacagttattagtgactaaaggggaaaatgttgaggagttttgtca

SEQ ID NO: 325851 - DNA, 75 bp, Artificial Sequence
  Synthetic
atcaataagatttcggtacacaagtaggaaatttaaagaatctctttcaatacagaatccagcacaactgtttat

SEQ ID NO: 325852 - DNA, 75 bp, Artificial Sequence
  Synthetic
agaacaaatcctctttgcaaataaaccaatgatagattacacaagtatccatgacaaattgttcggtatccaaga

SEQ ID NO: 325853 - DNA, 75 bp, Artificial Sequence
  Synthetic
tgatcctaatataaatgatgctacatgcatcataggaaagaagactttccctgaaacctacaatcaaataaaatc

SEQ ID NO: 325854 - DNA, 75 bp, Artificial Sequence
  Synthetic
tgatctagagaaattcccattgaataatgaagacattaagacggtgtatagcttttgtctcatgaatgatcctat

SEQ ID NO: 325855 - DNA, 75 bp, Artificial Sequence
  Synthetic
attaatagcatgtgcaaacaatataatactatctatgaaagggatgaccattgataggtcagctatgacatgtgc

SEQ ID NO: 325856 - DNA, 75 bp, Artificial Sequence
  Synthetic
acagatgccagaaattaaaagcctaaaggtaatatatcatagtccagctttagtattaagggcatatgttaccgg

SEQ ID NO: 325857 - DNA, 75 bp, Artificial Sequence
  Synthetic
tgatatgtctattagaggagcagagcctgatgaaatgagaagagatatatatcacctcgaagaatttattgaaaa

SEQ ID NO: 325858 - DNA, 75 bp, Artificial Sequence
  Synthetic
aactggtttaaaagcaaaaatgagagacagaataaataaaaatgaggtaaggacaaatggaagagatattaaatt

SEQ ID NO: 325859 - DNA, 75 bp, Artificial Sequence
  Synthetic
tgagataaaagaattgactaaatactatcaaatatgttatgactatataaaatcaacagagcataaaattaaaat

SEQ ID NO: 325860 - DNA, 75 bp, Artificial Sequence
  Synthetic
atttatacttccaaaaaggcctgccacaccatcagatttctgctctatagtagctggtaatatgttactagatga

SEQ ID NO: 325861 - DNA, 75 bp, Artificial Sequence
  Synthetic
taaatgggtaacagtgcatcatttaaagcaaataacatcacaagcaaagaaagctcaaattgcaacttcaacaga

SEQ ID NO: 325862 - DNA, 75 bp, Artificial Sequence
  Synthetic
tctagaattgcaattatcatatgaatgtatacgtttaattgcccattttgcagattcatttttagctgaatcttc

SEQ ID NO: 325863 - DNA, 75 bp, Artificial Sequence
  Synthetic
tagaaagcaatttttaaaaagggttataggagaatttgcatataaaggagtccctatacgggagctatatgacaa

SEQ ID NO: 325864 - DNA, 75 bp, Artificial Sequence
  Synthetic
gatcaagcattctagattgaggtccaaaattgtgcccattttataccatatgggtgacttggatcaactagatct

SEQ ID NO: 325865 - DNA, 75 bp, Artificial Sequence
  Synthetic
agatagatacgatgcagaaaaagcagaagaacaaataacatggaacaattggcaaacatcacgagaatttcagac

SEQ ID NO: 325866 - DNA, 75 bp, Artificial Sequence
  Synthetic
cggaccaatagatctatcaattaaaggctatggaagaaatataagagttattggtaataattcaaaactcactgc

SEQ ID NO: 325867 - DNA, 75 bp, Artificial Sequence
  Synthetic
agctgaattgcaaattagtagaatacgagatgatatcatatcacgacacagccaagcattattgaacaaaaatca

SEQ ID NO: 325868 - DNA, 75 bp, Artificial Sequence
  Synthetic
tggtctaaagtttgaattgatggaagagtacaaagatctagacccaagattgttctatatatgttaccaattaag

SEQ ID NO: 325869 - DNA, 75 bp, Artificial Sequence
  Synthetic
agcaaaaaagaggtatcattataatatactatcagttagcaatatattagagcataataagagaatacaggaatc

SEQ ID NO: 325870 - DNA, 75 bp, Artificial Sequence
  Synthetic
aaggatccgctccacaaatttttgggtaccagtatgtcctgtggttatatcaaaattaagttacacagataaacc

SEQ ID NO: 325871 - DNA, 75 bp, Artificial Sequence
  Synthetic
gcagctagcaatgataaaaaaactaaatatggacaatgttagactgacatcaatacaggtagctattgaagatta

SEQ ID NO: 325872 - DNA, 75 bp, Artificial Sequence
  Synthetic
tgctatgattagaaaatgcaatcttgcaaaaatgcagttttttgatggccctgagttgccatgtggcgggataga

SEQ ID NO: 325873 - DNA, 75 bp, Artificial Sequence
  Synthetic
tatttccaaaatgatgaaatcgcagaatatattaaatcttcaagttgatacattagtaagtatttctcttataga

SEQ ID NO: 325874 - DNA, 75 bp, Artificial Sequence
  Synthetic
attatgtcgaatctttaactgcaagggtaatattgaggacaacaatgcatttgaattcctctctgatgaaatttt

SEQ ID NO: 325875 - DNA, 75 bp, Artificial Sequence
  Synthetic
agatgaagaaatagacgaagaattagattcttcaccagcacttagaataacatatacaaagaaatcaattaggaa

SEQ ID NO: 325876 - DNA, 75 bp, Artificial Sequence
  Synthetic
taatacttacaaaaatactatagtaaaagcattaatacgtgaatgtgataaatttgaagagtgctttgacataac

SEQ ID NO: 325877 - DNA, 75 bp, Artificial Sequence
  Synthetic
agatgaaggttttacatcagatagcaatttggaaattttagaatcactggtctggatcttgaaagaactgcatac

SEQ ID NO: 325878 - DNA, 75 bp, Artificial Sequence
  Synthetic
gaatcagtggtcaactgaattaatgcaatgcattcacatgtcactatatcgcaatgatatggaccatttatatca

SEQ ID NO: 325879 - DNA, 75 bp, Artificial Sequence
  Synthetic
ccgattttctataccagagcaatttgtagacaatccaatagaattaaattaccgatggtctagcgttatagaatt

SEQ ID NO: 325880 - DNA, 75 bp, Artificial Sequence
  Synthetic
cctaataacattaaaacaaataaattataagcaagaaccatggatatctataatgtcacactcattagataaagc

SEQ ID NO: 325881 - DNA, 75 bp, Artificial Sequence
  Synthetic
aatagaatatgcaacagaaaggaaaattcatgaatcatcaaaagaaaataaactgcttaaatttatcaaaggcaa

SEQ ID NO: 325882 - DNA, 75 bp, Artificial Sequence
  Synthetic
gaagatgggcggacgatctaagtttgacttctaatctatacagaaatatttaatcatctcttcataaattgtgtc

SEQ ID NO: 325883 - DNA, 75 bp, Artificial Sequence
  Synthetic
gatgggcggacgatctaagtttgacttctaatctatacagaaatatttaatcatctcttcataaattgtgtctct

SEQ ID NO: 325884 - DNA, 75 bp, Artificial Sequence
  Synthetic
gccacatataacatttttaacaatgaacttcttctttttattttttatcttgcctcttgcactgtcagtcccacc

SEQ ID NO: 325885 - DNA, 75 bp, Artificial Sequence
  Synthetic
taaaaatacaaaaggtgggaagtgcttttatggaggtgagaagtttaaagaagtcaatgcgtcaatgaacatggc

SEQ ID NO: 325886 - DNA, 75 bp, Artificial Sequence
  Synthetic
cgaggtttgtttgcgagatgatatatcattgattaaatccattagccatcataccctttccagtgatcgttccaa

SEQ ID NO: 325887 - DNA, 75 bp, Artificial Sequence
  Synthetic
aattgagtcaagcgtgtcatactataggttattctttgttaaagagtggtttaactgcaatcccattgaagatgt

SEQ ID NO: 325888 - DNA, 75 bp, Artificial Sequence
  Synthetic
agcaggcacctttttagtactagatgttgatcatgtaggtagtatagttgctaaagtctatgcatgcagggcagt

SEQ ID NO: 325889 - DNA, 75 bp, Artificial Sequence
  Synthetic
gtgtgaaatcacaactgagcaggatacagggaatatactgattaaatctgaagacttaaatcattatagtataca

SEQ ID NO: 325890 - DNA, 75 bp, Artificial Sequence
  Synthetic
aggaactacaataaaaaatggctggttcaaagggacaattgaaataagcttagaagccacatgtgagcatattca

SEQ ID NO: 325891 - DNA, 75 bp, Artificial Sequence
  Synthetic
catcacatgcggccataaaactatagaattcaatgcatgcttccgaacccataaaaaatgcattaggtacttcaa

SEQ ID NO: 325892 - DNA, 75 bp, Artificial Sequence
  Synthetic
aaagtctatattacctgaactaataatagaatcattttgcaccaatatggaactaattatcttactaatgtttgg

SEQ ID NO: 325893 - DNA, 75 bp, Artificial Sequence
  Synthetic
gatcattagtgttgtaatgtcaatcatattgactaaaacatatctggtttaccttttaataccaatattttatcc

SEQ ID NO: 325894 - DNA, 75 bp, Artificial Sequence
  Synthetic
atttgttaaggcttatggcattttttatgaaaaatgtatgaggaaatgcaaaaattgtgggcttgcaatacaccc

SEQ ID NO: 325895 - DNA, 75 bp, Artificial Sequence
  Synthetic
attttccaaatgtcctgtatcttgtatttgtggaatgcaatacaactccactgaagcacttaaagtccatagaca

SEQ ID NO: 325896 - DNA, 75 bp, Artificial Sequence
  Synthetic
atgcaagaattgcactggctttaaatcactaactcatacaagatcactatgcaaaaaaaagctcccaaatgcaac

SEQ ID NO: 325897 - DNA, 75 bp, Artificial Sequence
  Synthetic
acttgcaataatggtgacagtcctgtttttttcttttattactccaattagtgctaaatgttatgaggaagaaca

SEQ ID NO: 325898 - DNA, 75 bp, Artificial Sequence
  Synthetic
actcgtcgatgaattccgatcagctttaaacaatttgcaacaaattacaatcagaaataacatatatatctgtgt

SEQ ID NO: 325899 - DNA, 75 bp, Artificial Sequence
  Synthetic
attagcaggcataataacgttaatatgtatgcggttgataattatgagatattacgttaagatccgttatgtact

SEQ ID NO: 325900 - DNA, 75 bp, Artificial Sequence
  Synthetic
atgcaattactgtggattgattcatttaaaacaaggtttgatcttagagcaagggtttacaaatcgatgtttaac

SEQ ID NO: 325901 - DNA, 75 bp, Artificial Sequence
  Synthetic
atgcatatgttcgaacaagaatgtgcataaagctacgcaagactgcttatcgcacagccatatgaaatcatatag

SEQ ID NO: 325902 - DNA, 75 bp, Artificial Sequence
  Synthetic
gtactcacacatcttgattctaactttagtagcaatgtctttattatctccagtttatagttcaccatgtttgca

SEQ ID NO: 325903 - DNA, 75 bp, Artificial Sequence
  Synthetic
accagaagagctaaacagtctagaagagatgtcactttgtttagccttatatcaaaatcagactcaaaatgtaga

SEQ ID NO: 325904 - DNA, 75 bp, Artificial Sequence
  Synthetic
atatagccagttaatgagtcagcttaaaacacatattcacgaagatgaattgaatgtactattacctaaaactaa

SEQ ID NO: 325905 - DNA, 75 bp, Artificial Sequence
  Synthetic
gcctactttcaaagaaatgattaaaaaaatagaaactgcaaatgactaccacatatctactatatatgaatatat

SEQ ID NO: 325906 - DNA, 75 bp, Artificial Sequence
  Synthetic
aaatggatttatgtaccctgaaacattgagagcattacttaaacctgcaggtgagacaactattgaatggagaac

SEQ ID NO: 325907 - DNA, 75 bp, Artificial Sequence
  Synthetic
gtactttaaaaacactggccttcatgcatgtgataaaaatatagagaaaatgatatgcagatgcatattagaaca

SEQ ID NO: 325908 - DNA, 75 bp, Artificial Sequence
  Synthetic
gaaagagtgcgataatacgaaagtagatgcagcaaaaactctagagaactattatacttcaagacctgaggaatt

SEQ ID NO: 325909 - DNA, 75 bp, Artificial Sequence
  Synthetic
gaaagaagacatggcaatcctcacaaaaaggctgagcaaggcatttccagggttgacagcaattttactaaatca

SEQ ID NO: 325910 - DNA, 75 bp, Artificial Sequence
  Synthetic
gattgtaagctcagaaaaatacgagctattcccgcatattacatttaaaatgaaattagcatctgcagataatag

SEQ ID NO: 325911 - DNA, 75 bp, Artificial Sequence
  Synthetic
gcaattaactggaatcttaaatttctttgagtttgttgccgacaggaatatgacaaaaaaggaaaaacaattgag

SEQ ID NO: 325912 - DNA, 75 bp, Artificial Sequence
  Synthetic
atcgttgccttctatacgccatctaggtgataagtttacccataaaagtgctggagaaaagaatattaagaagtg

SEQ ID NO: 325913 - DNA, 75 bp, Artificial Sequence
  Synthetic
tgcggagccaaaaacagtgaggtgtacagggaaaagattgcgaagtttgataatagaatttcaagcatgcaatag

SEQ ID NO: 325914 - DNA, 75 bp, Artificial Sequence
  Synthetic
caatggtataagattgtataaacagccaaagtacccaagaataatgactggaccagtactctgtctcgcagatag

SEQ ID NO: 325915 - DNA, 75 bp, Artificial Sequence
  Synthetic
acattgcttgcaagacttcgtacctatatctgttgacgacaatgtagaaaagctccaatgttatgcttcacagtc

SEQ ID NO: 325916 - DNA, 75 bp, Artificial Sequence
  Synthetic
atcagatgagtcaaatggtatgttagttgccaagaacgacattaggctaaaaaagattggtcaatgttctataaa

SEQ ID NO: 325917 - DNA, 75 bp, Artificial Sequence
  Synthetic
ctctgaaaagaaatcgattgtagaatctaaagatgggaaattttatgaatatagagtattgcagcacaagaagac

SEQ ID NO: 325918 - DNA, 75 bp, Artificial Sequence
  Synthetic
agctctagttgatgaatattgcttatcatctgaatgtgacgaacagttttatccttaccatcctgacaacttaaa

SEQ ID NO: 325919 - DNA, 75 bp, Artificial Sequence
  Synthetic
atcctgcacttggcatgagtcgacacatggcacaactagccaaactaaggttgtccacaatgatattgaatcatt

SEQ ID NO: 325920 - DNA, 75 bp, Artificial Sequence
  Synthetic
tgcatcagcaattaagctatctctgcacaatgacttgactacccatcatttcaagcctacagacagcctgccaca

SEQ ID NO: 325921 - DNA, 75 bp, Artificial Sequence
  Synthetic
tgtagtgccgaactatagaggaatatcaataagaggaacggaaaatgaaaacggaattcaaaatgcttttgtttt

SEQ ID NO: 325922 - DNA, 75 bp, Artificial Sequence
  Synthetic
attcaatataccacttcaaagtgggcattcacagggttatacactgtctgacactaatggggcaaaaatatttga

SEQ ID NO: 325923 - DNA, 75 bp, Artificial Sequence
  Synthetic
cattgtcgtatatgtaaaacaagctaaagttaaagcacagtatgtatatcaatactctacaggaccaacaatagg

SEQ ID NO: 325924 - DNA, 75 bp, Artificial Sequence
  Synthetic
aataaatgtaaagcatgaagagctatgtactggctcatgccctcatgacatacccaaggatcaaaattggctaac

SEQ ID NO: 325925 - DNA, 75 bp, Artificial Sequence
  Synthetic
attctctagagagcatactagtgcatggggttgcgaatcatggggctgcctagctattggaacggggtgtgttta

SEQ ID NO: 325926 - DNA, 75 bp, Artificial Sequence
  Synthetic
tggatcttgccaggacatcattaaagaagaaggtcatgtttataaaaaattgggatcggaagaaatagagacaga

SEQ ID NO: 325927 - DNA, 75 bp, Artificial Sequence
  Synthetic
aatatgcatcagtgatccatatgaaacattgtgtaataaaattgacgtactagagccagttttaacagacaccat

SEQ ID NO: 325928 - DNA, 75 bp, Artificial Sequence
  Synthetic
gcaagtagaaattacagcccaacagacaaaccttttaaaagaagtattgtttgtgaaggacaaaaacatttattc

SEQ ID NO: 325929 - DNA, 75 bp, Artificial Sequence
  Synthetic
aggtgacattaatccaagaggaacatatgcaaagaaatgtggttcagttcagaaggttgatggccttatttcagg

SEQ ID NO: 325930 - DNA, 75 bp, Artificial Sequence
  Synthetic
tataggcaatccaaaatttgattaccattgtcacgctatgtccagaaaagatataattcttagaagatgttatga

SEQ ID NO: 325931 - DNA, 75 bp, Artificial Sequence
  Synthetic
taatgagtatgtttcttgttcggctctacaattagaaccagatttaaaaattacaaaagataatggtaagatact

SEQ ID NO: 325932 - DNA, 75 bp, Artificial Sequence
  Synthetic
tatattaaatgatggaaatctactagggggtgcagcaataagattgaatttaggagatattaaatataaaagtat

SEQ ID NO: 325933 - DNA, 75 bp, Artificial Sequence
  Synthetic
ctcagctgctgaaattcaaatatcgggtatcggcacttgtggtggatgtgttcaatgctttacagatatagcatg

SEQ ID NO: 325934 - DNA, 75 bp, Artificial Sequence
  Synthetic
caaattagaaataacatcaacagggataaaacagtgtgaagtcactagcaattgttatgtatacactagtaatat

SEQ ID NO: 325935 - DNA, 75 bp, Artificial Sequence
  Synthetic
tttagttcaagagggattgaacacactaaatgtcaaattaaagtgcttgtctaaagaagttaaaatctcaatatg

SEQ ID NO: 325936 - DNA, 75 bp, Artificial Sequence
  Synthetic
caagacaaacatagatttaaaatcatcggttgtagaagatcatagtgtgctggacttgacatcatcagaccagac

SEQ ID NO: 325937 - DNA, 75 bp, Artificial Sequence
  Synthetic
ttcatatataaaagaatacgacaaaaaatgttctacatggctgtgtagagtgtatgatgagggtttaggttttat

SEQ ID NO: 325938 - DNA, 75 bp, Artificial Sequence
  Synthetic
atttaagcctttctggtctgagatcaacttatgggggaaatatatattaatcattgtaggattatgcttacttat

SEQ ID NO: 325939 - DNA, 75 bp, Artificial Sequence
  Synthetic
aattataatagctaaattaatagcaccacttataaaatatataatttcaacactaaaatacaatgattatgtcta

SEQ ID NO: 325940 - DNA, 75 bp, Artificial Sequence
  Synthetic
taaaatagagaataaaatgcattagattgtaaacaaactgggtgggtggggggtatgagcagctggatttatgtt

SEQ ID NO: 325941 - DNA, 75 bp, Artificial Sequence
  Synthetic
ggggtatgagcagctggatttatgttcattacctggagtatataaatgtttctatgtggtagcacactactggac

SEQ ID NO: 325942 - DNA, 75 bp, Artificial Sequence
  Synthetic
agtagtgtactccactatagaacaaagcttttaaatggcaaaccaattcattttccaagatgttcctcaacggaa

SEQ ID NO: 325943 - DNA, 75 bp, Artificial Sequence
  Synthetic
gggtatgtggcatttattgctaaatatggggcccagctcaatttcgataccgttagagtcttcttcctcaatcag

SEQ ID NO: 325944 - DNA, 75 bp, Artificial Sequence
  Synthetic
ttggttaataaccattttccccaatacacagcaaatcctgtgccagacactgccctcactctccaccgcctctcg

SEQ ID NO: 325945 - DNA, 75 bp, Artificial Sequence
  Synthetic
ggatatttagctaaatgggttgcagatcaatgcaaaacaaaccagataaaactggccgaggccatggaaaaaatt

SEQ ID NO: 325946 - DNA, 75 bp, Artificial Sequence
  Synthetic
gtcatgccacttgctgaagtaaaaggttgtacctggactgaggggctgactatgtatttaggctttgcaccaggc

SEQ ID NO: 325947 - DNA, 75 bp, Artificial Sequence
  Synthetic
gcagaaatgttccttgaaacatttgagttctaccctttagttatcgacatgcatagagtactaaaagatggaatg

SEQ ID NO: 325948 - DNA, 75 bp, Artificial Sequence
  Synthetic
gatgtcaactttatgagaaaggtactccgccaacgttatggtacattaactgcagagcaatggatgacccaaaag

SEQ ID NO: 325949 - DNA, 75 bp, Artificial Sequence
  Synthetic
atagatgcagttcgtgcagccttcaatgctgttggacaattgagctgggctaaatcaggattctcaccagcagct

SEQ ID NO: 325950 - DNA, 75 bp, Artificial Sequence
  Synthetic
agaaccttccttgcccaatttggtataaatatctaaacttctaaaaaaccccactccctccctagtatggtgttc

SEQ ID NO: 325951 - DNA, 75 bp, Artificial Sequence
  Synthetic
cacaacaccatacgccatttctgcagcattgttcatttatctttattgattgttctatgtggagcacactactag

SEQ ID NO: 325952 - DNA, 75 bp, Artificial Sequence
  Synthetic
acaacaccatacgccatttctgcagcattgttcatttatctttattgattgttctatgtggagcacactactagc

SEQ ID NO: 325953 - DNA, 75 bp, Artificial Sequence
  Synthetic
gtacccctagagaaaacaattcaacatggatccttatcgtattgacaccttccgtaacaggatcttgaattgcaa

SEQ ID NO: 325954 - DNA, 75 bp, Artificial Sequence
  Synthetic
tgatccagaagatgcaaaagatataatgtctgaccttttaatggaacgccacaactactttggcagagaagtatg

SEQ ID NO: 325955 - DNA, 75 bp, Artificial Sequence
  Synthetic
tcattttctagatatagaatttagaaatgacacacctgctcatgatatcctccatgattttcttccaccaggatc

SEQ ID NO: 325956 - DNA, 75 bp, Artificial Sequence
  Synthetic
tgtcttcaacatccgcaattgtagcccagacaattatactatcttaaatggcaaactttatataatagactataa

SEQ ID NO: 325957 - DNA, 75 bp, Artificial Sequence
  Synthetic
agtctctgtagatgctacatacgggcaggcaacaaagactaagtatgaggaaatatttggtgatgctcttgcacc

SEQ ID NO: 325958 - DNA, 75 bp, Artificial Sequence
  Synthetic
atttggtctagattttgaagtggttatcatacgagcagacccagtacgtgagatggtacatgttgacagcatgga

SEQ ID NO: 325959 - DNA, 75 bp, Artificial Sequence
  Synthetic
ttttataaatacatacggtaacatctatatcgatctagacttcacttggttttttaacctacgtgccttattata

SEQ ID NO: 325960 - DNA, 75 bp, Artificial Sequence
  Synthetic
tgataggttcaaggacaacgatagatttcttgagattgttaatcagggagaatttactatgacatccccatggat

SEQ ID NO: 325961 - DNA, 75 bp, Artificial Sequence
  Synthetic
tgaggaaaacacaccagaattgtacactcatccagtattcaaggaattttacaattcactaaatgatgaagagaa

SEQ ID NO: 325962 - DNA, 75 bp, Artificial Sequence
  Synthetic
aaatacatttaatacaagtttggagtttgatgccactaaatctgaaaaatggaaccaaaatttgattactatctt

SEQ ID NO: 325963 - DNA, 75 bp, Artificial Sequence
  Synthetic
gcaaaaatatgaacctttttataaaaaattctgcaatattgctgcatctagtgtattcaagtgtacaggcaacta

SEQ ID NO: 325964 - DNA, 75 bp, Artificial Sequence
  Synthetic
tccggcaccgagcagagatcaaatctcagaaggttggaatgatatgtatgaacgaattaaaacagaaagggagct

SEQ ID NO: 325965 - DNA, 75 bp, Artificial Sequence
  Synthetic
aactgaggatctatctaaacaaaaacctagtttccacttcatatggtctcccccagacattgatcggtctaatga

SEQ ID NO: 325966 - DNA, 75 bp, Artificial Sequence
  Synthetic
gaatatatcaaaaatcttaaccctagctaaagcattacagaaaattcaaggagattcaacatttgtcaatagttt

SEQ ID NO: 325967 - DNA, 75 bp, Artificial Sequence
  Synthetic
tagatcaatgggactgctgatggatttctcatctaatataggattatatgaatcccatgtaagcaaactaaaaaa

SEQ ID NO: 325968 - DNA, 75 bp, Artificial Sequence
  Synthetic
taccgcacggcaaacatcaaaaaaagttgaccaaaagttagaagaaatagagataggaacatcaactgtactatg

SEQ ID NO: 325969 - DNA, 75 bp, Artificial Sequence
  Synthetic
ggaacagcaattcaaatttaattcaaaagtaatgaatacgcaagacaaatcgcacttgttcaaagattttgttgg

SEQ ID NO: 325970 - DNA, 75 bp, Artificial Sequence
  Synthetic
cattggaggccacaagccatttaataaaaagctatctgatgacatagatatagaaaagcctaagatactagattt

SEQ ID NO: 325971 - DNA, 75 bp, Artificial Sequence
  Synthetic
caattcaaaaaatgtgctagatgcatgcaatagaatatatagacaagtaaagaatatattaggtatgcctaatac

SEQ ID NO: 325972 - DNA, 75 bp, Artificial Sequence
  Synthetic
gctgcagaagatgggttgctatttagaagaatatgggtttaatatatcgaatacatcccccgatatgtggcaaag

SEQ ID NO: 325973 - DNA, 75 bp, Artificial Sequence
  Synthetic
gatacaagaaatatgtgcaacaaactactgggctgcaatattagattattctactcttatgaaaaatatgcttgc

SEQ ID NO: 325974 - DNA, 75 bp, Artificial Sequence
  Synthetic
tgcatcacaatataataggcataacacctttagggttgtgacttgtgcgaacaataatttatacgggatagttat

SEQ ID NO: 325975 - DNA, 75 bp, Artificial Sequence
  Synthetic
gccatcatcagatattaagaccaaaaggtccacattgtgctactttataattgcattgcatgacgaaaaacaaaa

SEQ ID NO: 325976 - DNA, 75 bp, Artificial Sequence
  Synthetic
tgttgcacactccgggtcaatgcatgcaacattccagtcaggttctaagtacctatccatttcaaagggttttag

SEQ ID NO: 325977 - DNA, 75 bp, Artificial Sequence
  Synthetic
attagataaggaaaggtgccagaggatagtatcagctccagggctatttttaatgacatcatgcctattcctttc

SEQ ID NO: 325978 - DNA, 75 bp, Artificial Sequence
  Synthetic
tgataataaaaccttaaacattggtgatgtattaaactttagcttccatacttctgtctcaataacaaaagcaat

SEQ ID NO: 325979 - DNA, 75 bp, Artificial Sequence
  Synthetic
gctctctttgacagaaccatcaagatatatgattatgaattccctagcaatatctagtcatgttcgtgagtacat

SEQ ID NO: 325980 - DNA, 75 bp, Artificial Sequence
  Synthetic
ggctgaaaaatttagtccttatactaaaactgctttctctgtagtcatgacacagacgataaagcgtgcatgtta

SEQ ID NO: 325981 - DNA, 75 bp, Artificial Sequence
  Synthetic
cgaagcattcgaacagaaagagaaggtagagcttaagaatatacatttaacggactatgagataacccaaaaagg

SEQ ID NO: 325982 - DNA, 75 bp, Artificial Sequence
  Synthetic
agtcaaagctcagcgtgacctaaaatccatatggtttcctggacaggttaatttaaaagaatatataaatcaagt

SEQ ID NO: 325983 - DNA, 75 bp, Artificial Sequence
  Synthetic
ttatatgccattttactttaattcaaaaggtttacatgagaaacaccatgtgatgatagatttagcaaaaactat

SEQ ID NO: 325984 - DNA, 75 bp, Artificial Sequence
  Synthetic
attagacattgagagagaccaaaggctaaatatacctggaatatggtcagatataccaagaaaacaaacagttaa

SEQ ID NO: 325985 - DNA, 75 bp, Artificial Sequence
  Synthetic
tttgagagttttaatatattcacttgcgaaggcattaaatatggacacatcaagacataactatatacggtccag

SEQ ID NO: 325986 - DNA, 75 bp, Artificial Sequence
  Synthetic
aatagagaacagtaacaatttgaaaagatccatcactaccatatctacttttactagctcaaagtcatgcattaa

SEQ ID NO: 325987 - DNA, 75 bp, Artificial Sequence
  Synthetic
aattggtgattttagtgatctaaaagtgcgtaaagaaaagaaaactcttgaaagcttaaaaaaggaaatccggaa

SEQ ID NO: 325988 - DNA, 75 bp, Artificial Sequence
  Synthetic
atacactattgcaaacccagaatttgctgatgagatggatatagcttgtgcaatacaccatgcagactacaatga

SEQ ID NO: 325989 - DNA, 75 bp, Artificial Sequence
  Synthetic
tgttagaaaagctgtacccaattacgctgactgcatgtcaactaaagtgtttgatgctctctatgaaaagataaa

SEQ ID NO: 325990 - DNA, 75 bp, Artificial Sequence
  Synthetic
aaatcaagaaattgacgataaaccaactgtaacacatatacttgatacaatgaaaaacataagcagttttatttt

SEQ ID NO: 325991 - DNA, 75 bp, Artificial Sequence
  Synthetic
agtttttaataaaggacaaaaaacagcaaaagacagagaaatttttgtaggagagtttgaagcaaaaatgtgttt

SEQ ID NO: 325992 - DNA, 75 bp, Artificial Sequence
  Synthetic
atacttagttgagcgtatttcaaaggaaagatgtcgattaaatcctgaggagatgattagtgaaccaggggactc

SEQ ID NO: 325993 - DNA, 75 bp, Artificial Sequence
  Synthetic
taaattgaaaaagttagaagatctagctgaatctgaaattagatatacagcacaaactttaaaaaatcttaatag

SEQ ID NO: 325994 - DNA, 75 bp, Artificial Sequence
  Synthetic
gaagatccaaaatgatatgtttggttcagaggtagatatagacatgaaattacgtgctttgaaaatcgaaattaa

SEQ ID NO: 325995 - DNA, 75 bp, Artificial Sequence
  Synthetic
tgctgatatgtcaaaatggagtgcacaagatgttttatacaaatatttttggttatttgtattagatccaattct

SEQ ID NO: 325996 - DNA, 75 bp, Artificial Sequence
  Synthetic
gtataagcatgagaaagaaaggattctttacttcttatgcaattatatgcaaaagcgtcttattttgccggatga

SEQ ID NO: 325997 - DNA, 75 bp, Artificial Sequence
  Synthetic
cttaattgcaagcatcttagatcagagaatccagcgacaaaacgatattatatatgagatgacaaacggtttaac

SEQ ID NO: 325998 - DNA, 75 bp, Artificial Sequence
  Synthetic
tcaaaactgggtagagattaaaagaaactggctgcaaggcaatctaaattacactagcagttatttgcacacatg

SEQ ID NO: 325999 - DNA, 75 bp, Artificial Sequence
  Synthetic
ttctatgaatgtctataaagatattatgaaacgttccatcgatttattggaaggtgaagctctagtcaattcaat

SEQ ID NO: 326000 - DNA, 75 bp, Artificial Sequence
  Synthetic
ggtacattcagatgataatcatacatccttagtaatagtccagaataagctgaatgataaaatacttatagaatt

SEQ ID NO: 326001 - DNA, 75 bp, Artificial Sequence
  Synthetic
ctctattaagttatttgaaaaaatctgtttaacgtttggtaatcaagcaaatatgaaaaaaacgtacctgacgaa

SEQ ID NO: 326002 - DNA, 75 bp, Artificial Sequence
  Synthetic
ttttataaaggagtttgtatcacttttcaacatatatggagaaccattttcagtttatgggcgattcttattgac

SEQ ID NO: 326003 - DNA, 75 bp, Artificial Sequence
  Synthetic
atcagttggggattgtgcatatttagggccttatgaagattgtgcaagtagattatcagcaacccaaactgcaat

SEQ ID NO: 326004 - DNA, 75 bp, Artificial Sequence
  Synthetic
taaacacggttgtccaccatccctcgcatgggttagtatagcattaaatcaatggattacccataatacatataa

SEQ ID NO: 326005 - DNA, 75 bp, Artificial Sequence
  Synthetic
catgcttcctggtcaaaataatgatccttgtagtattcttcctacatataatcgatttgaaatacctattgaatt

SEQ ID NO: 326006 - DNA, 75 bp, Artificial Sequence
  Synthetic
atgcggtcttcttaactgctcattgcctagtatagcaatagcaggtctagaggcagataatttagagtttttggt

SEQ ID NO: 326007 - DNA, 75 bp, Artificial Sequence
  Synthetic
cagaacatcaagaaaattatcaccagtaatttatcaaagggagccaattcaaaaccagtatgaacatattgcaga

SEQ ID NO: 326008 - DNA, 75 bp, Artificial Sequence
  Synthetic
atgggacataacaaaactgacagaaatggaaataattaggtttaagatgctacgattcatggcattagactcttc

SEQ ID NO: 326009 - DNA, 75 bp, Artificial Sequence
  Synthetic
aatgtcatctgatgacggcatgggagaaacaagtgacatgagatccagatcacttcttacacctaggaagtttac

SEQ ID NO: 326010 - DNA, 75 bp, Artificial Sequence
  Synthetic
cacacaggcttcattaaatagacttgtctcctataacgattaccagcaaataattcaagatcaagctagtataga

SEQ ID NO: 326011 - DNA, 75 bp, Artificial Sequence
  Synthetic
tgaattattaggttattttatacaatacccacagctattagttaccaaaggggagaatgttgaagagttttgcca

SEQ ID NO: 326012 - DNA, 75 bp, Artificial Sequence
  Synthetic
atcaataaggtatcgttacacaagtaggaaatttaaagaatctctctcaatacagaatccagcacaattatttat

SEQ ID NO: 326013 - DNA, 75 bp, Artificial Sequence
  Synthetic
agagcaaatcctctttgcaaataaaccaatgatagattatacaagcattcacgataaactgtttggtattcaaga

SEQ ID NO: 326014 - DNA, 75 bp, Artificial Sequence
  Synthetic
tgatccaaatataaatgatgccacatgcattatagggaaaaaaacattccctgaaacttataatcaaataaaatg

SEQ ID NO: 326015 - DNA, 75 bp, Artificial Sequence
  Synthetic
tgatttagaaaaatttacattaaccaacgatgatatcaaaacagtatatagtttctgtcttatgaatgaccctat

SEQ ID NO: 326016 - DNA, 75 bp, Artificial Sequence
  Synthetic
attaatagcttgtgcaaacaatattatattgtcgatgaaagggatgactatagatagatcagcaatgacatgtgc

SEQ ID NO: 326017 - DNA, 75 bp, Artificial Sequence
  Synthetic
tcaaatgcctgaaattaaaagtctaaaagtaatataccatagcccagctttagttttaagggcatatgtaactgg

SEQ ID NO: 326018 - DNA, 75 bp, Artificial Sequence
  Synthetic
tgacatgtcaatcagaggagcagaaccagacgagatgagacgagatatataccatcttgaagaatttatcgagaa

SEQ ID NO: 326019 - DNA, 75 bp, Artificial Sequence
  Synthetic
aactggcttgaaaatgaaaatgagagataggataaataaaaatgaaataagaacaaatgggagggatattaaatt

SEQ ID NO: 326020 - DNA, 75 bp, Artificial Sequence
  Synthetic
tgaaataaaagaattaactaagtattatcagatatgctatgactatataaaatcaacagaacataaaattaaaat

SEQ ID NO: 326021 - DNA, 75 bp, Artificial Sequence
  Synthetic
atttatattacctaaaaggccagccacaccatcagatttctgttctatagtagctggcaatatgttgctagatga

SEQ ID NO: 326022 - DNA, 75 bp, Artificial Sequence
  Synthetic
taaatgggttacaatccatcatctgaagcagataacatcgcaagcaaaaaaggctcaaattgcaatatcgacaga

SEQ ID NO: 326023 - DNA, 75 bp, Artificial Sequence
  Synthetic
cctagaattgcagatatcatatgagtgcatgcgcttaattgcacattttgcagattcatttttagctgaatcatc

SEQ ID NO: 326024 - DNA, 75 bp, Artificial Sequence
  Synthetic
taggaggcaatttctgaaacgagttatcggagagtttgcatataaaggagttcctataagggaattatatgaaaa

SEQ ID NO: 326025 - DNA, 75 bp, Artificial Sequence
  Synthetic
gatcaaacattctagattgagatctaaaattgtgcccattctataccacatgggtgatttggatcaattagattt

SEQ ID NO: 326026 - DNA, 75 bp, Artificial Sequence
  Synthetic
agataggtatgatgcagaaaaagcagaagagcaaataacatggaataactggcaaacatctcgagaatttcaaac

SEQ ID NO: 326027 - DNA, 75 bp, Artificial Sequence
  Synthetic
tgggccaatagatttgtcaataaagggttacggcaggagtattagaatcattggtagcaactcaaagctcactgc

SEQ ID NO: 326028 - DNA, 75 bp, Artificial Sequence
  Synthetic
agctgagttgcaaataactagattacgcgatgatattatatcacggcacggtcaagtattattgaataaaaatca

SEQ ID NO: 326029 - DNA, 75 bp, Artificial Sequence
  Synthetic
tggattgaaattcgagttgatggaagaatataaagatctagatccaaggttattttatttatgttatcaactaag

SEQ ID NO: 326030 - DNA, 75 bp, Artificial Sequence
  Synthetic
ggcaaaaaagagatatcactataatatattatcagttaacaatatagtagatcataacaaaagaatacaagaatc

SEQ ID NO: 326031 - DNA, 75 bp, Artificial Sequence
  Synthetic
aagaattagatctacaaacttttggataccagtgtgtcctgttgttgtgtcaaagataaattatacagataaacc

SEQ ID NO: 326032 - DNA, 75 bp, Artificial Sequence
  Synthetic
tcaattagcaatggtaaaaaaattaaacatggatagtattaagctgacatcagtgcaggttgctattgaagatta

SEQ ID NO: 326033 - DNA, 75 bp, Artificial Sequence
  Synthetic
tgctatggttagaaaatgcaatcttgcaaagatgcagttttttgatggcccagagttaccatgcggtggaataga

SEQ ID NO: 326034 - DNA, 75 bp, Artificial Sequence
  Synthetic
tatttctaaaatgatgaaatctcaaaatatactaaatcttcaggtcgatacattaataaatgtttctcttataga

SEQ ID NO: 326035 - DNA, 75 bp, Artificial Sequence
  Synthetic
tttatgtcgaatcttcaattgcaaaggaaatattgaagataacaatgcctttgagtttctttccgatgaaatctt

SEQ ID NO: 326036 - DNA, 75 bp, Artificial Sequence
  Synthetic
agacgaagagataaatgaggaattggattcttcaccagcactcaaaataacatacacaaaaaaatcaattaaaaa

SEQ ID NO: 326037 - DNA, 75 bp, Artificial Sequence
  Synthetic
taatacttacaaaaatacaattgtgaaagcattaatacgtgaatgcgatagatttgaagaatgttttgatataac

SEQ ID NO: 326038 - DNA, 75 bp, Artificial Sequence
  Synthetic
agatgagggatttacatcggatagcaacctggaaattatggaatcattagtctggatcttgaaagaacttcatac

SEQ ID NO: 326039 - DNA, 75 bp, Artificial Sequence
  Synthetic
aaatcagtggtcgactgaattaatgcaatgcattcacatgtcattataccgtaataacatggaccatttatacca

SEQ ID NO: 326040 - DNA, 75 bp, Artificial Sequence
  Synthetic
tagattctctataccagaacagtttgtagataatccaatagaactgaattacaaatggtccaatgttatagagtt

SEQ ID NO: 326041 - DNA, 75 bp, Artificial Sequence
  Synthetic
tttaatgacattaaaacagataaactataagcaggaaccgtggctatctataatgtcacattcattagacaaggc

SEQ ID NO: 326042 - DNA, 75 bp, Artificial Sequence
  Synthetic
aatagagtatgcaactgagcggaaaatacaagaatcatcaaaagaaaataaactgctcagatttattaaaggcaa

SEQ ID NO: 326043 - DNA, 75 bp, Artificial Sequence
  Synthetic
gaaaatgggcgggaaatctaaatttgacttctaatccatatagaaatatataatcacctctttataaattgtgtc

SEQ ID NO: 326044 - DNA, 75 bp, Artificial Sequence
  Synthetic
atgggcgggaaatctaaatttgacttctaatccatatagaaatatataatcacctctttataaattgtgtctcta

SEQ ID NO: 326045 - DNA, 75 bp, Artificial Sequence
  Synthetic
aaaatgaaaacaatccttcgtatcgcctcaattttagcacaatgtgctatcatgatatgcttaccattgaagaac

SEQ ID NO: 326046 - DNA, 75 bp, Artificial Sequence
  Synthetic
catgatatgcttaccattgaagaactccataggtgggaggtgcttcacaggtggtgagccatttaaaaccattaa

SEQ ID NO: 326047 - DNA, 75 bp, Artificial Sequence
  Synthetic
tgcaacatcagcaccgagtgaggtctgcctcagagatgatatatcgatggttaaatctatcggaatacactcacg

SEQ ID NO: 326048 - DNA, 75 bp, Artificial Sequence
  Synthetic
tggggatgactcagatatgatcacatctagcgtcacgttctatagactgtattatgttaaagattggcacgattg

SEQ ID NO: 326049 - DNA, 75 bp, Artificial Sequence
  Synthetic
caacccaatctcagaccacatgggtactttccttgttctaaatattgaggatagtggttctattaaagcagaaaa

SEQ ID NO: 326050 - DNA, 75 bp, Artificial Sequence
  Synthetic
ctatgcatgccgaacaagatgtgacatttctttaaacagggaccgtggaactatagaattaacctctactaatct

SEQ ID NO: 326051 - DNA, 75 bp, Artificial Sequence
  Synthetic
caaccattattctattactgggacaactattgcatctgggtggttcaaactgaaattagaggtgcaattgctttc

SEQ ID NO: 326052 - DNA, 75 bp, Artificial Sequence
  Synthetic
gacatgtgaaagcatcagtgtaacctgcggtcaaaaaacattggaattcaaggcatgtttcagacaacatcgtaa

SEQ ID NO: 326053 - DNA, 75 bp, Artificial Sequence
  Synthetic
gtgtatcaattatttccatggctctatactacccgagataatgattgaaggaatatgtgcaaacctggaagtgat

SEQ ID NO: 326054 - DNA, 75 bp, Artificial Sequence
  Synthetic
aatattggtcttctttatatgcttaaatacaatactagctataataattaccaatacatatgtgatatatgcttt

SEQ ID NO: 326055 - DNA, 75 bp, Artificial Sequence
  Synthetic
aatcccactaatatacccattttataaattatatggaataatatacaataagtgcttgaaaaagtgcaaaaattg

SEQ ID NO: 326056 - DNA, 75 bp, Artificial Sequence
  Synthetic
taagcttgctatacacccttttactatttgccctacaaaatgtatttgcggtatggtttataatagtacagaagc

SEQ ID NO: 326057 - DNA, 75 bp, Artificial Sequence
  Synthetic
tctgtatctacatagacaatgcaataattgtacagggtataaagcactaacccatgcacgtattgcatgcaaaaa

SEQ ID NO: 326058 - DNA, 75 bp, Artificial Sequence
  Synthetic
aaagattcccaatgcaatcatggcaatatttactaccattttaatatttagctttttaacacctgtttctgctga

SEQ ID NO: 326059 - DNA, 75 bp, Artificial Sequence
  Synthetic
atgttacaatctcagcgagttaccacaggattatatcaatatggtcaattacatcggaatgcgatcgttgcttgg

SEQ ID NO: 326060 - DNA, 75 bp, Artificial Sequence
  Synthetic
atatgtcgtagcatctctcgctctgctaatagcgatagtggtgttgcttcaaaacaaattagctgagcaagcttt

SEQ ID NO: 326061 - DNA, 75 bp, Artificial Sequence
  Synthetic
gaagctgtattatgtcaactgtgcattctgtgggatgatccatcataaaagaaatctcatactagaacaaggctt

SEQ ID NO: 326062 - DNA, 75 bp, Artificial Sequence
  Synthetic
tacaaatcaatgtctaacatgtatttgccacgacaaaaacatacataaagccacaaaaaagtgtactattagata

SEQ ID NO: 326063 - DNA, 75 bp, Artificial Sequence
  Synthetic
caaatggcacatcacaaacaatattagatggcttgtttttgtttccatactcataataatgccagcaagcattta

SEQ ID NO: 326064 - DNA, 75 bp, Artificial Sequence
  Synthetic
ctcaatgcaatgcttaagatctgaagaaataacaaatctagaagaggcttcagcttgcatatctgtttatcaaaa

SEQ ID NO: 326065 - DNA, 75 bp, Artificial Sequence
  Synthetic
tgtaacacaaaaaaagcaatatcacgagttgattaagtctatgagtgaacaactaagctcagatgaagtctctat

SEQ ID NO: 326066 - DNA, 75 bp, Artificial Sequence
  Synthetic
attgctgccacaggttgtcccatcttatattaacttaatacacgagatagaaaatgaaaatgatctacatacagc

SEQ ID NO: 326067 - DNA, 75 bp, Artificial Sequence
  Synthetic
tatagtaaaagagataatcttagcaaatttatacccagaaatagtaaaaaaatactatagtgcagcaagacctga

SEQ ID NO: 326068 - DNA, 75 bp, Artificial Sequence
  Synthetic
cactgttaaatggcgtacaatacttcttaatgctggactccacatctgttcagaacatgttgttaaaatgatatg

SEQ ID NO: 326069 - DNA, 75 bp, Artificial Sequence
  Synthetic
tagatgtgctttattacaacaggaatgtcaatcagtcacaagcgatgatggaaatcaaattgagacttactataa

SEQ ID NO: 326070 - DNA, 75 bp, Artificial Sequence
  Synthetic
atcacataaagaagaattttatgaagatatggcttcaattttcaaagttatatacactgcatttcctggtctcac

SEQ ID NO: 326071 - DNA, 75 bp, Artificial Sequence
  Synthetic
taaattcttacttgtcagatcaatgtctagtaaagcattgcaagatgcagtcccagtacttgggaaattgaaata

SEQ ID NO: 326072 - DNA, 75 bp, Artificial Sequence
  Synthetic
ttacacgaggaacaacaatcgtctaaacggtataattacattcgcagaacatataatatcgaagaatgtgacaag

SEQ ID NO: 326073 - DNA, 75 bp, Artificial Sequence
  Synthetic
cgaaagtaggaccattaactttgaggtacgtaagttgactggtcagcaattcactgataaaaatgtcggctccag

SEQ ID NO: 326074 - DNA, 75 bp, Artificial Sequence
  Synthetic
tggtatcacgacatgtcaaacacccaagttagttacatgcacagggaaaagattgagatcattgcaaaaggaata

SEQ ID NO: 326075 - DNA, 75 bp, Artificial Sequence
  Synthetic
catagcatgttcaaacaatggggttaaaatgtatctaaaggaagacaaaatctattgcagagtaggagcagacct

SEQ ID NO: 326076 - DNA, 75 bp, Artificial Sequence
  Synthetic
aggaaaatgtagataaattaatatgttatgcaacagaatttcgggaccagtcaaatggtatgctaaaaagttcac

SEQ ID NO: 326077 - DNA, 75 bp, Artificial Sequence
  Synthetic
aatcaattagagtaaaaaaactaggcagctgtgcacttaaaggccaattagtcaacatagcgatgtcatcagaga

SEQ ID NO: 326078 - DNA, 75 bp, Artificial Sequence
  Synthetic
atttactgtataagtatgatacaatctatcataaaaaaacaccacttgtggacgagtactgcttatcagagaagt

SEQ ID NO: 326079 - DNA, 75 bp, Artificial Sequence
  Synthetic
gtactagtgatcattatccttatagtagtgaaaaccttaaaaattgtgtgtggactataacgaaccacaaatttc

SEQ ID NO: 326080 - DNA, 75 bp, Artificial Sequence
  Synthetic
agagtcaattgcatatagaccatcaagatatagaatctttcatatcaggtatcaaactatcattacataatgact

SEQ ID NO: 326081 - DNA, 75 bp, Artificial Sequence
  Synthetic
taattactcacaactacaaaccaacacaaaatatgccacacataattcctaattataagtctatatccatagctg

SEQ ID NO: 326082 - DNA, 75 bp, Artificial Sequence
  Synthetic
gaagcgataatggaaatacaataacagatgcttatgtccttttcactataccgctcaccactggcctctctcaag

SEQ ID NO: 326083 - DNA, 75 bp, Artificial Sequence
  Synthetic
gttttagtgtaaatacaaaaacaaataaaggcttatttgatttagtagtctatataaagagagccactataaaag

SEQ ID NO: 326084 - DNA, 75 bp, Artificial Sequence
  Synthetic
ctgaatatacttttgagtatgaaaccgggccgactatcggcataaatgctgtccattctgaaaaatgcacaggat

SEQ ID NO: 326085 - DNA, 75 bp, Artificial Sequence
  Synthetic
tttgcccaagagagataccgcatgctacaaactggttaacatttacaaaagaacatactagttcatggggctgcg

SEQ ID NO: 326086 - DNA, 75 bp, Artificial Sequence
  Synthetic
aagaatgggggtgccttgctataaatactggctgcgtatatggatcatgtcaagatataataaaaccagaaggca

SEQ ID NO: 326087 - DNA, 75 bp, Artificial Sequence
  Synthetic
aagtatataagaaaataggctctgaagcaattgatgcagaaatatgtataactgacagtagtgaaacattttgta

SEQ ID NO: 326088 - DNA, 75 bp, Artificial Sequence
  Synthetic
cagagataacctcttataacccaatattaggtgaaaaagtacaaattgaaataatgtctcaagattcaagcctat

SEQ ID NO: 326089 - DNA, 75 bp, Artificial Sequence
  Synthetic
tgccatctaatatatttcaaaaaaacaataatatttacaaaggagatataaaccctaaaggcacttttgcaaaaa

SEQ ID NO: 326090 - DNA, 75 bp, Artificial Sequence
  Synthetic
aatgcggatctgtgcagaaagtgcaagatcagatatatggttctggggagccacgatttgattatatatgtcatg

SEQ ID NO: 326091 - DNA, 75 bp, Artificial Sequence
  Synthetic
ctgctagtagaaaggatgtagtagtgcgcaagtgttacgataatgcatatatctcttgtagcacattggaatcga

SEQ ID NO: 326092 - DNA, 75 bp, Artificial Sequence
  Synthetic
tccaaaatatggatctaatcaaagatgaatctaagtggtatttaagacaagatactggtttatatggttcagtta

SEQ ID NO: 326093 - DNA, 75 bp, Artificial Sequence
  Synthetic
aagtaaagttactgctgggggatctaaattataagcaagatgatacaactaccacaaggataacagcgaaggctg

SEQ ID NO: 326094 - DNA, 75 bp, Artificial Sequence
  Synthetic
tatgtggcggttgcacagactgctttgatgatgtatcatgccgagttgatgtcacgtctaataacattgcctcat

SEQ ID NO: 326095 - DNA, 75 bp, Artificial Sequence
  Synthetic
gctcagtagagagtacatgctcgccatatataaataggttgtcattggtagaaggctcccagcaacttcatttaa

SEQ ID NO: 326096 - DNA, 75 bp, Artificial Sequence
  Synthetic
agttcaaatgcaaaatggaagctatagcattttctatatgcggcattaaagcagagattagatcagagatagtga

SEQ ID NO: 326097 - DNA, 75 bp, Artificial Sequence
  Synthetic
aaagccataagatactggacttggcatcactgagccagacatcgtacattagagaatatgataaaaaatgcggaa

SEQ ID NO: 326098 - DNA, 75 bp, Artificial Sequence
  Synthetic
catggctatgtcgtgtttacaacgagggtattgagggaatcatagggccaatatggaaagaatttaatatatggc

SEQ ID NO: 326099 - DNA, 75 bp, Artificial Sequence
  Synthetic
tcaagtatggtactgtagttgttgtattaatattctctgttattttaatagtgaaagtgataaatccgttaatca

SEQ ID NO: 326100 - DNA, 75 bp, Artificial Sequence
  Synthetic
aactaataattaacaccttaaagcacaatgaacaaatgtacttacttgagtctaagcaaaaataaactcatttaa

SEQ ID NO: 326101 - DNA, 75 bp, Artificial Sequence
  Synthetic
tctaagcaaaaataaactcatttaactttatattttcattaggggttgggtggtgggttatatgcagcttgaagg

SEQ ID NO: 326102 - DNA, 75 bp, Artificial Sequence
  Synthetic
taaactcatttaactttatattttcattaggggttgggtggtgggttatatgcagcttgaaggatttttcatttt

SEQ ID NO: 326103 - DNA, 75 bp, Artificial Sequence
  Synthetic
agtagtgaactaccaaaatgaaaacaatccttcgtatcgcctcaattttagcacaatgtgctatcatgatatgct

SEQ ID NO: 326104 - DNA, 75 bp, Artificial Sequence
  Synthetic
gcacaatgtgctatcatgatatgcttaccattgaagaactccataggtgggaggtgcttcacaggtggtgagcca

SEQ ID NO: 326105 - DNA, 75 bp, Artificial Sequence
  Synthetic
aaaggaagacaaaatctattgcagagtaggagcagacctgtgtgtaggtgacaaatattgtcttataagttttac

SEQ ID NO: 326106 - DNA, 75 bp, Artificial Sequence
  Synthetic
accgattactgacaaggaaaatgtagataaattaatatgttatgcaacagaatttcgggaccagtcaaatggtat

SEQ ID NO: 326107 - DNA, 75 bp, Artificial Sequence
  Synthetic
ctttatattttcattaggggttgggtggtgggttatatgcagcttgaaggattttcattttggtagaacaccact

SEQ ID NO: 326108 - DNA, 75 bp, Artificial Sequence
  Synthetic
agtagtgaatccactattaactacagaaatatgtcaagccaattcatttttgaagatgtaccacaacggaatgca

SEQ ID NO: 326109 - DNA, 75 bp, Artificial Sequence
  Synthetic
gctacatttaacccggaggtcgggtatgtggcatttattggtaagtatgggcaacaactcaatttcggtgttgct

SEQ ID NO: 326110 - DNA, 75 bp, Artificial Sequence
  Synthetic
agagtcttcttcctcaaccagaagaaggccaaaatggtcctacataagacggcacaaccaagtgtcgatcttact

SEQ ID NO: 326111 - DNA, 75 bp, Artificial Sequence
  Synthetic
tttggtggggtcaaattcacagtggttaataaccattttccccaatatgtctcaaatcctgtgccagacaatgcc

SEQ ID NO: 326112 - DNA, 75 bp, Artificial Sequence
  Synthetic
attacacttcacaggatgtcaggatatctagcacgctggattgctgatacatgcaaggctagtgtcctcaaacta

SEQ ID NO: 326113 - DNA, 75 bp, Artificial Sequence
  Synthetic
gctgaagctagtgctcagattgtcatgccccttgctgaggttaagggatgtacctgggctgatggttatacaatg

SEQ ID NO: 326114 - DNA, 75 bp, Artificial Sequence
  Synthetic
tatcttggatttgcacctggggccgaaatgttccttgatgcttttgatttttatccgctagttatcgaaatgcat

SEQ ID NO: 326115 - DNA, 75 bp, Artificial Sequence
  Synthetic
agggtccttaaggacaatatggatgtgaattttatgaaaaaagtcctccgccaacgctatggaacaatgactgct

SEQ ID NO: 326116 - DNA, 75 bp, Artificial Sequence
  Synthetic
gaagaatggatgactcagaaaataacagaaataaaggctgctttcaattctgttggacagcttgcctgggctaaa

SEQ ID NO: 326117 - DNA, 75 bp, Artificial Sequence
  Synthetic
tctggattctctcctgctgctagaactttcttgcagcaattcggtatcaacatctaaacctcttcatcacagatc

SEQ ID NO: 326118 - DNA, 75 bp, Artificial Sequence
  Synthetic
ttcaatttccgtgcaatatgtctatgtattgcacaccattatactgcaaggcttctgttaagatagttaataagt

SEQ ID NO: 326119 - DNA, 75 bp, Artificial Sequence
  Synthetic
ggagaacactactgcccaggcatagttcaccatctttcgggtcctaacgcatgcgctcgtgctccacctccccga

SEQ ID NO: 326120 - DNA, 75 bp, Artificial Sequence
  Synthetic
caccatctttcgggtcctaacgcatgcgctcgtgctccacctccccgacgcggtcgggtcgtagtacgggccggt

SEQ ID NO: 326121 - DNA, 75 bp, Artificial Sequence
  Synthetic
gcccctaattacaatcactatggagacatacaagatcaatatttttagagacaggatcaaccagtgtcgaagtgc

SEQ ID NO: 326122 - DNA, 75 bp, Artificial Sequence
  Synthetic
tgaagaagccaaagacattgttgctgatcttcttatggctagacatgactattttggtagagaggtatgttatta

SEQ ID NO: 326123 - DNA, 75 bp, Artificial Sequence
  Synthetic
cctggatatcgagttccggcaggacgttccagcttatgacatacttcttgaatttctgccagccggcactgcttt

SEQ ID NO: 326124 - DNA, 75 bp, Artificial Sequence
  Synthetic
taacatccgcaattgtacgccagacaattttatcattcataatggcaaactttatgtcattgattacaaggtatc

SEQ ID NO: 326125 - DNA, 75 bp, Artificial Sequence
  Synthetic
aactgatcatgcatatggccaaaaaacttatgaaaaatacacccaaatctttggagacgcattgtcagaattgcc

SEQ ID NO: 326126 - DNA, 75 bp, Artificial Sequence
  Synthetic
gtttgattttgaggttgtgatcatccgtgctgaccctttgcgagatactattcatgtcaattcaaatcaattctt

SEQ ID NO: 326127 - DNA, 75 bp, Artificial Sequence
  Synthetic
ggaaatatttgggccgctcaacataaaccttgattttacttggttcttcaacttacgatccctaatatatgaaaa

SEQ ID NO: 326128 - DNA, 75 bp, Artificial Sequence
  Synthetic
atataaggatgatgacagattccttgaaattgtgaatcaaggtgaattcacaatgactggaccctggatcgatga

SEQ ID NO: 326129 - DNA, 75 bp, Artificial Sequence
  Synthetic
ggataccccggagctttattcgcaccctgtctttttagagttctatgattctttagatgagatggcaaagctgac

SEQ ID NO: 326130 - DNA, 75 bp, Artificial Sequence
  Synthetic
attccatgaatctatgacatttgatgcaactcgcggtgaaaagtggaatcaaaacctgcaaaaagttataaatag

SEQ ID NO: 326131 - DNA, 75 bp, Artificial Sequence
  Synthetic
atatggcaatgattataacgtttttgtgaaagacgccgctgcaggaatctttagatgtgaagggaattatcctaa

SEQ ID NO: 326132 - DNA, 75 bp, Artificial Sequence
  Synthetic
accaaatcatgatgagattacaatcggttggaatcaaatggttcagagagtgagtactgagcgaaatctgactca

SEQ ID NO: 326133 - DNA, 75 bp, Artificial Sequence
  Synthetic
ggatgtcagcaagcaaaagccatctatccatttcatatggggccaacctgatgaagcatcaaatgcaacaacacc

SEQ ID NO: 326134 - DNA, 75 bp, Artificial Sequence
  Synthetic
aaaactaatcaaaattgcaaaggcacttcaaaatatctctggtgagtctacatatataggcgcattcagagcact

SEQ ID NO: 326135 - DNA, 75 bp, Artificial Sequence
  Synthetic
gggcatgcttatggacttttctgagaacacagccttatatgaagcacatactagcaagttgaaaagtatggcaag

SEQ ID NO: 326136 - DNA, 75 bp, Artificial Sequence
  Synthetic
acagacatcaaagagaattgatactaaactggagccaataaaaataggcactgcaacaatttattgggagcaaca

SEQ ID NO: 326137 - DNA, 75 bp, Artificial Sequence
  Synthetic
atttaaattggatactgaaataatgaatacaaaagataaatcacatttgctaaaggacttccttggtataggggg

SEQ ID NO: 326138 - DNA, 75 bp, Artificial Sequence
  Synthetic
tcatgtgcaattctcaaaaaagaccattgacgatttagatactgacaaacctactattttggatttcaacaaaaa

SEQ ID NO: 326139 - DNA, 75 bp, Artificial Sequence
  Synthetic
ggaagtcattgatttctgcaaattccagtatgaaaatgtaaagaaaatattatctgaagataataatctagagcg

SEQ ID NO: 326140 - DNA, 75 bp, Artificial Sequence
  Synthetic
tatagggtgttatttagaagaatatggtgcaaacattgcatcatgctcaaaggatacatggaatcagataaatcg

SEQ ID NO: 326141 - DNA, 75 bp, Artificial Sequence
  Synthetic
aatagggaagtcaaattattgggcttgtattaaagatttttcagtcttgatgaaaaatatgctagcagtctctca

SEQ ID NO: 326142 - DNA, 75 bp, Artificial Sequence
  Synthetic
atataataggcacaatacttttcgcgtagtgtgttgtgcgaacaataatctgtttgggtttgtgatgccttcttc

SEQ ID NO: 326143 - DNA, 75 bp, Artificial Sequence
  Synthetic
tgatatcaaagcaaaacgatccacacttgtttatttcttagctgtattgcattctacccctcagaatgtgatgca

SEQ ID NO: 326144 - DNA, 75 bp, Artificial Sequence
  Synthetic
tcatggtgcattgcatgcaacatttaaaacaggttcaaaataccttagtatctctaagggaatacgattggataa

SEQ ID NO: 326145 - DNA, 75 bp, Artificial Sequence
  Synthetic
agaaagatgtcagcgtatagttagttcaccaggactttttatgttgactacattaatgtttacaggagacaatcc

SEQ ID NO: 326146 - DNA, 75 bp, Artificial Sequence
  Synthetic
aacactcaatttgactgatgtcatgaattttacattccacacttccctgtctataactaaggctatgctgtcact

SEQ ID NO: 326147 - DNA, 75 bp, Artificial Sequence
  Synthetic
tacagaaccatcaaggtatatgataatgaattcattagccatatccagccatgttagagattacatagcagaaaa

SEQ ID NO: 326148 - DNA, 75 bp, Artificial Sequence
  Synthetic
atttggcccttatacaaagaccagtttctctgtggtaatggcaaacttgattaaaagaggatgttatatggcata

SEQ ID NO: 326149 - DNA, 75 bp, Artificial Sequence
  Synthetic
taatcaaagagataaagtggacatgagaaatatctgcctaactgattatgaaataacccaaaaaggtgtgaggga

SEQ ID NO: 326150 - DNA, 75 bp, Artificial Sequence
  Synthetic
taacagagatctatcatcgatctggtttgaaggctatgtatcattaaaggaatatattaaccagatatatctgcc

SEQ ID NO: 326151 - DNA, 75 bp, Artificial Sequence
  Synthetic
gttttactttaattcaaaaggtttgcatgaaaagcatcatgttatgatagatctggctaagacaattttagatat

SEQ ID NO: 326152 - DNA, 75 bp, Artificial Sequence
  Synthetic
agaaagggatcagaggttaaatatcccaggaatatggtctacaacacctagaaagcagactgcaaatttaaatat

SEQ ID NO: 326153 - DNA, 75 bp, Artificial Sequence
  Synthetic
aactatttatgcagttgcaaaaaatctaataatggacactgctagacataattatatcaggtcacggatagaaaa

SEQ ID NO: 326154 - DNA, 75 bp, Artificial Sequence
  Synthetic
cacaaacaacttaaatagatcgatatgcactatttctacattcaccagctccaaatcatgtattaaggtaggaga

SEQ ID NO: 326155 - DNA, 75 bp, Artificial Sequence
  Synthetic
ctttgagaaagaaaaaagctcagcaataaaaaaggctgcagattgtatgtcaaaagaaataaagaagtataccat

SEQ ID NO: 326156 - DNA, 75 bp, Artificial Sequence
  Synthetic
tgcaaacccagaatttgttgatgaagaattaatgaatgcaactataaggcattcacgctatgaagacttaaaaaa

SEQ ID NO: 326157 - DNA, 75 bp, Artificial Sequence
  Synthetic
agcaatcccaaattatattgatattatgtcaaccaaagtatttgactctctataccagaaaataacaaggaaaga

SEQ ID NO: 326158 - DNA, 75 bp, Artificial Sequence
  Synthetic
gataaatgataaacccactgtgtatcacatactctctgctatgaagaatcacacagattttaagttcacattctt

SEQ ID NO: 326159 - DNA, 75 bp, Artificial Sequence
  Synthetic
taataaaggccaaaaaacagcaaaggatagggaaatattcgtaggcgaatttgaggcaaaaatgtgcttgtatct

SEQ ID NO: 326160 - DNA, 75 bp, Artificial Sequence
  Synthetic
agtggaaaggatatctaaagaacgctgcaagttgaacccagatgagatgatcagcgaaccaggcgattctaaatt

SEQ ID NO: 326161 - DNA, 75 bp, Artificial Sequence
  Synthetic
gaaaaaattggaagagcttgcagaatctgaaatacgattcacagcagcaactatgaaacaaatcaaagaacgtta

SEQ ID NO: 326162 - DNA, 75 bp, Artificial Sequence
  Synthetic
cttagcagaaatgggagaagcaagccatatgatcacatataaaccacattctgttaagattgaaatcaatgcaga

SEQ ID NO: 326163 - DNA, 75 bp, Artificial Sequence
  Synthetic
catgtcaaaatggagtgctcaggatgttttattcaaatatttctggttgtttgcattggaccctgcactttatct

SEQ ID NO: 326164 - DNA, 75 bp, Artificial Sequence
  Synthetic
gcaagaaaaagaaaggatattatacttcctgtgcaattatatgcaaaaaaagctagttttgcctgatgaaatgct

SEQ ID NO: 326165 - DNA, 75 bp, Artificial Sequence
  Synthetic
ctgtagtatccttgaccagcgtattaaacatgaggatgatataatatatgaaatgaccaatggcttatcacaaaa

SEQ ID NO: 326166 - DNA, 75 bp, Artificial Sequence
  Synthetic
ttgggtcaatatcaaacgaaactggctgcaagggaatctcaattatacaagtagctacctgcattcatgttctat

SEQ ID NO: 326167 - DNA, 75 bp, Artificial Sequence
  Synthetic
gaatgtttacaaggatattctaaagagggcagccactttactagaaggagaggtcttagtcaattctatggtcca

SEQ ID NO: 326168 - DNA, 75 bp, Artificial Sequence
  Synthetic
ttctgatgacaatcatacttcaatagtgatgatccaggacaaattagatgatgacattattattgaattttctgc

SEQ ID NO: 326169 - DNA, 75 bp, Artificial Sequence
  Synthetic
aaagctctttgaaaaaatatgcctaactttcggaaaccaggcaaatatgaagaagacatacataacaaatttcat

SEQ ID NO: 326170 - DNA, 75 bp, Artificial Sequence
  Synthetic
aaaagaatttgtttcactcttcaatatttacggcgagccattttctgtttatggtcgctttattttgacatctgt

SEQ ID NO: 326171 - DNA, 75 bp, Artificial Sequence
  Synthetic
tggcgattgtgcttttcttggaccatatgaagatgttgccagcaggttatctgcaacacagacagcaatcaaaca

SEQ ID NO: 326172 - DNA, 75 bp, Artificial Sequence
  Synthetic
tggagcaccgccatcgcttgcatggactgccattgcattaactcaatggataacacatagtacatataacatgct

SEQ ID NO: 326173 - DNA, 75 bp, Artificial Sequence
  Synthetic
cccaggccaaatcaatgatcctacttcagttttacctagtcatgataggtttgagctgcctatagaattatgtgg

SEQ ID NO: 326174 - DNA, 75 bp, Artificial Sequence
  Synthetic
cttgataaattcagaattgcccactatagctatagcaggtttggaagcagataatctaagttatttagttaggtt

SEQ ID NO: 326175 - DNA, 75 bp, Artificial Sequence
  Synthetic
atcgaaaagaatgtctcctatacatctttgccgtgaaccaatccagcatcaatatgagaatatacatacatggga

SEQ ID NO: 326176 - DNA, 75 bp, Artificial Sequence
  Synthetic
tattagcaggctgacgcaatgtgatatattcagacttaagcttttaagatacatgacattagactcaaccatgtc

SEQ ID NO: 326177 - DNA, 75 bp, Artificial Sequence
  Synthetic
atctgatgacgggatgggcgaaactagcgagatgagatctaggtctcttttaacaccaaggaaattcactactgc

SEQ ID NO: 326178 - DNA, 75 bp, Artificial Sequence
  Synthetic
tagctcattgtctagattgcattcatatgctgattaccagaaaacaatacaagatcaacagaaagttgaagaatt

SEQ ID NO: 326179 - DNA, 75 bp, Artificial Sequence
  Synthetic
atttgaatattttatagccaatcctcaactattggtcacaaaaggtgagacttgtgaagagttttgtatgtctgt

SEQ ID NO: 326180 - DNA, 75 bp, Artificial Sequence
  Synthetic
attgttcaggtacaacagtcgcaagttcaaagaatcattgtctattcagaatccagctcagctcttcatagagca

SEQ ID NO: 326181 - DNA, 75 bp, Artificial Sequence
  Synthetic
agtgttgtttgcaaataaacctatgatagactatacaagcattcatgataggttatttggtatacaagatgaccc

SEQ ID NO: 326182 - DNA, 75 bp, Artificial Sequence
  Synthetic
aaatataaatgatactacatgtattattggcaagaagacttttgttgaaacatatcagcaaataaaagctgatgt

SEQ ID NO: 326183 - DNA, 75 bp, Artificial Sequence
  Synthetic
agaaaagtttacacttgatgtagaagacataaaaacaatttacagcttctgtataatgaatgaccctatattggt

SEQ ID NO: 326184 - DNA, 75 bp, Artificial Sequence
  Synthetic
tgcttgtgcaaacaacttgttaatttcaatacagggtgtagagatgcagcgattgggtatgacatgctgttatat

SEQ ID NO: 326185 - DNA, 75 bp, Artificial Sequence
  Synthetic
gccagagattaaaagtcttaaagtaatttatcatagtcctgctcttgtactgcgtgcttatgtaacagataacta

SEQ ID NO: 326186 - DNA, 75 bp, Artificial Sequence
  Synthetic
tgagcaaaaagggatggagccagatgaaatgcgcagagacatatatcatttagaagaatttatagaaaagactaa

SEQ ID NO: 326187 - DNA, 75 bp, Artificial Sequence
  Synthetic
attaagggcaaatatgcaagggagaattgcaaacaatgaggttaaattaatgaagcgagatttgaaatttgaagt

SEQ ID NO: 326188 - DNA, 75 bp, Artificial Sequence
  Synthetic
gcaggaactaactaaattctatcagatctgttatgaatatgtgaaatcgacagaacacaaaattaaaatatttat

SEQ ID NO: 326189 - DNA, 75 bp, Artificial Sequence
  Synthetic
tcttccaaaaaaagcttacactcccattgatttctgctcattggtgacaggcaatctaatatcagacaataaatg

SEQ ID NO: 326190 - DNA, 75 bp, Artificial Sequence
  Synthetic
gatggttgttcattatttaaaacaaataactgtcccagcaaagaaagcacaaatagccacatctatagatctgga

SEQ ID NO: 326191 - DNA, 75 bp, Artificial Sequence
  Synthetic
gatacaaatagcctatgaatgtttcaggttaattacacactttgctgatatgtttctgaatgatgattctaaaaa

SEQ ID NO: 326192 - DNA, 75 bp, Artificial Sequence
  Synthetic
ggcttatattaatgcgatcattagcacatacacatacaaggacgttcaagtatccaatctctacaagaaaatcaa

SEQ ID NO: 326193 - DNA, 75 bp, Artificial Sequence
  Synthetic
aagttcaaggttacgctcaaaaatcataccattattatatcacttgggcgacttgcaacaagtggatgttgacag

SEQ ID NO: 326194 - DNA, 75 bp, Artificial Sequence
  Synthetic
atttgatgcagaaaaagcagaagagcagatcacgtggaataactggcaaacatcacgagaatttactactggccc

SEQ ID NO: 326195 - DNA, 75 bp, Artificial Sequence
  Synthetic
gattgatctatcaatcaaaggttatggacggtcaataaggatcataggtgaagacaacaagcttacagctgcaga

SEQ ID NO: 326196 - DNA, 75 bp, Artificial Sequence
  Synthetic
aatgcagttgtcaagagtgaggagtgacattgtatcaaggcatggacaagccttgttgaacaaaccccacgggct

SEQ ID NO: 326197 - DNA, 75 bp, Artificial Sequence
  Synthetic
gaaattagagaaaatggaaccagtgactgatctaaacccaaaattatggtatattgcataccaattacgcgagaa

SEQ ID NO: 326198 - DNA, 75 bp, Artificial Sequence
  Synthetic
aaagcggtatcactatggggtctttagtacatcttacatagaagagcacaactcaaggatagaggcgtctcggat

SEQ ID NO: 326199 - DNA, 75 bp, Artificial Sequence
  Synthetic
acgtaagaccaataaatggataccagtttgccctattgctatatcaaagcaatcgtctgatgggaagcctaatct

SEQ ID NO: 326200 - DNA, 75 bp, Artificial Sequence
  Synthetic
tgcgaagatccctatgttgaatattggggagataaaatttacaaaattgcagattgcagtagatgaccatgcaat

SEQ ID NO: 326201 - DNA, 75 bp, Artificial Sequence
  Synthetic
gattaggaaggccccattcagtaagatggttttctttgatggcccacctatacaaagtggtggcattgatattgg

SEQ ID NO: 326202 - DNA, 75 bp, Artificial Sequence
  Synthetic
aaagcttatgaagaatcaaaatattctcaatctaagattagataatatacagagtataacgttgttagacttgtg

SEQ ID NO: 326203 - DNA, 75 bp, Artificial Sequence
  Synthetic
ccgtatattttcatgtcgaggatctaaagtggatcaagatgcatttgaatttttatctgatgaacctttagacga

SEQ ID NO: 326204 - DNA, 75 bp, Artificial Sequence
  Synthetic
agatgttattgatgaattagacagctcacctgcattagtagtatcttacacaaagaaatcaaccaagtccaatag

SEQ ID NO: 326205 - DNA, 75 bp, Artificial Sequence
  Synthetic
ttttaaaaatgttatagttagagcattgataagagaatgcgatatatttgaagatataatggatataacagacga

SEQ ID NO: 326206 - DNA, 75 bp, Artificial Sequence
  Synthetic
tggatttacatctgatagtaatctagaagtactagaaaacttaacatggattttgaatatgctggcaacaaatca

SEQ ID NO: 326207 - DNA, 75 bp, Artificial Sequence
  Synthetic
atggtctacagaattattagcatgtatacacatgtgcttatatcgtaatgagatggaccatatctatcataattt

SEQ ID NO: 326208 - DNA, 75 bp, Artificial Sequence
  Synthetic
tcaagttccagaaatatttgtggacaatccaatttcattaaatgtaaaatgggatgaagtagtcatgtttttaaa

SEQ ID NO: 326209 - DNA, 75 bp, Artificial Sequence
  Synthetic
tgtactgcgagacagggattataaaattgaaccatgggtatctatactagatcattccttaactaaggctataga

SEQ ID NO: 326210 - DNA, 75 bp, Artificial Sequence
  Synthetic
atatgcttacaagaagatggatgaggagaggaagcaaaaatcaacaggcattaataaattcttaaagggtaaaaa

SEQ ID NO: 326211 - DNA, 75 bp, Artificial Sequence
  Synthetic
gatgggtggcagatcaaaatttgatttccaatagcttgactctaaatattgcataatctttgccccaaatctgta

SEQ ID NO: 326212 - DNA, 75 bp, Artificial Sequence
  Synthetic
actctaaatattgcataatctttgccccaaatctgtattatataaataattttaaagtagtttcatgtaattagg

SEQ ID NO: 326213 - DNA, 75 bp, Artificial Sequence
  Synthetic
aaaatgaaaacaatccttcgtatcgcttcagttttagcacaatgtgctatcatgatatgcttaccattgaagaac

SEQ ID NO: 326214 - DNA, 75 bp, Artificial Sequence
  Synthetic
catgatatgcttaccattgaagaactccataggtgggagatgcttcacaggtggtgagccatttaaaactattaa

SEQ ID NO: 326215 - DNA, 75 bp, Artificial Sequence
  Synthetic
tgcaacatctgcaccaagtgaagtctgcctcagagatgatatatcaatggtcaaatccattggaatacattcacg

SEQ ID NO: 326216 - DNA, 75 bp, Artificial Sequence
  Synthetic
tggggatgactcggacatgattgaatctagcgttacattttataggctgtattatgttaaagactggcacgattg

SEQ ID NO: 326217 - DNA, 75 bp, Artificial Sequence
  Synthetic
taacccaatctcagatcacatgggcacttttcttgttctaaatattgaggagagtggctctattaaagcagaaaa

SEQ ID NO: 326218 - DNA, 75 bp, Artificial Sequence
  Synthetic
ttatgcatgtcggaccagatgtgatatctccttaaatagagaccgcgggaccatagaattaacttctaccaatct

SEQ ID NO: 326219 - DNA, 75 bp, Artificial Sequence
  Synthetic
caaccattattctattaccgggacaacaattgcatctgggtggtttaaattgaaattagaagtgcaattgctttc

SEQ ID NO: 326220 - DNA, 75 bp, Artificial Sequence
  Synthetic
tgaaattagaagtgcaattgctttcgacatgtgaaagcattagtgtaacttgtggccaaaaaacgctggagttca

SEQ ID NO: 326221 - DNA, 75 bp, Artificial Sequence
  Synthetic
gacatgtgaaagcattagtgtaacttgtggccaaaaaacgctggagttcaaagcatgtttcagacaacatcgcaa

SEQ ID NO: 326222 - DNA, 75 bp, Artificial Sequence
  Synthetic
gtgtatcaattacttccatggctctatactacctgagataatgattgaaggaatatgtgcaaacttggaagttat

SEQ ID NO: 326223 - DNA, 75 bp, Artificial Sequence
  Synthetic
aatattgattttctttatatgcttgaatacaatacttgctataataatcactaacacatacgtagtatatgcttt

SEQ ID NO: 326224 - DNA, 75 bp, Artificial Sequence
  Synthetic
aatcccattaatatatccattctataaattatatgggacaatatataataagtgcttgaaaaagtgcaaaaactg

SEQ ID NO: 326225 - DNA, 75 bp, Artificial Sequence
  Synthetic
taaacttgctatacaccctttcactatttgtcccacaaaatgtatctgcggcatggtctataatagtactgaagc

SEQ ID NO: 326226 - DNA, 75 bp, Artificial Sequence
  Synthetic
tctgtacctacataggcaatgcaacaattgtacagggtataaagcactaacccatgcacgcattgcatgcaaaaa

SEQ ID NO: 326227 - DNA, 75 bp, Artificial Sequence
  Synthetic
aaagattcctaatgcaattatggcaatatttaccacaattttaatctttagcttcttaacacctgtttctgccga

SEQ ID NO: 326228 - DNA, 75 bp, Artificial Sequence
  Synthetic
atgctacaacctcagcgatctgccacaagattatgtcaatatggtcaattacatcggaatgcgttcgctgcttgg

SEQ ID NO: 326229 - DNA, 75 bp, Artificial Sequence
  Synthetic
gtacattatagcatctcttgctctgttagtagcgatagtgatattactccagaataaattagctgaacaagcttt

SEQ ID NO: 326230 - DNA, 75 bp, Artificial Sequence
  Synthetic
gaggttgtattatgtcaactgtgcattctgtgggatgatccatcataaaagaaatctcatactagagcagggctt

SEQ ID NO: 326231 - DNA, 75 bp, Artificial Sequence
  Synthetic
tacaaatcaatgcctaacttgtgtctgtcatgacaaaaatatacataaagccacaaagaagtgtactattaaata

SEQ ID NO: 326232 - DNA, 75 bp, Artificial Sequence
  Synthetic
caaatggcacatcacaaacaatattaggtggcttgtttttatttccatactcataataatgccagcaagtattta

SEQ ID NO: 326233 - DNA, 75 bp, Artificial Sequence
  Synthetic
tccaacacagtgcctaagatctgaagagataacaaatctagaagaagcctcaacttgcatatctgtttatcaaaa

SEQ ID NO: 326234 - DNA, 75 bp, Artificial Sequence
  Synthetic
cataacgcaaaaaaagcaatatcatgagttgattaagtccatgagtgaacaactaagctcagatgaagtctctat

SEQ ID NO: 326235 - DNA, 75 bp, Artificial Sequence
  Synthetic
attgttgccacaggttgttccatcttatattaatttaatacatgaaatagaaaatgagaatgatctacatacagc

SEQ ID NO: 326236 - DNA, 75 bp, Artificial Sequence
  Synthetic
catagtaaaagaaataatcttagctaatttatacccagaaatagtaaaaaagtactatagtgcagcagggcctga

SEQ ID NO: 326237 - DNA, 75 bp, Artificial Sequence
  Synthetic
cactgttaaatggcgaacaatacttcttaatgctggacttcatatctgttcagaacatgttgttaaaatgatatg

SEQ ID NO: 326238 - DNA, 75 bp, Artificial Sequence
  Synthetic
cagatgtgctttattacaacaagagtgtcaatcagtcacaagcgacgatggaaatcaaatagagacttattataa

SEQ ID NO: 326239 - DNA, 75 bp, Artificial Sequence
  Synthetic
gtcgcataaggaagaattttatgaggatatggcttcaattttcaaagtcatatatactgcattccctggtctcac

SEQ ID NO: 326240 - DNA, 75 bp, Artificial Sequence
  Synthetic
taaattcttacttgttaaatcaatgtctaatagggcactgcaagatgcagttccagtgcttgggaaattgaaata

SEQ ID NO: 326241 - DNA, 75 bp, Artificial Sequence
  Synthetic
ttccagtgcttgggaaattgaaatattatacaagaaacaataaccacttaaatggtatagttacatttgcagaac

SEQ ID NO: 326242 - DNA, 75 bp, Artificial Sequence
  Synthetic
ttatacaagaaacaataaccacttaaatggtatagttacatttgcagaacatataatatcaaaaaatgtgacaag

SEQ ID NO: 326243 - DNA, 75 bp, Artificial Sequence
  Synthetic
tgaaagtaggactattaattttgaggtacgcaaattaaccggtcagcaattcactgataaaaatattggttctag

SEQ ID NO: 326244 - DNA, 75 bp, Artificial Sequence
  Synthetic
tggtatcacaacatgtcaaacgcctaaattagtcacatgtacagggaaaagattaagatcattgcaaaaggagta

SEQ ID NO: 326245 - DNA, 75 bp, Artificial Sequence
  Synthetic
catagcatgctcaaacaatggggttaaaatgtatctaaaggaagataaaatctattgtagagtaggagcagatct

SEQ ID NO: 326246 - DNA, 75 bp, Artificial Sequence
  Synthetic
gtgtgtgggtgacaaatattgccttataagttttacaccaattactgataaggaaaatgtagataagttaatatg

SEQ ID NO: 326247 - DNA, 75 bp, Artificial Sequence
  Synthetic
ttatgcaacagaattccgggatcaatcaaatggtatgctaaaaagttcacaatcaattagagtaaaaaaactagg

SEQ ID NO: 326248 - DNA, 75 bp, Artificial Sequence
  Synthetic
aagctgcacactcaaagatcaatcagtcaatgtagctatgtcttcagagaatttattatataagtatgatacaat

SEQ ID NO: 326249 - DNA, 75 bp, Artificial Sequence
  Synthetic
ttatcataagaaaacaccacttgtggatgagtactgcctatcaaaaaaatgtactagtgatcattatccctatag

SEQ ID NO: 326250 - DNA, 75 bp, Artificial Sequence
  Synthetic
taatgaaaacctgaaaaactgcctatggacaataacaaatcacaaatttcagagtcagctacacatagatcatca

SEQ ID NO: 326251 - DNA, 75 bp, Artificial Sequence
  Synthetic
agatatagaatcattcatatcaggtatcaaactgtcattacataatgacttaattactcacaattataaacctac

SEQ ID NO: 326252 - DNA, 75 bp, Artificial Sequence
  Synthetic
acaaaacatgccacacataatccctaactataagtccatattcgtatctggaagcgataatgggaatacaataac

SEQ ID NO: 326253 - DNA, 75 bp, Artificial Sequence
  Synthetic
agatgcctacatcctctttaatataccactcaccactgggctctcccaaggattcagtgtgaatacaaaagcaaa

SEQ ID NO: 326254 - DNA, 75 bp, Artificial Sequence
  Synthetic
caaaggcttgtttgacttagtagtctatattaagagagccactataaaagcagaatatgtcttcgagtatgaaac

SEQ ID NO: 326255 - DNA, 75 bp, Artificial Sequence
  Synthetic
tgggcctactatcggtataaatgctgtccattctgaaaaatgcacagggttttgtccaagagaaataccccatac

SEQ ID NO: 326256 - DNA, 75 bp, Artificial Sequence
  Synthetic
tacaaactggttaacatttacaaaagagcacactagttcatggggttgtgaagaatggggctgtcttgccataaa

SEQ ID NO: 326257 - DNA, 75 bp, Artificial Sequence
  Synthetic
tactggctgtgtatatgggtcatgccaagatataataaagccagaaggcaaagtgtataagaagataggctctga

SEQ ID NO: 326258 - DNA, 75 bp, Artificial Sequence
  Synthetic
aacaattgatgcagaaatatgtataaccgatagcagtgaaacattttgcacagagataacttcttacaacccaat

SEQ ID NO: 326259 - DNA, 75 bp, Artificial Sequence
  Synthetic
actaggtgaaaaagtacaaattgagatagtatctcaagacactagcctgttgccatccaatatatttcaaagaaa

SEQ ID NO: 326260 - DNA, 75 bp, Artificial Sequence
  Synthetic
taataatatctataaaggagatataaatcctaaaggcacctttgcaaaaaaatgcggatccgtgcagaaagtgca

SEQ ID NO: 326261 - DNA, 75 bp, Artificial Sequence
  Synthetic
agatcaaatatacggttctggggagccaagatttgattatatatgccatgctgctagtagaaaggatgtagtggt

SEQ ID NO: 326262 - DNA, 75 bp, Artificial Sequence
  Synthetic
ctgctagtagaaaggatgtagtggtgcgcaagtgttatgataatgcatatatttcttgtagcacattggaaccga

SEQ ID NO: 326263 - DNA, 75 bp, Artificial Sequence
  Synthetic
tccaaaatatggatctaatcaaagacaactccaagtggtatttaagacaaggtactggtttatatggttcagtca

SEQ ID NO: 326264 - DNA, 75 bp, Artificial Sequence
  Synthetic
aagtaaagctattactgggggacttaaattataaacaggatgacacaactactacaagaataacagcaaaagctg

SEQ ID NO: 326265 - DNA, 75 bp, Artificial Sequence
  Synthetic
tatgtggcggctgtacagattgttttgatgatgtatcatgccgagttgacgtcacgtctaataatattgcctcat

SEQ ID NO: 326266 - DNA, 75 bp, Artificial Sequence
  Synthetic
gtccagtggagagtacatgctcagcatatattaacaggttgtccttggtagaaggctctcagcaactccatttaa

SEQ ID NO: 326267 - DNA, 75 bp, Artificial Sequence
  Synthetic
aattcaaatgcaaaatggaagctatagcattctctatatgtggcattaaagtggagattagatcagagatagtaa

SEQ ID NO: 326268 - DNA, 75 bp, Artificial Sequence
  Synthetic
agagccataagatattagatttggcatcactaagccaaacatcatatattagagaatatgataaaaaatgcggaa

SEQ ID NO: 326269 - DNA, 75 bp, Artificial Sequence
  Synthetic
atcactaagccaaacatcatatattagagaatatgataaaaaatgcggaacatggttatgtcgtgtttataacga

SEQ ID NO: 326270 - DNA, 75 bp, Artificial Sequence
  Synthetic
agagaatatgataaaaaatgcggaacatggttatgtcgtgtttataacgagggccttgaagggatcatcgggcct

SEQ ID NO: 326271 - DNA, 75 bp, Artificial Sequence
  Synthetic
atatggaaagaattcaatatatggctcaaatatggtactgtagttgttatattgatattttctgctattttgata

SEQ ID NO: 326272 - DNA, 75 bp, Artificial Sequence
  Synthetic
gtgaaagtaataaatccgttaattaaattaataatcaatactttaaagcacaatgaacaaatgtatctacttgag

SEQ ID NO: 326273 - DNA, 75 bp, Artificial Sequence
  Synthetic
tctaaacaaaaataatttcatttaactttatattttcattaggggttgggtggtgggttatatgcagcttgaagg

SEQ ID NO: 326274 - DNA, 75 bp, Artificial Sequence
  Synthetic
taatttcatttaactttatattttcattaggggttgggtggtgggttatatgcagcttgaaggatttttcatttt

SEQ ID NO: 326275 - DNA, 75 bp, Artificial Sequence
  Synthetic
gacatgtgaaagcattagtgtaacttgtggccaaaaaacgctggagtttaaagcatgttttagacaacatcgcaa

SEQ ID NO: 326276 - DNA, 75 bp, Artificial Sequence
  Synthetic
ttatacaaaaaacaataaccacttaaatggtatagttacatttgcagaacatataatatcaaaaaatgtaacaag

SEQ ID NO: 326277 - DNA, 75 bp, Artificial Sequence
  Synthetic
gtccagtggagagtacatgctcagcatatataaacaggttgtccttggtagaaggttctcagcaactccatttaa

SEQ ID NO: 326278 - DNA, 75 bp, Artificial Sequence
  Synthetic
agagaatatgataaaaaatgcggaacatggttatgtcgtgtttataatgagggccttgaaggaatcatcggacct

SEQ ID NO: 326279 - DNA, 75 bp, Artificial Sequence
  Synthetic
acgcttaacagcaaagtcagagaagagataagcctctacaatgagcgaatcaaaatgtaacacccctacaatgga

SEQ ID NO: 326280 - DNA, 75 bp, Artificial Sequence
  Synthetic
ctctgaaaagattgttttcaaagttcgtaaccaggtggtgtctttgaagccagaaataatctctgatcagtatga

SEQ ID NO: 326281 - DNA, 75 bp, Artificial Sequence
  Synthetic
gtacaaatatcctgcaattctggatggaagaaaaccggggatcactctagggagagctccagacttaaacacggc

SEQ ID NO: 326282 - DNA, 75 bp, Artificial Sequence
  Synthetic
ttacaaatcaattttgtctggtatgaatgctgccaaattggatccagatgatgtgtgctcctatttggctgctgc

SEQ ID NO: 326283 - DNA, 75 bp, Artificial Sequence
  Synthetic
gatgcagctgtttgaaggtgtttgcccagaggattggactagttatggtattgtgattgcaaagaagggtgataa

SEQ ID NO: 326284 - DNA, 75 bp, Artificial Sequence
  Synthetic
gatcactccggaagatttgatagatgttactaggacaaatgtagagggaaattgggctcaaacagggggaacaga

SEQ ID NO: 326285 - DNA, 75 bp, Artificial Sequence
  Synthetic
catgacaagagatccaacaagtgcagaacatgcatctttagtggggttgctgttgtgcttatatcgtctaagcaa

SEQ ID NO: 326286 - DNA, 75 bp, Artificial Sequence
  Synthetic
gatagtcggccagaatactgcaaattacaagaccaatgtggccgatagaatggaacaaatttttgaaactgcacc

SEQ ID NO: 326287 - DNA, 75 bp, Artificial Sequence
  Synthetic
ttttgtgaaaattgttgaacatcatactctaatgactactcataaaatgtgtgctaattggagtacaattccaaa

SEQ ID NO: 326288 - DNA, 75 bp, Artificial Sequence
  Synthetic
ctttagatttcttgctggagcttatgatatgtattttgcaagaatagagcatctttactctgctataagggttgg

SEQ ID NO: 326289 - DNA, 75 bp, Artificial Sequence
  Synthetic
aactgtagtgactgcttacgaagattgttcaggattggtctccttcactggatttataaaacaaattaatttatc

SEQ ID NO: 326290 - DNA, 75 bp, Artificial Sequence
  Synthetic
tgctagagatgctttgctttatttctttcacaaaaattttgaagaagaaataagaagaatgttcgaacctggtca

SEQ ID NO: 326291 - DNA, 75 bp, Artificial Sequence
  Synthetic
agaaactgcaattcctcattcttacttcatacattttagagctttgggattaagcggcaaatcaccctattcatc

SEQ ID NO: 326292 - DNA, 75 bp, Artificial Sequence
  Synthetic
aaatgcagtaggtcataccttcaacttgattcactttataggttgttatatgggtcagataagatctctaaatgc

SEQ ID NO: 326293 - DNA, 75 bp, Artificial Sequence
  Synthetic
cacagttattcaagcttgtgcacctcatgagatgtctgtcttgggaggttatctaggagaggaattctttggaaa

SEQ ID NO: 326294 - DNA, 75 bp, Artificial Sequence
  Synthetic
aggtacttttgaaagaaggttcttcagggatgaaaaggagatgcaagactatgcagaattggagggaattaaaat

SEQ ID NO: 326295 - DNA, 75 bp, Artificial Sequence
  Synthetic
agaggcagcattggcagatgatggaacagttgactctgatgatgaggatttcttttcaggagagacaagaagtcc

SEQ ID NO: 326296 - DNA, 75 bp, Artificial Sequence
  Synthetic
agaagcagtgtatagtcgaatcatgatgaacaacggcagattgaaaaggtcacacataaggcggtacatatcagt

SEQ ID NO: 326297 - DNA, 75 bp, Artificial Sequence
  Synthetic
cagctcaaatcatcaggcaaggcctaactcatttgcagagtttttaaacaaggtgtactcagatgggtcctaata

SEQ ID NO: 326298 - DNA, 75 bp, Artificial Sequence
  Synthetic
ttgatttcaacagaatgcataggagacaggagagtttccattgtaaaaggggtactgaaaaaaactcaacacccc

SEQ ID NO: 326299 - DNA, 75 bp, Artificial Sequence
  Synthetic
tcttcaatccttccctccaagatgagcaaggggcttattcatccgagttccattcgctccgggcttgtggatttg

SEQ ID NO: 326300 - DNA, 75 bp, Artificial Sequence
  Synthetic
gagatggcggaagaaactgtcgatctaattcacaaaaacttgacagacgggcaggctcacttacaaggtgaacca

SEQ ID NO: 326301 - DNA, 75 bp, Artificial Sequence
  Synthetic
ttagatgtcgattctcttcctgaagatatgagaagaatgaggctgattgacatgtccagacaaaaggacatcagg

SEQ ID NO: 326302 - DNA, 75 bp, Artificial Sequence
  Synthetic
atcggagatgaaggagagagcagctctgaggacgagttttacctacctagtgggaaagatccgatggttcctctt

SEQ ID NO: 326303 - DNA, 75 bp, Artificial Sequence
  Synthetic
caagattttcttgatgaaatcggagctcaagtagtgaagaggatgaaatctggagatgggttcttcaaaatctgg

SEQ ID NO: 326304 - DNA, 75 bp, Artificial Sequence
  Synthetic
tctactgtaactgaagatataaagggatatatttcttcaaatttcactgcagcagaaccaagatccagtgacaat

SEQ ID NO: 326305 - DNA, 75 bp, Artificial Sequence
  Synthetic
aaatcagtccaaacagaacctgctcagattcaaaaagggttgccagaacctccatcccatgaagagaaagcaaag

SEQ ID NO: 326306 - DNA, 75 bp, Artificial Sequence
  Synthetic
gaaacacaagaatcctctaagaacaggcaggagtcaaagcctgctccctcttctgattgggacaataatcaagaa

SEQ ID NO: 326307 - DNA, 75 bp, Artificial Sequence
  Synthetic
gaagttgacgacatagagggggaagttgctcatcaagttgcagagagtttctctaaaaagtacaagtttccatct

SEQ ID NO: 326308 - DNA, 75 bp, Artificial Sequence
  Synthetic
agatcatctggaatctttttatggaactttgaacaactcaagatgaatctagatgacatagtgaaggctgccttg

SEQ ID NO: 326309 - DNA, 75 bp, Artificial Sequence
  Synthetic
aacataccaggaattgataaaattgcagagaaaggagggaagctaccattgagatgtatcttgggatatgtttca

SEQ ID NO: 326310 - DNA, 75 bp, Artificial Sequence
  Synthetic
ttaagtgcatctaagagattctgcttgcttgctgacaatgacaaaactgctaggttgatgcaagatgacatcaac

SEQ ID NO: 326311 - DNA, 75 bp, Artificial Sequence
  Synthetic
aattatattgcaaaaattgaggaaatagacaaaagttaaaaccctacacagattccattgatccacactcagcct

SEQ ID NO: 326312 - DNA, 75 bp, Artificial Sequence
  Synthetic
catcatattcttgaaaaaaacatataacacccctaaaagaatgaatttcctgaggagaattgtgaaaaactgcaa

SEQ ID NO: 326313 - DNA, 75 bp, Artificial Sequence
  Synthetic
agacgaagatgccccaaaactgggaactccctcagctcctccggatgatgatgatttgtggctacctccccctga

SEQ ID NO: 326314 - DNA, 75 bp, Artificial Sequence
  Synthetic
atacatgcctttagcacaaatcaaaggtaaagaaagtgtcagaaacttttgcataaacggagaggtcaaaatctg

SEQ ID NO: 326315 - DNA, 75 bp, Artificial Sequence
  Synthetic
cagtcctaatggatattcattcagaataattagacacatcttaaagtcttttgataacgtgtattctgggaacag

SEQ ID NO: 326316 - DNA, 75 bp, Artificial Sequence
  Synthetic
aagaatgattggactagctaaagtggtaatcggattggcactgtccggctcacccgttccagaaggaatgaactg

SEQ ID NO: 326317 - DNA, 75 bp, Artificial Sequence
  Synthetic
ggtttacaagctaaggagaacactgatttttcaatgggcagaatctcaaggcccgttagaaggggaagagctaga

SEQ ID NO: 326318 - DNA, 75 bp, Artificial Sequence
  Synthetic
atattcccaggagataacctgggacgatgaatcggagtttgttggtttacaaatcagaatcagtgccaaacaatg

SEQ ID NO: 326319 - DNA, 75 bp, Artificial Sequence
  Synthetic
tcacatccaggggagattgtggtgtatcaacatgaactccagagcttgccaactgtgggcagacatggccctcaa

SEQ ID NO: 326320 - DNA, 75 bp, Artificial Sequence
  Synthetic
gacccagcagtctaaagatgatgagaatacttcgcttctgttggaatgaacttacgcatgttagaactgcttgaa

SEQ ID NO: 326321 - DNA, 75 bp, Artificial Sequence
  Synthetic
acttttacctccattttgagccgatattatctgcgagcaatagaacaaacacagttatggtgcctgctttcagca

SEQ ID NO: 326322 - DNA, 75 bp, Artificial Sequence
  Synthetic
aaatggacacgacttccacctttattagtctttagattaaaactttgagcaagacgtgaaaaaaacattccctaa

SEQ ID NO: 326323 - DNA, 75 bp, Artificial Sequence
  Synthetic
cgggctaacagccctccccttttgtcatcatgagcaatttatgcaccattttcatcctgtgtgcaagtataatgg

SEQ ID NO: 326324 - DNA, 75 bp, Artificial Sequence
  Synthetic
tttctttaggtgattttccactgtacacaattcccgagaaaataggaccatggacgcccattgatttgacccatc

SEQ ID NO: 326325 - DNA, 75 bp, Artificial Sequence
  Synthetic
tgagttgtccaaacaacctgctttcagaagatgacggatgcagctcttcctcaactttcagttatatagaattga

SEQ ID NO: 326326 - DNA, 75 bp, Artificial Sequence
  Synthetic
gaactggttatctcacccatcaaaaagtgtctggatttacgtgtactggagtcatcaacgaagcagttacataca

SEQ ID NO: 326327 - DNA, 75 bp, Artificial Sequence
  Synthetic
ccaattttgtaggatatgtaacaaccacttttaaaagaaaacatttcaaaccaactgcttctgcctgtagggatg

SEQ ID NO: 326328 - DNA, 75 bp, Artificial Sequence
  Synthetic
catatcattggaaaatttctggagatcctcgttatgaagaatcactacacactccttacccggacaacagttggt

SEQ ID NO: 326329 - DNA, 75 bp, Artificial Sequence
  Synthetic
tgagaacagtcactacaaccaaagaatcacttctaatcatctctccaagcatagtggagatggacatttatagtc

SEQ ID NO: 326330 - DNA, 75 bp, Artificial Sequence
  Synthetic
gttctcttcattcaccaatgtttcccacagggaggtgttatgacttctataaatctaccccttcttgcttgacca

SEQ ID NO: 326331 - DNA, 75 bp, Artificial Sequence
  Synthetic
accatgactatacaatatggcttcctgatgatgcaaatgtacgactcacatgcgatatctttgtaacgagtaccg

SEQ ID NO: 326332 - DNA, 75 bp, Artificial Sequence
  Synthetic
gaaagaaatcaatgaatggttcaaaaatgtgtggctttactgatgaaagaggactttatagaactctgaaagggg

SEQ ID NO: 326333 - DNA, 75 bp, Artificial Sequence
  Synthetic
cttgtaagttgacattatgtggaaagccaggactgagattgttcgatggcacctggatttctatcacaagacctg

SEQ ID NO: 326334 - DNA, 75 bp, Artificial Sequence
  Synthetic
agattgttatgtggtgttctcctaatcaacttgtgaatgtgcataacaacagagtggatgagatagaacacttaa

SEQ ID NO: 326335 - DNA, 75 bp, Artificial Sequence
  Synthetic
ttgtgggtgacttgatccgtagaagagaagagtgcctggataccttagagacagttcttatgtcaaagtcagtta

SEQ ID NO: 326336 - DNA, 75 bp, Artificial Sequence
  Synthetic
gttttagacgactgagtcatttcagaaagcttgtcccgggttttggaaaggcatataccatcgccaatgggagcc

SEQ ID NO: 326337 - DNA, 75 bp, Artificial Sequence
  Synthetic
taatggaaaccaatgtacactacaaaagagtagatcgttgggaggaaatattaccctccaaagggtgcctaaaac

SEQ ID NO: 326338 - DNA, 75 bp, Artificial Sequence
  Synthetic
tgaatgacaagtgtcttaaccctgagaatggggtgttttttaatgggatcattaaaggccctgatggacaggttt

SEQ ID NO: 326339 - DNA, 75 bp, Artificial Sequence
  Synthetic
taattccagaaatgcagtcaagtttattgaagcaacatatggacttgctgaaagcttctgtatttcctctaagac

SEQ ID NO: 326340 - DNA, 75 bp, Artificial Sequence
  Synthetic
atcctttgatcgatcaaacatctatcttcaaaaaagatggagaggcagatgactttgttgatgttcacatgccag

SEQ ID NO: 326341 - DNA, 75 bp, Artificial Sequence
  Synthetic
atccgcataagtcaatatccaatatagatttaggtttaccagactggggtctatatgcaatgattgggggaactg

SEQ ID NO: 326342 - DNA, 75 bp, Artificial Sequence
  Synthetic
tagttgcatttctaatattggtgtgtctcctctgtacttgttgtaaaagaagacgaaggaggaattccagaaagc

SEQ ID NO: 326343 - DNA, 75 bp, Artificial Sequence
  Synthetic
ctagctcagaacaaaccccaaaaatttcatctactcctccttctgggactaaagtcatatcatcttgggagtctt

SEQ ID NO: 326344 - DNA, 75 bp, Artificial Sequence
  Synthetic
ataaaggcacatctagtgtgtaaactagatattgtttaaaacaactctgagtgccataaatacagctcaacaaac

SEQ ID NO: 326345 - DNA, 75 bp, Artificial Sequence
  Synthetic
tgcctctttatcatcatatcactttattttgttttactcgatataacgttatatcttacagtgcattcatctcat

SEQ ID NO: 326346 - DNA, 75 bp, Artificial Sequence
  Synthetic
ataacctcttaaaatgagacaatcaataaagtatatcaatctcatctttttgtggtacacacaaccgggacagag

SEQ ID NO: 326347 - DNA, 75 bp, Artificial Sequence
  Synthetic
tactcatgttgcaaggttatattggacagaaacaccggcaatagactgtgacatatttcaattgagaacattata

SEQ ID NO: 326348 - DNA, 75 bp, Artificial Sequence
  Synthetic
acaagcaatcgattacaccctatcgtatgatacaaaagccgcaactgagattacttatttcacctcgagtgattg

SEQ ID NO: 326349 - DNA, 75 bp, Artificial Sequence
  Synthetic
tctcagttcttgaacctttagggtgcatataccttaatcaaagcaatcttcctgtacaataactccttctgatct

SEQ ID NO: 326350 - DNA, 75 bp, Artificial Sequence
  Synthetic
aataatattcagggattctgtaaataacctgcctaagaatgtaatgtagtataagagatgtttggtttttgtcat

SEQ ID NO: 326351 - DNA, 75 bp, Artificial Sequence
  Synthetic
gtcaattcatgtgctaactttgctcacacgtcacattgtaaggaacatgaaaaaaacatcttacactccccaaga

SEQ ID NO: 326352 - DNA, 75 bp, Artificial Sequence
  Synthetic
ttaagcctcaacagccctcctgggttttgttccaacatgattgagtcctctgaggtatatgatgatcctcttgat

SEQ ID NO: 326353 - DNA, 75 bp, Artificial Sequence
  Synthetic
cctgcagagcctgaaagtgaatggagtaatacctccataattccaaacatactgagaaattctgattataatctg

SEQ ID NO: 326354 - DNA, 75 bp, Artificial Sequence
  Synthetic
aattcccctcttttagaagatcatgctgatcttatgttgcaatggttgtcctcaggaaatcgtcctctgagaatg

SEQ ID NO: 326355 - DNA, 75 bp, Artificial Sequence
  Synthetic
agtactacagacaatatatccagatcttacaaagtattaaaattgtcctttaagaaaatagatatagcttcaata

SEQ ID NO: 326356 - DNA, 75 bp, Artificial Sequence
  Synthetic
aaatttggaggtcagggagctcaggcaatgatgaatacttgggttctgtgttctcatgcagaatcctctagaagt

SEQ ID NO: 326357 - DNA, 75 bp, Artificial Sequence
  Synthetic
aggaaatgcttgacagacttatccatcttttaccaaagatctatacctatagagtctattttaaattacacatta

SEQ ID NO: 326358 - DNA, 75 bp, Artificial Sequence
  Synthetic
agtaatcgaggactacaaacaccgaaagaaggagtattatcatgtttaggtcgtattagttatgatcagtccttt

SEQ ID NO: 326359 - DNA, 75 bp, Artificial Sequence
  Synthetic
ggtagatatttagggaatctatattcatcttatctattgtttcatactatgatcctttacatgaatgcattggat

SEQ ID NO: 326360 - DNA, 75 bp, Artificial Sequence
  Synthetic
tgggaagaagaaaagacgattatagctttgtggaaagagataacatcgatagatgtcaagaacgacaaggtcacc

SEQ ID NO: 326361 - DNA, 75 bp, Artificial Sequence
  Synthetic
ttcagagatcccttatggggaaaatttttagttacaaaagaatttgtttactcttatactaactgcagcttattt

SEQ ID NO: 326362 - DNA, 75 bp, Artificial Sequence
  Synthetic
gataggaattacacattaatgttgaaagatttgtttttgtctagatttaactccttgttaattcttatatcacct

SEQ ID NO: 326363 - DNA, 75 bp, Artificial Sequence
  Synthetic
cctgaacctagatactctgatgatttaatttctaatctctgtcaattatataaatctggggacaaagtcatttca

SEQ ID NO: 326364 - DNA, 75 bp, Artificial Sequence
  Synthetic
gagtgtgggaattccggatacgatgtcatcaaaatcttagaaccctacgttgtcaatcacctagttcaaaaagct

SEQ ID NO: 326365 - DNA, 75 bp, Artificial Sequence
  Synthetic
gagactttcagaccattgattcactctttaggagactttcctgctttcatcaaagataaaaccacacagttgaga

SEQ ID NO: 326366 - DNA, 75 bp, Artificial Sequence
  Synthetic
gggacttttgggccttgtgcatcacaatttttctcggctctagaccaatttgacaacattcacgatttggttttt

SEQ ID NO: 326367 - DNA, 75 bp, Artificial Sequence
  Synthetic
gtgtatggatgttatagacattggggccatccttatattgactatcggaaaggtctaaccaagttgtttgatcaa

SEQ ID NO: 326368 - DNA, 75 bp, Artificial Sequence
  Synthetic
gtccatatgaaaaagaccattgacaaacattatcaggaatgcttggctagtgatttagcaaagaaaatattgaga

SEQ ID NO: 326369 - DNA, 75 bp, Artificial Sequence
  Synthetic
tggggatttgataaatattcaagatggtatttagacacctcattgttaccaaagaaccaccccttgattccctat

SEQ ID NO: 326370 - DNA, 75 bp, Artificial Sequence
  Synthetic
ataacaacacagacttggcctcctagacatgttgtagatttgttgggggattcatggcattctctcccaatgaca

SEQ ID NO: 326371 - DNA, 75 bp, Artificial Sequence
  Synthetic
cagatctttgaaataccggaatcaatggatccttctgaaatattagatgacaaatctcactcattcacaagaaca

SEQ ID NO: 326372 - DNA, 75 bp, Artificial Sequence
  Synthetic
agacttgcatcctggctatctgaaaatagaggaggtcctgtccccagtgaaaaagtcataatcactgccttatct

SEQ ID NO: 326373 - DNA, 75 bp, Artificial Sequence
  Synthetic
aaggctccagttaatcccagagagttcttgaaggcggttgatctaaatgggcttgctgaagatgacttgatcata

SEQ ID NO: 326374 - DNA, 75 bp, Artificial Sequence
  Synthetic
ggtttgaaaccaaaggagagggaactcaaaatagaaggcaggttttttgcattaatgtcatggaatttaagactt

SEQ ID NO: 326375 - DNA, 75 bp, Artificial Sequence
  Synthetic
tactttgttatcacggagaaacttttagcaaaccatattcttcctttatttgatgctttgacgatgacagacaac

SEQ ID NO: 326376 - DNA, 75 bp, Artificial Sequence
  Synthetic
ttaaacaaagtattcaagaaattaattgatagggtcactggtcagggactttgtgattactcgagagtcacatat

SEQ ID NO: 326377 - DNA, 75 bp, Artificial Sequence
  Synthetic
gctttccatcttgattatgaaaaatggaacaatcaccaaagactagagtctaccaaagatgtcttctctgtattg

SEQ ID NO: 326378 - DNA, 75 bp, Artificial Sequence
  Synthetic
gataaggcattcggactatcccgtgttttttctagaactcatgagttttttcagaagtcctgggtttattattca

SEQ ID NO: 326379 - DNA, 75 bp, Artificial Sequence
  Synthetic
gacagatctgatttaatcggaatttggaatgatcagatatattgtcttgacatggccgatggaccaacctgctgg

SEQ ID NO: 326380 - DNA, 75 bp, Artificial Sequence
  Synthetic
aatggtcaagatggtggtcttgaaggtctcaggcaaaagggttggagtttagttagtttgcttatgatagaccga

SEQ ID NO: 326381 - DNA, 75 bp, Artificial Sequence
  Synthetic
gaatctcaaacaagaaacacaagaaccaaaatattagcacagggtgacaatcaagttttgtgtcccacttatatg

SEQ ID NO: 326382 - DNA, 75 bp, Artificial Sequence
  Synthetic
ttgtcctctgggttaaataatgagggcttaatgtatgaattagaaagcatatcaaaaaatgcaatgtcaatttat

SEQ ID NO: 326383 - DNA, 75 bp, Artificial Sequence
  Synthetic
cgcgccattgaagagggggcttctaagttgggactgataatcaaaaaggaggaaaccatgtgtagttatgacttt

SEQ ID NO: 326384 - DNA, 75 bp, Artificial Sequence
  Synthetic
ttaatctatggcaaaactccactgtttagaggaaacatacttgttcccgagtctaagagatgggctagagtgtcc

SEQ ID NO: 326385 - DNA, 75 bp, Artificial Sequence
  Synthetic
tgcatatcaaatgatcagatagtaaacttggcaaatatcatgtccactgtatcaaccaatgcgctgactgtagcc

SEQ ID NO: 326386 - DNA, 75 bp, Artificial Sequence
  Synthetic
cagcattcacaatccctaatcaagcctatgagggattttcttctaatgtctgttcaagctatttatcattacctc

SEQ ID NO: 326387 - DNA, 75 bp, Artificial Sequence
  Synthetic
ttatttagccccatcttaaaagatcgagtatataaagtattaaactcaaagggggatgactttctcttgaccatg

SEQ ID NO: 326388 - DNA, 75 bp, Artificial Sequence
  Synthetic
tctaggataatatacttagacccttcattgggaggagtgtcagggatgtctctaggtagatttcatataagacaa

SEQ ID NO: 326389 - DNA, 75 bp, Artificial Sequence
  Synthetic
ttctcagatcctgtatcagagggattgacgttctggaaagagatatggctaagttcttctgaatcttggattcat

SEQ ID NO: 326390 - DNA, 75 bp, Artificial Sequence
  Synthetic
catctttgtcaagaagcaggaaatcctgatttaggagatagaagtcttgagagttttacccgattgctggaggat

SEQ ID NO: 326391 - DNA, 75 bp, Artificial Sequence
  Synthetic
cccacaactttaaacataagagggggtgcaagccctacaattttgttgaaagaagctattagaaaagccctttac

SEQ ID NO: 326392 - DNA, 75 bp, Artificial Sequence
  Synthetic
gatgaggttgataaagtagaaaattcagaattcagagaggctattatcttatccaaaacccacagggacaacttt

SEQ ID NO: 326393 - DNA, 75 bp, Artificial Sequence
  Synthetic
attctatttttaaaatcaattgaaccactatttccccgatttttaagcgaattgttcagttcttcattcttaggg

SEQ ID NO: 326394 - DNA, 75 bp, Artificial Sequence
  Synthetic
ataccagaatcaatcataggtctcattcaaaactccaggactgttagaagacaatttagaaaaagcttatcaaga

SEQ ID NO: 326395 - DNA, 75 bp, Artificial Sequence
  Synthetic
gcgttagaagaatccttttttcactctgaaattcatggaatcagtagaatgactcaatctcctcaaagacttggg

SEQ ID NO: 326396 - DNA, 75 bp, Artificial Sequence
  Synthetic
agagtctggtcatgttcggcagaaagagctgatcagctgcgcgagatctcttggggaagaaaagttgtaggaaca

SEQ ID NO: 326397 - DNA, 75 bp, Artificial Sequence
  Synthetic
actgtccctcacccatcggagatgctaatgttggtccccaaatcttcagtctcttgtggttgtagtattagggag

SEQ ID NO: 326398 - DNA, 75 bp, Artificial Sequence
  Synthetic
ctgtacaaccctagaatctcagtttctgttctcccttcctttgacaattctttcttctctagaggatccctcagg

SEQ ID NO: 326399 - DNA, 75 bp, Artificial Sequence
  Synthetic
gggtatctagggtcttctacatccgtctcaactcaattgttccatgcatgggagaaggtgaccaatgtccatgtt

SEQ ID NO: 326400 - DNA, 75 bp, Artificial Sequence
  Synthetic
gttaaaagagctctctctctcaaggagtcaatcaactggtttatttcccgagactctaatttggcacagactctg

SEQ ID NO: 326401 - DNA, 75 bp, Artificial Sequence
  Synthetic
ataagaaacatactgtcgttaacagggcctgagtttccgatagaagaggctccagtgtttaaaaggactgggtct

SEQ ID NO: 326402 - DNA, 75 bp, Artificial Sequence
  Synthetic
gccctacatagattcaaatctgcaaggtacagtgaaggtggttattcagctgtatgtccgaatctcttgtctcat

SEQ ID NO: 326403 - DNA, 75 bp, Artificial Sequence
  Synthetic
atttctgtaagcactgatacgatgtcggatctcactcaagacggaactaattttgactttatgtttcaaccctta

SEQ ID NO: 326404 - DNA, 75 bp, Artificial Sequence
  Synthetic
atgttgtatgctcagacatggacatcggagcttgttcagaaggatttaagattgagagactcaacttttcattgg

SEQ ID NO: 326405 - DNA, 75 bp, Artificial Sequence
  Synthetic
catctgaggtgtcaaaaatgtataaggcctattgaggaggttagtttagaagctccacaaagctttgcttttcct

SEQ ID NO: 326406 - DNA, 75 bp, Artificial Sequence
  Synthetic
gatatctccactcgaatatccagaatggtgtctggggccgtacctcagtttagaaaacttcctacaatagaactt

SEQ ID NO: 326407 - DNA, 75 bp, Artificial Sequence
  Synthetic
aaagcgggagatctttccagtctgacaaacaatgagagatcttatcatgtagggactgcccaaggtttgctatat

SEQ ID NO: 326408 - DNA, 75 bp, Artificial Sequence
  Synthetic
tctatcctcgtagcaatacatgatcctggatacaatgacaactctttattcccagtcaacatatatggaaaggtc

SEQ ID NO: 326409 - DNA, 75 bp, Artificial Sequence
  Synthetic
tctgctagaagttatttgaggggcctagcaagaggtgtgtttattggatcttccatatgttttctaacccggatg

SEQ ID NO: 326410 - DNA, 75 bp, Artificial Sequence
  Synthetic
actaatataaatattaacagacctcttgagttaatttctggcgtgatctcatacattttgctcagactagataat

SEQ ID NO: 326411 - DNA, 75 bp, Artificial Sequence
  Synthetic
cacccttctctttatgtgatgttaaaagaacctgaattgaggtcagagatcttttcaattcctcagaaaatccca

SEQ ID NO: 326412 - DNA, 75 bp, Artificial Sequence
  Synthetic
gcagcttacccaaccaccatgaaggaaggtaacagatcagttttatgttatcttcaacaggtactaagatatgaa

SEQ ID NO: 326413 - DNA, 75 bp, Artificial Sequence
  Synthetic
agagacagtatgtcctcatctccaggtaacgatctcctgtggatattctcagacttcagaagcatcaaaatgaca

SEQ ID NO: 326414 - DNA, 75 bp, Artificial Sequence
  Synthetic
tatttgactttaataactttccaggcccacctttggttacaacggattgagagaaatttgtctaaacaaatgaga

SEQ ID NO: 326415 - DNA, 75 bp, Artificial Sequence
  Synthetic
gcaaaacttcgtcaactgaactcattaatgagacaagttttgggcggtcatggagaggaaaatatcgaatcggat

SEQ ID NO: 326416 - DNA, 75 bp, Artificial Sequence
  Synthetic
gatgaaataaactctctgctcaaggaagctcttagaagaactagatgggtagatcaggaggtacgtcatgctgct

SEQ ID NO: 326417 - DNA, 75 bp, Artificial Sequence
  Synthetic
aagactatgagacctgacttaagtccagttccaaagaactcacgcaaaattggttcttcagaatggatttgctct

SEQ ID NO: 326418 - DNA, 75 bp, Artificial Sequence
  Synthetic
gcccaacaaatagctttctcaacctctttgaaccctgccccaatgtcagatatagatttgagactattgtctcga

SEQ ID NO: 326419 - DNA, 75 bp, Artificial Sequence
  Synthetic
cagtttcaaaaccctcttatgtcaggtttaagagtcgtccaatgggctacaggagcacattataagttaaagcca

SEQ ID NO: 326420 - DNA, 75 bp, Artificial Sequence
  Synthetic
atcttggatgatttagaagtcggtccaagcttgtcactcgtagtaggagatggttcagggggaatttctaggact

SEQ ID NO: 326421 - DNA, 75 bp, Artificial Sequence
  Synthetic
gttctgaacatgtttccagactctaagttggttttcaatagccttctagaggtaaatgatttgatggcttcggga

SEQ ID NO: 326422 - DNA, 75 bp, Artificial Sequence
  Synthetic
acacatcctcttcctccttccgccttgatgagaggaggagaagatataacatcaagagtgatagactttgaatct

SEQ ID NO: 326423 - DNA, 75 bp, Artificial Sequence
  Synthetic
atatgggaaaagccttctgatttaagaaattctgtcacatggaaatattttcagtctgtccaaacaagagtgaag

SEQ ID NO: 326424 - DNA, 75 bp, Artificial Sequence
  Synthetic
gctcattttgatctaatcgtttgtgatgcagaggtaacagacattgaatctgtcaacaagatcactttgcttttg

SEQ ID NO: 326425 - DNA, 75 bp, Artificial Sequence
  Synthetic
tctgattttgcaatgtcaataagaggacccttatgtctgatcttcaagacatatggaactatgctgattaatcct

SEQ ID NO: 326426 - DNA, 75 bp, Artificial Sequence
  Synthetic
gattacaaggccatccatcacttatccagagcatttcctaacatgattgggtttgttactcagatgacatcatct

SEQ ID NO: 326427 - DNA, 75 bp, Artificial Sequence
  Synthetic
ttctcttctgaagtttatctcagattttccaaaaagggtcatttttttagagagcatgagtcactcactgcctcc

SEQ ID NO: 326428 - DNA, 75 bp, Artificial Sequence
  Synthetic
actattagagaaatgagcctggttttgttcaattgtagcaatcctaaaagtgaaatgttgagggccagatcgctg

SEQ ID NO: 326429 - DNA, 75 bp, Artificial Sequence
  Synthetic
aactatcaagatttgatcagaggattccctgaagagataatctccaatccatataacgaaatgataataacttta

SEQ ID NO: 326430 - DNA, 75 bp, Artificial Sequence
  Synthetic
attgatagtgaagtcgagtcatttcttgtccataagttggtggatgatctagagttaaaaagaggctcctcatcc

SEQ ID NO: 326431 - DNA, 75 bp, Artificial Sequence
  Synthetic
aagatggcaattattgttgcaataattatactgttttctaacagggtcttcaatgtgtcaaagtcaattaaagat

SEQ ID NO: 326432 - DNA, 75 bp, Artificial Sequence
  Synthetic
acaaaattctttcctccctcagatccgaaaattctccgacactttaacatatgtttgagcacgatgttgtttttg

SEQ ID NO: 326433 - DNA, 75 bp, Artificial Sequence
  Synthetic
tctacaactatgggggacctgtcaaacttcacaaaaattcatgagttgtataactctccagtcatatactatttt

SEQ ID NO: 326434 - DNA, 75 bp, Artificial Sequence
  Synthetic
cgaaaacagactatcaaaggcaaaaagtttctctcttggagttgggctgatcccagtagcatattcaaaaaggta

SEQ ID NO: 326435 - DNA, 75 bp, Artificial Sequence
  Synthetic
tcttgtaactcatctcttagtttatcagctcattggattagaatgatttataaaattgtcaaaactactaggttg

SEQ ID NO: 326436 - DNA, 75 bp, Artificial Sequence
  Synthetic
aactcaaatccccgagagttgttgaaagaggtagaaatttaccttaagggatacaatcgatggattacaatgaga

SEQ ID NO: 326437 - DNA, 75 bp, Artificial Sequence
  Synthetic
gatgttagatctagaacctccttgctagactattgttgtttgtaatttgaatcgttgaggattctcacctaaaag

SEQ ID NO: 326438 - DNA, 75 bp, Artificial Sequence
  Synthetic
ttcaactgacaggtcacctggactgaagaagatacaaaactagaaaaaaacatgtctaagactcacagcatgtca

SEQ ID NO: 326439 - DNA, 75 bp, Artificial Sequence
  Synthetic
aaaaacatgtctaagactcacagcatgtcactgcttgaggactcttcttttttatgttgtttttttgttaagcgt

SEQ ID NO: 326440 - DNA, 75 bp, Artificial Sequence
  Synthetic
acaaacaacatgtttttcaaagtgatattgattttcattctattcaagcagtgtgagcaaatcccattgcgtgaa

SEQ ID NO: 326441 - DNA, 75 bp, Artificial Sequence
  Synthetic
gggacaactggctctcgctgttttgctaatggcgaattagtcaaaacagtgaatgctactaatgtgccagcagaa

SEQ ID NO: 326442 - DNA, 75 bp, Artificial Sequence
  Synthetic
ctaatggcgaattagtcaaaacagtgaatgctactaatgtgccagcagaagtctgcgtcaaagatgatatatcga

SEQ ID NO: 326443 - DNA, 75 bp, Artificial Sequence
  Synthetic
taattaagtccaatggagaacattataaaaaagacaacaacattggcgctgtagttaaatactaccggctatatc

SEQ ID NO: 326444 - DNA, 75 bp, Artificial Sequence
  Synthetic
aattagataaaatataaaacaatcataagtgggcttttgctcacacaatattgcagctgaaaaaatgttgtatgt

SEQ ID NO: 326445 - DNA, 75 bp, Artificial Sequence
  Synthetic
aaataaaagattgggctacttgcaatcctattctggatacacatgggacattcatgctcttagatatagacaata

SEQ ID NO: 326446 - DNA, 75 bp, Artificial Sequence
  Synthetic
cagggatgttaattcccagaatgcatacttgccgtgtagaatgcgatataacactcaacaaagatacagcagaaa

SEQ ID NO: 326447 - DNA, 75 bp, Artificial Sequence
  Synthetic
acactcaacaaagatacagcagaaataatattaaattcatatagattaaaccattataggatatctggctcaatg

SEQ ID NO: 326448 - DNA, 75 bp, Artificial Sequence
  Synthetic
ccattataggatatctggctcaatgcatgtatcaggatggttcaagaataaaatagatattcctttagaaaatac

SEQ ID NO: 326449 - DNA, 75 bp, Artificial Sequence
  Synthetic
catgtatcaggatggttcaagaataaaatagatattcctttagaaaatacttgtgagactattgatgtcacatgt

SEQ ID NO: 326450 - DNA, 75 bp, Artificial Sequence
  Synthetic
ggtttgaaaacaatgtcatttcatgcttgcttccacacccacaaatcttgcactaggtatttcaaaggttccata

SEQ ID NO: 326451 - DNA, 75 bp, Artificial Sequence
  Synthetic
cttgcttccacacccacaaatcttgcactaggtatttcaaaggttccatattgccagaaataacaattgagtcta

SEQ ID NO: 326452 - DNA, 75 bp, Artificial Sequence
  Synthetic
cactaggtatttcaaaggttccatattgccagaaataacaattgagtctatgtgccagaatatcgaattgattat

SEQ ID NO: 326453 - DNA, 75 bp, Artificial Sequence
  Synthetic
tgtgccagaatatcgaattgattattattggctctgctatattctttggttcaatatttctaataatactaacta

SEQ ID NO: 326454 - DNA, 75 bp, Artificial Sequence
  Synthetic
tcaatatttctaataatactaactaaaacttatattgtgtatctttttataccaatattttatccatttgttaag

SEQ ID NO: 326455 - DNA, 75 bp, Artificial Sequence
  Synthetic
tcttgcagtccatcctttcacaaactgtcctacaacttgtatctgcggtatgtcatatggcaatacagaatcact

SEQ ID NO: 326456 - DNA, 75 bp, Artificial Sequence
  Synthetic
tgtcctacaacttgtatctgcggtatgtcatatggcaatacagaatcacttagattgcatagattatgcaaaact

SEQ ID NO: 326457 - DNA, 75 bp, Artificial Sequence
  Synthetic
tagattgcatagattatgcaaaacttgtgatggctataaggcattacctaaagctagaaggctatgtaaaagcaa

SEQ ID NO: 326458 - DNA, 75 bp, Artificial Sequence
  Synthetic
agtgagtaacataatactatgcacatgcagtgcgttaatattcttctcattcattactcctattaatgcagaatg

SEQ ID NO: 326459 - DNA, 75 bp, Artificial Sequence
  Synthetic
cttcactctggatatgctgcctgatgaattcagagaatgcagagaaaacacgtcaacacttgtacatgcatcgtc

SEQ ID NO: 326460 - DNA, 75 bp, Artificial Sequence
  Synthetic
cgtcaacacttgtacatgcatcgtccataaaaatttgcttattattaagtataagtgccctgtacttactcactc

SEQ ID NO: 326461 - DNA, 75 bp, Artificial Sequence
  Synthetic
caatactaattaggttttttctatatttattatatatagtttgtccattttgtggcatgttgcataagaggcatg

SEQ ID NO: 326462 - DNA, 75 bp, Artificial Sequence
  Synthetic
tttattatatatagtttgtccattttgtggcatgttgcataagaggcatggtttgaagatgtcaggagatatgac

SEQ ID NO: 326463 - DNA, 75 bp, Artificial Sequence
  Synthetic
gtttgaagatgtcaggagatatgactaattattgcctagtttgtgtctgttcaaaagataaaggtctaacgtacc

SEQ ID NO: 326464 - DNA, 75 bp, Artificial Sequence
  Synthetic
tcaaaagataaaggtctaacgtaccacaaagtttctagtaactgttatagcccagtcaaaattaagataatgtat

SEQ ID NO: 326465 - DNA, 75 bp, Artificial Sequence
  Synthetic
agaaaataaaatagattgcctgcatctaaaagaaagtgaaattggtattcagaaaatatctcaatgtattgcaat

SEQ ID NO: 326466 - DNA, 75 bp, Artificial Sequence
  Synthetic
agaaaatatctcaatgtattgcaatccatcagaattacactgagtcagctaaaagtttagaggtattgctacagg

SEQ ID NO: 326467 - DNA, 75 bp, Artificial Sequence
  Synthetic
aaaagtttagaggtattgctacaggagatgagtacagttgagcagcaggaaaaggaagaaataatatcatctgaa

SEQ ID NO: 326468 - DNA, 75 bp, Artificial Sequence
  Synthetic
tgtgcaaccaacacccacataagcatatatgtaaatgtatgtcttcttttacttattgcacatcaactttaactg

SEQ ID NO: 326469 - DNA, 75 bp, Artificial Sequence
  Synthetic
tatatgtaaatgtatgtcttcttttacttattgcacatcaactttaactgaccatgcagatgagactaagaaata

SEQ ID NO: 326470 - DNA, 75 bp, Artificial Sequence
  Synthetic
attaggatcaatgctaatagacaaaattgaaaaaagtagacgctatacagacttaatccacatcaccggcaaatt

SEQ ID NO: 326471 - DNA, 75 bp, Artificial Sequence
  Synthetic
acttaatccacatcaccggcaaattaattccaaaagcatcagaaaacacacagttgaaagggtttttagaattca

SEQ ID NO: 326472 - DNA, 75 bp, Artificial Sequence
  Synthetic
ctaataaaatgctcacatataatgtttcaatagtgtcagaagaaccagaaatcagtgccatgtcattgattaaaa

SEQ ID NO: 326473 - DNA, 75 bp, Artificial Sequence
  Synthetic
tcatgtacaggagctaaaaaggtaatatgctttagccctcggggtgtgagtcaaccatatgattatataatctgc

SEQ ID NO: 326474 - DNA, 75 bp, Artificial Sequence
  Synthetic
tcaaccatatgattatataatctgcaatgataagctatacaagtggccacaggatggtgtctataaaaataataa

SEQ ID NO: 326475 - DNA, 75 bp, Artificial Sequence
  Synthetic
gaaaatttgtaaaagctatgagataacatacaatgaagatgcatattccaattcaatagcagaatgtgttgttga

SEQ ID NO: 326476 - DNA, 75 bp, Artificial Sequence
  Synthetic
acatacaatgaagatgcatattccaattcaatagcagaatgtgttgttgagaaatttggaacttgcactgttaag

SEQ ID NO: 326477 - DNA, 75 bp, Artificial Sequence
  Synthetic
gaaatttggaacttgcactgttaagagcagcacatggtcatttgcagtatgccaaggcttatattattacacaag

SEQ ID NO: 326478 - DNA, 75 bp, Artificial Sequence
  Synthetic
agcagcacatggtcatttgcagtatgccaaggcttatattattacacaagtgctagacagcatgcaaaaacacat

SEQ ID NO: 326479 - DNA, 75 bp, Artificial Sequence
  Synthetic
gatattaccaaatattgtctgagtagtacatgccaagagcaacgatttccatttcgtagtgattattgttcaggc

SEQ ID NO: 326480 - DNA, 75 bp, Artificial Sequence
  Synthetic
atttcgtagtgattattgttcaggcacagtttgggattcaacatatcgcacaaaattaaataccagacatatatc

SEQ ID NO: 326481 - DNA, 75 bp, Artificial Sequence
  Synthetic
gcaccctgatatagaaaattatattgctgctttacaatcagatattgctaatgatctaacaatacatcatttcag

SEQ ID NO: 326482 - DNA, 75 bp, Artificial Sequence
  Synthetic
tgtaagaaattcatatatagaaagcaaattgcctgcaatatcaggattagcaactggagtggatataaaaatgcc

SEQ ID NO: 326483 - DNA, 75 bp, Artificial Sequence
  Synthetic
tgatggtaatgacttattctcattggttgtctatatcaaaaagataactgttaagtcaaactatcaatatattta

SEQ ID NO: 326484 - DNA, 75 bp, Artificial Sequence
  Synthetic
ctcgacagggccgactatatctgtgaatgttaaacacaatgaacagtgtactggcaaatgtccaacatctatacc

SEQ ID NO: 326485 - DNA, 75 bp, Artificial Sequence
  Synthetic
tcgagagaaagatctagcacatggggatgcgaagaatggggatgtatggctataaatgatggatgcgtttacggg

SEQ ID NO: 326486 - DNA, 75 bp, Artificial Sequence
  Synthetic
gatgcgaagaatggggatgtatggctataaatgatggatgcgtttacgggtcgtgtcaagatgtaattaggcctg

SEQ ID NO: 326487 - DNA, 75 bp, Artificial Sequence
  Synthetic
aactcaaaatctataagaaaataggttcagaaacaaaagaagctgaagtctgtataacaacagcacatgaaactt

SEQ ID NO: 326488 - DNA, 75 bp, Artificial Sequence
  Synthetic
ttcagaaacaaaagaagctgaagtctgtataacaacagcacatgaaactttctgcaataccgttgatgtattaca

SEQ ID NO: 326489 - DNA, 75 bp, Artificial Sequence
  Synthetic
accattgataagtcaaagaatacagttagatcttcagactgtaaccactgcaaacatgccaaatataataggggt

SEQ ID NO: 326490 - DNA, 75 bp, Artificial Sequence
  Synthetic
gaaagatgggaagatatacagtggggatataaatgacctaggaacaactgcaaagaaatgcgggtcagtacagat

SEQ ID NO: 326491 - DNA, 75 bp, Artificial Sequence
  Synthetic
gactgacaatgcagtaataggtacaggaaatgtaaaatttgattatatttgtcatgcatttaatcggaaggatat

SEQ ID NO: 326492 - DNA, 75 bp, Artificial Sequence
  Synthetic
aattgtgcggaagtgctttgacaatgcatatgaatcgtgcaaatatcttgatttaaggaatgatttactaatgca

SEQ ID NO: 326493 - DNA, 75 bp, Artificial Sequence
  Synthetic
gcatatgaatcgtgcaaatatcttgatttaaggaatgatttactaatgcaagcgacagcgaataatgaaatacat

SEQ ID NO: 326494 - DNA, 75 bp, Artificial Sequence
  Synthetic
taaaatgcggcggttgtctctcttgcccagatggcatgcattgtgcttttaaggctaccacagataaggcaactt

SEQ ID NO: 326495 - DNA, 75 bp, Artificial Sequence
  Synthetic
cccagatggcatgcattgtgcttttaaggctaccacagataaggcaactttatgtaagatagtttcaaattgcat

SEQ ID NO: 326496 - DNA, 75 bp, Artificial Sequence
  Synthetic
taatgatattgaaatttctttatgtggtttaaagttaaaagcacgaccatctataactaagcaaaatccaaagat

SEQ ID NO: 326497 - DNA, 75 bp, Artificial Sequence
  Synthetic
tagtcttgcaagtctagatgaatctacatacattgagcaacatgatgagagatgtgcaacatggttatgtagagt

SEQ ID NO: 326498 - DNA, 75 bp, Artificial Sequence
  Synthetic
aagagatgaaggtgtatcagcaatcttttctccaatatttggaggcttgtcatactattgggcaatagcaatgta

SEQ ID NO: 326499 - DNA, 75 bp, Artificial Sequence
  Synthetic
catactattgggcaatagcaatgtattcaatccttgccatattactcattgctttcctgatatttgttttagtgc

SEQ ID NO: 326500 - DNA, 75 bp, Artificial Sequence
  Synthetic
gctttcctgatatttgttttagtgccattctgcaagagaatcaaaggcgtgctagaatataacgaaagaatatat

SEQ ID NO: 326501 - DNA, 75 bp, Artificial Sequence
  Synthetic
gctagaatataacgaaagaatatatcagattgaaaataaatccaaataaattagattaaaattagctaaaatata

SEQ ID NO: 326502 - DNA, 75 bp, Artificial Sequence
  Synthetic
aattagctaaaatataaaataatcataagtgggcttttgctcacacaatattgcagctgaaaaaatgttgtatgt

SEQ ID NO: 326503 - DNA, 75 bp, Artificial Sequence
  Synthetic
cttgcttccacacccacaaatcttgcactaggtatttcaaaggttccatattgccggaaataacaattgagtcta

SEQ ID NO: 326504 - DNA, 75 bp, Artificial Sequence
  Synthetic
cttgcttccacacccacaaatcttgcactaggtatttctaaggttccatattgccggaaataacaattgagtcta

SEQ ID NO: 326505 - DNA, 75 bp, Artificial Sequence
  Synthetic
cttgcttccacacccacaaatcttgcactaggtatttccaaggttccatattgccggaaataacaattgagtcta

SEQ ID NO: 326506 - DNA, 75 bp, Artificial Sequence
  Synthetic
cttgcttccacacccacaaatcttgcactaggtatttcgaaggttccatattgccggaaataacaattgagtcta

SEQ ID NO: 326507 - DNA, 75 bp, Artificial Sequence
  Synthetic
tcattactcctatcaatgcagaatgcttcactctggatatgctgcctgatgaattcagagaatgcagagaaaaca

SEQ ID NO: 326508 - DNA, 75 bp, Artificial Sequence
  Synthetic
caatactaattaggttctttctatatctattatatatagtttgcccattttgtggcatgttgcataagagacatg

SEQ ID NO: 326509 - DNA, 75 bp, Artificial Sequence
  Synthetic
cccagtcaaaattaagataatgtatgtatggataactatcttatttctaatgaatacaactgtaacaatcgctgc

SEQ ID NO: 326510 - DNA, 75 bp, Artificial Sequence
  Synthetic
agaaaatatctcaatgtattgcaatccatcagaattacaccgagtcagctaaaagtttagaggtattgctacagg

SEQ ID NO: 326511 - DNA, 75 bp, Artificial Sequence
  Synthetic
agatgagtacagttgagcagcaggaaaaggaagaaataatatcatctgaaatcaaatgtactaacattaataaga

SEQ ID NO: 326512 - DNA, 75 bp, Artificial Sequence
  Synthetic
tcatagaatcacttacagttttagaagcacaagtgttttatgagcaaatcaagtccaaaatgtgcccatcagaag

SEQ ID NO: 326513 - DNA, 75 bp, Artificial Sequence
  Synthetic
tcaatgacattacaagattaaactctggcggcaacatccagtggaagacccttgctagaacttacactttaggat

SEQ ID NO: 326514 - DNA, 75 bp, Artificial Sequence
  Synthetic
cttgctagaacttacactttaggattgtgtaaccaacacccacataagcacatatgtaaatgtatgtcttctttt

SEQ ID NO: 326515 - DNA, 75 bp, Artificial Sequence
  Synthetic
tgtgtaaccaacacccacataagcacatatgtaaatgtatgtcttcttttacttactgcacatcaactttgactg

SEQ ID NO: 326516 - DNA, 75 bp, Artificial Sequence
  Synthetic
accatgcagacgaaactaagaaatactatactaataagataacaaattttgagcacgacattaaaataatattac

SEQ ID NO: 326517 - DNA, 75 bp, Artificial Sequence
  Synthetic
gtattgttcgatacatggtgccaggattaggatcaatgctaatagacaaaattgaaaaaagtaggcgctatacag

SEQ ID NO: 326518 - DNA, 75 bp, Artificial Sequence
  Synthetic
attaggatcaatgctaatagacaaaattgaaaaaagtaggcgctatacagatttaatccacatcaccggcaaatt

SEQ ID NO: 326519 - DNA, 75 bp, Artificial Sequence
  Synthetic
atcagtgccatgtcattgattaaaagggatggacaaacagtaaattcgaaggttcctggagttactcctatcaat

SEQ ID NO: 326520 - DNA, 75 bp, Artificial Sequence
  Synthetic
aatgataagctatataagtggccacaggatggtgtctataaaaataataaaaacaatggtgaagcatgcgcaagg

SEQ ID NO: 326521 - DNA, 75 bp, Artificial Sequence
  Synthetic
gcctacaaaaaacttacctgctatagccccttcatacattggagttactattaaaggcgataaagtatcctctgg

SEQ ID NO: 326522 - DNA, 75 bp, Artificial Sequence
  Synthetic
ttaagtcaaattatcaatatatttactcgacagggccgactatatctgtgaatgttaaacacaatgaacagtgta

SEQ ID NO: 326523 - DNA, 75 bp, Artificial Sequence
  Synthetic
aatgttaaacacaatgaacagtgtactggcaaatgtccaacatctataccagcagatacgaactggttaactttt

SEQ ID NO: 326524 - DNA, 75 bp, Artificial Sequence
  Synthetic
ctggcaaatgtccaacatctataccagcagatacgaactggttaactttttcaagagaaagatctagtacatggg

SEQ ID NO: 326525 - DNA, 75 bp, Artificial Sequence
  Synthetic
agcagatacgaactggttaactttttcaagagaaagatctagtacatggggatgcgaagaatggggatgtatggc

SEQ ID NO: 326526 - DNA, 75 bp, Artificial Sequence
  Synthetic
tataaatgatggatgcgtttacgggtcgtgtcaggatgtaattagacctgaactcaaaatctataagaaaatagg

SEQ ID NO: 326527 - DNA, 75 bp, Artificial Sequence
  Synthetic
tccggaaacaaaagaagctgaagtctgtataacaacagcacatgaaactttctgcaataccgttgatgtgttgca

SEQ ID NO: 326528 - DNA, 75 bp, Artificial Sequence
  Synthetic
gaaagatgggaagatatatagtggggatataaatgacctaggaacaactgcaaagaaatgcgggtcagtacagat

SEQ ID NO: 326529 - DNA, 75 bp, Artificial Sequence
  Synthetic
ggcgacaacgaataatgaaatacatatgaaagtatcaaatgttggaactataaattacaaagttatgttaggaga

SEQ ID NO: 326530 - DNA, 75 bp, Artificial Sequence
  Synthetic
atgaaagtatcaaatgttggaactataaattacaaagttatgttaggagattttgactatgatatgttcaaagaa

SEQ ID NO: 326531 - DNA, 75 bp, Artificial Sequence
  Synthetic
cccagatggcatgcattgtgcttttaaagctaccacagataaggcaactttatgcaagatagtatcaaattgcat

SEQ ID NO: 326532 - DNA, 75 bp, Artificial Sequence
  Synthetic
tagttttttgaacaatataattatcgatccgcaacaaagtgagtactcaataaaacttgaatgttcacaattaac

SEQ ID NO: 326533 - DNA, 75 bp, Artificial Sequence
  Synthetic
tagtcttgcaagtctagatgaatccacatacattgagcaacatgatgagagatgtgcaacatggttatgtagagt

SEQ ID NO: 326534 - DNA, 75 bp, Artificial Sequence
  Synthetic
aagagatgaaggtgtatcagcaatcttttctccaatatttggaggtttgtcatactattgggcaatagcaatgta

SEQ ID NO: 326535 - DNA, 75 bp, Artificial Sequence
  Synthetic
gctagaatataacgaaagaatatatcagattgaaaataaatccaaataagttagattaaaattagctaaaatata

SEQ ID NO: 326536 - DNA, 75 bp, Artificial Sequence
  Synthetic
aaatgctactaatgtgccagcagaagtctgcgtcaaagatgatatatcgataattaagtccaatggagaacatta

SEQ ID NO: 326537 - DNA, 75 bp, Artificial Sequence
  Synthetic
aaatagatattcctttagaaaatacttgtgagactattgatgtcacatgtggtttaaaaacagtgtcatttcatg

SEQ ID NO: 326538 - DNA, 75 bp, Artificial Sequence
  Synthetic
tcaatatttctaataatactaactaaaacttatattgtgtatctttttataccgatattctatccatttgtcaag

SEQ ID NO: 326539 - DNA, 75 bp, Artificial Sequence
  Synthetic
atatatgcaatactttacaacaggtatttcaaattatgcaaaaaatgtcttcttgcagtccatcctttcacaaac

SEQ ID NO: 326540 - DNA, 75 bp, Artificial Sequence
  Synthetic
cataaaaatttgcttattattaagtataagtgccctgtatttactcactccaatactaattaggttctttctata

SEQ ID NO: 326541 - DNA, 75 bp, Artificial Sequence
  Synthetic
taattattgcctagtttgtgtctgttcaaaagataaaggtctaacataccacaaagtttctagtaactgttatag

SEQ ID NO: 326542 - DNA, 75 bp, Artificial Sequence
  Synthetic
cccagtcaaaattaagataatgtatatatggataactatcttatttctgatgaatacaactgtaacaatcgctgc

SEQ ID NO: 326543 - DNA, 75 bp, Artificial Sequence
  Synthetic
tgaatacaactgtaacaatcgctgcagaaaataaaatagattgcctgcatctaaaagaaagtgaaattggtattc

SEQ ID NO: 326544 - DNA, 75 bp, Artificial Sequence
  Synthetic
aaaggaagaaataatatcatctgaagtcaaatgtactaacattaataagatcatagaatcacttacagttttaga

SEQ ID NO: 326545 - DNA, 75 bp, Artificial Sequence
  Synthetic
catatgtaaatgtatgtcttcttttacttactgcacatcaactttgactgaccatgcagatgaaactaaaaaata

SEQ ID NO: 326546 - DNA, 75 bp, Artificial Sequence
  Synthetic
ggttcctggagttactcctatcaattcatgtacaggagctaaaaaagtaatatgctttagccctcggggtgtgag

SEQ ID NO: 326547 - DNA, 75 bp, Artificial Sequence
  Synthetic
agcagatacgaactggttaactttttcaagagaaagatctagcacatggggatgcgaggagtggggatgtatggc

SEQ ID NO: 326548 - DNA, 75 bp, Artificial Sequence
  Synthetic
cattgtgcggaagtgctttgacaatgcatatgaatcatgcaaatatcttgatttaaggaatgatttactaatgca

SEQ ID NO: 326549 - DNA, 75 bp, Artificial Sequence
  Synthetic
agcgacaacgaataatgaaatacatatgaaagtgtcaaatgttggaactataaattacaaagttatgttaggaga

SEQ ID NO: 326550 - DNA, 75 bp, Artificial Sequence
  Synthetic
taaattacaaagttatgttaggagattttgactatgatatgtttaaagaaagtgctgcgttaacagtagatgtac

SEQ ID NO: 326551 - DNA, 75 bp, Artificial Sequence
  Synthetic
caatactaattaagttctttctatacctattatatatagtttgcccattttgtggcatgttgcataagagacatg

SEQ ID NO: 326552 - DNA, 75 bp, Artificial Sequence
  Synthetic
aatcccaaaggcatcagaaaatacacagttgaaagggtttttagaattcactaataaaatgctcacatataatgt

SEQ ID NO: 326553 - DNA, 75 bp, Artificial Sequence
  Synthetic
gttgtctatatcaaaaagataactgttaagtcaaattatcaatatatttattcaacagggccgactatatctgtg

SEQ ID NO: 326554 - DNA, 75 bp, Artificial Sequence
  Synthetic
taattaagtccaatggagaacattataaaaaagacaacaacattggtgctgtagttaaatactatcgactatatc

SEQ ID NO: 326555 - DNA, 75 bp, Artificial Sequence
  Synthetic
catatgtaaatgtatgtcttcttttacttattgcacatcaactttaactgaccatgcagatgaaactaagaaata

SEQ ID NO: 326556 - DNA, 75 bp, Artificial Sequence
  Synthetic
ctatactaataagataacaaattttgagcatgacattaaaataatattacgtattgttcgatacatggtgccagg

SEQ ID NO: 326557 - DNA, 75 bp, Artificial Sequence
  Synthetic
aaacaatggtgaagcgtgcgcaagggatacccactgcatatccatgtttgaacctgcaacacgtggaattgatag

SEQ ID NO: 326558 - DNA, 75 bp, Artificial Sequence
  Synthetic
cccagacggcatgcattgtgcttttaaggctaccacagataaggcaactttatgtaaaatagtttcaaattgcat

SEQ ID NO: 326559 - DNA, 75 bp, Artificial Sequence
  Synthetic
tcattactcctattaacgcagaatgcttcactctggatatgctgcctgatgaatttagagaatgcagagaaaata

SEQ ID NO: 326560 - DNA, 75 bp, Artificial Sequence
  Synthetic
tgaatacaactgtaacagtcgctgcagaaaataagatagattgcctgcatctaaaagaaagtgaaattagtattc

SEQ ID NO: 326561 - DNA, 75 bp, Artificial Sequence
  Synthetic
tcaatgacattacaagattaaattctggcggcaacatccagtggaagaccctcgctagaacttacactctaggat

SEQ ID NO: 326562 - DNA, 75 bp, Artificial Sequence
  Synthetic
acttaatccacatcaccggcaaattaatcccaaaagcatcagaaaacatacaattgaaagggtttttagaattca

SEQ ID NO: 326563 - DNA, 75 bp, Artificial Sequence
  Synthetic
ttcaatagtgtcagaagaaccagaaatcagtgccatgtcattgattaaaagggatggggaaacagtaaattcgaa

SEQ ID NO: 326564 - DNA, 75 bp, Artificial Sequence
  Synthetic
aatgataagctatacaagtggccacaggatggtgtctataaaaataataaaaacaatggtgaagcatgtgcaaga

SEQ ID NO: 326565 - DNA, 75 bp, Artificial Sequence
  Synthetic
gatacccactgcatatccatgtttgaacctgcaacacgtgggattgacaggaaaatttgtaaaagctatgagata

SEQ ID NO: 326566 - DNA, 75 bp, Artificial Sequence
  Synthetic
cccagacggcatgctttgtgcttttaaggctaccacagataaggcaactttatgtaagatagtttcaaattgcat

SEQ ID NO: 326567 - DNA, 75 bp, Artificial Sequence
  Synthetic
gtgtgagcaaatcccattgcgtgaagggacaactggctctcgctgctttgctaatggcgaactagtcaaaacagt

SEQ ID NO: 326568 - DNA, 75 bp, Artificial Sequence
  Synthetic
atatatgcgatactttacaacaggtatttcaaattatgcaaaaaatgtcttcttgcagttcatcctttcacaaat

SEQ ID NO: 326569 - DNA, 75 bp, Artificial Sequence
  Synthetic
cgtcaacacttgtacatgcatcgtccacaaaaatttgcttattattaagtataagtgccctgtacttactcactc

SEQ ID NO: 326570 - DNA, 75 bp, Artificial Sequence
  Synthetic
acaaagtttctagtaattgctatagcccagtcaagattaagataatgtatgtatggataactatcttatttctga

SEQ ID NO: 326571 - DNA, 75 bp, Artificial Sequence
  Synthetic
ccatcagaattataccgagtcggctaaaagtttagaggtattgctacaggagatgagtacagttgagcaacagga

SEQ ID NO: 326572 - DNA, 75 bp, Artificial Sequence
  Synthetic
tgtgtaaccaacacccacataagcacatatgtaaatgtatgtcttcttttacctactgcacatcaactttaactg

SEQ ID NO: 326573 - DNA, 75 bp, Artificial Sequence
  Synthetic
agcagcacatggtcatttgcagtatgccaaggcttatattattacacaagtgctagacagcatgcaaagacacat

SEQ ID NO: 326574 - DNA, 75 bp, Artificial Sequence
  Synthetic
ctggcaaatgtccgacatctataccagcagatttgaactggttaactttttcaagagaaagatctagcacatggg

SEQ ID NO: 326575 - DNA, 75 bp, Artificial Sequence
  Synthetic
agcagatttgaactggttaactttttcaagagaaagatctagcacatggggatgtgaagaatggggatgtatggc

SEQ ID NO: 326576 - DNA, 75 bp, Artificial Sequence
  Synthetic
caaagaaatgcgggtcagtacagatgactgataatgcagtaataggcacgggaaatgtaaaatttgattatattt

SEQ ID NO: 326577 - DNA, 75 bp, Artificial Sequence
  Synthetic
ttttgactatgatatgttcaaagaaagcgctgcgttaacagtagatgtactaaaatgcggcggttgtctctcttg

SEQ ID NO: 326578 - DNA, 75 bp, Artificial Sequence
  Synthetic
ttcactcattgccatattactcattgctttcctgctatttgttttagtgccattttgcaagagaatcaaaggcgt

SEQ ID NO: 326579 - DNA, 75 bp, Artificial Sequence
  Synthetic
agtagtgtactaccacaaacaacatgtttctcaaagtcttcataattttcgccctgtttaatacaggagtgccaa

SEQ ID NO: 326580 - DNA, 75 bp, Artificial Sequence
  Synthetic
tacctttgaaggaaggcacgactggctctcgatgctttgcaaatggagagctggtgaaaactgtcaacaccactc

SEQ ID NO: 326581 - DNA, 75 bp, Artificial Sequence
  Synthetic
taataccatctgaagtttgcgttaaagatgatatttcaataatcaagtcaaatggtgaacattacaaaaaagggg

SEQ ID NO: 326582 - DNA, 75 bp, Artificial Sequence
  Synthetic
atattttaggtgctgttatcaaatattatcgactgtatcagattaaagactgggctacttgcaatcctattcttg

SEQ ID NO: 326583 - DNA, 75 bp, Artificial Sequence
  Synthetic
ataatcatgggacgtttatgctactagatatagataatacaggaatgctaatacctaaaatgcatacatgcagag

SEQ ID NO: 326584 - DNA, 75 bp, Artificial Sequence
  Synthetic
aagagtgcgacattacattaaacaaagacactgcagaaattattttgaattcttacaggttgaaccattaccgaa

SEQ ID NO: 326585 - DNA, 75 bp, Artificial Sequence
  Synthetic
tctcaggctccatgcatatatctggatggtttaaaaacaagatagatataccattagaaaatacatgcgagacga

SEQ ID NO: 326586 - DNA, 75 bp, Artificial Sequence
  Synthetic
ttgatgtcacttgtggcctcaaaacaatgtctttccatgcttgctttcatacacataaatcatgcataagatact

SEQ ID NO: 326587 - DNA, 75 bp, Artificial Sequence
  Synthetic
ttaaaggatcaatgctgccagaaataactattgaagccatgtgtcagaatatagaattaataataattggcgcgg

SEQ ID NO: 326588 - DNA, 75 bp, Artificial Sequence
  Synthetic
ttattttctttggctctatatttctaattattttaactaaaacttatatagtatatctatttatccctatatttt

SEQ ID NO: 326589 - DNA, 75 bp, Artificial Sequence
  Synthetic
atccagtagttaaagtgtatgcaatcttgtacaacaggtattttaaactatgcaaaaagtgtctgctagcagtgc

SEQ ID NO: 326590 - DNA, 75 bp, Artificial Sequence
  Synthetic
acccattcacaaactgctctaccatttgtatctgtggcatggcatacggaaatactgaatcattacgtttgcacc

SEQ ID NO: 326591 - DNA, 75 bp, Artificial Sequence
  Synthetic
ggttgtgtaaatcttgtgatggttataaagcattacccaaagcacgaaaattatgcaaaagtaaagtgagcaata

SEQ ID NO: 326592 - DNA, 75 bp, Artificial Sequence
  Synthetic
taatcttatgtgcttgtagtgctctcattttcttctcatttataacacctataaatgctgaatgcttcacattgg

SEQ ID NO: 326593 - DNA, 75 bp, Artificial Sequence
  Synthetic
aagatctaccggatgaatttactgcttgcaaacagcaggttgaagaagataccagaatgagtaaactaagggtag

SEQ ID NO: 326594 - DNA, 75 bp, Artificial Sequence
  Synthetic
tgcttgatataataataattctattagggtgcatgacaccatttatgacaaagatattgataaaggcaatttacg

SEQ ID NO: 326595 - DNA, 75 bp, Artificial Sequence
  Synthetic
tggtatgtcctttttgtggcatgcttcataagcgacgtgggttgaaaatggcagatggcatgacaaactattgct

SEQ ID NO: 326596 - DNA, 75 bp, Artificial Sequence
  Synthetic
taatgtgtatttgctctacagataaaggcctaacttaccatagagcatcaacacggtgttacagtccgactaaga

SEQ ID NO: 326597 - DNA, 75 bp, Artificial Sequence
  Synthetic
tcaagattatttactcatggctcttaatgttattaattactaatgccctaacgatagttgatgcaaatgataaag

SEQ ID NO: 326598 - DNA, 75 bp, Artificial Sequence
  Synthetic
tagactgtacaaatctgaaagatggtgacattgctatagaaaaagtctcacaatgtatagcaatacaccaaaatt

SEQ ID NO: 326599 - DNA, 75 bp, Artificial Sequence
  Synthetic
atacagaggcagctaaaaatttagaagatatattgaatgaatattctatagttgaccagcaagaaaaggcagaaa

SEQ ID NO: 326600 - DNA, 75 bp, Artificial Sequence
  Synthetic
ttaaaaatgctaatatcaattgcaaaaccatcaataaggcaatagaaggtctaagtgttttagagacacaagcct

SEQ ID NO: 326601 - DNA, 75 bp, Artificial Sequence
  Synthetic
tttatgagcaagtgaaatcaaaaatgtgcccaattgatgtaaatgatataacaaagcctaactctgcctcaaact

SEQ ID NO: 326602 - DNA, 75 bp, Artificial Sequence
  Synthetic
tgcagtggaaaactttagctagaacatatacattagcactatgcaatgaacatccacataagcatatctgcaaat

SEQ ID NO: 326603 - DNA, 75 bp, Artificial Sequence
  Synthetic
gtatgtctgcttttacatattgtacatctactaatacggatcatggaggcgaaatgaggaaattttatgaacaca

SEQ ID NO: 326604 - DNA, 75 bp, Artificial Sequence
  Synthetic
aaattgacaactttgagcacgatgtaaagatagtcttgagaataattaaatatatggttcctgggttaggatcaa

SEQ ID NO: 326605 - DNA, 75 bp, Artificial Sequence
  Synthetic
cactactccaaaaaatagaagaaagcaggaaatattcagaactggtacatatagtgggaaaattgcttccaaagg

SEQ ID NO: 326606 - DNA, 75 bp, Artificial Sequence
  Synthetic
cagagaaaaatatccaaatgaagggagttttgcaatttgcaacacaacttctaacatataacgtcagtatagtat

SEQ ID NO: 326607 - DNA, 75 bp, Artificial Sequence
  Synthetic
cagaaactccaaacatagttgctatgtctttgattaaaagcgaaggacaaagtgtcacaggtaaattaccaggga

SEQ ID NO: 326608 - DNA, 75 bp, Artificial Sequence
  Synthetic
cagcaccacttaatatatgtactaatagcaaaaaagtaatttgctttagcccaagaggtataagtcaaccttatg

SEQ ID NO: 326609 - DNA, 75 bp, Artificial Sequence
  Synthetic
attacattatgtgtgaggataaactatataagtggccacaggatggtgtttataggcataacaaaaatagtggag

SEQ ID NO: 326610 - DNA, 75 bp, Artificial Sequence
  Synthetic
aagcatgtgccagggatacacactgtatatcaacgtttgaaccagcaacacgtggcgttgaacgcagaatatgcg

SEQ ID NO: 326611 - DNA, 75 bp, Artificial Sequence
  Synthetic
agagctatgaaactacatatgctgatgatatttattcaaatgccatcagcgagtgcatagttacaaaatttggca

SEQ ID NO: 326612 - DNA, 75 bp, Artificial Sequence
  Synthetic
cctgtactgtcaaatcaagtacatggcctttcgcagtttgtcaaggtgtatattattacacaagtgctcgtcaac

SEQ ID NO: 326613 - DNA, 75 bp, Artificial Sequence
  Synthetic
attcaaagactcacgacattacaaaatattgtttgagcagtacatgcaaagaaaaaagatatccatttcgaagcg

SEQ ID NO: 326614 - DNA, 75 bp, Artificial Sequence
  Synthetic
attattgttcgaatacagtgtgggactccacttacagaactaaactaaatatgaagcatatctctcatccggata

SEQ ID NO: 326615 - DNA, 75 bp, Artificial Sequence
  Synthetic
tagaaaattatatttcagcattgcagtctgatatagcaaatgatttgacaacacatcactttagacccactaaaa

SEQ ID NO: 326616 - DNA, 75 bp, Artificial Sequence
  Synthetic
atttgccttccattgcgcccacatataatggcataacaatacaaggagataagatctcctctggcattagaaatg

SEQ ID NO: 326617 - DNA, 75 bp, Artificial Sequence
  Synthetic
catttattgaaggcaaattgccagctatagctggtctggcatctggtcttgatgttcatatgcctgatggcacaa

SEQ ID NO: 326618 - DNA, 75 bp, Artificial Sequence
  Synthetic
atttattttctatcataatctatgttaagaagatatctataaaatcaaattaccaatatatctactcaacgggac

SEQ ID NO: 326619 - DNA, 75 bp, Artificial Sequence
  Synthetic
caactgtgtcaatcaatgttaaacataatgaatactgcacaggtaaatgcccagaatcaatccctagcgatctca

SEQ ID NO: 326620 - DNA, 75 bp, Artificial Sequence
  Synthetic
actggctcacattctctagagagcactctagttcctggggttgtgaagaatggggttgtatagctataaatgaag

SEQ ID NO: 326621 - DNA, 75 bp, Artificial Sequence
  Synthetic
gatgcgttttcggttcttgtcaagatgtaattaaaccagaaatgaaagtttacaagagaataggatctgaaacta

SEQ ID NO: 326622 - DNA, 75 bp, Artificial Sequence
  Synthetic
aagaggtggaggtttgcattaccactgctcatgaaacattttgtaataacgtagatgtgttacagccattaatca

SEQ ID NO: 326623 - DNA, 75 bp, Artificial Sequence
  Synthetic
gccagcggattcagctagatttacaaagtatcacaacaacaaacatgccaccgattattgcagtcaaaaatggca

SEQ ID NO: 326624 - DNA, 75 bp, Artificial Sequence
  Synthetic
aaatctacacgggggatataaatgatttgggtgtgacggcaaaaaaatgcggatcagtgcagagtacagataacg

SEQ ID NO: 326625 - DNA, 75 bp, Artificial Sequence
  Synthetic
gtattctcggatctggaaacgtgaagtttgactatatatgccatgcttttaatagaaaagatattatagttcgca

SEQ ID NO: 326626 - DNA, 75 bp, Artificial Sequence
  Synthetic
gatgttacgaaaacgcatatgaatcatgcaaatttttggatatgcgtgaagatttagcaatgatgtctggcatga

SEQ ID NO: 326627 - DNA, 75 bp, Artificial Sequence
  Synthetic
gcaatgaagtacatatgaaaatttcaaatgttggaactattagttataaaattatgctaggggattttgattatg

SEQ ID NO: 326628 - DNA, 75 bp, Artificial Sequence
  Synthetic
acttatttacagagcatgcatctctaaacctagatgcattaaaatgtgggggatgcaaatcttgccctgatggca

SEQ ID NO: 326629 - DNA, 75 bp, Artificial Sequence
  Synthetic
tgcactgttcatttaaggcaaacaccgataaaatagtattgtgtaaaatagtctcaaattgtgttagctttctaa

SEQ ID NO: 326630 - DNA, 75 bp, Artificial Sequence
  Synthetic
acaatataattatagacccagagcaaaatgattattcacttaaacttgactgttctgaattgatttcagacattg

SEQ ID NO: 326631 - DNA, 75 bp, Artificial Sequence
  Synthetic
aaattaatatatgcaatgctaaattaaaagcaagacctacattaattaaacaagtaccaaaaattagcttagcta

SEQ ID NO: 326632 - DNA, 75 bp, Artificial Sequence
  Synthetic
gcatagatgaatccacatacatagaacagcatgatgatagatgcagcacatggctgtgcagagttagagatgaag

SEQ ID NO: 326633 - DNA, 75 bp, Artificial Sequence
  Synthetic
gcataaatgcaatattatcacctatcttcggaaagttatcctactattggatggtcacaatatatacagtccttg

SEQ ID NO: 326634 - DNA, 75 bp, Artificial Sequence
  Synthetic
caataatatctttaataatactactatatgtattaataccattttgcaaacgaataaaaggtatattagagtaca

SEQ ID NO: 326635 - DNA, 75 bp, Artificial Sequence
  Synthetic
acgagagagtctatcaaatagaaaacaaatttaaataattagataatatgtaacataaattatcttaataaaata

SEQ ID NO: 326636 - DNA, 75 bp, Artificial Sequence
  Synthetic
aacaaaaagcaaaggatgggcatttgctcatcctataattcagctgagaaaatattgtatgtggtagcacactac

SEQ ID NO: 326637 - DNA, 75 bp, Artificial Sequence
  Synthetic
acaaaaagcaaaggatgggcatttgctcatcctataattcagctgagaaaatattgtatgtggtagcacactact

SEQ ID NO: 326638 - DNA, 75 bp, Artificial Sequence
  Synthetic
agtagtgtactccactatagaacaaagcttttaaatggcaaaccagtttattttccaagatgttcctcaacggaa

SEQ ID NO: 326639 - DNA, 75 bp, Artificial Sequence
  Synthetic
agcttttaaatggcaaaccagtttattttccaagatgttcctcaacggaatctcgctacgtttaacccggaggtc

SEQ ID NO: 326640 - DNA, 75 bp, Artificial Sequence
  Synthetic
gggtatgtggcatttattgctaaacatggggcccaactcaatttcgataccgttagagtcttcttcctcaatcag

SEQ ID NO: 326641 - DNA, 75 bp, Artificial Sequence
  Synthetic
agacggcacaaccgagtgttgatcttacatttggtggcatcaaatttacattggttaataaccattttccccaat

SEQ ID NO: 326642 - DNA, 75 bp, Artificial Sequence
  Synthetic
acacagcaaatcctgtgccagacactgccctcactctccaccgtctctcaggatatctagcaaaatgggttgcag

SEQ ID NO: 326643 - DNA, 75 bp, Artificial Sequence
  Synthetic
atcaatgcaaaacaaatcaaatcaaattggcagaggccatggaaaaaatagtcatgccacttgctgaagtaaaag

SEQ ID NO: 326644 - DNA, 75 bp, Artificial Sequence
  Synthetic
gttgtacctggactgaggggttgaccatgtatctgggattcgcaccaggtgctgaaatgttcctggaaacattcg

SEQ ID NO: 326645 - DNA, 75 bp, Artificial Sequence
  Synthetic
aattctatcctctggtcattgatatgcacagagtgctaaaagatgggatggatgtcaacttcatgcgaaaggtac

SEQ ID NO: 326646 - DNA, 75 bp, Artificial Sequence
  Synthetic
aattctatcctctggtcattgatatgcacagagtgctaaaagatgggatggatgtcaacttcatgcgaaaggttc

SEQ ID NO: 326647 - DNA, 75 bp, Artificial Sequence
  Synthetic
aattctatcctctggtcattgatatgcacagagtgctaaaagatgggatggatgtcaacttcatgcgaaaggtcc

SEQ ID NO: 326648 - DNA, 75 bp, Artificial Sequence
  Synthetic
aattctatcctctggtcattgatatgcacagagtgctaaaagatgggatggatgtcaacttcatgcgaaaggtgc

SEQ ID NO: 326649 - DNA, 75 bp, Artificial Sequence
  Synthetic
ttcgccaacgctatgggacattgactgcagaacaatggatgactcaaaaaatagatgctgtccgtgcagcattca

SEQ ID NO: 326650 - DNA, 75 bp, Artificial Sequence
  Synthetic
atgctgttgggcagctaagctgggccaaatcaggattctcaccagctgccagaactttccttgcccaattcggta

SEQ ID NO: 326651 - DNA, 75 bp, Artificial Sequence
  Synthetic
taaacatctaaattctcaaaacaatcccacccctttcccccagtatggtgttccaaaacaccatacgccatttct

SEQ ID NO: 326652 - DNA, 75 bp, Artificial Sequence
  Synthetic
tccaaaacaccatacgccatttctgcagcattgttcattcatctctattaattgttctatgtggagcacactact

SEQ ID NO: 326653 - DNA, 75 bp, Artificial Sequence
  Synthetic
agtagtgtacccctagagaaaacaattcaaaatggatccttaccgtatcgatatgttccgcaatagaatccttgc

SEQ ID NO: 326654 - DNA, 75 bp, Artificial Sequence
  Synthetic
atccaacgatcctgaagatgcaaaggatattatgtcagatctattgatggaacgccataactactttggcagaga

SEQ ID NO: 326655 - DNA, 75 bp, Artificial Sequence
  Synthetic
agtgtgtcaatacctagacatcgaatttagaaatgatacacctgctcaagatatacttcttgaattcctgcctcc

SEQ ID NO: 326656 - DNA, 75 bp, Artificial Sequence
  Synthetic
agggactgttttcaatgtgagaaactgcagcccggataattatgttatcttaaatggaaaattatatatcataga

SEQ ID NO: 326657 - DNA, 75 bp, Artificial Sequence
  Synthetic
ctataaagtctctgttgatgctggctatggattgtcaacaaagacaaaatatgaggaaatatttggtgatgcttt

SEQ ID NO: 326658 - DNA, 75 bp, Artificial Sequence
  Synthetic
gtctccctttggtctcgattttgaggttgttataatcagagcagatcctattcgagaaatggtgcatattgacag

SEQ ID NO: 326659 - DNA, 75 bp, Artificial Sequence
  Synthetic
tcaagacttcataaatgcttttggaaacatctacattgatctagattttacatggttcttcaatctgcgtgcgtt

SEQ ID NO: 326660 - DNA, 75 bp, Artificial Sequence
  Synthetic
actttatgataaatttaaagataatgaccgatttttagaaattgtcaaccaaggcgaatttacaatgacttcacc

SEQ ID NO: 326661 - DNA, 75 bp, Artificial Sequence
  Synthetic
atggatagaagaaaatacaccagagttatatactcatcctatattcaaagagttttacaactcacttaatgatga

SEQ ID NO: 326662 - DNA, 75 bp, Artificial Sequence
  Synthetic
agaaaaaaatacatttaataccagcttagaatttgacgctactaaatctgagaaatggaatcaaaacctgattgc

SEQ ID NO: 326663 - DNA, 75 bp, Artificial Sequence
  Synthetic
agtaatccaaaagtatgagccattttacaagaaattttgcaacattgcagcatcaggagtttttaaatgcacagg

SEQ ID NO: 326664 - DNA, 75 bp, Artificial Sequence
  Synthetic
tgattatccagcacctagtaaggatcaaatatcaaagggatgggaagatatgtatgagagagtcaagcttgagag

SEQ ID NO: 326665 - DNA, 75 bp, Artificial Sequence
  Synthetic
agatttaactgatgacttatctaaacagaagccaagtttccacttcatatggtcgcctcctgatgctgagagacc

SEQ ID NO: 326666 - DNA, 75 bp, Artificial Sequence
  Synthetic
aaatgaaaatatttcaaagatattgacattggcaaaggcgcttcagaagatacaaggtgactccactttcattaa

SEQ ID NO: 326667 - DNA, 75 bp, Artificial Sequence
  Synthetic
tgggtttagatcattgggtttgttaatggatttctcatctaatatcggcttgtatgaatcgcatgttagcaagct

SEQ ID NO: 326668 - DNA, 75 bp, Artificial Sequence
  Synthetic
taaaaatacagcacggcagacttctaaaaaaatagaccaaaagttagaagaagtagaaattgggagtgcaactgt

SEQ ID NO: 326669 - DNA, 75 bp, Artificial Sequence
  Synthetic
cttatgggagcagcaattcaaatttaatacaaaaataatgaatgctcaagacaagtcacatctatttaaagattt

SEQ ID NO: 326670 - DNA, 75 bp, Artificial Sequence
  Synthetic
ccttggaattggtggccacaaatcatttgggaaaaaatcaattgatgacttggatatagagaagcctaagatatt

SEQ ID NO: 326671 - DNA, 75 bp, Artificial Sequence
  Synthetic
ggatttcaattcaaaaaacgtccaagatgcgtgtaatagaatttatcgacaagtcaaaaatgtcctatctaacac

SEQ ID NO: 326672 - DNA, 75 bp, Artificial Sequence
  Synthetic
taattccttgaaaaaaatgggctgttatttagaagaatacggatataatatatcaaacgcttccccagacatatg

SEQ ID NO: 326673 - DNA, 75 bp, Artificial Sequence
  Synthetic
ggagagagtccaagaagtatgttctacaaattattgggctgcaatcttagattattcaactctgatgaaaaatat

SEQ ID NO: 326674 - DNA, 75 bp, Artificial Sequence
  Synthetic
gttagctgcatcccaatataatcgccataatacatttagggttgtcacatgtgcaaacaacaacctctacgggat

SEQ ID NO: 326675 - DNA, 75 bp, Artificial Sequence
  Synthetic
agttatgccttcctcagatatcaagacaaaaagatcaactctttgctattttgtaatagctctacatgacgggaa

SEQ ID NO: 326676 - DNA, 75 bp, Artificial Sequence
  Synthetic
agaggacgttgtgcattctggatcaatacattcaactttccaatcaggatctaagtttgtatcaatctcaaaggg

SEQ ID NO: 326677 - DNA, 75 bp, Artificial Sequence
  Synthetic
ttttagactagataaagagcgatgtcaaaggattgtatcatcaccaggcttattcttaatgacatcttgcttatt

SEQ ID NO: 326678 - DNA, 75 bp, Artificial Sequence
  Synthetic
cttatccgacaacaaatcattgaatacaaatgatgtcttaaactttagtttccacacatctgtttcaataacaaa

SEQ ID NO: 326679 - DNA, 75 bp, Artificial Sequence
  Synthetic
ggcaatgttatcgctaactgagccttctagatatatgattatgaattcacttgcaatctcaagtcatgtgcgtga

SEQ ID NO: 326680 - DNA, 75 bp, Artificial Sequence
  Synthetic
gtatatggctgaaaagtttagcccatacacaaagactgcattttctgttgttatgacacagatcattaagcgtgc

SEQ ID NO: 326681 - DNA, 75 bp, Artificial Sequence
  Synthetic
atgttatgaggcatttgaccagaaagaaaagatagagctaaaaaatatacatctgacagattatgagataacaca

SEQ ID NO: 326682 - DNA, 75 bp, Artificial Sequence
  Synthetic
aaaaggtgtgaaaccacagagagaccttaaatctatatggttcccagggcgtgtaaatttgaaggaatatatcaa

SEQ ID NO: 326683 - DNA, 75 bp, Artificial Sequence
  Synthetic
tcaggtatacatgccattttatttcaactctaaaggtttgcatgaaaaacaccatgttatgattgacctagctaa

SEQ ID NO: 326684 - DNA, 75 bp, Artificial Sequence
  Synthetic
aactatattagaaattgagaaagatcaacggttgaacatacctgggatctggtcagatattccaaagaagcaaac

SEQ ID NO: 326685 - DNA, 75 bp, Artificial Sequence
  Synthetic
agtcaacattagggttttgatttattcacttgctaaaacattgaacatggacacatcgagacataattatatacg

SEQ ID NO: 326686 - DNA, 75 bp, Artificial Sequence
  Synthetic
ttctcgtatagaaaacaacaacaacttaaaacgatccataacaactatatctacattcaccagttcaaaatcatg

SEQ ID NO: 326687 - DNA, 75 bp, Artificial Sequence
  Synthetic
cattaagattggagattttagcgaatttaaaaatcgtaaagaaaaaaagataataggtaatataaaaaaagaaat

SEQ ID NO: 326688 - DNA, 75 bp, Artificial Sequence
  Synthetic
aagcaagtatacagttgcaaatccagagtttgcagaagatttagatgtgtcttgtgctatacaccatgccgatta

SEQ ID NO: 326689 - DNA, 75 bp, Artificial Sequence
  Synthetic
tgcagatgtgcgtaaggctataccaaattattcagattgcatatcaacaaaggtctttgatgcattatatgaaaa

SEQ ID NO: 326690 - DNA, 75 bp, Artificial Sequence
  Synthetic
gataaaaaatggagaaattgatgataaaccaacagtatcacatatatttgaagtaatgaggaaacataaacaatt

SEQ ID NO: 326691 - DNA, 75 bp, Artificial Sequence
  Synthetic
ttacttcagtttctttaacaaaggtcaaaaaacagcaaaagacagagagatttttgttggagaatttgaagcaaa

SEQ ID NO: 326692 - DNA, 75 bp, Artificial Sequence
  Synthetic
gatgtgcttatatttagttgaaaggatctccaaagagcgttgccgccttaatccagaagagatgatcagtgaacc

SEQ ID NO: 326693 - DNA, 75 bp, Artificial Sequence
  Synthetic
aggagattctaaattgaaaaaattagaggatttggcagaagcagaaattcgatacacagcccaaacactaaagaa

SEQ ID NO: 326694 - DNA, 75 bp, Artificial Sequence
  Synthetic
tttgaaccgtaaaatacaaaaagatatgtttggatcagagattgatgttgatatgaagttgcatgcactgaaaat

SEQ ID NO: 326695 - DNA, 75 bp, Artificial Sequence
  Synthetic
agaaataaatgctgatatgtcaaaatggagtgctcaggatgttttatacaagtatttttggctttttgctttaga

SEQ ID NO: 326696 - DNA, 75 bp, Artificial Sequence
  Synthetic
tcctgttttgtacaaatgcgaaaaagagaggatcttgtatttcttatgtaactatatgcaaaaaagacttatcct

SEQ ID NO: 326697 - DNA, 75 bp, Artificial Sequence
  Synthetic
accagacgatttaattgcaaatattctagatcagagagttcagcgccaagatgacatcatatatgaaatgagtaa

SEQ ID NO: 326698 - DNA, 75 bp, Artificial Sequence
  Synthetic
tggtcttactcaaaattgggttgaaatcaagagaaactggctccaagggaatttaaactacactagtagttatct

SEQ ID NO: 326699 - DNA, 75 bp, Artificial Sequence
  Synthetic
acacacatgctcaatgaatgtttataaagatgtaattaaaagatctattgatttgcttgaaggagagacacttgt

SEQ ID NO: 326700 - DNA, 75 bp, Artificial Sequence
  Synthetic
caactcaatggtgcattcagatgacaaccatacatcattagtcatagtgcagaataaattaaatgataatatttt

SEQ ID NO: 326701 - DNA, 75 bp, Artificial Sequence
  Synthetic
aattgaattttctataaagttgtttgaaaagatatgcttaacatttggcaaccaagcaaacatgaagaaaacata

SEQ ID NO: 326702 - DNA, 75 bp, Artificial Sequence
  Synthetic
tctaacaaattttattaaagaatttgtatcgttatttaatatatacggtgaacccttttcagtatatggtcgctt

SEQ ID NO: 326703 - DNA, 75 bp, Artificial Sequence
  Synthetic
tctgctgacagctgtcggtgactgtgcctatctagggccttatgaagattgtgctagtagattgtcagcaacaca

SEQ ID NO: 326704 - DNA, 75 bp, Artificial Sequence
  Synthetic
aactgcaataaaacatggctgcccgccatcacttgcatggatcagtatagcattaaaccaatggatcacacacaa

SEQ ID NO: 326705 - DNA, 75 bp, Artificial Sequence
  Synthetic
cacttataacatgcttccaggccaaaacaatgacccatgtaacatattgccttgctacaatagattcgaggtccc

SEQ ID NO: 326706 - DNA, 75 bp, Artificial Sequence
  Synthetic
tattgaattgtgtgggctattaaattgttccttaccgagcattgcaatagcaggtttagaagcagataatctcga

SEQ ID NO: 326707 - DNA, 75 bp, Artificial Sequence
  Synthetic
atttttagtcaggacatcacgaaagctatctcccataatgtatcaacgagagccaatacaatcgcagtatgatca

SEQ ID NO: 326708 - DNA, 75 bp, Artificial Sequence
  Synthetic
cattttagactgggatttgaaccaattaaccgaaatagaagcaattagattcaaaatgctgaggtttatggcctt

SEQ ID NO: 326709 - DNA, 75 bp, Artificial Sequence
  Synthetic
ggactcttctatgtcatcagatgacggaatgggtgagacaagcgatatgcgatcaagatctttgctcaccccaag

SEQ ID NO: 326710 - DNA, 75 bp, Artificial Sequence
  Synthetic
gaaattcacaacacaagcatcactatcaagattaacatcttacaatgactatcaacaaattatacaggatcagac

SEQ ID NO: 326711 - DNA, 75 bp, Artificial Sequence
  Synthetic
taaagttgacgagttgttaggctatttcatacaatatccccaactgttggtcacaaagggagaaaatgtagagga

SEQ ID NO: 326712 - DNA, 75 bp, Artificial Sequence
  Synthetic
attttgccagtctataagattcagatatactagccggaagtttaaagaatcactatcaatacaaaatcctgcaca

SEQ ID NO: 326713 - DNA, 75 bp, Artificial Sequence
  Synthetic
attatttatagaacagatattatttgcaaacaagccaatgattgattatactagtattcatgataaattatttgg

SEQ ID NO: 326714 - DNA, 75 bp, Artificial Sequence
  Synthetic
cattcaagatgatcctaacatatcagatactacatgcattattggaaagaaaaccttcccagaaacctataatca

SEQ ID NO: 326715 - DNA, 75 bp, Artificial Sequence
  Synthetic
gattaaatgcgatttagaaagattcacattaacaaatgctgatatcaagacagtttatagttattgcttgatgaa

SEQ ID NO: 326716 - DNA, 75 bp, Artificial Sequence
  Synthetic
tgatcctatattgatagcatgtgcaaataatataatattatccatgaaaggcatgactatagataggtcagctat

SEQ ID NO: 326717 - DNA, 75 bp, Artificial Sequence
  Synthetic
gacatgtgcacaaatgcctgagattaaaagccttaaagtaatttaccatagtccagctttagttttgagggcata

SEQ ID NO: 326718 - DNA, 75 bp, Artificial Sequence
  Synthetic
tgtaactggtgacatgaccatacgaggagcagagcctgatgaaatgaggagagatatatatcatcttgaggactt

SEQ ID NO: 326719 - DNA, 75 bp, Artificial Sequence
  Synthetic
tatagaaaagacaaacatacggaataagatgagagaaagaattaacaagaatgaaataaggtctaatggaagaaa

SEQ ID NO: 326720 - DNA, 75 bp, Artificial Sequence
  Synthetic
tattaaatttgagatcaaagagctaactaagtattatcaaatatgctacgattatattaaatctactgagcataa

SEQ ID NO: 326721 - DNA, 75 bp, Artificial Sequence
  Synthetic
aataaaaatattcattttgccaaaaagaccagctaccccttctgacttctgctctatagtagctggtaatctaat

SEQ ID NO: 326722 - DNA, 75 bp, Artificial Sequence
  Synthetic
gctagacaacaaatgggttacaatacaccatctaaaacagataacttcacaaacaaaaaaagcagaaatagcaac

SEQ ID NO: 326723 - DNA, 75 bp, Artificial Sequence
  Synthetic
ttcaacagatttagagctgcaactgtcgtatgaatgtttgcgcctggtagcacattttgctgattcttttctggc

SEQ ID NO: 326724 - DNA, 75 bp, Artificial Sequence
  Synthetic
agataattctagaaaacagttcctaaagagggtaattgaagaattctcttataaaggagttcctgtcaaagagtt

SEQ ID NO: 326725 - DNA, 75 bp, Artificial Sequence
  Synthetic
gtatggtaaaataaaacattcaagattaaggtcaaagatagttcctatactatattatatggacgatttagatca

SEQ ID NO: 326726 - DNA, 75 bp, Artificial Sequence
  Synthetic
attagatttggatagatatgatgctgaaaaagcagaagagcagattacatggaataattggcagacatcaagaga

SEQ ID NO: 326727 - DNA, 75 bp, Artificial Sequence
  Synthetic
atttcagactggaccaatagatttatcaattaaaggctatggacgtagcatccgaatcattgggaataattctag

SEQ ID NO: 326728 - DNA, 75 bp, Artificial Sequence
  Synthetic
gttgactgcagcagaacttcaaataagtaggatacgtgatgacataatttctagacacagtcaagcattgctaaa

SEQ ID NO: 326729 - DNA, 75 bp, Artificial Sequence
  Synthetic
taagaatcatgggttgaaatttgaacttatggaagaatacaaagaccttgatcctaggttgttttatatatgtta

SEQ ID NO: 326730 - DNA, 75 bp, Artificial Sequence
  Synthetic
ccaacttagggctaagaaaagatatcactacaacatactgtcggtctcacatatactagaccacaatagacgcat

SEQ ID NO: 326731 - DNA, 75 bp, Artificial Sequence
  Synthetic
acaggagtctaaaataagatctaccaattattgggtgccagtctgcccagtagcaatttctaagctaacatataa

SEQ ID NO: 326732 - DNA, 75 bp, Artificial Sequence
  Synthetic
tgacaaacctcaattaggattgatcaagaggttaaatatggataatacaaaattgacatcaatacaggtagcagt

SEQ ID NO: 326733 - DNA, 75 bp, Artificial Sequence
  Synthetic
tgaagactatgcaatggttagaaaatgcaactttgctaagatgcaattctttgacggaccagaattaccatgtgg

SEQ ID NO: 326734 - DNA, 75 bp, Artificial Sequence
  Synthetic
tggaatagatatttcaaagatgatgaaatcccagaatattctgaacttacaagtagatactttacaaagtatatc

SEQ ID NO: 326735 - DNA, 75 bp, Artificial Sequence
  Synthetic
ccttattgaattgtgtcggatctttaactgtaaaggtactaaggatgataataatgcttttgaattcttgtctga

SEQ ID NO: 326736 - DNA, 75 bp, Artificial Sequence
  Synthetic
tgaaattcttgatgaggaagtagatgaagagcttgattcctccccagctttgaagataacatacacaaaaaagtc

SEQ ID NO: 326737 - DNA, 75 bp, Artificial Sequence
  Synthetic
aataaaaaataatacatacaaaaacacaatagtaaaagcactaatacgtgaatgcgacaaatttgaggaatgctt

SEQ ID NO: 326738 - DNA, 75 bp, Artificial Sequence
  Synthetic
tgacataactgacgaaggctttacatcagatagcaatctggaaattttggaatctttagtctggattttgagaga

SEQ ID NO: 326739 - DNA, 75 bp, Artificial Sequence
  Synthetic
gttacatactaatcaatggtcgacagaattaatgcaatgcattcatatgacactgtatagaaacgagatggatca

SEQ ID NO: 326740 - DNA, 75 bp, Artificial Sequence
  Synthetic
tctgttccatagattttccattcctgaacaatttgtagataacccaatatcattgaattataagtggtcaaatgt

SEQ ID NO: 326741 - DNA, 75 bp, Artificial Sequence
  Synthetic
gatagaattcttggtgacattaatgcagatagattataagcaagaaccgtgggtttcaattatggcacattcatt

SEQ ID NO: 326742 - DNA, 75 bp, Artificial Sequence
  Synthetic
aaacaaagctgttgaatatgcaactgaaaggaagatacaggaatcaaccaaagagaacaaattgcagaagtttat

SEQ ID NO: 326743 - DNA, 75 bp, Artificial Sequence
  Synthetic
caaagggaagaaaatgggtgggaggtctaagtttgatttctaatgtaagatttagcacttagtctaagcaacata

SEQ ID NO: 326744 - DNA, 75 bp, Artificial Sequence
  Synthetic
ctatacttctaaaatcacgcttcttaatatacaattaatcatttaaatatctttaaataaattgtgtctctaggg

SEQ ID NO: 326745 - DNA, 75 bp, Artificial Sequence
  Synthetic
aaaatcacgcttcttaatatacaattaatcatttaaatatctttaaataaattgtgtctctaggggcacactact

SEQ ID NO: 326746 - DNA, 75 bp, Artificial Sequence
  Synthetic
acaaacaacatgtttttcaaagtgatattgatttttacgctgttcaagcagtatgggcaaatcccactgcgtgaa

SEQ ID NO: 326747 - DNA, 75 bp, Artificial Sequence
  Synthetic
gggacaactggttctcgatgttttgccaatggagaattggttaagacaataaataccactgctgtacctgctgag

SEQ ID NO: 326748 - DNA, 75 bp, Artificial Sequence
  Synthetic
gtctgtgtgaaagatgatatatctataattaaatcaaatggagagcattataagaaagataatggtattggtgct

SEQ ID NO: 326749 - DNA, 75 bp, Artificial Sequence
  Synthetic
gtgataaaatattatcggctataccaagttaaagactgggcaacttgtaaccccattttagacgcacatggaacg

SEQ ID NO: 326750 - DNA, 75 bp, Artificial Sequence
  Synthetic
tttatgctactagatatagataatacaggaatgttaatacctaaaatgcatacttgccgcgtagaatgtgatgtt

SEQ ID NO: 326751 - DNA, 75 bp, Artificial Sequence
  Synthetic
acccttaataaggatacagcagagataatcttaaattcatatagattgaaccactataggatatctggttccatg

SEQ ID NO: 326752 - DNA, 75 bp, Artificial Sequence
  Synthetic
catgtttctggatggtttaaaaataaaattgatatccccctagaaaatacatgtgagactattgatgttacatgc

SEQ ID NO: 326753 - DNA, 75 bp, Artificial Sequence
  Synthetic
ggtttaaaaacaatgtcatttcatgcttgcttccatactcataagtcctgcatcaggtattttaagggatccata

SEQ ID NO: 326754 - DNA, 75 bp, Artificial Sequence
  Synthetic
ctcccagagatgacaattgaatctatgtgtcagaatattgagttaattatcattggctcagcaatattttttggt

SEQ ID NO: 326755 - DNA, 75 bp, Artificial Sequence
  Synthetic
tctatatttttaataatactgactagaacttatattgtgtatctttttataccaatattttatccatttgtcaaa

SEQ ID NO: 326756 - DNA, 75 bp, Artificial Sequence
  Synthetic
atatatgctatgctctacaatagatattttaaattgtgcaagaaatgcctccttgcagttcatccttttactaat

SEQ ID NO: 326757 - DNA, 75 bp, Artificial Sequence
  Synthetic
tgccccacaacttgcatctgcggtatgtcttatggcaatacagaatcgctaagattgcataggctatgtaagaca

SEQ ID NO: 326758 - DNA, 75 bp, Artificial Sequence
  Synthetic
tgtgatggttacaaagcacttcctagagcaagaagattatgtaaaagcaaagtgagtaacataatactatgcaca

SEQ ID NO: 326759 - DNA, 75 bp, Artificial Sequence
  Synthetic
tgcagtgcattaatatttttctcatttatcacacctattaatggtgaatgttttgatttagaagtattgcctaat

SEQ ID NO: 326760 - DNA, 75 bp, Artificial Sequence
  Synthetic
gaatttagacgatgtaaagaaactgcatcagcacttatgcatgcatctactgttaaaaattgcttactattaagc

SEQ ID NO: 326761 - DNA, 75 bp, Artificial Sequence
  Synthetic
ttaagtcttttatatctattaacaccactagtaaccaggtttttcttgtatgtattatacattatatgcccattt

SEQ ID NO: 326762 - DNA, 75 bp, Artificial Sequence
  Synthetic
tgcggtatgttacataaaagatatggactgaaaatgtcaggagacatgactaattactgcttgatctgtgtttgc

SEQ ID NO: 326763 - DNA, 75 bp, Artificial Sequence
  Synthetic
tcgaaagacaagggcttgacatatcatagggtctccagcaattgctatagcccaaccaagattagaataatatat

SEQ ID NO: 326764 - DNA, 75 bp, Artificial Sequence
  Synthetic
atatgggtagctataatatttttgttaaatgcaactgtaatagctgctgctgaaaataaagtagattgcctacat

SEQ ID NO: 326765 - DNA, 75 bp, Artificial Sequence
  Synthetic
ctaaaagaaaatgaaattgaaatccaaaaagtgtctcagtgtattgcaatccaccaaaattatagtggaccagcc

SEQ ID NO: 326766 - DNA, 75 bp, Artificial Sequence
  Synthetic
aagaatttagaaacaatactacaagaaatgagcactattgaacaagaagaaaaggaagaaatattatcatcagga

SEQ ID NO: 326767 - DNA, 75 bp, Artificial Sequence
  Synthetic
attacctgtgctaatataaataaagccatagaatcacttacagtcttagagacacaagtattctatgaacagatt

SEQ ID NO: 326768 - DNA, 75 bp, Artificial Sequence
  Synthetic
aaatctaaaatgtgtccatcagaggttaatgatataacaaaattgaactctggtggtaatatccaatggaaaact

SEQ ID NO: 326769 - DNA, 75 bp, Artificial Sequence
  Synthetic
cttgccaggacatacacattaggattatgtaatcagcatccgcataagcatatatgcaaatgtgtgtcatctttt

SEQ ID NO: 326770 - DNA, 75 bp, Artificial Sequence
  Synthetic
acttattgtacatcaacaacaactgaccacgcagatgaaacaaagaaatattacacaaacaaaataacaaatttt

SEQ ID NO: 326771 - DNA, 75 bp, Artificial Sequence
  Synthetic
gaacatgatatcaaaataattttacgtgtaactaaatatatggtgccaggcttaggatcaacattaatagataaa

SEQ ID NO: 326772 - DNA, 75 bp, Artificial Sequence
  Synthetic
atcaaaaaaagtagacgttatacagacttaattcacatcattggcaaactaattgtaaagacagcagaaaatact

SEQ ID NO: 326773 - DNA, 75 bp, Artificial Sequence
  Synthetic
caattgaaggggtttttggattttgtcaacaagatgctcacttacaatgtttcaatagtatcggaggagccagaa

SEQ ID NO: 326774 - DNA, 75 bp, Artificial Sequence
  Synthetic
atcagtgcaatgtcattaataaaacgagacggccaaagtgtaagctcaaaaattccaggtactagcccaataaac

SEQ ID NO: 326775 - DNA, 75 bp, Artificial Sequence
  Synthetic
tcctgcacgggagcaaagaaagtaatatgttttagccctcgaggaataagccaaccatatgattatataatctgc

SEQ ID NO: 326776 - DNA, 75 bp, Artificial Sequence
  Synthetic
aatgagaaattgtataagtggccgcaagatggagtttacaaaaataataagaacaatggtgaggcttgtgcgaga

SEQ ID NO: 326777 - DNA, 75 bp, Artificial Sequence
  Synthetic
gacactcactgcatttcaacatttgaacctgcaacccgtgggattgacaggaggatttgcaaaagttatgaaata

SEQ ID NO: 326778 - DNA, 75 bp, Artificial Sequence
  Synthetic
acatacaatgatgatgcatattcaaattctataacagaatgtgtcgttgaaaaatttgggacttgcactgtcaaa

SEQ ID NO: 326779 - DNA, 75 bp, Artificial Sequence
  Synthetic
agcagcatgtggtcatttgcagtgtgtcacggcctatattattatacaagtgctagacaacatgccaaggcgcat

SEQ ID NO: 326780 - DNA, 75 bp, Artificial Sequence
  Synthetic
gatattacgaagtattgcttaagtaacacatgtcaagagcaacggtttccatttcgtagtgattactgctctaac

SEQ ID NO: 326781 - DNA, 75 bp, Artificial Sequence
  Synthetic
actatttgggactcaacttatcaaacaaggttaagtacaaagcatatatcacatcctgacatagaaaattatatt

SEQ ID NO: 326782 - DNA, 75 bp, Artificial Sequence
  Synthetic
gctgccttacaatcagacattgccaatgatttaacaatacatcactttaggcctacaaaaaatttgcctgctata

SEQ ID NO: 326783 - DNA, 75 bp, Artificial Sequence
  Synthetic
gccccttcatatattggggttacaatcaaaggtgacaaagtttcctctggtattagaaattcatacattgaaagt

SEQ ID NO: 326784 - DNA, 75 bp, Artificial Sequence
  Synthetic
aagctacctgcagtatctggattagcaactggagtggatattaaaatgccagacggaactgacctattttcacta

SEQ ID NO: 326785 - DNA, 75 bp, Artificial Sequence
  Synthetic
atcgtttatattaagaaaataactgttaaatcaaattaccagtatatttattcaacaggtccaactatatctata

SEQ ID NO: 326786 - DNA, 75 bp, Artificial Sequence
  Synthetic
aatgtaaaacacaacgaacaatgcactggtaaatgcccaatacatattcctgcagaaacaaattggctaactttc

SEQ ID NO: 326787 - DNA, 75 bp, Artificial Sequence
  Synthetic
tcaagagaaagatctagcacatgggggtgcgaagaatggggttgcatggctataaatgatggatgcatttacggc

SEQ ID NO: 326788 - DNA, 75 bp, Artificial Sequence
  Synthetic
tcttgtcaagatgtaattagacctgaacttaaaatttacaaaaaaatagggtcagagacgaaagaagttgaagtc

SEQ ID NO: 326789 - DNA, 75 bp, Artificial Sequence
  Synthetic
tgcataacaacagcacatgaaactttctgtaatactgttgatgtgctgcagccgttaataaaccaaagaatacaa

SEQ ID NO: 326790 - DNA, 75 bp, Artificial Sequence
  Synthetic
ttggacctccaaactgtaaccactgcaaatatgccaaatatagtaggaataaaggatgggaaaatatatagtgga

SEQ ID NO: 326791 - DNA, 75 bp, Artificial Sequence
  Synthetic
gatataaacgacctaggtgcaactgcaaagaaatgtggctcggtgcaaatgactgggacaacaacaataggcaca

SEQ ID NO: 326792 - DNA, 75 bp, Artificial Sequence
  Synthetic
ggaaatgtgaaatttgactacatatgccatgcatttaaccgaaaggatgtagttgtccggaaatgtttcgacaat

SEQ ID NO: 326793 - DNA, 75 bp, Artificial Sequence
  Synthetic
gcgtatgaatcatgtaaataccttgacgtgagggacgacctattaatacaggcaagtacaaatgacgaaatacac

SEQ ID NO: 326794 - DNA, 75 bp, Artificial Sequence
  Synthetic
atgaaggtatctaatgttgggacaataaattataaagttatgttaggggactttgattatgaaatgtttaaagaa

SEQ ID NO: 326795 - DNA, 75 bp, Artificial Sequence
  Synthetic
aatgctgtgctaacagtagatgtactaaaatgtggcggctgcctttcctgtccagatggcatgcattgtgctttt

SEQ ID NO: 326796 - DNA, 75 bp, Artificial Sequence
  Synthetic
aaagcaactacagataaaacaactttatgtaaaatagtatcaaactgcattagcttcttgaataatataatcatt

SEQ ID NO: 326797 - DNA, 75 bp, Artificial Sequence
  Synthetic
gacccgcagcaaagcgattattcaataaaacttgaatgctcgcaattaactggtgatatagaagtttccctatgt

SEQ ID NO: 326798 - DNA, 75 bp, Artificial Sequence
  Synthetic
ggtttaaaattgaaagccaggccatctataactaagaaaaacccaaagattagtcttgcaagcctagatgaggct

SEQ ID NO: 326799 - DNA, 75 bp, Artificial Sequence
  Synthetic
acgtatatagagcaacatgatgaaagatgtgctacatggctctgtagagtcagggatgagggcatatcggcaatc

SEQ ID NO: 326800 - DNA, 75 bp, Artificial Sequence
  Synthetic
ctttctccattatttggaggtttgtcatactactggatgattgcagtatattcactttttaccattgtaattata

SEQ ID NO: 326801 - DNA, 75 bp, Artificial Sequence
  Synthetic
gtcttcctactatttattttaataccattctgtaaaagaatcaaaggcatattagaatataatgaacaaatatat

SEQ ID NO: 326802 - DNA, 75 bp, Artificial Sequence
  Synthetic
cagattgagaataaatctaaatgaatttaaatcaactttatcccaaaataaaaacaacaaaaataaaaacaattt

SEQ ID NO: 326803 - DNA, 75 bp, Artificial Sequence
  Synthetic
aaacaacaaaaataaaaacaatttgcaagtgggcctttgctcacacaatattgcagctgaaaaattgttgtatgt

SEQ ID NO: 326804 - DNA, 75 bp, Artificial Sequence
  Synthetic
gtgtactaccacaaacaacatgtttttcaaagtgatattgatcttcattctattcaagcaatgcaagcaaatccc

SEQ ID NO: 326805 - DNA, 75 bp, Artificial Sequence
  Synthetic
ttcaaagtgatattgatcttcattctattcaagcaatgcaagcaaatcccattgcgtgaagggacaactggctct

SEQ ID NO: 326806 - DNA, 75 bp, Artificial Sequence
  Synthetic
cgctgctttgctaatggagaattagtcaaaacagtaaatgctactaatgtgccagcagaagtctgcgtgaaagat

SEQ ID NO: 326807 - DNA, 75 bp, Artificial Sequence
  Synthetic
gatatatcaataattaagtctaacggagaacattataaaaaagacaataatattggcgctgtagttaaatattat

SEQ ID NO: 326808 - DNA, 75 bp, Artificial Sequence
  Synthetic
cggctgtatcaaataaaagattgggctacttgcaatcctattttagatacgcatggaacattcatgctcctggat

SEQ ID NO: 326809 - DNA, 75 bp, Artificial Sequence
  Synthetic
ctacttgcaatcctattttagatacgcatggaacattcatgctcctggatatagataatacagggatgttaattc

SEQ ID NO: 326810 - DNA, 75 bp, Artificial Sequence
  Synthetic
acagcagaaataatattaaattcatatagattaaaccattataggatatccggctcaatgcatatatctggatgg

SEQ ID NO: 326811 - DNA, 75 bp, Artificial Sequence
  Synthetic
ttcaagaataaaatagatattcctttagaaaatacttgtgaaactatcgatgtcacatgtggcttaaagacaatg

SEQ ID NO: 326812 - DNA, 75 bp, Artificial Sequence
  Synthetic
tcgtttcatgcttgtttccatacacataaatcttgcactaggtacttcaaaggttccgtgttgccggagataaca

SEQ ID NO: 326813 - DNA, 75 bp, Artificial Sequence
  Synthetic
attgaatctatgtgccagaatatcgaattaattattattggctctgctatattctttggttcaatattcctgata

SEQ ID NO: 326814 - DNA, 75 bp, Artificial Sequence
  Synthetic
atactaactaagacttatattgtgtatctttttataccgatattctatccatttgtcaagatatatgcaatacta

SEQ ID NO: 326815 - DNA, 75 bp, Artificial Sequence
  Synthetic
atttgtcaagatatatgcaatactatacaacaggtatttcaaattgtgcaagaaatgtcttcttgcagtccatcc

SEQ ID NO: 326816 - DNA, 75 bp, Artificial Sequence
  Synthetic
tttcacaaactgtcctacaacctgtatctgcggtatgtcatatggcaatacagaatcacttaaattacatagatt

SEQ ID NO: 326817 - DNA, 75 bp, Artificial Sequence
  Synthetic
gtaaaagcaaagtgagtaacataatactatgcacatgcagtgcgttaatattcttctcattcattactcctatca

SEQ ID NO: 326818 - DNA, 75 bp, Artificial Sequence
  Synthetic
atgcagaatgctttactctagatatgctgcctgatgaattcagagaatgcagagaaaacacatcaatacttatac

SEQ ID NO: 326819 - DNA, 75 bp, Artificial Sequence
  Synthetic
atgcatcgtccacaaaaatttgcttattattaagtataagtgctttgtacttattcactccaatagtaattaggt

SEQ ID NO: 326820 - DNA, 75 bp, Artificial Sequence
  Synthetic
tctttttatatctattatatgtagtctgcccattttgtggtatgttgcacaagaggcatggtttgaagatgtcag

SEQ ID NO: 326821 - DNA, 75 bp, Artificial Sequence
  Synthetic
gagatatgactaattattgcctagtttgtgtctgctcaaaggataaaggtctaacataccacaaagtttctagca

SEQ ID NO: 326822 - DNA, 75 bp, Artificial Sequence
  Synthetic
actgctatagcccagttaagattaaaataatgtacgtgtggataaccatcttatttctgatgaatacaactataa

SEQ ID NO: 326823 - DNA, 75 bp, Artificial Sequence
  Synthetic
cagttgctgcagaaaataaaatagattgtctacatctaaaagaaaatgaaattggtattcaaaaaatatctcagt

SEQ ID NO: 326824 - DNA, 75 bp, Artificial Sequence
  Synthetic
gcattgcaatccatcaaaattacactgaatcagctaaaagtttagaggtaatactacaggagatgagcacagttg

SEQ ID NO: 326825 - DNA, 75 bp, Artificial Sequence
  Synthetic
agcagcaagaaaaggaggaaataatgtcatctgaaatcaggtgtactaacattaataagatcatagaatcactta

SEQ ID NO: 326826 - DNA, 75 bp, Artificial Sequence
  Synthetic
cagttctagaagcacaagtgttttatgagcaaatcaagtctaaaatgtgcccatcagaagtcaacgacattacaa

SEQ ID NO: 326827 - DNA, 75 bp, Artificial Sequence
  Synthetic
tgagcaaatcaagtctaaaatgtgcccatcagaagtcaacgacattacaagattaaactctggcggcaataccca

SEQ ID NO: 326828 - DNA, 75 bp, Artificial Sequence
  Synthetic
gtggaagacccttgctagaacttacactttaggattgtgcaaccaacatccacataaacacatatgtaaatgcat

SEQ ID NO: 326829 - DNA, 75 bp, Artificial Sequence
  Synthetic
gtcttcttttacttattgcacatcaacattgactgaccatgcagacgaaaccaagaaatactatactaataagat

SEQ ID NO: 326830 - DNA, 75 bp, Artificial Sequence
  Synthetic
ccaagaaatactatactaataagataacaaattttgagcacgacattaaaataatattacgtattgttaaataca

SEQ ID NO: 326831 - DNA, 75 bp, Artificial Sequence
  Synthetic
tggtgccagggttgggatcaatgctaatagacaaaattaaaaaaagtagacgctatacagacttaattcatatta

SEQ ID NO: 326832 - DNA, 75 bp, Artificial Sequence
  Synthetic
ctggcaaattaatcccaaaggcgtcagaaaatacacaattgaaagggtttttggaattcaccaataaaatgctta

SEQ ID NO: 326833 - DNA, 75 bp, Artificial Sequence
  Synthetic
catacaatgtttcaatagtatcagaagaaccagaaatcagtgctatgtcattgattaaaagagatggacaaacag

SEQ ID NO: 326834 - DNA, 75 bp, Artificial Sequence
  Synthetic
taaattcgaagattcccggagttactcctattaattcatgtacgggagctaaaaaggtaatatgctttagccctc

SEQ ID NO: 326835 - DNA, 75 bp, Artificial Sequence
  Synthetic
aaaaaggtaatatgctttagccctcggggtgtgagtcagccatatgattatataatctgtaatgataagctatat

SEQ ID NO: 326836 - DNA, 75 bp, Artificial Sequence
  Synthetic
aagtggccacaggatggtgtctataaaaataataaaaacaatggtgaagcatgtgcaagggacacccactgcata

SEQ ID NO: 326837 - DNA, 75 bp, Artificial Sequence
  Synthetic
tccatgtttgaacctgcgacacgtgggattgacaggaaaatttgtaagagttatgagataacatacaatgaagat

SEQ ID NO: 326838 - DNA, 75 bp, Artificial Sequence
  Synthetic
gcatattctaattcaatagcagaatgtgttgttgagaaatttggaacttgcactgtcaagagcagtacatggtca

SEQ ID NO: 326839 - DNA, 75 bp, Artificial Sequence
  Synthetic
tttgcagtatgccaaggcttatattattacacaagtgctagacagcatgcaaagacacatgatatcaccaaatat

SEQ ID NO: 326840 - DNA, 75 bp, Artificial Sequence
  Synthetic
tgtctgagtaatacatgccaggagcaacgatttccatttcgtagtgattattgttcaggcacagtttgggattca

SEQ ID NO: 326841 - DNA, 75 bp, Artificial Sequence
  Synthetic
ttgttcaggcacagtttgggattcaacatatcgcacgaagttaaatactagacatatatcgcaccctgatataga

SEQ ID NO: 326842 - DNA, 75 bp, Artificial Sequence
  Synthetic
aaattatattgctgctttacaatcagatattgctaatgatctaacaatacatcatttcaggcccacgaaaaattt

SEQ ID NO: 326843 - DNA, 75 bp, Artificial Sequence
  Synthetic
acctgctatagccccttcatacattggtgttactatcaagggtgataaagtgtcctctggcgtaagaaactcata

SEQ ID NO: 326844 - DNA, 75 bp, Artificial Sequence
  Synthetic
tgtcctctggcgtaagaaactcatatatagaaagcaaattgcctgcaatatccggattagcgactggagtagata

SEQ ID NO: 326845 - DNA, 75 bp, Artificial Sequence
  Synthetic
taaaaatgcctgatggtaatgacctattctcattggttgtctacatcaaaaagataactgttaagtcaaattatc

SEQ ID NO: 326846 - DNA, 75 bp, Artificial Sequence
  Synthetic
aatatatttactcaacagggccgactatatctgtgaatgttaaacacaatgaacagtgtactggtaaatgcccaa

SEQ ID NO: 326847 - DNA, 75 bp, Artificial Sequence
  Synthetic
catctataccagcagatacgaactggttaactttctcaagagaaaggtccagcacatggggatgcgaagaatggg

SEQ ID NO: 326848 - DNA, 75 bp, Artificial Sequence
  Synthetic
gatgtatggctataaatgatgggtgtgtttacgggtcgtgtcaggatataattagacctgaactcaaaatctata

SEQ ID NO: 326849 - DNA, 75 bp, Artificial Sequence
  Synthetic
aaaaaataggttcagaaacaaaagaagctgaagtctgtataacaacagcacatgaaactttttgcaataccgttg

SEQ ID NO: 326850 - DNA, 75 bp, Artificial Sequence
  Synthetic
gtaaccactgcaaacatgccaaacataataggagtgaaagatgggaagatatacagtggggatataaatgaccta

SEQ ID NO: 326851 - DNA, 75 bp, Artificial Sequence
  Synthetic
gttggaactataaattataaagttatgttaggagattttgactatgatatgttcaaagaaagtgctgcgttgaca

SEQ ID NO: 326852 - DNA, 75 bp, Artificial Sequence
  Synthetic
gtagatgtactaaaatgcggtggttgtctctcttgcccagatggcatgcattgtgcttttaaagccaccacagat

SEQ ID NO: 326853 - DNA, 75 bp, Artificial Sequence
  Synthetic
gtctctcttgcccagatggcatgcattgtgcttttaaagccaccacagataaagcaactttatgtaagatagtat

SEQ ID NO: 326854 - DNA, 75 bp, Artificial Sequence
  Synthetic
caaattgcattagttttttaaacaatataattatcgatccgcaacaaagtgaatactcaataaaacttgaatgtt

SEQ ID NO: 326855 - DNA, 75 bp, Artificial Sequence
  Synthetic
cgcaattaattaatgatattgaaatctctttatgtggtttaaaattaaaagcacgaccatctataactaagcaaa

SEQ ID NO: 326856 - DNA, 75 bp, Artificial Sequence
  Synthetic
ctctttatgtggtttaaaattaaaagcacgaccatctataactaagcaaaacccaaagattagtcttgcaagtct

SEQ ID NO: 326857 - DNA, 75 bp, Artificial Sequence
  Synthetic
agatgaatccacatacattgagcagcatgatgagagatgtgcaacatggttatgtagagtaagagatgaaggtat

SEQ ID NO: 326858 - DNA, 75 bp, Artificial Sequence
  Synthetic
atcagcaatcttttctccaatattcggaggtttgtcatattactgggcgatagcaatgtattcattcctcgctat

SEQ ID NO: 326859 - DNA, 75 bp, Artificial Sequence
  Synthetic
attactcattgtcttcctgctgttcattttagtgccattctgtaagagaatcaaaggtgtgctagaatataacga

SEQ ID NO: 326860 - DNA, 75 bp, Artificial Sequence
  Synthetic
aagaatatatcagattgaaaataaatctaaataagctggattaaaattagataaaatataaaacaatcataagtg

SEQ ID NO: 326861 - DNA, 75 bp, Artificial Sequence
  Synthetic
aaacaatcataagtgggcttttgctcacacaatattgcagctgaaaaaatgttgtatgtggtagcacactactcg

SEQ ID NO: 326862 - DNA, 75 bp, Artificial Sequence
  Synthetic
ctccactatagaacaaagcttttaaatggcaaaccaatttattttccaagatgttcctcaacggaatctcgctac

SEQ ID NO: 326863 - DNA, 75 bp, Artificial Sequence
  Synthetic
cttcttcctcaatcagaagaaggccaagatggtactcagtaagacggcacaaccaagtgttgatcttacatttgg

SEQ ID NO: 326864 - DNA, 75 bp, Artificial Sequence
  Synthetic
aaccaagtgttgatcttacatttggtggcatcaagtttacactggttaataaccattttccccaatacacagcaa

SEQ ID NO: 326865 - DNA, 75 bp, Artificial Sequence
  Synthetic
atcctgtgccagacactgccctcactctccatcgtctctcaggatatctagcaaaatgggttgcagaccaatgta

SEQ ID NO: 326866 - DNA, 75 bp, Artificial Sequence
  Synthetic
aaacgaatcagattaaattggctgaggccatggaaaaaattgtcatgccactggctgaagtgaaaggttgcacct

SEQ ID NO: 326867 - DNA, 75 bp, Artificial Sequence
  Synthetic
ggactgaagggctgactatgtatctgggatttgcaccaggtgctgaaatgtttttagaaacatttgaattctacc

SEQ ID NO: 326868 - DNA, 75 bp, Artificial Sequence
  Synthetic
ctttggttattgatatgcacagagtgctgaaggatggaatggatgtcaacttcatgaggaaggtccttcgccagc

SEQ ID NO: 326869 - DNA, 75 bp, Artificial Sequence
  Synthetic
gctacggcacattgactgcagaacagtggatgactcaaaaaatagatgctgtccgtgcagccttcaatgctgttg

SEQ ID NO: 326870 - DNA, 75 bp, Artificial Sequence
  Synthetic
ggcagctaagctgggctaaatcaggattctcaccagctgctagagccttccttgcccaatttggcataaacatct

SEQ ID NO: 326871 - DNA, 75 bp, Artificial Sequence
  Synthetic
aaattcctgtaaaaccccaccccttcccccagtatggtgttccaaaacaccatacgccattcctgcagcattgtt

SEQ ID NO: 326872 - DNA, 75 bp, Artificial Sequence
  Synthetic
tggtgttccaaaacaccatacgccattcctgcagcattgtttatttctttctattgattgttctatgtggagcac

SEQ ID NO: 326873 - DNA, 75 bp, Artificial Sequence
  Synthetic
ctgggctgcagttcctcacagtgaagacagcgccaggtggcaagaagtcaaaaggtatatcttgagtagtgtacc

SEQ ID NO: 326874 - DNA, 75 bp, Artificial Sequence
  Synthetic
cctagagaaaacaattcaaaatggatccttatcgtattgatatgttccgcaacaggatccttgcatctgacgacc

SEQ ID NO: 326875 - DNA, 75 bp, Artificial Sequence
  Synthetic
cagaagatgcaaaggatatcatgtcggatttgttgatggaacgccacaactattttggtagagaagtgtgccaat

SEQ ID NO: 326876 - DNA, 75 bp, Artificial Sequence
  Synthetic
acttagacatagagtttaggaatgatacacctgctcaagatatactttttgacttcttgccacctggcgctgtct

SEQ ID NO: 326877 - DNA, 75 bp, Artificial Sequence
  Synthetic
tcactgtgaggaactgcagcccagacaactacatcatattcaatgggaagttatatattatagattacaaagttt

SEQ ID NO: 326878 - DNA, 75 bp, Artificial Sequence
  Synthetic
ctgttgatgccagttatgggttgtcaacaaagacaaagtacgaagaaatatttggtgatgctttagctccttttg

SEQ ID NO: 326879 - DNA, 75 bp, Artificial Sequence
  Synthetic
gtttggactttgaagttgttataatcagggcagatcctattcgagaaatggtacatattgatagtcaagatttca

SEQ ID NO: 326880 - DNA, 75 bp, Artificial Sequence
  Synthetic
tcaatgcatttggcaatatttatattgacttagatttcacatggtttttcaatttgcgcacattactttatgata

SEQ ID NO: 326881 - DNA, 75 bp, Artificial Sequence
  Synthetic
aattcaaggacaatgatcggttcttagaaattgttaatcaaggcgaattcacaatgacttcaccatggatagaag

SEQ ID NO: 326882 - DNA, 75 bp, Artificial Sequence
  Synthetic
aaaatacgccagaattgtacactcatcctatatttagagaattctataactcattgaatgatgaagaaaaaaata

SEQ ID NO: 326883 - DNA, 75 bp, Artificial Sequence
  Synthetic
catttaatatcagtttggaattcgatgccaccaagtcagagaaatggaaccataatttgatagcgatcatccaaa

SEQ ID NO: 326884 - DNA, 75 bp, Artificial Sequence
  Synthetic
agtatgagccattttataagaaattttgtaatattgcagcatcaggcgtatttaagtgcacaggcgattatcctg

SEQ ID NO: 326885 - DNA, 75 bp, Artificial Sequence
  Synthetic
cgcctagtaaagatcagatctcaaagggctgggatgatatgtacgaaagagttaaacttgaaagagatttaaccg

SEQ ID NO: 326886 - DNA, 75 bp, Artificial Sequence
  Synthetic
atgatctgtctaaacagaaaccaagtttccattttatatggtcgcctcctgatcccgaaagaccaaatgagaata

SEQ ID NO: 326887 - DNA, 75 bp, Artificial Sequence
  Synthetic
tctctaaaatactaacattggctaaagcactccaaaaaatacaaggtgattctacatttattaacagcttccggg

SEQ ID NO: 326888 - DNA, 75 bp, Artificial Sequence
  Synthetic
cattgggcttactaatggatttttcgtcaaatattggtttgtatgaatcacatgttagtaaacttaaaaacacag

SEQ ID NO: 326889 - DNA, 75 bp, Artificial Sequence
  Synthetic
cacgacaaacttccaaaaagatcgatcagaaattagaagaggtggagattggaagtgcaactgtcctgtgggagc

SEQ ID NO: 326890 - DNA, 75 bp, Artificial Sequence
  Synthetic
aacaattcaaattcaacacaaagataatgaatgcttatgataagtcacatctcttcaaagatttcctcggaattg

SEQ ID NO: 326891 - DNA, 75 bp, Artificial Sequence
  Synthetic
gtggccataaatcatttagcaagaaatcaatagatgatttagatacagaaaagcctaaaatattagattttaact

SEQ ID NO: 326892 - DNA, 75 bp, Artificial Sequence
  Synthetic
cgaaaaatgttcaagatgcctgcaatagaatttatcgtcaagtcaagaatatcttatcaaatgttaattctttga

SEQ ID NO: 326893 - DNA, 75 bp, Artificial Sequence
  Synthetic
aaaaaatggggtgttatctagaagaatacggatacaatatatcaaatgcttccccagacatgtgggagagagttc

SEQ ID NO: 326894 - DNA, 75 bp, Artificial Sequence
  Synthetic
aagaagtatgttccacaaacttctgggctgcaatcttggattattcaactctgatgaaaaatatgttagctgcat

SEQ ID NO: 326895 - DNA, 75 bp, Artificial Sequence
  Synthetic
ctcaatacaaccgccacaacacatttagagttgtcacttgtgcaaacaataatctttatggaatagttatgcctt

SEQ ID NO: 326896 - DNA, 75 bp, Artificial Sequence
  Synthetic
cttcggatattaaaacaaaacgatcaactctttgctactttataatagctttacatgataagagagaagatgttg

SEQ ID NO: 326897 - DNA, 75 bp, Artificial Sequence
  Synthetic
ctcattctggctcaatacattcaactttccaatcaggttctaaatatgtatcaatttcaaagggatttaggcttg

SEQ ID NO: 326898 - DNA, 75 bp, Artificial Sequence
  Synthetic
acaaagaaagatgccaaagaattgtatcatcaccaggtttgttcttgatgacttcttgtctatttttatctgata

SEQ ID NO: 326899 - DNA, 75 bp, Artificial Sequence
  Synthetic
acaaatcactgaacacaaatgatgttttaaattttagttttcacacatctgtttcaataacaaaggcaatgttgt

SEQ ID NO: 326900 - DNA, 75 bp, Artificial Sequence
  Synthetic
cactaactgaaccatccaggtatatgattatgaattcacttgcaatttcaagtcatgtacgtgaatatatggctg

SEQ ID NO: 326901 - DNA, 75 bp, Artificial Sequence
  Synthetic
aaaaatttagcccatatactaagacagcattttctgtagttatgacgcaaattattaagcgtgcatgctatgagg

SEQ ID NO: 326902 - DNA, 75 bp, Artificial Sequence
  Synthetic
catttgatcaaaaggagaagatagagctaaaaaacatacatctaacagattatgaaataacacagaaaggtgtca

SEQ ID NO: 326903 - DNA, 75 bp, Artificial Sequence
  Synthetic
aaccacagagagatctaaaatctatttggtttccaggacaagtaaatttaaaagaatatataaatcaggtatata

SEQ ID NO: 326904 - DNA, 75 bp, Artificial Sequence
  Synthetic
tgccattttatttcaactctaaaggactgcatgaaaaacaccatgttatgattgatctagcaaaaactatattag

SEQ ID NO: 326905 - DNA, 75 bp, Artificial Sequence
  Synthetic
aaattgaaaaagaccagcgtttgaatatacctggaatctggtctgatattccgaagaagcagacagttaatatta

SEQ ID NO: 326906 - DNA, 75 bp, Artificial Sequence
  Synthetic
gagtcttgatctactcacttgcaaagacattaaacatggacacatcaagacataactatatacgatctaggatag

SEQ ID NO: 326907 - DNA, 75 bp, Artificial Sequence
  Synthetic
aaaataataacaatctaaagagatctataaccaccatatctacatttactagttctaaatcatgcattaagattg

SEQ ID NO: 326908 - DNA, 75 bp, Artificial Sequence
  Synthetic
gagactttagtgaatttaaaaccgtaagaaaaaagatgattgacagtatgaaaaaggaaataaataaatacacag

SEQ ID NO: 326909 - DNA, 75 bp, Artificial Sequence
  Synthetic
ttgcaaatccagaatttgcagaagatctagatacatcttatgccatacatcatgctgattatgcagatgtgcgta

SEQ ID NO: 326910 - DNA, 75 bp, Artificial Sequence
  Synthetic
aagctataccgaattatgctgattgtatatcaacaaaggtttttgacgcattgtatgaaaagataaaaaacggcg

SEQ ID NO: 326911 - DNA, 75 bp, Artificial Sequence
  Synthetic
agattgatgataaaccaacagtatcacatatacttgagataatgaaaaaacataaacagttttattttagtttct

SEQ ID NO: 326912 - DNA, 75 bp, Artificial Sequence
  Synthetic
ttaacaaggggcaaaaaacagcaaaagatagagaaatctttgttggtgaatttgaggctaagatgtgcttatatt

SEQ ID NO: 326913 - DNA, 75 bp, Artificial Sequence
  Synthetic
taattgaaagaatctctaaagaacgttgtcgtctaaacccagaagaaatgatcagcgaaccaggagattctaaat

SEQ ID NO: 326914 - DNA, 75 bp, Artificial Sequence
  Synthetic
taaaaaaactcgaagatctggcagaagcagaaatacgatatacagcacagacgctaaaaaaccttaatcggaaaa

SEQ ID NO: 326915 - DNA, 75 bp, Artificial Sequence
  Synthetic
ttcaaaaagatatgtttggatcagaaattgacattgatatgaaattgcatgctttaaaaatagaaataaatgctg

SEQ ID NO: 326916 - DNA, 75 bp, Artificial Sequence
  Synthetic
atatgtcaaaatggagtgctcaagatgttttatacaaatatttttggctctttgtcttagaccctgtcctgtata

SEQ ID NO: 326917 - DNA, 75 bp, Artificial Sequence
  Synthetic
aatatgagaaagagagaatcttatatttcctatgcaattatatgcaaaaaagactgattctaccagatgatctaa

SEQ ID NO: 326918 - DNA, 75 bp, Artificial Sequence
  Synthetic
ttgcaaatattttagatcaaaggatccagcgccaagacgacatcatatatgagatgagtaatggactcactcaga

SEQ ID NO: 326919 - DNA, 75 bp, Artificial Sequence
  Synthetic
attgggttgagattaagaggaattggctccaaggcaacttaaattacactagtagctatttgcatacatgctcaa

SEQ ID NO: 326920 - DNA, 75 bp, Artificial Sequence
  Synthetic
tgaatgtttacaaagatataataaaaagatctattgatttgcttgaaggggaaacactagttaattcaatggtac

SEQ ID NO: 326921 - DNA, 75 bp, Artificial Sequence
  Synthetic
attcggatgataatcatacatcactggttatagtccaaaataaattaaatgacaatattttaattgagttctcaa

SEQ ID NO: 326922 - DNA, 75 bp, Artificial Sequence
  Synthetic
taaaattatttgaaaagatatgcttaacatttggaaatcaagctaatatgaaaaaaacatatttaacaaatttta

SEQ ID NO: 326923 - DNA, 75 bp, Artificial Sequence
  Synthetic
tcaaagaatttgtttcattatttaacatatatggtgaaccattttcagtatacgggcgtttcttactaacagctg

SEQ ID NO: 326924 - DNA, 75 bp, Artificial Sequence
  Synthetic
taggtgactgtgcttacttaggaccttatgaagattgtgctagtaggttatcagcaacacagactgcaataaagc

SEQ ID NO: 326925 - DNA, 75 bp, Artificial Sequence
  Synthetic
atggctgcccgccatcacttgcatggatcagcatagctttgaatcaatggatcacacataacacatataatatgc

SEQ ID NO: 326926 - DNA, 75 bp, Artificial Sequence
  Synthetic
ttcctggtcaaaataatgatccatgtaatatattaccatgctataacagatttgaggttcctatcgaattgtgtg

SEQ ID NO: 326927 - DNA, 75 bp, Artificial Sequence
  Synthetic
ggttattgaattgctctttgcctagcattgcaatagcaggtttagaagcagataatcttgaatttttagttagga

SEQ ID NO: 326928 - DNA, 75 bp, Artificial Sequence
  Synthetic
catcacggaaactgtcatctgtaatgtaccaacgtgagccgatacaagtgcaatatgaacacattttagattggg

SEQ ID NO: 326929 - DNA, 75 bp, Artificial Sequence
  Synthetic
atataagccaattaactgaaatagaaacaatcaggtttaaaatgttacgattcatggccctagactcttctatgt

SEQ ID NO: 326930 - DNA, 75 bp, Artificial Sequence
  Synthetic
cttcagatgatggaatgggtgaaacaagtgacatgagatcaagatctctgcttactccaagaaagtttacaacac

SEQ ID NO: 326931 - DNA, 75 bp, Artificial Sequence
  Synthetic
aagcatcactatcaaggctagtatcttataatgattatcaacagattatacaggatcaaactaaaattgacgaat

SEQ ID NO: 326932 - DNA, 75 bp, Artificial Sequence
  Synthetic
tgttaggctattttatacagtgcccacagttattagtcacaaaaggcgaaaatgtagaagaattctgccaatcta

SEQ ID NO: 326933 - DNA, 75 bp, Artificial Sequence
  Synthetic
taagatttaggtatactagcaggaaatttaaagaatcattatcaatacaaaatccagctcaactgtttatagagc

SEQ ID NO: 326934 - DNA, 75 bp, Artificial Sequence
  Synthetic
aaatactatttgcaaataaaccaatgattgactatacaagtatccatgataaattatttggtattcaagatgacc

SEQ ID NO: 326935 - DNA, 75 bp, Artificial Sequence
  Synthetic
ctaatatatccgataccacatgcattattggaaagaaaactttccctgaaacttataatcagatcaaatgtgatt

SEQ ID NO: 326936 - DNA, 75 bp, Artificial Sequence
  Synthetic
tagagagatttgccctaacaagtgatgatattaaaacagtttatagctattgcttaatgaacgatcctatattaa

SEQ ID NO: 326937 - DNA, 75 bp, Artificial Sequence
  Synthetic
tagcatgtgcaaataatataatattgtctatgaaaggcatgtctattgatagatcggctatgacatgtgcacaga

SEQ ID NO: 326938 - DNA, 75 bp, Artificial Sequence
  Synthetic
tgccggagattaaaagcctaaaagtaatctaccatagcccagctatggtcttgagagcatatgtaactggtgata

SEQ ID NO: 326939 - DNA, 75 bp, Artificial Sequence
  Synthetic
tgaacattcggggggcagaaccagatgagatgaggagggatatataccaccttgaagaattcatagaaaaaacaa

SEQ ID NO: 326940 - DNA, 75 bp, Artificial Sequence
  Synthetic
atattagaaacaagatgagagaaaggattaacaaaaacgaaatcaaatccaatggtagagatatcaaatttgaaa

SEQ ID NO: 326941 - DNA, 75 bp, Artificial Sequence
  Synthetic
ttaaggaattgaccaaatattatcaaatatgttatgactatatcaaatctactgagcataaaataaaaatattta

SEQ ID NO: 326942 - DNA, 75 bp, Artificial Sequence
  Synthetic
ttttacctaaaaggccagttactccttctgacttttgttctatagtagctggcaatttgatgttagacaataaat

SEQ ID NO: 326943 - DNA, 75 bp, Artificial Sequence
  Synthetic
ggattacaatacaccacttaaagcagataacttcgcaaacaaagaaagcacaaatagcaacctcaaccgatttag

SEQ ID NO: 326944 - DNA, 75 bp, Artificial Sequence
  Synthetic
aattgcagctagcatacgaatgctttcgcttaattgcacattttgcagattcctttttagcagagaattctagaa

SEQ ID NO: 326945 - DNA, 75 bp, Artificial Sequence
  Synthetic
agcaatttcttaaaaaagttgttgaagagttctcttataaaggggtttcagttaaaaatttgtatgataaaataa

SEQ ID NO: 326946 - DNA, 75 bp, Artificial Sequence
  Synthetic
agcattcaagactgagatcaaagatagttcccatattgtattatatgaatgacctagatcagctagatctagaca

SEQ ID NO: 326947 - DNA, 75 bp, Artificial Sequence
  Synthetic
ggcatgatgctgaaaaagcagaagagcaaattacatggaataactggcaaacatcaagagaatttcagacaggtc

SEQ ID NO: 326948 - DNA, 75 bp, Artificial Sequence
  Synthetic
cgatagatttatcaataaaaggatatgggcgtactatccgaattataggcaataattctaaactaactgcagcag

SEQ ID NO: 326949 - DNA, 75 bp, Artificial Sequence
  Synthetic
aacttcaaataagtagaatacgtgatgatataatatctagacatagccaagcattgctaaacaaaaatcatggac

SEQ ID NO: 326950 - DNA, 75 bp, Artificial Sequence
  Synthetic
taaaatttgaacttatggaagaatacaaagatctagaccctaagttgttttatatatgctatcaacttagggcta

SEQ ID NO: 326951 - DNA, 75 bp, Artificial Sequence
  Synthetic
aaaaaaggtatcattataatatattatcagttccacatataacagagcacaataggcgaacacaggaatccaaaa

SEQ ID NO: 326952 - DNA, 75 bp, Artificial Sequence
  Synthetic
taagatctacaaattattgggtgccagtgtgcccagtagcaatctctaagttaatatataatgataagcctcaat

SEQ ID NO: 326953 - DNA, 75 bp, Artificial Sequence
  Synthetic
tagcattgattaagcgattaaacatggacagtataaagttgacatcaatacaagtagctgtcgaagactatgcaa

SEQ ID NO: 326954 - DNA, 75 bp, Artificial Sequence
  Synthetic
tgattaggaaatgcaactttgccaagatgcaattttttgatggcccggaactaccatgtggtggtatagatatct

SEQ ID NO: 326955 - DNA, 75 bp, Artificial Sequence
  Synthetic
caaaaatgatgaaatctcaaaatgtactaaatctgcaggttgacactttacagagtatatcacttattgaattgt

SEQ ID NO: 326956 - DNA, 75 bp, Artificial Sequence
  Synthetic
gccgaatttttaattgtaaaggtaccaaagaagacaacaacgcttttgaattcttatctgatgaagttcttgatg

SEQ ID NO: 326957 - DNA, 75 bp, Artificial Sequence
  Synthetic
aggagatagatgaagaacttgattcctcaccagtgttaaaaataacatacacaaagaagtcgatgagaaataata

SEQ ID NO: 326958 - DNA, 75 bp, Artificial Sequence
  Synthetic
catataaaaatataattgtaaaggcactaatacgcgaatgtgacaaatttgaagaatgttttgacataaccgatg

SEQ ID NO: 326959 - DNA, 75 bp, Artificial Sequence
  Synthetic
agggtttcacgtcagatagtaacctagagattctagaatctctggtatggattttgaaagaattacatacaaacc

SEQ ID NO: 326960 - DNA, 75 bp, Artificial Sequence
  Synthetic
aatggtcaacagagttgatgcagtgcattcatatggcattgtatagaaatgaaatggatcacctgtttcacagat

SEQ ID NO: 326961 - DNA, 75 bp, Artificial Sequence
  Synthetic
tcactataccagaacaatttgtagacaatccaatatcgctaaactataaatggtcaaatgtaatagaattcctag

SEQ ID NO: 326962 - DNA, 75 bp, Artificial Sequence
  Synthetic
taacattaatgcagatagactataaacaggaaccatgggtttcgattatggcacattcattaaataaagcagttg

SEQ ID NO: 326963 - DNA, 75 bp, Artificial Sequence
  Synthetic
aatatgcaactgaaaggaaaattcaggaatcagctaaagagaacaaactccaaaagtttataaaagggaagaaga

SEQ ID NO: 326964 - DNA, 75 bp, Artificial Sequence
  Synthetic
tgggtggaaaatctaagtttgacttttaatataacattcaatattcaaaccagccttgatttcatgctcctagag

SEQ ID NO: 326965 - DNA, 75 bp, Artificial Sequence
  Synthetic
ctcctagagttatattctctaatatacaattaattatttaattatttttaaataaattgtatctctaggggcaca

SEQ ID NO: 326966 - DNA, 75 bp, Artificial Sequence
  Synthetic
aacatgtttttcaaagtgatattgatcttcattctattcaagcaatgcaagcaaatcccattgcgtgaagggaca

SEQ ID NO: 326967 - DNA, 75 bp, Artificial Sequence
  Synthetic
acatagattatgtaaaacttgtgatggctataaggcactacctaaagctagaagattatgtaaaagcaaagtgag

SEQ ID NO: 326968 - DNA, 75 bp, Artificial Sequence
  Synthetic
ataccgttgatgtattgcaaccattgataagtcaaagaatacagttagatcttcagactgtaaccactgcaaaca

SEQ ID NO: 326969 - DNA, 75 bp, Artificial Sequence
  Synthetic
aatgatctaggaacaactgcaaaaaaatgcgggtcagtacagatgactgacaattcaataataggcacaggaaac

SEQ ID NO: 326970 - DNA, 75 bp, Artificial Sequence
  Synthetic
gtaaaatttgattatatttgtcatgcatttaatcggaaagatataattgtgcggaagtgctttgacaatgcatat

SEQ ID NO: 326971 - DNA, 75 bp, Artificial Sequence
  Synthetic
gaatcgtgtaaatatcttgatttaaggaatgatttgctaatgcaggcaacaacgaataatgaaatacatatgaaa

SEQ ID NO: 326972 - DNA, 75 bp, Artificial Sequence
  Synthetic
agcccctaatataacaattcaatggatagaccaacaataaatgcatttagggatcgcattaatgcatgcaatgat

SEQ ID NO: 326973 - DNA, 75 bp, Artificial Sequence
  Synthetic
cctgaagatgcaaaagatattatgtctgccctacttatggcaagacatgactattttggcaaagaggtttgctat

SEQ ID NO: 326974 - DNA, 75 bp, Artificial Sequence
  Synthetic
ttcttagacattgaatatagatcagatgttcctgctagtgacattgttgcagaagttgctcctccaggagtgact

SEQ ID NO: 326975 - DNA, 75 bp, Artificial Sequence
  Synthetic
atccatgttaggcattgcactccagacaactatatgattatagatgacaaattgtttataatagattataaagta

SEQ ID NO: 326976 - DNA, 75 bp, Artificial Sequence
  Synthetic
tctgttgaaagtgcttatggagatctagcaaagaagaaatacgaagagatattccatgatgcattagatgaatac

SEQ ID NO: 326977 - DNA, 75 bp, Artificial Sequence
  Synthetic
ggaattgactttgaagtagtgattattcgtgcagatccagtgagagacataatacatgttgattcagaagatttt

SEQ ID NO: 326978 - DNA, 75 bp, Artificial Sequence
  Synthetic
ttgaacagagttggtgcaatacatattatccttgacttcacttggttttacaatcttagggccttaatttatgac

SEQ ID NO: 326979 - DNA, 75 bp, Artificial Sequence
  Synthetic
aaatttaaggacaatgaaaggttcttagaaattgtaacccagggtgaattcacaatgacatctccttggatagaa

SEQ ID NO: 326980 - DNA, 75 bp, Artificial Sequence
  Synthetic
gaagggacccctgaactatataaccatccgatatttatagaattctataattcgttagatgaaaaagctaaaatt

SEQ ID NO: 326981 - DNA, 75 bp, Artificial Sequence
  Synthetic
gtcttccaggagtcaatacactttgatgctacacaaggtgataagtggaatcaaaatttagttaagacaatgaat

SEQ ID NO: 326982 - DNA, 75 bp, Artificial Sequence
  Synthetic
ctttatcgccaagattacaattcctttgtcaaaatagcatctacgagtgtctttaagtgtactggaaattatcct

SEQ ID NO: 326983 - DNA, 75 bp, Artificial Sequence
  Synthetic
aagcctgatcatgatgaaattacagaaggttgggatttgatggttcaaagagtgtctgtagaaaggcagattacc

SEQ ID NO: 326984 - DNA, 75 bp, Artificial Sequence
  Synthetic
caggatatttcaaagcagaaaccatcatttcatatgatatggagcccgcctaatgatggttctaatgagaacatt

SEQ ID NO: 326985 - DNA, 75 bp, Artificial Sequence
  Synthetic
aagaaaattcttaaattatcatcgttattgcagaaggtttctggagaatctacatacataggatcatttagagct

SEQ ID NO: 326986 - DNA, 75 bp, Artificial Sequence
  Synthetic
ataggcaggctgatggatttttctgaaaatgtaggactgtatgagagtcatgtgagcaaacttaaaaatatgtca

SEQ ID NO: 326987 - DNA, 75 bp, Artificial Sequence
  Synthetic
agacaaacatctaagaaaattgataaaaaacttgatgaaataaaaataggtacatccactattctatgggaacag

SEQ ID NO: 326988 - DNA, 75 bp, Artificial Sequence
  Synthetic
caatttaaatttgattcgaatgtcattgatactaaggacaagacacatttatttaaagattttctagggataggt

SEQ ID NO: 326989 - DNA, 75 bp, Artificial Sequence
  Synthetic
ggccataaacaattcaacaaaaagagtattgatgatgtagatctttcaaaaccaactattcttgattttaacgat

SEQ ID NO: 326990 - DNA, 75 bp, Artificial Sequence
  Synthetic
aaaaacactattgataaatgtaaattccagtacaaacaagtgcaatcaatattatcgcaagagaatgaccgtaca

SEQ ID NO: 326991 - DNA, 75 bp, Artificial Sequence
  Synthetic
aaattaggctgttacctagaggaatacggacataaaatctcaagttgttctgctgatatgtggtcattaatttgt

SEQ ID NO: 326992 - DNA, 75 bp, Artificial Sequence
  Synthetic
aaggtttgtaaaatgcaattttggtctgctgtcaatgattactcaacattaatgaaaaatatgcttgctgtctca

SEQ ID NO: 326993 - DNA, 75 bp, Artificial Sequence
  Synthetic
caatataataggcacaacacttttagagttgtcacatgtgcaaataacagcctgtttgggatagttatgccgtcc

SEQ ID NO: 326994 - DNA, 75 bp, Artificial Sequence
  Synthetic
tcagatataaaaacaaagagagcaacacttgtatatttcatcattgcaatacatgatgaacctgaagatatagtg

SEQ ID NO: 326995 - DNA, 75 bp, Artificial Sequence
  Synthetic
catcatggagcactccatgggacatttaaatctgggtctaagtttgttagcatctcaaaagggatgaggctggac

SEQ ID NO: 326996 - DNA, 75 bp, Artificial Sequence
  Synthetic
aaagagagatgccaaagaattgtggctagccctggattattcttgatgacagtctgcttgatggccaacaataat

SEQ ID NO: 326997 - DNA, 75 bp, Artificial Sequence
  Synthetic
cctacaatcgatttgagtgaggtctgcaattttgcattccatacatctttatcaataaccaaggctatgttatct

SEQ ID NO: 326998 - DNA, 75 bp, Artificial Sequence
  Synthetic
ctgacagagccatcaaggtacatgatcatgaattctttagctatatctagccatgtaaaagattatatggctgag

SEQ ID NO: 326999 - DNA, 75 bp, Artificial Sequence
  Synthetic
aagttttcaccatacaccaaaacaagtttctctgttgttatggcaaacataataaagaaggcctgctataatgca

SEQ ID NO: 327000 - DNA, 75 bp, Artificial Sequence
  Synthetic
aacacccagaaagaccgcatacaattgaaaaacatacatttgacagattatgagataactcaaaaaggtgtctca

SEQ ID NO: 327001 - DNA, 75 bp, Artificial Sequence
  Synthetic
tcaactagagaattactatccatttggtttaaaggatatgtcaatttaaaggagtatataaaccagatatacatg

SEQ ID NO: 327002 - DNA, 75 bp, Artificial Sequence
  Synthetic
ccattttattttaattcaaaaggtttacatgaaaagcatcatgtgatgatagatttggctaaaacagtcttagag

SEQ ID NO: 327003 - DNA, 75 bp, Artificial Sequence
  Synthetic
atagaaaaagaccagagggaaaatataccaggcatatggtcgtcagttccaaaaaaacaaactgcaaatctgccg

SEQ ID NO: 327004 - DNA, 75 bp, Artificial Sequence
  Synthetic
gttcttatttattcagtagcaaaaaatctagccatggatacatccagacacaattacatcagatcaaggattgaa

SEQ ID NO: 327005 - DNA, 75 bp, Artificial Sequence
  Synthetic
aatgcgaataatcttaaaaggccaataacgacaatctcaacatttacaagttcaaagtcttgtataaaaagaggt

SEQ ID NO: 327006 - DNA, 75 bp, Artificial Sequence
  Synthetic
gattttgcagaatttaaagcaaaagtttctaaaaaaacagccaattcattagctaagtctattcaaaaatatgtt

SEQ ID NO: 327007 - DNA, 75 bp, Artificial Sequence
  Synthetic
gtagcaaacccagaatttgcagatttagaaatagagaatggtcaaatcagacatgcacagtatgaagatgttgtc

SEQ ID NO: 327008 - DNA, 75 bp, Artificial Sequence
  Synthetic
aaagctgttccaaattatatcgatgttatgtcaactaaagtatttgatagactgtatgaacttatcagttgtggg

SEQ ID NO: 327009 - DNA, 75 bp, Artificial Sequence
  Synthetic
tctatagacaataagccaacaatacatcatatactacaaataatgaaagatcacacagaatttatatttactttc

SEQ ID NO: 327010 - DNA, 75 bp, Artificial Sequence
  Synthetic
tttaacaaagggcagaaaactgccaaagatagagaaatatttgttggagaatttgaagctaagatgtgtttatat

SEQ ID NO: 327011 - DNA, 75 bp, Artificial Sequence
  Synthetic
ctcgtcgagagaatttctaaagaaagatgtaaactcaatccagaagaaatgatcagtgagcctggagatggaaaa

SEQ ID NO: 327012 - DNA, 75 bp, Artificial Sequence
  Synthetic
ctaaaaaagctggaagaattagctgagtctgaaattagatatacagcacagacattgaagattatgaaggaaaag

SEQ ID NO: 327013 - DNA, 75 bp, Artificial Sequence
  Synthetic
aaaatatctgaaatgtttggaggccaaatagacattgattataggccacattcacttaaaatagaaataaatgca

SEQ ID NO: 327014 - DNA, 75 bp, Artificial Sequence
  Synthetic
gacatgtcaaaatggagtgcacaagatgtattatttaaatacttttggctatttacattagacccagcattatat

SEQ ID NO: 327015 - DNA, 75 bp, Artificial Sequence
  Synthetic
agacatgagaaagagcgtatattatattttctatgtaactacatgcagaagaagctgatactaccagatgaatta

SEQ ID NO: 327016 - DNA, 75 bp, Artificial Sequence
  Synthetic
gttcaaacaatactagaccagagagggcacagagataatgatttgatttttgaaatgaccaatggattgtcacag

SEQ ID NO: 327017 - DNA, 75 bp, Artificial Sequence
  Synthetic
aactgggtagaaatcaagagaaactggcttcaaggcaatctcaactacacaagtagttatttacattcatgctgc

SEQ ID NO: 327018 - DNA, 75 bp, Artificial Sequence
  Synthetic
atgaatgtatataaagatgttattaaatcagcaagtgaactgctagaaggggaatcattaatcaattctatggtc

SEQ ID NO: 327019 - DNA, 75 bp, Artificial Sequence
  Synthetic
cactcagatgataaccacacctcaatagtgataatacaagataaactgcctgatgatactattatagaattttgc

SEQ ID NO: 327020 - DNA, 75 bp, Artificial Sequence
  Synthetic
attaaattatttgagaaaatttgcttaacttttggtaatcaagcaaatatgaagaaaacatatataaccaatttt

SEQ ID NO: 327021 - DNA, 75 bp, Artificial Sequence
  Synthetic
attaaagaatttgtttcattgtttaatatatatggtgaacccttttcagtgtatggcagatttttactaactgca

SEQ ID NO: 327022 - DNA, 75 bp, Artificial Sequence
  Synthetic
gttggagattgtgcatatttaggcccctatgaagatgctgcaagtaggttatctgccactcaaactgccataaaa

SEQ ID NO: 327023 - DNA, 75 bp, Artificial Sequence
  Synthetic
catggttgtcctggatcattggcatggatttctattgcactcaatcaatggataactcatacaacttacaatatg

SEQ ID NO: 327024 - DNA, 75 bp, Artificial Sequence
  Synthetic
ctcccaggtcaaaacaatgacccatgtaatgtgttcccaacatacaatagacaagagatacctatagaattgtgt

SEQ ID NO: 327025 - DNA, 75 bp, Artificial Sequence
  Synthetic
ggcttaattaatgcagacctatcaactatagcaattgcaggtttggaatcaggtaatttggaatacttagttggg

SEQ ID NO: 327026 - DNA, 75 bp, Artificial Sequence
  Synthetic
ttatctaaaaggatgtcatcaatagaacttcagagagaacctatccaatcacaatataataaaatagaagaatgg

SEQ ID NO: 327027 - DNA, 75 bp, Artificial Sequence
  Synthetic
aatattgattcactgacaccaatggaccgaataaagttaaaattattgagatttatgactttagactcttcaatg

SEQ ID NO: 327028 - DNA, 75 bp, Artificial Sequence
  Synthetic
tcttcagacgacgggatgggtgaaactagtgacatgaggtcaagatcattactaactccaaggaagtttacaaca

SEQ ID NO: 327029 - DNA, 75 bp, Artificial Sequence
  Synthetic
aatgcctcattgattagattaaaatcttataatgactaccagcaaatattacaagacaaggataaattagaccag

SEQ ID NO: 327030 - DNA, 75 bp, Artificial Sequence
  Synthetic
ctcttcgaatattttgtacaaaatcctcaattgctagttacaaaaggagaaactgttgaagaattttgtcagtca

SEQ ID NO: 327031 - DNA, 75 bp, Artificial Sequence
  Synthetic
ataaggtttagatatagcagtagaaaatttaaagagtcattatcaattcaaaaccctgcacaactatttatagaa

SEQ ID NO: 327032 - DNA, 75 bp, Artificial Sequence
  Synthetic
caaatattatttgcaaataagcccatgattgattatacaaccatccatgataagctattcggtatacaagatgat

SEQ ID NO: 327033 - DNA, 75 bp, Artificial Sequence
  Synthetic
ccaaacatagaaaatgctacagcaataatagggaaaaagactttccctgagacatacaagcagattcttcttgat

SEQ ID NO: 327034 - DNA, 75 bp, Artificial Sequence
  Synthetic
cttgagagattcgaattaacagtagatgatgttaaaacagttttcagttactgtcttatgaatgaccctatactt

SEQ ID NO: 327035 - DNA, 75 bp, Artificial Sequence
  Synthetic
attgcatgtgcaaataacatcttaatatctgtacgaggtatggaaattgatagaactgcaatgacgtgctccact

SEQ ID NO: 327036 - DNA, 75 bp, Artificial Sequence
  Synthetic
atgcctgagatcaaaagtctcaaagttatttatcacacaccagcattagtattaagagcttatgtacaagataat

SEQ ID NO: 327037 - DNA, 75 bp, Artificial Sequence
  Synthetic
atacaccttaaaggagttgaacctgatgagatgcgccgagacttacaccacttagaacaattcattgagcaaact

SEQ ID NO: 327038 - DNA, 75 bp, Artificial Sequence
  Synthetic
aaattaagagaacacatgcgccaacggatacaaaaaaacgagataaagacaatggggagagacttaaaattcgaa

SEQ ID NO: 327039 - DNA, 75 bp, Artificial Sequence
  Synthetic
attagagagctaacaaaattttaccaaatatgttacgattatgtaaagtctactgaacacaaagtaaaaatattt

SEQ ID NO: 327040 - DNA, 75 bp, Artificial Sequence
  Synthetic
atattacctagaaggaattataccccattggaattctgtggagcagtaacaggaaatttgctaaaagatgacaag

SEQ ID NO: 327041 - DNA, 75 bp, Artificial Sequence
  Synthetic
tgggtcactatctattatttaaagcagataacactcccgtcaaaaaaagcgcaaatagcttctagtatagactta

SEQ ID NO: 327042 - DNA, 75 bp, Artificial Sequence
  Synthetic
gaggtccaaactggattcgaagcaatgagattaattgctcattttgcagactcatttctaagcgacaattctaga

SEQ ID NO: 327043 - DNA, 75 bp, Artificial Sequence
  Synthetic
attacattccttaagaggatgatttcagattacacttacaaaggtgtgaaagttgaattgttatatagaaaatta

SEQ ID NO: 327044 - DNA, 75 bp, Artificial Sequence
  Synthetic
tgttcttctcggtttagaacaaagatattgccaatactattttatatgggtgatttatctcaaagtgatatagat

SEQ ID NO: 327045 - DNA, 75 bp, Artificial Sequence
  Synthetic
aggtttgatgcagaaaaagcagaagagcagataacctggaataattggcaaacatctagagaattcacaacaggg

SEQ ID NO: 327046 - DNA, 75 bp, Artificial Sequence
  Synthetic
cctatagatctttcaattaagggctatagtagaagtatacgaattgttggaaatgataatgaactaactgctgca

SEQ ID NO: 327047 - DNA, 75 bp, Artificial Sequence
  Synthetic
gaactaaatatcccaaaaattagaggcgatgttataactagacacggtcaggctttacttaacaagcctcatggc

SEQ ID NO: 327048 - DNA, 75 bp, Artificial Sequence
  Synthetic
cttaaatttgaaaatatgaaacctgtagatgaattgaatccaaagctgtattatatatgttaccagcttagggca

SEQ ID NO: 327049 - DNA, 75 bp, Artificial Sequence
  Synthetic
aaaaaacgatattattacaatatactctcagtttctactatattggagcataatgataggatagatgagactagg

SEQ ID NO: 327050 - DNA, 75 bp, Artificial Sequence
  Synthetic
atacgaaagaataacaaatgggttccagtttgcccagttgctattgggaaatttagtcaatctgaaaaaccattg

SEQ ID NO: 327051 - DNA, 75 bp, Artificial Sequence
  Synthetic
attgacaagatcaaatatttaaatatggaggaaatcaagctgacaaaattacaaatcgctgtagatgaccatgcg

SEQ ID NO: 327052 - DNA, 75 bp, Artificial Sequence
  Synthetic
atgatcaggaaagcccctatgcagaaaatgtcattctttgagggccctccaatcccatcaggtggaatagatgtg

SEQ ID NO: 327053 - DNA, 75 bp, Artificial Sequence
  Synthetic
agtaagttaatgcaatctcaagttatgataaatctaaatatggatacattatcaaatatatcactcttggactta

SEQ ID NO: 327054 - DNA, 75 bp, Artificial Sequence
  Synthetic
tgcagaattttcagttgcaaaggtgagacaacagaccaagatgcctttgaatttctatcagatgaaataattgat

SEQ ID NO: 327055 - DNA, 75 bp, Artificial Sequence
  Synthetic
gaagatataacagaggaattagatagctcacctgctttaaaagtcacctatacaaggaaatcagataaaaataat

SEQ ID NO: 327056 - DNA, 75 bp, Artificial Sequence
  Synthetic
acctataaaaatgcaataataagatgcctgataagagagtcagataagtttgaatcttgttttgatatatcagat

SEQ ID NO: 327057 - DNA, 75 bp, Artificial Sequence
  Synthetic
gagggatttacctctgattctaatttagagattttagaatgtttagtctggatattagaattacttaaaacaaat

SEQ ID NO: 327058 - DNA, 75 bp, Artificial Sequence
  Synthetic
caatggtctactgagttgattagctgcatccacatgtgtctatataggaacaatttagaccaactatttcacaac

SEQ ID NO: 327059 - DNA, 75 bp, Artificial Sequence
  Synthetic
tttactgccccagagtcttttgtatcagatgctataatccaaaaaccactgtggactgaaattattgatttccta

SEQ ID NO: 327060 - DNA, 75 bp, Artificial Sequence
  Synthetic
caaatattgcaggcaacaaattataaactggaaccatgggtatcaattatgaagcattctataagcaaggctata

SEQ ID NO: 327061 - DNA, 75 bp, Artificial Sequence
  Synthetic
gaatatgcaaagaagaaatatgatgaggaaaaccagctgaatcctaagaatttaaggaaatttattaagggcaaa

SEQ ID NO: 327062 - DNA, 75 bp, Artificial Sequence
  Synthetic
aagatgggaggaaaatcaaagtttgaattttaaatctatcacagtgtgcccctgctctgtaaatatattttaagt

SEQ ID NO: 327063 - DNA, 75 bp, Artificial Sequence
  Synthetic
taagtaaaattgtatatattaggggcacactactctgccggcgtagggtaggcacacgctgagccagtcagtgta

SEQ ID NO: 327064 - DNA, 75 bp, Artificial Sequence
  Synthetic
taccacaaataacatgccttcttacgttggatttacaattctcttgtgtgccacaattgtggcctcattaccatt

SEQ ID NO: 327065 - DNA, 75 bp, Artificial Sequence
  Synthetic
aagagaagggactactggaagtagatgcttctcgaatggtgacttagttaaaaccatcaacacttccacggtagt

SEQ ID NO: 327066 - DNA, 75 bp, Artificial Sequence
  Synthetic
atcggaggtttgcttaaaagatgacatatcattaattaaatctattggtgaacattataaagttggcaatcaatt

SEQ ID NO: 327067 - DNA, 75 bp, Artificial Sequence
  Synthetic
ggcagcagtactgaaatactttagactttatcaagttaaagattggcatacctgtaatcccatattagatgagca

SEQ ID NO: 327068 - DNA, 75 bp, Artificial Sequence
  Synthetic
tggtacattcatgattatgaatgtacaggaagatggccttcttatgcctaagatgcatacatgtagggttgagtg

SEQ ID NO: 327069 - DNA, 75 bp, Artificial Sequence
  Synthetic
tgatatttcagtcaataaggaaacaggggagattgttttacattcatatagactcaaccactaccgtattgctgg

SEQ ID NO: 327070 - DNA, 75 bp, Artificial Sequence
  Synthetic
cacaatccagcaggctggctggtttaaaaacaaaatagaaataccattagaaaatacatgcgaaaatatagaaat

SEQ ID NO: 327071 - DNA, 75 bp, Artificial Sequence
  Synthetic
aacatgtgggcttaaaaccatgaatgtccatgcatgctttagacaacataaatcttgtacaaggtattttaaagg

SEQ ID NO: 327072 - DNA, 75 bp, Artificial Sequence
  Synthetic
ctctttaatgccagaactaatgatagaatctatttgcacaaatatagaactaatactattaaccacatttatatt

SEQ ID NO: 327073 - DNA, 75 bp, Artificial Sequence
  Synthetic
ggtctctagtataattatgatgatactaacaaaaacttatattgtttatatactaataccattattttacccgtt

SEQ ID NO: 327074 - DNA, 75 bp, Artificial Sequence
  Synthetic
tgtaaaagtatatgggatcatatataataaatactttaaattatgtaaaaaatgccttcttgctgtgcatccatt

SEQ ID NO: 327075 - DNA, 75 bp, Artificial Sequence
  Synthetic
ttctgattgtccaacaacttgtatttgtggaatggtttacaataacactgagtcgctaaaactacacaggttatg

SEQ ID NO: 327076 - DNA, 75 bp, Artificial Sequence
  Synthetic
ttctaactgtacaggatatagggcattaacaaaatctagaaggttatgcaaaagcaaaggctggaatatcttttt

SEQ ID NO: 327077 - DNA, 75 bp, Artificial Sequence
  Synthetic
atgcatatgttttgggttaatattcttctcctttataacaccagtgcagtctgagtgttttaaattcgaggattt

SEQ ID NO: 327078 - DNA, 75 bp, Artificial Sequence
  Synthetic
aactcaggaattcaaaagttgtttgtcagaaaatgcacaaataaaggaaagagaatcaaacaatataaaaaccat

SEQ ID NO: 327079 - DNA, 75 bp, Artificial Sequence
  Synthetic
tattgctgtgcttgtaatattattaacactaatggcatttaagattcctattgttaatgtttatcaaatgattac

SEQ ID NO: 327080 - DNA, 75 bp, Artificial Sequence
  Synthetic
cattacaaagtgtaaattttgtggaatgcttcattataagaaaaaccttaaagtaggggaaggttatactaacaa

SEQ ID NO: 327081 - DNA, 75 bp, Artificial Sequence
  Synthetic
gtgccttttttgtatttgctctgaagacaagggcttggttgctcatactgcaagagaaagctgtaaatactatag

SEQ ID NO: 327082 - DNA, 75 bp, Artificial Sequence
  Synthetic
tactaaaaatattgataaagtatttacaattttgctgatagttatactagtgattttaattaaaccaatatacgg

SEQ ID NO: 327083 - DNA, 75 bp, Artificial Sequence
  Synthetic
aacatctacagactgtagagaatttagagttgatgaacctacaatagaacaaatctcaaaatgtttagctatata

SEQ ID NO: 327084 - DNA, 75 bp, Artificial Sequence
  Synthetic
ccaaaataaaacaagtagtgatagaaaagagcaggtaattgaatcattaaaacagtatgctacaaaagaggagat

SEQ ID NO: 327085 - DNA, 75 bp, Artificial Sequence
  Synthetic
tgagagtttaaatatcccagatgattatgaagagctgaatactaagatagaacaatttacagttttagaaggaaa

SEQ ID NO: 327086 - DNA, 75 bp, Artificial Sequence
  Synthetic
aatcttcttagaatactataagtctcaaacgttatcagaagatgtaaacggaattaagattttaaacgaccccca

SEQ ID NO: 327087 - DNA, 75 bp, Artificial Sequence
  Synthetic
gaacattaaatggaagatgtacataaaacataggacaatgaacctgtgtatgccacactcatataagtacatatg

SEQ ID NO: 327088 - DNA, 75 bp, Artificial Sequence
  Synthetic
tagatgcatacattcatttaagtattgttctagcacagcaactgatcatgagagtgaaataaccacttactatag

SEQ ID NO: 327089 - DNA, 75 bp, Artificial Sequence
  Synthetic
agataaagcagctgaatatacgcatgatttgaacctattgttggatgcaataaagtatgctgttccaggcctagg

SEQ ID NO: 327090 - DNA, 75 bp, Artificial Sequence
  Synthetic
tgcttcaatactagatcaaatcaaaaaagataaggactatgataatatcccacacataactggcaaattgcaggt

SEQ ID NO: 327091 - DNA, 75 bp, Artificial Sequence
  Synthetic
ctatgcaaaaaataatattcatttgttaggaatcctaaaatttatagaccatatgagaagtttaagtgttactgg

SEQ ID NO: 327092 - DNA, 75 bp, Artificial Sequence
  Synthetic
tcttcagaaaggttcagcaagattaaaaacaattaagtcaatatcttctgaaccggtactaagagcaaatactgt

SEQ ID NO: 327093 - DNA, 75 bp, Artificial Sequence
  Synthetic
aggagaaagtcctatcacatcatgctaccaagcaaaaaaagcaacatgtgtctcgcccaagggtgtggggacacc

SEQ ID NO: 327094 - DNA, 75 bp, Artificial Sequence
  Synthetic
aaatcaatacctattgtgccagagtaaattatatttatggcctatggatggagtttatgtgagcaatcggaatcc

SEQ ID NO: 327095 - DNA, 75 bp, Artificial Sequence
  Synthetic
ttctgaacattgcgctgatgacacccattgccatataccaataaatccaccaaaagatgatatttcaaagaaagt

SEQ ID NO: 327096 - DNA, 75 bp, Artificial Sequence
  Synthetic
ttgtagggaacataatatagaaactaatacagacatttactctaaatcagtgacagagtgttcagttgaaaaatt

SEQ ID NO: 327097 - DNA, 75 bp, Artificial Sequence
  Synthetic
tggaacatgcaatgttaaaagtgtaacatggcaaatagcagtgtgcaatggtgtctactactatacaagtgccag

SEQ ID NO: 327098 - DNA, 75 bp, Artificial Sequence
  Synthetic
gcagcatgctaagggtcatgatataacatcctactgtttaacagcaagctgcactgaagctagatatccatttag

SEQ ID NO: 327099 - DNA, 75 bp, Artificial Sequence
  Synthetic
gaaaagactttgtactcaaacggtatgggacacaacttatagggataaagtacatataaagaaactatcccacac

SEQ ID NO: 327100 - DNA, 75 bp, Artificial Sequence
  Synthetic
taacatagaaaattatattgctgcaatacaatcagaactatctaatgacctctcaacacattcgtatagaccatt

SEQ ID NO: 327101 - DNA, 75 bp, Artificial Sequence
  Synthetic
aaaaaacctccctaaggttatacccacatataaatctatatccatacaaggtgatgaatcaaaaacaggtgtcag

SEQ ID NO: 327102 - DNA, 75 bp, Artificial Sequence
  Synthetic
aaatgcatttgtaaagtcaagtctgcctgcaataacaggggtatcaacgggattaaatgtaaaatttaaagacgg

SEQ ID NO: 327103 - DNA, 75 bp, Artificial Sequence
  Synthetic
atcagaattgttttctttagtggtttttgttaaaaaaataatagttaaagcaacatataggcatatttatacaac

SEQ ID NO: 327104 - DNA, 75 bp, Artificial Sequence
  Synthetic
aggtccaacagtagggatcaatactaagcacaatgagatttgtactggtacatgcccgaaaacaattcctggaga

SEQ ID NO: 327105 - DNA, 75 bp, Artificial Sequence
  Synthetic
aaagaattggttaacattctcaaaagaacacactagcaattggggttgtgaagagtggggttgcttagcaattgg

SEQ ID NO: 327106 - DNA, 75 bp, Artificial Sequence
  Synthetic
ggcaggctgcctatatggctcatgtcaagatatattaaaacctgaattaagagtgtataaaaaggttgggactga

SEQ ID NO: 327107 - DNA, 75 bp, Artificial Sequence
  Synthetic
gactcgcgaagtagaagtttgtatcacaatgcctcatgaaacattctgtaatctagttgatgtgcttcaaccatt

SEQ ID NO: 327108 - DNA, 75 bp, Artificial Sequence
  Synthetic
aattagtgagagagttcagatctctctagagactgtagatgtcaaacagttgccaacattaataggaataaaaaa

SEQ ID NO: 327109 - DNA, 75 bp, Artificial Sequence
  Synthetic
tgggaaagtattagttggcgatattaatgatttgggtaatacagcaaaaaagtgcgggtctgttcaaataacatc

SEQ ID NO: 327110 - DNA, 75 bp, Artificial Sequence
  Synthetic
agatagtgttattggttctggaacaccgaaatttgactatatttgccatgctgcacagagaaaagatgttatagt

SEQ ID NO: 327111 - DNA, 75 bp, Artificial Sequence
  Synthetic
gaggcgatgctatgacaatgcatatgattcatgcaggtttctccaagaagatccaaattacaatatagctcaagg

SEQ ID NO: 327112 - DNA, 75 bp, Artificial Sequence
  Synthetic
gacagccactgaattgcatctgaagactgcaaatataggtcaaattgattttaaagttatgcttggagatttcga

SEQ ID NO: 327113 - DNA, 75 bp, Artificial Sequence
  Synthetic
ttacgatgttgtctctagagattcaacagtcattataaattctattaaatgtgcagggtgctcagattgtgttga

SEQ ID NO: 327114 - DNA, 75 bp, Artificial Sequence
  Synthetic
agaaatggcatgcgcattaaatatacaagcagaatcttctaccacatgcaaggtaacatcaaattgtgaattata

SEQ ID NO: 327115 - DNA, 75 bp, Artificial Sequence
  Synthetic
tatggacaggatcattttagacccagctgtgaatgattacagccttaaactctcatgcaaaaaagatataaaaat

SEQ ID NO: 327116 - DNA, 75 bp, Artificial Sequence
  Synthetic
aataaaagttgcagtctgcaaatctgcctcagaaacaataccaatcctaaagcagagtagcgttaagctagatct

SEQ ID NO: 327117 - DNA, 75 bp, Artificial Sequence
  Synthetic
aactagtttagatgagtctgcatacatccaggagcatgacaaaaagtgtggaacatggttatgtagggtaaagga

SEQ ID NO: 327118 - DNA, 75 bp, Artificial Sequence
  Synthetic
ggaaggactgtcaataatcttcgagcccatttttgggaaaattagctattattggaagatttttatagcagtaac

SEQ ID NO: 327119 - DNA, 75 bp, Artificial Sequence
  Synthetic
ttctgcgatcattggattgcttgcactagtatatatctgtttcccagtttgcaagaggttaaaagggctactcga

SEQ ID NO: 327120 - DNA, 75 bp, Artificial Sequence
  Synthetic
acagaacgagagaatataccagatggaaacaaaattcaaataatctgaggaaaataaacattggtttatattaat

SEQ ID NO: 327121 - DNA, 75 bp, Artificial Sequence
  Synthetic
tagttgcttgatttaatttccaattatcatgttaataaattcattccaaaatttatttcaaaattaggggctttg

SEQ ID NO: 327122 - DNA, 75 bp, Artificial Sequence
  Synthetic
gggctttgcctcaagtttgctgctaagaagttgctatatgtggtagcacactactcgtcgcggcgtagcgtccgc

SEQ ID NO: 327123 - DNA, 75 bp, Artificial Sequence
  Synthetic
ctccactattaactatattattaaatggcaaaccaattcatttttgaggatgtacctcaacggaacttatctaca

SEQ ID NO: 327124 - DNA, 75 bp, Artificial Sequence
  Synthetic
tttagtccggaggcagggtatgtggcatttattggtcggtatgggcaacaacttaacttcagtgttgttagagtc

SEQ ID NO: 327125 - DNA, 75 bp, Artificial Sequence
  Synthetic
ttcttcctcaaccagaagaaggccaaaatggtcttacataagacggcacaaccaaatgttgatcttacttttgga

SEQ ID NO: 327126 - DNA, 75 bp, Artificial Sequence
  Synthetic
ggggtcaaatttacactggttaataacaattttccccaatacacagctaatccggtgccagacaatgccctcacc

SEQ ID NO: 327127 - DNA, 75 bp, Artificial Sequence
  Synthetic
ctccacaggctctctggatatctagctagatggacagcagagcaagttaagaacaatcaagtgaaacttgctgaa

SEQ ID NO: 327128 - DNA, 75 bp, Artificial Sequence
  Synthetic
gctactgctgcaattgttatgcctctggctgaagtcaaaggatgcacctggaatgatggctataccatgtatctt

SEQ ID NO: 327129 - DNA, 75 bp, Artificial Sequence
  Synthetic
ggatttgcaccaggagcggaaatgtttctagagacatttgaatttttccctcttgtcatcgatatgcatagagtt

SEQ ID NO: 327130 - DNA, 75 bp, Artificial Sequence
  Synthetic
ttaaaagatggcatggatgtaaactttatgcggaaagctcttcgccagaggtatgggctgcttactgcagaacaa

SEQ ID NO: 327131 - DNA, 75 bp, Artificial Sequence
  Synthetic
tggatgactcaaaagattgttgaagtcaaagcagcattcgatgcagttgggcaaatagcttgggctaaatctggc

SEQ ID NO: 327132 - DNA, 75 bp, Artificial Sequence
  Synthetic
ttctcccctgctgctagagccttcctgcagcagtttggtatcactgtgtaaactttccaaaaaatcttatcatcc

SEQ ID NO: 327133 - DNA, 75 bp, Artificial Sequence
  Synthetic
tctcattttcatcctttcacttcctagtacaacatgtctatgtgttgtacgccatttcagcagcttgtatcttca

SEQ ID NO: 327134 - DNA, 75 bp, Artificial Sequence
  Synthetic
gtctatgtgttgtacgccatttcagcagcttgtatcttcattatctgtatagttaattagtggagcacactactg

SEQ ID NO: 327135 - DNA, 75 bp, Artificial Sequence
  Synthetic
accaaggggagaatcagagcgggtccgaccataacgatgtacaaaaagatatcgtaggcccggaaccagtgtgct

SEQ ID NO: 327136 - DNA, 75 bp, Artificial Sequence
  Synthetic
tttagcagactacgaaatagcacacctcgattacttatcttaccaggctcggatagggagtattgaacattactc

SEQ ID NO: 327137 - DNA, 75 bp, Artificial Sequence
  Synthetic
ccggtgccggttgcgattcgcacctgcacgggttggttgaccgggcctttcaattcggactgttatccaaattgc

SEQ ID NO: 327138 - DNA, 75 bp, Artificial Sequence
  Synthetic
ccttcaggataggattgatttattagcccatctcactgcaaagcaaatgattaactctataataggactggatga

SEQ ID NO: 327139 - DNA, 75 bp, Artificial Sequence
  Synthetic
tctcatcatgtcgagcgttttaaagacattcgagaggtttacaatccaacaagaactccaggatcatgaggagga

SEQ ID NO: 327140 - DNA, 75 bp, Artificial Sequence
  Synthetic
atcagtgtcccttctcaatgatgcggttgttacttctgattacacaaataactggatcagtgagtgttcatacac

SEQ ID NO: 327141 - DNA, 75 bp, Artificial Sequence
  Synthetic
tacccctgtacctctcgaaacgataagaccattgattcgggtatttgttgtcaacagcaatgatcctgcattaag

SEQ ID NO: 327142 - DNA, 75 bp, Artificial Sequence
  Synthetic
taagatagacttagtatttaagatgatggcatggaatctactgctagagttgtcattccaaatgtactatttgag

SEQ ID NO: 327143 - DNA, 75 bp, Artificial Sequence
  Synthetic
agcacagttactactatttaatcttagaataatcatgagcaatacggccagagaatcccataaaacaggtgcact

SEQ ID NO: 327144 - DNA, 75 bp, Artificial Sequence
  Synthetic
gattactacctggagcaatatattcgattacacttatatgacccttaggcgtattccggggaatgctctcacaaa

SEQ ID NO: 327145 - DNA, 75 bp, Artificial Sequence
  Synthetic
tcttagtatgttttcccttcctgccgctgccatgggtaaccacctgaagcttgccactagatctccagaagcaag

SEQ ID NO: 327146 - DNA, 75 bp, Artificial Sequence
  Synthetic
tatagcagctaccatcagccacccaaaacttcttcgacgagccatgaaccttgatgttataacacctgtccatgc

SEQ ID NO: 327147 - DNA, 75 bp, Artificial Sequence
  Synthetic
cattgatcgggttgaaataacaggttttgaagggcgatcatttagagtcgtccccgatgcaagatcaacaatgtc

SEQ ID NO: 327148 - DNA, 75 bp, Artificial Sequence
  Synthetic
accatatttagcatctttagattacataaaattaagtatagatgcaattcagtggggtatcaaacaagttctagc

SEQ ID NO: 327149 - DNA, 75 bp, Artificial Sequence
  Synthetic
tcgggctgaagtattagcatacgaggcaattgcggaagacataccagatactctcaatcacaaaactccctttgt

SEQ ID NO: 327150 - DNA, 75 bp, Artificial Sequence
  Synthetic
tgatctacacaatggaattgactatgaaatacttatactgtctgaggattctttggagttgagtgatcgggccat

SEQ ID NO: 327151 - DNA, 75 bp, Artificial Sequence
  Synthetic
gaatgcagatgtagaacaaggtgactatgacgagacagagggatttttagaactctgctacagtgtcctaatgca

SEQ ID NO: 327152 - DNA, 75 bp, Artificial Sequence
  Synthetic
gaacctaatcgcacggaagttaacattgctggctttaatacaaggaaaccaactcgtgctgccaaagattaaagg

SEQ ID NO: 327153 - DNA, 75 bp, Artificial Sequence
  Synthetic
ggcttggatagtaacctgcaaatgcatgactgctcctgaccagcccccaatctcaatcgagaagagaatggcaaa

SEQ ID NO: 327154 - DNA, 75 bp, Artificial Sequence
  Synthetic
gttgtccccagatgaaaaatgcttagtactaacagaacatttaatgtcagagtaccaattattgttgttagatga

SEQ ID NO: 327155 - DNA, 75 bp, Artificial Sequence
  Synthetic
ataccaacaacagggaagaatcaatcctagattcattctccaaccagaagcaagacggatcatccaaaatgccat

SEQ ID NO: 327156 - DNA, 75 bp, Artificial Sequence
  Synthetic
tgcagaacttagtaagcgtagttacaacttaactaatcctaggattaccgctttcccaagcaataacttttatct

SEQ ID NO: 327157 - DNA, 75 bp, Artificial Sequence
  Synthetic
tcggaaggcaatggtagttagacacttccttacctatgaactccaaatggcacaatctaaaacccttttagcaaa

SEQ ID NO: 327158 - DNA, 75 bp, Artificial Sequence
  Synthetic
gactcgaaaggtccttaatagcatacgggattctgaggaggggcaataccttattggggcatattatgattcatt

SEQ ID NO: 327159 - DNA, 75 bp, Artificial Sequence
  Synthetic
cagatactatgctatggttggagatgtaggcaaatatattgaacatagtgggatggggggattcttctgtactct

SEQ ID NO: 327160 - DNA, 75 bp, Artificial Sequence
  Synthetic
ccagcaaatggagaccgatattattttgcactctacccttatagctccatatgacacaagtgagactttaaccaa

SEQ ID NO: 327161 - DNA, 75 bp, Artificial Sequence
  Synthetic
taagtacgggttgggcacaaggtggcctactctagctctggctgcattctcaggagaattacagaagttgaaggc

SEQ ID NO: 327162 - DNA, 75 bp, Artificial Sequence
  Synthetic
atttgatctatgtatctctctctttcctcatgatgataacctcgaaaaatacccattacctgtagatcatgactc

SEQ ID NO: 327163 - DNA, 75 bp, Artificial Sequence
  Synthetic
tctgatgttgcattatcaaagcttaggccctatggcgaagtatatggcactcctggagtcaccaaagctaatgga

SEQ ID NO: 327164 - DNA, 75 bp, Artificial Sequence
  Synthetic
gcaatcagcagtgtctacaatagttcctggaccaccaatacaccatgtactacggcccttaggggtttcctcaac

SEQ ID NO: 327165 - DNA, 75 bp, Artificial Sequence
  Synthetic
ttttgcaccggctgagtacccgttgatgtatagctacgcaatgggaatagggactgtcatcgatacaaatatgcg

SEQ ID NO: 327166 - DNA, 75 bp, Artificial Sequence
  Synthetic
atcatggtacaaaggactcagttatgttaggtacctggaactatgtaaagtcccaaccggtgatcatctatatct

SEQ ID NO: 327167 - DNA, 75 bp, Artificial Sequence
  Synthetic
aaattatgcctatgggagatcctatcttaaccctcagtacttccaattaggtgtagaaactgctaggaaacaaca

SEQ ID NO: 327168 - DNA, 75 bp, Artificial Sequence
  Synthetic
tgcagaaggcagtggagcatccatgtcattagtggaaatgctaatcccaggtcaaaaagtgtattacaatagtct

SEQ ID NO: 327169 - DNA, 75 bp, Artificial Sequence
  Synthetic
gggtgcagttgatcaccgaactgctgaagatctcggaatgtcccaagcagataaagtggaacttgcagcaactct

SEQ ID NO: 327170 - DNA, 75 bp, Artificial Sequence
  Synthetic
ctttagcagtggtgagaatcctccccagagaaactatgccccattaccaactcaatttgtacaaagtgtaccata

SEQ ID NO: 327171 - DNA, 75 bp, Artificial Sequence
  Synthetic
tgccaagctcacaattggtcaaggtggacgtgggcgtcagcctcttgatgatccatttgctggtgcagctggaga

SEQ ID NO: 327172 - DNA, 75 bp, Artificial Sequence
  Synthetic
caaattatggcaggcagatctcactaacaaagaaggtataattgaagactttataccactatggaatggaaatgg

SEQ ID NO: 327173 - DNA, 75 bp, Artificial Sequence
  Synthetic
ctaccagggtgcggcagctggaggtgcacaagggtttgactacgcctcccgtcgggttagaaaatataatgatta

SEQ ID NO: 327174 - DNA, 75 bp, Artificial Sequence
  Synthetic
tgcagtgaccgatctgagtaacaaggattgtgttgcttttatcatacataaggtaggagcagagcaagcatcgtt

SEQ ID NO: 327175 - DNA, 75 bp, Artificial Sequence
  Synthetic
tgagagtgatgaggaagctggaatggatgacgattatgagcaagaggctagagagggcaggggctatgatgatga

SEQ ID NO: 327176 - DNA, 75 bp, Artificial Sequence
  Synthetic
agttcatgttgacctagagtcaactgcaaacctgaatcaacaatccctttcaaggtctcagatacatgccctgat

SEQ ID NO: 327177 - DNA, 75 bp, Artificial Sequence
  Synthetic
tgatgcccgtcaaggtattggaggtcaatcgggatttgacttcagtgttcctcaaagggctccgggaatgagtga

SEQ ID NO: 327178 - DNA, 75 bp, Artificial Sequence
  Synthetic
aatagctaccacagtattgaaaagaggaggcttcctagtgtataaaacctcgtggctcccattttctagattaag

SEQ ID NO: 327179 - DNA, 75 bp, Artificial Sequence
  Synthetic
tgaggaattccaagcacagatgacaaagtacatccagcatgtgcaacagcactatcaagaagctcaggaaggtgc

SEQ ID NO: 327180 - DNA, 75 bp, Artificial Sequence
  Synthetic
ccaattggcttgtgtgttatggtccttttttgataaaatcaccatgattcgtagcagctactctgacccaaatag

SEQ ID NO: 327181 - DNA, 75 bp, Artificial Sequence
  Synthetic
agaggatggcggctacaaccaaaccacagacgatcagggagcaggaggcgattttgacacataattaatttaaga

SEQ ID NO: 327182 - DNA, 75 bp, Artificial Sequence
  Synthetic
ccatgaaatatatctagtctgtcgccttgctgccgatttcaaaaccataggctttagtgctgcactcgcatctgc

SEQ ID NO: 327183 - DNA, 75 bp, Artificial Sequence
  Synthetic
ttgatctacttgtaagatagcaaacaatgactgtactagaataatccctgtaatctagccataaaggcatactcc

SEQ ID NO: 327184 - DNA, 75 bp, Artificial Sequence
  Synthetic
aatagcaatagcaatacatggggatggttttacaaccattcatcctgatgtcgtcagtaattattggcaacatca

SEQ ID NO: 327185 - DNA, 75 bp, Artificial Sequence
  Synthetic
tgcaactgttgatttaaagaaaaacttaggcccggactggtatcacaccgccggctctttcaagcgttggccaac

SEQ ID NO: 327186 - DNA, 75 bp, Artificial Sequence
  Synthetic
ccttgagaacgtcgggcgggttgggaaggcaatagatgatgtaatagatggcgtatccactaatttctattctgg

SEQ ID NO: 327187 - DNA, 75 bp, Artificial Sequence
  Synthetic
ccttttgcctcctgctgcagtcatggcagaagagccaacctacacggccgagcaggtcaatgacgtagtccatgc

SEQ ID NO: 327188 - DNA, 75 bp, Artificial Sequence
  Synthetic
agataacggattaatcctccgttgtggaggaacacctagttcacgaaaatggttggatatagatcttctcccaac

SEQ ID NO: 327189 - DNA, 75 bp, Artificial Sequence
  Synthetic
aggactcggaactgtggatttcttcctatcccgtccagtagatggtcaatcatccctgggcaagggaagtgtgcc

SEQ ID NO: 327190 - DNA, 75 bp, Artificial Sequence
  Synthetic
attctcttctctacaggagacattggtaaatctggtgacagttcacctcaaagagattattgaaattcaaacttc

SEQ ID NO: 327191 - DNA, 75 bp, Artificial Sequence
  Synthetic
tccaggcataaccgctgtgctgacaaatgctgctgagcttaaagccaagacagctgctgctgcccctgtaaagcc

SEQ ID NO: 327192 - DNA, 75 bp, Artificial Sequence
  Synthetic
atctatggaggattatacctccttattgtttacaccctataatattgggtcagttgggaaaattaggactattgt

SEQ ID NO: 327193 - DNA, 75 bp, Artificial Sequence
  Synthetic
caaaagaaagaagattcagcatatgactccagcttacaccattgctgacaatggagatccaaatcgtttgccagc

SEQ ID NO: 327194 - DNA, 75 bp, Artificial Sequence
  Synthetic
taagcttatcctagagagatctttgatgtatgtaatcaggaattggttagtcatgccatcatcttatcaggacag

SEQ ID NO: 327195 - DNA, 75 bp, Artificial Sequence
  Synthetic
taacaccccaattgctaacccacttataccaattgaacggcctcctggtaggatgactgatcttgacctggcaac

SEQ ID NO: 327196 - DNA, 75 bp, Artificial Sequence
  Synthetic
cgttagacaagacttggaattaggatctttccgactgtcttccgtactacaggaagatacattttggaaattgac

SEQ ID NO: 327197 - DNA, 75 bp, Artificial Sequence
  Synthetic
tggaacagtaacacagggcacttataagggcgttgaactagctaaagcagggaaaaatgcactattaacaaggtt

SEQ ID NO: 327198 - DNA, 75 bp, Artificial Sequence
  Synthetic
agagaatcgtaaatacttagcaagccagcttacaagagattatatcaccacattctttactacgcattctatcct

SEQ ID NO: 327199 - DNA, 75 bp, Artificial Sequence
  Synthetic
tagttcaggtccatcactgaccgatcaggcgtcatccaaggaccccaactttaagagggggggagaaattgacgg

SEQ ID NO: 327200 - DNA, 75 bp, Artificial Sequence
  Synthetic
cccaattcacaggtcgtatcaaaaacgcatttggaaagccttagggagtgtgatttactgttcagaagttccagg

SEQ ID NO: 327201 - DNA, 75 bp, Artificial Sequence
  Synthetic
acgccacaaaggccgacataggagggagtggagcatcgcctgggtcggagacgaagttaaggtttatgagtggtg

SEQ ID NO: 327202 - DNA, 75 bp, Artificial Sequence
  Synthetic
ggaaagccagcaaaattgggattccattccattagtttatgaggaagatcagattgagcgcggtatcgatgggga

SEQ ID NO: 327203 - DNA, 75 bp, Artificial Sequence
  Synthetic
caatccaacatgtgccccagttactgccactgaccgcaagttctcctgtacttgtggaacctgccccgataggtg

SEQ ID NO: 327204 - DNA, 75 bp, Artificial Sequence
  Synthetic
agagctgtagaaacactttaatcaacagttgaagacagttttaatttaagaaaaaatatccgttctccccttggt

SEQ ID NO: 327205 - DNA, 75 bp, Artificial Sequence
  Synthetic
cggagaatgtgaaggagataattgaaatacttcgaggccttgatctcagaatgcaatctctggaagggaaagtgg

SEQ ID NO: 327206 - DNA, 75 bp, Artificial Sequence
  Synthetic
ataagattcttgcaacctcggcaaccataacagccttaaagaatgaagtgacaagtctaaaagcaaatgtggcca

SEQ ID NO: 327207 - DNA, 75 bp, Artificial Sequence
  Synthetic
cagttgagggcatgatgactactatgaaaattatggacccaagcactccaactaatgtaccagttgaaaagataa

SEQ ID NO: 327208 - DNA, 75 bp, Artificial Sequence
  Synthetic
gaaagaacctgaaagatactcctgttataatctcagggcccctgagtgagagccacatcactgaagggagtgata

SEQ ID NO: 327209 - DNA, 75 bp, Artificial Sequence
  Synthetic
tgattgtgcttgatgaattagccaggccttctctaagttccacaaagaagattgtgaggagacctgaacccaaga

SEQ ID NO: 327210 - DNA, 75 bp, Artificial Sequence
  Synthetic
aggatttaacaggtatgaaattaatgttgatccaactagctaatgactgtatggggaagcctgatcaaaaggcag

SEQ ID NO: 327211 - DNA, 75 bp, Artificial Sequence
  Synthetic
aaatcgtggcaaaaattcatgcggctactcgtgaggctcagctgttagatatcaagcgcagcatcatcaagtctg

SEQ ID NO: 327212 - DNA, 75 bp, Artificial Sequence
  Synthetic
caatataagaaatcttagttgagtacatacctaagacacaacaataattccactacatatatattgaatcgaagt

SEQ ID NO: 327213 - DNA, 75 bp, Artificial Sequence
  Synthetic
gagcactagggtggataggtcaagggacacatctaggcatcagaaatccgagtcaatctgcactgtccgggttta

SEQ ID NO: 327214 - DNA, 75 bp, Artificial Sequence
  Synthetic
agaaaaaaccaagtgtcaagagcatcagataggcacgaacctaacacaccccgagacacaccagccacacacatc

SEQ ID NO: 327215 - DNA, 75 bp, Artificial Sequence
  Synthetic
cgggccgaccagcagccatgcccaccatatccatccccgctgatcccgcatctccagaccagggcctaaaaccct

SEQ ID NO: 327216 - DNA, 75 bp, Artificial Sequence
  Synthetic
ttccaatccaacttgactccaaggacgggaaaagtgggaagcttgtgaagcaaatcagaatcaaataccttactg

SEQ ID NO: 327217 - DNA, 75 bp, Artificial Sequence
  Synthetic
agcccaactcaagatcacccccacttacattcatcaatacttacggtttcatctatgcacgagatttgagtggtg

SEQ ID NO: 327218 - DNA, 75 bp, Artificial Sequence
  Synthetic
ggatcatgaatgagcaatcatcggggatccagtctggatcagtaaccgcctgcatgatgactctaggtcctggtc

SEQ ID NO: 327219 - DNA, 75 bp, Artificial Sequence
  Synthetic
ctgacattaagaacgcaaacagagtcttggccgcactgaatggattctatgttaaagtcagaaaaacttctagcc

SEQ ID NO: 327220 - DNA, 75 bp, Artificial Sequence
  Synthetic
ttaaagaggaagcggtctttgagcttgttaatgttccaaaattattggcaaaccatgcactgtgtaagcagggga

SEQ ID NO: 327221 - DNA, 75 bp, Artificial Sequence
  Synthetic
gactggtatgttctgctgagaagttcgttaagaacccatctaagatgatggccggtcaggaatacctgtactttc

SEQ ID NO: 327222 - DNA, 75 bp, Artificial Sequence
  Synthetic
caacatttgtgtccttgacttactgtccatcaaatctcaattatcaagttgcgaaaccgattctaaagattcgat

SEQ ID NO: 327223 - DNA, 75 bp, Artificial Sequence
  Synthetic
ccagatttgtctacagtatccatatggagattattttcagattgctctgtaaacctgattccccactattgaaga

SEQ ID NO: 327224 - DNA, 75 bp, Artificial Sequence
  Synthetic
cttatgcaactgatcctgaaggcaggggctgccttgcatcagtatggatccatgtgtgtaacattctcaagaaca

SEQ ID NO: 327225 - DNA, 75 bp, Artificial Sequence
  Synthetic
agaagatcaaacaaagaggggttgatagctatttttcaagtaaggctatcagcatgcaactgactgtctcaattg

SEQ ID NO: 327226 - DNA, 75 bp, Artificial Sequence
  Synthetic
ctgatacatggggccccactgtgataatcaaggccaacggtcatattcctaagactgcagctcctttcttcagta

SEQ ID NO: 327227 - DNA, 75 bp, Artificial Sequence
  Synthetic
aagatggtgtagcatgtcacccccttcaggatgtatcccctgctttgacaaagtcactatggtcggtggggtgtg

SEQ ID NO: 327228 - DNA, 75 bp, Artificial Sequence
  Synthetic
agatcaccaaggctcgactaatcttacaggaatcaaacatcagtgacctcctcaagacacaggatttgatcactg

SEQ ID NO: 327229 - DNA, 75 bp, Artificial Sequence
  Synthetic
atcagattaagatcaagaaaggtcattcacactttggccgatcatccttcaacccattcaaaaaagctatctctt

SEQ ID NO: 327230 - DNA, 75 bp, Artificial Sequence
  Synthetic
tacccaacctgacccaattggggcaagatgatgaagattaacctccatgcaaagaaatatacaattgcatagtta

SEQ ID NO: 327231 - DNA, 75 bp, Artificial Sequence
  Synthetic
tagtatcctctcaataatcagtcgagtaactaattgtcaatatactctaagcagtgctatcaaatttataaattt

SEQ ID NO: 327232 - DNA, 75 bp, Artificial Sequence
  Synthetic
taatcttagattaggtccgaacccaggcacaaccgccccacaccccaccgacccgccaccgccccactcactgcc

SEQ ID NO: 327233 - DNA, 75 bp, Artificial Sequence
  Synthetic
aacaagcaatcatcaaacactacattgagtgataatgaggctaactccctaccctatcgctctcactacacttat

SEQ ID NO: 327234 - DNA, 75 bp, Artificial Sequence
  Synthetic
gattgctttaacaacactacctgaaactggattagggattgctcgggatgctttgagccaggttggagtgatcca

SEQ ID NO: 327235 - DNA, 75 bp, Artificial Sequence
  Synthetic
atcaaaagctagatcactgatgtactattccgatggaagttcaagttttattgtagtgaaattgctccctactct

SEQ ID NO: 327236 - DNA, 75 bp, Artificial Sequence
  Synthetic
ccctactccatctggcaattgcaatctgacaagcattactgcttataacactacattatttaaattgcttacgcc

SEQ ID NO: 327237 - DNA, 75 bp, Artificial Sequence
  Synthetic
cctgatggaaaatctggacaccattgtgagtgcaaaccaagctggcagcagaagaaagagatttgctggtgttgt

SEQ ID NO: 327238 - DNA, 75 bp, Artificial Sequence
  Synthetic
tgtaggcttagctgccctgggagtagcaactgcagcccaagtgaccgcagctgtggcagtagtcaaagccaatgc

SEQ ID NO: 327239 - DNA, 75 bp, Artificial Sequence
  Synthetic
caatgcagctgctatcaataagttggctgcctctatccagtctaccaatgcagccatctctgacgtgatatcatc

SEQ ID NO: 327240 - DNA, 75 bp, Artificial Sequence
  Synthetic
aactagaacactagcgacagcaattcaagctgtccaagatcatgtaaatggggtgctggcaagtggcttgacaga

SEQ ID NO: 327241 - DNA, 75 bp, Artificial Sequence
  Synthetic
ggcaaactgtaggtcccaagatgcattgattggatcaatcctgaatctctatctaactgaactcactacaatttt

SEQ ID NO: 327242 - DNA, 75 bp, Artificial Sequence
  Synthetic
ccataatcaaattgtcaatcccgcattaactccactgtctatccaagcactacgaataattctaggaagcactct

SEQ ID NO: 327243 - DNA, 75 bp, Artificial Sequence
  Synthetic
cccacttattgttgaatcacggtggaatacaaatctaaatacagcagaactcttaagttccgggctattaactgg

SEQ ID NO: 327244 - DNA, 75 bp, Artificial Sequence
  Synthetic
gcaaatcatatcgatctctccatcctatatgcagatggtgatccagattacagtccctacctttgttatgcaacc

SEQ ID NO: 327245 - DNA, 75 bp, Artificial Sequence
  Synthetic
aggggcaaagattatcgatttagttacaatcacggccaatcgaatggaagaagaggtattgattcaagttccgcc

SEQ ID NO: 327246 - DNA, 75 bp, Artificial Sequence
  Synthetic
aagaatccttgagtatgcaaacgagattcaggcatataccgcggatgattgtgttgtaacccctcatgcagtctt

SEQ ID NO: 327247 - DNA, 75 bp, Artificial Sequence
  Synthetic
ttgtaagtacaatgacggctctcccatctctgatagcttatatcaatgccttaaagggaatttaacatcctgtgt

SEQ ID NO: 327248 - DNA, 75 bp, Artificial Sequence
  Synthetic
attcactccagtagttggaaattatcttaagcgatttgcatttgccaatggggtaatgtatgttaattgcaaagc

SEQ ID NO: 327249 - DNA, 75 bp, Artificial Sequence
  Synthetic
ccttctatgtcgctgtgctgatccgccaatggtcattacgcaggacgatctagcaggaatcacagtaatagacat

SEQ ID NO: 327250 - DNA, 75 bp, Artificial Sequence
  Synthetic
tactgtctgtagagaagtcatgctagatacattagcatttaagattacttctctgaacaatgttacttatggtgc

SEQ ID NO: 327251 - DNA, 75 bp, Artificial Sequence
  Synthetic
taatttctcaatgctggcagcggccatcaaagacctctctccattagatctttcagcccagttggcccaagtcaa

SEQ ID NO: 327252 - DNA, 75 bp, Artificial Sequence
  Synthetic
caagtcgttggcgtctgcagaagagaaaattgcgcagagttcctcacttgcagcacaagcagtatcccaagaagc

SEQ ID NO: 327253 - DNA, 75 bp, Artificial Sequence
  Synthetic
tacaatcactgtcggatcagttgcaatgctcattgctgttctcgcgctaattgctggttgcacagggattatgat

SEQ ID NO: 327254 - DNA, 75 bp, Artificial Sequence
  Synthetic
tgcagtccagatgagccgtaggttagaggtacttaggcatttaactgatcaaagcattatatcaaatcatcacta

SEQ ID NO: 327255 - DNA, 75 bp, Artificial Sequence
  Synthetic
tgctgaattgaaccccccaccatataaccactcctatgaatcattacatcctattccacaaagccattgattcta

SEQ ID NO: 327256 - DNA, 75 bp, Artificial Sequence
  Synthetic
attacagtataagtaagctgttaactacccattaatatacatgtttcttgaactaatcattcctatatatttaat

SEQ ID NO: 327257 - DNA, 75 bp, Artificial Sequence
  Synthetic
ttaagaaaaaatgataggcacgaacccttatggtgccgtaacgtctcgtggcactgggttcaacaaaaccctcgc

SEQ ID NO: 327258 - DNA, 75 bp, Artificial Sequence
  Synthetic
tttagacactacatccaatttcctttccctatccaatcaattacctcacagttggtaacccactacaagaagtca

SEQ ID NO: 327259 - DNA, 75 bp, Artificial Sequence
  Synthetic
tatacactacactggtgccgccaccatgtccggagcagagggtaacaccaacaagcggacatttagggcagtatt

SEQ ID NO: 327260 - DNA, 75 bp, Artificial Sequence
  Synthetic
caggacactaatcattcttattactctcacgatattagccttaagtgcggctattctttatgaagtcactcatac

SEQ ID NO: 327261 - DNA, 75 bp, Artificial Sequence
  Synthetic
aagtaatggttctgagtcaaacaaccaggtgtttgaccctactgacactctaaatgccattacaggaaatatcaa

SEQ ID NO: 327262 - DNA, 75 bp, Artificial Sequence
  Synthetic
atcaatgattgccctgctgaatcaaatattgtataatgcagcaattgctttaccgctcaagattgacagtactga

SEQ ID NO: 327263 - DNA, 75 bp, Artificial Sequence
  Synthetic
atcagtcctcctcgcagcaattaaagatttgcaattcagtaaccctgcctctcaaaactgctcttctggcggaaa

SEQ ID NO: 327264 - DNA, 75 bp, Artificial Sequence
  Synthetic
tttactaaatgatgcactttacattaatggcatcaatcaatacttgctctctaattcatttgcaggaactgtagg

SEQ ID NO: 327265 - DNA, 75 bp, Artificial Sequence
  Synthetic
tcttggtccactattaaatataccaagcttcattccatctgccactgcacctggaggctgcactaggatcccatc

SEQ ID NO: 327266 - DNA, 75 bp, Artificial Sequence
  Synthetic
cttttcgttgacaaagacgcattggtgctattcacacaatgtcattctagcaggatgtgcagactcaaaggcatc

SEQ ID NO: 327267 - DNA, 75 bp, Artificial Sequence
  Synthetic
taatcaataccttgcgatgggtattgttgagcagtcgtctgcagacttcccattcttccgtaccatgagaacgct

SEQ ID NO: 327268 - DNA, 75 bp, Artificial Sequence
  Synthetic
ctacctaagcgacggtattaaccgtaagagctgctcaattgtagccattccaggcgggtgtgctctttattgcta

SEQ ID NO: 327269 - DNA, 75 bp, Artificial Sequence
  Synthetic
tgttgctactaaaacagaacaggaagactatgctgcaactactccttcagagttgagattaacattttattacta

SEQ ID NO: 327270 - DNA, 75 bp, Artificial Sequence
  Synthetic
taatgaaaccctagtagaaaggacattgactataccaaatgtcaccgggaattgggccacacttaacccagctgt

SEQ ID NO: 327271 - DNA, 75 bp, Artificial Sequence
  Synthetic
tggaagtggagtatatcatttgggctatcttgcattccctgtgtatggtgggctaatacagaacagtgcagcatg

SEQ ID NO: 327272 - DNA, 75 bp, Artificial Sequence
  Synthetic
gaacagtcaatttgggtcgtactttctcccccaaaatccagcagtgcagtgttccggatcagcagagcaacaaat

SEQ ID NO: 327273 - DNA, 75 bp, Artificial Sequence
  Synthetic
aaatactgctaaggggtcatatgttgtcaattggttctcaggacgcctaatccaaagcgcagtccttgtttgccc

SEQ ID NO: 327274 - DNA, 75 bp, Artificial Sequence
  Synthetic
actaagcgatcaactaaccgaccagtgtcgagttgtgctgttcaataattccgagaccatgatgggagctgaagg

SEQ ID NO: 327275 - DNA, 75 bp, Artificial Sequence
  Synthetic
ccggctatacaccattgggggtgacctctactactatcaaagaagctcatcctggtggaccgcatcgttactcta

SEQ ID NO: 327276 - DNA, 75 bp, Artificial Sequence
  Synthetic
caagattaacactgatttttctcaagggcttccaccgttaattgaagcacaatgggtgccaacctacttagtacc

SEQ ID NO: 327277 - DNA, 75 bp, Artificial Sequence
  Synthetic
aaggcctggagcccaaccatgcagtgcaggtaatttttgtcctgccaactgtattaccggagtctatgctgatgt

SEQ ID NO: 327278 - DNA, 75 bp, Artificial Sequence
  Synthetic
ctggcctatgaacaatccattccctgcagggagctcaggagtcaatccaaactacttatttggtggggcttttct

SEQ ID NO: 327279 - DNA, 75 bp, Artificial Sequence
  Synthetic
gtgggctgacgttgcccgtgttaatccgacattttatatggcttctgctacacaatataaaaacactacaggctt

SEQ ID NO: 327280 - DNA, 75 bp, Artificial Sequence
  Synthetic
ccctaactccaatcagaaagctgcatacactagtaccacgtgctttcaaaataccggcagtaagaaaatctactg

SEQ ID NO: 327281 - DNA, 75 bp, Artificial Sequence
  Synthetic
tttattcataattgaaatgggatcctcgttaatgggagagttccagattgttccatttttgcgtgaggtgatcat

SEQ ID NO: 327282 - DNA, 75 bp, Artificial Sequence
  Synthetic
tacttaggaaccatactcataatatgttcaaacctattacataaccatagttgacagcacccactatgattatca

SEQ ID NO: 327283 - DNA, 75 bp, Artificial Sequence
  Synthetic
agatttaagcccaatcaaatccatttctcccatttgatggtacacttaagcaattactacaaagaatgatttatt

SEQ ID NO: 327284 - DNA, 75 bp, Artificial Sequence
  Synthetic
taaagaaaaattacaataggccagaatggcggcctctgctgacattctgttgcccgaagtccatcttaactcacc

SEQ ID NO: 327285 - DNA, 75 bp, Artificial Sequence
  Synthetic
aattgttaaacacaagcttgtctatttcctccttcttggaaagctacctcataatctttccgaagatgagattac

SEQ ID NO: 327286 - DNA, 75 bp, Artificial Sequence
  Synthetic
accactacacaaccagaattgggaccaaattgcacatgaggaatccaacctatctgaaaggttatttgctgtgcg

SEQ ID NO: 327287 - DNA, 75 bp, Artificial Sequence
  Synthetic
cagtgagctaacacgacgaatagcccaattacgggctacacgatggagatcagagattgcagtcctattatggcc

SEQ ID NO: 327288 - DNA, 75 bp, Artificial Sequence
  Synthetic
caattctctcccttacctttgcactttcaaaccatacaatcgcttaaacactattgatgaatggaataagcttgt

SEQ ID NO: 327289 - DNA, 75 bp, Artificial Sequence
  Synthetic
ctctgctgcttctaatattttatcctcacccctatctaaatgtatgcaggatatatcaaccaaattgattgggag

SEQ ID NO: 327290 - DNA, 75 bp, Artificial Sequence
  Synthetic
gaccaatttgttttctagatctcaaagtcgcccagggcaatcagcagataatactataacactaaataagattgc

SEQ ID NO: 327291 - DNA, 75 bp, Artificial Sequence
  Synthetic
tgcagtctgggcggacaacaaatggcaacccttagtgtcattatggctgactattaaataccagatgaggcagat

SEQ ID NO: 327292 - DNA, 75 bp, Artificial Sequence
  Synthetic
gatagcaaatcaaagcaagcgcacgtgcagtgaattagtgtatgtagtagacactaggtcaggtatcataataat

SEQ ID NO: 327293 - DNA, 75 bp, Artificial Sequence
  Synthetic
cactcccgaacttgtaacatgcttcgataaagatcactcagtactaatgtacttcactttcgaaatggttttgat

SEQ ID NO: 327294 - DNA, 75 bp, Artificial Sequence
  Synthetic
gatctctgacctatttgagggtcgtatgaatgtcacagctctttgcactgttagtaactacctcagccctttact

SEQ ID NO: 327295 - DNA, 75 bp, Artificial Sequence
  Synthetic
atcccgaattgagagactatttgatattgttgatcacttggctcacctattaggagataatgtgtataaaataat

SEQ ID NO: 327296 - DNA, 75 bp, Artificial Sequence
  Synthetic
agcatctttagaatcattggtctatggttgtttgcagctgcatgatcccgtcattgaccttgcaggaacatttta

SEQ ID NO: 327297 - DNA, 75 bp, Artificial Sequence
  Synthetic
ctccttcgttgcccaagagatagtagatggattgcagcaaggtaacatattaagcccagaagaagcatacaccgt

SEQ ID NO: 327298 - DNA, 75 bp, Artificial Sequence
  Synthetic
cactgaacaactattagaatgcttcagtggcctttcccccgacctcactgcagaattactatgtttgatgagatt

SEQ ID NO: 327299 - DNA, 75 bp, Artificial Sequence
  Synthetic
atggggacatcccaacctcactgctgcacaagctgcaaaaaaagtcagagacacaatgtgtgccggtaaagtact

SEQ ID NO: 327300 - DNA, 75 bp, Artificial Sequence
  Synthetic
tgacttccaaataattatgaaaaccctagctttcttccatacaattcttatcaacgggtacagaagaaagaaaaa

SEQ ID NO: 327301 - DNA, 75 bp, Artificial Sequence
  Synthetic
tgggatttggccaccactcagtctcccagggaatgccagtaaaagtttgattgagctccaccatgataactctga

SEQ ID NO: 327302 - DNA, 75 bp, Artificial Sequence
  Synthetic
aatctcttatgaatacaccctacgtcattggaaagaattatccctcatagaattcaaaaaatgtttcgattttga

SEQ ID NO: 327303 - DNA, 75 bp, Artificial Sequence
  Synthetic
cccaggagaggagctaagcatattcatgaaggataaggctataagtgcaccaaaagaggattggatgagtgtttt

SEQ ID NO: 327304 - DNA, 75 bp, Artificial Sequence
  Synthetic
ccggaaaagtttaatcaagcagagacatcagcgtcatcacatcccaatgcctaaccccttcaatcgacggctact

SEQ ID NO: 327305 - DNA, 75 bp, Artificial Sequence
  Synthetic
cttaaattttatagaggacccgtcatttgaccccgccaaggagttagagtatgttacaagtggtgaatacttaag

SEQ ID NO: 327306 - DNA, 75 bp, Artificial Sequence
  Synthetic
ggatccacacttttgtgcatcatactcactaaaggagaaagagattaaaccagatggaagaatctttgctaagtt

SEQ ID NO: 327307 - DNA, 75 bp, Artificial Sequence
  Synthetic
aactaaccgcatgaggtcctgtcaagttatagctgaagcactgttagcaaatcatgctgggaaactcatgaaaga

SEQ ID NO: 327308 - DNA, 75 bp, Artificial Sequence
  Synthetic
aaatggtgtggtcatgaatcagatatccctaaccaaatcattactaacaatgagtcaaatcggattaatatctga

SEQ ID NO: 327309 - DNA, 75 bp, Artificial Sequence
  Synthetic
gaaagcacaacggtatacacgagataatattgctctaggtgccttattttctaaaggacaaaggactagagctca

SEQ ID NO: 327310 - DNA, 75 bp, Artificial Sequence
  Synthetic
tcctcaaacacaactaagcagtatagattcatcccagaacagggagcttcctgatgactcattagaattgagtgc

SEQ ID NO: 327311 - DNA, 75 bp, Artificial Sequence
  Synthetic
ctgcttcatcacaacagatcttactaaatactgtccgcagtggaggtatcaaactataatcccttttgccaaaac

SEQ ID NO: 327312 - DNA, 75 bp, Artificial Sequence
  Synthetic
acttaatagaatgtatggtgtaccacatttgtttgaatggatccacctaaggctattgaggtctaccctctatgt

SEQ ID NO: 327313 - DNA, 75 bp, Artificial Sequence
  Synthetic
aggggacccatttaatccaccagctgacactagtgtgtttgatctggatcaggtgttgaatggtgacatattcat

SEQ ID NO: 327314 - DNA, 75 bp, Artificial Sequence
  Synthetic
cgtgtcaccaaaaggaggtatagagggcttatgccaaaaaatgtggacgatgatatccatctcagtaattattct

SEQ ID NO: 327315 - DNA, 75 bp, Artificial Sequence
  Synthetic
ctcttctgcagaatctaaaactcgagtaatgagtatggttcagggagataaccaagcaatagctgtaacaacaaa

SEQ ID NO: 327316 - DNA, 75 bp, Artificial Sequence
  Synthetic
ggttccaaggtcagttcctctcactgaaaagaggaacctagcctataatgcaagcaaactgttttttgatcggct

SEQ ID NO: 327317 - DNA, 75 bp, Artificial Sequence
  Synthetic
aaaacataacaattttggactaggtcatcagcttaaagcacaggaaacaattatcagttctcaattcttcatcta

SEQ ID NO: 327318 - DNA, 75 bp, Artificial Sequence
  Synthetic
cagtaaaagggttttttatcagggtaggatcctaactcaggctctcaagaatgctagcaaactgtgtctaaccgc

SEQ ID NO: 327319 - DNA, 75 bp, Artificial Sequence
  Synthetic
ggatgtcttaggggagtgcactcaagcatcttgttcaaatgcagctacaacgattatgagattaactgagaatgg

SEQ ID NO: 327320 - DNA, 75 bp, Artificial Sequence
  Synthetic
agtggagaaggatgtgtgctacatgctcaatgtttaccaagcaataagacaattatgttttgacctgtattatcc

SEQ ID NO: 327321 - DNA, 75 bp, Artificial Sequence
  Synthetic
tcagtacagtatccccggagaacaaattagccaacattatctcaagcatccgagtatagttgcccggctagttat

SEQ ID NO: 327322 - DNA, 75 bp, Artificial Sequence
  Synthetic
attaccatctcagttgggtggcttgaactacctgtcctgtagccgactatttaacaggaatatcggtgatccact

SEQ ID NO: 327323 - DNA, 75 bp, Artificial Sequence
  Synthetic
aggaactgctgttgcagacctaaagaggctgattaagtgtggagcattagaaagttgggtattatcaaacttatt

SEQ ID NO: 327324 - DNA, 75 bp, Artificial Sequence
  Synthetic
atcccgtaaaccaggtactggttcctgggcaacccttgctgctgatccatactctctgaacatagactacctata

SEQ ID NO: 327325 - DNA, 75 bp, Artificial Sequence
  Synthetic
cccaccaaccactattctcaaacggcatactcaaaacaccctcatggaggtgtgcaaaaacccaatgctgaaggg

SEQ ID NO: 327326 - DNA, 75 bp, Artificial Sequence
  Synthetic
tgtcttcaccgacaacgcccgagaagaggagaacaatcttgctaaatttctacttgacagggatatagtactacc

SEQ ID NO: 327327 - DNA, 75 bp, Artificial Sequence
  Synthetic
tcgggtggcgcacattgtgattgagcagtcaagtgtgggcagaaagaagcaaatccagggcttctttgacacgac

SEQ ID NO: 327328 - DNA, 75 bp, Artificial Sequence
  Synthetic
taggaccatcatgaggaaatcttttgagataaagccattgtcatctaagaggactctttcagtaatcgagtgtaa

SEQ ID NO: 327329 - DNA, 75 bp, Artificial Sequence
  Synthetic
tattaactatttagcatacaacttcaacataatccatcaccccaaccccatcccaggttacttacagtgtattac

SEQ ID NO: 327330 - DNA, 75 bp, Artificial Sequence
  Synthetic
cacagacaattgcagtgttgatatcgcaaggagtctcagaaaattgtcatggtcttctctcttgaacggaaggac

SEQ ID NO: 327331 - DNA, 75 bp, Artificial Sequence
  Synthetic
tttggaaggattagagacacctgacccaatagaagtagtcaatggtgcactagttataggagtgggtgaatgcga

SEQ ID NO: 327332 - DNA, 75 bp, Artificial Sequence
  Synthetic
ctactgcatgcaaggagatacaaaattcacttggttctttctaccaaaaggtatagagatagatggggatccaga

SEQ ID NO: 327333 - DNA, 75 bp, Artificial Sequence
  Synthetic
aaagaacccaccaattcgcgtcccatatgttgggtcaaaaacagaagagagacgtgttgcctcaatggcttatgt

SEQ ID NO: 327334 - DNA, 75 bp, Artificial Sequence
  Synthetic
taaaggggcgactagtagccttaaggccgctctcagaggagcgggggtattcatctgggcctatggagacactga

SEQ ID NO: 327335 - DNA, 75 bp, Artificial Sequence
  Synthetic
tgctaactgggacgatgccttggatctagcaaacacaagagtacaaatatcaaaagaacaactgcaagctctgac

SEQ ID NO: 327336 - DNA, 75 bp, Artificial Sequence
  Synthetic
accgttacccacttcagctaatatcacccacaggttagatgatggagcgactacaattaagttcaccccagcgag

SEQ ID NO: 327337 - DNA, 75 bp, Artificial Sequence
  Synthetic
ttcttatgctttttctagttatacccatatctctaatgatcagcagtaccttgaagtagacaatagagtggttga

SEQ ID NO: 327338 - DNA, 75 bp, Artificial Sequence
  Synthetic
ctctaacatcatttatcagcaactcatgatcactggcctaggtattatagaaacatacaacaatccacccataag

SEQ ID NO: 327339 - DNA, 75 bp, Artificial Sequence
  Synthetic
gacttcaagtgaagagctgactctccatctgcatactagttcttcctgttgtataagacctgtagatgggtgcat

SEQ ID NO: 327340 - DNA, 75 bp, Artificial Sequence
  Synthetic
catatgtgaaagcccatccttattgcctcaattaactgtgccatataccaacccatttgtgtacgaccctaatcc

SEQ ID NO: 327341 - DNA, 75 bp, Artificial Sequence
  Synthetic
gttctacgtcacaaaaatggggggggcaaccccgcccttttggcgggaaccaatcaaattttcaaacctgtccaa

SEQ ID NO: 327342 - DNA, 75 bp, Artificial Sequence
  Synthetic
attcacatactataatctacatgggtggggcctctatagtcccctgtggctagatccagacagaatagaaccaga

SEQ ID NO: 327343 - DNA, 75 bp, Artificial Sequence
  Synthetic
tcccgacacgctacctcagaactacgtcacgtccgggcgccattttcaaattcagtataagacgcggaggggtga

SEQ ID NO: 327344 - DNA, 75 bp, Artificial Sequence
  Synthetic
aagtgaagccgccttcctagcagtaagatacaacccccttaatgacaaaggtgaaggtaactgggtagcgctaca

SEQ ID NO: 327345 - DNA, 75 bp, Artificial Sequence
  Synthetic
cgaatggtagagtttttccgcgccggacggtgaaaagaacaccgggaggagaacttttcagcgcctgggcgggtg

SEQ ID NO: 327346 - DNA, 75 bp, Artificial Sequence
  Synthetic
acctctcacaaaagaattacccatactagatgacacctgcaaaatggtattaaaagactatccgttatggctcat

SEQ ID NO: 327347 - DNA, 75 bp, Artificial Sequence
  Synthetic
ccggaggtgagtttacacaccgcagtcaaggggcaattcgggcgggcgcagtccggagcaaccgggcaagtgtct

SEQ ID NO: 327348 - DNA, 75 bp, Artificial Sequence
  Synthetic
actatatggatatccagacgctgccaccaagatactctcaggcagcagccccctaaacaacactagactcattat

SEQ ID NO: 327349 - DNA, 75 bp, Artificial Sequence
  Synthetic
gaaaagcgaaaccccatgtcccagctgcatttcaggcgcagacggccgcggccgccggttcatgggcaaacagga

SEQ ID NO: 327350 - DNA, 75 bp, Artificial Sequence
  Synthetic
tagatgtcagtatacagacccccctctagccttcccacaagccacagattacaaaagaggttacaccatctatag

SEQ ID NO: 327351 - DNA, 75 bp, Artificial Sequence
  Synthetic
cagcatcccagtgacctgcatatgttctggaaagcgccgcaggaggatgcgaggaccctcgagacccggtggctc

SEQ ID NO: 327352 - DNA, 75 bp, Artificial Sequence
  Synthetic
cagggacttcgccaccggaagaatgccgggtggcaacacatttatccctatcacaaccgccaggctgtggtatcc

SEQ ID NO: 327353 - DNA, 75 bp, Artificial Sequence
  Synthetic
cggatggtcctcatgtctcattctactttttgtcattgcctgcatcctcttggtcatttacattatatttctgtt

SEQ ID NO: 327354 - DNA, 75 bp, Artificial Sequence
  Synthetic
cagattgcagaaccaactggacgtagttgaggcaatagttaactgtggaccgttaatgcctagagacgacttaca

SEQ ID NO: 327355 - DNA, 75 bp, Artificial Sequence
  Synthetic
cgggataagggtccgcatggacagggacagactcccccccgcaccccacagctagacgtgccccccaacacccct

SEQ ID NO: 327356 - DNA, 75 bp, Artificial Sequence
  Synthetic
tcaaggctgggcggtaactatgggctacaagtaccgatttcaactgggagggaatctcccccccaaacaggaccc

SEQ ID NO: 327357 - DNA, 75 bp, Artificial Sequence
  Synthetic
gtgaccaccagcacgccggccaacagcaccgggggctcccagagcctcagtagcggccggggctcatggcctggt

SEQ ID NO: 327358 - DNA, 75 bp, Artificial Sequence
  Synthetic
agtcgacccctgcaaagttcccaagagagaactgcccgaccccagtgcagagcttactgcagtacaaattgtcga

SEQ ID NO: 327359 - DNA, 75 bp, Artificial Sequence
  Synthetic
acgggtggagaagaagaaggcgaggctgggggcgccggcgctggaggtatcgacgactactcagaggccgacctc

SEQ ID NO: 327360 - DNA, 75 bp, Artificial Sequence
  Synthetic
cccggccaccatggaccccctcagcaccttgcacccctgggattatcgaagatctatgctcaccagctcaggtat

SEQ ID NO: 327361 - DNA, 75 bp, Artificial Sequence
  Synthetic
gccgagctctacgccgccgtggatggagacgccgctggcaggtgaggaggagacgctgggggaggcggtggagac

SEQ ID NO: 327362 - DNA, 75 bp, Artificial Sequence
  Synthetic
taagagaatgtcagcagaccgcgaaactgactcatctctttacccaggtgcaacaggcgtggcaaaaaggccaaa

SEQ ID NO: 327363 - DNA, 75 bp, Artificial Sequence
  Synthetic
gcaggagacacaggagaccccgacgcagacgcaggtatcgacgcagacgcaggcgcagacgcactctcgcgctca

SEQ ID NO: 327364 - DNA, 75 bp, Artificial Sequence
  Synthetic
aacagacgtcccaacccaaaaaggcgaagagccagggccaggcgaaaggctgcgggaggtcctccagagtctcct

SEQ ID NO: 327365 - DNA, 75 bp, Artificial Sequence
  Synthetic
gacagtggaaccccaccacagttcgtggctgttcgatccgtggatggtttccattcctgatcacgggactaggac

SEQ ID NO: 327366 - DNA, 75 bp, Artificial Sequence
  Synthetic
ggaagaacagcagcaggagaccgaggacccgccgtcaccgccaccgggggaaagagtccagcagccagagctctt

SEQ ID NO: 327367 - DNA, 75 bp, Artificial Sequence
  Synthetic
gactcccctttctctacacacaccacatggacgacatccccgcagaaaagatgtcctttggaggcgggctagcag

SEQ ID NO: 327368 - DNA, 75 bp, Artificial Sequence
  Synthetic
ccaacagctcgccctcagataccagctgcagcagcagcgagagcgacaaggaaaactagcccagggtatcaagta

SEQ ID NO: 327369 - DNA, 75 bp, Artificial Sequence
  Synthetic
tcagccgcttctccctgtctgtgctgtacgaagagtaccgccgacaccacaacaagtggtctcgcagtaatgtag

SEQ ID NO: 327370 - DNA, 75 bp, Artificial Sequence
  Synthetic
catgttccaacagcttatcaaaacccagcagggagtacaagtagacccccgactgctatagtaagccccaccacc

SEQ ID NO: 327371 - DNA, 75 bp, Artificial Sequence
  Synthetic
acttagacctactccgataccacggagtctcctttaagttctatagagaaccagagatagacttcattgtccact

SEQ ID NO: 327372 - DNA, 75 bp, Artificial Sequence
  Synthetic
tctttcctactgttccccgagagagggccaaaaaggagactccccttcaccgattttgaccaccgaacagaggca

SEQ ID NO: 327373 - DNA, 75 bp, Artificial Sequence
  Synthetic
ggagcttagaaacacccatggagattaacctcatgacacacatgagtctccatcccctactcttgctgctaaaca

SEQ ID NO: 327374 - DNA, 75 bp, Artificial Sequence
  Synthetic
gaactggcctcggccttccgccgaccccctagagacagacccttccccgaagaggtgccctactaccccgacctc

SEQ ID NO: 327375 - DNA, 75 bp, Artificial Sequence
  Synthetic
aacacaaaataattattcccagcatgaaaaccagaccacacggacgcagagcggtgagactcacgctaccaccgc

SEQ ID NO: 327376 - DNA, 75 bp, Artificial Sequence
  Synthetic
aactacagagtctcctttcgcctgggttggaaaccctccccccaataaaacgcatccatcgagtttcagtggtcg

SEQ ID NO: 327377 - DNA, 75 bp, Artificial Sequence
  Synthetic
ccagactcatgaccaacaagtggtacttcaccaaagacttttgcaaagtaggcctctgcatgctcatggccaccc

SEQ ID NO: 327378 - DNA, 75 bp, Artificial Sequence
  Synthetic
gtgtccatttatataagtcggcgccgtcctaaatgggggtgcaggggtccacgctccaaaggtcgggctcgcgcg

SEQ ID NO: 327379 - DNA, 75 bp, Artificial Sequence
  Synthetic
catgcagcctgctgtatccctggttagacccaggaaaaaccagcccctgcgtacattttcacattttagaccagt

SEQ ID NO: 327380 - DNA, 75 bp, Artificial Sequence
  Synthetic
caaagcgcgcgacccctccggcgccgacgcgcgaacgtccgcgcttgcgcgcgtccgaacctcggcttcgggccc

SEQ ID NO: 327381 - DNA, 75 bp, Artificial Sequence
  Synthetic
cctactacaaacacatccccaacatagatccaaataaatacacagaaagagaaaatgatctaaaagatatcctaa

SEQ ID NO: 327382 - DNA, 75 bp, Artificial Sequence
  Synthetic
ttcgggccctcgcctcggatcgcgctgccgcattttttttactaaacagactccgagactgggccaccgccctgt

SEQ ID NO: 327383 - DNA, 75 bp, Artificial Sequence
  Synthetic
aaatagatgggtcctcaagtacatgtgtaggagcctgccactgctacacagaactcttcagagacgcctggccca

SEQ ID NO: 327384 - DNA, 75 bp, Artificial Sequence
  Synthetic
ggcgtaccgggaagtctccctaccgccaggggacgcgacttccgggtttaagagcaacatggcggcggtggcgcg

SEQ ID NO: 327385 - DNA, 75 bp, Artificial Sequence
  Synthetic
gcattagaaagccaggagtggcatcccaaccctttgggctaacagaaatatgtaaaacacaaaactatactaaca

SEQ ID NO: 327386 - DNA, 75 bp, Artificial Sequence
  Synthetic
ttgtagtgacgtcatggccgacatcttggtcttgaacccggaaggtcaaagttcaactacgtcacatccgcttcc

SEQ ID NO: 327387 - DNA, 75 bp, Artificial Sequence
  Synthetic
actcactagcagacacattcatatcgaaagctaacgaggcccactcaaatataactgacaaactcatgccttgtg

SEQ ID NO: 327388 - DNA, 75 bp, Artificial Sequence
  Synthetic
gggtagtggatgtcacatgatcagtcatgtgacttagtgcttgctggtcatgtgacatccgccatcttgatgcgg

SEQ ID NO: 327389 - DNA, 75 bp, Artificial Sequence
  Synthetic
tctatggcagcaattctgctgtcataactcaattaaaatcctcaaaggacaaaacattcatgcacagatggggcc

SEQ ID NO: 327390 - DNA, 75 bp, Artificial Sequence
  Synthetic
cagccatcttcgtagtcccttcctctttttctttcctaaaaaaagcggaagtccattctacgctgaatcggggtt

SEQ ID NO: 327391 - DNA, 75 bp, Artificial Sequence
  Synthetic
tgtattcacactactttctcaccacacgcagactagacccccaactcacaggacccactataaaagtaggctaca

SEQ ID NO: 327392 - DNA, 75 bp, Artificial Sequence
  Synthetic
tcgttgcaccgggggggctaaggcccccccccccgcgcatgcgcgcgggtccccccccacggggggctccgcccc

SEQ ID NO: 327393 - DNA, 75 bp, Artificial Sequence
  Synthetic
gggggctaaggcccccccccccgcgcatgcgcgcgggtccccccccacggggggctccgccccccggcccccccc

SEQ ID NO: 327394 - DNA, 75 bp, Artificial Sequence
  Synthetic
atccccagacagacgagggcaaaggcaacctcatattcctacaacccctaactaggtcagacaccatttttaacc

SEQ ID NO: 327395 - DNA, 75 bp, Artificial Sequence
  Synthetic
gcatacgtcacaaaccccgcccttttggcgggaaccaatcaaaaaatggggggggaatattcaaatccctccaat

SEQ ID NO: 327396 - DNA, 75 bp, Artificial Sequence
  Synthetic
ccaccagcagcaagtgcgccatctttgacacgcccctctggctagccctctatgggtacgagtcctactgcacca

SEQ ID NO: 327397 - DNA, 75 bp, Artificial Sequence
  Synthetic
cacatacaaacacgtcacagttacgtcccttccgggcgccatcttcaaactcactataaaacacggaggggtgac

SEQ ID NO: 327398 - DNA, 75 bp, Artificial Sequence
  Synthetic
aattcctcaatgacgaacaagtcatgtacaactacgtgctctgcgtgcgctgcacttacacctggcctcgcatgt

SEQ ID NO: 327399 - DNA, 75 bp, Artificial Sequence
  Synthetic
gaatggtagagtttttccgcgccggacggtgaaaagaacaccgggaggagatcttctcagcgcctgggcgggtgc

SEQ ID NO: 327400 - DNA, 75 bp, Artificial Sequence
  Synthetic
accgcacgggcaacccaaaccagtgtgacatccccctaggcaacagtttccttgaaggcaacatgccaggagggg

SEQ ID NO: 327401 - DNA, 75 bp, Artificial Sequence
  Synthetic
cggaggtgagtttacacaccgcagtcaaggggcaattcgggcgggcgcagtccggagcaaccgggcaagtgtctt

SEQ ID NO: 327402 - DNA, 75 bp, Artificial Sequence
  Synthetic
cctacccgccccccttactcatgagaaccaaatggtacccctgcctcctccaccagagagagtttatcaacgcag

SEQ ID NO: 327403 - DNA, 75 bp, Artificial Sequence
  Synthetic
aaaaccgaaagcatgttctctttcagacgccgccgcagagtacatgggcaaacaagacagcgtcccagtctgctg

SEQ ID NO: 327404 - DNA, 75 bp, Artificial Sequence
  Synthetic
tagtaggcagcgggcccttcatgcccagaggctactcagtcaagagctgggaactcacggcgggctacaaattta

SEQ ID NO: 327405 - DNA, 75 bp, Artificial Sequence
  Synthetic
tccatgttctggaaaaagagtgcggaggatgcaggggcctgggaggagaggtggctgcgatccgtgtacgacact

SEQ ID NO: 327406 - DNA, 75 bp, Artificial Sequence
  Synthetic
gattctcctggggcggtcacgccccctacacaaaacaggtcgacgacccctgcaagaaaggcacccatgcccttc

SEQ ID NO: 327407 - DNA, 75 bp, Artificial Sequence
  Synthetic
cacgctcttttttgctcttgtaattattttctgggccatctatctgctattcaagctcgccatcgagggccgcgg

SEQ ID NO: 327408 - DNA, 75 bp, Artificial Sequence
  Synthetic
ccgatcccgatagacaacgcatggcagtacaagtcgaggacccggggcgactggatccccagtacatgttccacg

SEQ ID NO: 327409 - DNA, 75 bp, Artificial Sequence
  Synthetic
ggacagtcccggactccccccaccctggacggcctggggccgccgtcaccaccacggctagcggcgcccccgccc

SEQ ID NO: 327410 - DNA, 75 bp, Artificial Sequence
  Synthetic
ggtgggatcagcgacgaggctatatcctgggacgcgctatcaaaagagtatcggaagacccaggccatgactcag

SEQ ID NO: 327411 - DNA, 75 bp, Artificial Sequence
  Synthetic
acccccgccagcagtcgggcctccaccacccccattagcctcctgcacagcggaggcagcagcagcagctcggga

SEQ ID NO: 327412 - DNA, 75 bp, Artificial Sequence
  Synthetic
atattccaacaggccctctcaagcgcccaagggtggacgcacccccagaagggggatggccggaccccgaaagag

SEQ ID NO: 327413 - DNA, 75 bp, Artificial Sequence
  Synthetic
gtccacaccgactcgccatggtctactggaggcgacggagacgctggtggccccggtggcgatggcgccggacaa

SEQ ID NO: 327414 - DNA, 75 bp, Artificial Sequence
  Synthetic
gttggatttccagtctcctccaggagacgccgccggggcgaagacactcgccgccgctccagctccagctcccaa

SEQ ID NO: 327415 - DNA, 75 bp, Artificial Sequence
  Synthetic
gatggcgtcgacgcgtttaccgccgagcagctggaagagctcttcgccgccgtcgaagaagacgcaaggtgagga

SEQ ID NO: 327416 - DNA, 75 bp, Artificial Sequence
  Synthetic
gagagcccgaagagacgacgagacgcaggcggcggtcagagggggagatccccccgccggagacggccgcagcgt

SEQ ID NO: 327417 - DNA, 75 bp, Artificial Sequence
  Synthetic
ggcgccggtactggaggtggcggagacgcaggcgggcgacttacagacgttggccccgcagacgtaggagacgca

SEQ ID NO: 327418 - DNA, 75 bp, Artificial Sequence
  Synthetic
cgacgcaggcgttcctcgagctggagctggagcgacagcgacagcagcagcaccggctccgaaagggtctccagg

SEQ ID NO: 327419 - DNA, 75 bp, Artificial Sequence
  Synthetic
gacgcaagaccctcagactcactcagtggaaccccaccacgatagttaaatgcaaaatccgtggctggtttccac

SEQ ID NO: 327420 - DNA, 75 bp, Artificial Sequence
  Synthetic
acctcttctcccgcctggtccgaaccgaaggcggccaccaagtagacccccggttgctgtgattcacccgggcgt

SEQ ID NO: 327421 - DNA, 75 bp, Artificial Sequence
  Synthetic
tgctagagactgggctgggcagacaagccttcaacttcaccacccacagcgaggacatcccgggggagaagcaca

SEQ ID NO: 327422 - DNA, 75 bp, Artificial Sequence
  Synthetic
ttcggagcctgtcagcatgtttcctgaaacgcaagggtgcatcacaagacccagaggccagtacaacgccttcga

SEQ ID NO: 327423 - DNA, 75 bp, Artificial Sequence
  Synthetic
gcttcgggggagggtcggcatatgccaaatttagcctccaactgttctaccaagagtttcagagaaaccataact

SEQ ID NO: 327424 - DNA, 75 bp, Artificial Sequence
  Synthetic
gagggagacggagcgagagctggcccaggtcttcggacgctttccccgcgtccaaccccggcccggagagatccc

SEQ ID NO: 327425 - DNA, 75 bp, Artificial Sequence
  Synthetic
ggtggacaggcagcaacagggaactagacctctgtagatacctaggcaccagcatccgtctctaccgagacccag

SEQ ID NO: 327426 - DNA, 75 bp, Artificial Sequence
  Synthetic
ccactacccctacctctcctaccaacacccccgcaacctccgagacacggcccaggtgcgcatcaccttccgcct

SEQ ID NO: 327427 - DNA, 75 bp, Artificial Sequence
  Synthetic
acatcagctacatagtctcctataacagagacaccccggtagtcctaaataccctcacctacatgagctgccatc

SEQ ID NO: 327428 - DNA, 75 bp, Artificial Sequence
  Synthetic
cggctacaaccccttctcaataaactaggcctacaacttacgctggagcggagtctgtttctttaagtcgcacca

SEQ ID NO: 327429 - DNA, 75 bp, Artificial Sequence
  Synthetic
cactcctacagctcctcagcaaacaccacatcatagtagccagtcagagagagagaccaggcaaaaagagatatg

SEQ ID NO: 327430 - DNA, 75 bp, Artificial Sequence
  Synthetic
taggcctacaacttacgctggagcggagtctgtttctttaagtcgcaccacttccgggtttacgccccgtgacgt

SEQ ID NO: 327431 - DNA, 75 bp, Artificial Sequence
  Synthetic
ttaaactcaacatcaaacctccacacctcatgctcaacaaatggtatttccaacaagatttctgtccagtgtcac

SEQ ID NO: 327432 - DNA, 75 bp, Artificial Sequence
  Synthetic
cacgggggcgggccaaggggacccggcaggaggccgcctgacggcggcctcctaccggcagggggcgcaccaagg

SEQ ID NO: 327433 - DNA, 75 bp, Artificial Sequence
  Synthetic
gcaggaggccgcctgacggcggcctcctaccggcagggggcgcaccaaggaccaacgaggttgccggtggtcgcc

SEQ ID NO: 327434 - DNA, 75 bp, Artificial Sequence
  Synthetic
tgtttgtcatcagggccagcgccatagacctgcagtggacctggatagacccaggcaaaccctctcccgttgtca

SEQ ID NO: 327435 - DNA, 75 bp, Artificial Sequence
  Synthetic
actcccgacgggggaacgtccgcgcttgcgcgcgtccgaacggcacatcgctccggcgcgctcgcgcgcgcctac

SEQ ID NO: 327436 - DNA, 75 bp, Artificial Sequence
  Synthetic
actttaaaatcttagacccctccatctacactacagtcacaaacctctctacaaaaaaggaggaaagaaacacag

SEQ ID NO: 327437 - DNA, 75 bp, Artificial Sequence
  Synthetic
ttgcgcgcgtccgaacggcacatcgctccggcgcgctcgcgcgcgcctacgctcctgccgatccccctgggaggg

SEQ ID NO: 327438 - DNA, 75 bp, Artificial Sequence
  Synthetic
gctcctgccgatccccctgggagggggaaatttaataaacaaactccgagacgccatttgccacaggcaagatgg

SEQ ID NO: 327439 - DNA, 75 bp, Artificial Sequence
  Synthetic
tcttaaacaaaatctggaacactacaaacggagggactggcaactattcgcccgccgccctctactactacacag

SEQ ID NO: 327440 - DNA, 75 bp, Artificial Sequence
  Synthetic
ccgccaccccctacgtcacatcctcttccggggcaaatgtcaaaggccgagcgaagcgaggcccggcccactgcc

SEQ ID NO: 327441 - DNA, 75 bp, Artificial Sequence
  Synthetic
cacccacccgagaggcctggggcaccctcaaaaaagcaggaggggtcacagccttcggtattgaaaccttaaata

SEQ ID NO: 327442 - DNA, 75 bp, Artificial Sequence
  Synthetic
ggaagcgcttacttccgcctccgggtcgtcaaaaagcggaagttaaattgttcgccccaagtgggatctccaaaa

SEQ ID NO: 327443 - DNA, 75 bp, Artificial Sequence
  Synthetic
caccaggtgaatggctgggaggtaacggtcctggtagtgcaatgccgacactgttcaacaaagacacagaaaccc

SEQ ID NO: 327444 - DNA, 75 bp, Artificial Sequence
  Synthetic
aggggaagtaaaaattttcgctggaagcggggggatggatccgatgaacctgccttgcagcgagaggtctcggcc

SEQ ID NO: 327445 - DNA, 75 bp, Artificial Sequence
  Synthetic
aaaaaaaattctataaggcagtcacaggcatcacaccacaaacatcttatggcacagacatcaccatgaaccaaa

SEQ ID NO: 327446 - DNA, 75 bp, Artificial Sequence
  Synthetic
gcgtcctggggaatggcagagcccccccccgcgcatgcgcgcgggacccccccccggggggctccgccccccggc

SEQ ID NO: 327447 - DNA, 75 bp, Artificial Sequence
  Synthetic
aactaggcatgtacagctacctgttcatgacagaaaaacgcatagacccacaagtcaaaggcccctacatccctg

SEQ ID NO: 327448 - DNA, 75 bp, Artificial Sequence
  Synthetic
gtgctacgtcaccaaccccgcctttttggcgggaaccaatcaaaaaatggggggggcgatttcaaattcagccaa

SEQ ID NO: 327449 - DNA, 75 bp, Artificial Sequence
  Synthetic
taggctacctaccacacatagatgcaggagaaggcaacatgctgtggataaacccctgcagcgacggcaccaccc

SEQ ID NO: 327450 - DNA, 75 bp, Artificial Sequence
  Synthetic
ggggaatggcagagcccccccccgcgcatgcgcgcgggacccccccccggggggctccgccccccggcccccccc

SEQ ID NO: 327451 - DNA, 75 bp, Artificial Sequence
  Synthetic
tggcagaccgccaggtcactgaaacgtcacatccgccggccatcttaggagcgcccatataaagcgggtaccctc

SEQ ID NO: 327452 - DNA, 75 bp, Artificial Sequence
  Synthetic
tgtacaactctgttaaaagcaaatgcctcatcaaagaacaacccctatggctagcactatatgggtatgaggact

SEQ ID NO: 327453 - DNA, 75 bp, Artificial Sequence
  Synthetic
cgaatggctgagtttttcgccgcgcgagacggtcgagagcggacagctgtcgctctgagcgactgggcgggtgcc

SEQ ID NO: 327454 - DNA, 75 bp, Artificial Sequence
  Synthetic
ggtgcataaagagcacaggcgacccacaggccatgttcaactactacctagtggtcagatgcccatacaccagcc

SEQ ID NO: 327455 - DNA, 75 bp, Artificial Sequence
  Synthetic
ggaggtgagtttacacaccggagtcaaggggcctatcgggcaggagcagtctcgcgcaacgggcaagtatagggg

SEQ ID NO: 327456 - DNA, 75 bp, Artificial Sequence
  Synthetic
ccaaactacaaaactccagtaacccagcacagggagagataccgtatggatactactttggagaaggcctcatgc

SEQ ID NO: 327457 - DNA, 75 bp, Artificial Sequence
  Synthetic
ttgctgtccctctctctatgtactttcagaggcggaggcgatccgtgtatgggaggaaaaaaggacaccatcccc

SEQ ID NO: 327458 - DNA, 75 bp, Artificial Sequence
  Synthetic
ccaacgggcagagccccatccccgtagccttccgaaactcctggtatatctgtctcttccaccagagaaactgga

SEQ ID NO: 327459 - DNA, 75 bp, Artificial Sequence
  Synthetic
gtgtgcagcccatgttctggaaagcgccagcggaggatgagggggcccgggaggagaggtggcttcgatccgtgg

SEQ ID NO: 327460 - DNA, 75 bp, Artificial Sequence
  Synthetic
tggagaccatagtctcctcaggccccttcatcccccgcaactacaaaaacaaaagctggcaactcaccatgggct

SEQ ID NO: 327461 - DNA, 75 bp, Artificial Sequence
  Synthetic
ttgatgggcatgctgctttttgtgcttgtcgctatcctctcgctcatctatcttatgtacacggtcgtcatagcg

SEQ ID NO: 327462 - DNA, 75 bp, Artificial Sequence
  Synthetic
ataactcacgctggctgtggggcggtgtccgccccgtcaccaaacaggttcaagacccctgctcagccggccgcc

SEQ ID NO: 327463 - DNA, 75 bp, Artificial Sequence
  Synthetic
gggcggcgggacaggcccgaactccccccgccccccggttccaggtggcgagcccctctccagtgaagccgcggc

SEQ ID NO: 327464 - DNA, 75 bp, Artificial Sequence
  Synthetic
accagctgcccgatcccgatcacaggcttaacccagtacaagttgttgacccgagcacagtccagccacagctca

SEQ ID NO: 327465 - DNA, 75 bp, Artificial Sequence
  Synthetic
ctcccccgccgaccccggccagcgaccccccgtcccgtaaccgtgacagcggagtatggtgtggctccgaagact

SEQ ID NO: 327466 - DNA, 75 bp, Artificial Sequence
  Synthetic
cattccacgggtgggacctcagacgtggggcgtttacagagacagctctcagaagagtgcaggaatactcgccat

SEQ ID NO: 327467 - DNA, 75 bp, Artificial Sequence
  Synthetic
ctggtacacgggacgctggcgaccccgccgcgcgcggtggcgtggacgatttctccgccgaagatttagaagacc

SEQ ID NO: 327468 - DNA, 75 bp, Artificial Sequence
  Synthetic
ctaacgagccaatgtcttcaggccctccagaacatccactcacagatgtctggaggatgcccgaagagcatcccc

SEQ ID NO: 327469 - DNA, 75 bp, Artificial Sequence
  Synthetic
tcttccgcgccgtcgaagaagacgccgccgggtaaggaggtggcggaggcgggggaggagacgctacgcccgacg

SEQ ID NO: 327470 - DNA, 75 bp, Artificial Sequence
  Synthetic
tcccctttgcaagaaaaagcttgtttttctcggacacggaagagggcagccccccgccggggtcgccaccgagaa

SEQ ID NO: 327471 - DNA, 75 bp, Artificial Sequence
  Synthetic
gtacagacgcagacgctggggacggagacgcagatggggacgaggcaggcgcaggagaaagcgaactctggttct

SEQ ID NO: 327472 - DNA, 75 bp, Artificial Sequence
  Synthetic
aaagacgcaaaacgcagagcaacgaggaggaccaggagtccccggtcctcctccagcagccagagcagcagctgg

SEQ ID NO: 327473 - DNA, 75 bp, Artificial Sequence
  Synthetic
gactcagtggaacccgtacacggttcgtgcctgctcgatccgtggatggtttcccatagtcatcaccggactggg

SEQ ID NO: 327474 - DNA, 75 bp, Artificial Sequence
  Synthetic
agcagtacctccgagaccaactccagcgacagcgacagcaccaaagaaaactccaaaaagccctcgaagagacct

SEQ ID NO: 327475 - DNA, 75 bp, Artificial Sequence
  Synthetic
ccgcatgcagcacgactacaccgcccacagcgaggagatccccgctagctccctgtccttcgggggagggttcgc

SEQ ID NO: 327476 - DNA, 75 bp, Artificial Sequence
  Synthetic
ggcagaggctggcccgaaccgagggccacctacagctagaccgccggctattgtgattcaccggggctctcatac

SEQ ID NO: 327477 - DNA, 75 bp, Artificial Sequence
  Synthetic
ctatgccaagctgagcctcaggttcttctaccaggagtaccagcggcaccacaactggtggaccgccagcaacct

SEQ ID NO: 327478 - DNA, 75 bp, Artificial Sequence
  Synthetic
agtcagtatgttccatgagaacccccaggtgagttacaacaaccagcgagagtacaaccagttcgagctagacac

SEQ ID NO: 327479 - DNA, 75 bp, Artificial Sequence
  Synthetic
agagctagacctctgcaggtacaaacacaccaccgtgcgcttctaccgcgacacggagcgcagctacatagtgaa

SEQ ID NO: 327480 - DNA, 75 bp, Artificial Sequence
  Synthetic
tgagagagagctggcccaggccttcatgagatacccccgcatccgcccccggccctacgaggtgccctactaccc

SEQ ID NO: 327481 - DNA, 75 bp, Artificial Sequence
  Synthetic
gtacagcctagacacccccttcaccatcaactccctgaccttcatgagcgagcaccccgtagtcatgatgctcag

SEQ ID NO: 327482 - DNA, 75 bp, Artificial Sequence
  Synthetic
ctgggtctaccactcggtcagcacccgcaccgagttcccgaaagtctccttcgccctgagattcaaccccttctc

SEQ ID NO: 327483 - DNA, 75 bp, Artificial Sequence
  Synthetic
caggcatcatcgcctgatacccagcctcaaagacaggcccttctggcgcaaaccctgggtcagcctcagactcag

SEQ ID NO: 327484 - DNA, 75 bp, Artificial Sequence
  Synthetic
aataaactaggccaaggaaggtacgcttgagtggagtctgtttctttaagtcgcaccacttccgggttctcgccc

SEQ ID NO: 327485 - DNA, 75 bp, Artificial Sequence
  Synthetic
cttgagtggagtctgtttctttaagtcgcaccacttccgggttctcgccccgtgacgtcacgggggcgggccaag

SEQ ID NO: 327486 - DNA, 75 bp, Artificial Sequence
  Synthetic
accccccagactcatgctgaaccactggtatttcagtcaggatttctgtgacgtgggcctggccctcatcatggc

SEQ ID NO: 327487 - DNA, 75 bp, Artificial Sequence
  Synthetic
gggacccggcaggaggccgcctgacggcggcctcctaccggcagggggcgcaccaaggaccaacgaggctgccgg

SEQ ID NO: 327488 - DNA, 75 bp, Artificial Sequence
  Synthetic
cagccccatcgacctcaccaacatgtgggtcgatcccaacaagctctccccggccacacactttcagatctttga

SEQ ID NO: 327489 - DNA, 75 bp, Artificial Sequence
  Synthetic
tggtcgccggcctgacggccggctccccccttgactcccgacgggggaacgtccgcgcttgcgcgcgtccgaacg

SEQ ID NO: 327490 - DNA, 75 bp, Artificial Sequence
  Synthetic
cctcaccaagtacaaacacacctttagcatagccagtgacaaagtaagtgaaagagaaaacacacttaagacact

SEQ ID NO: 327491 - DNA, 75 bp, Artificial Sequence
  Synthetic
tcactcgctccggctcgcttcgctcgcctccgctccctccgatccccctgggagggggaactttaataaacaaac

SEQ ID NO: 327492 - DNA, 75 bp, Artificial Sequence
  Synthetic
actgtccaccaacaaaaataatgaagaggtgtgccccgccgggcgccacctctggaccagagaggccagggacca

SEQ ID NO: 327493 - DNA, 75 bp, Artificial Sequence
  Synthetic
tccgagccgccatttgtcacagacaagatggccgacaccccctacgtcacttccacttccgggccatatgtcaaa

SEQ ID NO: 327494 - DNA, 75 bp, Artificial Sequence
  Synthetic
ctggaactcctggcgaaaagacaacaccaagggctttagctcaggcaatttatgtaacagccaagcatggaaaca

SEQ ID NO: 327495 - DNA, 75 bp, Artificial Sequence
  Synthetic
ggccgagcgaagcgaggcccggcccactgccggaagcagttacttccgcctccgggtcgccaaaaagcggaagtt

SEQ ID NO: 327496 - DNA, 75 bp, Artificial Sequence
  Synthetic
cagtgggccctacgagacatttaaacaactaggacaacaagaagtaaacgacaacaacaagctatacaaatccat

SEQ ID NO: 327497 - DNA, 75 bp, Artificial Sequence
  Synthetic
aaagtcttcgcaccaagtgggatctccaaaaagcggaagtataaaaattcgtcccaagggggtgctagcgcaccc

SEQ ID NO: 327498 - DNA, 75 bp, Artificial Sequence
  Synthetic
ctactcaggcacaccaggcaacgactggaccttaaacaacgtgtatggcatgtacacatataccatgctcagcca

SEQ ID NO: 327499 - DNA, 75 bp, Artificial Sequence
  Synthetic
agtataaaaattcgtcccaagggggtgctagcgcacccccccccccccggggggctccgccccccggcccccccc

SEQ ID NO: 327500 - DNA, 75 bp, Artificial Sequence
  Synthetic
gaacagactagacagtgaaatcaagggtccctaccagaccataggctaccacccccacatagacgatggggaagg

SEQ ID NO: 327501 - DNA, 75 bp, Artificial Sequence
  Synthetic
taacctgctgtttctacagcctctggtcaagggagactcggtctttgacacgcagcgcagcaaatgcgccatcgt

SEQ ID NO: 327502 - DNA, 75 bp, Artificial Sequence
  Synthetic
ggaccagcccctctggctggccgcctggggatactgggactactgttccaagtacctctatccagacaagacctg

SEQ ID NO: 327503 - DNA, 75 bp, Artificial Sequence
  Synthetic
gttctacagctacatgatctgtgtcaggtgccccttcacctaccccaagatgtacaggtcgggagagcccaaaaa

SEQ ID NO: 327504 - DNA, 75 bp, Artificial Sequence
  Synthetic
atgtgacgtcccctacagctataactttggacagggcaagatgccagggggcatctggccgccgtccctagactt

SEQ ID NO: 327505 - DNA, 75 bp, Artificial Sequence
  Synthetic
ccgcaacaagtggtatctctgcgcctaccaccagaaggagtggctagagaacctagtcagctgcgggcccatggt

SEQ ID NO: 327506 - DNA, 75 bp, Artificial Sequence
  Synthetic
ccccaaggcctacccccacaagtcctactccctgaccatgggctacaagagcaagtggctgtggggcggcaacgc

SEQ ID NO: 327507 - DNA, 75 bp, Artificial Sequence
  Synthetic
catttacacccgacaggtccaggacccgtgcagtgcggggcgacacgagcttcccggtcccgatcaaaagcatga

SEQ ID NO: 327508 - DNA, 75 bp, Artificial Sequence
  Synthetic
ctcagtacaagttgttgacccgggaacccaggccccccaactcatcttccataactgggacacccgacgtggggg

SEQ ID NO: 327509 - DNA, 75 bp, Artificial Sequence
  Synthetic
ctatacggacagctctcttaaaagagtgcgcgactacgagccgcttgacgaaactctgtattcaggggctccgaa

SEQ ID NO: 327510 - DNA, 75 bp, Artificial Sequence
  Synthetic
acgtccaagaaacgatgtcttccgggtccagctcagccccgggcgcgccgccgccgccggagactggacttcggc

SEQ ID NO: 327511 - DNA, 75 bp, Artificial Sequence
  Synthetic
ggcggggggctcggaggagagatacccggggacggagtccgaccgctggacgagcagcgaggaggaagaagagga

SEQ ID NO: 327512 - DNA, 75 bp, Artificial Sequence
  Synthetic
ggaggagggagtcttggggtcggagaaccagcagcagagaccccagcagcagcagcagctggaactccgactccg

SEQ ID NO: 327513 - DNA, 75 bp, Artificial Sequence
  Synthetic
agaccgactcctccgcaagctccgcgagcagagagagcagcaggcccagctcaaggcccagatgcagcacgtctt

SEQ ID NO: 327514 - DNA, 75 bp, Artificial Sequence
  Synthetic
ctctcgcctggtaagggccgagggcaacctgcacctcgacccccggctcctgtgattcaccggggcgttcaggag

SEQ ID NO: 327515 - DNA, 75 bp, Artificial Sequence
  Synthetic
tcttccctgctgttccctgaaacgcgccgaggaatctccgggttcggggcctactcggagttcgccctgcagacg

SEQ ID NO: 327516 - DNA, 75 bp, Artificial Sequence
  Synthetic
gaaagagaggtggcccaggtcttccgccgctacccgcgccgccagccgcgccccggagacgtccccttctacccc

SEQ ID NO: 327517 - DNA, 75 bp, Artificial Sequence
  Synthetic
tacctctcctaccagcaccccaactgccgagagtcccccggccgctacacggtcaccttccgcctgggattcaac

SEQ ID NO: 327518 - DNA, 75 bp, Artificial Sequence
  Synthetic
cccttctcaataaactaggcctgcgaggcgcacttgagcggagtctgtttctttaagtcgcaccgcttccgggtt

SEQ ID NO: 327519 - DNA, 75 bp, Artificial Sequence
  Synthetic
tggcgccaatgacgtcacgggggcgggccaaggggacccggcaggaggccgcctggcggcggcctcctaccggca

SEQ ID NO: 327520 - DNA, 75 bp, Artificial Sequence
  Synthetic
gggggcgcaccaaggaccaacgaggttgccgcgggtcgccggcctgacggccggctcccccctcgactcccgacg

SEQ ID NO: 327521 - DNA, 75 bp, Artificial Sequence
  Synthetic
atccccctgggagggggaactttaataaacaaactccgagacgccatttgccacaggcaagatggccgccacccc

SEQ ID NO: 327522 - DNA, 75 bp, Artificial Sequence
  Synthetic
cttttccgggtccgggtcccaaaaaaggggaaggggaatttaaatttttttttccaagtgggatttccaaaaagc

SEQ ID NO: 327523 - DNA, 75 bp, Artificial Sequence
  Synthetic
ggaagtaaaaaaattcgttccaaggggggggttgccccccccccccgcgcatgcgcgcgggtccccccccacggg

SEQ ID NO: 327524 - DNA, 75 bp, Artificial Sequence
  Synthetic
gggggggttgccccccccccccgcgcatgcgcgcgggtccccccccacggggggctccgccccccggcccccccc

SEQ ID NO: 327525 - DNA, 75 bp, Artificial Sequence
  Synthetic
gacggcgcgcgaagactctcgggaacggggcgttggctgtctccgcccattttttggcgggaaccaaaaaatggg

SEQ ID NO: 327526 - DNA, 75 bp, Artificial Sequence
  Synthetic
gggggatcaacaccaatcacccattgccacgtcacatccggacgccatctttgaataccctatataaccaacaca

SEQ ID NO: 327527 - DNA, 75 bp, Artificial Sequence
  Synthetic
accgacgaatggctgagtttttcccgtccggcctccggtgaggagcctcgcgcggccgagagcgatccgaaccag

SEQ ID NO: 327528 - DNA, 75 bp, Artificial Sequence
  Synthetic
ccctgggcgggtgccggaggtgagtttacacaccgcagtcaaggggcaattcgggcagggctggccgggcggaac

SEQ ID NO: 327529 - DNA, 75 bp, Artificial Sequence
  Synthetic
gggcaagtgtctaaaacccacgccccgccacagatagggcaccgggaggactatcaagagatctatgacatggaa

SEQ ID NO: 327530 - DNA, 75 bp, Artificial Sequence
  Synthetic
gcctccggtcagtgggagcccccccagcagtcgatcgcggagagggaggacgactggtaccgctccgtctggtgg

SEQ ID NO: 327531 - DNA, 75 bp, Artificial Sequence
  Synthetic
agccatctgtgtttttgtgggtgcggtgatcctagctttcatttcagtctacttgctcatcgcaatcaaggccct

SEQ ID NO: 327532 - DNA, 75 bp, Artificial Sequence
  Synthetic
cggggacctcctggaggtcctcctgcgccacctggagggcccggccctcgacccctaggccaaggccccccacaa

SEQ ID NO: 327533 - DNA, 75 bp, Artificial Sequence
  Synthetic
aacctcgcccgttttctgcctctgccggccctcccgccggcccctgaacgccagccaccacggcctggagatggg

SEQ ID NO: 327534 - DNA, 75 bp, Artificial Sequence
  Synthetic
gatggtggggccgccgcggccgtcggtggcccgcccgcagaggccgcggacgctggatggcgagaagaagatatc

SEQ ID NO: 327535 - DNA, 75 bp, Artificial Sequence
  Synthetic
gcagaggcgctcgccggactagaagaggccgaaagagggtaaggagacgttgggtgggccgacgcagaaggcgac

SEQ ID NO: 327536 - DNA, 75 bp, Artificial Sequence
  Synthetic
ggacgtacagacgcagaccctgggtgagacgcagacgcccccgacgcagacgcctcttaaccctaaaacaatggc

SEQ ID NO: 327537 - DNA, 75 bp, Artificial Sequence
  Synthetic
agccacagactaacgttagactgacggttaggggcatcctccccttcatggtcttcggacccaagcgaacccagc

SEQ ID NO: 327538 - DNA, 75 bp, Artificial Sequence
  Synthetic
gcaactacaccatgtggcaggacaccgtcccccccgagaaagaatcctacggaggcagttttgccacgtaccgat

SEQ ID NO: 327539 - DNA, 75 bp, Artificial Sequence
  Synthetic
tcagcatgcagaccctgtacgatgagtacatgagactgagaaactggtggtcccgctccaacacccacttagacc

SEQ ID NO: 327540 - DNA, 75 bp, Artificial Sequence
  Synthetic
tagtcagatacacgggagtctccttcagactctacaggcacacacaccgagactacatagtcagctacagcctag

SEQ ID NO: 327541 - DNA, 75 bp, Artificial Sequence
  Synthetic
agacccccatggaaagcagcatagccacccacatgtccctgcaccccatgcgccaactgttccaaagcaaacacc

SEQ ID NO: 327542 - DNA, 75 bp, Artificial Sequence
  Synthetic
gcaccgtaccctccttctacaccaaacccgggggcaaaccctacatcacactcaaagccagaccccctcgcctca

SEQ ID NO: 327543 - DNA, 75 bp, Artificial Sequence
  Synthetic
tgaaaacccagtggtactttcaacacgatttttgcaatgtgggcctcatcctcctgcgggcggcctgttgcaacc

SEQ ID NO: 327544 - DNA, 75 bp, Artificial Sequence
  Synthetic
tgaccaacccctggatggctccttccgcccccactccttgcctcaccatttacgccatctccaacggcagccacg

SEQ ID NO: 327545 - DNA, 75 bp, Artificial Sequence
  Synthetic
agcacctcagcataaatgcagatgacacacacaaacaatacagacaacacatgcttcaaaaactatataacaatc

SEQ ID NO: 327546 - DNA, 75 bp, Artificial Sequence
  Synthetic
ctcaacacctctacaacaatcactttagacgccactggtccaaagtggccccaaaaaaaaatggaaatcagcaaa

SEQ ID NO: 327547 - DNA, 75 bp, Artificial Sequence
  Synthetic
cagaaccctttacatgggaaaaggttttaaaaaatgacacaatacaaacaattcaaaaaaatatataccaggaaa

SEQ ID NO: 327548 - DNA, 75 bp, Artificial Sequence
  Synthetic
gactaaaggaaacacaagaagtcagtaccaaaagacaacaagcaggcttcaggggaaaccacaacgaagatgaaa

SEQ ID NO: 327549 - DNA, 75 bp, Artificial Sequence
  Synthetic
catttaactacacatggggtctctacagctccatcctcctcaacactgagccaggcttcccagaactatcagttc

SEQ ID NO: 327550 - DNA, 75 bp, Artificial Sequence
  Synthetic
cctacagcaaagtcagatacaaccccatagcagacaggggctccggcaacgccatctggatagagaccctcacaa

SEQ ID NO: 327551 - DNA, 75 bp, Artificial Sequence
  Synthetic
aagacaattgccacttcagttcccagtacgagtgtctcatcaaagacgcccccctgtggctctgcctatacggct

SEQ ID NO: 327552 - DNA, 75 bp, Artificial Sequence
  Synthetic
acttagactggtgtaccaagtacaaaaacaacaaagaagtctacctcaactacagagtaggcatacgctgcccct

SEQ ID NO: 327553 - DNA, 75 bp, Artificial Sequence
  Synthetic
acacggtaccccaattatatagtcatgacacacccaccaaagggtggatcccgctgtccacgaacttcatgaatg

SEQ ID NO: 327554 - DNA, 75 bp, Artificial Sequence
  Synthetic
gcaaaatgccaggcggtagcaccaccatccctctcagactacaaaacaactggtaccccatgatctatcaccagg

SEQ ID NO: 327555 - DNA, 75 bp, Artificial Sequence
  Synthetic
aagagatgatagaggaactggtagcctcaggtccctttgccccccgagaccacggaccggtagttacgtccagtg

SEQ ID NO: 327556 - DNA, 75 bp, Artificial Sequence
  Synthetic
acattaccataggctacaaatttggctttcgactgggcggtaactacatcgccccaaaacaggtgggcgacccgt

SEQ ID NO: 327557 - DNA, 75 bp, Artificial Sequence
  Synthetic
gcaaacaaccggtacacgaactccccgctcccggaggcggtgactaccttagagaagtacaagtcacggacccga

SEQ ID NO: 327558 - DNA, 75 bp, Artificial Sequence
  Synthetic
caagagtgggcccccactaccagttccacccctgggacctcagacgtggcctctttagcgaaaagtctcttaaaa

SEQ ID NO: 327559 - DNA, 75 bp, Artificial Sequence
  Synthetic
gagtcagagaagactcagatattgagacagacgtttggagaccttcaaaatatgctaaaccagatccacccgcag

SEQ ID NO: 327560 - DNA, 75 bp, Artificial Sequence
  Synthetic
agggaagaggactcgccgagctctgttcctcagtcctccgggatctcctacaagagacccaacactcgcagtccc

SEQ ID NO: 327561 - DNA, 75 bp, Artificial Sequence
  Synthetic
ccttctcgcaagcacacccgaaaacgccggaggagacgccgaccgtcgacctccagcgactccagcgagagatcc

SEQ ID NO: 327562 - DNA, 75 bp, Artificial Sequence
  Synthetic
gacagcagcagcagcagcagtccaatctccagaagggcatcaaaaatctggtgctagaaatggtcaagtatcaac

SEQ ID NO: 327563 - DNA, 75 bp, Artificial Sequence
  Synthetic
gccacctaggcgtcgacccctgcctcaggtaggccctcaggcttatctcttcacccctaagaagcgcaagctcct

SEQ ID NO: 327564 - DNA, 75 bp, Artificial Sequence
  Synthetic
gccagagacagacttcgaccgccagaccgaagtagagctcagccaaatcatgaaacgcccctgccgcacctgcta

SEQ ID NO: 327565 - DNA, 75 bp, Artificial Sequence
  Synthetic
tctgcgagaacagccgcactatccctatctaccccgagacccccaccacttcgtgtcctttcgcttgggcttctc

SEQ ID NO: 327566 - DNA, 75 bp, Artificial Sequence
  Synthetic
ctgccccgaataaacatacgatgccagacaaatttcacttgagtggtgtctgcttctataagtcacgtatgggta

SEQ ID NO: 327567 - DNA, 75 bp, Artificial Sequence
  Synthetic
actggggggcccccgccttcaacggacgtcgcccggctgccgccgggctccttcctcgctcccgccggtcgcgcc

SEQ ID NO: 327568 - DNA, 75 bp, Artificial Sequence
  Synthetic
gcgcttcgcgcgtcacgcccagggcccgctccgtcgtccctcctccgcgggctggtgatttataaggaactccga

SEQ ID NO: 327569 - DNA, 75 bp, Artificial Sequence
  Synthetic
gtcgctgcaccgccaccaagggagtcacaggaccgtctccctatcgccatactgcgcgaccctcgatctgggggc

SEQ ID NO: 327570 - DNA, 75 bp, Artificial Sequence
  Synthetic
caaaatggcgtcgagtgacgtatttgtcgacgtcatcggggccattttggttcaaaggtcaaaggtcaaaggtca

SEQ ID NO: 327571 - DNA, 75 bp, Artificial Sequence
  Synthetic
tctacgtcacaggtcatctattaacgtcacatccgcttccgggttgccgccattttgtggtggccgccattttga

SEQ ID NO: 327572 - DNA, 75 bp, Artificial Sequence
  Synthetic
gtgtaacttcctctttaatgattgacaggtacccccccgcggcgcagggggggcgctacgcgcccccccttcggg

SEQ ID NO: 327573 - DNA, 75 bp, Artificial Sequence
  Synthetic
ttgacaggtacccccccgcggcgcagggggggcgctacgcgcccccccttcgggggggcgcgccccgcccccccc

SEQ ID NO: 327574 - DNA, 75 bp, Artificial Sequence
  Synthetic
gaaaaagtcacctgacggggcgtgtctcactgctcctcccattttggcggcaaccaatggcaaaatggggggggc

SEQ ID NO: 327575 - DNA, 75 bp, Artificial Sequence
  Synthetic
agccaatcactgcctgccacgtcacagtgagacgccattttaaattcagtataagagcaagtggggtgacgaatg

SEQ ID NO: 327576 - DNA, 75 bp, Artificial Sequence
  Synthetic
gtagagttttcccccgcgaccgaggaggcgatcgcatcgcagaggtgagctccgcggtctctgggcgggtgccgg

SEQ ID NO: 327577 - DNA, 75 bp, Artificial Sequence
  Synthetic
agcggaggtttaccccgcgcagtcaaggggcaattcgggcagagaccggtcgcggaaccgggcaaggctcttaaa

SEQ ID NO: 327578 - DNA, 75 bp, Artificial Sequence
  Synthetic
aaatgtactttcgccgcaggcgccgtaaagcgaaactgggctccgtaggagactacctagaactctctcaccctg

SEQ ID NO: 327579 - DNA, 75 bp, Artificial Sequence
  Synthetic
gccttccgacaggtacaccgcgagcaatggcaaaaaggcctcgggaaacgtatgagacgacgagtaaggaagcgg

SEQ ID NO: 327580 - DNA, 75 bp, Artificial Sequence
  Synthetic
caacatggctgcaccttgtcggtgagactcacgacctctggtgcccttgcggtaagcctctgcctcatctttctg

SEQ ID NO: 327581 - DNA, 75 bp, Artificial Sequence
  Synthetic
ctctacttaatactgtgggtgctgctacaacaacgtcaacatgccgtactggtggagaagacgccgccggcggtg

SEQ ID NO: 327582 - DNA, 75 bp, Artificial Sequence
  Synthetic
gccgcgccgcaggcgctggacccgctaccgaaggcggcgatggatgggacgatataaacctcgacgagctactcg

SEQ ID NO: 327583 - DNA, 75 bp, Artificial Sequence
  Synthetic
ccgacgtcgccgccgaagacgccgaacggtaaggagacgcttctcggggtacactcgcagagcgacacgtagaag

SEQ ID NO: 327584 - DNA, 75 bp, Artificial Sequence
  Synthetic
agggcgacgcagacgcagactgactgtcactttaaagcagtggaaaccagagactctcaggagcctaagagtgac

SEQ ID NO: 327585 - DNA, 75 bp, Artificial Sequence
  Synthetic
tggactgtttccattgattgtctgtggctcaggagctagtagaaataactggatccagagatcctttgacgtccc

SEQ ID NO: 327586 - DNA, 75 bp, Artificial Sequence
  Synthetic
gggaccagacacacctataggaggtaacctatctgtctcagtatggaccatgagagtactatatgaggaatggca

SEQ ID NO: 327587 - DNA, 75 bp, Artificial Sequence
  Synthetic
gcttcatagaaataactggagtagaactaacagtgacctggatctggttatgtattatggctgcacactaaagtt

SEQ ID NO: 327588 - DNA, 75 bp, Artificial Sequence
  Synthetic
ctggagacacccatacgtagactacatagtcaaatacatcagaaacactccctttaaaacagaagagctcacaca

SEQ ID NO: 327589 - DNA, 75 bp, Artificial Sequence
  Synthetic
cgcagcaggacatcccatggtactcatgctcagcaaacaccacgtagtggtgcctagtttactcacaaaaccgca

SEQ ID NO: 327590 - DNA, 75 bp, Artificial Sequence
  Synthetic
cggtagacgctggatcaaagtcacagtacgtccgccaagaatgcttacttcaaagttctatttccagagcgattt

SEQ ID NO: 327591 - DNA, 75 bp, Artificial Sequence
  Synthetic
ctgtaatgttaacctcctaggcatagtagcttcagcctgcaaactcaactctccgtggctggagccagataaaat

SEQ ID NO: 327592 - DNA, 75 bp, Artificial Sequence
  Synthetic
cacaccctgtatcaccttctatgccttaaaaaacacagttttcaaaaatcaaaacatcactgaagcacaaaatgc

SEQ ID NO: 327593 - DNA, 75 bp, Artificial Sequence
  Synthetic
ctacacggcactcacagccataatagtacaaaacaaagaaatggcctacaatacgtggcttgaacatcactgggg

SEQ ID NO: 327594 - DNA, 75 bp, Artificial Sequence
  Synthetic
atcctttggcaacggcaaagcgtttaacattactaatgtaaaagataacagtacattaactcaaaaccaaataaa

SEQ ID NO: 327595 - DNA, 75 bp, Artificial Sequence
  Synthetic
taccttaagacaaacagcagaaaatacattcaaatcaagatataatttcatatatgaagcgcaaccgcctaccac

SEQ ID NO: 327596 - DNA, 75 bp, Artificial Sequence
  Synthetic
aagcaaacactgaataaaggatatacagaatggtagggtgggtttgcatcttcctcgtggtccttactactgcaa

SEQ ID NO: 327597 - DNA, 75 bp, Artificial Sequence
  Synthetic
tggtccgagaaaagaatatattacctgaggacatattgccagactcattattttctttcaggcatgttgatgtgc

SEQ ID NO: 327598 - DNA, 75 bp, Artificial Sequence
  Synthetic
ctgctgggttgacacggaatctttatgagttaaagatagaatgtccgcatactgttggtttaggccagggttatg

SEQ ID NO: 327599 - DNA, 75 bp, Artificial Sequence
  Synthetic
tgagttaaagatagaatgtccgcatactgttggtttaggccagggttatgtgacaggttcagtggaaactacacc

SEQ ID NO: 327600 - DNA, 75 bp, Artificial Sequence
  Synthetic
tgttaaaaagactatttcctcgtgaccctgtatcttcattttattaataattttctttgttccagatcatgactt

SEQ ID NO: 327601 - DNA, 75 bp, Artificial Sequence
  Synthetic
tattctcttgacacaggtagctgacctcaagattgagagttcctgtaattttgatctgcatgtcccggccactac

SEQ ID NO: 327602 - DNA, 75 bp, Artificial Sequence
  Synthetic
ctcaagattgagagttcctgtaattttgatctgcatgtcccggccactactactcaaaaatacaatcaggttgac

SEQ ID NO: 327603 - DNA, 75 bp, Artificial Sequence
  Synthetic
attttattaataattttctttgttccagatcatgacttgttctctctactgctctgttctcggagcatactacta

SEQ ID NO: 327604 - DNA, 75 bp, Artificial Sequence
  Synthetic
actgttggtttaggccagggttatgtgacaggttcagtggaaactacacctattctcttaacacaggtagctgat

SEQ ID NO: 327605 - DNA, 75 bp, Artificial Sequence
  Synthetic
tggaccaaaaagagttctactacagaaagcacaaatgcaggtgcaaatacatttgaggctaaaacaaaggaaata

SEQ ID NO: 327606 - DNA, 75 bp, Artificial Sequence
  Synthetic
atttgaggctaaaacaaaggaaataaatttgaaaggcacatgcaacattcctccaactacatttgaggctgcata

SEQ ID NO: 327607 - DNA, 75 bp, Artificial Sequence
  Synthetic
tactcaaaaatacaatcaggttgactggaccaaaaagggttctactacagaaagtacaaatgcaggtgcaaatac

SEQ ID NO: 327608 - DNA, 75 bp, Artificial Sequence
  Synthetic
caaatcaaggaaaacagtgatctgttatgatctagcctgtaatcaaacacactgtcttccaacagtgcatttaat

SEQ ID NO: 327609 - DNA, 75 bp, Artificial Sequence
  Synthetic
atttgaggctaaaacaaaggaagtaaatctgaaaggcacatgcaatattcctccaaccacatttgaggctgcata

SEQ ID NO: 327610 - DNA, 75 bp, Artificial Sequence
  Synthetic
tgctcctgtccaaacatgcatgtctgtacgaagctgtatgataggcttattgtccagtaggattcaagtcatcta

SEQ ID NO: 327611 - DNA, 75 bp, Artificial Sequence
  Synthetic
tgagaaaacatattgtgtcacaggtcaattaatagaagggttatgcttcattccaacacacacaattgcacttac

SEQ ID NO: 327612 - DNA, 75 bp, Artificial Sequence
  Synthetic
gcagcctggtcatacttatgacactatgacattaccagtaacttgttttttggtagcaaaaaaactgggaacaca

SEQ ID NO: 327613 - DNA, 75 bp, Artificial Sequence
  Synthetic
gcagcctggtcatacttatgacactatgacactaccagtaacttgttttttagtagccaaaaagctgggaacaca

SEQ ID NO: 327614 - DNA, 75 bp, Artificial Sequence
  Synthetic
actcaagttagctgtggagttagaaaaattaattactggtgtgagctgtacagaaaatagtttccaaggttatta

SEQ ID NO: 327615 - DNA, 75 bp, Artificial Sequence
  Synthetic
actcaagttagctgttgagttagaaaaattgattactggtgtgagctgtacagaaaatagtttccaaggttatta

SEQ ID NO: 327616 - DNA, 75 bp, Artificial Sequence
  Synthetic
catctgctttattgggaaacattcagagcccctatttgtgccaacaatggaggattataggtcagctgaattatt

SEQ ID NO: 327617 - DNA, 75 bp, Artificial Sequence
  Synthetic
tatctgctttattgggaaacattcagagcccctattcgtgccaacaatggaggattataggtcagctgaggtatt

SEQ ID NO: 327618 - DNA, 75 bp, Artificial Sequence
  Synthetic
tactcgtatggttttaaatccaagaggtgaagatcatgatcctgatcagaatgggcaaggtttgatgagaatagc

SEQ ID NO: 327619 - DNA, 75 bp, Artificial Sequence
  Synthetic
tactcgtatggttttaaatccaagaggtgaagatcatgatcctgatcagaatgggcaaggtctaatgagaatagc

SEQ ID NO: 327620 - DNA, 75 bp, Artificial Sequence
  Synthetic
tggacctgttactgctaaggtaccatctacagaaacaactgaaacaatgcaaggaattgcatttgctggagcacc

SEQ ID NO: 327621 - DNA, 75 bp, Artificial Sequence
  Synthetic
aatgtatagttcattttcaactcttgtgaggaaggctgatcctgagtatgtcttttccccgggtataattgcaga

SEQ ID NO: 327622 - DNA, 75 bp, Artificial Sequence
  Synthetic
gtgaggaaggctgatcctgagtatgtcttttccccgggtataattgcagaatcaaatcatagtgtctgtgataag

SEQ ID NO: 327623 - DNA, 75 bp, Artificial Sequence
  Synthetic
aaaacagtacccctcacatggactggatttttggcagtctcaggagaaatagaaaggataacaggctgtacagtc

SEQ ID NO: 327624 - DNA, 75 bp, Artificial Sequence
  Synthetic
ttttgtactttggctggacctggcgcaagctgtgaggcatactcagagacaggaatcttcaatataagttccccc

SEQ ID NO: 327625 - DNA, 75 bp, Artificial Sequence
  Synthetic
ttttgtactttggctgggcctggtgcaagctgtgaggcatactcagagacaggaatattcaacataagctccccc

SEQ ID NO: 327626 - DNA, 75 bp, Artificial Sequence
  Synthetic
acttgtctggttaataaagttcaaaaattcagaggttcagagcaaagaatcaacttcatgtgtcagagggttgat

SEQ ID NO: 327627 - DNA, 75 bp, Artificial Sequence
  Synthetic
acttgtttggttaataaggttcaaaaattcagaggttctgagcaaagaattaacttcatgtgccagagggttgat

SEQ ID NO: 327628 - DNA, 75 bp, Artificial Sequence
  Synthetic
gactctagttataggccaatgtatttatacattcaccagtttattttcactgattccaggagttgctcattctct

SEQ ID NO: 327629 - DNA, 75 bp, Artificial Sequence
  Synthetic
gactctagttataggccaatgtatttatacattcactagtttattttcattaatcccaggagttgctcattctct

SEQ ID NO: 327630 - DNA, 75 bp, Artificial Sequence
  Synthetic
ctgcatggttgggcaacaactgcattacttatcacattttgttttggctggctccttataccaacagttacctta

SEQ ID NO: 327631 - DNA, 75 bp, Artificial Sequence
  Synthetic
tacttatcacattttgttttggctggctccttataccaacagttaccttacttatattaaaaatcctgaggttgc

SEQ ID NO: 327632 - DNA, 75 bp, Artificial Sequence
  Synthetic
gcttcttataccaacagttaccttaattatattaaaaatcctgaggttacttactttttcatgctcacattattc

SEQ ID NO: 327633 - DNA, 75 bp, Artificial Sequence
  Synthetic
ttactttttcatgctcacattattctacagagtcaaaattcaaagtcatcttggaaagggtaaaggtggaatatc

SEQ ID NO: 327634 - DNA, 75 bp, Artificial Sequence
  Synthetic
tacagagtcaaagttcaaagtcatcttggaaagggtaaaggtagaatatcagaaaacaatgggctcaatggtgtg

SEQ ID NO: 327635 - DNA, 75 bp, Artificial Sequence
  Synthetic
tacagagtcaaaattcaaagtcatcttggaaagggtaaaggtggaatatcaaaaaacgatgggctcaatggtgtg

SEQ ID NO: 327636 - DNA, 75 bp, Artificial Sequence
  Synthetic
tgacatttgccatcatgaatgtgaaacagctaaagaacttgaaacacataagaagagttgcccggaaggtcagtg

SEQ ID NO: 327637 - DNA, 75 bp, Artificial Sequence
  Synthetic
tgacatttgccatcacgaatgtgaaacagctaaagaacttgaaacacataagaagagttgcccagaaggtcagtg

SEQ ID NO: 327638 - DNA, 75 bp, Artificial Sequence
  Synthetic
agaagagttgcccggaaggtcagtgcccatactgcatgacaataactgaatccactgaaagtgctctacaagctc

SEQ ID NO: 327639 - DNA, 75 bp, Artificial Sequence
  Synthetic
acagctaaagaacttgaaacacataagaagagttgcccagaaggtcagtgcccatactgcatgacaataactgag

SEQ ID NO: 327640 - DNA, 75 bp, Artificial Sequence
  Synthetic
tccactgaaagtgctctacaagctcatttctcaatctgtaagttaacaaacaggtttcaggaaaatttaaaaaag

SEQ ID NO: 327641 - DNA, 75 bp, Artificial Sequence
  Synthetic
tccactgaaagtgctctacaagctcatttctcaatctgtaagttaactaacaggtttcaggaaaatttaaagaag

SEQ ID NO: 327642 - DNA, 75 bp, Artificial Sequence
  Synthetic
atttcggtataagagtcggtgttatgttggtctagtatggggaattcttctaacaactgagctaattatatgggc

SEQ ID NO: 327643 - DNA, 75 bp, Artificial Sequence
  Synthetic
ctggcttcatcgtcttcttatagttataggagaaaacttgtaaatcctgccaatcaagaagaaacacttcctttc

SEQ ID NO: 327644 - DNA, 75 bp, Artificial Sequence
  Synthetic
ctagcttcatcatcttcttatagttataggagaaaacttgtaaatcctgccaatcaagaagaaacacttcctttt

SEQ ID NO: 327645 - DNA, 75 bp, Artificial Sequence
  Synthetic
caatcaagaagaaacacttccttttcatttccagctagacaagcaagtggttcatgcagagatacagaatctagg

SEQ ID NO: 327646 - DNA, 75 bp, Artificial Sequence
  Synthetic
ataggagaaaacttgtaaatcctgccaatcaagaagaaacacttcctttccatttccagctagacaaacaagtag

SEQ ID NO: 327647 - DNA, 75 bp, Artificial Sequence
  Synthetic
ttcatgcagagatacagaatctagggcattggatggatggcacattcaacataaaaactgctttccattgttatg

SEQ ID NO: 327648 - DNA, 75 bp, Artificial Sequence
  Synthetic
gagaatgtaaaaaatatgcttatccctggcagacagcaaagtgtttctttgaaaaggattaccagtatgagacaa

SEQ ID NO: 327649 - DNA, 75 bp, Artificial Sequence
  Synthetic
gagaatgtaagaaatatgcttatccttggcagacagcaaagtgtttctttgaaaaggattaccagtatgagacaa

SEQ ID NO: 327650 - DNA, 75 bp, Artificial Sequence
  Synthetic
gaaaaggattaccagtatgagacaagttggggctgtaacccaccagattgcccaggggtaggtacaggctgtaca

SEQ ID NO: 327651 - DNA, 75 bp, Artificial Sequence
  Synthetic
gaaaaggattaccagtatgagacaagttgggggtgtaacccaccagattgcccaggggtaggcacaggttgtaca

SEQ ID NO: 327652 - DNA, 75 bp, Artificial Sequence
  Synthetic
gcctgtggggtataccttgacaagctccgctcagttgggaaagcttacaaaattgtatcacttaaatatacacgg

SEQ ID NO: 327653 - DNA, 75 bp, Artificial Sequence
  Synthetic
aaagtgtgcatacaattagggacagaacaaacttgtaagcatatagatgttaatgattgcttggtcactccatca

SEQ ID NO: 327654 - DNA, 75 bp, Artificial Sequence
  Synthetic
taatgattgcttggtcactccatcagttaaagtttgtatgattggtaccatatctaagcttcagcctggtgatac

SEQ ID NO: 327655 - DNA, 75 bp, Artificial Sequence
  Synthetic
tttattgtttttaggccctttagagcaaggtgggattatccttaaacaatggtgtacaacatcatgtgtgtttgg

SEQ ID NO: 327656 - DNA, 75 bp, Artificial Sequence
  Synthetic
tttattatttttaggccctttagagcaaggtgggattatcctcaaacaatggtgtacaacatcatgtgtatttgg

SEQ ID NO: 327657 - DNA, 75 bp, Artificial Sequence
  Synthetic
ggtgtacaacatcatgtgtgtttggcgatccaggtgatattatgtcgacaacaagcgggatgaggtgccctgaac

SEQ ID NO: 327658 - DNA, 75 bp, Artificial Sequence
  Synthetic
ggtgtacaacatcatgtgtatttggcgatccaggtgatatcatgtcaacgacaagcggaatgaggtgccctgaac

SEQ ID NO: 327659 - DNA, 75 bp, Artificial Sequence
  Synthetic
acactgggtctttcaggaagatctgcggctttgccacaacaccaacatgtgagtatcaaggcaacacagtgtctg

SEQ ID NO: 327660 - DNA, 75 bp, Artificial Sequence
  Synthetic
gagtatcaaggcaacacagtgtctggatttcaacgcatgatggcaacccgagattcttttcaatcgtttaatgtg

SEQ ID NO: 327661 - DNA, 75 bp, Artificial Sequence
  Synthetic
acagaaccacacattactagcaatcggcttgaatggattgatccagacagtagtatcaaggaccatataaatatg

SEQ ID NO: 327662 - DNA, 75 bp, Artificial Sequence
  Synthetic
acagaaccacacatcactagtaatcggcttgaatggattgatccagacagtagtattaaggaccatataaatatg

SEQ ID NO: 327663 - DNA, 75 bp, Artificial Sequence
  Synthetic
gttctaaaccgagatgtatcctttcaagatctaagtgacaatccatgtaaggttgatttgcacacacaatcaatt

SEQ ID NO: 327664 - DNA, 75 bp, Artificial Sequence
  Synthetic
attttaaaccgagatgtttcctttcaagatctaagcgacaatccatgtaaggttgatttgcatacacaatcaatt

SEQ ID NO: 327665 - DNA, 75 bp, Artificial Sequence
  Synthetic
gatggagcttggggatcaggagtgggttttacgttagtatgtactgttggtcttacagaatgtgcaaattttata

SEQ ID NO: 327666 - DNA, 75 bp, Artificial Sequence
  Synthetic
aagatctaagcgacaatccatgtaaggttgatttgcatacacaatcaattgatggagcctggggatcgggagtgg

SEQ ID NO: 327667 - DNA, 75 bp, Artificial Sequence
  Synthetic
gtttcacgttagtgtgtactgttggtcttacagaatgtgcaaattttataacctcaatcaaagcatgtgattctg

SEQ ID NO: 327668 - DNA, 75 bp, Artificial Sequence
  Synthetic
acctctatcaaagcatgtgattctgccatgtgttatggggccacagtgacaaatttgcttagggggtcaaacact

SEQ ID NO: 327669 - DNA, 75 bp, Artificial Sequence
  Synthetic
ccatgtgttatggggccacagtaacaaatttgcttagggggtcaaacacggttaaagttgttggtaaaggtgggc

SEQ ID NO: 327670 - DNA, 75 bp, Artificial Sequence
  Synthetic
gttaaagttgttggtaaaggtggacattctgggtctttattcaaatgctgtcatgatactgattgtactgaagaa

SEQ ID NO: 327671 - DNA, 75 bp, Artificial Sequence
  Synthetic
aaatttgcttagggggtcaaacacggttaaagttgttggtaaaggtgggcactctgggtctttattcaaatgctg

SEQ ID NO: 327672 - DNA, 75 bp, Artificial Sequence
  Synthetic
gttaaagttgttggtaaaggtgggcactctgggtctttattcaaatgctgtcatgacactgattgcaccgaagaa

SEQ ID NO: 327673 - DNA, 75 bp, Artificial Sequence
  Synthetic
gacggtgcaccgccctgtacaattaaatgctggtttacaaagtcaggtgagtggctattggggatccttaacggt

SEQ ID NO: 327674 - DNA, 75 bp, Artificial Sequence
  Synthetic
gacggtgcaccaccctgtacaattaaatgctggtttacaaagtcaggtgagtggctattggggattcttaacggt

SEQ ID NO: 327675 - DNA, 75 bp, Artificial Sequence
  Synthetic
aattgggtggtagttgctgttttgattgtgattctgatattatcaatactccttttcagcttcttttgtcctgtt

SEQ ID NO: 327676 - DNA, 75 bp, Artificial Sequence
  Synthetic
aatgctggtttacaaagtcaggtgagtggctattggggattcttaacggtaattgggtggtagttgctgttttaa

SEQ ID NO: 327677 - DNA, 75 bp, Artificial Sequence
  Synthetic
ttgtgattctgatactatcaatactccttttcagcttcttttgtcctgttagaagtagaaagaataaggctaatt

SEQ ID NO: 327678 - DNA, 75 bp, Artificial Sequence
  Synthetic
agaagtagaaagaataaagctaattagcaaatatatgtgtgaacaagggtatgactatattatcctatcatttgt

SEQ ID NO: 327679 - DNA, 75 bp, Artificial Sequence
  Synthetic
agcaaatatatatgtggacaagggtatgactatattatctcattttttcatattcttataccaataatatctgta

SEQ ID NO: 327680 - DNA, 75 bp, Artificial Sequence
  Synthetic
atattcttataccaataatatctgtatatccttataatccaaatatttatactaatttttacttttatataagta

SEQ ID NO: 327681 - DNA, 75 bp, Artificial Sequence
  Synthetic
atgactatattatctcattttttcatattcttataccaataatatctgtatatctttatattccaaatatttata

SEQ ID NO: 327682 - DNA, 75 bp, Artificial Sequence
  Synthetic
ctaatttttacttttatataagtattaactagccccttatcagctaaaaaaaacaaactcttaacacctatataa

SEQ ID NO: 327683 - DNA, 75 bp, Artificial Sequence
  Synthetic
aagatcgagagttcttgcaattttgacttgcatgtcccagccactactactcagaaatacaatcaagttgactgg

SEQ ID NO: 327684 - DNA, 75 bp, Artificial Sequence
  Synthetic
aactagccccttatcagctaaaaaaaacaaactcttaacacctatataatcccatttgcttattacgaggctttt

SEQ ID NO: 327685 - DNA, 75 bp, Artificial Sequence
  Synthetic
gagaaattcaggaaaatggaaaaatatagggagattcatcaaagaatcaaggagattcctcctgggggggcttct

SEQ ID NO: 327686 - DNA, 75 bp, Artificial Sequence
  Synthetic
ggagattcctcctgggggggcttctgcattagaatgtttagatttacttgaccgtctttatgcagtcagacatga

SEQ ID NO: 327687 - DNA, 75 bp, Artificial Sequence
  Synthetic
caactacgtttgaggctgcatacaagtcaaggaagacagtgatttgttatgatttggcctgtaatcaaacacatt

SEQ ID NO: 327688 - DNA, 75 bp, Artificial Sequence
  Synthetic
tcctgttcaaacatgtatgtctgtacggagctgtatgataggtctgttatctagcaggatccaggttatctacga

SEQ ID NO: 327689 - DNA, 75 bp, Artificial Sequence
  Synthetic
aaagacctataggtcaagttctgttaatggctggtgtgccaaatgatgtaattcaaggtatggagaagaaagtca

SEQ ID NO: 327690 - DNA, 75 bp, Artificial Sequence
  Synthetic
tacctacaagcccttcaggacagatcttgaaaagctttttccgcatgacacctgataattataaaattacaggtg

SEQ ID NO: 327691 - DNA, 75 bp, Artificial Sequence
  Synthetic
ctttaattgagtttattgaagtaacagtgactgcagatgttgctaaaggtatccgtgaaaagaaattaaagtacg

SEQ ID NO: 327692 - DNA, 75 bp, Artificial Sequence
  Synthetic
gacaagggttgatgagaatagctggacctgttactgccaaggtaccatctacagaaacgactgaaacaatgcaag

SEQ ID NO: 327693 - DNA, 75 bp, Artificial Sequence
  Synthetic
agagcggtcttcagtttgtagagtctttattaagtcaagaacacaagaagggtaatataaatcaagcttacaaga

SEQ ID NO: 327694 - DNA, 75 bp, Artificial Sequence
  Synthetic
ggtaatataaatcaagcttacaagattacatttgatgttgtggctgtaaaaacagatggttcaaacatatcaact

SEQ ID NO: 327695 - DNA, 75 bp, Artificial Sequence
  Synthetic
caatggcctagtcggcgtaatgatggtgttgttcaacatatgaggcttgtgcaggctgatattaattatgttaga

SEQ ID NO: 327696 - DNA, 75 bp, Artificial Sequence
  Synthetic
gaacatctcatcaagcctgatgagcgtgcatcactagaagccatgttcaatcttaaatttcatgtaggaggccct

SEQ ID NO: 327697 - DNA, 75 bp, Artificial Sequence
  Synthetic
tccctggagttgctcattcccttgctgtggagttatgtgttccaggtcttcatggctgggctacaacagcactgc

SEQ ID NO: 327698 - DNA, 75 bp, Artificial Sequence
  Synthetic
aaactgaggtactttaatataccagattacaagcctcagtcattatgtcagcctgagatcacaaatttgattcaa

SEQ ID NO: 327699 - DNA, 75 bp, Artificial Sequence
  Synthetic
tactgcaagcactggctcacagaagatcatgattttgtttttaaggaagttacaggcaataatgttatgaactca

SEQ ID NO: 327700 - DNA, 75 bp, Artificial Sequence
  Synthetic
tttgagaacaatgaggatgtatatatgtctagatatagggagtcacgtaaaccacgtaatttcttgttaattcaa

SEQ ID NO: 327701 - DNA, 75 bp, Artificial Sequence
  Synthetic
ggttctattcaaggtccatacttaccatcaactatcagctctgatcagtgtgatacaagaattggctgcttggag

SEQ ID NO: 327702 - DNA, 75 bp, Artificial Sequence
  Synthetic
gtgttgaaagtacatccagagacaccagtacaagcaattgcagtggacatggcatataagtatatggagttgaat

SEQ ID NO: 327703 - DNA, 75 bp, Artificial Sequence
  Synthetic
actgagagtgcattacaagctcatttttcaatctgtaagctaacgaacaggttccaggaaatcttaaaaaagtca

SEQ ID NO: 327704 - DNA, 75 bp, Artificial Sequence
  Synthetic
agagatgagatcattaactactacaatcccagggttcatttccaagcaactcagtcagtgaaggagccaggtaca

SEQ ID NO: 327705 - DNA, 75 bp, Artificial Sequence
  Synthetic
tcagtcagtgaaggagccaggtacattcaaattaggactttctcaattaaatccaatgtctaaatcaatattgga

SEQ ID NO: 327706 - DNA, 75 bp, Artificial Sequence
  Synthetic
aagggcctctttggtgaaccattagagagtataaacatatcgagccagattcaacagaatgagtgttcacgcatt

SEQ ID NO: 327707 - DNA, 75 bp, Artificial Sequence
  Synthetic
atagaatcaatactttcaaatctcgaaataaatgttggtgaagtaacaatgagtctagctaatcctcgtaaaact

SEQ ID NO: 327708 - DNA, 75 bp, Artificial Sequence
  Synthetic
acaggtgtagatgagttgctagggaaattttatgagaatgaactgtctaagtatctgatcagcatattacggaaa

SEQ ID NO: 327709 - DNA, 75 bp, Artificial Sequence
  Synthetic
actgcagcctggcatattggtcatttaataagagatataacagaaagtcttattgctcatgcaggtttaaagcgg

SEQ ID NO: 327710 - DNA, 75 bp, Artificial Sequence
  Synthetic
gttcagttgggaaagcctataaaattgtatcactcaaatacacgcgaaaggtgtgtattcaattggggacagaac

SEQ ID NO: 327711 - DNA, 75 bp, Artificial Sequence
  Synthetic
tccaaatactggtcaatccatgcttatgatcatggtggggtaatattatttatcctcccttcaaagtctttagag

SEQ ID NO: 327712 - DNA, 75 bp, Artificial Sequence
  Synthetic
aaacctgtaaacatatagatgttaatgattgtttggtcaccccgtctgttaaagtttgcatgataggtaccatct

SEQ ID NO: 327713 - DNA, 75 bp, Artificial Sequence
  Synthetic
gttgttggatcttatattcggtatttcacagtgttcaaagatggtatagggcttatagatgaggaaaatttagac

SEQ ID NO: 327714 - DNA, 75 bp, Artificial Sequence
  Synthetic
cgaagcttcagccaggtgacaccttattgtttttgggccctttagagcaaggtgggattattctaaaacaatggt

SEQ ID NO: 327715 - DNA, 75 bp, Artificial Sequence
  Synthetic
tcaaaggtagacattgacggtgttcagtggtgtttttcaaaagtaatgagtattgatcttaacaggttgttagct

SEQ ID NO: 327716 - DNA, 75 bp, Artificial Sequence
  Synthetic
ttaaatatcgcctttgaaaaggcactccttgcaactgccacttggtttcaatattacacagaagaccaagggcac

SEQ ID NO: 327717 - DNA, 75 bp, Artificial Sequence
  Synthetic
ttcccactacaacatgcattacggtctgtgttctcttttcattttttattatgtgtttctcaaaagatgaagata

SEQ ID NO: 327718 - DNA, 75 bp, Artificial Sequence
  Synthetic
tgtgcaatttttgacaacttacgctatttaatcccagctgtcacatcattatattcaggttatgagctcctgata

SEQ ID NO: 327719 - DNA, 75 bp, Artificial Sequence
  Synthetic
atattcaggttatgagctcctgatagaaaaattctttgagcggccatttaagagtgccttagaagtgtacttata

SEQ ID NO: 327720 - DNA, 75 bp, Artificial Sequence
  Synthetic
taatataataaaagcattgcttataagcctagcacaaaataataaggtacgattttactctaaagtgcgtcttct

SEQ ID NO: 327721 - DNA, 75 bp, Artificial Sequence
  Synthetic
tggcctcactgttgatcattcaactgtaggtgcaagtggagtttatccttcattgatgtctagggttgtttataa

SEQ ID NO: 327722 - DNA, 75 bp, Artificial Sequence
  Synthetic
gcactatcgcagtctcatttctgaagctacaacatgtttttttcttttcgaaaaaggtctacatgggaatctaaa

SEQ ID NO: 327723 - DNA, 75 bp, Artificial Sequence
  Synthetic
gttcagcttcttttgtcctgttagaaatagaaaaaataaggccaattagcaaacatatatgtaagtaagggtatg

SEQ ID NO: 327724 - DNA, 75 bp, Artificial Sequence
  Synthetic
tgaggaagctaaaatacatcttgagactgtggagtgggcaaggaaatttgaggcaaaagaaagaaaatatggaga

SEQ ID NO: 327725 - DNA, 75 bp, Artificial Sequence
  Synthetic
atcatattatatcattatgtgtatactcttatatctataatatctatgtatccttatactctaactatttatatt

SEQ ID NO: 327726 - DNA, 75 bp, Artificial Sequence
  Synthetic
tatattaatgagggaaggttatacgattgatgctatacgtgttggtgatgtgcaggtagaacaacaattattttg

SEQ ID NO: 327727 - DNA, 75 bp, Artificial Sequence
  Synthetic
aaaaacaaacccttaacacctatataatcccatttgcttattacgattcttttgttcctgcggagtctactacta

SEQ ID NO: 327728 - DNA, 75 bp, Artificial Sequence
  Synthetic
tcaggaggttgtagagttaagtgcagaagaactcaacaagtatttgcaagcaaaaagtcaggtcttatcttctaa

SEQ ID NO: 327729 - DNA, 75 bp, Artificial Sequence
  Synthetic
tgagttaaagatagaatgtccgcatactgtcggtttaggccagggttatgtaacaggttcagtggaaactacacc

SEQ ID NO: 327730 - DNA, 75 bp, Artificial Sequence
  Synthetic
tatcatgaataaacattgggataagccatattttagccagacaagaaatataagtttaaagggtatgtccggagc

SEQ ID NO: 327731 - DNA, 75 bp, Artificial Sequence
  Synthetic
attgcaagaagatggacatcttgcagcaagtgttacattaattgaggcaattagatttttaaataggtcacagac

SEQ ID NO: 327732 - DNA, 75 bp, Artificial Sequence
  Synthetic
taatccaaatgttattgacatgtatgaacagacaaagcagcacaaagctcaagcacgtattgtgaggaaatatca

SEQ ID NO: 327733 - DNA, 75 bp, Artificial Sequence
  Synthetic
acggactgaagctgatagaggtttttttatcacaactctcccaacaagagtcagattagaaattatagaagatta

SEQ ID NO: 327734 - DNA, 75 bp, Artificial Sequence
  Synthetic
ttatgatgcaatagccagagttgttccagaggaatatatatcatatgggggagacaagaaaattctaaatataca

SEQ ID NO: 327735 - DNA, 75 bp, Artificial Sequence
  Synthetic
gactgcgttagagaaagcattacgatgggcttcaggatcatcagaggtcataacaagcacaggaaatgtgattaa

SEQ ID NO: 327736 - DNA, 75 bp, Artificial Sequence
  Synthetic
atttaagaggaggctgatgtatgtaagtgctgatgctacgaagtggtcaccaggagataattcagcaaagtttaa

SEQ ID NO: 327737 - DNA, 75 bp, Artificial Sequence
  Synthetic
gagattcacacaggctttatatgatggcttatcagatgagaagttaaagtgttgcgttgttgatgcccttaggca

SEQ ID NO: 327738 - DNA, 75 bp, Artificial Sequence
  Synthetic
caagatgtagtagtttactgtaatggacaaaagaaagtcattctcactaagactctagttataggccaatgtatt

SEQ ID NO: 327739 - DNA, 75 bp, Artificial Sequence
  Synthetic
tgctgtagaattatgtgttcctgggctgcatggttgggcaacaactgcattacttatcacattttgtttcggctg

SEQ ID NO: 327740 - DNA, 75 bp, Artificial Sequence
  Synthetic
tgtctatgagacagagtttttcatgtctagaaaacttcatcgctatatagattctatggatgagcattctgaggc

SEQ ID NO: 327741 - DNA, 75 bp, Artificial Sequence
  Synthetic
tgtccaagacttccttgatttttttaagggtggagtgtctgctacagtcaaaggtaattggctccaaggtaactt

SEQ ID NO: 327742 - DNA, 75 bp, Artificial Sequence
  Synthetic
tacttatcacattttgtttcggctggctccttataccaacagttaccttaattatattaaaaatcctgaggttgc

SEQ ID NO: 327743 - DNA, 75 bp, Artificial Sequence
  Synthetic
aaataaatgttcttcattatttggggctgcagtgtcattgctctttagacgtatttgggcagagctatttccaga

SEQ ID NO: 327744 - DNA, 75 bp, Artificial Sequence
  Synthetic
gctgcagtgtcattgctctttagacgtatttgggcagagctatttccagaattagaatgcttttttgagtttgcg

SEQ ID NO: 327745 - DNA, 75 bp, Artificial Sequence
  Synthetic
tacagagtcaaaattcaaagtcatcttggaaagggtaaaggtggaatatcagaagacgatgggctcaatggtgtg

SEQ ID NO: 327746 - DNA, 75 bp, Artificial Sequence
  Synthetic
catcactcggatgatgccctctttatttatggttatttagagccagaagatgatggaactgattggtttttatat

SEQ ID NO: 327747 - DNA, 75 bp, Artificial Sequence
  Synthetic
tgatggaactgattggtttttatatgtatctcaacagatacaggctggtaattatcactggcatgctgtcaacca

SEQ ID NO: 327748 - DNA, 75 bp, Artificial Sequence
  Synthetic
tcattaaaacgcccagaagtaaagaaaggttgttacaggacactaggggtatttcggtataagagtcggtgttat

SEQ ID NO: 327749 - DNA, 75 bp, Artificial Sequence
  Synthetic
agaaatgtggaagagtatgtttaatttacatgagcacttgctgctaatgggatccataaaggtgtccccgaaaaa

SEQ ID NO: 327750 - DNA, 75 bp, Artificial Sequence
  Synthetic
gttggtctagtatgggggattcttctaacaactgagctaattatatgggcagctagcgctgacacccccttaatg

SEQ ID NO: 327751 - DNA, 75 bp, Artificial Sequence
  Synthetic
gagtctggttggtctgatacagcacatggagttggcataattcccatgaaaacagatttagagcttgatttcgca

SEQ ID NO: 327752 - DNA, 75 bp, Artificial Sequence
  Synthetic
gacgacagtttctcctacaaatgctgaatttctttccacattttttgaaggttgtgcagtgtcaatcccttttat

SEQ ID NO: 327753 - DNA, 75 bp, Artificial Sequence
  Synthetic
aaaaatactgcttggatcattatcagatttaccaggattaggattttttgatgatctggctgctgcacaaagtag

SEQ ID NO: 327754 - DNA, 75 bp, Artificial Sequence
  Synthetic
atgtgttaaagcaatggacttaggggcatccccacagttggcgcaattagctgttgttatttgcactagtaaagt

SEQ ID NO: 327755 - DNA, 75 bp, Artificial Sequence
  Synthetic
tgagagattgtacggcactgcagatgggatggttaacagcccggtagcatttctaaaggtaacaaaggcccatgt

SEQ ID NO: 327756 - DNA, 75 bp, Artificial Sequence
  Synthetic
acctattcctttgggaggtgatggctcaatgtctataatggagcttgccacagcaggtataggtatggctgataa

SEQ ID NO: 327757 - DNA, 75 bp, Artificial Sequence
  Synthetic
gaatattctcaagcaagcattttattcttacaaacatacaagacgtgatggggatagatatgttttgggtctttt

SEQ ID NO: 327758 - DNA, 75 bp, Artificial Sequence
  Synthetic
taagttcttaatgtctcttagtgaagatgtttttcagcatgataggctgggtgagtttagttttgttggtaaagt

SEQ ID NO: 327759 - DNA, 75 bp, Artificial Sequence
  Synthetic
ccaatggaaggtgttcacacctaaaaatgagtttgaattttttgatcaattttcacagtcctatttaaagagttg

SEQ ID NO: 327760 - DNA, 75 bp, Artificial Sequence
  Synthetic
gttttaaaccgagatgtttcctttcaagatctaagcgataatccatgtaaggttgatttgcatacacaatcaatt

SEQ ID NO: 327761 - DNA, 75 bp, Artificial Sequence
  Synthetic
aagatctaagcgataatccatgtaaggttgatttgcatacacaatcaattgacggagcttggggatcaggagtgg

SEQ ID NO: 327762 - DNA, 75 bp, Artificial Sequence
  Synthetic
gacaaatcaacacccagtatatgattatattatacctagaggtagagataatctcttagtctatttagtcagaaa

SEQ ID NO: 327763 - DNA, 75 bp, Artificial Sequence
  Synthetic
attaaatgatcctagtattgtcacagctatgacaatgcaatctccattgcaacttagattcagaatgcaagcaaa

SEQ ID NO: 327764 - DNA, 75 bp, Artificial Sequence
  Synthetic
gctatgacaatgcaatctccattgcaacttagattcagaatgcaagcaaagcagcatatgaaagtgtgtaagctt

SEQ ID NO: 327765 - DNA, 75 bp, Artificial Sequence
  Synthetic
gttaaagttgttggtaaaggtgggcactctgggtctttattcaaatgctgtcatgatactgattgcactgaagaa

SEQ ID NO: 327766 - DNA, 75 bp, Artificial Sequence
  Synthetic
ggcttagcagcgtcaccacctcatttagatagggttacaggttataatcaaatagattctgataaagtttatgat

SEQ ID NO: 327767 - DNA, 75 bp, Artificial Sequence
  Synthetic
gaaggggaatgggtgacattcagagaagttttagctgcagcagatagttttgcaactaagtacaatcccacagaa

SEQ ID NO: 327768 - DNA, 75 bp, Artificial Sequence
  Synthetic
aagttttagctgcagcagatagttttgcaactaagtacaatcccacagaaaaagacttagatctgtttaatacat

SEQ ID NO: 327769 - DNA, 75 bp, Artificial Sequence
  Synthetic
aatgctggtttacaaagtcaggtgagtggctattggggattcttaacggtaattgggtggtagttgcagttttga

SEQ ID NO: 327770 - DNA, 75 bp, Artificial Sequence
  Synthetic
tagttagttgtacattctctaaagagtatgcatggaaagatttcttgaacgaagttaggtgtgaagtggtaccta

SEQ ID NO: 327771 - DNA, 75 bp, Artificial Sequence
  Synthetic
gaagttaggtgtgaagtggtacctacaaaacatgtccatcggtcaaaaattgcaagaacttttacagtacgtgag

SEQ ID NO: 327772 - DNA, 75 bp, Artificial Sequence
  Synthetic
agcaaatatatatgtagacaagggtatgactatattatcctattttttcagattcttataccaataatatctgta

SEQ ID NO: 327773 - DNA, 75 bp, Artificial Sequence
  Synthetic
atgactatattatcctattttttcagattcttataccaataatatctgtatatctttataatccaaataattata

SEQ ID NO: 327774 - DNA, 75 bp, Artificial Sequence
  Synthetic
aaggatcaagctattcagaacccaattactgctgttatagggtataaatatgcttcaactgtagatgaaatcagt

SEQ ID NO: 327775 - DNA, 75 bp, Artificial Sequence
  Synthetic
ttactgctgttatagggtataaatatgcttcaactgtagatgaaatcagtgatgttttagatagttccttctttc

SEQ ID NO: 327776 - DNA, 75 bp, Artificial Sequence
  Synthetic
gatgttttagatagttccttctttcctgattcattatctgctgacctccaagtcatgaaggaaggggtgtataga

SEQ ID NO: 327777 - DNA, 75 bp, Artificial Sequence
  Synthetic
gagctgggtctagatataggtcttcctgaggtgctgaagcgaatagcaccacttttatacaaagctggaagatct

SEQ ID NO: 327778 - DNA, 75 bp, Artificial Sequence
  Synthetic
agagttgttatagtagaaggtaatgtagagggtacagcagaatcaatttgtagttattggcttcgtagcatgtca

SEQ ID NO: 327779 - DNA, 75 bp, Artificial Sequence
  Synthetic
ttagtcaaaacaattaaagtacgtcccaaaaaagaagtgctcagagcagtttcactatacagtacaaaggaaaac

SEQ ID NO: 327780 - DNA, 75 bp, Artificial Sequence
  Synthetic
attggtttacaagatgatgttgcagctacacgactgtgtatagaagtttggagatggtgtaaagctaatgatcag

SEQ ID NO: 327781 - DNA, 75 bp, Artificial Sequence
  Synthetic
cattgagatatggaaatgtccttgatgtaaattccattgacttagaagagccaagtgggcaaacagctgattgga

SEQ ID NO: 327782 - DNA, 75 bp, Artificial Sequence
  Synthetic
aatgtaaatgactggttaaatgcattatacttcgaaaagcaaactctcatggattgggtagaaaggttccgtcga

SEQ ID NO: 327783 - DNA, 75 bp, Artificial Sequence
  Synthetic
cttgtagatatcaaggtcagggaaatctctaaccaagaaccacttaaactttaagtgggcagtaatcaacttata

SEQ ID NO: 327784 - DNA, 75 bp, Artificial Sequence
  Synthetic
aaaggagtggttcctattgatcctgaaatccagtgtattgccttgctactttatgacgtgttgggttataagagt

SEQ ID NO: 327785 - DNA, 75 bp, Artificial Sequence
  Synthetic
gtattacagatgcaggcaaataggcgggcatactcagggaaacagtatgatgcatactgtgttcaaacatataac

SEQ ID NO: 327786 - DNA, 75 bp, Artificial Sequence
  Synthetic
gaagaaacaagactttatgagggtgatttgagagtcacatttaattttggccttgattgtgcaaggttagaaatc

SEQ ID NO: 327787 - DNA, 75 bp, Artificial Sequence
  Synthetic
atttgagagtcacatttaattttggccttgattgtgcaaggttagaaatcttttgggataagaaagaatacattc

SEQ ID NO: 327788 - DNA, 75 bp, Artificial Sequence
  Synthetic
ttgaaacatcaattacgcaacgtcatgttttaaagttgatgatggaggaggtcacacaagaattgttaaggtgtg

SEQ ID NO: 327789 - DNA, 75 bp, Artificial Sequence
  Synthetic
ggatgagattcaaaacagagcaagtaagtcatactaagagtctggttttattcaaaacggaatcagggtttgaat

SEQ ID NO: 327790 - DNA, 75 bp, Artificial Sequence
  Synthetic
ggggtaaaccaaatgtgccatgtatagtctttaagcattgtgctttgcgtacaggtttaaggactaagcaagcta

SEQ ID NO: 327791 - DNA, 75 bp, Artificial Sequence
  Synthetic
ttaataaggaattcatgataaatgtccaagcagatgggttcagagctatagcacagatggatatggaaagtccta

SEQ ID NO: 327792 - DNA, 75 bp, Artificial Sequence
  Synthetic
gatttttattggcacatgcttaccatacattacgtgatgtccgttaccaagctgtacaggctgtaggcaatgtgt

SEQ ID NO: 327793 - DNA, 75 bp, Artificial Sequence
  Synthetic
ggtttcaaactacccaacataaattattcataaacccaataatatcctctggattgttagaaaactttatgaaag

SEQ ID NO: 327794 - DNA, 75 bp, Artificial Sequence
  Synthetic
gcttgccagcagcaattcctcctgcagcttattctttaattatgaataaagctaagatatctgtagatttattta

SEQ ID NO: 327795 - DNA, 75 bp, Artificial Sequence
  Synthetic
ctcgtggtccttactactgcaactgctgggctaacacggaatctttatgagttgaagatagaatgtccacatact

SEQ ID NO: 327796 - DNA, 75 bp, Artificial Sequence
  Synthetic
tgttcaatgagttgttggctttagttaacccaaaaaacgttctcaatctagacgggatagaagagacttcagaag

SEQ ID NO: 327797 - DNA, 75 bp, Artificial Sequence
  Synthetic
gatatagtacagtaacctctatatctagccgacaatggtccgaagaggtaagtcttatggctgacgatgatattg

SEQ ID NO: 327798 - DNA, 75 bp, Artificial Sequence
  Synthetic
atgatgaagaggaatttacaatagctctcgatgacatagactttgagcagatcaatcttgatgaggatatccaac

SEQ ID NO: 327799 - DNA, 75 bp, Artificial Sequence
  Synthetic
attttttgcaagatgaatcagcttatactggtgatttaacaatacaaacggaggaggttgaggtaaaaaggataa

SEQ ID NO: 327800 - DNA, 75 bp, Artificial Sequence
  Synthetic
gaggtgtaacacgtgtacttgaaccagttaagctaattaaaagttgggtttcaaaagggcttgctattgataaag

SEQ ID NO: 327801 - DNA, 75 bp, Artificial Sequence
  Synthetic
tgtataaccccatagggatagtgttgatggcaagatacatgtcaaagaattatgatttcagcaaaattcctttag

SEQ ID NO: 327802 - DNA, 75 bp, Artificial Sequence
  Synthetic
ccttattaaacccatatgatttaactgagtttgaaagtgtcgtcaaaggctggggtgaaactgttaatgacaggt

SEQ ID NO: 327803 - DNA, 75 bp, Artificial Sequence
  Synthetic
tgagtttgaaagtgtcgtcaaaggctggggtgaaactgttaatgacaggttcctagaggttgataatgatgcaca

SEQ ID NO: 327804 - DNA, 75 bp, Artificial Sequence
  Synthetic
ctactacgactaaagctggaatgagcaccctcaaagaagtgcaagacaacatcactctccacgaacaacaactcg

SEQ ID NO: 327805 - DNA, 75 bp, Artificial Sequence
  Synthetic
acggttggtccgagagaaaaacatattgcccgaagacatattaccagattcattattttcttttaggcacgttga

SEQ ID NO: 327806 - DNA, 75 bp, Artificial Sequence
  Synthetic
caccctcaaagaagtgcaagacaacatcactctccacgaacaacaactcgtgactgccagacagaagctcaaaga

SEQ ID NO: 327807 - DNA, 75 bp, Artificial Sequence
  Synthetic
tgtactgttgaagagactatttcctcgtgaccctgtatcttcattttattaacaattttctttattccaaaccat

SEQ ID NO: 327808 - DNA, 75 bp, Artificial Sequence
  Synthetic
acctgttgatccaacagggattgaacctgatgaccatctaaaggaaaaatcatcattacggtatggcaatgttct

SEQ ID NO: 327809 - DNA, 75 bp, Artificial Sequence
  Synthetic
ctgtatcttcattttattaacaattttctttattccaaaccatgacttgttctctctactgctctgttctcggag

SEQ ID NO: 327810 - DNA, 75 bp, Artificial Sequence
  Synthetic
cagaatggtagggtgggtttgcatcttcctcgtggtccttactactgcaaccgctggattgacacggaatctcta

SEQ ID NO: 327811 - DNA, 75 bp, Artificial Sequence
  Synthetic
tgatgtaaattctattgacttggaagaaccaagtgggcagacagctgattggaaatctattgggctctacatttt

SEQ ID NO: 327812 - DNA, 75 bp, Artificial Sequence
  Synthetic
ccgctggattgacacggaatctctatgaattaaagatagaatgcccacatactgtgggtctaggtcagggttatg

SEQ ID NO: 327813 - DNA, 75 bp, Artificial Sequence
  Synthetic
aagttttgcattaccaattattctcaaagccctgtacatgttgtctactaggggccgtcaaacaatcaaagagaa

SEQ ID NO: 327814 - DNA, 75 bp, Artificial Sequence
  Synthetic
tgacaggttctgtggaaactacacctattcttttaacacaggtagctgacctcaagattgagagttcttgcaatt

SEQ ID NO: 327815 - DNA, 75 bp, Artificial Sequence
  Synthetic
caaagggacaagaattcgatttaaggatgattcatcatatgaggaagttaacggaatacgcaagccaagacacct

SEQ ID NO: 327816 - DNA, 75 bp, Artificial Sequence
  Synthetic
ctcaagattgagagttcttgcaattttgacttgcatgtcccggccactactactcagaaatacaatcaagttgat

SEQ ID NO: 327817 - DNA, 75 bp, Artificial Sequence
  Synthetic
tggactaaaaaaagttctactacagaaagcacgaatgcaggtgcagctacatttgaggctaaaacaaaagaggta

SEQ ID NO: 327818 - DNA, 75 bp, Artificial Sequence
  Synthetic
atatgtttctatgcctactgcccagtctacaatgaaagcagatgagatcactcctgggaggttccgtactatagc

SEQ ID NO: 327819 - DNA, 75 bp, Artificial Sequence
  Synthetic
atttgaggctaaaacaaaagaggtaaatttaaaaggcacatgtaatattcctccaactacgtttgaggctgcata

SEQ ID NO: 327820 - DNA, 75 bp, Artificial Sequence
  Synthetic
ctgtgggctatttccagctcaagtcaaggccagaaacatcatcagtcctgtcatgggtgtgattggctttagctt

SEQ ID NO: 327821 - DNA, 75 bp, Artificial Sequence
  Synthetic
ttttgtaaaggattggatggaaagaattgatgacttcttggctgctcgctgcccttttttgcctgagcagaaaga

SEQ ID NO: 327822 - DNA, 75 bp, Artificial Sequence
  Synthetic
attgtcttcctacagtccatttgattgctcctgttcaaacatgtatgtctgtacggagctgtatgataggtctgt

SEQ ID NO: 327823 - DNA, 75 bp, Artificial Sequence
  Synthetic
tgctcctgttcaaacatgtatgtctgtacggagctgtatgataggtctgttatctagcaggatccaggtcatcta

SEQ ID NO: 327824 - DNA, 75 bp, Artificial Sequence
  Synthetic
ccctagagatgctgcactggcaactaacagggcttatttcataacacgccagatgcaagttgatgagtcaaaggt

SEQ ID NO: 327825 - DNA, 75 bp, Artificial Sequence
  Synthetic
tgagaagacatattgtgtcacgggtcagttgatagaagggttatgtttcattccaacacatacaattgcacttac

SEQ ID NO: 327826 - DNA, 75 bp, Artificial Sequence
  Synthetic
tagcgatattgaggacttaattgctgatgcaagggctgagtctgccacaatattcgcagatattgcaactcccca

SEQ ID NO: 327827 - DNA, 75 bp, Artificial Sequence
  Synthetic
acagcctggtcatacgtatgatactatgacattgcctgtaacttgttttttagtggccaaaaaattgggaacaca

SEQ ID NO: 327828 - DNA, 75 bp, Artificial Sequence
  Synthetic
ctcagtatgggtctttgcatgtgctccagatcgctgtccacctacagcactatatgtggcagggatgccagaact

SEQ ID NO: 327829 - DNA, 75 bp, Artificial Sequence
  Synthetic
gcttaagctggctgttgagttagagaaattgattactggtgtgagctgcacagagaatagcttccaaggttatta

SEQ ID NO: 327830 - DNA, 75 bp, Artificial Sequence
  Synthetic
aggtgcattctttgccattcttcaggatatgagaaacaccataatggcatcaaaatctgtaggaacatctgaaga

SEQ ID NO: 327831 - DNA, 75 bp, Artificial Sequence
  Synthetic
catctgttttatcggaaaacattcagagcccttatttgtaccaacaatggaagattatagatcagctgagttatt

SEQ ID NO: 327832 - DNA, 75 bp, Artificial Sequence
  Synthetic
gaaattgaagaaaaaatcggcattctaccagtcatacctgagacgtactcaatctatggggattcagctggacca

SEQ ID NO: 327833 - DNA, 75 bp, Artificial Sequence
  Synthetic
gagcccttatttgtaccaacaatggaagattatagatcagctgagttatttacccgtatggttttaaatccaaga

SEQ ID NO: 327834 - DNA, 75 bp, Artificial Sequence
  Synthetic
tacccgtatggttttaaatccaagaggtgaagatcatgatcctgatcagaatggacaagggttgatgagaatagc

SEQ ID NO: 327835 - DNA, 75 bp, Artificial Sequence
  Synthetic
gaaaataatcatcctgtatatgagccattggggacgagaggctgtaaaccatttccaccttggggatgatatgga

SEQ ID NO: 327836 - DNA, 75 bp, Artificial Sequence
  Synthetic
tggacctgttactgccaaggtaccatctacagaaacaaccgaaacaatgcaaggaattgcatttgctggggcacc

SEQ ID NO: 327837 - DNA, 75 bp, Artificial Sequence
  Synthetic
tcctgaactcagggaacttgctcagacccttgtggacatcaaggttagggaaatctccaaccaagagccactcaa

SEQ ID NO: 327838 - DNA, 75 bp, Artificial Sequence
  Synthetic
tctacagaaacaaccgaaacaatgcaaggaattgcatttgctggggcaccaatgtatagctcgttctcaactctt

SEQ ID NO: 327839 - DNA, 75 bp, Artificial Sequence
  Synthetic
gtgagaaaagcagatcctgaatatgtcttttctccaggtataattgcagaatcaaatcatagtgtttgtgataaa

SEQ ID NO: 327840 - DNA, 75 bp, Artificial Sequence
  Synthetic
gctgtaagtggttattaactaaacttgtattcagggcattattataaccagggtaatgggcaccaatcaggtttt

SEQ ID NO: 327841 - DNA, 75 bp, Artificial Sequence
  Synthetic
tcttttctccaggtataattgcagaatcaaatcatagtgtttgtgataaaaagacagtgcccctcacatggactg

SEQ ID NO: 327842 - DNA, 75 bp, Artificial Sequence
  Synthetic
aagacagtgcccctcacatggactgggttcctagcagtttcaggagagatagaaaggataacaggctgtacagtt

SEQ ID NO: 327843 - DNA, 75 bp, Artificial Sequence
  Synthetic
tccttcttgcactagggtgggtttaagggccaactatattacagggtatataatccatgttaattagtgttaagg

SEQ ID NO: 327844 - DNA, 75 bp, Artificial Sequence
  Synthetic
ttttgtacattggctggacctggtgctagttgcgaagcatactcagaaacaggaatcttcaacataagctcccca

SEQ ID NO: 327845 - DNA, 75 bp, Artificial Sequence
  Synthetic
attatcaattatatttgtattcatgtaagtcttatattagtgttaagttgtactaactctgttaagtattgttaa

SEQ ID NO: 327846 - DNA, 75 bp, Artificial Sequence
  Synthetic
ctagttgcgaagcatactcagaaacaggaatcttcaacataagctccccaacttgtttggtaaataaagttcaaa

SEQ ID NO: 327847 - DNA, 75 bp, Artificial Sequence
  Synthetic
gtcttgttaggtcctttaaattttgttaaatctttaggttacgttaagttctgttaagtctttaagttttgttaa

SEQ ID NO: 327848 - DNA, 75 bp, Artificial Sequence
  Synthetic
aatttagaggttcagaacaaagaattaattttatgtgtcaaagggttgatcaagatgttgtggtgtactgtaatg

SEQ ID NO: 327849 - DNA, 75 bp, Artificial Sequence
  Synthetic
gttctgttaagtctttaagttttgttaagtcttttaagtttatgtcttgttaagtcagatatatgggttatttag

SEQ ID NO: 327850 - DNA, 75 bp, Artificial Sequence
  Synthetic
gacaaaagaaagtcatccttactaaaaccctagtaataggtcaatgtatctacacatttacaagtttattttcac

SEQ ID NO: 327851 - DNA, 75 bp, Artificial Sequence
  Synthetic
aaccctagtaataggtcaatgtatctacacatttacaagtttattttcactaattcctggagttgcccattctct

SEQ ID NO: 327852 - DNA, 75 bp, Artificial Sequence
  Synthetic
tgttaagtcattgtttatcgaccattagtgttaagtctatatatgatttattaattaaagtaagattatatatat

SEQ ID NO: 327853 - DNA, 75 bp, Artificial Sequence
  Synthetic
tgctgtggagttgtgtgttccaggtcttcatggttgggctacaacagcactacttattactttctgttttggctg

SEQ ID NO: 327854 - DNA, 75 bp, Artificial Sequence
  Synthetic
agatttgttatattcacctattatcatctcgaactagttgatcagggtctgtttaaatcttctcaggtctatttt

SEQ ID NO: 327855 - DNA, 75 bp, Artificial Sequence
  Synthetic
atctcgaactagttgatcagggtctgtttaaatcttctcaggtctattttctattagaggattgtcctattaacc

SEQ ID NO: 327856 - DNA, 75 bp, Artificial Sequence
  Synthetic
gcttctcataccaacagttactttaattatactaaaagtcttaaggctgctgactttctcatgctcgcactattc

SEQ ID NO: 327857 - DNA, 75 bp, Artificial Sequence
  Synthetic
tgactttctcatgctcgcactattctacagaatcaaaattcaaagtcattttagaaagagtcaaggtggagtatc

SEQ ID NO: 327858 - DNA, 75 bp, Artificial Sequence
  Synthetic
tacagaatcaaaattcaaagtcattttagaaagagtcaaggtggagtatcaaaagacaatgggctcaatggtgtg

SEQ ID NO: 327859 - DNA, 75 bp, Artificial Sequence
  Synthetic
cgttccgttgatagtacatgacactaatgcttgctttgctactaattgatctcctccttacaacaatctacttca

SEQ ID NO: 327860 - DNA, 75 bp, Artificial Sequence
  Synthetic
aaaagacaatgggctcaatggtgtgtgatatttgtcaccatgaatgtgagacagcaaaagagcttgaaacacata

SEQ ID NO: 327861 - DNA, 75 bp, Artificial Sequence
  Synthetic
ttgctactaattgatctcctccttacaacaatctacttcattgtccccatctccttccctattacctcaacaaaa

SEQ ID NO: 327862 - DNA, 75 bp, Artificial Sequence
  Synthetic
ctactacgactaaagctggaatgagcaccctcaaagaagtgcaggacaacatcactcttcacgaacaacaactcg

SEQ ID NO: 327863 - DNA, 75 bp, Artificial Sequence
  Synthetic
agaaaagttgtccagaaggtcaatgcccatactgcatgacaataactgagtccactgagagtgcattgcaagctc

SEQ ID NO: 327864 - DNA, 75 bp, Artificial Sequence
  Synthetic
atttttcaatctgtaagctaacaaataggttccaggaaaatctaaaaaaatcattaaaacgcccagaagtacgga

SEQ ID NO: 327865 - DNA, 75 bp, Artificial Sequence
  Synthetic
aaggttgttacaggacattaggagttttccgctacaagagcaggtgctatgtcggcttagtatgggggattctct

SEQ ID NO: 327866 - DNA, 75 bp, Artificial Sequence
  Synthetic
tttccgctacaagagcaggtgctatgtcggcttagtatgggggattctcttaacgacagagctgattatatgggc

SEQ ID NO: 327867 - DNA, 75 bp, Artificial Sequence
  Synthetic
tgctagtgcagatacccctctaatggagtctggttggtcagatacagcacatggtgtaggtataattcctatgaa

SEQ ID NO: 327868 - DNA, 75 bp, Artificial Sequence
  Synthetic
aacagacttagagcttgactttgccctggcctcatcatcctcttatagttatagaagaaagcttgtaaaccctgc

SEQ ID NO: 327869 - DNA, 75 bp, Artificial Sequence
  Synthetic
caatcaagaggaaacacttccctttcatttccagttagataagcaagtagtgcatgcagagatacagaatttagg

SEQ ID NO: 327870 - DNA, 75 bp, Artificial Sequence
  Synthetic
catttccagttagataagcaagtagtgcatgcagagatacagaatttagggcattggatggatggcacatttaac

SEQ ID NO: 327871 - DNA, 75 bp, Artificial Sequence
  Synthetic
ataaagactgcttttcattgctatggagaatgtaaaaaatatgcctatccttggcagacagccaagtgtttcttt

SEQ ID NO: 327872 - DNA, 75 bp, Artificial Sequence
  Synthetic
gaaaaggattatcagtatgaaacaagttggggctgtaacccaccagattgcccaggggtaggaacaggttgtaca

SEQ ID NO: 327873 - DNA, 75 bp, Artificial Sequence
  Synthetic
gcctgtggggtatacttagacaagctccgttcagttgggaaagcctataagattgtatcactcaagtatacacga

SEQ ID NO: 327874 - DNA, 75 bp, Artificial Sequence
  Synthetic
tccgttcagttgggaaagcctataagattgtatcactcaagtatacacgaaaggtatgtattcaattggggacag

SEQ ID NO: 327875 - DNA, 75 bp, Artificial Sequence
  Synthetic
aacaaacctgcaaacacatagatgttaatgattgtttagtcaccccgtctgttaaagtttgcatgataggtacca

SEQ ID NO: 327876 - DNA, 75 bp, Artificial Sequence
  Synthetic
taatgattgtttagtcaccccgtctgttaaagtttgcatgataggtaccatctcaaagctccagccaggtgatac

SEQ ID NO: 327877 - DNA, 75 bp, Artificial Sequence
  Synthetic
tctcaaagctccagccaggtgataccttattgttcttgggtcctttagagcaaggtgggattattctgaaacaat

SEQ ID NO: 327878 - DNA, 75 bp, Artificial Sequence
  Synthetic
ttcagtctgggtctttgcatgtgctccagatcgttgtccgcctacagcattatatgtggccgggatgccagagtt

SEQ ID NO: 327879 - DNA, 75 bp, Artificial Sequence
  Synthetic
ggtgcacaacatcatgtgtgtttggagaccctggtgatatcatgtcaacaacaagtgggatgagatgccctgagc

SEQ ID NO: 327880 - DNA, 75 bp, Artificial Sequence
  Synthetic
tggatttgctacaacacctacatgtgaatatcaaggcaatacagtgtctggattccaacgcatgatggcaactcg

SEQ ID NO: 327881 - DNA, 75 bp, Artificial Sequence
  Synthetic
aaagctgaagaagaaatcagcattctatcagtcttacttaagacgtactcaatcaatggggattcagctagacca

SEQ ID NO: 327882 - DNA, 75 bp, Artificial Sequence
  Synthetic
agattcctttcaatcattcaatgtgacagaaccacatattaccagcaatcgactcgaatggattgatccagatag

SEQ ID NO: 327883 - DNA, 75 bp, Artificial Sequence
  Synthetic
tagtattaaggatcatatcaacatggttttaaatagagatgtttccttccaagatttaagtgacaatccatgtaa

SEQ ID NO: 327884 - DNA, 75 bp, Artificial Sequence
  Synthetic
acccttgtggacattaaggtcagagagatctcgaaccaggaaccacttaaactgtaagtgggcattaaatcaatt

SEQ ID NO: 327885 - DNA, 75 bp, Artificial Sequence
  Synthetic
ggttgatttacatacacaatctattgatggagcttggggatcaggagtgggcttcacattagtatgtactgtagg

SEQ ID NO: 327886 - DNA, 75 bp, Artificial Sequence
  Synthetic
tatattcagggcattataataaccagggtaatgggcactaatcaggatttattgcactagggtgggtttaagggc

SEQ ID NO: 327887 - DNA, 75 bp, Artificial Sequence
  Synthetic
gatggagcttggggatcaggagtgggcttcacattagtatgtactgtaggtcttacagagtgtgcaaacttcata

SEQ ID NO: 327888 - DNA, 75 bp, Artificial Sequence
  Synthetic
tatgttaatcagtattagtgtagtatggtgttaagtatctgtcaattatatctgtgtttatgtagtctttgtatt

SEQ ID NO: 327889 - DNA, 75 bp, Artificial Sequence
  Synthetic
aaatctgctcagaggatctaacacagttaaagttgttggtaaaggtgggcattctgggtccttatttaagtgctg

SEQ ID NO: 327890 - DNA, 75 bp, Artificial Sequence
  Synthetic
aattgttaagtcttgttaggtcttttaagtttaagttctgttaagtctttaagtttttggtaagtctttaagttt

SEQ ID NO: 327891 - DNA, 75 bp, Artificial Sequence
  Synthetic
ccatgatactgactgtactgaagaaggtttagcagcatcaccacctcatttagatagggttactggttacaatca

SEQ ID NO: 327892 - DNA, 75 bp, Artificial Sequence
  Synthetic
aagtttttggtaagtctttaagtttttgataagtttttgataagtctttaagtttttggtaagtctttaagtttt

SEQ ID NO: 327893 - DNA, 75 bp, Artificial Sequence
  Synthetic
ggtttagcagcatcaccacctcatttagatagggttactggttacaatcaaatagattctgataaggtttatgat

SEQ ID NO: 327894 - DNA, 75 bp, Artificial Sequence
  Synthetic
gatggtgcaccgccctgtacaattaaatgttggttcacaaagtcaggtgagtggctgctaggaattcttaatggc

SEQ ID NO: 327895 - DNA, 75 bp, Artificial Sequence
  Synthetic
aattgggtagtagtcgctgttttgattgtaattttgatactatcaatactcctgttcagctttttttgccctgtt

SEQ ID NO: 327896 - DNA, 75 bp, Artificial Sequence
  Synthetic
aggaataggaagaataaggccaattagcagacatatatgtgagtaaaagtatgatcatattatattattatgtgt

SEQ ID NO: 327897 - DNA, 75 bp, Artificial Sequence
  Synthetic
atgatcatattatattattatgtgtatactcttatacctatgatatctgtatgtccttataatctaactatttat

SEQ ID NO: 327898 - DNA, 75 bp, Artificial Sequence
  Synthetic
attaatttttacttttatacaagtattaactaacccattaccagctaaaaaaaacaaacccttaacacctatata

SEQ ID NO: 327899 - DNA, 75 bp, Artificial Sequence
  Synthetic
aactaacccattaccagctaaaaaaaacaaacccttaacacctatataatcccatttgcttattacgaggctttt

SEQ ID NO: 327900 - DNA, 75 bp, Artificial Sequence
  Synthetic
tagtagtagactccttgagaagctactacgactaaagctggaatgagcaccctcaaagaagtgcaagacaacatc

SEQ ID NO: 327901 - DNA, 75 bp, Artificial Sequence
  Synthetic
ctacgactaaagctggaatgagcaccctcaaagaagtgcaagacaacatcacacttcacgaacaacaactcgtga

SEQ ID NO: 327902 - DNA, 75 bp, Artificial Sequence
  Synthetic
tcaaagaagtgcaagacaacatcacccttcacgaacaacaactcgtgactgccaggcagaagctcaaagatgcag

SEQ ID NO: 327903 - DNA, 75 bp, Artificial Sequence
  Synthetic
cctcaaagaagtgcaagacaacatcacacttcacgaacaacaactcgtgacttccagacagaagctcaaagatgc

SEQ ID NO: 327904 - DNA, 75 bp, Artificial Sequence
  Synthetic
gatgatgttaacaaaagcacattacagagcagacgggcagctgtgtctgcattggagaccaaactcggagaactc

SEQ ID NO: 327905 - DNA, 75 bp, Artificial Sequence
  Synthetic
agagcagacgggcagctgtgtctgcattggagaccaaactcggagaactcaaacgagagctggctgatcatattg

SEQ ID NO: 327906 - DNA, 75 bp, Artificial Sequence
  Synthetic
cagctcagaaattggcttcaaaacctgttgatccaacagggattgaacctgatgaccatctaaaggagaaatctt

SEQ ID NO: 327907 - DNA, 75 bp, Artificial Sequence
  Synthetic
ttgagatatggaaatgtccttgatgtaaattccattgacttagaagagccaagcgggcaaacagctgattggaaa

SEQ ID NO: 327908 - DNA, 75 bp, Artificial Sequence
  Synthetic
cattaagatatggtaatgtccttgatgtaaactccattgacctagaagaaccgaacggccagacagctgattgga

SEQ ID NO: 327909 - DNA, 75 bp, Artificial Sequence
  Synthetic
tccatcggactttacattctaagttttgcattaccgattatccttaaagccttgtacatgttatccactaggggc

SEQ ID NO: 327910 - DNA, 75 bp, Artificial Sequence
  Synthetic
agtctattgggctatatattttgagttttgcactaccaattatccttaaggccttgtacatgttatctaccaggg

SEQ ID NO: 327911 - DNA, 75 bp, Artificial Sequence
  Synthetic
cgtcaaacaatcaaagaaaataagggaacaagaatccgattcaaggatgattcatcttatgaagaagttaatgga

SEQ ID NO: 327912 - DNA, 75 bp, Artificial Sequence
  Synthetic
gccgtcagacaatcaaggaaaacaaggggacaagaattcgattcaaagatgattcatcctatgaggaagtcaatg

SEQ ID NO: 327913 - DNA, 75 bp, Artificial Sequence
  Synthetic
atacgtaagccaagacatctatatgtttctatgccaactgctcaatctacaatgaaagcagatgagattactccc

SEQ ID NO: 327914 - DNA, 75 bp, Artificial Sequence
  Synthetic
gaatacgtaagccaagacacctgtatgtttctatgcctactgctcaatccacaatgaaagcagatgagatcaccc

SEQ ID NO: 327915 - DNA, 75 bp, Artificial Sequence
  Synthetic
ggaaggttccgtacaattgcttgcgggttattcccagcccaagtcaaagcaaggaatattatcagtcctgttatg

SEQ ID NO: 327916 - DNA, 75 bp, Artificial Sequence
  Synthetic
ctggcaggttccgtacaattgcttgtgggttgtttccagctcaagtcaaggctagaaacataatcagccctgtca

SEQ ID NO: 327917 - DNA, 75 bp, Artificial Sequence
  Synthetic
ggtgtgattggctttagtttctttgtgaaagattggatggaaaggattgatgactttctggctgcacggtgccca

SEQ ID NO: 327918 - DNA, 75 bp, Artificial Sequence
  Synthetic
tgggtgtgattggttttagtttttttgtcaaagattggatggagaggattgatgaatttttggctgctcgctgtc

SEQ ID NO: 327919 - DNA, 75 bp, Artificial Sequence
  Synthetic
tgaaagattggatggaaaggattgatgactttctggctgcacggtgcccatttctacctgaacagaaggacccta

SEQ ID NO: 327920 - DNA, 75 bp, Artificial Sequence
  Synthetic
catttttacctgagcaaaaagaccctagggatgctgcactggcaaccaatcgagcctatttcataacacgtcaat

SEQ ID NO: 327921 - DNA, 75 bp, Artificial Sequence
  Synthetic
tacaggttgatgaatcaaaggtgagtgatattgaagacttgattgctgatgcaagggctgaatctgccactatat

SEQ ID NO: 327922 - DNA, 75 bp, Artificial Sequence
  Synthetic
atattgaggacctgattgctgatgcaagagctgagtctgccactatattcgcagatattgccactcctcattcag

SEQ ID NO: 327923 - DNA, 75 bp, Artificial Sequence
  Synthetic
tcgcagatattgccactcctcactcagtctgggtttttgcatgtgcaccagatcgttgtccacccacagcattat

SEQ ID NO: 327924 - DNA, 75 bp, Artificial Sequence
  Synthetic
tctgggtctttgcatgtgctccagatcgttgtccacctacagcattatatgtggccgggatgccggagctgggtg

SEQ ID NO: 327925 - DNA, 75 bp, Artificial Sequence
  Synthetic
atgtggcagggatgccagagctaggcgcattctttggaatccttcaggatatgagaaacaccataatggcatcaa

SEQ ID NO: 327926 - DNA, 75 bp, Artificial Sequence
  Synthetic
tctgtggggacatctgaagagaaattgaagaagaaatcagcattctaccagtcatacttaaggcgtactcagtca

SEQ ID NO: 327927 - DNA, 75 bp, Artificial Sequence
  Synthetic
aatctgtgggaacatctgaagagaagttgaagaaaaaatcagcattttaccagtcatatttaaggcgtactcagt

SEQ ID NO: 327928 - DNA, 75 bp, Artificial Sequence
  Synthetic
atggggattcaactggaccagaagataatcatcttatacatgagccattggggaagagaagccgtgaatcatttc

SEQ ID NO: 327929 - DNA, 75 bp, Artificial Sequence
  Synthetic
caatggggattcaactggatcagaaaataatcatcctgtacatgagccattgggggagagaggctgtgaatcact

SEQ ID NO: 327930 - DNA, 75 bp, Artificial Sequence
  Synthetic
catcttggagatgatatggatcctgagcttagggagcttgcccagacccttgtagacatcaaggtcagggaaatc

SEQ ID NO: 327931 - DNA, 75 bp, Artificial Sequence
  Synthetic
ttcatcttggagatgatatggatcctgaactcagggaacttgcccagacccttgtggacatcaaggtcagggaga

SEQ ID NO: 327932 - DNA, 75 bp, Artificial Sequence
  Synthetic
tctaaccaagaaccacttaaactttaaggggcagtaatcaacttatattcagggcattattataaccagggttat

SEQ ID NO: 327933 - DNA, 75 bp, Artificial Sequence
  Synthetic
tctctaaccaagaaccacttaaactttaagtggatattaactcaacttatattcagggcattattgtaaccaggg

SEQ ID NO: 327934 - DNA, 75 bp, Artificial Sequence
  Synthetic
gggcactaatcagggtttattgcactagggtgggttcgagggccaattatattacagggtatataatctatatta

SEQ ID NO: 327935 - DNA, 75 bp, Artificial Sequence
  Synthetic
taatgggcaccaatcagggtttattgcactagggtgggtttaagggccaattatattacagggtatataatctat

SEQ ID NO: 327936 - DNA, 75 bp, Artificial Sequence
  Synthetic
cttagtgttattgtagtattgtattatgtattgttaattatattagtgttaagtctattaaatcttgttaagttt

SEQ ID NO: 327937 - DNA, 75 bp, Artificial Sequence
  Synthetic
gttaattagtgttattgtagtattatgtatgtactcatttattctttatattagtgttaagttgtattaaatcct

SEQ ID NO: 327938 - DNA, 75 bp, Artificial Sequence
  Synthetic
gttaagtttgttaagttttattaagtttcggtaagtctgttaagtatagttattcttggtagtgttaagtcatat

SEQ ID NO: 327939 - DNA, 75 bp, Artificial Sequence
  Synthetic
gttaagttttgttaagtccttagagtcatgttaagtctttagagttttgttaagttttgttaagtacagttaatt

SEQ ID NO: 327940 - DNA, 75 bp, Artificial Sequence
  Synthetic
gtatgggggttgtttagtgttaagtcatatgtatggggttgtttagtgttaagtcattgtttattgtttattatt

SEQ ID NO: 327941 - DNA, 75 bp, Artificial Sequence
  Synthetic
gtatgggttattcatgttaagtctaatatatggggttgtttagtgttaagtcattgtttattagttgtttagtgt

SEQ ID NO: 327942 - DNA, 75 bp, Artificial Sequence
  Synthetic
atttgtctaatgttaagtctatatgatttattaatcaaattaagatttatatacataggtttattttatatacat

SEQ ID NO: 327943 - DNA, 75 bp, Artificial Sequence
  Synthetic
taagtttatatatgatttattaattaaagtaagatttacctatatagatacatttaatacttcattatcatctct

SEQ ID NO: 327944 - DNA, 75 bp, Artificial Sequence
  Synthetic
atacataggtttattttatatacatagatttattttatcgactctcatcattaatcagggtttataaaatctcct

SEQ ID NO: 327945 - DNA, 75 bp, Artificial Sequence
  Synthetic
aaagtaagatttacctatatagatacatttaatacttcattatcatctctgatcagggttttcaaaaatttctca

SEQ ID NO: 327946 - DNA, 75 bp, Artificial Sequence
  Synthetic
caggtctatccctatattggaagattgttctattaaccgttcaaactggaactaacactgtgactctgtaaagtc

SEQ ID NO: 327947 - DNA, 75 bp, Artificial Sequence
  Synthetic
ggtctatccatatattagaggattgttctattaaccattcaaactggaactaacactgtgactctgtaaagtcca

SEQ ID NO: 327948 - DNA, 75 bp, Artificial Sequence
  Synthetic
taacactgtgactctgtaaagtccagattatattcatatctgtatatatggatgtaaatttcgttccgttaatag

SEQ ID NO: 327949 - DNA, 75 bp, Artificial Sequence
  Synthetic
tacatgacactaatgcttgctttgctactaattgatttcttcactacaacaatctacctcattgtccctatcccc

SEQ ID NO: 327950 - DNA, 75 bp, Artificial Sequence
  Synthetic
actaatgcttgctttgctactaattgatttcttcattacaacaatctacctcattgtccctatccccttccctat

SEQ ID NO: 327951 - DNA, 75 bp, Artificial Sequence
  Synthetic
tctttaactcataaagattccgtgttagcccagcagttgctagtagtagactccgcacgaagaagcaaacactga

SEQ ID NO: 327952 - DNA, 75 bp, Artificial Sequence
  Synthetic
cccttccctattacctcaacgaaactacctcattataagtaaattcttgattgcttttcaaggcgtatactacta

SEQ ID NO: 327953 - DNA, 75 bp, Artificial Sequence
  Synthetic
tagtagtagactccgcacgaagaagcaaacactgaataaaggatatacagaatggtagggtgggtttgcatcttc

SEQ ID NO: 327954 - DNA, 75 bp, Artificial Sequence
  Synthetic
ttactactgcaactgctgggctaacacggaatctttatgagttaaagatagaatgtccacatactgtgggtttag

SEQ ID NO: 327955 - DNA, 75 bp, Artificial Sequence
  Synthetic
ctggattgacacggaatctctatgaattaaagatagaatgtccacatactgtgggtctaggtcaaggttatgtga

SEQ ID NO: 327956 - DNA, 75 bp, Artificial Sequence
  Synthetic
gtcagggttatgtgacaggttcagtggaaactacacctattctcttaacgcaggtagctgatcttaagattgaga

SEQ ID NO: 327957 - DNA, 75 bp, Artificial Sequence
  Synthetic
caggttctgtagaaactacacctattctcttaacacaggtagctgacctcaagatcgagagttcttgcaattttg

SEQ ID NO: 327958 - DNA, 75 bp, Artificial Sequence
  Synthetic
caggtagctgatcttaagattgagagttcctgcaattttgatctgcatgtcccggccacgactacccaaaaatac

SEQ ID NO: 327959 - DNA, 75 bp, Artificial Sequence
  Synthetic
tctcttaacacaggtagctgacctcaagatcgagagttcttgcaattttgacttgcatgtcccagccactactac

SEQ ID NO: 327960 - DNA, 75 bp, Artificial Sequence
  Synthetic
aagatcgagagttcttgcaattttgacttgcatgtcccagccactactactcagaaatataatcaagttgattgg

SEQ ID NO: 327961 - DNA, 75 bp, Artificial Sequence
  Synthetic
accaaaaaaagttctactacagaaagcacaaatgcaggtgcaactacatttgaggctaaaacaaaagaggtaaat

SEQ ID NO: 327962 - DNA, 75 bp, Artificial Sequence
  Synthetic
gcacaaatgcaggtgcaactacatttgaggctaaaacaaaagaggtaaatttaaaaggcacatgtaatattcccc

SEQ ID NO: 327963 - DNA, 75 bp, Artificial Sequence
  Synthetic
acaaaagaggtaaatttaaaaggcacatgtaatatccctccaaccacatttgaagctgcatacaaatcaaggaag

SEQ ID NO: 327964 - DNA, 75 bp, Artificial Sequence
  Synthetic
acagtaatttgttatgatttagcctgtaatcagacacactgtcttcctacagtccatttgattgctcctgttcaa

SEQ ID NO: 327965 - DNA, 75 bp, Artificial Sequence
  Synthetic
acatgcatgtctgtgcggagctgtatgataggcttgctgtcaagcagaattcaagtcatatacgaaaagacatac

SEQ ID NO: 327966 - DNA, 75 bp, Artificial Sequence
  Synthetic
tgataggcttgctgtcaagcagaattcaagtcatatacgaaaagacatactgtgttacaggtcaattgatagagg

SEQ ID NO: 327967 - DNA, 75 bp, Artificial Sequence
  Synthetic
tcctgttcaaacatgtatgtctgtacggagctgtatgataggtctgttatctagcaggatccaagtcatctacga

SEQ ID NO: 327968 - DNA, 75 bp, Artificial Sequence
  Synthetic
gaagacatattgtgtcacgggtcagttaatagaagggctatgtttcattccaacacatacaattgcacttacaca

SEQ ID NO: 327969 - DNA, 75 bp, Artificial Sequence
  Synthetic
ggctatgtttcatcccaacacatacaattgcactcacacaacctggtcatacctatgatactatgacactgccag

SEQ ID NO: 327970 - DNA, 75 bp, Artificial Sequence
  Synthetic
caacacatacaattgcacttacacagcctggtcatacctatgatactatgacattgcctgtgacttgttttttag

SEQ ID NO: 327971 - DNA, 75 bp, Artificial Sequence
  Synthetic
taacttgttttttagtggctaaaaagctggggacacagcttaagttggctgttgagttagagaagctgatcactg

SEQ ID NO: 327972 - DNA, 75 bp, Artificial Sequence
  Synthetic
acattgcctgtgacttgttttttagtagccaaaaagttggggacacagcttaagctggctgttgagttagagaaa

SEQ ID NO: 327973 - DNA, 75 bp, Artificial Sequence
  Synthetic
gtgtaagttgcacagaaaacagctttcaaggttactatatctgttttattggaaaacattcagaacccttatttg

SEQ ID NO: 327974 - DNA, 75 bp, Artificial Sequence
  Synthetic
tcgtatggttttaaatccaagaggtgaagatcatgaccctgatcaaaatggacaagggttgatgagaatagctgg

SEQ ID NO: 327975 - DNA, 75 bp, Artificial Sequence
  Synthetic
gaagatcatgaccctgatcaaaatggacaagggttgatgagaatagctggacctgttactgccaaggtaccatcc

SEQ ID NO: 327976 - DNA, 75 bp, Artificial Sequence
  Synthetic
gacaagggttgatgagaatagctggacctgttactgccaaggtaccatccacagaaacaactgaaacaatgcaag

SEQ ID NO: 327977 - DNA, 75 bp, Artificial Sequence
  Synthetic
gctaaggtaccatctacagaaacaactgaaacaatgcaaggaattgcatttgctggagcaccgatgtatagctct

SEQ ID NO: 327978 - DNA, 75 bp, Artificial Sequence
  Synthetic
ttaaatccaagaggtgaagatcatgaccctgatcaaaatggacaaggtttaatgagaatagctgggcctattaca

SEQ ID NO: 327979 - DNA, 75 bp, Artificial Sequence
  Synthetic
gaattgcatttgctggggcaccaatgtatagctcattctcaactcttgtgagaaaagctgatcctgaatatgtct

SEQ ID NO: 327980 - DNA, 75 bp, Artificial Sequence
  Synthetic
ttctcaacccttgtgaggaaggctgatcctgaatatgtcttttccccaggtataattgcagaatcaaatcatagt

SEQ ID NO: 327981 - DNA, 75 bp, Artificial Sequence
  Synthetic
atcctgaatatgtcttttccccaggtataattgcagaatcaaatcatagtgtttgtgataagaagacagtgcccc

SEQ ID NO: 327982 - DNA, 75 bp, Artificial Sequence
  Synthetic
ttacatggacaggatttttggcagtttctggagagatagagaaaataacaggctgtacagtcttctgtacattgg

SEQ ID NO: 327983 - DNA, 75 bp, Artificial Sequence
  Synthetic
acagtgcccctaacatggactgggtttctagcagtttcaggagagatagaaaggataacaggctgtacagttttc

SEQ ID NO: 327984 - DNA, 75 bp, Artificial Sequence
  Synthetic
tgtacattggctggacctggcgccagttgtgaagcatactcagaaacaggaatcttcaacataagctccccaact

SEQ ID NO: 327985 - DNA, 75 bp, Artificial Sequence
  Synthetic
ccggacctggtgcaagttgtgaagcatactcagagacaggaatcttcaatataagctctcctacttgtttggtga

SEQ ID NO: 327986 - DNA, 75 bp, Artificial Sequence
  Synthetic
gttgtgaagcatactcagaaacaggaatcttcaacataagctccccaacttgcttggtaaataaagtccaaaaat

SEQ ID NO: 327987 - DNA, 75 bp, Artificial Sequence
  Synthetic
ataaagttcaaaaatttagaggctcagaacagagaatcaacttcatgtgccaaagagttgatcaagatgttgtag

SEQ ID NO: 327988 - DNA, 75 bp, Artificial Sequence
  Synthetic
ttagaggttcagaacaaagaattaattttatgtgtcaaagggttgatcaagatgttgtggtttactgtaatggac

SEQ ID NO: 327989 - DNA, 75 bp, Artificial Sequence
  Synthetic
tttattgtaatggacaaaaaaaagtcattcttaccaaaactctggttataggccaatgtatttatacattcacta

SEQ ID NO: 327990 - DNA, 75 bp, Artificial Sequence
  Synthetic
agaagaaagtcattctcaccaaaaccctagtaataggtcaatgtatctacacatttactagtctgttttcactga

SEQ ID NO: 327991 - DNA, 75 bp, Artificial Sequence
  Synthetic
ggccaatgtatttatacattcactagtttattctcactaatcccaggagttgcccgttcccttgctgtagagcta

SEQ ID NO: 327992 - DNA, 75 bp, Artificial Sequence
  Synthetic
cctagtaataggtcaatgtatctacacatttactagtctgttttcactgatccctggagttgctcattcccttgc

SEQ ID NO: 327993 - DNA, 75 bp, Artificial Sequence
  Synthetic
tgtgttccaggccttcatggctgggctacaacagcattactgattactttttgctttggctggctccttatacca

SEQ ID NO: 327994 - DNA, 75 bp, Artificial Sequence
  Synthetic
ttattactttctgttttggctggcttctcataccaacagttactttaattatactaaaaatcttaaggctattga

SEQ ID NO: 327995 - DNA, 75 bp, Artificial Sequence
  Synthetic
acagtcaccttaattatattaaagatcctaaggttgcttactttttcatgctcacattattctacagaatcaaaa

SEQ ID NO: 327996 - DNA, 75 bp, Artificial Sequence
  Synthetic
tctcataccaacagttactttaattatactaaaaatcttaaggctattgactttctcgtgctcgcactattctac

SEQ ID NO: 327997 - DNA, 75 bp, Artificial Sequence
  Synthetic
ttcaaagttatcttagaaagggttaaggttgaataccaaaaaacaatgggctctatggtgtgtgatatttgtcat

SEQ ID NO: 327998 - DNA, 75 bp, Artificial Sequence
  Synthetic
ctctatggtgtgtgatatttgtcatcacgaatgtgaaacagcaaaagaacttgaaacacataagaagagttgccc

SEQ ID NO: 327999 - DNA, 75 bp, Artificial Sequence
  Synthetic
agacaatgggctcaatggtgtgtgacatttgtcaccatgaatgtgagacagcaaaagagctcgaaacacataaga

SEQ ID NO: 328000 - DNA, 75 bp, Artificial Sequence
  Synthetic
gcaaaagagctcgaaacacataagaaaagttgtccagaaggtcaatgcccatactgcatgacaataactgagtcc

SEQ ID NO: 328001 - DNA, 75 bp, Artificial Sequence
  Synthetic
agaaggtcaatgcccatattgtatgacaataactgaatccactgagagtgctctccaagcccattttgcaatctg

SEQ ID NO: 328002 - DNA, 75 bp, Artificial Sequence
  Synthetic
atactgcatgacaataactgagtccactgagagtgcgttacaagctcatttttcaatctgtaagctaacgaacag

SEQ ID NO: 328003 - DNA, 75 bp, Artificial Sequence
  Synthetic
actgagagtgcgttacaagctcatttttcaatctgtaagctaacgaacaggttccaggaaatcttaaaaaaatca

SEQ ID NO: 328004 - DNA, 75 bp, Artificial Sequence
  Synthetic
taaattaacaaacaggtttcaggaaaacttgaaaaagtcattaaaacgtccagaagtacggaaaggttgttatag

SEQ ID NO: 328005 - DNA, 75 bp, Artificial Sequence
  Synthetic
ttaaaacgtccagaagtacggaaaggttgttacaggacattaggagtattccgctacaagagcaggtgctatgtt

SEQ ID NO: 328006 - DNA, 75 bp, Artificial Sequence
  Synthetic
gacattaggagtttttagatacaagagtaggtgttatgttggtttggtatggggaatccttttaacaactgaact

SEQ ID NO: 328007 - DNA, 75 bp, Artificial Sequence
  Synthetic
gttgttacaggacattaggagtattccgctacaagagcaggtgctatgttggcttagtatgggggatcctcttga

SEQ ID NO: 328008 - DNA, 75 bp, Artificial Sequence
  Synthetic
cgacagagctgattatatgggctgctagtgcagatacccctctaatggagtctggttggtcagatacagcacatg

SEQ ID NO: 328009 - DNA, 75 bp, Artificial Sequence
  Synthetic
gatcatatgggcagctagtgcagatacccccttaatggagtccggttggtctgacacagcacatggtgtgggcat

SEQ ID NO: 328010 - DNA, 75 bp, Artificial Sequence
  Synthetic
gtgtaggtatagtccctatgaaaacagatttagagcttgactttgccttggcctcatcatcttcttatagttata

SEQ ID NO: 328011 - DNA, 75 bp, Artificial Sequence
  Synthetic
gaagaaagcttgtaaaccctgccaatcaagaggagacactcccttttcatttccagttagataagcaagtagtgc

SEQ ID NO: 328012 - DNA, 75 bp, Artificial Sequence
  Synthetic
tgtaaatcctgctaatcaagaagaaacactcccttttcactttcagttagacaaacaagtagtacatgcagagat

SEQ ID NO: 328013 - DNA, 75 bp, Artificial Sequence
  Synthetic
ttccagttagataagcaagtagtgcatgcagagatacagaacctggggcattggatggatggcacattcaacata

SEQ ID NO: 328014 - DNA, 75 bp, Artificial Sequence
  Synthetic
ccagaacctaggacattggatggatggtacattcaatataaaaactgctttccattgttacggggagtgtaaaaa

SEQ ID NO: 328015 - DNA, 75 bp, Artificial Sequence
  Synthetic
gtatgcctatccctggcaaacagccaagtgcttttttgaaaaagattatcaatatgaaacaagctggggctgtaa

SEQ ID NO: 328016 - DNA, 75 bp, Artificial Sequence
  Synthetic
gcagacagccaagtgtttctttgaaaaggattatcagtatgaaacaagctggggctgtaacccaccagattgccc

SEQ ID NO: 328017 - DNA, 75 bp, Artificial Sequence
  Synthetic
tccaccagattgcccaggagtaggtacaggttgtacagcctgtggggtgtatcttgataagctccgttcagtcgg

SEQ ID NO: 328018 - DNA, 75 bp, Artificial Sequence
  Synthetic
ggggctgtaacccaccagattgcccaggagtagggacaggttgtacagcctgtggggtatacctagacaagctcc

SEQ ID NO: 328019 - DNA, 75 bp, Artificial Sequence
  Synthetic
acaggttgtacagcctgtggggtgtatcttgataagctccgttcagtcgggaaggcatacaagatagtatcactc

SEQ ID NO: 328020 - DNA, 75 bp, Artificial Sequence
  Synthetic
gttcagttgggaaagcctataagattgtatcactcaaatacacgcgaaaggtgtgtattcaattgggaacagaac

SEQ ID NO: 328021 - DNA, 75 bp, Artificial Sequence
  Synthetic
aaatatacacggaaggtgtgtattcaattaggaacagaacaaacttgtaaacatatagatgtaaatgattgccta

SEQ ID NO: 328022 - DNA, 75 bp, Artificial Sequence
  Synthetic
gtcaccccttctgtcaaagtttgtatgattggtactatatcaaagctccagccaggtgataccctgttattctta

SEQ ID NO: 328023 - DNA, 75 bp, Artificial Sequence
  Synthetic
caaagctccagccaggtgacaccttattgtttttgggccctttagagcaaggtgggattatcctgaaacaatggt

SEQ ID NO: 328024 - DNA, 75 bp, Artificial Sequence
  Synthetic
ggccctttagagcagggcgggattattcttaagcagtggtgtacaacatcatgtgtgtttggagaccctggtgat

SEQ ID NO: 328025 - DNA, 75 bp, Artificial Sequence
  Synthetic
attatgtcaacgacaagtgggatgaggtgcccagaacatactggctcttttaggaagatctgtgggtttgccaca

SEQ ID NO: 328026 - DNA, 75 bp, Artificial Sequence
  Synthetic
ccctggtgatatcatgtcaacaacaagtgggatgagatgccctgagcacactgggtcttttagaaaaatctgtgg

SEQ ID NO: 328027 - DNA, 75 bp, Artificial Sequence
  Synthetic
acaccaacttgtgagtatcaaggtaacacagtgtcagggttccagcgcatgatggcaactagagattcttttcaa

SEQ ID NO: 328028 - DNA, 75 bp, Artificial Sequence
  Synthetic
tccaacgcatgatggcaactcgagattcttttcaatcattcaatgtgacagaaccacatattaccagcaatcgac

SEQ ID NO: 328029 - DNA, 75 bp, Artificial Sequence
  Synthetic
tcattcaatgtaacagagccacacatcactagcaaccgacttgagtggattgatccagatagtagcatcaaagat

SEQ ID NO: 328030 - DNA, 75 bp, Artificial Sequence
  Synthetic
tggaatggattgatccagatagtagtattaaagaccatatcaacatggttttgaatagagatgtttccttccaag

SEQ ID NO: 328031 - DNA, 75 bp, Artificial Sequence
  Synthetic
catattaatatggttttaaatcgggatgtttcctttcaagatctaagtgataacccatgtaaggttgacctgcat

SEQ ID NO: 328032 - DNA, 75 bp, Artificial Sequence
  Synthetic
atctaagtgataatccatgtaaggttgatttgcatacgcaatctattgatggggcttggggatcaggagtgggct

SEQ ID NO: 328033 - DNA, 75 bp, Artificial Sequence
  Synthetic
acacaatcaattgatggggcctggggctcaggggtaggttttacattggtatgtactgtggggcttacagaatgt

SEQ ID NO: 328034 - DNA, 75 bp, Artificial Sequence
  Synthetic
ggggcttggggatcaggagtgggcttcacattagtatgtactgtaggtcttacagagtgtgcaaatttcataact

SEQ ID NO: 328035 - DNA, 75 bp, Artificial Sequence
  Synthetic
tacagagtgtgcaaatttcataacttcaattaaggcatgtgattctgctatgtgttatggggccacagttacaaa

SEQ ID NO: 328036 - DNA, 75 bp, Artificial Sequence
  Synthetic
gcaaatttcataacttcaatcaaagcatgtgattctgctatgtgttatggggccacagtgacaaatctgcttaga

SEQ ID NO: 328037 - DNA, 75 bp, Artificial Sequence
  Synthetic
gggtctaatacagttaaagttgttggtaagggtgggcattctggatctttgtttaaatgctgccatgacactgac

SEQ ID NO: 328038 - DNA, 75 bp, Artificial Sequence
  Synthetic
tctactcagagggtctaacacagttaaagttgtcggtaaaggtgggcattctgggtccttgtttaagtgctgcca

SEQ ID NO: 328039 - DNA, 75 bp, Artificial Sequence
  Synthetic
tgtaccgaagaaggcttagcagcatctccaccacatttagatagggttacaggctataatcagatagattctgat

SEQ ID NO: 328040 - DNA, 75 bp, Artificial Sequence
  Synthetic
agattctgataaggtttatgatgacggtgcaccgccctgtacaattaaatgttggttcacaaagtcaggtgagtg

SEQ ID NO: 328041 - DNA, 75 bp, Artificial Sequence
  Synthetic
aaagtttatgatgacggtgcaccgccttgtacaatcaagtgctggtttacaaagtcaggtgaatggctgttagga

SEQ ID NO: 328042 - DNA, 75 bp, Artificial Sequence
  Synthetic
gttgctaggaattcttaatggcaattgggtagtagttgctgttttgattgtaattttgatactatcaatactcct

SEQ ID NO: 328043 - DNA, 75 bp, Artificial Sequence
  Synthetic
atccttaatggcaattgggtggtagttgctgttctgattgtaattttggtattgtcaatacttctttttagcttt

SEQ ID NO: 328044 - DNA, 75 bp, Artificial Sequence
  Synthetic
ttttgtcctgttagaagtagaaaaaataaagctaaaaagaagtattgacaataccaaaattacaatcagaacagc

SEQ ID NO: 328045 - DNA, 75 bp, Artificial Sequence
  Synthetic
gttcagtttcttttgtcctgttagaaatagaaagaataaggccaattagcaaatatatatgtaagtaagggtatg

SEQ ID NO: 328046 - DNA, 75 bp, Artificial Sequence
  Synthetic
tgtcctgttagaagtagaaaaaataaagctaaaaagaagtattgacaataccaaaattacaatcagaacagcaac

SEQ ID NO: 328047 - DNA, 75 bp, Artificial Sequence
  Synthetic
atcatattatatcattatgtgtatactcttatatctatgatatctatgtatccttatattctaactatttatatt

SEQ ID NO: 328048 - DNA, 75 bp, Artificial Sequence
  Synthetic
aaaaacaaacccttaacacctatataatcccatttgcttattacgaggcttttgttcccgcggagtctactacta

SEQ ID NO: 328049 - DNA, 75 bp, Artificial Sequence
  Synthetic
tagtagtagactccgagatagagaaattcaggaaaatggaaaaatatagggagattcatcaaagagtcaaggaga

SEQ ID NO: 328050 - DNA, 75 bp, Artificial Sequence
  Synthetic
ctttatgcagtcagacatgatgtagttgatcagatgatcaagcatgattggtctgacaataaagatatggaaaga

SEQ ID NO: 328051 - DNA, 75 bp, Artificial Sequence
  Synthetic
cctataggtcaagttctgttaatggctggtgtaccaaatgatgtgattcaaggtatggagaagaaagttatacct

SEQ ID NO: 328052 - DNA, 75 bp, Artificial Sequence
  Synthetic
acaagcccttcaggacagattttaaaaagctttttccgcatgacacctgataattataaaatcacaggtgcctta

SEQ ID NO: 328053 - DNA, 75 bp, Artificial Sequence
  Synthetic
gaagataatcatattgtatatgagccactgggggagagaggctgtaaatcacttccatcttggagacgacatgga

SEQ ID NO: 328054 - DNA, 75 bp, Artificial Sequence
  Synthetic
attgagtttatcgaggtaacagtgactgcagatgttgctaaaggtatccgtgaaaagaaattaaagtatgagagt

SEQ ID NO: 328055 - DNA, 75 bp, Artificial Sequence
  Synthetic
acccttgtggacattaaggtcagagagatctcgaaccaggaaccacttaaactgtaagtaggcattaaatcaact

SEQ ID NO: 328056 - DNA, 75 bp, Artificial Sequence
  Synthetic
ggtcttcagtttgtggagtctttattaagtcaagaacacaaaaaaggtaatataaatcaagcttataagatcaca

SEQ ID NO: 328057 - DNA, 75 bp, Artificial Sequence
  Synthetic
tataaatcaagcttataagatcacatttgatgttgtggctgtaaagacggatggttcaaacatatcaactcaatg

SEQ ID NO: 328058 - DNA, 75 bp, Artificial Sequence
  Synthetic
gcctagtcggcgtaatgatggtgttgttcaacatatgaggcttgttcaggctgatattaattatgttagagaaca

SEQ ID NO: 328059 - DNA, 75 bp, Artificial Sequence
  Synthetic
ggtgttaagtatctgttaattgtatttgtgtttatgtagtctttgtattaatgttgcattgtattaattgttaag

SEQ ID NO: 328060 - DNA, 75 bp, Artificial Sequence
  Synthetic
tctcattaagcctgatgaacgtgcatcattagaagccatgtttaatcttaagtttcatgtaggaggccctaaact

SEQ ID NO: 328061 - DNA, 75 bp, Artificial Sequence
  Synthetic
gaggtattttaatataccagattacaagcctcagtcattatgtcaacctgagattacgaatttaattcaatattg

SEQ ID NO: 328062 - DNA, 75 bp, Artificial Sequence
  Synthetic
ttctgttaagtctttaagtttttggtaagtctttaagtttttgataagtctttaagtttttggtaagtctttaag

SEQ ID NO: 328063 - DNA, 75 bp, Artificial Sequence
  Synthetic
caagcactggctcacagaagatcatgattttgtttttaaggaagtcacgggtaataatgttatgaactcatttga

SEQ ID NO: 328064 - DNA, 75 bp, Artificial Sequence
  Synthetic
gaataatgaaagtgtatatatgtctagatacagggagtctcgtaaaccacgtaatttcttattaattcaaggttc

SEQ ID NO: 328065 - DNA, 75 bp, Artificial Sequence
  Synthetic
tattcaaggtccttatttaccatcaactattagctctgaccagtgtgacacaagaattggctgtttggaggtgtt

SEQ ID NO: 328066 - DNA, 75 bp, Artificial Sequence
  Synthetic
aaaagtacatccagagacaccagtacaagcaattgcagtggatatggcatataagtatatggagttaaatagaga

SEQ ID NO: 328067 - DNA, 75 bp, Artificial Sequence
  Synthetic
attcatatttgtatatatggatgtaaatttcgttccgttaatagtacatgacactaatgcttgcttcgctactaa

SEQ ID NO: 328068 - DNA, 75 bp, Artificial Sequence
  Synthetic
tgagatcatcaactactacaatcctagagttcattttcaagcaactcagtcagtgaaggaaccaggtacattcaa

SEQ ID NO: 328069 - DNA, 75 bp, Artificial Sequence
  Synthetic
agagttcattttcaagcaactcagtcagtgaaggaaccaggtacattcaaattaggactttctcaactaaatccg

SEQ ID NO: 328070 - DNA, 75 bp, Artificial Sequence
  Synthetic
atgtctaaatcaatattggaccaggttgggaaacacaagtcagaaaagggcctttttggtgaaccattagagagt

SEQ ID NO: 328071 - DNA, 75 bp, Artificial Sequence
  Synthetic
cctttttggtgaaccattagagagtataaacatatcaagccagattcaacagaatgagtgttcacgtattataga

SEQ ID NO: 328072 - DNA, 75 bp, Artificial Sequence
  Synthetic
atcaatactttcaaatctcgaaataaatgttggtgaggtaacaatgagtctagctaatcctcgtaaaactacagg

SEQ ID NO: 328073 - DNA, 75 bp, Artificial Sequence
  Synthetic
tgtagatgagttgttaggtaagttctatgagaatgaactgtctaagtatttgatcagcatattacgaaaaactgc

SEQ ID NO: 328074 - DNA, 75 bp, Artificial Sequence
  Synthetic
agcctggcatattgggcatttaataagagatataacagaaagtctcattgctcatgcaggtttaaagcggtctaa

SEQ ID NO: 328075 - DNA, 75 bp, Artificial Sequence
  Synthetic
atactggtcaatccatgcttatgatcatggtggggtaatattgttcatccttccttcaaagtctttagaggttgt

SEQ ID NO: 328076 - DNA, 75 bp, Artificial Sequence
  Synthetic
cggatcttatattcggtatttcacagtattcaaagatggtatagggcttatagatgaggaaaatttagactcaaa

SEQ ID NO: 328077 - DNA, 75 bp, Artificial Sequence
  Synthetic
ggtagacatcgacggtgtgcagtggtgtttttcaaaagtaatgagtattgacttaaacaggttgttagctttaaa

SEQ ID NO: 328078 - DNA, 75 bp, Artificial Sequence
  Synthetic
tattgcctttgaaaaggcacttcttgctactgccacttggtttcaatattacacagaagaccaagggcattttcc

SEQ ID NO: 328079 - DNA, 75 bp, Artificial Sequence
  Synthetic
attacaacatgcattaaggtctgtgttctcttttcattttttattatgtgtttctcagaaaatgaagatatgtgc

SEQ ID NO: 328080 - DNA, 75 bp, Artificial Sequence
  Synthetic
aatttttgataatttacgctatttgatcccagctgtcacatcattatattcaggttatgagctcttaatagaaaa

SEQ ID NO: 328081 - DNA, 75 bp, Artificial Sequence
  Synthetic
caggttatgagctcttaatagaaaaattctttgagcggccgtttaagagtgccttagaagtatatttatataata

SEQ ID NO: 328082 - DNA, 75 bp, Artificial Sequence
  Synthetic
taataaaagcattgcttataagcctagcacaaaataataaggtacgattctactctaaagtgcgtcttcttggcc

SEQ ID NO: 328083 - DNA, 75 bp, Artificial Sequence
  Synthetic
tcactgtcgatcactcaactgtaggtgcaagtggagtttatccttcattgatgtctagagttgtttataagcact

SEQ ID NO: 328084 - DNA, 75 bp, Artificial Sequence
  Synthetic
atcgtagtcttatttctgaagcaacaacatgtttctttctttttgaaaagggcctacacggaaatctaaatgagg

SEQ ID NO: 328085 - DNA, 75 bp, Artificial Sequence
  Synthetic
aggctaaaatacatcttgagactgtagagtgggcaagaaagtttgaggcaaaagagagaaaatatggagacatat

SEQ ID NO: 328086 - DNA, 75 bp, Artificial Sequence
  Synthetic
taatgagggaaggttacacgattgatgctatacgtgttggtgatgtgcaggtagaacaacaattattttgtcaag

SEQ ID NO: 328087 - DNA, 75 bp, Artificial Sequence
  Synthetic
aggttgtggagttaagtgcagaagaactcaacaagtatttacaagcaaaaagtcaggtcttatcatccaatatca

SEQ ID NO: 328088 - DNA, 75 bp, Artificial Sequence
  Synthetic
tgaataaacattgggataagccgtattttagtcagacaaggaatataagtttaaagggtatgtctggagcattgc

SEQ ID NO: 328089 - DNA, 75 bp, Artificial Sequence
  Synthetic
aagaagatggacatcttgcagcaagtgttacgttaattgaggcaattagatttttaaatagatcacagactaatc

SEQ ID NO: 328090 - DNA, 75 bp, Artificial Sequence
  Synthetic
caaacgttattgacatgtatgaacagacaaagcagcacaaagctcaagcacgtattgtgaggaaatatcagcgga

SEQ ID NO: 328091 - DNA, 75 bp, Artificial Sequence
  Synthetic
ccgaagctgatagaggttttttcatcactactctcccgacaagagtcaggttagaaattatagaagattattatg

SEQ ID NO: 328092 - DNA, 75 bp, Artificial Sequence
  Synthetic
atgcaatagctagagttgtcccagaggaatatatatcatacggaggagacaagaaaattctaaatatacagactg

SEQ ID NO: 328093 - DNA, 75 bp, Artificial Sequence
  Synthetic
cattagagaaggcattacgatgggcttcaggatcatcagaggtcataacaagcacaggaaatgtaattaaattca

SEQ ID NO: 328094 - DNA, 75 bp, Artificial Sequence
  Synthetic
agaggaggctgatgtatgtgagtgctgatgccacgaaatggtcaccaggagataattcggcaaagtttaagagat

SEQ ID NO: 328095 - DNA, 75 bp, Artificial Sequence
  Synthetic
tcacacaggcattatatgatggcttgtcagatgagaagttaaaatgttgcgttgttgatgcccttagacatgttt

SEQ ID NO: 328096 - DNA, 75 bp, Artificial Sequence
  Synthetic
atgaaacagagttctttatgtccagaaaacttcatcgctatatagattctatggatgagcattctgaggctgtcc

SEQ ID NO: 328097 - DNA, 75 bp, Artificial Sequence
  Synthetic
aagatttcctcgatttttttaagggtggagtgtctgctacagtcaaaggtaattggctccaaggtaacttgaaca

SEQ ID NO: 328098 - DNA, 75 bp, Artificial Sequence
  Synthetic
aatgttcttcattgtttggggctgcagtgtcactgctgtttaggcgtatttgggcagagttatttccagaattag

SEQ ID NO: 328099 - DNA, 75 bp, Artificial Sequence
  Synthetic
agtgtcactgctgtttaggcgtatttgggcagagttatttccagaattagaatgcttttttgagtttgcacatca

SEQ ID NO: 328100 - DNA, 75 bp, Artificial Sequence
  Synthetic
gaactgattggtttttatatgtatctcaacagatacaggctggtaattatcactggcatgctgttaaccaagaga

SEQ ID NO: 328101 - DNA, 75 bp, Artificial Sequence
  Synthetic
tgtggaagagcatgtttaatttgcatgagcatttactgctgatgggctccataaaggtatccccaaaaaagacaa

SEQ ID NO: 328102 - DNA, 75 bp, Artificial Sequence
  Synthetic
cagtttctcctacaaatgcagaatttctttccacattttttgaaggttgtgcggtgtcaatcccttttataaaaa

SEQ ID NO: 328103 - DNA, 75 bp, Artificial Sequence
  Synthetic
tactgcttggatcgttatcagatttaccaggattaggattctttgatgatctggctgctgcacaaagtagatgtg

SEQ ID NO: 328104 - DNA, 75 bp, Artificial Sequence
  Synthetic
tcaaagcaatggacttaggggcatccccacagttggcacaattagctgttgttatttgcactagtaaagttgaga

SEQ ID NO: 328105 - DNA, 75 bp, Artificial Sequence
  Synthetic
gattatacggcactgcagatgggatggttaatagtccagtggcatttttaaaggtaacgaaggcccatgtaccca

SEQ ID NO: 328106 - DNA, 75 bp, Artificial Sequence
  Synthetic
tacctttaggaggtgatggctcaatgtctattatggagcttgccacagcaggtataggtatggctgataaaaata

SEQ ID NO: 328107 - DNA, 75 bp, Artificial Sequence
  Synthetic
ttctcaagcaagcattttattcttacaagcatacaagacgtgatggggataggtatgttttgggtcttttcaagt

SEQ ID NO: 328108 - DNA, 75 bp, Artificial Sequence
  Synthetic
tcttaatgtctcttagtgaagatgtttttcagcatgatagactaggtgagtttagttttgttggtaaagttcagt

SEQ ID NO: 328109 - DNA, 75 bp, Artificial Sequence
  Synthetic
ggaaggtattcacacctaaaaatgagtttgaattctttgatcaattttcacagtcctacttaaagagttggacaa

SEQ ID NO: 328110 - DNA, 75 bp, Artificial Sequence
  Synthetic
atcaacacccagtatatgattatattatacctagaggtagggataatcttttagtctatttagtcagaaaattaa

SEQ ID NO: 328111 - DNA, 75 bp, Artificial Sequence
  Synthetic
atgaccctagtattgtcacagctatgacaatgcaatctccattacaacttagattcaggatgcaggcaaagcagc

SEQ ID NO: 328112 - DNA, 75 bp, Artificial Sequence
  Synthetic
gacaatgcaatctccattacaacttagattcaggatgcaggcaaagcagcacatgaaagtgtgtaagcttgaagg

SEQ ID NO: 328113 - DNA, 75 bp, Artificial Sequence
  Synthetic
ggaatgggtgacattcagagaagttttagctgcagcagacagttttgcaactaagtacaatcccacagaaaagga

SEQ ID NO: 328114 - DNA, 75 bp, Artificial Sequence
  Synthetic
cttagatctgtttaatacattagttagttgtacattttctaaagagtatgcatggaaagatttcttgaacgaagt

SEQ ID NO: 328115 - DNA, 75 bp, Artificial Sequence
  Synthetic
catggaaagatttcttgaacgaagttaggtgtgaagtggtacctacaaaacatgtccatcggtcaaaaatcgcaa

SEQ ID NO: 328116 - DNA, 75 bp, Artificial Sequence
  Synthetic
taggtgtgaagtggtacctacaaaacatgtccatcggtcaaaaatcgcaagaacttttacagtgcgtgagaagga

SEQ ID NO: 328117 - DNA, 75 bp, Artificial Sequence
  Synthetic
tttagatagttccttttttcctgattcattatctgctgaccttcaagtcatgaaggaaggtgtgtatagagagct

SEQ ID NO: 328118 - DNA, 75 bp, Artificial Sequence
  Synthetic
gggtttagatataggtcttcctgaggtgttgaagcgaatagcaccacttttgtacaaagctgggagatctagagt

SEQ ID NO: 328119 - DNA, 75 bp, Artificial Sequence
  Synthetic
tgttatagtggaaggcaacgtagagggcacagcagaatcaatttgtagctattggcttcgtagcatgtcattggt

SEQ ID NO: 328120 - DNA, 75 bp, Artificial Sequence
  Synthetic
caaaacaatcaaagtacgtccaaaaaaagaagtgctcagagcagtttcactatatagcacaaaggaaaatattgg

SEQ ID NO: 328121 - DNA, 75 bp, Artificial Sequence
  Synthetic
gttacaagatgatgttgcagctacacgattgtgtatagaagtctggagatggtgcaaagctaatgatcagaatgt

SEQ ID NO: 328122 - DNA, 75 bp, Artificial Sequence
  Synthetic
aaatgactggttaaatgcactgtactttgaaaagcaaactctcatggattgggtagaaaggttccgtagaaaagg

SEQ ID NO: 328123 - DNA, 75 bp, Artificial Sequence
  Synthetic
agtggttcctattgaccctgaaattcagtgtattgccttactactttatgatgtgttaggttataagagtgtatt

SEQ ID NO: 328124 - DNA, 75 bp, Artificial Sequence
  Synthetic
gcagatgcaggcaaataggcgagcatattcagggaaacagtatgatgcatattgtgttcaaacgtataatgaaga

SEQ ID NO: 328125 - DNA, 75 bp, Artificial Sequence
  Synthetic
aacaagactctatgagggagatttaagggtcacatttaattttggccttgattgtgcaaggttggaaatcttttg

SEQ ID NO: 328126 - DNA, 75 bp, Artificial Sequence
  Synthetic
agggtcacatttaattttggccttgattgtgcaaggttggaaatcttttgggataagaaagaatatattcttgaa

SEQ ID NO: 328127 - DNA, 75 bp, Artificial Sequence
  Synthetic
acatcaattacgcaacgtcatgttttaaagttgatgatggaggaagtcacacaagaattgttaaggtgtgggatg

SEQ ID NO: 328128 - DNA, 75 bp, Artificial Sequence
  Synthetic
agatttaagacagagcaagtaagtcatacgaggagtttggttttattcaaaacggaatcagggtttgagtggggt

SEQ ID NO: 328129 - DNA, 75 bp, Artificial Sequence
  Synthetic
aaaccaaatgtgccgtgtatagtcttcaagcattgtgctttacgtacaggtttaaggactaagcaagctattaat

SEQ ID NO: 328130 - DNA, 75 bp, Artificial Sequence
  Synthetic
aaagagttcatgataaatgtccaagcagatgggtttagagctatagcacagatggatatggaaagtccgagattt

SEQ ID NO: 328131 - DNA, 75 bp, Artificial Sequence
  Synthetic
ctattagcacatgcttatcatacattacgtgatgtgcgttaccaagctgtgcaggctgtaggcaatgtgtggttt

SEQ ID NO: 328132 - DNA, 75 bp, Artificial Sequence
  Synthetic
caaactgctcaacataaattattcataaatccaataatatcatccgggttgttagaaaactttatgaaaggcttg

SEQ ID NO: 328133 - DNA, 75 bp, Artificial Sequence
  Synthetic
ccagcagcaattcctcctgcagcttattctttaattatgaataaggctaagatatctgtagatttatttatgttc

SEQ ID NO: 328134 - DNA, 75 bp, Artificial Sequence
  Synthetic
aatgagttgctggctttagttaacccaagaaatgttctcaatttggacggaatagaagagacttcagaaggatat

SEQ ID NO: 328135 - DNA, 75 bp, Artificial Sequence
  Synthetic
agtacagtaacctctatatctagccgacaatggtctgaagaggtaagtcttatggctgatgatgacattgatgat

SEQ ID NO: 328136 - DNA, 75 bp, Artificial Sequence
  Synthetic
gaagaagaatttacaatagctcttgatgatatagactttgagcagatcaatcttgatgaggacatccaacatttt

SEQ ID NO: 328137 - DNA, 75 bp, Artificial Sequence
  Synthetic
ttgcaagatgaatcagcttatactggtgatttaacaatacaaacagaggaagttgaggtaaaaaggatacggggt

SEQ ID NO: 328138 - DNA, 75 bp, Artificial Sequence
  Synthetic
gtaacgcgcgtgcttgaaccagttaagctaattaagagctgggtttcgaaagggcttgctatcgataaagtgtat

SEQ ID NO: 328139 - DNA, 75 bp, Artificial Sequence
  Synthetic
aaccctatagggatagtgctgatggcaaggtacatgtcaaagaattatgattttagcaaaattcccctagcttta

SEQ ID NO: 328140 - DNA, 75 bp, Artificial Sequence
  Synthetic
ttaaacccatatgatttaactgagtttgaaagtgttgtcaaaggctggggtgaaactgttaatgacagatttcta

SEQ ID NO: 328141 - DNA, 75 bp, Artificial Sequence
  Synthetic
gaggttgacaatgatgcacaacggttggtccgagagaaaaacatattgcccgaagacatattaccagattcatta

SEQ ID NO: 328142 - DNA, 75 bp, Artificial Sequence
  Synthetic
tggtccgagagaaaaacatattgcccgaagacatattaccagattcattattttcttttaggcacgttgatgtgt

SEQ ID NO: 328143 - DNA, 75 bp, Artificial Sequence
  Synthetic
tgttaaagagactattccctcatgaccctgtgtcttcattctattaacaattttctttattccaaaccatgactt

SEQ ID NO: 328144 - DNA, 75 bp, Artificial Sequence
  Synthetic
attctattaacaattttctttattccaaaccatgacttgttctctctactgctctgttctcggagcatactacta

SEQ ID NO: 328145 - DNA, 75 bp, Artificial Sequence
  Synthetic
agagcagacgggcagctgtgtctgcattggagaccaaactcggagaacttaagcgggaactggctgatcttattg

SEQ ID NO: 328146 - DNA, 75 bp, Artificial Sequence
  Synthetic
cagctcagaaattggcttcaaaacctgttgatccaacagggattgaacctgatgaccatctaaaggaaaagtcat

SEQ ID NO: 328147 - DNA, 75 bp, Artificial Sequence
  Synthetic
aatccatcggactctacattctaagtttcgcattaccgattattcttaaagccttgtacatgttatctactaggg

SEQ ID NO: 328148 - DNA, 75 bp, Artificial Sequence
  Synthetic
gccgtcaaacaatcaaagaaaacaagggaacaagaattcgattcaaggatgattcatcttatgaagaagtcaatg

SEQ ID NO: 328149 - DNA, 75 bp, Artificial Sequence
  Synthetic
ggatacgtaagccaagacatctgtatgtttctatgccaactgcccagtctacaatgaaagcagatgagattactc

SEQ ID NO: 328150 - DNA, 75 bp, Artificial Sequence
  Synthetic
ccgggaggttccgtacaattgcttgtggattattcccagcccaagtcaaagcaaggaatattatcagtcctgtca

SEQ ID NO: 328151 - DNA, 75 bp, Artificial Sequence
  Synthetic
tgggtgtgattggctttagtttttttgtgaaagattggatggaaaggattgatgacttcctggctgcacgttgcc

SEQ ID NO: 328152 - DNA, 75 bp, Artificial Sequence
  Synthetic
tgtgaaagattggatggaaaggattgatgacttcctggctgcacgttgcccatttctgcctgagcagaaagaccc

SEQ ID NO: 328153 - DNA, 75 bp, Artificial Sequence
  Synthetic
tagagatgctgcattggcaactaatagagcctattttataacacgtcaattacaggttgatgagtcaaaggttag

SEQ ID NO: 328154 - DNA, 75 bp, Artificial Sequence
  Synthetic
agagcctattttataacacgtcaattacaggttgatgagtcaaaggttagtgatattgaggacctgattgctgat

SEQ ID NO: 328155 - DNA, 75 bp, Artificial Sequence
  Synthetic
tgatattgaggacctgattgctgatgcaagggctgagtctgccactatattcgcagatattgctactcctcattc

SEQ ID NO: 328156 - DNA, 75 bp, Artificial Sequence
  Synthetic
agtttgggtctttgcatgtgctccagatcgttgtccacctacagcattatatgtggccgggatgccggaactggg

SEQ ID NO: 328157 - DNA, 75 bp, Artificial Sequence
  Synthetic
tgcattttttgctattctccaggatatgaggaacaccataatggcatcaaaatctgtggggacatctgaagagaa

SEQ ID NO: 328158 - DNA, 75 bp, Artificial Sequence
  Synthetic
attgaagaagaaatcagcattctaccagtcatacttaagacgtactcagtcaatgggaattcaactggaccagaa

SEQ ID NO: 328159 - DNA, 75 bp, Artificial Sequence
  Synthetic
gataatcatcttatacatgagccattggggaagagaggccgtgaatcacttccatcttggagatgatatggatcc

SEQ ID NO: 328160 - DNA, 75 bp, Artificial Sequence
  Synthetic
tgagcttagggaacttgcccagacccttgtagatatcaaggtcagggaaatctctaaccaagaaccacttaaact

SEQ ID NO: 328161 - DNA, 75 bp, Artificial Sequence
  Synthetic
cttgtagatatcaaggtcagggaaatctctaaccaagaaccacttaaactttaagtggggcagtaatcaacttat

SEQ ID NO: 328162 - DNA, 75 bp, Artificial Sequence
  Synthetic
attcagggcattattataaccagggtaatgggcactaatcagggtttattgcactagggtgggttcaagggccaa

SEQ ID NO: 328163 - DNA, 75 bp, Artificial Sequence
  Synthetic
ctatatcacagggtatataatctatattgtttagtgttattgtagtattgtattatgtattgttagttaagctta

SEQ ID NO: 328164 - DNA, 75 bp, Artificial Sequence
  Synthetic
ttaaatcttgttaagtttgttaagttttgttaagttgtattaagttttgttaagtttcggtaagtctgttaaatg

SEQ ID NO: 328165 - DNA, 75 bp, Artificial Sequence
  Synthetic
tagttaatcttgatagtattaagtcatatgtatggggggtgtttagtgttaagtcattgtttattgtttattgtt

SEQ ID NO: 328166 - DNA, 75 bp, Artificial Sequence
  Synthetic
atctgtttaatgttaagtctatatgatttattaatcaaaataagatttatatacatagatttattttatatacat

SEQ ID NO: 328167 - DNA, 75 bp, Artificial Sequence
  Synthetic
agatttattttatcaactcattatcatctctcatcattaatcagggtttataaaattttctcaggtctatcccta

SEQ ID NO: 328168 - DNA, 75 bp, Artificial Sequence
  Synthetic
cccttccctattacctcaacaaaactacctcattataagtaaattcttgattgcttttcaaggagcatactacta

SEQ ID NO: 328169 - DNA, 75 bp, Artificial Sequence
  Synthetic
gtgggtttaggtcagggttacgtgacaggttcagtggaaattacacctattctcttaacgcaggtagctgatctg

SEQ ID NO: 328170 - DNA, 75 bp, Artificial Sequence
  Synthetic
tctcttaacgcaggtagctgatctgaagattgagagttcttgtaatttcgatctgcatgtcccggctaccactac

SEQ ID NO: 328171 - DNA, 75 bp, Artificial Sequence
  Synthetic
ccaaaaatacaatcaggttgactggaccaaaaaaagttcaactacagaaagcacaaatgcaggtgcaactacatt

SEQ ID NO: 328172 - DNA, 75 bp, Artificial Sequence
  Synthetic
tgaggctaaaacaaaagagataaatttgaaaggcacatgtaatattcctccaactacatttgaagctgcatataa

SEQ ID NO: 328173 - DNA, 75 bp, Artificial Sequence
  Synthetic
atcaaggaagacagtaatttgttatgatttagcctgtaatcaaacacattgtcttcctacggtccatttgattgc

SEQ ID NO: 328174 - DNA, 75 bp, Artificial Sequence
  Synthetic
tcctgttcaaacgtgcatgtctgtgcggagctgtatgataggtttgctgtcaagcaggattcaagtgatatatga

SEQ ID NO: 328175 - DNA, 75 bp, Artificial Sequence
  Synthetic
cggagctgtatgataggtttgctgtcaagcaggattcaagtgatatatgagaagacatactgcgttacaggtcaa

SEQ ID NO: 328176 - DNA, 75 bp, Artificial Sequence
  Synthetic
ttaatagaggggctatgtttcatcccaacacatacaattgcactcacacaacctggtcatacctatgatactatg

SEQ ID NO: 328177 - DNA, 75 bp, Artificial Sequence
  Synthetic
acattgccagtgacttgttttttagtagctaaaaagttgggaacacagcttaagctggctgttgagttagagaaa

SEQ ID NO: 328178 - DNA, 75 bp, Artificial Sequence
  Synthetic
ctgattactggtgtaagttgcacagaaaacagctttcaaggttactacatctgttttatcgggaaacattcagag

SEQ ID NO: 328179 - DNA, 75 bp, Artificial Sequence
  Synthetic
cccttatttgtgccaacaatggaggattataggtcagctgagttatttacccgtatggttttaaatccgagaggt

SEQ ID NO: 328180 - DNA, 75 bp, Artificial Sequence
  Synthetic
ccgtatggttttaaatccgagaggtgaagatcatgaccctgatcaaaatggacaaggtttaatgagaatagctgg

SEQ ID NO: 328181 - DNA, 75 bp, Artificial Sequence
  Synthetic
gcctgttacagctaaggtgccatctacagaaacaactgaaacaatgcaaggaattgcatttgctggagcaccaat

SEQ ID NO: 328182 - DNA, 75 bp, Artificial Sequence
  Synthetic
gtatagctctttctcaaccctcgtaaggaaggctgatcctgagtatgtcttctcaccaggtataattgcagaatc

SEQ ID NO: 328183 - DNA, 75 bp, Artificial Sequence
  Synthetic
tctcaccaggtataattgcagaatcaaatcatagtgtttgtgataaaaaaacagtaccccttacatggacagggt

SEQ ID NO: 328184 - DNA, 75 bp, Artificial Sequence
  Synthetic
ttttggcagtttctggagagatagagaaaataacaggctgtacagtcttctgtacattggctggacctggtgcta

SEQ ID NO: 328185 - DNA, 75 bp, Artificial Sequence
  Synthetic
gttgtgaagcatactcagaaacaggaatctttaatataagttctcctacttgtctagtgaataaagttcaaaaat

SEQ ID NO: 328186 - DNA, 75 bp, Artificial Sequence
  Synthetic
tcagaggctcagaacagaggattaacttcatgtgccaaagagttgatcaagatgtagttgtctattgtaatggac

SEQ ID NO: 328187 - DNA, 75 bp, Artificial Sequence
  Synthetic
aaaagaaagtcattcttaccaaaactctggtcataggccaatgcatttatacattcactagtttattctcactaa

SEQ ID NO: 328188 - DNA, 75 bp, Artificial Sequence
  Synthetic
tctggtcataggccaatgcatttatacattcactagtttattctcactaatcccaggagttgcccattctcttgc

SEQ ID NO: 328189 - DNA, 75 bp, Artificial Sequence
  Synthetic
tgtagagctatgtgttccaggccttcatggctgggctacaacggcattactgattactttttgctttggctggct

SEQ ID NO: 328190 - DNA, 75 bp, Artificial Sequence
  Synthetic
ccttataccggcagtcaccttaattatactgaagatcctgaggttgctcactttctcatgctcacattattccac

SEQ ID NO: 328191 - DNA, 75 bp, Artificial Sequence
  Synthetic
agaatcaaaattcaaagttatcttagaaagggttaaggttgaatatcagaaaacaatgggctctatggtgtgtga

SEQ ID NO: 328192 - DNA, 75 bp, Artificial Sequence
  Synthetic
tatttgccaccacgaatgcgaaacagcaaaagaacttgaaacacataagaaaagctgtccagaaggtcaatgccc

SEQ ID NO: 328193 - DNA, 75 bp, Artificial Sequence
  Synthetic
gtattgtatgacaataactgaatccactgagagtgctctccaagcccattttgcaatctgtaagctaacaaacag

SEQ ID NO: 328194 - DNA, 75 bp, Artificial Sequence
  Synthetic
gtttcaggaaaacttaaaaaagtcattgaaacgcccagaagtacggaaaggttgttacaggacactgggagtttt

SEQ ID NO: 328195 - DNA, 75 bp, Artificial Sequence
  Synthetic
tagatacaagagcagatgttatgttggtttagtatggggaattcttttaacaactgaactgatcatatgggcagc

SEQ ID NO: 328196 - DNA, 75 bp, Artificial Sequence
  Synthetic
caactgaactgatcatatgggcagccagtgcagacacccctttaatggagtctggttggtctgacacagcgcatg

SEQ ID NO: 328197 - DNA, 75 bp, Artificial Sequence
  Synthetic
gtgtgggcataattcctatgaagacagatttggagcttgattttgcattggcctcatcatcttcttacagttata

SEQ ID NO: 328198 - DNA, 75 bp, Artificial Sequence
  Synthetic
agatttggagcttgattttgcattggcctcatcatcttcttacagttataggcgaaagcttgttaatcctgctaa

SEQ ID NO: 328199 - DNA, 75 bp, Artificial Sequence
  Synthetic
ggcgaaagcttgttaatcctgctaatcaagaagaaacactcccttttcatttccagttagataaacaagtagtgc

SEQ ID NO: 328200 - DNA, 75 bp, Artificial Sequence
  Synthetic
atgcagagatccagaacctaggacattggatggatggcacattcaacataaaaactgcttttcactgttatgggg

SEQ ID NO: 328201 - DNA, 75 bp, Artificial Sequence
  Synthetic
agtgtaaaaaatatgcctatccttggcaaacagccaagtgtttttttgaaaaggattatcaatatgaaacaagtt

SEQ ID NO: 328202 - DNA, 75 bp, Artificial Sequence
  Synthetic
ggggctgtaatccaccagactgtccaggggtaggtacaggttgtacagcttgtggggtgtaccttgataagctcc

SEQ ID NO: 328203 - DNA, 75 bp, Artificial Sequence
  Synthetic
aggggtaggtacaggttgtacagcttgtggggtgtaccttgataagctccgttcggttgggaaagcgtacaagat

SEQ ID NO: 328204 - DNA, 75 bp, Artificial Sequence
  Synthetic
agtatcactcaaatatacacggaaggtgtgtattcaattaggaacagaacaaacttgtaaacatatagatgtaaa

SEQ ID NO: 328205 - DNA, 75 bp, Artificial Sequence
  Synthetic
tgattgcctggttaccccttctgtcaaagtttgtatgattggtactatatcaaagctccagccaggtgatacctt

SEQ ID NO: 328206 - DNA, 75 bp, Artificial Sequence
  Synthetic
gttgttcttaggtcctttagagcagggtgggatcattcttaagcaatggtgtacaacatcatgtgtgtttggaga

SEQ ID NO: 328207 - DNA, 75 bp, Artificial Sequence
  Synthetic
tcccggtgatattatgtcaacaacaagtgggatgcggtgcccagaacatactggatcttttagaaagatctgtgg

SEQ ID NO: 328208 - DNA, 75 bp, Artificial Sequence
  Synthetic
gtttgctacaacaccaacatgtgagtatcaaggcaacacagtgtctggattccaacgcatgatggcaactcgaga

SEQ ID NO: 328209 - DNA, 75 bp, Artificial Sequence
  Synthetic
ttctttccagtcattcaatgtgacagaaccacatatcactagcaaccgacttgagtggattgatccagatagcag

SEQ ID NO: 328210 - DNA, 75 bp, Artificial Sequence
  Synthetic
tatcaaagatcacattaatatggttttaaatcgagatgtttcctttcaggatctaagtgataacccatgcaaggt

SEQ ID NO: 328211 - DNA, 75 bp, Artificial Sequence
  Synthetic
tgacctgcatacacaatcaattgacggggcctggggttcaggagtaggttttacgttggtatgtactgtggggct

SEQ ID NO: 328212 - DNA, 75 bp, Artificial Sequence
  Synthetic
tacagagtgtgcaaattttataacttcaattaaagcatgtgattctgccatgtgttatggagccacagtgacaaa

SEQ ID NO: 328213 - DNA, 75 bp, Artificial Sequence
  Synthetic
tctgcttagagggtctaacacagttaaagttgttggtaaaggtgggcattctggatctttgtttaaatgctgcca

SEQ ID NO: 328214 - DNA, 75 bp, Artificial Sequence
  Synthetic
tgatactgactgtaccgaagaagggttagcagcatctccaccacatttagacagggttacaggctataatcaaat

SEQ ID NO: 328215 - DNA, 75 bp, Artificial Sequence
  Synthetic
agattctgataaagtttatgatgacggtgcaccgccctgtacaatcaagtgctggttcacaaagtcaggtgaatg

SEQ ID NO: 328216 - DNA, 75 bp, Artificial Sequence
  Synthetic
gctgttgggaatccttaatggcaattgggtggtagttgctgttctgattgtaattttgatattatcgatactcct

SEQ ID NO: 328217 - DNA, 75 bp, Artificial Sequence
  Synthetic
ttttagctttttttgtcctgtcagaagtagaaagaataaagctaattagtgaatatatatgtgagcaagagtatg

SEQ ID NO: 328218 - DNA, 75 bp, Artificial Sequence
  Synthetic
acaacattatttcattatatgtatgttcttatatcaataacatttgtatattcccataaccgaaatacttatact

SEQ ID NO: 328219 - DNA, 75 bp, Artificial Sequence
  Synthetic
ttcccataaccgaaatacttatactaatttttatttttatacaagtattaactaacccattaacagctaaaaaaa

SEQ ID NO: 328220 - DNA, 75 bp, Artificial Sequence
  Synthetic
aaaaacaaatccttaacacctatataatcccatttgcttattacgaggcttttgttcctgcggagcatactacta

SEQ ID NO: 328221 - DNA, 75 bp, Artificial Sequence
  Synthetic
ggaatgagcaccctcaaagaagtgcaggacaacatcactcttcacgaacaacaactcgtgactgccagacaaaaa

SEQ ID NO: 328222 - DNA, 75 bp, Artificial Sequence
  Synthetic
ctcaaagatgcagaaagagcggtggaactggaccccgatgatgttaacaaaagcacattacagagcagacgggca

SEQ ID NO: 328223 - DNA, 75 bp, Artificial Sequence
  Synthetic
tgatcttattgcagctcagaaactggcttcaaaacctgttgatccaacagggattgaacctgatgaccatttgaa

SEQ ID NO: 328224 - DNA, 75 bp, Artificial Sequence
  Synthetic
ggaaaaatcatcactacggtatggcaatgttcttgatgtgaattctattgacttagaagaaccaagtgggcaaac

SEQ ID NO: 328225 - DNA, 75 bp, Artificial Sequence
  Synthetic
agctgattggaaatcgattggactctacatcttgagttttgcattaccaattatcctcaaggccttatacatgtt

SEQ ID NO: 328226 - DNA, 75 bp, Artificial Sequence
  Synthetic
atctactagaggccgtcaaacaatcaaagagaacaaaggaacaagaattcgattcaaggatgattcatcatatga

SEQ ID NO: 328227 - DNA, 75 bp, Artificial Sequence
  Synthetic
ggaagttaatggaatacgcaagccaagacatttatatgtctctatgcctactgcccaatccacaatgaaagcaga

SEQ ID NO: 328228 - DNA, 75 bp, Artificial Sequence
  Synthetic
tgagattactcccggaaggttccgtactattgcttgtgggctatttccagcccaagtcaaggctagaaacatcat

SEQ ID NO: 328229 - DNA, 75 bp, Artificial Sequence
  Synthetic
tagtcctgttatgggtgtgattgggtttagcttttttgtaaaagattggatggaaaggattgatgacttcctggc

SEQ ID NO: 328230 - DNA, 75 bp, Artificial Sequence
  Synthetic
tgctcgttgcccttttttgcctgagcaaaaagaccccagagatgctgcactggcaaccaatagagcctatttcat

SEQ ID NO: 328231 - DNA, 75 bp, Artificial Sequence
  Synthetic
aacacgccaattgcaggttgatgaatcaaaagtcagcgacatcgaggacttgattgctgatgcaagggctgagtc

SEQ ID NO: 328232 - DNA, 75 bp, Artificial Sequence
  Synthetic
tgccactatatttgcagacattgcaactccccattcagtctgggtctttgcatgtgctccagatcgttgcccgcc

SEQ ID NO: 328233 - DNA, 75 bp, Artificial Sequence
  Synthetic
actccccattcagtctgggtctttgcatgtgctccagatcgttgcccgcctacagcattatatgtggctgggatg

SEQ ID NO: 328234 - DNA, 75 bp, Artificial Sequence
  Synthetic
ccagagttgggtgcattctttgccattctccaggatatgaggaacaccataatggcatcaaaatctgtgggaaca

SEQ ID NO: 328235 - DNA, 75 bp, Artificial Sequence
  Synthetic
tctgaagaaaagctgaagaagaaatcagcattctatcagtcttacttaagacgtactcaatcaatggggattcag

SEQ ID NO: 328236 - DNA, 75 bp, Artificial Sequence
  Synthetic
gacatggatcctgaactcagggaacttgcacaaacccttgtggacattaaggtcagagagatctcaaaccaggaa

SEQ ID NO: 328237 - DNA, 75 bp, Artificial Sequence
  Synthetic
ttgcacaaacccttgtggacattaaggtcagagagatctcaaaccaggaaccacttaaactgtaagtgggcatta

SEQ ID NO: 328238 - DNA, 75 bp, Artificial Sequence
  Synthetic
ggtcagagagatctcaaaccaggaaccacttaaactgtaagtgggcattaaatcagtttatattcagggcattat

SEQ ID NO: 328239 - DNA, 75 bp, Artificial Sequence
  Synthetic
ttaagggccaattatatcacagggtatgtagtctacgttaatcagtattagtgtagtatggtgttaagtatctgt

SEQ ID NO: 328240 - DNA, 75 bp, Artificial Sequence
  Synthetic
caattatatttgtgtttatgtagtctttgtattaatgtcacattgtattaactgttaagtcttgttaggtctttt

SEQ ID NO: 328241 - DNA, 75 bp, Artificial Sequence
  Synthetic
actgttaagtcttgttaggtcttttaagtttaagttctgttaagtctttaagtttttagtaagtctttaagtttt

SEQ ID NO: 328242 - DNA, 75 bp, Artificial Sequence
  Synthetic
taagtttttggtaagtctttaagttttgttaagtctttaaagtttattagtgttaagtcatatatatggaattta

SEQ ID NO: 328243 - DNA, 75 bp, Artificial Sequence
  Synthetic
ttggtgttgagtattgaattcatatatgatttattaattagaataaggttatatacaaatctattttattcatat

SEQ ID NO: 328244 - DNA, 75 bp, Artificial Sequence
  Synthetic
attatcatctcaaattaagtaatcagggtctttttaaatcttctcaggtctatccctatattagaggattgtcct

SEQ ID NO: 328245 - DNA, 75 bp, Artificial Sequence
  Synthetic
gggtctttttaaatcttctcaggtctatccctatattagaggattgtcctattaaccattcaaactggaactaac

SEQ ID NO: 328246 - DNA, 75 bp, Artificial Sequence
  Synthetic
tgacactaatgcttgcttcgctactaattgattttcccattacaacaagctacctcattgtccctatccccttcc

SEQ ID NO: 328247 - DNA, 75 bp, Artificial Sequence
  Synthetic
tcgctactaattgattttcccattacaacaagctacctcattgtccctatccccttccctattacctcaacaaaa

SEQ ID NO: 328248 - DNA, 75 bp, Artificial Sequence
  Synthetic
ctactacgactaaagctggaatgagcaccctcaaagaagtgcaagacaacatcacacttcacgaacaacaactcg

SEQ ID NO: 328249 - DNA, 75 bp, Artificial Sequence
  Synthetic
caccctcaaagaagtgcaagacaacatcacacttcacgaacaacaactcgtgactgccagacaaaagctcaaaga

SEQ ID NO: 328250 - DNA, 75 bp, Artificial Sequence
  Synthetic
ctcaaacgggagctggctgatcttattgcagctcagaaattggcttcaaaacctgttgatccaacagggattgaa

SEQ ID NO: 328251 - DNA, 75 bp, Artificial Sequence
  Synthetic
ttgcagctcagaaattggcttcaaaacctgttgatccaacagggattgaacctgatgaccatctaaaggaaaaat

SEQ ID NO: 328252 - DNA, 75 bp, Artificial Sequence
  Synthetic
acctgttgatccaacagggattgaacctgatgaccatctaaaggaaaaatcatcattaagatatggcaatgtcct

SEQ ID NO: 328253 - DNA, 75 bp, Artificial Sequence
  Synthetic
tgatgtaaactctattgacttagaagaaccgagtggccagacagctgattggaagtctattggactctatatttt

SEQ ID NO: 328254 - DNA, 75 bp, Artificial Sequence
  Synthetic
gagctttgcattaccaattatccttaaggccctgtacatgttatctactaggggccgtcagacaatcaaagagaa

SEQ ID NO: 328255 - DNA, 75 bp, Artificial Sequence
  Synthetic
caaagggacaagaattcgattcaaggatgattcatcttatgaggaagtgaatggaatacgtaagccaagacatct

SEQ ID NO: 328256 - DNA, 75 bp, Artificial Sequence
  Synthetic
gtatgtttctatgcctactgctcaatccacaatgaaggcagatgaaatcacccctggtaggttccgtacaattgc

SEQ ID NO: 328257 - DNA, 75 bp, Artificial Sequence
  Synthetic
ctgtggactgtttccggctcaagtcaaggctagaaacatcatcagtcctgtcatgggtgtgatcggttttagttt

SEQ ID NO: 328258 - DNA, 75 bp, Artificial Sequence
  Synthetic
ttttgtgaaagattggatggagaggattgatgattttttggctgctcgctgtccatttttacctgagcagaaaga

SEQ ID NO: 328259 - DNA, 75 bp, Artificial Sequence
  Synthetic
ccctagagatgctgcactggcaactaatcgagcttatttcataacacgtcaattacaggttgatgagtcaaaggt

SEQ ID NO: 328260 - DNA, 75 bp, Artificial Sequence
  Synthetic
aagtgatattgaggacttgattgctgacgcaagagctgagtctgccactatattcgcagatattgctactcctca

SEQ ID NO: 328261 - DNA, 75 bp, Artificial Sequence
  Synthetic
ctcagtttgggtctttgcatgtgccccagatcgttgtccacccacagcattgtatgtggcagggatgccggagct

SEQ ID NO: 328262 - DNA, 75 bp, Artificial Sequence
  Synthetic
tggtgcattttttgcaatccttcaggatatgagaaacaccataatggcatcaaaatctgtgggaacatctgaaga

SEQ ID NO: 328263 - DNA, 75 bp, Artificial Sequence
  Synthetic
aaagttgaagaaaaagtcggcattctaccagtcatacctaaggcgtactcagtcaatggggattcaactggatca

SEQ ID NO: 328264 - DNA, 75 bp, Artificial Sequence
  Synthetic
gaagataatcatcttatatatgagccattggggaagagaggctgtgaatcattttcatcttggagatgatatgga

SEQ ID NO: 328265 - DNA, 75 bp, Artificial Sequence
  Synthetic
tcccgaactcagggagcttgcccagaccctcgtggacatcaaggtcagggagatttccaaccaagaaccacttaa

SEQ ID NO: 328266 - DNA, 75 bp, Artificial Sequence
  Synthetic
actttaagtgggcattaactcacttatattcagggcattattataaccagggtgttgggcaccaatcagggttta

SEQ ID NO: 328267 - DNA, 75 bp, Artificial Sequence
  Synthetic
ttgcactagggtgggttcaagggccaattatactacagggtatataatctatgttaatcagtattatgataatat

SEQ ID NO: 328268 - DNA, 75 bp, Artificial Sequence
  Synthetic
tatgtatgtactcatttattctttatattagtgttaagttgtattatcctgttaagtctgttaagtccatagagt

SEQ ID NO: 328269 - DNA, 75 bp, Artificial Sequence
  Synthetic
aatgttaagtcttagagttttgttaagttttattaagttctgttaagtatagttaactgtatgggttgtaatgtt

SEQ ID NO: 328270 - DNA, 75 bp, Artificial Sequence
  Synthetic
aagtctagtgtatagggttgtctagtgttaagtcattgtttattggttgtttagtgttaaatttatatatgattt

SEQ ID NO: 328271 - DNA, 75 bp, Artificial Sequence
  Synthetic
attaattaaagtaagatttatatatagatatgtttaatacttcattatcatctctaatcagttaatcagggtttt

SEQ ID NO: 328272 - DNA, 75 bp, Artificial Sequence
  Synthetic
agatatgtttaatacttcattatcatctctaatcagttaatcagggttttcaaaaagattctcaggtctatccat

SEQ ID NO: 328273 - DNA, 75 bp, Artificial Sequence
  Synthetic
atccaaactggaactaacactgtgactctgtaaagtccagattatattcatatctgtatatatggatgtaaattt

SEQ ID NO: 328274 - DNA, 75 bp, Artificial Sequence
  Synthetic
cgttccgttaatagcacatgacactaatgcttgctttgctactaattgatttctttactacaacaatctacctca

SEQ ID NO: 328275 - DNA, 75 bp, Artificial Sequence
  Synthetic
caatctacctcattgtccctatccccttccctattacctcaacaaaactacctcattataagtaaattcttgatt

SEQ ID NO: 328276 - DNA, 75 bp, Artificial Sequence
  Synthetic
tagtagtagacttcgtaaaaagctactacgactaaagctggaatgagcaccctcaaagaagtgcaagacaacatt

SEQ ID NO: 328277 - DNA, 75 bp, Artificial Sequence
  Synthetic
acattacacgaacaacagctcgtaactgccaggcagaagcttaaagatgcagaaaaggcagtggaagtggaccca

SEQ ID NO: 328278 - DNA, 75 bp, Artificial Sequence
  Synthetic
gatgacgttaacaaaagcacattacagggtagacgggcggctgtgtctgcattggaaaccaaactcggggagctc

SEQ ID NO: 328279 - DNA, 75 bp, Artificial Sequence
  Synthetic
aaacgacagctggcagaccttattgcagctcagaaattggcttcaaaacctattgatccaacagggattgaacct

SEQ ID NO: 328280 - DNA, 75 bp, Artificial Sequence
  Synthetic
gatgaccatttaaaggaaaaatcatcattgagatatgggaatgttcttgatgtgaattcaattgatttggaagaa

SEQ ID NO: 328281 - DNA, 75 bp, Artificial Sequence
  Synthetic
ccaagtggccaaacagcagattggaaagctattggaatgtatatcctgagctttgcaataccaatcatcttaaag

SEQ ID NO: 328282 - DNA, 75 bp, Artificial Sequence
  Synthetic
gccctttatatgctatcaaccaggggtcgtcaaacagttaaggaaaataaagggacaagaatcaggttcaaggac

SEQ ID NO: 328283 - DNA, 75 bp, Artificial Sequence
  Synthetic
gactcatcctatgaagaagtcaatgggatccgaaagccaagacatctgtacgtgtcaatgcctacagcccagtcc

SEQ ID NO: 328284 - DNA, 75 bp, Artificial Sequence
  Synthetic
acgatgaaggcagatgagatcactccagggcgtttccgcacgattgcatgtggattgttccctgcacaagtgaaa

SEQ ID NO: 328285 - DNA, 75 bp, Artificial Sequence
  Synthetic
gctaggaatattatcagtccagtcatgggtgtaataggatttaatttttttgttaaggattggatggacaggatt

SEQ ID NO: 328286 - DNA, 75 bp, Artificial Sequence
  Synthetic
gatgattttctagctgagcggtgcccattcctacctgagccaagagaccctaaggatgctgcattaggaacaaat

SEQ ID NO: 328287 - DNA, 75 bp, Artificial Sequence
  Synthetic
agagcctattttataacacgtcaggcacaagtagatgaatcgaaggttgttgacattgaggaactgattgttgat

SEQ ID NO: 328288 - DNA, 75 bp, Artificial Sequence
  Synthetic
gcaagagctgagtctgcaactcttttcacagacattgcaacgccccattcggtctgggtcttcgcatgtgcacct

SEQ ID NO: 328289 - DNA, 75 bp, Artificial Sequence
  Synthetic
gacaggtgtccccctacagcattatatgttgctggaatgcctgaacttggcgcattttttgccatacttcaggat

SEQ ID NO: 328290 - DNA, 75 bp, Artificial Sequence
  Synthetic
atgagaaacacaataatggcatcaaaatctgtagggacagctgaggagaaattaaagaaaaaatcggcattctac

SEQ ID NO: 328291 - DNA, 75 bp, Artificial Sequence
  Synthetic
caatcctaccttagacgaactcagtcaatgggaattcaactggatcaaaagataatcatcctttacatgattcat

SEQ ID NO: 328292 - DNA, 75 bp, Artificial Sequence
  Synthetic
tggggaaaggaagctgttaaccatttccaccttggtgatgatatggacccagagttgagggagttggcacaggcc

SEQ ID NO: 328293 - DNA, 75 bp, Artificial Sequence
  Synthetic
ctcgttgatgctaaagttaaagagatttccaatcaggagccacttaaactgtaagtggctgagccattcatttac

SEQ ID NO: 328294 - DNA, 75 bp, Artificial Sequence
  Synthetic
tcagggcattatattatcagggtcatgggcactaatcagggattattgcactagggtgggtttgagggccaatta

SEQ ID NO: 328295 - DNA, 75 bp, Artificial Sequence
  Synthetic
ctctctaactttatgtaattgtagttaagtgtattaattgttttatgttaacatgttaagtttgagtttaatgtc

SEQ ID NO: 328296 - DNA, 75 bp, Artificial Sequence
  Synthetic
aatatctgttaagtttaagttcaggtttaagtttaagttcactgttagtcttgttaagtttgacctatgtgtaag

SEQ ID NO: 328297 - DNA, 75 bp, Artificial Sequence
  Synthetic
attgtagtaatacttgtccggttaatcatctctataggtaatgtcattatgtaatcaaatcttaggtgttaagtt

SEQ ID NO: 328298 - DNA, 75 bp, Artificial Sequence
  Synthetic
gaaattatatatgttaagttgattggtatattaagtcttaattatatgcatcaatataagtcaggtaatcattat

SEQ ID NO: 328299 - DNA, 75 bp, Artificial Sequence
  Synthetic
aagtcaatatatgttatgattatatgttattattatatgttatcaatttaactatctttcattctgtcttttcat

SEQ ID NO: 328300 - DNA, 75 bp, Artificial Sequence
  Synthetic
ttaataaatcaggatattatctcaggtctatccctatattggaagtttgttaaactactatgttgactggaacta

SEQ ID NO: 328301 - DNA, 75 bp, Artificial Sequence
  Synthetic
acactatgatctcattgaattaattgtatatttgggtgtaaatttcattttatcaacaatatacataacactaat

SEQ ID NO: 328302 - DNA, 75 bp, Artificial Sequence
  Synthetic
gcctgctttgctactaactgattattcctgttacaacaacctacctcattatccaactcccctttcctatcacct

SEQ ID NO: 328303 - DNA, 75 bp, Artificial Sequence
  Synthetic
ccctttcctatcacctcaacaaaactacctcattataagtaaattcttgattgcttttcaaggagtatactacta

SEQ ID NO: 328304 - DNA, 75 bp, Artificial Sequence
  Synthetic
cttgtggttcttactactgccacggctgggttaacacggaatctttatgagttaaagatagaatgcccacatact

SEQ ID NO: 328305 - DNA, 75 bp, Artificial Sequence
  Synthetic
gtgggtttaggccaaggttatgttacaggatcagttgaaacaacaccagttcctttagggcaggtgactgattta

SEQ ID NO: 328306 - DNA, 75 bp, Artificial Sequence
  Synthetic
aagattgagagctcttgtaactttgatttgcatgtaccgtcaacaacaattcagaagtacaatcaagtggaatgg

SEQ ID NO: 328307 - DNA, 75 bp, Artificial Sequence
  Synthetic
gcaaagaaaacatctacaacagaaagtactaatgcaggtgcatctacatttgaagcaaagacaaaggaagtaaat

SEQ ID NO: 328308 - DNA, 75 bp, Artificial Sequence
  Synthetic
ctgaagggcacatgcaacattccagtaactacgtttgaggctgcttataagtcaagaaagacagtcatttgctat

SEQ ID NO: 328309 - DNA, 75 bp, Artificial Sequence
  Synthetic
gacctagcatgtaatcagacccattgccttcccacagtccatttaattgcccctgtccagacatgcatgtctgtt

SEQ ID NO: 328310 - DNA, 75 bp, Artificial Sequence
  Synthetic
cgaagttgtatgatagggcttttatctagtagaattcatgtgatatatgaaaaaacatattgtgtcaccggacaa

SEQ ID NO: 328311 - DNA, 75 bp, Artificial Sequence
  Synthetic
gtagtggaagggttatgtttcattcccacacacacaattgcattgacacaaccaggacatacatacgatacaatg

SEQ ID NO: 328312 - DNA, 75 bp, Artificial Sequence
  Synthetic
accttgccaataacttgttttttagtggcaaagaaattagggacacaattaaagattgctgtagagcttgagaag

SEQ ID NO: 328313 - DNA, 75 bp, Artificial Sequence
  Synthetic
ttgatcactgcaagtggctgtactgaaaatagttttcaaggttattatatttgcttcttggggaaacactctgag

SEQ ID NO: 328314 - DNA, 75 bp, Artificial Sequence
  Synthetic
cctttgtatgtaccgactatggatgattacagatcagctgaactatttacaaggatggttctaaaccccaaaggt

SEQ ID NO: 328315 - DNA, 75 bp, Artificial Sequence
  Synthetic
gaggatcatgatcctgatcaggatgggcagggactgatgaggattaccggacctattactgctaaggtgccttca

SEQ ID NO: 328316 - DNA, 75 bp, Artificial Sequence
  Synthetic
acagagacaactgaaacaatgcaaggggtagcatttgctggaacaccaatgtatagttctttctcaacactacta

SEQ ID NO: 328317 - DNA, 75 bp, Artificial Sequence
  Synthetic
agaaaggctgaccctgagtatgtgttttctccagggataattcctgagtcaaatcacagtgtttgtgataagaag

SEQ ID NO: 328318 - DNA, 75 bp, Artificial Sequence
  Synthetic
acaatgcctatcacctggacgggatttcttgcagtatctggagaaattgagaagataacaggttgtacagtcttt

SEQ ID NO: 328319 - DNA, 75 bp, Artificial Sequence
  Synthetic
tgcacacttgctggaccaggtgcaagttgtgaagcctactcagaaactggcatatttaatattagctcacctaca

SEQ ID NO: 328320 - DNA, 75 bp, Artificial Sequence
  Synthetic
tgtctggtcaacaaagtgcaaaaatttaggggatcagaacaacgagtaaattttatgtgtcagagagttgaccaa

SEQ ID NO: 328321 - DNA, 75 bp, Artificial Sequence
  Synthetic
gatgtagtagtatactgcaatgggcaaaagaaagtgatcctcacaaaaacattggtcataggacaatgtatttat

SEQ ID NO: 328322 - DNA, 75 bp, Artificial Sequence
  Synthetic
acattcaccagtctcttctccttgcttccaggtgtggcccattcacttgccgttgaattatgtgtaccagggctt

SEQ ID NO: 328323 - DNA, 75 bp, Artificial Sequence
  Synthetic
catggctgggcaacgactgctttactcatcacattctgttttggatggctgcttataccctcggtaacattaata

SEQ ID NO: 328324 - DNA, 75 bp, Artificial Sequence
  Synthetic
atattaagaatcttacggctcctcacattttcttgctcacactactcaacagagtcaaaatttaagatactcttg

SEQ ID NO: 328325 - DNA, 75 bp, Artificial Sequence
  Synthetic
gagaaggtaaaagtggagtatcaaaaaacaatgggttcaatggtctgtgatatttgccatcatgagtgtgaaacc

SEQ ID NO: 328326 - DNA, 75 bp, Artificial Sequence
  Synthetic
gccaaagaactcgatacacacagaaaaagctgtcctgaaggtcaatgtccttactgcatgacaatgactgagtca

SEQ ID NO: 328327 - DNA, 75 bp, Artificial Sequence
  Synthetic
acagagagtgcacttcaggcccacttttcagtctgcaagctcacaaataggttccaggaaaatttaaaaaagtct

SEQ ID NO: 328328 - DNA, 75 bp, Artificial Sequence
  Synthetic
ttaaagcatccagaagtgaaacaaggctgttataggacattaggggttttcagatataaaagcaggtgttacgta

SEQ ID NO: 328329 - DNA, 75 bp, Artificial Sequence
  Synthetic
ggattagtttggggtatactcttaacagctgaattgataatctgggcagcaagtgcagaaactccattgatggaa

SEQ ID NO: 328330 - DNA, 75 bp, Artificial Sequence
  Synthetic
tcaggttggtcagatacagcacatggagttggtatagttcctatgaaaactgatttggagctagattttgcattg

SEQ ID NO: 328331 - DNA, 75 bp, Artificial Sequence
  Synthetic
gcatcatcctcctcatacagctatagaaggaagcttgtgaatcctgcaaattcagaagagacactgccattccac

SEQ ID NO: 328332 - DNA, 75 bp, Artificial Sequence
  Synthetic
cttcaattggagaaacaagttgttcatgctgaaatccacaatttggggcattggatggatggtacatttaacatc

SEQ ID NO: 328333 - DNA, 75 bp, Artificial Sequence
  Synthetic
aagactgcatttcattgttatggggaatgtaagaaatatgcttacccttggcagacagcaaaatgtttctttgaa

SEQ ID NO: 328334 - DNA, 75 bp, Artificial Sequence
  Synthetic
aaagattatcagtatgaaacaagttggggctgtaatccacctgactgcccaggggtagggacaggatggacagct

SEQ ID NO: 328335 - DNA, 75 bp, Artificial Sequence
  Synthetic
tgtggagtttaccttgataagctaagatcagttgggaaggcatataaaattgtctccttaaaatataccaggaaa

SEQ ID NO: 328336 - DNA, 75 bp, Artificial Sequence
  Synthetic
gtctgcatccaactaggcacagaacagacatgcaagcatattgatgtgaatgattgtcttgttactccatcagtg

SEQ ID NO: 328337 - DNA, 75 bp, Artificial Sequence
  Synthetic
aaggtatgtatgattggtactgtatcaaagttacagcctggtgatacattgttgttcctgggtccattggagcaa

SEQ ID NO: 328338 - DNA, 75 bp, Artificial Sequence
  Synthetic
ggaggtatcattctaaaacagtggtgcacaacatcatgtgtttttggggacccaggggacataatgtccacaacc

SEQ ID NO: 328339 - DNA, 75 bp, Artificial Sequence
  Synthetic
agtggaatgaaatgtcctgaacatacagggtcatttagaaaaatctgtggatttgcaacaacaccaacttgtgag

SEQ ID NO: 328340 - DNA, 75 bp, Artificial Sequence
  Synthetic
tatcaagggaacacagtttcagggtttaagaggatgatggccacgagggattcttttcaatcatttaatgtgaca

SEQ ID NO: 328341 - DNA, 75 bp, Artificial Sequence
  Synthetic
gaaccgcatatcaccagtaaccgattagaatggattgaccctgacagtagtatcaaagatcatataaatgtagtg

SEQ ID NO: 328342 - DNA, 75 bp, Artificial Sequence
  Synthetic
ttaaatcgtgatgtgtcctttcaagatttgagtgataacccttgtaaagtagacttacacacacagtctatagat

SEQ ID NO: 328343 - DNA, 75 bp, Artificial Sequence
  Synthetic
ggtgcatggggttctggagtgggcttcactttagtgtgtacagtaggcttgacagaatgcgcaaactttatcaca

SEQ ID NO: 328344 - DNA, 75 bp, Artificial Sequence
  Synthetic
tcaatcaaggcctgtgacttagcaatgtgttatggagcaacagtgacaaacttactgaggggttcaaatacagtt

SEQ ID NO: 328345 - DNA, 75 bp, Artificial Sequence
  Synthetic
aaggttgttgggaagggtgggcattcaggttcactattcaaatgttgtcatgatactgactgtactgatgaaggg

SEQ ID NO: 328346 - DNA, 75 bp, Artificial Sequence
  Synthetic
cttgctgcctctccaccacatcttgaccgagtcactggattcaatcaaatagattctgacaaagtttatgatgat

SEQ ID NO: 328347 - DNA, 75 bp, Artificial Sequence
  Synthetic
ggtgctccaccatgttccgtcaaatgttggtttacgaaatctggagagtggctgcttagaatactgaatggcaat

SEQ ID NO: 328348 - DNA, 75 bp, Artificial Sequence
  Synthetic
tggatggtggtggctgtgctgattgttatcctaatactgtctattctactattcagctttttttgccccattcga

SEQ ID NO: 328349 - DNA, 75 bp, Artificial Sequence
  Synthetic
agtagaaagagcaaacccaattagttggatatacctgtaacaccataatgccgtatataattttatatattctta

SEQ ID NO: 328350 - DNA, 75 bp, Artificial Sequence
  Synthetic
ttatttaatatttatactaacttttatttttatatacatattaacagactaattattagctaaaaaaaacaaatc

SEQ ID NO: 328351 - DNA, 75 bp, Artificial Sequence
  Synthetic
aaaaacaaatccttaacacccatataatctcatttgcttatcacgaggcttttgttcctgcggagcatactacta

SEQ ID NO: 328352 - DNA, 75 bp, Artificial Sequence
  Synthetic
accgtctttatgcagtcagacatgatgtagttgatcagatgattaagcatgattggtctgacaataaagatatgg

SEQ ID NO: 328353 - DNA, 75 bp, Artificial Sequence
  Synthetic
gaccctgtatcttcattttattaacaattttctttattccaaaccatgacttgttctctctactgctctgttatc

SEQ ID NO: 328354 - DNA, 75 bp, Artificial Sequence
  Synthetic
ctcgtggtccttactacttccacggctggattaacacggaatctttatgagttgaagatagaatgcccgcataca

SEQ ID NO: 328355 - DNA, 75 bp, Artificial Sequence
  Synthetic
gtagggttaggtcaaggttatgtgacagggtcggttgagataacacctgttcctttagggcaggtgactgattta

SEQ ID NO: 328356 - DNA, 75 bp, Artificial Sequence
  Synthetic
aagattgaaagttcctgtaattttgatttacatgtgccgtcaacaacaatccaaaagtatactcaagttgagtgg

SEQ ID NO: 328357 - DNA, 75 bp, Artificial Sequence
  Synthetic
gcaaaaaaaagttcaactacagaaagcaccaatgcagctgctactacattcgaggccaagacaaaggaggtgagt

SEQ ID NO: 328358 - DNA, 75 bp, Artificial Sequence
  Synthetic
ttaaagggcacatgcaatattccagtgacaacatttgaagctgcttataagtcaaggaagacagtcatatgttat

SEQ ID NO: 328359 - DNA, 75 bp, Artificial Sequence
  Synthetic
gatttagcatgtaatcaaactcactgtctacctacagttcatctcattgctcctgtacaaacatgtatgtctgtt

SEQ ID NO: 328360 - DNA, 75 bp, Artificial Sequence
  Synthetic
cgaagttgtatggtaggattgctgtctagtaggatacaagtaatttatgaaaaaacatactgtgttaccggtcaa

SEQ ID NO: 328361 - DNA, 75 bp, Artificial Sequence
  Synthetic
ttggtagagggattgtgttttatacctactcatacaatagcactgacacaaccagggcatacatatgacacaatg

SEQ ID NO: 328362 - DNA, 75 bp, Artificial Sequence
  Synthetic
accttacctattacctgctttcttgtagcaaagaaattaggaacacagttaaaaatagctgtagagcttgaaaag

SEQ ID NO: 328363 - DNA, 75 bp, Artificial Sequence
  Synthetic
ttaatcactgccagcgggtgtactgaaaatagctttcaaggttactatatctgttttttaggaaagcattctgaa

SEQ ID NO: 328364 - DNA, 75 bp, Artificial Sequence
  Synthetic
cctatgtatgtaccaacaatggatgattatagatcagctgagctattcacaaggatggttttaaaccctaaaggt

SEQ ID NO: 328365 - DNA, 75 bp, Artificial Sequence
  Synthetic
gaagatcatgaccctgatcaaaatgggcagggattaatgagaattgctggacccattacagccaaagttccgtca

SEQ ID NO: 328366 - DNA, 75 bp, Artificial Sequence
  Synthetic
acagagacaacagagactatgcaaggaatagcatttgctggagcaccaatgtatagcacttttgcaaccttagta

SEQ ID NO: 328367 - DNA, 75 bp, Artificial Sequence
  Synthetic
aggaaagcagatcctgagtatgtgttttcaccaggcataatccctgaatcaaatcatagtgtctgtgacaaaaag

SEQ ID NO: 328368 - DNA, 75 bp, Artificial Sequence
  Synthetic
acaatgcctatcacatggactggctttcttgcactttctggagaaatagaaaggataacaggatgtacagttttt

SEQ ID NO: 328369 - DNA, 75 bp, Artificial Sequence
  Synthetic
tgtacacttgcaggacctggtgcaagttgtgaagcatattcagaaactggcatatttaatattagctcaccaact

SEQ ID NO: 328370 - DNA, 75 bp, Artificial Sequence
  Synthetic
tgcctagtcaataaagtacaaaagtttaggggttcagagcaaagaattaattttatgtgccaaagagttgatcaa

SEQ ID NO: 328371 - DNA, 75 bp, Artificial Sequence
  Synthetic
gatgtggttgtatattgcaatggacagaagaaggtaattctcactaaaaccctagtcataggacagtgtatttat

SEQ ID NO: 328372 - DNA, 75 bp, Artificial Sequence
  Synthetic
acattcactagtcttttctccctgcttcctggtgtggcccattcccttgctgttgaactatgtgtgcctggcctc

SEQ ID NO: 328373 - DNA, 75 bp, Artificial Sequence
  Synthetic
catggttgggctacaacagctttactcatcacattttgctttggctggttgctcatacctgcaatcacattgatt

SEQ ID NO: 328374 - DNA, 75 bp, Artificial Sequence
  Synthetic
gtgctgaaaattttaagactgctcacattttcatgttcacattactcaaaagagtctagatttaaaatactctta

SEQ ID NO: 328375 - DNA, 75 bp, Artificial Sequence
  Synthetic
gaaaaggtgaaggttgaataccaaaagacaatgggttcaatggtttgtgacatttgtcatcatgattgtgagaca

SEQ ID NO: 328376 - DNA, 75 bp, Artificial Sequence
  Synthetic
gctaaagagcttgatacacacaaaaagagttgtccagagggtcaatgcccttactgtatgaccatgactgaatca

SEQ ID NO: 328377 - DNA, 75 bp, Artificial Sequence
  Synthetic
acagaaagtgctctccaggcccatttttcagtctgcaaacttacaaatagatttcaagaaaatttaaaaaaatcc

SEQ ID NO: 328378 - DNA, 75 bp, Artificial Sequence
  Synthetic
ttaaagcacccagaagtaaaacagggctgttataggacattaggagtatttaggtataaaagtagatgttatgta

SEQ ID NO: 328379 - DNA, 75 bp, Artificial Sequence
  Synthetic
ggccttgtgtggggtttgcttctgacaactgaacttatcatctgggcagctagtgcagaaactccattgatggag

SEQ ID NO: 328380 - DNA, 75 bp, Artificial Sequence
  Synthetic
tcagggtggtctgatacagcacatggtgtaggtatagtccctatgagaacagatctagaacttgattttgcatta

SEQ ID NO: 328381 - DNA, 75 bp, Artificial Sequence
  Synthetic
gcatcatcatcctcatacagctatagaaggaagctcgtaaaccctgccaatacagaggaaactttacctttccat

SEQ ID NO: 328382 - DNA, 75 bp, Artificial Sequence
  Synthetic
cttcaattggaaaaacaggttgttcatgccgaaatacaaaatctggggcattggatggatgggacattcaatatc

SEQ ID NO: 328383 - DNA, 75 bp, Artificial Sequence
  Synthetic
aaaactgcatttcactgttatggagaatgtaaaaaatatgcctacccttggcagactgccaagtgtttttttgaa

SEQ ID NO: 328384 - DNA, 75 bp, Artificial Sequence
  Synthetic
aaagattatcaatatgagacaagttggggttgtaacccacctgattgcccaggggtagggacaggatgtacagca

SEQ ID NO: 328385 - DNA, 75 bp, Artificial Sequence
  Synthetic
tgtggggtttatcttgataagttgcgatcagttgggaaggcatataagattgtttctttaaaatacacaagaaag

SEQ ID NO: 328386 - DNA, 75 bp, Artificial Sequence
  Synthetic
gtttgcatccaattgggcacggaacaaacgtgcaaacatattgatgttaatgattgtcttgtttctccatcagta

SEQ ID NO: 328387 - DNA, 75 bp, Artificial Sequence
  Synthetic
aaagtttgcatgattggcactgtctcaaaactacagcctggtgacacactactgtttttaggtccacttgaacaa

SEQ ID NO: 328388 - DNA, 75 bp, Artificial Sequence
  Synthetic
ggtggtattatactaaagcagtggtgtacaacatcatgtgtgtttggagatcctggagacataatgtcaacaacg

SEQ ID NO: 328389 - DNA, 75 bp, Artificial Sequence
  Synthetic
agtgggatgagatgtcctgagcatacaggttcatttagaaagatctgtggttttgcaacaacaccgacttgcgaa

SEQ ID NO: 328390 - DNA, 75 bp, Artificial Sequence
  Synthetic
tatcagggcaatacaatttcaggatttaaaagaatgatggccacaagagattctttccagtcattcaatgttaca

SEQ ID NO: 328391 - DNA, 75 bp, Artificial Sequence
  Synthetic
gaacctcatataactagtaaccgactagaatggattgaccctgacagtagtattaaagaccatataaatgtagtg

SEQ ID NO: 328392 - DNA, 75 bp, Artificial Sequence
  Synthetic
ctaaatcgtgatgtgtcttttcaagatttaagtgataatccctacaaagtagatttgcacacacaatctatagac

SEQ ID NO: 328393 - DNA, 75 bp, Artificial Sequence
  Synthetic
ggtgcatggggttctggggtaggttttactctagtatgtattgtgggtcttacagagtgtgcaaattttatcact

SEQ ID NO: 328394 - DNA, 75 bp, Artificial Sequence
  Synthetic
tcaatcaaggcatgtgatatggcaatgtgttatggggcaactgtgacaaacttattgaggggttctaacacagtc

SEQ ID NO: 328395 - DNA, 75 bp, Artificial Sequence
  Synthetic
aaagttgtgggcaaaggtgggcattcaggctcattattcaagtgctgccatgatactgactgtactgaagaaggt

SEQ ID NO: 328396 - DNA, 75 bp, Artificial Sequence
  Synthetic
cttgctgcctccccaccacatctagatcgggttactggttacaatcaaatagactcagataaagtttgtgatgat

SEQ ID NO: 328397 - DNA, 75 bp, Artificial Sequence
  Synthetic
ggtgctccactatgttcagttaagtgttggttcactaagtctggagaatggctgcttgggatattaaatggcaat

SEQ ID NO: 328398 - DNA, 75 bp, Artificial Sequence
  Synthetic
tggatggtagtggctgtcttggttgtgatactgatactttcaatattacttttcagctttttctgcccaatccgg

SEQ ID NO: 328399 - DNA, 75 bp, Artificial Sequence
  Synthetic
agtaaaaagagtaagcccaattaatccgatgtacttttaaggcctttaaatcgtatacatctatatattcttatt

SEQ ID NO: 328400 - DNA, 75 bp, Artificial Sequence
  Synthetic
atttaatatttatactaatttttatttttatatatatattaacagactaactatcagctaaaaaaaacaaaccct

SEQ ID NO: 328401 - DNA, 75 bp, Artificial Sequence
  Synthetic
tagtagtagactccgagatagagaaagttagaaaaatggaaaaatatagagagattcatcaaagagtaaaggaga

SEQ ID NO: 328402 - DNA, 75 bp, Artificial Sequence
  Synthetic
ttcctcctgggggggcatctgcattagagtgtttagatttacttgaccgtctctacgcagtcaggcatgatgtag

SEQ ID NO: 328403 - DNA, 75 bp, Artificial Sequence
  Synthetic
ttgatcaactgatcaagcatgattggtctgataataaggatatggaaaggcctataggtcaagttttgttgatgg

SEQ ID NO: 328404 - DNA, 75 bp, Artificial Sequence
  Synthetic
ctggtgtaccaaatgatattattcaaggtatggaaaagaaagtcattcctacaagtccttcagggcagatcctca

SEQ ID NO: 328405 - DNA, 75 bp, Artificial Sequence
  Synthetic
agagctttttccgcatgacacctgataattataagataacaggtgctttgattgaatttatcgaggtaacagtga

SEQ ID NO: 328406 - DNA, 75 bp, Artificial Sequence
  Synthetic
ctgcagatgtggctaaaggcatccgtgagaagaaattaaaatatgagagtggtcttcaatttatagaatctttat

SEQ ID NO: 328407 - DNA, 75 bp, Artificial Sequence
  Synthetic
tgagtcaagaacataagaaaggtaatataaaccaggtatacaagatcacatttgatgtcgtggctgtaaagacag

SEQ ID NO: 328408 - DNA, 75 bp, Artificial Sequence
  Synthetic
atggttcaaatatatctactcaatggcctagtcggcgtaatgatggtgttgttcaacatatgaggcttgttcaag

SEQ ID NO: 328409 - DNA, 75 bp, Artificial Sequence
  Synthetic
ctgatattaattatgttagggagcacctcataaaacctgacgagcgtgcatcattagaagccatgtttaatctta

SEQ ID NO: 328410 - DNA, 75 bp, Artificial Sequence
  Synthetic
agtttcatgtaggaggtcccaaactaagatattttaatataccagattataaacctcaatcactgtgtcagcctg

SEQ ID NO: 328411 - DNA, 75 bp, Artificial Sequence
  Synthetic
agattacaaatttgatccagtattgtaagcactggcttacggaagaccatgattttgtttttaaagaagttacag

SEQ ID NO: 328412 - DNA, 75 bp, Artificial Sequence
  Synthetic
gcaataatgtcatgagttcatttgagaataatgaagatgtgtatatgtctagatataaggaatctcgtaaaccgc

SEQ ID NO: 328413 - DNA, 75 bp, Artificial Sequence
  Synthetic
gtaattttttgctgatacaaggttctattcaaggtccttacttaccgtcaactattagctctgatcagtgtgata

SEQ ID NO: 328414 - DNA, 75 bp, Artificial Sequence
  Synthetic
caagaattggctgtctagaggtattaaaagtacatccagaaacaccagtgcaagcaatagcagtagatatggctt

SEQ ID NO: 328415 - DNA, 75 bp, Artificial Sequence
  Synthetic
ataaatacatggagttgaatagagatgagattattaattactataatcctcgagttcattttcaggcaactcaat

SEQ ID NO: 328416 - DNA, 75 bp, Artificial Sequence
  Synthetic
ccgtaaaggagccaggtacatttaaattaggactctctcaattaaatccaatgtctaaatcaatattggatcaag

SEQ ID NO: 328417 - DNA, 75 bp, Artificial Sequence
  Synthetic
ttggaaaacacaaatcagaaaagggtttatttggcgaaccattagaaagtataaatatatcaagccagattcaac

SEQ ID NO: 328418 - DNA, 75 bp, Artificial Sequence
  Synthetic
agaatgagtgttcacgcatcatagaatcaatactatcaaaccttgaaataaatgtcggtgaggtaacaatgaatc

SEQ ID NO: 328419 - DNA, 75 bp, Artificial Sequence
  Synthetic
tagctaatcctcgtaagaccacaggtgtagatgaattattaggaaaattttatgagaatgagctgtctaagtatt

SEQ ID NO: 328420 - DNA, 75 bp, Artificial Sequence
  Synthetic
tgattagtatattacggaaaactgcagcttggcatattggtcatttaataagagatataacagaaagtcttattg

SEQ ID NO: 328421 - DNA, 75 bp, Artificial Sequence
  Synthetic
cccatgcaggtttaaaacggtctaagtattggtcaattcatgcctatgaccatggtggggttatactgttcatcc

SEQ ID NO: 328422 - DNA, 75 bp, Artificial Sequence
  Synthetic
tcccttcaaaatccctagaggttgttggatcttatatccgttattttacagtattcaaagatggcattggactca

SEQ ID NO: 328423 - DNA, 75 bp, Artificial Sequence
  Synthetic
tagatgaggaaaatttagattcaaaagttgatattgatggtgttcagtggtgtttttcaaaagtaatgagtattg

SEQ ID NO: 328424 - DNA, 75 bp, Artificial Sequence
  Synthetic
acttaaatagactattagccttaaatattgcttttgagaaagcactccttgctacggctacctggtttcaatatt

SEQ ID NO: 328425 - DNA, 75 bp, Artificial Sequence
  Synthetic
atacagaagatcaaggacattttccattacagcatgcattgcgctctgtattttcattccatttcttattatgtg

SEQ ID NO: 328426 - DNA, 75 bp, Artificial Sequence
  Synthetic
tttcccagaagatgaagatctgtgcaatttttgataatttacgatatttgattccagctgttacttcgctatatt

SEQ ID NO: 328427 - DNA, 75 bp, Artificial Sequence
  Synthetic
caggttatgagctcttaatagagaaattctttgagaggccctttaagagtgccttagaagtgtacttgtataata

SEQ ID NO: 328428 - DNA, 75 bp, Artificial Sequence
  Synthetic
taataaaggcattgctcataagtctggcacaaaataataaggtacggttttattctaaagtgcgtctccttggtc

SEQ ID NO: 328429 - DNA, 75 bp, Artificial Sequence
  Synthetic
ttactgttgaccattcaactgtaggtgcaagtggagtctatccttcattgatgtctagagttgtttataaacatt

SEQ ID NO: 328430 - DNA, 75 bp, Artificial Sequence
  Synthetic
atcgcagccttatctctgaggcaacaacatgtttctttctttttgaaaagggcttacatggaaatttaaacgaag

SEQ ID NO: 328431 - DNA, 75 bp, Artificial Sequence
  Synthetic
aggctaaaatacatcttgaaactgtagaatgggcaaggaagtttgaggctaaagagcggaaatatggggacatat

SEQ ID NO: 328432 - DNA, 75 bp, Artificial Sequence
  Synthetic
tgatgagagaaggttacacgattgatgctatacgtgtcggtgatgtacaagtagaacagcaactattctgtcaag

SEQ ID NO: 328433 - DNA, 75 bp, Artificial Sequence
  Synthetic
aggtcgtagagttaagtgcagaggaactaaacaaatacttgcaggcaaaaagtcaagtattatcgtctaatatta

SEQ ID NO: 328434 - DNA, 75 bp, Artificial Sequence
  Synthetic
tgaataaacattgggacaaaccttattttagtcaaacgagaaatataagtctaaaaggtatgtccggggcattgc

SEQ ID NO: 328435 - DNA, 75 bp, Artificial Sequence
  Synthetic
aagaggatggacatcttgcagcaagtgtcacattaattgaggctattagattcttgaataggtcacagactaatc

SEQ ID NO: 328436 - DNA, 75 bp, Artificial Sequence
  Synthetic
ccaatgttattgacatgtatgagcagacaaagcagcacaaagctcaagcacgtattgtaagaaaatatcaacgta

SEQ ID NO: 328437 - DNA, 75 bp, Artificial Sequence
  Synthetic
ctgaggctgatagagggttcttcatcacaactcttccaacaagggtcaggttagagattatagaagattattatg

SEQ ID NO: 328438 - DNA, 75 bp, Artificial Sequence
  Synthetic
atgcaatagctagagttgttccagaagagtacatatcatatgggggggataagaaaattttaaatatacagactg

SEQ ID NO: 328439 - DNA, 75 bp, Artificial Sequence
  Synthetic
cactagagaaggcattacgatgggcttcagggtcatcagaaattacaacaagtacagggaatgtgattaagttta

SEQ ID NO: 328440 - DNA, 75 bp, Artificial Sequence
  Synthetic
agagaaggttaatgtatgtgagtgctgatgccacaaagtggtctcctggagacaactcagcaaagtttaagaggt

SEQ ID NO: 328441 - DNA, 75 bp, Artificial Sequence
  Synthetic
ttacacaggctttatatgatggtctgtcagatgaaaagttgaagtgttgtgttgtagatgccctcaggcatgttt

SEQ ID NO: 328442 - DNA, 75 bp, Artificial Sequence
  Synthetic
atgagacggagtttttcatgtctagaaaacttcatcgctatatagattctatggatgagcattctgaggctgtgc

SEQ ID NO: 328443 - DNA, 75 bp, Artificial Sequence
  Synthetic
aagatttcctcgacttctttaagggtggtgtgtctgccactgtcaaaggaaattggcttcaaggtaacttaaata

SEQ ID NO: 328444 - DNA, 75 bp, Artificial Sequence
  Synthetic
aatgttcctcactattcggagctgcagtatcattattattcagacgtatctgggcagagttgttccctgaattag

SEQ ID NO: 328445 - DNA, 75 bp, Artificial Sequence
  Synthetic
aatgcttttttgaatttgcacatcattcagatgatgccctatttatttatggctatcttgagccagaagatgatg

SEQ ID NO: 328446 - DNA, 75 bp, Artificial Sequence
  Synthetic
gaactgactggttcctatatgtatcccaacaaatccaggccggcaactatcactggcatgcagtcaatcaagaga

SEQ ID NO: 328447 - DNA, 75 bp, Artificial Sequence
  Synthetic
tgtggaaaagtatgttcaacctccatgagcacttgttgttgatgggttctataaaggtatcaccaaaaaagacaa

SEQ ID NO: 328448 - DNA, 75 bp, Artificial Sequence
  Synthetic
cagtttctcctacaaatgcagagttcctttccacattttttgagggctgtgcagtgtcaatcccgttcatcaaga

SEQ ID NO: 328449 - DNA, 75 bp, Artificial Sequence
  Synthetic
tactattagggtcattatcggatttaccaggattagggttctttgatgatttagcagctgcacagagtaggtgtg

SEQ ID NO: 328450 - DNA, 75 bp, Artificial Sequence
  Synthetic
tcaaagcaatggatttaggagcatccccgcaattggcacaattggctgttgtcatctgcactagtaaagttgaga

SEQ ID NO: 328451 - DNA, 75 bp, Artificial Sequence
  Synthetic
ggttatatggtactgcagatggaatggttaatagtccagtagcattcttaaaggtaacaaaggcccatgtaccta

SEQ ID NO: 328452 - DNA, 75 bp, Artificial Sequence
  Synthetic
tcccattgggaggtgatggatcaatgtctattatggaacttgctacagcaggtataggtatggcagacaaaaata

SEQ ID NO: 328453 - DNA, 75 bp, Artificial Sequence
  Synthetic
ttctcaagcaagccttttattcttacaagcatacaagacgtgatggagataggtatgttctgggtctttttaagt

SEQ ID NO: 328454 - DNA, 75 bp, Artificial Sequence
  Synthetic
ttttgatgtctctcagtgaggatgtcttccagcatgataggttaggtgagtttagttttgttggtaaagtacagt

SEQ ID NO: 328455 - DNA, 75 bp, Artificial Sequence
  Synthetic
ggaaggtttttacacctaagaatgagtttgaattctatgatcaattttcacaatcttatttaaaaagttggacca

SEQ ID NO: 328456 - DNA, 75 bp, Artificial Sequence
  Synthetic
atcaacacccagtatatgattatatcatacccagaggtagagataatctattagtttacttagtccgaaaattaa

SEQ ID NO: 328457 - DNA, 75 bp, Artificial Sequence
  Synthetic
atgatcccagcattgtcacagctatgacaatgcaatccccgttgcaacttaggtttaggatgcaagctaaacaac

SEQ ID NO: 328458 - DNA, 75 bp, Artificial Sequence
  Synthetic
atatgaaagtatgtaaacttgatggagagtgggtaacatttagagaagttttagctgcagcagatagttttgcca

SEQ ID NO: 328459 - DNA, 75 bp, Artificial Sequence
  Synthetic
ctaaatataatccaacagagaaagacttagatttattcaatacactggttagttgtacattttctaaagaatacg

SEQ ID NO: 328460 - DNA, 75 bp, Artificial Sequence
  Synthetic
catggaaagacttcctaaatgaagtccgatgtgaagtagtacctacaaaacatgttcatcggtcaaaaattgcaa

SEQ ID NO: 328461 - DNA, 75 bp, Artificial Sequence
  Synthetic
gaactttcacagtgcgtgaaaaagaccaagctattcaaaacccaattactgctgttatagggtataaatatgcct

SEQ ID NO: 328462 - DNA, 75 bp, Artificial Sequence
  Synthetic
caactgtggatgagattagtgatgtcttggatagttctttttttcctgactcattgtctgcagatcttcaagtta

SEQ ID NO: 328463 - DNA, 75 bp, Artificial Sequence
  Synthetic
tgaaggaaggtgtttatagagaactgggtctagatataggtcttcctgaggtattgaaaagaatagcaccacttt

SEQ ID NO: 328464 - DNA, 75 bp, Artificial Sequence
  Synthetic
tatataaagcagggaggtctagggttgttatagtagagggtaatgtggagggtacagctgagtcaatttgcagct

SEQ ID NO: 328465 - DNA, 75 bp, Artificial Sequence
  Synthetic
attggcttagaagcatgtcattagttaaaacaattaaagtacgtcctaaaaaggaagtcctcagggctgtttcgc

SEQ ID NO: 328466 - DNA, 75 bp, Artificial Sequence
  Synthetic
tgtatagtactaaagagaatattgggttgcaagatgatgttgcagctacacggttatgcatagaagtttggagat

SEQ ID NO: 328467 - DNA, 75 bp, Artificial Sequence
  Synthetic
ggtgtaaggctaatgaccagaatgtgaatgactggttgaatgcattatattttgaaaagcaaactcttatggact

SEQ ID NO: 328468 - DNA, 75 bp, Artificial Sequence
  Synthetic
gggtagagagatttcgtagaaaaggtgttgttcctgtagaccctgagatccagtgtattgccttgcttctctatg

SEQ ID NO: 328469 - DNA, 75 bp, Artificial Sequence
  Synthetic
atgtgttaggttataagagcgtattacaaatgcaggcaaatagacgggcgtattcaggaaagcaatatgatgcat

SEQ ID NO: 328470 - DNA, 75 bp, Artificial Sequence
  Synthetic
attgtgttcagacatataatgaggaaacaaagctttatgagggggatttaagggttacatttaactttggtcttg

SEQ ID NO: 328471 - DNA, 75 bp, Artificial Sequence
  Synthetic
attgtgcaagactagaaatcttttgggataaaaaggaatatattcttgaaacatcaatcacacagcgtcatgtct

SEQ ID NO: 328472 - DNA, 75 bp, Artificial Sequence
  Synthetic
taaagttgatgatggaagaagttacacaagagttgctgagatgtgggatgagatttaagacagaacaagttagtc

SEQ ID NO: 328473 - DNA, 75 bp, Artificial Sequence
  Synthetic
atacaaagagtttagttttattcaagacggagtcagggtttgagtgggggaaaccaaatgtgccatgtattgtct

SEQ ID NO: 328474 - DNA, 75 bp, Artificial Sequence
  Synthetic
ttaagcattgtgctttacgcacagggttgaggactaagcaagcaatcaataaagaatttatgataaatgttcaag

SEQ ID NO: 328475 - DNA, 75 bp, Artificial Sequence
  Synthetic
cagatgggttcagagctatagcacaaatggatgtggaaagccctagattcttgttggcacatgcttaccatacat

SEQ ID NO: 328476 - DNA, 75 bp, Artificial Sequence
  Synthetic
tacgtgatgttcgctatcaagctgtgcaggctgtaggtaatgtatggttccaaactaatcaacataaattattca

SEQ ID NO: 328477 - DNA, 75 bp, Artificial Sequence
  Synthetic
taaatccgataatatcatctggattgttagaaaactttatgaaaggattgccagcagcaatcccacctgcagctt

SEQ ID NO: 328478 - DNA, 75 bp, Artificial Sequence
  Synthetic
attctttaattatgaataaggccaaaatatctgtagaccttttcatgtttaacgagttattggctttggtcaacc

SEQ ID NO: 328479 - DNA, 75 bp, Artificial Sequence
  Synthetic
caagaaacgttcttaatctagatggaatagaagaaacttcagagggttacagtacagtgacctctatatccagca

SEQ ID NO: 328480 - DNA, 75 bp, Artificial Sequence
  Synthetic
gacaatggtctgaggaagtgagtcttatggctgatgataatattgatgatgaagaagaatttacaatagctcttg

SEQ ID NO: 328481 - DNA, 75 bp, Artificial Sequence
  Synthetic
atgatatagattttgaacagatcaatctagatgaagatatacaacattttttacaagatgaatcagcttatacag

SEQ ID NO: 328482 - DNA, 75 bp, Artificial Sequence
  Synthetic
gtgacctaacaatacaaacagaggaagttgaagttaaacgaataagaggtgtaacacgtgtgcttgaacctgtta

SEQ ID NO: 328483 - DNA, 75 bp, Artificial Sequence
  Synthetic
agcttattaagagttgggtatcaaaaggtcttgctattgacaaagtgtataatcccatagggatagtgttgatgg

SEQ ID NO: 328484 - DNA, 75 bp, Artificial Sequence
  Synthetic
ccaggtatatgtcaaagaattatgacttcagtaaaattcctttagctttactaaatccatatgatttaacagagt

SEQ ID NO: 328485 - DNA, 75 bp, Artificial Sequence
  Synthetic
ttgagagtgttgtcaaaggttggggtgagactgttaatgacaggtttctagaagttgataatgatgcacaacgtt

SEQ ID NO: 328486 - DNA, 75 bp, Artificial Sequence
  Synthetic
attgacggcgtagtacacactattgaatcaaacagccgaccaacagcactaccatcataatggagaagcctgtag

SEQ ID NO: 328487 - DNA, 75 bp, Artificial Sequence
  Synthetic
accatcataatggagaagcctgtagttaacgtagacgtagacccccagagtccgtttgtcgctcaactgcaaaag

SEQ ID NO: 328488 - DNA, 75 bp, Artificial Sequence
  Synthetic
aaatgtgcagcatttatcggcgacgacaacattatacacggagtagtatctgacaaagaaatggctgagaggtgt

SEQ ID NO: 328489 - DNA, 75 bp, Artificial Sequence
  Synthetic
tgacaaagaaatggctgagaggtgtgccacctggctcaacatggaggttaagatcattgacgcagtcatcggcga

SEQ ID NO: 328490 - DNA, 75 bp, Artificial Sequence
  Synthetic
agcttcccgcaattcgaggtagtagcacagcaggccacaccaaatgaccatgctaatgccagagcattttcgcat

SEQ ID NO: 328491 - DNA, 75 bp, Artificial Sequence
  Synthetic
cacagcaggccacaccaaatgaccatgctaatgccagagcattttcgcatctggctagtaaattaatcgagctgg

SEQ ID NO: 328492 - DNA, 75 bp, Artificial Sequence
  Synthetic
aggttcctaccacagcgacgattttggacataggcagcgcaccggctcgtagaatgttttccgagcaccactatc

SEQ ID NO: 328493 - DNA, 75 bp, Artificial Sequence
  Synthetic
actgcgtctgccctatgcggagccccgaagatcccgaccgtatgatgaaatacgccaataagttggcggagaagg

SEQ ID NO: 328494 - DNA, 75 bp, Artificial Sequence
  Synthetic
gctagatgaaacaaaggcgtggtttagagtaggtataacagacaccttagcagtggccgtggcaactcggtatga

SEQ ID NO: 328495 - DNA, 75 bp, Artificial Sequence
  Synthetic
caaataagattactaataaaaatttgcatgagaagattaaagacctccggatcgtacttgatactccggatgctg

SEQ ID NO: 328496 - DNA, 75 bp, Artificial Sequence
  Synthetic
gcaaaagagcatttcaagccatcagaggggaaataaagcatctctacggtggtcctaaatagtcagcatagtaca

SEQ ID NO: 328497 - DNA, 75 bp, Artificial Sequence
  Synthetic
agacaccgtcgctctgcttccataatgacgttacctgcagtacgcgtgcagagtactccgttatgcaagatgtgt

SEQ ID NO: 328498 - DNA, 75 bp, Artificial Sequence
  Synthetic
tgacgttacctgcagtacgcgtgcagagtactccgttatgcaagatgtgtatattaatgcacccggaactattta

SEQ ID NO: 328499 - DNA, 75 bp, Artificial Sequence
  Synthetic
tttcatctgactaataccacaacaccaccaccatgaatagaggattctttaacatgctcggccgccgccccttcc

SEQ ID NO: 328500 - DNA, 75 bp, Artificial Sequence
  Synthetic
ccatcaagctatgaaaggcgtgcggacactttactggattgggtttgacaccactcagttcatgttctcggctat

SEQ ID NO: 328501 - DNA, 75 bp, Artificial Sequence
  Synthetic
ggcaggatcatatcctgcctataatactaactgggccgatgaaaaagtccttgaagcacgcaatattggactctg

SEQ ID NO: 328502 - DNA, 75 bp, Artificial Sequence
  Synthetic
tagtaccaagttgagcgaaggccgtataggaaagttgtcaataatgaggaaaaaggagttgaagcccgggtcacg

SEQ ID NO: 328503 - DNA, 75 bp, Artificial Sequence
  Synthetic
gcaactagacctcaaaccccacgcccacgcccgccgccgcgccagaagaagcaggcgccaaagcaaccaccgaag

SEQ ID NO: 328504 - DNA, 75 bp, Artificial Sequence
  Synthetic
ggtctacttctcagtgggatcaacactctacccagaatatagggacagcttacagagctggcacctcccatcagt

SEQ ID NO: 328505 - DNA, 75 bp, Artificial Sequence
  Synthetic
ccgaagaaaccaaaaacacaggagaagaagaagaagcaacctgcaaaacccaaacccggaaagagacagcgtatg

SEQ ID NO: 328506 - DNA, 75 bp, Artificial Sequence
  Synthetic
gttccatctgaaaggaaagcaatcgtatacatgccgctgtgatacagtggtaagttgcgaaggctacgtagtgaa

SEQ ID NO: 328507 - DNA, 75 bp, Artificial Sequence
  Synthetic
gcacttaagttggaggccgacagactgttcgacgtcaaaaatgaggacggagatgtcatcgggcacgcactggcc

SEQ ID NO: 328508 - DNA, 75 bp, Artificial Sequence
  Synthetic
gaagatcactattagtcccgggattacgggagaaaccgtgggatacgcggttacaaacaatagcgagggtttctt

SEQ ID NO: 328509 - DNA, 75 bp, Artificial Sequence
  Synthetic
gctatgtaaagttactgacacagtaaaaggggaacgggtctcgttccccgtgtgcacgtatatcccggccaccat

SEQ ID NO: 328510 - DNA, 75 bp, Artificial Sequence
  Synthetic
aaaggggaacgggtctcgttccccgtgtgcacgtatatcccggccaccatatgcgaccagatgacaggtataatg

SEQ ID NO: 328511 - DNA, 75 bp, Artificial Sequence
  Synthetic
agttcgcacagttgccggtcaacatgagaagtgaggcgttcacctacaccagtgaacaccctgaagggttctaca

SEQ ID NO: 328512 - DNA, 75 bp, Artificial Sequence
  Synthetic
ccatggaaggaaaggtaatgaaaccactccacgtgaaaggaactattgaccaccctgtgctatcaaagctcaaat

SEQ ID NO: 328513 - DNA, 75 bp, Artificial Sequence
  Synthetic
gtcacggatatttcacctgacgatgcacagaagcttctggttgggctcaaccagaggattgtcattaacggtaaa

SEQ ID NO: 328514 - DNA, 75 bp, Artificial Sequence
  Synthetic
actggcaccacggagcggtgcagtatagtggaggcagatttaccatcccccgcggagtaggaggcagaggagaca

SEQ ID NO: 328515 - DNA, 75 bp, Artificial Sequence
  Synthetic
accaacaggaacactaacaccatgcaaaactaccttctgccgattatagcacaaggcttcagcaagtgggctaaa

SEQ ID NO: 328516 - DNA, 75 bp, Artificial Sequence
  Synthetic
gtggtcgtccgattatggataactcaggccgggttgtcgcgatagtcctcggaggggctgatgagggaacaagaa

SEQ ID NO: 328517 - DNA, 75 bp, Artificial Sequence
  Synthetic
aggccgggttgtcgcgatagtcctcggaggggctgatgagggaacaagaaccgccctttcggtcgtcacctggaa

SEQ ID NO: 328518 - DNA, 75 bp, Artificial Sequence
  Synthetic
gagcgcaaagaagatcttgataatgaaaagaagctgggcactagggagcgtaagcttatttacgggtgtctatgg

SEQ ID NO: 328519 - DNA, 75 bp, Artificial Sequence
  Synthetic
tagcaaagggaagacaatcaagacaaccccggaagggacagaagagtggtctgctgcaccactggtcacggccat

SEQ ID NO: 328520 - DNA, 75 bp, Artificial Sequence
  Synthetic
gcggttcgtactaagaaagtgcactcgttttaccgcccgcccggaacgcagaccagcgtgaaagtcccggcatct

SEQ ID NO: 328521 - DNA, 75 bp, Artificial Sequence
  Synthetic
tttagcgcttttccaatgtcatctgtatggacaacctcactacccatgtcgctgaggcagaagataaaattggta

SEQ ID NO: 328522 - DNA, 75 bp, Artificial Sequence
  Synthetic
ctacaaccgaaaaaggaggagaaattactgcaggtctcagaagagttagttgcggaggctaaagcggcctttgaa

SEQ ID NO: 328523 - DNA, 75 bp, Artificial Sequence
  Synthetic
acgccatattgcggtgcggatcgtccggcagaagtaaaagaagcgtcactgacgactttaccttgaccagcccgt

SEQ ID NO: 328524 - DNA, 75 bp, Artificial Sequence
  Synthetic
gatgcacaggaggagatcagagcggagcaactccgtgaagcacttccaccactggtagcagacaaaggtattgaa

SEQ ID NO: 328525 - DNA, 75 bp, Artificial Sequence
  Synthetic
acttgggcacatgctcgtactgtcaccatactgaaccgtgctttagcccgattaagatcgagcaggtctgggatg

SEQ ID NO: 328526 - DNA, 75 bp, Artificial Sequence
  Synthetic
agcaactccgtgaagcacttccaccactggtagcagacaaaggtattgaagccgctgcagaagtcgtctgtgaag

SEQ ID NO: 328527 - DNA, 75 bp, Artificial Sequence
  Synthetic
gacgactttaccttgaccagcccgtacttgggcacatgctcgtactgtcaccatactgaaccgtgctttagcccg

SEQ ID NO: 328528 - DNA, 75 bp, Artificial Sequence
  Synthetic
tggaagggcttcaagctgatataggagcagctcttgttgagacgccacgagggcatgtaaggattatacctcaag

SEQ ID NO: 328529 - DNA, 75 bp, Artificial Sequence
  Synthetic
gaccaaagcggagcagcaagctcaaataagtaccgctacatgtcgctcgagcaggatcatactgtcaaagaaggc

SEQ ID NO: 328530 - DNA, 75 bp, Artificial Sequence
  Synthetic
taacagaccgcatgattgggcagtacatcgtggtctcaccaacctccgtgcttaagaacgccaaattaacacctg

SEQ ID NO: 328531 - DNA, 75 bp, Artificial Sequence
  Synthetic
ttcaccctttggctgaccaagtcaaaattataacacattcagggaggacaggaagattcgcggtggaaccgtatg

SEQ ID NO: 328532 - DNA, 75 bp, Artificial Sequence
  Synthetic
ctacaaaggatactttctcctcgcgaagtgtcctccaggggacagcgtaacggttagcatagcgagtagcaactc

SEQ ID NO: 328533 - DNA, 75 bp, Artificial Sequence
  Synthetic
ggaagattcgcggtggaaccgtatgatgctaaagtgttgatgccagcaggtagcgccgttccatggcctgagttc

SEQ ID NO: 328534 - DNA, 75 bp, Artificial Sequence
  Synthetic
cggtgcggatcgtctggcagaagcaaaagaagcgtcattgacggctttaccctgaccagcccctacttgggcaca

SEQ ID NO: 328535 - DNA, 75 bp, Artificial Sequence
  Synthetic
tagtgtataacgaaagagaatttgtcaaccgcaaactttaccatatcgccatacatggtcccgcgaagaatactg

SEQ ID NO: 328536 - DNA, 75 bp, Artificial Sequence
  Synthetic
tcacggtaagaagattccttgcacagtgtacgaccgtctgaaagaaacaaccgccggctacatcactatgcacag

SEQ ID NO: 328537 - DNA, 75 bp, Artificial Sequence
  Synthetic
aagaggagcagtataaagtcactaaagccgaactcgcagaaacagagtatgtatttgatgtcgacaagaagcgtt

SEQ ID NO: 328538 - DNA, 75 bp, Artificial Sequence
  Synthetic
gcgttaagaaggaagaggcctcggggctggttctcccgggagaactaactaacccaccgtatcatgaaatggcgc

SEQ ID NO: 328539 - DNA, 75 bp, Artificial Sequence
  Synthetic
gaacattacgtacgagtgcaagtgcggcgattacaagaccggaaccgttacgacccgtaccgaaatcacgggctg

SEQ ID NO: 328540 - DNA, 75 bp, Artificial Sequence
  Synthetic
ataatggccacggatatctcacctgacgatgcacaaaaacttctggttgggctcaaccagcgaattgtcattaac

SEQ ID NO: 328541 - DNA, 75 bp, Artificial Sequence
  Synthetic
cgacccgtaccgaaatcacgggctgcaccgccatcaagcagtgcgtcgcctataagagcgaccaaacgaagtggg

SEQ ID NO: 328542 - DNA, 75 bp, Artificial Sequence
  Synthetic
ttgaggggctgaagactcgacccgctgttccgtataaggtcgaaacaataggagtaataggcacaccaggatcag

SEQ ID NO: 328543 - DNA, 75 bp, Artificial Sequence
  Synthetic
tataagagcgaccaaacgaagtgggtcttcaactcgccggactcgatcagacacgccgaccacacggcccaaggg

SEQ ID NO: 328544 - DNA, 75 bp, Artificial Sequence
  Synthetic
gcaagtctgcgattattaaatcgaccgttaccgtacgagatcttgttaccagcggaaagaaggaaaactgccgtg

SEQ ID NO: 328545 - DNA, 75 bp, Artificial Sequence
  Synthetic
aaattgcatttgcctttcaagctgatcccgagtacctgcatggtccctgttgcccacgcgccgaacgtagtacac

SEQ ID NO: 328546 - DNA, 75 bp, Artificial Sequence
  Synthetic
aaattgaaactgacgtgttgaggttgagaggtatgcagatcacgtcaaggacggtagactcagtcatgcttaacg

SEQ ID NO: 328547 - DNA, 75 bp, Artificial Sequence
  Synthetic
gagaggtatgcagatcacgtcaaggacggtagactcagtcatgcttaacggatgccataaagccgtagagatgct

SEQ ID NO: 328548 - DNA, 75 bp, Artificial Sequence
  Synthetic
atacgttgatgaagcatttgcgtgccatgctggtacgttgcttgccttgatcgctattgttagaccccgaaagaa

SEQ ID NO: 328549 - DNA, 75 bp, Artificial Sequence
  Synthetic
acagtatatcgtcgtttcaccaacctctgtgctgaagaacgccaaactcgcaccagcacacccgctagcagacca

SEQ ID NO: 328550 - DNA, 75 bp, Artificial Sequence
  Synthetic
ggtagtacttcgcggggatcctaagcagtgtggttttttcaatatgatgcagctcaaagtacattttaatcaccc

SEQ ID NO: 328551 - DNA, 75 bp, Artificial Sequence
  Synthetic
cgtcgaccgagatggcctggaatacatatggggcaatcacgaaccagtaagggtctatgcccaagagtctgcacc

SEQ ID NO: 328552 - DNA, 75 bp, Artificial Sequence
  Synthetic
tgaaaaagatatatgtactaagacgttttacaaattcatctctcgacgctgcacgcaaccagtaacggcgattgt

SEQ ID NO: 328553 - DNA, 75 bp, Artificial Sequence
  Synthetic
aagggtctatgcccaagagtcagcaccaggagaccctcacggatggccacacgaaatagtacagcattactacca

SEQ ID NO: 328554 - DNA, 75 bp, Artificial Sequence
  Synthetic
tagctcttgagggactgaagactcgacccgcggtcccgtacaaggtcgaaacaataggagtgataggcacaccag

SEQ ID NO: 328555 - DNA, 75 bp, Artificial Sequence
  Synthetic
ttcaacacttcattacgacggaaagatgaagactacaaacccctgcaagaagagcattgagatagatattacagg

SEQ ID NO: 328556 - DNA, 75 bp, Artificial Sequence
  Synthetic
acaataggagtgataggcacaccaggatcgggcaagtcagctatcatcaagtcaactgtcacggcacgtgacctt

SEQ ID NO: 328557 - DNA, 75 bp, Artificial Sequence
  Synthetic
gccatcctgtgtacaccatcttagccgtcgcatcagctgctgtggcgatgatgattggcgtaactgttgcagcat

SEQ ID NO: 328558 - DNA, 75 bp, Artificial Sequence
  Synthetic
gtcaactgtcacggcacgtgaccttgttaccagcggaaagaaagaaaactgccgcgaaattgaggccgacgtgct

SEQ ID NO: 328559 - DNA, 75 bp, Artificial Sequence
  Synthetic
tactacgaagccgaagcccggggacctcgttttgacgtgcttccgcggatgggtcaagcagctacagatcgatta

SEQ ID NO: 328560 - DNA, 75 bp, Artificial Sequence
  Synthetic
gacgttgcacacagccagtcacggcaattgtatcgacactgcattacgatggaaagatgaaaaccacgaacccgt

SEQ ID NO: 328561 - DNA, 75 bp, Artificial Sequence
  Synthetic
cgcgggaaatgaagtgatgacggctgctgcctcgcagggactgactagaaagggtgtttacgccgttcggcaaaa

SEQ ID NO: 328562 - DNA, 75 bp, Artificial Sequence
  Synthetic
gttaccagcggaaagaaagaaaactgccgcgaaattgaggccgacgtgctaaggctgaggggcatgcagatcacg

SEQ ID NO: 328563 - DNA, 75 bp, Artificial Sequence
  Synthetic
agttaatgagaatccactgtacgcgattacgtcggagcacgtgaacgtgttactcacccgtactgaggatagatt

SEQ ID NO: 328564 - DNA, 75 bp, Artificial Sequence
  Synthetic
ctagaaaaggagtatatgccgtccggcaaaaagtcaatgaaaacccgctgtacgcgatcacatcagagcacgtaa

SEQ ID NO: 328565 - DNA, 75 bp, Artificial Sequence
  Synthetic
agtgtggaagaccttacagggcgatccatggatcaaacaacttactaacattccgaaaggaaacttccaagctac

SEQ ID NO: 328566 - DNA, 75 bp, Artificial Sequence
  Synthetic
tacgcgatcacatcagagcacgtaaacgtgttgctcacccgcactgaggacagactagtatggaaaaccttgcaa

SEQ ID NO: 328567 - DNA, 75 bp, Artificial Sequence
  Synthetic
ttccgaaaggaaacttccaagctactattgaggactgggaagctgaacataaggggatcatcgctgcaataaaca

SEQ ID NO: 328568 - DNA, 75 bp, Artificial Sequence
  Synthetic
acttgttgaaagggcagggtacgccccgctcaatttggagattactgtcatgtcctcggaggttttgccttccac

SEQ ID NO: 328569 - DNA, 75 bp, Artificial Sequence
  Synthetic
agccaccatcgaggactgggaagctgaacacaagggaataattgctgcaataaacagccccgctccccgtaccaa

SEQ ID NO: 328570 - DNA, 75 bp, Artificial Sequence
  Synthetic
gcccaacccttcgtataaacccgttcagctgtaagactaatgtgtgctgggcgaaggcactggaaccgatactgg

SEQ ID NO: 328571 - DNA, 75 bp, Artificial Sequence
  Synthetic
taccggttgccagtggagcgagctgttcccgcagtttgcggatgacaaaccgcactcggccatttacgccttaga

SEQ ID NO: 328572 - DNA, 75 bp, Artificial Sequence
  Synthetic
cagttcgtagatgataaaccccactcagctatctacgccctagatgtgatttgtattaagttctttggtatccat

SEQ ID NO: 328573 - DNA, 75 bp, Artificial Sequence
  Synthetic
ctgacaagcggtctattttcaaagcagagcatccctctgacgtaccaccctgcggactctgcaaggccagtggcg

SEQ ID NO: 328574 - DNA, 75 bp, Artificial Sequence
  Synthetic
tgcggactctgcaaggccagtggcgcattgggacaacagtccaggaacccgaaagtatggatacgatcatgcggt

SEQ ID NO: 328575 - DNA, 75 bp, Artificial Sequence
  Synthetic
actgccgcgatgaaagtaggactgcgtatagtgtacgggaacactaccagtttcctagatgtgtacgtgaacgga

SEQ ID NO: 328576 - DNA, 75 bp, Artificial Sequence
  Synthetic
tgctgccgaattgtctcgtacattcccggtgttccaacttgctggaaaaggcacacagcttgacttgcagactgg

SEQ ID NO: 328577 - DNA, 75 bp, Artificial Sequence
  Synthetic
tgaaagtcatagctggaccaatttcagcattgtttacaccattcgatcacaaggtcgttatcaatcgcggcctgg

SEQ ID NO: 328578 - DNA, 75 bp, Artificial Sequence
  Synthetic
tagaaccagagtcgtttccgcgcagtgtaacttggtcccagtgaaccgtaacctcccgcacgctcttgtccccga

SEQ ID NO: 328579 - DNA, 75 bp, Artificial Sequence
  Synthetic
gttgaccacaacccgtcgtctagcccgccaaaaacgctgccgtgtctttgcatgtatgccatgacgccggaaagg

SEQ ID NO: 328580 - DNA, 75 bp, Artificial Sequence
  Synthetic
gtataaagagaaacaacccggcccgattaaaaattttttaaatcagtttaagcatcactccatacttgtagtatc

SEQ ID NO: 328581 - DNA, 75 bp, Artificial Sequence
  Synthetic
ctagcaaagacctcatcgccagcacagacattaggctactcaagccttccgccaagaacgtgcatgtcccgtaca

SEQ ID NO: 328582 - DNA, 75 bp, Artificial Sequence
  Synthetic
agaaacgaaaatcgaagttcccaataagcgcatcgaatggattgcaccgcttggcatagctggtgcagataagag

SEQ ID NO: 328583 - DNA, 75 bp, Artificial Sequence
  Synthetic
tgtgcctatgtctttcggatcgttttccgacggagagattgaggagctgagccgcagagtaaccgagtcggaacc

SEQ ID NO: 328584 - DNA, 75 bp, Artificial Sequence
  Synthetic
ctacaacctggccttcggatttccaccgcaggcacggtatgatatggtgtttatcaatataggaacaaaatatag

SEQ ID NO: 328585 - DNA, 75 bp, Artificial Sequence
  Synthetic
gtggaaaaacaactcaggccgcccactgcaggaaaccgccccttttgggtgcaagattgcagtcaatccgcttcg

SEQ ID NO: 328586 - DNA, 75 bp, Artificial Sequence
  Synthetic
cgcaggccgcatctggattcgagatgtggaaaaacaactcaggccgcccactgcaggaaaccgccccttttgggt

SEQ ID NO: 328587 - DNA, 75 bp, Artificial Sequence
  Synthetic
aaaccaccattttcaacagtgtgaagaccatgcggcgactttgaagactctttcccgctcggctctgaattgcct

SEQ ID NO: 328588 - DNA, 75 bp, Artificial Sequence
  Synthetic
caaccctggaggcaccttagtggtgaaatcctatggatatgctgatcgcaatagcgaggacgtagtcaccgcact

SEQ ID NO: 328589 - DNA, 75 bp, Artificial Sequence
  Synthetic
aactactccgacccaaagtttgctgtagcggtttgcaacaactatctgcatgagaactacccgacggtagcatct

SEQ ID NO: 328590 - DNA, 75 bp, Artificial Sequence
  Synthetic
tgccaggaagtttgttagagtgtctgcggccaggccagagtgcgtctcaagtaacacagaaatgtacctaatctt

SEQ ID NO: 328591 - DNA, 75 bp, Artificial Sequence
  Synthetic
ggacaatgccctgtacattcgcattcgagcacagcaaccctccaagagtcgacagttcatgtcctggagaaagga

SEQ ID NO: 328592 - DNA, 75 bp, Artificial Sequence
  Synthetic
cccgaacatccgcagtgcggttccatcagcgatgcagaacacgttgcaaaatgtgctcattgccgcgactaaaag

SEQ ID NO: 328593 - DNA, 75 bp, Artificial Sequence
  Synthetic
tcggcaattagataatagccgtacacggcagttcactccacatcatttgaactgtgtaatctcgtcggtgtatga

SEQ ID NO: 328594 - DNA, 75 bp, Artificial Sequence
  Synthetic
atacgtggccagactgaaaggccctaaggccgccgcactgtttgcaaagacgcataatttggtcccattgcaaga

SEQ ID NO: 328595 - DNA, 75 bp, Artificial Sequence
  Synthetic
cgagcccacaggcgaacttcattgtatcgctgtgtggtaagaagacaacatgcaatgcagaatgcaaaccaccag

SEQ ID NO: 328596 - DNA, 75 bp, Artificial Sequence
  Synthetic
cgcataatttggtcccattgcaagaagtgcctatggatagattcgtcatggacatgaaaagagacgtgaaagtta

SEQ ID NO: 328597 - DNA, 75 bp, Artificial Sequence
  Synthetic
aggcacgagagaaggagtcggagctgcgccatcctaccgtgtgaaacgggaaaatattgcagactgccatgagga

SEQ ID NO: 328598 - DNA, 75 bp, Artificial Sequence
  Synthetic
agcaatcgtcaacgccgctaactcgctgggtaaaccaggtgaaggagtttgccgcgccgtctacaagcgttggcc

SEQ ID NO: 328599 - DNA, 75 bp, Artificial Sequence
  Synthetic
atcgctgtgtggtaagaagacaacatgcaatgcagaatgcaaaccaccagctgatcatatcgtgagcaccccgca

SEQ ID NO: 328600 - DNA, 75 bp, Artificial Sequence
  Synthetic
atcggcgacgacaacatcatacacggagtagtatctgacaaagaaatggctgagaggtgtgccacctggctcaac

SEQ ID NO: 328601 - DNA, 75 bp, Artificial Sequence
  Synthetic
gaaacgggtacggctaaattaactgtaagccaaggaatgaaagtgatacacgcggtcggccctgacttccgtaag

SEQ ID NO: 328602 - DNA, 75 bp, Artificial Sequence
  Synthetic
acctgtcctgctggcattgagaacttttgcccagagcaaacgagcattccaagccataagaggtgaaataaagca

SEQ ID NO: 328603 - DNA, 75 bp, Artificial Sequence
  Synthetic
tatcctgaggcggaagctttgaagctgctgcaaaacgcttaccatgcagtggcggacttggttaacaaacacaac

SEQ ID NO: 328604 - DNA, 75 bp, Artificial Sequence
  Synthetic
atatagcaacaccaaaactcgacgtatttccgaggaagcgcagtgcataatgctgcgcagtgttgccaaataatc

SEQ ID NO: 328605 - DNA, 75 bp, Artificial Sequence
  Synthetic
attaagtccattgctatcccgctactatcaacaggtatatatgcagctggtaaggatcgcttggaagtttcgctc

SEQ ID NO: 328606 - DNA, 75 bp, Artificial Sequence
  Synthetic
cgccccttcccggcccccactgccatgtggaggccgcggagaaggaggcaggcggccccgatgcctgcccgcaat

SEQ ID NO: 328607 - DNA, 75 bp, Artificial Sequence
  Synthetic
atttccgaggaagcgcagtgcataatgctgcgcagtgttgccaaataatcactatattaaccatttattcagcgg

SEQ ID NO: 328608 - DNA, 75 bp, Artificial Sequence
  Synthetic
taaggatcgcttggaagtttcgctcaattgcctgaccaccgcactagacaggaccgatgcagatgcagatgtaac

SEQ ID NO: 328609 - DNA, 75 bp, Artificial Sequence
  Synthetic
tatttattgtttggataagaaatggaaagagagaattgacgcggtgttgcaacttaaggagtcagtgacagaact

SEQ ID NO: 328610 - DNA, 75 bp, Artificial Sequence
  Synthetic
gtagcaactcagcaacgtcatgcacgatggcccgcaagataaaaccaaaattcgtgggacgggaaaaatatgacc

SEQ ID NO: 328611 - DNA, 75 bp, Artificial Sequence
  Synthetic
gaaggacgaggacatggaaatcgatgacgaattggtatggattcatccggatagttgtctaaaagggagaaaggg

SEQ ID NO: 328612 - DNA, 75 bp, Artificial Sequence
  Synthetic
gatggcccgcaagataaaaccaaaattcgtgggacgggaaaaatatgacctacctcccgttcacggtaagaagat

SEQ ID NO: 328613 - DNA, 75 bp, Artificial Sequence
  Synthetic
atacagtactacaaaaggaaagctatattcgtactttgagggtactaaatttcaccaagcagccaaagatatggc

SEQ ID NO: 328614 - DNA, 75 bp, Artificial Sequence
  Synthetic
ctacacatcctacctggaggaatcatcagggaaagtttacgcgaagccaccatccgggaagaacattacgtacga

SEQ ID NO: 328615 - DNA, 75 bp, Artificial Sequence
  Synthetic
tattcgtactttgagggtactaaatttcaccaagcagccaaagatatggctgaaataaaagtgctgtttccggac

SEQ ID NO: 328616 - DNA, 75 bp, Artificial Sequence
  Synthetic
gaccaggaaagcaacgaacagttatgcgcttacatactgggcgaaaccatggaagcaattcgtgaaaaatgccca

SEQ ID NO: 328617 - DNA, 75 bp, Artificial Sequence
  Synthetic
ttcaagttgatcccgagtacctgcatggtccctgttgcccacgcgccgaacgtagtgcacggcttcaaacacatc

SEQ ID NO: 328618 - DNA, 75 bp, Artificial Sequence
  Synthetic
gttgatcgtaacccgtcatccagtcctccgaagacgctgccttgcctttgcatgtatgcaatgactccggaaaga

SEQ ID NO: 328619 - DNA, 75 bp, Artificial Sequence
  Synthetic
gttcataggctcagaagtaacaatgttaaagaaattactgtgtgctcctcgaccccgcttccaaaatataagatt

SEQ ID NO: 328620 - DNA, 75 bp, Artificial Sequence
  Synthetic
aagaacgtccagaaagtccagtgcactaaagtagtcctgtttaacccgcacactcctacttttgtcccggcccgt

SEQ ID NO: 328621 - DNA, 75 bp, Artificial Sequence
  Synthetic
ctaaagtagtcctgtttaacccgcacactcctacttttgtcccggcccgtaaatatgtggaagtgccagaatcac

SEQ ID NO: 328622 - DNA, 75 bp, Artificial Sequence
  Synthetic
aaatatgtggaagtgccagaatcacctgccatcacacctgtacaggccgacacgctagatcagccacctgccgcg

SEQ ID NO: 328623 - DNA, 75 bp, Artificial Sequence
  Synthetic
cataatgccacgcagcgtctgcataacttttattatttcttttattaatcaagcaaattttgtttttaacatttc

SEQ ID NO: 328624 - DNA, 75 bp, Artificial Sequence
  Synthetic
ctgccatcacacctgtacaggccgacacgctagatcagccacctgccgcggacggtataccgcttgatgttacgg

SEQ ID NO: 328625 - DNA, 75 bp, Artificial Sequence
  Synthetic
acatttcattaaatatggaagatagtagcgaaggattgtccattttagatttccacgggtcagaaagttccattt

SEQ ID NO: 328626 - DNA, 75 bp, Artificial Sequence
  Synthetic
aaccagttctttggggccagaggacaatagaaggcaagtagtgacagtcgatgtccactccacccaagaggatac

SEQ ID NO: 328627 - DNA, 75 bp, Artificial Sequence
  Synthetic
atgtccactccacccaagaggatactcccattcctcctccaaggttaaagaaactggcccggttagcggcggcga

SEQ ID NO: 328628 - DNA, 75 bp, Artificial Sequence
  Synthetic
aaactggcccggttagcggcggcgaaacaaaccccagtagcacttaccgtatcgaatgatgtgggctcaatggat

SEQ ID NO: 328629 - DNA, 75 bp, Artificial Sequence
  Synthetic
ataatgctgcgcagtgttgccacattatcactatattaaccatttatttagcggacgccgaaactcaatgtattt

SEQ ID NO: 328630 - DNA, 75 bp, Artificial Sequence
  Synthetic
gagtccctctgcctttcatttggcagcgtatccatgtcttttggatctttttccgacggtgagatcgatgaaata

SEQ ID NO: 328631 - DNA, 75 bp, Artificial Sequence
  Synthetic
agcatctctacggtggtcctaaatagtcagcatagtacatttcatctgactaaacaccaccaccatgaatagagg

SEQ ID NO: 328632 - DNA, 75 bp, Artificial Sequence
  Synthetic
tggagaagttaattccattatatcgtctcgatcagccgtgtcttttccaccgctaaggcagagacgtagacgtag

SEQ ID NO: 328633 - DNA, 75 bp, Artificial Sequence
  Synthetic
gaacaagcggactgaatactgactaaccggggtaggtgggtacatattttcgacggatacagggccaggacatct

SEQ ID NO: 328634 - DNA, 75 bp, Artificial Sequence
  Synthetic
tggacaggcaactagacctcaacccccacgtccacgcccgccaccgcgccagaagaagcaggcgcccaagcaacc

SEQ ID NO: 328635 - DNA, 75 bp, Artificial Sequence
  Synthetic
gcaaaagaagtctgtcttgcagaatcaattttccgaaccgaccttggagcgtaacgtgctggaaaagatatacgc

SEQ ID NO: 328636 - DNA, 75 bp, Artificial Sequence
  Synthetic
caattttccgaaccgaccttggagcgtaacgtgctggaaaagatatacgctccgacgcttgatacgtcgaaagaa

SEQ ID NO: 328637 - DNA, 75 bp, Artificial Sequence
  Synthetic
tccgacgcttgatacgtcgaaagaagaactactcaaatttagataccaaatgatgcccaccgaagccaataagag

SEQ ID NO: 328638 - DNA, 75 bp, Artificial Sequence
  Synthetic
gaactactcaaatttagataccaaatgatgcccaccgaagccaataagagcaggtaccagtcccgcaaagtcgaa

SEQ ID NO: 328639 - DNA, 75 bp, Artificial Sequence
  Synthetic
caatggagaagccagtagttaacgtagacgtagaccctcagagtccgtttgtcgtgcaactgcaaaagagcttcc

SEQ ID NO: 328640 - DNA, 75 bp, Artificial Sequence
  Synthetic
aatcaaaaagccgtcaccactgagcgtttgctttcagggttacggctatatacctcggcaactgatcagcctgaa

SEQ ID NO: 328641 - DNA, 75 bp, Artificial Sequence
  Synthetic
tgttataaaattacttacccgaaacctttgtattccagcagtgtaccagcaagttactccgacccgaagttcgca

SEQ ID NO: 328642 - DNA, 75 bp, Artificial Sequence
  Synthetic
ttagcattgagtgagagtgccacgctagtgtacaacgaaagagagtttgtaaatcgcaagctgtaccatattgcc

SEQ ID NO: 328643 - DNA, 75 bp, Artificial Sequence
  Synthetic
gttgccgtctgcaataactacttgcatgaaaactacccaacggtagcgtcctaccagattactgatgaatacgac

SEQ ID NO: 328644 - DNA, 75 bp, Artificial Sequence
  Synthetic
gcttacctcgatatggtggatgggactgtcgcttgcctggacaccgcaacattctgcccggctaaactcagaagt

SEQ ID NO: 328645 - DNA, 75 bp, Artificial Sequence
  Synthetic
tatccaaagaggcatgagtatcgcgcaccgaatatccgtagcgcagtcccgtctgctatgcagaacacgttgcaa

SEQ ID NO: 328646 - DNA, 75 bp, Artificial Sequence
  Synthetic
aacgtgctcatcgctgcaaccaagaggaactgcaacgttacacaaatgcgtgaactaccaacgctggactcagcg

SEQ ID NO: 328647 - DNA, 75 bp, Artificial Sequence
  Synthetic
acgtttaacgtcgagtgctttaaaaaatatgcgtgcaacaatgaatactgggaagagtttgcccgtaaaccaatt

SEQ ID NO: 328648 - DNA, 75 bp, Artificial Sequence
  Synthetic
agaattaccacggagttcgttactgcgtatgtagccagactgaaaggaccaaaggcagcagccttatttgcaaag

SEQ ID NO: 328649 - DNA, 75 bp, Artificial Sequence
  Synthetic
acgtacaatttggtcccattgcaagaggtacccatggataggtttgttatggatatgaaaagagatgtgaaagtc

SEQ ID NO: 328650 - DNA, 75 bp, Artificial Sequence
  Synthetic
acaccaggtaccaagcacaccgaagagagaccaaaggtgcaggtaatccaagctgcagagccactagcgacggca

SEQ ID NO: 328651 - DNA, 75 bp, Artificial Sequence
  Synthetic
tatttgtgcggaatccatcgcgagttggtgcgtagacttacggcggtgttgctacctaacattcatacacttttt

SEQ ID NO: 328652 - DNA, 75 bp, Artificial Sequence
  Synthetic
gatatgtcagcagaggactttgacgctattatagccgaacactttaaacatggcgatccggtgctggagacagat

SEQ ID NO: 328653 - DNA, 75 bp, Artificial Sequence
  Synthetic
ctattatagccgaacactttaaacatggcgatccggtgctggagacagatattgcttcattcgataagagccaag

SEQ ID NO: 328654 - DNA, 75 bp, Artificial Sequence
  Synthetic
agaaggcaccatggatgacatcaagattagcacctcaggaccgtgtagaaggcttagctacaaaggatactttct

SEQ ID NO: 328655 - DNA, 75 bp, Artificial Sequence
  Synthetic
atgacgctatggcgttgactggcctgatgatcttggaagatctaggcgtggatcacctactactcgacttaattg

SEQ ID NO: 328656 - DNA, 75 bp, Artificial Sequence
  Synthetic
gatcacctactactcgacttaattgagtgtgcctttggtgaaatatcgtcaacacacttgcccacgggcactcgt

SEQ ID NO: 328657 - DNA, 75 bp, Artificial Sequence
  Synthetic
ttcaaatttggtgcaatgatgaaatccggaatgtttcttacattattcgttaacacagttttgaatgttgtgatc

SEQ ID NO: 328658 - DNA, 75 bp, Artificial Sequence
  Synthetic
ctcccgttcacggtaaaaaaattccttgcacagtgtacgaccgtctgaaagaaacaactgcaggctacatcacta

SEQ ID NO: 328659 - DNA, 75 bp, Artificial Sequence
  Synthetic
ccggaatgtttcttacattattcgttaacacagttttgaatgttgtgatcgcctgcagagtactagaggaaaggc

SEQ ID NO: 328660 - DNA, 75 bp, Artificial Sequence
  Synthetic
gaaacaactgcaggctacatcactatgcacaggccgggaccgcacgcttatacatcctacctggaagaatcatca

SEQ ID NO: 328661 - DNA, 75 bp, Artificial Sequence
  Synthetic
ttaagatgtcgagatgcgcggcgtttatcggcgacgataacattatacacggggtagtgtctgataaggtgatgg

SEQ ID NO: 328662 - DNA, 75 bp, Artificial Sequence
  Synthetic
gtgggacgggaaaaatatgatctacctcccgttcacggtaaaaaaattccttgcacagtgtacgaccgtctgaaa

SEQ ID NO: 328663 - DNA, 75 bp, Artificial Sequence
  Synthetic
cagctgcaagactaacgtttgctgggcgaaagcactggaaccgatactggccacggccggcatcgtacttaccgg

SEQ ID NO: 328664 - DNA, 75 bp, Artificial Sequence
  Synthetic
tcgcccacctggaacgcagaccagcgtaaaagtcccagcctcttttagcgctttccccatgtcatccgtatggac

SEQ ID NO: 328665 - DNA, 75 bp, Artificial Sequence
  Synthetic
cagagaggtgcgccacctggcttaacatggaagttaagattatcgacgccattatcggtgagagaccaccgtatt

SEQ ID NO: 328666 - DNA, 75 bp, Artificial Sequence
  Synthetic
tttgcggtggatttattctgcaagactcagtcacttccacagcgtgccgcgtggccgacccactgaaaagattat

SEQ ID NO: 328667 - DNA, 75 bp, Artificial Sequence
  Synthetic
gacctcattgcccatgtcgctgaggcagaagatgaaattggcattacaaccaaagaaggaggaaaaactgctgca

SEQ ID NO: 328668 - DNA, 75 bp, Artificial Sequence
  Synthetic
ttaagcttggtaaaccgctaccagccgacgacgagcaagacgaagatagaaggcgagctttattggacgaaacaa

SEQ ID NO: 328669 - DNA, 75 bp, Artificial Sequence
  Synthetic
caaagaaggaggaaaaactgctgcaggtcccggaggaattagtcatggaggccaaggctgctttcgaggatgctc

SEQ ID NO: 328670 - DNA, 75 bp, Artificial Sequence
  Synthetic
aggaggaagccagagcggagaagctccgagaagcactcccaccattagtggcagacaaaggcatcgaggcagccg

SEQ ID NO: 328671 - DNA, 75 bp, Artificial Sequence
  Synthetic
aggcgtggttcagagtgggcattactgatactttagcaactgctgtagcaacccggtacgaggtagataatatca

SEQ ID NO: 328672 - DNA, 75 bp, Artificial Sequence
  Synthetic
tgatactttagcaactgctgtagcaacccggtacgaggtagataatatcacacctgtcttattggcattgagaac

SEQ ID NO: 328673 - DNA, 75 bp, Artificial Sequence
  Synthetic
cggaagttgtctgcgaagtggaggggctccaggcggacattggagcagcactcgtcgaaaccccgcgcggtcatg

SEQ ID NO: 328674 - DNA, 75 bp, Artificial Sequence
  Synthetic
gtttgcccagagcaaaaattcgtttcaagccattagaggagaaataaagcaactctacggtggtcctaaatagtc

SEQ ID NO: 328675 - DNA, 75 bp, Artificial Sequence
  Synthetic
caagccattagaggagaaataaagcaactctacggtggtcctaaatagtcagcatagcatattttatctgactaa

SEQ ID NO: 328676 - DNA, 75 bp, Artificial Sequence
  Synthetic
tactgtaacacccctactatgaatagaggattctttaacatgcttggccgccgccccttcccggcccccacttct

SEQ ID NO: 328677 - DNA, 75 bp, Artificial Sequence
  Synthetic
atgtggaggccacgtagaaggaggcaggcggccccgatgcccgcccgcaacgggttggcttcccaaattcagcag

SEQ ID NO: 328678 - DNA, 75 bp, Artificial Sequence
  Synthetic
atgcagtcgaaccatacgacgctaaagtactgatgccagcaggaagtgccgtaccatggccagaattcttagcac

SEQ ID NO: 328679 - DNA, 75 bp, Artificial Sequence
  Synthetic
cttaccacagcagttagcgccttggttataggacaggcagctagacctcaacagccacgtcctcgcccgccaccc

SEQ ID NO: 328680 - DNA, 75 bp, Artificial Sequence
  Synthetic
ccgcaggcacggtacgacctggtgttcatcaatattggaactaaatacagaaaccatcactttcagcagtgcgaa

SEQ ID NO: 328681 - DNA, 75 bp, Artificial Sequence
  Synthetic
cgccaaaagaagcagccgccaaagcaattaccaaaaccgaagaaaccgaaaacacaggataagaagaagcgacag

SEQ ID NO: 328682 - DNA, 75 bp, Artificial Sequence
  Synthetic
taaccccggaggcaccctcgtggtgaagtcctacggttacgccgaccgcaacagtgaggacgtagtcaccgctct

SEQ ID NO: 328683 - DNA, 75 bp, Artificial Sequence
  Synthetic
cccgcgaagccgaaacctggaaagaggcagcgcatggcgcttaagctagaggccgacagactgtttgatgttaag

SEQ ID NO: 328684 - DNA, 75 bp, Artificial Sequence
  Synthetic
aacgagaatggtgatgtcatcggacatgctctggccatggaaggaaaagtaatgaaaccactccacgtgaaagga

SEQ ID NO: 328685 - DNA, 75 bp, Artificial Sequence
  Synthetic
actatagatcacccagtgctgtcgaagcttaaattcaccaagtcgtcggcatatgacatggagtttgcacaacta

SEQ ID NO: 328686 - DNA, 75 bp, Artificial Sequence
  Synthetic
actgtcatgtcctcggaggttttgccttccaccaaccaagagtacattacctgcaaattcaccactgtggtcccc

SEQ ID NO: 328687 - DNA, 75 bp, Artificial Sequence
  Synthetic
cctgtcaatatgcgaagcgaagctttcacgtacaccagcgagcacccagaaggattctataactggcaccatggc

SEQ ID NO: 328688 - DNA, 75 bp, Artificial Sequence
  Synthetic
gcagtgcagtatagtggaggtagattcactattccgcgtggagtaggaggcagaggtgacagcggccgcccgatt

SEQ ID NO: 328689 - DNA, 75 bp, Artificial Sequence
  Synthetic
attcggttatgctcaacggatgccacaaagccgtagaagtgctgtatgttgacgaagcgttcgcgtgccacgcag

SEQ ID NO: 328690 - DNA, 75 bp, Artificial Sequence
  Synthetic
catccagaggcagaagccctgaaattgctgcaaaacgcctaccatgcagtggcagacttggtaaatgaacacaat

SEQ ID NO: 328691 - DNA, 75 bp, Artificial Sequence
  Synthetic
atggacaacgcaggccgcgtcgtcgctatcgtcctcggaggagctgatgagggaacacgtactgccctctcggta

SEQ ID NO: 328692 - DNA, 75 bp, Artificial Sequence
  Synthetic
tgagaacagccagatgagtgaggcgtacgtcgaattgtcagcagattgcgcgtctgaccacgcgcaggcgattaa

SEQ ID NO: 328693 - DNA, 75 bp, Artificial Sequence
  Synthetic
gttacctggaacagtaaaggaaaaacgattaagacatcccctgagggaactgaagagtggtccgcagcaccgctg

SEQ ID NO: 328694 - DNA, 75 bp, Artificial Sequence
  Synthetic
gttacggccatgtgcttacttggaaatgtaagcttcccttgcaaccgtccgcctacttgctacacccgcgaacca

SEQ ID NO: 328695 - DNA, 75 bp, Artificial Sequence
  Synthetic
cactttgctcgacgctatactgcgatgcgatttttccggtagaaataaaagaagtgttaccggcgactttacctt

SEQ ID NO: 328696 - DNA, 75 bp, Artificial Sequence
  Synthetic
gaccagcccgtacctaggtacatgtccatactgtcaccataccgagccgtgctttagtccgataaagatcgagca

SEQ ID NO: 328697 - DNA, 75 bp, Artificial Sequence
  Synthetic
ggtctgggatgaaccggatgacaccactatacgcatccagacctctgcccaatttgggtacgatcagagtggagc

SEQ ID NO: 328698 - DNA, 75 bp, Artificial Sequence
  Synthetic
gacaagcgtaaataaataccgctacatgtcgttcgatcaggatcatactgtgaaagaaggccagatggacgatat

SEQ ID NO: 328699 - DNA, 75 bp, Artificial Sequence
  Synthetic
taagatcagtacttcaggaccgtgcagaagacttggccataaaggttacttcctccttgcgaaatgtccgcccgg

SEQ ID NO: 328700 - DNA, 75 bp, Artificial Sequence
  Synthetic
atcccgaacgctgcctttatcaggacatcagatgcaccactggtctcaacagtcaaatgtgaagtcagtgagtgc

SEQ ID NO: 328701 - DNA, 75 bp, Artificial Sequence
  Synthetic
gactgggaagctgaacacaagggaataattgctgcaataaacagccccgctccccgtaccaatccgttcagctgc

SEQ ID NO: 328702 - DNA, 75 bp, Artificial Sequence
  Synthetic
gtttgtgggacgggaacggtatgatctgccccccgtttacggaaagaacatcccttgcagaatgtacgaccgtct

SEQ ID NO: 328703 - DNA, 75 bp, Artificial Sequence
  Synthetic
gaaagaaacgtctgctggctatattactatgcacagacctggcccacatgcctacacgtcctatctggaggaagc

SEQ ID NO: 328704 - DNA, 75 bp, Artificial Sequence
  Synthetic
cctacacgtcctatctggaggaagcgtccggaaaaatttacgctaagccaccatccggaaagaatattacctacg

SEQ ID NO: 328705 - DNA, 75 bp, Artificial Sequence
  Synthetic
gacaacatgcaatgcagaatgtaaaccaccagctgaccatatcgtgagcaccccgcacaaaaatgaccaagaatt

SEQ ID NO: 328706 - DNA, 75 bp, Artificial Sequence
  Synthetic
agtgtaaatgcggagactataaaacaggaacggtaaaaacccgcactgaaattactggctgcactgccattaagc

SEQ ID NO: 328707 - DNA, 75 bp, Artificial Sequence
  Synthetic
agtgtgtcgcttataagagcgaccaaacgaagtgggtctttaactcacccgacctgataaggcatgccgatcacg

SEQ ID NO: 328708 - DNA, 75 bp, Artificial Sequence
  Synthetic
ctgcacaaggaaagttgcatttaccttttagattggtcccgagttcctgcaaggtcccagtggctcacgcaccga

SEQ ID NO: 328709 - DNA, 75 bp, Artificial Sequence
  Synthetic
gtgtagtgcacggcttcaaacacattagcctccaactggatacggaccacctgacactgctcaccaccaggagac

SEQ ID NO: 328710 - DNA, 75 bp, Artificial Sequence
  Synthetic
taggagcgaaccccgaaccaacctccgaatggattatcggtaagactgttagaaatttttctgttggacgggacg

SEQ ID NO: 328711 - DNA, 75 bp, Artificial Sequence
  Synthetic
gcttggagtatacgtggggcaaccacgacccggtaagagtttacgcccaagaatcagcgcctggcgatccccatg

SEQ ID NO: 328712 - DNA, 75 bp, Artificial Sequence
  Synthetic
cgacccggtaagagtttacgcccaagaatcagcgcctggcgatccccatggatggcctcatgagataatacagca

SEQ ID NO: 328713 - DNA, 75 bp, Artificial Sequence
  Synthetic
ttactatcaccgccatcctgcgtataccatcctaaccgttgtctcagctgccgttgcagtgcttatcggcttgac

SEQ ID NO: 328714 - DNA, 75 bp, Artificial Sequence
  Synthetic
cgttgcagcactgtgtacgtgtaaagcgcgacgtgaatgtttaacaccgtatgccctagccccgaatgccgttgt

SEQ ID NO: 328715 - DNA, 75 bp, Artificial Sequence
  Synthetic
aaatttgtcagagtgtctgcagcgaggccagagtgtgtctcaagcaatacagaaatgtacctgattttccgacaa

SEQ ID NO: 328716 - DNA, 75 bp, Artificial Sequence
  Synthetic
tccgacttcgatagcgctcctatgttgcattagatcggctaacgctgaaacattttctgagacgatgagctacct

SEQ ID NO: 328717 - DNA, 75 bp, Artificial Sequence
  Synthetic
gtggtcaaacagtcagccgttcttttgggctcagttgtgtatccccttagccgctgttgtcatccttgtgcgttg

SEQ ID NO: 328718 - DNA, 75 bp, Artificial Sequence
  Synthetic
ccacccagttcatgttttcggctatggcaggttcgtaccccgcgtacaacactaactgggccgacgagaaagtcc

SEQ ID NO: 328719 - DNA, 75 bp, Artificial Sequence
  Synthetic
ctgttcatgttgcttgccttttttagtggttgccggcgtctacctggggaaggtagacgcctacgaacatgcgac

SEQ ID NO: 328720 - DNA, 75 bp, Artificial Sequence
  Synthetic
caccattccaaatgtgccgaagattccgtataaagcacttgtagaacggtctggctacgccccgcttaacttaga

SEQ ID NO: 328721 - DNA, 75 bp, Artificial Sequence
  Synthetic
gatcaccgtcgtgtcgtcgcaggttttaccatctactaatcaagagtatatcacctgcaagtttactactgtagt

SEQ ID NO: 328722 - DNA, 75 bp, Artificial Sequence
  Synthetic
cccctccccgaaagtcaaatgttgcggctccttggaatgtcagcccgccgctcacgccgactataactgcaaagt

SEQ ID NO: 328723 - DNA, 75 bp, Artificial Sequence
  Synthetic
ttttggaggggtttacccattcatgtggggaggagcacagtgtttttgcgacagcgagaacacccagatgagcga

SEQ ID NO: 328724 - DNA, 75 bp, Artificial Sequence
  Synthetic
ggcgtacgtcaaactgtcagcggactgcgtaacggattacgcacaggcagttaatgtgcatactgctgcaatgaa

SEQ ID NO: 328725 - DNA, 75 bp, Artificial Sequence
  Synthetic
ggtaggactacgtatagtgtatgggaataccaccagctatttagatgtgtacgtgaatggagtcacgccggggac

SEQ ID NO: 328726 - DNA, 75 bp, Artificial Sequence
  Synthetic
atccaaagatctaaaagtcatagctgggccagtttcgtcctcctttacgccgtttaatcataaggttgtcatcta

SEQ ID NO: 328727 - DNA, 75 bp, Artificial Sequence
  Synthetic
aaggcaccaaattccatcaagcagcaaaggatatggcggagataaaggtcctgttcccaaatgaccaggaaagca

SEQ ID NO: 328728 - DNA, 75 bp, Artificial Sequence
  Synthetic
ccgtggtttagtctataattatgacttccctgaatacggcgcaatgaaacctggagtgttcggagacatccaagc

SEQ ID NO: 328729 - DNA, 75 bp, Artificial Sequence
  Synthetic
tacctccttgaccagtagagaccttattgcaagcacggacattagattgcttaagccttccgttaaaaacgtgca

SEQ ID NO: 328730 - DNA, 75 bp, Artificial Sequence
  Synthetic
gcgggatccaccgggagttagtgcgcaggcttacagccgtcttgttacccaacattcacacgctttttgacatgt

SEQ ID NO: 328731 - DNA, 75 bp, Artificial Sequence
  Synthetic
ttaagccttccgttaaaaacgtgcacgtcccgtacacgcaagctgcttcaggattcgagatgtggaagaacaact

SEQ ID NO: 328732 - DNA, 75 bp, Artificial Sequence
  Synthetic
gcggcctcccaagggctaactagaaaaggagtgtatgccgtccggcaaaaagtcaatgaaaacgccctgtacgcg

SEQ ID NO: 328733 - DNA, 75 bp, Artificial Sequence
  Synthetic
caggtcgaccactgcaggaaaccgctccttttgggtgtaagattgcagtcaacccgctacgagcggtggactgtt

SEQ ID NO: 328734 - DNA, 75 bp, Artificial Sequence
  Synthetic
cgtacggtaatattcctatctccatcgatatcccaaatgccgccttcattaggatatcggatgcgccgctagttt

SEQ ID NO: 328735 - DNA, 75 bp, Artificial Sequence
  Synthetic
cgatatcccaaatgccgccttcattaggatatcggatgcgccgctagtttcgacggttaaatgtgaggtcagcgg

SEQ ID NO: 328736 - DNA, 75 bp, Artificial Sequence
  Synthetic
aggttcagtgcacgaaagtagtcctgtttaacccgcatacccccgcattcgttcccgcccgtaagtacatagaag

SEQ ID NO: 328737 - DNA, 75 bp, Artificial Sequence
  Synthetic
atgtacctattcagctgattttggtggtatggcaaccctgcagtatgtgtcggaccgcgaaggacaatgccccgt

SEQ ID NO: 328738 - DNA, 75 bp, Artificial Sequence
  Synthetic
gcactctcactcaagcacagcaacacttcaggaatcgacagtgcatgtcctggagaaaggggcggtgaccgtgca

SEQ ID NO: 328739 - DNA, 75 bp, Artificial Sequence
  Synthetic
cacggacatctcactggacatggatgacagtagcgaaggctcacttttttcgagctttagcggatcggacaattc

SEQ ID NO: 328740 - DNA, 75 bp, Artificial Sequence
  Synthetic
ctttagtaccgccagcccacaggctaatttcattatatcgctgtgtggcaagaaaacaacatgcaacgcggaatg

SEQ ID NO: 328741 - DNA, 75 bp, Artificial Sequence
  Synthetic
taagccacctgcggaccacattgtgagtacaccgcacaaaatcgatcaggagttccaaaccgctatttcaaaaac

SEQ ID NO: 328742 - DNA, 75 bp, Artificial Sequence
  Synthetic
atcatggagctggttactggcactctttggcggcgcctcgtcgctattaattataggactcatgatttttacttg

SEQ ID NO: 328743 - DNA, 75 bp, Artificial Sequence
  Synthetic
ccaccggcaagtactagctctgcggacgagtccctccacctttcttttggtggggtatccatgtccttcggatca

SEQ ID NO: 328744 - DNA, 75 bp, Artificial Sequence
  Synthetic
ttataggactcatgatttttacttgcagcatgttgctgacaagcacccggagatgaccgctatgtcccaatgacc

SEQ ID NO: 328745 - DNA, 75 bp, Artificial Sequence
  Synthetic
cttctcgacggagagatggcccgcttggcagcggcgcaaccccccgctacaggccctacggatgtgcctatgtct

SEQ ID NO: 328746 - DNA, 75 bp, Artificial Sequence
  Synthetic
cgaccagcaaaactcgacgtatttccgaggaactgatgtgcataatgcatcaggctggtatattagatccccgct

SEQ ID NO: 328747 - DNA, 75 bp, Artificial Sequence
  Synthetic
acgtccatgccgtccaagagcctgcccctattccaccgccaaggctaaagaagatggcccgcctggcagcggcaa

SEQ ID NO: 328748 - DNA, 75 bp, Artificial Sequence
  Synthetic
catcgcgggcactatagcaacaatgaaactcgatgtatttccgaggaagcgcagtgcataatgctgcgccgtgtt

SEQ ID NO: 328749 - DNA, 75 bp, Artificial Sequence
  Synthetic
gccatataatcattttattaatcaactatttagcagacgctaaaactcaatgtatttctgaggaagcgtggtgca

SEQ ID NO: 328750 - DNA, 75 bp, Artificial Sequence
  Synthetic
aatactgactaaccggggtaggtgggtacatattttcgacggacacaggccctgggcacttgcaaatgaagtccg

SEQ ID NO: 328751 - DNA, 75 bp, Artificial Sequence
  Synthetic
gccctacggatgtgcctatgtctttcggatcgttttccgacggagagattgaggagctgagccgcagagtaaccg

SEQ ID NO: 328752 - DNA, 75 bp, Artificial Sequence
  Synthetic
attgacggcgtagtacacactattgaatcaaacagccgaccaattgcactaccatcacaatggagaagccagtag

SEQ ID NO: 328753 - DNA, 75 bp, Artificial Sequence
  Synthetic
aatgccatgcagcgtctgtataatttcttttattattcttttatcaattaaccaaaattttgtttttaacatttc

SEQ ID NO: 328754 - DNA, 75 bp, Artificial Sequence
  Synthetic
agcttcccgcaatttgaggtagtagcacagcaggtcactccaaatgaccatgctaatgccagagcattttcgcat

SEQ ID NO: 328755 - DNA, 75 bp, Artificial Sequence
  Synthetic
ctggccagtaaactaatcgagctggaggttcctaccacagcgacgatcttggacataggcagcgcaccggctcgt

SEQ ID NO: 328756 - DNA, 75 bp, Artificial Sequence
  Synthetic
ctacgactgtataactctgccacagatcagccagaatgctataagatcacctacccgaaaccatcgtattccagc

SEQ ID NO: 328757 - DNA, 75 bp, Artificial Sequence
  Synthetic
agaatgttttccgagcaccagtatcattgtgtctgccccatgcgtagtccagaagacccggaccgcatgatgaaa

SEQ ID NO: 328758 - DNA, 75 bp, Artificial Sequence
  Synthetic
agaagacccggaccgcatgatgaaatatgccagtaaactggcggaaaaagcgtgcaagattacaaacaagaactt

SEQ ID NO: 328759 - DNA, 75 bp, Artificial Sequence
  Synthetic
caactatctgcatgagaactacccgacggtagcatcttatcagattaccgacgagtacgatgcttatttggatat

SEQ ID NO: 328760 - DNA, 75 bp, Artificial Sequence
  Synthetic
gcatgagaagattaaggatctccggaccgtacttgatacgccggatgctgaaacaccatcgctctgctttcacaa

SEQ ID NO: 328761 - DNA, 75 bp, Artificial Sequence
  Synthetic
cgatgttacctgcaacatgcgtgccgaatattccgtcatgcaggacgtgtatatcaacgctcccggaactatcta

SEQ ID NO: 328762 - DNA, 75 bp, Artificial Sequence
  Synthetic
gaatattccgtcatgcaggacgtgtatatcaacgctcccggaactatctatcatcaggctatgaaaggcgtgcgg

SEQ ID NO: 328763 - DNA, 75 bp, Artificial Sequence
  Synthetic
agtgcggttccatcagcgatgcagaacacgttgcaaaatgtgctcattgccgcgactaaaagaaactgcaacgtc

SEQ ID NO: 328764 - DNA, 75 bp, Artificial Sequence
  Synthetic
accctgtactggattggcttcgacaccacccagttcatgttctcggctatggcaggttcgtaccctgcgtacaac

SEQ ID NO: 328765 - DNA, 75 bp, Artificial Sequence
  Synthetic
accaactgggccgacgagaaagtccttgaagcgcgtaacatcggactttgcagcacaaagctgagtgaaggtagg

SEQ ID NO: 328766 - DNA, 75 bp, Artificial Sequence
  Synthetic
acaggaaaattgtcgataatgaggaagaaggagttgaagcccgggtcgcgggtttatttctccgtaggatcgaca

SEQ ID NO: 328767 - DNA, 75 bp, Artificial Sequence
  Synthetic
ctttatccagaacacagagccagcttgcagagctggcatcttccatcggtgttccacttgaatggaaagcagtcg

SEQ ID NO: 328768 - DNA, 75 bp, Artificial Sequence
  Synthetic
tgcagagctggcatcttccatcggtgttccacttgaatggaaagcagtcgtacacttgccgctgtgatacagtgg

SEQ ID NO: 328769 - DNA, 75 bp, Artificial Sequence
  Synthetic
gaaaatcaccatcagtcccgggatcacgggagaaaccgtgggatacgcggttacacacaatagcgagggcttctt

SEQ ID NO: 328770 - DNA, 75 bp, Artificial Sequence
  Synthetic
gctatgcaaagttactgacacagtaaaaggagaacgggtatcgttccctgtgtgcacgtacatcccggccaccat

SEQ ID NO: 328771 - DNA, 75 bp, Artificial Sequence
  Synthetic
agtgatacaagccgcagaacccctggcgactgcttacctatgcgggatccaccgggagttagtgcgcaggcttac

SEQ ID NO: 328772 - DNA, 75 bp, Artificial Sequence
  Synthetic
acacgctttttgacatgtcggcggaggactttgatgcaatcatagcagaacacttcaagcaaggtgacccggtac

SEQ ID NO: 328773 - DNA, 75 bp, Artificial Sequence
  Synthetic
atgcgatcagatgactggtataatggccacggatatatcacctgacgatgcacaaaaacttctggttgggctcaa

SEQ ID NO: 328774 - DNA, 75 bp, Artificial Sequence
  Synthetic
aggcaccatggatgacatcaagatcagcacctcaggaccgtgtagaaggcttagctacaaaggatactttctcct

SEQ ID NO: 328775 - DNA, 75 bp, Artificial Sequence
  Synthetic
actaacaggaacaccaacaccatgcaaaattaccttctgccgatcatagcacaagggttcagcaaatgggctaag

SEQ ID NO: 328776 - DNA, 75 bp, Artificial Sequence
  Synthetic
agcacctcaggaccgtgtagaaggcttagctacaaaggatactttctcctcgcgaaatgccctccaggggacagc

SEQ ID NO: 328777 - DNA, 75 bp, Artificial Sequence
  Synthetic
gaaatatcatccacccatttgcccacgggtacccgtttcaaattcggggcgatgatgaaatccggaatgttcctc

SEQ ID NO: 328778 - DNA, 75 bp, Artificial Sequence
  Synthetic
gagcgcaaggatgatcttgataacgagaaaatgctgggtactagagaacgcaagcttacgtatggctgcttgtgg

SEQ ID NO: 328779 - DNA, 75 bp, Artificial Sequence
  Synthetic
gcgtttcgcactaagaaagtacattcgttttatcgcccacctggaacgcagacctgcgtaaaagtcccagcctct

SEQ ID NO: 328780 - DNA, 75 bp, Artificial Sequence
  Synthetic
tttagcgcttttcccatgtcgtccgtatggacgacctctttgcccatgtcgctgaggcagaaattgaaactggca

SEQ ID NO: 328781 - DNA, 75 bp, Artificial Sequence
  Synthetic
ttgcaaccaaagaaggaggaaaaactgctgcaggtctcggaggaattagtcatggaggccaaggctgcttttgag

SEQ ID NO: 328782 - DNA, 75 bp, Artificial Sequence
  Synthetic
tgctgcaggtctcggaggaattagtcatggaggccaaggctgcttttgaggatgctcaggaggaagccagagcgg

SEQ ID NO: 328783 - DNA, 75 bp, Artificial Sequence
  Synthetic
agaagctccgagaagcacttccaccattagtggcagacaaaggcatcgaggcagccgcagaagttgtctgcgaag

SEQ ID NO: 328784 - DNA, 75 bp, Artificial Sequence
  Synthetic
tggaggggctccaggcggacatcggagcagcattagttgaaaccccgcgcggtcacgtaaggataatacctcaag

SEQ ID NO: 328785 - DNA, 75 bp, Artificial Sequence
  Synthetic
caaatgaccgtatgatcggacagtatatcgttgtctcgccaaactctgtgctgaagaatgccaaactcgcaccag

SEQ ID NO: 328786 - DNA, 75 bp, Artificial Sequence
  Synthetic
cgcacccgctagcagatcaggttaagatcataacacactccggaagatcaggaaggtacgcggtcgaaccatacg

SEQ ID NO: 328787 - DNA, 75 bp, Artificial Sequence
  Synthetic
acgctaaagtactgatgccagcaggaggtgccgtaccatggccagaattcctagcactgagtgagagcgccacgt

SEQ ID NO: 328788 - DNA, 75 bp, Artificial Sequence
  Synthetic
tagtgtacaacgaaagagagtttgtgaaccgcaaactataccacattgccatgcatggccccgccaagaatacag

SEQ ID NO: 328789 - DNA, 75 bp, Artificial Sequence
  Synthetic
aagaggagcagtacaaggttacaaaggcagagcttgcagaaacagagtacgtgtttgacgtggacaagaagcgtt

SEQ ID NO: 328790 - DNA, 75 bp, Artificial Sequence
  Synthetic
gcccgccgccgcgccagaagaagcaggcgccaaagcaaccaccgaagccgaagaaaccaaaaccacaggagaaga

SEQ ID NO: 328791 - DNA, 75 bp, Artificial Sequence
  Synthetic
gcgttaagaaggaagaagcctcaggtctggtcctctcgggagaactgaccaaccctccctatcatgagctagctc

SEQ ID NO: 328792 - DNA, 75 bp, Artificial Sequence
  Synthetic
agaagaagcaacccgcaaaaaccaaacccggaaagagacagcgtatggcacttaagttggaggccgacagattgt

SEQ ID NO: 328793 - DNA, 75 bp, Artificial Sequence
  Synthetic
acccggaaagagacagcgtatggcacttaagttggaggccgacagattgttcgacgtcaaaaatgaggacggaga

SEQ ID NO: 328794 - DNA, 75 bp, Artificial Sequence
  Synthetic
tggagggactgaagacccgacctgcggtcccgtacaaggtcgaaacaataggagtgataggcacaccggggtcgg

SEQ ID NO: 328795 - DNA, 75 bp, Artificial Sequence
  Synthetic
acgtgtacatcaacgctcccggaactatctaccatcaggctatgaaaggcgtgcggactctgtactggattggct

SEQ ID NO: 328796 - DNA, 75 bp, Artificial Sequence
  Synthetic
gcaagtcagctattatcaagtcaactgtcacggcacgagatcttgttaccagcggaaagaaagaaaattgtcgcg

SEQ ID NO: 328797 - DNA, 75 bp, Artificial Sequence
  Synthetic
aaattgaggccgacgtgctaagactgaggggtatgcagattacgtcgaagacagtagattcggttatgctcaacg

SEQ ID NO: 328798 - DNA, 75 bp, Artificial Sequence
  Synthetic
gtcgtcagcatacgacatggagttcgcacagttgccggtcaacatgaggagtgaggcgttcacctacaccagcga

SEQ ID NO: 328799 - DNA, 75 bp, Artificial Sequence
  Synthetic
gagtgaggcgttcacctacaccagcgagcaccctgaaggattctataactggcaccacggtgcggtgcagtatag

SEQ ID NO: 328800 - DNA, 75 bp, Artificial Sequence
  Synthetic
gatgccacaaagccgtagaagtgctgtacgttgacgaagcgttcgcgtgccacgcaggagcactacttgccttga

SEQ ID NO: 328801 - DNA, 75 bp, Artificial Sequence
  Synthetic
ggcaccacggtgcggtgcagtatagcggaggtagatttaccatcccccgaggagtaggaggcagaggagatagcg

SEQ ID NO: 328802 - DNA, 75 bp, Artificial Sequence
  Synthetic
ttgctatcgtcaggccccgcaagaaggtagtactatgcggagaccccatgcaatgcggattcttcaacatgatgc

SEQ ID NO: 328803 - DNA, 75 bp, Artificial Sequence
  Synthetic
gacgtccgatcatggataactcaggtcgggttgtcgcgatagtcctcggaggggctgatgagggaacacgaactg

SEQ ID NO: 328804 - DNA, 75 bp, Artificial Sequence
  Synthetic
aactaaaggtacatttcaatcaccctgaaaaagacatatgcaccaagacattctacaagtatatctcccggcgtt

SEQ ID NO: 328805 - DNA, 75 bp, Artificial Sequence
  Synthetic
ccctttcggtcgtcacctggaatagcaaagggaagacaatcaagacaactccggaagggacagaagagtggtctg

SEQ ID NO: 328806 - DNA, 75 bp, Artificial Sequence
  Synthetic
gcacacagccagttacagctattgtatcgacactgcattacgatggaaagatgaaaaccacgaacccgtgcaaga

SEQ ID NO: 328807 - DNA, 75 bp, Artificial Sequence
  Synthetic
gaacagccagatgagtgaggcgtacgtcgaattgtcagcagattgcgcgactgaccacgcgcaggcgattaaggt

SEQ ID NO: 328808 - DNA, 75 bp, Artificial Sequence
  Synthetic
agaacattgaaatcgatattacaggggccacaaagccgaagccaggggatatcatcctgacatgtttccgcgggt

SEQ ID NO: 328809 - DNA, 75 bp, Artificial Sequence
  Synthetic
gggttaagcaattgcaaatcgactatcccggacatgaagtaatgacagccgcggcctcacaagggctaaccagaa

SEQ ID NO: 328810 - DNA, 75 bp, Artificial Sequence
  Synthetic
tcccggacatgaagtaatgacagccgcggcctcacaagggctaaccagaaaaggagtgtatgccgtccggcaaaa

SEQ ID NO: 328811 - DNA, 75 bp, Artificial Sequence
  Synthetic
agtcaatgaaaacccactgtacgcgatcacatcagagcatgtgaacgtgttgctcacccgcactgaggacaggct

SEQ ID NO: 328812 - DNA, 75 bp, Artificial Sequence
  Synthetic
aagatcgagcaggtctgggatgaagcggacgacaacaccatacgcattcagacttccgcccagtttggatacgac

SEQ ID NO: 328813 - DNA, 75 bp, Artificial Sequence
  Synthetic
agtgtggaaaaccttgcagggcgacccatggattaagcagctcactaacatacctaaaggaaactttcaggctac

SEQ ID NO: 328814 - DNA, 75 bp, Artificial Sequence
  Synthetic
aaaagcggagcagcaagcacaaataagtaccgctacatgtcattcgagcaggatcataccgttaaagaaggcacc

SEQ ID NO: 328815 - DNA, 75 bp, Artificial Sequence
  Synthetic
tatagaggactgggaagctgaacacaagggaataattgctgcaataaacagccccactccccgtgccaatccgtt

SEQ ID NO: 328816 - DNA, 75 bp, Artificial Sequence
  Synthetic
cagctgcaagaccaacgtttgctgggcgaaagcattggaaccgatactagccacggccggtatcgtacttaccgg

SEQ ID NO: 328817 - DNA, 75 bp, Artificial Sequence
  Synthetic
ttgccagtggagcgaactgttcccacagtttgcggatgacaaaccacattcggccatttacgccttagacgtaat

SEQ ID NO: 328818 - DNA, 75 bp, Artificial Sequence
  Synthetic
ttgcattaagtttttcggcatggacttgacaagcggactgttttctaaacagagcatcccactaacgtaccatcc

SEQ ID NO: 328819 - DNA, 75 bp, Artificial Sequence
  Synthetic
agagcatcccactaacgtaccatcccgccgattcagcgaggccggtagctcattgggacaacagcccaggaaccc

SEQ ID NO: 328820 - DNA, 75 bp, Artificial Sequence
  Synthetic
gcaagtatgggtacgatcacgccattgccgccgaactctcccgtagatttccggtgttccagctagctgggaagg

SEQ ID NO: 328821 - DNA, 75 bp, Artificial Sequence
  Synthetic
gcacacaacttgatttgcagacggggagaaccagagttatctctgcacagcataacctggtcccggtgaaccgca

SEQ ID NO: 328822 - DNA, 75 bp, Artificial Sequence
  Synthetic
atcttcctcacgccttagtccccgagtacaaggagaagcaacccggcccggtcgaaaaattcttgaaccagttca

SEQ ID NO: 328823 - DNA, 75 bp, Artificial Sequence
  Synthetic
gtcgaaaaattcttgaaccagttcaaacaccactcagtacttgtggtatcagaggaaaaaattgaagctccccgt

SEQ ID NO: 328824 - DNA, 75 bp, Artificial Sequence
  Synthetic
cgagtacctgcatggtccctgttgcccacgcgccgaacgtaatacacggctttaaacacatcagcctccaattag

SEQ ID NO: 328825 - DNA, 75 bp, Artificial Sequence
  Synthetic
aagagaatcgaatggatcgccccgattggcatagccggtgcagataagaactacaacctggctttcgggtttccg

SEQ ID NO: 328826 - DNA, 75 bp, Artificial Sequence
  Synthetic
ccgcaggcacggtacgacctggtgttcatcaacattggaactaaatacagaaaccaccactttcagcagtgcgaa

SEQ ID NO: 328827 - DNA, 75 bp, Artificial Sequence
  Synthetic
gaccatgcggcgaccttaaaaaccctttcgcgttcggccctgaattgccttaacccaggaggcaccctcgtggtg

SEQ ID NO: 328828 - DNA, 75 bp, Artificial Sequence
  Synthetic
tatcactatattaaccatttatttagcggacgccgaaactcaatgtatttctgaggaagcatggtgcataatgcc

SEQ ID NO: 328829 - DNA, 75 bp, Artificial Sequence
  Synthetic
aagtcctatggctacgccgaccgcaacagtgaggacgtagtcaccgctcttgccagaaagtttgtcagggtgtct

SEQ ID NO: 328830 - DNA, 75 bp, Artificial Sequence
  Synthetic
gcagcgagaccagattgtgtctcaagcaatacagaaatgtacctgattttccgacaactagacaacagccgtaca

SEQ ID NO: 328831 - DNA, 75 bp, Artificial Sequence
  Synthetic
tacccttggccgctgtcatcgtcctaatgcgctgttgctcctgctgcctgccttttttagtggttgccggcgcct

SEQ ID NO: 328832 - DNA, 75 bp, Artificial Sequence
  Synthetic
cggcaattcaccccgcaccatctgaattgcgtgatttcgtccgtgtatgagggtacaagagatggagttggagcc

SEQ ID NO: 328833 - DNA, 75 bp, Artificial Sequence
  Synthetic
gcgccgtcataccgcaccaaaagggagaatattgctgactgtcaagaggaagcagttgtcaacgcagccaatccg

SEQ ID NO: 328834 - DNA, 75 bp, Artificial Sequence
  Synthetic
ctgggtagaccaggcgaaggagtctgccgtgccatctataaacgttggccgaccagttttaccgattcagccacg

SEQ ID NO: 328835 - DNA, 75 bp, Artificial Sequence
  Synthetic
gagacaggcaccgcaagaatgactgtgtgcctaggaaagaaagtgatccacgcggtcggccctgatttccggaag

SEQ ID NO: 328836 - DNA, 75 bp, Artificial Sequence
  Synthetic
cacccagaagcagaagccttgaaattgctacaaaacgcctaccatgcagtggcagacttagtaaatgaacataac

SEQ ID NO: 328837 - DNA, 75 bp, Artificial Sequence
  Synthetic
atcaagtctgtcgccattccactgctatctacaggcatttacgcagccggaaaagaccgccttgaagtatcactt

SEQ ID NO: 328838 - DNA, 75 bp, Artificial Sequence
  Synthetic
tatctacaggcatttacgcagccggaaaagaccgccttgaagtatcacttaactgcttgacaaccgcgctagaca

SEQ ID NO: 328839 - DNA, 75 bp, Artificial Sequence
  Synthetic
tcaaatgctgcggctccttggaatgtcagcccgccgctcacgcagactatacctgcaaggtctttggaggggtgt

SEQ ID NO: 328840 - DNA, 75 bp, Artificial Sequence
  Synthetic
gaactgacgcggacgtaaccatctattgcctggataagaagtggaaggaaagaatcgacgcggcactccaactta

SEQ ID NO: 328841 - DNA, 75 bp, Artificial Sequence
  Synthetic
aggagtctgtaacagagctgaaggatgaagatatggagatcgacgatgagttagtatggatccatccagacagtt

SEQ ID NO: 328842 - DNA, 75 bp, Artificial Sequence
  Synthetic
gcttgaagggaagaaagggattcagtactacaaaaggaaaattgtattcgtacttcgaaggcaccaaattccatc

SEQ ID NO: 328843 - DNA, 75 bp, Artificial Sequence
  Synthetic
aagcagcaaaagacatggcggagataaaggtcctgttccctaatgaccaggaaagtaatgaacaactgtgtgcct

SEQ ID NO: 328844 - DNA, 75 bp, Artificial Sequence
  Synthetic
acatattgggtgagaccatggaagcaatccgcgaaaagtgcccggtcgaccataacccgtcgtctagcccgccca

SEQ ID NO: 328845 - DNA, 75 bp, Artificial Sequence
  Synthetic
aatccgcgaaaagtgcccggtcgaccataacccgtcgtctagcccgcccaaaacgttgccgtgcctttgcatgta

SEQ ID NO: 328846 - DNA, 75 bp, Artificial Sequence
  Synthetic
tgccatgacgccagaaagggtccacagacttagaagcaataacgtcaaagaagttacagtatgctcctccacccc

SEQ ID NO: 328847 - DNA, 75 bp, Artificial Sequence
  Synthetic
ccttcctaagcacaaaattaagaatgttcagaaggttcagtgcacgaaagtagtcctgtttaatccgcacactcc

SEQ ID NO: 328848 - DNA, 75 bp, Artificial Sequence
  Synthetic
cgcattcgttcccgcccgtaagtacatagaagtgccagaacagcctaccgctcctcctgcacaggccgaggaggc

SEQ ID NO: 328849 - DNA, 75 bp, Artificial Sequence
  Synthetic
cccatttctattgacatcccgaacgctgcctttatcaggacatcagatgcaccactggtctcaacagtcaaatgt

SEQ ID NO: 328850 - DNA, 75 bp, Artificial Sequence
  Synthetic
ccccgaagttgtagcgacaccgtcaccatctacagctgataacacctcgcttgatgtcacagacatctcactgga

SEQ ID NO: 328851 - DNA, 75 bp, Artificial Sequence
  Synthetic
ctgcctttatcaggacatcagatgcaccactggtctcaacagtcaaatgtgatgtcagtgagtgcacttattcag

SEQ ID NO: 328852 - DNA, 75 bp, Artificial Sequence
  Synthetic
ttgatgtcacagacatctcactggatatggatgacagtagcgaaggctcacttttttcgagctttagcggatcgg

SEQ ID NO: 328853 - DNA, 75 bp, Artificial Sequence
  Synthetic
gcacagcaaccctccaagagtcgacagttcatgtcctggagaaaggagcggtgacagtacacttcagcaccgcga

SEQ ID NO: 328854 - DNA, 75 bp, Artificial Sequence
  Synthetic
gcataatgccacgcagcgtctgcataacttttattatttcttttattaatcaacaaaattttgttttaacatttc

SEQ ID NO: 328855 - DNA, 75 bp, Artificial Sequence
  Synthetic
tggtggctgacgttcatgccgtccaagagcctgcccctattccaccgccaaggctaaagaagatggcccgcctgg

SEQ ID NO: 328856 - DNA, 75 bp, Artificial Sequence
  Synthetic
catggtgcataatgccatgcagcgtctgcacaattttttattatttcttttattaatcaacaaaattttgttttt

SEQ ID NO: 328857 - DNA, 75 bp, Artificial Sequence
  Synthetic
cagcggcaagaaaagagcccactccaccggcaagcaatagctctgagtccctccacctctcttttggtggggtat

SEQ ID NO: 328858 - DNA, 75 bp, Artificial Sequence
  Synthetic
tgccgccgaactctcccgtagatttccggtgttccagctagctggggaagggcacacaacttgatttgcagacgg

SEQ ID NO: 328859 - DNA, 75 bp, Artificial Sequence
  Synthetic
ataatgccatgcagcgtctgcacaattttttattatttcttttattaatcaacaaaattttgtttttaacatttc

SEQ ID NO: 328860 - DNA, 75 bp, Artificial Sequence
  Synthetic
ccatgtccctcggatcaattttcgacggagagacggcccgccaggcagcggtacaacccctggcaacaggcccca

SEQ ID NO: 328861 - DNA, 75 bp, Artificial Sequence
  Synthetic
cggatgtgcctatgtctttcggatcgttttccgacggagagattgatgagctgagccgcagagtaactgagtccg

SEQ ID NO: 328862 - DNA, 75 bp, Artificial Sequence
  Synthetic
aacccgtcctgtttggatcatttgaaccgggcgaagtgaactcaattatatcgtcccgatcagccgtatcttttc

SEQ ID NO: 328863 - DNA, 75 bp, Artificial Sequence
  Synthetic
accgggcgaagtgaactcaattatatcgtcccgatcagccgtatcttttcctctacgcaagcagagacgtagacg

SEQ ID NO: 328864 - DNA, 75 bp, Artificial Sequence
  Synthetic
tttcgacggacacaggccctgggcacttgcaaaagaagtccgttctgcagaaccagcttacagaaccgaccttgg

SEQ ID NO: 328865 - DNA, 75 bp, Artificial Sequence
  Synthetic
cttgcaaaagaagtccgttctgcagaaccagcttacagaaccgaccttggagcgcaatgtcctggaaagaattca

SEQ ID NO: 328866 - DNA, 75 bp, Artificial Sequence
  Synthetic
ataatgccatgcagcgtctgcataactttttattatttcttttattaatcaacaaaattttgtttttaacatttc

SEQ ID NO: 328867 - DNA, 75 bp, Artificial Sequence
  Synthetic
tgccccggtgctcgacacgtcgaaagaggaacaactcaaactcaggtaccagatgatgcccaccgaagccaacaa

SEQ ID NO: 328868 - DNA, 75 bp, Artificial Sequence
  Synthetic
aagtaggtaccagtctcgtaaagtagaaaatcagaaagccataaccactgagcgactactgtcaggactacgact

SEQ ID NO: 328869 - DNA, 75 bp, Artificial Sequence
  Synthetic
gtataactctgccacagatcagccagaatgctataagatcacctatccgaaaccattgtactccagtagcgtacc

SEQ ID NO: 328870 - DNA, 75 bp, Artificial Sequence
  Synthetic
agcatctctacggtggtcctaaatagtcagcatagtacatttcatctgactagtgctacgacaccaccaccatga

SEQ ID NO: 328871 - DNA, 75 bp, Artificial Sequence
  Synthetic
ggcgaactactccgatccacagttcgctgtagctgtctgtaacaactatctgcatgagaactatccgacagtagc

SEQ ID NO: 328872 - DNA, 75 bp, Artificial Sequence
  Synthetic
atcttatcagattactgacgagtacgatgcttacttggatatggtagacgggacagtcgcctgcctggatactgc

SEQ ID NO: 328873 - DNA, 75 bp, Artificial Sequence
  Synthetic
attagtggcagacaaaggtatcgaggcagctgcggaagttgtctgcgaagtggaggggctccaggcggacatcgg

SEQ ID NO: 328874 - DNA, 75 bp, Artificial Sequence
  Synthetic
aaccttctgccccgctaagcttagaagttacccgaaaaaacatgagtatagagccccgaatatccgcagtgcggt

SEQ ID NO: 328875 - DNA, 75 bp, Artificial Sequence
  Synthetic
tccatcagcgatgcagaacacgctacaaaatgtgctcattgccgcaactaaaagaaattgcaacgtcacgcagat

SEQ ID NO: 328876 - DNA, 75 bp, Artificial Sequence
  Synthetic
gcgtgaactgccaacactggactcagcgacattcaatgtcgaatgctttcgaaaatatgcatgtaatgacgagta

SEQ ID NO: 328877 - DNA, 75 bp, Artificial Sequence
  Synthetic
aaagaagcgtcattgacgactttaccctgaccagcccctacttgggcacatgctcgtactgccatactgaaccgt

SEQ ID NO: 328878 - DNA, 75 bp, Artificial Sequence
  Synthetic
ttgggaggagttcgctcggaagccaattaggattaccactgagtttgtcaccgcatatgtagctagactgaaagg

SEQ ID NO: 328879 - DNA, 75 bp, Artificial Sequence
  Synthetic
ccctaaggccgccgcactatttgcaaagacgtataatttggtcccattgcaagaagtgcctatggatagattcgt

SEQ ID NO: 328880 - DNA, 75 bp, Artificial Sequence
  Synthetic
agcatctctacggtggtcctaaatagtcagcatagtacatttcaccaccatgaatagaggattctttaacatgct

SEQ ID NO: 328881 - DNA, 75 bp, Artificial Sequence
  Synthetic
catggacatgaaaagagacgtgaaagttacaccaggcacgaaacacacagaagaaagaccgaaagtacaagtgat

SEQ ID NO: 328882 - DNA, 75 bp, Artificial Sequence
  Synthetic
cggccatctacgccttagacgtaatttgcattaagtttttcggcatggactcgacaagcggactgttttccaaac

SEQ ID NO: 328883 - DNA, 75 bp, Artificial Sequence
  Synthetic
gttacaccaggcacgaaacacacagaagaaagaccgaaagtacaagtgatacaagccgcagaacccctggcgact

SEQ ID NO: 328884 - DNA, 75 bp, Artificial Sequence
  Synthetic
acaagccgcagaacccctggcgactgcttacttatgcgggattcaccgggaattagtgcgtaggcttacggccgt

SEQ ID NO: 328885 - DNA, 75 bp, Artificial Sequence
  Synthetic
cttgcttccaaacattcacacgctttttgacatgtcggcggaggattttgatgcaatcatagcagaacacttcaa

SEQ ID NO: 328886 - DNA, 75 bp, Artificial Sequence
  Synthetic
gcaaggcgacccggtactggagacggatatcgcatcattcgacaaaagccaagacgacgctatggcgttaaccgg

SEQ ID NO: 328887 - DNA, 75 bp, Artificial Sequence
  Synthetic
gaacagtttcaccgattcagccacagagacaggcaccgcaaaactgactgtgtgccaaggaaagaaagtgatcca

SEQ ID NO: 328888 - DNA, 75 bp, Artificial Sequence
  Synthetic
tctgatgatcttggaggacctgggtgtggatcaaccactactcgacttgatcgagtgcgcctttggagaaatatc

SEQ ID NO: 328889 - DNA, 75 bp, Artificial Sequence
  Synthetic
atccacccatctacctacgggtactcgttttaaattcggggcgatgatgaaatccggaatgttcctcacactttt

SEQ ID NO: 328890 - DNA, 75 bp, Artificial Sequence
  Synthetic
tgtcaacacagttttgaatgtcgttatcgccagcagagtactagaagagcggcttaaaacgtccagatgtgcagc

SEQ ID NO: 328891 - DNA, 75 bp, Artificial Sequence
  Synthetic
gttcattggcgacgacaacatcatacatggagtagtatctgacaaagaaatggctgagaggtgcgccacctggct

SEQ ID NO: 328892 - DNA, 75 bp, Artificial Sequence
  Synthetic
caacatggaggttaagatcatcgacgcagtcatcggtgagagaccaccttacttctgcggcggatttatcttgca

SEQ ID NO: 328893 - DNA, 75 bp, Artificial Sequence
  Synthetic
acttctgcggcggatttatcttgcaagattcggttacttccacagcgtgccgcgtggcggatcccctgaaaaggc

SEQ ID NO: 328894 - DNA, 75 bp, Artificial Sequence
  Synthetic
tgtttaagttgggtaaaccgctcccagccgacgacgagcaagacgaagacagaagacgcgctctgctagatgaaa

SEQ ID NO: 328895 - DNA, 75 bp, Artificial Sequence
  Synthetic
caaaggcgtggtttagagtaggtataacaggcactttagcagtggccgtgacgacccggtatgaggtagacaata

SEQ ID NO: 328896 - DNA, 75 bp, Artificial Sequence
  Synthetic
atcccttttcgacggagagatggtccgcttggcagcggcacaacccccggcaacatgccctacggatgtgcctat

SEQ ID NO: 328897 - DNA, 75 bp, Artificial Sequence
  Synthetic
caacatgccctacggatgtgcctatgtctttcggatcgttttccgacggagagattgaggagttgatccgcagag

SEQ ID NO: 328898 - DNA, 75 bp, Artificial Sequence
  Synthetic
ttacacctgtcctactggcattgagaacttttgcccagagcaaaagagcattccaagccatcagaggggaaataa

SEQ ID NO: 328899 - DNA, 75 bp, Artificial Sequence
  Synthetic
ttccaagccatcagaggggaaataaagcatctctacggtggtcctaaatagtcagcatagtacatttcatctgac

SEQ ID NO: 328900 - DNA, 75 bp, Artificial Sequence
  Synthetic
agcatctctacggtggtcctaaatagtcagcatagtacatttcatctgactaatactacaacaccaccaccatga

SEQ ID NO: 328901 - DNA, 75 bp, Artificial Sequence
  Synthetic
gcaaaagaagcgtcattgacgactttaccctgaccagcccctacttgggcacatgctcgtactgccaccatactg

SEQ ID NO: 328902 - DNA, 75 bp, Artificial Sequence
  Synthetic
atagaggattctttaacatgctcggccgccgccccttcccggcccccactgccatgtggaggccgcggagaagga

SEQ ID NO: 328903 - DNA, 75 bp, Artificial Sequence
  Synthetic
ccgccgccccttcccggcccccactgccatgtggaggccgcggagaaggaggcaggcggccccgatgcctgcccg

SEQ ID NO: 328904 - DNA, 75 bp, Artificial Sequence
  Synthetic
caacgggctggcttctcaaatccagcaactgaccacagccgtcagtgccctagtcgttggacaggcaactagacc

SEQ ID NO: 328905 - DNA, 75 bp, Artificial Sequence
  Synthetic
cggagcagcaagcgcaaacaagtaccgctacatgtcgcttaagcaggatcacaccgttaaagaaggcaccatgga

SEQ ID NO: 328906 - DNA, 75 bp, Artificial Sequence
  Synthetic
agcaaccaccgaagccgaagaaaccaaaaacgcaggagaagaagaagaagcaacctgcaaaacccaaacccggaa

SEQ ID NO: 328907 - DNA, 75 bp, Artificial Sequence
  Synthetic
agagacagcgcatggcacttaagttggaggccgacagattgttcgacgtcaagaacgaagacggagatgtcatcg

SEQ ID NO: 328908 - DNA, 75 bp, Artificial Sequence
  Synthetic
ggcacgcactggccatggaaggaaaggtaatgaaacctctgcacgtgaaaggaaccatcgaccaccctgtgctat

SEQ ID NO: 328909 - DNA, 75 bp, Artificial Sequence
  Synthetic
caaagctcaaatttaccaagtcgtcagcatacgacatggagttcgcacagttgccagtcaacatgagaagtgagg

SEQ ID NO: 328910 - DNA, 75 bp, Artificial Sequence
  Synthetic
cattcacctacaccagtgaacaccccgaaggattctataactggcaccacggagcggtgcagtatagtggaggta

SEQ ID NO: 328911 - DNA, 75 bp, Artificial Sequence
  Synthetic
gatttaccatccctcgcggagtaggaggcagaggagacagcggtcgtccgatcatggataactccggtcgggttg

SEQ ID NO: 328912 - DNA, 75 bp, Artificial Sequence
  Synthetic
tcgcgatagtcctcggtggcgctgatgaaggaacacgaactgccctttcggtcgtcacctggaatagtaaaggga

SEQ ID NO: 328913 - DNA, 75 bp, Artificial Sequence
  Synthetic
agacaattaagacgaccccggaagggacagaagagtggtccgcagcaccactggtcacggcaatgtgtttgctcg

SEQ ID NO: 328914 - DNA, 75 bp, Artificial Sequence
  Synthetic
gaaatgtgagcttcccatgcgaccgcccgcccacatgctatacccgcgaaccttccagagccctcgacatccttg

SEQ ID NO: 328915 - DNA, 75 bp, Artificial Sequence
  Synthetic
aagagaacgtgaaccatgaggcctacgataccctgctcaatgccatattgcggtgcggatcgtctggcagaagca

SEQ ID NO: 328916 - DNA, 75 bp, Artificial Sequence
  Synthetic
cgtgcttcagccctgttaagatcgagcaggtctgggacgaagcggacgataacaccatacgcatacagacttccg

SEQ ID NO: 328917 - DNA, 75 bp, Artificial Sequence
  Synthetic
gcaggtctgggacgaagcggacgataacaccatacgcatacagacttccgcccagtttggatacgaccaaagcgg

SEQ ID NO: 328918 - DNA, 75 bp, Artificial Sequence
  Synthetic
cccagtttggatacgaccaaagcggagcagcaagcgcaaacaagtaccgctacatgtcgcttaagcaggatcaca

SEQ ID NO: 328919 - DNA, 75 bp, Artificial Sequence
  Synthetic
tacatgtcgcttaagcaggatcacaccgttaaagaaggcaccatggatgacatcaagattagcacctcaggaccg

SEQ ID NO: 328920 - DNA, 75 bp, Artificial Sequence
  Synthetic
catcaagattagcacctcaggaccgtgtagaaggcttagctacaaaggatactttctcctcgcaaaatgccctcc

SEQ ID NO: 328921 - DNA, 75 bp, Artificial Sequence
  Synthetic
aggggacagcgtaacggttagcatagtgagtagcaactcagcaacgtcatgtacactggcccgcaagataaaacc

SEQ ID NO: 328922 - DNA, 75 bp, Artificial Sequence
  Synthetic
aaaattcgtgggacgggaaaaatatgatctacctcccgttcacggtaaaaaaattccttgcacagtgtacgaccg

SEQ ID NO: 328923 - DNA, 75 bp, Artificial Sequence
  Synthetic
tctgaaagaaacaactgcaggctacatcactatgcacaggccgggaccgcacgcttatacatcctacctggaaga

SEQ ID NO: 328924 - DNA, 75 bp, Artificial Sequence
  Synthetic
atcactatgcacaggccgggaccgcacgcttatacatcctacctggaagaatcatcagggaaagtttacgcaaag

SEQ ID NO: 328925 - DNA, 75 bp, Artificial Sequence
  Synthetic
ccgccatctgggaagaacattacgtatgagtgcaagtgcggcgactacaagaccggaaccgtttcgacccgcacc

SEQ ID NO: 328926 - DNA, 75 bp, Artificial Sequence
  Synthetic
gaaatcactggttgcaccgccatcaagcagtgcgtcgcctataagagcgaccaaacgaagtgggtcttcaactca

SEQ ID NO: 328927 - DNA, 75 bp, Artificial Sequence
  Synthetic
agcagtgcgtcgcctataagagcgaccaaacgaagtgggtcttcaactcaccggacttgatcagacatgacgacc

SEQ ID NO: 328928 - DNA, 75 bp, Artificial Sequence
  Synthetic
ccaaacgaagtgggtcttcaactcaccggacttgatcagacatgacgaccacacggtccaagggaaattgcattt

SEQ ID NO: 328929 - DNA, 75 bp, Artificial Sequence
  Synthetic
acacggtccaagggaaattgcatttgcctttcaagttgatcccgagtacctgcatggtccctgttgcccacgcgc

SEQ ID NO: 328930 - DNA, 75 bp, Artificial Sequence
  Synthetic
cgaatgtaatacatggctttaaacacatcagcctccaattagatacagaccacttgacattgctcaccaccagga

SEQ ID NO: 328931 - DNA, 75 bp, Artificial Sequence
  Synthetic
cggcatagtacatacttttgaataaacagccgaccaatagcactaccatcataatggagaagcctgtagttaacg

SEQ ID NO: 328932 - DNA, 75 bp, Artificial Sequence
  Synthetic
atagctggaccaatttcagcatcgtttacgccattcgatcataaggtcgttatccatcgcggcctggtgtacaac

SEQ ID NO: 328933 - DNA, 75 bp, Artificial Sequence
  Synthetic
gactaggggcaaacccggaaccaaccactgaatggatcgtcggaaagacggtcagaaacttcaccgtcgaccgag

SEQ ID NO: 328934 - DNA, 75 bp, Artificial Sequence
  Synthetic
atggcctggaatacatatggggaaatcatgagccagtgagggtctatgcccaagagtcagcaccaggagaccctc

SEQ ID NO: 328935 - DNA, 75 bp, Artificial Sequence
  Synthetic
tgaaaccaggagcgtttggagacattcaagctacctccttgactagcaaggatctcatcgccagcacagacatta

SEQ ID NO: 328936 - DNA, 75 bp, Artificial Sequence
  Synthetic
gatctcatcgccagcacagacattaggctactcaagccttccgccaagaacgtgcatgtcccgtacacgcaggcc

SEQ ID NO: 328937 - DNA, 75 bp, Artificial Sequence
  Synthetic
acggatggccacacgaaatagtacagcattactaccatcgccatcctgtgtacaccatcttagccgtcgcatcag

SEQ ID NO: 328938 - DNA, 75 bp, Artificial Sequence
  Synthetic
ctaccgtggcgatgatgattggcgtaactgttgcagtgttatgtgcctgtaaagcgcgccgtgagtgcctgacgc

SEQ ID NO: 328939 - DNA, 75 bp, Artificial Sequence
  Synthetic
catacgccctggccccaaacgccgtaatcccaacttcgctggcactcttgtgctgcgttaggtcggccaatgctg

SEQ ID NO: 328940 - DNA, 75 bp, Artificial Sequence
  Synthetic
aaacgttcaccgagaccatgagttacttgtggtcgaacagtcagccgttcttctgggtccagttgtgcatacctt

SEQ ID NO: 328941 - DNA, 75 bp, Artificial Sequence
  Synthetic
tacctgcagtacgcgtgcagagtactccgttatgcaagatgtgtatattaacgcacctggaactatttaccatca

SEQ ID NO: 328942 - DNA, 75 bp, Artificial Sequence
  Synthetic
ttctgggtccagttgtgcatacctttggccgctttcatcgttctaatgcgctgctgctcctgctgcctgcctttt

SEQ ID NO: 328943 - DNA, 75 bp, Artificial Sequence
  Synthetic
ttagtggttgccggcgcctacctggcgaaggtagacgcctacgaacatgcgaccactgttccaaatgtgccacag

SEQ ID NO: 328944 - DNA, 75 bp, Artificial Sequence
  Synthetic
gttttgccttccaccaaccaagagtacattacctgcaaattcaccactgtggtcccctccccaaaaatcaaatgc

SEQ ID NO: 328945 - DNA, 75 bp, Artificial Sequence
  Synthetic
tgcggctccttggaatgtcagccggccgctcatgcaggctatacctgcaaggtcttcggaggggtctaccccttt

SEQ ID NO: 328946 - DNA, 75 bp, Artificial Sequence
  Synthetic
atgtggggaggagcgcaatgtttttgcgacagtgagaacagccagatgagtgaggcgtacgtcgaattgtcagca

SEQ ID NO: 328947 - DNA, 75 bp, Artificial Sequence
  Synthetic
tgaggcgtacgtcgaattgtcagcagattgcgcgtctgaccacgcgcaggcgattaaggtgcacactgccgcgat

SEQ ID NO: 328948 - DNA, 75 bp, Artificial Sequence
  Synthetic
gggaacactaccagtttcctagatgtgtacgtgaacggagtcacaccaggaacgtctaaagacttgaaagtcata

SEQ ID NO: 328949 - DNA, 75 bp, Artificial Sequence
  Synthetic
aacgtctaaagacttgaaagtcatagctggaccaatttcagcatcgtttacgccattcgatcataaggtcgttat

SEQ ID NO: 328950 - DNA, 75 bp, Artificial Sequence
  Synthetic
aacgccatattgcggtgcggatcgtccggcagaagtaaaaaaaaaagcgtcactgacgactttaccttgaccagc

SEQ ID NO: 328951 - DNA, 75 bp, Artificial Sequence
  Synthetic
aactgcttgacaaccgcgctagacagaactgacgcggacgtaaccatctactgcctggataagaagtggaaggaa

SEQ ID NO: 328952 - DNA, 75 bp, Artificial Sequence
  Synthetic
ctcatcgccagcacagacattaggctactcaagccttccgccaagaacgtgcatgtcccgtacacgcaggcctca

SEQ ID NO: 328953 - DNA, 75 bp, Artificial Sequence
  Synthetic
tcaggatttgagatgtggaaaaacaactcaggccgcccactgcaggaaaccgcacctttcgggtgtaagattgca

SEQ ID NO: 328954 - DNA, 75 bp, Artificial Sequence
  Synthetic
cgcacctttcgggtgtaagattgcagtaaatccgctccgagcggtggactgttcatacgggaacattcccatttc

SEQ ID NO: 328955 - DNA, 75 bp, Artificial Sequence
  Synthetic
atcctatctgaaggaatcatcagggaaagtttacgcgaagccaccatccgggaagaacattacgtacgagtgcaa

SEQ ID NO: 328956 - DNA, 75 bp, Artificial Sequence
  Synthetic
tgagtgcacttattcagcagacttcggcgggatggccaccctgcagtatgtatccgaccgcgaaggtcaatgccc

SEQ ID NO: 328957 - DNA, 75 bp, Artificial Sequence
  Synthetic
cgtacattcgcattcgagcacagcaactctccaagagtcgacagtacatgtcctggagaaaggagcggtgacagt

SEQ ID NO: 328958 - DNA, 75 bp, Artificial Sequence
  Synthetic
acactttagcaccgcgagtccacaggcgaactttatcgtatcgctgtgtgggaagaagacaacatgcaatgcaga

SEQ ID NO: 328959 - DNA, 75 bp, Artificial Sequence
  Synthetic
gaacgtgaaccacgaggcctacgataccctgctcaacgccatattgcggtgcggatcgtccggcagaagcaaaag

SEQ ID NO: 328960 - DNA, 75 bp, Artificial Sequence
  Synthetic
tgctcaccaccaggagactaggggcaaacccggaaccaaccactgaatggatcatcggaaagacggttagaaact

SEQ ID NO: 328961 - DNA, 75 bp, Artificial Sequence
  Synthetic
aacatcatggagttggctgtttgcccttttcggcggcgcctcgtcgctattaattataggacttatgatttttgc

SEQ ID NO: 328962 - DNA, 75 bp, Artificial Sequence
  Synthetic
cttttcggcggcgcctcgtcgctattaattataggacttatgatttttgcttgcagcatgatgctgactagcaca

SEQ ID NO: 328963 - DNA, 75 bp, Artificial Sequence
  Synthetic
aacacattcagggaggacaggaagattcgcggtggaaccgtatgacgctaaagtgctgatgccagcaggtagtgc

SEQ ID NO: 328964 - DNA, 75 bp, Artificial Sequence
  Synthetic
cgttccatggcctgagttcctggcgttgagtgaaagcgccacgctagtgtataacgaaagagaatttgtcaaccg

SEQ ID NO: 328965 - DNA, 75 bp, Artificial Sequence
  Synthetic
ttccgaggaactgatgtgcataatgcatcaggctggtacattagatccccgcttaccgcgggcaatatagcaaca

SEQ ID NO: 328966 - DNA, 75 bp, Artificial Sequence
  Synthetic
catcaggctggtacattagatccccgcttaccgcgggcaatatagcaacactaaaaactcgatgtacttccgagg

SEQ ID NO: 328967 - DNA, 75 bp, Artificial Sequence
  Synthetic
agctgtgtatacctctggccgctgtcatcgttctaatgcgctgttgctcatgctgcctgccttttttagtggttg

SEQ ID NO: 328968 - DNA, 75 bp, Artificial Sequence
  Synthetic
aagcgcagtgcataatgctgcgcagtgttgccacataaccactatattaaccatttatctagcggacgccaaaaa

SEQ ID NO: 328969 - DNA, 75 bp, Artificial Sequence
  Synthetic
tgttgccacataaccactatattaaccatttatctagcggacgccaaaaactcaatgtatttctgaggaagcgtg

SEQ ID NO: 328970 - DNA, 75 bp, Artificial Sequence
  Synthetic
ctcaatgtatttctgaggaagcgtggtgcataatgccacgcagcgtctgcataacttttattatttcttttatta

SEQ ID NO: 328971 - DNA, 75 bp, Artificial Sequence
  Synthetic
cataatgccacgcagcgtctgcataacttttattatttcttttattaatcaacaaaattttgtttttaacatttc

SEQ ID NO: 328972 - DNA, 75 bp, Artificial Sequence
  Synthetic
cctaaagtcagatgctgcggctccttggaatgtcagcccgcggctcacgcagattatacctgcaaggtctttgga

SEQ ID NO: 328973 - DNA, 75 bp, Artificial Sequence
  Synthetic
caacgggctggcttctcaaatccagcaactgaccacagccgtcagtgccctagtcattggacaggcaactagacc

SEQ ID NO: 328974 - DNA, 75 bp, Artificial Sequence
  Synthetic
tatgcagatcacgtcaaggacggtagactcagtcatgcttaacggatgtcataaagccgttgaggtgctatacgt

SEQ ID NO: 328975 - DNA, 75 bp, Artificial Sequence
  Synthetic
aaagaagcgtcattgacgactttaccctgaccagcccctacttgggcacatgctcgtactgccaccatactgaac

SEQ ID NO: 328976 - DNA, 75 bp, Artificial Sequence
  Synthetic
tgctcgtactgccaccatactgaaccgtgcttcagccctgttaagatcgagcaggtctgggacgaagcggacgat

SEQ ID NO: 328977 - DNA, 75 bp, Artificial Sequence
  Synthetic
tgatgaagcatttgcgtgccatgctggtgcgttgcttgccttgatcgctattgttagaccccgaaagaaggtagt

SEQ ID NO: 328978 - DNA, 75 bp, Artificial Sequence
  Synthetic
acgatgcacaaaaacttctggttgggctcaaccagcgaattgtcattaacggtaagactaacaggaacaccaaca

SEQ ID NO: 328979 - DNA, 75 bp, Artificial Sequence
  Synthetic
actttgcggagatcctaagcagtgtggttttttcaatatgatgcaacttaaagtacactttaatcaccctgaaaa

SEQ ID NO: 328980 - DNA, 75 bp, Artificial Sequence
  Synthetic
gggcgcaagattgcagtcaatccgcttcaggcggtggactgctcatacgggaacattcccatctctattgacatc

SEQ ID NO: 328981 - DNA, 75 bp, Artificial Sequence
  Synthetic
agaagacccggaccgcatgatgaaatatgccagtaagctggcggaaaaagcgtgcaagattacgaacaagaactt

SEQ ID NO: 328982 - DNA, 75 bp, Artificial Sequence
  Synthetic
tattcagcggacttcggcgggatggctaccctgcagtatgtatccgaccgcgaaggacaatgccctgtacattcg

SEQ ID NO: 328983 - DNA, 75 bp, Artificial Sequence
  Synthetic
gcactggaaccgatactggccacagccggtattgtccttaccggttgccagtggagtgagctgtttccacagttc

SEQ ID NO: 328984 - DNA, 75 bp, Artificial Sequence
  Synthetic
gcagatgacaaaccccactcagctatctacgccctagatgtgatttgtattaagttctttggtatggatctgaca

SEQ ID NO: 328985 - DNA, 75 bp, Artificial Sequence
  Synthetic
tccctctgacgtaccaccctgcggactctgcaaggccagtggcgcattgggacaacagtccaggaacccgaaggt

SEQ ID NO: 328986 - DNA, 75 bp, Artificial Sequence
  Synthetic
gaccggaaccgtttcgacccgcaccgaaatcactggttgcaccgccatcaagcagtgcgtcgcctatgggagcga

SEQ ID NO: 328987 - DNA, 75 bp, Artificial Sequence
  Synthetic
ctctgcaaggccagtggcgcattgggacaacagtccaggaacccgaaggtatggatacgaccatgcggttgctgc

SEQ ID NO: 328988 - DNA, 75 bp, Artificial Sequence
  Synthetic
atgaaaccactccacgtgaaaggaactattgaccaccctgtactatcaaagctcaaatttaccaagtcgtcagca

SEQ ID NO: 328989 - DNA, 75 bp, Artificial Sequence
  Synthetic
gcataatgccacgcagcgtctgcataacttttattatttcttttattaatcaacaaaattttgtttttaacattc

SEQ ID NO: 328990 - DNA, 75 bp, Artificial Sequence
  Synthetic
attgacggcgtagtagacactattataagaaatagccgaccaatagcactccatcacaatggagaaacctgtagt

SEQ ID NO: 328991 - DNA, 75 bp, Artificial Sequence
  Synthetic
taacgtggacgtagacccccagagtccgtttgtcgctcagctgcagaagagtttcccgcaatttgaggtagtagc

SEQ ID NO: 328992 - DNA, 75 bp, Artificial Sequence
  Synthetic
gctaacgccagagcattttcgcatctggccagtaaactaatcgagctggagattccgatcacagcgacgattttg

SEQ ID NO: 328993 - DNA, 75 bp, Artificial Sequence
  Synthetic
gacattggcagcgcaccagctcgtagaatgtattccgagcacaagtaccattgcgtctgccccatgcgcagtccc

SEQ ID NO: 328994 - DNA, 75 bp, Artificial Sequence
  Synthetic
gaggatccggaccgcatgatgaaatacgccgccaagctggcagaaaaagcgcccaaaattaccgacaagaacctt

SEQ ID NO: 328995 - DNA, 75 bp, Artificial Sequence
  Synthetic
cacgaaaaaattagcgacctccgaaccgttctcgacacaccagacgtcgaaacaccgtccctttgctttcacaat

SEQ ID NO: 328996 - DNA, 75 bp, Artificial Sequence
  Synthetic
gatgtcacgtgcagcatccgtgccgaatactccgtcatgcaggacgtttacatcaacgccccggggacaattttt

SEQ ID NO: 328997 - DNA, 75 bp, Artificial Sequence
  Synthetic
gcaggtctgggacgaagcggacgataacaccatacgcatacagacttccgcccagtttggatacaaccaaagcgg

SEQ ID NO: 328998 - DNA, 75 bp, Artificial Sequence
  Synthetic
caccaggccttgaaaggggtcaggacactgtactggatcggattcgataccacccaatttatgttttcagccatg

SEQ ID NO: 328999 - DNA, 75 bp, Artificial Sequence
  Synthetic
cgtcaacgccgctaactcgctgggtaaaccaggtgaaggagtttgccgcgccgtctacaagcgttggccgaacag

SEQ ID NO: 329000 - DNA, 75 bp, Artificial Sequence
  Synthetic
gctggatcgtacccggcctacaataccaactgggccgacgaaaaagtcctagaggcacgtaacatcgggttatgt

SEQ ID NO: 329001 - DNA, 75 bp, Artificial Sequence
  Synthetic
ctttattgattccgccacagaaacgggtacggctaaattaactgtaagccaaggaatgaaagtgatacacgcggt

SEQ ID NO: 329002 - DNA, 75 bp, Artificial Sequence
  Synthetic
agtacaaagttaagcgaaggaaggacaggcaaattgtcggtaatgaggaagaaagaattgaaacctggatcacgg

SEQ ID NO: 329003 - DNA, 75 bp, Artificial Sequence
  Synthetic
gtttatttctctgtagggtcaactctgtaccccgaagacagggctagtctgcagagttggcaccttccatctgtg

SEQ ID NO: 329004 - DNA, 75 bp, Artificial Sequence
  Synthetic
caggtatatatgcagctggtaaggatcgcttggaagtttcgcttaattgcctgaccaccgcactagacaggaccg

SEQ ID NO: 329005 - DNA, 75 bp, Artificial Sequence
  Synthetic
tttcacttaaaaggaaagcaatcatacacttgccgctgtgatacagtagtaagttgtgaaggctatgtggtcaag

SEQ ID NO: 329006 - DNA, 75 bp, Artificial Sequence
  Synthetic
atgcagacgtaactatttattgtttggataagaaatggaaagagagaattgacgcggtgttgcaacttaaggagt

SEQ ID NO: 329007 - DNA, 75 bp, Artificial Sequence
  Synthetic
acaactctattactagtatggacagttggtcgtcaggacctagttcgctagagatagtagaccgaaggcaggtgg

SEQ ID NO: 329008 - DNA, 75 bp, Artificial Sequence
  Synthetic
aagatcaccataagtcccgggatcacgggagagaccgtgggttacgcggtcacaaataatagcgagggattcttg

SEQ ID NO: 329009 - DNA, 75 bp, Artificial Sequence
  Synthetic
ctatgcaaagtaacagacactgtgaaaggagaacgggtctcgttccctgtatgcacatacattccggcgaccatt

SEQ ID NO: 329010 - DNA, 75 bp, Artificial Sequence
  Synthetic
cagcggcaagaagggagcccactccaccggcaagcaatggctctgagtccctccgcctctcttttggtggggtgt

SEQ ID NO: 329011 - DNA, 75 bp, Artificial Sequence
  Synthetic
tgtgaccaaatgactggtataatggctacggacatctcaccggatgacgctcagaaattgctagttgggctcaac

SEQ ID NO: 329012 - DNA, 75 bp, Artificial Sequence
  Synthetic
aaaaggaaagctatattcgtactttgagggtactaaatttcaccaagcagccaaagacatggctgaaataaaaat

SEQ ID NO: 329013 - DNA, 75 bp, Artificial Sequence
  Synthetic
cagcgaatcgtcatcaacggtaaaacgaacaaaaacaccaacactatgcaaaactatttactgcccatcatcgcc

SEQ ID NO: 329014 - DNA, 75 bp, Artificial Sequence
  Synthetic
gctgtttccggacgaccaggaaagcaacgaacagttatgcgcttacatactgggcgaaactatggaagcaattcg

SEQ ID NO: 329015 - DNA, 75 bp, Artificial Sequence
  Synthetic
caaggattcagcaagtgggctaaggagaggaaagaagacctggagaacgaaagattactggggaccagggagcgc

SEQ ID NO: 329016 - DNA, 75 bp, Artificial Sequence
  Synthetic
aggttgaggccgacgtgctaagactgaggggtatgcagattacgtcgaagacagtagattcggttatgctcaacg

SEQ ID NO: 329017 - DNA, 75 bp, Artificial Sequence
  Synthetic
aagcttacatacggctgcctgtgggcttttcgaactaagaaagtacactcattttaccgcccgccagggacacaa

SEQ ID NO: 329018 - DNA, 75 bp, Artificial Sequence
  Synthetic
accagtgttaaggtgccctcttcctttagtgcgtttccactgtcatcggtatggacgacgtctttaccgatgtca

SEQ ID NO: 329019 - DNA, 75 bp, Artificial Sequence
  Synthetic
ctgcgacagaaaatgaaactagcacttagacctaaatattctgaaaaactgctgcaagtctcggaagggcttgtc

SEQ ID NO: 329020 - DNA, 75 bp, Artificial Sequence
  Synthetic
gtgccagaattacctgccatcatacctgtacaggccgacacgctagatcagccacctgccgcggacggtacaccg

SEQ ID NO: 329021 - DNA, 75 bp, Artificial Sequence
  Synthetic
gctgaagcgaaagcggcatttgaggaagcccaggagaccatccgagcggagaaactgcgtgaagcactcccgcct

SEQ ID NO: 329022 - DNA, 75 bp, Artificial Sequence
  Synthetic
ggcaggctgccccgatgcctgcccgcaacgggctggcttctcaaatccagcaactgaccacagccgtcagtgccc

SEQ ID NO: 329023 - DNA, 75 bp, Artificial Sequence
  Synthetic
cttgatgttacggacatttcgttaaatatggaagatagtagcgaaggattgtccattttagatttccacgggtca

SEQ ID NO: 329024 - DNA, 75 bp, Artificial Sequence
  Synthetic
ctagtcgcagataaaaacgtggacgctgcggccgaagtcatatgcgaagtggaaggacttcaagcggacattggg

SEQ ID NO: 329025 - DNA, 75 bp, Artificial Sequence
  Synthetic
atatggaagatagtagcgaaggattgtccattttagatttccacgggtcagaaagttccatttttagtatggata

SEQ ID NO: 329026 - DNA, 75 bp, Artificial Sequence
  Synthetic
gttggtcgtcaggaaccagttctttggggccagaggacaatagaaggcaagtagtgacagtcgatgtccactcca

SEQ ID NO: 329027 - DNA, 75 bp, Artificial Sequence
  Synthetic
gccgccctagtagaaaccccacggggccacgtgaggataattccacagcaatcagaccgcatgatcgggcaatac

SEQ ID NO: 329028 - DNA, 75 bp, Artificial Sequence
  Synthetic
attgtggtctctccgacctcagtgctaaagaacaccaaattggccccagcccacccgttagcggagcaaattaaa

SEQ ID NO: 329029 - DNA, 75 bp, Artificial Sequence
  Synthetic
ttagcggcggcgaaacagaccccagtagcacttaccgtatcgaatgatgcggactcaatggatgagtccctctgc

SEQ ID NO: 329030 - DNA, 75 bp, Artificial Sequence
  Synthetic
atcattacgcactccgggagatcaggaaggtatgcggtggagccttacgatgcaaaagtactaatgccggcaggt

SEQ ID NO: 329031 - DNA, 75 bp, Artificial Sequence
  Synthetic
cttttggatctttttccgacggtgagatcgatgaaataagtcgtatgaagactgagtcagaacccgttctatttg

SEQ ID NO: 329032 - DNA, 75 bp, Artificial Sequence
  Synthetic
agtgccataccgtggcccgagttcctggcgcttagcgaaagcgcaaccctggtgtataacgagagggcatttgtg

SEQ ID NO: 329033 - DNA, 75 bp, Artificial Sequence
  Synthetic
tgcactaccatcacaatggagaagccagtagttaacgtagacgtagaccctcagagtccgtttgtcgtgcaactg

SEQ ID NO: 329034 - DNA, 75 bp, Artificial Sequence
  Synthetic
gaacttttgagcctggagaagttaattccattatatcgtctcgatcagccgtgtcttttccaccgctaaggcaga

SEQ ID NO: 329035 - DNA, 75 bp, Artificial Sequence
  Synthetic
aaccgcaagctctaccacatagctatgcacggtgcagcaaagaacacggaggaagaacaatacaaggtcctgagg

SEQ ID NO: 329036 - DNA, 75 bp, Artificial Sequence
  Synthetic
tagtagcacagcaggccactccaaatgaccatgctaatgccagagcattttcgcatctggccagtaaactaatcg

SEQ ID NO: 329037 - DNA, 75 bp, Artificial Sequence
  Synthetic
agctggaggttcctaccacagcgacgattttggacataggcagcgcaccggctcgtagaatgttttccgagcacc

SEQ ID NO: 329038 - DNA, 75 bp, Artificial Sequence
  Synthetic
gcggaactcgctgacaccgagtacgtcttcgacgtggacaagaggaggtgtgtaagaaaagaggaggcctccggg

SEQ ID NO: 329039 - DNA, 75 bp, Artificial Sequence
  Synthetic
gctcgtagaatgttttccgagcaccagtatcattgcgtttgccccatgcgtagtccagaagacccggaccgcatg

SEQ ID NO: 329040 - DNA, 75 bp, Artificial Sequence
  Synthetic
agtatcattgcgtttgccccatgcgtagtccagaagacccggaccgcatgatgaaatatgccagcaaactggcgg

SEQ ID NO: 329041 - DNA, 75 bp, Artificial Sequence
  Synthetic
cttgttctatccggagagctgactaatccgccataccatgaactagccctagaaggactgcggacgcgccctgct

SEQ ID NO: 329042 - DNA, 75 bp, Artificial Sequence
  Synthetic
atgaaatatgccagcaaactggcggaaaaagcatgcaagattacaaacaagaacttgcatgagaagatcaaggac

SEQ ID NO: 329043 - DNA, 75 bp, Artificial Sequence
  Synthetic
tacgtcgaaagaagaactacttaaatttaggtaccaaatgatgcccaccgaagccaataagagcaggtaccagtc

SEQ ID NO: 329044 - DNA, 75 bp, Artificial Sequence
  Synthetic
gtcccgtacaaagtggagacaatcggagtaataggaacacccggatctggtaaatccgccataattaaaacaaca

SEQ ID NO: 329045 - DNA, 75 bp, Artificial Sequence
  Synthetic
ctccggaccgtactcgatacaccggatgctgaaacgccatcactctgcttccacaacgatgttacctgcaacacg

SEQ ID NO: 329046 - DNA, 75 bp, Artificial Sequence
  Synthetic
gtaactgcacgcgaccttgttaccagcgggaagaaagaaaactgccgagagatcgaggctgatgtaatgaagtta

SEQ ID NO: 329047 - DNA, 75 bp, Artificial Sequence
  Synthetic
acactttagcaccgcgagtccacaggcgaactttatcgtatcgctgtgtgggaagaggacagcatgcaatgcaga

SEQ ID NO: 329048 - DNA, 75 bp, Artificial Sequence
  Synthetic
cgtgccgagtattccgtcatgcaggacgtgtacatcaacgctcccggaactatctaccatcaggctatgaaaggc

SEQ ID NO: 329049 - DNA, 75 bp, Artificial Sequence
  Synthetic
cgtggcatgcaaattacgtctaagactgttgactccgttatgcttaacggatgccacaaggtggtcgatgtcttg

SEQ ID NO: 329050 - DNA, 75 bp, Artificial Sequence
  Synthetic
atgctgaaacgccatcactctgcttccacaacgatgttacctgcaacacgcgtgccgagtattccgtcatgcagg

SEQ ID NO: 329051 - DNA, 75 bp, Artificial Sequence
  Synthetic
gtgcggactctgtactggattggctttgacaccacccagttcatgttttcggctatggcaggttcgtaccccgcg

SEQ ID NO: 329052 - DNA, 75 bp, Artificial Sequence
  Synthetic
tacgtcgacgaggcgtttgcctgccacgcaggagcactgctcgcgcttattgctatagtccggcctagaaagaag

SEQ ID NO: 329053 - DNA, 75 bp, Artificial Sequence
  Synthetic
tttaggtaccaaatgatgcccaccgaagccaataagagcaggtaccagtcccgtaaagttgaaaatcaaaaagcc

SEQ ID NO: 329054 - DNA, 75 bp, Artificial Sequence
  Synthetic
tacaacaccaattgggccgacgagaaagtccttgaagcgcgtaacatcggactctgcagcacaaagctgagtgaa

SEQ ID NO: 329055 - DNA, 75 bp, Artificial Sequence
  Synthetic
aagtccttgaagcgcgtaacatcggactctgcagcacaaagctgagtgaaggcaggacaggaaagttgtcgataa

SEQ ID NO: 329056 - DNA, 75 bp, Artificial Sequence
  Synthetic
gtggttctgtgcggcgatccgaagcagtgcgggttcttcaacatgatgcaactgaaggtacatttcaacaaccca

SEQ ID NO: 329057 - DNA, 75 bp, Artificial Sequence
  Synthetic
ggcaggacaggaaagttgtcgataatgaggaagaaggagttgaagcccgggtcacgggtttatttctccgttgga

SEQ ID NO: 329058 - DNA, 75 bp, Artificial Sequence
  Synthetic
tgaggaagaaggagttgaagcccgggtcacgggtttatttctccgttggatcgacactttacccagaacacagag

SEQ ID NO: 329059 - DNA, 75 bp, Artificial Sequence
  Synthetic
gtcacgggtttatttctccgttggatcgacactttacccagaacacagagccagcttgcagagctggcatcttcc

SEQ ID NO: 329060 - DNA, 75 bp, Artificial Sequence
  Synthetic
gagaaagacatttgcacgaaaacgttctataagtacatatcaagacgatgcacccagcccgtcacggccatagtt

SEQ ID NO: 329061 - DNA, 75 bp, Artificial Sequence
  Synthetic
tcaacactgcattacgatgggaagatgagaaccacgaacccctgcaagaagaatatcgaaatagacattacaggg

SEQ ID NO: 329062 - DNA, 75 bp, Artificial Sequence
  Synthetic
cagtggtgagctgcgaaggctacgtagtgaagaaaatcactatcagtcccgggatcacgggagaaaccgtgggat

SEQ ID NO: 329063 - DNA, 75 bp, Artificial Sequence
  Synthetic
gccacgaaaccgaagcccggcgacataattctgacgtgtttcagagggtgggtcaagcagctccagatagactat

SEQ ID NO: 329064 - DNA, 75 bp, Artificial Sequence
  Synthetic
ccaggtcacgaagttatgaccgcggctgcgtcccaaggtctgacaagaaaaggggtgtatgctgtccggcaaaaa

SEQ ID NO: 329065 - DNA, 75 bp, Artificial Sequence
  Synthetic
gtcaacgagaacccgctatacgctatcacatctgaacacgttaatgtcctgctcacgcgcaccgaagacaggctc

SEQ ID NO: 329066 - DNA, 75 bp, Artificial Sequence
  Synthetic
gtctggaagacattgcagggagacccgtggatcaagcagcttaccgatataccaaaaggcaacttccaggccacc

SEQ ID NO: 329067 - DNA, 75 bp, Artificial Sequence
  Synthetic
gctcaaccagcgaattgttattaacggtaagactaacaggaacaccaataccatgcaaaattaccttctgccaat

SEQ ID NO: 329068 - DNA, 75 bp, Artificial Sequence
  Synthetic
attgaggactgggaagcggagcaccgcggaatcattgccgccataaacagccctgccccaaaaacaaacccattt

SEQ ID NO: 329069 - DNA, 75 bp, Artificial Sequence
  Synthetic
cattgcacaagggttcagtaaatgggccaaggagcgcaaagaagatcttgacaacgagaaaatgctgggcaccag

SEQ ID NO: 329070 - DNA, 75 bp, Artificial Sequence
  Synthetic
aaaattcgtgggacgggaaaaatatgatctacttcccgttcacggtaaaaaaattccttgcacagtgtacggccg

SEQ ID NO: 329071 - DNA, 75 bp, Artificial Sequence
  Synthetic
agttgcaagaccaacgtgtgctgggctaaagcactagagcccatactagccaccgcagggatatctctgacaggg

SEQ ID NO: 329072 - DNA, 75 bp, Artificial Sequence
  Synthetic
agagcgcaagcttacgtatggctgcttgtgggcgtttcgcactaagaaagtgcactcgttctatcgcccacctgg

SEQ ID NO: 329073 - DNA, 75 bp, Artificial Sequence
  Synthetic
gaggactttgacgctattatagccgagcactttaaacatggcgatccggtgctggagacagatattgcttctttc

SEQ ID NO: 329074 - DNA, 75 bp, Artificial Sequence
  Synthetic
tgccagtggagtgaactttttccgcagtttgccgaggacaaacctcattcagctacctacgcgctagatgtcatc

SEQ ID NO: 329075 - DNA, 75 bp, Artificial Sequence
  Synthetic
gataagagccaagatgacgctatggcgttgacgggcctgatgatcttggaagatctaggcgtggatcacctacta

SEQ ID NO: 329076 - DNA, 75 bp, Artificial Sequence
  Synthetic
ccatgcaaaattaccttctgccaatcattgcacaagggttcagtaaatgggccaaggagcgcaaagaagatcttg

SEQ ID NO: 329077 - DNA, 75 bp, Artificial Sequence
  Synthetic
tgcataaagttctttggcatggaccttacaagcggtctatttgcgaagcaaagcatccctttgacgtaccatcca

SEQ ID NO: 329078 - DNA, 75 bp, Artificial Sequence
  Synthetic
gcagacatttcccgccctgtagcccattgggacaacagtccaggagcccgcaagtacgggttcgatgctgctgta

SEQ ID NO: 329079 - DNA, 75 bp, Artificial Sequence
  Synthetic
cattgcacaagggttcagtaaatgggccaaagagcgcaaagaagatcttgacaacgagaaaatgctgggcaccag

SEQ ID NO: 329080 - DNA, 75 bp, Artificial Sequence
  Synthetic
gccgctgaactttcccggcgtttccccgtctatcaaatggcagggaaaggtacgcagctcgacttacaaacggga

SEQ ID NO: 329081 - DNA, 75 bp, Artificial Sequence
  Synthetic
aaaaactgctgcaggtctcggaggaattagtcatggaggccaaggctgctttcgaggatgctcaggaggaagcca

SEQ ID NO: 329082 - DNA, 75 bp, Artificial Sequence
  Synthetic
agaacaagagtcatttctgcgcaacacaatttggtacccgttaaccgcaacctgccgcacgctttggtcccagag

SEQ ID NO: 329083 - DNA, 75 bp, Artificial Sequence
  Synthetic
tacaaagacagaaatcctggacctgttgaagatttcctgaaacaattcaagcatcatacggtggttatggtgtcg

SEQ ID NO: 329084 - DNA, 75 bp, Artificial Sequence
  Synthetic
tctgtgctgaagaacgccaaactcgcaccagcacacccgctagcagaccaggttaagatcataacgcactccgga

SEQ ID NO: 329085 - DNA, 75 bp, Artificial Sequence
  Synthetic
gcagagaaagtagaagtaccgcagaagaaaattgaatggatagctccactaggcgtccctggtgctgatcggaac

SEQ ID NO: 329086 - DNA, 75 bp, Artificial Sequence
  Synthetic
caccagcacacccgctagcagaccaggttaagatcataacgcactccggaagagcaggaaggtacgcagtcgaac

SEQ ID NO: 329087 - DNA, 75 bp, Artificial Sequence
  Synthetic
tataacctggcgttcggatttccaccccagtcgcgctacgatatggtgttcgtgaagatcggaactaagtatagg

SEQ ID NO: 329088 - DNA, 75 bp, Artificial Sequence
  Synthetic
gaattcttagcactgagtgagagtgccacgctagtgtacaacgaaagagagtttgtgaatcgcaagctgtaccat

SEQ ID NO: 329089 - DNA, 75 bp, Artificial Sequence
  Synthetic
aaccatcactttcagcagtgcgaagaccatgcggcgactctaaaaaccctgtcaagctcagctctcaattgtctt

SEQ ID NO: 329090 - DNA, 75 bp, Artificial Sequence
  Synthetic
gagtgggcattactgatactttagcaactgctgtagcaactcggtacgaggtagataatatcacacctgtcttac

SEQ ID NO: 329091 - DNA, 75 bp, Artificial Sequence
  Synthetic
attgccatgcacggccccgctaagaatacagaagaggagcagtacaaggttacaaaggcagagctcgcagaaaca

SEQ ID NO: 329092 - DNA, 75 bp, Artificial Sequence
  Synthetic
aatcccgggggaactttagtagtgaaggcgtacggatacgcagaccgtaacagtgaagacgtggtcaccgctctg

SEQ ID NO: 329093 - DNA, 75 bp, Artificial Sequence
  Synthetic
ttgacaagcggactgttttccaaacagagcatcccgctaacgtaccatcccgccgattcagcgaggccggtagct

SEQ ID NO: 329094 - DNA, 75 bp, Artificial Sequence
  Synthetic
gagtacgtgttcgacgtggacaagaagcgatgcgttaagaaggaagaagcctcaggactcgtcctctcgggagaa

SEQ ID NO: 329095 - DNA, 75 bp, Artificial Sequence
  Synthetic
gccagaaagttcgtccgcgtctcggctgccagacccgagtgcgttaccagtaacactgagatgttcctcattttc

SEQ ID NO: 329096 - DNA, 75 bp, Artificial Sequence
  Synthetic
tggcattgagaacgtttgcccagagcaaaaattcgtttcaggccattagaggagaaataaagcaactctacggtg

SEQ ID NO: 329097 - DNA, 75 bp, Artificial Sequence
  Synthetic
tttatctgactaatactgtaacacccctactatgaatagaggattctttaacatgcttggccgccgccccttccc

SEQ ID NO: 329098 - DNA, 75 bp, Artificial Sequence
  Synthetic
aggcaattggataacagccgcacacgccagtttacgccccaccacctcaactgcgtggtctcatccgtctatgaa

SEQ ID NO: 329099 - DNA, 75 bp, Artificial Sequence
  Synthetic
caaaaattcgtttcaggccattagaggagaaataaagcaactctacggtggtcctaaatagtcagcatagtatac

SEQ ID NO: 329100 - DNA, 75 bp, Artificial Sequence
  Synthetic
ggaacaagagacggagttggtgccgcgccgtcctatcgcgtgaaaagagaaaacatagcagattgcctagaggaa

SEQ ID NO: 329101 - DNA, 75 bp, Artificial Sequence
  Synthetic
gccgtagttaatgcggccaacccgctcgggagacctggggaaggcgtctgtcgcgccatctataagaggtggcct

SEQ ID NO: 329102 - DNA, 75 bp, Artificial Sequence
  Synthetic
aaggctgaggggcatgcagatcacgtcgaagacagtggattcggttatgctcaacggatgccacaaagccgtaga

SEQ ID NO: 329103 - DNA, 75 bp, Artificial Sequence
  Synthetic
tcaacggatgccacaaagccgtagaagtgctgtatgttgacgaagcgttcgcgtgccacgcaggagcgctgcttg

SEQ ID NO: 329104 - DNA, 75 bp, Artificial Sequence
  Synthetic
aactgcttcaccgactctgccaccgaaaccggcacggcaagaatgaccgagagcaacggaaaaagagtaattcac

SEQ ID NO: 329105 - DNA, 75 bp, Artificial Sequence
  Synthetic
ccttgattgcaatcgtcagaccccgcaagaaggtagtactatgtggggaccctaagcaatgcggattcttcaaca

SEQ ID NO: 329106 - DNA, 75 bp, Artificial Sequence
  Synthetic
gcagtcggccctgacttccgcaggcacacagaagccgaagctttaaaactgcttcagaacacctatcatgcggta

SEQ ID NO: 329107 - DNA, 75 bp, Artificial Sequence
  Synthetic
tgatgcaactaaaggtacatttcaaccatcctgaaaaagatatatgtaccaagacattctacaagttcatctccc

SEQ ID NO: 329108 - DNA, 75 bp, Artificial Sequence
  Synthetic
gcagacctgatcaacgaacacaacatcaagtcggttgcgatccctctgctatctacgggaatatatgctgcgggg

SEQ ID NO: 329109 - DNA, 75 bp, Artificial Sequence
  Synthetic
aaagaccgccttgaggtctcactaaactgcctaactaccgcgttggacagaactgatgcagacgtcaccatatat

SEQ ID NO: 329110 - DNA, 75 bp, Artificial Sequence
  Synthetic
gcaagaagaatatcgaaattgacattacaggggccacgaagccgaagccaggggatatcatcctgacatgttttc

SEQ ID NO: 329111 - DNA, 75 bp, Artificial Sequence
  Synthetic
tgcctagataagaaatggaaagaaaggattgacgtggtactacagagaaaggaggcagtcaccgagttgaaggat

SEQ ID NO: 329112 - DNA, 75 bp, Artificial Sequence
  Synthetic
ttggtggggtatccatgtccttcggatcccttttcgacggagagatgggcgccttggcagcggcacaacccccgg

SEQ ID NO: 329113 - DNA, 75 bp, Artificial Sequence
  Synthetic
gcgggtgggttaagcaactgcaaatcgactatcccggacatgaggtaatgacagccgcggcctcccaagggctaa

SEQ ID NO: 329114 - DNA, 75 bp, Artificial Sequence
  Synthetic
gatgacatggaaatcgatgacgaacttgtatgggttcaccccgatagttgcttaaaaggacgcaaaggatttagc

SEQ ID NO: 329115 - DNA, 75 bp, Artificial Sequence
  Synthetic
accacgaaaggcaaactgtactcatactttgaggggacgaagttccaccaggctgccaaggacatggcggagatc

SEQ ID NO: 329116 - DNA, 75 bp, Artificial Sequence
  Synthetic
aaagtactattccctgatgatcaggagtgtaacgaacaactgtgtgcttacatactaggagaaaccatggaggcc

SEQ ID NO: 329117 - DNA, 75 bp, Artificial Sequence
  Synthetic
cagactagtatggaaaaccttgcaaggcgacccatggattaagcagctcactaatgtacctaaaggaaatttcca

SEQ ID NO: 329118 - DNA, 75 bp, Artificial Sequence
  Synthetic
cttgcaaccgtccgcctacttgctacacccgcgaaccatccagagcgttagatatcctggaagagaatgtggacc

SEQ ID NO: 329119 - DNA, 75 bp, Artificial Sequence
  Synthetic
attcgtgaaaaatgtcctatagaccttaatccatcttccagcccacccaaaactttcccgtgcttatgcatgtac

SEQ ID NO: 329120 - DNA, 75 bp, Artificial Sequence
  Synthetic
ataaggactacgacactttgctcgacgctatactgcgatgcgatttttccggtagaaataaaagaagtgttaccg

SEQ ID NO: 329121 - DNA, 75 bp, Artificial Sequence
  Synthetic
gcgatgacacccgagcgagttcaccgacttcggagtaacaacgtaaaagaggtcacagtttgctcgtccacccca

SEQ ID NO: 329122 - DNA, 75 bp, Artificial Sequence
  Synthetic
cgctatactgcgatgcgatttttccggtagaaataaaagaagtgttaccgacgacttcaccttgaccagcccgta

SEQ ID NO: 329123 - DNA, 75 bp, Artificial Sequence
  Synthetic
cttcctaagtacagaattaagaacgtgcagaaggtgcagtgcacaaaagtggtgctttttaacccacaaacccct

SEQ ID NO: 329124 - DNA, 75 bp, Artificial Sequence
  Synthetic
acattcgttcctgcccgcaagtatatcgaaacaccagaacagcgcatcaccgatgtcccgactcaagaagagccc

SEQ ID NO: 329125 - DNA, 75 bp, Artificial Sequence
  Synthetic
cgtaatctgcattaagtttttcggcatggatttgacaagcggactgttttccaaacagagcatcccgctaacgta

SEQ ID NO: 329126 - DNA, 75 bp, Artificial Sequence
  Synthetic
atggatttgacaagcggactgttttccaaacagagcatcccgctaacgtatcatcctgccgattcagcgaggccg

SEQ ID NO: 329127 - DNA, 75 bp, Artificial Sequence
  Synthetic
gttaatacagcaccagaacctacatgtactgctaccggagacaacacttcgcttgatgttacggatatttcttta

SEQ ID NO: 329128 - DNA, 75 bp, Artificial Sequence
  Synthetic
tatgtctttcggatcgttttccgacggagagattgaggagctgagccgcagagtaaccgagtctgagcccgtcct

SEQ ID NO: 329129 - DNA, 75 bp, Artificial Sequence
  Synthetic
gaccatgagcctagcgaccagggctctatgtcctacgactttgcaggctccaatagctccattgacagcggaatg

SEQ ID NO: 329130 - DNA, 75 bp, Artificial Sequence
  Synthetic
cgccgttgctgcagaactctcccgcagatttccggtgttccagctagctgggaaaggcacacagcttgacttgca

SEQ ID NO: 329131 - DNA, 75 bp, Artificial Sequence
  Synthetic
aatgtccgcccggggacagcgtgacggtcagtatagtgagcagcagttcaactacatcatgcacgttggcacgca

SEQ ID NO: 329132 - DNA, 75 bp, Artificial Sequence
  Synthetic
agctgggcaacaccatcgggacggtccgttatagtgtcagcagaagtccacgctgcacaagcaccaatacccaca

SEQ ID NO: 329133 - DNA, 75 bp, Artificial Sequence
  Synthetic
gacgggcagaaccagagttatctctgcacagcataacttggtcccagtgaaccgcaatctccctcacgccttagt

SEQ ID NO: 329134 - DNA, 75 bp, Artificial Sequence
  Synthetic
agataaaaccgaagtttgtgggacgggaacggtatgatctgccccccgtttacggaaagaacatcccttgcagaa

SEQ ID NO: 329135 - DNA, 75 bp, Artificial Sequence
  Synthetic
ccgcctccacgccttaagaagctagccaggcttgcagcccaggcccaactcgctgccgaggaaacggagcccgtg

SEQ ID NO: 329136 - DNA, 75 bp, Artificial Sequence
  Synthetic
ccctgagcacaaggagaaacaacccggcccggtcgaaaaattcttgaaccagttcaaacaccactccgtacttgt

SEQ ID NO: 329137 - DNA, 75 bp, Artificial Sequence
  Synthetic
cgacgtacttccgaggaagcgcagtgcataatgctgcgcagtgttgccacattatcactatattaaccatttatt

SEQ ID NO: 329138 - DNA, 75 bp, Artificial Sequence
  Synthetic
accaccgatacgactagcgaggacgaatcactacacctttctttgaatggtatggcaatgtcatttggctcgttc

SEQ ID NO: 329139 - DNA, 75 bp, Artificial Sequence
  Synthetic
cctggcccacatgcctacacgtcctatctggaggaagcgtctggaaaaatttacgctaagccaccatccggaaag

SEQ ID NO: 329140 - DNA, 75 bp, Artificial Sequence
  Synthetic
gtttgggtcatttgaaccgggcgaagtgaactcaattatatcgtcccgatcagttgtatcttttccaccacgcaa

SEQ ID NO: 329141 - DNA, 75 bp, Artificial Sequence
  Synthetic
actgacggcgaagtggaagagttgagccgcaggaagaccaactccgaaccagtactgtttggatcgtttgagcca

SEQ ID NO: 329142 - DNA, 75 bp, Artificial Sequence
  Synthetic
atctggaggaagcgtctggaaaaatttacgctaagccaccatccggaaagaacattacctacgagtgtaaatgcg

SEQ ID NO: 329143 - DNA, 75 bp, Artificial Sequence
  Synthetic
ggggaagtgaactcaatcatttcgtctcgctccgctgtgtccttcccagcgcgcagacggcgcagaagacacacc

SEQ ID NO: 329144 - DNA, 75 bp, Artificial Sequence
  Synthetic
tgcgaagaccatgcggcgaccttgaaaaccctttcgcgttcggccctgaactgccttaaccccggaggcaccctc

SEQ ID NO: 329145 - DNA, 75 bp, Artificial Sequence
  Synthetic
cgtaagaaagcggagtactgactaaccggggtaggtgggtacatcttctcaacggatactggtcctggacatttg

SEQ ID NO: 329146 - DNA, 75 bp, Artificial Sequence
  Synthetic
cagaagaaatcagttctgcagaacgtacttacagaaccgttgcttgagcgcaataatctagaacaaatctatgcg

SEQ ID NO: 329147 - DNA, 75 bp, Artificial Sequence
  Synthetic
cgctcttgccagaaaatttgtcagagtgtctgcagcgaggccagagtgtgtctcaagcaatacagaaatgtacct

SEQ ID NO: 329148 - DNA, 75 bp, Artificial Sequence
  Synthetic
ccgacgtacgaccagtccaaagaagagctactaaaatttaagtacccaatgatacccaccgaagccaacaagagc

SEQ ID NO: 329149 - DNA, 75 bp, Artificial Sequence
  Synthetic
gattttccgacaactagacaacagccgcacacgacaattcaccccgcatcatctgaattgcgtgatttcgtcagt

SEQ ID NO: 329150 - DNA, 75 bp, Artificial Sequence
  Synthetic
tctcaagcaatacagaaatgtacctgattttccgacaactagacaacagccgcacacgacaattcaccccgcatc

SEQ ID NO: 329151 - DNA, 75 bp, Artificial Sequence
  Synthetic
aggtaccaatcacggaaagtagagaatcagaaagccgtcaccaccgaacgcttactatcgggattacgattgtac

SEQ ID NO: 329152 - DNA, 75 bp, Artificial Sequence
  Synthetic
gtacgagggtacaagagacggagttggagccgcaccgtcataccgcactaaaagggagaacattgctgactgtca

SEQ ID NO: 329153 - DNA, 75 bp, Artificial Sequence
  Synthetic
acccacgcacaaaaccaacctgaatgttacaaggttacgtaccctaaacccatgtactctagcagcgtacccgcc

SEQ ID NO: 329154 - DNA, 75 bp, Artificial Sequence
  Synthetic
agaggaagcagttgtcaatgcagccaatccgctgggcagaccaggcgaaggagtctgccgtgccatctataaacg

SEQ ID NO: 329155 - DNA, 75 bp, Artificial Sequence
  Synthetic
agtttacgctcaagaatcagcgcctggcgatccccatggatggcctcatgagatagtacagcattactatcaccg

SEQ ID NO: 329156 - DNA, 75 bp, Artificial Sequence
  Synthetic
agttactccgagcctaaatttgcggtagccgtttgcaacaattaccttcacgaaaactaccccacagtggcatcc

SEQ ID NO: 329157 - DNA, 75 bp, Artificial Sequence
  Synthetic
ttggccgaacagttttaccgattcagccacagagacaggcaccgcaaaactgactgtgtgccatggaaagaaagt

SEQ ID NO: 329158 - DNA, 75 bp, Artificial Sequence
  Synthetic
tatcagattacagacgagtacgacgcctacttggatatggttgacggaacagtggcgtgtttggacacagctaca

SEQ ID NO: 329159 - DNA, 75 bp, Artificial Sequence
  Synthetic
gatacacgcggtcggccctgatttccggaaacatccagaggcagaagccctgaaattgctgcaaaacgcctacca

SEQ ID NO: 329160 - DNA, 75 bp, Artificial Sequence
  Synthetic
ttctgtcccgcaaaattgagaagctatcccaagaaacacgactaccacggcccgaatatccgcagagccgttcca

SEQ ID NO: 329161 - DNA, 75 bp, Artificial Sequence
  Synthetic
tcagcaatgcaaaacaccctccaaaacgtgctaattgcagctaccaaaagaaattgtaatgtcacccagatgcgc

SEQ ID NO: 329162 - DNA, 75 bp, Artificial Sequence
  Synthetic
gaactgcctacccttgactccgcgaactttaatgttgaatgttttcgcaagtacgcttgcaatgacgaatattgg

SEQ ID NO: 329163 - DNA, 75 bp, Artificial Sequence
  Synthetic
catctactgcctggataagaagtggaaggaacgaatcgacgcggtgctccaactcaaggagtctgtaacagagct

SEQ ID NO: 329164 - DNA, 75 bp, Artificial Sequence
  Synthetic
aactcaaggagtctgtaacagagctgaaggatgaagatatggagatcgacgacgagttagtatggatccatccgg

SEQ ID NO: 329165 - DNA, 75 bp, Artificial Sequence
  Synthetic
gatgaattcgcagccaaaccaatccggtttaccaccgagttcgtcaccgcatatgtggctagattgaaggggcca

SEQ ID NO: 329166 - DNA, 75 bp, Artificial Sequence
  Synthetic
aaagcggctgcattgtttgctaagactcataacttgattccactacaagaggtaccgatggacagatttgtcatg

SEQ ID NO: 329167 - DNA, 75 bp, Artificial Sequence
  Synthetic
acagttgcttgaagggaagaaagggattcagtactactaaaggaaagttgtattcgtacttcgaaggcaccaaat

SEQ ID NO: 329168 - DNA, 75 bp, Artificial Sequence
  Synthetic
gacatgaagcgcgacgttaaagtcactccaggaacaaaacatactgaggaacgtccgaaggtacaagtcatccag

SEQ ID NO: 329169 - DNA, 75 bp, Artificial Sequence
  Synthetic
tccatcaagcagcaaaggatatggcggagataaaggtcctgttcccaaatgaccaggaaagcaacgaacaactgt

SEQ ID NO: 329170 - DNA, 75 bp, Artificial Sequence
  Synthetic
gtgcctacatattgggagagaccatggaaacaatccgcgaaaaatgcccggttgaccacaacccgtcgtctagcc

SEQ ID NO: 329171 - DNA, 75 bp, Artificial Sequence
  Synthetic
gcggcagaacccctggccactgcgtacttatgcgggattcacatagaatttgtccgcagacttactgccgtcctc

SEQ ID NO: 329172 - DNA, 75 bp, Artificial Sequence
  Synthetic
ctccctaacatacatacgctctttgacatgtccgcagaggactttgatgctatcatagccgaacactttaagcag

SEQ ID NO: 329173 - DNA, 75 bp, Artificial Sequence
  Synthetic
gtccacagactcagaagcaacaacgtcaaagaagttacagtatgctcctccacccctcttccaaagtataaaatc

SEQ ID NO: 329174 - DNA, 75 bp, Artificial Sequence
  Synthetic
ggcgacccggtccttgaaacagacatcgcatcgtttgacaaaagccaagatgacgccatggcattaacaggtctg

SEQ ID NO: 329175 - DNA, 75 bp, Artificial Sequence
  Synthetic
aagaatgttcagaaggttcagtgcacgaaagtagtcctgtttaacccgcatacccccgcattcgttcccgcccgt

SEQ ID NO: 329176 - DNA, 75 bp, Artificial Sequence
  Synthetic
atgatacttgaggacttgggtgtggaccaacccttgctagacttgattgagtgtgcatttggagaaatatcgtcc

SEQ ID NO: 329177 - DNA, 75 bp, Artificial Sequence
  Synthetic
aaggccgccgcactgtttgcaaagacgcataatttggtcccattgcaagaagtgcctatggatagatttatcatg

SEQ ID NO: 329178 - DNA, 75 bp, Artificial Sequence
  Synthetic
aagtacatagaagtgccagaacagcctgcagctccgcctgcacaggacgaggaggcccccgaagctgtagcgaca

SEQ ID NO: 329179 - DNA, 75 bp, Artificial Sequence
  Synthetic
ctgcagctccgcctgcacaggacgaggaggcccccgaagctgtagcgacaccagcaccacctgcagccgataaca

SEQ ID NO: 329180 - DNA, 75 bp, Artificial Sequence
  Synthetic
aaccacctgcctacgggtactggttttaaattcggggcgatgatgaaatccggaatgttcctcacactttttgtc

SEQ ID NO: 329181 - DNA, 75 bp, Artificial Sequence
  Synthetic
cctcgcttgatgtcacggacatctcactggacatggatgacagtagcgaaggctcacttttttcgagctttagcg

SEQ ID NO: 329182 - DNA, 75 bp, Artificial Sequence
  Synthetic
aacaccgtactcaacgtcgtgattgctagcagagtacttgaagaccggcttaaaacgtccagatgtacagcgttc

SEQ ID NO: 329183 - DNA, 75 bp, Artificial Sequence
  Synthetic
ttaaaaacgtgcacgttccgtacacgcaagctgcttcaggatttgagatgtggaagaacaactcaggtcgaccac

SEQ ID NO: 329184 - DNA, 75 bp, Artificial Sequence
  Synthetic
gatcggacaattctattactagtatggaccgttggtcgtcaggacctagttcgctagagatagtagatcgaaggc

SEQ ID NO: 329185 - DNA, 75 bp, Artificial Sequence
  Synthetic
attggcgacgataacatcatacatggagtgatctccgataaggaaatggctgaccgatgcgccacgtggcttaac

SEQ ID NO: 329186 - DNA, 75 bp, Artificial Sequence
  Synthetic
atggaagtaaaaatcatcgatgcggtcatcggtgaaagtccgccgtatttttgcggcggcttcatactgcaagat

SEQ ID NO: 329187 - DNA, 75 bp, Artificial Sequence
  Synthetic
ccgccaaggctaaagaagatggcccgcctggcagcggcaagtaaaacgcaggaagagccaattccaccggcaagt

SEQ ID NO: 329188 - DNA, 75 bp, Artificial Sequence
  Synthetic
tcagtcacacttaccgcatgccgggtggctgacccattgaagagactgttcaagcttggaaaaccgctacccgcg

SEQ ID NO: 329189 - DNA, 75 bp, Artificial Sequence
  Synthetic
tgccgccttcattaggatatcggatgcgccgttagtttcgacggttaaatgtgaggtcagcgaatgtacttattc

SEQ ID NO: 329190 - DNA, 75 bp, Artificial Sequence
  Synthetic
gacgacaatcaagacgaggataggagacgcgccctcctggatgagaccaaagcgtggtttagagtcggtattact

SEQ ID NO: 329191 - DNA, 75 bp, Artificial Sequence
  Synthetic
ctgacactagactccgccgtggcgactaggtacgaggtggataacatcgcacccgtattgttggcactacggacg

SEQ ID NO: 329192 - DNA, 75 bp, Artificial Sequence
  Synthetic
tttgcctcgagcaaaaaggcatttcaggccatcagaggagaagtaaagcagctctacggtggtcctaaatagtgc

SEQ ID NO: 329193 - DNA, 75 bp, Artificial Sequence
  Synthetic
cgtcctgtttgggtcatttgaaccaggcgaagtgaactcaatcatatcgtcccgatcagccgtatcttttccacc

SEQ ID NO: 329194 - DNA, 75 bp, Artificial Sequence
  Synthetic
attgacggcgtagtatacactattgaatcaaacagccgaccaattgcactaccatcacaatggagaagccagtag

SEQ ID NO: 329195 - DNA, 75 bp, Artificial Sequence
  Synthetic
attgtcggcgtagtatacactattgaatcaaacagccgaccaattgcactaccatcacaatggagaagccagtag

SEQ ID NO: 329196 - DNA, 75 bp, Artificial Sequence
  Synthetic
attgccggcgtagtatacactattgaatcaaacagccgaccaattgcactaccatcacaatggagaagccagtag

SEQ ID NO: 329197 - DNA, 75 bp, Artificial Sequence
  Synthetic
attggcggcgtagtatacactattgaatcaaacagccgaccaattgcactaccatcacaatggagaagccagtag

SEQ ID NO: 329198 - DNA, 75 bp, Artificial Sequence
  Synthetic
tttgacggcgtagtatacactattgaatcaaacagccgaccaattgcactaccatcacaatggagaagccagtag

SEQ ID NO: 329199 - DNA, 75 bp, Artificial Sequence
  Synthetic
tttgtcggcgtagtatacactattgaatcaaacagccgaccaattgcactaccatcacaatggagaagccagtag

SEQ ID NO: 329200 - DNA, 75 bp, Artificial Sequence
  Synthetic
tttgccggcgtagtatacactattgaatcaaacagccgaccaattgcactaccatcacaatggagaagccagtag

SEQ ID NO: 329201 - DNA, 75 bp, Artificial Sequence
  Synthetic
tttggcggcgtagtatacactattgaatcaaacagccgaccaattgcactaccatcacaatggagaagccagtag

SEQ ID NO: 329202 - DNA, 75 bp, Artificial Sequence
  Synthetic
cttgacggcgtagtatacactattgaatcaaacagccgaccaattgcactaccatcacaatggagaagccagtag

SEQ ID NO: 329203 - DNA, 75 bp, Artificial Sequence
  Synthetic
cttgtcggcgtagtatacactattgaatcaaacagccgaccaattgcactaccatcacaatggagaagccagtag

SEQ ID NO: 329204 - DNA, 75 bp, Artificial Sequence
  Synthetic
cttgccggcgtagtatacactattgaatcaaacagccgaccaattgcactaccatcacaatggagaagccagtag

SEQ ID NO: 329205 - DNA, 75 bp, Artificial Sequence
  Synthetic
cttggcggcgtagtatacactattgaatcaaacagccgaccaattgcactaccatcacaatggagaagccagtag

SEQ ID NO: 329206 - DNA, 75 bp, Artificial Sequence
  Synthetic
gttgacggcgtagtatacactattgaatcaaacagccgaccaattgcactaccatcacaatggagaagccagtag

SEQ ID NO: 329207 - DNA, 75 bp, Artificial Sequence
  Synthetic
gttgtcggcgtagtatacactattgaatcaaacagccgaccaattgcactaccatcacaatggagaagccagtag

SEQ ID NO: 329208 - DNA, 75 bp, Artificial Sequence
  Synthetic
gttgccggcgtagtatacactattgaatcaaacagccgaccaattgcactaccatcacaatggagaagccagtag

SEQ ID NO: 329209 - DNA, 75 bp, Artificial Sequence
  Synthetic
gttggcggcgtagtatacactattgaatcaaacagccgaccaattgcactaccatcacaatggagaagccagtag

SEQ ID NO: 329210 - DNA, 75 bp, Artificial Sequence
  Synthetic
actatcatacacagtatatgatttgacaccgcaccgccaccatgaatagaggaatatttaacatgctgagccgcc

SEQ ID NO: 329211 - DNA, 75 bp, Artificial Sequence
  Synthetic
acgcaagcagagacgtagacgcaggagcaggaggaccgaatactgactaaccggggtaggtgggtacatattttc

SEQ ID NO: 329212 - DNA, 75 bp, Artificial Sequence
  Synthetic
tatgccagcaaactggcggaaaaagcatgcaagattacgaataagaacttgcatgagaagatcaaggacctccgg

SEQ ID NO: 329213 - DNA, 75 bp, Artificial Sequence
  Synthetic
gccccttccccgcccccacagctatgtggaggcctaggcgaaggaggcaggcggcaccactgcccgcccgtaatg

SEQ ID NO: 329214 - DNA, 75 bp, Artificial Sequence
  Synthetic
gacggacacaggccctgggcacttgcaaatgaagtccgttctgcagaaccagcttacagaaccgaccttggagcg

SEQ ID NO: 329215 - DNA, 75 bp, Artificial Sequence
  Synthetic
ggttggcatcccaaattcaacagctaaccacagctgtcagtgccctagtcattggtcaagccacccgacctcaac

SEQ ID NO: 329216 - DNA, 75 bp, Artificial Sequence
  Synthetic
ccggtgctcgacacgtcgaaagaggaacagctcaaactcaggtaccagatgatgcccaccgaagccaataaaagc

SEQ ID NO: 329217 - DNA, 75 bp, Artificial Sequence
  Synthetic
ccacccagttcatgttctcggctatggcaggttcgtaccctgcgtacaacaccaactgggccgacgaaaaagtcc

SEQ ID NO: 329218 - DNA, 75 bp, Artificial Sequence
  Synthetic
aaccaaggccacgcccgctaccacgccctaagaagcagtccccgaagcaaccaccgaatgctaaaaagacaaaac

SEQ ID NO: 329219 - DNA, 75 bp, Artificial Sequence
  Synthetic
aggtaccagtctcgaaaagtagaaaatcaaaaagctataaccactgagcgattgctatcagggctacgactgtat

SEQ ID NO: 329220 - DNA, 75 bp, Artificial Sequence
  Synthetic
cgcaggagaacaaggagaaacaacccgcaaaaccgaagccgggtaagagacagcgtatggcactaaaattgatgc

SEQ ID NO: 329221 - DNA, 75 bp, Artificial Sequence
  Synthetic
tgacaggactctttgacgtgaacaacgaagccggtgacgtaataggacacgccctcgctatggaaggcaaagtga

SEQ ID NO: 329222 - DNA, 75 bp, Artificial Sequence
  Synthetic
cttctgaggaagcgtggtgcataatgccatgcagcgtctgtataatttcttttattattcttttatcaattaacc

SEQ ID NO: 329223 - DNA, 75 bp, Artificial Sequence
  Synthetic
acaagggttcagcaaatgggccaaggagcgcaaagaagaccttgacaatgaaaaaatgctgggtaccagagagcg

SEQ ID NO: 329224 - DNA, 75 bp, Artificial Sequence
  Synthetic
aatcaaacagccgaccaattgcactaccatcacaatggagaagccagtagttaacgtagacgtagaccctcagag

SEQ ID NO: 329225 - DNA, 75 bp, Artificial Sequence
  Synthetic
accatcacaatggagaagccagtagttaacgtagacgtagaccctcagagtccgtttgtcgtgcaactgcaaaag

SEQ ID NO: 329226 - DNA, 75 bp, Artificial Sequence
  Synthetic
tatcagattaccgacgagtacgatgcttatttggatatggtagatgggacagtcgcttgcctggatactgcaacc

SEQ ID NO: 329227 - DNA, 75 bp, Artificial Sequence
  Synthetic
tgaagccacttcacgtgaaaggggtcatagaccacccggttttggcaaagctgaaatttaccaagtcatcagcgt

SEQ ID NO: 329228 - DNA, 75 bp, Artificial Sequence
  Synthetic
acgacatggagttcgcccagcttccagccagtatgaaaagcgaagcatttgcatacaccagcgagcaccctgaag

SEQ ID NO: 329229 - DNA, 75 bp, Artificial Sequence
  Synthetic
ttttgccccgccaagcttaggagttacccgaaaagacacgagtacagagccccgaacatccgcagtgcggttcca

SEQ ID NO: 329230 - DNA, 75 bp, Artificial Sequence
  Synthetic
catggaggccaaggctgctttcgaggatgctcaggaggaatccagagcggagaagctccgagaagcactcccacc

SEQ ID NO: 329231 - DNA, 75 bp, Artificial Sequence
  Synthetic
gcttctacaactggcatcatggtgccgtgcagtacagcggcggtcgctttacagtcccgcgcggagttgggggaa

SEQ ID NO: 329232 - DNA, 75 bp, Artificial Sequence
  Synthetic
attggcggcgtagtacacactattgaatcaaacagccgaccaattgcactaccatcacaatggagaagccagtag

SEQ ID NO: 329233 - DNA, 75 bp, Artificial Sequence
  Synthetic
aaggcgacagtggaagaccgatcatggataatacaggtaaggtggtcgcgatagtgctgggcggcgctgacgaag

SEQ ID NO: 329234 - DNA, 75 bp, Artificial Sequence
  Synthetic
gaattgccaacgctggactcagcgacattcaacgtcgaatgctttcgaaaatacgcatgcaacgacgagtattgg

SEQ ID NO: 329235 - DNA, 75 bp, Artificial Sequence
  Synthetic
agaagacccggaccgcatgatgaaatatgccagtaaactggcggaaaaagcatgcaagattacaaacaagaactt

SEQ ID NO: 329236 - DNA, 75 bp, Artificial Sequence
  Synthetic
gcgcccgcactgctctctccgtcgtcacttggaacagcaaaggaaagaccatcaaaacgactccggaagggactg

SEQ ID NO: 329237 - DNA, 75 bp, Artificial Sequence
  Synthetic
gaggagttcgctcgaaagccaattaggattactactgagttcgtcaccgcatacgtggccagactgaaaggccct

SEQ ID NO: 329238 - DNA, 75 bp, Artificial Sequence
  Synthetic
aggaatggtctgcagcaccattagtcacggctatgtgcttctttgagaatgtatcgttcccgtgcagtcgtccgc

SEQ ID NO: 329239 - DNA, 75 bp, Artificial Sequence
  Synthetic
ttagcactgagtgagagcgccacgctagtgtacaacgaaagagagtttgtgaaccgcaagctgtaccatattgcc

SEQ ID NO: 329240 - DNA, 75 bp, Artificial Sequence
  Synthetic
ggattactactgagttcgtcaccgcatacgtggccagactgaaaggccctaaggccgccgcactgtttgcgaaga

SEQ ID NO: 329241 - DNA, 75 bp, Artificial Sequence
  Synthetic
ctacgtgctattcccgaaaaccatctcgtgcccttgacatcctggaggagaacgtgaacaacgacgcctacgata

SEQ ID NO: 329242 - DNA, 75 bp, Artificial Sequence
  Synthetic
ggtcatgtaaggataataccacaagcaaatgaccgtatgatcggacagtacatcgttgtctcgccaacctctgtg

SEQ ID NO: 329243 - DNA, 75 bp, Artificial Sequence
  Synthetic
ccttattagcggcagtgttgaagtgcaggacgtccggtcggaacaaacgcagcatcaccgacgatttcaccctga

SEQ ID NO: 329244 - DNA, 75 bp, Artificial Sequence
  Synthetic
accctgtactggattggcttcgacaccacccagttcatgttctcggccatggcaggctcgtaccctgcgtacaac

SEQ ID NO: 329245 - DNA, 75 bp, Artificial Sequence
  Synthetic
ttgagggactgaagactcgacccgtggtcccgtacaaggttgaaacaataggagtgataggcgcaccaggatcgg

SEQ ID NO: 329246 - DNA, 75 bp, Artificial Sequence
  Synthetic
ccagcccgtacctgggcacttgctcgtattgccatcatactgaaccctgcttcagcccaattaagatcgagcaag

SEQ ID NO: 329247 - DNA, 75 bp, Artificial Sequence
  Synthetic
accaactgggccgacgagaaagtccttgaagcgcgtaacatcggactttgcagcacaaagctgagtgaaggcagg

SEQ ID NO: 329248 - DNA, 75 bp, Artificial Sequence
  Synthetic
acatgtcggcggaggactttgatgcaatcatagcagaacacttcaagcaaggtgacccggtactggagacggata

SEQ ID NO: 329249 - DNA, 75 bp, Artificial Sequence
  Synthetic
tttgggacgaggcggacgacggatcaatacgaatacagacatccgcccagttcgggtacgaccaaagtggggcag

SEQ ID NO: 329250 - DNA, 75 bp, Artificial Sequence
  Synthetic
tgtcacggcacgtgatcttgttaccagcggaaagaaagaaaactgccgcgaaattcaggccgatgtgctacggct

SEQ ID NO: 329251 - DNA, 75 bp, Artificial Sequence
  Synthetic
cagacgtcaacaagtacaggtacatgtcaattgaccaggaccatgccgtgaaagaaggctctatggatcatatca

SEQ ID NO: 329252 - DNA, 75 bp, Artificial Sequence
  Synthetic
atgatcttggaggacctgggtgtggaccaaccactactcgacttgatcgagtgcgccttcggagaaatatcatcc

SEQ ID NO: 329253 - DNA, 75 bp, Artificial Sequence
  Synthetic
agatcagcacatccgggccctgtaggcggcttcaatcacaaaggtacttcttgcttgcgaaatgcccaccgggag

SEQ ID NO: 329254 - DNA, 75 bp, Artificial Sequence
  Synthetic
gatgccgcaaagccgtagaagtgctgtatgttgacgaagcgttcgcgtgccacgcaggagcactacttgccttga

SEQ ID NO: 329255 - DNA, 75 bp, Artificial Sequence
  Synthetic
acccatttgcccacgggtacccgtttcaaattcggggcgatgatgaaatccggaatgttcctcacgctttttgtc

SEQ ID NO: 329256 - DNA, 75 bp, Artificial Sequence
  Synthetic
ttgcaatcgtcagaccccgtcataaggtagtgctatgcggagaccctaagcaatgcggattcttcaacatgatgc

SEQ ID NO: 329257 - DNA, 75 bp, Artificial Sequence
  Synthetic
atagcgttacggttagcataaccggcggcactatggccacctcctgtacattagcacgtaaaataaggcaaaaat

SEQ ID NO: 329258 - DNA, 75 bp, Artificial Sequence
  Synthetic
aatacagttctgaatgttgtcatcgccagcagagtgttggaagagcggctcaaaacgtccaaatgtgcagcattc

SEQ ID NO: 329259 - DNA, 75 bp, Artificial Sequence
  Synthetic
tcgtaggacgtgagaagtatgaccttcccccagcacacggaaagaacatcccctgcaccgtgtatgatcgtctta

SEQ ID NO: 329260 - DNA, 75 bp, Artificial Sequence
  Synthetic
aaaggagaacgggtatcgttccctgtgtgcacgtatatcccggccaccatatgcgatcagatgaccggcataatg

SEQ ID NO: 329261 - DNA, 75 bp, Artificial Sequence
  Synthetic
gagaatcaccatcagtcccgggatcacgggagaaaccgtgggatacgcggttacaaataatagcgagggattctt

SEQ ID NO: 329262 - DNA, 75 bp, Artificial Sequence
  Synthetic
aggagacgtcagccggatacatcaccatgcacaggcctggacctcatgcctatacctcatacctagaggctacct

SEQ ID NO: 329263 - DNA, 75 bp, Artificial Sequence
  Synthetic
ggtagtgctatgcggagaccctaagcaatgcggattcttcaacatgatgcaactaaaggtatatttcaaccaccc

SEQ ID NO: 329264 - DNA, 75 bp, Artificial Sequence
  Synthetic
atggaagttaagatcattgacgcagtcatcggcgagagaccaccctacttctgcggcggattcatcttgcaagac

SEQ ID NO: 329265 - DNA, 75 bp, Artificial Sequence
  Synthetic
caggaaaaatttacgccaaaccaccatcaggaaagaacatcacgtacgagtgtaagtgtggcgattataaaactg

SEQ ID NO: 329266 - DNA, 75 bp, Artificial Sequence
  Synthetic
ccagcgaatcgtcattaacggtaagaccaacaggaacaccaacaccatgcaaaattaccttctgccaattattgc

SEQ ID NO: 329267 - DNA, 75 bp, Artificial Sequence
  Synthetic
tcggttacctccacagcgtgtcgcgtggctgaccccttgaaaaggctgtttaagttgggtaaaccgctcccagcc

SEQ ID NO: 329268 - DNA, 75 bp, Artificial Sequence
  Synthetic
cgaccgtttccgtcagaacagagatcgcaggatgtactgccataaaacagtgcgtggcgtacaagagcgaccaga

SEQ ID NO: 329269 - DNA, 75 bp, Artificial Sequence
  Synthetic
gtcccgctccccgtaccaatccgttcagctgcaagactaacgtttgctgggcgaaacgactggaaccgatactgg

SEQ ID NO: 329270 - DNA, 75 bp, Artificial Sequence
  Synthetic
agtatggaaaactttacagggcgacccatggattaagcagctcactaacgtaccaaaaggaaattttcaagccac

SEQ ID NO: 329271 - DNA, 75 bp, Artificial Sequence
  Synthetic
caagcttacatatggctgcctgtgggcgtttcgcactaagaaagtgcactcgttctatcgcccacctggaacgca

SEQ ID NO: 329272 - DNA, 75 bp, Artificial Sequence
  Synthetic
ggcgtggtttagagtaggtataacagacaccttagcagtggccgtggcgactcggtatgaggtagataacattac

SEQ ID NO: 329273 - DNA, 75 bp, Artificial Sequence
  Synthetic
ccaagtgggtgttcaactcgcccgatctaatcaggcacgctgaccacacagcccaaggtaaattccactttcctt

SEQ ID NO: 329274 - DNA, 75 bp, Artificial Sequence
  Synthetic
tcaagcctaccttcagtacatgcctggtaccactggcacacgagccgactgtaattcatgggttcaaacacataa

SEQ ID NO: 329275 - DNA, 75 bp, Artificial Sequence
  Synthetic
cggccatctacgccctggacgtaatctgcattaagtttttcggcatggacttgacaagcggactgttttccaaac

SEQ ID NO: 329276 - DNA, 75 bp, Artificial Sequence
  Synthetic
aaccatcgtaaaagtcccagcctcttttagcgctttccccatgtcatccgtgtggacgacctctttgcccatgtc

SEQ ID NO: 329277 - DNA, 75 bp, Artificial Sequence
  Synthetic
gcctccatttagacacagaccacccaaccttgctcaccattagaagactgggcgagaaacccgaaccgacgtcgg

SEQ ID NO: 329278 - DNA, 75 bp, Artificial Sequence
  Synthetic
ttgacaagcggactgttttccaaacagagcatcccgttaacgtaccatcctgccgattcagcgaggccagtagct

SEQ ID NO: 329279 - DNA, 75 bp, Artificial Sequence
  Synthetic
tctctacggtggtcctaaatagtcagcatagtacatttcatctgactaataccacaacaccaccaccatgaatag

SEQ ID NO: 329280 - DNA, 75 bp, Artificial Sequence
  Synthetic
agtggatctcaggaaaaacagttaggaattttactgtcgacagagacgggctagagtatatatggggcaatcacg

SEQ ID NO: 329281 - DNA, 75 bp, Artificial Sequence
  Synthetic
cattgggacaacagcccaggaacccgcaagtatgggtacgatcacgccgttgccgccgaactctcccgtagattt

SEQ ID NO: 329282 - DNA, 75 bp, Artificial Sequence
  Synthetic
aaccggtgagagtatatgcacaagagtccgcccccggtgaccctcacggatggccacacaaaataattcaacact

SEQ ID NO: 329283 - DNA, 75 bp, Artificial Sequence
  Synthetic
attagtggcagacaaaggcatcgaggcagccgcggaagttgtctgcgaagtggaggggcttcaggcggacatcgg

SEQ ID NO: 329284 - DNA, 75 bp, Artificial Sequence
  Synthetic
gggctggcttcccaaattcagcaactgaccacagccgtcagtgccctagtcattggacaggcaactagacctcaa

SEQ ID NO: 329285 - DNA, 75 bp, Artificial Sequence
  Synthetic
tgaccacagccgtcagtgccctagtcattggacaggcaactagacctcaaaacccacgtccacgcccgccgccgc

SEQ ID NO: 329286 - DNA, 75 bp, Artificial Sequence
  Synthetic
actatcaacgccacccagtatacactagcttggctgtagcagcttccgctgtggcggtgatagtcggcctggcca

SEQ ID NO: 329287 - DNA, 75 bp, Artificial Sequence
  Synthetic
aacaccactccgtacttgtggtctcagaggaaaaaattgaagctccccacaagagaatcgaatggatcgccccga

SEQ ID NO: 329288 - DNA, 75 bp, Artificial Sequence
  Synthetic
ccgccgtgatgtgtatctgcagagcgcgacgggagtgcctaaccccgtacgcgttagccccgaatgcagtcatcc

SEQ ID NO: 329289 - DNA, 75 bp, Artificial Sequence
  Synthetic
atctcccgcacgccttagtccccgagcacaaggagaaacaacccggcccggtcaaaaaattcttgagccagttca

SEQ ID NO: 329290 - DNA, 75 bp, Artificial Sequence
  Synthetic
ggtcatgtaaggataatacctcaagcaaatgaccgtatgatcggacagtatatcgtcgtctcgccaacctctgtg

SEQ ID NO: 329291 - DNA, 75 bp, Artificial Sequence
  Synthetic
cgacgtccttggccttattgtgctgcgttcggtccgccaacgccgaatctttcaccgacacgatgggatacctat

SEQ ID NO: 329292 - DNA, 75 bp, Artificial Sequence
  Synthetic
ggaaggtatgcagtagaaccatacgacgctaaagtactgatgccagcaggaagcgccgtaccatggccagaattc

SEQ ID NO: 329293 - DNA, 75 bp, Artificial Sequence
  Synthetic
acagcgtatggcacttaagttggaggccgacagattgttcgacgtcaaaaatgaggacggagatgtcatcgggca

SEQ ID NO: 329294 - DNA, 75 bp, Artificial Sequence
  Synthetic
ggtcgaacagtcaaacatttttctgggtgcagctgtgcatccccttggcagtagtaatagtactcgtacgctgct

SEQ ID NO: 329295 - DNA, 75 bp, Artificial Sequence
  Synthetic
cgcactggccatggaaggaaaggtaatgaaaccactccacgtgaaaggaactattgaccaccctgtgctatcaaa

SEQ ID NO: 329296 - DNA, 75 bp, Artificial Sequence
  Synthetic
atgaaaccactccacgtgaaaggaactattgaccaccctgtgctatcaaagctcaaattcaccaagtcgtcagca

SEQ ID NO: 329297 - DNA, 75 bp, Artificial Sequence
  Synthetic
gttcgtgctgcctcccttttttagtggttgcaggcgcctacctggcgaaggtagacgccttcgaacatgcgacca

SEQ ID NO: 329298 - DNA, 75 bp, Artificial Sequence
  Synthetic
gctcaaattcaccaagtcgtcagcatacgacatggagttcgcacagttgccggtcaacatgaggagtgaggcgtt

SEQ ID NO: 329299 - DNA, 75 bp, Artificial Sequence
  Synthetic
ctgtcccaaatgtgccgaagattccgtataaagctttggtcgagagagccggatacgccccgcttaacttggaaa

SEQ ID NO: 329300 - DNA, 75 bp, Artificial Sequence
  Synthetic
cggtcaacatgaggagtgaggcgttcacctacaccagcgagcaccctgaaggattctataactggcaccacggtg

SEQ ID NO: 329301 - DNA, 75 bp, Artificial Sequence
  Synthetic
acttgtcctctcgggagaactgaccaacccgccctatcacgaactagctcttgagggactgaagactcgacccgc

SEQ ID NO: 329302 - DNA, 75 bp, Artificial Sequence
  Synthetic
ttactgttatgtcttcagaggtcctcccttcgattcaccaagaatacatcacctgcaaatactccactatcgtgc

SEQ ID NO: 329303 - DNA, 75 bp, Artificial Sequence
  Synthetic
cttccccgaaagtgaaatgctgcggttcccttgagtgccaacccgcttcgcatgccgactacaactgcaaagtat

SEQ ID NO: 329304 - DNA, 75 bp, Artificial Sequence
  Synthetic
ttggcggcgtttaccctttcatgtggggtggagcgcaatgtttttgcgacagcgagaacagccagatgagtgagg

SEQ ID NO: 329305 - DNA, 75 bp, Artificial Sequence
  Synthetic
tgtcacggcacgtgatcttgttaccagcggaaagaaagaaaattgccgtgaaattgaggccgacgtgttaaggct

SEQ ID NO: 329306 - DNA, 75 bp, Artificial Sequence
  Synthetic
tcacggccatgtgcttgcttggaaacgtgagcttcccatgcaaccgcccgcccacatgctacacccgcgaaccat

SEQ ID NO: 329307 - DNA, 75 bp, Artificial Sequence
  Synthetic
cgtatgtcgagctatcggccgattgtgcccttgatcacgcacaggcggtgaaagtgcacacagccgcaatgaagg

SEQ ID NO: 329308 - DNA, 75 bp, Artificial Sequence
  Synthetic
gaggggcatgcagatcacgtcgaagacagtggattcggttatgctcaacggatgccacaaagccgtagaagtgct

SEQ ID NO: 329309 - DNA, 75 bp, Artificial Sequence
  Synthetic
ccagagctctcgacatcctcgaagagaacgtgaaccacgaggcctacgataccctgctcaacgccatattgcggt

SEQ ID NO: 329310 - DNA, 75 bp, Artificial Sequence
  Synthetic
tcggactacgcattgtgtatgggaacaccactagcctcctggatgcgtacgtaaacggagtcacgccaggcacat

SEQ ID NO: 329311 - DNA, 75 bp, Artificial Sequence
  Synthetic
cgtgagcttcccatgcaaccgcccgcccacatgctacacccgcgaaccatccagagctctcgacatcctcgaaga

SEQ ID NO: 329312 - DNA, 75 bp, Artificial Sequence
  Synthetic
gcggatcgtccggcagaagcaaaagaagcgtcactgacgactttaccctgaccagcccatacttgggcacatgct

SEQ ID NO: 329313 - DNA, 75 bp, Artificial Sequence
  Synthetic
ggtagtactatgcggggaccctaagcaatgcggattcttcaacatgatgcaactaaaggtacatttcaaccaccc

SEQ ID NO: 329314 - DNA, 75 bp, Artificial Sequence
  Synthetic
ctaaagacctgaaagtcattgccggacccatctcgtccgcgttttccccttttgactctaaagtcgtgatacacc

SEQ ID NO: 329315 - DNA, 75 bp, Artificial Sequence
  Synthetic
gagggctcgtgtacaattacgattttccagagtacggggcaatgaaaccgggtgcctttggggacattcaagcta

SEQ ID NO: 329316 - DNA, 75 bp, Artificial Sequence
  Synthetic
accagcccatacttgggcacatgctcgtactgtcaccatactgaaccgtgctttagcccgattaagattgagcag

SEQ ID NO: 329317 - DNA, 75 bp, Artificial Sequence
  Synthetic
tgccatgacgccagaaagggtccacagactcagaagcaacaacgtcaaagaagttacagtatgctcctccacccc

SEQ ID NO: 329318 - DNA, 75 bp, Artificial Sequence
  Synthetic
gctctttgacgggcaacgacctgattgccagcaccgacatacgtttgcttaaacccgcagcaaagaatgtgcacg

SEQ ID NO: 329319 - DNA, 75 bp, Artificial Sequence
  Synthetic
gcacacagccagtcacggctattgtatcgacactgcattacgatggaaagatgaaaaccacgaacccgtgcaaga

SEQ ID NO: 329320 - DNA, 75 bp, Artificial Sequence
  Synthetic
gtctgggatgaagcggacgacaacaccatacgcattcagacttccgcccagtttggatacgacaaaagcggagca

SEQ ID NO: 329321 - DNA, 75 bp, Artificial Sequence
  Synthetic
ttccctatacccaagcagcatcaggatttgaaatttggaagaacaactccggaagaccactgcaagagacggccc

SEQ ID NO: 329322 - DNA, 75 bp, Artificial Sequence
  Synthetic
tagtcctgtttaacccgcatacccctgcattcgttcccgcccgtaagtacatagaagcgccagaacagcctgcag

SEQ ID NO: 329323 - DNA, 75 bp, Artificial Sequence
  Synthetic
gggttaagcaactgcaaatcgactatcccggacatgaggtaatgacagccgcggcctctcaagggctaaccagaa

SEQ ID NO: 329324 - DNA, 75 bp, Artificial Sequence
  Synthetic
catttggctgtaagattgccgtcaaccctctgaaggccgtggattgttcctatgggaacatcccgatatcgattg

SEQ ID NO: 329325 - DNA, 75 bp, Artificial Sequence
  Synthetic
atagaagcgccagaacagcctgcagctccgcctgcacaggccgaggaggcccccgaagttgcagcaacaccaaca

SEQ ID NO: 329326 - DNA, 75 bp, Artificial Sequence
  Synthetic
gacagcgtgacggttagcatagcgagtagcaactcagcaacgtcatgcacgatggcccgcaagataaaaccaaaa

SEQ ID NO: 329327 - DNA, 75 bp, Artificial Sequence
  Synthetic
aaggagtatatgccgtccggcaaaaagtcaatgaaaacccgctgtacgcgatcacatcagagcatgtgaacgtgt

SEQ ID NO: 329328 - DNA, 75 bp, Artificial Sequence
  Synthetic
atatcccccacgccgcctttattagaccatccgatgcgccatttatctccgaagtgaagtgcgaagtcagcgact

SEQ ID NO: 329329 - DNA, 75 bp, Artificial Sequence
  Synthetic
tgctcacccgcactgaggacagactagtatggaaaaccttacagggcgacccatggattaagcagctcactaatg

SEQ ID NO: 329330 - DNA, 75 bp, Artificial Sequence
  Synthetic
tacctcccgttcacggtaagaagattccttgcacagtgtatgaccgtctgaaagaaacgaccgccggctatatca

SEQ ID NO: 329331 - DNA, 75 bp, Artificial Sequence
  Synthetic
gcacatactctgctgacttcggaggcatggccaccctacagtatgtgtctgaccgagagggccagtgcccagtgc

SEQ ID NO: 329332 - DNA, 75 bp, Artificial Sequence
  Synthetic
aaagaaacgaccgccggctatatcactatgcacaggcccggaccgcatgcctacacatcctacctggaggaatca

SEQ ID NO: 329333 - DNA, 75 bp, Artificial Sequence
  Synthetic
tacctaaaggaaattttcaagccaccattgaggactgggaagctgaacacaagggaataattgctgcgataaaca

SEQ ID NO: 329334 - DNA, 75 bp, Artificial Sequence
  Synthetic
attcccattcaagtaccgccacactccaggaatcaactgttcacgtcttggaaaaaggggcgacgacagtgcact

SEQ ID NO: 329335 - DNA, 75 bp, Artificial Sequence
  Synthetic
tcagggaaagtttacgcaaagccaccatccgggaagaacattacgtacgagtgcaagtgcggcgattacaagacc

SEQ ID NO: 329336 - DNA, 75 bp, Artificial Sequence
  Synthetic
gccccgctccccgtaccaatccgttcagctgtaagactaacgtttgctgggcgaaagcgctggaaccgatactgg

SEQ ID NO: 329337 - DNA, 75 bp, Artificial Sequence
  Synthetic
tcagcacagctagccctcacgccagctttgtggtctcattatgcggaaagaagacgacctgcaccgcaggatgca

SEQ ID NO: 329338 - DNA, 75 bp, Artificial Sequence
  Synthetic
ggaaccgttacgacccgtactgaaatcactggctgcaccgccattaagcagtgcgtcgcctataagagcgaccag

SEQ ID NO: 329339 - DNA, 75 bp, Artificial Sequence
  Synthetic
ccacggccggtatcgtacttaccggttgccagtggagcgagctgttcccacagtttgcggatgacaaaccacact

SEQ ID NO: 329340 - DNA, 75 bp, Artificial Sequence
  Synthetic
gtgcgtcgcctataagagcgaccagacgaagtgggtctttaactcgccggacttgatcaggcatgccgatcacac

SEQ ID NO: 329341 - DNA, 75 bp, Artificial Sequence
  Synthetic
cggccatttacgccttagacgtaatctgtattaagtttttcggcatggacttgacaagcggactgttttccaaac

SEQ ID NO: 329342 - DNA, 75 bp, Artificial Sequence
  Synthetic
aaccacctgtcggccacatagtcagcacaccccacaagaaggaccaagagttccagaccgccgtctccaggacat

SEQ ID NO: 329343 - DNA, 75 bp, Artificial Sequence
  Synthetic
ggcccaagggaaattgcatttgcctttcaagttgatcccgagtacctgcatggtccctgttgcccacgcgccgaa

SEQ ID NO: 329344 - DNA, 75 bp, Artificial Sequence
  Synthetic
catggagctggctcttcgcgctgttcggaggagcttcgtccctagtaatcatgggactgttaatcttctcctgca

SEQ ID NO: 329345 - DNA, 75 bp, Artificial Sequence
  Synthetic
tggtccctgttgcccacgcgccgaacgtaatacacggcttcaaacacatcagcctccaattagacacagaccacc

SEQ ID NO: 329346 - DNA, 75 bp, Artificial Sequence
  Synthetic
gcatgatgctcactaacaccagaagatgaccgctatgccccactgacctgaccagtaaccggtgtgcataatgca

SEQ ID NO: 329347 - DNA, 75 bp, Artificial Sequence
  Synthetic
agcctccaattagacacagaccacctgacactgctcaccaccaggagactaggggcaaacccggaaccaaccact

SEQ ID NO: 329348 - DNA, 75 bp, Artificial Sequence
  Synthetic
tgccgccgaactctctcgtagatttccggtgttccagctagctgggaaaggcacacagcttgatttgcagacggg

SEQ ID NO: 329349 - DNA, 75 bp, Artificial Sequence
  Synthetic
aggggcaaacccggaaccaaccactgaatggatcattggaaagacggtcagaaacttcaccgtcgaccgagatgg

SEQ ID NO: 329350 - DNA, 75 bp, Artificial Sequence
  Synthetic
ctggtctggtacattagatccccgcataatgcgggccaactagcaacgtataaatagcagtgcataacgctgcat

SEQ ID NO: 329351 - DNA, 75 bp, Artificial Sequence
  Synthetic
gaaacttcaccgtcgaccgagatggcctggagtacatatggggcaatcacgaaccagtaagggtctatgcccaag

SEQ ID NO: 329352 - DNA, 75 bp, Artificial Sequence
  Synthetic
cagaactagagttatctctgcacagtataacttggtcccagtgaaccgcaatctcccccacgccttagttcccga

SEQ ID NO: 329353 - DNA, 75 bp, Artificial Sequence
  Synthetic
gaaccagtaagggtctatgcccaagagtcagcaccaggagaccctcacggatggccacacgaaatagtacagcat

SEQ ID NO: 329354 - DNA, 75 bp, Artificial Sequence
  Synthetic
cacgttgcaatataaacacttatacatcgcaaacgccaaaactcaagtactcctgaggaagcatggtgcataatg

SEQ ID NO: 329355 - DNA, 75 bp, Artificial Sequence
  Synthetic
ataatgccatgcagcgtttgcattatctttttatatttttattattaataatcaatattttgtttttaacattcc

SEQ ID NO: 329356 - DNA, 75 bp, Artificial Sequence
  Synthetic
atctcccccacgccttagttcccgagcacaaggagaaacaaccaggcccggtcgaaaaatttttgaaccagttca

SEQ ID NO: 329357 - DNA, 75 bp, Artificial Sequence
  Synthetic
ccggtgttccagctagctgggaaaggcacacagcttgatttgcagacgggcagaactagagttatctctgcacag

SEQ ID NO: 329358 - DNA, 75 bp, Artificial Sequence
  Synthetic
tgtggcgatgatgattggcgtaactgttgcagcattatgtgcctgtaaagcgcgccgtgagtgcctgacgccata

SEQ ID NO: 329359 - DNA, 75 bp, Artificial Sequence
  Synthetic
aagagaatcgaatggatcgccccgattggcatagccggtgcagacaagaactacaacctggctttcgggttcccg

SEQ ID NO: 329360 - DNA, 75 bp, Artificial Sequence
  Synthetic
gttgcagcattatgtgcctgtaaagcgcgccgtgagtgcctgacgccatatgccctggccccaaatgccgtaatt

SEQ ID NO: 329361 - DNA, 75 bp, Artificial Sequence
  Synthetic
tgccctggccccaaatgccgtaattccaacttcgctggcactcttgtgctgtgttaggtcggctaacgctgaaac

SEQ ID NO: 329362 - DNA, 75 bp, Artificial Sequence
  Synthetic
gttcaccgagaccatgagttatttatggtcgaacagccagccgttcttctgggtccagctgtgcatacccttggc

SEQ ID NO: 329363 - DNA, 75 bp, Artificial Sequence
  Synthetic
ttgcctagatactgcaactttttgccccgccaagcttagaagttacccgaaaagacacgagtatagagccccaaa

SEQ ID NO: 329364 - DNA, 75 bp, Artificial Sequence
  Synthetic
cccgccaagcttagaagttacccgaaaagacacgagtatagagccccaaacactcgcagtgcggttccatcagcg

SEQ ID NO: 329365 - DNA, 75 bp, Artificial Sequence
  Synthetic
ccgacaattagacaacagtcgcacacgccaattcactccgcatcatctgaattgcgtgatttcgtccgtgtacga

SEQ ID NO: 329366 - DNA, 75 bp, Artificial Sequence
  Synthetic
agggtacgccccgctcaatctggagattactgtcatgtcctcggaggttttaccttccaccaaccaagagtacat

SEQ ID NO: 329367 - DNA, 75 bp, Artificial Sequence
  Synthetic
taccttccaccaaccaagagtacatcacttgtaaattcactaccgtggtcccctcccctaaagtcaaatgctgcg

SEQ ID NO: 329368 - DNA, 75 bp, Artificial Sequence
  Synthetic
ccctcccctaaagtcaaatgctgcggctccttggaatgtcagcccgccgctcacgcagactatacctgcaaggtc

SEQ ID NO: 329369 - DNA, 75 bp, Artificial Sequence
  Synthetic
agcagttgtcaatgcagccaatccgctgggcagaccaggcgaaggagtctgccgtgccatctacaaacgttggcc

SEQ ID NO: 329370 - DNA, 75 bp, Artificial Sequence
  Synthetic
tttggaggggtgtaccccttcatgtggggaggagcacaatgtttttgcgacagtgagaacagccagatgagtgag

SEQ ID NO: 329371 - DNA, 75 bp, Artificial Sequence
  Synthetic
aaacagtttcaccgattcatctacagagacaggcactgcaaaactgactgtgtgccaaggaaagaaagtgatcca

SEQ ID NO: 329372 - DNA, 75 bp, Artificial Sequence
  Synthetic
gcacgaaacacacagaagaaagaccgaaagtacaagtgctacaagccgcagaacccctggcgaccgcttacctgt

SEQ ID NO: 329373 - DNA, 75 bp, Artificial Sequence
  Synthetic
gcgtacgtcgaattgtcagcagattgcgcgactgaccacgcgcaggcgattaaggtacatactgccgcgatgaaa

SEQ ID NO: 329374 - DNA, 75 bp, Artificial Sequence
  Synthetic
tatggcgttaactggcctgatgatcttggaagacctgggtgtggaccaaccactactcgacttgatcgagtgcgc

SEQ ID NO: 329375 - DNA, 75 bp, Artificial Sequence
  Synthetic
tctaaagacctgaaagtcatagctggaccgatttcagcatcgtttacaccattcgatcacaaggtcgttatccat

SEQ ID NO: 329376 - DNA, 75 bp, Artificial Sequence
  Synthetic
cgcggcctggtgtacaactatgacttcccggaatacggagcgatgaaaccaggagcgtttggagacattcaagct

SEQ ID NO: 329377 - DNA, 75 bp, Artificial Sequence
  Synthetic
gaactgatgctgacgtaaccatctactgcctggataagaagtggaaggaaagaatcgacgcggtgctccaactta

SEQ ID NO: 329378 - DNA, 75 bp, Artificial Sequence
  Synthetic
tcccggaatacggagcgatgaaaccaggagcgtttggagacattcaagctacctccttgactagcaaagacctca

SEQ ID NO: 329379 - DNA, 75 bp, Artificial Sequence
  Synthetic
ctgcctggataagaagtggaaggaaagaatcgacgcggtgctccaacttaaggagtctgtaacagagctgaagga

SEQ ID NO: 329380 - DNA, 75 bp, Artificial Sequence
  Synthetic
aggagtctgtaacagagctgaaggatgaagatatggagattgacgacgagctagtatggatccatccggacagtt

SEQ ID NO: 329381 - DNA, 75 bp, Artificial Sequence
  Synthetic
tcgccagcacagacattaggctacttaagccttccgccaagaacgtgcatgtcccgtacacgcaggccgcatcag

SEQ ID NO: 329382 - DNA, 75 bp, Artificial Sequence
  Synthetic
gtcccgtacacgcaggccgcatcaggattcgagatgtggaaaaacaactcaggccgcccactgcaggaaaccgcc

SEQ ID NO: 329383 - DNA, 75 bp, Artificial Sequence
  Synthetic
gattcgagatgtggaaaaacaactcaggccgcccactgcaggaaaccgcccctttcgggtgtaagatcgcagtca

SEQ ID NO: 329384 - DNA, 75 bp, Artificial Sequence
  Synthetic
tactacaaaaggaaagttgtattcgtactttgaaggcaccaaattccatcaagcagcaaaagatatggcggagat

SEQ ID NO: 329385 - DNA, 75 bp, Artificial Sequence
  Synthetic
gttaagatcattgacgcagtcatcggcgagagaccgccttacttctgcggtggattcatcttgcaagattcggtt

SEQ ID NO: 329386 - DNA, 75 bp, Artificial Sequence
  Synthetic
atccgcttcgagcggtggactgctcatacgggaacattcccatttctattgacatcccgaacgctgcctttatca

SEQ ID NO: 329387 - DNA, 75 bp, Artificial Sequence
  Synthetic
aatccgcgaaaaatgcccggtcgaccataacccgtcgtctagcccgccaaaaacgctgccgtgcctttgcatgta

SEQ ID NO: 329388 - DNA, 75 bp, Artificial Sequence
  Synthetic
agactcagaagcaacaacgtcaaagaagttacagtatgctcctccaccccccttccaaagtacaagatcaagaat

SEQ ID NO: 329389 - DNA, 75 bp, Artificial Sequence
  Synthetic
cattcgcattcaagcacagcaaccctccaagagtcgacagttcatgtcctggagaaaggagcggtgacagtacac

SEQ ID NO: 329390 - DNA, 75 bp, Artificial Sequence
  Synthetic
atgaggtagacaacatcacacctgtcctgctggcattgagaacttttgcccagagcaaaagagcatttcaagcca

SEQ ID NO: 329391 - DNA, 75 bp, Artificial Sequence
  Synthetic
ttcagcaccgcgagtccacaggcgaacttcattgtatcgctgtgcggtaagaagacaacatgcaatgcagaatgt

SEQ ID NO: 329392 - DNA, 75 bp, Artificial Sequence
  Synthetic
atagaagtgccagaacagcctgcagctccgcctgcacagactgaggaggcccccgaagttgtagcgacaccagca

SEQ ID NO: 329393 - DNA, 75 bp, Artificial Sequence
  Synthetic
acaccaccaccatgaatagaggattctttaacatgctcggccgccgccccttcccggcccccactgccatgtgga

SEQ ID NO: 329394 - DNA, 75 bp, Artificial Sequence
  Synthetic
ctccgcctgcacagactgaggaggcccccgaagttgtagcgacaccagcaccacctgcagccgatgatacctcgc

SEQ ID NO: 329395 - DNA, 75 bp, Artificial Sequence
  Synthetic
tagtacacactattgaatcgaacagccgaccaattgcactaccatcacaatggagaagccagtagttaacgtaga

SEQ ID NO: 329396 - DNA, 75 bp, Artificial Sequence
  Synthetic
gaccagcaaaactcgatgtacttccgaggaactgatgtgcataatgcatcaggctggtatattagatccccgctt

SEQ ID NO: 329397 - DNA, 75 bp, Artificial Sequence
  Synthetic
tggtggccgacgtccatgccgcccaagagcctgcccctgttccaccgccaaggctaaagaagatggcccgcctgg

SEQ ID NO: 329398 - DNA, 75 bp, Artificial Sequence
  Synthetic
gaggaactgatgtgcataatgcatcaggctggtatattagatccccgcttactgcgggcaatatagcaacaccaa

SEQ ID NO: 329399 - DNA, 75 bp, Artificial Sequence
  Synthetic
actgcgggcaatatagcaacaccaaaactcgacgtacttccgaggaagcgcagtgcataatgctgcgcagtgttg

SEQ ID NO: 329400 - DNA, 75 bp, Artificial Sequence
  Synthetic
caacaccaaaactcgacgtacttccgaggaagcgcagtgcataatgctgcgcagtgttgccacatcatcactata

SEQ ID NO: 329401 - DNA, 75 bp, Artificial Sequence
  Synthetic
aggctaaagaagatggcccgcctggcagcggcaagaaaaacgcaggaagaaccaactccaccggcaagcactagc

SEQ ID NO: 329402 - DNA, 75 bp, Artificial Sequence
  Synthetic
cggatcacttttcgacggtttggcagcggcacaacccccggcaagtacaggccccacggatgtgcctatgtcttt

SEQ ID NO: 329403 - DNA, 75 bp, Artificial Sequence
  Synthetic
acatgagaagtgaggcgttcacctacaccagcgaacaccctgaagggttttacaactggcaccacggagcggtgc

SEQ ID NO: 329404 - DNA, 75 bp, Artificial Sequence
  Synthetic
atttgaaccgggcgaagtgaactcaattatatcgtcccgatcagccgtatcttttccaccacgcaagcagagacg

SEQ ID NO: 329405 - DNA, 75 bp, Artificial Sequence
  Synthetic
ctgcagaaccagcttacagaaccgaccttggagcgtaacgttccggaaagaatctacgccccggtgctcgacacg

SEQ ID NO: 329406 - DNA, 75 bp, Artificial Sequence
  Synthetic
tgctacacccgcgaaccatccagagctcttgacatccttgaagagaacgtgaaccacgaggcctacgacaccctg

SEQ ID NO: 329407 - DNA, 75 bp, Artificial Sequence
  Synthetic
caacaaaagcaggtaccagtctcgaaaagtagaaaatcagaaagccataaccactgagcgactgctttcagggct

SEQ ID NO: 329408 - DNA, 75 bp, Artificial Sequence
  Synthetic
acgactgtataactctgccacagatcagccagaatgttataagatcacctatccgaaaccatcgtattctagcag

SEQ ID NO: 329409 - DNA, 75 bp, Artificial Sequence
  Synthetic
cagccagaatgttataagatcacctatccgaaaccatcgtattctagcagcataccggcgaactactccgaccca

SEQ ID NO: 329410 - DNA, 75 bp, Artificial Sequence
  Synthetic
gagtatgatgcttatttggatatggtagacgggacagtcgcttgcctggatactgcaaccttttgccccgccaag

SEQ ID NO: 329411 - DNA, 75 bp, Artificial Sequence
  Synthetic
tactgcaaccttttgccccgccaagcttagaagttacccgaaaaaacacgagtatagagccccgaacatccgcag

SEQ ID NO: 329412 - DNA, 75 bp, Artificial Sequence
  Synthetic
tgcggttccatcagcgatgcagaacacgttgcaaaatgtgctcattgccgcgactaaacgtaactgcaacgtcac

SEQ ID NO: 329413 - DNA, 75 bp, Artificial Sequence
  Synthetic
tctggttgggctcaaccagcgaattgtcattaacggtaagactaacaggaacaccaataccatgcaaaattacct

SEQ ID NO: 329414 - DNA, 75 bp, Artificial Sequence
  Synthetic
gcaaatgcgtgagttgccaacactggactcagcgacattcaacgtcgaatgcttccgaaaatatgcatgcaacga

SEQ ID NO: 329415 - DNA, 75 bp, Artificial Sequence
  Synthetic
acaccaataccatgcaaaattaccttctgccaatcattgcacaagggttcagtaaatgggccaaggagcgcaaag

SEQ ID NO: 329416 - DNA, 75 bp, Artificial Sequence
  Synthetic
cacagtgtacgaccgtctgaaagaaacaaccgccggctacatcactatgcacaggccgggaccgcacgcctatac

SEQ ID NO: 329417 - DNA, 75 bp, Artificial Sequence
  Synthetic
gcttaccgcgggcaatatagcaacactaaaaaactcgatgtacttccgaggaagcgcagtgcataatgctgcgca

SEQ ID NO: 329418 - DNA, 75 bp, Artificial Sequence
  Synthetic
cgagtactgggaggagttcgctcgaaaaccaattaggatcactactgagttcgtcaccgcgtatgtggccagact

SEQ ID NO: 329419 - DNA, 75 bp, Artificial Sequence
  Synthetic
gtcctatctggaggaatcatcagggaaagtctacgcgaagccaccatccggaaagaacattacgtacgagtgcaa

SEQ ID NO: 329420 - DNA, 75 bp, Artificial Sequence
  Synthetic
tcgtcaccgcgtatgtggccagactgaaaggccctaaggccgctgcactgtttgcaaagacgcataacttggtcc

SEQ ID NO: 329421 - DNA, 75 bp, Artificial Sequence
  Synthetic
actcaatgtatttctgaggaagcgtggtgcataatgccacgcagcgtctgcataacttttattatttcttttatt

SEQ ID NO: 329422 - DNA, 75 bp, Artificial Sequence
  Synthetic
tgggtcttcaattcgccggacttgatcagacatgccgaccacacggcccaagggaaattgcatttacctttcaag

SEQ ID NO: 329423 - DNA, 75 bp, Artificial Sequence
  Synthetic
gcgacagcttacctatgcgggatccaccgggagttagtgcgtaggcttacagccgtcttgctacccaacatccac

SEQ ID NO: 329424 - DNA, 75 bp, Artificial Sequence
  Synthetic
acacggctttaaacacatcagcctccaattagacacagaccacctgacattgctcaccaccaggagactaggggc

SEQ ID NO: 329425 - DNA, 75 bp, Artificial Sequence
  Synthetic
aaatccggaaccaactactgaatggatcatcggaaagacggttagaaacttcaccgtcgaccgagatggcctgga

SEQ ID NO: 329426 - DNA, 75 bp, Artificial Sequence
  Synthetic
aaccggcctgatgatcttggaggacctgggcgtggaccaaccactactcgacttgatcgagtgcgcctttggaga

SEQ ID NO: 329427 - DNA, 75 bp, Artificial Sequence
  Synthetic
ctgggcgtggaccaaccactactcgacttgatcgagtgcgcctttggagaaatatcatccacccatctgcccacg

SEQ ID NO: 329428 - DNA, 75 bp, Artificial Sequence
  Synthetic
aatatcatccacccatctgcccacgggtacccgtttcaaattcggggcgatgatgaaatccggaatgttcctcac

SEQ ID NO: 329429 - DNA, 75 bp, Artificial Sequence
  Synthetic
gctctttgtcaacacagttctgaatgtcgttatcgccagcagagtattggaggagcggcttaaaacgtccaaatg

SEQ ID NO: 329430 - DNA, 75 bp, Artificial Sequence
  Synthetic
gtcgttatcgccagcagagtattggaggagcggcttaaaacgtccaaatgtgcagcatttattggcgacgacaac

SEQ ID NO: 329431 - DNA, 75 bp, Artificial Sequence
  Synthetic
ggccccaaatgccgtgattccaacttcgctggcacttttgtgctgtgttaggtcggctaatgctgaaacattcac

SEQ ID NO: 329432 - DNA, 75 bp, Artificial Sequence
  Synthetic
acacggtccaagggaaattgcatttgcctttcaagttgatcccgggtacctgcatggtccctgttgcccacgcgc

SEQ ID NO: 329433 - DNA, 75 bp, Artificial Sequence
  Synthetic
ggtcggctaatgctgaaacattcaccgagaccatgagttacctatggtcgaacagccagccattcttctgggtcc

SEQ ID NO: 329434 - DNA, 75 bp, Artificial Sequence
  Synthetic
tcgggagaactgaccaacccgccctatcacgagctagctcttgagggactgaagactcgacccgcggtcccgtac

SEQ ID NO: 329435 - DNA, 75 bp, Artificial Sequence
  Synthetic
ccaccaaccaagagtacatcacctgcaaattcaccactgtggtcccctcccctaaagtcaaatgctgcggctcct

SEQ ID NO: 329436 - DNA, 75 bp, Artificial Sequence
  Synthetic
atgaaacaaaggcgtggtttagagtaggtataacagacaccttagcagtggccgtggcgactcgatatgaggtag

SEQ ID NO: 329437 - DNA, 75 bp, Artificial Sequence
  Synthetic
gtcgaattgtcagcagattgcgcgactgaccacgcgcaggcgattaaggtgcatactgccgcgatgaaagtagga

SEQ ID NO: 329438 - DNA, 75 bp, Artificial Sequence
  Synthetic
gggtgcaagattgcagtcaatccgcttcgagcggtggactgctcatacgggaacattcccatctctatcgacatc

SEQ ID NO: 329439 - DNA, 75 bp, Artificial Sequence
  Synthetic
ccggaaagagacagcgtatggcacttaagttggaggccgacagattgttcgacgtcaaaaatgaggatggagacg

SEQ ID NO: 329440 - DNA, 75 bp, Artificial Sequence
  Synthetic
tcatcgggcacgcactggccatggaaggtaaggtaatgaaaccactccacgtgaaaggaactattgaccaccctg

SEQ ID NO: 329441 - DNA, 75 bp, Artificial Sequence
  Synthetic
gtcgtcagcatacgacatggagtttgcgcagttgccggtcaacatgaggagtgaggcattcacctacaccagcga

SEQ ID NO: 329442 - DNA, 75 bp, Artificial Sequence
  Synthetic
acaccctgaaggattctataactggcaccacggagcggtgcagtatagtggaggtagatttaccatcccccgtgg

SEQ ID NO: 329443 - DNA, 75 bp, Artificial Sequence
  Synthetic
caccacggagcggtgcagtatagtggaggtagatttaccatcccccgtggagtcggaggcagaggagacagcggt

SEQ ID NO: 329444 - DNA, 75 bp, Artificial Sequence
  Synthetic
ggaagggacagaagagtggtctgcagcaccactggtcacggccatgtgcttgcttggaaacgtgagcttcccatg

SEQ ID NO: 329445 - DNA, 75 bp, Artificial Sequence
  Synthetic
gcaccactggtcacggccatgtgcttgcttggaaacgtgagcttcccatgcaatcgcccgcccacatgctacacc

SEQ ID NO: 329446 - DNA, 75 bp, Artificial Sequence
  Synthetic
aatcactatattaaccatttatttagcggacgccaaaactcaatgtatttctgaggaagcatggtgcataatgcc

SEQ ID NO: 329447 - DNA, 75 bp, Artificial Sequence
  Synthetic
gcggacgccaaaactcaatgtatttctgaggaagcatggtgcataatgccatgcagcgtctgcataactttttat

SEQ ID NO: 329448 - DNA, 75 bp, Artificial Sequence
  Synthetic
attgacggcgtagtacacactattgaatcaaacagccgaccaattgcactaccatcacaatggagaagcccagta

SEQ ID NO: 329449 - DNA, 75 bp, Artificial Sequence
  Synthetic
gtaaacgtagacgtagacccccagagtccgtttgtcgtgcaactgcaaaaaagcttcccgcaatttgaggtagta

SEQ ID NO: 329450 - DNA, 75 bp, Artificial Sequence
  Synthetic
aagcggagcagcaagcacaaataagtaccgctacatgtcgctcgagcaggatcataccgttaaagaaggcaccat

SEQ ID NO: 329451 - DNA, 75 bp, Artificial Sequence
  Synthetic
cgtacttgtggtctcagaagaaaaaattgaagctccccacaagagaatcgaatggatcgccccgattggcatagc

SEQ ID NO: 329452 - DNA, 75 bp, Artificial Sequence
  Synthetic
tgaccgtctgaaagaaacgaccgccggctacatcactatgcacaggccgggaccgcacgcctacacatcctacct

SEQ ID NO: 329453 - DNA, 75 bp, Artificial Sequence
  Synthetic
ggaggaatcatcagggaaagtttacgcgaagccaccatccgggaagaacatcacgtacgagtgccagtgcggcga

SEQ ID NO: 329454 - DNA, 75 bp, Artificial Sequence
  Synthetic
ttacaagaccgggaccgttacgacccgcaccgaaatcactggctgcaccgccatcaagcagtgcgtcgcctataa

SEQ ID NO: 329455 - DNA, 75 bp, Artificial Sequence
  Synthetic
gagcgaccaaacgaagtgggtctttaactcgccggacttgatcagacatgccgatcacacggcccaagggaaatt

SEQ ID NO: 329456 - DNA, 75 bp, Artificial Sequence
  Synthetic
acgcgccgaacgtaatacacggcttcaaacacattagcctccaattagacacagaccacctgacattgctcacca

SEQ ID NO: 329457 - DNA, 75 bp, Artificial Sequence
  Synthetic
aagacggttagaaacttcaccgtcgaccgagacggcctggaatacatatggggcaatcatgaaccagtaagggtc

SEQ ID NO: 329458 - DNA, 75 bp, Artificial Sequence
  Synthetic
tatgcccaagagtcagcaccaggagaccctcacggatggccacacgaaatagtacaacattactaccaccgccat

SEQ ID NO: 329459 - DNA, 75 bp, Artificial Sequence
  Synthetic
accgggcgaagtgaactcaattatatcgtcccgatcagccgtatcttttccactacgcaagcagagacgtagacg

SEQ ID NO: 329460 - DNA, 75 bp, Artificial Sequence
  Synthetic
tgacgccatatgccctggccccaaatgccgtaattccaacttcgctggcactcttgtgctgcgttaggtcggcta

SEQ ID NO: 329461 - DNA, 75 bp, Artificial Sequence
  Synthetic
atgctgaaacgttcaccgagaccatgagttacttatggtcgaacagccagccgttcttctgggtccagctgtgta

SEQ ID NO: 329462 - DNA, 75 bp, Artificial Sequence
  Synthetic
ccacagataccgtataaggcacttgttgaaagggcagggtacgccccgctcaatttggagatcactgtcatgtcc

SEQ ID NO: 329463 - DNA, 75 bp, Artificial Sequence
  Synthetic
ttgaaagggcagggtacgccccgctcaatttggagatcactgtcatgtcctcggaggtcttaccttccaccaacc

SEQ ID NO: 329464 - DNA, 75 bp, Artificial Sequence
  Synthetic
aaatgctgcggctccttggaatgtcagcccgccgcccatgcagactatacctgcaaggtctttggaggggtgtac

SEQ ID NO: 329465 - DNA, 75 bp, Artificial Sequence
  Synthetic
gatgagtgaggcgtatgttgaattgtcagcagattgcgcgactgaccacgcgcaggcggttaaggtgcatacagc

SEQ ID NO: 329466 - DNA, 75 bp, Artificial Sequence
  Synthetic
gtgtacgggaacactaccagtttcctagatgtgtacgtgaacggagtcacaccaggaacgtctaaagacctgaaa

SEQ ID NO: 329467 - DNA, 75 bp, Artificial Sequence
  Synthetic
atcgaaggcaggtggtggtggctgacgtccatgccgtccaagagcctgcccctgttccaccgccaaggctaaaga

SEQ ID NO: 329468 - DNA, 75 bp, Artificial Sequence
  Synthetic
ttaggctactcaagccttccgccaagaacgtgcatgtcccatacacgcaggccgcatcggggttcgagatgtgga

SEQ ID NO: 329469 - DNA, 75 bp, Artificial Sequence
  Synthetic
tgtcagtgagtgcacttactcagcagacttcggcgggatggccaccctgcagtacgtatccgaccgcgaaggaca

SEQ ID NO: 329470 - DNA, 75 bp, Artificial Sequence
  Synthetic
acagcaaccctccaggagtcgacagttcatgtcctggagaaaggagcggtgacagtacatttcagcaccgcgagt

SEQ ID NO: 329471 - DNA, 75 bp, Artificial Sequence
  Synthetic
catatcgtgagcaccccgcacaaaaatgaccaagaattccaagccgccatctcaaaaacatcatggagttggctg

SEQ ID NO: 329472 - DNA, 75 bp, Artificial Sequence
  Synthetic
agcacacgaagatgaccgctacgccccaatgacccgaccagcaaaactcgatgtacttccgaggaactgatgtgc

SEQ ID NO: 329473 - DNA, 75 bp, Artificial Sequence
  Synthetic
tggcggcgtagtacacactattgaatcaaacagccgaccaattgcactaccatcacaatggagaagccagtagtt

SEQ ID NO: 329474 - DNA, 75 bp, Artificial Sequence
  Synthetic
attatttctttttattaatcaacaaaaattttgtttttaacatttcaaaaaaaaaaaaaaaaaaaaaaaaaaaaa

SEQ ID NO: 329475 - DNA, 75 bp, Artificial Sequence
  Synthetic
cagcaggccactccaaatgaccatgctaatgccagagcattttcgcatctggccagtaaactaatcgagctggag

SEQ ID NO: 329476 - DNA, 75 bp, Artificial Sequence
  Synthetic
ttcaagcaaggtgacccggtactggagacggatatcgcctcgttcgacaaaagccaagacgacgctatggcgtta

SEQ ID NO: 329477 - DNA, 75 bp, Artificial Sequence
  Synthetic
gagtactccgtcatgcaggacgtgtacatcaacgctcccggaactatttaccaccaggctatgaaaggcgtgcgg

SEQ ID NO: 329478 - DNA, 75 bp, Artificial Sequence
  Synthetic
aagacagaagacgcgctctgctagatgaaacgaaggcgtggtttagagtaggtataacagacaccttagcagtgg

SEQ ID NO: 329479 - DNA, 75 bp, Artificial Sequence
  Synthetic
tgcagagctggcatcttccatcggtgttccacttgaaaggaaagcagtcgtacacttgccgctgtgatacagtgg

SEQ ID NO: 329480 - DNA, 75 bp, Artificial Sequence
  Synthetic
tgagctgcgaaggctacgtagtgaagaaaatcaccatcagtcccgggatcacgggagaaaccgtgggatacgcgg

SEQ ID NO: 329481 - DNA, 75 bp, Artificial Sequence
  Synthetic
gaaaatcaccatcagtcccgggatcacgggagaaaccgtgggatacgcggttacaaacaatagcgagggcttctt

SEQ ID NO: 329482 - DNA, 75 bp, Artificial Sequence
  Synthetic
acgggagaaaccgtgggatacgcggttacaaacaatagcgagggcttcttgctatgcaaagttaccgatacagta

SEQ ID NO: 329483 - DNA, 75 bp, Artificial Sequence
  Synthetic
acaagggttcagcaaatgggccaaggagcgcaaagaagatcttgacaatgaaaaaatgctgggcaccagagagcg

SEQ ID NO: 329484 - DNA, 75 bp, Artificial Sequence
  Synthetic
gaccatcgtaaaagtcccagcctcttttagcgctttccccatgtcatccgtatggactacctctttgcccatgtc

SEQ ID NO: 329485 - DNA, 75 bp, Artificial Sequence
  Synthetic
gctgaggcagaagatgaaattggcattacaaccaaagaaggaggaaaaactgctgcaagtcccggaggaattagt

SEQ ID NO: 329486 - DNA, 75 bp, Artificial Sequence
  Synthetic
agcagcactcgtcgaaaccccgcgcggtcatgtaaggataatacctcaagcaaatgaccgtatgatcggacagta

SEQ ID NO: 329487 - DNA, 75 bp, Artificial Sequence
  Synthetic
caaatgaccgtatgatcggacagtatatcgttgtctcgccgatctctgtgctgaagaacgctaaactcgcaccag

SEQ ID NO: 329488 - DNA, 75 bp, Artificial Sequence
  Synthetic
cacacccgctagcagaccaggttaagatcataacgcactccggaagatcaggaaggtatgcagtcgaaccatacg

SEQ ID NO: 329489 - DNA, 75 bp, Artificial Sequence
  Synthetic
ggcagagctcgcagaaacagagtacgtgtttgacgtggacaagaagcgatgcgttaagaaggaagaagcctcagg

SEQ ID NO: 329490 - DNA, 75 bp, Artificial Sequence
  Synthetic
gcaagtcagctatcatcaagtcaactgtcacggcacgtgatcttgttaccagcggaaagaaagaaaactgccgcg

SEQ ID NO: 329491 - DNA, 75 bp, Artificial Sequence
  Synthetic
gtatgttgacgaagcgttccggtgccacgcaggagcactacttgccttgattgcaatcgtcagaccccgtaagaa

SEQ ID NO: 329492 - DNA, 75 bp, Artificial Sequence
  Synthetic
cacgcaggagcactacttgccttgattgcaatcgtcagaccccgtaagaaggtagtactatgcggagaccctaag

SEQ ID NO: 329493 - DNA, 75 bp, Artificial Sequence
  Synthetic
tgaaaaagacatatgtaccaagacattctacaagtttatctcccgacgttgcacacagccagtcacggctattgt

SEQ ID NO: 329494 - DNA, 75 bp, Artificial Sequence
  Synthetic
gcacacagccagtcacggctattgtatcgacactgcattacgatggaaaaatgaaaaccacaaacccgtgcaaga

SEQ ID NO: 329495 - DNA, 75 bp, Artificial Sequence
  Synthetic
agaacatcgaaatcgacattacaggggccacgaagccgaagccaggggacatcatcctgacatgtttccgcgggt

SEQ ID NO: 329496 - DNA, 75 bp, Artificial Sequence
  Synthetic
tgctcacccgcactgaggacaggctagtatggaaaactttacagggcgacccatggattaagcagctcactaacg

SEQ ID NO: 329497 - DNA, 75 bp, Artificial Sequence
  Synthetic
agtatggaaaactttacagggcgacccatggattaagcagctcactaacgtacctaaaggaaattttcaggccac

SEQ ID NO: 329498 - DNA, 75 bp, Artificial Sequence
  Synthetic
catcgaggactgggaagctgaacacaagggaataattgctgcgataaacagtcccgctccccgtaccaatccgtt

SEQ ID NO: 329499 - DNA, 75 bp, Artificial Sequence
  Synthetic
cagtttgcggatgacaaaccacactcggccatctacgccttagacgtaatttgcattaagtttttcggcatggac

SEQ ID NO: 329500 - DNA, 75 bp, Artificial Sequence
  Synthetic
ccgattcagcgaggccggtagctcattgggacaacagcccaggaacccgcaagtatgggtacgatcacgccgttg

SEQ ID NO: 329501 - DNA, 75 bp, Artificial Sequence
  Synthetic
cggccatctacgccttagacgtaatttgcattaagtttttcggcatggacttgacaagcgggctgttttccaaac

SEQ ID NO: 329502 - DNA, 75 bp, Artificial Sequence
  Synthetic
agagcatcccgttaacgtaccatcctgccgactcagcgaggccagtagctcattgggacaacagcccaggaacac

SEQ ID NO: 329503 - DNA, 75 bp, Artificial Sequence
  Synthetic
cataacttggtcccagtgaaccgcaatctccctcacgccttagtccccgagcacaaggagaaacaacccggcccg

SEQ ID NO: 329504 - DNA, 75 bp, Artificial Sequence
  Synthetic
gtcgaaaaattcttgagccagttcaaacaccactccgtacttgtgatctcagagaaaaaaattgaagctccccac

SEQ ID NO: 329505 - DNA, 75 bp, Artificial Sequence
  Synthetic
aagagaatcgaatggatcgccccgattggcatagccggcgcagataagaactacaacctggctttcgggtttccg

SEQ ID NO: 329506 - DNA, 75 bp, Artificial Sequence
  Synthetic
catgcgaccactgttccaaatgtgccacagataccgtataaggcacttgttgaaagggcagggtacgccccgctc

SEQ ID NO: 329507 - DNA, 75 bp, Artificial Sequence
  Synthetic
ccgacaactagacaacagccgcacacgacaattcaccccgcatcatttgaattgtgtgatttcgtccgtgtacga

SEQ ID NO: 329508 - DNA, 75 bp, Artificial Sequence
  Synthetic
gggtacaagagacggagttggagccgcaccgtcgtaccgtactaaaagggagaacattgctgattgtcaagagga

SEQ ID NO: 329509 - DNA, 75 bp, Artificial Sequence
  Synthetic
gcaccgtcgtaccgtactaaaagggagaacattgctgattgtcaagaggaagcagttgtcaatgcagccaatcca

SEQ ID NO: 329510 - DNA, 75 bp, Artificial Sequence
  Synthetic
ctgggcagaccaggagaaggagtctgccgtgccatctataaacgttggccgaacagtttcaccgattcagccaca

SEQ ID NO: 329511 - DNA, 75 bp, Artificial Sequence
  Synthetic
tgtgccaaggaaagaaagtgatccacgcggttggccctgatttccggaaacacccagaggcagaagccctgaaat

SEQ ID NO: 329512 - DNA, 75 bp, Artificial Sequence
  Synthetic
tgctgcaaaacgcctaccatgcagtggcagacttagtaaatgaacataatatcaagtctgtcgccatcccactgc

SEQ ID NO: 329513 - DNA, 75 bp, Artificial Sequence
  Synthetic
ctgcctggataagaagtggaaggaaagaatcgacgcggtgctccaacttaaggagtctgtaactgagctgaagga

SEQ ID NO: 329514 - DNA, 75 bp, Artificial Sequence
  Synthetic
agtatggatccatccggacagttgcttgaagggaagaaagggattcagtactactaaaggaaagttgtattcgta

SEQ ID NO: 329515 - DNA, 75 bp, Artificial Sequence
  Synthetic
tgaggatatggagatcgacgacgagttagtatggatccatccggacagttgcctgaagggaagaaagggattcag

SEQ ID NO: 329516 - DNA, 75 bp, Artificial Sequence
  Synthetic
aaaggtcctgttcccaaatgaccaggaaagcaacgaacaactgtgtgcctacatattgggggagaccatggaagc

SEQ ID NO: 329517 - DNA, 75 bp, Artificial Sequence
  Synthetic
aatccgcgaaaaatgcccggtcgaccacaacccgtcgtctagcccgccaaaaacgctgccgtgcctctgtatgta

SEQ ID NO: 329518 - DNA, 75 bp, Artificial Sequence
  Synthetic
aaacgctgccgtgcctctgtatgtatgccatgacgccagaaagggtccacagactcagaagcaataacgtcaaag

SEQ ID NO: 329519 - DNA, 75 bp, Artificial Sequence
  Synthetic
aagttacagtatgctcctccaccccccttccaaagtacaaaatcaagaatgttcagaaggttcagtgcacaaaag

SEQ ID NO: 329520 - DNA, 75 bp, Artificial Sequence
  Synthetic
atagaagcaccagaacagcctgcagctccgcctgcacaggccgaggaggcccccggagttgtagcgacaccaaca

SEQ ID NO: 329521 - DNA, 75 bp, Artificial Sequence
  Synthetic
caatgacccgaccagcaaaactcgatgtatttccgaggaactgatgtgcataatgcatcaggctggtatattaga

SEQ ID NO: 329522 - DNA, 75 bp, Artificial Sequence
  Synthetic
ccacctgcagctgataacacctcgcttgatgtcacggacatctcactggacatggaagacagtagcgaaggctca

SEQ ID NO: 329523 - DNA, 75 bp, Artificial Sequence
  Synthetic
ttgatgtcacggacatctcactggacatggaagacagtagcgaaggctcactcttttcgagctttagcggatcgg

SEQ ID NO: 329524 - DNA, 75 bp, Artificial Sequence
  Synthetic
catggaagacagtagcgaaggctcactcttttcgagctttagcggatcggacaactaccgaaggcaggtggtggt

SEQ ID NO: 329525 - DNA, 75 bp, Artificial Sequence
  Synthetic
tttttcgagctttagcggatcggacaattctattactagtatggaccgttggtcgtcaggacctagttcgctaga

SEQ ID NO: 329526 - DNA, 75 bp, Artificial Sequence
  Synthetic
tggtgcataatgccatgcagcgtctgcataactttttattatttcttttattaatcaacaaaattttgtttttaa

SEQ ID NO: 329527 - DNA, 75 bp, Artificial Sequence
  Synthetic
ggcaagaatgcaggaagagccaactccaccggcaagcaccagctctgcggacgagtcccttcacctttcttttga

SEQ ID NO: 329528 - DNA, 75 bp, Artificial Sequence
  Synthetic
ccaccggcaagcaccagctctgcggacgagtcccttcacctttcttttgatggggtatctatatccttcggatcc

SEQ ID NO: 329529 - DNA, 75 bp, Artificial Sequence
  Synthetic
tggggtatctatatccttcggatcccttttcgacggagagatggcccgcttggcagcggcacaacccccggcaag

SEQ ID NO: 329530 - DNA, 75 bp, Artificial Sequence
  Synthetic
tggcagcggcacaacccccggcaagtacatgccctacggatgtgcctatgtctttcggatcgttttccgacggag

SEQ ID NO: 329531 - DNA, 75 bp, Artificial Sequence
  Synthetic
agattgaggagttgagccgcagagtaaccgagtcggagcccgtcctgtttgggtcatttgaaccgggcgaagtga

SEQ ID NO: 329532 - DNA, 75 bp, Artificial Sequence
  Synthetic
gtccgttctgcagaaccagcttacagaaccgaccttggagcgcaatgttctggaaagaatctacgccccggtgct

SEQ ID NO: 329533 - DNA, 75 bp, Artificial Sequence
  Synthetic
cagatcagccagaatgctataagatcacctacccgaaaccatcgtattccagcagtgtaccagcgaactactctg

SEQ ID NO: 329534 - DNA, 75 bp, Artificial Sequence
  Synthetic
cacagatcagccagaatgctataagatcacctacccgaaaccatcgtattccagcagtgtagcagctaactactc

SEQ ID NO: 329535 - DNA, 75 bp, Artificial Sequence
  Synthetic
acccaaagtttgctgtagctgtttgtaacaactatctgcatgagaattacccgacggtagcatcttatcagatca

SEQ ID NO: 329536 - DNA, 75 bp, Artificial Sequence
  Synthetic
ccgacgagtacgatgcttacttggatatggtagacgggacagtcgcttgcctagatactgcaactttttgccccg

SEQ ID NO: 329537 - DNA, 75 bp, Artificial Sequence
  Synthetic
ccaagcttagaagttacccgaaaagacacgagtatagagccccaaacatccgcagtgcggttccatcagcgatgc

SEQ ID NO: 329538 - DNA, 75 bp, Artificial Sequence
  Synthetic
agaacacgttgcaaaacgtgctcattgccgcgactaaaagaaactgcaacgtcacacaaatgcgtgaactgccaa

SEQ ID NO: 329539 - DNA, 75 bp, Artificial Sequence
  Synthetic
cactggactcagcgacattcaacgttgaatgctttcgaaaatatgcatgcaatgacgagtattgggaggagtttg

SEQ ID NO: 329540 - DNA, 75 bp, Artificial Sequence
  Synthetic
attgccgcgactaaaagaaactgcaacgtcacgcaaatgcgggaattgccaacgctggactcagcgacattcaac

SEQ ID NO: 329541 - DNA, 75 bp, Artificial Sequence
  Synthetic
aatgacgagtattgggaggagtttgcccgaaagccaattaggatcactactgagttcgttaccgcatacgtggcc

SEQ ID NO: 329542 - DNA, 75 bp, Artificial Sequence
  Synthetic
gagacgtgaaagttacacctggcacgaaacacacagaagaaagaccgaaagtacaagtgatacaagccgcagaac

SEQ ID NO: 329543 - DNA, 75 bp, Artificial Sequence
  Synthetic
gatccaccgggagttagtgcgcaggcttacagccgttttgctacccaacattcacacgctctttgacatgtcggc

SEQ ID NO: 329544 - DNA, 75 bp, Artificial Sequence
  Synthetic
agatgttcgcgttggtgagcgaggaagaaacggatttcttttttggaggattacaacttaacttgactgcgaaca

SEQ ID NO: 329545 - DNA, 75 bp, Artificial Sequence
  Synthetic
cataaaaggagacagagctgttcacagtgacctatcgtattggattgagagcaaaaagaatggaacatggcagct

SEQ ID NO: 329546 - DNA, 75 bp, Artificial Sequence
  Synthetic
agtgacctatcgtattggattgagagcaaaaagaatggaacatggcagctggagcgagccgtcatgggagaagtg

SEQ ID NO: 329547 - DNA, 75 bp, Artificial Sequence
  Synthetic
gttttttagcagggaattacccgatgtctaaaaaaccaggaaaacccggtaaaaaccgggttgtcaatatgctaa

SEQ ID NO: 329548 - DNA, 75 bp, Artificial Sequence
  Synthetic
tccaatcatcaacaagaaaggggaaatcattgggctctatggaaatggggtgttgataggacagggcgaatatgt

SEQ ID NO: 329549 - DNA, 75 bp, Artificial Sequence
  Synthetic
aagtcttgcacctggccagaaacgcacaccctatggggtgatggcgttgttgaaagcgaaatgatcatcccggtg

SEQ ID NO: 329550 - DNA, 75 bp, Artificial Sequence
  Synthetic
acaccctatggggtgatggcgttgttgaaagcgaaatgatcatcccggtgacattaggaggccctaaaagccatc

SEQ ID NO: 329551 - DNA, 75 bp, Artificial Sequence
  Synthetic
cttgatggggttgaagaggatacttggaagcttgttggatggtcgtgggcctattcggttcattttagctatctt

SEQ ID NO: 329552 - DNA, 75 bp, Artificial Sequence
  Synthetic
tagtggcatcatccagggggaaaggacagaagaaccaattccagatgcatacaatgaggaaatgctccgaaagag

SEQ ID NO: 329553 - DNA, 75 bp, Artificial Sequence
  Synthetic
acaacaagagaaccggatatcacacacagacaaaaggaccctggagtgaaggagaaataaccctggactttgact

SEQ ID NO: 329554 - DNA, 75 bp, Artificial Sequence
  Synthetic
aacatttttccgatttacagctctacagccaaccgaagcgcttaagcgcagatggagggctgtggataaaaaaac

SEQ ID NO: 329555 - DNA, 75 bp, Artificial Sequence
  Synthetic
catccaaaaacgcttgcgaacagctgtgctagcccccacccgggtagtagcctgtgaaattgctgaagcgttgaa

SEQ ID NO: 329556 - DNA, 75 bp, Artificial Sequence
  Synthetic
attgcccaggaacaacagttactgttactgaaaattgtggaaacaggggagcgtcactgcgcacaactacagcga

SEQ ID NO: 329557 - DNA, 75 bp, Artificial Sequence
  Synthetic
agcattaaaacatctgaacggattcaaacgtgacctaggatcaatgcttgacaccatcaaccgacgtccaagtaa

SEQ ID NO: 329558 - DNA, 75 bp, Artificial Sequence
  Synthetic
aggattgccaattcgttacctgacaccagccgtgaagaatgaacatcagggcaatgagattgttgatgtgatgtg

SEQ ID NO: 329559 - DNA, 75 bp, Artificial Sequence
  Synthetic
gaagaaaggaggatctggatcactgcttggattggctgcgctggtgggactcgcaagttctttgcagctttcgac

SEQ ID NO: 329560 - DNA, 75 bp, Artificial Sequence
  Synthetic
ttgcaggagctgttccctgccaccactgcgatacaccacaaaagatggatgttggtatggaatggagatccggcc

SEQ ID NO: 329561 - DNA, 75 bp, Artificial Sequence
  Synthetic
accaagtttacatcatggatgaggcccacttcattgatccagcaagtattgctgctcgtgggtacatttcaacga

SEQ ID NO: 329562 - DNA, 75 bp, Artificial Sequence
  Synthetic
atatcaaggcaaggtaatgatgtcgataaataagactgacgttcagagcgccatcaacattcccagcaccaacgg

SEQ ID NO: 329563 - DNA, 75 bp, Artificial Sequence
  Synthetic
agtgaaggaggaagaagcgaaacttgtgaaatctcgagtgacagctggagttgcgggggggatggaaccattcca

SEQ ID NO: 329564 - DNA, 75 bp, Artificial Sequence
  Synthetic
gagtggaattgggggaagcagctgccatctttatgacggctactccgccaggaacaaatgaccccttcccagatt

SEQ ID NO: 329565 - DNA, 75 bp, Artificial Sequence
  Synthetic
tgcaaacacatgcatcgttcgagcacttgacgtgggggttatgtgcaaggatgacatcacatatctctgtccggt

SEQ ID NO: 329566 - DNA, 75 bp, Artificial Sequence
  Synthetic
acttggcctcctggtagcattcatagccacccaagaagtgctgaaacgcagatggactgggaagttgaccctgac

SEQ ID NO: 329567 - DNA, 75 bp, Artificial Sequence
  Synthetic
gccacccaagaagtgctgaaacgcagatggactgggaagttgaccctgacctcactagcggtgtgtttggcacta

SEQ ID NO: 329568 - DNA, 75 bp, Artificial Sequence
  Synthetic
actctcagccgggaatgacccggaagatattgactgttggtgtgatgtagaagaggtgtgggtgcactatggcag

SEQ ID NO: 329569 - DNA, 75 bp, Artificial Sequence
  Synthetic
gcttcacggggaggactgtgtggtttgtccccagcgtgaaaagcggaaatgagatcgccatctgcttgcaaaaag

SEQ ID NO: 329570 - DNA, 75 bp, Artificial Sequence
  Synthetic
tggatctggtgcgatacttggtccttgttggaacagcttttgcggaaatgaacactggaggtgatgtgatccact

SEQ ID NO: 329571 - DNA, 75 bp, Artificial Sequence
  Synthetic
gtgcacacgcatgggacactctagacgaagcagacgatcgatctctgtccaacaccatggagattcaacattggc

SEQ ID NO: 329572 - DNA, 75 bp, Artificial Sequence
  Synthetic
aacactggaggtgatgtgatccacttggcacttgttgctgccttcaaagtgcaaccagcattcttagcgggtctg

SEQ ID NO: 329573 - DNA, 75 bp, Artificial Sequence
  Synthetic
gatggactgggaagttgaccctgacctcactagcggtgtgtttggcactactaatttttggaaacctgacataca

SEQ ID NO: 329574 - DNA, 75 bp, Artificial Sequence
  Synthetic
aacaaaaaacacgccatggcttgacactgtgaagacctctaagtatctaacaaaggttgagaactgggtcctacg

SEQ ID NO: 329575 - DNA, 75 bp, Artificial Sequence
  Synthetic
tttttgagaatgcaatggagtaaccaggaaaacatcttgatggttattggagcagctttccttcaaatggcagcc

SEQ ID NO: 329576 - DNA, 75 bp, Artificial Sequence
  Synthetic
caaaggttgagaactgggtcctacgcaatccagggtacgcattggttgcattggccatcggatggatgctaggca

SEQ ID NO: 329577 - DNA, 75 bp, Artificial Sequence
  Synthetic
agcagctttccttcaaatggcagccaacgatctgaagcttgaggtccttccgattctcaatgccatgtccattgc

SEQ ID NO: 329578 - DNA, 75 bp, Artificial Sequence
  Synthetic
tgtccccagcgtgaaaagcggaaatgagatcgccatctgcttgcaaaaagcaggaaagcgggtgattcaactaaa

SEQ ID NO: 329579 - DNA, 75 bp, Artificial Sequence
  Synthetic
gcaacaacacacagaaggtagtgtttgtgatcatgctaatgctgattgcacctgcatatagcttcaactgcctgg

SEQ ID NO: 329580 - DNA, 75 bp, Artificial Sequence
  Synthetic
atggatgctgataagggcaatgaaagaaggtaaagtggcgatgtacgctcttcccatcttgtgtgctctgactcc

SEQ ID NO: 329581 - DNA, 75 bp, Artificial Sequence
  Synthetic
tgatgaccgagtcatcctcaatggacccatggcaattacatcagcaagcgcagcacaacgtagaggccgtattgg

SEQ ID NO: 329582 - DNA, 75 bp, Artificial Sequence
  Synthetic
gaacatcgaaccgtgattttgttgaaggagccactggggcaacatggattgacttagttcttgaagggggaagtt

SEQ ID NO: 329583 - DNA, 75 bp, Artificial Sequence
  Synthetic
aggaatgagaatggccgggcttgacgtcatcagatgtctgttgttgataattggaattgtaacactcctgaatga

SEQ ID NO: 329584 - DNA, 75 bp, Artificial Sequence
  Synthetic
gagaaatccctctcagattggagatgagtaccattatgggggtgcaaccaatgaggatgaccacgatttggccaa

SEQ ID NO: 329585 - DNA, 75 bp, Artificial Sequence
  Synthetic
aggagccactggggcaacatggattgacttagttcttgaagggggaagttgtgttacggtcatggcaccagaaaa

SEQ ID NO: 329586 - DNA, 75 bp, Artificial Sequence
  Synthetic
aagaagagaaagcgtggccaagaaaaaaggtggctacctgcttgcagcagctctctgccaagctggattgtgcag

SEQ ID NO: 329587 - DNA, 75 bp, Artificial Sequence
  Synthetic
aagatggaggccacggagctggcgaccgtacgtgagtactgctatgaagtgaccttggacacgctgtcgacggtg

SEQ ID NO: 329588 - DNA, 75 bp, Artificial Sequence
  Synthetic
gacaacatatatctcccaaacggactggtggcacaaatgtaccagcccgagcgagataaggttttcaccatggat

SEQ ID NO: 329589 - DNA, 75 bp, Artificial Sequence
  Synthetic
ggggagtttcgattgcgcggagaggaaaggaagaactttgttgagttgatgcgcaatggtgacctcccagtgtgg

SEQ ID NO: 329590 - DNA, 75 bp, Artificial Sequence
  Synthetic
gccaggtgcccaacaaccggcgaagcccataacaccaagagaagcgacccagcatttgtctgcaagagagacgtt

SEQ ID NO: 329591 - DNA, 75 bp, Artificial Sequence
  Synthetic
atcttggctcaccctaatgggaaaaggagttggccagcaagtgaggtcttgaccggagtcggattgatgtgcgct

SEQ ID NO: 329592 - DNA, 75 bp, Artificial Sequence
  Synthetic
ttagcttacaaagtggcttccaacgggtacagctaccaagaccgctcatggtgttttacaggacaaactaacaac

SEQ ID NO: 329593 - DNA, 75 bp, Artificial Sequence
  Synthetic
gtggaccgcggatggggtaacgggtgtggtttatttgggaaaggaagcatcgatacgtgcgcgaagttcacgtgt

SEQ ID NO: 329594 - DNA, 75 bp, Artificial Sequence
  Synthetic
ggagttggccagcaagtgaggtcttgaccggagtcggattgatgtgcgctctggcaggaggccttctcgagtttg

SEQ ID NO: 329595 - DNA, 75 bp, Artificial Sequence
  Synthetic
tgcaatagctggactgatgtacatcacatacaccgtctcgggaagggccgcagagatgtggattgagaaagcagc

SEQ ID NO: 329596 - DNA, 75 bp, Artificial Sequence
  Synthetic
cgatacgtgcgcgaagttcacgtgtaagagtaaggcaacagggaaaacgatcttgagagaaaacatcaaatacga

SEQ ID NO: 329597 - DNA, 75 bp, Artificial Sequence
  Synthetic
acaatcctggaagataacaacgaagttgaagtcttcaccaaaactggagacaggaaaattctcaggccaagatgg

SEQ ID NO: 329598 - DNA, 75 bp, Artificial Sequence
  Synthetic
atggatgcgcgggtctgttgtgactaccaagcgctcaagtcattcaaagaatttgcagcagggaagagatcagcg

SEQ ID NO: 329599 - DNA, 75 bp, Artificial Sequence
  Synthetic
acagactcctcatcacatggaaactactctgagcaaattgggaaaaatcaagcagctaggttcactattagccca

SEQ ID NO: 329600 - DNA, 75 bp, Artificial Sequence
  Synthetic
actctgagcaaattgggaaaaatcaagcagctaggttcactattagcccacaggcaccatcctttacagccaaca

SEQ ID NO: 329601 - DNA, 75 bp, Artificial Sequence
  Synthetic
taacttcaagctcctgaacgatcctggagctccagtacacttgttcgcgttgagattcatacttctgggcttgag

SEQ ID NO: 329602 - DNA, 75 bp, Artificial Sequence
  Synthetic
ttaggcatgatggaggtcatgggtaggatgccaaaccacttctgggaaaaaacagtggccgccgcggatacattg

SEQ ID NO: 329603 - DNA, 75 bp, Artificial Sequence
  Synthetic
agacatcacatgggaacagaatgctgagatcaccggaaccagccccaggcttgatgttgaccttgactcacatgg

SEQ ID NO: 329604 - DNA, 75 bp, Artificial Sequence
  Synthetic
tgattgtgaagctaggtcaggaataaacacagaggactactatgtcttcacagtcaaagagaaatcatggcttgt

SEQ ID NO: 329605 - DNA, 75 bp, Artificial Sequence
  Synthetic
acagcagggcacacaaagaagcactggcggaactgccagactccctggaaacgcttctcttgattggaatgttgt

SEQ ID NO: 329606 - DNA, 75 bp, Artificial Sequence
  Synthetic
cgcacggtttcattggttcattccatttggagtactggggttttggttgctcggaaaacactcaaagcgaggagg

SEQ ID NO: 329607 - DNA, 75 bp, Artificial Sequence
  Synthetic
caaccgagactggttccatgatttgaacctcccatggacgagccccgctacgactgattggcgaaatcgtgaaac

SEQ ID NO: 329608 - DNA, 75 bp, Artificial Sequence
  Synthetic
agcattgtgggacgtgccgtcaccaaaagtatatccaaaatgtgagacaaaaccaggaatctatcgaatcatgac

SEQ ID NO: 329609 - DNA, 75 bp, Artificial Sequence
  Synthetic
agcagctaggttcactattagcccacaggcaccatcctttacagccaacatgggtgagtacgggacagtgaccat

SEQ ID NO: 329610 - DNA, 75 bp, Artificial Sequence
  Synthetic
acttgtggaatttgaggaaccccatgctaccaaacaaactgtagttgcattggggtcacaagaaggagcgttgca

SEQ ID NO: 329611 - DNA, 75 bp, Artificial Sequence
  Synthetic
gctggagttggtgtgatgcatgaaggagtttttcacacaatgtggcacgcgactgaaggagcagtcctgcgaaac

SEQ ID NO: 329612 - DNA, 75 bp, Artificial Sequence
  Synthetic
gtgggcagcagaagtgcctggaacgcagatagctggagttctgctgatagtgttcctactgatgattgtgctgat

SEQ ID NO: 329613 - DNA, 75 bp, Artificial Sequence
  Synthetic
cacagcattggcaggagcaattccagccacagtcagtagttccactctgactctgcagtcaggacaccttaaatg

SEQ ID NO: 329614 - DNA, 75 bp, Artificial Sequence
  Synthetic
aaagtatatccaaaatgtgagacaaaaccaggaatctatcgaatcatgaccaggggaatcctgggcactttccaa

SEQ ID NO: 329615 - DNA, 75 bp, Artificial Sequence
  Synthetic
tccagaacctgagaagcaacggtcccagactgacaaccaactggctgtcttcttgatatgcatcatgaccctcat

SEQ ID NO: 329616 - DNA, 75 bp, Artificial Sequence
  Synthetic
cagagctaaattagacaaggtaaagattaagggaaccacatatgggatgtgtggctcggcattcacttttagcaa

SEQ ID NO: 329617 - DNA, 75 bp, Artificial Sequence
  Synthetic
agtgccacttgggatgggactgaggaggtccaaatgattgcagtagctccgggaaaaccagccatcaatgtccaa

SEQ ID NO: 329618 - DNA, 75 bp, Artificial Sequence
  Synthetic
gtggctcggcattcacttttagcaagaatcccactgacacaggacacgggacagtgatcgtggaactgcagtaca

SEQ ID NO: 329619 - DNA, 75 bp, Artificial Sequence
  Synthetic
gggagtggtggcggcaaatgaaatgagccttttggaaaaaaccaaatccgacattgccaaattgtttggtggcca

SEQ ID NO: 329620 - DNA, 75 bp, Artificial Sequence
  Synthetic
gaatcccactgacacaggacacgggacagtgatcgtggaactgcagtacacaggaagtaatgggccttgtagagt

SEQ ID NO: 329621 - DNA, 75 bp, Artificial Sequence
  Synthetic
acctgggtcagtgggatttgcagtaagaacaacgccttgggacatcagtctcgatatcaagccagccacggcctg

SEQ ID NO: 329622 - DNA, 75 bp, Artificial Sequence
  Synthetic
ccccatctctgttacagcaaatctcatggacttgacgccagtcggcaggttagtcacagttaacccgtttgtcag

SEQ ID NO: 329623 - DNA, 75 bp, Artificial Sequence
  Synthetic
gggagatcattgggctctatggaaatggggtactgattggacagggcgaatatgttagtggcatcatccaagggg

SEQ ID NO: 329624 - DNA, 75 bp, Artificial Sequence
  Synthetic
ggcactgtatgcggcagcaacaatggttgtgacacctttaataaaacatctcatcacgacgcagtatgtgaactt

SEQ ID NO: 329625 - DNA, 75 bp, Artificial Sequence
  Synthetic
cacgggaggagcgaacaataaggtcatggttgaagttgaacctccttttggcgactcttatatagttgttggaag

SEQ ID NO: 329626 - DNA, 75 bp, Artificial Sequence
  Synthetic
tcatcacgacgcagtatgtgaacttctcactaacagccatcgcagcccaagctggcgtgctattgggcttgacca

SEQ ID NO: 329627 - DNA, 75 bp, Artificial Sequence
  Synthetic
aagaggaaactaacggtgctagaactgcacccaggagctggaaagaccagaaaggtgttgcctcaaatcatcaaa

SEQ ID NO: 329628 - DNA, 75 bp, Artificial Sequence
  Synthetic
aggcaccacccaaatcaattaccattggcacaaagagggaagcagtattgggaaagctttggcgaccacatggaa

SEQ ID NO: 329629 - DNA, 75 bp, Artificial Sequence
  Synthetic
tggcacaaagagggaagcagtattgggaaagctttggcgaccacatggaaaggcgctcaaagactggcggtcttg

SEQ ID NO: 329630 - DNA, 75 bp, Artificial Sequence
  Synthetic
gattgcatccagaaacgcctgcgaacagctgtgctagcccccacccgggtagtggcttgtgaaatcgctgaagcg

SEQ ID NO: 329631 - DNA, 75 bp, Artificial Sequence
  Synthetic
tctgtcggtgccactactggtgctagggtgctggaaccaaatgaccctgccaagcttggctgtcgcagtcatgct

SEQ ID NO: 329632 - DNA, 75 bp, Artificial Sequence
  Synthetic
ggagacaccgcatgggactttggttccattgggggggtgttcaattcaattggaaaagccgtgcatcaagttttt

SEQ ID NO: 329633 - DNA, 75 bp, Artificial Sequence
  Synthetic
ctgaagggattgccaatccgttatctgacaccagccgtgaagaatgaacatcagggcaatgagatagtggatgtg

SEQ ID NO: 329634 - DNA, 75 bp, Artificial Sequence
  Synthetic
ggaggagcgttcagaacactgtttggagggatgtcatggataacgcaaggactacttggagccctgctcttgtgg

SEQ ID NO: 329635 - DNA, 75 bp, Artificial Sequence
  Synthetic
atgtgtcacgccacgcttacacagaaactgttgacaccaactcgggttcccaactaccaagtgtacatcatggat

SEQ ID NO: 329636 - DNA, 75 bp, Artificial Sequence
  Synthetic
ggctggcatcatgaagaatgctgtggttgacgggatagtggcgactgatatcccagacctatcaccagcgacccc

SEQ ID NO: 329637 - DNA, 75 bp, Artificial Sequence
  Synthetic
atgggattgcaagctcgtgacaggagcatctcgctaaccttgctggctgtcggaggagtgctcgtattcttagcg

SEQ ID NO: 329638 - DNA, 75 bp, Artificial Sequence
  Synthetic
caactaccaagtgtacatcatggatgaggcccactttattgatccagcaagcattgctgcgcgtgggtacatctc

SEQ ID NO: 329639 - DNA, 75 bp, Artificial Sequence
  Synthetic
acaagtgtgcaggccgattcggggtgtgcaattgacttgcagcgccgtgaattgaaatgcgggggaggcatcttt

SEQ ID NO: 329640 - DNA, 75 bp, Artificial Sequence
  Synthetic
ctgttcgatcaaagagtttggggtcttgggatcagcagcccttgtgacgctgattgaaggaacggccggagttgt

SEQ ID NO: 329641 - DNA, 75 bp, Artificial Sequence
  Synthetic
agattcaaattctcccatactggatgtcgaggcccaagttccggacaaggcgtggagcactgggtatgagtggat

SEQ ID NO: 329642 - DNA, 75 bp, Artificial Sequence
  Synthetic
gtctacaacgatgttgaaaagtggaagagtggttataagtattttccactcactccaactggacttgctcgcgtt

SEQ ID NO: 329643 - DNA, 75 bp, Artificial Sequence
  Synthetic
ctggaattgcacaacagcggttggcctttgcaacctcatgagaggaggatggttggctggaatgtccatcacatg

SEQ ID NO: 329644 - DNA, 75 bp, Artificial Sequence
  Synthetic
cgtggagcactgggtatgagtggataaccaacttcacagggaggactgtgtggtttgtccctagtgtgaaaagcg

SEQ ID NO: 329645 - DNA, 75 bp, Artificial Sequence
  Synthetic
atccaagaggcgcatgcttctggcatttgcggcatccgatcaacctcaagactggaacatttgatgtgggacaac

SEQ ID NO: 329646 - DNA, 75 bp, Artificial Sequence
  Synthetic
ggaatgagatcgccatctgcttgcaaaaagcaggaaaacgggtgattcaactaaacaggaagagcttcgacacgg

SEQ ID NO: 329647 - DNA, 75 bp, Artificial Sequence
  Synthetic
gactgtctacaagaatgtggacaagcctaaaggaaagcgtggaggaggaaaaggagccactctcggagagatctg

SEQ ID NO: 329648 - DNA, 75 bp, Artificial Sequence
  Synthetic
gtgcaacgggaactcaatgcgatctttgaagacaatgagatcgatttgtcaatagtggtccaagaagacccaaag

SEQ ID NO: 329649 - DNA, 75 bp, Artificial Sequence
  Synthetic
aataccccaaaacaaagaacaacgaatgggacttcgttgtgaccactgacatatcagagatgggggccaactttg

SEQ ID NO: 329650 - DNA, 75 bp, Artificial Sequence
  Synthetic
cctaaaggaaagcgtggaggaggaaaaggagccactctcggagagatctggaagtcaagactaaatcagctgaca

SEQ ID NO: 329651 - DNA, 75 bp, Artificial Sequence
  Synthetic
ttttacagaagagctccaaaaaggctgaagaagctggaagatgaactgaattatggatggaagaaatggggaaaa

SEQ ID NO: 329652 - DNA, 75 bp, Artificial Sequence
  Synthetic
atatcagagatgggggccaactttggagcgcacagagtcattgacagccgcaagtgtgtgaaaccagtcatcttg

SEQ ID NO: 329653 - DNA, 75 bp, Artificial Sequence
  Synthetic
aagacggaatcgtggaagtagacagagcccctgctaggaaggccaggagagaagggcgcctcacaggtggtcacc

SEQ ID NO: 329654 - DNA, 75 bp, Artificial Sequence
  Synthetic
accttatttgtggaacctaagctgggcaataacacgttcgtgattgacggtccagaaaccagggaatgcccaacg

SEQ ID NO: 329655 - DNA, 75 bp, Artificial Sequence
  Synthetic
gaggatgatgaccgagtcatccttaatggacccatggcaatcacatcagcgagcgcagcacaacgcagaggccgt

SEQ ID NO: 329656 - DNA, 75 bp, Artificial Sequence
  Synthetic
aagatggataactgaaagaggatttgtcaaacccatgggaaaggttgttgacttaggctgtggacgaggagggtg

SEQ ID NO: 329657 - DNA, 75 bp, Artificial Sequence
  Synthetic
accaatagagcgtggaatagctttaaggtggaagactttggatttggcatggtgttcactcgactgtggcttaca

SEQ ID NO: 329658 - DNA, 75 bp, Artificial Sequence
  Synthetic
attgggagaaacccttcccagattggagatgaataccattacgggggtgcaaccaatgaggacgaccacgatttg

SEQ ID NO: 329659 - DNA, 75 bp, Artificial Sequence
  Synthetic
catgttcaagaagtgaaaggattcacaaaaggtggaccaggccatgaagaaccgcaactcatgcagagctatgga

SEQ ID NO: 329660 - DNA, 75 bp, Artificial Sequence
  Synthetic
attcgagaagaaaacaccacagaatgtgactcagctatcataggcacagccataaaaggggacaaggctgtgcat

SEQ ID NO: 329661 - DNA, 75 bp, Artificial Sequence
  Synthetic
gccaactggactgaagcaaagattctcctcgataacatatacctcccaaacggactggtggcacagatgtaccag

SEQ ID NO: 329662 - DNA, 75 bp, Artificial Sequence
  Synthetic
cagtatctagagggtcagcaaaactaagatggataactgaaagaggatttgtcaaacccatgggaaaggttgttg

SEQ ID NO: 329663 - DNA, 75 bp, Artificial Sequence
  Synthetic
agtgatttgtcatactggattgaaagcaagaagaacgaaacatggcaattagaacgggctgtcatgggggaagtg

SEQ ID NO: 329664 - DNA, 75 bp, Artificial Sequence
  Synthetic
cccgagcgagacaaggtttttaccatggatggggagtttcggttgcgcggagaggaaaggaagaactttgttgag

SEQ ID NO: 329665 - DNA, 75 bp, Artificial Sequence
  Synthetic
accgcaactcatgcagagctatggatggaatttggttcacatgaaaagcagagtggacgtgttccacaagccagc

SEQ ID NO: 329666 - DNA, 75 bp, Artificial Sequence
  Synthetic
ctaatgcgcaacggtgaccttccagtgtggctagcttacaaagtggcctccaacgggtatagttaccaagaccgt

SEQ ID NO: 329667 - DNA, 75 bp, Artificial Sequence
  Synthetic
aaatcttgtacgtggccggagacacacaccttgtggggcgatggtgttgttgaaagcgagatgatcattccagtc

SEQ ID NO: 329668 - DNA, 75 bp, Artificial Sequence
  Synthetic
aagagtgttggatatggctgaggaatggctgaagaaaggggccactgagttctgcattaaagtcttgtgtccata

SEQ ID NO: 329669 - DNA, 75 bp, Artificial Sequence
  Synthetic
actctaggtggacccaagagccatcataacaagagagctggataccacacccaaacaaagggaccgtggagtgag

SEQ ID NO: 329670 - DNA, 75 bp, Artificial Sequence
  Synthetic
tcatggtgttttacaggccaaaccaacaatacaatcttggaagataacaacgaagttgaagtcttcaccaaaacc

SEQ ID NO: 329671 - DNA, 75 bp, Artificial Sequence
  Synthetic
catgcccaaaatcattgagaagctggaaaaactgcagcggaagtatggaggtggcctggtcagagtccccttatc

SEQ ID NO: 329672 - DNA, 75 bp, Artificial Sequence
  Synthetic
ggagaggtaaccttggactttgacttctgtcccggaaccacggtaactgtcactgaacgttgtggtaaccgaggg

SEQ ID NO: 329673 - DNA, 75 bp, Artificial Sequence
  Synthetic
agtggatggatgcgcgggtctgttgtgactaccaagcgctcaagtcatttaaagagtttgcggcagggaagagat

SEQ ID NO: 329674 - DNA, 75 bp, Artificial Sequence
  Synthetic
cagaaactcgacacatgagatgtactgggttagtggggcggctggaaacatcatacatgccgtcagcatgactag

SEQ ID NO: 329675 - DNA, 75 bp, Artificial Sequence
  Synthetic
gcctcactgcgcacaaccactgcaagcggaaaattagtcacagactggtgctgcagaagctgctcattgccacca

SEQ ID NO: 329676 - DNA, 75 bp, Artificial Sequence
  Synthetic
cagcattgggcatgatggaggtcatgggtaggatgccaaaccacttctgggaaaagacagttgctgctgcggata

SEQ ID NO: 329677 - DNA, 75 bp, Artificial Sequence
  Synthetic
ctgcagaagctgctcattgccaccattgcggtatgtcaccaaagacggctgttggtatggaatggagattcgacc

SEQ ID NO: 329678 - DNA, 75 bp, Artificial Sequence
  Synthetic
atgaggaagatgtgaacttaggaagtggaacgcgctccgtcggaaagctcacagagaagccagatctccggaaag

SEQ ID NO: 329679 - DNA, 75 bp, Artificial Sequence
  Synthetic
ccttgtatctcctaggaaccagtgaggcaaacagcagggcacacaaagaagcactggcggaactgccagactccc

SEQ ID NO: 329680 - DNA, 75 bp, Artificial Sequence
  Synthetic
gactagagaggacgaagcaaagctcgtgaagtctcgagtaacggctggagtagcgggaggaatggaaccctttca

SEQ ID NO: 329681 - DNA, 75 bp, Artificial Sequence
  Synthetic
ggcaaacagcagggcacacaaagaagcactggcggaactgccagactccctggaaacacttctcctgattggaat

SEQ ID NO: 329682 - DNA, 75 bp, Artificial Sequence
  Synthetic
tagcgggaggaatggaaccctttcagctcggcttgctggtggcattcatagccacgcaggaagtgctaaaacgga

SEQ ID NO: 329683 - DNA, 75 bp, Artificial Sequence
  Synthetic
tatgaccacaacaacccatacagaacgtggaactaccatggaagttatgaagtgaaaccaactggatcagctagc

SEQ ID NO: 329684 - DNA, 75 bp, Artificial Sequence
  Synthetic
gatggactggaaaattgacattgacatcattggcagtctgcttgatgctattgatcacaggaaacctaacataca

SEQ ID NO: 329685 - DNA, 75 bp, Artificial Sequence
  Synthetic
gagttggcaaaatggggctgggagcatttgtgatgactcttgctacggcattgttgtgggcagcagaagtgcccg

SEQ ID NO: 329686 - DNA, 75 bp, Artificial Sequence
  Synthetic
gaacgcagatagctggagttttgctgatagtgttcctattaatgattgtgctgattccagaacctgagaagcaac

SEQ ID NO: 329687 - DNA, 75 bp, Artificial Sequence
  Synthetic
tggatctagtgaggtacttggttcttgttggaacagccttcgcggaaatgaacacgggcggtgatgtgatccacc

SEQ ID NO: 329688 - DNA, 75 bp, Artificial Sequence
  Synthetic
aaagggtcttcaaagaaaaggttgacacaaaagctcccgaaccaccactaggagttgctcaaatcatggatgtga

SEQ ID NO: 329689 - DNA, 75 bp, Artificial Sequence
  Synthetic
tagccctagtagctgtcttcaaagtgcagcctgcttttttaacaggcctgttcttaaggatgcaatggagcaatc

SEQ ID NO: 329690 - DNA, 75 bp, Artificial Sequence
  Synthetic
ggtcccagaccgacaaccaactggctgtcttcttgatatgcatcatgactctcatgggtgtggtggcagcaaatg

SEQ ID NO: 329691 - DNA, 75 bp, Artificial Sequence
  Synthetic
cgacagactggctgtgggacttcgttgctcgggaaaagaagccaagaatttgcaccccagaagaattcaaagcaa

SEQ ID NO: 329692 - DNA, 75 bp, Artificial Sequence
  Synthetic
aagaaagcatcctgatggtcataggagcagcttttctacagatggcggcaaatgacctggagctggaggtgcttc

SEQ ID NO: 329693 - DNA, 75 bp, Artificial Sequence
  Synthetic
aaatgggccttttagaaaaaaccaagtctgacattgccaaattgtttggcagtcaacctggaccaatgggatttg

SEQ ID NO: 329694 - DNA, 75 bp, Artificial Sequence
  Synthetic
aggtgaacagccacgcggccctaggagccatgtttgaagaacagaatcagtggagcagtgcccgtgaagccgttg

SEQ ID NO: 329695 - DNA, 75 bp, Artificial Sequence
  Synthetic
cacttcttaacgccatgtctattgcctggatgttaattcgagccatgaaagagggaaaggtggcgatgtacgctc

SEQ ID NO: 329696 - DNA, 75 bp, Artificial Sequence
  Synthetic
gtctgacattgccaaattgtttggcagtcaacctggaccaatgggatttgtaagaacaacaccttgggacatcag

SEQ ID NO: 329697 - DNA, 75 bp, Artificial Sequence
  Synthetic
aagatccaaagttctgggaaatggttgatgaagaaagagaagcccatctcaaaggagagtgtcacacatgcatct

SEQ ID NO: 329698 - DNA, 75 bp, Artificial Sequence
  Synthetic
tccctgccctgtgtgccctcactcccggaatgagaatggctggactggatgtcatcagatgcttattgctaattg

SEQ ID NO: 329699 - DNA, 75 bp, Artificial Sequence
  Synthetic
cctcatcacgacgcagtatgtgaatttttcactaacagccatcgcatcccaagctggtgtgctgttaggtttgac

SEQ ID NO: 329700 - DNA, 75 bp, Artificial Sequence
  Synthetic
gtcatcagatgcttattgctaattgttggaatcgtgacgctcctgaatgaaagacgagaaagtgtggcgaaaaag

SEQ ID NO: 329701 - DNA, 75 bp, Artificial Sequence
  Synthetic
gaagacgggagaatttgggaaggccaaaggaagcagagccatctggtacatgtggctaggagctcggtttttgga

SEQ ID NO: 329702 - DNA, 75 bp, Artificial Sequence
  Synthetic
caatgggatgccattcactgccatggacctttcggtgccactattggtgctggggtgttggaatcaaatgaccct

SEQ ID NO: 329703 - DNA, 75 bp, Artificial Sequence
  Synthetic
ttggaatcgtgacgctcctgaatgaaagacgagaaagtgtggcgaaaaagaaaggaggatacctacttgcagctg

SEQ ID NO: 329704 - DNA, 75 bp, Artificial Sequence
  Synthetic
ctttatgccaagtggggctgtgttctccactgataatgatgggaggcctgattctggcccacccaaatgggaaga

SEQ ID NO: 329705 - DNA, 75 bp, Artificial Sequence
  Synthetic
gtttgaagctctcgggtttctaaatgaagatcactggatgagccgcgagaactcacatgggggagttgaggggaa

SEQ ID NO: 329706 - DNA, 75 bp, Artificial Sequence
  Synthetic
actcacatgggggagttgaggggaaaggactccaaaaactcggatacatcctacaagaaatctcccaaattccag

SEQ ID NO: 329707 - DNA, 75 bp, Artificial Sequence
  Synthetic
gaagttggccagcaagtgaggtcctgaccggtgttgggctgatgtgtgctttgacaggaggacttttggagtttg

SEQ ID NO: 329708 - DNA, 75 bp, Artificial Sequence
  Synthetic
gacctttcggtgccactattggtgctggggtgttggaatcaaatgaccctgccaagcttagctgttgcagtcatg

SEQ ID NO: 329709 - DNA, 75 bp, Artificial Sequence
  Synthetic
gaggaaagatgtatgcagatgacacagccggctgggacacccgcatcacaaaagaagacttgaaaaatgaagcaa

SEQ ID NO: 329710 - DNA, 75 bp, Artificial Sequence
  Synthetic
aggagacctcgatggtggtcccctttgccattgcggggttaatgtacatcacgtataccgtctcgggaagagcgg

SEQ ID NO: 329711 - DNA, 75 bp, Artificial Sequence
  Synthetic
gcggctggtatcatgaaaaatgctgtggtcgacgggattgtggcaactgatataccagacctgtcaccggcgacc

SEQ ID NO: 329712 - DNA, 75 bp, Artificial Sequence
  Synthetic
ccaatgacagagaagaaaatgggtcaaatcctactcattgctgcagcggtactagctgtgctcgtcaggccaggg

SEQ ID NO: 329713 - DNA, 75 bp, Artificial Sequence
  Synthetic
ccgaaatgtggatcgagaaagcggccgatataacgtgggaacagaacgcagaaatcacaggaaccagccctagac

SEQ ID NO: 329714 - DNA, 75 bp, Artificial Sequence
  Synthetic
agataacaaaaagaatggatgaaaggcacagaaagctcgcagaggcggtcattgacttgacctaccgccacaagg

SEQ ID NO: 329715 - DNA, 75 bp, Artificial Sequence
  Synthetic
atctgttcgatcaaagagtttggggtcttggggtcagcagcccttgtgacgcttattgaaggaacggctggagtt

SEQ ID NO: 329716 - DNA, 75 bp, Artificial Sequence
  Synthetic
ttgatgttgatctcgactcacacggcaatttcaaactcttgaacgacccaggagctccagtgcacctgtttgcct

SEQ ID NO: 329717 - DNA, 75 bp, Artificial Sequence
  Synthetic
tggtgaaagtcatgagaccagggcctgatgggaaaacttacatggatgtcatctctagagaagaccaaaggggta

SEQ ID NO: 329718 - DNA, 75 bp, Artificial Sequence
  Synthetic
gtctggaattgcacaacagcggttggtctctgcaacctcatgaggggagggtggctggctggaatgtctatcaca

SEQ ID NO: 329719 - DNA, 75 bp, Artificial Sequence
  Synthetic
tgaggctcgtcctccttggcctgagcgcacggttttactggtttatcccgtttggagtactggggttttttctgc

SEQ ID NO: 329720 - DNA, 75 bp, Artificial Sequence
  Synthetic
gtggacaggtagtcacatacgccctgaacaccttcaccaacctggccgttcaattgataagatgcatggaagctg

SEQ ID NO: 329721 - DNA, 75 bp, Artificial Sequence
  Synthetic
tggacgatctacaagaatgtggataagcccaagggaaagcgtgggggaggaaaaggagccactcttggagagatc

SEQ ID NO: 329722 - DNA, 75 bp, Artificial Sequence
  Synthetic
taggaaagcattcaaaacgtgggggagctctgtgggatgttccgtcaccaaaggtatacccaaagtgtgaaacca

SEQ ID NO: 329723 - DNA, 75 bp, Artificial Sequence
  Synthetic
aaggggtagtggatgaggatgacatcatgagggtgagactcggacgattggccaaagcggttgaatggctaagaa

SEQ ID NO: 329724 - DNA, 75 bp, Artificial Sequence
  Synthetic
agaatggacccgaacggctgagtagaatggcagtgagtggggatgattgtgttgtgaaaccaattgatgacagat

SEQ ID NO: 329725 - DNA, 75 bp, Artificial Sequence
  Synthetic
cacgagccgaatttatggcatacaggaaagatggaatcgtggaggtagacagagcccctgctaggaaggccagga

SEQ ID NO: 329726 - DNA, 75 bp, Artificial Sequence
  Synthetic
aagaggaattctagggactttccaagctggcgttggtgtgatgcacgaaggagtctttcatacaatgtggcacgc

SEQ ID NO: 329727 - DNA, 75 bp, Artificial Sequence
  Synthetic
agagcccctgctaggaaggccaggagagaagggcgtctcacaggtggtcacccagtgtctagagggtcagcaaaa

SEQ ID NO: 329728 - DNA, 75 bp, Artificial Sequence
  Synthetic
ttgccaccgcactccacttcctcaacaacatgtcaaaaatcagaaaggatatccaagaatggaaaccttcaacag

SEQ ID NO: 329729 - DNA, 75 bp, Artificial Sequence
  Synthetic
caccgaaggggcagttttgcgaaatggtgagggaagaatggatccgtataccggagatgtccgcaatgacttgat

SEQ ID NO: 329730 - DNA, 75 bp, Artificial Sequence
  Synthetic
cccagtgtctagagggtcagcaaaattgagatggataaccgaaagaggatttgtcaaacccatgggaaaggttgt

SEQ ID NO: 329731 - DNA, 75 bp, Artificial Sequence
  Synthetic
gttggcacaattggcaggaggtgccattctgctcacaccacttcaacgaactaatgctgaaggatgggcggacca

SEQ ID NO: 329732 - DNA, 75 bp, Artificial Sequence
  Synthetic
ctcgtacggtggtccatggaaactgagtgccacatgggacggggctgaagaagtccaaatgatagctgtcgctcc

SEQ ID NO: 329733 - DNA, 75 bp, Artificial Sequence
  Synthetic
tgacttaggctgtggacgaggaggatggagctactactgtgcaaccctgaagcatgttcaagaagtgaaaggatt

SEQ ID NO: 329734 - DNA, 75 bp, Artificial Sequence
  Synthetic
ctaatgctgaaggatgggcggaccatcgtggtgccatgcaggagccaggacgaactgattggcagagccagaatt

SEQ ID NO: 329735 - DNA, 75 bp, Artificial Sequence
  Synthetic
gggaagaccggccgtgaacgtccaaacgacaccaggggtattcaaaaccccttttgggaccattggagcagtgac

SEQ ID NO: 329736 - DNA, 75 bp, Artificial Sequence
  Synthetic
tcaccaggagcaggatggaatgtgaaagagacagcttgcctgagcaaatcctatgcccagatgtggttgctcatg

SEQ ID NO: 329737 - DNA, 75 bp, Artificial Sequence
  Synthetic
cttagattttccaaaaggaacatcggggtccccaatcatcaacaggaaaggagagatcataggactctatggcaa

SEQ ID NO: 329738 - DNA, 75 bp, Artificial Sequence
  Synthetic
tacttccacaggcgggatctcaggatgatggcaaatgccatctgttctgccgtcccaatcaactgggtccccact

SEQ ID NO: 329739 - DNA, 75 bp, Artificial Sequence
  Synthetic
gtgacattggagagtcaaacccaagttgtgaggtagaggaagcccgaacagcaagagtgttggacatggctgagg

SEQ ID NO: 329740 - DNA, 75 bp, Artificial Sequence
  Synthetic
tggtgttttgattggacaaggtgagtacgttagtggcatcattcaaggagagagaacagaagaaccaattccaga

SEQ ID NO: 329741 - DNA, 75 bp, Artificial Sequence
  Synthetic
aatggctaaagaaaggagccactgagttttgtataaaagtcttgtgtccatacatgcccaaaatcattgagaagc

SEQ ID NO: 329742 - DNA, 75 bp, Artificial Sequence
  Synthetic
cgcctacaatgaagaaatgcttaggaagaggaaactaactgtgttagagctccatcctggagccgggaaaaccag

SEQ ID NO: 329743 - DNA, 75 bp, Artificial Sequence
  Synthetic
tggaaaaactgcaacggaagtatggaggcggcctggtcagagtccccctgtccaggaactcgacacatgaaatgt

SEQ ID NO: 329744 - DNA, 75 bp, Artificial Sequence
  Synthetic
aaaggtcttgccccagattataaaagattgcattcaaaagcgtttgcgaactgcagtgctggctcccaccagggt

SEQ ID NO: 329745 - DNA, 75 bp, Artificial Sequence
  Synthetic
gacttagttcttgaagggggaagttgtgttacggtcatggcaccagaaaaaccaacactggactttaaggtgatg

SEQ ID NO: 329746 - DNA, 75 bp, Artificial Sequence
  Synthetic
actgggttagtggagcggctggaaacatcatacatgccgtcagtatgactagccaggtgctcatgggaaggatgg

SEQ ID NO: 329747 - DNA, 75 bp, Artificial Sequence
  Synthetic
agtagcctgtgaaatagcggaggcattgaaaggactaccaattcgctatctcacacccgccgtgaagagtgaaca

SEQ ID NO: 329748 - DNA, 75 bp, Artificial Sequence
  Synthetic
acaaacagaacagaagcgggccacgctatgaggaagatgtgaatttgggaagtggaacgcgctccgttggaaagc

SEQ ID NO: 329749 - DNA, 75 bp, Artificial Sequence
  Synthetic
ccaaggcaatgaaatagttgatgtgatgtgtcatgccacactaacacaaaaattgctcactccgactcgagtgcc

SEQ ID NO: 329750 - DNA, 75 bp, Artificial Sequence
  Synthetic
agggaagaaactcatgtggtaggaggagtgttgtaaattaaaatgtaaatagtgtaaataaataaaaacaggtaa

SEQ ID NO: 329751 - DNA, 75 bp, Artificial Sequence
  Synthetic
ttacagagaagccagacctccggaaagttggggaaaggatacggagattgagagaagaataccaacaaacatgga

SEQ ID NO: 329752 - DNA, 75 bp, Artificial Sequence
  Synthetic
acattatcaggtgtacatcatggatgaagcccacttcattgatccagccagcatagccgctcgagggtacatttc

SEQ ID NO: 329753 - DNA, 75 bp, Artificial Sequence
  Synthetic
cgtatgaccacaacaatccatacagaacgtggaattatcatggaagttatgaagtgaaaccaactggatcagcca

SEQ ID NO: 329754 - DNA, 75 bp, Artificial Sequence
  Synthetic
aactagagtggagctaggggaagcagctgccattttcatgacagcaactccaccagggacaaatgatcccttccc

SEQ ID NO: 329755 - DNA, 75 bp, Artificial Sequence
  Synthetic
aagcccctcattccgactcgggagggtccctggcacgtaggctggagaggacgcaaaagtcagaccagaaatgcc

SEQ ID NO: 329756 - DNA, 75 bp, Artificial Sequence
  Synthetic
aacgtggaattatcatggaagttatgaagtgaaaccaactggatcagccagctcgatggtgaacggagtcgtgag

SEQ ID NO: 329757 - DNA, 75 bp, Artificial Sequence
  Synthetic
gctcctctcaaaaccatgggacatgatcacaaacgtgaccaccatggcaatgactgacaccacgccttttggtca

SEQ ID NO: 329758 - DNA, 75 bp, Artificial Sequence
  Synthetic
agattcaaactctcccataatggacattgaggcccagataccagacaaggcatggagcactggatatgattggat

SEQ ID NO: 329759 - DNA, 75 bp, Artificial Sequence
  Synthetic
catggagcactggatatgattggattaccaatttcacggggcggacagtgtggtttgttcctagtgtgaaaagcg

SEQ ID NO: 329760 - DNA, 75 bp, Artificial Sequence
  Synthetic
tgactgacaccacgccttttggtcaacaaagggtcttcaaagaaaaggttgacacaaaagctcccgaaccaccgc

SEQ ID NO: 329761 - DNA, 75 bp, Artificial Sequence
  Synthetic
atcacaaacgtgaccaccatggcaatgactgacaccacgccttttggtcaacaaagggtcttcaaagaaaaggtt

SEQ ID NO: 329762 - DNA, 75 bp, Artificial Sequence
  Synthetic
taggagtcgcccaaatcatggatgtgacaacagactggctgtgggacttcgttgcccgggaaaagaaaccaagaa

SEQ ID NO: 329763 - DNA, 75 bp, Artificial Sequence
  Synthetic
ggaatgagattgccatctgccttcaaaaggcaggaaaacgagtaattcagcttaataggaagagctttgacacgg

SEQ ID NO: 329764 - DNA, 75 bp, Artificial Sequence
  Synthetic
cttaataggaagagctttgacacggaatacccaaagacacgaaacaatgaatgggacttcgttgtgaccacggac

SEQ ID NO: 329765 - DNA, 75 bp, Artificial Sequence
  Synthetic
tctgcaccccggaagaattcaaagcaaaggtgaacagccacgcggctctgggagccatgttcgaagaacagaatc

SEQ ID NO: 329766 - DNA, 75 bp, Artificial Sequence
  Synthetic
acgcaaataacagcatattgacacctggaaagacaggagatcccctgctttttcaacaccagccacaaggcacag

SEQ ID NO: 329767 - DNA, 75 bp, Artificial Sequence
  Synthetic
atatcagaaatgggagctaactttggagcacacagagtcatcgacagtcgaaaatgcgtgaaaccggtcatcttg

SEQ ID NO: 329768 - DNA, 75 bp, Artificial Sequence
  Synthetic
agtggagcagcgcccgtgaagccgtggaagatccaaagttctgggaaatggttgatgaagaaagaagagcccatc

SEQ ID NO: 329769 - DNA, 75 bp, Artificial Sequence
  Synthetic
aaaatgcgtgaaaccggtcatcttggaagatgatgaccgggtcattctgaatggaccaattgcaatcacatcagc

SEQ ID NO: 329770 - DNA, 75 bp, Artificial Sequence
  Synthetic
tcaaaggggagtgtcacacatgcatctacaacatgatgggaaagcgcgagaagaagacgggagaatttgggaagg

SEQ ID NO: 329771 - DNA, 75 bp, Artificial Sequence
  Synthetic
gaagatgatgaccgggtcattctgaatggaccaattgcaatcacatcagccagtgctgcccaacgcagaggccga

SEQ ID NO: 329772 - DNA, 75 bp, Artificial Sequence
  Synthetic
atcgggagaaatccctctcaggtcggagatgagtatcactatggaggcacaacaaatgatgatgaccacgatctg

SEQ ID NO: 329773 - DNA, 75 bp, Artificial Sequence
  Synthetic
catgtggctaggagctcggtttttggagtttgaggctctcggattcctaaatgaagaccactggatgagccgtga

SEQ ID NO: 329774 - DNA, 75 bp, Artificial Sequence
  Synthetic
gccaattggacagaagcaaagatcctgttggataacatataccttccaaacgggctggtcgcacaaatgtaccaa

SEQ ID NO: 329775 - DNA, 75 bp, Artificial Sequence
  Synthetic
atgaagaccactggatgagccgtgagaactcccatggaggagttgaggggaaaggactccagaaactcggataca

SEQ ID NO: 329776 - DNA, 75 bp, Artificial Sequence
  Synthetic
caaattctcccatactggatgttgaggcccaggttccggacaaggcgtggagcactgggtatgagtggatcacca

SEQ ID NO: 329777 - DNA, 75 bp, Artificial Sequence
  Synthetic
cctgagcgagacaagatcttcaccatggatggggaattccgactgagaggagacgaaaggaaaaattttgtggaa

SEQ ID NO: 329778 - DNA, 75 bp, Artificial Sequence
  Synthetic
aaaggactccagaaactcggatacatactgcaagaaatctcccaaatcccaggaggaaagatgtacgcggatgat

SEQ ID NO: 329779 - DNA, 75 bp, Artificial Sequence
  Synthetic
aggaggaaagatgtacgcggatgatacagccggctgggacacccgcatcacaaaagaagacttaaaaaatgaagc

SEQ ID NO: 329780 - DNA, 75 bp, Artificial Sequence
  Synthetic
ctcatgcgcaacggagatcttccggtgtggctggcctacaaggtggcttctaacgggtatagttatcaggatcgg

SEQ ID NO: 329781 - DNA, 75 bp, Artificial Sequence
  Synthetic
acagccggctgggacacccgcatcacaaaagaagacttaaaaaatgaagcaaaaataacaaagagaatggatgaa

SEQ ID NO: 329782 - DNA, 75 bp, Artificial Sequence
  Synthetic
taacgggtatagttatcaggatcggtcatggtgtttcacaggacagactaacaacacaattctggaggatagtaa

SEQ ID NO: 329783 - DNA, 75 bp, Artificial Sequence
  Synthetic
aggcacagaaagcttgcagaggcaatcattgatctgacctaccgccataaggtggtgaaagtcatgagaccaggg

SEQ ID NO: 329784 - DNA, 75 bp, Artificial Sequence
  Synthetic
tcatggtgtttcacaggacagactaacaacacaattctggaggatagtaacgaggttgaaatttttacaaagact

SEQ ID NO: 329785 - DNA, 75 bp, Artificial Sequence
  Synthetic
ggagataggaaagtactcagaccaagatggatggatgctcgggtatgttgtgactaccaagcgctcaagtcattc

SEQ ID NO: 329786 - DNA, 75 bp, Artificial Sequence
  Synthetic
cctgatgggaaaacttacatggatatcatctccagagaagaccaaaggggcagtggacaagtggtcacatacgcc

SEQ ID NO: 329787 - DNA, 75 bp, Artificial Sequence
  Synthetic
gaaggtaaagtggcgatgtacgctcttcccatcttgtgtgctctgactccaggaatgagaatggccgggcttgac

SEQ ID NO: 329788 - DNA, 75 bp, Artificial Sequence
  Synthetic
aaagaattcgctgctgggaaaagatcagcattgggcatgatagaagtaatgggaagaatgccaagccacttttgg

SEQ ID NO: 329789 - DNA, 75 bp, Artificial Sequence
  Synthetic
ctaaacaccttcaccaacctagccgttcaactgataagatgcatggaagctgaaggagtggtggatgaggatgac

SEQ ID NO: 329790 - DNA, 75 bp, Artificial Sequence
  Synthetic
cagcattgggcatgatagaagtaatgggaagaatgccaagccacttttgggagaaaacagtagctgcagcggata

SEQ ID NO: 329791 - DNA, 75 bp, Artificial Sequence
  Synthetic
atcatgagagtgagacttggacgattggctaaagcggttgagtggctgaggaagaatggacctgaacggttgagt

SEQ ID NO: 329792 - DNA, 75 bp, Artificial Sequence
  Synthetic
gggaagaatgccaagccacttttgggagaaaacagtagctgcagcggatacactgtatctgttagggaccagtga

SEQ ID NO: 329793 - DNA, 75 bp, Artificial Sequence
  Synthetic
ggccaacagtagagcccacagagaagcgctggctgagttgccagactctcttgaaacacttctcctcataggaat

SEQ ID NO: 329794 - DNA, 75 bp, Artificial Sequence
  Synthetic
agaatggcagtgagtggggacgactgtgttgtgaaaccaactgatgacagatttgccactgcactccacttcctt

SEQ ID NO: 329795 - DNA, 75 bp, Artificial Sequence
  Synthetic
ttgaaacacttctcctcataggaatgctatgtgtgatgtcaatgggcacatttgtctttctcatgaacagaaaag

SEQ ID NO: 329796 - DNA, 75 bp, Artificial Sequence
  Synthetic
aacaacatgtcaaaaatcaggaaggacattcaagaatggaaaccttcaacaggctggcacaattggcaggaggtg

SEQ ID NO: 329797 - DNA, 75 bp, Artificial Sequence
  Synthetic
gagttggaaagatgggattgggagctttcgtgatgactctcgctacggcactgctgtgggcggcagaagtgcctg

SEQ ID NO: 329798 - DNA, 75 bp, Artificial Sequence
  Synthetic
aagagtaaggcaacagggaaaacgatcttgagagaaaacatcaaatacgaagttgctatctttgtccatggatca

SEQ ID NO: 329799 - DNA, 75 bp, Artificial Sequence
  Synthetic
cccttctgctcacaccacttcaatgaactaatgctaaaggatgggaggaccatcgtggtgccatgcaggagccag

SEQ ID NO: 329800 - DNA, 75 bp, Artificial Sequence
  Synthetic
ggacgcagatcgctggggttctactaatagctttcttgctgatgattgtgctaataccagaacctgagacacaac

SEQ ID NO: 329801 - DNA, 75 bp, Artificial Sequence
  Synthetic
aactaatgctaaaggatgggaggaccatcgtggtgccatgcaggagccaggatgaactaattggtagagccagaa

SEQ ID NO: 329802 - DNA, 75 bp, Artificial Sequence
  Synthetic
gctcgcaaactgacaaccatctagctgtctttttgatatgtatcataacccttatgggggttgtggcagcaaatg

SEQ ID NO: 329803 - DNA, 75 bp, Artificial Sequence
  Synthetic
tttcaccaggagcaggatggaatgtgagagagacagcttgcctgagcaaatcctatgctcagatgtggttactca

SEQ ID NO: 329804 - DNA, 75 bp, Artificial Sequence
  Synthetic
tgtctttttgatatgtatcataacccttatgggggttgtggcagcaaatgaaatgggccttctggagagaaccaa

SEQ ID NO: 329805 - DNA, 75 bp, Artificial Sequence
  Synthetic
tgtacttccaccggcgggatctcaggatgatggcaaatgccatctgttcagccgtcccagtcaactgggttccca

SEQ ID NO: 329806 - DNA, 75 bp, Artificial Sequence
  Synthetic
cttatgggggttgtggcagcaaatgaaatgggccttctggagagaaccaaggctgacgttatcaagctactcgga

SEQ ID NO: 329807 - DNA, 75 bp, Artificial Sequence
  Synthetic
ggccaacccaatccagttggatttgcatcaagaaccattccctgggacatcagtctagacatgaagccagccacg

SEQ ID NO: 329808 - DNA, 75 bp, Artificial Sequence
  Synthetic
ctggacgtactacatggtcaattcatggaaagggtgaatggatgacaactgaagacatgttgagtgtctggaacc

SEQ ID NO: 329809 - DNA, 75 bp, Artificial Sequence
  Synthetic
gaagacatgttgagtgtctggaaccgtgtgtggattgaagagaatgaatacatgaaagacaaaacaccattggcg

SEQ ID NO: 329810 - DNA, 75 bp, Artificial Sequence
  Synthetic
gcctgggcactgtacgcggcggcgacaatggtcatgacaccattaataaaacacctcattataacacaatatgtg

SEQ ID NO: 329811 - DNA, 75 bp, Artificial Sequence
  Synthetic
aatttctcattgacggctattgccactcaagccggtgtgttgctaggtctgaccaatggaatgcctttcaccgcc

SEQ ID NO: 329812 - DNA, 75 bp, Artificial Sequence
  Synthetic
aaaggtggctacctgcttgcagcagctctctgccaagctggattgtgcagtcccttgattatgatgggaggcttg

SEQ ID NO: 329813 - DNA, 75 bp, Artificial Sequence
  Synthetic
gccacctgggctgagaacatctacgctccaatcatgcagatccgcaacctcatcggggaagaagagtatagagac

SEQ ID NO: 329814 - DNA, 75 bp, Artificial Sequence
  Synthetic
atggacatatcagtaccactgctggtcttaggatgctggaaccaaatgaccctgccaagcttggctgtgacggtt

SEQ ID NO: 329815 - DNA, 75 bp, Artificial Sequence
  Synthetic
ctccaatcatgcagatccgcaacctcatcggggaagaagagtatagagactacatggttgcccaaaacagatttg

SEQ ID NO: 329816 - DNA, 75 bp, Artificial Sequence
  Synthetic
atgctcttgaccattcattacacgttcatgatacctggatggcaagctgaggccatgagagcagcgcaacgcaga

SEQ ID NO: 329817 - DNA, 75 bp, Artificial Sequence
  Synthetic
gcagggaagaaactcatgtggtgggaggagcgctgtagattaaaatgtaaatagtgtaaataaataaaataggta

SEQ ID NO: 329818 - DNA, 75 bp, Artificial Sequence
  Synthetic
ggccatgagagcagcgcaacgcagaacggctgctggaatcatgaaaaacgcagtggtagatgggatcgtggcaac

SEQ ID NO: 329819 - DNA, 75 bp, Artificial Sequence
  Synthetic
acggctgctggaatcatgaaaaacgcagtggtagatgggatcgtggcaacggacataccggaattaactccggcc

SEQ ID NO: 329820 - DNA, 75 bp, Artificial Sequence
  Synthetic
agtcaggccaattagttttgccaccggatgtcaggtaaacggtgctgtctgtaacctggccccaggtgactgggt

SEQ ID NO: 329821 - DNA, 75 bp, Artificial Sequence
  Synthetic
agagatgggggccaacttcggagcacatagagtgatcgacagccgcaagtgtgtgaaaccagtcatcctggagga

SEQ ID NO: 329822 - DNA, 75 bp, Artificial Sequence
  Synthetic
gtaacctggccccaggtgactgggttatcaaagccaatctggctgagtgcaaagcccctcattccgactcgggag

SEQ ID NO: 329823 - DNA, 75 bp, Artificial Sequence
  Synthetic
acgccaatgacagaaaagaagatgggtcaaatcttactcatcgctgcggcagtgctagctgtgttggttcgtcca

SEQ ID NO: 329824 - DNA, 75 bp, Artificial Sequence
  Synthetic
ggaatctgctcgatcaaggagtttggagtcctaggttcagctgctcttgtaactttggttgaagggactgcggga

SEQ ID NO: 329825 - DNA, 75 bp, Artificial Sequence
  Synthetic
gcagtttggaactgcacaacagcagttggcctctgcaacctgatgagggggggatggttagctggcatgtcaata

SEQ ID NO: 329826 - DNA, 75 bp, Artificial Sequence
  Synthetic
acctggacaatttataaaaatgtggataaaccaaaaggaaaacggggaggtggaaaaggagccacccttggagaa

SEQ ID NO: 329827 - DNA, 75 bp, Artificial Sequence
  Synthetic
ataaaccaaaaggaaaacggggaggtggaaaaggagccacccttggagaaatttggaaatcaagactaaaccaac

SEQ ID NO: 329828 - DNA, 75 bp, Artificial Sequence
  Synthetic
taactcgagctgagttcatggcatacagaaaagatgggattttggaagtagatagagcgcctgccagaaaagcga

SEQ ID NO: 329829 - DNA, 75 bp, Artificial Sequence
  Synthetic
gaccggagtcggattgatgtgcgctctggcaggaggccttctcgagtttgaggagacttcaatggtggttccctt

SEQ ID NO: 329830 - DNA, 75 bp, Artificial Sequence
  Synthetic
gaagagaagggcgcctcacaggtggccacccagtgtctcgaggatcggcgaagttacggtggataactgaacgtg

SEQ ID NO: 329831 - DNA, 75 bp, Artificial Sequence
  Synthetic
gataacaacttaacttgactgcgaacagttttttagcagggaattacccaatgtctaaaaaaccaggaaaacccg

SEQ ID NO: 329832 - DNA, 75 bp, Artificial Sequence
  Synthetic
gaggaaacagatttcttttttggaggataacaacttaacttgactgcgaacagttttttagcagggaattaccca

SEQ ID NO: 329833 - DNA, 75 bp, Artificial Sequence
  Synthetic
ggttcgtcaaaccaatgggaaaagtcgccgatctcggctgtggaagaggagggtggagctactattgtgcaacct

SEQ ID NO: 329834 - DNA, 75 bp, Artificial Sequence
  Synthetic
atgtctaaaaaaccaggaaaacccggtagaaaccgggttgtcaatatgctaaaacgcggtgtatcccgcgtgaac

SEQ ID NO: 329835 - DNA, 75 bp, Artificial Sequence
  Synthetic
gggtggagctactattgtgcaaccttgaaacacgtccaagaggtgaagggcttcaccaagggcggaccgggtcat

SEQ ID NO: 329836 - DNA, 75 bp, Artificial Sequence
  Synthetic
gaagagccacagctaatgcagagctacggttggaacctagttcacatgaaaagtggaattgatgtgttccacaag

SEQ ID NO: 329837 - DNA, 75 bp, Artificial Sequence
  Synthetic
ccatctgaacctgctgacacagttctctgtgacattggagagtcaaacccgagctgtgaagtggaggaagcccga

SEQ ID NO: 329838 - DNA, 75 bp, Artificial Sequence
  Synthetic
acggctagagtccttgacatgattgaggagtggctaaagaaaggggcaacagaattttgtgtgaaagttttatgt

SEQ ID NO: 329839 - DNA, 75 bp, Artificial Sequence
  Synthetic
aagaagagaggagggaccagatcgttgcttggattggcagcattaataggactggcgagttcattgcagttgtca

SEQ ID NO: 329840 - DNA, 75 bp, Artificial Sequence
  Synthetic
ccatacacgcccaagatcatcgagaagttggaaaaactgcaacggaaatacggaggtggacttgttagggtccca

SEQ ID NO: 329841 - DNA, 75 bp, Artificial Sequence
  Synthetic
ctgtccagaaactctacgcatgaaatgtactgggttagtggtgcagctggcaacattatccatgccgtaaacatg

SEQ ID NO: 329842 - DNA, 75 bp, Artificial Sequence
  Synthetic
accagccaagtgctcatgggaagaatagaaaaacggaacagaagcggaccacgctatgaggaggacgtgaatttg

SEQ ID NO: 329843 - DNA, 75 bp, Artificial Sequence
  Synthetic
acgctatgaggaggacgtgaatttgggaagcggaacacgctcagttggaaagctcactgaaaaacccgacctccg

SEQ ID NO: 329844 - DNA, 75 bp, Artificial Sequence
  Synthetic
ggaagcggaacacgctcagttggaaagctcactgaaaaacccgacctccgaaaagtcggagagcgaatcaaacgg

SEQ ID NO: 329845 - DNA, 75 bp, Artificial Sequence
  Synthetic
ctgaaagaggagtaccaacaaacatggacgtatgaccacaacaatccatacagaacttggaactaccatgggagt

SEQ ID NO: 329846 - DNA, 75 bp, Artificial Sequence
  Synthetic
tacgaggtaaaaccaacaggatctgccagctcaatggtgaatggagtcgtgagacttctttcaaagccatgggac

SEQ ID NO: 329847 - DNA, 75 bp, Artificial Sequence
  Synthetic
atgatcaccaacgtgacaaccatggccatgacagacaccactccttttgggcaacagagagtgtttaaggaaaaa

SEQ ID NO: 329848 - DNA, 75 bp, Artificial Sequence
  Synthetic
gttgacacaaaagcgccagaaccaccgctaggagtagcgcaaatcatggatgtgaccacagattggttgtgggac

SEQ ID NO: 329849 - DNA, 75 bp, Artificial Sequence
  Synthetic
gagggggccagcggggcaacatggattgacttggtactcgaagggggaagctgtgttacagtgatggcaccagag

SEQ ID NO: 329850 - DNA, 75 bp, Artificial Sequence
  Synthetic
tttgttgcacgcgagaagaaaccgagattatgcacaccagacgaatttaaggccaaggtgaacagccatgcagct

SEQ ID NO: 329851 - DNA, 75 bp, Artificial Sequence
  Synthetic
ctaggggcaatgtttgaagaacagaaccaatggagcaatgctcgtgaagcagtgcaggacccaaagttttgggag

SEQ ID NO: 329852 - DNA, 75 bp, Artificial Sequence
  Synthetic
atggtcgacagagagaggagagcccacctaaaaggagaatgccacacatgcatttacaacatgatggggaaacga

SEQ ID NO: 329853 - DNA, 75 bp, Artificial Sequence
  Synthetic
gagaagaagacaggagagttcggaaaagccaagggcagtagggccatctggtacatgtggctgggggctcggttt

SEQ ID NO: 329854 - DNA, 75 bp, Artificial Sequence
  Synthetic
atgtggtctgtttggaaaggggagcattgacacatgcgcaaagttcacatgcaaaaacaaggcaacagggaagac

SEQ ID NO: 329855 - DNA, 75 bp, Artificial Sequence
  Synthetic
ttggaatttgaagctcttggatttctcaacgaagaccattggatgagccgcgaaaactcccacggaggagtggaa

SEQ ID NO: 329856 - DNA, 75 bp, Artificial Sequence
  Synthetic
ggaaaagggctccaaaaactggggtacatcctgcaggaaatctcccagattccaggggggaagatgtacgcagac

SEQ ID NO: 329857 - DNA, 75 bp, Artificial Sequence
  Synthetic
gacacagcaggctgggacacccgtattacaaaagaagatttaaaaaacgaggcaaagataacaaggaaaatggag

SEQ ID NO: 329858 - DNA, 75 bp, Artificial Sequence
  Synthetic
catgggcgagtatggaacagttaccattgattgtgaggcaagatcaggaattaacacggaggattattatgtctt

SEQ ID NO: 329859 - DNA, 75 bp, Artificial Sequence
  Synthetic
gagagacacaagaagcttgctgaagcaatcatagacttgacctaccgccacaaggtggtgagagtcatgcggcca

SEQ ID NO: 329860 - DNA, 75 bp, Artificial Sequence
  Synthetic
gggccagacgggaagacctacatggacgtgatctccagagaagaccaacgtggaagcggacaggtggtcacatac

SEQ ID NO: 329861 - DNA, 75 bp, Artificial Sequence
  Synthetic
gctctaaatactttcacaaatttggccgtgcagctgatcagatgcatggaagcggaaggagtggtagatgaggat

SEQ ID NO: 329862 - DNA, 75 bp, Artificial Sequence
  Synthetic
catacagcattggccggagccattccagccactgttagcaactcaaccttgaccttgcaatcagggcatctgaaa

SEQ ID NO: 329863 - DNA, 75 bp, Artificial Sequence
  Synthetic
gatatcatgagagtcaggcttggacggttggcaaaagcagtggagtggttgagaaagaatggacctgaacggtta

SEQ ID NO: 329864 - DNA, 75 bp, Artificial Sequence
  Synthetic
agcaggatggcagtgagtggggatgattgtgttgtgaagccaattgatgacaggtttgccaccgcgcttcacttt

SEQ ID NO: 329865 - DNA, 75 bp, Artificial Sequence
  Synthetic
ctcaacaacatgtcaaaaataaggaaagacatccaggaatggaaaccttccacaggctggcacaattggcaggaa

SEQ ID NO: 329866 - DNA, 75 bp, Artificial Sequence
  Synthetic
aagacatccaggaatggaaaccttccacaggctggcacaattggcaggaagtgcctttctgttcacaccacttca

SEQ ID NO: 329867 - DNA, 75 bp, Artificial Sequence
  Synthetic
cactggaagtaacggaccctgccgggttcccatctccgtaactgcaaacctcatggacttgacaccggttggaag

SEQ ID NO: 329868 - DNA, 75 bp, Artificial Sequence
  Synthetic
atgaactaatgctgaaagatggacgagtcattgtcgtgccatgcaggaaccaggatgagttaattggcagagcga

SEQ ID NO: 329869 - DNA, 75 bp, Artificial Sequence
  Synthetic
ggatttctccaggggcagggtggaacatcaaggaaacagcatgtttgagcaaatcttatgcacaaatgtggttgc

SEQ ID NO: 329870 - DNA, 75 bp, Artificial Sequence
  Synthetic
agaggtaccacccagatcaactatcactggcacaaagagggaagcagcattgggaaggctctggcgaccacatgg

SEQ ID NO: 329871 - DNA, 75 bp, Artificial Sequence
  Synthetic
actggcacaaagagggaagcagcattgggaaggctctggcgaccacatggaaaggagcccaacggctagccgtct

SEQ ID NO: 329872 - DNA, 75 bp, Artificial Sequence
  Synthetic
tcatgtattttcacagacgtgacctcagaatgatggctaacgccatctgttcagctgtcccaattgactgggtcc

SEQ ID NO: 329873 - DNA, 75 bp, Artificial Sequence
  Synthetic
caacagggcgcaccacatggtccattcatggaaaaggtgagtggatgacaactgaggacatgttgagcgtttgga

SEQ ID NO: 329874 - DNA, 75 bp, Artificial Sequence
  Synthetic
attggcaaagctgtccaccaagtttttggaggagcatttaggactttgttcgggggaatgtcctggatcacacag

SEQ ID NO: 329875 - DNA, 75 bp, Artificial Sequence
  Synthetic
tcatggaaaaggtgagtggatgacaactgaggacatgttgagcgtttggaatcgcgtgtggattgaagaaaatga

SEQ ID NO: 329876 - DNA, 75 bp, Artificial Sequence
  Synthetic
ggactacttggagcccttctcctgtggatggggttgcaggcccgcgacaggagcatctcgctgactctactggct

SEQ ID NO: 329877 - DNA, 75 bp, Artificial Sequence
  Synthetic
gtacatgaaagacaaaacaccacttgcagcttggagtgacattccctatctcggaaaaagagaagacatatggtg

SEQ ID NO: 329878 - DNA, 75 bp, Artificial Sequence
  Synthetic
cggaagcttgatagggacgaggaccagggcaacttgggctgagaacatttatgcacccatcatgcagatccgcaa

SEQ ID NO: 329879 - DNA, 75 bp, Artificial Sequence
  Synthetic
cctgattgggaacgaaaaatacagagattacatggttgcccagaatagattcagcaaggaggaattcagcatggc

SEQ ID NO: 329880 - DNA, 75 bp, Artificial Sequence
  Synthetic
tgggggagtattgtaaatagaaaattgaaaatgtaaataggaaatataagtgagtcaggccaattaaaattgcca

SEQ ID NO: 329881 - DNA, 75 bp, Artificial Sequence
  Synthetic
ccggatgtcaggtaaacggtgctgcctgtaacctggccccaggtgactgggttaacaaagccaatccagctgggt

SEQ ID NO: 329882 - DNA, 75 bp, Artificial Sequence
  Synthetic
ctgtaacctggccccaggtgactgggttaacaaagccaatccagctgggtgctaagcccctcgttccgactcggg

SEQ ID NO: 329883 - DNA, 75 bp, Artificial Sequence
  Synthetic
gccacctgaaagcatgctaaaggtgctgtctgtacatgccccaggcggactgggtaatcaaagcttaacggcccc

SEQ ID NO: 329884 - DNA, 75 bp, Artificial Sequence
  Synthetic
ggatgccaaaccacttctgggaaaaaacagtggccgccgcggatacattgtatctcctagggaccagtgaggcta

SEQ ID NO: 329885 - DNA, 75 bp, Artificial Sequence
  Synthetic
agcggcccaaaccatggagtgcgtgaccatggcgtaaggactagaggttagaggagaccccgctgaaacttggca

SEQ ID NO: 329886 - DNA, 75 bp, Artificial Sequence
  Synthetic
caaagtggaagactttggatttggcatggtgttcactcgattgtggctcacaatccgggaggaaaacacaacgga

SEQ ID NO: 329887 - DNA, 75 bp, Artificial Sequence
  Synthetic
atggtgttcactcgattgtggctcacaatccgggaggaaaacacaacggaatgcgattcggcaatcattggcaca

SEQ ID NO: 329888 - DNA, 75 bp, Artificial Sequence
  Synthetic
gagacgggggaaggactagaggttagaggagaccccttgccgaaaacgcaaaaaacagcatattgacacctggag

SEQ ID NO: 329889 - DNA, 75 bp, Artificial Sequence
  Synthetic
tgacacctggagagacaggagatcccctgctttttcaacaccagccacaaggcacagagcgccgtaaagtgtggc

SEQ ID NO: 329890 - DNA, 75 bp, Artificial Sequence
  Synthetic
aggtccaaatgattgcagtagctccgggaaaaccagccatcaatgtccaaacaacaccaggagtgttcaagaccc

SEQ ID NO: 329891 - DNA, 75 bp, Artificial Sequence
  Synthetic
gacttagttcttgaagggggaagttgtgttacggtcatggcaccagaaaaaccgacactggacttcaaggtgatg

SEQ ID NO: 329892 - DNA, 75 bp, Artificial Sequence
  Synthetic
ggagcagccttcctccaaatggcggccaacgacctgaagcttgaggttcttccgatacttaacgccatgtccatt

SEQ ID NO: 329893 - DNA, 75 bp, Artificial Sequence
  Synthetic
gcatggatgctgataagggcaatgaaagaaggtaaagtggcgatgtacgctcttcccatcttgtgtgctctgact

SEQ ID NO: 329894 - DNA, 75 bp, Artificial Sequence
  Synthetic
aagagcaaggcaacagggaaaacgatcttgagagaaaacatcaaatacgaagttgccatctttgttcatggatca

SEQ ID NO: 329895 - DNA, 75 bp, Artificial Sequence
  Synthetic
ccaggaatgaggatggctgggcttgatgtcatcagatgcttgttgttgataattgggattgtaacacttctgaat

SEQ ID NO: 329896 - DNA, 75 bp, Artificial Sequence
  Synthetic
agcagctaggttcactattagcccacaggcaccatcctttacagccaacatgggtgaatatgggacagtgaccat

SEQ ID NO: 329897 - DNA, 75 bp, Artificial Sequence
  Synthetic
ctttggcagggggccttctcgagtttgaggagacctcaatggtggtcccttttgcaatagctggactaatgtaca

SEQ ID NO: 329898 - DNA, 75 bp, Artificial Sequence
  Synthetic
gaatcccactgacacaggacacgggacagtgatcgtggaactgcagtacacaggaagcaatggaccttgtagagt

SEQ ID NO: 329899 - DNA, 75 bp, Artificial Sequence
  Synthetic
tcacatacaccgtctcgggaaaagccgcagaaatgtggattgaaaaagcagcagacatcacatgggaacagaatg

SEQ ID NO: 329900 - DNA, 75 bp, Artificial Sequence
  Synthetic
ctggagctccagtgcacttgtttgcgctgagattcatactcctgggcttgagtgcacgattttactggttcattc

SEQ ID NO: 329901 - DNA, 75 bp, Artificial Sequence
  Synthetic
catttggagtactggggttttggttgcttggaaaacactcgaagcgaggaggagcattgtgggacgtgccatcac

SEQ ID NO: 329902 - DNA, 75 bp, Artificial Sequence
  Synthetic
aaatcttgtacgtggccggagacacacaccctttggggcgatggtgttgttgaaagcgagatgatcatcccagtt

SEQ ID NO: 329903 - DNA, 75 bp, Artificial Sequence
  Synthetic
ccagggaaaccagccattaatgtccagacaacaccaggagtattcaagaccccgttcgggaccattggagccgtg

SEQ ID NO: 329904 - DNA, 75 bp, Artificial Sequence
  Synthetic
aatatgttagtggcatcatccaaggggaaaggacagaagaaccaattccagatgcatacaatgaggaaatgctcc

SEQ ID NO: 329905 - DNA, 75 bp, Artificial Sequence
  Synthetic
ttggaatcgtgacgctcctgaatgaaagacgagaaagtgtggcgaaaaagaaaggaggatatctaattgcagctg

SEQ ID NO: 329906 - DNA, 75 bp, Artificial Sequence
  Synthetic
tcaacaaaagtggaattgggggaagcagctgccatctttatgacggcgactccaccaggaacaaatgaccccttt

SEQ ID NO: 329907 - DNA, 75 bp, Artificial Sequence
  Synthetic
ccagattcaaattctcccatactggatgttgaggcccaggttccggataaggcgtggagcactgggtatgagtgg

SEQ ID NO: 329908 - DNA, 75 bp, Artificial Sequence
  Synthetic
ggcgtggagcactgggtatgagtggatcaccaacttcacagggaggactgtgtggtttgtccccagtgtgaaaag

SEQ ID NO: 329909 - DNA, 75 bp, Artificial Sequence
  Synthetic
ggaataccccaagacaaagaacaacgaatgggattttgttgtgaccactgacatatcagagatgggggctaactt

SEQ ID NO: 329910 - DNA, 75 bp, Artificial Sequence
  Synthetic
agctctgtgggatgtcccgtcaccaaaggtatacccaaagtgtgaaaccaaaccaggaatttatcgaattatgac

SEQ ID NO: 329911 - DNA, 75 bp, Artificial Sequence
  Synthetic
tggagatgagtatcattatgggggtgcaaccaatgaggacgaccatgatctggccaactggactgaagcaaagat

SEQ ID NO: 329912 - DNA, 75 bp, Artificial Sequence
  Synthetic
catggatggggagtttcgactgcgtggagaagaaaggaagaactttgttgagttgatgcgcaacggtgacctccc

SEQ ID NO: 329913 - DNA, 75 bp, Artificial Sequence
  Synthetic
agtgtggttagcttacaaagtagcttccaacgggtacagttaccaggaccgttcatggtgttttacaggacaaac

SEQ ID NO: 329914 - DNA, 75 bp, Artificial Sequence
  Synthetic
caacaacacaatcctggaagacaataacgaagttgaagtttttaccaaaactggagataggaaaattctcaggcc

SEQ ID NO: 329915 - DNA, 75 bp, Artificial Sequence
  Synthetic
ctggagataggaaaattctcaggccaaagtggatggatgcgcgggtttgttgcgactaccaagcgctcaagtcat

SEQ ID NO: 329916 - DNA, 75 bp, Artificial Sequence
  Synthetic
gaaatgagattgccatctgccttcaaaaggcagggaaacgagtaattcagctcaataggaagagctttgacacgg

SEQ ID NO: 329917 - DNA, 75 bp, Artificial Sequence
  Synthetic
ctcaataggaagagctttgacacggaatacccaaagacacgaaacaatgaatgggactttgttgtgaccacggac

SEQ ID NO: 329918 - DNA, 75 bp, Artificial Sequence
  Synthetic
gaagatgatgaccgggtcattctgaatggaccaattgcaattacatcagctagtgctgcccaacgcagaggccga

SEQ ID NO: 329919 - DNA, 75 bp, Artificial Sequence
  Synthetic
gcatttgtgatgactcttgccacggcattgctgtgggcagcagaagtacccggaacgcagatagctggagttttg

SEQ ID NO: 329920 - DNA, 75 bp, Artificial Sequence
  Synthetic
ctgatagtgttcttgttgatgattgtgttgattccagaacctgagaagcaacggtctcagactgataaccaactg

SEQ ID NO: 329921 - DNA, 75 bp, Artificial Sequence
  Synthetic
gctgtcttcttgatatgcatcatgaccctcatgggtgtggtggcggcgaatgaaatgggccttttggaaaaaacc

SEQ ID NO: 329922 - DNA, 75 bp, Artificial Sequence
  Synthetic
tcatggtgtttcacaggacagactaacaacacaattctggaggatagcaacgaagttgaaatttatacaaagact

SEQ ID NO: 329923 - DNA, 75 bp, Artificial Sequence
  Synthetic
aagtctgacattgccaagttgtttggcagccaacctggatcagtgggatttgcaacaagaacaacaccttgggac

SEQ ID NO: 329924 - DNA, 75 bp, Artificial Sequence
  Synthetic
gggaagaatgccaagccacttttgggagaaaacagtagctgcagcggatacactgtatctgctagggactagtga

SEQ ID NO: 329925 - DNA, 75 bp, Artificial Sequence
  Synthetic
atcagccttgacatcaaaccagccaccgcatgggcactgtatgcggcagcaacaatggtcatgacacccttgata

SEQ ID NO: 329926 - DNA, 75 bp, Artificial Sequence
  Synthetic
cttatgggggttgtggcagcaaatgaaatgggccttctggagagaaccaaggctgacatcagcaagctactcgga

SEQ ID NO: 329927 - DNA, 75 bp, Artificial Sequence
  Synthetic
acggctgctggaatcatgaaaaacgcagtggtagacgggatcgtggcaacggacataccggaattaacaccggcc

SEQ ID NO: 329928 - DNA, 75 bp, Artificial Sequence
  Synthetic
tcacgtggacagtctacaagaatgtggacaagccaaagggaaagcgcggaggagggaaaggagccactcttggag

SEQ ID NO: 329929 - DNA, 75 bp, Artificial Sequence
  Synthetic
ggacaagccaaagggaaagcgcggaggagggaaaggagccactcttggagagatctggaagtcaaggctgaatca

SEQ ID NO: 329930 - DNA, 75 bp, Artificial Sequence
  Synthetic
ataaaccaaaaggaaaacggggaggtggaaaaggagccacccttggagaaatctggaaatcaaaactaaaccaac

SEQ ID NO: 329931 - DNA, 75 bp, Artificial Sequence
  Synthetic
caggagagaaggacgtctcacaggtggccatccagtgtccagagggtcagcaaaattaagatggataacagaaag

SEQ ID NO: 329932 - DNA, 75 bp, Artificial Sequence
  Synthetic
ggttcgtcaaaccaatgggaaaagtcgtcgatctcggctgtgggagaggaggatggagctactattgtgcaacct

SEQ ID NO: 329933 - DNA, 75 bp, Artificial Sequence
  Synthetic
ggatggagctactattgtgcaaccttgaaacacgtccaagaggtgaagggcttcaccaagggcggaccgggccat

SEQ ID NO: 329934 - DNA, 75 bp, Artificial Sequence
  Synthetic
ctatggatggaatctggtccacatgaagagtggagtggacgtgttccataagccagctgagccagctgacactgt

SEQ ID NO: 329935 - DNA, 75 bp, Artificial Sequence
  Synthetic
ccaagctgtgaggtggaggaagcccgaacagcaagagtgttggacatggttgaggaatggctgaagaaaggagcc

SEQ ID NO: 329936 - DNA, 75 bp, Artificial Sequence
  Synthetic
ggaagcggaacacgctcagttggaaagctcactgaaaaacccgacctccggaaagtcggagagagaatcaaacgg

SEQ ID NO: 329937 - DNA, 75 bp, Artificial Sequence
  Synthetic
ccttgtctagaaattcgacacatgagatgtactgggttagtggggcggctggaaacatcatacatgccgtcagta

SEQ ID NO: 329938 - DNA, 75 bp, Artificial Sequence
  Synthetic
tgactagccaggtactcatggggaggatggacaaacagaacagaagtgggccacgctacgaggaagatgtgaatt

SEQ ID NO: 329939 - DNA, 75 bp, Artificial Sequence
  Synthetic
gatggacaaacagaacagaagtgggccacgctacgaggaagatgtgaatttgggaagcggaacgcgctctgttgg

SEQ ID NO: 329940 - DNA, 75 bp, Artificial Sequence
  Synthetic
gttatgaagtgaaaccaactggatcagctagctcgatggtgaacggagttgtgaggctcctctcaaaaccatggg

SEQ ID NO: 329941 - DNA, 75 bp, Artificial Sequence
  Synthetic
ggtcaacaaagggtgttcaaagaaaaggttgacacaaaggctcccgaaccaccattgggagtcgcccaaatcatg

SEQ ID NO: 329942 - DNA, 75 bp, Artificial Sequence
  Synthetic
gatgtgacaacagactggctgtgggacttcgtcgcccgggaaaagaaaccaagagtttgcaccccagaagaattc

SEQ ID NO: 329943 - DNA, 75 bp, Artificial Sequence
  Synthetic
ctctgggagctatgtttgaagagcaaaaccagtggagtagcgctcgtgaagctgtggaagatccaaagttctgga

SEQ ID NO: 329944 - DNA, 75 bp, Artificial Sequence
  Synthetic
tcatggaaaaggtgagtggatgacaactgaggacatgctgagcgtttggaaccgcgtgtggattgaagaaaatga

SEQ ID NO: 329945 - DNA, 75 bp, Artificial Sequence
  Synthetic
cctgctttttcaacaccagccacaaggcacagagcgccgtaaagtgtggctggtggtgaaaaaatcacaggatct

SEQ ID NO: 329946 - DNA, 75 bp, Artificial Sequence
  Synthetic
agatgttcgcgtcggtgagcggagaggaaacagatttcctttttggaggataataacttaacttgactgcgaaca

SEQ ID NO: 329947 - DNA, 75 bp, Artificial Sequence
  Synthetic
atgacacagccggctgggacacccgtatcacaaaagaggacttgaaaaatgaagcaaaaataacaaagagaatgg

SEQ ID NO: 329948 - DNA, 75 bp, Artificial Sequence
  Synthetic
cttgacggggttgaagaggatacttggaagtctgctggatggccgtggacccgtgcggttcatactagccatcct

SEQ ID NO: 329949 - DNA, 75 bp, Artificial Sequence
  Synthetic
cagccaactgaggcgctgaagcgcagatggagggctgtggacaaaagaacggcattgaaacacctgaacggattt

SEQ ID NO: 329950 - DNA, 75 bp, Artificial Sequence
  Synthetic
aaacgtgacctcggatccatgctagacaccatcaaccggcggccaagcaagaagagaggagggaccagatcgttg

SEQ ID NO: 329951 - DNA, 75 bp, Artificial Sequence
  Synthetic
acaccatcaaccggcggccaagcaagaagagaggagggaccagatcgttgctcggattggctgcgctaattggac

SEQ ID NO: 329952 - DNA, 75 bp, Artificial Sequence
  Synthetic
atgacatcacgagagtgagactcggacgactggccaaagcggttgagtggctgaggaagaatggacctgaacgac

SEQ ID NO: 329953 - DNA, 75 bp, Artificial Sequence
  Synthetic
tgagtagaatggcagtgagtggggacgactgtgttgtgaaaccaattgatgacagatttgccactgcactccact

SEQ ID NO: 329954 - DNA, 75 bp, Artificial Sequence
  Synthetic
tggcgagttcattgcagttatcaacctatcaggggaaagtgttaatgtcaatcaacaagactgacgctcaaagcg

SEQ ID NO: 329955 - DNA, 75 bp, Artificial Sequence
  Synthetic
atcaacaagactgacgctcaaagcgccataaacattcctagtgccaacggagcaaacacttgcattgtgagggct

SEQ ID NO: 329956 - DNA, 75 bp, Artificial Sequence
  Synthetic
ctagatgtgggggtcatgtgcaaagatgacatcacatacctgtgcccagtgctttcagcgggaaatgatcccgag

SEQ ID NO: 329957 - DNA, 75 bp, Artificial Sequence
  Synthetic
caatgaactaatgctaaaggatgggcggaccatcgtggtgccatgcaggagccaggatgagctgattggcagagc

SEQ ID NO: 329958 - DNA, 75 bp, Artificial Sequence
  Synthetic
cggaccatcgtggtgccatgcaggagccaggatgagctgattggcagagccagaatttcaccaggagcgggatgg

SEQ ID NO: 329959 - DNA, 75 bp, Artificial Sequence
  Synthetic
gacattgactgttggtgtgacgtcgaagaggtgtgggtgcactacggcagatgtacgcgcatgggacattcgagg

SEQ ID NO: 329960 - DNA, 75 bp, Artificial Sequence
  Synthetic
aagaggtgtgggtgcactacggcagatgtacgcgcatgggacattcgaggcgtagccgacggtcaatttctgtgc

SEQ ID NO: 329961 - DNA, 75 bp, Artificial Sequence
  Synthetic
aatgtgaaagagacagcctgcctgagcaaatcctacgctcagatgtggttgcttatgtacttccacaggcgggat

SEQ ID NO: 329962 - DNA, 75 bp, Artificial Sequence
  Synthetic
agcaccatggagattccacactggcaacaaagaacacgccatggttggacaccgtgaaaaccaccaaatacttga

SEQ ID NO: 329963 - DNA, 75 bp, Artificial Sequence
  Synthetic
cccaactggacgcaccacatggtcaattcatgggaagggtgagtggatgacaacagaagacatgttgaatgtctg

SEQ ID NO: 329964 - DNA, 75 bp, Artificial Sequence
  Synthetic
acaatacaatcttggaagataacaacgaagttgaagtcttcaccaaaaccggagacaggaaaattctcaggccaa

SEQ ID NO: 329965 - DNA, 75 bp, Artificial Sequence
  Synthetic
tgtgatcatgctgatgctgattgctccggcatacagcttcaactgtctgggaacatcaaacagggactttgtcga

SEQ ID NO: 329966 - DNA, 75 bp, Artificial Sequence
  Synthetic
tggcggcttggaacgacattccatacctaggaaaaagagaggatatctggtgtggaagccttatcggaacaagga

SEQ ID NO: 329967 - DNA, 75 bp, Artificial Sequence
  Synthetic
gaacatcaaacagggactttgtcgagggagccagtggggcaacatggattgacttggtacttgaagggggaagct

SEQ ID NO: 329968 - DNA, 75 bp, Artificial Sequence
  Synthetic
gtgttacagtgatggcaccagagaaaccaacactggacttcaaggtgatgaagatggaggctaccgagttagcca

SEQ ID NO: 329969 - DNA, 75 bp, Artificial Sequence
  Synthetic
ctacgctccaatcatgcagatccgcaacctcatcggggaagaagagtacagagactacatggtcgcccaaaacag

SEQ ID NO: 329970 - DNA, 75 bp, Artificial Sequence
  Synthetic
aagatggaggctaccgagttagccactgtgcgtgagtattgttacgaagcaaccttggacacgctgtcaacagtg

SEQ ID NO: 329971 - DNA, 75 bp, Artificial Sequence
  Synthetic
atttggtagggaagaaactcatgtggtaggaggagtgctgtagattaaaatgtaaatagtgtaagtaaataaaac

SEQ ID NO: 329972 - DNA, 75 bp, Artificial Sequence
  Synthetic
ctgtgcgtgagtattgttacgaagcaaccttggacacgctgtcaacagtggcaaggtgccctacaacaggagagg

SEQ ID NO: 329973 - DNA, 75 bp, Artificial Sequence
  Synthetic
ctcacaacaccaaaaggagtgacccaacatttgtctgcaaaagagatgttgtggaccgcggatggggtaacggat

SEQ ID NO: 329974 - DNA, 75 bp, Artificial Sequence
  Synthetic
gtggcctgtttggaaaagggagcattgacacatgcgctaagttcacatgcaaaaacaaggcaacagggaagacga

SEQ ID NO: 329975 - DNA, 75 bp, Artificial Sequence
  Synthetic
tcttgagagaaaacatcaagtatgaggttgcaatttttgtgcatggttcaacggactctacgtcacatggcaatt

SEQ ID NO: 329976 - DNA, 75 bp, Artificial Sequence
  Synthetic
actctgagcagattgggaaaaaccaagcggctagattcaccataagcccgcaagcaccgtcctttacggccaaca

SEQ ID NO: 329977 - DNA, 75 bp, Artificial Sequence
  Synthetic
caagcaccgtcctttacggccaacatgggcgagtatggaacagttaccattgattgtgaagcaagatcaggaatc

SEQ ID NO: 329978 - DNA, 75 bp, Artificial Sequence
  Synthetic
aacgcggtgtatcccgcgtgaatcccttaacggggttaaagaggatacttggaagtctgctagatggtcgtggac

SEQ ID NO: 329979 - DNA, 75 bp, Artificial Sequence
  Synthetic
aacacggaggattattatgtcttcactgtcaaggagaagtcatggctagtgaacagggactggtttcacgacttg

SEQ ID NO: 329980 - DNA, 75 bp, Artificial Sequence
  Synthetic
ctgtgcggttcatactggccattctgacattcttccgattcacagctctacagccaactgaggcactgaagcgca

SEQ ID NO: 329981 - DNA, 75 bp, Artificial Sequence
  Synthetic
aaccttccatggacgagccctgccacaactgattggcgcaacagagaaacactggtggaatttgaggaaccgcat

SEQ ID NO: 329982 - DNA, 75 bp, Artificial Sequence
  Synthetic
cgagccagctgacactgtgctctgtgacattggagaatcaaacccaagctgtgaggtggaggaagcccggacagc

SEQ ID NO: 329983 - DNA, 75 bp, Artificial Sequence
  Synthetic
taggatcgcaagaaggtgccctgcacacagcattggctggagctattccagccactgttagcagctcaaccctaa

SEQ ID NO: 329984 - DNA, 75 bp, Artificial Sequence
  Synthetic
gccactgttagcagctcaaccctaaccttgcaatcagggcatctgaaatgcagagctaagcttgacaaggtcaaa

SEQ ID NO: 329985 - DNA, 75 bp, Artificial Sequence
  Synthetic
ccttgcaatcagggcatctgaaatgcagagctaagcttgacaaggtcaaaatcaagggaacgacatatggcatgt

SEQ ID NO: 329986 - DNA, 75 bp, Artificial Sequence
  Synthetic
tggcgagctcattgcaactttcaacctaccagggaaaagtgctaatgtcaataaacaagactgacgcccaaagcg

SEQ ID NO: 329987 - DNA, 75 bp, Artificial Sequence
  Synthetic
gtgattctgccttcaccttcagcaagaacccaactgacacagggcacgggacagtgattgtggaactgcagtata

SEQ ID NO: 329988 - DNA, 75 bp, Artificial Sequence
  Synthetic
ccataaacattcccagtgccaacggagcaaacacctgcattgtgagagctctagacgtgggagtcatgtgcaaag

SEQ ID NO: 329989 - DNA, 75 bp, Artificial Sequence
  Synthetic
agcaaacacctgcattgtgagagctctagacgtgggagtcatgtgcaaagatgatatcacatacctgtgcccagt

SEQ ID NO: 329990 - DNA, 75 bp, Artificial Sequence
  Synthetic
ctggaagcaacggaccctgccgagttcccatctccgtgactgcaaacctcatggatttgacaccggttggaagac

SEQ ID NO: 329991 - DNA, 75 bp, Artificial Sequence
  Synthetic
tcccatctccgtgactgcaaacctcatggatttgacaccggttggaagactggtcacggtcaatccttttataag

SEQ ID NO: 329992 - DNA, 75 bp, Artificial Sequence
  Synthetic
aagaagtgtgggtgcactatggtagatgcacgcgcatgggacattcaaggcgtagtcggcggtcaatttctgtgc

SEQ ID NO: 329993 - DNA, 75 bp, Artificial Sequence
  Synthetic
aggcaccacccagattaactaccactggcacaaagaaggaagcagcattggtaaggctttggcgaccacatggaa

SEQ ID NO: 329994 - DNA, 75 bp, Artificial Sequence
  Synthetic
accgtgaaaaccaccaagtacttgacaaaagttgaaaactgggttctgcgcaatcctggatatgccctagttgca

SEQ ID NO: 329995 - DNA, 75 bp, Artificial Sequence
  Synthetic
aggagcccaacggctagccgtcttaggggacacagcgtgggactttggatctattggaggagttttcaattcaat

SEQ ID NO: 329996 - DNA, 75 bp, Artificial Sequence
  Synthetic
ctggcgattggatggatgctaggcagcaacaacacacagagagtggtctttgtgatcatgctgatgttgattgcc

SEQ ID NO: 329997 - DNA, 75 bp, Artificial Sequence
  Synthetic
tggcaaagctgtccaccaagttttcggaggagcgttcaggaccctgttcgggggaatgtcctggatcacacaggg

SEQ ID NO: 329998 - DNA, 75 bp, Artificial Sequence
  Synthetic
gaacatcaaacagggatttcgtcgaaggggccagcggggcaacatggatcgacttggtacttgagggaggaagct

SEQ ID NO: 329999 - DNA, 75 bp, Artificial Sequence
  Synthetic
gcatctcgctgactctactggctgttggagggattcttatctttctggcaaccagcgtgcaagccgattcgggat

SEQ ID NO: 330000 - DNA, 75 bp, Artificial Sequence
  Synthetic
gtgtcacagtgatggcaccagagaaaccaacattggacttcaaagtaatgaagatggaggccacggacttagcta

SEQ ID NO: 330001 - DNA, 75 bp, Artificial Sequence
  Synthetic
tctgtggcatccgatcaacgtcacggttggagcacttgatgtgggagaacatacagagagagctaaacgcaatct

SEQ ID NO: 330002 - DNA, 75 bp, Artificial Sequence
  Synthetic
gtggaccgtggatggggcaacggatgtggtctgtttggaaaaggaagcattgacacatgtgcgaagttcacttgc

SEQ ID NO: 330003 - DNA, 75 bp, Artificial Sequence
  Synthetic
ttgaagacaatgagattgacttgtcagttgtagtgcaagaagatcccaaatactacaaaagggctccccgacgcc

SEQ ID NO: 330004 - DNA, 75 bp, Artificial Sequence
  Synthetic
aagaacaaggcaacagggaagacaatcctgagggaaaacatcaagtacgaggtcgcaatttttgtgcatggttca

SEQ ID NO: 330005 - DNA, 75 bp, Artificial Sequence
  Synthetic
ggtcgcaatttttgtgcatggttcaacggactccacgtcacatggcaactactctgagcaaattgggaaaaacca

SEQ ID NO: 330006 - DNA, 75 bp, Artificial Sequence
  Synthetic
acggactccacgtcacatggcaactactctgagcaaattgggaaaaaccaagcagctagattcaccataagcccg

SEQ ID NO: 330007 - DNA, 75 bp, Artificial Sequence
  Synthetic
tgaagaagctggaggatgaattggactacggatggaagaaatggggaaaaaccctgtttgtggaacccagacttg

SEQ ID NO: 330008 - DNA, 75 bp, Artificial Sequence
  Synthetic
tgactgtgaagcaagatcaggaatcaacacagaagactattatgtctttacagtcaaggagaagtcatggctggt

SEQ ID NO: 330009 - DNA, 75 bp, Artificial Sequence
  Synthetic
ggtgttcactcgattgtggctcacaatccgggaggaaaacacaacggaatgcgattcggcaatcatcggcacagc

SEQ ID NO: 330010 - DNA, 75 bp, Artificial Sequence
  Synthetic
aaatagggattggtttcacgacctgaaccttccatggacgagccctgccacaactgactggcgtaacagagaaac

SEQ ID NO: 330011 - DNA, 75 bp, Artificial Sequence
  Synthetic
tataaaaggagacagagctgttcacagtgacctatcgtattggattgagagcaaaaagaatgagacatggcaact

SEQ ID NO: 330012 - DNA, 75 bp, Artificial Sequence
  Synthetic
ggaacgagccgtcatgggagaagtgaaatcttgtacctggccagaaacgcacaccctgtggggtgatggtgttgt

SEQ ID NO: 330013 - DNA, 75 bp, Artificial Sequence
  Synthetic
tgaaagcgaaatgatcatcccggtgacattaggaggtccaaaaagccatcacaacaagagaaacggatactatac

SEQ ID NO: 330014 - DNA, 75 bp, Artificial Sequence
  Synthetic
acagacaaaaggaccctggagtgaaggagaaataatcctggactttgactactgtccaggaacaacagtcaccgt

SEQ ID NO: 330015 - DNA, 75 bp, Artificial Sequence
  Synthetic
actgtccaggaacaacagtcaccgttactgaacattgtggaaacaggggagcgtcgctgcgcacaaccacagcga

SEQ ID NO: 330016 - DNA, 75 bp, Artificial Sequence
  Synthetic
tggttacggtcaatccctttataagcacagggggagcgaacaacaaggtcatgatcgaagttgaaccacccttcg

SEQ ID NO: 330017 - DNA, 75 bp, Artificial Sequence
  Synthetic
ttgcaggagctgttccttgccaccactgcgatacaccacaaaagatggatgctggtatggaatggaaatccggcc

SEQ ID NO: 330018 - DNA, 75 bp, Artificial Sequence
  Synthetic
ggtgaaggaggaggaagcaaagcttgtgaaatctcgagtgacagctggagttgcaggagggatggaaccattcca

SEQ ID NO: 330019 - DNA, 75 bp, Artificial Sequence
  Synthetic
gtgaaatctcgagtgacagctggagttgcaggagggatggaaccattccaacttggtctcctggtagcattcata

SEQ ID NO: 330020 - DNA, 75 bp, Artificial Sequence
  Synthetic
gtgactcttacatcgtcgtcggaagaggcacaacccaaatcaactaccactggcacaaagagggaagcagcattg

SEQ ID NO: 330021 - DNA, 75 bp, Artificial Sequence
  Synthetic
aggcacaacccaaatcaactaccactggcacaaagagggaagcagcattgggaaggctttggcgactacatggaa

SEQ ID NO: 330022 - DNA, 75 bp, Artificial Sequence
  Synthetic
gccacacaagaagtgctgaaacgcagatggactgggaagctgaccctgacctcactagcagtatgtttggcactg

SEQ ID NO: 330023 - DNA, 75 bp, Artificial Sequence
  Synthetic
ttgatttttggaaacctaacatacatggacctggtgcgatacctggtccttgttggaactgcttttgcggaaatg

SEQ ID NO: 330024 - DNA, 75 bp, Artificial Sequence
  Synthetic
cggcaaagctgtccaccaagtttttggaggggcattcaggactctgttcggaggaatgtcctggatcacacaggg

SEQ ID NO: 330025 - DNA, 75 bp, Artificial Sequence
  Synthetic
actacttggagctcttctcttgtggatgggattgcaggctcgtgacaggagcatctcgctgactctactggctgt

SEQ ID NO: 330026 - DNA, 75 bp, Artificial Sequence
  Synthetic
atgggattgcaggctcgtgacaggagcatctcgctgactctactggctgttggagggattctaatctttctagcg

SEQ ID NO: 330027 - DNA, 75 bp, Artificial Sequence
  Synthetic
agcagcttttctccaaatggcggccaatgacttgaagcttgaggtccttccgatactcaacgccatgtccattgc

SEQ ID NO: 330028 - DNA, 75 bp, Artificial Sequence
  Synthetic
gtgtacaatgacgtcgagaagtggaaaagtgactataagtattttcctttgactccaactggactcgcgcgcgtg

SEQ ID NO: 330029 - DNA, 75 bp, Artificial Sequence
  Synthetic
gtggatgctgataagggcaatgaaagaaggtaaagtggcgatgtacgctcttcccatcttgtgtgctttgactcc

SEQ ID NO: 330030 - DNA, 75 bp, Artificial Sequence
  Synthetic
atacagagagagctgaacgcaatctttgaagacaacgaaattgacttgtcagttgtagtgcaggaagatcccaaa

SEQ ID NO: 330031 - DNA, 75 bp, Artificial Sequence
  Synthetic
aagaagagaaagtgtggccaagaaaaaaggcggctacttgctcgcagcggccctctgccaagctggagtgtgcag

SEQ ID NO: 330032 - DNA, 75 bp, Artificial Sequence
  Synthetic
ttgggattgtaacacttctgaatgaaagaagagaaagtgtggccaagaaaaaaggcggctacttgctcgcagcgg

SEQ ID NO: 330033 - DNA, 75 bp, Artificial Sequence
  Synthetic
cactacagaagagctccccaacgcttgaagaaattggaggatgagctggattacggatggaagaaatgggggaaa

SEQ ID NO: 330034 - DNA, 75 bp, Artificial Sequence
  Synthetic
tcccttgattatgatgggaggcttaatcctggctcaccccaacgggaaaaggagttggccggcgagtgaggtctt

SEQ ID NO: 330035 - DNA, 75 bp, Artificial Sequence
  Synthetic
ttacggatggaagaaatgggggaaaaccctgttcatggaacctaaacttggaaacaacacatttgttgttgacgg

SEQ ID NO: 330036 - DNA, 75 bp, Artificial Sequence
  Synthetic
aactggagttggactgatgtgcgctttggcaggaggtcttctcgagtttgaggaaacctcaatggtggtcccttt

SEQ ID NO: 330037 - DNA, 75 bp, Artificial Sequence
  Synthetic
ttggcaggaggtcttctcgagtttgaggaaacctcaatggtggtcccttttgcaatagccggactgatgtatatc

SEQ ID NO: 330038 - DNA, 75 bp, Artificial Sequence
  Synthetic
gcaaacagagcatggaacagtttcaaggtggaagactttggatttggcatggtgttcactcgattatggctcaca

SEQ ID NO: 330039 - DNA, 75 bp, Artificial Sequence
  Synthetic
ccttgacatcaaaccagccaccgcatgggcactgtatgcagcagcaacaatggtcatgacacctttgataaaaca

SEQ ID NO: 330040 - DNA, 75 bp, Artificial Sequence
  Synthetic
agacatcacatgggaacagaatgccgagatcaccggaaccagccccaggcttgatgttgaccttgactcacatgg

SEQ ID NO: 330041 - DNA, 75 bp, Artificial Sequence
  Synthetic
caacttcaagctcctgaacgaccctggagctccagtgcacttgtttgcgctgagattcatactcctgggcttgag

SEQ ID NO: 330042 - DNA, 75 bp, Artificial Sequence
  Synthetic
tgagattcatactcctgggcttgagtgcacgattccattggttcattccattcggagtactggggttttggctac

SEQ ID NO: 330043 - DNA, 75 bp, Artificial Sequence
  Synthetic
aaagtgtatccaaagtgtgagacaaaaccaggaatctatcgaatcatgactagaggaattttgggcactttccaa

SEQ ID NO: 330044 - DNA, 75 bp, Artificial Sequence
  Synthetic
gccggagtcggtgtgatgcacgaaggagtttttcacacaatgtggcacgcaactgaaggagcagtcctacgaaat

SEQ ID NO: 330045 - DNA, 75 bp, Artificial Sequence
  Synthetic
gcggcaagctggtcactgattggtgctgcaggagctgttccttgccaccactgcgatacaccacaaaagatggat

SEQ ID NO: 330046 - DNA, 75 bp, Artificial Sequence
  Synthetic
agtgaaggaggaagaagcaaaacttgtaaaatctcgagtgacagctggagtcgcaggggggatggaaccattcca

SEQ ID NO: 330047 - DNA, 75 bp, Artificial Sequence
  Synthetic
agtgccacttgggatggaactgaggaggtccaaatgattgcagtagctccggggaaaccagccattaatgtccag

SEQ ID NO: 330048 - DNA, 75 bp, Artificial Sequence
  Synthetic
ggggaaaccagccattaatgtccagacaacaccaggagtgtttaagaccccgctcgggaccattggagccgtgac

SEQ ID NO: 330049 - DNA, 75 bp, Artificial Sequence
  Synthetic
acttggtctcttggtagcattcatagccacccaagaagtgctaaaacgcagatggactgggaagttgaccctgac

SEQ ID NO: 330050 - DNA, 75 bp, Artificial Sequence
  Synthetic
acaacaccaggagtgtttaagaccccgctcgggaccattggagccgtgacgcttgatttcccaaaaggaacatca

SEQ ID NO: 330051 - DNA, 75 bp, Artificial Sequence
  Synthetic
ctcattggcggtatgtttggcactattaatttttggaaacctaacatacatggatctggtgcggtacctggtcct

SEQ ID NO: 330052 - DNA, 75 bp, Artificial Sequence
  Synthetic
tatgttagtggcatcatccaaggggaaaggacagaagaaccaattccagatgcatacaatgaggaaatgctccgg

SEQ ID NO: 330053 - DNA, 75 bp, Artificial Sequence
  Synthetic
tggcgcttgttgctgtcttcaaagtgcaaccagcattcttggcgggtttgttcttgagaatgcagtggagcaatc

SEQ ID NO: 330054 - DNA, 75 bp, Artificial Sequence
  Synthetic
aaaggacagaagaaccaattccagatgcatacaatgaggaaatgctccggaagagaaaactaacagtactggaat

SEQ ID NO: 330055 - DNA, 75 bp, Artificial Sequence
  Synthetic
gcaaccagcattcttggcgggtttgttcttgagaatgcagtggagcaatcaggaaaacatcttgatggtcattgg

SEQ ID NO: 330056 - DNA, 75 bp, Artificial Sequence
  Synthetic
tgcatccgggagctggaaagaccagaaaggtgttgccccaaatcatcaaagattgcatccaaaaacgcttgcgaa

SEQ ID NO: 330057 - DNA, 75 bp, Artificial Sequence
  Synthetic
gattgcatccaaaaacgcttgcgaacggccgtgctagctcccactcgggtagtggcttgtgagatcgctgaagcg

SEQ ID NO: 330058 - DNA, 75 bp, Artificial Sequence
  Synthetic
caattctcaatgctatgtccattgcatggatgctaataagggcaatgaaagaaggtaaagtggcgatgtgcgctc

SEQ ID NO: 330059 - DNA, 75 bp, Artificial Sequence
  Synthetic
cggccgtgctagctcccactcgggtagtggcttgtgagatcgctgaagcgttaaaaggactgccaatccgttacc

SEQ ID NO: 330060 - DNA, 75 bp, Artificial Sequence
  Synthetic
taacaccagccgtgaggaatgaacatcagggcaatgagatagttgacgtgatgtgccatgccacgctcacacaga

SEQ ID NO: 330061 - DNA, 75 bp, Artificial Sequence
  Synthetic
aactgctgacaccgacccgggttcccaactaccaagtgtacatcatggatgaggcccacttcattgatccagcaa

SEQ ID NO: 330062 - DNA, 75 bp, Artificial Sequence
  Synthetic
aagaagagaaagtgtggccaagaaaaaaggcggctacttgctcgccgcagccctctgccaagctggattgtgcag

SEQ ID NO: 330063 - DNA, 75 bp, Artificial Sequence
  Synthetic
aaaggcggctacttgctcgccgcagccctctgccaagctggattgtgcagtcctttgatcatgatgggaggcctg

SEQ ID NO: 330064 - DNA, 75 bp, Artificial Sequence
  Synthetic
aacaaaagtggaattgggggaagcagctgccatctttatgacggcaactccaccaggaacaaatgacccttttcc

SEQ ID NO: 330065 - DNA, 75 bp, Artificial Sequence
  Synthetic
agattcaaattctcccatactggatgttgaggcccaggttccggataaggcgtggagcaccgggtatgagtggat

SEQ ID NO: 330066 - DNA, 75 bp, Artificial Sequence
  Synthetic
caccaacttcacagggaggactgtgtggtttgttcccagtgtgaaaagtgggaacgaaattgccatctgcctaca

SEQ ID NO: 330067 - DNA, 75 bp, Artificial Sequence
  Synthetic
cagaaatgtggattgagaaagcagctgacatcacatgggaacagaatgctgagatcactggaaccagtcccaggc

SEQ ID NO: 330068 - DNA, 75 bp, Artificial Sequence
  Synthetic
aaaagcaggaaagcgagtgattcaactaaacaggaaaagctttgacacagaataccctaagacaaagaacaacga

SEQ ID NO: 330069 - DNA, 75 bp, Artificial Sequence
  Synthetic
ctaaacaggaaaagctttgacacagaataccctaagacaaagaacaacgaatgggattttgttgtgactactgat

SEQ ID NO: 330070 - DNA, 75 bp, Artificial Sequence
  Synthetic
atatcagagatgggggctaactttggagcgcacagagtcatcgacagccgcaagtgtgtgaaaccagtcatcttg

SEQ ID NO: 330071 - DNA, 75 bp, Artificial Sequence
  Synthetic
atggacccatggcaatcacatcagcgagcgcagcacagcgcagaggccgcattggaagaaatccttcgcagattg

SEQ ID NO: 330072 - DNA, 75 bp, Artificial Sequence
  Synthetic
cagaggaatcctgggcacgtttcaagctggagttggtgtgatgcatgaaggagtttttcacacaatgtggcacgc

SEQ ID NO: 330073 - DNA, 75 bp, Artificial Sequence
  Synthetic
gccaactggactgaagcaaagattctccttgacaacatatacctcccaaacggactggtggcacaaatgtaccag

SEQ ID NO: 330074 - DNA, 75 bp, Artificial Sequence
  Synthetic
aactgaaggggcagtcctgcgaaacggagaagggaggctagatccgtatgcaggggatgtccgaaatgatttgat

SEQ ID NO: 330075 - DNA, 75 bp, Artificial Sequence
  Synthetic
cccgagcgagataaggttttcaccatggatggggagtttcgattgcgtggagaagaaaggaagaactttgttgag

SEQ ID NO: 330076 - DNA, 75 bp, Artificial Sequence
  Synthetic
agctctgtgggatgttccgtcaccaaaggtatacccaaagtgtgaaaccaaaccaggaatttaccgaatcatgac

SEQ ID NO: 330077 - DNA, 75 bp, Artificial Sequence
  Synthetic
ctcgtatggaggtccctggaaactgagtgccacttgggatgggattgaggaagttcaaatgattgcagtagctcc

SEQ ID NO: 330078 - DNA, 75 bp, Artificial Sequence
  Synthetic
ctgatgcgcaacggtgacctcccagtgtggttagcttacaaagtagcctctaatggacacagttaccaagaccgc

SEQ ID NO: 330079 - DNA, 75 bp, Artificial Sequence
  Synthetic
tgtggttagcttacaaagtagcctctaatggacacagttaccaagaccgctcatggtgttttacaggacaaacca

SEQ ID NO: 330080 - DNA, 75 bp, Artificial Sequence
  Synthetic
aggaaaaccagccatcaatgtccagacaacaccaggagtgttcaagacccaattcgggaccatcggagctgtgac

SEQ ID NO: 330081 - DNA, 75 bp, Artificial Sequence
  Synthetic
acaacacaatcctggaagacaacaacgaagttgaagttttcaccaaaactggagacaggaaaattctcaggccaa

SEQ ID NO: 330082 - DNA, 75 bp, Artificial Sequence
  Synthetic
tcttgatttcccaaaaggaacatcaggttccccaatcattaacaagaaaggggaaatcattgggctctatggaaa

SEQ ID NO: 330083 - DNA, 75 bp, Artificial Sequence
  Synthetic
cgactaccaagcgctcaagtcatttaaagagtttgcagcagggaagagatcagcgctgggcatgatggaggtcat

SEQ ID NO: 330084 - DNA, 75 bp, Artificial Sequence
  Synthetic
tggagtattgataggacagggcgaatatgttagtggcatcatccaaggggaaaggacagaagagccaattcctga

SEQ ID NO: 330085 - DNA, 75 bp, Artificial Sequence
  Synthetic
tatgttagtggcatcatccaaggggaaaggacagaagagccaattcctgacgcatacaatgaggaaatgctccgg

SEQ ID NO: 330086 - DNA, 75 bp, Artificial Sequence
  Synthetic
gggtagaatgccaaatcacttctgggaaaagacagttgccgctgcagacacactgtatctcctaggaaccagtga

SEQ ID NO: 330087 - DNA, 75 bp, Artificial Sequence
  Synthetic
aagagaaaactaacagtgctagaactgcacccaggagctggaaagaccagaaaggtgttgcctcaaatcatcaaa

SEQ ID NO: 330088 - DNA, 75 bp, Artificial Sequence
  Synthetic
tgcacccaggagctggaaagaccagaaaggtgttgcctcaaatcatcaaagattgcatccaaaaacgcttgcgaa

SEQ ID NO: 330089 - DNA, 75 bp, Artificial Sequence
  Synthetic
cactgtatctcctaggaaccagtgaggcaaacagtagggcacacaaagaggcactggcagaactgccagattccc

SEQ ID NO: 330090 - DNA, 75 bp, Artificial Sequence
  Synthetic
gattgcatccaaaaacgcttgcgaacagctgtgctagcccccacccgggtagtagcttgtgaaattgctgaagcg

SEQ ID NO: 330091 - DNA, 75 bp, Artificial Sequence
  Synthetic
tggaaacgcttctcctgattggaatgctatgcgtcatgtcaatgggtacgttcatttttctcatgaacaggaaag

SEQ ID NO: 330092 - DNA, 75 bp, Artificial Sequence
  Synthetic
cagctgtgctagcccccacccgggtagtagcttgtgaaattgctgaagcgttgaaaggattgccaatccgctatc

SEQ ID NO: 330093 - DNA, 75 bp, Artificial Sequence
  Synthetic
gagttggtaaaatgggactgggagcatttgtgatgactcttgcaacggcattgctttgggcagcagaagttcccg

SEQ ID NO: 330094 - DNA, 75 bp, Artificial Sequence
  Synthetic
gaacgcagatagctggagttttgttgatagtgtttctattgatgattgtgttgattccagaacctgagaagcaac

SEQ ID NO: 330095 - DNA, 75 bp, Artificial Sequence
  Synthetic
caactaccaagtttacatcatggatgaggcccacttcattgatccagcaagcattgctgctcgtgggtacatttc

SEQ ID NO: 330096 - DNA, 75 bp, Artificial Sequence
  Synthetic
gcattgctgctcgtgggtacatttcaacaagagtagaattgggggaagcagctgccatcttcatgacggcaactc

SEQ ID NO: 330097 - DNA, 75 bp, Artificial Sequence
  Synthetic
aacaagagtagaattgggggaagcagctgccatcttcatgacggcaactccaccaggaacaaatgacccttcccc

SEQ ID NO: 330098 - DNA, 75 bp, Artificial Sequence
  Synthetic
aaatgggccttttggaaaaaaccaagtctgacattgccaagttgtttggcagccaacctggatcggtgggatttg

SEQ ID NO: 330099 - DNA, 75 bp, Artificial Sequence
  Synthetic
agattcaaattctcccatactggatgttgaggcccaggttccggacaaagcgtggagcactgggtatgagtggat

SEQ ID NO: 330100 - DNA, 75 bp, Artificial Sequence
  Synthetic
gtctgacattgccaagttgtttggcagccaacctggatcggtgggatttgcaacaagaacaacaccttgggatat

SEQ ID NO: 330101 - DNA, 75 bp, Artificial Sequence
  Synthetic
cagccttgacatcaaaccagccaccgcatgggcactgtatgcagcagcaacaatggtcatgacacccttgataaa

SEQ ID NO: 330102 - DNA, 75 bp, Artificial Sequence
  Synthetic
gcatctcatcacgacacagtacgtgaatttttcactaacagccattgcatcccaagctggtgtactattaggttt

SEQ ID NO: 330103 - DNA, 75 bp, Artificial Sequence
  Synthetic
gaccaatggaatgccattcactgctatggatctatcggtgccattattggtgctagggtgttggaatcagatgac

SEQ ID NO: 330104 - DNA, 75 bp, Artificial Sequence
  Synthetic
cctgccaagtttggccgttgcagtgatgcttttggctatccactatgcattcatgatcccaggctggcaggctga

SEQ ID NO: 330105 - DNA, 75 bp, Artificial Sequence
  Synthetic
agcaatgagagcagcccagcggagaacagcggctggcattatgaaaaacgctgtggtcgacgggattgtagcaac

SEQ ID NO: 330106 - DNA, 75 bp, Artificial Sequence
  Synthetic
ctgtggtcgacgggattgtagcaaccgacataccagacctgtcaccggcgaccccaatgacagagaagaaaatgg

SEQ ID NO: 330107 - DNA, 75 bp, Artificial Sequence
  Synthetic
accccaatgacagagaagaaaatgggtcaaatcctgctcatcgctgcagcagtgttagctgtgctcgtccggcct

SEQ ID NO: 330108 - DNA, 75 bp, Artificial Sequence
  Synthetic
gggatctgttcgatcaaagaatttggggtcttagggtcagcagcccttgtgacgctaatcgaaggaacggccgga

SEQ ID NO: 330109 - DNA, 75 bp, Artificial Sequence
  Synthetic
gttgtctggaattgcacaacagcggttggcctctgtaacctcatgaggggagggtggttagctggaatgtctatc

SEQ ID NO: 330110 - DNA, 75 bp, Artificial Sequence
  Synthetic
acgtggacagtctacaagaacgtggacaagcccaagggaaagcgtggaggaggaaaaggagccactcttggagag

SEQ ID NO: 330111 - DNA, 75 bp, Artificial Sequence
  Synthetic
acaacacaatcctggaagacaacaacgaagttgaagtctttaccaaaaccggagacaggagaattctcaggccac

SEQ ID NO: 330112 - DNA, 75 bp, Artificial Sequence
  Synthetic
agcccaagggaaagcgtgggggaggaaaaggagccactcttggagagatctggaagtcaagactgaatcagctga

SEQ ID NO: 330113 - DNA, 75 bp, Artificial Sequence
  Synthetic
tgacacgagccgaattcatggcatacaggaaagatggaatcgtggaagtagacagagcccccgccaggaaagcca

SEQ ID NO: 330114 - DNA, 75 bp, Artificial Sequence
  Synthetic
ggtggatggatgcgcgagtctgttgtgactaccaggcgcttaagtcattcaaagagtttgcagcagggaagagat

SEQ ID NO: 330115 - DNA, 75 bp, Artificial Sequence
  Synthetic
ggagagaagggcgtctcacaggtggccacccagtgtccagagggtcagcaaaattaagatggataacagaaagag

SEQ ID NO: 330116 - DNA, 75 bp, Artificial Sequence
  Synthetic
tagcgttgggcatgatggaggtcatgggtaggatgccaaaccacttctgggaaaagacagttgccgccgcggata

SEQ ID NO: 330117 - DNA, 75 bp, Artificial Sequence
  Synthetic
gaaaagacagttgccgccgcggatacactgtatctcttagggaccagtgaggccaacagcagggcacacaaagaa

SEQ ID NO: 330118 - DNA, 75 bp, Artificial Sequence
  Synthetic
gattcgtcaaacccatgggaaaggttgttgacttaggctgtggacgaggagggtggagctactactgcgcaaccc

SEQ ID NO: 330119 - DNA, 75 bp, Artificial Sequence
  Synthetic
tgaagcatgttcaagaagtgaaaggattcacaaagggcggaccaggccatgaagaaccgcagctcatgcaaagct

SEQ ID NO: 330120 - DNA, 75 bp, Artificial Sequence
  Synthetic
gagttggcaaaatggggctgggagcatttgtgatgacccttgccacggcgctgctgtgggcagcagaagtgcctg

SEQ ID NO: 330121 - DNA, 75 bp, Artificial Sequence
  Synthetic
atggatggaatctggtccacatgaaaagtggagtggacgtgttccataagccagctgagccagctgacactgtgc

SEQ ID NO: 330122 - DNA, 75 bp, Artificial Sequence
  Synthetic
aagtggagtggacgtgttccataagccagctgagccagctgacactgtgctctgtgacattggagagtcaaaccc

SEQ ID NO: 330123 - DNA, 75 bp, Artificial Sequence
  Synthetic
ccagctgagccagctgacactgtgctctgtgacattggagagtcaaacccaagctgtgaggtggaggaagcccga

SEQ ID NO: 330124 - DNA, 75 bp, Artificial Sequence
  Synthetic
acagcaagagtgttggacatggttgaggaatggttgaagaaaggagccactgagttctgcataaaagtcctgtgt

SEQ ID NO: 330125 - DNA, 75 bp, Artificial Sequence
  Synthetic
gtccgacattgccaaattgtttggaagccaacccgggtcaatgggatttgcagtaagaacaacaccttgggacat

SEQ ID NO: 330126 - DNA, 75 bp, Artificial Sequence
  Synthetic
tggaggaggcctggtcagagtccccttgtctagaaactcgacacatgagatgtactgggttagtggggcggctgg

SEQ ID NO: 330127 - DNA, 75 bp, Artificial Sequence
  Synthetic
ttgtctagaaactcgacacatgagatgtactgggttagtggggcggctggaaacatcatacacgccgtcagcatg

SEQ ID NO: 330128 - DNA, 75 bp, Artificial Sequence
  Synthetic
caatggtcatgacacctttgataaagcatctcatcacgacgcagtatgtgaacttttcactaacagccatcgcag

SEQ ID NO: 330129 - DNA, 75 bp, Artificial Sequence
  Synthetic
aacttttcactaacagccatcgcagcccaagctggtgtgctgttaggcctgaccaatgggatgccattcactgcc

SEQ ID NO: 330130 - DNA, 75 bp, Artificial Sequence
  Synthetic
gaaagttggggaaaggatacggagattgagggaagaataccaacaaacgtggacgtatgaccacaacaacccata

SEQ ID NO: 330131 - DNA, 75 bp, Artificial Sequence
  Synthetic
atggatctgtctgtgccactactggtgctagggtgctggaatcaaatgaccctgccgagcttggctgtcgcagtc

SEQ ID NO: 330132 - DNA, 75 bp, Artificial Sequence
  Synthetic
ggacgtatgaccacaacaacccatatagaacgtggaactatcatggaagttatgaagtgaaaccaacaggatcag

SEQ ID NO: 330133 - DNA, 75 bp, Artificial Sequence
  Synthetic
ggacgtatgaccacaacaacccatatagaacgtggaactatcatggaagttatgaagtgaaaccaactggatcag

SEQ ID NO: 330134 - DNA, 75 bp, Artificial Sequence
  Synthetic
ggacgtatgaccacaacaacccatatagaacgtggaactatcatggaagttatgaagtgaaaccaaccggatcag

SEQ ID NO: 330135 - DNA, 75 bp, Artificial Sequence
  Synthetic
ggacgtatgaccacaacaacccatatagaacgtggaactatcatggaagttatgaagtgaaaccaacgggatcag

SEQ ID NO: 330136 - DNA, 75 bp, Artificial Sequence
  Synthetic
tagaacgtggaactatcatggaagttatgaagtgaaaccaacaggatcagctagctcgatggtgaacggagtcgt

SEQ ID NO: 330137 - DNA, 75 bp, Artificial Sequence
  Synthetic
tagaacgtggaactatcatggaagttatgaagtgaaaccaactggatcagctagctcgatggtgaacggagtcgt

SEQ ID NO: 330138 - DNA, 75 bp, Artificial Sequence
  Synthetic
tagaacgtggaactatcatggaagttatgaagtgaaaccaaccggatcagctagctcgatggtgaacggagtcgt

SEQ ID NO: 330139 - DNA, 75 bp, Artificial Sequence
  Synthetic
tagaacgtggaactatcatggaagttatgaagtgaaaccaacgggatcagctagctcgatggtgaacggagtcgt

SEQ ID NO: 330140 - DNA, 75 bp, Artificial Sequence
  Synthetic
atgcttttgaccattcattatgcattcatggtcccaggctggcaggctgaagcgatgagggcagcccagcggaga

SEQ ID NO: 330141 - DNA, 75 bp, Artificial Sequence
  Synthetic
tatgaagtgaaaccaacaggatcagctagctcgatggtgaacggagtcgtgaggctcctttcaaaaccatgggat

SEQ ID NO: 330142 - DNA, 75 bp, Artificial Sequence
  Synthetic
tatgaagtgaaaccaactggatcagctagctcgatggtgaacggagtcgtgaggctcctttcaaaaccatgggat

SEQ ID NO: 330143 - DNA, 75 bp, Artificial Sequence
  Synthetic
tatgaagtgaaaccaaccggatcagctagctcgatggtgaacggagtcgtgaggctcctttcaaaaccatgggat

SEQ ID NO: 330144 - DNA, 75 bp, Artificial Sequence
  Synthetic
tatgaagtgaaaccaacgggatcagctagctcgatggtgaacggagtcgtgaggctcctttcaaaaccatgggat

SEQ ID NO: 330145 - DNA, 75 bp, Artificial Sequence
  Synthetic
gaggctcctttcaaaaccatgggatatgatcacaaacgtgaccactatggccatgactgacaccacgccctttgg

SEQ ID NO: 330146 - DNA, 75 bp, Artificial Sequence
  Synthetic
acagcggctggcatcatgaagaatgccgtggttgacgggattgtggcaactgacattccagacctatcaccagcg

SEQ ID NO: 330147 - DNA, 75 bp, Artificial Sequence
  Synthetic
ccatgactgacaccacgccctttggtcaacaaagggtgttcaaagaaaaggttgacacaaaggctcccgaaccac

SEQ ID NO: 330148 - DNA, 75 bp, Artificial Sequence
  Synthetic
accccaatgacagagaagaaaatgggccaaatcctgctcatcgccgcagcggtgctagctgtgcttgtccggcca

SEQ ID NO: 330149 - DNA, 75 bp, Artificial Sequence
  Synthetic
gccaaatcctgctcatcgccgcagcggtgctagctgtgcttgtccggccagggatctgctcgatcaaagaatttg

SEQ ID NO: 330150 - DNA, 75 bp, Artificial Sequence
  Synthetic
tcaacaaagggtgttcaaagaaaaggttgacacaaaggctcccgaaccaccactaggagtcgcccaaatcatgga

SEQ ID NO: 330151 - DNA, 75 bp, Artificial Sequence
  Synthetic
agcaaaggtgaacagccatgcagctctgggagccatgtttgaagagcaaaatcagtggagtagcgcccgtgaagc

SEQ ID NO: 330152 - DNA, 75 bp, Artificial Sequence
  Synthetic
tgtggaagatccaaagttctgggaaatggttgatgaagaaagagaagctcatcttaaaggagagtgtcacacatg

SEQ ID NO: 330153 - DNA, 75 bp, Artificial Sequence
  Synthetic
acaaacctaaaggaaagcgtgggggaggaaagggagccactctcggagagatctggaagtcaagactgaatcagc

SEQ ID NO: 330154 - DNA, 75 bp, Artificial Sequence
  Synthetic
atcttaaaggagagtgtcacacatgcatctacaacatgatggggaagcgtgagaaaaagactggagagtttggga

SEQ ID NO: 330155 - DNA, 75 bp, Artificial Sequence
  Synthetic
ggagagaagggcgtctcacaggtggtcacccagtgtctagagggtcagcaaaattaagatggataactgaaagag

SEQ ID NO: 330156 - DNA, 75 bp, Artificial Sequence
  Synthetic
taaatgaagaccactggatgagccgcgagaactcctatggaggagttgaggggaaaggactccagaaacttggat

SEQ ID NO: 330157 - DNA, 75 bp, Artificial Sequence
  Synthetic
gattcgtcaaacccatggggaaagttgttgacctaggctgtggacgaggagggtggagctactactgtgcaactc

SEQ ID NO: 330158 - DNA, 75 bp, Artificial Sequence
  Synthetic
gacacagccggctgggacacccggatcacaaaagaagacttgaaaaatgaagcaaaaataacaaagagaatggaa

SEQ ID NO: 330159 - DNA, 75 bp, Artificial Sequence
  Synthetic
attcacaaagggtggaccaggccatgaagaaccgcaactcatgcagagctatggatggaacttggtttacatgaa

SEQ ID NO: 330160 - DNA, 75 bp, Artificial Sequence
  Synthetic
agcaaaaataacaaagagaatggaagaaaggcatagaaagcttgcggaggcgatcattgatctaacctaccgcca

SEQ ID NO: 330161 - DNA, 75 bp, Artificial Sequence
  Synthetic
taaggtggtgaaagtcatgagaccagggcctgatggtaaaacctacatggatgtcatctccagagaagaccaaag

SEQ ID NO: 330162 - DNA, 75 bp, Artificial Sequence
  Synthetic
gggcagtggacaggtggtcacatatgccctgaacaccttcaccaacctggccgttcaactgataagatgcatgga

SEQ ID NO: 330163 - DNA, 75 bp, Artificial Sequence
  Synthetic
ggctgaaggggtggtagatgaggatgacattacgagagtgagacttggacggttggccaaagcggtcgagtggct

SEQ ID NO: 330164 - DNA, 75 bp, Artificial Sequence
  Synthetic
ccatacatgcccaagatcattgagaaactggaaaaactgcagcggaagtatggaggtggcctggtcagagtcccc

SEQ ID NO: 330165 - DNA, 75 bp, Artificial Sequence
  Synthetic
gacattacgagagtgagacttggacggttggccaaagcggtcgagtggctgaggaagaatggacctgaacgattg

SEQ ID NO: 330166 - DNA, 75 bp, Artificial Sequence
  Synthetic
agcagaatggcagtgagtggggacgactgtgttgtgaaaccaattgatgacagatttgccactgcactccacttt

SEQ ID NO: 330167 - DNA, 75 bp, Artificial Sequence
  Synthetic
aaacatcatacatgccgtcagcatgactagccaagtgctcatggggaggatggataaacagaacaggagtgggcc

SEQ ID NO: 330168 - DNA, 75 bp, Artificial Sequence
  Synthetic
ctcaacaacatgtcaaagatcagaaaggacattcaggagtggaaaccttcaacaggctggcacaactggcaagag

SEQ ID NO: 330169 - DNA, 75 bp, Artificial Sequence
  Synthetic
tggataaacagaacaggagtgggccacgatatgaggaagacgtgaatctaggaagtggaactcgctccgttggaa

SEQ ID NO: 330170 - DNA, 75 bp, Artificial Sequence
  Synthetic
aacaggctggcacaactggcaagaggtgcccttctgctcacaccacttcaatgaactaatgctgaaggatgggcg

SEQ ID NO: 330171 - DNA, 75 bp, Artificial Sequence
  Synthetic
gaccatcgtggtgccatgtaggagccaggatgagctgattggcagagccagaatctcaccaggagcaggatggaa

SEQ ID NO: 330172 - DNA, 75 bp, Artificial Sequence
  Synthetic
gaatctcaccaggagcaggatggaatgtgaaagagacagcctgcttgagcaaatcctatgctcagatgtggttgc

SEQ ID NO: 330173 - DNA, 75 bp, Artificial Sequence
  Synthetic
ttatgtacttccacaggcgggacctcagaatgatggcaaatgccatttgttcagctgtcccagtcaactgggtcc

SEQ ID NO: 330174 - DNA, 75 bp, Artificial Sequence
  Synthetic
cagaatgatggcaaatgccatttgttcagctgtcccagtcaactgggtcccaactggacgtaccacatggtcaat

SEQ ID NO: 330175 - DNA, 75 bp, Artificial Sequence
  Synthetic
caatgactgacaccacgccttttggtcaacaaagggtcttcaaagaaaaggttgacacaaaagctcccgaaccgc

SEQ ID NO: 330176 - DNA, 75 bp, Artificial Sequence
  Synthetic
caactggacgtaccacatggtcaattcatgggaagggcgaatggatgacaacagaagacatgttgagtgtctgga

SEQ ID NO: 330177 - DNA, 75 bp, Artificial Sequence
  Synthetic
cattaggagtcgcgcaaatcatggatgtgacgactgactggctgtgggacttcgttgctcgggaaaagaagccaa

SEQ ID NO: 330178 - DNA, 75 bp, Artificial Sequence
  Synthetic
tgtgacgactgactggctgtgggacttcgttgctcgggaaaagaagccaagaatctgtaccccagaagaattcaa

SEQ ID NO: 330179 - DNA, 75 bp, Artificial Sequence
  Synthetic
accgtgtgtggattgaagagaatgaatacatgaaagacaaaacaccattggcggcttggaacgacattccatacc

SEQ ID NO: 330180 - DNA, 75 bp, Artificial Sequence
  Synthetic
gcggcttggaacgacattccatacctaggaaagagagaggacatctggtgtggaagccttatcggaacaaggacc

SEQ ID NO: 330181 - DNA, 75 bp, Artificial Sequence
  Synthetic
taggaaagagagaggacatctggtgtggaagccttatcggaacaaggaccagagccacctgggctgagaacatct

SEQ ID NO: 330182 - DNA, 75 bp, Artificial Sequence
  Synthetic
tggaagccttatcggaacaaggaccagagccacctgggctgagaacatctacgctccaatcatgcagatccgcaa

SEQ ID NO: 330183 - DNA, 75 bp, Artificial Sequence
  Synthetic
agagccacctgggctgagaacatctacgctccaatcatgcagatccgcaacctcatcggggaagaggagtacaga

SEQ ID NO: 330184 - DNA, 75 bp, Artificial Sequence
  Synthetic
acgctccaatcatgcagatccgcaacctcatcggggaagaggagtacagagactacatggttgcccaaaacagat

SEQ ID NO: 330185 - DNA, 75 bp, Artificial Sequence
  Synthetic
cctcatcggggaagaggagtacagagactacatggttgcccaaaacagatttggtagggaagaaactcatgtggt

SEQ ID NO: 330186 - DNA, 75 bp, Artificial Sequence
  Synthetic
atctcaaaggagagtgtcacacatgcatctacaacatgatgggaaagcgcgagaagaagatgggagaatttggga

SEQ ID NO: 330187 - DNA, 75 bp, Artificial Sequence
  Synthetic
ttggtagggaagaaactcatgtggtaggaggagtgctgtagattgaaatgtaaatagtgtaaataaataaaaaca

SEQ ID NO: 330188 - DNA, 75 bp, Artificial Sequence
  Synthetic
aggctaaaggaagcagggctatctggtacatgtggctaggagctcggtttttggagtttgaggccctcgggtttc

SEQ ID NO: 330189 - DNA, 75 bp, Artificial Sequence
  Synthetic
ggtaagtcaggccaatcagttttgccaccggatgtcaggtaaacggtgctgtctgtaacctggccccaggcgact

SEQ ID NO: 330190 - DNA, 75 bp, Artificial Sequence
  Synthetic
gtacatgtggctaggagctcggtttttggagtttgaggccctcgggtttctaaatgaagatcactggatgaaccg

SEQ ID NO: 330191 - DNA, 75 bp, Artificial Sequence
  Synthetic
gtctgtaacctggccccaggcgactgggttatcaaagccaacccggctgggtgcaaagcccctcattccgactcg

SEQ ID NO: 330192 - DNA, 75 bp, Artificial Sequence
  Synthetic
ggagggtccctggcacgtaggctggagaggacgcacaagtcagaccagaaatgccacctgaaagcatgctaaagg

SEQ ID NO: 330193 - DNA, 75 bp, Artificial Sequence
  Synthetic
tcacaaaagaagacttgaaaaatgaagcaaaaataacaaaaagaatggatgaaaggcacagaaagcttgcagagg

SEQ ID NO: 330194 - DNA, 75 bp, Artificial Sequence
  Synthetic
ccagcggcccaaaccatggagtgcgtgaccatggcgtaaggactagaggttagaggagaccccgctgtaacttgg

SEQ ID NO: 330195 - DNA, 75 bp, Artificial Sequence
  Synthetic
caaggtggtgaaagtcatgagaccagggcctgatgggaaaacttacatggatgtcatttctagagaagaccaaag

SEQ ID NO: 330196 - DNA, 75 bp, Artificial Sequence
  Synthetic
gggcctgatgggaaaacttacatggatgtcatttctagagaagaccaaaggggcagtggacaggtggttacatat

SEQ ID NO: 330197 - DNA, 75 bp, Artificial Sequence
  Synthetic
gccctgaacaccttcaccaatctggctgtgcaactgataagatgcatggaagctgaaggggtggtagatgaggat

SEQ ID NO: 330198 - DNA, 75 bp, Artificial Sequence
  Synthetic
agaggaaacagatttcttttttggaggataacaacttaacttgactgcgaacagttttttagcagggaaacaccc

SEQ ID NO: 330199 - DNA, 75 bp, Artificial Sequence
  Synthetic
aatgtctaaaaaaccaggaaaacccggtagaaaccgggttgttaatatgctaaaacgcggtgtatcccgcgtgaa

SEQ ID NO: 330200 - DNA, 75 bp, Artificial Sequence
  Synthetic
tcccttaacggggttaaagaggatacttggaagtctgctagatggccgtggacccgtgcggttcatactggccat

SEQ ID NO: 330201 - DNA, 75 bp, Artificial Sequence
  Synthetic
aaccatcgtggtgccatgcaggagtcaggatgaactgattggcagagccaggatttcaccaggagcaggatggaa

SEQ ID NO: 330202 - DNA, 75 bp, Artificial Sequence
  Synthetic
ttcaaacgtgatctcggatccatgctagacaccatcaatcggcggcccagcaagaagagaggagggaccggatcg

SEQ ID NO: 330203 - DNA, 75 bp, Artificial Sequence
  Synthetic
tagacaccatcaatcggcggcccagcaagaagagaggagggaccggatcgttgctcggactggcagcactaattg

SEQ ID NO: 330204 - DNA, 75 bp, Artificial Sequence
  Synthetic
caagaagagaggagggaccggatcgttgctcggactggcagcactaattggactggcgggctcattgcaactttc

SEQ ID NO: 330205 - DNA, 75 bp, Artificial Sequence
  Synthetic
aaatcctatgctcagatgtggttgctcatgtatttccacagacgggatcttaggatgatggcaaacgctatctgt

SEQ ID NO: 330206 - DNA, 75 bp, Artificial Sequence
  Synthetic
gactggcgggctcattgcaactttcaacctaccagggaaaagtgctgatgtcaataaacaagactgacgcccaaa

SEQ ID NO: 330207 - DNA, 75 bp, Artificial Sequence
  Synthetic
cggagcaaacacctgcattgtgagagctctagatgtgggagtcatgtgcaaagatgacatcacatacctgtgccc

SEQ ID NO: 330208 - DNA, 75 bp, Artificial Sequence
  Synthetic
accgtgtgtggattgaagagaatgaatacatgaaggacaaaacaccattggcggcttggaacgacattccatacc

SEQ ID NO: 330209 - DNA, 75 bp, Artificial Sequence
  Synthetic
agtgctttcagcgggaaacgatcctgaggacattgattgttggtgtgatgttgaagaagtgtgggtgcactatgg

SEQ ID NO: 330210 - DNA, 75 bp, Artificial Sequence
  Synthetic
agagccacctgggctgagaacatctatgctccaatcatgcagatccgcaaccttattggggaagaagagtacaga

SEQ ID NO: 330211 - DNA, 75 bp, Artificial Sequence
  Synthetic
tgcagcatcatggagactccacactggcaacaaagaacacaccatggctggacaccgtgaaaaccaccaagtact

SEQ ID NO: 330212 - DNA, 75 bp, Artificial Sequence
  Synthetic
gcagcaacaacacacagagagtggtctttgtgatcatgctgatgttgatagccccggcatacagcttcaattgtt

SEQ ID NO: 330213 - DNA, 75 bp, Artificial Sequence
  Synthetic
tgggaacatcaaacagggatttcgtcgaaggggccagcggggcaacatggatcgacttggtacttgaaggaggaa

SEQ ID NO: 330214 - DNA, 75 bp, Artificial Sequence
  Synthetic
cgaaggggccagcggggcaacatggatcgacttggtacttgaaggaggaagctgtgtcacagtgatggcaccgga

SEQ ID NO: 330215 - DNA, 75 bp, Artificial Sequence
  Synthetic
gaaaccaacattggacttcaaagtaatgaagatggaggccacggagttagctactgtgcgtgagtattgctacga

SEQ ID NO: 330216 - DNA, 75 bp, Artificial Sequence
  Synthetic
ctactgtgcgtgagtattgctacgaagcaaccttggacacgctgtcaacagtggcaagatgtcccacaacaggag

SEQ ID NO: 330217 - DNA, 75 bp, Artificial Sequence
  Synthetic
agaggagaccccgctgcaacttggcaaggcccaaacccgctcgaagctgtagagacgggggaaggactagaggtt

SEQ ID NO: 330218 - DNA, 75 bp, Artificial Sequence
  Synthetic
aaggcccaaacccgctcgaagctgtagagacgggggaaggactagaggttagaggagaccccttgccgttaacgc

SEQ ID NO: 330219 - DNA, 75 bp, Artificial Sequence
  Synthetic
aagcccacaacaccaagaggagtgacccaacatttgtctgcaaaagagatgttgtggaccgtggatggggcaacg

SEQ ID NO: 330220 - DNA, 75 bp, Artificial Sequence
  Synthetic
gatgtggtctgtttggaaaaggaagcattgacacatgcgcgaagttcacatgcaagaacaaggcaacagggaaga

SEQ ID NO: 330221 - DNA, 75 bp, Artificial Sequence
  Synthetic
agatgttcgtgtcggtgagcggagaggaaacagatttcttttttggaggataacaacttaacttgattgcgaaca

SEQ ID NO: 330222 - DNA, 75 bp, Artificial Sequence
  Synthetic
cgaggtcgcaatttttgtgcatggttcaacggactccacgacacatggtaattactctgagcaaattgggaaaaa

SEQ ID NO: 330223 - DNA, 75 bp, Artificial Sequence
  Synthetic
cagccaactgaggcgctgaagcgcagatggagggctgtagataaaagaacggcattgaaacacttaaacggattc

SEQ ID NO: 330224 - DNA, 75 bp, Artificial Sequence
  Synthetic
ccaagcagctagatttaccataagcccgcaagcaccatcttttacggctaacatgggcgagtatggaacagtcac

SEQ ID NO: 330225 - DNA, 75 bp, Artificial Sequence
  Synthetic
cattgactgtgaagcaagatcaggaatcaacacagaagactactatgtctttacagtcaaggagaagtcatggct

SEQ ID NO: 330226 - DNA, 75 bp, Artificial Sequence
  Synthetic
cttggattggctgcgttaattggactggcgagttcactgcaattgtcaacctaccaggggaaagtgttaatgtca

SEQ ID NO: 330227 - DNA, 75 bp, Artificial Sequence
  Synthetic
agtaaatagggattggtttcacgatctgaaccttccatggacgagccctgccacaactgactggcgcaacagaga

SEQ ID NO: 330228 - DNA, 75 bp, Artificial Sequence
  Synthetic
aacattggtggaatttgaagaaccacatgccaccaagcaaactgtggttgccctaggctcgcaagaaggagccct

SEQ ID NO: 330229 - DNA, 75 bp, Artificial Sequence
  Synthetic
ccctaggctcgcaagaaggagccctgcacacagcactggctggagccattccagccactgttagcagctccacct

SEQ ID NO: 330230 - DNA, 75 bp, Artificial Sequence
  Synthetic
gtgcagagccaagcttgacaaggtcaaaatcaaaggaacaacatatggcatgtgtgactctgcgtttaccttcag

SEQ ID NO: 330231 - DNA, 75 bp, Artificial Sequence
  Synthetic
tgtgtgactctgcgtttaccttcagcaagaacccagctgacacagggcatgggacagtgatcgtggaactgcaat

SEQ ID NO: 330232 - DNA, 75 bp, Artificial Sequence
  Synthetic
acactggaagcaacggaccctgccgggttcccatttccgtgacagcaaacctcatggacttgacaccggttggaa

SEQ ID NO: 330233 - DNA, 75 bp, Artificial Sequence
  Synthetic
ggttcccatttccgtgacagcaaacctcatggacttgacaccggttggaagattggttacggtcaatccctttat

SEQ ID NO: 330234 - DNA, 75 bp, Artificial Sequence
  Synthetic
aagcacagggggagcgaacaacaaggtcatgattgaagttgaaccacccttcggtgactcttacatcgttgtcgg

SEQ ID NO: 330235 - DNA, 75 bp, Artificial Sequence
  Synthetic
gcaagatgccccacaactggagaagctcacaacaccaaaaggagtgacccaacatttgtctgcaaaagagatgtt

SEQ ID NO: 330236 - DNA, 75 bp, Artificial Sequence
  Synthetic
aagaggcaccacccaaatcaactaccactggcacaaagagggaagcagcatcggaaaggctttggcgactacatg

SEQ ID NO: 330237 - DNA, 75 bp, Artificial Sequence
  Synthetic
gtggaccgtggatggggtaacggatgtggtttgtttggaaaaggaagcattgatacgtgcgcaaagttcacatgc

SEQ ID NO: 330238 - DNA, 75 bp, Artificial Sequence
  Synthetic
gaaaggagcacaacggctagccgtcttgggggacacagcgtgggacttcggatccattggaggagtcttcaattc

SEQ ID NO: 330239 - DNA, 75 bp, Artificial Sequence
  Synthetic
ttgggggacacagcgtgggacttcggatccattggaggagtcttcaattcaatcggcaaagctgtccaccaagtt

SEQ ID NO: 330240 - DNA, 75 bp, Artificial Sequence
  Synthetic
aatcggcaaagctgtccaccaagtttttggaggggcattcaggactctgtttggaggaatgtcctggatcacaca

SEQ ID NO: 330241 - DNA, 75 bp, Artificial Sequence
  Synthetic
gggattacttggagctcttctcttgtggatggggttgcaggcccgtgacaggagcatctcgctgactctactggc

SEQ ID NO: 330242 - DNA, 75 bp, Artificial Sequence
  Synthetic
tggatggggttgcaggcccgtgacaggagcatctcgctgactctactggctgttggaggggttttaatctttcta

SEQ ID NO: 330243 - DNA, 75 bp, Artificial Sequence
  Synthetic
cagttaaggagaagtcatggctagtaaacagggactggtttcacgacttgaaccttccatggacgagtcctgcca

SEQ ID NO: 330244 - DNA, 75 bp, Artificial Sequence
  Synthetic
gcgaccagcgtgcaagctgattcgggatgtgcaattgacttacaacgacgtgaattgaaatgtggaggaggcatc

SEQ ID NO: 330245 - DNA, 75 bp, Artificial Sequence
  Synthetic
gatgtgcaattgacttacaacgacgtgaattgaaatgtggaggaggcatctttgtgtacaatgacgtcgagaagt

SEQ ID NO: 330246 - DNA, 75 bp, Artificial Sequence
  Synthetic
tttgtgtacaatgacgtcgagaagtggaaaagtgactacaagtattttcccttgactccaactggactcgcgcgc

SEQ ID NO: 330247 - DNA, 75 bp, Artificial Sequence
  Synthetic
gtgattcaagaggcgcacgccaacggcatctgtggcatcagatcgacgtcacgcttggagcacttgatgtgggag

SEQ ID NO: 330248 - DNA, 75 bp, Artificial Sequence
  Synthetic
gcatctgtggcatcagatcgacgtcacgcttggagcacttgatgtgggagaacatacagagagagctgaatgcaa

SEQ ID NO: 330249 - DNA, 75 bp, Artificial Sequence
  Synthetic
acgcttggagcacttgatgtgggagaacatacagagagagctgaatgcaatctttgaagacaatgaaattgactt

SEQ ID NO: 330250 - DNA, 75 bp, Artificial Sequence
  Synthetic
gtcagttgtggtgcaggaagatcccaaatactacaaaagagctccccaacgcttgaagaaactggaggatgagct

SEQ ID NO: 330251 - DNA, 75 bp, Artificial Sequence
  Synthetic
ggactacggatggaagaaatgggggaaaaccctgttcatggaaccaaaactaggaaacaacacatttgttgttga

SEQ ID NO: 330252 - DNA, 75 bp, Artificial Sequence
  Synthetic
cggaccagagaccaaggaatgtccaacagcaaatagagcatggaacagtttcaaggtggaagactttggttttgg

SEQ ID NO: 330253 - DNA, 75 bp, Artificial Sequence
  Synthetic
acagcaaatagagcatggaacagtttcaaggtggaagactttggttttggcatggtgttcactagattgtggctc

SEQ ID NO: 330254 - DNA, 75 bp, Artificial Sequence
  Synthetic
acaatccgggaggaaaacacaacggaatgcgattcggcaatcattggcacagccataaaaggagacagagctgtt

SEQ ID NO: 330255 - DNA, 75 bp, Artificial Sequence
  Synthetic
aatgcgattcggcaatcattggcacagccataaaaggagacagagctgttcacagtgacctatcgtattggattg

SEQ ID NO: 330256 - DNA, 75 bp, Artificial Sequence
  Synthetic
cacagtgacctatcgtattggattgagagcaagaagaatggaacatggcagctagaacgagctgttatgggagaa

SEQ ID NO: 330257 - DNA, 75 bp, Artificial Sequence
  Synthetic
gtgaaatcttgcacctggccagaaacgcacactctatggggtgatggcgttgttgagagtgaaatgatcattccg

SEQ ID NO: 330258 - DNA, 75 bp, Artificial Sequence
  Synthetic
gtaacattaggaggccctaaaagccatcacaacaagagaactggataccacacacagacaaaaggaccctggagt

SEQ ID NO: 330259 - DNA, 75 bp, Artificial Sequence
  Synthetic
gaaggagaaataaccctagactttgattattgcccaggaacaacagtgactgtcactgaacattgtggaaacagg

SEQ ID NO: 330260 - DNA, 75 bp, Artificial Sequence
  Synthetic
acccgaaaccaaggaatgtccaacagcaaacagagcatggaacagtttcaaggtggaagactttggatttggcat

SEQ ID NO: 330261 - DNA, 75 bp, Artificial Sequence
  Synthetic
tgtcactgaacattgtggaaacaggggagcatcactgcgcacaaccacagcgagcggcaagctggtcactgattg

SEQ ID NO: 330262 - DNA, 75 bp, Artificial Sequence
  Synthetic
ccactgcgatacaccacaaaagatggatgctggtacggaatggaaattcggccagtgaaggaggaagaagcaaaa

SEQ ID NO: 330263 - DNA, 75 bp, Artificial Sequence
  Synthetic
acaccctatggggtgatggcgttattgaaagcgaaatgatcatcccggtgacactaggcggccctaaaagccatc

SEQ ID NO: 330264 - DNA, 75 bp, Artificial Sequence
  Synthetic
atagccacccaagaagtgctgaaacgcagatggactgggaagctgaccctgacctcattggcggtatgtttggct

SEQ ID NO: 330265 - DNA, 75 bp, Artificial Sequence
  Synthetic
attgcccaggaacaacagttactgtcacagaacattgtggaaacaggggagcgtcactgcgcacaactacagcga

SEQ ID NO: 330266 - DNA, 75 bp, Artificial Sequence
  Synthetic
ctattaatttttggaaacctaacatacatggatctggtgcggtacctggtccttgttggaactgcttttgcggaa

SEQ ID NO: 330267 - DNA, 75 bp, Artificial Sequence
  Synthetic
atgaacactggaggcgatgtgatccatctggcgcttgttgctgtcttcaaagtgcaaccagcattcttggcgggt

SEQ ID NO: 330268 - DNA, 75 bp, Artificial Sequence
  Synthetic
agtgcaaccagcattcttggcgggtttgttcttgagaatgcagtggagtaatcaagaaaacatcttgatggttat

SEQ ID NO: 330269 - DNA, 75 bp, Artificial Sequence
  Synthetic
gatggactgggaagttgaccctgacctcactagcagtgtgtttggcactactgatttttggaaatctgacataca

SEQ ID NO: 330270 - DNA, 75 bp, Artificial Sequence
  Synthetic
tggagcagccttccttcaaatggcagccaacgacctgaagcttgaggtccttccaattctcaatgctatgtccat

SEQ ID NO: 330271 - DNA, 75 bp, Artificial Sequence
  Synthetic
aacactggaggtgatgtggtccacttggcacttgttgctgtcttcaaagtgcaaccagcattcttagcgggtcta

SEQ ID NO: 330272 - DNA, 75 bp, Artificial Sequence
  Synthetic
tgcatggatgctaataagggcaatgaaagaaggtaaagtggcgatgtacgctcttcccatcttgtgtgctttgac

SEQ ID NO: 330273 - DNA, 75 bp, Artificial Sequence
  Synthetic
tccaggaatgagaatggctgggcttgacgtcatcagatgcctgctgctgataattgggattgtgacacttctgaa

SEQ ID NO: 330274 - DNA, 75 bp, Artificial Sequence
  Synthetic
gacgtcatcagatgcctgctgctgataattgggattgtgacacttctgaatgaaagaagagaaagcgtggccaag

SEQ ID NO: 330275 - DNA, 75 bp, Artificial Sequence
  Synthetic
aaaggtggctacctgcttgcagcagctctctgccaggctggattgtgcagtcccttgatcatgatgggaggtttg

SEQ ID NO: 330276 - DNA, 75 bp, Artificial Sequence
  Synthetic
cagtcccttgatcatgatgggaggtctgattctggctcaccctaatgggaaaaggagttggccagcgagtgaagt

SEQ ID NO: 330277 - DNA, 75 bp, Artificial Sequence
  Synthetic
gaccggagtcggattgatgtgcgctctggcagggggccttctcgagtttgaggagacctcaatggtggttccctt

SEQ ID NO: 330278 - DNA, 75 bp, Artificial Sequence
  Synthetic
cttgaccggagtcggactgatgtgcgctctagcaggaggccttctcgagtttgaggaaacctcaatggtggtccc

SEQ ID NO: 330279 - DNA, 75 bp, Artificial Sequence
  Synthetic
ctttgcaatagctgggttgatgtacatcacatacaccgtctcgggaaaggccgcagaaatgtggattgagaaagc

SEQ ID NO: 330280 - DNA, 75 bp, Artificial Sequence
  Synthetic
ccgcagaaatgtggattgagaaagcagctgacatcacatgggaacagaatgctgagattaccggaaccagtccca

SEQ ID NO: 330281 - DNA, 75 bp, Artificial Sequence
  Synthetic
aaagtatatccaaaatgtgagacaaaaccaggaatctatcgaatcatgaccaggggaatcctgggcacctttcaa

SEQ ID NO: 330282 - DNA, 75 bp, Artificial Sequence
  Synthetic
ggcttgatgttgacctcgactcacatggcaacttcaagcttctgaatgaccctggagctccagtgcacttgtttg

SEQ ID NO: 330283 - DNA, 75 bp, Artificial Sequence
  Synthetic
tggcaacttcaagcttctgaatgaccctggagctccagtgcacttgtttgcactgagattcatactcttgggctt

SEQ ID NO: 330284 - DNA, 75 bp, Artificial Sequence
  Synthetic
gagtttttcacacaatgtggcacgcaactgaaggagcagtcctgcgaaacggagaagggagactagatccgtatg

SEQ ID NO: 330285 - DNA, 75 bp, Artificial Sequence
  Synthetic
gagtgcacggttccattggtttattccatttggagtgttggggttttggttgcttggaaaacactcgaagcgggg

SEQ ID NO: 330286 - DNA, 75 bp, Artificial Sequence
  Synthetic
aggagcattgtgggacgtgccatcacccaaagtttatccaaaatgtgagacaaaaccaggaatttaccggatcat

SEQ ID NO: 330287 - DNA, 75 bp, Artificial Sequence
  Synthetic
agtgccacttgggatgggattgaggaggtccaaatgatagcagtagctccgggaaaaccagccatcaatgtccag

SEQ ID NO: 330288 - DNA, 75 bp, Artificial Sequence
  Synthetic
aggtccaaatgatagcagtagctccgggaaaaccagccatcaatgtccagacaacaccaggagtgttcaagaccc

SEQ ID NO: 330289 - DNA, 75 bp, Artificial Sequence
  Synthetic
caaaaccaggaatttaccggatcatgaccagaggaatcctgggtacgtttcaagctggagttggtgtgatgcatg

SEQ ID NO: 330290 - DNA, 75 bp, Artificial Sequence
  Synthetic
cgcgactgaaggggcagtcctgcgaaacggggaagggaggctagatccgtatgcaggagatgtccgaaatgatct

SEQ ID NO: 330291 - DNA, 75 bp, Artificial Sequence
  Synthetic
gatctcgtatggaggtccctggaaactgagtgccacttgggatgggattgaggaagtccaaatgattgcagtagc

SEQ ID NO: 330292 - DNA, 75 bp, Artificial Sequence
  Synthetic
cccaggaaaaccagctatcaatgtccagacaactccaggggtgttcaagaccccattcggaaccatcggagctgt

SEQ ID NO: 330293 - DNA, 75 bp, Artificial Sequence
  Synthetic
gattgcattcaaaaacgcctgcgaacagctgtgctagcccccacccgggtagtggcttgtgaaattgctgaagcg

SEQ ID NO: 330294 - DNA, 75 bp, Artificial Sequence
  Synthetic
gactcttgatttcccaaaaggaacatcaggttccccaatcattaacaagaaaggggaaatcattggactctatgg

SEQ ID NO: 330295 - DNA, 75 bp, Artificial Sequence
  Synthetic
aaatggggtattgataggacagggcgaatatgttagtggcatcatccaaggggaaaggacagaagaaccaattcc

SEQ ID NO: 330296 - DNA, 75 bp, Artificial Sequence
  Synthetic
caactaccaagtgtacatcatggatgaagcccactttattgatccagcaagcattgctgcacgtgggtacatctc

SEQ ID NO: 330297 - DNA, 75 bp, Artificial Sequence
  Synthetic
tgatgcatacaatgaggaaatgctccggaagagaaaactaacagtgctagaattgcacccaggagctggaaagac

SEQ ID NO: 330298 - DNA, 75 bp, Artificial Sequence
  Synthetic
gaacagctgtgctagcccccacccgggtagtagcctgtgaaattgctgaagcgctgaaaggattgccaattcgct

SEQ ID NO: 330299 - DNA, 75 bp, Artificial Sequence
  Synthetic
atctgacaccagccgtgaagaatgaacatcagggcaatgagatagttgatgtgatgtgtcacgccacgcttacac

SEQ ID NO: 330300 - DNA, 75 bp, Artificial Sequence
  Synthetic
gtgatgtgtcacgccacgcttacacagaaactgctgacaccgacccgggttcccaactaccaagtttacatcatg

SEQ ID NO: 330301 - DNA, 75 bp, Artificial Sequence
  Synthetic
gcagctgccatcttcatgacggcaactccaccaggaacaaatgaccccttcccagattcaaattcccccatactg

SEQ ID NO: 330302 - DNA, 75 bp, Artificial Sequence
  Synthetic
gatgttgaggcccaggttccggacaaagcgtggagcactgggtatgagtggatcaccagcttcacagggaggact

SEQ ID NO: 330303 - DNA, 75 bp, Artificial Sequence
  Synthetic
gtgtggtttgtcccaagtgtgaaaagcggaaatgagatcgccatctgcttgcaaaaagcaggaaagcgggtgatc

SEQ ID NO: 330304 - DNA, 75 bp, Artificial Sequence
  Synthetic
cagcgttgggcatgatggaggtcatgggtaggatgccaaaccacttctgggaaaagacagttgctgctgcggaca

SEQ ID NO: 330305 - DNA, 75 bp, Artificial Sequence
  Synthetic
caactaaacaggaaaagcttcgacacggaatatcccaaaacaaagaacaacgaatgggattttgttgtgaccact

SEQ ID NO: 330306 - DNA, 75 bp, Artificial Sequence
  Synthetic
gacatatcagagatgggggccaactttggagcacatagagtgatcgacagccgcaagtgtgtgaaaccagtcatc

SEQ ID NO: 330307 - DNA, 75 bp, Artificial Sequence
  Synthetic
gttgtgtgtcatgtcaatgggaacattcatctttctcatgaacaggaaaggagttggcaaaatggggctgggagc

SEQ ID NO: 330308 - DNA, 75 bp, Artificial Sequence
  Synthetic
ttggagatgagtaccactacgggggtgcaaccaatgaggatgaccacgatttggccaactggactgaagcaaaga

SEQ ID NO: 330309 - DNA, 75 bp, Artificial Sequence
  Synthetic
taatggaatgccattcactgccatggacctttcggtgccattattggtgctggggtgttggaatcaaatgaccct

SEQ ID NO: 330310 - DNA, 75 bp, Artificial Sequence
  Synthetic
gacctttcggtgccattattggtgctggggtgttggaatcaaatgaccctgccaagcttagctgcagcagtcatg

SEQ ID NO: 330311 - DNA, 75 bp, Artificial Sequence
  Synthetic
ttctccttgacaacatatatctcccaaacggactggtggcacaaatgtaccagcccgagcgggataaggttttca

SEQ ID NO: 330312 - DNA, 75 bp, Artificial Sequence
  Synthetic
cttttgaccatccattatgcatttatgatcccaggctggcaggctgaagcgatgagagcagctcagcggagaaca

SEQ ID NO: 330313 - DNA, 75 bp, Artificial Sequence
  Synthetic
ccatggatggggagttccggttgcgtggagaggaaaggaagaactttgttgagttgatgcgcaatggtgacctcc

SEQ ID NO: 330314 - DNA, 75 bp, Artificial Sequence
  Synthetic
cagtatggttggcttacaaagtggcttccaacgggtacagctaccaagaccgctcatggtgtttcacaggacaaa

SEQ ID NO: 330315 - DNA, 75 bp, Artificial Sequence
  Synthetic
ttccaacgggtacagctaccaagaccgctcatggtgtttcacaggacaaactaacaacacaatcctggaagacaa

SEQ ID NO: 330316 - DNA, 75 bp, Artificial Sequence
  Synthetic
ctaacaacacaatcctggaagacaacaacgaagtcgaagtcttcaccaaaaccggagacaggagaattctcaggc

SEQ ID NO: 330317 - DNA, 75 bp, Artificial Sequence
  Synthetic
cacggtggatggatgcgcgggtctgttgtgactaccaggcgctcaagtcattcaaagagttcgcagcagggaaga

SEQ ID NO: 330318 - DNA, 75 bp, Artificial Sequence
  Synthetic
gatcagcgttgggcatgatggaggtcatgggtaggatgccaaaccacttctgggaaaagacagttgccgctgcgg

SEQ ID NO: 330319 - DNA, 75 bp, Artificial Sequence
  Synthetic
tgggaaaagacagttgccgctgcggatacattgtatctcttagggaccagtgaggctaacagcagggcacacaaa

SEQ ID NO: 330320 - DNA, 75 bp, Artificial Sequence
  Synthetic
tgacttgggctgtggacgaggagggtggagctactactgtgcaaccctgaagcatgttcaagaagtgaaaggatt

SEQ ID NO: 330321 - DNA, 75 bp, Artificial Sequence
  Synthetic
aatgttgtgtgtcatgtcaatgggaacattcatttttctcatgaacaggaaaggagttggcaaaatggggctggg

SEQ ID NO: 330322 - DNA, 75 bp, Artificial Sequence
  Synthetic
acattcatttttctcatgaacaggaaaggagttggcaaaatggggctgggagcatttgtgatgacccttgccacg

SEQ ID NO: 330323 - DNA, 75 bp, Artificial Sequence
  Synthetic
agcatttgtgatgacccttgccacggcgctgctatgggcagcagaagtgcctggaacgcagatagctggagtttt

SEQ ID NO: 330324 - DNA, 75 bp, Artificial Sequence
  Synthetic
gctgatagtgtttctattgatgatcgtgctgattccagaacctgagaagcaacggtctcagactgacaaccaact

SEQ ID NO: 330325 - DNA, 75 bp, Artificial Sequence
  Synthetic
aatggctaaagaaaggagccattgagttttgtataaaagtcttgtgcccatacacgcccaaaatcattgagaagc

SEQ ID NO: 330326 - DNA, 75 bp, Artificial Sequence
  Synthetic
gtgctgattccagaacctgagaagcaacggtctcagactgacaaccaactggcagtcttcctgatatgcatcatg

SEQ ID NO: 330327 - DNA, 75 bp, Artificial Sequence
  Synthetic
ggcagtcttcctgatatgcatcatgaccctcatgggagtggtggcggcaaatgaaatgggccttttggaaaaaac

SEQ ID NO: 330328 - DNA, 75 bp, Artificial Sequence
  Synthetic
accctcatgggagtggtggcggcaaatgaaatgggccttttggaaaaaaccaagtccgacattgccaaattgttt

SEQ ID NO: 330329 - DNA, 75 bp, Artificial Sequence
  Synthetic
caagtccgacattgccaaattgtttggaagccaacctgggtcagtgggatttgcagtgagaacaacaccttggga

SEQ ID NO: 330330 - DNA, 75 bp, Artificial Sequence
  Synthetic
catcagcctcgacatcaagccagccacagcttgggcactgtatgcggcagcaacaatggtcatgacacctttgat

SEQ ID NO: 330331 - DNA, 75 bp, Artificial Sequence
  Synthetic
aaagcatcttattacgacacagtatgtgaatttttcactaacagccatcgcagcccaagctggtgtgctattagg

SEQ ID NO: 330332 - DNA, 75 bp, Artificial Sequence
  Synthetic
cttgaccaatgggatgccattcactgccatggatctgtctgtgccactactggtgctagggtgctggaaccaaat

SEQ ID NO: 330333 - DNA, 75 bp, Artificial Sequence
  Synthetic
tggtgctagggtgctggaaccaaatgaccctgccgagcttggctgtcgcagtcatgcttttgaccatccattacg

SEQ ID NO: 330334 - DNA, 75 bp, Artificial Sequence
  Synthetic
cattcatggtcccaggctggcaggctgaagcgatgagagcagctcagcggagaacagcggctggcatcatgaaga

SEQ ID NO: 330335 - DNA, 75 bp, Artificial Sequence
  Synthetic
gagtttgaggctctcggattcctaaatgaagatcactggatgagccgtgagaattcctatggaggagttgagggg

SEQ ID NO: 330336 - DNA, 75 bp, Artificial Sequence
  Synthetic
atgccgtggttgacgggatcgtggcaactgatattccagacctatcaccagcgaccccaatgacagagaagaaaa

SEQ ID NO: 330337 - DNA, 75 bp, Artificial Sequence
  Synthetic
tgggccaaatcttgctcattgccgcggcggtgctagctgtgcttgtccgtccaggaatctgttcgatcaaagaat

SEQ ID NO: 330338 - DNA, 75 bp, Artificial Sequence
  Synthetic
ttggggtcttggggtcagcagctcttgtgacgctgattgaaggaacggccggagttgtctggaattgcacaacag

SEQ ID NO: 330339 - DNA, 75 bp, Artificial Sequence
  Synthetic
cggttggtctctgcaacctcatgagaggaggatggttggctggaatgtccatcacgtggacagtctacaagaatg

SEQ ID NO: 330340 - DNA, 75 bp, Artificial Sequence
  Synthetic
aggaggatggttggctggaatgtccatcacgtggacagtctacaagaatgtggacaaacctaaaggaaagcgtgg

SEQ ID NO: 330341 - DNA, 75 bp, Artificial Sequence
  Synthetic
tggacaaacctaaaggaaagcgtgggggaggaaaaggagccactctcggagagatctggaagtcgagactgaatc

SEQ ID NO: 330342 - DNA, 75 bp, Artificial Sequence
  Synthetic
agctgacacgagccgaattcatggcatacaggaaagacggaatcgtggaagtggacagagcccctgctaggaagg

SEQ ID NO: 330343 - DNA, 75 bp, Artificial Sequence
  Synthetic
gaggattcgtcaaacccatgggaaaggttgttgacttaggctgtggacgaggagggtggagctactactgtgcaa

SEQ ID NO: 330344 - DNA, 75 bp, Artificial Sequence
  Synthetic
gcagggaagaaactcatgtggtaggaggagcgctgtagattaaaatgtgaatagtgtaaataaataaaataggta

SEQ ID NO: 330345 - DNA, 75 bp, Artificial Sequence
  Synthetic
ggagggtggagctactactgtgcaactctaaagcatgttcaagaagtgaaaggattcacaaagggtggaccaggc

SEQ ID NO: 330346 - DNA, 75 bp, Artificial Sequence
  Synthetic
catgaagaaccgcaactcatgcagagctatggatggaatttggttcacatgaaaagcggagtggacgtgttccat

SEQ ID NO: 330347 - DNA, 75 bp, Artificial Sequence
  Synthetic
aagccagccgagccagctgacactgtgctctgtgacattggagaatcaaacccaagctgtgaagtggaggaagcc

SEQ ID NO: 330348 - DNA, 75 bp, Artificial Sequence
  Synthetic
cggacagcaagagtgctggatatgactgaggaatggctgaagaagggagccactgagttctgcatcaaagtcttg

SEQ ID NO: 330349 - DNA, 75 bp, Artificial Sequence
  Synthetic
cccttgacggggttgaagaggatacttggaagtctgctagatggtcgtggacccgtgcggttcatattggccatt

SEQ ID NO: 330350 - DNA, 75 bp, Artificial Sequence
  Synthetic
ctgaggaatggctgaagaagggagccactgagttctgcatcaaagtcttgtgtccatacatgcccaaaatcattg

SEQ ID NO: 330351 - DNA, 75 bp, Artificial Sequence
  Synthetic
tgtccatacatgcccaaaatcattgaaaagctggaaaaactgcagcggaagtatggaggcggcctggtcagagtc

SEQ ID NO: 330352 - DNA, 75 bp, Artificial Sequence
  Synthetic
cagatggagggctgtagataaaagaacggcattgaaacatctgaacggattcaaacgtgatctcggatctatgct

SEQ ID NO: 330353 - DNA, 75 bp, Artificial Sequence
  Synthetic
agatgtactgggttagtggggcggctggaaacatcatacatgccgtcagcatgactagccaagtgctcatgggga

SEQ ID NO: 330354 - DNA, 75 bp, Artificial Sequence
  Synthetic
cccttgtccagaaactcaacacatgagatgtactgggttagtggggcggctggaaacatcatacatgccgtcagc

SEQ ID NO: 330355 - DNA, 75 bp, Artificial Sequence
  Synthetic
agacaccattaatcggcggccaagcaagaagagaggagggaccggatcattgctcggattagctatgctaattgg

SEQ ID NO: 330356 - DNA, 75 bp, Artificial Sequence
  Synthetic
ggatggacaaacagaacaggagtgggccacgatatgaggaagacgtaaatctgggaagtggaactcgctccgttg

SEQ ID NO: 330357 - DNA, 75 bp, Artificial Sequence
  Synthetic
actagcgagttcattgcaattgtcaacttaccaggggaaagtattaatatcaataaacaagactgacgcccaaag

SEQ ID NO: 330358 - DNA, 75 bp, Artificial Sequence
  Synthetic
gaaagctcacagagaagccagacctccggaaagttggggaaagaatacggagactgagagaagaataccaacaaa

SEQ ID NO: 330359 - DNA, 75 bp, Artificial Sequence
  Synthetic
catggacgtatgaccataacaacccatacagaacatggaactatcatggaagttatgaagtgaagccaactggat

SEQ ID NO: 330360 - DNA, 75 bp, Artificial Sequence
  Synthetic
agatgatatcacatatctgtgtccagtgctttcagcgggaaatgatcccgaggacattgattgttggtgtgatgc

SEQ ID NO: 330361 - DNA, 75 bp, Artificial Sequence
  Synthetic
agttatgaagtgaagccaactggatcagctagctcgatggtgaatggagtcgtgaggctcctctcaaaaccatgg

SEQ ID NO: 330362 - DNA, 75 bp, Artificial Sequence
  Synthetic
tgaagaagtgtgggtgcattacggtagatgcacgcgcatgggacactcgaggcgtagtcggcgatcaatttctgt

SEQ ID NO: 330363 - DNA, 75 bp, Artificial Sequence
  Synthetic
tggcgatgactgacaccacgccttttggtcaacaaagggtcttcaaagaaaaggttgacacaaaagctcccgaac

SEQ ID NO: 330364 - DNA, 75 bp, Artificial Sequence
  Synthetic
gcagcatcacggagactccacactggcaacaaagaacacgccatggttggacactattaaaaccaccaagtactt

SEQ ID NO: 330365 - DNA, 75 bp, Artificial Sequence
  Synthetic
caccattaggagtcgctcaaatcatggatgtgacgactgactggctgtgggatttcgttgctcgggaaaagaaac

SEQ ID NO: 330366 - DNA, 75 bp, Artificial Sequence
  Synthetic
ggatgtgacgactgactggctgtgggatttcgttgctcgggaaaagaaaccaagaatctgcaccccagaagaatt

SEQ ID NO: 330367 - DNA, 75 bp, Artificial Sequence
  Synthetic
gacaaaagtcgaaaattgggttctgcgcaatcctggatatgccctagttgcactggcgattggatggatgctagg

SEQ ID NO: 330368 - DNA, 75 bp, Artificial Sequence
  Synthetic
caaagcaaaggtgaacagccatgcggccttgggagccatgtttgaggaacagaatcagtggagcagcgcccgtga

SEQ ID NO: 330369 - DNA, 75 bp, Artificial Sequence
  Synthetic
tagcaacaacacacagaaagtggtatttgtgatcatgctgatgttgattgccccggcatacagcttcaattgtct

SEQ ID NO: 330370 - DNA, 75 bp, Artificial Sequence
  Synthetic
gccttgggagccatgtttgaggaacagaatcagtggagcagcgcccgtgaagctgttgaagatccaaagttttgg

SEQ ID NO: 330371 - DNA, 75 bp, Artificial Sequence
  Synthetic
ccccggcatacagcttcaattgtctgggaacatcaaacagggacttcgtcgaaggggccagcggggcaacatgga

SEQ ID NO: 330372 - DNA, 75 bp, Artificial Sequence
  Synthetic
cccatctcaaaggagagtgtcacacatgcatctacaacatgatgggaaagcgcgagaagaagacgggagaatttg

SEQ ID NO: 330373 - DNA, 75 bp, Artificial Sequence
  Synthetic
ttgacttggtacttgaaggaggaggctgtgtcacagtgatggcaccagagaaaccaacactagacttcaaagtga

SEQ ID NO: 330374 - DNA, 75 bp, Artificial Sequence
  Synthetic
ggaaggccaaaggaagcagggctatctggtacatgtggctgggagctcggtttttggagtttgaggcccttgggt

SEQ ID NO: 330375 - DNA, 75 bp, Artificial Sequence
  Synthetic
tgaagatggaggccacggaactagccactgtgcgtgagtattgctacgaagcaaccttgaacacgctgtcaacag

SEQ ID NO: 330376 - DNA, 75 bp, Artificial Sequence
  Synthetic
ctggtacatgtggctgggagctcggtttttggagtttgaggcccttgggtttctaaatgaagatcactggatgag

SEQ ID NO: 330377 - DNA, 75 bp, Artificial Sequence
  Synthetic
ccgcgagaactcacatggaggagttgagggaaaaggactccagaagctcggatacatcctgcaagaaatctccca

SEQ ID NO: 330378 - DNA, 75 bp, Artificial Sequence
  Synthetic
tggcaagatgccccacaacaggagaggctcacaacaccaagaggagtgacccaacattcgtctgtaaaagagatg

SEQ ID NO: 330379 - DNA, 75 bp, Artificial Sequence
  Synthetic
gagggaaaaggactccagaagctcggatacatcctgcaagaaatctcccaaatcccaggaggaaagatgtatgca

SEQ ID NO: 330380 - DNA, 75 bp, Artificial Sequence
  Synthetic
ttgtagaccgtggatggggcaacggatgtggtctgtttggaaagggaagcattgacacatgcgcaaagttcacat

SEQ ID NO: 330381 - DNA, 75 bp, Artificial Sequence
  Synthetic
gcaaaaacaaggcaacggggaagacaatcctgagagaaaacatcaagtatgaggttgcaatttttgtgcatggtt

SEQ ID NO: 330382 - DNA, 75 bp, Artificial Sequence
  Synthetic
aggcgatcattgacctgacctaccgtcacaaggtggtgaaagtcatgagaccagggcctgatgggaaaacttaca

SEQ ID NO: 330383 - DNA, 75 bp, Artificial Sequence
  Synthetic
caacggactccacatcacatggcaactatgctgagcaaattgggaaaaaccaagcagctagattcaccataagcc

SEQ ID NO: 330384 - DNA, 75 bp, Artificial Sequence
  Synthetic
tggatgtcatttctagagaagaccaaaggggcagtggacaggtagtcacatacgccctgaacaccttcaccaatc

SEQ ID NO: 330385 - DNA, 75 bp, Artificial Sequence
  Synthetic
cgcaagcgccgtcctttacggccaacatgggcgagtatggaacagtcactattgattgtgaggcaagatcaggaa

SEQ ID NO: 330386 - DNA, 75 bp, Artificial Sequence
  Synthetic
tcaacacagaggattattatgtctttacagctaaggagaaatcatggctggtgaatagggattggtttcacgatt

SEQ ID NO: 330387 - DNA, 75 bp, Artificial Sequence
  Synthetic
gatgacgtcatgagagtgagacttggacgattggccaaagcggttgagtggctaaggaagaatggacctgaacgg

SEQ ID NO: 330388 - DNA, 75 bp, Artificial Sequence
  Synthetic
tgaatcttccatggacgagccctgccacaacggactggcgcaacagagaaacgctggtggaatttgaagagccac

SEQ ID NO: 330389 - DNA, 75 bp, Artificial Sequence
  Synthetic
ctgagtagaatggcagtgagcggggatgattgtgttgtgaaaccaattgatgacagattcgccaccgcactccat

SEQ ID NO: 330390 - DNA, 75 bp, Artificial Sequence
  Synthetic
atgattgtgttgtgaaaccaattgatgacagattcgccaccgcactccatttcctcaacaacatgtcaaaaatca

SEQ ID NO: 330391 - DNA, 75 bp, Artificial Sequence
  Synthetic
atgccaccaagcaaaccgtagttgccctaggttcacaagaaggagctctgcacacagcactggccggagccattc

SEQ ID NO: 330392 - DNA, 75 bp, Artificial Sequence
  Synthetic
ggaaggacattcaagaatggaaaccttcaacaggttggcacaattggcaggaggtgcctttctgctcacaccact

SEQ ID NO: 330393 - DNA, 75 bp, Artificial Sequence
  Synthetic
cggccactgtcagtagctctaccctgaccttgcaatcagggcacttgaagtgcagagccaagcttgataaggtta

SEQ ID NO: 330394 - DNA, 75 bp, Artificial Sequence
  Synthetic
tcaatgaactaatgctgaaggatgggcgaaccatcgtggtgccatgcaggagccaggatgaactgattggcagag

SEQ ID NO: 330395 - DNA, 75 bp, Artificial Sequence
  Synthetic
aaattaagggaacaacatatggcatgtgtgactctgctttcattttcagcaaaaacccaactgacacagggcatg

SEQ ID NO: 330396 - DNA, 75 bp, Artificial Sequence
  Synthetic
gcgaaccatcgtggtgccatgcaggagccaggatgaactgattggcagagctagaatttcaccaggagcaggatg

SEQ ID NO: 330397 - DNA, 75 bp, Artificial Sequence
  Synthetic
gaatgtgaaggagacagcttgcctgagcaaatcctatgctcagatgtggttgctcatgtatttccacagacggga

SEQ ID NO: 330398 - DNA, 75 bp, Artificial Sequence
  Synthetic
ggacagtgattgtggaactgcagtacaccggaagcaatggaccctgccgggttcccatttccgtgactgcaaacc

SEQ ID NO: 330399 - DNA, 75 bp, Artificial Sequence
  Synthetic
gttcccatttccgtgactgcaaacctcatggacttgacgccggttggaagactggttacggtcaatccctttata

SEQ ID NO: 330400 - DNA, 75 bp, Artificial Sequence
  Synthetic
agcaaatcctatgctcagatgtggttgctcatgtatttccacagacgggatcttaggatgatggcaaatgctatt

SEQ ID NO: 330401 - DNA, 75 bp, Artificial Sequence
  Synthetic
tgttcagccgtcccagtcaactgggtccccactggacgcactacatggtcaattcatgggaagggtgagtggatg

SEQ ID NO: 330402 - DNA, 75 bp, Artificial Sequence
  Synthetic
aattcatgggaagggtgagtggatgacaactgaagacatgctgagtgtctggaaccgtgtgtggattgaagagaa

SEQ ID NO: 330403 - DNA, 75 bp, Artificial Sequence
  Synthetic
cggcgattcctacgtcgttgtcggaaggggcaccactcaaatcaactaccactggcacaaagagggaagcagcat

SEQ ID NO: 330404 - DNA, 75 bp, Artificial Sequence
  Synthetic
tgggaaggctttggcgaccacatggaaaggagcccaacggctagccgttttgggggacacagcgtgggactttgg

SEQ ID NO: 330405 - DNA, 75 bp, Artificial Sequence
  Synthetic
acctaggaaagagagaggacatctggtgtggaagcctaattggaacaaggaccagagccacctgggctgagaaca

SEQ ID NO: 330406 - DNA, 75 bp, Artificial Sequence
  Synthetic
atctattgggggagttttcaattcaatcggcaaagctgtccaccaagtgtttggaggagcgttcaggaccttgtt

SEQ ID NO: 330407 - DNA, 75 bp, Artificial Sequence
  Synthetic
atcggcaaagctgtccaccaagtgtttggaggagcgttcaggaccttgtttgggggaatgtcctggatcacacag

SEQ ID NO: 330408 - DNA, 75 bp, Artificial Sequence
  Synthetic
agagactacatgattgctcaaaacagatttggtagggaagaaactcatgtggtaggaggagtgctgtaaattaaa

SEQ ID NO: 330409 - DNA, 75 bp, Artificial Sequence
  Synthetic
gatttggtagggaagaaactcatgtggtaggaggagtgctgtaaattaaaatgtaaatagtgtaaataaataaaa

SEQ ID NO: 330410 - DNA, 75 bp, Artificial Sequence
  Synthetic
ggattacttggagcccttctcttgtggatggggttgcaggcccgcgacaggagcatctcgctgactctattggcc

SEQ ID NO: 330411 - DNA, 75 bp, Artificial Sequence
  Synthetic
actggagggattttaatctttctagcgactagcgtgcaagctgattcgggatgtgcaattgatctacagcgacgt

SEQ ID NO: 330412 - DNA, 75 bp, Artificial Sequence
  Synthetic
caggtaagtcaggccaattagttttgccaccggatgtcaggtaaacggtgctgtctgtaacctggccccaggtga

SEQ ID NO: 330413 - DNA, 75 bp, Artificial Sequence
  Synthetic
ctgtctgtaacctggccccaggtgactgggttatcaaagccaatctagctgagtacaaagcccctcattccgact

SEQ ID NO: 330414 - DNA, 75 bp, Artificial Sequence
  Synthetic
gaattgaaatgtggaggaggcatcttcgtgtacaatgacgtcgagaagtggaagagtggctacaagtattttccc

SEQ ID NO: 330415 - DNA, 75 bp, Artificial Sequence
  Synthetic
ttgactccaactggactcgcgcgtgtgattcaaggggcacgttccagcggcatctgtggcatccgatcgacgtca

SEQ ID NO: 330416 - DNA, 75 bp, Artificial Sequence
  Synthetic
tgattcaaggggcacgttccagcggcatctgtggcatccgatcgacgtcacgtttggagcacttgatgtgggaga

SEQ ID NO: 330417 - DNA, 75 bp, Artificial Sequence
  Synthetic
acatacagagagagctgaacgcaatctttgaagacaatgaaatcgacttgtcagttgtagtgcaggaagatccca

SEQ ID NO: 330418 - DNA, 75 bp, Artificial Sequence
  Synthetic
aatactacaaaagagctcctcaacgcttgaagaaactagaggatgagttagattacggatggaagaaatggggga

SEQ ID NO: 330419 - DNA, 75 bp, Artificial Sequence
  Synthetic
aaggactagaggttagaggagaccccttgccgttaacgcaaacaacagcatattgacacctggaaagacaggaga

SEQ ID NO: 330420 - DNA, 75 bp, Artificial Sequence
  Synthetic
aaaccctgttcatggaacccaaacttggaaacaacacgttcgttgttgatggacccgaaaccaaggaatgtccaa

SEQ ID NO: 330421 - DNA, 75 bp, Artificial Sequence
  Synthetic
agatgttcgcgtcggtgagcggagaggaaacagatttcttttttggaggataacaacttaacttgactgcgaaca

SEQ ID NO: 330422 - DNA, 75 bp, Artificial Sequence
  Synthetic
cagcaaacagagcttggaatagcttcaaggtggaagattttggatttggcatggtgttcactagattgtggctca

SEQ ID NO: 330423 - DNA, 75 bp, Artificial Sequence
  Synthetic
gtctaaaaaaccaggaaaacccggtagaaaccgggttgtcaatatgctaaaacgcggtgtatcccgcgtgaaccc

SEQ ID NO: 330424 - DNA, 75 bp, Artificial Sequence
  Synthetic
gacattcttccgatttacagctctacagccaactgaggcgctgaagcgcagatggagggctgtagacaaaagaac

SEQ ID NO: 330425 - DNA, 75 bp, Artificial Sequence
  Synthetic
cagccaactgaggcgctgaagcgcagatggagggctgtagacaaaagaacggcattgaaacacctgaacggattc

SEQ ID NO: 330426 - DNA, 75 bp, Artificial Sequence
  Synthetic
gagcaggaagaatgaaacatggcagctggaacgagccgtcatgggagaagtgaaatcttgcacctggccagaaac

SEQ ID NO: 330427 - DNA, 75 bp, Artificial Sequence
  Synthetic
gcatactctatggggtgatggcgttgttgaaagtgaaatgatcatcccggtgacactaggaggccctaaaagcca

SEQ ID NO: 330428 - DNA, 75 bp, Artificial Sequence
  Synthetic
tcataacaagagaattggataccacacacagacaaaaggaccttggagtgaaggggaaataaccctggactttga

SEQ ID NO: 330429 - DNA, 75 bp, Artificial Sequence
  Synthetic
atcaacaagactgacgctcaaagcgccataaacattcccagtgccaacggagcaaacacttgcatcgtgcgggct

SEQ ID NO: 330430 - DNA, 75 bp, Artificial Sequence
  Synthetic
gacattgactgttggtgtgacgttaaagaggtgtgggtgcactacggcagatgcacgcgcatgggacattcgagg

SEQ ID NO: 330431 - DNA, 75 bp, Artificial Sequence
  Synthetic
aagaggtgtgggtgcactacggcagatgcacgcgcatgggacattcgaggcgtagccgacggtcaatctctgtgc

SEQ ID NO: 330432 - DNA, 75 bp, Artificial Sequence
  Synthetic
tgctgcaagagctgttccttgccaccactgcgatacaccacaaaagatggatgttggtacggaatggaaatcagg

SEQ ID NO: 330433 - DNA, 75 bp, Artificial Sequence
  Synthetic
caaaagtcgaaaactgggttttgcgcaatcctggatatgccctagttgcgctggcgattggatggatgctaggca

SEQ ID NO: 330434 - DNA, 75 bp, Artificial Sequence
  Synthetic
caatcctggatatgccctagttgcgctggcgattggatggatgctaggcagcaacaacacacagagagtggtttt

SEQ ID NO: 330435 - DNA, 75 bp, Artificial Sequence
  Synthetic
ccagtgaaggaggaagaagcaaaactcgtgaaatctcgggtgacagctggagtcgcagggggaatggaaccattc

SEQ ID NO: 330436 - DNA, 75 bp, Artificial Sequence
  Synthetic
caacttggtctcctggtagcgttcatagccactcaagaagtgctgaaacgcaggtggactgggaagttgaccctg

SEQ ID NO: 330437 - DNA, 75 bp, Artificial Sequence
  Synthetic
ctggcgattggatggatgctaggcagcaacaacacacagagagtggtttttgtgatcatgctgatgctgattgct

SEQ ID NO: 330438 - DNA, 75 bp, Artificial Sequence
  Synthetic
acctcattggcggtgtgtttagcactattaatttttggaaacctaacatacatggatttagtgcgatacctggtc

SEQ ID NO: 330439 - DNA, 75 bp, Artificial Sequence
  Synthetic
gggagccagcggggcaacatggattgacttgatacttgaagggggaagctgtgttacagtgatggcaccagagaa

SEQ ID NO: 330440 - DNA, 75 bp, Artificial Sequence
  Synthetic
cttgttggaactgcttttgcggaaatgaacaccggaggcgatgtgatccacctggcgcttgttgctgtcttcaaa

SEQ ID NO: 330441 - DNA, 75 bp, Artificial Sequence
  Synthetic
accaacactggatttcaaagtgatgaagatggaggctactgagttagccactgtgcgtgagtattgctacgaagc

SEQ ID NO: 330442 - DNA, 75 bp, Artificial Sequence
  Synthetic
aagatggaggctactgagttagccactgtgcgtgagtattgctacgaagcaaccttggacacgctgtcaatagtg

SEQ ID NO: 330443 - DNA, 75 bp, Artificial Sequence
  Synthetic
gtgcagccagcattcttagcgggtctgttcttgagaatgcagtggagtaatcaggaaaacatcttgatggttatt

SEQ ID NO: 330444 - DNA, 75 bp, Artificial Sequence
  Synthetic
ggagcagcatttcttcagatggccgccaacgatctgaaacttgaggttcttcccattctcaacgcaatgtccatt

SEQ ID NO: 330445 - DNA, 75 bp, Artificial Sequence
  Synthetic
tgacacatgcgcaaagttcacatgcaaaaacaaggcaacagggaagacaatcttgagagaaaacatcaagtacga

SEQ ID NO: 330446 - DNA, 75 bp, Artificial Sequence
  Synthetic
aagagggtaaagtggcgatgtacgctcttcccatcttgtgtgctctgactccaggaatgaaaatggctgggcttg

SEQ ID NO: 330447 - DNA, 75 bp, Artificial Sequence
  Synthetic
tcttgagagaaaacatcaagtacgaggttgcaatttttgtgcatggttcaacggactccacgtcacatggcaatt

SEQ ID NO: 330448 - DNA, 75 bp, Artificial Sequence
  Synthetic
acgtcattagatgcctgttgctgataattgggatcgtgacacttctgaatgaaagaagagaaagtgtggccaaga

SEQ ID NO: 330449 - DNA, 75 bp, Artificial Sequence
  Synthetic
acggactccacgtcacatggcaattactttgagcagattgggaaaaaccaagcggctagattcaccataagcccg

SEQ ID NO: 330450 - DNA, 75 bp, Artificial Sequence
  Synthetic
aaaaaggcggctacttgctggccgcagccctctgccaagctggggtgtgcagtcccatgatcatgatgggaggct

SEQ ID NO: 330451 - DNA, 75 bp, Artificial Sequence
  Synthetic
agcggctagattcaccataagcccgcaagcaccgtcttttacggctaacatgggcgagtatggaacagttaccat

SEQ ID NO: 330452 - DNA, 75 bp, Artificial Sequence
  Synthetic
tgatcttggcccatcctaatgggaaaaggagttggccagcaagtgaggtcttgaccggagttggactgatgtgcg

SEQ ID NO: 330453 - DNA, 75 bp, Artificial Sequence
  Synthetic
ccctagcaggaggccttctcgagtttgaggaaacctcaatggtggtccccttcgcaatagctggactgatgtaca

SEQ ID NO: 330454 - DNA, 75 bp, Artificial Sequence
  Synthetic
actggtggaatttgaggaaccgcatgccaccaagcaaactgtagtcgccctaggatcgcaagaaggtgccctgca

SEQ ID NO: 330455 - DNA, 75 bp, Artificial Sequence
  Synthetic
tcacatataccgtctcaggaaaagctgcagaaatgtggattgagaaagcagcagacatcacatgggaacagaatg

SEQ ID NO: 330456 - DNA, 75 bp, Artificial Sequence
  Synthetic
gccaccaagcaaactgtagtcgccctaggatcgcaagaaggtgccctgcacacagcattggccggagccattcca

SEQ ID NO: 330457 - DNA, 75 bp, Artificial Sequence
  Synthetic
gtgactctgccttcaccttcagcaagaacccaactgacacagggcatgggacagtgattgtggaactgcagtaca

SEQ ID NO: 330458 - DNA, 75 bp, Artificial Sequence
  Synthetic
agtgcacggtttcactggttcattccatttggagtattggggttttggttgcttggaaagcactcgaagcgagga

SEQ ID NO: 330459 - DNA, 75 bp, Artificial Sequence
  Synthetic
acagtgattgtggaactgcagtacactggaagcaacggaccctgccgggttcccatctccgtgactgcaaacctc

SEQ ID NO: 330460 - DNA, 75 bp, Artificial Sequence
  Synthetic
ggagcattgtgggacgtgccgtcaccaaaagtttatccaaaatgtgagacaaaaccaggaatctaccggataatg

SEQ ID NO: 330461 - DNA, 75 bp, Artificial Sequence
  Synthetic
atggacttgacaccggttggaagattggtcacggtcaatccctttataagcacagggggagcgaacaacaaggtc

SEQ ID NO: 330462 - DNA, 75 bp, Artificial Sequence
  Synthetic
aaaaccaggaatctaccggataatgaccagaggaatcctaggcacttttcaggctggagttggtgtgatgcatga

SEQ ID NO: 330463 - DNA, 75 bp, Artificial Sequence
  Synthetic
cacagggggagcgaacaacaaggtcatgatcgaagttgaaccacccttcggcgattcttacatcgtcgtcggaag

SEQ ID NO: 330464 - DNA, 75 bp, Artificial Sequence
  Synthetic
aggcaccacccagattaactaccactggcacaaaaagggaagcagcattgggaaggctttggcgaccacatggaa

SEQ ID NO: 330465 - DNA, 75 bp, Artificial Sequence
  Synthetic
tgcaggagacgttcggaatgatttgatctcgtatggaggtccttggaagttgagtgccacctgggacgggaccca

SEQ ID NO: 330466 - DNA, 75 bp, Artificial Sequence
  Synthetic
ctattggaggagttttcaattcaattggcaaagccgtccaccaagttttcggaggagcgttcaggactctgttcg

SEQ ID NO: 330467 - DNA, 75 bp, Artificial Sequence
  Synthetic
cgaagtccaaatgattgccctagctccaggaaaaccagccattaatgtccagacaacaccaggagtgtttaaaac

SEQ ID NO: 330468 - DNA, 75 bp, Artificial Sequence
  Synthetic
ggggaatgtcctggatcacacagggactacttggagcccttctcttgtggatggggttgcaggcccgcgacagga

SEQ ID NO: 330469 - DNA, 75 bp, Artificial Sequence
  Synthetic
cccattcgggactattggagcccttactcttgacttcccaaaaggaacatcccgctctccgatcatcaacaagaa

SEQ ID NO: 330470 - DNA, 75 bp, Artificial Sequence
  Synthetic
gcatctcgctgactctactggctgtcggagggattctcatctttctggcaaccagcgtgcaagccgattcgggat

SEQ ID NO: 330471 - DNA, 75 bp, Artificial Sequence
  Synthetic
aggggagatccttgggctctatggaaatggggtattgataggacagggcgaatatgttactggcctcgtccaagg

SEQ ID NO: 330472 - DNA, 75 bp, Artificial Sequence
  Synthetic
gtgtacaacgacgttgagaagtggaagagtgactacaagtatttccctctgactccaactggactcgcgcgtgtg

SEQ ID NO: 330473 - DNA, 75 bp, Artificial Sequence
  Synthetic
ggagaggacagaagaaccaattccagatgtgtacaatgaggaaatgctccggaagagaaaactaacagtgctaga

SEQ ID NO: 330474 - DNA, 75 bp, Artificial Sequence
  Synthetic
gactccaactggactcgcgcgtgtgattcaagaggcgcatgccaacggcatctgtggcatccgatcaacgtcacg

SEQ ID NO: 330475 - DNA, 75 bp, Artificial Sequence
  Synthetic
agaaaggtgttgcctcaaatcatcaaagattgcatccaaaaacgcttgcgaacagctgtgttagcccccactcgg

SEQ ID NO: 330476 - DNA, 75 bp, Artificial Sequence
  Synthetic
tgaagaagctggaggatgagttggattacggatggaagaaatggggaaaaaccctgttcgtggaacccaaacttg

SEQ ID NO: 330477 - DNA, 75 bp, Artificial Sequence
  Synthetic
gtagtggcttgtgaaattgctgaagcgttgaaaggactgccaatccgttatctgacaccagccgtgaagaatgaa

SEQ ID NO: 330478 - DNA, 75 bp, Artificial Sequence
  Synthetic
gaaacaacacatttgttgttgatggacccgaaaccaaggagtgtccaacagcaaacagagcatggaacagtttca

SEQ ID NO: 330479 - DNA, 75 bp, Artificial Sequence
  Synthetic
cgttgaaaggactgccaatccgttatctgacaccagccgtgaagaatgaacaccagggcaatgagatagtcgatg

SEQ ID NO: 330480 - DNA, 75 bp, Artificial Sequence
  Synthetic
tgatgtgtcatgccacgctcacacagaaactgttgacaccaactcgggttcccaactaccaagtttacatcatgg

SEQ ID NO: 330481 - DNA, 75 bp, Artificial Sequence
  Synthetic
gcgattcggcaatcattggcacagccataaaaggagacagagctgttcacagtgacctatcgtattggattgaga

SEQ ID NO: 330482 - DNA, 75 bp, Artificial Sequence
  Synthetic
atgaggcccacttcattgatccagcaagcattgctgcccgtgggtatatctcaacaagagtggaattgggggaag

SEQ ID NO: 330483 - DNA, 75 bp, Artificial Sequence
  Synthetic
ggaacgagccgtcatgggagaagtgaaatcttgtacctggccagaaacgcatactctatggggtgatggtgttga

SEQ ID NO: 330484 - DNA, 75 bp, Artificial Sequence
  Synthetic
cagccgccatcttcatggcggcgactccaccaggaacaaaggaccctttcccagattcaaattctcccatactgg

SEQ ID NO: 330485 - DNA, 75 bp, Artificial Sequence
  Synthetic
tgaaagcgaaatgatcatcccggtgacattaggaggcccaaaaagccatcacaacaagagaaacggataccacac

SEQ ID NO: 330486 - DNA, 75 bp, Artificial Sequence
  Synthetic
atgttgagacccaagttccggacaaggcgtggagcactgggtatgagtggatcactaacttcacagggagaactg

SEQ ID NO: 330487 - DNA, 75 bp, Artificial Sequence
  Synthetic
acagacaaaaggaccctggagtgaaggagaaataaccctggactttgactactgcccaggaacaacagtcaccgt

SEQ ID NO: 330488 - DNA, 75 bp, Artificial Sequence
  Synthetic
tgtggtttgtccccagtgtgaaaagtgggaatgagatcgctgtctgcttgcaaaagacaggaaagagagtgatcc

SEQ ID NO: 330489 - DNA, 75 bp, Artificial Sequence
  Synthetic
cactgaacattgtggaaacaggggagcgtcactgcgcacaaccacagcgagcggcaagctggtcactgattggtg

SEQ ID NO: 330490 - DNA, 75 bp, Artificial Sequence
  Synthetic
aactaaataggaaaagcttcgacacagaataccccaaaacaaagaacaacgaatgggactttgttgtgaccactg

SEQ ID NO: 330491 - DNA, 75 bp, Artificial Sequence
  Synthetic
gcggcaagctggtcactgattggtgttgcaggagctgttccttgccaccactgcgatacaccacaaaagatggat

SEQ ID NO: 330492 - DNA, 75 bp, Artificial Sequence
  Synthetic
acatatcagagatgggggccaactttggagctcacagagtgatcgacagccgcaagtgtgtgaaaccagtcatct

SEQ ID NO: 330493 - DNA, 75 bp, Artificial Sequence
  Synthetic
caatggacccatggcaatcacatcagcgagcgcagcacaacgcagaggccgtattgggagaaatccttctcagat

SEQ ID NO: 330494 - DNA, 75 bp, Artificial Sequence
  Synthetic
tggagacgaataccattacgggggtgcaaccaatgaggacgaccacgatttggctaactggactgaagcaaaaat

SEQ ID NO: 330495 - DNA, 75 bp, Artificial Sequence
  Synthetic
aacactggaggcgatgtgatccacctagcacttgttgctgtcttcaaagtgcagccagcattcttggcgggtctg

SEQ ID NO: 330496 - DNA, 75 bp, Artificial Sequence
  Synthetic
tcttcttgacaacatatatctcccaaacggactggtagcacaaatgtaccagcccgagcgagacaaggtgttcac

SEQ ID NO: 330497 - DNA, 75 bp, Artificial Sequence
  Synthetic
gcagccagcattcttggcgggtctgtttttaagaatgcagtggagcaaccaggaaaacatcttgatggttattgg

SEQ ID NO: 330498 - DNA, 75 bp, Artificial Sequence
  Synthetic
tatggatggggagttccggttgcgcggagaggaaaggaagaactttgttgagctgatgcgcaatggtgacctccc

SEQ ID NO: 330499 - DNA, 75 bp, Artificial Sequence
  Synthetic
agcagcctttctccaaatggcagccaacgacctgaagcttgaggttcttccgatactcaacgccatgtccatcgc

SEQ ID NO: 330500 - DNA, 75 bp, Artificial Sequence
  Synthetic
agtgtggctggcttacaaagtggcttccaatgggcacagttaccaagaccgttcatggtgcttcacaggacaaac

SEQ ID NO: 330501 - DNA, 75 bp, Artificial Sequence
  Synthetic
caacaacacaatcttggaagataacaacgaagttgaagtcttcaccaaaaccggagacaggaaaattctcaagcc

SEQ ID NO: 330502 - DNA, 75 bp, Artificial Sequence
  Synthetic
aaagtggatggatgcacgggtctgttgtgattaccaagcgctcaagtcattcaaagagtttgcagcagggaagag

SEQ ID NO: 330503 - DNA, 75 bp, Artificial Sequence
  Synthetic
atcagcgttaggcatgatagaggtcatgggtaggatgccaaaccacttctgggagaagacagttgccgccgcgga

SEQ ID NO: 330504 - DNA, 75 bp, Artificial Sequence
  Synthetic
aaaggcggctacttgctcgcagcagccctctgccaagctggattgtgcagtcccttgattatgatgggaggctta

SEQ ID NO: 330505 - DNA, 75 bp, Artificial Sequence
  Synthetic
atcttggctcaccctaacgggaaaaggagttggccagcgagtgaggtcttgactggagtcggactgatgtgcgct

SEQ ID NO: 330506 - DNA, 75 bp, Artificial Sequence
  Synthetic
tacattgtacctcctagggaccagtgaggctaacagcagggcacacaaagaagcactggcggaattgccagactc

SEQ ID NO: 330507 - DNA, 75 bp, Artificial Sequence
  Synthetic
cttggaaacacttctcttgattggaatgttgtgcgtcatgtcaatgggcacatttatttttctcatgaacaggaa

SEQ ID NO: 330508 - DNA, 75 bp, Artificial Sequence
  Synthetic
ttggcaggaggtcttctcgagtttgaggagacctcaatggtggtcccttttgcaatagccggactgatgtacatc

SEQ ID NO: 330509 - DNA, 75 bp, Artificial Sequence
  Synthetic
tggaacgcagataactggagtcttgctgatagtgttcctattgatgatcgtgctgattccagaacctgagaagca

SEQ ID NO: 330510 - DNA, 75 bp, Artificial Sequence
  Synthetic
ggagctccagtgcacttgtttgcgctgagattcatactcctgggcttgagcgcacgattttattggttcattcca

SEQ ID NO: 330511 - DNA, 75 bp, Artificial Sequence
  Synthetic
acggtcccagactgataaccaactggctgtcttcttgatatgcatcatgaccctcatgggtgtggtggcggcaaa

SEQ ID NO: 330512 - DNA, 75 bp, Artificial Sequence
  Synthetic
ttggaaaacactcgaagcgaggaggagcattgtgggacgtgccgtcaccaaaagtgtatccaaagtgtgagacaa

SEQ ID NO: 330513 - DNA, 75 bp, Artificial Sequence
  Synthetic
tgagatgggccttttggaaaaaaccaagtccgacattgccaaattatttggcagccaacttggatcagtgggatt

SEQ ID NO: 330514 - DNA, 75 bp, Artificial Sequence
  Synthetic
aaagtgtatccaaagtgtgagacaaaaccaggaatctaccgaatcatgactagaggaattctgggcactttccaa

SEQ ID NO: 330515 - DNA, 75 bp, Artificial Sequence
  Synthetic
tgcagtaagagcaacaccttgggacatcagcctcgatatcaggccggccacggcctgggcactgtatgcggcatc

SEQ ID NO: 330516 - DNA, 75 bp, Artificial Sequence
  Synthetic
atcagcctcgatatcaggccggccacggcctgggcactgtatgcggcatcaacaatggtcatgacacctttgata

SEQ ID NO: 330517 - DNA, 75 bp, Artificial Sequence
  Synthetic
ggagaagggagactagatccgtatgcaggagatgtccggaatgatctgatctcgtatggaggtccctggaagctg

SEQ ID NO: 330518 - DNA, 75 bp, Artificial Sequence
  Synthetic
aagcatctcatcacgacgcagtatgtgaacttttcactaacagccatcgcagcccaagctggtgttttgttaggc

SEQ ID NO: 330519 - DNA, 75 bp, Artificial Sequence
  Synthetic
ttgaccaatgggatgccattcaccgccatggatctttcggtgccactactggtgctagggtgttggaatcaaatg

SEQ ID NO: 330520 - DNA, 75 bp, Artificial Sequence
  Synthetic
cgttcgggaccattggagccgtgactcttgatttcccaaaaggaacatcaggttctccaatcatcaacaagaaag

SEQ ID NO: 330521 - DNA, 75 bp, Artificial Sequence
  Synthetic
accctgccaagcttggccgtcgcaatcatgcttttgactatccattatgcactcatggtcccaggctggcaggct

SEQ ID NO: 330522 - DNA, 75 bp, Artificial Sequence
  Synthetic
gaagcgatgagagcagctcagcggagaacagcggctggtatcatgaagaatgctgtggttgacgggattgtggca

SEQ ID NO: 330523 - DNA, 75 bp, Artificial Sequence
  Synthetic
aaaggacagaagaaccaattccagatgcatacaatgaggaaatgctccggaagagaaaactaacggtgctggaat

SEQ ID NO: 330524 - DNA, 75 bp, Artificial Sequence
  Synthetic
actgatattccagacctatcaccggcgaccccaatgacagagaagaaaatgggccaaatcttactcattgctgca

SEQ ID NO: 330525 - DNA, 75 bp, Artificial Sequence
  Synthetic
gcggtgctggctgtgctcgtccggccagggatcagttcgatcaaagaatttggggtcctggggtcagcagccctt

SEQ ID NO: 330526 - DNA, 75 bp, Artificial Sequence
  Synthetic
cggccgtgctagcccccactcgggtagtggcttgtgagatcgctgaagcgttgaaaggactaccaatccgttacc

SEQ ID NO: 330527 - DNA, 75 bp, Artificial Sequence
  Synthetic
gtgacgctgattgatggaacggccggagttgtctggaattgcacaacagcggttggcctctgtaacctcatgagg

SEQ ID NO: 330528 - DNA, 75 bp, Artificial Sequence
  Synthetic
ggaggatggttggctggagtgtctatcacgtggacagtctacaagaatgtggacaagcctaagggaaagcgtgga

SEQ ID NO: 330529 - DNA, 75 bp, Artificial Sequence
  Synthetic
gaggcccacttcattgatccagcaagcattgctgctcgtggatatatctcaacaaaagtggaattgggggaagca

SEQ ID NO: 330530 - DNA, 75 bp, Artificial Sequence
  Synthetic
ggaggaaaaggagccactctcggagagatctggaagtcaagactgaatcagctgacacgagccgaattcatgaca

SEQ ID NO: 330531 - DNA, 75 bp, Artificial Sequence
  Synthetic
gctgacacgagccgaattcatgacatacaggaaagacggaattgtggaagtagacagagcccctgctaggaaggc

SEQ ID NO: 330532 - DNA, 75 bp, Artificial Sequence
  Synthetic
cgtggagcactgggtatgagtggatcaccaacttcacagggaggactgtgtggtttgtccccagtgtgaaaagtg

SEQ ID NO: 330533 - DNA, 75 bp, Artificial Sequence
  Synthetic
ggaacgaaattgccatctgcctgcaaaaagcaggaaagcgagtgattcaactaaacaggaaaagcttcgacacgg

SEQ ID NO: 330534 - DNA, 75 bp, Artificial Sequence
  Synthetic
caaaactaagatggataactgaaagaggatttgtcaaacccatgggaaaggttgttgatttaggctgtggaagag

SEQ ID NO: 330535 - DNA, 75 bp, Artificial Sequence
  Synthetic
ctaaacaggaaaagcttcgacacggaataccttaagacaaagaacaacgaatgggattttgttgtgaccactgac

SEQ ID NO: 330536 - DNA, 75 bp, Artificial Sequence
  Synthetic
gagggtggagctactactgtgcaactctgaagcatgttcaagaagtgaaaggattcacaaagggtggaccgggcc

SEQ ID NO: 330537 - DNA, 75 bp, Artificial Sequence
  Synthetic
atgaagaaccgcaactcatgcaaagctatggatggaatctggttcacatgaaaagtggagtggacgtattccata

SEQ ID NO: 330538 - DNA, 75 bp, Artificial Sequence
  Synthetic
caagtgtgtgaaaccagtcatcttggaggatgatgatcgagtcatcctcaatggacccatggcaatcacatcagc

SEQ ID NO: 330539 - DNA, 75 bp, Artificial Sequence
  Synthetic
agccagctgagtcagctgacactgtgctctgtgacattggagagtcaaatccaagctgtgaggtggaggaagccc

SEQ ID NO: 330540 - DNA, 75 bp, Artificial Sequence
  Synthetic
gagcgcagcacagcgcagaggccgtattgggagaaatccttctcagattggagatgagtatcattatgggggtgc

SEQ ID NO: 330541 - DNA, 75 bp, Artificial Sequence
  Synthetic
gcacagcaagagtgttggatacggttgaggaatggttgaagaaaggggccactgagttttgcatcaaggtcttgt

SEQ ID NO: 330542 - DNA, 75 bp, Artificial Sequence
  Synthetic
aaccaatgaggacgaccatgatctggccaactggactgaagcaaagattctccttgataacatatatctcccaaa

SEQ ID NO: 330543 - DNA, 75 bp, Artificial Sequence
  Synthetic
gccaactggactgaagcaaagattctccttgataacatatatctcccaaacggactggtagcacaaatgtaccag

SEQ ID NO: 330544 - DNA, 75 bp, Artificial Sequence
  Synthetic
gtccatacatgcccaaaattattgagaggttagaaaaactgcaacggaagtatggaggtggcctagtcagagtcc

SEQ ID NO: 330545 - DNA, 75 bp, Artificial Sequence
  Synthetic
gaggttagaaaaactgcaacggaagtatggaggtggcctagtcagagtccccttgtccaggaactcgacacatga

SEQ ID NO: 330546 - DNA, 75 bp, Artificial Sequence
  Synthetic
ctgatgcgcaacggtgacctcccagtgtggttagcttacaaggtagcttctaatgggcacagttaccaggaccgt

SEQ ID NO: 330547 - DNA, 75 bp, Artificial Sequence
  Synthetic
tgtggttagcttacaaggtagcttctaatgggcacagttaccaggaccgttcatggtgtttcacgggacaaacca

SEQ ID NO: 330548 - DNA, 75 bp, Artificial Sequence
  Synthetic
tgactagccaagtgctcatggggaggatggacaaacagaacaggagtgggccacgctatgaggaagatgtgaatt

SEQ ID NO: 330549 - DNA, 75 bp, Artificial Sequence
  Synthetic
ccacgctatgaggaagatgtgaatttgggaagtggaacgcgctccgttggaaaactcacagagaagccagacctc

SEQ ID NO: 330550 - DNA, 75 bp, Artificial Sequence
  Synthetic
ggagacaggaaaattctcaggccaaagtggatggatgcgcgggtctgttgcgactaccaagcgctcaagtcattt

SEQ ID NO: 330551 - DNA, 75 bp, Artificial Sequence
  Synthetic
cggaaagttggggaaagaatacggagattgagagaagaacaccaacaaacatggacgtatgaccacaacaaccca

SEQ ID NO: 330552 - DNA, 75 bp, Artificial Sequence
  Synthetic
cgactaccaagcgctcaagtcatttaaagagtttgcagcaggaaagaggtcagcgttgggcatgatggaggtcat

SEQ ID NO: 330553 - DNA, 75 bp, Artificial Sequence
  Synthetic
cactgtatctcctaggaaccagtgaggcaaacagcagggcacacaaagaggcactggcggaactgccagactccc

SEQ ID NO: 330554 - DNA, 75 bp, Artificial Sequence
  Synthetic
atatgatcacaaacgtcaccaccatggccatgactgacaccacgccctttggcccacaatgggtgttcaaagaaa

SEQ ID NO: 330555 - DNA, 75 bp, Artificial Sequence
  Synthetic
gctatgcgtcatgtcaatgggtacgttcatttttctcatgaacaggaaaggagttggtaaaatggggctgggagc

SEQ ID NO: 330556 - DNA, 75 bp, Artificial Sequence
  Synthetic
aggttgacacaaaagctcctgaaccaccactaggagtcgctcaaatcatggacgtgacgacagactggctgtggg

SEQ ID NO: 330557 - DNA, 75 bp, Artificial Sequence
  Synthetic
gagttggtaaaatggggctgggagcatttgtgatgactcttgctacggcattgctgtgggcagcagaagttcccg

SEQ ID NO: 330558 - DNA, 75 bp, Artificial Sequence
  Synthetic
atttcgttgctcgggaaaagaaaccaagaatctgcactccagaagaattcaaagcaaaggtgaacagccacgcag

SEQ ID NO: 330559 - DNA, 75 bp, Artificial Sequence
  Synthetic
gaacgcagatagctggagttctgctgatagtgttcctattgatgattgtgttgattccagaacctgagaagcaac

SEQ ID NO: 330560 - DNA, 75 bp, Artificial Sequence
  Synthetic
ctctaggagccatgtttgaagaacagaatcagtggagcagcgcccgtgaagctgttgaagatccaaagttctggg

SEQ ID NO: 330561 - DNA, 75 bp, Artificial Sequence
  Synthetic
aaatggttgatgaagagagagaagtccatctcaaaggagagtgtcgtacatgcatctacgacatgatgggaaagc

SEQ ID NO: 330562 - DNA, 75 bp, Artificial Sequence
  Synthetic
tgcatctacgacatgatgggaaagcgtgagaagaagactggagaatttgggaaggctaaaggaagcagagctatc

SEQ ID NO: 330563 - DNA, 75 bp, Artificial Sequence
  Synthetic
tggtacatgtggctaggagctcggtttttggagtttgaggccctcggattcctaaatgaagatcactggatgagc

SEQ ID NO: 330564 - DNA, 75 bp, Artificial Sequence
  Synthetic
gcatctcatcacgacacagtatgtgaatttttcactaacagctattgcatctcaagctggtgtactgctaggttt

SEQ ID NO: 330565 - DNA, 75 bp, Artificial Sequence
  Synthetic
aatttttcactaacagctattgcatctcaagctggtgtactgctaggtttgaccaatgggatgccattcactgct

SEQ ID NO: 330566 - DNA, 75 bp, Artificial Sequence
  Synthetic
cgcgagaactcacatggaggagttgaggggaaaggactccagaaacttggatacatcctacaagaaatctcccaa

SEQ ID NO: 330567 - DNA, 75 bp, Artificial Sequence
  Synthetic
caatggtcatgacacccttgataaagcatctcatcacgacacagtatgtgaatttttcactaacagctattgcat

SEQ ID NO: 330568 - DNA, 75 bp, Artificial Sequence
  Synthetic
atggatctatcggtgccactattggtgctagggtgctggaatcaaatgaccctgccaagtttggctgttgcagtc

SEQ ID NO: 330569 - DNA, 75 bp, Artificial Sequence
  Synthetic
atcccaggaggaaagatgtacgcagatgacacagccggttgggacacccgcatcacgaaagaagacttgaaaaat

SEQ ID NO: 330570 - DNA, 75 bp, Artificial Sequence
  Synthetic
cctgccaagtttggctgttgcagtcatgctcttggctatccactatgcatttatgatcccaggctggcaggctga

SEQ ID NO: 330571 - DNA, 75 bp, Artificial Sequence
  Synthetic
gaagcaaaaataacgaaaagaatggatgaaagacacaggaagcttgcagatgcaattattagcttgacctaccgt

SEQ ID NO: 330572 - DNA, 75 bp, Artificial Sequence
  Synthetic
agcgatgagagcagcccagcggagaacagcggctggcattatgaaaaacgccatggtcgatgggattgtagcaac

SEQ ID NO: 330573 - DNA, 75 bp, Artificial Sequence
  Synthetic
acagcggctggcattatgaaaaacgccatggtcgatgggattgtagcaactgacataccagacctgtcatcggcg

SEQ ID NO: 330574 - DNA, 75 bp, Artificial Sequence
  Synthetic
cataaggtggtgaaagttatgagaccagggcctgatgggaaaacttacatggatgtcatctccagagaagaccaa

SEQ ID NO: 330575 - DNA, 75 bp, Artificial Sequence
  Synthetic
accccaatgacagagaagaaaatgggtcaaatcctgctcattgctgcagcggtgttagctgtgctcgtccggcca

SEQ ID NO: 330576 - DNA, 75 bp, Artificial Sequence
  Synthetic
agaggcagtggacaggtggtcacatacgccctgaacaccttcaccaacctggccgttcagctgataagatgcatg

SEQ ID NO: 330577 - DNA, 75 bp, Artificial Sequence
  Synthetic
gtcaaatcctgctcattgctgcagcggtgttagctgtgctcgtccggccagggatctgttcgatcaaagaatttg

SEQ ID NO: 330578 - DNA, 75 bp, Artificial Sequence
  Synthetic
gggatctgttcgatcaaagaatttggggtcttggggtcagcagcccttgtgacgctaattgaaggaacggccgga

SEQ ID NO: 330579 - DNA, 75 bp, Artificial Sequence
  Synthetic
gaagctgaagggctagtggatgaagatgatatcatgagagtgagactcggacgattggccaaggtggttgagtgg

SEQ ID NO: 330580 - DNA, 75 bp, Artificial Sequence
  Synthetic
ctaaggaagaatggacccgaacggctgagtagaatggcagtgagtggggacgattgtgttgtaaaaccaattgac

SEQ ID NO: 330581 - DNA, 75 bp, Artificial Sequence
  Synthetic
acgtggacagtctacaagaatgtggacaagcctaagggaaagcgtggaggagggaagggagccactcttggagag

SEQ ID NO: 330582 - DNA, 75 bp, Artificial Sequence
  Synthetic
gacagatttgccagcgcactccacttcctcaataacatgtcaaaaatcagaaaggacattcaggaatggaaaccc

SEQ ID NO: 330583 - DNA, 75 bp, Artificial Sequence
  Synthetic
atctggaagtcaagactgaatcagctgacacgagccgaattcatggcatacaggaaagatggaatcgtggaagta

SEQ ID NO: 330584 - DNA, 75 bp, Artificial Sequence
  Synthetic
tcaacaggctggcacaattggcaggaggtgcccttttgctcacaccacttcaatgagctaatgctgaaggatggg

SEQ ID NO: 330585 - DNA, 75 bp, Artificial Sequence
  Synthetic
cgaaccatcgtggtgccatgtaggagtcaggatgaactgattggcagagccagaatttcacctggagcaggatgg

SEQ ID NO: 330586 - DNA, 75 bp, Artificial Sequence
  Synthetic
aatgtgaaagagacagcttgcctgagcaaatcttatgctcagatgtggttactcatgtacttccataggcgggat

SEQ ID NO: 330587 - DNA, 75 bp, Artificial Sequence
  Synthetic
gcaaatcttatgctcagatgtggttactcatgtacttccataggcgggatctcaggatgatggcaaatgccatct

SEQ ID NO: 330588 - DNA, 75 bp, Artificial Sequence
  Synthetic
acagcaagagtgttggacatggttgaggaatggctgaagaaaggagccactgagttttgcataaaagtcttgtgt

SEQ ID NO: 330589 - DNA, 75 bp, Artificial Sequence
  Synthetic
ccatacatgcccaaaatcattgagaagttggaaaaactgcaacggaagtatggaggaggcctggtcagagtcccc

SEQ ID NO: 330590 - DNA, 75 bp, Artificial Sequence
  Synthetic
tgtactgggttagtggggcggctggaaacatcatacatgccgtcagcatgactagccaggtgctcatggggagga

SEQ ID NO: 330591 - DNA, 75 bp, Artificial Sequence
  Synthetic
tgacggcttggagcgacattccatacctaggaaagagagaggacatctggtgcggaagtctaattggaacaagga

SEQ ID NO: 330592 - DNA, 75 bp, Artificial Sequence
  Synthetic
cctaggaaagagagaggacatctggtgcggaagtctaattggaacaaggaccagagccacctgggctgagaacat

SEQ ID NO: 330593 - DNA, 75 bp, Artificial Sequence
  Synthetic
ggaagcggaacgcgctctgttggaaagctcacagagaagccagacctccggaaagttggggaaaggatacggaga

SEQ ID NO: 330594 - DNA, 75 bp, Artificial Sequence
  Synthetic
ttgagggaagaataccaacaaacgtggacgtatgatcacaacaacccatacagaacgtggaactatcatggaagt

SEQ ID NO: 330595 - DNA, 75 bp, Artificial Sequence
  Synthetic
gagtatagagactacatggttgcccaaaacagatttggtaaggaagaaactcatgtggtaggaggagtgctgtag

SEQ ID NO: 330596 - DNA, 75 bp, Artificial Sequence
  Synthetic
gttcgcgtcggtgagcggagaggaaacagattcttttttggaggataacaacttaacttgactgcgaacagtttt

SEQ ID NO: 330597 - DNA, 75 bp, Artificial Sequence
  Synthetic
ccgggttgtcaatatgctaaaacgcggtgtatcccgcgtgaaccccttgacggggttgaagaggatacttggaag

SEQ ID NO: 330598 - DNA, 75 bp, Artificial Sequence
  Synthetic
ggtgtatcccgcgtgaaccccttgacggggttgaagaggatacttggaagtctgctagacggccgtggacccgtg

SEQ ID NO: 330599 - DNA, 75 bp, Artificial Sequence
  Synthetic
tcaacaaagggtgttcaaagaaaaggttgacacaaaggctcctgaaccaccactaggagtcgcccagatcatgga

SEQ ID NO: 330600 - DNA, 75 bp, Artificial Sequence
  Synthetic
cggttcatattggccattctgacattcttccgatttacagctctacagccaactgaggcgctgaagcgcagatgg

SEQ ID NO: 330601 - DNA, 75 bp, Artificial Sequence
  Synthetic
gagtttgcaccccagaagaattcaaagcaaaggtgaacagccatgcagctctgggagccatgtttgaagagcaaa

SEQ ID NO: 330602 - DNA, 75 bp, Artificial Sequence
  Synthetic
aactgaggcgctgaagcgcagatggagggctgtagataaaagaacggcattgaaacacctgaacggattcaaacg

SEQ ID NO: 330603 - DNA, 75 bp, Artificial Sequence
  Synthetic
atcttaaaggagagtgtcacacatgcatctacaacatgatggggaagcgtgagaagaagactggagaatttggga

SEQ ID NO: 330604 - DNA, 75 bp, Artificial Sequence
  Synthetic
tgatcttggatctatgctagacaccatcaaccggcggccaagcaaaaagagaggagggaccggatcgttgctcgg

SEQ ID NO: 330605 - DNA, 75 bp, Artificial Sequence
  Synthetic
atcaaccggcggccaagcaaaaagagaggagggaccggatcgttgctcggactggcagcactaataggactggcg

SEQ ID NO: 330606 - DNA, 75 bp, Artificial Sequence
  Synthetic
aggctaaaggaagcagagccatttggtacatgtggttgggagctcggttcttggagtttgaagccctcgggttcc

SEQ ID NO: 330607 - DNA, 75 bp, Artificial Sequence
  Synthetic
caagactgacgcccaaagcgccataaacattcccagtgccaacggagcaaacacttgcattgtgagagctctaga

SEQ ID NO: 330608 - DNA, 75 bp, Artificial Sequence
  Synthetic
aacattcccagtgccaacggagcaaacacttgcattgtgagagctctagatgtgggggtcatgtgcaaagatgat

SEQ ID NO: 330609 - DNA, 75 bp, Artificial Sequence
  Synthetic
gggaaaggactccagaaactcggatacatcctgcaagaaatctcccaaattccaggaggaaagatgtacgcagat

SEQ ID NO: 330610 - DNA, 75 bp, Artificial Sequence
  Synthetic
agcaaaaataacaaagagaatggaagaaaggcatagaaagcttgcagaggcaatcattgatctaacctaccgcca

SEQ ID NO: 330611 - DNA, 75 bp, Artificial Sequence
  Synthetic
atcacatacctgtgcccagtgctttcagcgggaaacgatcctgaggacattgactgttggtgtgatgttgaagaa

SEQ ID NO: 330612 - DNA, 75 bp, Artificial Sequence
  Synthetic
tcggcggtcaatttctgtgcagcatcacggagactccacactggcaacaaagaacacgccatggctagacaccgt

SEQ ID NO: 330613 - DNA, 75 bp, Artificial Sequence
  Synthetic
agctgaaggggtggtagatgaggatgacatcacgagagtgagactcggacgattggccaaagcggttgagtggct

SEQ ID NO: 330614 - DNA, 75 bp, Artificial Sequence
  Synthetic
agaacacgccatggctagacaccgtgaaaaccactaagtacttgacaaaagtcgaaaactgggttctgcgcaatc

SEQ ID NO: 330615 - DNA, 75 bp, Artificial Sequence
  Synthetic
gacatcacgagagtgagactcggacgattggccaaagcggttgagtggctgaggaagaatggatctgaacgattg

SEQ ID NO: 330616 - DNA, 75 bp, Artificial Sequence
  Synthetic
ctcaataacatgtcaaagatcagaaaggacattcaggaatggaaaccttcaacaggctggcacaattggcaagag

SEQ ID NO: 330617 - DNA, 75 bp, Artificial Sequence
  Synthetic
aggacattcaggaatggaaaccttcaacaggctggcacaattggcaagaggtgcccttctgctcacatcacttca

SEQ ID NO: 330618 - DNA, 75 bp, Artificial Sequence
  Synthetic
ccagcggggcaacatggattgacttggtacttgaaggaggaagctgtgtcacagtgatggcaccagagaaaccaa

SEQ ID NO: 330619 - DNA, 75 bp, Artificial Sequence
  Synthetic
aacaggctggcacaattggcaagaggtgcccttctgctcacatcacttcaatgagctaatgctgaaggatgggcg

SEQ ID NO: 330620 - DNA, 75 bp, Artificial Sequence
  Synthetic
cgtgagtattgctacgaagcaaccttggacacgctgtcaacagtggcaagatgtcccacaacgggagaagctcac

SEQ ID NO: 330621 - DNA, 75 bp, Artificial Sequence
  Synthetic
aacaccaagaggagtgacctaacattcgtctgcaaaagagatgttgtagaccgtggatggggtaacggatgtggt

SEQ ID NO: 330622 - DNA, 75 bp, Artificial Sequence
  Synthetic
tcagctgtcccagtcaactgggtcccaactggacgtaccacatggtcaatccatgggaagggtgagtggatgaca

SEQ ID NO: 330623 - DNA, 75 bp, Artificial Sequence
  Synthetic
acagaagacatgttgagtgtctggaaccgtgtgtggattgaagaaaatgaatatatgaaagacaaaacaccattg

SEQ ID NO: 330624 - DNA, 75 bp, Artificial Sequence
  Synthetic
ctccacgtcacacggcaactactctgagcaaattgggaaaaaccaagcggctagattcaccataagcccacaagc

SEQ ID NO: 330625 - DNA, 75 bp, Artificial Sequence
  Synthetic
acgctccaatcatgcagatccgcaacctcatcggggaagaagagtacagagactacatggttgcccaaaatagat

SEQ ID NO: 330626 - DNA, 75 bp, Artificial Sequence
  Synthetic
accatctttcacggccaacatgggtgaatatggaacagtcaccattgactgtgaagcaagatcaggaatcaacac

SEQ ID NO: 330627 - DNA, 75 bp, Artificial Sequence
  Synthetic
agaagactattatgtcttcacagtcaaggagaagtcatggctagtgaatagggactggtttcacgatctgaacct

SEQ ID NO: 330628 - DNA, 75 bp, Artificial Sequence
  Synthetic
tccatggacgagccctgccacaactgattggcgcaacagagaaacactggtggaatttgaagaaccacatgccac

SEQ ID NO: 330629 - DNA, 75 bp, Artificial Sequence
  Synthetic
tgccacctgaaagcatgctaaaggtgctgtctgtacatgccccaggaggactgggttaacaaagcttaacagccc

SEQ ID NO: 330630 - DNA, 75 bp, Artificial Sequence
  Synthetic
tgttagcagctccaccttaaccttgcaatcagggcacttgaagtgcagagccaagcttgacaaggtcaaaatcaa

SEQ ID NO: 330631 - DNA, 75 bp, Artificial Sequence
  Synthetic
ccaagcttgacaaggtcaaaatcaaaggaacaacatatggcatgtgtgactctgcgttcaccttcagtaagaacc

SEQ ID NO: 330632 - DNA, 75 bp, Artificial Sequence
  Synthetic
cagctgacacagggcatgggacagtgattgtggaactgcagtacactggaagcaacggaccctgtcgggttccca

SEQ ID NO: 330633 - DNA, 75 bp, Artificial Sequence
  Synthetic
agatgttcgcgtcggtgagcgaagaggaaacagatttcttttttggaggataacaacttaacttgattgcgaaca

SEQ ID NO: 330634 - DNA, 75 bp, Artificial Sequence
  Synthetic
ggggagcgaacaacaaggtcatgatcgaagttgagccacccttcggcgattcttacatcgtcgtcggaagaggca

SEQ ID NO: 330635 - DNA, 75 bp, Artificial Sequence
  Synthetic
ccacccaaatcaactacaactggcacaaagagggaagcagcattgggaaggctttggcgactacatggaaaggag

SEQ ID NO: 330636 - DNA, 75 bp, Artificial Sequence
  Synthetic
ccacccaaatcaactactactggcacaaagagggaagcagcattgggaaggctttggcgactacatggaaaggag

SEQ ID NO: 330637 - DNA, 75 bp, Artificial Sequence
  Synthetic
ccacccaaatcaactaccactggcacaaagagggaagcagcattgggaaggctttggcgactacatggaaaggag

SEQ ID NO: 330638 - DNA, 75 bp, Artificial Sequence
  Synthetic
ccacccaaatcaactacgactggcacaaagagggaagcagcattgggaaggctttggcgactacatggaaaggag

SEQ ID NO: 330639 - DNA, 75 bp, Artificial Sequence
  Synthetic
aagctgtccaccaagtttttggaggggcatttaggaccctgttcgggggaatgtcctggatcacacagggattgc

SEQ ID NO: 330640 - DNA, 75 bp, Artificial Sequence
  Synthetic
aaacgtgatctcggatccatgctggacaccattaaccggcggccaagcaaaaagagaggagggaccggatctctg

SEQ ID NO: 330641 - DNA, 75 bp, Artificial Sequence
  Synthetic
ttggagcccttctcttatggatggggttgcaggcccgcgacaggagcatctcgttgaccttactggctgttggag

SEQ ID NO: 330642 - DNA, 75 bp, Artificial Sequence
  Synthetic
gttgcaggcccgcgacaggagcatctcgttgaccttactggctgttggagggattctaatctttctagcgaccag

SEQ ID NO: 330643 - DNA, 75 bp, Artificial Sequence
  Synthetic
cttggattggctgcgctaattggactggcgagttcactgcaattgtcaacctatcaggggaaagtgttagtgtca

SEQ ID NO: 330644 - DNA, 75 bp, Artificial Sequence
  Synthetic
cgtgcaagctgattcgggatgtgcaattgacctgcaacgacgtgaattgaaatgcggaggaggcatcttcgtgta

SEQ ID NO: 330645 - DNA, 75 bp, Artificial Sequence
  Synthetic
ataaacaagaccgacgcccaaagcgctattaacattcccagtgccaacggagcaaacacctgcgttgtgagggct

SEQ ID NO: 330646 - DNA, 75 bp, Artificial Sequence
  Synthetic
caatgacgtcgagaagtggaagagtgactacaagtattttcccttgactccaactgggctcgcgcgcgtgattca

SEQ ID NO: 330647 - DNA, 75 bp, Artificial Sequence
  Synthetic
ctagatgtgggggtcatgtgcaaagatgatattacatacctttgcccagttctttcagcgggaaatgatcccgag

SEQ ID NO: 330648 - DNA, 75 bp, Artificial Sequence
  Synthetic
agaggcgcacgccaatggcatctgtggcatcagatcgacgtcacgtttggagcatttgatgtgggagaacataca

SEQ ID NO: 330649 - DNA, 75 bp, Artificial Sequence
  Synthetic
gacattgactgttggtgtgatgttgaagaggtgtgggtgcattacggcagatgcacgcgcatgggacattcaagg

SEQ ID NO: 330650 - DNA, 75 bp, Artificial Sequence
  Synthetic
cgtagccgacggtcaatttctgtgcagcaccacggagactccacactggcaacaaagaacacgccatggttggac

SEQ ID NO: 330651 - DNA, 75 bp, Artificial Sequence
  Synthetic
tagtgcaggaagatcccaaatactacaaaagagctccccaacgcttgaagaaactggaggatgagctggattacg

SEQ ID NO: 330652 - DNA, 75 bp, Artificial Sequence
  Synthetic
gatggaagaaatggggaaaaaccctgttcatggaacctaaacttggaaacaacacatttgttgttgatggaccag

SEQ ID NO: 330653 - DNA, 75 bp, Artificial Sequence
  Synthetic
caatcctggatatgccctagttgcactagcgatcggatggatgctgggtagcaacaacacacagagagtggtctt

SEQ ID NO: 330654 - DNA, 75 bp, Artificial Sequence
  Synthetic
aacacatttgttgttgatggaccagaaactaaggaatgtccaacagcaaacagagcatggaatagtttcaaggtg

SEQ ID NO: 330655 - DNA, 75 bp, Artificial Sequence
  Synthetic
tgtgatcatgctgatgttgattgccccggcatacagctttaactgtctgggaacatcaaacagggacttcgtcga

SEQ ID NO: 330656 - DNA, 75 bp, Artificial Sequence
  Synthetic
ccggcatacagctttaactgtctgggaacatcaaacagggacttcgtcgaaggagccagcggggcaacatggatt

SEQ ID NO: 330657 - DNA, 75 bp, Artificial Sequence
  Synthetic
aaggagatagagctgttcacagtgacctatcatattggattgagagcaagaagaatgaaacatggcagctggaac

SEQ ID NO: 330658 - DNA, 75 bp, Artificial Sequence
  Synthetic
gacttggtacttgaaggaggaagctgtgtcacagtaatggcaccagagaaaccaacactggacttcaaagtgatg

SEQ ID NO: 330659 - DNA, 75 bp, Artificial Sequence
  Synthetic
gagctgttatgggagaagtgaaatcttgcacctggccagaaacgcacactctgtggggtgatggcgttgttgaga

SEQ ID NO: 330660 - DNA, 75 bp, Artificial Sequence
  Synthetic
aagatggaggccacggagttagccactgtgcgtgagtattgctacgaggcatccctagacacgctgtcaacagtg

SEQ ID NO: 330661 - DNA, 75 bp, Artificial Sequence
  Synthetic
gcgaaatgattattccggtgacattaggaggccccaaaagccatcataacaagagaactggataccacacacaga

SEQ ID NO: 330662 - DNA, 75 bp, Artificial Sequence
  Synthetic
aggaggccccaaaagccatcataacaagagaactggataccacacacagacaaaaggaccttggagtgaaggaga

SEQ ID NO: 330663 - DNA, 75 bp, Artificial Sequence
  Synthetic
aacatttgtctgcaaaagagatgttgtggaccgtggatggggtaacggatgtggtttgtttggaaaaggaagcat

SEQ ID NO: 330664 - DNA, 75 bp, Artificial Sequence
  Synthetic
gtggaccgtggatggggtaacggatgtggtttgtttggaaaaggaagcattgacacgtgcgcaaagtttacatgc

SEQ ID NO: 330665 - DNA, 75 bp, Artificial Sequence
  Synthetic
aataaccttggactttgactattgcccaggaacaacagtcactgtcactgaacattgtggaaacaggggagcatc

SEQ ID NO: 330666 - DNA, 75 bp, Artificial Sequence
  Synthetic
aaaaacaaggcaacagggaagacaatcctgagggaaaacatcaagtacgaggttgcaattttcgtgcatggctca

SEQ ID NO: 330667 - DNA, 75 bp, Artificial Sequence
  Synthetic
actgactccacgtcacatggcaattactctgagcaaattgggaaaaatcaagcagctagattcaccattagcccg

SEQ ID NO: 330668 - DNA, 75 bp, Artificial Sequence
  Synthetic
caagcaccgtctttcacggctaacatgggcgagtatgggacagtcactattgattgtgaggcaagatcaggaatc

SEQ ID NO: 330669 - DNA, 75 bp, Artificial Sequence
  Synthetic
ggggggatggaaccattccaacttggtctcttggtagcattcatagccacccaagaagtgctgaaacgcagatgg

SEQ ID NO: 330670 - DNA, 75 bp, Artificial Sequence
  Synthetic
aacacagaggactattatgtcttcacagttaaggagaagtcatggctagtaaacagggattggtttcacgacttg

SEQ ID NO: 330671 - DNA, 75 bp, Artificial Sequence
  Synthetic
cagttaaggagaagtcatggctagtaaacagggattggtttcacgacttgaaccttccatggacgagccctgcta

SEQ ID NO: 330672 - DNA, 75 bp, Artificial Sequence
  Synthetic
tggcggtatgcttggcactattaatttttggaaacctaacatacatggatctggtgcggtacctggtccttgttg

SEQ ID NO: 330673 - DNA, 75 bp, Artificial Sequence
  Synthetic
gccaccaagcaaactgtggtcgccttaggctcgcaagaaggtgctctgcacacagcactagccggggccattcca

SEQ ID NO: 330674 - DNA, 75 bp, Artificial Sequence
  Synthetic
gaaccgctttcgcggaaatgaacaccggaggcgatgtgatccatctggcgcttgttgctgtcttcaaagtgcaac

SEQ ID NO: 330675 - DNA, 75 bp, Artificial Sequence
  Synthetic
taggctcgcaagaaggtgctctgcacacagcactagccggggccattccagccactgttagcagctccaccttaa

SEQ ID NO: 330676 - DNA, 75 bp, Artificial Sequence
  Synthetic
cagcattcttagcaggtctgttcttgaggatgcagtggagtaaccaggaaaacatcttgatggttattggagcag

SEQ ID NO: 330677 - DNA, 75 bp, Artificial Sequence
  Synthetic
ccttgcaatcagggcacttgaagtgcagagccaagcttgacaaggttaaaatcaaggggacgacatatggtatgt

SEQ ID NO: 330678 - DNA, 75 bp, Artificial Sequence
  Synthetic
ccttccttcaaatggcagccaacgacctgaaacttgaggtccttccgattctcaatgccatgtccattgcgtgga

SEQ ID NO: 330679 - DNA, 75 bp, Artificial Sequence
  Synthetic
gtgactctgctttcaccttcagcaagaaccctgctgacacagggcatgggacagtgatcgtggaactgcagtaca

SEQ ID NO: 330680 - DNA, 75 bp, Artificial Sequence
  Synthetic
tgctaataagggcaatgaaagaaggcaaagtggcgatgtacgctcttcccatcttgtgtgctctgactccaggaa

SEQ ID NO: 330681 - DNA, 75 bp, Artificial Sequence
  Synthetic
ctggaagcaacggaccatgccgggttcccatttctgtgactgcaaacctcatggacttgacaccggttggaagac

SEQ ID NO: 330682 - DNA, 75 bp, Artificial Sequence
  Synthetic
tgagaatggctgggcttgacgtcctcagatgcctgttgctgataattggtattgtgacacttctgaatgaaagaa

SEQ ID NO: 330683 - DNA, 75 bp, Artificial Sequence
  Synthetic
tggtcacggtcaatccctttattagcacagggggagcgaacaacaaggtcatgatcgaagttgaaccaccctttg

SEQ ID NO: 330684 - DNA, 75 bp, Artificial Sequence
  Synthetic
atgatcgaagttgaaccaccctttggcgactcttacatcgtcgtcggaagaggcaccacccagatcaactaccac

SEQ ID NO: 330685 - DNA, 75 bp, Artificial Sequence
  Synthetic
tggcacaaagagggaagcagcattgggaaggctttggcaaccacatggaaaggagcccaacggctagccgttttg

SEQ ID NO: 330686 - DNA, 75 bp, Artificial Sequence
  Synthetic
tgatcatgatgggaggcctgattttggctcaccctaatgggaaaaggagttggccagcgagtgaggtcttgaccg

SEQ ID NO: 330687 - DNA, 75 bp, Artificial Sequence
  Synthetic
ggggacacagcgtgggacttcggatccattggaggagttttcaattcaatcggcaaagctgtccaccaagtcttt

SEQ ID NO: 330688 - DNA, 75 bp, Artificial Sequence
  Synthetic
cggcaaagctgtccaccaagtctttggaggggcgttcaggaccctgttcgggggaatgtcctggattacacaggg

SEQ ID NO: 330689 - DNA, 75 bp, Artificial Sequence
  Synthetic
caccgtctcgggaaaggccgcagaaatgtggattgagaaagcagctgacatcacatgggaacaaaatgctgagat

SEQ ID NO: 330690 - DNA, 75 bp, Artificial Sequence
  Synthetic
atgtggattgagaaagcagctgacatcacatgggaacaaaatgctgagatcaccggaaccagccccaggcttgat

SEQ ID NO: 330691 - DNA, 75 bp, Artificial Sequence
  Synthetic
gcatttcgctgactctactggctgttggagggattcttatctttctggcgaccagcgtgcaagctgattcgggat

SEQ ID NO: 330692 - DNA, 75 bp, Artificial Sequence
  Synthetic
accagcgtgcaagctgattcgggatgtgcaattgacctgcaacgacgtgaattgaaatgtggaggaggcatcttc

SEQ ID NO: 330693 - DNA, 75 bp, Artificial Sequence
  Synthetic
gtgcaattgacctgcaacgacgtgaattgaaatgtggaggaggcatcttcgtgtacaacgacgttgagaagtgga

SEQ ID NO: 330694 - DNA, 75 bp, Artificial Sequence
  Synthetic
ttcatactcttgggcttgagtgcacggtttcactggtttattccatttggagtattggggttttggttgcttgga

SEQ ID NO: 330695 - DNA, 75 bp, Artificial Sequence
  Synthetic
agagtgactacaagtactttcccttgactccaactggacttgcgcgtgtgattcaagaggcgcatgccaatggca

SEQ ID NO: 330696 - DNA, 75 bp, Artificial Sequence
  Synthetic
aaacactcgaagcgaggaggagcattgtgggacgtgccatcaccaaaagtctatccaaaatgtgagacaaaacca

SEQ ID NO: 330697 - DNA, 75 bp, Artificial Sequence
  Synthetic
tgtgggacgtgccatcaccaaaagtctatccaaaatgtgagacaaaaccaggaatctatcggattatgaccagag

SEQ ID NO: 330698 - DNA, 75 bp, Artificial Sequence
  Synthetic
tctgtggcatccgatcgacgtcacgtttggagcacttaatgtgggagaacatacagaaagagctaaacgcgatct

SEQ ID NO: 330699 - DNA, 75 bp, Artificial Sequence
  Synthetic
gaatcctgggcacgtttcaagctggagttggtgtgatgcatgaaggagttttccacacaatgtggcacgcaactg

SEQ ID NO: 330700 - DNA, 75 bp, Artificial Sequence
  Synthetic
ttgaagacaatgaaattgacttgtcagttgtagtgcaggaagatcccaaatactacaaaagggctccccgacgcc

SEQ ID NO: 330701 - DNA, 75 bp, Artificial Sequence
  Synthetic
aaggggcagtcttgcgaaacggagaagggagactagatccgtatgcaggagacgtccggaatgacctgatctcgt

SEQ ID NO: 330702 - DNA, 75 bp, Artificial Sequence
  Synthetic
tgaagaagctggaagatgagctggactacggatggaaaaaatggggaaaaaccctgttcatggaacccaaacttg

SEQ ID NO: 330703 - DNA, 75 bp, Artificial Sequence
  Synthetic
ctacggatggaaaaaatggggaaaaaccctgttcatggaacccaaacttggaaacaacacatttgttgttgatgg

SEQ ID NO: 330704 - DNA, 75 bp, Artificial Sequence
  Synthetic
atggaggtccctggaaactgagtgccacttgggacgggattgaggaagtccaaatgattgcagtagctccaggaa

SEQ ID NO: 330705 - DNA, 75 bp, Artificial Sequence
  Synthetic
aaccagccatcaatgttcagacaacaccaggagtgttcaagaccccatttgggaccattggagctgtgactcttg

SEQ ID NO: 330706 - DNA, 75 bp, Artificial Sequence
  Synthetic
aggtggaagactttggatttggcatggtgttcacgcgattgtggctcacaatccgggaggaaaacacaacagaat

SEQ ID NO: 330707 - DNA, 75 bp, Artificial Sequence
  Synthetic
atttcccaaaaggaacatcaggttctccaatcatcaacaagaaaggggaaatcattgggctctatggaaatgggg

SEQ ID NO: 330708 - DNA, 75 bp, Artificial Sequence
  Synthetic
ctatataaccaagtggggtggcgaatggctgagtttaccccgctagacggtgcagggaccggatcgagcgcagcg

SEQ ID NO: 330709 - DNA, 75 bp, Artificial Sequence
  Synthetic
aggaggtcccaggctgcccatgggcgggagcccgaggtgagtgaaaccaccgaggtctaggggcaattcgggcta

SEQ ID NO: 330710 - DNA, 75 bp, Artificial Sequence
  Synthetic
gggcagtctagcggaacgggcaagaaacttaaatatattttatttcagatgctgtgtgccaaagactacttcacc

SEQ ID NO: 330711 - DNA, 75 bp, Artificial Sequence
  Synthetic
caaacagactacaatactgaaaccaaaaatcaactatggatgtcaatgatagctgattctcatgatattcactgc

SEQ ID NO: 330712 - DNA, 75 bp, Artificial Sequence
  Synthetic
aaatgccacactccatttgcacaccttttggcaagtatttttccaccaggtcacagtgacagagaactaactatt

SEQ ID NO: 330713 - DNA, 75 bp, Artificial Sequence
  Synthetic
aaccaaattcttaccagagacttcaaggaactaagatgcctttctggtggaggaggagaaaaaggttttggaaaa

SEQ ID NO: 330714 - DNA, 75 bp, Artificial Sequence
  Synthetic
gaagaaacccatacttcaagagaaagaattacagaaaaagaaaacctatacgtagaagacgaagaactaagagaa

SEQ ID NO: 330715 - DNA, 75 bp, Artificial Sequence
  Synthetic
ttcatcgccgccgcagaagacgccgccggtacaaggtaagaagaaaaaaacaaaaaattcctatctatcaatggc

SEQ ID NO: 330716 - DNA, 75 bp, Artificial Sequence
  Synthetic
aaccagactctattagaaaatgtaaaattaaaggtgttggagttctagtactaggagcacatggaaaacaatttg

SEQ ID NO: 330717 - DNA, 75 bp, Artificial Sequence
  Synthetic
tatgctatactgatgtgcagcaaaaagcaccacctcccagatcacctggaggaggaggttttgcctgccaacagt

SEQ ID NO: 330718 - DNA, 75 bp, Artificial Sequence
  Synthetic
tcagtctccagctactatatgaacaatacaaatttagaaacaatatctggactcatactaatataaactatgacc

SEQ ID NO: 330719 - DNA, 75 bp, Artificial Sequence
  Synthetic
ttgtgagatatataagaactgtctttactttttacagacactcagacatagactttattataacatatgacagac

SEQ ID NO: 330720 - DNA, 75 bp, Artificial Sequence
  Synthetic
aaccaccatttatattagataagcttacatatccactatgtcacccacaaacttactgctaggtaaacacaaaat

SEQ ID NO: 330721 - DNA, 75 bp, Artificial Sequence
  Synthetic
tttaatacttagtaaaaacacaaaaccaaatggaaaactaaaaaagagagtagtcattaaacctccaaagcaaat

SEQ ID NO: 330722 - DNA, 75 bp, Artificial Sequence
  Synthetic
gctaacaaaatggttttttcaagagcaattctccaatgctcctttactaagcttaagagcagcagcttgcagctt

SEQ ID NO: 330723 - DNA, 75 bp, Artificial Sequence
  Synthetic
tacatacccacatatcagcccactagcacaaaaccaagtgttaactttctcttgtttaaacccaggattttatca

SEQ ID NO: 330724 - DNA, 75 bp, Artificial Sequence
  Synthetic
acagggcaactgggcttatgctcaagcccaaaccagtccatattcaccatatattggcatacctagaaatttagt

SEQ ID NO: 330725 - DNA, 75 bp, Artificial Sequence
  Synthetic
attctgggatgtaacacaaagagaagtagtagaggccaaaaaacaaacagacacatgggaagcttataaaaagaa

SEQ ID NO: 330726 - DNA, 75 bp, Artificial Sequence
  Synthetic
acactgcttccaacctaatatacactcctatgatgattctattagctataaacaaggatactttagtacaaaagt

SEQ ID NO: 330727 - DNA, 75 bp, Artificial Sequence
  Synthetic
tcttacagctaaatttgtaggcagagacacagaagacctcactggcattgccaacacaccactaaacatatgtag

SEQ ID NO: 330728 - DNA, 75 bp, Artificial Sequence
  Synthetic
atataatcctaacatagacacaggcaaaggaaacatagcttggctacacagcaacctaactacatcatatgacaa

SEQ ID NO: 330729 - DNA, 75 bp, Artificial Sequence
  Synthetic
acccacatcagaccaagacattataattcaaggaatgccaatatggatgatgctatatggctggttaagctgggt

SEQ ID NO: 330730 - DNA, 75 bp, Artificial Sequence
  Synthetic
acaacatgttaaaacagctccagatttttacttatcatacacactatgtcttcaaagtcctgcactagaagtagc

SEQ ID NO: 330731 - DNA, 75 bp, Artificial Sequence
  Synthetic
aacaaaaggaacaaccatactaccagttattccattagataatacttttataaaaggaaatgcaccatacaacca

SEQ ID NO: 330732 - DNA, 75 bp, Artificial Sequence
  Synthetic
aatactaaccaacaaagactacacacactggtacccagacatatacaaccaaacagaaatcataaacagctttgt

SEQ ID NO: 330733 - DNA, 75 bp, Artificial Sequence
  Synthetic
aacttcaggaccctatgtaccaaagcttgaaaatgttacaaacagttcttgggaactccactattcatataactt

SEQ ID NO: 330734 - DNA, 75 bp, Artificial Sequence
  Synthetic
tctttttaagtggggaggacctgaacaaactgaaacaccagttgcagacccatccaaacaaccagtatatgatgc

SEQ ID NO: 330735 - DNA, 75 bp, Artificial Sequence
  Synthetic
cctcgataaacagcaacaaacaatacaaattaggaacccagcaaaacaaaaatatgctaccattatgcatccctg

SEQ ID NO: 330736 - DNA, 75 bp, Artificial Sequence
  Synthetic
ggatgtcagaaggggaatcattacaaacaaagctcttaaaagaatgtatgaaaacctctcaattgattcaacttt

SEQ ID NO: 330737 - DNA, 75 bp, Artificial Sequence
  Synthetic
cgaagcagatagcactacctccaaaaaaaggagagttacaggcccttgctttacagccctccaagaaatcaacca

SEQ ID NO: 330738 - DNA, 75 bp, Artificial Sequence
  Synthetic
agaagaaacatcatgtctccaggagctctgcaaagaaaatatcttccaagaaacgccgcaagaggaaaacctcca

SEQ ID NO: 330739 - DNA, 75 bp, Artificial Sequence
  Synthetic
gcagctcatcctccagcagcagcaacagcagcaagacatcaaatacaacctcctcaaattaatatcctacatgaa

SEQ ID NO: 330740 - DNA, 75 bp, Artificial Sequence
  Synthetic
agaacaacaaaacatgttaaaacttcacacaggaatgttaccctaacccgctttgctccaggctttgaacaagaa

SEQ ID NO: 330741 - DNA, 75 bp, Artificial Sequence
  Synthetic
acagaaagagacttagctattgcctttaaaagacccatgagaacctttaaagaagacacccccttttacccctgg

SEQ ID NO: 330742 - DNA, 75 bp, Artificial Sequence
  Synthetic
ttaccaccagaacccactgtaaattttcaccttaatttcaaattaaaacctgccacgtcacagtaagtgggagga

SEQ ID NO: 330743 - DNA, 75 bp, Artificial Sequence
  Synthetic
aacccactgtaaattttcaccttaatttcaaattaaaacctgccacgtcacagtaagtgggaggagactttaaaa

SEQ ID NO: 330744 - DNA, 75 bp, Artificial Sequence
  Synthetic
accagagggaaaattcagaagggtcgttctcgatagaggaaggtcctgatattgtgagcccggaagtggcaaggc

SEQ ID NO: 330745 - DNA, 75 bp, Artificial Sequence
  Synthetic
ccacaataagttcatctttgattcagatcctttagacaaagatcaaattgaggtaattgataatgtcatgattca

SEQ ID NO: 330746 - DNA, 75 bp, Artificial Sequence
  Synthetic
tcggagtcgaaatcgactttgagcttgttcttccggagcctctgacttgcctgatttcataagtcagcctttctc

SEQ ID NO: 330747 - DNA, 75 bp, Artificial Sequence
  Synthetic
gtcacgtttatgtggaattgattgtttaacgatagaagaaagaatcccactgcttgcacacctaatttcattgca

SEQ ID NO: 330748 - DNA, 75 bp, Artificial Sequence
  Synthetic
tgttgttggaagccatggcgtccatattcagagcacttgaacaattcactcttgatcaggatggaggggggagag

SEQ ID NO: 330749 - DNA, 75 bp, Artificial Sequence
  Synthetic
atttgctcatacgctgactggactagatgagtcaacatcactcattaatgatgctgtggtagatgctgattattc

SEQ ID NO: 330750 - DNA, 75 bp, Artificial Sequence
  Synthetic
ggggattcgctgaccagccgcctgagacattgcaggcaactatcaaagtctttgtcatcaatactcctgatccaa

SEQ ID NO: 330751 - DNA, 75 bp, Artificial Sequence
  Synthetic
agcaaactggatcagcgagtgcctgaatacatatttagataaagtattctattatactgcctggaatataatgct

SEQ ID NO: 330752 - DNA, 75 bp, Artificial Sequence
  Synthetic
atcttcgctatagaatgatgtgcttttgcttgcgcttagtagttagtaattcggcaagaactgggcagagacatg

SEQ ID NO: 330753 - DNA, 75 bp, Artificial Sequence
  Synthetic
ggacttggcataccagatgtactacatgaggattatagggcttcattccataattgactacctaaacatagtttt

SEQ ID NO: 330754 - DNA, 75 bp, Artificial Sequence
  Synthetic
gagcactcatgacactgcttagcttgcccactgcagtgatgcagaatcattttaggactgctgaacgctcacctg

SEQ ID NO: 330755 - DNA, 75 bp, Artificial Sequence
  Synthetic
aactaggatcccagggttggcactgactggtatatcatcaactatcaatcatcccaaaatcttaagacgactcat

SEQ ID NO: 330756 - DNA, 75 bp, Artificial Sequence
  Synthetic
actgccaaatcgaaagaattgaggtcgatggattcgaaccgggaacataccgcatcaggcccaatgcaagaacac

SEQ ID NO: 330757 - DNA, 75 bp, Artificial Sequence
  Synthetic
aaacttgggaattctagtcccaaagaactccccctatcttgcaacactgaactatcataagcttgcaacagaagc

SEQ ID NO: 330758 - DNA, 75 bp, Artificial Sequence
  Synthetic
cgctgacagtaggggaggttgttgctcttgaagaaatggcagatgatatcccagaggcattggctaataacaccc

SEQ ID NO: 330759 - DNA, 75 bp, Artificial Sequence
  Synthetic
aataatgtggggagcgcaccaggctctagcagacatcaggactggagttgatattgaacttataataccatctga

SEQ ID NO: 330760 - DNA, 75 bp, Artificial Sequence
  Synthetic
cttttattgatgccaacaccgagatggaagactgtgatgaaactgagaaattcttagaggcaatttacagcaccc

SEQ ID NO: 330761 - DNA, 75 bp, Artificial Sequence
  Synthetic
agatagtacagaattgtctgatagaacactgaacctagttgcaaggaagttaactctaatagcaattgctattgc

SEQ ID NO: 330762 - DNA, 75 bp, Artificial Sequence
  Synthetic
ttatccaagtttggatcatggtgtgcaaaagcatgaccaactttgaccagcctaccgggtcagacgaacgcagag

SEQ ID NO: 330763 - DNA, 75 bp, Artificial Sequence
  Synthetic
agataatccaaatttgccttacgtgaggggtttagctcctgatcagaagtgcaaggtactcactgaatacctact

SEQ ID NO: 330764 - DNA, 75 bp, Artificial Sequence
  Synthetic
ttgcaaaataccagcaacaaggtaggctgaaccagcattacctgttgcagggagaggtaaggcgaagaatacagg

SEQ ID NO: 330765 - DNA, 75 bp, Artificial Sequence
  Synthetic
agtccaggtgaagcttttaactgctgaaccagagaagcttgctatgtggaagacagtaatctgtgagccaaaaat

SEQ ID NO: 330766 - DNA, 75 bp, Artificial Sequence
  Synthetic
tagcaataagagagagtcttccaatcagacaatttttagtcaatgagctccagattgcaagcaaccagggaccca

SEQ ID NO: 330767 - DNA, 75 bp, Artificial Sequence
  Synthetic
gtctgcattccctcacaacctgtactatttaactagaaagattttgaattcgataagggaatcaccactggggca

SEQ ID NO: 330768 - DNA, 75 bp, Artificial Sequence
  Synthetic
ttacaggcaagtactatgctatggttgcagacattggtaaatatattatgaatgcaggaatgggaggcttcttca

SEQ ID NO: 330769 - DNA, 75 bp, Artificial Sequence
  Synthetic
gaccttaatagatcaattttatagcagttttggttttttagagtcagacccaaacatgaccttaatgaatctggc

SEQ ID NO: 330770 - DNA, 75 bp, Artificial Sequence
  Synthetic
tgacaattaggtttgctttgggacaaaaatggccaccgttagctcttgctgcattctcaggtgagattgtcaaga

SEQ ID NO: 330771 - DNA, 75 bp, Artificial Sequence
  Synthetic
atcaaatttgggcggtgaatttcagagtctaactgtgttcgatgtctccaaggatatttataaggagtcagatga

SEQ ID NO: 330772 - DNA, 75 bp, Artificial Sequence
  Synthetic
ttaaaagtctcatgttacagtatagaaggttgggtgagagggccaagtatatggctcttttggagatgtcagaaa

SEQ ID NO: 330773 - DNA, 75 bp, Artificial Sequence
  Synthetic
taacgagagataccactatccattcctgagccaggactcagtggatcagaccgcaaaatttgcagccccgcctac

SEQ ID NO: 330774 - DNA, 75 bp, Artificial Sequence
  Synthetic
tgatggattttgcagcagcaaatttcccactcctatacagttatgcaatgggaatcggaagtgtccaagatcctc

SEQ ID NO: 330775 - DNA, 75 bp, Artificial Sequence
  Synthetic
gcatcatatattgaggcccattggactctcctccacctcttggtacaaaggaatttcaataatcaattatttggc

SEQ ID NO: 330776 - DNA, 75 bp, Artificial Sequence
  Synthetic
aaatgcgaggctatgcatttggcagaccttacttgaatgctgcattttaccaattgggggttgagactgccaatc

SEQ ID NO: 330777 - DNA, 75 bp, Artificial Sequence
  Synthetic
aaataaaagagttcccctgggcaatcatctttatctggcagagggtagtggggcactaatgaccataattgaagc

SEQ ID NO: 330778 - DNA, 75 bp, Artificial Sequence
  Synthetic
agcagcaaggctcagtggacaaggagatggcagaagagttgggactcaccgaagcagacaagcgggcaatggcgg

SEQ ID NO: 330779 - DNA, 75 bp, Artificial Sequence
  Synthetic
ttactatccaggagagaagatatattacaacagcttcttctcaagcggccaatgcccccctcagagaaacttcca

SEQ ID NO: 330780 - DNA, 75 bp, Artificial Sequence
  Synthetic
ccactgttgcacgactcacaacaggaagaggacaacaaggaggcaacattggggtcaatgcaatggctcggagag

SEQ ID NO: 330781 - DNA, 75 bp, Artificial Sequence
  Synthetic
acctcttcccacacaattcactgagagtatcatctatcaacatctaattaataatattccttgtgaattgggctt

SEQ ID NO: 330782 - DNA, 75 bp, Artificial Sequence
  Synthetic
ggcaagcccaaccgcccagacagcaagcaattgataatctaattgatgaagaggaagaggatgaagaagaagaag

SEQ ID NO: 330783 - DNA, 75 bp, Artificial Sequence
  Synthetic
tgttcaagagttcctaccactctggagcggaaatagtaaacagactgacttaagcaagagagagtgtgttgagtt

SEQ ID NO: 330784 - DNA, 75 bp, Artificial Sequence
  Synthetic
aggaagaagagcagaatcttgatgcagaaatagaaagaagatttgcactcaggttagcacaggagcaggaaagat

SEQ ID NO: 330785 - DNA, 75 bp, Artificial Sequence
  Synthetic
tatattgagtcaagtctccacagggacagtgtcactactagtatgtgatttagaggaagggttcatatcgaacaa

SEQ ID NO: 330786 - DNA, 75 bp, Artificial Sequence
  Synthetic
ggggacgccgcctggccgaactcgaagccgaaagggcacagacaagacaagggccaggggcagcaccccagtctg

SEQ ID NO: 330787 - DNA, 75 bp, Artificial Sequence
  Synthetic
ctgtgatctatcctgtgcattgatacatgttttactattatctttcatgttaataatggataatggattacttat

SEQ ID NO: 330788 - DNA, 75 bp, Artificial Sequence
  Synthetic
ggcaacaccaaaaccagacagacaatgaccaatcagaatacaacagcaatttcgcagaatagcaaggctttcaaa

SEQ ID NO: 330789 - DNA, 75 bp, Artificial Sequence
  Synthetic
cctaaaatcagacctagaaccattccaaaagctgtctacaatagtatccatcctgtcatacaggttcaaaaatat

SEQ ID NO: 330790 - DNA, 75 bp, Artificial Sequence
  Synthetic
caacgagcgggcttgcagcttatacgcattttcttgcaactttacagttataggcttttaagaaaaaactactat

SEQ ID NO: 330791 - DNA, 75 bp, Artificial Sequence
  Synthetic
taccttagcaagatcagcatactctgaccctcaaagtagtgaagtatttctgatttgccttgctggaccagagaa

SEQ ID NO: 330792 - DNA, 75 bp, Artificial Sequence
  Synthetic
aggcccgaaggttggcaactttcgggcccccctcagccttggctccaaggcgcccccccaatccacccacaagcc

SEQ ID NO: 330793 - DNA, 75 bp, Artificial Sequence
  Synthetic
aaccgttgggacattcaatgtggcaagagcccttgcacaacaggataagatggatgggttctcattgataaatcc

SEQ ID NO: 330794 - DNA, 75 bp, Artificial Sequence
  Synthetic
agcactaacagccacagcacaactgacagaaaatggaccagccaccatcagatgcggaaatttccgcctggatag

SEQ ID NO: 330795 - DNA, 75 bp, Artificial Sequence
  Synthetic
atgtgttctcaaggatctgcgggaggagatggctgaatcatgcaataatgtaattgatgtgatcgatatgcagct

SEQ ID NO: 330796 - DNA, 75 bp, Artificial Sequence
  Synthetic
agaggggactggccactgccaggcacttcgcaccaggcccagtcacgtcccaaagcagtcttgggaagtccacca

SEQ ID NO: 330797 - DNA, 75 bp, Artificial Sequence
  Synthetic
taaaatggcacatgcacttgagaatcaagacgatcatgtactgctatcaaggctaggcagcagatcacagacaaa

SEQ ID NO: 330798 - DNA, 75 bp, Artificial Sequence
  Synthetic
tcaagaagggaaacacaaaacaattggttgactccgcggaattcaccgccgcaacactggcgcccgcaggaggac

SEQ ID NO: 330799 - DNA, 75 bp, Artificial Sequence
  Synthetic
ccagctactccaaacaccacaagccaacactatccaagaagtcattgaaagaatagccaacttggttactatata

SEQ ID NO: 330800 - DNA, 75 bp, Artificial Sequence
  Synthetic
tgcagggatcaatgccctgctcgattccagcagggcaatctaaggcagggcaaggcgcccggccaaaggttaaga

SEQ ID NO: 330801 - DNA, 75 bp, Artificial Sequence
  Synthetic
cttgaaggagacactgactacaattgaatcttacaatgaagacagaaccaggctcctatttctagcatataatat

SEQ ID NO: 330802 - DNA, 75 bp, Artificial Sequence
  Synthetic
aagctgcccaaactcgagcgacgcccactaaacctgatgctcctacaattgaaccagtgtatgaggacatagtat

SEQ ID NO: 330803 - DNA, 75 bp, Artificial Sequence
  Synthetic
ttcggctttcggaaaaattagaacatcagcccaattgacagccagggccgtactggatatcgtgattagaaactg

SEQ ID NO: 330804 - DNA, 75 bp, Artificial Sequence
  Synthetic
ccactcctggtagagacaaagcacaagtgcagcttccatccccaaaattgagcgcaaaagacaaactcctatcgg

SEQ ID NO: 330805 - DNA, 75 bp, Artificial Sequence
  Synthetic
gcctataattgatttccatatgaggaaagttgtgatagcttctttgaagttgggtgaattcagtgtaagtctagt

SEQ ID NO: 330806 - DNA, 75 bp, Artificial Sequence
  Synthetic
ccccgccactccagcaacattccaatatccccactggtccggagggacaaaactttaagagggggctgtcctcag

SEQ ID NO: 330807 - DNA, 75 bp, Artificial Sequence
  Synthetic
tttgactccaaaatcattcctcagtatcactcatgccaggaagtatttttcacaaaaccttggacttgaccaatt

SEQ ID NO: 330808 - DNA, 75 bp, Artificial Sequence
  Synthetic
gaagcgccgcctctattagaagaaaccccaatccaggacacagacgagagttcgatcttgtatggggaggaggat

SEQ ID NO: 330809 - DNA, 75 bp, Artificial Sequence
  Synthetic
ggatattgaactagggcaaaacctaaaagttcttctacccagatcagagcaaaaacttatctggaaaaatatcgg

SEQ ID NO: 330810 - DNA, 75 bp, Artificial Sequence
  Synthetic
cattcacaatgcgagagtggtgcaatccaacctgcagtccaatcacaccaatccccaggagacatcactgcagat

SEQ ID NO: 330811 - DNA, 75 bp, Artificial Sequence
  Synthetic
ctgcattaatttgatatctactcttgaagatgataataatgatttcaggtatgagccatacccagatgaatctca

SEQ ID NO: 330812 - DNA, 75 bp, Artificial Sequence
  Synthetic
gtggtcagtgccctcgagtctgcaaacagtgtgaaggagattatcaggtacttgaaggtgatggagaacaagatg

SEQ ID NO: 330813 - DNA, 75 bp, Artificial Sequence
  Synthetic
ggaccagcccgagttcgatctcgctggcgatgaaatctaattgactaggaagagaaaatgcagtctcagatattt

SEQ ID NO: 330814 - DNA, 75 bp, Artificial Sequence
  Synthetic
aaccagctggagtggaaaattgacaaagtattggctcaaaacaatataatacagcagattaggaacgaacaaatg

SEQ ID NO: 330815 - DNA, 75 bp, Artificial Sequence
  Synthetic
tgaaatctaattgactaggaagagaaaatgcagtctcagatatttaagaaaaaacttatagattttccccttggt

SEQ ID NO: 330816 - DNA, 75 bp, Artificial Sequence
  Synthetic
gttctcaaagcagggatggctacacttgaagggctgataaccacgataaaaattatggatcccggagtcggcacg

SEQ ID NO: 330817 - DNA, 75 bp, Artificial Sequence
  Synthetic
ggagctgacgctgctcaagcaaagcgtgcatttaaggatgtgccagtagtagtcagcggacctgttattggggag

SEQ ID NO: 330818 - DNA, 75 bp, Artificial Sequence
  Synthetic
aatgatctcatctttgagtccaaactagaagtcggtaatctaggaaggcctcaaaaggtcaatcccacaccccga

SEQ ID NO: 330819 - DNA, 75 bp, Artificial Sequence
  Synthetic
cgccgtggagtcccgaccgaatccgaattggcaagttacaaattgactctagcaaagttactcaaagactgcatc

SEQ ID NO: 330820 - DNA, 75 bp, Artificial Sequence
  Synthetic
cctaataacacagcacaatcaaagttccttgacgcgattgaaaagataaaaactgaggctgactttaaggcgctc

SEQ ID NO: 330821 - DNA, 75 bp, Artificial Sequence
  Synthetic
aaacgagagatagtacgtgctgcagtgtgaaaactgtcattgactatcgcttcatatctcaacactttttgcaat

SEQ ID NO: 330822 - DNA, 75 bp, Artificial Sequence
  Synthetic
cttagcctaactggtttctctgcttgcactatccgcacaacatctcaaaacaaaaagcattcacctctgttattg

SEQ ID NO: 330823 - DNA, 75 bp, Artificial Sequence
  Synthetic
caaatgccaaccaccaaaaaaatcataacctgaaggtctttaagaaaaaactaaggtgggtccgaacccgttcga

SEQ ID NO: 330824 - DNA, 75 bp, Artificial Sequence
  Synthetic
ccccgaccgaccccaaaatggcgcaccgccaagcaacgattcctgtccatgtggatcaccacagtgagaagaatc

SEQ ID NO: 330825 - DNA, 75 bp, Artificial Sequence
  Synthetic
atctccgtgctttcccgattgtccaagcggattcacctgagggcacagaaaaggggcggttaattaaacagatga

SEQ ID NO: 330826 - DNA, 75 bp, Artificial Sequence
  Synthetic
gattcaaggatctaactcctaggggctcaactgaaccccctatatcattcataaacacctacgggttcataaaac

SEQ ID NO: 330827 - DNA, 75 bp, Artificial Sequence
  Synthetic
cacttaggaccagagaggaattcttctcagagttgcataagcaatcacagaccccctgtctcactgcatgcagca

SEQ ID NO: 330828 - DNA, 75 bp, Artificial Sequence
  Synthetic
taccattcggagcaggcccagcgctggatcatccggaaagactcttggacgaaattgagaaggctttaatagttg

SEQ ID NO: 330829 - DNA, 75 bp, Artificial Sequence
  Synthetic
tgaggaagagtgccagcacaagtgaggagtgtgtatttgaaatcaggaaacttcccccgatgctgaccaggcacc

SEQ ID NO: 330830 - DNA, 75 bp, Artificial Sequence
  Synthetic
agcttgcggggaacaagatcctatgtgttccatctgataaatatgttaaggctcctgggaaattgacctcaggtg

SEQ ID NO: 330831 - DNA, 75 bp, Artificial Sequence
  Synthetic
tggattacgcttaccacattgtctttatatctgtcacactgtgccctcctagtcaaaaattcagggtacctatgc

SEQ ID NO: 330832 - DNA, 75 bp, Artificial Sequence
  Synthetic
cggtccaaagcttgcgtgcaaaagtcatgaggagtgtgcatttggaagtcatgttaaagattgactgtgatccgg

SEQ ID NO: 330833 - DNA, 75 bp, Artificial Sequence
  Synthetic
gttcccctataaccaaaaatttgatatatgattctgagaatgatgtttggcttgcttccatctggttccatctat

SEQ ID NO: 330834 - DNA, 75 bp, Artificial Sequence
  Synthetic
gtaatctatacaaaggccataagcccttcaaagaatacgatgaccatcattttgctgcaaagtgcaggtcaatga

SEQ ID NO: 330835 - DNA, 75 bp, Artificial Sequence
  Synthetic
aactggaagtagggattgttgatctatggggtcccacgtttcttgttaagtcccacgggaaaataccccatgcag

SEQ ID NO: 330836 - DNA, 75 bp, Artificial Sequence
  Synthetic
ctcggcctttcttcggaaagcatggttgggtctgtcatcccataatggattgtgcacctgcaatttgcaagtcat

SEQ ID NO: 330837 - DNA, 75 bp, Artificial Sequence
  Synthetic
tgtgggcactgagtgtatctattgtgcaagtaactgcagtcctacaggcatcagatttgtctcaaatggtccgaa

SEQ ID NO: 330838 - DNA, 75 bp, Artificial Sequence
  Synthetic
tgacagatgtgattttcccgaaaataaaagttaatccggacctacacggccttggcaaatccagatggaacccag

SEQ ID NO: 330839 - DNA, 75 bp, Artificial Sequence
  Synthetic
taaccaaaatagtcagccccgaataaagacaccacaactaggtgcaacaaaagcatcaagaacctgagacatccc

SEQ ID NO: 330840 - DNA, 75 bp, Artificial Sequence
  Synthetic
ccaacattccaaagacagagtccaaacctcggcatatgacccataatcaatattgctgcaagactgcatagaaat

SEQ ID NO: 330841 - DNA, 75 bp, Artificial Sequence
  Synthetic
gcttctgctctaagctatagcggtagcctgcaagttaatagaaagagctctcacatcactatctgcattatcaaa

SEQ ID NO: 330842 - DNA, 75 bp, Artificial Sequence
  Synthetic
tctgcacactcatttctcaacgcttgctttaccaatcttcagatttaagaaaaaacctaatctcaattacaaatg

SEQ ID NO: 330843 - DNA, 75 bp, Artificial Sequence
  Synthetic
cagaattgagcagtctaaattgggtccgaacccgttcggacccgaacccgagacaccaagcgaagacatccactc

SEQ ID NO: 330844 - DNA, 75 bp, Artificial Sequence
  Synthetic
ccccccccaaccccaaaggaagccgactccaaaaagaggactccacacaatggcacacataaactcattaatttt

SEQ ID NO: 330845 - DNA, 75 bp, Artificial Sequence
  Synthetic
acttctaatgttgacagagacagggagttctgtgaatattcagctgcttcagtcactgggagtaatcaacactca

SEQ ID NO: 330846 - DNA, 75 bp, Artificial Sequence
  Synthetic
taaacgccaacttgcattttataatcaacaacctccgtcatacctcgtaattagacttctgccgacactaaatat

SEQ ID NO: 330847 - DNA, 75 bp, Artificial Sequence
  Synthetic
tcctaagcagaattgcactcttaatagtattaacaggtatgaaaaggctgtcaaagatataataaaacccattag

SEQ ID NO: 330848 - DNA, 75 bp, Artificial Sequence
  Synthetic
tgacaatctcaattggctttctgacaatttaattccaaaaagaagagggaaaagatttgcgggggcagctatagg

SEQ ID NO: 330849 - DNA, 75 bp, Artificial Sequence
  Synthetic
acttgcagcactcggtgttgcagttgctgcacaggcaacagctgcagtagctctagtggaagccagagcaaatgc

SEQ ID NO: 330850 - DNA, 75 bp, Artificial Sequence
  Synthetic
agagaagatttcctcaatgtcagcagccctacaagagacgaaccaagctgtctcttctttgacagctgccatggc

SEQ ID NO: 330851 - DNA, 75 bp, Artificial Sequence
  Synthetic
gagtagtggtattgcaattcaagcaatacagaatgagatcaataatgtgattcatcctattctcaaccaggtaca

SEQ ID NO: 330852 - DNA, 75 bp, Artificial Sequence
  Synthetic
gtgtggggtactagactcacaaattgcatccatcttaaacttatatctcataaagatcacaaccatctttaacaa

SEQ ID NO: 330853 - DNA, 75 bp, Artificial Sequence
  Synthetic
tcaactaacaaatcctgctctccatagaatatcgatccaggcattgtctgttctaatgcaaagtactaaagactc

SEQ ID NO: 330854 - DNA, 75 bp, Artificial Sequence
  Synthetic
actcaaaaacctcacagccggagatacccaaacctcactggatctgataagaaccaatctaatagagggccagat

SEQ ID NO: 330855 - DNA, 75 bp, Artificial Sequence
  Synthetic
tgttgcagtcaacatgacaacgcttcagatggttatagcagtgtacatcccggcggttgcgaagttggagtcagc

SEQ ID NO: 330856 - DNA, 75 bp, Artificial Sequence
  Synthetic
tgtcctcttagattttatttcaattactgtcagctctaatcaatctgaggtaatgctgcagctgccctcaagaat

SEQ ID NO: 330857 - DNA, 75 bp, Artificial Sequence
  Synthetic
attagaggtcggaaataacatatatacgtttaagggagatcagtgcacattaactgaaactacagcttactgctt

SEQ ID NO: 330858 - DNA, 75 bp, Artificial Sequence
  Synthetic
atacagtgatgctgtccctgtcaatgagaaaatttctgattgcatgaagggaattcaaagctcctgtatatttac

SEQ ID NO: 330859 - DNA, 75 bp, Artificial Sequence
  Synthetic
aaggatcataggctcctttgctaatagatttgccagtgtgaatggggcaatatttgcaaattgtaagagtttaac

SEQ ID NO: 330860 - DNA, 75 bp, Artificial Sequence
  Synthetic
atgttcttgtacccaacctgatgggttaatatatcagcccgataatgtacccttgacaatcattgacaaaattaa

SEQ ID NO: 330861 - DNA, 75 bp, Artificial Sequence
  Synthetic
atgttcaaagttgaatataggacacctgacctttaatataagagatagcacaaatgctactattgatctacatac

SEQ ID NO: 330862 - DNA, 75 bp, Artificial Sequence
  Synthetic
tgatctgtccgattctcagattactattacaaatcctcttgacttatccgcagagcttactcaaattaataattc

SEQ ID NO: 330863 - DNA, 75 bp, Artificial Sequence
  Synthetic
ggtaattaattcccacctgcatcttatgaatagtgaaaatatattgagaagaattgatagtggactattcagcaa

SEQ ID NO: 330864 - DNA, 75 bp, Artificial Sequence
  Synthetic
ggcgataatgatcttcttgcttgtgggggtctgctctttaattatagttgttataggtcttatagtctggattag

SEQ ID NO: 330865 - DNA, 75 bp, Artificial Sequence
  Synthetic
gtttatactcctccatttaaagagttcttcacacactaatcgccaaggaagcagtttattttctattgatagtgt

SEQ ID NO: 330866 - DNA, 75 bp, Artificial Sequence
  Synthetic
ataacaatagcagtagatagaacattatccactacacaggttgcctaatgcataataggtctttcaaccactact

SEQ ID NO: 330867 - DNA, 75 bp, Artificial Sequence
  Synthetic
ctcctataagttaaaatctgttttaataaaaaacttacagtaaaagtcaggtaacttgggctcgacccagtcagc

SEQ ID NO: 330868 - DNA, 75 bp, Artificial Sequence
  Synthetic
ccaccagcccacaaatcccgaacggacagggtctgccctcaacaagaacaccatgcatgccagaaactcatcagt

SEQ ID NO: 330869 - DNA, 75 bp, Artificial Sequence
  Synthetic
cagtagcatcagtgattccatcgacaatgtgtttgggaaaaggaacactcctgtaatcaaaaggacaggaaaaaa

SEQ ID NO: 330870 - DNA, 75 bp, Artificial Sequence
  Synthetic
attatttagactaggctcactcatatttctaatagtaataattagcctaacagttaagataataactgaactctc

SEQ ID NO: 330871 - DNA, 75 bp, Artificial Sequence
  Synthetic
tctagttaagagtgagtgtagcaatagagaccatgttaccgaaataatcaatttgcagcaaaaagaactcagtct

SEQ ID NO: 330872 - DNA, 75 bp, Artificial Sequence
  Synthetic
gatgaataacatcataacaaccttgaacacattattaacaacaaccacggttgacctcccgattaaattgactaa

SEQ ID NO: 330873 - DNA, 75 bp, Artificial Sequence
  Synthetic
ctttgggaaaagtatagttgatcaggtgacaatgatggttagacagtgcaatgcagtgtgtaggggccctggtga

SEQ ID NO: 330874 - DNA, 75 bp, Artificial Sequence
  Synthetic
taaaccaacccagaatatccaattattcaacgggcgctacgctataataaataattcaacagcatatccatcaag

SEQ ID NO: 330875 - DNA, 75 bp, Artificial Sequence
  Synthetic
aaatagtatatctgaacttaaagtaccaagagactttgtgccttcaccaggcaccttccatgggtgttcaagatt

SEQ ID NO: 330876 - DNA, 75 bp, Artificial Sequence
  Synthetic
cccgtcgtatagtaaccattatgggttatggtgttatagtcatactgtatcaaatgatacttgtgacgggtctaa

SEQ ID NO: 330877 - DNA, 75 bp, Artificial Sequence
  Synthetic
tccgtctgtccaaatcttgtctgtagggaaattaattacaggggataatggacaacctgaacacaagactcttta

SEQ ID NO: 330878 - DNA, 75 bp, Artificial Sequence
  Synthetic
cactcagcaactaagccaaacagatcggttgtatcattgctcagtgactatgaccactttaggttgttacatttt

SEQ ID NO: 330879 - DNA, 75 bp, Artificial Sequence
  Synthetic
atgctcaaagccaagggttaatgagacccaggattacgagacaatagggatagagcccatgataataggtatgtt

SEQ ID NO: 330880 - DNA, 75 bp, Artificial Sequence
  Synthetic
agggcttgacggagtatatactgatctgggtaaccctgtaggaatctctgacaatagcttatacgcaatgtatcc

SEQ ID NO: 330881 - DNA, 75 bp, Artificial Sequence
  Synthetic
aggccccgggggaggtgtgatgtataaggattttttggtctttccattgcatggaggggttagattctctgaggc

SEQ ID NO: 330882 - DNA, 75 bp, Artificial Sequence
  Synthetic
ttccaaaatgttagggaagaacatcacttttcggggcttccctcctagtgacacatgcactgagcatgaaaagag

SEQ ID NO: 330883 - DNA, 75 bp, Artificial Sequence
  Synthetic
cctgacccaagagccggctaatatgctaacaagtccttattacggtgaggttttagttcttgactttctttatgt

SEQ ID NO: 330884 - DNA, 75 bp, Artificial Sequence
  Synthetic
gtgtacgttattggataacatacctggggagtgtagtatacagttaattcctcctgacaacatgacaatgggctc

SEQ ID NO: 330885 - DNA, 75 bp, Artificial Sequence
  Synthetic
tgaatcaaaattgtacaaattgaataactcattgctactttataaacgaagctcatcttggtggccttatacaga

SEQ ID NO: 330886 - DNA, 75 bp, Artificial Sequence
  Synthetic
agtataccaactaagtctaagggtgtccaaaaatagcatgaaagtgcgtgaatcagtaaggctgaatatcacttc

SEQ ID NO: 330887 - DNA, 75 bp, Artificial Sequence
  Synthetic
tactactagacctggagtagaaggatgcaacatcaacaaagtatgtcctaaagtatgtgtaactggagtgtttca

SEQ ID NO: 330888 - DNA, 75 bp, Artificial Sequence
  Synthetic
ggcaccaggaattataaggaaagcattgagtccaaaggagtctaatgaggatctgttgtttttccaggcctggac

SEQ ID NO: 330889 - DNA, 75 bp, Artificial Sequence
  Synthetic
ttcagattctatagcacgccaaggtccccttatatctctatgtagggctgattcatgtgtactgaccatcccgct

SEQ ID NO: 330890 - DNA, 75 bp, Artificial Sequence
  Synthetic
aggcaattctgatgttttcattggatacacagattcattctgtctatcagatagagataatgagaagatctactg

SEQ ID NO: 330891 - DNA, 75 bp, Artificial Sequence
  Synthetic
tgttgcattattagaactagataacatgccttactctgagatgacaatcagatcttttttgtaccttatcaaata

SEQ ID NO: 330892 - DNA, 75 bp, Artificial Sequence
  Synthetic
acaatgtaagaaagagagtcactagaacatacaacatgctaggagctcaggttacatggtaattatctagagtag

SEQ ID NO: 330893 - DNA, 75 bp, Artificial Sequence
  Synthetic
gatgcaaagcaattttaatcttcttgatgtctcactcataatattaacttcttcgactcaactatcccccaagaa

SEQ ID NO: 330894 - DNA, 75 bp, Artificial Sequence
  Synthetic
aaagctacgctatgcttaaattcttctttaagaaaaaagatgggccagaatggctgccccggcccagatcatcct

SEQ ID NO: 330895 - DNA, 75 bp, Artificial Sequence
  Synthetic
ccctgaggtgcatctggactctcccattgttgagaacaagttgctatacctaatccaactgggagaattaccaac

SEQ ID NO: 330896 - DNA, 75 bp, Artificial Sequence
  Synthetic
ttatgattattactacaatcatgactatttcccaggcattgattggagccgaatcaggcatgaagaaagtaaaat

SEQ ID NO: 330897 - DNA, 75 bp, Artificial Sequence
  Synthetic
attccaaagactgagtgaagtaaaggagagactattggccaaatgtctatcttctcaaagaaaacgaaaaaacct

SEQ ID NO: 330898 - DNA, 75 bp, Artificial Sequence
  Synthetic
gtccttaaatttcaatcctgtaccatggccgaaatgcatgactatactgcacagagtaatcatcaattcgtcact

SEQ ID NO: 330899 - DNA, 75 bp, Artificial Sequence
  Synthetic
tgaaagatttaaagatgcagaacatataatcagtcatgcattagcaccgttgtcacctggcctcacaacccttct

SEQ ID NO: 330900 - DNA, 75 bp, Artificial Sequence
  Synthetic
agaagatgtgtcaagcaaaattacagggaaacaaaacctattccaacaaaatattaagtcctgtagttttcaccc

SEQ ID NO: 330901 - DNA, 75 bp, Artificial Sequence
  Synthetic
gaatcattctagacccaattctgtcatgcacattgccacaagtgcattccaagtggagtggaaggacaacttcaa

SEQ ID NO: 330902 - DNA, 75 bp, Artificial Sequence
  Synthetic
tcaatggtttttgataaggcatttaatgagacagctaattatgaggaatagtgagggccacacacagattacacc

SEQ ID NO: 330903 - DNA, 75 bp, Artificial Sequence
  Synthetic
tgtagagattgatgataggattatgagtgtgatcattacaccagagttagtaaccatttggctatcagagaacaa

SEQ ID NO: 330904 - DNA, 75 bp, Artificial Sequence
  Synthetic
cacaatcatttatctgacttttgagatggtcctgatgatcactgatctgtatgaaggacgaatgaacatgatgct

SEQ ID NO: 330905 - DNA, 75 bp, Artificial Sequence
  Synthetic
cctaactaccttaagctgttatttggcaccgcttaaatcaaggctaaagcagctgttcatcattgtggatgactt

SEQ ID NO: 330906 - DNA, 75 bp, Artificial Sequence
  Synthetic
aagttccatcatagggaattcagtttactccattgttgcatctatggaaagtttagtgtatggtcaactccaact

SEQ ID NO: 330907 - DNA, 75 bp, Artificial Sequence
  Synthetic
ttctgatcctgtacctgatgtagcaggtgaattctattcctttgttgtcggagaaatgttaacagcactgacaga

SEQ ID NO: 330908 - DNA, 75 bp, Artificial Sequence
  Synthetic
tacaaaagaattcacaacagatgaggctagaattgtagtggaaagaattactgagtgttatgaggatttaacacc

SEQ ID NO: 330909 - DNA, 75 bp, Artificial Sequence
  Synthetic
ggacttgattgctgaactgctctgtgtcatgaggatgtggggtcacccatctttgagtgcagaaaaagctgctga

SEQ ID NO: 330910 - DNA, 75 bp, Artificial Sequence
  Synthetic
aaaggtgcgaaaatctatgtgtgctccaaagataatagatttagaaacaactctgaagacacttgctttctttca

SEQ ID NO: 330911 - DNA, 75 bp, Artificial Sequence
  Synthetic
tggaatattgatcaatggttacaggaggaagcataatgggatttggcctaaatgtagacttccaccaaatgcagg

SEQ ID NO: 330912 - DNA, 75 bp, Artificial Sequence
  Synthetic
agtaagcctgactgagatgaagcatgacaattctgagctcccacatcagtacatcctaaatcattggaaagagat

SEQ ID NO: 330913 - DNA, 75 bp, Artificial Sequence
  Synthetic
tgcttttatagaatttgagaaaagcttcgattcagacccaggtgatgacttgagtatattcatgaaggataaggc

SEQ ID NO: 330914 - DNA, 75 bp, Artificial Sequence
  Synthetic
tattagtgcaccaaaaagtgactggatgagtgtgttcaggaaaagtctcataaaaccaacttgtgagcggttaca

SEQ ID NO: 330915 - DNA, 75 bp, Artificial Sequence
  Synthetic
tgcgccaatgccaaggccatttaataggcggttattgctaaactttttggcagacagcaactttgatccatccaa

SEQ ID NO: 330916 - DNA, 75 bp, Artificial Sequence
  Synthetic
ggagttagagtatgtgacaactggagcgtaccttgaagatgaggaattttgtgcctcctactcactcaaagagaa

SEQ ID NO: 330917 - DNA, 75 bp, Artificial Sequence
  Synthetic
ggaaataaaggagacaggaagaatctttgcaaaactaacaaagaacatgagatcctgccaagtaatggcagagtc

SEQ ID NO: 330918 - DNA, 75 bp, Artificial Sequence
  Synthetic
actcctggccaatcatgcaggcaagctgttcaaagagaacggagttgttcaagataatttaaatcttaccaaatc

SEQ ID NO: 330919 - DNA, 75 bp, Artificial Sequence
  Synthetic
cttgttaacaatgtcccagattggattgatctccagacagtcaagacgaaacattagagagaatgtgacaatcct

SEQ ID NO: 330920 - DNA, 75 bp, Artificial Sequence
  Synthetic
tcacaaagtcacaaaaaaccatcaccaaaagttctcatctgccccgagcactaaaactggacaaaagtcacagca

SEQ ID NO: 330921 - DNA, 75 bp, Artificial Sequence
  Synthetic
agacgagcagtttgagattgcagctttttatctgactacagatcttgagaagtactgtctcaattggaggtacca

SEQ ID NO: 330922 - DNA, 75 bp, Artificial Sequence
  Synthetic
gactataattatgtttgcaacatcaatgaatagactatatggttatcctcacttatttgagtggattcatccccg

SEQ ID NO: 330923 - DNA, 75 bp, Artificial Sequence
  Synthetic
actaatgaggtcaacactgtatgtcggagacccttttaatatgccacgctaccttgatacaactgatcttgactt

SEQ ID NO: 330924 - DNA, 75 bp, Artificial Sequence
  Synthetic
agttaagaatgaaggtattttcatagtctcccccagaggtggtatagagggtctgtgtcagaaactctggacaat

SEQ ID NO: 330925 - DNA, 75 bp, Artificial Sequence
  Synthetic
gatttccatatctgtcattatcctttctgcagctgaatccaatacaagagtaatgagcatggtacaaggagacaa

SEQ ID NO: 330926 - DNA, 75 bp, Artificial Sequence
  Synthetic
ccaggcagtcggtattaccaccagagttccaagatgtgtaagtacaaaagagaagaaaaggattgctttcgagaa

SEQ ID NO: 330927 - DNA, 75 bp, Artificial Sequence
  Synthetic
cagcaaggcattcattgaaaggttgagagtgaacaatcataatttagggcaccacctcaagagtcaagagactat

SEQ ID NO: 330928 - DNA, 75 bp, Artificial Sequence
  Synthetic
actcagttcctctttttttgtgtatagtaagagaattttctcaaatggcaggatacttaatcaggctcttaagaa

SEQ ID NO: 330929 - DNA, 75 bp, Artificial Sequence
  Synthetic
catgagcaaagccaacttaatatctgatgtcttaggtgagtgtacccaatcttcatgctcaaacctaacaacaac

SEQ ID NO: 330930 - DNA, 75 bp, Artificial Sequence
  Synthetic
actgatgagattgactgaaaacggtgtagaaaaggacatctgttactggctcagctttttcctttctgctaaaca

SEQ ID NO: 330931 - DNA, 75 bp, Artificial Sequence
  Synthetic
gcttgtttatgatctactgttccctctgctagctcaattcgaagatgaagtgacatctacataccttaacaaccc

SEQ ID NO: 330932 - DNA, 75 bp, Artificial Sequence
  Synthetic
acatctgatcgggagactttgtgctattccctctcaactgggtggtcttaattactattctttaagtagactttt

SEQ ID NO: 330933 - DNA, 75 bp, Artificial Sequence
  Synthetic
ctgtaggaatataggtgatcccctgacatctgcaacagctgacctcaagaggctgattcaacatggagttctacc

SEQ ID NO: 330934 - DNA, 75 bp, Artificial Sequence
  Synthetic
agagtggtatctcaataatctcttcaaaaggaaacctggagatggtaactggactacccttgcagctgaccctta

SEQ ID NO: 330935 - DNA, 75 bp, Artificial Sequence
  Synthetic
tgctttaaatattgactacatttaccctccaacctccttcctgaaaaaacacacccaaagggttctgatggaaca

SEQ ID NO: 330936 - DNA, 75 bp, Artificial Sequence
  Synthetic
cagcacgaatcccatgttggcaggtgtatttgtagaaagttcttacagcgaagaattagatcttgcaaagttctt

SEQ ID NO: 330937 - DNA, 75 bp, Artificial Sequence
  Synthetic
gctagacaggcccatggtaatgccgagagtagcacacattattgtcgaacagacatcatgtggtcggagaaagca

SEQ ID NO: 330938 - DNA, 75 bp, Artificial Sequence
  Synthetic
agtacagggttacctagacaccacaagaacaatgatcaaacacgccattacaaaacaaccaccgagcttcagaaa

SEQ ID NO: 330939 - DNA, 75 bp, Artificial Sequence
  Synthetic
attagagaaaattataaattataataaattgtacttgggttacaatttggaaatgatacaaaagccagttggggg

SEQ ID NO: 330940 - DNA, 75 bp, Artificial Sequence
  Synthetic
tagacaaaagatgatagagatagctcacatctcagatttatgcagtatagatatctcaaagatattaaggagaat

SEQ ID NO: 330941 - DNA, 75 bp, Artificial Sequence
  Synthetic
ctcttggtcgagcttgctcacagggagaccgttggaaggtctagaaacacccgatccaattgaactcattaatgg

SEQ ID NO: 330942 - DNA, 75 bp, Artificial Sequence
  Synthetic
gtcactgattgatggttgcaatatctgtcaccattgtttatctggggacaggaaattcacctggttttttatccc

SEQ ID NO: 330943 - DNA, 75 bp, Artificial Sequence
  Synthetic
ttcagggatagaactggacaccccccctgaagacaaccctccaatgagagtcccatatgtgggttcaaggacaga

SEQ ID NO: 330944 - DNA, 75 bp, Artificial Sequence
  Synthetic
tgagcggagagtggcatcaattggatatgtcaaaggggcttcaccatcacttaaatcggctctaaggcttgcagg

SEQ ID NO: 330945 - DNA, 75 bp, Artificial Sequence
  Synthetic
cgtgtacatctgggctttcggagatactgagaacaattgggaagatgcactggatcttgcaaatactagagttta

SEQ ID NO: 330946 - DNA, 75 bp, Artificial Sequence
  Synthetic
tattgaaatggaccaactaaagactctcacaccaatgcctaccagtgcaaacctcacacaccgattggatgatgg

SEQ ID NO: 330947 - DNA, 75 bp, Artificial Sequence
  Synthetic
cttgactcaaatgaagtttactcctgctagttcgtacgcatattcttgttttgtgcacatctccaatgacaacca

SEQ ID NO: 330948 - DNA, 75 bp, Artificial Sequence
  Synthetic
aaatttagaacaactagacaggttgttagactccaatctaatctatcagcaagtgatgattttaggtctaggggt

SEQ ID NO: 330949 - DNA, 75 bp, Artificial Sequence
  Synthetic
cattgagacctggctatcatttccgaaccaaattaatgatgaagacatctctgtccacctgcatacagggggttc

SEQ ID NO: 330950 - DNA, 75 bp, Artificial Sequence
  Synthetic
ttgttgcatcaggccagttgacatgtgtgttctaaatgagagtcctaatgtacctccgaccttgaatgttccaca

SEQ ID NO: 330951 - DNA, 75 bp, Artificial Sequence
  Synthetic
agattttcttgcacgtgcatgcttttgcttcggacagcactggcagcggcaggtttgagagagacgatctttcgc

SEQ ID NO: 330952 - DNA, 75 bp, Artificial Sequence
  Synthetic
tctcatcagtcgtgaacgtgttgagaaaaagacagcttaggagaacaagagctggggatgggcaggaagtccatc

SEQ ID NO: 330953 - DNA, 75 bp, Artificial Sequence
  Synthetic
ctgaaaggtaaggggggcggtccccctcgacgagtgtcgaaagagaccgcaacgaagacgcgtcaacccagagtc

SEQ ID NO: 330954 - DNA, 75 bp, Artificial Sequence
  Synthetic
caaatgccaaatggactggtgttgatgcgcatgatgggaatcttgtggcatgccgtggctggcactgcgaggaac

SEQ ID NO: 330955 - DNA, 75 bp, Artificial Sequence
  Synthetic
cctgtgttgaaggcattctggaactctgttccactgaggcaggccactgccgcactccggaagatcaagaggaca

SEQ ID NO: 330956 - DNA, 75 bp, Artificial Sequence
  Synthetic
gtgagtgccttaatggtcggcctgcaaagacgcggaaaaaggagatcaatgacagactggatgaactggctactg

SEQ ID NO: 330957 - DNA, 75 bp, Artificial Sequence
  Synthetic
ctcattgccctgttggggatgacacttgccgcgacagtaaggaaagaaagggacggcaccactgtgatcagggct

SEQ ID NO: 330958 - DNA, 75 bp, Artificial Sequence
  Synthetic
gaaggaaaagacgcagcaactcaggtgcgtgtggagaatggtacttgtgtgatcctggccacagacatggggtca

SEQ ID NO: 330959 - DNA, 75 bp, Artificial Sequence
  Synthetic
tggtgtgatgactcactgtcctatgagtgtgtgaccatagagcagggggaagaacctgttgacgtggactgtttt

SEQ ID NO: 330960 - DNA, 75 bp, Artificial Sequence
  Synthetic
tgccggaatgttgatggagtctatctggagtatggacgctgcgggaaacaggaaggctcccggacaagacgctcg

SEQ ID NO: 330961 - DNA, 75 bp, Artificial Sequence
  Synthetic
gtgctgatcccatctcacgcccagggagagctgacggggaggggacgcaaatggctggagggagattcactgcgg

SEQ ID NO: 330962 - DNA, 75 bp, Artificial Sequence
  Synthetic
acacacctcactagagtggaaggatgggtttggaagaataagttattaactctggcgatgtttgccgttgtgtgg

SEQ ID NO: 330963 - DNA, 75 bp, Artificial Sequence
  Synthetic
cttgcactggagagcgtggtgaccagggttgccgtgctggttgtgctcctgtgtttggccccggtctatgcctcg

SEQ ID NO: 330964 - DNA, 75 bp, Artificial Sequence
  Synthetic
cgttgcacacacctggagaacagagattttgttactggcacccaggggactacaagggtcaccttggtgctggag

SEQ ID NO: 330965 - DNA, 75 bp, Artificial Sequence
  Synthetic
ctgggcggatgcgttaccataaccgctgaggggaagccttcaatggatgtgtggcttgatgctatctaccaggag

SEQ ID NO: 330966 - DNA, 75 bp, Artificial Sequence
  Synthetic
aaccctgccaagacacgcgagtactgcttgcacgccaagttatcagagaccaaggtggcagccagatgtccaaca

SEQ ID NO: 330967 - DNA, 75 bp, Artificial Sequence
  Synthetic
atgggcccagctgtcctggctgaggaacaccagattggcacagtgtgcaagagggaccagagtgaccggggatgg

SEQ ID NO: 330968 - DNA, 75 bp, Artificial Sequence
  Synthetic
ggcaaccactgtggactgtttggaaagggcagcattgtggcctgcgtcaaggcagcttgtgaagcaaaaaagaaa

SEQ ID NO: 330969 - DNA, 75 bp, Artificial Sequence
  Synthetic
gccacgggatacgtgtacgacgccaataaaatagtgtacacagtgaaggttgaaccacacacaggagactatgtt

SEQ ID NO: 330970 - DNA, 75 bp, Artificial Sequence
  Synthetic
gccgccaacgagacgcataaggggaggaagacggcgactttcacggtttcttcagagaaaaccatcttgaccttg

SEQ ID NO: 330971 - DNA, 75 bp, Artificial Sequence
  Synthetic
ggggagtatggagatgtttcgctgctgtgcagggttgccagtggagttgacttggcccagactatcgtcctggag

SEQ ID NO: 330972 - DNA, 75 bp, Artificial Sequence
  Synthetic
cttgacaagacagcggaacacctcccaacggcttggcaggtccatagagattggttcaatgacctggctctgcca

SEQ ID NO: 330973 - DNA, 75 bp, Artificial Sequence
  Synthetic
tggaagcatgatgggggcccacgttggaacaacgcagagagattggttgaatttggggcccctcatgctgttaaa

SEQ ID NO: 330974 - DNA, 75 bp, Artificial Sequence
  Synthetic
atggatgtgtacaaccttggggatcagaccggagtactgctgaaggcgctcgcaggggtccccgtagcgcacatt

SEQ ID NO: 330975 - DNA, 75 bp, Artificial Sequence
  Synthetic
gagggaaacaagtaccacctgaagagcggtcatgtgacctgcgaagtggggctggaaaaattaaagatgaaaggc

SEQ ID NO: 330976 - DNA, 75 bp, Artificial Sequence
  Synthetic
ctcacgtacacaatgtgtgacaaatcaaagtttgcatggaagagagttccaacagacagcggacatgacacagtg

SEQ ID NO: 330977 - DNA, 75 bp, Artificial Sequence
  Synthetic
gttatggaagtcacattctccgggtcgaaaccctgtaggatcccggtgagggcagtggcacatggatctcctgaa

SEQ ID NO: 330978 - DNA, 75 bp, Artificial Sequence
  Synthetic
gttaatgtggccatgctgataacaccaaacccaacaattgaaaacgacggaggaggcttcatcgagatgcagctt

SEQ ID NO: 330979 - DNA, 75 bp, Artificial Sequence
  Synthetic
cccccgggagacaacatcatctatgttggagaattgagtcatcagtggtttcagaaagggagcagcatcggaagg

SEQ ID NO: 330980 - DNA, 75 bp, Artificial Sequence
  Synthetic
gttttccaaacaaccaggaaaggtatagaaagactgacagtgataggagagcatgcctgggactttggatccgct

SEQ ID NO: 330981 - DNA, 75 bp, Artificial Sequence
  Synthetic
gggggttttttgagctcaatcgggaaagcggtgcacacagttcttggtggtgctttcaacagcatcttcggaggg

SEQ ID NO: 330982 - DNA, 75 bp, Artificial Sequence
  Synthetic
gtggggtttctgccaaagctcctaatgggagtggcgctggcctggttgggtttgaacacgaggaaccccacgatg

SEQ ID NO: 330983 - DNA, 75 bp, Artificial Sequence
  Synthetic
tccatgagcttcctcttggctggaggcctggtcttggccatgactcttggggtgggggcggatgtaggttgtgct

SEQ ID NO: 330984 - DNA, 75 bp, Artificial Sequence
  Synthetic
gtggacacagagcgaatggagctccgttgtggagagggtctggttgtgtggagagaggtttcagagtggtatgat

SEQ ID NO: 330985 - DNA, 75 bp, Artificial Sequence
  Synthetic
aactatgcatactacccggagacaccaggagctcttgcatcggcaataaaagaggcgtttgaggaaggaagctgc

SEQ ID NO: 330986 - DNA, 75 bp, Artificial Sequence
  Synthetic
ggcgtggtccctcagaacagactcgagatggccatgtggagaagctcggccacggaactgaatttggctctagcg

SEQ ID NO: 330987 - DNA, 75 bp, Artificial Sequence
  Synthetic
gaaggggatgcaaatctcacagtggtggtagacaaaaacgaccccaccgactatcgaggtggagttcctggtttg

SEQ ID NO: 330988 - DNA, 75 bp, Artificial Sequence
  Synthetic
ctgaaaaaagggaaagacatgaagatctcctggaagagttggggccactcaatgatctggagcatccctgaggct

SEQ ID NO: 330989 - DNA, 75 bp, Artificial Sequence
  Synthetic
cctcggcggttcatggtgggcacggaaggacaaagcgagtgcccactagagaggcgtaaaacaggtgttttcact

SEQ ID NO: 330990 - DNA, 75 bp, Artificial Sequence
  Synthetic
gttgcagagtttggggttggcctgagaacaaaggtctttctggattttagacaggaaccaacacatgagtgtgac

SEQ ID NO: 330991 - DNA, 75 bp, Artificial Sequence
  Synthetic
acaggagtgatgggagcggccgttaaaaacggcatggcagtccacacagaccaaagcctctggatgagatcagtg

SEQ ID NO: 330992 - DNA, 75 bp, Artificial Sequence
  Synthetic
agaaatgacacaggcacctacatagttgaacttctggtcactgatctgaggaactgctcatggcctgccagtcac

SEQ ID NO: 330993 - DNA, 75 bp, Artificial Sequence
  Synthetic
actatcgacaatgccgacgtggtgaactcggagctttttcttccggcgagcctagcaggacccagatcctggtac

SEQ ID NO: 330994 - DNA, 75 bp, Artificial Sequence
  Synthetic
aacaagatccccggctactcggaacaggtgaaaggaccatggcaatacacgcccatccgagttatcagagaggaa

SEQ ID NO: 330995 - DNA, 75 bp, Artificial Sequence
  Synthetic
tgtccaggaacgacagtcacaataaatgccaagtgtgagaaaaggggggcttccgtgaggagcactacagagagc

SEQ ID NO: 330996 - DNA, 75 bp, Artificial Sequence
  Synthetic
ggcaaggtgattccagaatggtgttgccgggcatgcacaatgcccccagtgacgttccggactggaactgactgc

SEQ ID NO: 330997 - DNA, 75 bp, Artificial Sequence
  Synthetic
tggtatgccatggaaatacggccagtccacgcccaggggggtcttgtccgttcaatggtggttgcggacaacgga

SEQ ID NO: 330998 - DNA, 75 bp, Artificial Sequence
  Synthetic
gaactgctaagtgagggaggaatccccgggatagtggcgttgtttgtggttcttgaatacatcatccggaggaga

SEQ ID NO: 330999 - DNA, 75 bp, Artificial Sequence
  Synthetic
ccttccacaggaacaacggtcgtgtggggaggtgtcatcgttctcgccctgctcgtcactgggatggtcaggatt

SEQ ID NO: 331000 - DNA, 75 bp, Artificial Sequence
  Synthetic
gagggtcttgtgcggtatgtggtggcggtaggaattgcgttccaccttgagctgggaccagaaattgtggccctg

SEQ ID NO: 331001 - DNA, 75 bp, Artificial Sequence
  Synthetic
atgctgctccaggctgtatttgagctgagagtggggcttctcagcgcttttgcgctgcgcagaggcctcaccgtc

SEQ ID NO: 331002 - DNA, 75 bp, Artificial Sequence
  Synthetic
cgagagatggtcaccacctatttcctcttgttggtcctggagatgggactgccgagtgtgagcttcgaggatctc

SEQ ID NO: 331003 - DNA, 75 bp, Artificial Sequence
  Synthetic
tggaaatggagcgatgcgctggccatgggggcactgatatttagagcttgcagtgcggagggaaagactggaacg

SEQ ID NO: 331004 - DNA, 75 bp, Artificial Sequence
  Synthetic
gggcttttgatcatagcccttatgacacagcaggacgttgtgaccatacatcacggacttgtgtgcttcctggca

SEQ ID NO: 331005 - DNA, 75 bp, Artificial Sequence
  Synthetic
gtggcttcggcctgctcggtctggagactgctcagaggacataaggagcagaagggactgacctggatagtcccc

SEQ ID NO: 331006 - DNA, 75 bp, Artificial Sequence
  Synthetic
ttggctagactgcttggaggggagggttctgggatcaggctgctggctttctgggaactggcagcccacagaaga

SEQ ID NO: 331007 - DNA, 75 bp, Artificial Sequence
  Synthetic
aaacgatccttcagtgaaccactgaccgtggtgggggtcatgttgacactggccagcggcatgatgcgtcatacc

SEQ ID NO: 331008 - DNA, 75 bp, Artificial Sequence
  Synthetic
tcccaggaggccctctgtgcgcttgcggtggcctcgtttttcttgttgatgcttgtgcttgggacgaggaggatg

SEQ ID NO: 331009 - DNA, 75 bp, Artificial Sequence
  Synthetic
cagctggttgccgaatggagtggctgcgtggaatggcatccagaactggtgaatgagggtggagagatcagcttg

SEQ ID NO: 331010 - DNA, 75 bp, Artificial Sequence
  Synthetic
cgggtccgccaagactcgatgggaaacttccatttgacagagcttgagaaagaggaaaggatgatggctttctgg

SEQ ID NO: 331011 - DNA, 75 bp, Artificial Sequence
  Synthetic
ctgcttgccggtctggtggcttcggctttccactggtcaggcattcttggcgtgatgggactgtggacacttaca

SEQ ID NO: 331012 - DNA, 75 bp, Artificial Sequence
  Synthetic
gaaatgatgaggtcatcccgaaggtctgacctggtcttctcaggacaggggggccgggaacgtggcgacagccct

SEQ ID NO: 331013 - DNA, 75 bp, Artificial Sequence
  Synthetic
ttcgaggtcaaggatggcgtctacagaatttttagccctggcttgttctggggtcagaggcaggtgggagtcggc

SEQ ID NO: 331014 - DNA, 75 bp, Artificial Sequence
  Synthetic
tacggtcacaagggtgtcttgcacacgatgtggcacgtgactagaggagcggcgttgtccattgatgatgctgtg

SEQ ID NO: 331015 - DNA, 75 bp, Artificial Sequence
  Synthetic
accggtccctactgggccgatgtgaaagaagacgtcgtgtgctacgggggagcctggagtctggaggaaaaatgg

SEQ ID NO: 331016 - DNA, 75 bp, Artificial Sequence
  Synthetic
aagggtgaaacagtacaggtccacgccttcccaccggggaaggcccatgagatacaccaatgccaacctggagag

SEQ ID NO: 331017 - DNA, 75 bp, Artificial Sequence
  Synthetic
ttgatccttgacacaggaaagaagcttggggcaatacccattgacttggcaaggggaacatctggtagccccatt

SEQ ID NO: 331018 - DNA, 75 bp, Artificial Sequence
  Synthetic
ctcaatgctcagggagctgttgttgggctatacggaaatggtttaaaaaccaatgagagctacgtcagcagtatc

SEQ ID NO: 331019 - DNA, 75 bp, Artificial Sequence
  Synthetic
gctcagggggaggcggagaagagccgaccaaaccttccacaggcggttgtgggcacaggctggacgtcaaagggg

SEQ ID NO: 331020 - DNA, 75 bp, Artificial Sequence
  Synthetic
cagatcacagtgttggacatgcacccgggctctggaaagacccatagagtcctcccggagctcatccgtcaatgc

SEQ ID NO: 331021 - DNA, 75 bp, Artificial Sequence
  Synthetic
atcgaaaggcgcctgaggacgctggtgctggccccgactcgtgtggtactgaaagagatggagcgtgctcttagt

SEQ ID NO: 331022 - DNA, 75 bp, Artificial Sequence
  Synthetic
gggaaacgggtcaggtttcattcaccggcggtcagtgaccagcaggttggaggggcgattgttgatgtgatgtgt

SEQ ID NO: 331023 - DNA, 75 bp, Artificial Sequence
  Synthetic
catgcaacctatgtcaacaggcgattactcccacaagggaggcagaactgggaagtggcaatcatggatgaggcc

SEQ ID NO: 331024 - DNA, 75 bp, Artificial Sequence
  Synthetic
cattggactgacccccatagtatagcagcaaggggccacttgtacaccctggcaaaggaaaacaaatgtgccctg

SEQ ID NO: 331025 - DNA, 75 bp, Artificial Sequence
  Synthetic
gttttgatgacggcaacgccccctggcaaaagtgaacccttcccagagtctaatggagccatcaccagtgaagaa

SEQ ID NO: 331026 - DNA, 75 bp, Artificial Sequence
  Synthetic
aggcagattcctgatggggaatggcgcgacggctttgactggatcactgaatacgaggggcgcaccgcctggttt

SEQ ID NO: 331027 - DNA, 75 bp, Artificial Sequence
  Synthetic
gtcccctcgattgcaaagggaggtgtgatagctcgcaccctgagacagaaagggaaaagtgtcatctgtctgaac

SEQ ID NO: 331028 - DNA, 75 bp, Artificial Sequence
  Synthetic
agcaagacttttgaaaaggattactccagagtgaaagaagagaagcctgactttgtggtgacgaccgacatctcg

SEQ ID NO: 331029 - DNA, 75 bp, Artificial Sequence
  Synthetic
gagatgggagccaaccttgacgtgagtcgcgtcatagatgggaggacaaacatcaagcctgaggaggttgatggg

SEQ ID NO: 331030 - DNA, 75 bp, Artificial Sequence
  Synthetic
aaggttgagttcactggcaccagacgagtgaccacggcctccgctgcccagcgacgcgggagggtcggtaggcag

SEQ ID NO: 331031 - DNA, 75 bp, Artificial Sequence
  Synthetic
ggtggacgaacagatgaatacatatactctggacagtgtgatgatgatgatagcggacttgtgcagtggaaggag

SEQ ID NO: 331032 - DNA, 75 bp, Artificial Sequence
  Synthetic
gcgcaaatacttcttgacaacataacaacactgcggggacctgtggccaccttctatggccctgagcaggatagg

SEQ ID NO: 331033 - DNA, 75 bp, Artificial Sequence
  Synthetic
atgccggaggtggccggtcattttcgactcactgaggagaagaggaagcacttccgccacctcctcacccattgt

SEQ ID NO: 331034 - DNA, 75 bp, Artificial Sequence
  Synthetic
gatttcactccctggctggcatggcacgtggcggcaaacgtgtctagcgtgacggaccgaagctggacatgggag

SEQ ID NO: 331035 - DNA, 75 bp, Artificial Sequence
  Synthetic
ggaccagaggccaatgccgtggacgaggccagtggggatctggtcactttcaggagcccgaatggggcagagaga

SEQ ID NO: 331036 - DNA, 75 bp, Artificial Sequence
  Synthetic
accctcaggccagtgtggagagacgcacgcatgtttagagagggacgtgacatcaaagagtttgtggcgtacgct

SEQ ID NO: 331037 - DNA, 75 bp, Artificial Sequence
  Synthetic
tctgggcggcgcagctttggagatgttttgacagggatgtcgggagttccggagcttctgcggcacagatgcgtc

SEQ ID NO: 331038 - DNA, 75 bp, Artificial Sequence
  Synthetic
agcgctttggatgtcttctatacactcatgcacgaggaacctggcagcagggcaatgaagatggcggagagagat

SEQ ID NO: 331039 - DNA, 75 bp, Artificial Sequence
  Synthetic
gcccccgaggctttcctgacggtagttgagatgatggtcctgggtttggcgaccttgggtgtcgtctggtgtttc

SEQ ID NO: 331040 - DNA, 75 bp, Artificial Sequence
  Synthetic
gtcgtccgaacatcgatcagtcgcatggtactaggcacgctagtcttgctggcctccttgctactcctgtgggct

SEQ ID NO: 331041 - DNA, 75 bp, Artificial Sequence
  Synthetic
ggtggcgttggctacgggagcatggcaggggtggcactcattttctacacactgttgacggttctgcagcccgag

SEQ ID NO: 331042 - DNA, 75 bp, Artificial Sequence
  Synthetic
acgggaaaacagagaagcagtgatgacaacaaactggcatacttcctgctgactctctgcagtcttgctggactg

SEQ ID NO: 331043 - DNA, 75 bp, Artificial Sequence
  Synthetic
gttgccgcaaatgagatggggtttctggagaaaaccaaggcggacctgtctgcggttctgtggagtgagcatgag

SEQ ID NO: 331044 - DNA, 75 bp, Artificial Sequence
  Synthetic
gagctccggcagtggagtgaatggaccaacgtggatatccagccggcaagatcctgggggacctatgtgctggta

SEQ ID NO: 331045 - DNA, 75 bp, Artificial Sequence
  Synthetic
gtctctctgttcacaccttacatcatccaccaattgcagaccaaaatccaacaacttgttaacagcgccgtggcg

SEQ ID NO: 331046 - DNA, 75 bp, Artificial Sequence
  Synthetic
tctggagcgcaggccatgagagacctgggagggggagctcccttctttggtgtggcaggacatgtcatgactctc

SEQ ID NO: 331047 - DNA, 75 bp, Artificial Sequence
  Synthetic
ggggtggtgtccctgattggggccaccccaacctcactgatggtgggcattggcttagcagctttccacttggcc

SEQ ID NO: 331048 - DNA, 75 bp, Artificial Sequence
  Synthetic
attgtggtgtctggactagaggctgaattgacacagagagcccacaaggccttcttcacttcaatggtacgcaac

SEQ ID NO: 331049 - DNA, 75 bp, Artificial Sequence
  Synthetic
cccatggtggatggggatgtcctcaatccgtttagagaaggagaggcaaaacctgctctatatgagaggaagatg

SEQ ID NO: 331050 - DNA, 75 bp, Artificial Sequence
  Synthetic
agcttggttctggccatagcgctgtgtctcatgtcggtggtcatgaatcgcacagcggcttccatggcggaggct

SEQ ID NO: 331051 - DNA, 75 bp, Artificial Sequence
  Synthetic
acagctgtggggctggcagcagctggacagctgctcagaccagaggcggacacactgtggacgatgccggtggcc

SEQ ID NO: 331052 - DNA, 75 bp, Artificial Sequence
  Synthetic
tgtggcatgagtagcgtggtcaggggtagcctctgggggtttctaccccttgggcacaggctttggctccgggcc

SEQ ID NO: 331053 - DNA, 75 bp, Artificial Sequence
  Synthetic
tctggggccaggcgtggtggctctgagggagacacacttggtgacctctggaagcgcaggctgaacagctgcacc

SEQ ID NO: 331054 - DNA, 75 bp, Artificial Sequence
  Synthetic
agggaagaattcttcgtttacaggcgcactggcatcctggagacagaacgtgatagggccagagagctgctcaag

SEQ ID NO: 331055 - DNA, 75 bp, Artificial Sequence
  Synthetic
agaggagagacaaacatgggactggcagtctcgcgaggcacggcaaagctcgcttggcttgaagaacgcggatac

SEQ ID NO: 331056 - DNA, 75 bp, Artificial Sequence
  Synthetic
gccaccctcaagggagaggtggtagatctggggtgtggaaggggtggctggtcttactatgcagcttcccggccg

SEQ ID NO: 331057 - DNA, 75 bp, Artificial Sequence
  Synthetic
ggcgtcatgagtgtcagggcatacaccattggaggaagggggcatgaggttccaaagatggtaacaagcctaggc

SEQ ID NO: 331058 - DNA, 75 bp, Artificial Sequence
  Synthetic
tggaacttgatcaagttcagatcgggaatggatgtgttcagcatgcaaccacaccgggctgacaccatcatgtgt

SEQ ID NO: 331059 - DNA, 75 bp, Artificial Sequence
  Synthetic
gacattggagagagcaatccagatgccactgtggagggtgaaaggacccggagagtgattttactcatggagcag

SEQ ID NO: 331060 - DNA, 75 bp, Artificial Sequence
  Synthetic
tggaaaataagaaaccctacagcggcttgtgtgttcaaggtgttggctccataccgcccagaggtaatagaggca

SEQ ID NO: 331061 - DNA, 75 bp, Artificial Sequence
  Synthetic
ttgcacagatttcagctacagtggggtgggggtctggtgaggactcccttctcaaggaactcaacacacgagatg

SEQ ID NO: 331062 - DNA, 75 bp, Artificial Sequence
  Synthetic
tactactcgacggctgtcactgggaatatagtgaactctgtcaacatacaatcgaggaagctcctagcccggttt

SEQ ID NO: 331063 - DNA, 75 bp, Artificial Sequence
  Synthetic
ggtgaccagagagggccaactagggtgcctgagcttgacctgggagtgggaactcggtgtgtggtcctggctgag

SEQ ID NO: 331064 - DNA, 75 bp, Artificial Sequence
  Synthetic
gacaaggtgaaagaacaagatgtgcaagaaaggatcagagcgctgcgtgaacagtacaatgagacctggcacatg

SEQ ID NO: 331065 - DNA, 75 bp, Artificial Sequence
  Synthetic
gatgaggaacacccgtacaggacatggcagtactggggtagctaccgtacaacaccaactgggtcggcggcatca

SEQ ID NO: 331066 - DNA, 75 bp, Artificial Sequence
  Synthetic
ctgatcaatggggtcgtgaaacttctcagctggccatggaacgcgcgggaagatgtggtgcgcatggccatgacc

SEQ ID NO: 331067 - DNA, 75 bp, Artificial Sequence
  Synthetic
gacacaaccgcctttggacagcagagagtgttcaaagagaaagttgacacaaaagctcaggagccccagccgggg

SEQ ID NO: 331068 - DNA, 75 bp, Artificial Sequence
  Synthetic
acgagagtaattatgagggcagtgaatgactggattctagaacgactggcccagaaaagcaaaccacgtatgtgc

SEQ ID NO: 331069 - DNA, 75 bp, Artificial Sequence
  Synthetic
agcagagaagaattcatagcaaaagtgagatcaaacgcagccttgggagcttggtcggatgagcagaacagatgg

SEQ ID NO: 331070 - DNA, 75 bp, Artificial Sequence
  Synthetic
gcaagtgcgagagaggctgtggaggatcctgcattctggcacctcgtggatgaggagagagagaggcatcttatg

SEQ ID NO: 331071 - DNA, 75 bp, Artificial Sequence
  Synthetic
gggaggtgcgcacattgcgtgtacaacatgatgggaaagagagagaagaaactgggagagtttggagtggcaaaa

SEQ ID NO: 331072 - DNA, 75 bp, Artificial Sequence
  Synthetic
ggcagccgggccatctggtacatgtggctggggagtcgctttctagagtttgaggccctcggattcctaaatgag

SEQ ID NO: 331073 - DNA, 75 bp, Artificial Sequence
  Synthetic
gaccattgggcttccagagagtccagtggaggaggagttgagggaataagcttaaactacctgggttggcacctc

SEQ ID NO: 331074 - DNA, 75 bp, Artificial Sequence
  Synthetic
aagaagctatcaactttgaatggaggtctcttctacgcagatgacactgctggctgggacacgaaggtcaccaac

SEQ ID NO: 331075 - DNA, 75 bp, Artificial Sequence
  Synthetic
gcagacctagaagatgaagaacagatcctgagatacatggaaggtgaacacaaacaactggcggccacaataatg

SEQ ID NO: 331076 - DNA, 75 bp, Artificial Sequence
  Synthetic
caaaaagcataccacgctaaggtggtgaaggtcgcgagaccctctcgtgatggaggctgcatcatggatgtcatc

SEQ ID NO: 331077 - DNA, 75 bp, Artificial Sequence
  Synthetic
acaagaagagatcagagaggctcaggccaggtcgtgacctatgccttgaacaccctcaccaacataaaggttcag

SEQ ID NO: 331078 - DNA, 75 bp, Artificial Sequence
  Synthetic
ttgatccgaatgatggagggtgaaggggttataggagcagaagacgcgcataacccgagactgcttcgagtggaa

SEQ ID NO: 331079 - DNA, 75 bp, Artificial Sequence
  Synthetic
cggtggttgaaagagcatggagaggagcgtcttggaagaatgcttgtcagtggtgatgactgcgtggtgagaccc

SEQ ID NO: 331080 - DNA, 75 bp, Artificial Sequence
  Synthetic
atggatgacagatttggcagggctctctacttcctgaatgacatggctaagactaggaaggacattggggagtgg

SEQ ID NO: 331081 - DNA, 75 bp, Artificial Sequence
  Synthetic
gagccctcagctggcttctcgagctgggaggaggtccctttctgctcacatcatttccatgagctggtgatgaag

SEQ ID NO: 331082 - DNA, 75 bp, Artificial Sequence
  Synthetic
gacggacgcaccctagtggtgccgtgccgtgaccaggatgagctcgtcgggagggcccgcgtctcaccggggtgt

SEQ ID NO: 331083 - DNA, 75 bp, Artificial Sequence
  Synthetic
ggatggagtgttcgtgagacggcttgtctttcaaaagcttacgggcagatgtggctgctgagctatttccaccgg

SEQ ID NO: 331084 - DNA, 75 bp, Artificial Sequence
  Synthetic
cgcgacttgaggactcttgggttcgccatcagctcagcagtgcctgtcgactgggttcccaccggccgtacgaca

SEQ ID NO: 331085 - DNA, 75 bp, Artificial Sequence
  Synthetic
tggagtatccatgctagcggagcctggatgactacagaagacatgctggacgtctggaaccgagtgtggatcctg

SEQ ID NO: 331086 - DNA, 75 bp, Artificial Sequence
  Synthetic
gacaaccccttcatgcagaacaaagagaggatcacggagtggagggacgttccgtatctccccaaggcccaagac

SEQ ID NO: 331087 - DNA, 75 bp, Artificial Sequence
  Synthetic
atggtatgctcctcccttgttggaaggaaggaaagagcagaatgggcgaagaacatctggggagcggtggaaaaa

SEQ ID NO: 331088 - DNA, 75 bp, Artificial Sequence
  Synthetic
gtgaggaaaatgataggtcctgagaggtttaaggactatctctcctgcatggaccgtcatgacctgcactgggag

SEQ ID NO: 331089 - DNA, 75 bp, Artificial Sequence
  Synthetic
ctcaagctggagagctcgataatctaagcccagcctgtgaccgagggaaaattttaagggatcatggaatgatgc

SEQ ID NO: 331090 - DNA, 75 bp, Artificial Sequence
  Synthetic
ggcagcgcgcgatagcgacggggagatggtcgcacccgacgcaccatccatgaggcaacaattcgtgagaccccc

SEQ ID NO: 331091 - DNA, 75 bp, Artificial Sequence
  Synthetic
cctggccaggaaaaggggggtgcaaacaggccaggggtgaagaacacccctagagtgcaccacggcagcacgcca

SEQ ID NO: 331092 - DNA, 75 bp, Artificial Sequence
  Synthetic
gtgagagtggcgacgggagaatggtcgatcccgacgtagggcactctgtagaatttgtgagaccccccgcaccat

SEQ ID NO: 331093 - DNA, 75 bp, Artificial Sequence
  Synthetic
gacaaggccgaacatggtgcaccaaaggggaggcccccggaagcacgcttccgggaggagggaagagagaaattg

SEQ ID NO: 331094 - DNA, 75 bp, Artificial Sequence
  Synthetic
gcagctctcttcaggatttttcctcctcctataccaaattccccctcgacagagggggggcggttcttgttctcc

SEQ ID NO: 331095 - DNA, 75 bp, Artificial Sequence
  Synthetic
tctccctgagccaccatcacccagacacagatagtctgacaaggaggtgatgcgtgactcggaaaaacacccgct

SEQ ID NO: 331096 - DNA, 75 bp, Artificial Sequence
  Synthetic
atgaaaaacccaaaaagagccggtagcagccggcttgtcaatatgctaagacgcggtgcagcccgtgtcatccct

SEQ ID NO: 331097 - DNA, 75 bp, Artificial Sequence
  Synthetic
ccaggaggagggctcaagaggctgcctgtaggattgctgttgggtcggggtccgatcaaaatgatcctggccata

SEQ ID NO: 331098 - DNA, 75 bp, Artificial Sequence
  Synthetic
ctggcattcctacgatttacagcaataaaaccgtccactggcctcatcaacagatggggaaaagtgggcaaaaaa

SEQ ID NO: 331099 - DNA, 75 bp, Artificial Sequence
  Synthetic
gaggccatcaaaatcctcacaaaattcaaggctgacgtgggcaccatgctgcgtatcatcaacaatcggaagaca

SEQ ID NO: 331100 - DNA, 75 bp, Artificial Sequence
  Synthetic
aaaaagagaggagtcgaaactggaattgtgttcctggcattgctggtgtctattgttgctgtggaagtcacaaaa

SEQ ID NO: 331101 - DNA, 75 bp, Artificial Sequence
  Synthetic
aagggggacacctattacatgtttgcggacaagaaggacgccggaaaggtggtgacctttgagactgaatctgga

SEQ ID NO: 331102 - DNA, 75 bp, Artificial Sequence
  Synthetic
cccaaccgttgctccatccaagcaatggacattggacatatgtgtccagctacaatgagctatgaatgtcccgtg

SEQ ID NO: 331103 - DNA, 75 bp, Artificial Sequence
  Synthetic
ctggaaccacagtatgagccagaggatgtcgactgttggtgcaactcgacagcagcatggattgtgtatggcaca

SEQ ID NO: 331104 - DNA, 75 bp, Artificial Sequence
  Synthetic
tgcacccacaagacaacgggagagacaagacgttccagacgttcaatcaccctgccatctcatgcctcacaaaag

SEQ ID NO: 331105 - DNA, 75 bp, Artificial Sequence
  Synthetic
ttggagaccagatcatcgacgtggcttgaatcccgcgaatactccaaatatctaataaaggtggaaaactggatc

SEQ ID NO: 331106 - DNA, 75 bp, Artificial Sequence
  Synthetic
ctccgcaatccaggatatgcgttggtggctgcagtgattggatggactctgggcagcagtcgcagccagaagatc

SEQ ID NO: 331107 - DNA, 75 bp, Artificial Sequence
  Synthetic
atctttgtcactctgctcatgttggtagcccccgcatacagcatcagatgcattggaattggaaacagagacttc

SEQ ID NO: 331108 - DNA, 75 bp, Artificial Sequence
  Synthetic
attgagggaatgtccggtggcacctgggtggacattgtcctggaacatggtggttgtgtgacagtaatgtcaaac

SEQ ID NO: 331109 - DNA, 75 bp, Artificial Sequence
  Synthetic
gacaaacccacattggactttgaactggtgacaacgaccgcaagtaacatggctgaggtcaggtcctactgctat

SEQ ID NO: 331110 - DNA, 75 bp, Artificial Sequence
  Synthetic
gaagctaacatatccgagatggcatcggacagcaggtgccccacacagggggaagcttatcttgacaaaatggcc

SEQ ID NO: 331111 - DNA, 75 bp, Artificial Sequence
  Synthetic
gactcccagtttgtgtgcaagcgtgggtacgttgacaggggctggggaaacggatgtggactctttggaaaagga

SEQ ID NO: 331112 - DNA, 75 bp, Artificial Sequence
  Synthetic
agcattgtcacttgcgctaagttcacgtgtgtgaaaaagctcacagggaaaagcattcaaccggagaatctcgag

SEQ ID NO: 331113 - DNA, 75 bp, Artificial Sequence
  Synthetic
taccgggtccttgtttcggtgcacgcttcccaacatggaggaatgattaacaatgacaccaatcaccaacacgac

SEQ ID NO: 331114 - DNA, 75 bp, Artificial Sequence
  Synthetic
aaggagaacagagcgcgcattgatatcacagctagcgctccccgtgttgaggtggaacttggctcctttggatcc

SEQ ID NO: 331115 - DNA, 75 bp, Artificial Sequence
  Synthetic
ttctcgatggagtgtgaaccccggtcaggattgaactttggtgacctgtattacctcaccatgaacaacaagcat

SEQ ID NO: 331116 - DNA, 75 bp, Artificial Sequence
  Synthetic
tggctggttaatagagattggtttcacgatctttccttgccatggcatacaggagccacatcaaacaatcatcac

SEQ ID NO: 331117 - DNA, 75 bp, Artificial Sequence
  Synthetic
tggaacaacaaggaggcgctggtagaattcagagaagcccacgcaaagaagcagacggctgtggtcctgggaagt

SEQ ID NO: 331118 - DNA, 75 bp, Artificial Sequence
  Synthetic
caggaaggagctgttcacgcagcactggccggcgcactggaggctgagtctgatggacacaaagcgactatctac

SEQ ID NO: 331119 - DNA, 75 bp, Artificial Sequence
  Synthetic
tctggacacttgaagtgtcgcttgaagctagacaaactgcgcctgaagggaatgtcatatgcactctgcacagga

SEQ ID NO: 331120 - DNA, 75 bp, Artificial Sequence
  Synthetic
gcattcaccttcgctcgcaccccctctgaaacaattcacggcaccgccacagtggagctgcaatatgcaggtgaa

SEQ ID NO: 331121 - DNA, 75 bp, Artificial Sequence
  Synthetic
gatgggccgtgcaaagttcccatagtaattaccagtgacaccaatagcatggcctcgacaggcaggctgatcaca

SEQ ID NO: 331122 - DNA, 75 bp, Artificial Sequence
  Synthetic
gcgaatccggtggtcacggaaagtggagcaaactcaaagatgatggtcgagattgaccctccgtttggtgattct

SEQ ID NO: 331123 - DNA, 75 bp, Artificial Sequence
  Synthetic
tacattattgtgggcactggcacaacaaaaattacccaccattggcacagagccggtagttcaattggacgtgca

SEQ ID NO: 331124 - DNA, 75 bp, Artificial Sequence
  Synthetic
tttgaggctaccatgagaggagcaaaacggatggcggtcctcggcgacaccgcttgggactttggctctgttggg

SEQ ID NO: 331125 - DNA, 75 bp, Artificial Sequence
  Synthetic
ggcatgttcaactccgttggaaagtttgtccaccaggtgtttggatcagcatttaaggcattgtttggaggcatg

SEQ ID NO: 331126 - DNA, 75 bp, Artificial Sequence
  Synthetic
tcctggttcacacagctcctgataggatttctgctcatatggatgggtttgaacgcacgcggtggaaccgtggcc

SEQ ID NO: 331127 - DNA, 75 bp, Artificial Sequence
  Synthetic
atgagcttcatgggcattggggctatgctgattttcctagccacctcggtgtcaggagacacaggatgctcggtt

SEQ ID NO: 331128 - DNA, 75 bp, Artificial Sequence
  Synthetic
gacatatccagaagggaaatgcggtgcgggagcggcatattcgtgtacaatgacgttgacgcatggcgaagccgc

SEQ ID NO: 331129 - DNA, 75 bp, Artificial Sequence
  Synthetic
tacaaataccatcctgaaacccccagagctttggccgctgccgtgaaaacggcttgggaagaagggacctgtggc

SEQ ID NO: 331130 - DNA, 75 bp, Artificial Sequence
  Synthetic
attacctcagtgagcagaatggaaaacctgatgtggagctctgtggctggagagttgaatgcaatccttgaggac

SEQ ID NO: 331131 - DNA, 75 bp, Artificial Sequence
  Synthetic
aattcagtgccattgacagtcgtcgttggcgagccaaaatatccactgtacaatgctccaaagaggctgaaacca

SEQ ID NO: 331132 - DNA, 75 bp, Artificial Sequence
  Synthetic
ccagcatcagagttaccgcaggggtggaagtcctggggaaagtcatactttgtctcagccgcaaaaaacaacaac

SEQ ID NO: 331133 - DNA, 75 bp, Artificial Sequence
  Synthetic
tcctttgtggtagatggtgacaccatgaaggaatgcccaagacagaagcgagcatggaacagcttgagaatagag

SEQ ID NO: 331134 - DNA, 75 bp, Artificial Sequence
  Synthetic
gatcatgggttcggagtcttccacactagcatctggctgaaattccatgaggacaactccaccgaatgtgacaca

SEQ ID NO: 331135 - DNA, 75 bp, Artificial Sequence
  Synthetic
gctatcataggaacggcggttcgcgggaaggaagccgttcatagtgacttgggctactggatagagagtgagcgc

SEQ ID NO: 331136 - DNA, 75 bp, Artificial Sequence
  Synthetic
aatgacacatggaggctctctcgagcgcacctgatcgaagcaaagacatgtgaatggccacggtcgcacacactg

SEQ ID NO: 331137 - DNA, 75 bp, Artificial Sequence
  Synthetic
tggacggacggagtggaagagagcgagctgatcattccacgtggcttagccggtcctttcagccatcataacacg

SEQ ID NO: 331138 - DNA, 75 bp, Artificial Sequence
  Synthetic
cgtgctggctacaagactcagaataaaggtccctggcatttaggtgatgttgaaattcagttcgccacgtgcccc

SEQ ID NO: 331139 - DNA, 75 bp, Artificial Sequence
  Synthetic
ggaacaaccgtggtccaggaccaagagtgcagggacaggggcgcttctctacgcacgaccacagctagtggaagg

SEQ ID NO: 331140 - DNA, 75 bp, Artificial Sequence
  Synthetic
gtaatcaatgaatggtgctgcaggtcgtgcaccatgcctccactcagtttcaagacaaaagatggatgttggtat

SEQ ID NO: 331141 - DNA, 75 bp, Artificial Sequence
  Synthetic
gcaatggagatacgtcctgtgaaagaacaagagtcaaacctcgtgcgatcgcacgtcactgccggaagcacagac

SEQ ID NO: 331142 - DNA, 75 bp, Artificial Sequence
  Synthetic
cacatggaccatttctctctcggattagtagtggtcatgttgatggtgcaagaaggtatgaagaagagaatgaca

SEQ ID NO: 331143 - DNA, 75 bp, Artificial Sequence
  Synthetic
tcaaaagcaataatcacctcagcggcctttctcctggcggttatgatagtgggaggtttcacgtaccaggatttt

SEQ ID NO: 331144 - DNA, 75 bp, Artificial Sequence
  Synthetic
gggaggctggtggtattggtgggtgctgcatttgctgagatgaacactggaggtgacgttgcgcacctggcgctg

SEQ ID NO: 331145 - DNA, 75 bp, Artificial Sequence
  Synthetic
gtggcagcgtttaaagtgaggccagcgatgctggtctcattcatgttcagagccttgtggacccccagggagtca

SEQ ID NO: 331146 - DNA, 75 bp, Artificial Sequence
  Synthetic
ctgcttttagctctggctgcctgcctcctgcaggtgtcagtgacaccactggatcattccatcatgatcgtggtt

SEQ ID NO: 331147 - DNA, 75 bp, Artificial Sequence
  Synthetic
gatgggattgcgctgtcctggttgtgtctgaaagccatcttggtgccgcgtaccccaaacatagcccttcctctt

SEQ ID NO: 331148 - DNA, 75 bp, Artificial Sequence
  Synthetic
ctcgctatgctgtcacccatgctccaaggtaccaccattgtggcatggcgagctatgatggcggccctggctgtc

SEQ ID NO: 331149 - DNA, 75 bp, Artificial Sequence
  Synthetic
ataaccttggcttccatgaagcatggaaggggtgtaaaaaagacgtttccctacaccatcggatgcatccttggc

SEQ ID NO: 331150 - DNA, 75 bp, Artificial Sequence
  Synthetic
agcatgggcttagttgaaaacttggggttggttggcctcctcttgttgacagcctcaaaaaagaggagttggcct

SEQ ID NO: 331151 - DNA, 75 bp, Artificial Sequence
  Synthetic
ccgagtgaggtgatgacggctgtcggactgatctgtgcaattgtgggcggactaaccaagaccgacattgacatg

SEQ ID NO: 331152 - DNA, 75 bp, Artificial Sequence
  Synthetic
gcgggacccatggcagccataggactgctggtggtgagctatgtggtttctggcaagagtgtggacatgtacatt

SEQ ID NO: 331153 - DNA, 75 bp, Artificial Sequence
  Synthetic
gaaaaggtgtgtgacatatcatgggacaaggacgctgaaataacaggcacaagtccgcggctggatgtggctctc

SEQ ID NO: 331154 - DNA, 75 bp, Artificial Sequence
  Synthetic
gacgacagtggagatttctcacttatccaggatgacgggccccccactcgagagattgtgttgaaggtgtttctg

SEQ ID NO: 331155 - DNA, 75 bp, Artificial Sequence
  Synthetic
atgtgtgtttgcggtgtcagccccatagccatcccctttgcagccgctgcttggttcgtgtacattaaatcaggg

SEQ ID NO: 331156 - DNA, 75 bp, Artificial Sequence
  Synthetic
aaaagaagcggcgccatgtgggacattccatccccaagagaagtgaaaaaaggggaaacaacggctggagtgtac

SEQ ID NO: 331157 - DNA, 75 bp, Artificial Sequence
  Synthetic
agaatcatgacgcgtaaattgctgggcagcacacaggtgggagccggagtaatgcatgaaggtgtttttcacaca

SEQ ID NO: 331158 - DNA, 75 bp, Artificial Sequence
  Synthetic
atgtggcacgtcacaaaaggttcggcccttcggagtggtgagggacgcctagatccatactggggaaacgtgaag

SEQ ID NO: 331159 - DNA, 75 bp, Artificial Sequence
  Synthetic
caggatttgatctcttactgcggaccatggaaactggatgggaaatgggacggcgtgtcggaagtccaactgata

SEQ ID NO: 331160 - DNA, 75 bp, Artificial Sequence
  Synthetic
gcggtcgccccaggtgagcgcgccagaaatgtgcagacaaaaccaggagtgttcaagaccactgatggggaaatc

SEQ ID NO: 331161 - DNA, 75 bp, Artificial Sequence
  Synthetic
ggggccttggcccttgacttcccaggcggaagttcaggctccccgataattgacaaaaatggacatgtaattggc

SEQ ID NO: 331162 - DNA, 75 bp, Artificial Sequence
  Synthetic
ctgtatggaaatggtgtcgtggtcaagagtggaagctacgtgagtgccatcatgcagacagagaagatggaggaa

SEQ ID NO: 331163 - DNA, 75 bp, Artificial Sequence
  Synthetic
cccgcagttgactgctttgaggaggacatgctgagaaaaaagaagctgacggtgctcgacctccatccaggagct

SEQ ID NO: 331164 - DNA, 75 bp, Artificial Sequence
  Synthetic
ggaaaaactcgaagagtgctccctcagatcgtcaaggctgcaattaagaaacgcctacgcacggtaatcctggca

SEQ ID NO: 331165 - DNA, 75 bp, Artificial Sequence
  Synthetic
cccacccgagtggtggcagctgagatggctgaggcactaaaagaccttccaataaggtacatgactccggcagtt

SEQ ID NO: 331166 - DNA, 75 bp, Artificial Sequence
  Synthetic
tcagccacccatgatggcaatgagattgttgaccttatgtgccacgccacttttacatcaaggctaatgcaacca

SEQ ID NO: 331167 - DNA, 75 bp, Artificial Sequence
  Synthetic
attagggtgcctaattacaatctatatataatggatgaggcccacttcacagatcctgcaagcatcgctgcaaga

SEQ ID NO: 331168 - DNA, 75 bp, Artificial Sequence
  Synthetic
gggtacatagcaacaagagtggacatgggagacgccgcggccatcttcatgacggccacccctcctggcagcact

SEQ ID NO: 331169 - DNA, 75 bp, Artificial Sequence
  Synthetic
gaagctttcccggattcaaacgcccccatcacagatgttgaaacagaggttcctgacaaggcgtggaattctgga

SEQ ID NO: 331170 - DNA, 75 bp, Artificial Sequence
  Synthetic
tttgaatggatcactgattacccagggaaaaccgtttggtttgtccctagtgtcagaatgggcaatgagatctcg

SEQ ID NO: 331171 - DNA, 75 bp, Artificial Sequence
  Synthetic
gcctgcctcacaaaagccggcaaatcggttatccaactcagccggaaaacctttgaaacagagtaccagaagaca

SEQ ID NO: 331172 - DNA, 75 bp, Artificial Sequence
  Synthetic
aagaatggtgagtgggactttgtcgtgaccactgacatctcagaaatgggagccaacttcaaggccgacagagtc

SEQ ID NO: 331173 - DNA, 75 bp, Artificial Sequence
  Synthetic
atagactcacggaaatgcttgaagccagtgattctggatgacatggaagagagagttgttcttgccgggccgatg

SEQ ID NO: 331174 - DNA, 75 bp, Artificial Sequence
  Synthetic
gcagtaacaccatccagcgcagctcaacgcagaggaagaattggaagaaaccccaacaaaactggagatgagttc

SEQ ID NO: 331175 - DNA, 75 bp, Artificial Sequence
  Synthetic
tattacggggggggctgtgccgcaacggatgatgaccatgctcattgggtagaggctaggatgctgcttgacaac

SEQ ID NO: 331176 - DNA, 75 bp, Artificial Sequence
  Synthetic
atctacctccaggacaacctcgttgcatctctgtacaagccagaacaaggaaaggtctcggcaatagaaggggag

SEQ ID NO: 331177 - DNA, 75 bp, Artificial Sequence
  Synthetic
ttcaaactgagaggagaacagaggaaaaccttcgtggagctgatgaagagaggggacttgccagtgtggttgtca

SEQ ID NO: 331178 - DNA, 75 bp, Artificial Sequence
  Synthetic
tatcaagtggcggcctccggactcagctatactgaccggcgctggtgctttgatggaaaaaacaacaacaccatc

SEQ ID NO: 331179 - DNA, 75 bp, Artificial Sequence
  Synthetic
ctggaggactgcgtccccgtcgaggtgtggacaaaatttggagagaaaaagattctgaagcccagatggatggac

SEQ ID NO: 331180 - DNA, 75 bp, Artificial Sequence
  Synthetic
gctcggatctgctctgatcatgcctctttgaagtctttcaaggagtttgctgcaggaaagagaacaatagccact

SEQ ID NO: 331181 - DNA, 75 bp, Artificial Sequence
  Synthetic
ggcttaattgaggcttttgggatgcttcccgggcacatgactgagagattccaggaggccgtcgacaatttggcc

SEQ ID NO: 331182 - DNA, 75 bp, Artificial Sequence
  Synthetic
gtgttgatgagggccgaggcaggctctagggcacacagaatggctgcagcacagctccctgagacaatggaaacc

SEQ ID NO: 331183 - DNA, 75 bp, Artificial Sequence
  Synthetic
atcctgctcctcagcctgctggcattcgtgtcacttggtgtattttttgtactgatgagggcaaaagggttagga

SEQ ID NO: 331184 - DNA, 75 bp, Artificial Sequence
  Synthetic
aaaatggggtccggcatgatcgtgctggcaggaagtggctggctcatgtggatgtctgaggtggaaccagcccgc

SEQ ID NO: 331185 - DNA, 75 bp, Artificial Sequence
  Synthetic
atagcttgtgtggtgatcatagtgtttctgctaatggtcgttctgattccggaaccggagaagcagcgctctccc

SEQ ID NO: 331186 - DNA, 75 bp, Artificial Sequence
  Synthetic
caggacaatcagctggctctaattatcttgatcgcgacgggcctcatcacgctcatcgcggccaatgagctgggt

SEQ ID NO: 331187 - DNA, 75 bp, Artificial Sequence
  Synthetic
tggttagaaagaacaaagagtgacctcaccaggctgttttggagagaacacgctgagccaacaggagggagaggg

SEQ ID NO: 331188 - DNA, 75 bp, Artificial Sequence
  Synthetic
ttttccttctcgctggacattgacctgcggccggcatcggcctgggcaatatatgccgctatgacaaccctgatc

SEQ ID NO: 331189 - DNA, 75 bp, Artificial Sequence
  Synthetic
acaccgacagtccaacacgctgtgaccacatcgtacaacaactactctctcatggctatggccactcaggccgga

SEQ ID NO: 331190 - DNA, 75 bp, Artificial Sequence
  Synthetic
gttctttttggcatgggacggggggtgcctttttacaaatgggactttggcgtgccactccttatgctgggctgc

SEQ ID NO: 331191 - DNA, 75 bp, Artificial Sequence
  Synthetic
tactcacaacttaccccactcaccctgatcgtggctctcgtgatgctagccgctcactatctctatctcatcccc

SEQ ID NO: 331192 - DNA, 75 bp, Artificial Sequence
  Synthetic
gggctccaggcaacggccgccagggccgcccaacgaaggacggctgctggaataatgaaaaacccagtggtggat

SEQ ID NO: 331193 - DNA, 75 bp, Artificial Sequence
  Synthetic
ggaattgtggtaactgacatagacccaatccaaatcgatccaaatgtcgaaaagaagatgggccaggtcatgctc

SEQ ID NO: 331194 - DNA, 75 bp, Artificial Sequence
  Synthetic
atctttgtggctttggcgagcgcggttctcatgagaacggcatggggttggggagaggctggtgcccttgcatcg

SEQ ID NO: 331195 - DNA, 75 bp, Artificial Sequence
  Synthetic
gcagcagctgccaccctatgggaaggggctcccaacaagtactggaattcatcaacggctacatccttgtgcaac

SEQ ID NO: 331196 - DNA, 75 bp, Artificial Sequence
  Synthetic
atatttcggggaagttatctggcaggtccctccctcatctacaccgtcacacgcaatgcaggtatcatgaagaaa

SEQ ID NO: 331197 - DNA, 75 bp, Artificial Sequence
  Synthetic
aggggcggtggaaatggagaaacggtgggcgagaaatggaaggagcgcttgaatcggatgaccgcgcttgaattc

SEQ ID NO: 331198 - DNA, 75 bp, Artificial Sequence
  Synthetic
tacgcctacaagcggtcaggaataactgaagtgtgcagagaacccgccagaagagccttgaaggatggagtcgtc

SEQ ID NO: 331199 - DNA, 75 bp, Artificial Sequence
  Synthetic
acaggaggacacgctgtctcccgcggaagcgcaaagctgcgatggatggtggaacgtggccacgtcaatctagtg

SEQ ID NO: 331200 - DNA, 75 bp, Artificial Sequence
  Synthetic
ggacgcgttgtcgacctcggatgtggaaggggtggctggagttactacgccgcatctcaaaagcaagtcctcgag

SEQ ID NO: 331201 - DNA, 75 bp, Artificial Sequence
  Synthetic
gtgagaggctacacaaaagggggagcgggccacgaggagcccatgaatgtccaaagttatggttggaacatagtg

SEQ ID NO: 331202 - DNA, 75 bp, Artificial Sequence
  Synthetic
cgactcaagagtggagtggacgttttttatctaccatcagaaccatgtgacacgctgctctgtgacattggagag

SEQ ID NO: 331203 - DNA, 75 bp, Artificial Sequence
  Synthetic
tcatcctcgagcccagcagtggaagaagcccggactctgagagtgctcgggatggttgaaacctggctggaacgg

SEQ ID NO: 331204 - DNA, 75 bp, Artificial Sequence
  Synthetic
ggcgtaaagaacttctgcatcaaagtgctctgcccgtacaccagtgccatgattgagcggctggaagccctccag

SEQ ID NO: 331205 - DNA, 75 bp, Artificial Sequence
  Synthetic
cgtcgctacggaggaggcctggtgagggttccactctccagaaattccacccacgaaatgtactgggtctctgga

SEQ ID NO: 331206 - DNA, 75 bp, Artificial Sequence
  Synthetic
gcaaaatcaaacatcatcaggagtgtgaatgccaccagccagctgctcatgcacagaatggacatccccacgcgg

SEQ ID NO: 331207 - DNA, 75 bp, Artificial Sequence
  Synthetic
aaaacaaagtttgaagaagacgtcaatctggggaccggaaccagggcagttgaaagcagagctgaccctcccgac

SEQ ID NO: 331208 - DNA, 75 bp, Artificial Sequence
  Synthetic
atgaaaaaactaggcagccggattgagcggttgagaaaggaatatggatccacttggcactacgatgaaaaccac

SEQ ID NO: 331209 - DNA, 75 bp, Artificial Sequence
  Synthetic
ccctacaggacatggcattaccacggcagttatgaggctgacacgcaaggctccgcctcctcaatggtcaacggc

SEQ ID NO: 331210 - DNA, 75 bp, Artificial Sequence
  Synthetic
gtggtgcgtctcctctcaaaaccatgggatgcattgagctcggtcaccaacattgctatgacggacacaactccg

SEQ ID NO: 331211 - DNA, 75 bp, Artificial Sequence
  Synthetic
tttggacagcagcgggtgttcaaggagaaagtggacacccggactccagaccccaagcagggcacgcaaagagtc

SEQ ID NO: 331212 - DNA, 75 bp, Artificial Sequence
  Synthetic
atggccataacatcacaatggctgtgggaccgcctagcaagaaacaagacccctcggatgtgcacgcgacaggaa

SEQ ID NO: 331213 - DNA, 75 bp, Artificial Sequence
  Synthetic
ttcataaacaaggtcaacagtcacgcggcgttgggacccgtttttagagaacagcagggatggggttcagcggcc

SEQ ID NO: 331214 - DNA, 75 bp, Artificial Sequence
  Synthetic
gaagcggtggtagatcctaggttttgggagctcgttgacaatgaaagagaagcccatttgagaggggagtgcttg

SEQ ID NO: 331215 - DNA, 75 bp, Artificial Sequence
  Synthetic
acctgtgtctacaacatgatggggaaaagagaaaagaagctcggtgaattcgggaaggcaaaaggcagcagagcc

SEQ ID NO: 331216 - DNA, 75 bp, Artificial Sequence
  Synthetic
atttggtacatgtggctgggagcccgcttcctcgagttcgaggccctgggcttcctcaatgaagaccactggtta

SEQ ID NO: 331217 - DNA, 75 bp, Artificial Sequence
  Synthetic
agcagagagaactctggagggggagttgagggcttgggcctccaaaaacttggatacatccttgaagagatcagc

SEQ ID NO: 331218 - DNA, 75 bp, Artificial Sequence
  Synthetic
aggaggccaggaggcaaaatgtatgccgatgacacggctggctgggacacccgcatcacgaaatgcgacctagaa

SEQ ID NO: 331219 - DNA, 75 bp, Artificial Sequence
  Synthetic
aatgaggcgcgcattttggaaaaaatggacgggatccacaaaaaactcgcacgggccgtcatcgagttgacatac

SEQ ID NO: 331220 - DNA, 75 bp, Artificial Sequence
  Synthetic
aagcataaggttgtgagagtcttgagaccagcaccacaagggaaggtcgttatggacatcatctccaggccagac

SEQ ID NO: 331221 - DNA, 75 bp, Artificial Sequence
  Synthetic
caaagggggagtgggcaggtggttacttatgccctcaacacctatacaaacttggtggtgcagctgatccgtaac

SEQ ID NO: 331222 - DNA, 75 bp, Artificial Sequence
  Synthetic
atggaagcagaggctgtcatcaatgaaagagacatggaggagctccaaaacccatggaaagtcatcaattggcta

SEQ ID NO: 331223 - DNA, 75 bp, Artificial Sequence
  Synthetic
gaaggaaatggatgggacagactccgctcgatggcagtgagtggagatgactgtgtcgtgaaaccaatggatgat

SEQ ID NO: 331224 - DNA, 75 bp, Artificial Sequence
  Synthetic
aggttcgcctatgcactgaatttcctcaatgacatgggcaaggtcagaaaagatgtccaggaatggaagccctcg

SEQ ID NO: 331225 - DNA, 75 bp, Artificial Sequence
  Synthetic
ccggggtggacaaactgggaagaagtgcccttttgctcccaccacttcaacaagctcccgatgaaggatggaaga

SEQ ID NO: 331226 - DNA, 75 bp, Artificial Sequence
  Synthetic
acaataatagttccctgccggcaccaagatgagttgataggcagggctagagtttctccaggaaaaggctggtca

SEQ ID NO: 331227 - DNA, 75 bp, Artificial Sequence
  Synthetic
ctcagtgaaacagcatgcttgggcaagtcttatgcccagatgtggctactgttgtactttcacaggagagatctc

SEQ ID NO: 331228 - DNA, 75 bp, Artificial Sequence
  Synthetic
cgactcatggcaaacgcaatctgctctgctgtaccggtgagttgggtgcccacggggagaacaacctggtccatc

SEQ ID NO: 331229 - DNA, 75 bp, Artificial Sequence
  Synthetic
catgggcgtggagagtggatgacaacagaggacatgctagaggtatggaacagagtgtggatcatagagaatgag

SEQ ID NO: 331230 - DNA, 75 bp, Artificial Sequence
  Synthetic
tacatggaggacaagacccctgtcacagagtggaccgatgttccatacttgggaaagagagaagacttgtggtgc

SEQ ID NO: 331231 - DNA, 75 bp, Artificial Sequence
  Synthetic
ggctcccttattggacacaggccaagaagcacatgggcagagaacatctgggctgccatttatcaagtgcgccga

SEQ ID NO: 331232 - DNA, 75 bp, Artificial Sequence
  Synthetic
gcaatcggcgaaactgaagaatatagagactacatgagcacacaggtccgctatggctcggaggaagggccaagc

SEQ ID NO: 331233 - DNA, 75 bp, Artificial Sequence
  Synthetic
gaagaatatagagactacatgagcacacaggtccgctatggctcggaggaagggccaagcgctggtgtgttgtaa

SEQ ID NO: 331234 - DNA, 75 bp, Artificial Sequence
  Synthetic
attgcagagcaatatatcttttaaaaaccaagagagagaaattctacatcctaagggaagaaggagtaggagggg

SEQ ID NO: 331235 - DNA, 75 bp, Artificial Sequence
  Synthetic
cttttgttttgaccctgatgcaaagatgaatttcctctcaagtgttgcactctatgagtcatgtattagctcagg

SEQ ID NO: 331236 - DNA, 75 bp, Artificial Sequence
  Synthetic
ggtttctctggcttatcttttgaaattaaactatatctctagtttgaagttaattataaaccctaagaatttaga

SEQ ID NO: 331237 - DNA, 75 bp, Artificial Sequence
  Synthetic
gattaaagaaggcttgaccccagatgttgaatcatggagtgacactagacggcacctgttcattaaaactcttgt

SEQ ID NO: 331238 - DNA, 75 bp, Artificial Sequence
  Synthetic
atttttttgttctaaaccatttgctctcagagacgtgaatccactatgtctgctcttagtttgttttctcagttt

SEQ ID NO: 331239 - DNA, 75 bp, Artificial Sequence
  Synthetic
agctcatgcttccttatcgcccctagatagattagagtcaattaattgcctccacaacatggtaaagatcaattt

SEQ ID NO: 331240 - DNA, 75 bp, Artificial Sequence
  Synthetic
gaaagtactaggatacggggagtaaacttaactgatgacaatcatgtggtgggctttgatgttattaacctcatt

SEQ ID NO: 331241 - DNA, 75 bp, Artificial Sequence
  Synthetic
ccttcctattttcttgcatgtttttatgggggggttttctacattgacgaatgaatcttttactatccaacgcat

SEQ ID NO: 331242 - DNA, 75 bp, Artificial Sequence
  Synthetic
tatgttgatcttagtagaatggcacccaagggaagagcaataatggttgaactcctttataaaattgcatttgat

SEQ ID NO: 331243 - DNA, 75 bp, Artificial Sequence
  Synthetic
tgatgatgtactgacttccagtattcaaacactattaagcatatgtggagacaagataggtctcaagattgtgat

SEQ ID NO: 331244 - DNA, 75 bp, Artificial Sequence
  Synthetic
cctagttatgaaaattatgtccgggtaagtgcggtgttgtctatcatgctttatgagttagcagtctcagatatg

SEQ ID NO: 331245 - DNA, 75 bp, Artificial Sequence
  Synthetic
tgagagaatgaaaggtctccaaagcacaactcctcttaaaatactaatgaatcctttaggtcttgaattggatga

SEQ ID NO: 331246 - DNA, 75 bp, Artificial Sequence
  Synthetic
gttcttcaagaattcgcgaaagaggcatccattacacttatctttactcaatgccgttgggatgcaaaacttgga

SEQ ID NO: 331247 - DNA, 75 bp, Artificial Sequence
  Synthetic
tggtctgagagaagaaccacctgctttggatcatgaaattcgagatttgatgtacgaaagtaaaaatactttggt

SEQ ID NO: 331248 - DNA, 75 bp, Artificial Sequence
  Synthetic
ccgataatcagccggaacacaaatgataatattggagagacctttggtgtgcagactgcattaactggagaactt

SEQ ID NO: 331249 - DNA, 75 bp, Artificial Sequence
  Synthetic
cacttgtgcattagattattgcggctcagaggaactggaagatttcgcatctaagattattggtaacaactcggt

SEQ ID NO: 331250 - DNA, 75 bp, Artificial Sequence
  Synthetic
gggaaaatgcgtgctccaccaaagaatgttgatccatcttttacagcagatagatgtgctcaaccatggcttatt

SEQ ID NO: 331251 - DNA, 75 bp, Artificial Sequence
  Synthetic
gcatgtcttattagcatcaacgatttttgataattctctgcaaggaagactttttggttttctaaatgggttgtg

SEQ ID NO: 331252 - DNA, 75 bp, Artificial Sequence
  Synthetic
ctcccaaaagtggtaacaaatccggacagaatttatgagacatataacaccagatttgcaagattcaatcaagag

SEQ ID NO: 331253 - DNA, 75 bp, Artificial Sequence
  Synthetic
caagactagaacattgcagcaaaaagttctcaaaaggcaaaaatatatgctgcagagaaaacgtattattacatt

SEQ ID NO: 331254 - DNA, 75 bp, Artificial Sequence
  Synthetic
aaagcattagacaaagaagctagattggagccagaccatgctaagatgctgacaactttaattaggtctaatata

SEQ ID NO: 331255 - DNA, 75 bp, Artificial Sequence
  Synthetic
ggaggcatctggcaaggttcgaaaatttgttggattaataggggaagaaaaattaagagtgaatgattcaggttc

SEQ ID NO: 331256 - DNA, 75 bp, Artificial Sequence
  Synthetic
ggattaaggagagtcctagcaaatgtcctaattaaaattggatcatctacgaaccatgggagtagacttgcaggt

SEQ ID NO: 331257 - DNA, 75 bp, Artificial Sequence
  Synthetic
aattaatctcttatattatgaagtacatgggtaccaaacatgttcccttgaaattgcagaaaaattgagaagcat

SEQ ID NO: 331258 - DNA, 75 bp, Artificial Sequence
  Synthetic
tatatagctgacataaacccatacattgaaaaccaaggtatgactgcttttttcatcacagttaacaatgccatc

SEQ ID NO: 331259 - DNA, 75 bp, Artificial Sequence
  Synthetic
gagaggaaagatgtgtaaggggaaagaaaatttagttttcaggttccattcttctcctagcataagagagatgat

SEQ ID NO: 331260 - DNA, 75 bp, Artificial Sequence
  Synthetic
cagactcgaagtcccttaatcataacgggtgcattgaatcaagacttgtcaagatttaaggaacttatgaaattg

SEQ ID NO: 331261 - DNA, 75 bp, Artificial Sequence
  Synthetic
atcaattcaaactgtgccaccatctgtatcccaacctcatctggtagttactctaagccccgggagtggaggttc

SEQ ID NO: 331262 - DNA, 75 bp, Artificial Sequence
  Synthetic
catatgagacttggcaatagggctccctatcttgccctcatggattctcctctcaagaatagattcgcccctgca

SEQ ID NO: 331263 - DNA, 75 bp, Artificial Sequence
  Synthetic
accttatcttggaagttctacagaagaaagaacgaaccataatgactgggatcaagatactttaactcccccagg

SEQ ID NO: 331264 - DNA, 75 bp, Artificial Sequence
  Synthetic
gagtactcaaacttatatagttttgcaattggattcgggatagaaaataatcctactcttaaagattttaatcat

SEQ ID NO: 331265 - DNA, 75 bp, Artificial Sequence
  Synthetic
caagacagcgattcagttagccactctgagcaagtggatcaccggagacactaaaatagtagagtctgtggtgag

SEQ ID NO: 331266 - DNA, 75 bp, Artificial Sequence
  Synthetic
gcttctagggtgacaaatctgaggtgggtggacatgggcaaggaagaggcgagaagactctccgtcaggattgca

SEQ ID NO: 331267 - DNA, 75 bp, Artificial Sequence
  Synthetic
gaacttactacaagttggggaggaggaaatgtcaatggaagatttgcctgaacaggttctttctagaaattttga

SEQ ID NO: 331268 - DNA, 75 bp, Artificial Sequence
  Synthetic
aaatctgatgctgcagaacatggttttgatgaggaagatctcatgctggccacatcagggtggaacggtactctt

SEQ ID NO: 331269 - DNA, 75 bp, Artificial Sequence
  Synthetic
tcacagattgaattctactagggctgaaactacgtatatggtgccatataaagataaaatgaattataagatgtc

SEQ ID NO: 331270 - DNA, 75 bp, Artificial Sequence
  Synthetic
cctgaatccaagattgggtcagtcaaatctattccagaggacacaatgaaggatgacatgttaacagaactcatg

SEQ ID NO: 331271 - DNA, 75 bp, Artificial Sequence
  Synthetic
gttttcaaccaatttcttcaaaattactagtgacatgatcttacacggtgataataataaaatactggattcaga

SEQ ID NO: 331272 - DNA, 75 bp, Artificial Sequence
  Synthetic
gcgagattccgtttcagtggtgactctgagagtgatgatgccacagctggtaggactggtcctccaagacaggca

SEQ ID NO: 331273 - DNA, 75 bp, Artificial Sequence
  Synthetic
tgatactaatgtaatataccaaaattgtatcatacactgtttatcatctacactgagcaccttagataaatccat

SEQ ID NO: 331274 - DNA, 75 bp, Artificial Sequence
  Synthetic
aacccaaactcggatgaaatacaattatcagatatttaacatgatattagtttctccacataagttctgtaaaac

SEQ ID NO: 331275 - DNA, 75 bp, Artificial Sequence
  Synthetic
agaagttgtaaaagacatagttgataatgaacccactcaaagtcaatgtaccaaggaggttaatgatgtaggata

SEQ ID NO: 331276 - DNA, 75 bp, Artificial Sequence
  Synthetic
aaaaaaagagagagaagttaaataaattctatttttcttctcttcttattacctctttctatcctcattcttgtc

SEQ ID NO: 331277 - DNA, 75 bp, Artificial Sequence
  Synthetic
tattgtagaaaatttggaagaggaatctattaaaagatctaataacgcactccaatttgacacccatcaaacaac

SEQ ID NO: 331278 - DNA, 75 bp, Artificial Sequence
  Synthetic
taacgaatcagttgcagacaatatccccacaaatttcgacctgagatctattttacaattgaaagtacaaaataa

SEQ ID NO: 331279 - DNA, 75 bp, Artificial Sequence
  Synthetic
agatttgattccagtagagggacattccttgccagtatctttcaaaggaaatatagaccaaaggaaaaggattat

SEQ ID NO: 331280 - DNA, 75 bp, Artificial Sequence
  Synthetic
caatgaggatcggacacggattaagcccaagacgattgagtgctctatcaaggcaaattaagttttaccttaaag

SEQ ID NO: 331281 - DNA, 75 bp, Artificial Sequence
  Synthetic
agcatatggagttttgaaaagaaattgctgtattcgtctgtcagattttatgcaagttccttttgatccgtgctg

SEQ ID NO: 331282 - DNA, 75 bp, Artificial Sequence
  Synthetic
tccgaactccaatgactataccattatccatagtctcatcctctaggacgttctccccatggcccgattgcgatg

SEQ ID NO: 331283 - DNA, 75 bp, Artificial Sequence
  Synthetic
tgaaagtcagatgagaatttcttgtaactacaaaccttttgctacaactatcattccgagattgagagctaagag

SEQ ID NO: 331284 - DNA, 75 bp, Artificial Sequence
  Synthetic
gccttcaaaagtggataagagagtctacacacaaagatcttttgagtggtgcatacatcatcatgaagaccacat

SEQ ID NO: 331285 - DNA, 75 bp, Artificial Sequence
  Synthetic
gatgaatgtagaggatttaggtctctattatgaagagaaacttgggtatcttatgggttattatttggggagaat

SEQ ID NO: 331286 - DNA, 75 bp, Artificial Sequence
  Synthetic
ggcgagtaggagcactagagaggaccagggtatgcaaaatccaagaaattgaagtggatccaggggatgaagata

SEQ ID NO: 331287 - DNA, 75 bp, Artificial Sequence
  Synthetic
tttgatcagatcttcatcgaaagttagaggtctgagtgaagaaaattttctagaagtttcttcaagtgggtctaa

SEQ ID NO: 331288 - DNA, 75 bp, Artificial Sequence
  Synthetic
gagtccaatatgtgaacctattgcttttgaactcctcatatattcttgaggttccacttccaaatgcttataaga

SEQ ID NO: 331289 - DNA, 75 bp, Artificial Sequence
  Synthetic
taaaaactattcatcagaaatatctttgtgtaattttgatgcatttatcatcggactggtgtggggattacttta

SEQ ID NO: 331290 - DNA, 75 bp, Artificial Sequence
  Synthetic
catttgagatagggtggccagatccagatcttggctctcccgacatatatgatacaaatcttgacaatcctgagg

SEQ ID NO: 331291 - DNA, 75 bp, Artificial Sequence
  Synthetic
tacgattatgtcttatcttaatcctgaatatgtgtctaatccccgtgaagttgaacctcatgtcactcaaatgat

SEQ ID NO: 331292 - DNA, 75 bp, Artificial Sequence
  Synthetic
tgttaacagtggagataaaggattcatctggtgtatccaagctagagttcactattgctgtggatcaccaatctc

SEQ ID NO: 331293 - DNA, 75 bp, Artificial Sequence
  Synthetic
ggtttcaataactcatcgaggcctagatacacttaaaaatactttatcggataagagggtccaggagtgtcgatc

SEQ ID NO: 331294 - DNA, 75 bp, Artificial Sequence
  Synthetic
acacctctccagaatgacttctccgtttggggaaatgcaagggattcaaaacttctactcgaacgagaatccaat

SEQ ID NO: 331295 - DNA, 75 bp, Artificial Sequence
  Synthetic
aagatctaaaatacgttggtcctactatggagtatctacagaaaaccaatccatcttggaagatttgcaatattt

SEQ ID NO: 331296 - DNA, 75 bp, Artificial Sequence
  Synthetic
aaatgatatatctagataacccccgagattcattgaaacaaccagaagcaaacatggataataaacaacataaaa

SEQ ID NO: 331297 - DNA, 75 bp, Artificial Sequence
  Synthetic
agtgactcggacatataggaatcttcctgatatattaagagggcactctaatcctcctttgattttggataatag

SEQ ID NO: 331298 - DNA, 75 bp, Artificial Sequence
  Synthetic
actaggttacgcttctggtcaaatataaaaaccgagagagaagtgaagtactttatctgttacttagtatctaaa

SEQ ID NO: 331299 - DNA, 75 bp, Artificial Sequence
  Synthetic
gaaaagaggagtgttagatgatgaagtacatgactcaaaccttaacccttacatttctactttggatcaggtatt

SEQ ID NO: 331300 - DNA, 75 bp, Artificial Sequence
  Synthetic
atcttctgaaatctgtattcctctctttcttttcctattccttcctcatttcatcaactgaggtttggctaaatc

SEQ ID NO: 331301 - DNA, 75 bp, Artificial Sequence
  Synthetic
caaaaagttattccaaaataggagtaatccggatatcaatatccctgttgtttatttggatgcaaaaatcccaat

SEQ ID NO: 331302 - DNA, 75 bp, Artificial Sequence
  Synthetic
atccacattcccctcagtcatggagctggctggaagtgttctagatgtaaagactcaaactctcatggagggaat

SEQ ID NO: 331303 - DNA, 75 bp, Artificial Sequence
  Synthetic
tttatgtagggaaattgttatcaagataaggaattcttcgatgggcaatttgagtcaggaacagattcaggatga

SEQ ID NO: 331304 - DNA, 75 bp, Artificial Sequence
  Synthetic
attagctgcaaccaaagaagacactgtcataagtgattggtcatctgatattgacaccgcaatgaagaacaactc

SEQ ID NO: 331305 - DNA, 75 bp, Artificial Sequence
  Synthetic
gagagaaaattcccttcctgataaaatccggatatccttgggtctccatagtgttaagttgaggaaagaagatac

SEQ ID NO: 331306 - DNA, 75 bp, Artificial Sequence
  Synthetic
agatcctcaaatacctgcttgggcttctggagttaactacaacatagacgaggcggaagatgaaaagcaggcctt

SEQ ID NO: 331307 - DNA, 75 bp, Artificial Sequence
  Synthetic
tattggtcttgaggttaaaacatctaaacacacttgttgggatggagaatacagtaatccgatcacgggaatttt

SEQ ID NO: 331308 - DNA, 75 bp, Artificial Sequence
  Synthetic
agattgcaaggatatcagtgtggaggaatatttgaggatgccaagtgcaccagaagcacacgacatacctgagga

SEQ ID NO: 331309 - DNA, 75 bp, Artificial Sequence
  Synthetic
tgttgaacctgttcttctactacaagtcaggactaatgaaaatagtaaactgattcacctttgcactagaacaca

SEQ ID NO: 331310 - DNA, 75 bp, Artificial Sequence
  Synthetic
tacaaacaggttctccactatatatgaagtggatgaagaatgtggtgaaagggccattctatccttaaatgggga

SEQ ID NO: 331311 - DNA, 75 bp, Artificial Sequence
  Synthetic
tggtttgaattcaactaccggttttaaatgtgtgtctctaataagaaatgcatttgatattattccggaaggacc

SEQ ID NO: 331312 - DNA, 75 bp, Artificial Sequence
  Synthetic
ggacaccaacgaaccaacagggcacatagaaggtgagtctggaacagcaactcatcaaggggaatataccataga

SEQ ID NO: 331313 - DNA, 75 bp, Artificial Sequence
  Synthetic
cattctgatgatgggggagggctccgggaacttctgtgcattgactctcagaatgcatgaatttttaagaggaga

SEQ ID NO: 331314 - DNA, 75 bp, Artificial Sequence
  Synthetic
cttggggcaaattaacagagacatcaaaaacagcatccaaacattcatagaaaccgggaaaagacatccggacat

SEQ ID NO: 331315 - DNA, 75 bp, Artificial Sequence
  Synthetic
ggaaaactatgagatgtacgtgcagtcgatgcatggagattatgatggatatacgaaagaattatggataccgtc

SEQ ID NO: 331316 - DNA, 75 bp, Artificial Sequence
  Synthetic
tctggcgattaatcctaaactctttatgcaaaatgcagctataatatggggaaattctgcagtccgaggaagagc

SEQ ID NO: 331317 - DNA, 75 bp, Artificial Sequence
  Synthetic
agagttagagaatgctggttttgatgtcataccattatttccagacaaaggaatttacgatgtgcaaaaaaagaa

SEQ ID NO: 331318 - DNA, 75 bp, Artificial Sequence
  Synthetic
aaatatatctccgatctccttcatacatttaagaagtgggatcagtcacccaataaaaagctggttcttcctagg

SEQ ID NO: 331319 - DNA, 75 bp, Artificial Sequence
  Synthetic
aggggtgttctcacttcaaccttttcctatgacaaatggtgatattttagatccttcttacctgagcaggttgga

SEQ ID NO: 331320 - DNA, 75 bp, Artificial Sequence
  Synthetic
aatgatgatggcatcttttaataagaaaggaaaacctacaggaagagcatttttcgtacctcatgaacaaataat

SEQ ID NO: 331321 - DNA, 75 bp, Artificial Sequence
  Synthetic
acctttaatccgatcatgtgtactgattacttgtgatgcagagtttgaatctgggactaatccacgtcttatata

SEQ ID NO: 331322 - DNA, 75 bp, Artificial Sequence
  Synthetic
ggctatatctcaaaaagacatgcagaactttaataaagtaaaacatattctggataagtacaaagaagatacaag

SEQ ID NO: 331323 - DNA, 75 bp, Artificial Sequence
  Synthetic
taggatgattaattatgttcttgaaagaagcccttgttgctttataattaaatgcttgatgaggtcgaagatgac

SEQ ID NO: 331324 - DNA, 75 bp, Artificial Sequence
  Synthetic
acagtccaatatctttatagttgatatcacaagagaaatagtactaaatgagaaaatgaaacagtttggagtgat

SEQ ID NO: 331325 - DNA, 75 bp, Artificial Sequence
  Synthetic
ttatttaatagatgagatcatcgcttcgaattggtacagggagatcaagatcttggcttatgtgccttataatca

SEQ ID NO: 331326 - DNA, 75 bp, Artificial Sequence
  Synthetic
tagaagttatgcactttgtgttcctaaataccaccatctatttccaagttcaagtttaaatacaatatttgggca

SEQ ID NO: 331327 - DNA, 75 bp, Artificial Sequence
  Synthetic
aggttataatgatttggaagtttacttgatattcagacttgaagttgagccgactcccctcatagacattaattt

SEQ ID NO: 331328 - DNA, 75 bp, Artificial Sequence
  Synthetic
agttcaaagtggtaacattagaatgcacataggggagagagaagtaattgaagatcttaacgccaagtgtataga

SEQ ID NO: 331329 - DNA, 75 bp, Artificial Sequence
  Synthetic
aataagtagcatccgacgttctctttcaattctggagtgggttaaagaaacccaatcagaaagatatttgattgc

SEQ ID NO: 331330 - DNA, 75 bp, Artificial Sequence
  Synthetic
gtacaacctgagcgatctccctagcgatgtgctgaacggagaaagggaggaagacaagagcaacagatatattca

SEQ ID NO: 331331 - DNA, 75 bp, Artificial Sequence
  Synthetic
gaaattgggaataccttctaattttgataaaatacagcttctattaagaatatgtcccaagataactgggaagga

SEQ ID NO: 331332 - DNA, 75 bp, Artificial Sequence
  Synthetic
agatgacatggatgaggataaaaagagaaagacaaatccaactccaataacattgaatgagcttagaagagaatt

SEQ ID NO: 331333 - DNA, 75 bp, Artificial Sequence
  Synthetic
gaaaaccggaagggagatcttggacttaatagaggaatccataataaaccgtgtaaaacttactagacgcactat

SEQ ID NO: 331334 - DNA, 75 bp, Artificial Sequence
  Synthetic
ggactccatttctcaaaatcagacacagttccaagaaattatccttcttattcttaaaaaacaagaggaaaggat

SEQ ID NO: 331335 - DNA, 75 bp, Artificial Sequence
  Synthetic
gaacaggaaattttccgatctatcttggactcaagatccagtttcaatattccaaaatgaggttgattacatttt

SEQ ID NO: 331336 - DNA, 75 bp, Artificial Sequence
  Synthetic
agataaaatttcagaaatattgggggatgtcctaagcctccagcagaagacgacatcacaaggagagatttggct

SEQ ID NO: 331337 - DNA, 75 bp, Artificial Sequence
  Synthetic
atctcaaattattttgatccagatcttggagaattatggaaagtcaggataccttcctgaagacactattaatca

SEQ ID NO: 331338 - DNA, 75 bp, Artificial Sequence
  Synthetic
cggggccagtattaaggcagcagaaaaaatctctcaatttgaaggaaatcaagagacatatcaaacctatctttt

SEQ ID NO: 331339 - DNA, 75 bp, Artificial Sequence
  Synthetic
ggtgttttcttttattttaaaggatacgagtctaacaataatacctgaaataggagaaaagaaaatttattcctt

SEQ ID NO: 331340 - DNA, 75 bp, Artificial Sequence
  Synthetic
gaccaagattatgatacacttgagagaatcagaacagagaattatcaaagagttatgccattttaaaactaatcc

SEQ ID NO: 331341 - DNA, 75 bp, Artificial Sequence
  Synthetic
taaacagatggatattaaagaaaccaaagttgaaactaaagagataccaagaccattggctaaaaatgttctaaa

SEQ ID NO: 331342 - DNA, 75 bp, Artificial Sequence
  Synthetic
tgtgagaccggaaataccgactcctaacctccttcttaggcgcgctcttgaaacaatgacggaggagatgagcct

SEQ ID NO: 331343 - DNA, 75 bp, Artificial Sequence
  Synthetic
gttagtcggacacataattttgctgcttagtggatcttgtcaagtaggtcttgaataatgatcttaaggttgtag

SEQ ID NO: 331344 - DNA, 75 bp, Artificial Sequence
  Synthetic
tcatccaaaagagaacctcatcaaatggaatcctaagataactgaaatcgttgagtccaaagatcctgagagaat

SEQ ID NO: 331345 - DNA, 75 bp, Artificial Sequence
  Synthetic
tttttacttaattaagttttatacctgatcctctcctctgaaatctcttcacaatttatgtatattctttatatg

SEQ ID NO: 331346 - DNA, 75 bp, Artificial Sequence
  Synthetic
taacaaaatggtccgtttcatgattcaggaaagaaacaagtactagtaagtctcgattcctgcctcttaatggca

SEQ ID NO: 331347 - DNA, 75 bp, Artificial Sequence
  Synthetic
atatattatcgagaaatataaattaaaaaatttgaaaaccagtttgatataagggtgtatggtctatctgaggat

SEQ ID NO: 331348 - DNA, 75 bp, Artificial Sequence
  Synthetic
aaagccaagaagcccccaaggaccacacgcacccaatgggaccccaagcattccaattaaaaaagagagagagaa

SEQ ID NO: 331349 - DNA, 75 bp, Artificial Sequence
  Synthetic
gatgtccagaccacccagacccacgaccccctcttgaagaaaaagagaaaaaattaaaaaaatgaaacaaaaagc

SEQ ID NO: 331350 - DNA, 75 bp, Artificial Sequence
  Synthetic
acccagacccacgaccccctcttgaagaaaaagagaaaaaattaaaaaaatgaaacaaaaagcgattgataatta

SEQ ID NO: 331351 - DNA, 75 bp, Artificial Sequence
  Synthetic
gttgacgtaaaggatattagacatataatacaaattgcttgttttattgatccaaatgagtttctcaaagcttgg

SEQ ID NO: 331352 - DNA, 75 bp, Artificial Sequence
  Synthetic
atacatgataggaggtgacttatccgctttggtttcatcagcactaaaattgccaccggatgaagctatgctggt

SEQ ID NO: 331353 - DNA, 75 bp, Artificial Sequence
  Synthetic
tgggaaaacgattcctcattaccttcaaggtccgggtttgtcagccagcagatacccaagttgtgagttgacctt

SEQ ID NO: 331354 - DNA, 75 bp, Artificial Sequence
  Synthetic
atttgcggcgagaattggggtcgaccaaaacaggcccatagcaatttccctaggattttgtagccttcctgttac

SEQ ID NO: 331355 - DNA, 75 bp, Artificial Sequence
  Synthetic
acaagaatctattgaccagaactttgtagggcttaaattggtagctttaagatttccaggtaaacaacaaagtgt

SEQ ID NO: 331356 - DNA, 75 bp, Artificial Sequence
  Synthetic
gattattaaatccgatggtcctttatcaggaaattcaaattggggaaagagaatatcgaaaggaataattataga

SEQ ID NO: 331357 - DNA, 75 bp, Artificial Sequence
  Synthetic
agaagctcatttcggatccttcttgttagaggtaccttatgggatccccctactcttggaggtcaaaggaggtgt

SEQ ID NO: 331358 - DNA, 75 bp, Artificial Sequence
  Synthetic
cgtaacaaggattccagattctgaaattacaagtatcccaatgtatccgtatggatgctccaagattacctctac

SEQ ID NO: 331359 - DNA, 75 bp, Artificial Sequence
  Synthetic
tccaagaacgcttggattaatgcttaaaatcatgctgggtccaacccaagataagaacattaagacaagagattt

SEQ ID NO: 331360 - DNA, 75 bp, Artificial Sequence
  Synthetic
agttgttccactccgtgttattggaaaaccagtgaatggcagtccagaagatgaaatcaatgcagtcgcattggc

SEQ ID NO: 331361 - DNA, 75 bp, Artificial Sequence
  Synthetic
tcttaaggattctatcaagaacatcagtcttggaagattggctggattatgtcttattgtggagttgagggaagg

SEQ ID NO: 331362 - DNA, 75 bp, Artificial Sequence
  Synthetic
tatacatccaatattagctcccttttttaaaaagttgaggataatcattagtccattagttaactctcagtgtga

SEQ ID NO: 331363 - DNA, 75 bp, Artificial Sequence
  Synthetic
catcctagcttggtctagaggaggatggattgaagtggaccaaattagacctatactcttctttgggagtggttg

SEQ ID NO: 331364 - DNA, 75 bp, Artificial Sequence
  Synthetic
tggattgtttagcacagaatacagcacgtctatgacatctgagattaaaggcttcaacccagaaggtcgtcccac

SEQ ID NO: 331365 - DNA, 75 bp, Artificial Sequence
  Synthetic
gattggtgatccaatattgggggaaagacccaagaaaaaagagtccaatccgatcacatggcttcaaaagaaatc

SEQ ID NO: 331366 - DNA, 75 bp, Artificial Sequence
  Synthetic
ttcaaaaaaagagtgattatgaagacaaaacctcagcaaaagacataacgaaaacacaaccacaagcaaagccca

SEQ ID NO: 331367 - DNA, 75 bp, Artificial Sequence
  Synthetic
agcccctgcacatctgatacaaaggcaccaaaagaaaccagaaataacctccagtcattcactacccacttaaga

SEQ ID NO: 331368 - DNA, 75 bp, Artificial Sequence
  Synthetic
cgccaagggaactttatatccaccccaaaatcaaagctcttttatatagtcagccctcccctaaatggagaacca

SEQ ID NO: 331369 - DNA, 75 bp, Artificial Sequence
  Synthetic
acacataataattaaaaaaaagaaaaaggggaaaaaaggaaagaaaaacaaaaaggagcggaagaaaaaaggaaa

SEQ ID NO: 331370 - DNA, 75 bp, Artificial Sequence
  Synthetic
gagagagaaagaaagagagaagaaaagcacacccaaacctcaactgaaacccaagatactaaccaatctccgtgg

SEQ ID NO: 331371 - DNA, 75 bp, Artificial Sequence
  Synthetic
agactcccccatggagactccacaactgttttccgggagaacaggacatcagtggtcaagaagatatattagata

SEQ ID NO: 331372 - DNA, 75 bp, Artificial Sequence
  Synthetic
caattactttcttaccttaactcttttgacagttatttttgcagatcatcaagaattaactcaaaacagtgatat

SEQ ID NO: 331373 - DNA, 75 bp, Artificial Sequence
  Synthetic
cattgtgtcgacagtggccttagaaactagggtagtgagtgtgcaaacaggctcttcgtggtttctgttaagagt

SEQ ID NO: 331374 - DNA, 75 bp, Artificial Sequence
  Synthetic
caatacaacatttaagaatgatggcctcaccagtagatgcacaaaactaggggaaaattttgtgtctcatgttaa

SEQ ID NO: 331375 - DNA, 75 bp, Artificial Sequence
  Synthetic
tgaattccaagagaacattaagattacagcttcttccctaatacccaagcaggcaatcctcgaggttaataccgc

SEQ ID NO: 331376 - DNA, 75 bp, Artificial Sequence
  Synthetic
taaaaatcttgtgtccgctttgactagaacaaccaggtccaataggagaaaacgcttagctggagcggcaattgc

SEQ ID NO: 331377 - DNA, 75 bp, Artificial Sequence
  Synthetic
agttgcagcagttgctatatcaggagcagccctagttactgcagggatagcattagccgagacaagaaccttggc

SEQ ID NO: 331378 - DNA, 75 bp, Artificial Sequence
  Synthetic
agctagtgtagatagtgtaatatcgggagctgaaaaaactaatgctgctttgaatcaactcacccagacaatgaa

SEQ ID NO: 331379 - DNA, 75 bp, Artificial Sequence
  Synthetic
gtcatttactaaagaaacacaggataacatctctacattggcaaaagaaatctcggaagcgaacaaaaggattga

SEQ ID NO: 331380 - DNA, 75 bp, Artificial Sequence
  Synthetic
ctgtttggaatattacactgaagtgaaaaatcaattcttagactttacgtcctataattatgaaatacttcaagc

SEQ ID NO: 331381 - DNA, 75 bp, Artificial Sequence
  Synthetic
atctatgtcaaaaaatggaggaatacctcttaggttaatgaaaagaattatggtccctaaccctcagatgacagc

SEQ ID NO: 331382 - DNA, 75 bp, Artificial Sequence
  Synthetic
tcaatctaacactatagaagaacttgttctccggagagggaggattagattgttagcctataccaacagtacttt

SEQ ID NO: 331383 - DNA, 75 bp, Artificial Sequence
  Synthetic
aacttatagaatagatgtgcctcgctttgcttccatggggaaaatctcacctttacttatctctgtagatgaacc

SEQ ID NO: 331384 - DNA, 75 bp, Artificial Sequence
  Synthetic
aatctcactaattggttctggaatctacacttccattttatcggttgatcttggaatagtcttattggattgtga

SEQ ID NO: 331385 - DNA, 75 bp, Artificial Sequence
  Synthetic
agaagataatatcagttacttatgctcttcatcttctccaagtgatgcaattgtgaagaactgtttgaaagattc

SEQ ID NO: 331386 - DNA, 75 bp, Artificial Sequence
  Synthetic
aacagccgactgtatctcagctcttcaagaatctggtgccaaaaaaggaaaatacttcgtatatcaatccggttt

SEQ ID NO: 331387 - DNA, 75 bp, Artificial Sequence
  Synthetic
tttggtttcacgttgctcacaacaagtatgtacatgtttagagcctgaaataagacgtatatatgtaagccatcc

SEQ ID NO: 331388 - DNA, 75 bp, Artificial Sequence
  Synthetic
actttccaaagaaacaagtcaatgcacgcaagttagtatcaaaactcaagatcaaacatttagacttttactcac

SEQ ID NO: 331389 - DNA, 75 bp, Artificial Sequence
  Synthetic
gagtgtgaaagcggcaggcatcatcaatatccaagcacctaccgaaattaaaaggaaaacatggaaagacatagg

SEQ ID NO: 331390 - DNA, 75 bp, Artificial Sequence
  Synthetic
attaacattcggtaagtacaacactaaatttgaagaaatagaggaattgattgagaatagtaatggagacctaga

SEQ ID NO: 331391 - DNA, 75 bp, Artificial Sequence
  Synthetic
gaaggccagaacttatcttgttttatctcaaaatctcaaggtggttgtgatagtgacaagtattgtgattgcttt

SEQ ID NO: 331392 - DNA, 75 bp, Artificial Sequence
  Synthetic
ccttatcctgtttgttatttttatattaaaaaggatttatgatcttaaaaacagagtcaccaaaattgaggtgta

SEQ ID NO: 331393 - DNA, 75 bp, Artificial Sequence
  Synthetic
tcttgagaggtaaaaacggaaatgaatgactttgttaagatttgatgatcaagttcttcactaaaatatacacta

SEQ ID NO: 331394 - DNA, 75 bp, Artificial Sequence
  Synthetic
ctcagaaagagtagattgtggactttgtattcaaagagttaaacccacgagtcatccttcaacagagtacgagag

SEQ ID NO: 331395 - DNA, 75 bp, Artificial Sequence
  Synthetic
aactccacactcttcccaattaaaaaatagggagagggagagagattaggcatacctagatctagaagttcagat

SEQ ID NO: 331396 - DNA, 75 bp, Artificial Sequence
  Synthetic
tctcctatctttgagcgtgttgaacaactcccaaaaacctagtcattgaaggcttgagaagaaggcaaagaacac

SEQ ID NO: 331397 - DNA, 75 bp, Artificial Sequence
  Synthetic
aaatcacttgtttttgaatacttactgtctctaagtatatggacaaagaccccctcatcacaaacattacctctt

SEQ ID NO: 331398 - DNA, 75 bp, Artificial Sequence
  Synthetic
aattggatgattaaatgccaggttgagatactctaaaaatgaaagaattgaagttagggctgtagttatctatca

SEQ ID NO: 331399 - DNA, 75 bp, Artificial Sequence
  Synthetic
ggatcacagggtggcttatttttcaaatatattgggttttaataagaaaattgaagggcattaaaatggtgagga

SEQ ID NO: 331400 - DNA, 75 bp, Artificial Sequence
  Synthetic
ataacataaagattgttgaggatgataattatgtgttttatggagatgaaagcacatcttctcttatcatggatt

SEQ ID NO: 331401 - DNA, 75 bp, Artificial Sequence
  Synthetic
ccttcttgcttcaaaaaaggagaaggaagatcaaaataatacttaaagttatgagctggtctttccttttattaa

SEQ ID NO: 331402 - DNA, 75 bp, Artificial Sequence
  Synthetic
cattcctaagtttattggtttttgggattaaaacaaagattatggaaaaagaaaccctgaagagagaaatgttat

SEQ ID NO: 331403 - DNA, 75 bp, Artificial Sequence
  Synthetic
taagtaaatctcaaatagaacaagagacatccttacgaaattgcactgagcatttgagggtgatgtctgaccttg

SEQ ID NO: 331404 - DNA, 75 bp, Artificial Sequence
  Synthetic
ctcctgaaatcagaagattgaattcagtgattgactccacttatatttcgatagagacatgcagattaagagctg

SEQ ID NO: 331405 - DNA, 75 bp, Artificial Sequence
  Synthetic
aagacataaatctccaacttaaagaatgccaacttgaacttcagaaatattatcttttatcagacaactctgatt

SEQ ID NO: 331406 - DNA, 75 bp, Artificial Sequence
  Synthetic
accctttaacacctccatctgtaccttatcagggatccagtgagcgccactttattatgccgactaattatcaac

SEQ ID NO: 331407 - DNA, 75 bp, Artificial Sequence
  Synthetic
aggagaaaatctcaggtttatgtccctactcatcacttgtttattttaaaatgttatcctttaatttgaaatata

SEQ ID NO: 331408 - DNA, 75 bp, Artificial Sequence
  Synthetic
acccaataataaataagttttcaaacataatagtgatcccgcatgagaattctgtcttgttttgggagaaaacac

SEQ ID NO: 331409 - DNA, 75 bp, Artificial Sequence
  Synthetic
cagtcaccataactgggaatcaattattaaatcatgtatctgagagaagcgtgggctttgaaagccgaactatac

SEQ ID NO: 331410 - DNA, 75 bp, Artificial Sequence
  Synthetic
ttaagggtttacatagattagagaccacagtaaaggacaatgagggtctatcaataacagccaaagagatgattg

SEQ ID NO: 331411 - DNA, 75 bp, Artificial Sequence
  Synthetic
gagatgtctctaggacactaccaaacagtcttgaatacaattcaatcctccaaacagattgctctgtggcaggtg

SEQ ID NO: 331412 - DNA, 75 bp, Artificial Sequence
  Synthetic
accagaaaagaatatttcagctttgcatcaaaggggcagatccaacaagaccatcctgcatagagaaccaaggaa

SEQ ID NO: 331413 - DNA, 75 bp, Artificial Sequence
  Synthetic
aaatgatctatatattagagagtaatatagaaaaagacaaaattacactagatcggataagacccataatggcca

SEQ ID NO: 331414 - DNA, 75 bp, Artificial Sequence
  Synthetic
aggatataaagaagattcctaagggtgagtctcttgataataatctttgcttcaaaatgacgtatcaaaacggac

SEQ ID NO: 331415 - DNA, 75 bp, Artificial Sequence
  Synthetic
tatgtttaaatagacgtgatagtgagaagggtggaaacaaatacacgtgtgtatatcccattttctatttaagac

SEQ ID NO: 331416 - DNA, 75 bp, Artificial Sequence
  Synthetic
aatctgagttgagtgaagcggatgagaaaagagattacccatgcagctattatccagattccatagtcatgcatg

SEQ ID NO: 331417 - DNA, 75 bp, Artificial Sequence
  Synthetic
aaaaaggttcaaaaactgaaatcaagaaatacaagcacctttcttggatgcttggggtgttcattgtaagaggtt

SEQ ID NO: 331418 - DNA, 75 bp, Artificial Sequence
  Synthetic
cagatgattcaataaagattactttttctccgatctcctatcaaggggctataatcattggcatgaaaataaata

SEQ ID NO: 331419 - DNA, 75 bp, Artificial Sequence
  Synthetic
agctcttctttataatagatcttattcttgactcgctcctgatcaatcccctccgggcatacgttgacttgaaag

SEQ ID NO: 331420 - DNA, 75 bp, Artificial Sequence
  Synthetic
aggtctccccatcaagagctaatgtggttaaaatggacatggtcacaatatcagcaatctttaatgaatataaaa

SEQ ID NO: 331421 - DNA, 75 bp, Artificial Sequence
  Synthetic
ctcactgttttcctgtagaaattctaccgacccttattgatataccttgttccgacaatttccagatgttaatta

SEQ ID NO: 331422 - DNA, 75 bp, Artificial Sequence
  Synthetic
agagaaaagagatcaggccaatttacacatgtttcgccaagcaaactgatagaagtatgttaagtgtatgtgaga

SEQ ID NO: 331423 - DNA, 75 bp, Artificial Sequence
  Synthetic
agaaagaaaatggtccactatgggtttctgatttcatagaagtgagcattattaaagaagaaactgggagaataa

SEQ ID NO: 331424 - DNA, 75 bp, Artificial Sequence
  Synthetic
taaatcttagtttttgtgatttgagtggttgcgagaatacaggaaaaaatcagcgaaataaagtttacatacctc

SEQ ID NO: 331425 - DNA, 75 bp, Artificial Sequence
  Synthetic
aaaattctgttagcagtcaaaaaatgatttgtgggcaggccacaaaacaactcaacataaaagtgatctgtactt

SEQ ID NO: 331426 - DNA, 75 bp, Artificial Sequence
  Synthetic
tgattttatcgagcatagatgaaaatctcggaatttacacgaatcacatacataacttatacctaggataaaagg

SEQ ID NO: 331427 - DNA, 75 bp, Artificial Sequence
  Synthetic
aatcaaccacgaatcaactctacttcggaaattgcaagtattcacaatacagtttccagccatcttagaaaggag

SEQ ID NO: 331428 - DNA, 75 bp, Artificial Sequence
  Synthetic
actacattttaggaaatttcttgctagggaaaagcacatactaagccttctgattgatcaccaaattaaaatgcc

SEQ ID NO: 331429 - DNA, 75 bp, Artificial Sequence
  Synthetic
taatgattaaattaaaaaaatgatcttgagagtgaaatccaatcatttatataagacataactaagaattccctt

SEQ ID NO: 331430 - DNA, 75 bp, Artificial Sequence
  Synthetic
tcttgcatgctttcctaggacatataagttgtttaactgatatatcttattaaatcagattatggactcgaagac

SEQ ID NO: 331431 - DNA, 75 bp, Artificial Sequence
  Synthetic
tggctctggattagatctagatggttcgtattttcatttgaattctcctattacagattgggatatctctttaat

SEQ ID NO: 331432 - DNA, 75 bp, Artificial Sequence
  Synthetic
tacgtacttctctacgggggtgccgcaaaattcagacggatttagaagaatattgtctaatctttcatatcagag

SEQ ID NO: 331433 - DNA, 75 bp, Artificial Sequence
  Synthetic
tagaaatgatcacttccatttatgtgacctaagagtgaagggagatgtaatgaaattatatttatctgatgtcac

SEQ ID NO: 331434 - DNA, 75 bp, Artificial Sequence
  Synthetic
acatgttgtgagatatcctcagtctcttagactaatggaaattatctgttcctttttttcaacaagagacccgct

SEQ ID NO: 331435 - DNA, 75 bp, Artificial Sequence
  Synthetic
tataccagcaagagataagttaaaaggggataagtatttgagccctaaattattccgtgagttactagatattcc

SEQ ID NO: 331436 - DNA, 75 bp, Artificial Sequence
  Synthetic
tggacaaaaacaggatattgtaaggaggcaaactgagcttttttttcaattgagcaggttccggtcatttataat

SEQ ID NO: 331437 - DNA, 75 bp, Artificial Sequence
  Synthetic
cgaacttggtagttttgaaaataggtgtatttggaaggccattaaaaacgaaacgattaggcgattaaggaaaga

SEQ ID NO: 331438 - DNA, 75 bp, Artificial Sequence
  Synthetic
attcaatttacttgatgaagtcctacctgagaaaacaagaaggagagcaagtgtggtaattagagaagagcatgc

SEQ ID NO: 331439 - DNA, 75 bp, Artificial Sequence
  Synthetic
taagttaaagacaagtcagaaaaagagtataataaagtcttttcctctcaaggaagatcagttgatcttatttat

SEQ ID NO: 331440 - DNA, 75 bp, Artificial Sequence
  Synthetic
tctagaggaagggttttttataaaagaaggacccaaactatcaattatccctaaaagtgcgttcttaggttttat

SEQ ID NO: 331441 - DNA, 75 bp, Artificial Sequence
  Synthetic
tgattctatagaatgcgaactcaacttgtatcttttttccaaaatgaaaccttatttctcagaaattggaagatt

SEQ ID NO: 331442 - DNA, 75 bp, Artificial Sequence
  Synthetic
gtctagtttgatcaggaatgcagtgatagagcatggtgaaccaatgttcgaaattcataagaatatagttccttt

SEQ ID NO: 331443 - DNA, 75 bp, Artificial Sequence
  Synthetic
tatacaatccagcatcttgaaaaaacttgagcaaagtgatgatccattatataatcagttctcagaaactgtcat

SEQ ID NO: 331444 - DNA, 75 bp, Artificial Sequence
  Synthetic
gaagaacttaaaaaagattacttctaagaccggggatcacacctccaatgtgatacctgaaacaatatcgagtat

SEQ ID NO: 331445 - DNA, 75 bp, Artificial Sequence
  Synthetic
cttccaagatatttcaaatgtgcttgaaagaatggacatagatgataggtgcgacttgattgcacttgagaaatg

SEQ ID NO: 331446 - DNA, 75 bp, Artificial Sequence
  Synthetic
ctgcttacatcctatattgggggtgagagaggctattttaaaggtccgagaacatatttctactcctcatgaatt

SEQ ID NO: 331447 - DNA, 75 bp, Artificial Sequence
  Synthetic
ggacaataaagttatacataaggtattagcatgttttaaggtgattattattaatggatatttgaaaaggtatca

SEQ ID NO: 331448 - DNA, 75 bp, Artificial Sequence
  Synthetic
aataggatggccacaaattgatgaaaactcgatcgtaaacgatgacttgaaaaggttgtatttaaaatctatgcc

SEQ ID NO: 331449 - DNA, 75 bp, Artificial Sequence
  Synthetic
tcttaccaatcaacatataaaaacatattggtttgagatatcacagatacatttcaagaaaaccttcaatccaga

SEQ ID NO: 331450 - DNA, 75 bp, Artificial Sequence
  Synthetic
tgagtatgatcctacgtcagatctgttacaagataaagctattgctccaattcgaaaagaatggctaagttgttt

SEQ ID NO: 331451 - DNA, 75 bp, Artificial Sequence
  Synthetic
ctcaggaagcgtccttggggaaaaaagggaacaacctactaaacccaaaagattgatagattacatgttgcaagt

SEQ ID NO: 331452 - DNA, 75 bp, Artificial Sequence
  Synthetic
ccctgagatgaaatctttgagtgttttagaatatgtgaagaataggaaacatcttttagataattctaacaatat

SEQ ID NO: 331453 - DNA, 75 bp, Artificial Sequence
  Synthetic
atcttattcaatgaaggagaaggaaaataaaacctctgctagactctttgcaaaaatgacttgtgacttaagagc

SEQ ID NO: 331454 - DNA, 75 bp, Artificial Sequence
  Synthetic
atgtcaaattgttttagaagggttgactgcaaaatttgtggccccccttttcccagaacatggtagtgttttaac

SEQ ID NO: 331455 - DNA, 75 bp, Artificial Sequence
  Synthetic
tttccttgatctagaaagagatttgagtactttgagctctttacaaaactcatatactcataaaaggaaagaact

SEQ ID NO: 331456 - DNA, 75 bp, Artificial Sequence
  Synthetic
gtcatctgaagttacatatctcactactgatttggttaagtactgtttaagatggagatctcaagtaacttctct

SEQ ID NO: 331457 - DNA, 75 bp, Artificial Sequence
  Synthetic
gttctttgaaacacttgatgagctatttggttttgaagagactttcaattggatgcaccccttccttatgacgaa

SEQ ID NO: 331458 - DNA, 75 bp, Artificial Sequence
  Synthetic
tcgattatttgttgctgatccaggttacccccctttgttgcatcttggtagaaagatagagacaagcttagatga

SEQ ID NO: 331459 - DNA, 75 bp, Artificial Sequence
  Synthetic
tgatttctttattgacggatcccttggaggaatagaggggtatcaacaaaaagaatggtcagctatatctatagc

SEQ ID NO: 331460 - DNA, 75 bp, Artificial Sequence
  Synthetic
attaataaaagcgtctgcgatttggagcggaactattgccccttctattgttcaaggagataaccaggtaatcgc

SEQ ID NO: 331461 - DNA, 75 bp, Artificial Sequence
  Synthetic
catcacttctctccactatcaaggtcaaactagagaaaaaataaatcatgaacacttggactcagttaagagatt

SEQ ID NO: 331462 - DNA, 75 bp, Artificial Sequence
  Synthetic
tttgaagactttcactgagtttaacagtgcaatgggacatgaattaaaagtagaggagacgataatatctagaga

SEQ ID NO: 331463 - DNA, 75 bp, Artificial Sequence
  Synthetic
gatctttgtatattccaagaaaatatataggaaagggaggtctatgggaatcccgggaaagaaagtaatgaaatc

SEQ ID NO: 331464 - DNA, 75 bp, Artificial Sequence
  Synthetic
gcctcggcctctgcataaataaaaaaaattagtcagccatggggcggagaatgggcggaactgggcggagttagg

SEQ ID NO: 331465 - DNA, 75 bp, Artificial Sequence
  Synthetic
ggcgggatgggcggagttaggggcgggactatggttgctgactaattgagatgcatgctttgcatacttctgcct

SEQ ID NO: 331466 - DNA, 75 bp, Artificial Sequence
  Synthetic
atgcatgctttgcatacttctgcctgctggggagcctggggactttccacaccctaactgacacacattccacag

SEQ ID NO: 331467 - DNA, 75 bp, Artificial Sequence
  Synthetic
ctggttctttccgcctcagaaggtacctaaccaagttcctctttcagaggttatttcaggccatggtgctgcgcc

SEQ ID NO: 331468 - DNA, 75 bp, Artificial Sequence
  Synthetic
ggctgtcacgccaggcctccgttaaggttcgtaggtcatggactgaaagtaaaaaaacagctcaacgcctttttg

SEQ ID NO: 331469 - DNA, 75 bp, Artificial Sequence
  Synthetic
tgtttgttttagagcttttgctgcaattttgtgaaggggaagatactgttgacgggaaacgcaaaaaaccaaaaa

SEQ ID NO: 331470 - DNA, 75 bp, Artificial Sequence
  Synthetic
ggttaactgaaaaaccagaaagttaactggtaagtttagtctttttgtcttttatttcaggtccatgggtgctgc

SEQ ID NO: 331471 - DNA, 75 bp, Artificial Sequence
  Synthetic
tttatttcaggtccatgggtgctgctttaacactgttgggggacctaattgctactgtgtctgaagctgctgctg

SEQ ID NO: 331472 - DNA, 75 bp, Artificial Sequence
  Synthetic
tttaacactgttgggggacctaattgctactgtgtctgaagctgctgctgctactggattttcagtagctgaaat

SEQ ID NO: 331473 - DNA, 75 bp, Artificial Sequence
  Synthetic
ctactggattttcagtagctgaaattgctgctggagaggccgctgctgcaattgaagtgcaacttgcatctgttg

SEQ ID NO: 331474 - DNA, 75 bp, Artificial Sequence
  Synthetic
ctactgttgaaggcctaacaacctctgaggcaatagctgctataggcctcactccacaggcctatgctgtgatat

SEQ ID NO: 331475 - DNA, 75 bp, Artificial Sequence
  Synthetic
ctggggctcctgctgctatagctggatttgcagctttactgcaaactgtgactggtgtgagcgctgttgctcaag

SEQ ID NO: 331476 - DNA, 75 bp, Artificial Sequence
  Synthetic
tggggtatagattttttagtgactgggatcacaaagtttctactgttggtttatatcaacaaccaggaatggctg

SEQ ID NO: 331477 - DNA, 75 bp, Artificial Sequence
  Synthetic
tagatttgtataggccagatgattattatgatattttatttcctggagtacaaacctttgttcacagtgttcagt

SEQ ID NO: 331478 - DNA, 75 bp, Artificial Sequence
  Synthetic
atcttgaccccagacattggggtccaacactttttaatgccatttctcaagctttttggcgtgtaatacaaaatg

SEQ ID NO: 331479 - DNA, 75 bp, Artificial Sequence
  Synthetic
acattcctaggctcacctcacaggagcttgaaagaagaacccaaagatatttaagggacagtttggcaaggtttt

SEQ ID NO: 331480 - DNA, 75 bp, Artificial Sequence
  Synthetic
tagaggaaactacttggacagtaattaatgctcctgttaattggtataactctttacaagattactactctactt

SEQ ID NO: 331481 - DNA, 75 bp, Artificial Sequence
  Synthetic
tgtctcccattaggcctacaatggtgagacaagtagccaacagggaagggttgcaaatatcatttgggcacacct

SEQ ID NO: 331482 - DNA, 75 bp, Artificial Sequence
  Synthetic
atgataatattgatgaagcagacagtattcagcaagtaactgagaggtgggaagctcaaagccaaagtcctaatg

SEQ ID NO: 331483 - DNA, 75 bp, Artificial Sequence
  Synthetic
tgcagtcaggtgaatttattgaaaaatttgaggctcctggtggtgcaaatcaaagaactgctcctcagtggatgt

SEQ ID NO: 331484 - DNA, 75 bp, Artificial Sequence
  Synthetic
catcttcatttttatcagcattttcctggctgtcttcatcatcatcatcactgtttcttagccaatctaaaactc

SEQ ID NO: 331485 - DNA, 75 bp, Artificial Sequence
  Synthetic
ctgtttcttagccaatctaaaactccaattcccatagccacattaaacttcattttttgatacactgacaaacta

SEQ ID NO: 331486 - DNA, 75 bp, Artificial Sequence
  Synthetic
tgcctttacttctaggcctgtacggaagtgttacttctgctctaaaagcttatgaagatggccccaacaaaaaga

SEQ ID NO: 331487 - DNA, 75 bp, Artificial Sequence
  Synthetic
aaaggaagttgtccaggggcagctcccaaaaaaccaaaggaaccagtgcaagtgccaaagctcgtcataaaagga

SEQ ID NO: 331488 - DNA, 75 bp, Artificial Sequence
  Synthetic
ggaatagaagttctaggagttaaaactggagtagacagcttcactgaggtggagtgctttttaaatcctcaaatg

SEQ ID NO: 331489 - DNA, 75 bp, Artificial Sequence
  Synthetic
ggcaatcctgatgaacatcaaaaaggcttaagtaaaagcttagcagctgaaaaacagtttacagatgactctcca

SEQ ID NO: 331490 - DNA, 75 bp, Artificial Sequence
  Synthetic
tttttttgctgttgttggggaacctttggagctgcagggtgtgttagcaaactgcagtaccaaataccctgctca

SEQ ID NO: 331491 - DNA, 75 bp, Artificial Sequence
  Synthetic
gacaaagaccaactgccttgctacagtgtggctagaattcctttgcctaatttaaatgaggacttaacctgtgga

SEQ ID NO: 331492 - DNA, 75 bp, Artificial Sequence
  Synthetic
aatattttgatgtgggaagctgttactgttaaaactgaggttattggggtaactgctatgttaaacttgcattca

SEQ ID NO: 331493 - DNA, 75 bp, Artificial Sequence
  Synthetic
gggacacaaaaaactcatgaaaatggtgctggaaaacccatacaagggtcaaactttcatttttttgctgttggt

SEQ ID NO: 331494 - DNA, 75 bp, Artificial Sequence
  Synthetic
aaactttcatttttttgctgttggtggggaacctttggagctgcagggtgtgttagcaaactacaggaccaaata

SEQ ID NO: 331495 - DNA, 75 bp, Artificial Sequence
  Synthetic
tcctgctcaaactgtaaccccaaaaaatgctacagttgacagtcagcagatgaacactgaccacaaggctgtttt

SEQ ID NO: 331496 - DNA, 75 bp, Artificial Sequence
  Synthetic
ggactatggttgctgactaattgagatgcatgctttgcatacttctgcctgctggggagcctggggactttcctt

SEQ ID NO: 331497 - DNA, 75 bp, Artificial Sequence
  Synthetic
ggataaggataatgcttatccagtggagtgctgggttcctgatccaagtaaaaatgaaaacactagatattttgg

SEQ ID NO: 331498 - DNA, 75 bp, Artificial Sequence
  Synthetic
gctgactaattgagatgcatgctttgcatacttctgcctgctggggagcctggggactttccacaccctaactga

SEQ ID NO: 331499 - DNA, 75 bp, Artificial Sequence
  Synthetic
aaaatgaaaacactagatattttggaacctacacaggtggggaaaatgtgcctcctgttttgcacattactaaca

SEQ ID NO: 331500 - DNA, 75 bp, Artificial Sequence
  Synthetic
tcagggggaggtgtgggaggttttttaaagcaagtaaaacctctacagatgtgatatggctcaggttattaattc

SEQ ID NO: 331501 - DNA, 75 bp, Artificial Sequence
  Synthetic
cagcaaccacagtgctgcttgatgagcagggtgttgggcccttgtgcaaagctgacagcttgtatgtttctgctg

SEQ ID NO: 331502 - DNA, 75 bp, Artificial Sequence
  Synthetic
ggcgggatgggcggagttaggggcgggactatggttgctgactaattgagatgcatgctttgcatacttggtaac

SEQ ID NO: 331503 - DNA, 75 bp, Artificial Sequence
  Synthetic
ttgacatttgtgggctgtttaccaacacttctggaacacagcagtggaagggacttcccagatattttaaaatta

SEQ ID NO: 331504 - DNA, 75 bp, Artificial Sequence
  Synthetic
atgcatgctttgcatacttggtaactgacacacggagcctggggactttccacaccctaactgacacacattcca

SEQ ID NO: 331505 - DNA, 75 bp, Artificial Sequence
  Synthetic
cccttagaaagaggtctgtgaaaaacccctacccaatttcctttttgttaagtgacctaattaacaggaggacac

SEQ ID NO: 331506 - DNA, 75 bp, Artificial Sequence
  Synthetic
agagggtggatgggcagcctatgattggaatgtcctctcaagtagaggaggttagggtttatgaggacacagagg

SEQ ID NO: 331507 - DNA, 75 bp, Artificial Sequence
  Synthetic
gcattcattttatgtttcaggttcagggggaggtggggaaggttttttaaagcaagtaaaacctctacagatgtg

SEQ ID NO: 331508 - DNA, 75 bp, Artificial Sequence
  Synthetic
agcttcctggggatccagacatgataagatacattgatgagtttggacaaaccacaactagaatgcagtgaaaaa

SEQ ID NO: 331509 - DNA, 75 bp, Artificial Sequence
  Synthetic
ggcgggactatggttgctgactaattgagatgcatgctttgcatacttctgcctgctggggagcctggggacttt

SEQ ID NO: 331510 - DNA, 75 bp, Artificial Sequence
  Synthetic
aatgctttatttgtgaaatttgtgatgctattgctttatttgtaaccattataagctgcaataaacaagttaaca

SEQ ID NO: 331511 - DNA, 75 bp, Artificial Sequence
  Synthetic
catcttcatttttatcagcattttcctggctgtcatcatcatcatcatcactgtttcttagccaatctaaaactc

SEQ ID NO: 331512 - DNA, 75 bp, Artificial Sequence
  Synthetic
gcctcggcctcagcataaataaaaaaaattagtcagccataggcggagctgtgggcggaacttgggcggagttgg

SEQ ID NO: 331513 - DNA, 75 bp, Artificial Sequence
  Synthetic
ttgagactgtgaatcaatgcctgtttcatgccctgagtcttccatgttcttctccccaccatcttcatttttatc

SEQ ID NO: 331514 - DNA, 75 bp, Artificial Sequence
  Synthetic
tctccccaccatcttcatttttatcagcattttcctggctgtcatcatcatcatcatcatcactgtttcttagcc

SEQ ID NO: 331515 - DNA, 75 bp, Artificial Sequence
  Synthetic
cacattaaacttcattttttgatacactgacaaactaaactctttgtccaatctctctttccactccacaattct

SEQ ID NO: 331516 - DNA, 75 bp, Artificial Sequence
  Synthetic
gctctgaatactttgagcaaactcagccacaggtctgtaccaaattaacataagaagcaaagcaatgccactttg

SEQ ID NO: 331517 - DNA, 75 bp, Artificial Sequence
  Synthetic
aattatcctcttttctaacaaaaactcactgcgttccaggcaatgctttaaataatctttgggcctaaaatctat

SEQ ID NO: 331518 - DNA, 75 bp, Artificial Sequence
  Synthetic
ttgttttacaaatctggcctgcagtgttttaggcacactgtactcattcatggtgactattccagggggaaatat

SEQ ID NO: 331519 - DNA, 75 bp, Artificial Sequence
  Synthetic
ttgagttcttttatttaggtgtttcttttctaagtttaccttaacactgccatccaaataatcccttaaattgtc

SEQ ID NO: 331520 - DNA, 75 bp, Artificial Sequence
  Synthetic
caggttattaattccctgacctgaaggcaaatctctggactcccctccagtgccctttacatcctcaaaaactac

SEQ ID NO: 331521 - DNA, 75 bp, Artificial Sequence
  Synthetic
cagtatcttgaccccagacattggggtccaacactttttaatgccatttctcaagctttttggcgtgtaatacaa

SEQ ID NO: 331522 - DNA, 75 bp, Artificial Sequence
  Synthetic
taaaaactggtcaatagctactcctagctcaaagttcagcctgtccaagggcaaattaacatttaaagctttccc

SEQ ID NO: 331523 - DNA, 75 bp, Artificial Sequence
  Synthetic
cccacataattcaagcaaagcagctgctaatgtagttttaccactatcaattggtcctttaaacagccagtatct

SEQ ID NO: 331524 - DNA, 75 bp, Artificial Sequence
  Synthetic
tctaggagttaaaactggagtagacagcttcactgaggtggagtgctttttaaatcctcaaatgggcaatcctga

SEQ ID NO: 331525 - DNA, 75 bp, Artificial Sequence
  Synthetic
ttttttaggaatgttgtacaccatgcattttaaaaagtcatacaccactgaatccattttgggcaacaaacagtg

SEQ ID NO: 331526 - DNA, 75 bp, Artificial Sequence
  Synthetic
tagccaagcaactccagccatccattcttctatgtcagcagagcctgtagaaccaaacattatatccatcctatc

SEQ ID NO: 331527 - DNA, 75 bp, Artificial Sequence
  Synthetic
caaaagatcattaaatctgtttgttaacatttgttctctagttagttgtaggctatcaacccgctttttagctaa

SEQ ID NO: 331528 - DNA, 75 bp, Artificial Sequence
  Synthetic
aacagtatcaacagcctgttggcatatggttttttggtttttgctgtcagcaaatatagcagcatttgcataatg

SEQ ID NO: 331529 - DNA, 75 bp, Artificial Sequence
  Synthetic
cttttcatggtacttatagtggctgggctgttcttttttaatacattttaaacacatttcaaaactgtactgaaa

SEQ ID NO: 331530 - DNA, 75 bp, Artificial Sequence
  Synthetic
ttccaagtacatcccaagcaataacaacacatcatcacattttgtttccattgcatactctgttacaagcttcca

SEQ ID NO: 331531 - DNA, 75 bp, Artificial Sequence
  Synthetic
aacacatcatcacattttgtttccattgcatactctgttacaagcttccaggacacttgtttagtttcctctgct

SEQ ID NO: 331532 - DNA, 75 bp, Artificial Sequence
  Synthetic
ggacacttgtttagtttcctctgcttcttctggattaaaatcatgctcctttaacccaccaggcaaactttcctc

SEQ ID NO: 331533 - DNA, 75 bp, Artificial Sequence
  Synthetic
aataacagaaaatggatctctagttaaggcactatacatcaaatattccttattaacccctttacaaattaaaaa

SEQ ID NO: 331534 - DNA, 75 bp, Artificial Sequence
  Synthetic
gctaaaggtacacaatttttgagcatagttattaatagcagacactctatgcctgtgtggagtaagaaaaaacag

SEQ ID NO: 331535 - DNA, 75 bp, Artificial Sequence
  Synthetic
tatgttatgattataactgttatgcctacttataaaggttacagaatatttttccataatttttttgtatagcag

SEQ ID NO: 331536 - DNA, 75 bp, Artificial Sequence
  Synthetic
ctacttataaaggttacagaatatttttccataatttttttgtatagcagtgcagctttttcctttgtggtgtaa

SEQ ID NO: 331537 - DNA, 75 bp, Artificial Sequence
  Synthetic
tgcagctttttcctttgtggtgtaaatagcaaagcaagcaagagttctattactaaacacagcatgactcaaaaa

SEQ ID NO: 331538 - DNA, 75 bp, Artificial Sequence
  Synthetic
acttagcaattctgaaggaaagtccttggggtcttctacctttctcttcttttttggaggagtagaatgttgaga

SEQ ID NO: 331539 - DNA, 75 bp, Artificial Sequence
  Synthetic
gtcagcagtagcctcatcatcactagatggcatttcttctgagcaaaacaggttttcctcattaaaggcattcca

SEQ ID NO: 331540 - DNA, 75 bp, Artificial Sequence
  Synthetic
ccactgctcccattcatcagttccataggttggaatctaaaatacacaaacaattagaatcagtagtttaacaca

SEQ ID NO: 331541 - DNA, 75 bp, Artificial Sequence
  Synthetic
tatttgtaaccattataagctgcaataaacaagttaacaacaacaattgcattcattttatgtttcaggttcagg

SEQ ID NO: 331542 - DNA, 75 bp, Artificial Sequence
  Synthetic
ttatacacttaaaaattttatatttaccttatagctttaaatctctgtaggtagtttgtccaattatgtcacacc

SEQ ID NO: 331543 - DNA, 75 bp, Artificial Sequence
  Synthetic
acagaagtaaggttccttcacaaagatcaagtccaaaccacattctaaagcaatcgaagcagtagcaatcaaccc

SEQ ID NO: 331544 - DNA, 75 bp, Artificial Sequence
  Synthetic
caatcgaagcagtagcaatcaacccacacaagtggatctttcctgtataattttctattttcatgcttcatcctc

SEQ ID NO: 331545 - DNA, 75 bp, Artificial Sequence
  Synthetic
acacaagtggatctttcctgtataattttctattttcatgcttcatcctcagtaagcacagcaagcatatgcagt

SEQ ID NO: 331546 - DNA, 75 bp, Artificial Sequence
  Synthetic
aggccattgtttgcagtatattgcatcaacaccaggatttaaggaagaagcaaatacctcagttgcatcccagaa

SEQ ID NO: 331547 - DNA, 75 bp, Artificial Sequence
  Synthetic
gcctccaaagtcaggttgatgagcatattttactccatcttccattttcttgtacagagtattcattttcttcat

SEQ ID NO: 331548 - DNA, 75 bp, Artificial Sequence
  Synthetic
ttttgcaaaaagctaggcctccaaaaaagcctcctcactacttctagaatagctcagaggccgaggcggcctcgg

SEQ ID NO: 331549 - DNA, 75 bp, Artificial Sequence
  Synthetic
caaagcttttcgcaaaagcctaggcctccaaaaaagcctcttcactacttctggaatagatcagaggccgaggcg

SEQ ID NO: 331550 - DNA, 75 bp, Artificial Sequence
  Synthetic
tttttcttcatctcctcctttatcaggatgaaactccttgcatttttttaaatatgcctttctcatcagaggaat

SEQ ID NO: 331551 - DNA, 75 bp, Artificial Sequence
  Synthetic
cctcagcataaataaaaaaaattagtcagccataggcggagctgtgggcggaacttgggcggagttgggcggagc

SEQ ID NO: 331552 - DNA, 75 bp, Artificial Sequence
  Synthetic
ttatcagcattttcctcatcatcatcactgtttcttagccaatttaaaactccagttcccatagccacattaaac

SEQ ID NO: 331553 - DNA, 75 bp, Artificial Sequence
  Synthetic
attcccccaggcactcctttcaagacctagaaggtccattagctgcaaagattcctctctgtttaaaactttatc

SEQ ID NO: 331554 - DNA, 75 bp, Artificial Sequence
  Synthetic
tgggaggagtttgggcggagtttgggcgggacacggttgagtaactcatttgcatgcatgcttcacatacttgcg

SEQ ID NO: 331555 - DNA, 75 bp, Artificial Sequence
  Synthetic
cctagaaggtccattagctgcaaagattcctctctgtttaaaactttatccatctttgcaaagctttttgcaaaa

SEQ ID NO: 331556 - DNA, 75 bp, Artificial Sequence
  Synthetic
caaagctttttgcaaaagcctaggcctccaaaaaagcctcttcactacttctggaatagctcagaggccgaggcg

SEQ ID NO: 331557 - DNA, 75 bp, Artificial Sequence
  Synthetic
gttgggactttccaaatgctaactgaacacattccacagcgctggttctttccgcctcagaaggtaccctaacca

SEQ ID NO: 331558 - DNA, 75 bp, Artificial Sequence
  Synthetic
gttcctcatttcaaaggttatttcaggccatggtgctgcgccggctgtcacgccaggcctctgttaaggttcgta

SEQ ID NO: 331559 - DNA, 75 bp, Artificial Sequence
  Synthetic
atcttgaccccagacattggggtccaacactttttaatgccatttctcaagctttttggcgtgtaatacaaaaca

SEQ ID NO: 331560 - DNA, 75 bp, Artificial Sequence
  Synthetic
ggtcatggactgaaaccaaaaaaacagctctacgaatttttgtgtttgttttagaacttttgctgcaattttgtg

SEQ ID NO: 331561 - DNA, 75 bp, Artificial Sequence
  Synthetic
ttagaacttttgctgcaattttgtgaaggggaagatactgtggacgggcgcggaaaaccacaaaggttaacagaa

SEQ ID NO: 331562 - DNA, 75 bp, Artificial Sequence
  Synthetic
gcctgtttcatgccctgagtcttccatgttcttctccccaccatcttcatttttatcagcattttcctggctgtc

SEQ ID NO: 331563 - DNA, 75 bp, Artificial Sequence
  Synthetic
aacaacactggcaaacaggtaaggttggtgttttttgttttatttcaggtccatgggtgctgctttaacactgtt

SEQ ID NO: 331564 - DNA, 75 bp, Artificial Sequence
  Synthetic
cagtggctgaaattgctgctggagaggccgctgctgctattgaagtgcaactagcatctgttgctactgttgaag

SEQ ID NO: 331565 - DNA, 75 bp, Artificial Sequence
  Synthetic
gcctaacaacttctgaagcaatagctgctataggcctcactccacaagcctatgctgtgatctctggggctcctg

SEQ ID NO: 331566 - DNA, 75 bp, Artificial Sequence
  Synthetic
ctgctattgctggatttgctgctttactacaaactgtgactggtgtgagcgctgttgctcaagtgggatataggt

SEQ ID NO: 331567 - DNA, 75 bp, Artificial Sequence
  Synthetic
tttttagtgactgggatcataaggtttctactgttggcctgtatcagcaaccaggaatggctttagaattgtatc

SEQ ID NO: 331568 - DNA, 75 bp, Artificial Sequence
  Synthetic
gcccagaggattactatgatattttatttcctggagttagcacatttgtgcatagtgttcagtatcttgacccta

SEQ ID NO: 331569 - DNA, 75 bp, Artificial Sequence
  Synthetic
gacattggggtcctacactgtttaatgctatttctcaagcattttggcgtgttatacaaaatgacattccaaggt

SEQ ID NO: 331570 - DNA, 75 bp, Artificial Sequence
  Synthetic
taacctcacaggagattgaaagaagaacacaaagatatttaagggacagtttggctaggtttttagaggaaacta

SEQ ID NO: 331571 - DNA, 75 bp, Artificial Sequence
  Synthetic
cttggacagttattaatgctcctgtgaattggtacaatgctttacaagactactattctactttatctcctgtga

SEQ ID NO: 331572 - DNA, 75 bp, Artificial Sequence
  Synthetic
tgctatgttaaacttgcattcagggacacaaaaaactcatgaaaatggtgctggaaaacccatacaagggtcaaa

SEQ ID NO: 331573 - DNA, 75 bp, Artificial Sequence
  Synthetic
ggcctacaatggttaggcaggttgctagcagggaaggagtgcaaatatcttttggccactcctatgataatattg

SEQ ID NO: 331574 - DNA, 75 bp, Artificial Sequence
  Synthetic
atgatgcagatagcattcagcaagtaactgaaaggtgggaatctcaaagccaacaaagtcctaatgtgcattcag

SEQ ID NO: 331575 - DNA, 75 bp, Artificial Sequence
  Synthetic
gtgaatttattgaaaagtatgaggctcctggtggtgcaaatcaaagaaccgctcctcagtggacgttacctttac

SEQ ID NO: 331576 - DNA, 75 bp, Artificial Sequence
  Synthetic
ttctaggcctgtacggaagtgttacttctgccctaaaatcttatgaagatggccccagcaaaaagaaaaggaagc

SEQ ID NO: 331577 - DNA, 75 bp, Artificial Sequence
  Synthetic
tgtccaggggcagctcccaaaaaaccaaaggaaccagttcaagtaccaaagctcgtcatagaaggaggaatagaa

SEQ ID NO: 331578 - DNA, 75 bp, Artificial Sequence
  Synthetic
gatgaacaccaaaaaggcttaagtaaaagcctagctgctgaaaagcagtttactgatgactctccagaaaaggac

SEQ ID NO: 331579 - DNA, 75 bp, Artificial Sequence
  Synthetic
cagctgccctgctacagtgtggccagaattccattgcctaatttaaatgaggaccttacctgtggaaatatttta

SEQ ID NO: 331580 - DNA, 75 bp, Artificial Sequence
  Synthetic
atgtgggaagctgtaactgtaaaaacagaagttattggggtaacttgtatgttaaatttgcactctggaacacaa

SEQ ID NO: 331581 - DNA, 75 bp, Artificial Sequence
  Synthetic
aaaacacatgaaaatggtgctggaaaacccatacaggggtcaaactttcatttctttgctattggtggggagcca

SEQ ID NO: 331582 - DNA, 75 bp, Artificial Sequence
  Synthetic
ctggagctgcaaggggtgctagctaactataggaccaaataccctgctttaactgttactcctaaaaatgccaca

SEQ ID NO: 331583 - DNA, 75 bp, Artificial Sequence
  Synthetic
acaattgcattcattttatgtttcaggttcagggggaggtgtgggaggttttttaaagcaagtaaaacctctaca

SEQ ID NO: 331584 - DNA, 75 bp, Artificial Sequence
  Synthetic
agtgacagtcagcaaatgaacactgatcataaagcagtgttggataaggataatgcttatccaattgagtgctgg

SEQ ID NO: 331585 - DNA, 75 bp, Artificial Sequence
  Synthetic
aaaactttatccatctttgcaaagctttttgcaaaagcctaggcctccaaaaaagcctcttcactacttctggaa

SEQ ID NO: 331586 - DNA, 75 bp, Artificial Sequence
  Synthetic
gttcctgatcctagtaaaaatgaaaatactagatactttggaacctacactggtggggaaaatgtaccccctgtg

SEQ ID NO: 331587 - DNA, 75 bp, Artificial Sequence
  Synthetic
tgccctgagtcttccatgttcttctccccaccatcttcgtcatcatcatcatcatcactgtttcttagccaatct

SEQ ID NO: 331588 - DNA, 75 bp, Artificial Sequence
  Synthetic
ctgcacattactaatactgcaaccacagtgcttcttgatgagcaaggcgcggggcccttatgcaaagctgacagc

SEQ ID NO: 331589 - DNA, 75 bp, Artificial Sequence
  Synthetic
ttgtatgtatctgctgcagacatttgtgggctttttaccaacacatctggaacccagcagtggaagggacttccc

SEQ ID NO: 331590 - DNA, 75 bp, Artificial Sequence
  Synthetic
agatactttaaaattaccctgagaaagcggtctgtgaaaaacccctacccaatttcctttttgttaagtgacctt

SEQ ID NO: 331591 - DNA, 75 bp, Artificial Sequence
  Synthetic
attaacagaaggacccaaagggtggatgggcaacccatgattggcatgtcctctcaggttgaagaggttagagtt

SEQ ID NO: 331592 - DNA, 75 bp, Artificial Sequence
  Synthetic
tatgaggacacagaagagcttccaggggatccagatatgataagatacattgatgagtttggacaaaccacaaca

SEQ ID NO: 331593 - DNA, 75 bp, Artificial Sequence
  Synthetic
cgaatgcagtgaacagcatgctttatttgtgcttaagcaatacaagtgtaatgttttttattatgcaataaaaca

SEQ ID NO: 331594 - DNA, 75 bp, Artificial Sequence
  Synthetic
tgtgagggctgagcctgaaatgagccttgagactgtgaatcaatgcctgtttcatgccctgagtcttccatgttc

SEQ ID NO: 331595 - DNA, 75 bp, Artificial Sequence
  Synthetic
cttgagactgtgaatcaatgcctgtttcatgccctgagtcttccatgttcttatcttcatttttatcagcatttt

SEQ ID NO: 331596 - DNA, 75 bp, Artificial Sequence
  Synthetic
gttaaaacaacaagcattttattttatgtgtcagggggtgggggaggttttttaaagcaggtaaaacctttacaa

SEQ ID NO: 331597 - DNA, 75 bp, Artificial Sequence
  Synthetic
aatgctttatttgtgaaatttgtgatgctttatttgtaaccattataagctgcaataaacaagtcaacaacaatt

SEQ ID NO: 331598 - DNA, 75 bp, Artificial Sequence
  Synthetic
gctggggagcctggggactttccacaccctaactgacacacattccacagcgctgactaattgagatgcatgctt

SEQ ID NO: 331599 - DNA, 75 bp, Artificial Sequence
  Synthetic
atgtgatatggttgattgtgatcataaacagactgtgaagattcgggggactgaaatgtgcgttgtgattgtgag

SEQ ID NO: 331600 - DNA, 75 bp, Artificial Sequence
  Synthetic
tatccatttttgcaaaaagctaggcctccaaaaaagcctcctcactacttctagaatagctcagaggccgaggcg

SEQ ID NO: 331601 - DNA, 75 bp, Artificial Sequence
  Synthetic
tcaacgcctgtttcatgccctgagtcttctaggttgtcattccccgcctgtttttcctgcacattttcctcctca

SEQ ID NO: 331602 - DNA, 75 bp, Artificial Sequence
  Synthetic
gcatcatcttcagaatctctaagccaatctagcacacctgttcccataccaacattaaacttcattttttgatat

SEQ ID NO: 331603 - DNA, 75 bp, Artificial Sequence
  Synthetic
atagacatactaaattccttgtcaagcctttctttccactccacaattctgctttgaatactttgagcaaactct

SEQ ID NO: 331604 - DNA, 75 bp, Artificial Sequence
  Synthetic
gcaacaggcctataccatattaacataagcagcaaggtaattccactttgaattattcttttttctagcagaaac

SEQ ID NO: 331605 - DNA, 75 bp, Artificial Sequence
  Synthetic
aaattagtcagccatggggcggagaatgggcggaactgggcggagttaggggcgggtgggcggagttaggggcgg

SEQ ID NO: 331606 - DNA, 75 bp, Artificial Sequence
  Synthetic
tcactgcgagccaggcaatgctttaaatattctttaggctgaaaatttaactgtttaacaaatctggcctgcaag

SEQ ID NO: 331607 - DNA, 75 bp, Artificial Sequence
  Synthetic
gactatggttgctgactaattgagatgcatgctttgcatacttttgcctgctggggagcctggggactttccaca

SEQ ID NO: 331608 - DNA, 75 bp, Artificial Sequence
  Synthetic
gtttttggcatatggtactcattcatggttactattccaggagggaaaatttgtgttctcttatttaggtgtttc

SEQ ID NO: 331609 - DNA, 75 bp, Artificial Sequence
  Synthetic
ttttctaggtttaccttaacactaccatctaggtaatctcttaaattgtcaaggttattaatcccttggcctgaa

SEQ ID NO: 331610 - DNA, 75 bp, Artificial Sequence
  Synthetic
ggtaaatctctagactctccccctgtccctttaacatcttcaaacactactaaaaactgatcaatagctactcca

SEQ ID NO: 331611 - DNA, 75 bp, Artificial Sequence
  Synthetic
agttcaaaatttagcctgtctaaaggtaagtttacatttaaagctttacccccacataattctagcaaggcagct

SEQ ID NO: 331612 - DNA, 75 bp, Artificial Sequence
  Synthetic
gctaaggtagttttaccactgtcaattggccctttaaaaagccagtatctctttttggggatgttataaaccata

SEQ ID NO: 331613 - DNA, 75 bp, Artificial Sequence
  Synthetic
tgtggagtaagaaaaaacagtatgttatgattataactgttatgcctacttataaaggttacagaatatttttcc

SEQ ID NO: 331614 - DNA, 75 bp, Artificial Sequence
  Synthetic
cattttaaaaactcataaaccaaagtatccattttgggtagtagacagtgcaaccaagcaactccagccatccat

SEQ ID NO: 331615 - DNA, 75 bp, Artificial Sequence
  Synthetic
tcttctatatcagcagagcctgcagagccaaacattatatccattctgtctaaaagctcattaaatctgtctgtt

SEQ ID NO: 331616 - DNA, 75 bp, Artificial Sequence
  Synthetic
aacatttggtctctagttagttgaaggctatcaacacgctttttagctagcacagtgtccactgcctgctggcaa

SEQ ID NO: 331617 - DNA, 75 bp, Artificial Sequence
  Synthetic
atgctcttttgatttttactgtcagcaaaaattgcagcatttgcataatgtttttcatgatgcttatagtggctt

SEQ ID NO: 331618 - DNA, 75 bp, Artificial Sequence
  Synthetic
ggctgttcctttttcatgcattttaaacacatttcataactatactgaaattccaaatacatcccaagtaataac

SEQ ID NO: 331619 - DNA, 75 bp, Artificial Sequence
  Synthetic
agcacatcatcacactttgtttccattgcatattctgttacaagcttccatgacacttgcttagtttcctctggc

SEQ ID NO: 331620 - DNA, 75 bp, Artificial Sequence
  Synthetic
tcttctggattaaaatcatgctcctttaatccccctggcaaactctcttccacaacagaaaatgggtctctagtt

SEQ ID NO: 331621 - DNA, 75 bp, Artificial Sequence
  Synthetic
aaagcactgtacatcaaatactccttatttacccctttacaaattaaaaagctaaaagtacacagcttttgagca

SEQ ID NO: 331622 - DNA, 75 bp, Artificial Sequence
  Synthetic
tagttattaatagcagatactctatgtctgtgtggggtaagaaaaaacaatatgttatgattgtagctattatgt

SEQ ID NO: 331623 - DNA, 75 bp, Artificial Sequence
  Synthetic
ctacttataaaagttacagaatacttttccataatttttttatataataatgcagctttttcctttgtggtgtaa

SEQ ID NO: 331624 - DNA, 75 bp, Artificial Sequence
  Synthetic
atagcaaagcaagctagagttctattactaaacacagcatgacttaaaaaactaagcagttctgcaggaaagtcc

SEQ ID NO: 331625 - DNA, 75 bp, Artificial Sequence
  Synthetic
ttggggtcttctacctttctcttcttttttggaggggttgaatgttgagagtcagcagtagcctcctcatcactg

SEQ ID NO: 331626 - DNA, 75 bp, Artificial Sequence
  Synthetic
gtcagcagtagcctcctcatcactggatggcatttcttctgagcaaaataggtcctcattaaaggcattccacca

SEQ ID NO: 331627 - DNA, 75 bp, Artificial Sequence
  Synthetic
ctgctcccattcatcagttccataggttggaatctaaaatacacaaacaattagaatcagtagtttaacacacaa

SEQ ID NO: 331628 - DNA, 75 bp, Artificial Sequence
  Synthetic
taagcttaaaaatttaatagttaccttaaagttttaaatctctgtaggtagtttgtccaattatgtcacaccaca

SEQ ID NO: 331629 - DNA, 75 bp, Artificial Sequence
  Synthetic
gaagcaatgttccttcacaaaggtcaagtccaaaccacattctaaagcaatcgaagcagtagcaatcaacccata

SEQ ID NO: 331630 - DNA, 75 bp, Artificial Sequence
  Synthetic
ataagctgcaataaacaagttaacaacaacaattgcattcattttatgtttcaggttcagggggaggtggttttt

SEQ ID NO: 331631 - DNA, 75 bp, Artificial Sequence
  Synthetic
caagaggatcttttctgtataattttctattttcgtgcttcatcctcagtaagcacagcaagcaaatgcagttag

SEQ ID NO: 331632 - DNA, 75 bp, Artificial Sequence
  Synthetic
taaagcaagtaaaacctctacagatgtgatatggctgatcatgaacagactgtgaggactgtgagggctgagggg

SEQ ID NO: 331633 - DNA, 75 bp, Artificial Sequence
  Synthetic
tagacatactttttgcacactcaggccactgtttgcagtaaattgcatccacaccaggatgtaaagaagaagcaa

SEQ ID NO: 331634 - DNA, 75 bp, Artificial Sequence
  Synthetic
tgtgaggactgtgagggctgaggggcctgaaatgagctttgggactgtgaatcaatgcctgtttcatgccctgag

SEQ ID NO: 331635 - DNA, 75 bp, Artificial Sequence
  Synthetic
atacctcagttgcatcccagaagcctccaaaatcaggttgatgagcatatttcactccatcttccattttcttgt

SEQ ID NO: 331636 - DNA, 75 bp, Artificial Sequence
  Synthetic
acttccatgttcttctccccaccatcttcatttttatcagcattttcctggctgtcttcatcatcactgtttctt

SEQ ID NO: 331637 - DNA, 75 bp, Artificial Sequence
  Synthetic
ataaggtattcattttcttcattttttcctcatcacctcctttatcaggatgaaactccttgcatttttttaaat

SEQ ID NO: 331638 - DNA, 75 bp, Artificial Sequence
  Synthetic
atgcctttctcataagaggaatatttccccaggcacttctttctagacctaaaaggtccattaattgcagggatt

SEQ ID NO: 331639 - DNA, 75 bp, Artificial Sequence
  Synthetic
tccccaggcacttctttctagacctaaaaggtccattaattgcagggattcttctctgcttaaaactttatccat

SEQ ID NO: 331640 - DNA, 75 bp, Artificial Sequence
  Synthetic
gcctcggcctctgcataaataaaaaaaattaggggcgggatgggcggagttaggggcgggactatggttgctgac

SEQ ID NO: 331641 - DNA, 75 bp, Artificial Sequence
  Synthetic
ctttgcatacttctgcctgctggggagcctggggactttccacaccctaactgacacacattccacagctggttc

SEQ ID NO: 331642 - DNA, 75 bp, Artificial Sequence
  Synthetic
gcaagtaaaacctctacagatgtgatatggctgattatgatcatgaacagactgtgaggactgtgagggctgagg

SEQ ID NO: 331643 - DNA, 75 bp, Artificial Sequence
  Synthetic
gagcctggggactttccacaccctaactgacacacattccacagctggttctttccgcctcagaaggtacctaac

SEQ ID NO: 331644 - DNA, 75 bp, Artificial Sequence
  Synthetic
gttttttaaagcaagtaaaacctctacaaatgtggtatggctgattatgatcatgaacagactgtgaggactgag

SEQ ID NO: 331645 - DNA, 75 bp, Artificial Sequence
  Synthetic
gggcctgaaatgagccttgggactgtgaatcaatgcctgtttcatgccctgagtcttccatgttcttctccccac

SEQ ID NO: 331646 - DNA, 75 bp, Artificial Sequence
  Synthetic
cttcttcatttttatcagcattttcctggctgtcttcatcatcatcatcattatcatcactgtttcttagccaat

SEQ ID NO: 331647 - DNA, 75 bp, Artificial Sequence
  Synthetic
cacttgtttagtttcctctgcttcttctggattaaaatcatgctcctttaacccacctggcaaactttcctcaat

SEQ ID NO: 331648 - DNA, 75 bp, Artificial Sequence
  Synthetic
ctatgcctgtgtggagtaagaaaaaacagtatgttatgattataactgttatgcctacttataaaggttacagaa

SEQ ID NO: 331649 - DNA, 75 bp, Artificial Sequence
  Synthetic
ccataattttcttgtatagcagtgcagctttttcctttgtggtgtaaatagcaaagcaagcaagagttctattac

SEQ ID NO: 331650 - DNA, 75 bp, Artificial Sequence
  Synthetic
tctattttcatgcttcatcctcagtaagcacagcaagcatatgcagttagtagacattttctttgcacactcagg

SEQ ID NO: 331651 - DNA, 75 bp, Artificial Sequence
  Synthetic
atgcatgctttgcatacttctgcctgctggggagcctggggactttccacacctggttgctgactaattgagatg

SEQ ID NO: 331652 - DNA, 75 bp, Artificial Sequence
  Synthetic
acctggttgctgactaattgagatgcatgctttgcatacttctgcctgctggggagcctggggactttccacacc

SEQ ID NO: 331653 - DNA, 75 bp, Artificial Sequence
  Synthetic
catgctttgcatacttctgcctgctggggagcctggggactttccacaccctaactgacacacattccacagctg

SEQ ID NO: 331654 - DNA, 75 bp, Artificial Sequence
  Synthetic
atgcatgctttgcatacttctgcctgctggggagcctggggactttccacaccctaactgacacacatgcatgct

SEQ ID NO: 331655 - DNA, 75 bp, Artificial Sequence
  Synthetic
cgcaccggggatcctaggcgttacgtgcactcttctttattgggctggattacacaaaacttttcaagcatgggc

SEQ ID NO: 331656 - DNA, 75 bp, Artificial Sequence
  Synthetic
aactgcaatcgaactcagaaacccagttcgtcttctaacaacctcgagaagccaccacaagctgcagaatttaga

SEQ ID NO: 331657 - DNA, 75 bp, Artificial Sequence
  Synthetic
agaacggcagagcccagtctatatgggaggtacaattgcaaatgttgttggtttgctgacaaaaacttaatcacc

SEQ ID NO: 331658 - DNA, 75 bp, Artificial Sequence
  Synthetic
tgtagtgaccattatctttgtctaagatgtcaccaaatcatgctgagaaactcagagctgtgcaacatctgctgg

SEQ ID NO: 331659 - DNA, 75 bp, Artificial Sequence
  Synthetic
aagcccctgccaacatccataagagtcccgctagaggcaagtgctccggatctgtaaccaacgacaaacaaggtc

SEQ ID NO: 331660 - DNA, 75 bp, Artificial Sequence
  Synthetic
tcccgctagaggcaagtgctccggatctgtaaccaacgacaaacaaggtcgctgaccccccggggggcccccaag

SEQ ID NO: 331661 - DNA, 75 bp, Artificial Sequence
  Synthetic
ggggcccccgtgggggtggcccccgggggagtttgggttctactcaatgtcctccactgtgtttctcctagctag

SEQ ID NO: 331662 - DNA, 75 bp, Artificial Sequence
  Synthetic
aggtctgcacataatgcctctcaacctcaaggacccctggttgtcagatacaacaaggtctttcagggacttact

SEQ ID NO: 331663 - DNA, 75 bp, Artificial Sequence
  Synthetic
gtatgcaaccttgaagttgacaaattcaacccagtccccgatcaactccagggacctgatcaagccagatctatg

SEQ ID NO: 331664 - DNA, 75 bp, Artificial Sequence
  Synthetic
taaatcatagacaaggacaaagtcctcttgttggaatagcatcacctgtgcagttgattttaaatagggccagag

SEQ ID NO: 331665 - DNA, 75 bp, Artificial Sequence
  Synthetic
ttggttcaacaaagcattcacatcttcagggtcgtccagtgcgccaattgccttcactattatatcaccagtcaa

SEQ ID NO: 331666 - DNA, 75 bp, Artificial Sequence
  Synthetic
ctccactctgtaagtagaaactttctcagttcccataaaaaagtggccgtctcttaacaccaatggctccccttg

SEQ ID NO: 331667 - DNA, 75 bp, Artificial Sequence
  Synthetic
atcgactggcccattgagtgtataggcatacttgtcactcaattcagataaaaatccaccaaagctgaatcttac

SEQ ID NO: 331668 - DNA, 75 bp, Artificial Sequence
  Synthetic
atccgtcagaattaggttgtcatttgtctccacaagatctgcatccatcatcagggaagccatattaaaagtgcc

SEQ ID NO: 331669 - DNA, 75 bp, Artificial Sequence
  Synthetic
ttgacctgtgaatatcggaagtcctgcaatcatggaaactccatccaacaagaggtgacttccccccgaccctga

SEQ ID NO: 331670 - DNA, 75 bp, Artificial Sequence
  Synthetic
cactgactgcgtcacatccaccacctgtaactctacgcttgcttctttaagatcaatgactttagaaacacatgt

SEQ ID NO: 331671 - DNA, 75 bp, Artificial Sequence
  Synthetic
aacactaaatgagtaagtcattttcctcttaaacctgtacttagttgatgttctagaatgctccacctggatcaa

SEQ ID NO: 331672 - DNA, 75 bp, Artificial Sequence
  Synthetic
aaacctcaagtcacaatcctcatggtcatcaaagttcccaagaagatccagcaagtcattgatgtgtctccctgg

SEQ ID NO: 331673 - DNA, 75 bp, Artificial Sequence
  Synthetic
agccagtggttgctctccaattgtgattttgtcaatgtacaatctaacatcttcaagatttgaaatcacataacc

SEQ ID NO: 331674 - DNA, 75 bp, Artificial Sequence
  Synthetic
cattgctatgtcttcaataaacatcgctctactgatcttctgatccctaactaagaaggtgaaatctgttaactc

SEQ ID NO: 331675 - DNA, 75 bp, Artificial Sequence
  Synthetic
acccaattcaatctgaccatcatcttccagctccaatacttcattaaaccaaaaaaacgattttaggcaagaagt

SEQ ID NO: 331676 - DNA, 75 bp, Artificial Sequence
  Synthetic
tgacatcactaaagggttcaccatcgatgataggatgatttgaaccatgaagttgtaacaaacctgttgaggact

SEQ ID NO: 331677 - DNA, 75 bp, Artificial Sequence
  Synthetic
cagtccaacttccttatctacgtaatcagactgcctaacgtgtgccatggcacagtcgctctgtttgactatgta

SEQ ID NO: 331678 - DNA, 75 bp, Artificial Sequence
  Synthetic
gacactattgtctctggctttcagtaggtggctgacgattcctagattctcattcatcaaatccaatgctatgca

SEQ ID NO: 331679 - DNA, 75 bp, Artificial Sequence
  Synthetic
aacatctaagaacttcagcttcctcccatccagtgttctgttcacttgcaaatcgctcatgaagggagacaagtg

SEQ ID NO: 331680 - DNA, 75 bp, Artificial Sequence
  Synthetic
ctcatcaaataatttcgggtaatttttccgaatggaatacaatacatgattcatacccagttgatcttctaattg

SEQ ID NO: 331681 - DNA, 75 bp, Artificial Sequence
  Synthetic
acgaacaattctaggcttaacagcccagaacaaattcctgttacttaacaccactggaatctgtggctctttcac

SEQ ID NO: 331682 - DNA, 75 bp, Artificial Sequence
  Synthetic
agatgagaatacccactcccctatttcgcaggcattggtcaaaactaaagaaaagtaatcccaaagaataggttt

SEQ ID NO: 331683 - DNA, 75 bp, Artificial Sequence
  Synthetic
ggaaaatttttcaattttttccagtgagggtctgcaataaatcacacctcttttcatgttgcacacctcacacag

SEQ ID NO: 331684 - DNA, 75 bp, Artificial Sequence
  Synthetic
acagggcttcacctttgtataaatatctttaatgtaaaggaaaccgccctcaccatctctgacacatttgctgcc

SEQ ID NO: 331685 - DNA, 75 bp, Artificial Sequence
  Synthetic
tatacttttacaaaaacctataaaaccagatgccactgaagactggaatgcagatttgtttatggactccgctaa

SEQ ID NO: 331686 - DNA, 75 bp, Artificial Sequence
  Synthetic
gatctttttaacaccctttgtgaagttccttgacaacctggactgcaatgtcttaatcagtgttggcacctcttc

SEQ ID NO: 331687 - DNA, 75 bp, Artificial Sequence
  Synthetic
tctctcaagaacccttctgctcgtcattaacttggtcctcaatactagtcttaggtcaccaaaacttgacaaatt

SEQ ID NO: 331688 - DNA, 75 bp, Artificial Sequence
  Synthetic
cacccatctaaagcctaaggcacgcataatatcttgctctgagcaacttgaataacgcaagaaccccacaagggc

SEQ ID NO: 331689 - DNA, 75 bp, Artificial Sequence
  Synthetic
gtcatcaccatctctaccaataagactgatcaggttttcctcaaaaactttgcctctttttatatcattaaaaac

SEQ ID NO: 331690 - DNA, 75 bp, Artificial Sequence
  Synthetic
ccttttagcacagcttctaatgaagcctgtcatctcatcatcagaaaatattgattcaatcttcctctgcaatcg

SEQ ID NO: 331691 - DNA, 75 bp, Artificial Sequence
  Synthetic
ataacccctcgtcccatccacccaatcttttacatcttgtttctcaacagcaccaaaaggggtttccttgaagcc

SEQ ID NO: 331692 - DNA, 75 bp, Artificial Sequence
  Synthetic
ggagtatttgatcagctggttcaccctttgagagatctttgagacaatttggacactaacaccatttgcgacaca

SEQ ID NO: 331693 - DNA, 75 bp, Artificial Sequence
  Synthetic
ctggtcacagattgtgtctattgtttctgacaactgtgttggtgttttgcatttcacattgtgcaacgctgcagc

SEQ ID NO: 331694 - DNA, 75 bp, Artificial Sequence
  Synthetic
aacaaattgagttaatagcggggtttcttcccccatcacaaaaaatcttgatttgaattcagctacaaaggtgcc

SEQ ID NO: 331695 - DNA, 75 bp, Artificial Sequence
  Synthetic
cgctacactcttggggctaacaaatttgttcaattttgaggagaggtactcatgaaaacacaacatttccaacca

SEQ ID NO: 331696 - DNA, 75 bp, Artificial Sequence
  Synthetic
ctcatcattaacttgattatcatctgaagcacaaggcaatttgataagtgtgacctggtcatcgctagaagtgta

SEQ ID NO: 331697 - DNA, 75 bp, Artificial Sequence
  Synthetic
ggaagttggaatgacatcatatagtaaatctagcacataatttaagaactgttctgttatcaatccatacaaatc

SEQ ID NO: 331698 - DNA, 75 bp, Artificial Sequence
  Synthetic
agacatgttatgcaggatgccttggcccatatctagaacagacattatgtgacttggtatctctccttggactgg

SEQ ID NO: 331699 - DNA, 75 bp, Artificial Sequence
  Synthetic
catgaattggtggaagaattcctctcccacgcttgagctaccacaacccatcaaccctaagcttctctttagatt

SEQ ID NO: 331700 - DNA, 75 bp, Artificial Sequence
  Synthetic
gccagtacagtaagcctcagcaacatttactggaacttctataactttatggaggtgccatctcagcacatttaa

SEQ ID NO: 331701 - DNA, 75 bp, Artificial Sequence
  Synthetic
gactggttcaagattaataatgttcctttcttttggggtcctaagttccaaaaattggaggaatgtcaagaaaag

SEQ ID NO: 331702 - DNA, 75 bp, Artificial Sequence
  Synthetic
cgcaggactcatggttggtccccatttagagtgatcaagagaacatgataggtcaccattgttcactgctaactt

SEQ ID NO: 331703 - DNA, 75 bp, Artificial Sequence
  Synthetic
catgtcacagatggctctatcaaattctttttctgaactgagacatgtatatctcatggaactgccaactgcctc

SEQ ID NO: 331704 - DNA, 75 bp, Artificial Sequence
  Synthetic
tgcaaagtcttcaactaaccttgttatcagcttagtgttaagatccccaacgtaaagttccctattggaacccac

SEQ ID NO: 331705 - DNA, 75 bp, Artificial Sequence
  Synthetic
ttgctccttgtaacttaagccaaactttaagttaccattatttgaactgatactggtaaactcagtaggagaatc

SEQ ID NO: 331706 - DNA, 75 bp, Artificial Sequence
  Synthetic
atcagagtaaaagcacaggttccttagtgcagcattggtaaaataactcctatccaacttatctgctatagcttc

SEQ ID NO: 331707 - DNA, 75 bp, Artificial Sequence
  Synthetic
agaattgctctctctcatgctaagtcttacttcatctttcactctcagtgcttcattagtgaaaccaagccttga

SEQ ID NO: 331708 - DNA, 75 bp, Artificial Sequence
  Synthetic
tctactcctatgttcataacttcctagtttttgatcataatgaccttgtatcaataagtatttgaagcactcaaa

SEQ ID NO: 331709 - DNA, 75 bp, Artificial Sequence
  Synthetic
atactcttcatcaaaatatgcagaagtagtgagatttttcaaaagcaatcctagaggacaaacttctaaaggtct

SEQ ID NO: 331710 - DNA, 75 bp, Artificial Sequence
  Synthetic
ctccaagaaatactctggtttgcttgaggagtaatagaccacatcacatagttctttatacaagtctgaagcgag

SEQ ID NO: 331711 - DNA, 75 bp, Artificial Sequence
  Synthetic
gttctttatacaagtctgaagcgagtacatcaggatcaaagtctttcacctcatgaagtgagacctctgtcctaa

SEQ ID NO: 331712 - DNA, 75 bp, Artificial Sequence
  Synthetic
tctctctcataatcccaaaaggaccccaaagttcctcaagtgtacctgtgctgcttttaaccctgccttcctttt

SEQ ID NO: 331713 - DNA, 75 bp, Artificial Sequence
  Synthetic
gattcggacttagattgacatctccagatttggagtccttcattttgaccattgctaattgcacggaatttttta

SEQ ID NO: 331714 - DNA, 75 bp, Artificial Sequence
  Synthetic
tatcattgaaagcttctgcttgctcttctgtcaacccttcaaacatcattgacagctcttcacaatctctctggg

SEQ ID NO: 331715 - DNA, 75 bp, Artificial Sequence
  Synthetic
ggcatttcttgtccatatttgcctaactgaaccaggtgaatcactcccaaccatggggcaattcattagtttcat

SEQ ID NO: 331716 - DNA, 75 bp, Artificial Sequence
  Synthetic
ttttagaaccaatactaacaagcccggttaagttttttagtatcaagtaatctaatgtacttggatcaatgttgt

SEQ ID NO: 331717 - DNA, 75 bp, Artificial Sequence
  Synthetic
atcttccctttgttttgaacctttccgccatggaagaaacacatgaagaaatcatcttctctctatcatataccg

SEQ ID NO: 331718 - DNA, 75 bp, Artificial Sequence
  Synthetic
aaagaacattcccaagttcatctagttttggtactactacgctcttattgctagagaggtctaaagcagtgctag

SEQ ID NO: 331719 - DNA, 75 bp, Artificial Sequence
  Synthetic
taatgtttggcttgaatgggtcgttcttaagctcacctgtgacttttagctttcctttattaaataatgagatgc

SEQ ID NO: 331720 - DNA, 75 bp, Artificial Sequence
  Synthetic
aataactcaacagttcattgctgacccctggtaatttggtgtcagaacagtctttgagggtctttgaataaaatt

SEQ ID NO: 331721 - DNA, 75 bp, Artificial Sequence
  Synthetic
caaaatcaacattgatagtgtcactgtgttaacaagatccgccgatgtctttgttcactctcctaaacttggttc

SEQ ID NO: 331722 - DNA, 75 bp, Artificial Sequence
  Synthetic
tatccagcccgtccaacatcattccttcttgagcttctgtcagttgaccatttaaagatgggttgactataacac

SEQ ID NO: 331723 - DNA, 75 bp, Artificial Sequence
  Synthetic
agttaaaatcaattttgggttcaatgaatttctcaaaacatttgatttggtctgttaatctgtcaggtgtttcct

SEQ ID NO: 331724 - DNA, 75 bp, Artificial Sequence
  Synthetic
ttgttattaaatgacaaaggtaacttacatttaagagatacttgaacctcctagcaaaataggggtccgaatcaa

SEQ ID NO: 331725 - DNA, 75 bp, Artificial Sequence
  Synthetic
caccttcaccaagaaggcattggaaaaggtccactgccagcctctgaactatgacttcagagccagacatacact

SEQ ID NO: 331726 - DNA, 75 bp, Artificial Sequence
  Synthetic
ccacttttaatttggacagtagatccacgtggtggaattgatttgagtatgccatcaaaaaataccttagccctt

SEQ ID NO: 331727 - DNA, 75 bp, Artificial Sequence
  Synthetic
gcagaaatacctgatttcttttggacggggcgcataaaatgcttaacaataaaagtcttagtttctctttggata

SEQ ID NO: 331728 - DNA, 75 bp, Artificial Sequence
  Synthetic
tcaccataagatcactgttgaagtccagccaagttgtcatctcatcacacatctcaaccaacacctcttgtgaaa

SEQ ID NO: 331729 - DNA, 75 bp, Artificial Sequence
  Synthetic
agattggcagaaaaaatctcttcgggtcacagtaaaaagagcccttctcgacaagaacaccatcttcacatgtgt

SEQ ID NO: 331730 - DNA, 75 bp, Artificial Sequence
  Synthetic
aaattgagtagcatcctgaacgctcacctgtcttttgataaaaaagaataacaatcagtccatcagttaaaaaga

SEQ ID NO: 331731 - DNA, 75 bp, Artificial Sequence
  Synthetic
atctctgttggtagcactcccttagtctcacattgccaaaataccttgagtattctttttcattaataagcaacc

SEQ ID NO: 331732 - DNA, 75 bp, Artificial Sequence
  Synthetic
ttgaagaaaacgaggttttcatagagtttattaaggaaagagacactgaggagagtattttgaaagcctcaacct

SEQ ID NO: 331733 - DNA, 75 bp, Artificial Sequence
  Synthetic
gttcagcatctgacatcatgtgaaatgtcttatgtttacattcagtgttaaagttccccccagcagagtatctca

SEQ ID NO: 331734 - DNA, 75 bp, Artificial Sequence
  Synthetic
taatgggtctatcagaagatattgtctgagctatagatattagcttggataaatcaggatatcttgcccacaccg

SEQ ID NO: 331735 - DNA, 75 bp, Artificial Sequence
  Synthetic
atatttgtgaccagatatcttgttgagacctcctcaagattttagagcaattctccacccacttaacattcgtct

SEQ ID NO: 331736 - DNA, 75 bp, Artificial Sequence
  Synthetic
attgaacagcatgggaggatgtaggtgtgggaagtatctgcctctgaagaagccaactatttggcatcgtagaca

SEQ ID NO: 331737 - DNA, 75 bp, Artificial Sequence
  Synthetic
ctattttctttttaattaatttcaccgcctccaaaaaatccaaggccctgtcattgactagtgtgaccatttgac

SEQ ID NO: 331738 - DNA, 75 bp, Artificial Sequence
  Synthetic
ttaggacagccatttgcgctcccaccggcccgggctttgcccgggccggtgtggccccccgatccgcggcgttgc

SEQ ID NO: 331739 - DNA, 75 bp, Artificial Sequence
  Synthetic
ccaggatgagaccagaccttctcaaagagtccagtgcttcgggtttggctgtaaataggtcatctaaaaagttta

SEQ ID NO: 331740 - DNA, 75 bp, Artificial Sequence
  Synthetic
ccattatgagatctagaaagagcaacgtatttcttcgggtgttaaaaacttttaatcccttaattttattgcaaa

SEQ ID NO: 331741 - DNA, 75 bp, Artificial Sequence
  Synthetic
aaaagctgttttgggaaagaaaaggaactctttgggtagtagtggtattggttcctctttgggtagttctccact

SEQ ID NO: 331742 - DNA, 75 bp, Artificial Sequence
  Synthetic
aactctttgggtagtagtggtattggttcctctttgggtagttctccactcatggctgagtggaacattatgcag

SEQ ID NO: 331743 - DNA, 75 bp, Artificial Sequence
  Synthetic
tcgacaacacgcctaaataggccttctcatgggggcagacaacatactgatctaattcagagtttgatttctccc

SEQ ID NO: 331744 - DNA, 75 bp, Artificial Sequence
  Synthetic
tgtcctgcctttttagtgctgtgaaagtcaaactatagattatgtccatgaatttgttgacacaaaagggacaat

SEQ ID NO: 331745 - DNA, 75 bp, Artificial Sequence
  Synthetic
ctgaggtggtgttatcctcatgtttccctaacctaattaaattgttcagaagctctgatctattagttatcctaa

SEQ ID NO: 331746 - DNA, 75 bp, Artificial Sequence
  Synthetic
acttccccaagtttttgtcaaaaacttcctttttgtaccagagtcttaatttcattaattcttccctaatcacag

SEQ ID NO: 331747 - DNA, 75 bp, Artificial Sequence
  Synthetic
attctcgaacatcgcctttgactccaacaaataatgatttggccagtctatcatcatactccaaaagatttcttt

SEQ ID NO: 331748 - DNA, 75 bp, Artificial Sequence
  Synthetic
tgagacactctatattctcaaatcctaaactttgattacgaacgtttgaaagactgtgtatcagacgttgatact

SEQ ID NO: 331749 - DNA, 75 bp, Artificial Sequence
  Synthetic
cttctcatcatgtggctttctgaagcagtggatgtattgtttctttgcaggttgatataatgcaagctctactgg

SEQ ID NO: 331750 - DNA, 75 bp, Artificial Sequence
  Synthetic
cagtggatgtattgtttctttgcaggttgatataatgcaagctctactgggtcagtaggaggtccctcgatgtcc

SEQ ID NO: 331751 - DNA, 75 bp, Artificial Sequence
  Synthetic
cttgatcctcaatatcaatctctgcggacgatcgggatttccgcaaaatttcaattaacaaccatctgatcctct

SEQ ID NO: 331752 - DNA, 75 bp, Artificial Sequence
  Synthetic
ccaccacccattcaggagtgaacctattagaataattagttctaccgtcaacaacaggaacaagtgtgatgcctg

SEQ ID NO: 331753 - DNA, 75 bp, Artificial Sequence
  Synthetic
acctcagaaggtcttgtttgagatttagtagttttgtcatgtcactcttccattttctctcaaattcttctggat

SEQ ID NO: 331754 - DNA, 75 bp, Artificial Sequence
  Synthetic
tgaccctcacaaatgtttccaatagtattaatgtttttccagtgagtttgaatccatcaggtatcactttaggga

SEQ ID NO: 331755 - DNA, 75 bp, Artificial Sequence
  Synthetic
gagtgggacatgggattccatgatcactgaggatcacatcaacatatttttggcaggtgttcaagtggcatgcat

SEQ ID NO: 331756 - DNA, 75 bp, Artificial Sequence
  Synthetic
gagattcacaggactctaactccacaaggttggagagaagtttaaaaccttcttgaagcagtgaccctgaatgac

SEQ ID NO: 331757 - DNA, 75 bp, Artificial Sequence
  Synthetic
agtgtgacaggaaggcatctttctggtgggcaaactcatgcctatttggaatgtgttttctaaccaagtctttga

SEQ ID NO: 331758 - DNA, 75 bp, Artificial Sequence
  Synthetic
gtgttttctaaccaagtctttgagttcagacacagtttcatccatggtcaagtgccgcctaggatccactgtgcg

SEQ ID NO: 331759 - DNA, 75 bp, Artificial Sequence
  Synthetic
ggcatttcttgtccatatttgcctaactgaaccaggtgaatcactcccaccatggggcaattcattagtttcatg

SEQ ID NO: 331760 - DNA, 75 bp, Artificial Sequence
  Synthetic
catggggcaattcattagtttcatgcaggagatacctattttcttgcaagaagcactcaacattgcattggtggc

SEQ ID NO: 331761 - DNA, 75 bp, Artificial Sequence
  Synthetic
agtcagcctcatctgtatagtgaaaggcttggtgaacctatacaggtgcggactgtttcaattgatggtcttcct

SEQ ID NO: 331762 - DNA, 75 bp, Artificial Sequence
  Synthetic
tgtgttggctggcagatcatgttcagaggaaacatttaagataggtatgcacacaaaattccaagaggtgtccct

SEQ ID NO: 331763 - DNA, 75 bp, Artificial Sequence
  Synthetic
ctctttaagtgcacttttgaccaatcagtctcatgaacttcctatgttatgtttagccaacaaaacacatctcta

SEQ ID NO: 331764 - DNA, 75 bp, Artificial Sequence
  Synthetic
gtttagccaacaaaacacatctctatctaaagagtggtagatccagtttcaaaatcaacattgatagtgtcactg

SEQ ID NO: 331765 - DNA, 75 bp, Artificial Sequence
  Synthetic
tgttaacaagatctgaagtgaacttaacatcaattaatttgacgagatcgatcgatgtctttgttcactctccta

SEQ ID NO: 331766 - DNA, 75 bp, Artificial Sequence
  Synthetic
aacttggttcttgttttgaaagtgatgaggagtgggttgttgcttggtggattgaagccatcggtcacagatggg

SEQ ID NO: 331767 - DNA, 75 bp, Artificial Sequence
  Synthetic
accaggacccaggtcttctatgcaggaataaaaccaaaacagagggtaaactgatccagattaacatttcaagag

SEQ ID NO: 331768 - DNA, 75 bp, Artificial Sequence
  Synthetic
ctgatggcaatgttcactatggatggagattaaaaaatggacttgatcatatttacagaggacgtgaagaaccct

SEQ ID NO: 331769 - DNA, 75 bp, Artificial Sequence
  Synthetic
cgcacagtggatcctaggcgattttgcccgcttctgccatattgaactacattaaactcaccccttgtgcagaat

SEQ ID NO: 331770 - DNA, 75 bp, Artificial Sequence
  Synthetic
cgcactgtggatcctaggcgattttgcccgcttctgccatattgaactacattaaactcaccccttgtgcagaat

SEQ ID NO: 331771 - DNA, 75 bp, Artificial Sequence
  Synthetic
cgcaccgtggatcctaggcgattttgcccgcttctgccatattgaactacattaaactcaccccttgtgcagaat

SEQ ID NO: 331772 - DNA, 75 bp, Artificial Sequence
  Synthetic
cgcacggtggatcctaggcgattttgcccgcttctgccatattgaactacattaaactcaccccttgtgcagaat

SEQ ID NO: 331773 - DNA, 75 bp, Artificial Sequence
  Synthetic
gttttgagggtgagcagtgtcttatcaaaattcaacctgaagactggccgactgactgtaaggctgaccacacaa

SEQ ID NO: 331774 - DNA, 75 bp, Artificial Sequence
  Synthetic
ctccaccatgggacagttcgtaagtttcatacaagagataccaaccttcctccaggaagcgctcaacatagcgtt

SEQ ID NO: 331775 - DNA, 75 bp, Artificial Sequence
  Synthetic
acacattccgctttttatcaaggagccaaaaaagcatagctgtaggaaggactctcaaggcatttttctcctggt

SEQ ID NO: 331776 - DNA, 75 bp, Artificial Sequence
  Synthetic
ggcagcagtgagtctcatctgtgttacaaaaggtttggtgaacttatacagatccggtctgttccaactagttct

SEQ ID NO: 331777 - DNA, 75 bp, Artificial Sequence
  Synthetic
cgcttactgaccctttagggaacgaagcccctgggggatactgtcttgaaaagtggatgcttgttgctagcgaat

SEQ ID NO: 331778 - DNA, 75 bp, Artificial Sequence
  Synthetic
gttccttcttttagctggaaagtcctgttcagaggaagttttcaagataggccttcacacaaggctacaagaagt

SEQ ID NO: 331779 - DNA, 75 bp, Artificial Sequence
  Synthetic
taaagtgttttgggaacactgcaattgccaagtgcaaccaaaatcacgactcagagttttgtgacatgctaaggc

SEQ ID NO: 331780 - DNA, 75 bp, Artificial Sequence
  Synthetic
gaccctctctccaggcgtgcttctaacaaatcatgatcacgaattgccagtgttatgttcagtgaataggacgca

SEQ ID NO: 331781 - DNA, 75 bp, Artificial Sequence
  Synthetic
tgtttgattacaacaaaaatgctataaaaacactgaatgaggagactaagacgagggtgaatgtcctgagccaca

SEQ ID NO: 331782 - DNA, 75 bp, Artificial Sequence
  Synthetic
tctatatttcaaaggcggcaacttcagttttgaagtttacattgacgatgttgttgtcctacttatggtggaagg

SEQ ID NO: 331783 - DNA, 75 bp, Artificial Sequence
  Synthetic
ccatcaatgctctgatctcagacaaccttctgatgaagaataagattcgagagctgatgagtgtaccttattgca

SEQ ID NO: 331784 - DNA, 75 bp, Artificial Sequence
  Synthetic
tggctccgacatctccattgattctcctaacctcagtgcctgtctcccagatggtcaggagtggttggtgaattg

SEQ ID NO: 331785 - DNA, 75 bp, Artificial Sequence
  Synthetic
actacacacgattttggtatgtcaatcacacactttcaggacagcactctcttccaagatgctggatgataagaa

SEQ ID NO: 331786 - DNA, 75 bp, Artificial Sequence
  Synthetic
gtggattgaaacaattggtcacaaatggggtcttgacccaaacatgctgtgcagaaacaagaccaaacctgaggg

SEQ ID NO: 331787 - DNA, 75 bp, Artificial Sequence
  Synthetic
acaattcttacctcaactcatctgaatttagaaatgagtggattcttgaaagtgatttcctcatttctgagatgc

SEQ ID NO: 331788 - DNA, 75 bp, Artificial Sequence
  Synthetic
ttttctgatacaaatcaacatttcgagagccgacaacaactatcgttatggttggaaattaaaaaatggcttgga

SEQ ID NO: 331789 - DNA, 75 bp, Artificial Sequence
  Synthetic
tgggtaaggagtattcagagagacaggggagaactccaatcactttagtggacatttgtttttggagtacagtgt

SEQ ID NO: 331790 - DNA, 75 bp, Artificial Sequence
  Synthetic
tcacatttacagagatcgtcaagaaccttgccttgaaggaaaaagatgtcttcttaaaattcggcctgcaggttg

SEQ ID NO: 331791 - DNA, 75 bp, Artificial Sequence
  Synthetic
tcttcactagcacactattcttgcacctcattggtttcccaactcatgaacacattcgaggggaaggttgccctc

SEQ ID NO: 331792 - DNA, 75 bp, Artificial Sequence
  Synthetic
gccacagagttgcaacgttgaccacatgaacactctcaactttctaataaggggtcaaaagaatatgtttacgag

SEQ ID NO: 331793 - DNA, 75 bp, Artificial Sequence
  Synthetic
tcccccatagattgaacagcatgggaggatgtaggtgtgggaagtatctgcctctgaagaagccaactatttggc

SEQ ID NO: 331794 - DNA, 75 bp, Artificial Sequence
  Synthetic
aagaactctaaaagcttttttctcttggtcactcactgattcctctggaagggacaccccaggagggtattgtct

SEQ ID NO: 331795 - DNA, 75 bp, Artificial Sequence
  Synthetic
atcgtagacattaggacagcacatttgcgctcccacgcgctttgcccgggccggtgtggccccccgatccgcgtt

SEQ ID NO: 331796 - DNA, 75 bp, Artificial Sequence
  Synthetic
ggagaaatggatgctactggcagctgaaatgaagtgttttgggaacactgctattgcaaaatgcaaccaaaatca

SEQ ID NO: 331797 - DNA, 75 bp, Artificial Sequence
  Synthetic
gccgcggatcggggaggcacctgtggtgcggaagtcttacagctcacagtgcaaaagctgttttgggaaagaaaa

SEQ ID NO: 331798 - DNA, 75 bp, Artificial Sequence
  Synthetic
tgattcagagttctgtgatatgttacgtctatttgattacaacaaaaatgcaattaagacactaaatgaagaaac

SEQ ID NO: 331799 - DNA, 75 bp, Artificial Sequence
  Synthetic
ggaactctttgggtagtagtggtattggttcctccttgggtagttctccactcacggctgagtggaacattatgc

SEQ ID NO: 331800 - DNA, 75 bp, Artificial Sequence
  Synthetic
taagaatagggttaacacattaactcagatgataaatgccttgatttcagacgatctattgatgaaaaacaaaat

SEQ ID NO: 331801 - DNA, 75 bp, Artificial Sequence
  Synthetic
agtccagcagtgcacagtgaggttcatcaggactggggcttggtggagaatctttgctcttattcttcttgctaa

SEQ ID NO: 331802 - DNA, 75 bp, Artificial Sequence
  Synthetic
tagagaattaatgaatgtgccttactgcaattacacacggttttggtatgttaatcacactctatctggccagca

SEQ ID NO: 331803 - DNA, 75 bp, Artificial Sequence
  Synthetic
taatcaccccattatgttgtttgcagaggtggccgaatttatcccacacttggtgctcgaatagtcttgcttgat

SEQ ID NO: 331804 - DNA, 75 bp, Artificial Sequence
  Synthetic
ctcccttccaaaatgctggatggtaaggaataactcctacttgaatttgtctgagtttaggaatgactggattct

SEQ ID NO: 331805 - DNA, 75 bp, Artificial Sequence
  Synthetic
ctgaagtgaacttaacatcaattaatttgagatctttccttccgtgaatatctagaagctttctgatgtcatcag

SEQ ID NO: 331806 - DNA, 75 bp, Artificial Sequence
  Synthetic
cgaaagcgacttcctgatctctgaaatgcttagtagagaatacttggaaaggcaagggaaaactcccatcacttt

SEQ ID NO: 331807 - DNA, 75 bp, Artificial Sequence
  Synthetic
atccttgtgttgtaatcaccatgttgggaggtagtaaccctatgacataactgagcacacctggcacagcatcct

SEQ ID NO: 331808 - DNA, 75 bp, Artificial Sequence
  Synthetic
agtagacatctgtttctggagtacgattttttacaccagcacactgtttcttcacctcattgggatcccaacaca

SEQ ID NO: 331809 - DNA, 75 bp, Artificial Sequence
  Synthetic
caatgtccttcattagaatgccgtgagaatgtctgctcccatttttaaatcccttctcatcatgtggctttctga

SEQ ID NO: 331810 - DNA, 75 bp, Artificial Sequence
  Synthetic
cagacatatccaaggtgatggctgccctttacctcataagctgaacagcttgggagggtgcagatgtggaaaata

SEQ ID NO: 331811 - DNA, 75 bp, Artificial Sequence
  Synthetic
agcagtggatgtattgtttctttgcaggttgatataatgcaagctctactgggtcaagttggaggtcctcgatgt

SEQ ID NO: 331812 - DNA, 75 bp, Artificial Sequence
  Synthetic
tcctccccttaggaaacctaccatttggtaccgcagacactgaaaacctcaggacaacagtctcccaccggcccg

SEQ ID NO: 331813 - DNA, 75 bp, Artificial Sequence
  Synthetic
ccaaccaaatagtgttggaggggtcaagttcactaatagcagctctgactattagttcttgcccctctgtgaggc

SEQ ID NO: 331814 - DNA, 75 bp, Artificial Sequence
  Synthetic
ggcactgcccgggccggtgtggcctcccgatccgcggctgcgccgcggatcgggaaggcaccgtcagtagtgcag

SEQ ID NO: 331815 - DNA, 75 bp, Artificial Sequence
  Synthetic
ttgccagtcttaaattttgcccctttctttctgctggccttggtgctgctcctggttctggcactgcatccggct

SEQ ID NO: 331816 - DNA, 75 bp, Artificial Sequence
  Synthetic
gtgctctcactgtctacagtgcgaatgctgtctttgggaggaaaagaaggtcttgggacaacaacggcattagct

SEQ ID NO: 331817 - DNA, 75 bp, Artificial Sequence
  Synthetic
tcttggtcagatctacgctcgtgttgtcccaggatcgccccataatttgcgatcgagagcctatatagggccagc

SEQ ID NO: 331818 - DNA, 75 bp, Artificial Sequence
  Synthetic
ctccctccgtcagtttcccatccattgccgactgaaacatgatgcagtcaagcagtgcacaatgtggttcactgg

SEQ ID NO: 331819 - DNA, 75 bp, Artificial Sequence
  Synthetic
catcacctgacaaacacagtttgtagagtaaattttcgtaggggttcctacttccaggtctgtcgtcaataaaca

SEQ ID NO: 331820 - DNA, 75 bp, Artificial Sequence
  Synthetic
aattgcccttggaagatgattcctttcctttgtttttcttgttgacaatgacaccattgtgctgtttgcagagat

SEQ ID NO: 331821 - DNA, 75 bp, Artificial Sequence
  Synthetic
taccctcccttctcttgacttgtaaggtgtttttgatcaggctagagaagttgtcgggactcactctgattgtct

SEQ ID NO: 331822 - DNA, 75 bp, Artificial Sequence
  Synthetic
tgccatacctgtcccacacctgttgttcaaattgccttgcttggtctgatgtaaatctgacatctaccagcttca

SEQ ID NO: 331823 - DNA, 75 bp, Artificial Sequence
  Synthetic
ccaacatgttaccaccatcaaggatggaggctcctgcttttactgctgccaacagactgaggttgtaacctgaaa

SEQ ID NO: 331824 - DNA, 75 bp, Artificial Sequence
  Synthetic
agtccttccttccatgcaggtcaaagagttttctaatgtcatcagatccctgtgtcgtgattaccatgtcctgag

SEQ ID NO: 331825 - DNA, 75 bp, Artificial Sequence
  Synthetic
tgttaattgaactctcttctttggttataatttgcagacactcatggtttgggatgagcttgtcaagatcagaaa

SEQ ID NO: 331826 - DNA, 75 bp, Artificial Sequence
  Synthetic
gtagcaagcctataacatagctcagcacaccgggtatcgcatcctcaatgtctttcattagtataccatgtgagt

SEQ ID NO: 331827 - DNA, 75 bp, Artificial Sequence
  Synthetic
gatttgggtatttcactgtataaagaaggcctaaagaggtcaatgcttgaactacattgttcatagtctcccctc

SEQ ID NO: 331828 - DNA, 75 bp, Artificial Sequence
  Synthetic
gcctgctcccatttttgaatcctttctcatcatgtggtttcctaaaacagtggatgtaacatttgctggaaggct

SEQ ID NO: 331829 - DNA, 75 bp, Artificial Sequence
  Synthetic
cttggacagtcatacatgcaattgttaatgcaggcatggatccaaattgattgttcagtttgctggaatctttca

SEQ ID NO: 331830 - DNA, 75 bp, Artificial Sequence
  Synthetic
gatatagagctaactctactggatctgtgggtgggccctcaatatctagccagagagtgttggtggagtcaagtc

SEQ ID NO: 331831 - DNA, 75 bp, Artificial Sequence
  Synthetic
catcccaaactctaacaattccattgggacgacctccctgctgagcaaatccgagtgttctcaaaatctcactcc

SEQ ID NO: 331832 - DNA, 75 bp, Artificial Sequence
  Synthetic
tccctacagcattctttatttcggtttcttgtgattctgtaagacttgctagtcttaggttttgtcctttccgtt

SEQ ID NO: 331833 - DNA, 75 bp, Artificial Sequence
  Synthetic
tcctgttgagttgagattgtggcagatttcccatgtaagcattggtaccattgctctcagttctttttattttgt

SEQ ID NO: 331834 - DNA, 75 bp, Artificial Sequence
  Synthetic
ccaactgtcttggtgttgggtctggctttctcgtcagatcaatactggtgttgtcccatgatcgtcccagaatct

SEQ ID NO: 331835 - DNA, 75 bp, Artificial Sequence
  Synthetic
cttttagcttttcaagatcggaggccagttccattagttcatcccttgccaggtcaccaactttgaagattgtgt

SEQ ID NO: 331836 - DNA, 75 bp, Artificial Sequence
  Synthetic
gtgatctagagcctatgtaaggccatccatcaccagacaaacacagtttgtaaagtaggttttcataagggttcc

SEQ ID NO: 331837 - DNA, 75 bp, Artificial Sequence
  Synthetic
tcttctgaacacttttcatagacatcagcctgtcgacctctatattgagatccctcaatttgttcaagtcatcat

SEQ ID NO: 331838 - DNA, 75 bp, Artificial Sequence
  Synthetic
ggctgccaggtgtgccaccaatgaacatcccttcccttcttttaacctgcagagtgcttttgatcagatttgaaa

SEQ ID NO: 331839 - DNA, 75 bp, Artificial Sequence
  Synthetic
cggttcttttggtctttctaagcactcgttgaacttgagcaacctggttgaagtcaatgctgtcggcaatcagct

SEQ ID NO: 331840 - DNA, 75 bp, Artificial Sequence
  Synthetic
agttatcaggtgtcaccctaattgtctccagcatattgccaccatcgagaatggacgctcctgcctttactgctg

SEQ ID NO: 331841 - DNA, 75 bp, Artificial Sequence
  Synthetic
tagcgtcctttaaaatatctgacttgactgtttgggtgaattgactcaatccctttctaagagactgggtccatc

SEQ ID NO: 331842 - DNA, 75 bp, Artificial Sequence
  Synthetic
ctgaaaggctgaaattataacctgaaatgttcacagaactctcatcctttgttatgatttgcaaacagtcatgct

SEQ ID NO: 331843 - DNA, 75 bp, Artificial Sequence
  Synthetic
tgaagcttggcacttccttggattgagccattatggcgatcaaagcaaggatttcaaaaaagagctcagtgaaag

SEQ ID NO: 331844 - DNA, 75 bp, Artificial Sequence
  Synthetic
cggagatcagtttgtcaagatctgacaaattcgggtactttactgtgtagagaaggcccagagatgttaacgctt

SEQ ID NO: 331845 - DNA, 75 bp, Artificial Sequence
  Synthetic
atggcgatcaaagcaaggatttcaaaaaagagctcagtgaaagagttagacaatttgcctaggatccactgtgcg

SEQ ID NO: 331846 - DNA, 75 bp, Artificial Sequence
  Synthetic
tctgtaaccaacgacaaacaaggtcgctgaccccccggggggcccccaagggggccccccgtgggggtggccccc

SEQ ID NO: 331847 - DNA, 75 bp, Artificial Sequence
  Synthetic
gaaccacattgttcatcgtctcccctccctgaactgtcatgcatgcaattgttagtgcgggaatagaaccaaatt

SEQ ID NO: 331848 - DNA, 75 bp, Artificial Sequence
  Synthetic
ggttattgagcttgcttgaatccttaacatcccagattctgacaacttcaccaactcggcctccttgttggacaa

SEQ ID NO: 331849 - DNA, 75 bp, Artificial Sequence
  Synthetic
atcccagagatttgagtatctctgacctcctacccaattgtgactgtgatagatttcccatgtagacacctgaac

SEQ ID NO: 331850 - DNA, 75 bp, Artificial Sequence
  Synthetic
ttcctgtctcagacctcttgatcttatctttcagtttctctaaatctgaggctaactccatcagttcatctctcc

SEQ ID NO: 331851 - DNA, 75 bp, Artificial Sequence
  Synthetic
ccaagtcaccgactttaaaaacagtgttcctttggacactcttcatggacattagcctgtcgacttccatgttca

SEQ ID NO: 331852 - DNA, 75 bp, Artificial Sequence
  Synthetic
ggtctcttagcttgttgaggtcttcctcactcctctttgttttcctgagcgccctttggacctgagcaacttgat

SEQ ID NO: 331853 - DNA, 75 bp, Artificial Sequence
  Synthetic
tgaagtcaatgctgtcagcaatgagtttcgcatcctttagaacatcagatttgactgtctgggtgtattgactta

SEQ ID NO: 331854 - DNA, 75 bp, Artificial Sequence
  Synthetic
gccctcttcttagggactgggtccatctgaagctgggaatttccttggattgagccattatgatggaaagtccag

SEQ ID NO: 331855 - DNA, 75 bp, Artificial Sequence
  Synthetic
tatgatggaaagtccaggaactcaaaatgaggctcagtgaaagagttagacactatgcctaggatccactgtgcg

SEQ ID NO: 331856 - DNA, 75 bp, Artificial Sequence
  Synthetic
accaaacaaagatgtatgagatattattaatttttaaagtgaaaattaatatcttaggagcaaagaacctccttc

SEQ ID NO: 331857 - DNA, 75 bp, Artificial Sequence
  Synthetic
tcgcacaagatatatctaatatcttatcattatcatctacgtgctatcgcaaaatatctacaagaatagttaaac

SEQ ID NO: 331858 - DNA, 75 bp, Artificial Sequence
  Synthetic
ttggtgcaggagttggtgtggcaaagatgtcacgcttagggaatgcactagaagagtttcgctcctttaaaaaca

SEQ ID NO: 331859 - DNA, 75 bp, Artificial Sequence
  Synthetic
ttagagacctcacaacagctaaactagggatgaataaggatatccttcaaggtcaagtagatcatgaaggacaga

SEQ ID NO: 331860 - DNA, 75 bp, Artificial Sequence
  Synthetic
atccacctaagagaggtgcactcactactgctcttcaaggtatcaagaagaatgttatagttcttgtaccaacaa

SEQ ID NO: 331861 - DNA, 75 bp, Artificial Sequence
  Synthetic
tgatgaccaggttaccttccataatggaaggtgggcgatggtatgagccattcttgttctggtttaaatgtaaat

SEQ ID NO: 331862 - DNA, 75 bp, Artificial Sequence
  Synthetic
tgaagcagcctgccaagcgtttccaattcatgactttaattttgcaaattgcatggtctgcaaaatcttctgcag

SEQ ID NO: 331863 - DNA, 75 bp, Artificial Sequence
  Synthetic
acattatgagaaagctcattaaaaggaacactaagcttagatataattcttaccaaaatgagttagtatcagata

SEQ ID NO: 331864 - DNA, 75 bp, Artificial Sequence
  Synthetic
ctttcataactggtgcatttttttcactgttatccatgtttgcagacaacccaggtgctatgctcagggctcttg

SEQ ID NO: 331865 - DNA, 75 bp, Artificial Sequence
  Synthetic
cctcactacattatatactagttaacaaacatatgtgtattattataaacaagcgtaacttgaatgtatattatt

SEQ ID NO: 331866 - DNA, 75 bp, Artificial Sequence
  Synthetic
tcaatgatcccgacattgatgtgcaaatagctgaagtttctgacgtgaatgattctaaaatgactctagccacta

SEQ ID NO: 331867 - DNA, 75 bp, Artificial Sequence
  Synthetic
ttacattagaattagttttgatgttttgtgatgtcttggaggggagaatgatgatagatttgggcatgacatgtg

SEQ ID NO: 331868 - DNA, 75 bp, Artificial Sequence
  Synthetic
ggggacgtggaatggaccgttatgaagaagagatcactcaaatgattgaaaccccgccaaagggcagggacaaac

SEQ ID NO: 331869 - DNA, 75 bp, Artificial Sequence
  Synthetic
acatgaggttcgaggattttagacataggggtcataacctttgggagctgatagattctctttttgaggatttgg

SEQ ID NO: 331870 - DNA, 75 bp, Artificial Sequence
  Synthetic
cgtatccgtatgctgaaccagactacatgaagatcatgcctaggtctacagaggatcttcaaattgctatccaga

SEQ ID NO: 331871 - DNA, 75 bp, Artificial Sequence
  Synthetic
ggaatgacacttatgacatggtagctatgattgaacctcttgtcctagggtttttacaacttaaagatgattcta

SEQ ID NO: 331872 - DNA, 75 bp, Artificial Sequence
  Synthetic
cagtgacagcacaactctggatcttgctgaccaaagcagtgactgccatcgacactgcaagagattcagagaacc

SEQ ID NO: 331873 - DNA, 75 bp, Artificial Sequence
  Synthetic
ttctgcttagaggtgcttttctacagttttgcttttctgaaatatacgagttattcagcagcagaggatttgaca

SEQ ID NO: 331874 - DNA, 75 bp, Artificial Sequence
  Synthetic
ggagatggatcaagtatgagcagcagagaagagctgatgctgactaccggctggacgaaggatggctgaatttcg

SEQ ID NO: 331875 - DNA, 75 bp, Artificial Sequence
  Synthetic
gtcaacaagacatagcatctgttattgaatcacttacaaatatattcctgatgaaggacattcatatgactggag

SEQ ID NO: 331876 - DNA, 75 bp, Artificial Sequence
  Synthetic
caagggtgagaattgcttcagatctggctgtcaggaggtacatggttgagattctaattgatgcaaaccgagcac

SEQ ID NO: 331877 - DNA, 75 bp, Artificial Sequence
  Synthetic
aatttttctcgtttttccgaacattcggtcatcccactcttgaagcagaagaagcagctgataaagttagactgc

SEQ ID NO: 331878 - DNA, 75 bp, Artificial Sequence
  Synthetic
cttcaccgaaagccagggtgcttgagcttatatgcgacattggtaactatataagtgaagctggtttagctgggt

SEQ ID NO: 331879 - DNA, 75 bp, Artificial Sequence
  Synthetic
atatgaataaacctaagattattgattttgagataatgatgaaagggcatgcattgttctgtggcatcataataa

SEQ ID NO: 331880 - DNA, 75 bp, Artificial Sequence
  Synthetic
ttcatcttacaatcaaatacgggatcgaaactcgctatccagccttggcactgaatgagctacaagctgacctag

SEQ ID NO: 331881 - DNA, 75 bp, Artificial Sequence
  Synthetic
acggattcagagagagacacggaggtgcatggccacctcatgagtttcccgatcatgtgagcaatattgttaagg

SEQ ID NO: 331882 - DNA, 75 bp, Artificial Sequence
  Synthetic
gaaccatactatccttgatgaagtgctatgttgagcttggagaaagagctccctacatggtgatcctagaagact

SEQ ID NO: 331883 - DNA, 75 bp, Artificial Sequence
  Synthetic
cagctgctgctaataacgaagccttaactcatgaaatctgcattcaggagtggaaatcttttactggattcaaat

SEQ ID NO: 331884 - DNA, 75 bp, Artificial Sequence
  Synthetic
caattcagacaaaattttctccaggctcctatccgttgctatggagttatgcgatgggtgttggagcaatgttag

SEQ ID NO: 331885 - DNA, 75 bp, Artificial Sequence
  Synthetic
ttaaatgttttatgcctttgacactagatgaggatctaactatgtacatgaaagataaagctttggctgcaattc

SEQ ID NO: 331886 - DNA, 75 bp, Artificial Sequence
  Synthetic
acagagcagttaacaacctaaactatgctcgaaactatcttgaacaacctttctacaaccttggagttggaatgg

SEQ ID NO: 331887 - DNA, 75 bp, Artificial Sequence
  Synthetic
gatcagagtgggattctgtctatttaagggaaaacatgatgtattcgccacccaaacaaacaacttcaaggagac

SEQ ID NO: 331888 - DNA, 75 bp, Artificial Sequence
  Synthetic
ttgagaaaatggagggctcggtcaacagacacatggcagaggagcttgggctaaccaatgagcagataagtcaga

SEQ ID NO: 331889 - DNA, 75 bp, Artificial Sequence
  Synthetic
tggttgaagttttcctgaatgatacagagtttgatccagtcaacctcattaattatgttctaagcggagaatatc

SEQ ID NO: 331890 - DNA, 75 bp, Artificial Sequence
  Synthetic
taaaagaccttgttaaacaagaggcagaccactcgggggcttcgacgaaacatgcttctaggactggtgttggta

SEQ ID NO: 331891 - DNA, 75 bp, Artificial Sequence
  Synthetic
tggatgacaaagaattcaacctctcatatagccttaaggagaaagaaattaaaagagtagggagactttttgcaa

SEQ ID NO: 331892 - DNA, 75 bp, Artificial Sequence
  Synthetic
gtgcaaagttcaacccggcaagtgtggatgagctcataccaagtgacgaagacgaaaatgaagcagacctggacg

SEQ ID NO: 331893 - DNA, 75 bp, Artificial Sequence
  Synthetic
aaatgacgtacaaaatgcgtgcttgccaagttgtaggagagtcccttattgcaacaggagtcgggcaatatttta

SEQ ID NO: 331894 - DNA, 75 bp, Artificial Sequence
  Synthetic
atcagtcatatgccaaaccctataggcctaaaattgaacttgctgaaagaccgaatgtcatcatgaacgatgaga

SEQ ID NO: 331895 - DNA, 75 bp, Artificial Sequence
  Synthetic
aggaaaatggtatggttaagaacgaacatgagttacttaagacactccataaactttctgtatcctctgttgctc

SEQ ID NO: 331896 - DNA, 75 bp, Artificial Sequence
  Synthetic
acaaaagaaccatgtacacagatgttgactccaacgaaatgagagagcagatcgctggaatactaaagagaaaca

SEQ ID NO: 331897 - DNA, 75 bp, Artificial Sequence
  Synthetic
gtgataataaagttgggaacaaagccgaaatattcagagcacagagaaggaaaagtcagacatctagacctgaga

SEQ ID NO: 331898 - DNA, 75 bp, Artificial Sequence
  Synthetic
agaagaagaaaagacctactgctgttggggaagaccaagttttcaccaacacaccaacaagcactgttggtgatc

SEQ ID NO: 331899 - DNA, 75 bp, Artificial Sequence
  Synthetic
attcagaaattagtgatgtgcaatatgagactatgagcacatttctaacaactgacttacagaagttttgtctta

SEQ ID NO: 331900 - DNA, 75 bp, Artificial Sequence
  Synthetic
tttcagttattgattcttaaatatcagagacccacatcaagcaagatcaacatttacgcaaagtatcattaatat

SEQ ID NO: 331901 - DNA, 75 bp, Artificial Sequence
  Synthetic
attggagacaagaaacaaccaatatttttgctgagcgacttgacgagatatatggactacctggctttttttcct

SEQ ID NO: 331902 - DNA, 75 bp, Artificial Sequence
  Synthetic
ataaggggaaaagcccaacttattaagaaaaacttaggaacaaagttccgttcctagcacactattgctacggtt

SEQ ID NO: 331903 - DNA, 75 bp, Artificial Sequence
  Synthetic
ggttacacaagaggttagaaaagtcaacattgtatgtagcagatccaaattgtcctccatataacactgaaagga

SEQ ID NO: 331904 - DNA, 75 bp, Artificial Sequence
  Synthetic
tttcctcaactgactgcagtgattgcagtgagtggtgacaaatgtcagattataccccagaagctcttcaacaac

SEQ ID NO: 331905 - DNA, 75 bp, Artificial Sequence
  Synthetic
ttaagatagatgacaccgaaaacaagcagatatttatcaagaatccaatgggtgggattgagggatactgtcaga

SEQ ID NO: 331906 - DNA, 75 bp, Artificial Sequence
  Synthetic
tcgtcaagaatggaatcaaaactatcgaacttttacaacagagtccggaggactttcagaagacgtacggcagaa

SEQ ID NO: 331907 - DNA, 75 bp, Artificial Sequence
  Synthetic
aaatgtggaccatcattacaattccgttactatttctgagtgcttatgaatgtggtgccaagattgctgctgtag

SEQ ID NO: 331908 - DNA, 75 bp, Artificial Sequence
  Synthetic
gtgcaatccaggaaccaaccaccagagcaagggttcaagcctgggaatccctcaataccaatcatgataacacca

SEQ ID NO: 331909 - DNA, 75 bp, Artificial Sequence
  Synthetic
ttcagggtgataatcaagcaatagcaataaccaagagggttcaccctaacataccttatcgacaaaagaagttct

SEQ ID NO: 331910 - DNA, 75 bp, Artificial Sequence
  Synthetic
gtaatcaagatcagagaaatcagggagttaaagagggaacaaacacgagcgagagcaagggagctccttcagctg

SEQ ID NO: 331911 - DNA, 75 bp, Artificial Sequence
  Synthetic
tatgctctcaattggctcaacaatacttcaatagattaagaatgaacatggcaggaataggacataatttgaaag

SEQ ID NO: 331912 - DNA, 75 bp, Artificial Sequence
  Synthetic
atggaagatatggaaatcaatccaagagtgacagggatgactcagcgactgggatccaaagggcagatcaaccgc

SEQ ID NO: 331913 - DNA, 75 bp, Artificial Sequence
  Synthetic
caaatgaaaccatagtgagttcacatttctttatttattcaaaaagaatctactatgacggacaagtgttatcac

SEQ ID NO: 331914 - DNA, 75 bp, Artificial Sequence
  Synthetic
tatgggatgctccgtataatgatggggatagtagcagaaataggggagataccgcaggtggacttccaacgattg

SEQ ID NO: 331915 - DNA, 75 bp, Artificial Sequence
  Synthetic
aagcattaaagcctctatcaagatgtgtgttctggtcggagactgtggttgatgagacaagatctgcttgcagca

SEQ ID NO: 331916 - DNA, 75 bp, Artificial Sequence
  Synthetic
gagaaggaagcaatactttccagtcaggagatcaagaatttgagggatatcatcccgacggtccagttaatgctg

SEQ ID NO: 331917 - DNA, 75 bp, Artificial Sequence
  Synthetic
atatatgcacctcagtggcaaagagtatagagcaaggttatagcagatggcttggttacagtatttgtatactca

SEQ ID NO: 331918 - DNA, 75 bp, Artificial Sequence
  Synthetic
gagagtatagtcagataagtgcaatggatcatgagatgtctgctgctgagatgtatggatctactactcagctaa

SEQ ID NO: 331919 - DNA, 75 bp, Artificial Sequence
  Synthetic
aaacactacagcaattgatcatatctcttaaattcacaattaatgactccatgactaaggacatcactgagcctc

SEQ ID NO: 331920 - DNA, 75 bp, Artificial Sequence
  Synthetic
cgagcatgagaaatgcaacaacggacgactttgcaaaagtctttgaagagggaacgcccaaggtgcaccgtagat

SEQ ID NO: 331921 - DNA, 75 bp, Artificial Sequence
  Synthetic
ttcttaaaaatccaaattggatattggccgcaacattgcttccttcacaacttggtgggttcaattacataaaca

SEQ ID NO: 331922 - DNA, 75 bp, Artificial Sequence
  Synthetic
tgagagggatcactgcggtagtacctgcaccgaaacaaatcggggctgttggagggcctgttaaaaaaggcacag

SEQ ID NO: 331923 - DNA, 75 bp, Artificial Sequence
  Synthetic
ttagcagattatatgtaaggaatataggtgatccagtaacagcctctctagcagatcttaaacggatgataaaag

SEQ ID NO: 331924 - DNA, 75 bp, Artificial Sequence
  Synthetic
acgagaatactgcatcgacacttttgggggacgtacaattatccgggagtggtgcaatccacaatgtgcacccct

SEQ ID NO: 331925 - DNA, 75 bp, Artificial Sequence
  Synthetic
tcgggttgcttgatgaacgtgttcttcaaaaagttatgcatcagaaaccaggggattgcacttatcttgattggg

SEQ ID NO: 331926 - DNA, 75 bp, Artificial Sequence
  Synthetic
cactgctactccaacccaaaaagaatgctcatgcggagaatgcccaaggcagtgtgcaagatgtatcaacgaccg

SEQ ID NO: 331927 - DNA, 75 bp, Artificial Sequence
  Synthetic
caagtgatccctactcaatcaatatacctgcttcacaaagtgtgacaattgtacttaagaacattacagcaagaa

SEQ ID NO: 331928 - DNA, 75 bp, Artificial Sequence
  Synthetic
gggctattggccaaagtaacgaggctgcattcagtaatcaggaggttgaaggaaagcttaacctggtgctaaagg

SEQ ID NO: 331929 - DNA, 75 bp, Artificial Sequence
  Synthetic
tggtactacagaacagtaagaatcccatgctcagtggtctgttccatgatgattttgatcaggaggataaggatc

SEQ ID NO: 331930 - DNA, 75 bp, Artificial Sequence
  Synthetic
agctggactcaattagcaagaaacttgattatcttccagagattaaagaggagatcaagaatatcaacaagaaaa

SEQ ID NO: 331931 - DNA, 75 bp, Artificial Sequence
  Synthetic
tagctaggtttctcttggatcgagcaatcataataccaagggcagctcatgagattatggacaaatcgcttacag

SEQ ID NO: 331932 - DNA, 75 bp, Artificial Sequence
  Synthetic
ttaccaatctgagtttaggactgtctactgttgagagctacatcaaatcaatgatgattgtgatacctggatctg

SEQ ID NO: 331933 - DNA, 75 bp, Artificial Sequence
  Synthetic
gagcaaggcaggaaatagcaggaatgcttgactccactaaaggtcttattaggaatggtctaagagctggaggtt

SEQ ID NO: 331934 - DNA, 75 bp, Artificial Sequence
  Synthetic
ggaaaacagatggtcaggagcctcctgaggttaacccagatttgagagctgtgattggaagggacaaaacaagag

SEQ ID NO: 331935 - DNA, 75 bp, Artificial Sequence
  Synthetic
taaggccaaggcttgtagaaaagctttccatgtatgattatgagcagtttagagtgtttaacagtttgatgtccg

SEQ ID NO: 331936 - DNA, 75 bp, Artificial Sequence
  Synthetic
ggctcaaagaagtgaccatgcaaagaagtgatcttgaaagtctggagctcccaagccccccaagggatgaaatag

SEQ ID NO: 331937 - DNA, 75 bp, Artificial Sequence
  Synthetic
gtagagagtttagttatctgataacatcagacgcgtgtgctgttgaactggcacgaaggttgaggaatgtgatgt

SEQ ID NO: 331938 - DNA, 75 bp, Artificial Sequence
  Synthetic
accctaaatacctaacacgtgatctagactttgagaaatctaatgcagccaattttgtgccaactgatgacccaa

SEQ ID NO: 331939 - DNA, 75 bp, Artificial Sequence
  Synthetic
ggaaccatctcacacatggtagacccatctatgggttagaggttcctgattctatcgaagcgatgaatgggtttc

SEQ ID NO: 331940 - DNA, 75 bp, Artificial Sequence
  Synthetic
gttcattctacacaatagttgcaatgataaaggatgaggtgacagaaatgaggagacaacaggacctcataaagt

SEQ ID NO: 331941 - DNA, 75 bp, Artificial Sequence
  Synthetic
taattgagagctgctctgattgctattattgtcaagccaataatcaagagtattgctggttctttgtccctaatc

SEQ ID NO: 331942 - DNA, 75 bp, Artificial Sequence
  Synthetic
gggtgtcagagtctatggcaaaataccctctgagtcagatatacaagatagttagagagatgcttgatgcagatg

SEQ ID NO: 331943 - DNA, 75 bp, Artificial Sequence
  Synthetic
attgtgagctcgatcaagttaagaaagagtctaacaacattcgtgtaccttactttggctcaacaaccgaagaaa

SEQ ID NO: 331944 - DNA, 75 bp, Artificial Sequence
  Synthetic
aagaagagtcagacagtagtgacagtgaataacacataacattgacaaattacctgtatcactcatttactcata

SEQ ID NO: 331945 - DNA, 75 bp, Artificial Sequence
  Synthetic
gaagtgagattaaactatcaagtgttaggtccgcttctagagctcttaaggctgcaattaggattgcaaccgtct

SEQ ID NO: 331946 - DNA, 75 bp, Artificial Sequence
  Synthetic
taagagtattattcaatcaacactatatggaattgcatagctaatgattaagaaaaacttagggccaatgcacaa

SEQ ID NO: 331947 - DNA, 75 bp, Artificial Sequence
  Synthetic
atacatgggcttatggtgacactgatgaatgctgggaagaagcttggtatcttgcatcatttagagcgaatttga

SEQ ID NO: 331948 - DNA, 75 bp, Artificial Sequence
  Synthetic
tggccgggaatgcaggaactgctgcattcttaacatcctcatgggaagagggtggcacacttgcagctatagatc

SEQ ID NO: 331949 - DNA, 75 bp, Artificial Sequence
  Synthetic
cacttgcagaattaaaggctattacacctatatctacatctaacaatatagctcatagattaagagataaaagta

SEQ ID NO: 331950 - DNA, 75 bp, Artificial Sequence
  Synthetic
cagaagcagatgaaaaaggcaggctcataccaaaactcagggtcatcaaccctggcactaatagtaggaagagtg

SEQ ID NO: 331951 - DNA, 75 bp, Artificial Sequence
  Synthetic
cacaaatgaaatactctgggaattcactgagtcgtgtgagtagatatacaatgattagtaatgacaacttgaatt

SEQ ID NO: 331952 - DNA, 75 bp, Artificial Sequence
  Synthetic
caggttacatgtacctgcttatacatggtatcatagaggagagagaagttgccaatgtctcacctaaaaacaaca

SEQ ID NO: 331953 - DNA, 75 bp, Artificial Sequence
  Synthetic
tcaccaaggatggctcaaagattgacacaaacctgatttatcaacaggtgatgttacttggattggcatcactcg

SEQ ID NO: 331954 - DNA, 75 bp, Artificial Sequence
  Synthetic
agacatttgctgcattccccttgggagtcgggaaatccaatgctctccctcaagatctcttggatggagttgtca

SEQ ID NO: 331955 - DNA, 75 bp, Artificial Sequence
  Synthetic
aagatctattcaggtttaacagaacaacaggttctgagaacacagtttatcatttacatgtggaagaaaactgtt

SEQ ID NO: 331956 - DNA, 75 bp, Artificial Sequence
  Synthetic
accttgatgtgactgtcaggaggactgcaggttcgagcgaaatgcttgtgtttggcacaagcaatattagtgctg

SEQ ID NO: 331957 - DNA, 75 bp, Artificial Sequence
  Synthetic
gtgtgatagaaatggaggaccatccgtatgttatcacagaggaaccaccacctatcttaagaggtgtgtatagca

SEQ ID NO: 331958 - DNA, 75 bp, Artificial Sequence
  Synthetic
ttttaacaccgtggaaagatattctgacgacaggtgccattttcccagcaataaaggtctgcaataatgtggaca

SEQ ID NO: 331959 - DNA, 75 bp, Artificial Sequence
  Synthetic
ataggctcatctatgatgatcacccgcttgaagatagagaagtggagaatatatacaagcaaacatatgtttccg

SEQ ID NO: 331960 - DNA, 75 bp, Artificial Sequence
  Synthetic
tggtggctgtggacagacagcaaaagtttaggtgtatcttcctcacgatcaccatgctgactgatgcaggggtct

SEQ ID NO: 331961 - DNA, 75 bp, Artificial Sequence
  Synthetic
cagttcttgacttcccaaggtataatatgaaagagcttaatacggtgcttgcacaatctcttgctataacattga

SEQ ID NO: 331962 - DNA, 75 bp, Artificial Sequence
  Synthetic
acaaagtgcccaagactattcttgacttcagaatggccaatgctgtctcttttaatttgcttattgagctattga

SEQ ID NO: 331963 - DNA, 75 bp, Artificial Sequence
  Synthetic
ttgacattataaccaaagagaataaggatcatctgaccgagtttaaagttctagcaaatgatgatgacattaata

SEQ ID NO: 331964 - DNA, 75 bp, Artificial Sequence
  Synthetic
ttggtgcggatatgacagcttctgggatcaaaggaatgatcaacgactatggagaaagagttacgacttttatga

SEQ ID NO: 331965 - DNA, 75 bp, Artificial Sequence
  Synthetic
gtctgatcacagaatttctacttgttgacccctccgaatttgtactttatcttgggttagctgtttcaataaatt

SEQ ID NO: 331966 - DNA, 75 bp, Artificial Sequence
  Synthetic
tccatgttgggaatttttttcgaggaaggaacaaagagtactcagttgattactgccgacaaaaaattgacaaaa

SEQ ID NO: 331967 - DNA, 75 bp, Artificial Sequence
  Synthetic
gggcatttgatgtttattatagaagaccccaaggtaaatatcaaatgatagagtacttgtcctcttacctcagaa

SEQ ID NO: 331968 - DNA, 75 bp, Artificial Sequence
  Synthetic
tggacctgcggttctctcttggagctgtcggagggctcagtttgcatgtctgcataaaagggaagatgagcaatg

SEQ ID NO: 331969 - DNA, 75 bp, Artificial Sequence
  Synthetic
tatcttccagatccttcattaatgtttttgctaatgctttgtcccatcctaaagtttttagaaggttctgggatg

SEQ ID NO: 331970 - DNA, 75 bp, Artificial Sequence
  Synthetic
ctttaaaggctcagcttggttacaaaaccacaatttgctactctttgatggacacaaacccctatctcaacaagt

SEQ ID NO: 331971 - DNA, 75 bp, Artificial Sequence
  Synthetic
taggtttaatagaacctatttatgggccaaaccttaacacacagaacttcactcttatagctgtcgagttattaa

SEQ ID NO: 331972 - DNA, 75 bp, Artificial Sequence
  Synthetic
tgatgtggaaagccgaatgcaagataaacaaagtgacagcagtacttcaaccctcggtgcccaaggagttcaagg

SEQ ID NO: 331973 - DNA, 75 bp, Artificial Sequence
  Synthetic
ttaagggttttgaggtatacttagactactggcttgatgacaacactgcagaatatatgctgcctgaaagtgtgc

SEQ ID NO: 331974 - DNA, 75 bp, Artificial Sequence
  Synthetic
tgtatgaagatgtcttgatcgaccatactgggaaaatcatgaagtaaggaagccgaatccttggagaagtgacat

SEQ ID NO: 331975 - DNA, 75 bp, Artificial Sequence
  Synthetic
aggatatagtggaccagaggtatgagagcatacagtcaagacatctatgtatattatgctgcctatatttagatc

SEQ ID NO: 331976 - DNA, 75 bp, Artificial Sequence
  Synthetic
gtcttgttgcactcagtacaggtatgataattatcatagtaacatagtatactaataactaagtttgcacggtgc

SEQ ID NO: 331977 - DNA, 75 bp, Artificial Sequence
  Synthetic
gtgagtatatgcctaagattctgggtttaacatcaattgagaaatgtagtattctaacggatgtactacagaatc

SEQ ID NO: 331978 - DNA, 75 bp, Artificial Sequence
  Synthetic
ttgcttgttgagccacagtactggcgaactaatactttatcacatttttacatagacaataagtgatatactctt

SEQ ID NO: 331979 - DNA, 75 bp, Artificial Sequence
  Synthetic
acaagtacacaacaccccagttcttcacctggaatctcgaacctcttcctgttacagtttatcctgtctctctta

SEQ ID NO: 331980 - DNA, 75 bp, Artificial Sequence
  Synthetic
cttcactgagaaacaacatactactctataaaaaacttagggggaaagttgctttagagctgatcaaggtatact

SEQ ID NO: 331981 - DNA, 75 bp, Artificial Sequence
  Synthetic
catacatccggagaggctcagttaaacatattagattaaggagaatgatacaatttaatgatcctttagctgata

SEQ ID NO: 331982 - DNA, 75 bp, Artificial Sequence
  Synthetic
atattgctttgagatttaatcattgctctgcaaatatgaaacttagtgtagtatatactaccttgttagtttcga

SEQ ID NO: 331983 - DNA, 75 bp, Artificial Sequence
  Synthetic
aagtcactgttgatcccctgaacatgaaaagctttatagtaatgagaaataatattgctggtataactacatctt

SEQ ID NO: 331984 - DNA, 75 bp, Artificial Sequence
  Synthetic
ctttctatagtgatctggcaagatctcaattggcacttagtgagttaactaagataggtgttatccctggtagat

SEQ ID NO: 331985 - DNA, 75 bp, Artificial Sequence
  Synthetic
ttagagcatttcaggctgttctcctcataagtgatgattttaggaaacttcagggtttggatgaatatttaccca

SEQ ID NO: 331986 - DNA, 75 bp, Artificial Sequence
  Synthetic
cctatgatctcaagatttctacacaggcatcctatcaatacatggttgttaaattgatccctaatctaactggtc

SEQ ID NO: 331987 - DNA, 75 bp, Artificial Sequence
  Synthetic
cgagaaatagatgggaagcacatgttcataggagggtgggtttaaattcaacatcatgctataaagcttgtgaga

SEQ ID NO: 331988 - DNA, 75 bp, Artificial Sequence
  Synthetic
ttaacaactgcactaatgggaccatagaagcatataagaaaatgctcaatagattactgtcaccaattgatgcgg

SEQ ID NO: 331989 - DNA, 75 bp, Artificial Sequence
  Synthetic
tcggtatatatatcattaataaaattgatgttaatggccctagattattcttaggagagggatcaggatctatga

SEQ ID NO: 331990 - DNA, 75 bp, Artificial Sequence
  Synthetic
cacttaggaagatgaaagatgctgtgaatgacaagcctcctgaatctgttgggaatgtcaaattctggggtgcag

SEQ ID NO: 331991 - DNA, 75 bp, Artificial Sequence
  Synthetic
tgactacatattatatgatgttgggtcctgcaaaatgttactataacacaggagttcttaatgtcggccttgttg

SEQ ID NO: 331992 - DNA, 75 bp, Artificial Sequence
  Synthetic
ttattggaggtgtggccctgggtgttgctacatctgctcaaattacagcaggtgttgctctgcataactcaatac

SEQ ID NO: 331993 - DNA, 75 bp, Artificial Sequence
  Synthetic
gacagcgagttttccaggttttcccatcagaggtgatgttggtttctcataacaatcctcgtgatataggactag

SEQ ID NO: 331994 - DNA, 75 bp, Artificial Sequence
  Synthetic
agaatgcaaatgcaatcctagcactcaaggactcaataagacaatcaaataaagctatacaagaattacaaactg

SEQ ID NO: 331995 - DNA, 75 bp, Artificial Sequence
  Synthetic
agcatgatataaaggtgttattcaatgggaaacctgagtgcacgtgggttggagatatggagtgtttctcatact

SEQ ID NO: 331996 - DNA, 75 bp, Artificial Sequence
  Synthetic
ctatgtctacaactgttgtggttctgaatgctctccaagatcagatcaacaatcagcttgtcccagctataaatt

SEQ ID NO: 331997 - DNA, 75 bp, Artificial Sequence
  Synthetic
tgatgaattccattgagacacattccatctctctagttcataatgacatggagtcatctcttgagaaatcacctg

SEQ ID NO: 331998 - DNA, 75 bp, Artificial Sequence
  Synthetic
ccttaggatgtcaggtagtagccaatactctaggacttaaactaaatcaatattttagtgaaatatccttggtgt

SEQ ID NO: 331999 - DNA, 75 bp, Artificial Sequence
  Synthetic
agactatattgcaagaacaagtgcatagtctatgtattgctgtgaatttaaccaaaagtgatggaatatatatca

SEQ ID NO: 332000 - DNA, 75 bp, Artificial Sequence
  Synthetic
ttggcccgaacctcagagacccaacgtcagagaccctttcaattcaagcattgtccagagcttttaatggtgatt

SEQ ID NO: 332001 - DNA, 75 bp, Artificial Sequence
  Synthetic
ccaaaatagcaccaagagcaggtgatatgagtcatatattgcttagcctcttatatcattactttagggaagtta

SEQ ID NO: 332002 - DNA, 75 bp, Artificial Sequence
  Synthetic
ttgattcaatgctgtctaagctcaaatatgatgatagtgacttcttagatttattagaaagtgatagtataagag

SEQ ID NO: 332003 - DNA, 75 bp, Artificial Sequence
  Synthetic
cttgttttattcctgcttatagtaatagttgctcacctgaatgttatctaatatgtagtggaaagaagtatcaca

SEQ ID NO: 332004 - DNA, 75 bp, Artificial Sequence
  Synthetic
gtaggatcattgacgtctctctttctgattatcttattactatacaaatagaatatcccgctttactgtctatta

SEQ ID NO: 332005 - DNA, 75 bp, Artificial Sequence
  Synthetic
gccttatttatcctgaaattataatgccaggcattagtaaaagtaattactcaaaaaatatagtcatcagtcaaa

SEQ ID NO: 332006 - DNA, 75 bp, Artificial Sequence
  Synthetic
aagatgctgttattcaaacatttaatctaatcagttataatacaagaggcactgagtggatatctatattcccaa

SEQ ID NO: 332007 - DNA, 75 bp, Artificial Sequence
  Synthetic
acatccttgatatgaagttcaatataaggaaagggattataaatgatctgcatttatacggagattatctgggtt

SEQ ID NO: 332008 - DNA, 75 bp, Artificial Sequence
  Synthetic
agcaactcttagtaagaggaacatatatatcaaatattgatatctcacaatgtgtgatagctgcaacatcaatca

SEQ ID NO: 332009 - DNA, 75 bp, Artificial Sequence
  Synthetic
catcattgaatacattagatgagacagagaaactgctgatgtcttatggattccagattaatggaccaaagataa

SEQ ID NO: 332010 - DNA, 75 bp, Artificial Sequence
  Synthetic
tatgcaagtcagatacaagcacacctataagctctgcaacctggtcttgtgcaactggtaatattacaaattgtg

SEQ ID NO: 332011 - DNA, 75 bp, Artificial Sequence
  Synthetic
ttaggcaattaacaggtcatgatgttggatcagggtctagtaatctcaaagcttatatcaattccagttttaaca

SEQ ID NO: 332012 - DNA, 75 bp, Artificial Sequence
  Synthetic
ctagaactagggtagtgaatgctcatgtgccaagatttgctctctatgggggtgtagtgtttgctaattgtgctc

SEQ ID NO: 332013 - DNA, 75 bp, Artificial Sequence
  Synthetic
atattataaattattgtgattcagagcgcattacgagtcatttcttggaaccttatccactagcgagagattcta

SEQ ID NO: 332014 - DNA, 75 bp, Artificial Sequence
  Synthetic
ctgtagtgtgcaaatgtcaagacccattgtatagtattaaccaggaacctaaagttactaatgtaatggttgatg

SEQ ID NO: 332015 - DNA, 75 bp, Artificial Sequence
  Synthetic
aactgagagaactggtggatgcactgtgcaagaaaatttgcatatacaccttgctttatatgaaagatacaaata

SEQ ID NO: 332016 - DNA, 75 bp, Artificial Sequence
  Synthetic
tggatgcatgcaaggaaatgtatttggatgggttgtatataacacttggcaagactcaaatatcaagagccatgt

SEQ ID NO: 332017 - DNA, 75 bp, Artificial Sequence
  Synthetic
gagattcaaggaagcagctgattaacatgatacggggcaagtatcttagggtgactataaactccaacatggtta

SEQ ID NO: 332018 - DNA, 75 bp, Artificial Sequence
  Synthetic
atgcagaggatgtgtcattaggaggtccaataagtgtagacccaattgatctaggtaatgaaattaattctataa

SEQ ID NO: 332019 - DNA, 75 bp, Artificial Sequence
  Synthetic
ggagtatagtacaagactacctcatgaagaaaatgaccaaaactagtattaatatgcattggcattaccccttac

SEQ ID NO: 332020 - DNA, 75 bp, Artificial Sequence
  Synthetic
atagtgctattaatagatcagaggaacatttgaatcatgctaatgaattgcttgataaagtaaaccctaggattg

SEQ ID NO: 332021 - DNA, 75 bp, Artificial Sequence
  Synthetic
aaacagcagaagtgaaagtgtggtggaagatagtgggttactcagttttacacaaggaagtgtgatgttcacttg

SEQ ID NO: 332022 - DNA, 75 bp, Artificial Sequence
  Synthetic
taaatgttaagacatttggtgtcatgataggactgttggttttagttgtactttggtgtgtaatcacattagtat

SEQ ID NO: 332023 - DNA, 75 bp, Artificial Sequence
  Synthetic
gattcgagttcccaaatccaattcttaagagtatcagagtctttacacaaccaagctacaaagattaagaaaaac

SEQ ID NO: 332024 - DNA, 75 bp, Artificial Sequence
  Synthetic
ggttaatttgtttgactaaacagttggccaggacagcctatgctgggagtatgggtagtcgggcttcgacagtta

SEQ ID NO: 332025 - DNA, 75 bp, Artificial Sequence
  Synthetic
agagtatcagagtctttacacaaccaagctacaaagattaagaaaaacttagtatttatatctcctttgtcaggt

SEQ ID NO: 332026 - DNA, 75 bp, Artificial Sequence
  Synthetic
attccctctccggattcgtgggttagtataaagaagatggtactgttcatcaaagatatcatgttagtatttata

SEQ ID NO: 332027 - DNA, 75 bp, Artificial Sequence
  Synthetic
ttaaccctacacggtacgaccgctttggatgatcacaatatagctttcttaatggtgctaattagaaaaaactta

SEQ ID NO: 332028 - DNA, 75 bp, Artificial Sequence
  Synthetic
ggatgaatgtgtctcatcccacatctttactctgtttgatgttcaatagttcaggtgtagagcaatacccaggta

SEQ ID NO: 332029 - DNA, 75 bp, Artificial Sequence
  Synthetic
catatggagagggacgtttccatagctttatttacgatatactttgtttgtatattttggggtatctcttctatt

SEQ ID NO: 332030 - DNA, 75 bp, Artificial Sequence
  Synthetic
atctggttcatgtatttaacaatccgcctctacatgattagatctgagatatataaaaagatctccatattaaat

SEQ ID NO: 332031 - DNA, 75 bp, Artificial Sequence
  Synthetic
aatgagatagtctatttacaggaactatctagggagaatactgataatataatgggtggtccaccgccttataca

SEQ ID NO: 332032 - DNA, 75 bp, Artificial Sequence
  Synthetic
caagtttgatgcagatcaagaataggagagtatattaggtcataacataagaaaaaacttagggctaatgcctaa

SEQ ID NO: 332033 - DNA, 75 bp, Artificial Sequence
  Synthetic
tgaggttaagtttgtgacctcttttctcttactatattttgtactcagattgttactaataatctttctttagcg

SEQ ID NO: 332034 - DNA, 75 bp, Artificial Sequence
  Synthetic
aagcaaattgaggaaggttatattgaaatatgtcttctgattatgaggatcctgcatctattccatcctgttatg

SEQ ID NO: 332035 - DNA, 75 bp, Artificial Sequence
  Synthetic
gatcaatgagcagctcaagaacaacttataagtccagtcagctaagaagatcaccgccttcacctgccccgaaac

SEQ ID NO: 332036 - DNA, 75 bp, Artificial Sequence
  Synthetic
atgttaggctttcaaggtcaagtaatatgagaaatcggagttataatatttactttgcttttgtgattttcgtat

SEQ ID NO: 332037 - DNA, 75 bp, Artificial Sequence
  Synthetic
gtagtattaatatggcattattatgctatataactattgcaattgagtcgaaatgccaacaaattgagaaaccct

SEQ ID NO: 332038 - DNA, 75 bp, Artificial Sequence
  Synthetic
ccattcgccctctgccaaaggctgaagcaaacacttgccctgagactgaccagatagtgagtagtattaacacaa

SEQ ID NO: 332039 - DNA, 75 bp, Artificial Sequence
  Synthetic
tgatgaatgcacttacttatacactgccacaggttcttacagcaaacaagcactctttagtaacaaggatgaatc

SEQ ID NO: 332040 - DNA, 75 bp, Artificial Sequence
  Synthetic
atttagtgttggaaattaaagacctagtcaaaatgaacaatttggacctaaatgtgagacttgggatcaacagga

SEQ ID NO: 332041 - DNA, 75 bp, Artificial Sequence
  Synthetic
caattgctttgaggacagggaacaacgggaaacaagagactgcagtctcctctgctccgcaaagaccaactaaac

SEQ ID NO: 332042 - DNA, 75 bp, Artificial Sequence
  Synthetic
cccctgtggttccttctatcactctcattcctgctaaaccgacaaataaggtaatgttttatcctttgattaaga

SEQ ID NO: 332043 - DNA, 75 bp, Artificial Sequence
  Synthetic
atagcatggctaatcttgatgactcacattttgacagcatcaaaagattgaacttgcatcataatccagaaaagg

SEQ ID NO: 332044 - DNA, 75 bp, Artificial Sequence
  Synthetic
gtgatcttcaagatgatattgctaacctcaatccaacgttttaggatcatgacttagtaaagtatagtgctgtag

SEQ ID NO: 332045 - DNA, 75 bp, Artificial Sequence
  Synthetic
gacaggacagaatgcctgacaatcacaccacatatataatactaataccctgctatatcaacccattttcttacg

SEQ ID NO: 332046 - DNA, 75 bp, Artificial Sequence
  Synthetic
caaattccagtgatatttactatacataattaaagaaaacttaggatcaaaggtcctagtgaattgatccatgca

SEQ ID NO: 332047 - DNA, 75 bp, Artificial Sequence
  Synthetic
atcaaatgagtcaacttgctgcacacaaccttgccatgtcgaatttctacgggatccatcaaggaggtcagagta

SEQ ID NO: 332048 - DNA, 75 bp, Artificial Sequence
  Synthetic
catcacagaaagaagaagagcagccggtgcaaggggtgatcaggtatgcttctatgattgttggcttgttgagct

SEQ ID NO: 332049 - DNA, 75 bp, Artificial Sequence
  Synthetic
tatttaccattattgccctcaatgtgacaaatattatttatatgacagagtctggtggtactatgcaatcgatca

SEQ ID NO: 332050 - DNA, 75 bp, Artificial Sequence
  Synthetic
agaatgcccagggctccatcgatggctcaatgaaagatctctctggaactattatggaagacattaaaccaaaga

SEQ ID NO: 332051 - DNA, 75 bp, Artificial Sequence
  Synthetic
ctgatctgataaatagtatggtaagctataatatacctgcacaattatcgatgatacatcagatcataaagaatg

SEQ ID NO: 332052 - DNA, 75 bp, Artificial Sequence
  Synthetic
atgttctaaagcaatgtacaccatcatttatgtttaacaacacaatctgcccccttgctgagaatcctacacatt

SEQ ID NO: 332053 - DNA, 75 bp, Artificial Sequence
  Synthetic
caagatactttgaagaagtcaatctggacagcatatccgaatgctcaggaaatgaaatgagccttgaacttggta

SEQ ID NO: 332054 - DNA, 75 bp, Artificial Sequence
  Synthetic
cagagccagagtttatagaatatccatcttttgcaccaggttcaacaaaaccaggaagttgtgtcaggcttccat

SEQ ID NO: 332055 - DNA, 75 bp, Artificial Sequence
  Synthetic
cattctcactcagttctacagtttttgcttatacccatacaatcatgggccacgggtgttcagagttggatgttg

SEQ ID NO: 332056 - DNA, 75 bp, Artificial Sequence
  Synthetic
gagatcactatctcgcaattgggagaatagctgatgcaggtcatgagataccccaatttgaaaccataagtagct

SEQ ID NO: 332057 - DNA, 75 bp, Artificial Sequence
  Synthetic
ggtttatcaatgataaaataaatagaagatcatgtacagttgcagcaggtgtgatggagacatggatgggctgtg

SEQ ID NO: 332058 - DNA, 75 bp, Artificial Sequence
  Synthetic
tcatcatgacagagaccttttatgatgacttagactcattggatactggtaaaatcaccatatcttacctcgatg

SEQ ID NO: 332059 - DNA, 75 bp, Artificial Sequence
  Synthetic
tctttggaagaaagaaagaatggatctacactcggagtgaaatactttatgactatacatacacatccgtctatt

SEQ ID NO: 332060 - DNA, 75 bp, Artificial Sequence
  Synthetic
tttcaataggctcaggggttgtagtgggtgatacagtgtattttcttctgtggggcagtttgtcgtccccaatag

SEQ ID NO: 332061 - DNA, 75 bp, Artificial Sequence
  Synthetic
aggaaaccgcatactgttatgcaccaggttgtagtaattacaaccaaaggatgtgtaatgaagcccaaagaccag

SEQ ID NO: 332062 - DNA, 75 bp, Artificial Sequence
  Synthetic
ctaagtttggccacagacaaatggcaaatgccatacttaggttcaaaacaaattcaatggggaaaccctcaataa

SEQ ID NO: 332063 - DNA, 75 bp, Artificial Sequence
  Synthetic
gtgttaggactttatctcctacagtgattcctttcggtactgaaggaaggctcatatactcggattttacaaaga

SEQ ID NO: 332064 - DNA, 75 bp, Artificial Sequence
  Synthetic
ttatatacctttatttgcggtcaacatcatggtatgtcttgccattaacaggactcttgattttaggtcctccag

SEQ ID NO: 332065 - DNA, 75 bp, Artificial Sequence
  Synthetic
tcagcatatcctgggtgacacaagaagctgtatctagaccaggtgaatatccatgtggagcctccaatagatgcc

SEQ ID NO: 332066 - DNA, 75 bp, Artificial Sequence
  Synthetic
ctaaagactgtattactggtgtatacacagatcttttcccacttggtgctaggtatgagtatgctgttactgtgt

SEQ ID NO: 332067 - DNA, 75 bp, Artificial Sequence
  Synthetic
atcttaatgcagagacttatcgtgtgaaccctactctggcattgatcgataggagcaagataatagctagaaaga

SEQ ID NO: 332068 - DNA, 75 bp, Artificial Sequence
  Synthetic
aaatcacaactgaatcacagaaagcaggttacacgactaccacatgttttgtgtttaaacttaggatatggtgta

SEQ ID NO: 332069 - DNA, 75 bp, Artificial Sequence
  Synthetic
tgagtgtggttgagctagcccctgccactatgactgcttttgagcctgttccttttctataccaattggatctta

SEQ ID NO: 332070 - DNA, 75 bp, Artificial Sequence
  Synthetic
cttgcaaacggaataacgggacaacagctatgcagtttagtggacaggatgggatgtataaatcagggaggtata

SEQ ID NO: 332071 - DNA, 75 bp, Artificial Sequence
  Synthetic
agtccccgagaaatgagtgtttttttgaaaaagtcagcaacaaatactactttgtggtttctacacctgagggga

SEQ ID NO: 332072 - DNA, 75 bp, Artificial Sequence
  Synthetic
tccaaccttatgaagttcgtgatctcactcctgagagagtgtcacatgttataatgtacatatctgatgtttgtg

SEQ ID NO: 332073 - DNA, 75 bp, Artificial Sequence
  Synthetic
cgcctgcactgagtgcctttaagaagttaataccagctatgagacctattacaacacttaccataggaaattggc

SEQ ID NO: 332074 - DNA, 75 bp, Artificial Sequence
  Synthetic
aatttagaccagttgatataagtggggggttaagagttaatatttatcggaacctcacacggtatggagacctgt

SEQ ID NO: 332075 - DNA, 75 bp, Artificial Sequence
  Synthetic
caatgtctgctcctgaggatcctggtactgatacttttcctggtacacatgccccatctaaaggacatgaggagg

SEQ ID NO: 332076 - DNA, 75 bp, Artificial Sequence
  Synthetic
tcggtcattacactttacctaatgagaaattgagtgaagtgacgacagctgcagtgaagacaaaagaatctctca

SEQ ID NO: 332077 - DNA, 75 bp, Artificial Sequence
  Synthetic
acttgattccagatacaaaagacacaagaggcgaggaagaaaatgggagtgggttgaatgagatcataactggtc

SEQ ID NO: 332078 - DNA, 75 bp, Artificial Sequence
  Synthetic
atacaacaccaggacacatcaagactcatccggctgagacaaaagtcacaaagcacacagttatcatcccccaaa

SEQ ID NO: 332079 - DNA, 75 bp, Artificial Sequence
  Synthetic
ttgaagaggatggtagtggtgcaacaacatcaactgagctgcaagatgaaactggttaccacactgaggactaca

SEQ ID NO: 332080 - DNA, 75 bp, Artificial Sequence
  Synthetic
acaccactaatacaaatggaagtctcactgcacctaatgaaagaaacaattacacctctggagatcatacagtat

SEQ ID NO: 332081 - DNA, 75 bp, Artificial Sequence
  Synthetic
cgggtgaagacatcactcatacaataacagtgtcggacagaactaagactacccagaccctccccaccgataaca

SEQ ID NO: 332082 - DNA, 75 bp, Artificial Sequence
  Synthetic
cgttcaaccaaacacctactaagatacaggagggtagcccaaagagtgagagcaccccaaaggactatacagcaa

SEQ ID NO: 332083 - DNA, 75 bp, Artificial Sequence
  Synthetic
tcgaatccgaggatagtcatttcacagatccaacccttatcagatcgacacctgagggtaccattgtccaggtta

SEQ ID NO: 332084 - DNA, 75 bp, Artificial Sequence
  Synthetic
taggagaccaattccattcagcagttacacagttaggtgagagcaatgctattgggaatagtgaacctatagatc

SEQ ID NO: 332085 - DNA, 75 bp, Artificial Sequence
  Synthetic
aagggaataacttaatacccactaccgatagagggacgatggataacacatctagtcaatcccacagctcaacaa

SEQ ID NO: 332086 - DNA, 75 bp, Artificial Sequence
  Synthetic
cttcaactcagggttcacatagtgcaggccacggtagtcagtctaacatgaacttaactgcactagctgatacgg

SEQ ID NO: 332087 - DNA, 75 bp, Artificial Sequence
  Synthetic
actcagtcacagatcagagcacatctacacaggagattgaccatgaacatgaaaacgtgagcagcatattaaacc

SEQ ID NO: 332088 - DNA, 75 bp, Artificial Sequence
  Synthetic
ccctcagccgacacacaagagtgatgagagacacagtgcaggaagccctaactggggcttgggggttcatacgag

SEQ ID NO: 332089 - DNA, 75 bp, Artificial Sequence
  Synthetic
ggatgataccttgacgattgaagagacgacagtcactaaattgaccacacctgggcattatgacttatcagtcga

SEQ ID NO: 332090 - DNA, 75 bp, Artificial Sequence
  Synthetic
tattaagactaccatacatcctacctcagccacacagctaacactgatagattcaggtaccagagtagataataa

SEQ ID NO: 332091 - DNA, 75 bp, Artificial Sequence
  Synthetic
tcatgtgtatcaatcaacactcagttatgagataattacaacaccaagtactccagttcatttgtcatctgtgga

SEQ ID NO: 332092 - DNA, 75 bp, Artificial Sequence
  Synthetic
aaatgggttagatgagtcaactgattctaggcttacactatctcaagatgcattaacctcgaccagcagtattag

SEQ ID NO: 332093 - DNA, 75 bp, Artificial Sequence
  Synthetic
cccagtgccttctgcagatattataacaactaagcaaccactggcagtggataaacaggtcagattgattaggct

SEQ ID NO: 332094 - DNA, 75 bp, Artificial Sequence
  Synthetic
gataacaacagattacagtgcagaggtttcgattagccaattagaggatagactgaaatggtcatctcagtcacc

SEQ ID NO: 332095 - DNA, 75 bp, Artificial Sequence
  Synthetic
taagaatcagaagcagtcatatattgtttcatcaataccttcatgtcatggctatatttctgaaacggccagttc

SEQ ID NO: 332096 - DNA, 75 bp, Artificial Sequence
  Synthetic
gattaacaagaatttgaagcagaagccaaatatacctgatatagatgtcgactcactatcacaaccatatgctta

SEQ ID NO: 332097 - DNA, 75 bp, Artificial Sequence
  Synthetic
ctcttgtacaaattctagtgacacatatgtaataccctatctgtctggattaaatggcaaagaattatttccctt

SEQ ID NO: 332098 - DNA, 75 bp, Artificial Sequence
  Synthetic
agatcctgaacaggttgatagtagagcatcagattcggatatagggggtcttataatgtacctgcttcctgtatc

SEQ ID NO: 332099 - DNA, 75 bp, Artificial Sequence
  Synthetic
gaagatggatttacatatgagggtaaaagacataagacaacagggttataattatgcttgcttagcactcgatat

SEQ ID NO: 332100 - DNA, 75 bp, Artificial Sequence
  Synthetic
atgtggctataccgtgatagcaacacagtctgacgatacaacaatattctacttagtggttagacctgcacggag

SEQ ID NO: 332101 - DNA, 75 bp, Artificial Sequence
  Synthetic
taacactacctatgagggagttcacctagaactggtttgcaatcatgccttgctaattctcctcgatgaaaacaa

SEQ ID NO: 332102 - DNA, 75 bp, Artificial Sequence
  Synthetic
atggatatacggggttaagggctctgtgacagtatctgatgcaatatcgttagtacaggtcaatgattataatta

SEQ ID NO: 332103 - DNA, 75 bp, Artificial Sequence
  Synthetic
tagtgcagtgtatcctactgagagttactgcacagtaaggatcctgaaatccttttggggttattttgcaaacaa

SEQ ID NO: 332104 - DNA, 75 bp, Artificial Sequence
  Synthetic
atcaattcttgagaagttgagatagtgaaatgaaattgcattgtttggtgattttgagtctgtaatagatacggt

SEQ ID NO: 332105 - DNA, 75 bp, Artificial Sequence
  Synthetic
acttttaaaattgaagatatcttaattaagcaaagggtgcttatagtcaatcctacctattactggattggttat

SEQ ID NO: 332106 - DNA, 75 bp, Artificial Sequence
  Synthetic
tgatggtttacagataatcaagtctaggttacatagagcttcatgatatctatgttgaattaagaaaaacttagg

SEQ ID NO: 332107 - DNA, 75 bp, Artificial Sequence
  Synthetic
actaatgtcctgctaactacacatatgaggcttaaattaacataccattttgtagattcacaaattccacaatgt

SEQ ID NO: 332108 - DNA, 75 bp, Artificial Sequence
  Synthetic
caaatactgcaatcacggacatcctataccccgagtgtcatcttgatagtcctattgtcacagggaaattgtact

SEQ ID NO: 332109 - DNA, 75 bp, Artificial Sequence
  Synthetic
cactactggaaaagggtggatttccacatagggaggaactgaatgacaagacattagacagaaatctgaaagtta

SEQ ID NO: 332110 - DNA, 75 bp, Artificial Sequence
  Synthetic
accacaactatgtaaggcaccttcaaaccaccatagatcagattgcattgagaaaaaaactgttagaaaagtacc

SEQ ID NO: 332111 - DNA, 75 bp, Artificial Sequence
  Synthetic
ctaaccttgcgaagctaaaccctgtaccctacccatatggaaacaaatatttattccgtattactgatcaagagt

SEQ ID NO: 332112 - DNA, 75 bp, Artificial Sequence
  Synthetic
atgaataagaataagaaacaaaaaccaaacactaaaatgaggagtaatcctcagaaaaacaaaattaaattggtt

SEQ ID NO: 332113 - DNA, 75 bp, Artificial Sequence
  Synthetic
aataaaaaattgcaaactttctttatggccttcttccaaattctgctggcggtgttcaagaattttaaggtttca

SEQ ID NO: 332114 - DNA, 75 bp, Artificial Sequence
  Synthetic
ctccaactgaggttcctggaaaaagtttaccggactgtctttaagaacttggcaatcaggagccctaaaggagct

SEQ ID NO: 332115 - DNA, 75 bp, Artificial Sequence
  Synthetic
gtggctataatgaaatggggtgtcggttaccttaagaagagaaagcaaaagaggcaaaaatctagtggtggctat

SEQ ID NO: 332116 - DNA, 75 bp, Artificial Sequence
  Synthetic
gaaattgaggctgcaagacaggctctctatccaattactttaggagttatggtcattttttgtggctatcagagt

SEQ ID NO: 332117 - DNA, 75 bp, Artificial Sequence
  Synthetic
ggaaatgaacctgtgtgtgtcgatttcaacaatcagactaacatcgttccttatgagaatgggaaagttatcttt

SEQ ID NO: 332118 - DNA, 75 bp, Artificial Sequence
  Synthetic
gggaacgtcaccattgtccctccaattgatagatttggtcttttgattccaacagacaattatgacactatagag

SEQ ID NO: 332119 - DNA, 75 bp, Artificial Sequence
  Synthetic
tgcgttaggatgagtcctggcattgaattgagtgaagaagtttgtggattcatggggccaaagtatgatgtcctt

SEQ ID NO: 332120 - DNA, 75 bp, Artificial Sequence
  Synthetic
ttgagaacacaatggggaaaaagagagacagaacacatgcacagaactagaagaagtgttacagagacaacccat

SEQ ID NO: 332121 - DNA, 75 bp, Artificial Sequence
  Synthetic
gagagctctggtggagaacattgggattatagtgaatacctcacagattttgaacacaaaatgagcaagtacaaa

SEQ ID NO: 332122 - DNA, 75 bp, Artificial Sequence
  Synthetic
atgccagtacttataatattggtgggatatttggttttaaaaactcaaaatatggcattattaataatacttgtg

SEQ ID NO: 332123 - DNA, 75 bp, Artificial Sequence
  Synthetic
atagcccaattctacctcgctgatgctgggcactgccacgatcctgagaaatttgacatcatagaagctggtggc

SEQ ID NO: 332124 - DNA, 75 bp, Artificial Sequence
  Synthetic
tacacgaaaatgacaacattccttaaacatgacaaatgtttcatggttagggttccagaacatgatgtggttgaa

SEQ ID NO: 332125 - DNA, 75 bp, Artificial Sequence
  Synthetic
ataacagttgttaagaaaacaattaggccaactactgggtgtaaaacattcttactaggggctagtgtcaacact

SEQ ID NO: 332126 - DNA, 75 bp, Artificial Sequence
  Synthetic
gaaagtagggccaaatgtccaggagctggttctgcaacgataccaaaaaccccaggagataagactttttgccat

SEQ ID NO: 332127 - DNA, 75 bp, Artificial Sequence
  Synthetic
attgagcatgttgataggggttgggatagtggctgttttatatttggcaaaggagaagttgtcacttgtgcagca

SEQ ID NO: 332128 - DNA, 75 bp, Artificial Sequence
  Synthetic
gtaacttactcgaaacctttttatgcttggatggttgattcagaacaaattacttgggaagttgaggttaatttt

SEQ ID NO: 332129 - DNA, 75 bp, Artificial Sequence
  Synthetic
ggaggagattccaatcgtaaaaaaacagctgaaatctcgatggactcagaatatgaggaatttgaagaccccaag

SEQ ID NO: 332130 - DNA, 75 bp, Artificial Sequence
  Synthetic
aacactggaagtaagattaggctgtattgtaagactcctagacaggaatgggacaactactatatggtagctaga

SEQ ID NO: 332131 - DNA, 75 bp, Artificial Sequence
  Synthetic
ccaggtggttccctctacaaagttaggagagagttaattaatgacttgaacttgccttggacagattttaaatac

SEQ ID NO: 332132 - DNA, 75 bp, Artificial Sequence
  Synthetic
ccctatgttactacaacaatagtaagaaatggagaaagcattttgaggtttaaaagaccaacaatgacctacatt

SEQ ID NO: 332133 - DNA, 75 bp, Artificial Sequence
  Synthetic
ccagttactgttgcagcaggacttgaaagactctacatggatgtggtcctgcaagggcctgttctgaagtgttca

SEQ ID NO: 332134 - DNA, 75 bp, Artificial Sequence
  Synthetic
ggaaaccactgtacaaaagaacaatggtcaggaaattccgaaacagaattgcctacaattactgaagatgtggga

SEQ ID NO: 332135 - DNA, 75 bp, Artificial Sequence
  Synthetic
actttaaagtgtgaaattgactactcaggtctgaaagtcagagttaccaatgtagctctttgcacccatacatca

SEQ ID NO: 332136 - DNA, 75 bp, Artificial Sequence
  Synthetic
acaatagtctctggacctttagtaacaaatgacattgtcatgattgtcctgagaggaactggttcagatactact

SEQ ID NO: 332137 - DNA, 75 bp, Artificial Sequence
  Synthetic
gagtgcaaattgaaagttgaagggaaaagtgcaagttcaaataattggatcacaaattattgcgccccccattcc

SEQ ID NO: 332138 - DNA, 75 bp, Artificial Sequence
  Synthetic
agatcaatgtcagtcaaaccaaatgaacaaacaacagtgaaaatgacttgccccaatggaatcattgacctcaga

SEQ ID NO: 332139 - DNA, 75 bp, Artificial Sequence
  Synthetic
tttaatgggaaaacaacaactcaggtagaggttaagtattccaggacaatgaaattggttagttccatgatggct

SEQ ID NO: 332140 - DNA, 75 bp, Artificial Sequence
  Synthetic
tcttttaaggatgtgactgaaaatgtcatgatacatgagagtggatttgagacatttaagaaagtggctaaaatg

SEQ ID NO: 332141 - DNA, 75 bp, Artificial Sequence
  Synthetic
ctcaccactccagtagtgggcttcttcaagagcatccttggtttggcttcaaattggtacattctaatttttgct

SEQ ID NO: 332142 - DNA, 75 bp, Artificial Sequence
  Synthetic
ttgctgcttgtctacgtgggtgtcaataaacaggggcctgtagggaacatcatgttggcattgggattaatttgt

SEQ ID NO: 332143 - DNA, 75 bp, Artificial Sequence
  Synthetic
ttgcttacctattactttgaagtggtagcagctgacaagtatgttctaatggttgatactgatgacatgtccttg

SEQ ID NO: 332144 - DNA, 75 bp, Artificial Sequence
  Synthetic
agtgttggcaaagctcaccacattgaatgggattggaagattaccatgccattgattccatcattaccttaccaa

SEQ ID NO: 332145 - DNA, 75 bp, Artificial Sequence
  Synthetic
gtaactttaattggtcttgatccaaaatatggtattaccatttatagggttgattcccaggaagagtacacaaat

SEQ ID NO: 332146 - DNA, 75 bp, Artificial Sequence
  Synthetic
ttggccaaagttttaagtgaaaaatatgatctggttaggaaaataacaggttggtatggaaattcatggattaag

SEQ ID NO: 332147 - DNA, 75 bp, Artificial Sequence
  Synthetic
gtgccttgcagagtgatagctagtgatgcagcattgaatctcacagctgattgtgaaaaagcaatttctgaaaat

SEQ ID NO: 332148 - DNA, 75 bp, Artificial Sequence
  Synthetic
tccaaggttgctgtcctcacttcagaacatactccaattgtgtgtagggattgcatagagaaatttgttaaatta

SEQ ID NO: 332149 - DNA, 75 bp, Artificial Sequence
  Synthetic
tccttagataaggaggaacagggagcttttagaaaccacaaacattacaatttccaaaatttgactagagaggag

SEQ ID NO: 332150 - DNA, 75 bp, Artificial Sequence
  Synthetic
tgtgttattgatgggaattggacctatagttctgctatcgaagtttacagtaaatatgaattggagaatgaagat

SEQ ID NO: 332151 - DNA, 75 bp, Artificial Sequence
  Synthetic
gaaattaccactactcaaggtggtgggtacggaaccataactattggagaaaaaacttggaaatatgttgaagtc

SEQ ID NO: 332152 - DNA, 75 bp, Artificial Sequence
  Synthetic
aaatttggtccaataagtgtaaaaaatactatactctttcaaggggtattggactcagttgtacctaccaagagg

SEQ ID NO: 332153 - DNA, 75 bp, Artificial Sequence
  Synthetic
aaatgggtgaacatgactaattgggcttgcaattttttcaagaaagagaatcaagttaataggggacacatattg

SEQ ID NO: 332154 - DNA, 75 bp, Artificial Sequence
  Synthetic
gctaaatcccttggaggtcctgctgctggctacaattgtatgattcaacttgtcaaggaaaataatgaagatgaa

SEQ ID NO: 332155 - DNA, 75 bp, Artificial Sequence
  Synthetic
gacattgaaaaatcagcattggattccgccctcaaacaatccacatcttatcgtagagaaattaagcctaagaat

SEQ ID NO: 332156 - DNA, 75 bp, Artificial Sequence
  Synthetic
ataaaggctatctattacacacaaaaagttgatgagagaaatataatgtgtggatggaatggaaaggattcagtg

SEQ ID NO: 332157 - DNA, 75 bp, Artificial Sequence
  Synthetic
aatgtagtaaaagcatcaaaaatgaacaaggacaacatccaagatttgattacaaagaacttgaacgtgctaatg

SEQ ID NO: 332158 - DNA, 75 bp, Artificial Sequence
  Synthetic
gtaattgacaacaatgatgaaagttcaattagagcactaattggagacaaaatgttgttctgcgaggcaaactgg

SEQ ID NO: 332159 - DNA, 75 bp, Artificial Sequence
  Synthetic
gttgattgtaacactcatgattatgaattaagcttttggacatcagcattgatcacaacaaaaagccgaagttat

SEQ ID NO: 332160 - DNA, 75 bp, Artificial Sequence
  Synthetic
gaacataaaccttgcaaaattcaacctaaagatgagatctttgaagatgccgattcctttttcagcgatgagaaa

SEQ ID NO: 332161 - DNA, 75 bp, Artificial Sequence
  Synthetic
gttgttttaacaactgcaggaatatccagagataatgttaatttttactggttgtttaccttctttttgggttgg

SEQ ID NO: 332162 - DNA, 75 bp, Artificial Sequence
  Synthetic
attctttttgaatgggctgtcatagtagatttaggttcaatctttttgtataacattaagaaaagatggacagtt

SEQ ID NO: 332163 - DNA, 75 bp, Artificial Sequence
  Synthetic
cttctaataattccaactgttttccagttaatggtgaatggaataataacgtcaattgtctcaataacagtgttc

SEQ ID NO: 332164 - DNA, 75 bp, Artificial Sequence
  Synthetic
ttttgcgggagcatgaagaatacgttggtaactgcaacagacatagtagaagggatcaatcttggacactggaaa

SEQ ID NO: 332165 - DNA, 75 bp, Artificial Sequence
  Synthetic
aggactgccatggtgacactaatggtgagtgggtttttcaagaatgaatttctgtctctgctaatgattctcaac

SEQ ID NO: 332166 - DNA, 75 bp, Artificial Sequence
  Synthetic
tttacattaaattggactcactttgttccaattttgatgtgcctcccccacttcctgggcttacctaacccttgg

SEQ ID NO: 332167 - DNA, 75 bp, Artificial Sequence
  Synthetic
atatggctaggagttttggttttagctctaattggcttaacaaatgggaaactcgagctggatttccaaaacaaa

SEQ ID NO: 332168 - DNA, 75 bp, Artificial Sequence
  Synthetic
ttggtacccttacctcagaagaaatttgaaactcaattgcaattaggcaaagtttactggacagcctctggaatt

SEQ ID NO: 332169 - DNA, 75 bp, Artificial Sequence
  Synthetic
gaagtggagattagagaagaaattagaatggcaaaatatgattaccctttgctagctctttacctgactttagtt

SEQ ID NO: 332170 - DNA, 75 bp, Artificial Sequence
  Synthetic
ttttcagcttctttaattcactggtcttttggaattacaacgttgatgctgggtggttctctatttaacctaaga

SEQ ID NO: 332171 - DNA, 75 bp, Artificial Sequence
  Synthetic
gacaaatcgaaagggctaattccgatgccagaattggaagaagttcatgatccacctgaaaaattgaaagatggt

SEQ ID NO: 332172 - DNA, 75 bp, Artificial Sequence
  Synthetic
ttctattccattagtgtggctggactctgctggaaatatcaaattggaattggctatgttcacaatggcactctc

SEQ ID NO: 332173 - DNA, 75 bp, Artificial Sequence
  Synthetic
accacccaataccacgtcacttgtggccgagatctttggtggaagggtaaaagttactctccagttgaagagaat

SEQ ID NO: 332174 - DNA, 75 bp, Artificial Sequence
  Synthetic
gttgtctctgactatgcttgttactttggtccgtggtctttcccgaaattgcaagagggctcagaatttaccata

SEQ ID NO: 332175 - DNA, 75 bp, Artificial Sequence
  Synthetic
atgatgagatggaagaacattgctttgaagaccatggggaaaattacaggtaattattacgcaattccaacagag

SEQ ID NO: 332176 - DNA, 75 bp, Artificial Sequence
  Synthetic
aagatcccaaaaggacagtcaggaacccccatattccaagagattaatggaacccttaaaccagtggcattagct

SEQ ID NO: 332177 - DNA, 75 bp, Artificial Sequence
  Synthetic
ggcaactccatcgtatttggaggtgaaagtgtccaggtgggtgagaacccttcctttgctcctcacttggacggt

SEQ ID NO: 332178 - DNA, 75 bp, Artificial Sequence
  Synthetic
aaaattaaacagttgctcaacacaaggggatgctgggaagaatttgttctaaagtgtggagctggaaaaacaaga

SEQ ID NO: 332179 - DNA, 75 bp, Artificial Sequence
  Synthetic
ggtgtaatcaaggatacaatccagcatgctactaggatgggagtgaaggtgcttgtcttagttccaaccagagtt

SEQ ID NO: 332180 - DNA, 75 bp, Artificial Sequence
  Synthetic
gttgctaatgaagcttacaatgtgctcaaggatgtagggactgtgggtatacaaacgtcaacatataggaatgat

SEQ ID NO: 332181 - DNA, 75 bp, Artificial Sequence
  Synthetic
gttggattaatgcatacaatcatgtgtcactcaacatttgcaagaagaattatgagaaagggaaagaggattctg

SEQ ID NO: 332182 - DNA, 75 bp, Artificial Sequence
  Synthetic
agaaattggcaactcattattgttgatgaatcccacttctgcaatcctgagaccctagctctccacaatcttttc

SEQ ID NO: 332183 - DNA, 75 bp, Artificial Sequence
  Synthetic
atgcgtgatctccgttcaccaacacccacttactcagtaatgtacttgacagccacaggttacacatcctatgat

SEQ ID NO: 332184 - DNA, 75 bp, Artificial Sequence
  Synthetic
tcaaactccaatttctttgtacacgaccatcctgtcgcatcgaaaaatgattttttggaaatcataaagcaaaac

SEQ ID NO: 332185 - DNA, 75 bp, Artificial Sequence
  Synthetic
aaagaaaagaaaattgtatattttgtagctagtggacctgaagcaaatgaaattgctgggaaattaagggcagag

SEQ ID NO: 332186 - DNA, 75 bp, Artificial Sequence
  Synthetic
attcaaaacataataatagttactagacagactttcaacaacacctatgaggctgcgaagaccatggaacagggt

SEQ ID NO: 332187 - DNA, 75 bp, Artificial Sequence
  Synthetic
ttgattttgactaccaatatcagtgaaatgggtgcaaactacaacgctgacattgttatggacccattagaggag

SEQ ID NO: 332188 - DNA, 75 bp, Artificial Sequence
  Synthetic
ataataccagtcttaggtgaagagggagttcaattggaaaaaacagtttgcacaagggcttctaaaattcaaaga

SEQ ID NO: 332189 - DNA, 75 bp, Artificial Sequence
  Synthetic
aggggcagagttggaaggtcaaaaccaggagactattattatttagctgtgaatgaaggacaaataaaccaacaa

SEQ ID NO: 332190 - DNA, 75 bp, Artificial Sequence
  Synthetic
atgcaccaccaacaagacatagtctgggctgaggctgaaatgtgctccaacttgatgggtgagatctgggaacca

SEQ ID NO: 332191 - DNA, 75 bp, Artificial Sequence
  Synthetic
gaaaactttcaaggatctgaacccccggctcccattaactattacttgacacctcaaaaattggcgaccattgtc

SEQ ID NO: 332192 - DNA, 75 bp, Artificial Sequence
  Synthetic
aacaagactgaaatggaaaatggatggacatactacacctcataccaccttactgatgattatggcaattccata

SEQ ID NO: 332193 - DNA, 75 bp, Artificial Sequence
  Synthetic
ccatacaatgttactgacccccaactccactacactcctaaccactgcccgaagtgtactggtctccacttccca

SEQ ID NO: 332194 - DNA, 75 bp, Artificial Sequence
  Synthetic
gtttgggatgaaagaaaccatgatatgttggtcagttgtggtagggacttggacaacaacgatgttaacacaagg

SEQ ID NO: 332195 - DNA, 75 bp, Artificial Sequence
  Synthetic
acaaggcaaaatgttggggtaatacaacctttagtacaaagagtctttagtggcattaggatgcaatcatcagga

SEQ ID NO: 332196 - DNA, 75 bp, Artificial Sequence
  Synthetic
gagggttgtgaattgttctcaattttatttggggttcaatgttatggatggatgacttactttgacatgccagcg

SEQ ID NO: 332197 - DNA, 75 bp, Artificial Sequence
  Synthetic
tcttggatagctttggctcaccaagctttgccgccacaatggagggagactatcaccccaatgaagttactcttt

SEQ ID NO: 332198 - DNA, 75 bp, Artificial Sequence
  Synthetic
atcctttttggcttcatgttaaaggttgtttatgacaaaataatggtaaataaacacttggtttacaactatgct

SEQ ID NO: 332199 - DNA, 75 bp, Artificial Sequence
  Synthetic
ccatacaaaggacattcacaaatgctaatgtttttgactgtagcatctaccatgttacaaaacgaggctctcaaa

SEQ ID NO: 332200 - DNA, 75 bp, Artificial Sequence
  Synthetic
attatgtcctatcccatctggcaaattctttttgtggtcttcattacagtcatagttgtggaaacagtttgtggt

SEQ ID NO: 332201 - DNA, 75 bp, Artificial Sequence
  Synthetic
ataacacagagggagaagtcaactggtgaagtcactcaactagtaaccataggtgcagtgatcttcattatctat

SEQ ID NO: 332202 - DNA, 75 bp, Artificial Sequence
  Synthetic
tacatactggctgatggtgaaatactgaccttaatcaagaaactaataaaagtcaaaatacaacaaattgagaat

SEQ ID NO: 332203 - DNA, 75 bp, Artificial Sequence
  Synthetic
aactatgaagtcccgcaacaaccaattgaggatacccggattagaacttggagtctgtttgacagaccgccagtt

SEQ ID NO: 332204 - DNA, 75 bp, Artificial Sequence
  Synthetic
tacctttatttcacccttcatccagttatcatccaactggctaggtcaacttcagttaaggcattaattcaattt

SEQ ID NO: 332205 - DNA, 75 bp, Artificial Sequence
  Synthetic
gttgataatgtgaaattaaggaaaacccctgtaaatatgccccaacccacagtttatttcatagtagctgtgttt

SEQ ID NO: 332206 - DNA, 75 bp, Artificial Sequence
  Synthetic
ataagtatattcaatttttattattatagttttcctcatttagtagcttcaattataccttctattctactttat

SEQ ID NO: 332207 - DNA, 75 bp, Artificial Sequence
  Synthetic
tgtgttatttactgtgcacattatactgatatttttaagaggtttgtagatactaatcatgagttaggcaatagt

SEQ ID NO: 332208 - DNA, 75 bp, Artificial Sequence
  Synthetic
aataatcaacatataccttattctgatcctgcttatagtgaaatttatagagttttagttatagttatagagata

SEQ ID NO: 332209 - DNA, 75 bp, Artificial Sequence
  Synthetic
acatatttgttagtttataaaactttaactttggattcggtgttggtagttttacatatgacttcaccatggatt

SEQ ID NO: 332210 - DNA, 75 bp, Artificial Sequence
  Synthetic
aggggacctataggagagggattaaacaattatggcgtagtcatattagctatgagcatgaagcatttgatgata

SEQ ID NO: 332211 - DNA, 75 bp, Artificial Sequence
  Synthetic
atacagctccaaacatgaattggttggttaggaatggaaacaggggtaatcttttagtttaaactagttagcttt

SEQ ID NO: 332212 - DNA, 75 bp, Artificial Sequence
  Synthetic
ccccaatctatagtggcaattacagcagtagttttagaccatttgaagacaacacaaagatttaggagttcaatc

SEQ ID NO: 332213 - DNA, 75 bp, Artificial Sequence
  Synthetic
gttaggtagggaattttaagagaaaggcaaggtacggattagccgtaggggcttgagaaccccccctccccactc

SEQ ID NO: 332214 - DNA, 75 bp, Artificial Sequence
  Synthetic
tttaccactcaaattctaaataggatggtggaacattatcaggaccttgaatggagagggaggcagtataaattc

SEQ ID NO: 332215 - DNA, 75 bp, Artificial Sequence
  Synthetic
attttatttcctctatgaggaaggttaggtttgggcaaggtgcaggttagctgcaggggcttgaaaaaccccccc

SEQ ID NO: 332216 - DNA, 75 bp, Artificial Sequence
  Synthetic
actcttaataagttaaacaaacatgacttcctccaattcaaaggagaaaatgtgtatgaattggagaataaagat

SEQ ID NO: 332217 - DNA, 75 bp, Artificial Sequence
  Synthetic
ccccattcaagacttttagtgcattagttttagggtaaagggcaaggtagagtgtttcgctctaagggcgtagga

SEQ ID NO: 332218 - DNA, 75 bp, Artificial Sequence
  Synthetic
cattcaagacttttagtgcattagttttagggtaaagggcaaggtagagtgtttcgctctaagggcgtaggaacc

SEQ ID NO: 332219 - DNA, 75 bp, Artificial Sequence
  Synthetic
gattttccttcaagaggttttgccaagatggactggatgatcaaatctacccttttccaaccccgaggttttgta

SEQ ID NO: 332220 - DNA, 75 bp, Artificial Sequence
  Synthetic
gtcgatggaggttgtggagctgggggcttttcagccaggatgtgttttgagaaaccagttgccaagatcctgggc

SEQ ID NO: 332221 - DNA, 75 bp, Artificial Sequence
  Synthetic
tataccattggaaaagataaacatcatacacctgatttgaacggtaaaaaggtctacaaaaaatttaattgggaa

SEQ ID NO: 332222 - DNA, 75 bp, Artificial Sequence
  Synthetic
attggagacttatttaaaaagagaattagatgtgacacatttgtcatggacattggagaatctcatcccaatcaa

SEQ ID NO: 332223 - DNA, 75 bp, Artificial Sequence
  Synthetic
gagattgaagccataggagatctaaaaaggttgaattggtttaaagaaaatgtggattgtaagaattggtgcatt

SEQ ID NO: 332224 - DNA, 75 bp, Artificial Sequence
  Synthetic
aaaataatggtaccaactcatgaacaggtgctacatgctctcccaaaaggttccacattaattcgaaacccttgg

SEQ ID NO: 332225 - DNA, 75 bp, Artificial Sequence
  Synthetic
agcagaaattctaccttggaaatgtattgtgttccagggtcgaatgaaccagggagaatggttagtaatgtgatt

SEQ ID NO: 332226 - DNA, 75 bp, Artificial Sequence
  Synthetic
aaagttctaaatcaaagaattaacagaacaagctggcagggaagtatcatgaaaaaactgtactatccagaagat

SEQ ID NO: 332227 - DNA, 75 bp, Artificial Sequence
  Synthetic
gaagaacaagttggttcaactaaggttaactacatcattgagaaggaaaagttgcaaaattttacgttgcaagaa

SEQ ID NO: 332228 - DNA, 75 bp, Artificial Sequence
  Synthetic
gaacgtagagtttttaatcactggaaatgtctcggtagtgttgaagcctcaaggaagggaagttctggtcaaaac

SEQ ID NO: 332229 - DNA, 75 bp, Artificial Sequence
  Synthetic
tacaactcaataatcacagcaataactagtggattgaggaaagtagtaccctctattgaacattggatgttaaca

SEQ ID NO: 332230 - DNA, 75 bp, Artificial Sequence
  Synthetic
tcaacaaaacctgaagacactttttccaccttcctaaggaaagttgatcaaccaccccaacctttgggtaactac

SEQ ID NO: 332231 - DNA, 75 bp, Artificial Sequence
  Synthetic
aaaagtgaatttcaagagaagttcaaatgggttcaacaatggtacaaatcaaaaaacaagcatggtaggatacta

SEQ ID NO: 332232 - DNA, 75 bp, Artificial Sequence
  Synthetic
actaatgaggaagttatttcaaaatttaagagtgatggtgctctcggctttaggtgccaacattatggatccata

SEQ ID NO: 332233 - DNA, 75 bp, Artificial Sequence
  Synthetic
caagaagcacttgaaaatccaaatttctttaaagaccttgaagctgaagaaataaatcaccttcatggaaaatgt

SEQ ID NO: 332234 - DNA, 75 bp, Artificial Sequence
  Synthetic
actagaggagtgtttgatgtgatagggaagaaagaaaagaaagatttgtatggtaagcctaagggctcaagactc

SEQ ID NO: 332235 - DNA, 75 bp, Artificial Sequence
  Synthetic
atcatgtatctggacctggttgaaagattcttggaacacaaatacctgggttttttgaattcagatcattggtgt

SEQ ID NO: 332236 - DNA, 75 bp, Artificial Sequence
  Synthetic
cacccagaaaatttgccctcaggagtgtctgctgttagtccttatgagtaccctaggatgattgtggagaaatgc

SEQ ID NO: 332237 - DNA, 75 bp, Artificial Sequence
  Synthetic
aaaattgatccacgttcggacttgatggaaaactgggtgatccaggacgacacagctggttgggatactagatta

SEQ ID NO: 332238 - DNA, 75 bp, Artificial Sequence
  Synthetic
catgatgatgttttggagtgtgaacaatcttttctttgcgattttgcagaaagtgaagaacatatcaaacatatc

SEQ ID NO: 332239 - DNA, 75 bp, Artificial Sequence
  Synthetic
ttaagaatctataaaaattacaggaaccccatgatcaaattaacagatgattctggaacaagagacctgatcttg

SEQ ID NO: 332240 - DNA, 75 bp, Artificial Sequence
  Synthetic
attgggaaaggccagagatgctcaggaacagtggtaacatattcaatgaacacaataacaaacacagtggttcaa

SEQ ID NO: 332241 - DNA, 75 bp, Artificial Sequence
  Synthetic
atgatgaggatgcaggaagttcttgaactcagtaatgaagaatgtcttcacaaaatgatggttagtggtgatgat

SEQ ID NO: 332242 - DNA, 75 bp, Artificial Sequence
  Synthetic
tgcctgctagtccttaaaccggaagaagctattaaagtctcaaaaagccttaaattcatcaattcaacaggattc

SEQ ID NO: 332243 - DNA, 75 bp, Artificial Sequence
  Synthetic
ataaggaaggacgttccaagacacgtgccatcaccagtagtgaaagattggaaaaatataagtttttgttcccat

SEQ ID NO: 332244 - DNA, 75 bp, Artificial Sequence
  Synthetic
ggaatagctaaaggaaggatgcaaaatggtgaatatctttggaccctgggcaaaaatgaggctgagataattgga

SEQ ID NO: 332245 - DNA, 75 bp, Artificial Sequence
  Synthetic
aaagctcagctccagattggagcttttggagatgagataaatgaacaatcccaggctaaagcaatggctctatac

SEQ ID NO: 332246 - DNA, 75 bp, Artificial Sequence
  Synthetic
ttattgctgacttttcccatgaggagagatatcagattgatagccaaagcaattatggcatgttgccaggaaggc

SEQ ID NO: 332247 - DNA, 75 bp, Artificial Sequence
  Synthetic
ctcgttccgatggggaaggttaaagagcctttgatttggggcgaaccatggctggacagcatggacatagtcaac

SEQ ID NO: 332248 - DNA, 75 bp, Artificial Sequence
  Synthetic
atcatcaataagatctatgggactaatttttatactctagaagaagtaccatatgttcgccactccttggacatg

SEQ ID NO: 332249 - DNA, 75 bp, Artificial Sequence
  Synthetic
gagcgtggttccacaattcacaccaatgagagatcaaattggaaaaagtttctccttgagaaaatggttccagat

SEQ ID NO: 332250 - DNA, 75 bp, Artificial Sequence
  Synthetic
ctaagtaggagaaataatacagctccaaacatgaattggttggttaggaatggaaacaggggtaatcttttagtt

SEQ ID NO: 332251 - DNA, 75 bp, Artificial Sequence
  Synthetic
agtaggagaaataatacagctccaaacatgaattggttggttaggaatggaaacaggggtaatcttttagtttaa

SEQ ID NO: 332252 - DNA, 75 bp, Artificial Sequence
  Synthetic
agtttgggttactcgcctactgtttaggttggcaaaaacctgcaggcgttcttaccatagttgggttttaacgct

SEQ ID NO: 332253 - DNA, 75 bp, Artificial Sequence
  Synthetic
gcacttttcaaaagtgttagggagtacaatatccaaaaatagactctgaagagagaaaaatgaataagaataaga

SEQ ID NO: 332254 - DNA, 75 bp, Artificial Sequence
  Synthetic
cgcaccgtggatcctaggcagttacagactctgcgcttagaggctcaaataccactactttaggaccttattttc

SEQ ID NO: 332255 - DNA, 75 bp, Artificial Sequence
  Synthetic
gactcaattgaccttttgatctgctcctctacttcaggcttcaatgttgtcagcacaggtgagccaccattcctg

SEQ ID NO: 332256 - DNA, 75 bp, Artificial Sequence
  Synthetic
accaatgggtctgagatactccaaagaggtcagggaccgtcacggcgacaaagacccagaagggaggatcccaat

SEQ ID NO: 332257 - DNA, 75 bp, Artificial Sequence
  Synthetic
ataggaaccggcggctttcttggtgagacatcaaactcaatgacagtgttgtcccaagctcgacccttgatctgt

SEQ ID NO: 332258 - DNA, 75 bp, Artificial Sequence
  Synthetic
cactcaaaccatgcctcagacactgtacggcaggtacaactgtaaatcatgttggttcgccaataaggggttgat

SEQ ID NO: 332259 - DNA, 75 bp, Artificial Sequence
  Synthetic
gatcgtgacgctatatatggccacccctctccagacaaacaaagcttgtacagaaggttttcatatggatttctc

SEQ ID NO: 332260 - DNA, 75 bp, Artificial Sequence
  Synthetic
caaatgtagcaaccattacatatgtctcaggtgcctaacctcaatgttaaacaggactgactactgcgagatctg

SEQ ID NO: 332261 - DNA, 75 bp, Artificial Sequence
  Synthetic
tgacctggcgtgatatcaacaaacatcctttcctttgattttatctccaatagtgttttgatgattgttgtgaag

SEQ ID NO: 332262 - DNA, 75 bp, Artificial Sequence
  Synthetic
tggtgaagtgctgccaaagaggctcacctttgagacgaccccaacagctccaccctatactccctgaacacacat

SEQ ID NO: 332263 - DNA, 75 bp, Artificial Sequence
  Synthetic
gttgattcttcaacttttattgtctcaagcatgttcccgccatcaaccaaacatgcgcctgccttcacagcagca

SEQ ID NO: 332264 - DNA, 75 bp, Artificial Sequence
  Synthetic
ggggcccagggcacacccccaatgggggtgtgccctcggggcccccccgggcccctcgggcccggggagtctact

SEQ ID NO: 332265 - DNA, 75 bp, Artificial Sequence
  Synthetic
gagagactcaggttaaagccagaaatgtttatttgtgactcttcttgggtgatcactttgagacaggagtgctta

SEQ ID NO: 332266 - DNA, 75 bp, Artificial Sequence
  Synthetic
cgatgtcggtgagtgttttctgtgcagatagggtcttgcagggcctacctttcagcctgtaatccccaccgtcat

SEQ ID NO: 332267 - DNA, 75 bp, Artificial Sequence
  Synthetic
ctggacagggctctccaagtcacccagattaggaaactttgctgtgtaaagtagcccacagatctgttaggcctt

SEQ ID NO: 332268 - DNA, 75 bp, Artificial Sequence
  Synthetic
cggctatcataatgcagttgagagtcttgctgaaacacaaagcaaaacagccaaactctatccaatctgagactg

SEQ ID NO: 332269 - DNA, 75 bp, Artificial Sequence
  Synthetic
agattaggaaactttgctgtgtaaagtagcccacagatctgttaggccttgcaacaacatcattcaaagtctctc

SEQ ID NO: 332270 - DNA, 75 bp, Artificial Sequence
  Synthetic
cactaaggacttgcatgaaagcagcctcatatagttcaaccaataggcacaagtcctgttgtgtcattcgaacaa

SEQ ID NO: 332271 - DNA, 75 bp, Artificial Sequence
  Synthetic
ctccctgttctgccatgcaggagatggtcactgcaggggttgatccaaattggttgatgagagagtgctcgggtt

SEQ ID NO: 332272 - DNA, 75 bp, Artificial Sequence
  Synthetic
aacaggggtctttcttccctggccttttcctcatgtactcatgtagggatgaaagaaatctaggtctattaccag

SEQ ID NO: 332273 - DNA, 75 bp, Artificial Sequence
  Synthetic
ctttgatgtcccaaattttaacaacacctccccttctattcagtccaggcctttggatgccaactagctgaagaa

SEQ ID NO: 332274 - DNA, 75 bp, Artificial Sequence
  Synthetic
acctccccttctattcagtccaggcctttggatgccaactagctgaagaatctctgatcttctagtaagttgtgt

SEQ ID NO: 332275 - DNA, 75 bp, Artificial Sequence
  Synthetic
ggtccagagcttctaaggcaaggaagagtgatcttgatgtcactggtacctcaagtcttgaaacaacagtattcc

SEQ ID NO: 332276 - DNA, 75 bp, Artificial Sequence
  Synthetic
tctctgatcttctagtaagttgtgttgtggtgagattgccttgatacacaccactgctcccacttattctctctg

SEQ ID NO: 332277 - DNA, 75 bp, Artificial Sequence
  Synthetic
tttccattatctggcccttgtccagatgtaagggttccaggccttgctctggaccctgtaacttgtaagagaatt

SEQ ID NO: 332278 - DNA, 75 bp, Artificial Sequence
  Synthetic
atctctgaaccttctcctttaatttattgagatcactggagagttccattagttcatcttttgacagagacccaa

SEQ ID NO: 332279 - DNA, 75 bp, Artificial Sequence
  Synthetic
tattctttaggtctttaacatggtccttgaaatcaagtttcacctttgagaatacaagcgaaatttgcttgaact

SEQ ID NO: 332280 - DNA, 75 bp, Artificial Sequence
  Synthetic
cctttaagaacatatttttctgtgatgacctcattgtcattaaagaatccacttccttgttcaagtccctaaggt

SEQ ID NO: 332281 - DNA, 75 bp, Artificial Sequence
  Synthetic
caatgtcttgatcacttaaaagtttattgaggtccagtgcctccttccctgagaacagagggtgcagtgggacca

SEQ ID NO: 332282 - DNA, 75 bp, Artificial Sequence
  Synthetic
ttgtcaggtcattgtcgtccctcttctctcttctcatcatgcgttgcacacttgcaacctttgagaagtcaagac

SEQ ID NO: 332283 - DNA, 75 bp, Artificial Sequence
  Synthetic
aaccaactccgtccagacttatatggtccccctcagagccactcacatagcaatcaatctcctcaacatgaagtt

SEQ ID NO: 332284 - DNA, 75 bp, Artificial Sequence
  Synthetic
cagacaaaagggctctggtatcattgagcacatctgctttaactggggttgtccatgcagacagcccccttctaa

SEQ ID NO: 332285 - DNA, 75 bp, Artificial Sequence
  Synthetic
caaagccatcagacaaggttgtgctaaatgatgatatttcactcttttgaattgtgattccacatttcacataat

SEQ ID NO: 332286 - DNA, 75 bp, Artificial Sequence
  Synthetic
gggattgaacccaccggaatgatggcactgactgatcactcatggtcaattgaagtagttgagaagatcccgtgg

SEQ ID NO: 332287 - DNA, 75 bp, Artificial Sequence
  Synthetic
agttcgtcttcctttcatacctaaatttaaagcttttccttgtgtgtgaaagaattattccaatctcaaggggta

SEQ ID NO: 332288 - DNA, 75 bp, Artificial Sequence
  Synthetic
gtaccactatggattgccctctaagtagtagacacaagtcactctatgcgtatatcacctaatagcctaggatcc

SEQ ID NO: 332289 - DNA, 75 bp, Artificial Sequence
  Synthetic
atggattgccctctaagtagtagacacaagtcactctatgcgtatatcacctaatagcctaggatccactgtgcg

SEQ ID NO: 332290 - DNA, 75 bp, Artificial Sequence
  Synthetic
tgtgatcagcattcgaatgaatcaaaacttcatcaaagctttgataactttctctattttcccaatcaaccaagt

SEQ ID NO: 332291 - DNA, 75 bp, Artificial Sequence
  Synthetic
tgataaaagttgataaatttatgaaaacttgtgataattcaattttactatgaacgtatcctacatcgagatcat

SEQ ID NO: 332292 - DNA, 75 bp, Artificial Sequence
  Synthetic
caagacacatacaccttgatatgttcaacaatttgcaatccatgatgaattgggttagttgccctaaatcatgat

SEQ ID NO: 332293 - DNA, 75 bp, Artificial Sequence
  Synthetic
cagcatcatttgggagaaattcgacttcaccataccagaaatactttttgaactggcttgtactcagcagcactg

SEQ ID NO: 332294 - DNA, 75 bp, Artificial Sequence
  Synthetic
agctgtgaaaaccatggacttaggaagatgtttaatgatggctgatataatgccagggcgagcaaactcaatatc

SEQ ID NO: 332295 - DNA, 75 bp, Artificial Sequence
  Synthetic
ggttcaacatggattcaaataacaattgtgtcagaaaattctgacatatctccacagagttcaactgaagaccct

SEQ ID NO: 332296 - DNA, 75 bp, Artificial Sequence
  Synthetic
tttccaacgagcaagactctcgtatatgacatacagacaactcctcttgttttacaatatacaattcttctcttc

SEQ ID NO: 332297 - DNA, 75 bp, Artificial Sequence
  Synthetic
tcttcctcataatatgagagataatacccaaacattcactagacatatccatggcaacacacaggtctaaaaatt

SEQ ID NO: 332298 - DNA, 75 bp, Artificial Sequence
  Synthetic
ttattctctgaacccaacttacctttaatgagttcaggtcagataaaaatggagcaatatgctcatcgaagagat

SEQ ID NO: 332299 - DNA, 75 bp, Artificial Sequence
  Synthetic
caggaaagttcctcttgattgagtataggacatggttcatattgactttgtcttctaactcagagtggcttccag

SEQ ID NO: 332300 - DNA, 75 bp, Artificial Sequence
  Synthetic
gcttcacaggccaaaaaaagttcggattcattgaccccaaagggggtctaggaagctcaacctttgagaagaccc

SEQ ID NO: 332301 - DNA, 75 bp, Artificial Sequence
  Synthetic
aatttcccaactcacatgcattagaaaatgttagtgagaaatagtcccaaaggagtggccttgaatacggcgcca

SEQ ID NO: 332302 - DNA, 75 bp, Artificial Sequence
  Synthetic
cctgtcttaaactatgttcacagaagacacttaataatgggcagcacacttcacagtttgtatgcctatcaatct

SEQ ID NO: 332303 - DNA, 75 bp, Artificial Sequence
  Synthetic
agactcaggttaaagccagaaatgtttatttgtgactcttcttgggtgatcactttgagacaggagtgtttattg

SEQ ID NO: 332304 - DNA, 75 bp, Artificial Sequence
  Synthetic
tcttcaataaatctttaatatatataaatcctccagatccatccctcacgcattttgaacccatgcttttgcaca

SEQ ID NO: 332305 - DNA, 75 bp, Artificial Sequence
  Synthetic
gacagggcctccaagtcacctagattaggaaactttgctgtgtaaagtagccccagatctgttagtccttgaaca

SEQ ID NO: 332306 - DNA, 75 bp, Artificial Sequence
  Synthetic
gcccaatgaacccagaacagatgctactttggaaggcagacttgtttattgcatctgttattatctttttagccc

SEQ ID NO: 332307 - DNA, 75 bp, Artificial Sequence
  Synthetic
acatcattcaaagtctctcctccctgttctgccatgcaggagatggtcactgcaggggttgatccaaattggttg

SEQ ID NO: 332308 - DNA, 75 bp, Artificial Sequence
  Synthetic
gttctgccatgcaggagatggtcactgcaggggttgatccaaattggttgatgaggagtgccggttctttgatgt

SEQ ID NO: 332309 - DNA, 75 bp, Artificial Sequence
  Synthetic
ctctgacaaagttttttgaaagttttgattggactgacttaatcaatgaaggcacctcttctttatctaaaattc

SEQ ID NO: 332310 - DNA, 75 bp, Artificial Sequence
  Synthetic
tagttcctgtcatgatttttgttcttaacaccagtcttaaatcaccaaaagcccttaaattcaaccacctcgttg

SEQ ID NO: 332311 - DNA, 75 bp, Artificial Sequence
  Synthetic
ttctagtaagatgtgttgtggtgaaattgccttgatacacaccactgcccccaattatcctctctgatctttgaa

SEQ ID NO: 332312 - DNA, 75 bp, Artificial Sequence
  Synthetic
taagtgcctcttcaatcagagagtcattcgttcctgttatctttagcatctgtctcaagcaatcatctggtgatg

SEQ ID NO: 332313 - DNA, 75 bp, Artificial Sequence
  Synthetic
ctttttcctttaatttattgagatcactggagagttccatcagttcatcttttgacagtgacccaacctttaaga

SEQ ID NO: 332314 - DNA, 75 bp, Artificial Sequence
  Synthetic
attggagtgcacttattaagtattcttcctgtattcggcctgatcttatcatgtaaaacagttgtctgcaggaat

SEQ ID NO: 332315 - DNA, 75 bp, Artificial Sequence
  Synthetic
acatatttttctgtgatgacctcattgtcatcaaagaatccacttcctttaaattatccctaaggtttgttaggt

SEQ ID NO: 332316 - DNA, 75 bp, Artificial Sequence
  Synthetic
ccctaattgtggagagtatctcttcactgttgatgatggattctatcgacctctgcaatcggtaaccccttgaac

SEQ ID NO: 332317 - DNA, 75 bp, Artificial Sequence
  Synthetic
cattgtcgtccctcctctctcttctcatcatgcgttgcacacttgcaacctttgagaaatcaagaccagacaaaa

SEQ ID NO: 332318 - DNA, 75 bp, Artificial Sequence
  Synthetic
catcaacccaatctttcaaatctgtcgtaaacacacacaaaaatgggtcaactgggtgcccactataagagatca

SEQ ID NO: 332319 - DNA, 75 bp, Artificial Sequence
  Synthetic
gggctctagtatcattgagcacatctgctttgactggtgttgtccagacagacagcccccttttaagggattgaa

SEQ ID NO: 332320 - DNA, 75 bp, Artificial Sequence
  Synthetic
atctgtttgtcctctttgataattcattaatgatctctattgatacaccattggctgcacactgatccaagattg

SEQ ID NO: 332321 - DNA, 75 bp, Artificial Sequence
  Synthetic
cccaccgaaatgatggcactgactgatcactcatggtcaattgtgttgttgagtgatcccgtgggtaccactatg

SEQ ID NO: 332322 - DNA, 75 bp, Artificial Sequence
  Synthetic
tgtcaatagtttcagcaagctggtgaggtgatttagctttcacattgtgcaatgctgcggcaacaaattttgtca

SEQ ID NO: 332323 - DNA, 75 bp, Artificial Sequence
  Synthetic
ctgactgatcactcatggtcaattgtgttgttgagtgatcccgtgggtaccactatggattgccctctaagtagt

SEQ ID NO: 332324 - DNA, 75 bp, Artificial Sequence
  Synthetic
gtaagggaacttcttgagaccaaataaaaaatctggacttaaactcacttgcaaacgaaccagcaactgttttgg

SEQ ID NO: 332325 - DNA, 75 bp, Artificial Sequence
  Synthetic
tacctcttagggtctgcatagaagctcttgcctaccttataaacatcagggccacctccctcctttgacacctta

SEQ ID NO: 332326 - DNA, 75 bp, Artificial Sequence
  Synthetic
ggctgataaatttattaagctttgaagataaataataatgaaattcaagaatttctttacacttttccatatcta

SEQ ID NO: 332327 - DNA, 75 bp, Artificial Sequence
  Synthetic
atagatcatcatcggactccctttttagagagtaggagttgcttaacatgatctcatcatcacttgatgtgtatg

SEQ ID NO: 332328 - DNA, 75 bp, Artificial Sequence
  Synthetic
cagtcatcttcacatcaaagcagagctctaaacacagggtgataaattgctcagtcaacaacccataataatctg

SEQ ID NO: 332329 - DNA, 75 bp, Artificial Sequence
  Synthetic
aagcattgtgtaggattccttgccccatatctaagactgatgtaatgtgagaaggaaccacaccttttgcaaatt

SEQ ID NO: 332330 - DNA, 75 bp, Artificial Sequence
  Synthetic
gtctgaagaaataatcttcagtcattgaacttgatgacctatccatcaggcctagacttctttttgtataacctt

SEQ ID NO: 332331 - DNA, 75 bp, Artificial Sequence
  Synthetic
tacaaggtccttcagttcattaaagtaggtcaagcactcagacatgatcaaggaatgcctaggatccccggtgcg

SEQ ID NO: 332332 - DNA, 75 bp, Artificial Sequence
  Synthetic
tcaggtaagcctccacaacattataaggaacctcaacaatcttgtgtaaatgccaattaagtaaattttcaattg

SEQ ID NO: 332333 - DNA, 75 bp, Artificial Sequence
  Synthetic
ggctcttatcaataaggcctccatcttttagctggagatccaggttagaaaagagtgcattaaatattgctggtg

SEQ ID NO: 332334 - DNA, 75 bp, Artificial Sequence
  Synthetic
acatgtacggcccccattttgaatggtcaaggctcactgccagaccagaaagacggaccacggatttcatgtcta

SEQ ID NO: 332335 - DNA, 75 bp, Artificial Sequence
  Synthetic
ggagtgctctctcaaactctgagtcattattcagacatgagaatctgcattctgatgttaaggactcaaagtaat

SEQ ID NO: 332336 - DNA, 75 bp, Artificial Sequence
  Synthetic
cctctattagcctactagtgagctttgtgtttaaatcaccaatataaagctccctattgctacctacctgttctt

SEQ ID NO: 332337 - DNA, 75 bp, Artificial Sequence
  Synthetic
tatacgacaagccgaatttaagtttccctacgctggatgaaactgaggatctataagttggggactcttcggaat

SEQ ID NO: 332338 - DNA, 75 bp, Artificial Sequence
  Synthetic
aaaaacacaaatttctaagggaggagttggtaaaaaaactcttgtctaaccttttggaaatagcttctgaattac

SEQ ID NO: 332339 - DNA, 75 bp, Artificial Sequence
  Synthetic
tttctctcgaacttattcttgattcttctttaacaagtgtggctgtgtccttaaaaccgagtctagctctgcttc

SEQ ID NO: 332340 - DNA, 75 bp, Artificial Sequence
  Synthetic
tatgatcaaacctaccaactctgttatcacaacctgctcctattagcaaatatttgaagcactcaaagtaatctc

SEQ ID NO: 332341 - DNA, 75 bp, Artificial Sequence
  Synthetic
cttcctcatagtgttttgttgctaagttcttgatcaacagttccaatgggcagagttttaaaaacttttcagtga

SEQ ID NO: 332342 - DNA, 75 bp, Artificial Sequence
  Synthetic
agaactcatttctataaacactatcataaacagcatcacacatctcctgataactttcactaggaagcaatgaag

SEQ ID NO: 332343 - DNA, 75 bp, Artificial Sequence
  Synthetic
ggtcaaagtccttcacttcatggaaagaggtttcactaagtatgagagacatatattccctggaccataactttt

SEQ ID NO: 332344 - DNA, 75 bp, Artificial Sequence
  Synthetic
gaagcagatcaactttctcaaatttcttgagacccttagaactttggttggatttattgcaccctgagctcattt

SEQ ID NO: 332345 - DNA, 75 bp, Artificial Sequence
  Synthetic
tgcttaaacaatcagaaacattagcctcaatttcatttatcagcttatgtgttccctcgtcaactaaatcttcga

SEQ ID NO: 332346 - DNA, 75 bp, Artificial Sequence
  Synthetic
tgtcttcaagtatcccactatcatttggatcatcttttgatctaaattcatttttcgacaccatgttggttagac

SEQ ID NO: 332347 - DNA, 75 bp, Artificial Sequence
  Synthetic
gtttgtaaatggcatattgtaaacttctcctatccaacttaaacctcagcttgtccttaaaagactgggccatct

SEQ ID NO: 332348 - DNA, 75 bp, Artificial Sequence
  Synthetic
caacaacaactgacgatagaaggctttgatagtcatactgtgttattgtctccccaacctcattcaatttcggga

SEQ ID NO: 332349 - DNA, 75 bp, Artificial Sequence
  Synthetic
caacaacgctcttattgctagatatgtctaaagctgtacttgtgaaagaaggtgattgtgggtcacggcttaaca

SEQ ID NO: 332350 - DNA, 75 bp, Artificial Sequence
  Synthetic
ctttcggcagagaaagcataccattattaaaacaagaagaacagagtgacaacacttcctttgagacccctggtt

SEQ ID NO: 332351 - DNA, 75 bp, Artificial Sequence
  Synthetic
ccttcagatcaagaacaccaaggtccttagaaaacaatttctttagatcgcctattattttttcctcagttccct

SEQ ID NO: 332352 - DNA, 75 bp, Artificial Sequence
  Synthetic
ctgttaactgaggggatgagtctaggtttaggatgactgaattgaaggttaacttaggctccagaaacttttcaa

SEQ ID NO: 332353 - DNA, 75 bp, Artificial Sequence
  Synthetic
aacacttgatttgatctgtaagccggtctggcgtttcctttgtaataaggtgacataaataagacagatttagaa

SEQ ID NO: 332354 - DNA, 75 bp, Artificial Sequence
  Synthetic
taaatttaaatgactttgtcatatgttcctctgaagtcccagttagcagcaaggcgactaaatcatccatctgtg

SEQ ID NO: 332355 - DNA, 75 bp, Artificial Sequence
  Synthetic
tgaagacactcagctcagccctggttaatggcttcacttttaacttgcaaactaattctttaacatgaaattcat

SEQ ID NO: 332356 - DNA, 75 bp, Artificial Sequence
  Synthetic
tgacataagccatgataaaatatcgaaaaccttgcaaataaatctgaactcttttgctgggaactgtcaatatac

SEQ ID NO: 332357 - DNA, 75 bp, Artificial Sequence
  Synthetic
ttatgaccagggtatatagtttagtcctcacatccatcatttctttttctgaaagccagtcaagccaagacaaca

SEQ ID NO: 332358 - DNA, 75 bp, Artificial Sequence
  Synthetic
tttctcggcacatcttgaggatgacctcagaactcataattggtaaaaaatacctcttagggtctgcatagaagc

SEQ ID NO: 332359 - DNA, 75 bp, Artificial Sequence
  Synthetic
ctcagaactcataattggtaaaaaatacctcttagggtctgcatagaagctcttgcctaccttataaacatcagg

SEQ ID NO: 332360 - DNA, 75 bp, Artificial Sequence
  Synthetic
tacctcttagggtctgcatagaagctcttgcctaccttataaacatcagggccacctccctcctttgacatcaga

SEQ ID NO: 332361 - DNA, 75 bp, Artificial Sequence
  Synthetic
ccataacacctcgtcctttcgccggtcttttgatatataagagtggttccataattgatgtccaagtcctgaaaa

SEQ ID NO: 332362 - DNA, 75 bp, Artificial Sequence
  Synthetic
taacattcatcacattgaactgtgccaaagtaatttctctcatcatttaccaccaacttggttgctgaacttgtc

SEQ ID NO: 332363 - DNA, 75 bp, Artificial Sequence
  Synthetic
ttcattgagttcataagacccatactcaaagttgataatgcatctaaataatcactgaaggtggagtcatctgtt

SEQ ID NO: 332364 - DNA, 75 bp, Artificial Sequence
  Synthetic
atcacatctttgttacaatcctcaccctgacaatcccctacaccactcttcttgtacttgattgtgggtttcaca

SEQ ID NO: 332365 - DNA, 75 bp, Artificial Sequence
  Synthetic
cattcaccggaattatccctttccaacttgaattcataccaatgggacacctcaataggcctcagccatgatata

SEQ ID NO: 332366 - DNA, 75 bp, Artificial Sequence
  Synthetic
acgtgatcaagatcatatattttaagtttatgccctatcttggttctcagtttacacagccagtttgggtctgat

SEQ ID NO: 332367 - DNA, 75 bp, Artificial Sequence
  Synthetic
gtcagttttttatcaagtttattaattatcaagtcaacagaaacaagcctgtcattgacacttttgaaatggttg

SEQ ID NO: 332368 - DNA, 75 bp, Artificial Sequence
  Synthetic
ttgatgaggtattggaggtctgtatactggagtttaattaaatttatcaaactgttgaggacaattatatcaagg

SEQ ID NO: 332369 - DNA, 75 bp, Artificial Sequence
  Synthetic
caaaggagtgtgttccgtcttgtgttaagaaccttcaatccctttattttgttgcaatctgacaaaagactcttg

SEQ ID NO: 332370 - DNA, 75 bp, Artificial Sequence
  Synthetic
tgtgccaaaatctcattggcatctctgcacctggagcccttccacccctttctaagtagcacaagatctttcaga

SEQ ID NO: 332371 - DNA, 75 bp, Artificial Sequence
  Synthetic
acggcatacatatgaatttgacaaaatttacaagtttcagcttctattaaagtctccctttcactgcttgacatt

SEQ ID NO: 332372 - DNA, 75 bp, Artificial Sequence
  Synthetic
tgcaccaattcatgggtctttaaccatgtgatcatctcagatcttgatgttgtggtgtatacatcttcatattgt

SEQ ID NO: 332373 - DNA, 75 bp, Artificial Sequence
  Synthetic
ccgctgtctcgtaaaagacagaagtgatcataaagctttgcaatacctactctgcattctgaagtggtcatgttc

SEQ ID NO: 332374 - DNA, 75 bp, Artificial Sequence
  Synthetic
gaatagatcccctcttttagtgtttttgttaatcttgtcttgtaatccagcccttcctcccttaaacttgcaagt

SEQ ID NO: 332375 - DNA, 75 bp, Artificial Sequence
  Synthetic
gattcaagacctaagttctgattctccatgtttgacaagctgtgtactaaccgttcatactccatctcttctatt

SEQ ID NO: 332376 - DNA, 75 bp, Artificial Sequence
  Synthetic
ttctcaccactgtctctcaaattgctcattatcctcaataacaaccacctcatcctttcgataacccagtcaggt

SEQ ID NO: 332377 - DNA, 75 bp, Artificial Sequence
  Synthetic
aagcgttcaatgtagtagcttgatctgccatcaatcacaggtacaagggtcaagccacacttggctagatctttg

SEQ ID NO: 332378 - DNA, 75 bp, Artificial Sequence
  Synthetic
gacaattgcatcagtttttcaaaatcatgtctatacttgcattcaaaggactcttgatttactctaacgaatgtc

SEQ ID NO: 332379 - DNA, 75 bp, Artificial Sequence
  Synthetic
tcaagtaagatcagtgtcgaacctgacactctgtagccatcgggaacaacgtcaggaagtgttggacccactatt

SEQ ID NO: 332380 - DNA, 75 bp, Artificial Sequence
  Synthetic
ctatggtcataaagtatctggttaacagtcttgcttctgttgtggatgcagccatgtttcacacaagagtcaacc

SEQ ID NO: 332381 - DNA, 75 bp, Artificial Sequence
  Synthetic
tctatcagagttgagaggagcttcaacccttcggtcacaatggaggaaaaattgacctgtgagagtaaaaccgtc

SEQ ID NO: 332382 - DNA, 75 bp, Artificial Sequence
  Synthetic
ttttgctccacataggtgtcctcatctggtacccacttccttacaaggtccttcagttcattaaagtaggtcaag

SEQ ID NO: 332383 - DNA, 75 bp, Artificial Sequence
  Synthetic
ctggtacccacttccttacaaggtccttcagttcattaaagtaggtcaagcactcagacatgatcaaggaatgcc

SEQ ID NO: 332384 - DNA, 75 bp, Artificial Sequence
  Synthetic
tacaaggtccttcagttcattaaagtaggtcaagcactcagacatgatcaaggaatgcctaggatccactgtgcg

SEQ ID NO: 332385 - DNA, 75 bp, Artificial Sequence
  Synthetic
cgcacggaggatcctaggcgtttgctgagtttgcgcaaatattgattcagctttaattcctagaaacttgacatt

SEQ ID NO: 332386 - DNA, 75 bp, Artificial Sequence
  Synthetic
caagacccaatcatggggcaattgatctcattctttaatgagataccaactattctacaagaagctctcaacatt

SEQ ID NO: 332387 - DNA, 75 bp, Artificial Sequence
  Synthetic
gcattgatagcagtcagcatcattgcaaccatcaagggcattgtgaatgtttgtaaaagtggcctcatccagcta

SEQ ID NO: 332388 - DNA, 75 bp, Artificial Sequence
  Synthetic
ctcatttttatcatgttggctgggagatcatgctcagttcaaatagggcatcaccttgaacttgagcacatcatt

SEQ ID NO: 332389 - DNA, 75 bp, Artificial Sequence
  Synthetic
ctgaacagttcttcaatcctgccattcacccctactctctgcaaggtaaacaagagctattttttagtgagaggg

SEQ ID NO: 332390 - DNA, 75 bp, Artificial Sequence
  Synthetic
cccttccaggcccactggggagttgatcttgcaattggcagcaccacggttacaattgaaaatgcgagcaatacc

SEQ ID NO: 332391 - DNA, 75 bp, Artificial Sequence
  Synthetic
tttgccctgaagtccaagaatttcacaggctgcttcgaaggcaatcctgatccggaatcagcagcattgttagtt

SEQ ID NO: 332392 - DNA, 75 bp, Artificial Sequence
  Synthetic
agctggctgttcaatagcttgcaccatgactataagaatgaccccacaatcttgtgtgaacgtgtgagtggggag

SEQ ID NO: 332393 - DNA, 75 bp, Artificial Sequence
  Synthetic
agttccttcagattccaagttaatataagtgaacacaattactgtgataagattttatctaaaatggctaatttg

SEQ ID NO: 332394 - DNA, 75 bp, Artificial Sequence
  Synthetic
tttggcaactttgaaaactattgcttgaatacaaaacatagtaaaaagctaataatcattaggaatctcacttgg

SEQ ID NO: 332395 - DNA, 75 bp, Artificial Sequence
  Synthetic
agtcaacagtgccatgaagatcatatgagtgccatgcagtttataacctcaaacattcacactcaagttgtaaga

SEQ ID NO: 332396 - DNA, 75 bp, Artificial Sequence
  Synthetic
gctagaagaattcttagttttttcacctggtcattatcagatgctgttggaaatgacatgccagggggatactgc

SEQ ID NO: 332397 - DNA, 75 bp, Artificial Sequence
  Synthetic
ctagaaaaatggatgctagtggccagtcaactgaagtgctttggcaacactgctgttgctaagtgcaacctaaac

SEQ ID NO: 332398 - DNA, 75 bp, Artificial Sequence
  Synthetic
catgattctgagttttgcgacatgcttaggctttttgacttcaacaagaaggcaattgagactctacaaaacaaa

SEQ ID NO: 332399 - DNA, 75 bp, Artificial Sequence
  Synthetic
acaaggagtcaactaaacatagctattaatgccattaactctttgatatctgacaacttgctaatgaaaaatagg

SEQ ID NO: 332400 - DNA, 75 bp, Artificial Sequence
  Synthetic
atcaaagaattaatggacatacccttctgcaattacactaaattttggtatgtgaatcacacaaagttaaatcac

SEQ ID NO: 332401 - DNA, 75 bp, Artificial Sequence
  Synthetic
cattcacttcctagatgttggttggtgaaaaatgggagttaccttaatgagtctgaattcaggaatgattggctt

SEQ ID NO: 332402 - DNA, 75 bp, Artificial Sequence
  Synthetic
cttgaaagtgatcatctcatctctgaaatcctgagcaaagagtatgaggagagacaaggacggacacccttgtcc

SEQ ID NO: 332403 - DNA, 75 bp, Artificial Sequence
  Synthetic
ttagtggacatctgcttctggagcactctattttatactgcatccatcttccttcatctgatcaggatcccaaca

SEQ ID NO: 332404 - DNA, 75 bp, Artificial Sequence
  Synthetic
cacaggcacataactggtgagggttgtccaaagcctcacagacttaaagctgactccacctgcgcatgtggacta

SEQ ID NO: 332405 - DNA, 75 bp, Artificial Sequence
  Synthetic
tataaacagaaaagaagaccccttaagtgggtcaagtccaactaactctgtgatccgtaatcaccttcactgcca

SEQ ID NO: 332406 - DNA, 75 bp, Artificial Sequence
  Synthetic
tataaacagaaaagaagaccccttaagtgggtcaagtccaactaactctgtgatccgttatcaccttcactgcca

SEQ ID NO: 332407 - DNA, 75 bp, Artificial Sequence
  Synthetic
tataaacagaaaagaagaccccttaagtgggtcaagtccaactaactctgtgatccgtcatcaccttcactgcca

SEQ ID NO: 332408 - DNA, 75 bp, Artificial Sequence
  Synthetic
tataaacagaaaagaagaccccttaagtgggtcaagtccaactaactctgtgatccgtgatcaccttcactgcca

SEQ ID NO: 332409 - DNA, 75 bp, Artificial Sequence
  Synthetic
caccccgatggggtgtggcagtggggcccattgcttgcatctgtgggaccattgcctcacagcccccgttgctgc

SEQ ID NO: 332410 - DNA, 75 bp, Artificial Sequence
  Synthetic
accccatcagggtgcagcaacgagggcccctctgggtccaaacctagagaactactgttgtgtcaggctctctga

SEQ ID NO: 332411 - DNA, 75 bp, Artificial Sequence
  Synthetic
acaagatgtccaacggtaggagtcttctgggtttatcattagggatagctcctaataagactccactaaacatga

SEQ ID NO: 332412 - DNA, 75 bp, Artificial Sequence
  Synthetic
tgcaatccattaatgcgcaatgggcattggtacttgctggtgtggttcccttcttcttatttttgatgactattc

SEQ ID NO: 332413 - DNA, 75 bp, Artificial Sequence
  Synthetic
ctttatgtttgtcacatagatgctcaaacctcttccaagtgagttcctcaaaaactcttgactgttcagctgtga

SEQ ID NO: 332414 - DNA, 75 bp, Artificial Sequence
  Synthetic
acttcacatcaacaatctttatgtcctgtctaccatgcatgtcaaaaagtctccttatatcttcgctgccttgag

SEQ ID NO: 332415 - DNA, 75 bp, Artificial Sequence
  Synthetic
cagtgaagaccatggatttgggaagatgtttaataatggctgatatgataccagggcgggcaaattcaatatctt

SEQ ID NO: 332416 - DNA, 75 bp, Artificial Sequence
  Synthetic
ttaacaagatgccgtgacaatatttgctttgatccttaaaagatttaatgtcattgggcttccgatagcaatgaa

SEQ ID NO: 332417 - DNA, 75 bp, Artificial Sequence
  Synthetic
tgtatctcagtgagtctggttgatagattgccagctcaacgggatcaaatggggggccctcaatgtcaatccatg

SEQ ID NO: 332418 - DNA, 75 bp, Artificial Sequence
  Synthetic
ttgtgtcgtgaatggaaagggattcaactgacttcttaatttgttcctccacctcaggcttcaatgtggtgagcg

SEQ ID NO: 332419 - DNA, 75 bp, Artificial Sequence
  Synthetic
tgggtgcaccaccattcctaataggaacaggtggcttccttggtgagacatcaaactcaacaacagtattatccc

SEQ ID NO: 332420 - DNA, 75 bp, Artificial Sequence
  Synthetic
atgctcttcctttaatctgtgagcgtgacgctatgtacggccatccctccccagatagacagagcttatacaaaa

SEQ ID NO: 332421 - DNA, 75 bp, Artificial Sequence
  Synthetic
gattttcatatgggtttctttgacccggtgtaacatcaataaacatcttttcccttgattttatctccagtagag

SEQ ID NO: 332422 - DNA, 75 bp, Artificial Sequence
  Synthetic
ttttgataattgttgtgaaggtcgactcttcaacccttatagtctcaagcatgtttccaccatccaccaaacatg

SEQ ID NO: 332423 - DNA, 75 bp, Artificial Sequence
  Synthetic
cacctgccttcacagcggcagagagacttaggttgaatccagagatatttatttgtgactcttcttgggtgatta

SEQ ID NO: 332424 - DNA, 75 bp, Artificial Sequence
  Synthetic
tcttgaggcaagagtgcttattggacagagcttctaggtcgcccaaattggggaactttgctgtgtaaagtagcc

SEQ ID NO: 332425 - DNA, 75 bp, Artificial Sequence
  Synthetic
ctaaatctgttaaaccttgcacaacatcatttagagtctctcccccctgctctgccatgcaggagatggtcactg

SEQ ID NO: 332426 - DNA, 75 bp, Artificial Sequence
  Synthetic
caggagttgatccaaactggttgataaggagtgctggttccttaatgtcccagatttttacgactccaccccttc

SEQ ID NO: 332427 - DNA, 75 bp, Artificial Sequence
  Synthetic
tgttcagcccgggtctctggataccgactaactggaggatctctgatctcctggtcagttgtgttgtggtcagat

SEQ ID NO: 332428 - DNA, 75 bp, Artificial Sequence
  Synthetic
tcccttgatagacgccaccgcccccacttaccctctctgatctctgaaccttttctttcagtttgtttaggtcac

SEQ ID NO: 332429 - DNA, 75 bp, Artificial Sequence
  Synthetic
tagagagttccattagttcatcttttgacaacgatccaactttcaggaacatgttcttctgtgatgacctcattg

SEQ ID NO: 332430 - DNA, 75 bp, Artificial Sequence
  Synthetic
tcatcaaagaatccacttccttatttaaatccctgagatttgttagatcattgtcgtctcttttctcccttctca

SEQ ID NO: 332431 - DNA, 75 bp, Artificial Sequence
  Synthetic
tcatgcgctgtacacttgcaacttttgagaagtcaagaccagacaaaagagccctggtgtcattgagaacgtctg

SEQ ID NO: 332432 - DNA, 75 bp, Artificial Sequence
  Synthetic
ctttgactggagttgtccaagcagatagccctcttctaagggattgaacccaccgaaatgatggcactgactgct

SEQ ID NO: 332433 - DNA, 75 bp, Artificial Sequence
  Synthetic
cactcatggttgattgatgggctgggtactcctgtgagcactgttaaagattgatccttagaacaagttgcacta

SEQ ID NO: 332434 - DNA, 75 bp, Artificial Sequence
  Synthetic
cactgttaaagattgatccttagaacaagttgcactatgcgtagataacctaaaaagcctaggatcctccgtgcg

SEQ ID NO: 332435 - DNA, 75 bp, Artificial Sequence
  Synthetic
cgcacagtggatcctaggcgtttcttgagcttgcgcaaatagtgattcagttaattttcagacatactcagaacc

SEQ ID NO: 332436 - DNA, 75 bp, Artificial Sequence
  Synthetic
cgatcatggggcaactgatctccttctttggagagattccaaccattctgcaagaggctctcaacattgcactca

SEQ ID NO: 332437 - DNA, 75 bp, Artificial Sequence
  Synthetic
ttgcagtcagcatcattgcaaccatcaagggtgtcgtgaatgtctggaaaagtggtctcatccagctgctcatgt

SEQ ID NO: 332438 - DNA, 75 bp, Artificial Sequence
  Synthetic
ttgttatgttggctgggaggtcatgctcagtgcagatagggcatcaccttgaacttgagcatataatactgaata

SEQ ID NO: 332439 - DNA, 75 bp, Artificial Sequence
  Synthetic
gttcttcaatcctaccattcaccccaaccctttgcaaactaaacaagacttacttccttgtgaggggacccttcc

SEQ ID NO: 332440 - DNA, 75 bp, Artificial Sequence
  Synthetic
aggctcactggggggtcgatcttgcaataggcagcacaacggttgcagttgaaaatgcaacgaaaacctacaccc

SEQ ID NO: 332441 - DNA, 75 bp, Artificial Sequence
  Synthetic
tgaagtctaaaaactttacaggctgtttcgagggcaaccccgatccagattcagcagcactactggttacttggt

SEQ ID NO: 332442 - DNA, 75 bp, Artificial Sequence
  Synthetic
tgttcaacagtctgcaccatgattacaaaaatgacccatcaattctgtgtgagcgtgtgagtggggagaattctt

SEQ ID NO: 332443 - DNA, 75 bp, Artificial Sequence
  Synthetic
ttcgattccagatcaacataagtgaaccagagtactgtgagaaaattctctctaggatggccaacctatttggca

SEQ ID NO: 332444 - DNA, 75 bp, Artificial Sequence
  Synthetic
gctttgaaaactactgcttaaacaatagacacattaaaaaactgataatcatcagaaaccttacatggagtcagc

SEQ ID NO: 332445 - DNA, 75 bp, Artificial Sequence
  Synthetic
agtgtcacgagaatcacatgagtgccatgcagcttataacctccaatatccacacccaggttgtgagagccagga

SEQ ID NO: 332446 - DNA, 75 bp, Artificial Sequence
  Synthetic
ggattctcagtttcttcacctggtcgttgtcagatgctgtgggaaacgacatgccaggagggtattgtttagaaa

SEQ ID NO: 332447 - DNA, 75 bp, Artificial Sequence
  Synthetic
aatggatgctgattgccagccaactaaaatgttttggcaatactgctgttgcaaagtgtaacttgaaccatgatt

SEQ ID NO: 332448 - DNA, 75 bp, Artificial Sequence
  Synthetic
ctgagttttgtgacatgctcagactttttgacttcaacagaaaagcgattgagactctgcagaacaaaacaagga

SEQ ID NO: 332449 - DNA, 75 bp, Artificial Sequence
  Synthetic
gccagctaaatatagctattaatgccatcaactccttaatatctgacaacctgttgatgaagaatagagttaagg

SEQ ID NO: 332450 - DNA, 75 bp, Artificial Sequence
  Synthetic
aattgatggatatacccttttgtaattacaccaaattttggtatgtgaatcacacaaaattgaaccaccattcac

SEQ ID NO: 332451 - DNA, 75 bp, Artificial Sequence
  Synthetic
ttcccagatgttggttagtgaaaaatgggagttacctcaatgaatcagagtttagaaatgattggcttcttgaga

SEQ ID NO: 332452 - DNA, 75 bp, Artificial Sequence
  Synthetic
gtgatcacctcatctctgagatcctgagcagagagtatgaggagaggcaggggcggacacccctatcattggtcg

SEQ ID NO: 332453 - DNA, 75 bp, Artificial Sequence
  Synthetic
acgtctgcttttggagcactttgttttatactgcatctatctttctccatttgatcagaattccaacacacagac

SEQ ID NO: 332454 - DNA, 75 bp, Artificial Sequence
  Synthetic
acatagttggtgaaggctgtccaaagccccacagacttagggcagattccacctgtgcatgtgggttatacaaac

SEQ ID NO: 332455 - DNA, 75 bp, Artificial Sequence
  Synthetic
aaaaaagaaggcctcttaagtgggttaggtccaactaactctgtgacttgtggtcaccttcactgccacgcccct

SEQ ID NO: 332456 - DNA, 75 bp, Artificial Sequence
  Synthetic
gtggggcgtggcagtaaggcctccgaccggttcatgtgaacgcagtccatgatcaacaaaccacatatgtgaaat

SEQ ID NO: 332457 - DNA, 75 bp, Artificial Sequence
  Synthetic
tgctgtcctatggcccccgttgctgcaccccatctggggtgcagcaacgagggcccagttaggtccagatctaga

SEQ ID NO: 332458 - DNA, 75 bp, Artificial Sequence
  Synthetic
gaacaactgttgtgtcaggttctctgaataagatgtctagtggtagaagccttctgggtttatcattagggattg

SEQ ID NO: 332459 - DNA, 75 bp, Artificial Sequence
  Synthetic
ctcccaacaaaacaccactaaacataatgcaatccattaacgcgcagtgagcattggtacttgctggtgtggtcc

SEQ ID NO: 332460 - DNA, 75 bp, Artificial Sequence
  Synthetic
ctttcttcttgctcttaatgactattcctttatgtttgtcacatagatgttcaaacctcttccaagtgagttctt

SEQ ID NO: 332461 - DNA, 75 bp, Artificial Sequence
  Synthetic
caaagactcttgattgctcagctgtgaacttaacatcaacaatctttaaatcttgtctaccatgcatatcaaaga

SEQ ID NO: 332462 - DNA, 75 bp, Artificial Sequence
  Synthetic
tcttgtctaccatgcatatcaaagagcctccttatatcctcacttccctgagctgtgaaaaccatggacttagga

SEQ ID NO: 332463 - DNA, 75 bp, Artificial Sequence
  Synthetic
agctgtgaaaaccatggacttaggaagatgtcttaatgatggctgatataatgccagggacgagcaatactcaat

SEQ ID NO: 332464 - DNA, 75 bp, Artificial Sequence
  Synthetic
atcctttagcaggattccatggcaatatttgctttgatctttaaaagatttgacatcattaggtttccggtagca

SEQ ID NO: 332465 - DNA, 75 bp, Artificial Sequence
  Synthetic
gtggatgtattttagtgagtcgggctggtaaattgccatttcaacagggtcaaatggtggtccctcaatgtcaat

SEQ ID NO: 332466 - DNA, 75 bp, Artificial Sequence
  Synthetic
tggtaaattgccatttcaacagggtcaaatggtggtccctcaatgtcaatccatgtagtgtcatgaactgagagg

SEQ ID NO: 332467 - DNA, 75 bp, Artificial Sequence
  Synthetic
agattttcttgcacgtgtgtgcgtttgctccggatagccacagcagcgaggtttgagagagataatttctcgttt

SEQ ID NO: 332468 - DNA, 75 bp, Artificial Sequence
  Synthetic
gacgagtgtcgaaagagaccgcgaggaagacgcgtcaatctagggtccaaatgccaaatggactcgtgttgatgc

SEQ ID NO: 332469 - DNA, 75 bp, Artificial Sequence
  Synthetic
cgcagaggcctcactgtccgagagatggtgacaatctacttcctcttgttggtcttggagctggggttgccgggt

SEQ ID NO: 332470 - DNA, 75 bp, Artificial Sequence
  Synthetic
gggagggcttgtccgctcaatggtggtggcagacaatggagagctgctcagcgaggggggcatccccggaatagt

SEQ ID NO: 332471 - DNA, 75 bp, Artificial Sequence
  Synthetic
tggtgacaatctacttcctcttgttggtcttggagctggggttgccgggtgagagccttgagggtctctgggaat

SEQ ID NO: 332472 - DNA, 75 bp, Artificial Sequence
  Synthetic
gtcatccggaggaggccagccactggaacaacggccatgtggggaggcattgttgtccttgcactgctcgtcact

SEQ ID NO: 332473 - DNA, 75 bp, Artificial Sequence
  Synthetic
cctggccacggacatgggatcatggtgtgatgactcattaacctatgagtgtgtaaccatagaccagggggagga

SEQ ID NO: 332474 - DNA, 75 bp, Artificial Sequence
  Synthetic
gccaacctctttggtggttggtgttggtctggcggcgttccacctggccattgtggtgtctggactagaggctga

SEQ ID NO: 332475 - DNA, 75 bp, Artificial Sequence
  Synthetic
ctgatcccgtcccatgcccagggagacctcacaggaaggggacacaaatggttagaaggggattcactgcggacg

SEQ ID NO: 332476 - DNA, 75 bp, Artificial Sequence
  Synthetic
gattaatggggggagggggttctggaatcaggctgttggctttctgggagctgtcaacccacagagggagacggt

SEQ ID NO: 332477 - DNA, 75 bp, Artificial Sequence
  Synthetic
accgtggaaagcgtggtgaccagggtcgccgtggtggtggcgctcttgtgcctggctccggtttatgcctcacga

SEQ ID NO: 332478 - DNA, 75 bp, Artificial Sequence
  Synthetic
tcgtgtgactctggtgctggaactgggaggatgcgtcaccataacagccgaggggaagccctcgatggacgtgtg

SEQ ID NO: 332479 - DNA, 75 bp, Artificial Sequence
  Synthetic
ctgggcttgcggcttcggccttccactggtcggggattcttggggtgatgggactgtggacgctttcagaaatga

SEQ ID NO: 332480 - DNA, 75 bp, Artificial Sequence
  Synthetic
gagcgaggtgatagacctttcgaggtcagggacggtgtctacaggatcttcagccctggtctgctctggggccaa

SEQ ID NO: 332481 - DNA, 75 bp, Artificial Sequence
  Synthetic
gcatgtgacaagaggagcggcgttgtccatcaatgacgccgtggcaggtccatattgggctgatgtcaaggaaga

SEQ ID NO: 332482 - DNA, 75 bp, Artificial Sequence
  Synthetic
gctaatgagacccatagtggaagaaaaacagcatccttcacggtttcctcggaaaaaaccatcttgaccatggga

SEQ ID NO: 332483 - DNA, 75 bp, Artificial Sequence
  Synthetic
ggaaaaaaccatcttgaccatgggagactacggagatgtgtccttgttgtgtcgagtagccagcggtgttgatct

SEQ ID NO: 332484 - DNA, 75 bp, Artificial Sequence
  Synthetic
acaatgctgaacggctagttgagtttggagctccacatgctgtgaaaatggatgtgtataaccttggagaccaga

SEQ ID NO: 332485 - DNA, 75 bp, Artificial Sequence
  Synthetic
ctcaaggagcagtggtgggactgtatggaaacggactgaaaacaaacgagacttatgtcagcagcattgctcaag

SEQ ID NO: 332486 - DNA, 75 bp, Artificial Sequence
  Synthetic
aaggtgtcctacacacgatgtggcatgtgacgagaggggcggcgttgtccattgatgacgccgtcgcagggccct

SEQ ID NO: 332487 - DNA, 75 bp, Artificial Sequence
  Synthetic
tgtatgctacggcggagcctggagtcttgaggagaagtggaaaggtgagacagtgcaggtccatgcctttccacc

SEQ ID NO: 332488 - DNA, 75 bp, Artificial Sequence
  Synthetic
aattcacgtggaagagaattccaactgacagtggacatgacacagtggtcatggaagtagcgttctctgggacca

SEQ ID NO: 332489 - DNA, 75 bp, Artificial Sequence
  Synthetic
accaactcgcgtggtgctcaaggaaatggagcgtgcactgaatgggaagagagtcaggttccactctcccgcggt

SEQ ID NO: 332490 - DNA, 75 bp, Artificial Sequence
  Synthetic
agggagtggttgtggggctgtatgggaacggactgaagaccaatgaaacctacgtcagcagcattgctcagggtg

SEQ ID NO: 332491 - DNA, 75 bp, Artificial Sequence
  Synthetic
gcaggggagacaaaactgggaggtggcaatcatggacgaagcccattggacagatccacacagcatagccgccag

SEQ ID NO: 332492 - DNA, 75 bp, Artificial Sequence
  Synthetic
tttcaaaaaaccaggaaaggcatagaaagactgacagtgatcggagaacacgcctgggattttggctcaactggt

SEQ ID NO: 332493 - DNA, 75 bp, Artificial Sequence
  Synthetic
gggcgcaccgcttggttcgttccatcgattgcaaagggtggtgtcattgctcgcaccttgagacaaaaagggaaa

SEQ ID NO: 332494 - DNA, 75 bp, Artificial Sequence
  Synthetic
agcgtgatttgtctgaacagcaaaacctttgagaaggattacaccagagtgagagatgaaaagcctgactttgtg

SEQ ID NO: 332495 - DNA, 75 bp, Artificial Sequence
  Synthetic
gacaccgaacggatggagctccgttgtggtgagggtctggttgtgtggagggaggtttccgagtggtatgacaat

SEQ ID NO: 332496 - DNA, 75 bp, Artificial Sequence
  Synthetic
agcattcggttggcttctcgaactgggaggaggttcccttctgctcacaccatttccacgagctggtgatgaaag

SEQ ID NO: 332497 - DNA, 75 bp, Artificial Sequence
  Synthetic
cggcaacgccacctgggaagagcgagcccttcccagagtccaacggagcaatttccagtgaagagaagcagatcc

SEQ ID NO: 332498 - DNA, 75 bp, Artificial Sequence
  Synthetic
gaacagatgaatacatatactctggacagtgtgatgatgatgacagtggactcgtgcagtggaaggaggcgcaga

SEQ ID NO: 332499 - DNA, 75 bp, Artificial Sequence
  Synthetic
tggcgacgggaaaatggtcgatcccgacgtagggcactctgtcaaactttgtgagacccccggcaccatgataag

SEQ ID NO: 332500 - DNA, 75 bp, Artificial Sequence
  Synthetic
cagatgaatacatatactctggacagtgtgatgatgatgatagtggacttgtgcagtggaaggaagcgcagatac

SEQ ID NO: 332501 - DNA, 75 bp, Artificial Sequence
  Synthetic
gtgcagtggaaggaagcgcagatacttcttgacaacataacaacactgcgggggcctgtggctaccttctatgga

SEQ ID NO: 332502 - DNA, 75 bp, Artificial Sequence
  Synthetic
agattttcttgcacgtgcgtgcgtttgcttcggatagcaacagcagcgacaggtttgaagaagacaatctttcgc

SEQ ID NO: 332503 - DNA, 75 bp, Artificial Sequence
  Synthetic
gaatttgtggcgtacgcttcagggcggcgcagcatcggtgacgtactgacaggaatgtcaggggtacccgagctt

SEQ ID NO: 332504 - DNA, 75 bp, Artificial Sequence
  Synthetic
aggatacccgggtactcagaacaagtgaaaggaccatggaagtactcgcccatccgagtgacaagagaagagtgc

SEQ ID NO: 332505 - DNA, 75 bp, Artificial Sequence
  Synthetic
aaacgtgtctagtgtgacaagtcggaactggacgtgggaaggtcctgaggagaacaccgtggacgaggccaatgg

SEQ ID NO: 332506 - DNA, 75 bp, Artificial Sequence
  Synthetic
ccgactgtgacaaaaggggggcttctgtgaggagtaccacagagagtggcaaggtgattccagagtggtgctgcc

SEQ ID NO: 332507 - DNA, 75 bp, Artificial Sequence
  Synthetic
cgggacgctggtactgctggcctccctagcacttttgtgggctggcggtgtcagctacgggaacatggctggagt

SEQ ID NO: 332508 - DNA, 75 bp, Artificial Sequence
  Synthetic
aaggtgattccagagtggtgctgccgaacgtgcacactacctccagtgacgatccgtacggggacagactgttgg

SEQ ID NO: 332509 - DNA, 75 bp, Artificial Sequence
  Synthetic
cgtcactggtctggtgagaatcgaaagcctggtgcgttatgtcgtggcagttgggatcacatttcaccttgagct

SEQ ID NO: 332510 - DNA, 75 bp, Artificial Sequence
  Synthetic
gggttggtctgctcagcgcttttgcactgcgcagcaacctcactgtcagagagatggtaaccatctacttccttc

SEQ ID NO: 332511 - DNA, 75 bp, Artificial Sequence
  Synthetic
actgcgcagcaacctcactgtcagagagatggtaaccatctacttccttctgctggttttggagctaggattgcc

SEQ ID NO: 332512 - DNA, 75 bp, Artificial Sequence
  Synthetic
tggagtgaacatgaggagttgcggtcgtgggaagagtggaccaatatcgatatccagcctgcacgttcttgggga

SEQ ID NO: 332513 - DNA, 75 bp, Artificial Sequence
  Synthetic
ggcagaggaaaagactggtgttggactcctgctcatggctctcatgacacagcaagacttggcgattgtacacta

SEQ ID NO: 332514 - DNA, 75 bp, Artificial Sequence
  Synthetic
tggactcatgctcttcctgggcgtggcctcatgttgttcaatctggaaactgattcgaggacacagagaacagaa

SEQ ID NO: 332515 - DNA, 75 bp, Artificial Sequence
  Synthetic
gggactgacttgggttgtccccctggccgggctactcggaggagagggctctggagtcagactgctggctttttg

SEQ ID NO: 332516 - DNA, 75 bp, Artificial Sequence
  Synthetic
aggccatgcgagacctcggaggaggggctccattttttggggtagcagggcatgtaatggctttgggagtggtat

SEQ ID NO: 332517 - DNA, 75 bp, Artificial Sequence
  Synthetic
gcttccatcacggaagcctcagccgtggggctggcggcagccggacaactgctcagaccggaggtggacacactg

SEQ ID NO: 332518 - DNA, 75 bp, Artificial Sequence
  Synthetic
atgtggaagaggtggctggtcctactatgcggcctcccgaccggcggtcatgagtgtcaaagcatacacaattgg

SEQ ID NO: 332519 - DNA, 75 bp, Artificial Sequence
  Synthetic
gatgggattgtggacgctgtcggaaatgctgaggacggctcgaagatcagatttggtcttctctggacagggggg

SEQ ID NO: 332520 - DNA, 75 bp, Artificial Sequence
  Synthetic
atggtgacaagcctgggttggaacttgatcaagtttagagccggaatggatgtgttcagcatgcaaccacatcgg

SEQ ID NO: 332521 - DNA, 75 bp, Artificial Sequence
  Synthetic
tgatcaagtttagagccggaatggatgtgttcagcatgcaaccacatcgggctgacaccatcatgtgtgacattg

SEQ ID NO: 332522 - DNA, 75 bp, Artificial Sequence
  Synthetic
ctcaatggctgtaccaaggaagagttcttcgcctataggcgcactggcatcctggagacggaaagggacaaggcg

SEQ ID NO: 332523 - DNA, 75 bp, Artificial Sequence
  Synthetic
ggaaggtgagaggacaaggagagtgatattgctcatggagcaatggaaaaaccggaaccccacggctgcctgtgt

SEQ ID NO: 332524 - DNA, 75 bp, Artificial Sequence
  Synthetic
actggtgaggacccctttctcaaggaactcaacccatgaaatgtactactcgaccgccgtcactgggaacatcgt

SEQ ID NO: 332525 - DNA, 75 bp, Artificial Sequence
  Synthetic
gcatcaatgtcagcccggggaactgctcctggacacaggtaggaggataggggcagtgccaattgatctggcaaa

SEQ ID NO: 332526 - DNA, 75 bp, Artificial Sequence
  Synthetic
cgaccgccgtcactgggaacatcgtgaactctgtcaacatccagtcaaggaaactcctagcccggtttggagacc

SEQ ID NO: 332527 - DNA, 75 bp, Artificial Sequence
  Synthetic
tgaaacctacgtcagcagcattgctcagggtgaggctgaaaaaagtcgacccaatctcccgccggccgttattgg

SEQ ID NO: 332528 - DNA, 75 bp, Artificial Sequence
  Synthetic
agcacccgtaccggacatggcagtactggggcagttaccgaactgcgccaactggctcagcggcgtctctgatca

SEQ ID NO: 332529 - DNA, 75 bp, Artificial Sequence
  Synthetic
ctggggcagttaccgaactgcgccaactggctcagcggcgtctctgatcaatggagttgtgaaactactcagctg

SEQ ID NO: 332530 - DNA, 75 bp, Artificial Sequence
  Synthetic
ggaaatggagcgtgccttgaatggaaagagagtcaggttccattctccggcagttggagatcagcaggtgggagg

SEQ ID NO: 332531 - DNA, 75 bp, Artificial Sequence
  Synthetic
aggaattcatagcaaaggtgaaatccaatgcggccctgggggcgtggtctgatgagcagaacagatggtcaaatg

SEQ ID NO: 332532 - DNA, 75 bp, Artificial Sequence
  Synthetic
cttatgacagcaacgccacccgggaagagcgaacccttcccagagtccaacggagcaattaccagtgaagagaag

SEQ ID NO: 332533 - DNA, 75 bp, Artificial Sequence
  Synthetic
gggcaagagagagaagaagcttggagagtttggagtggccaagggaagccgagccatctggtacatgtggctggg

SEQ ID NO: 332534 - DNA, 75 bp, Artificial Sequence
  Synthetic
aagacctttgaaaaggactactccagagtgagagatgagaaacccgacttcgtggtcacaaccgacatatctgaa

SEQ ID NO: 332535 - DNA, 75 bp, Artificial Sequence
  Synthetic
tcatgagagcagtgaatgactggattctggaacgattggcacgaaaaagcaaaccacgaatgtgcagcagagagg

SEQ ID NO: 332536 - DNA, 75 bp, Artificial Sequence
  Synthetic
gggcctctagagagtccagtggagctggagtggaaggaataagcctgaactacctgggctggcacctaaaaaaat

SEQ ID NO: 332537 - DNA, 75 bp, Artificial Sequence
  Synthetic
ctatgcggatgacacggctggctgggacaccaaggttaccaatgcagatctagaggatgaggagcagatcttgcg

SEQ ID NO: 332538 - DNA, 75 bp, Artificial Sequence
  Synthetic
ctggcggccacaataatgcaaaaggcataccacgcaaaagtggtgaaagttgccaggccttcccgtgatggaggc

SEQ ID NO: 332539 - DNA, 75 bp, Artificial Sequence
  Synthetic
cactgcgggggcctgtggccactttttatggaccagagcaggacaagatgccagaggtggcaggtcatttccgcc

SEQ ID NO: 332540 - DNA, 75 bp, Artificial Sequence
  Synthetic
ttcacgccatggttggcatggcacgtcgcagcaaacgtgtctagtgtgacaagtcggaactggacttgggaaggc

SEQ ID NO: 332541 - DNA, 75 bp, Artificial Sequence
  Synthetic
tgaaagaacatggagaggaacgccttggaagaatgctcgtcagtggtgacgactgtgtggtgagaccaattgatg

SEQ ID NO: 332542 - DNA, 75 bp, Artificial Sequence
  Synthetic
gggagacgcagctttggagatgtgttgagcggaatgtccggtgttcctgagcttctgcgccatagatgtgttagc

SEQ ID NO: 332543 - DNA, 75 bp, Artificial Sequence
  Synthetic
ggttcagtagggcgctctactttctgaatgacatggcaaaaaccaggaaagacatcggggaatgggagcattcgg

SEQ ID NO: 332544 - DNA, 75 bp, Artificial Sequence
  Synthetic
gttcgcacctcaatcagtcgcatgatgcttggcacgctggtactgctggcctcactggcgctcctgtgggccggt

SEQ ID NO: 332545 - DNA, 75 bp, Artificial Sequence
  Synthetic
aaccgagtgtggattctggacaaccccttcatgcagaacaaagaaagggttgcagagtggagagatattccgtat

SEQ ID NO: 332546 - DNA, 75 bp, Artificial Sequence
  Synthetic
gagtggccctcattttctacacgctgctgacggtgctgcagcctgaagcggggaaacagaggagcagtgatgaca

SEQ ID NO: 332547 - DNA, 75 bp, Artificial Sequence
  Synthetic
gggaaacagaggagcagtgatgacaacaagttggcctacttcctgttgacgctctgcagtctagctggactggta

SEQ ID NO: 332548 - DNA, 75 bp, Artificial Sequence
  Synthetic
gctcctccctcgttggaaggaaggagagggctgagtgggccaagaacatctggggagcggtggaaaaggtcagga

SEQ ID NO: 332549 - DNA, 75 bp, Artificial Sequence
  Synthetic
agatgatagggcctgaaaagttcagggactacctttcctgcatggaccgacatgacttgcactgggaactcagac

SEQ ID NO: 332550 - DNA, 75 bp, Artificial Sequence
  Synthetic
tgctctgtatgagaggaaaatgagcctggtcttggcgatagtgctttgcttgatgtcggtggtcatgaacagaac

SEQ ID NO: 332551 - DNA, 75 bp, Artificial Sequence
  Synthetic
aactgctcagaccagaggcggatactctgtggacgatgccagtggcctgtggcctgagcggcgtggtcaggggta

SEQ ID NO: 332552 - DNA, 75 bp, Artificial Sequence
  Synthetic
gggagtaggcgtggtggttctgagggggacactctcggtgacttgtggaaacggaaactcaatggctgtaccaaa

SEQ ID NO: 332553 - DNA, 75 bp, Artificial Sequence
  Synthetic
aacctgatcaagttcagagcgggaatggatgtattcagcatgcaaccacaccgagctgataccattatgtgtgac

SEQ ID NO: 332554 - DNA, 75 bp, Artificial Sequence
  Synthetic
tggtggagggtgagaagacacggaaagtgatactactcatggaacagtggaaaaaccgcaatcccacggctacct

SEQ ID NO: 332555 - DNA, 75 bp, Artificial Sequence
  Synthetic
ccgcccagaggtcatagaagcactacacagattccaactgcagtggggcggaggactggtgaggacccctttctc

SEQ ID NO: 332556 - DNA, 75 bp, Artificial Sequence
  Synthetic
gaggactggtgaggacccctttctcgaggaattcaacccatgaaatgtattactcgactgctgtcactggaaaca

SEQ ID NO: 332557 - DNA, 75 bp, Artificial Sequence
  Synthetic
gtcactggtctggtaaggatcgagagtttagtgcgctatgtcgtggcagttgggatcacatttcatcttgagctg

SEQ ID NO: 332558 - DNA, 75 bp, Artificial Sequence
  Synthetic
ctgagctggacctcggagttgggactcgatgcgttgtcttggctgaggacaaggtgaaggaaaaagatgtgcagg

SEQ ID NO: 332559 - DNA, 75 bp, Artificial Sequence
  Synthetic
agtactggggcagctaccgcaccgcgccaaccgggtcagcggcgtcactgatcaatggagtcgtgaagcttctca

SEQ ID NO: 332560 - DNA, 75 bp, Artificial Sequence
  Synthetic
gctggccatggaacgcgcgggaggatgtcgtgcgaatggccatgactgacaccacagcctttggacagcagcgag

SEQ ID NO: 332561 - DNA, 75 bp, Artificial Sequence
  Synthetic
aaggtcatcatgagagcagtgaatgactggattctggaacgattggcacggaaaagcaaaccacgaatgtgcagc

SEQ ID NO: 332562 - DNA, 75 bp, Artificial Sequence
  Synthetic
gaaaagcaaaccacgaatgtgcagcagagaggagttcatagcgaaagtgaaatccaatgcggctctgggggcttg

SEQ ID NO: 332563 - DNA, 75 bp, Artificial Sequence
  Synthetic
tggagagtttggagtggccaaaggaagccgggccatatggtacatgtggctggggagccgctttctggagttcga

SEQ ID NO: 332564 - DNA, 75 bp, Artificial Sequence
  Synthetic
cactgggcctctagggggtccagtggatctggagtggagggaataagcttgaattacctgggctggtacctcaaa

SEQ ID NO: 332565 - DNA, 75 bp, Artificial Sequence
  Synthetic
ttaaatatagtccagacaaaacagaacatgacaaagcaaataggctgagctaaaagttcccactacgggactgct

SEQ ID NO: 332566 - DNA, 75 bp, Artificial Sequence
  Synthetic
ctaagaggcgaagccacagatcatggaatgatgcggcagcgcgcgagagcgacggggaagtggtcgcacccgacg

SEQ ID NO: 332567 - DNA, 75 bp, Artificial Sequence
  Synthetic
gaatgatgcggcagcgcgcgagagcgacggggaagtggtcgcacccgacgcaccatccatgaagcaacacttcgt

SEQ ID NO: 332568 - DNA, 75 bp, Artificial Sequence
  Synthetic
gcatgaggagcctggcagcagagcaatgaagatggccgagagagatgctccagaggccttcttgacggtggtaga

SEQ ID NO: 332569 - DNA, 75 bp, Artificial Sequence
  Synthetic
atgaagatggccgagagagatgctccagaggccttcttgacggtggtagagatgatggtgctcggcctggccact

SEQ ID NO: 332570 - DNA, 75 bp, Artificial Sequence
  Synthetic
gtctcggaagaatgctcgtgagcggtgatgattgtgtggtgagaccggtggatgacaggttcagtagggcactct

SEQ ID NO: 332571 - DNA, 75 bp, Artificial Sequence
  Synthetic
agcccgcgtctcaccagggtgcggctggagtgtccgtgaaactgcctgcctttcaaaagcttatgggcagatgtg

SEQ ID NO: 332572 - DNA, 75 bp, Artificial Sequence
  Synthetic
gacttgcggacgcttggacttgccatctgttcggcggtgcccattgactgggtccccactggccgcacgacctgg

SEQ ID NO: 332573 - DNA, 75 bp, Artificial Sequence
  Synthetic
aggaaactcctggcccggttcggggaccagaggggacccactagggtgcctgagctggaccttggagttgggact

SEQ ID NO: 332574 - DNA, 75 bp, Artificial Sequence
  Synthetic
agattgtggaatggagggatgtcccgtatctccccaaatcccatgacatgctgtgttcctctcttgttgggagga

SEQ ID NO: 332575 - DNA, 75 bp, Artificial Sequence
  Synthetic
cccccggcaccatgataaggccgaacatggtgcaagaacgggaggcccccggaagcatgcttccgggaggaggga

SEQ ID NO: 332576 - DNA, 75 bp, Artificial Sequence
  Synthetic
ttccccctcaacagagggggggcggttcttgttctccctgagccaccatcacccagacacagatagtctgacaag

SEQ ID NO: 332577 - DNA, 75 bp, Artificial Sequence
  Synthetic
agattttcttgcacgtgcgtgcgtttgcttcggatagcattagcagcggcaggttcggaagagacattgtctcgt

SEQ ID NO: 332578 - DNA, 75 bp, Artificial Sequence
  Synthetic
gctggggatggccaggaaggccattctgaaaggaaaggggggcggtccccctcgacgagtgtcgaaagagaccgc

SEQ ID NO: 332579 - DNA, 75 bp, Artificial Sequence
  Synthetic
ggatggcactactgtgatcagggctgaaggaaaggacgcagcaactcaggtgcgcgtggagaacggcacctgtgt

SEQ ID NO: 332580 - DNA, 75 bp, Artificial Sequence
  Synthetic
agattttcttgcacgtgcatgcttttgcttcggatagcattagcagcggttggtttgaaagagatattctttcgt

SEQ ID NO: 332581 - DNA, 75 bp, Artificial Sequence
  Synthetic
agtgtgtgactatagaccagggggaagagccggttgatgtggattgcttttgcagaaatgttgatggggtctacc

SEQ ID NO: 332582 - DNA, 75 bp, Artificial Sequence
  Synthetic
tgcagaaatgttgatggggtctaccttgagtatggacgctgtggaaaacaggaaggctcaaggacaaggcgctca

SEQ ID NO: 332583 - DNA, 75 bp, Artificial Sequence
  Synthetic
ttgagtatggacgctgtggaaaacaggaaggctcaaggacaaggcgctcagtgctgattccgtctcatgcccagg

SEQ ID NO: 332584 - DNA, 75 bp, Artificial Sequence
  Synthetic
aactttgtgagacccccggcaccatgataaggccgaacatggtgcaagaacgggaggcccccggaagcatgcttc

SEQ ID NO: 332585 - DNA, 75 bp, Artificial Sequence
  Synthetic
acgcatctcaccagagttgaagggtgggtttggaaaaacaaactacttgccctggcagtggtagccgttgtgtgg

SEQ ID NO: 332586 - DNA, 75 bp, Artificial Sequence
  Synthetic
gggtttggaaaaacaaactacttgccctggcagtggtagccgttgtgtggttgaccgtggaaagtgtggtgaccc

SEQ ID NO: 332587 - DNA, 75 bp, Artificial Sequence
  Synthetic
acacacctcactagagttgagggatgggtctggaagaacaagctacttgccttggcgatggttaccgttgtgtgg

SEQ ID NO: 332588 - DNA, 75 bp, Artificial Sequence
  Synthetic
gtctgcatgccaagttatcggacaccaaggttgcagctagatgcccaacaatggggcctgccactctggctgaag

SEQ ID NO: 332589 - DNA, 75 bp, Artificial Sequence
  Synthetic
aacatcagagtggcacggtgtgcaagagagaccagagtgatcgaggctggggcaaccattgcggactgtttggaa

SEQ ID NO: 332590 - DNA, 75 bp, Artificial Sequence
  Synthetic
ggtcgccgtagtggtggtgctcttgtgcctggctccggtttatgcctcacgatgcacacatctggaaaacaggga

SEQ ID NO: 332591 - DNA, 75 bp, Artificial Sequence
  Synthetic
ggggactatggagatgtgtccttgttatgcagagttgccagtggcgttgacttggctcagactgtcattcttgag

SEQ ID NO: 332592 - DNA, 75 bp, Artificial Sequence
  Synthetic
atggacgtgtacaaccttggagatcaaacgggggtgttgctgaagtcacttgctggggttcctgtggcgcacatt

SEQ ID NO: 332593 - DNA, 75 bp, Artificial Sequence
  Synthetic
tgctggggttcctgtggcgcacattgatggaacaaagtaccacctaaaaagcggccatgtgacctgtgaggtagg

SEQ ID NO: 332594 - DNA, 75 bp, Artificial Sequence
  Synthetic
ctagaaaaactcaagatgaaaggtctcacatacacaatgtgcgacaagacgaaattcacgtggaagagaattcca

SEQ ID NO: 332595 - DNA, 75 bp, Artificial Sequence
  Synthetic
tcggggaactgagtcatcagtggttccaaaaggggagtagcattggaagagttttccagaagaccaggaagggca

SEQ ID NO: 332596 - DNA, 75 bp, Artificial Sequence
  Synthetic
acacgcctgggactttggttccactgggggtttcttggcttcggtgggcaaagcgctgcacacagttctcggtgg

SEQ ID NO: 332597 - DNA, 75 bp, Artificial Sequence
  Synthetic
gggggtttcttggcttcggtgggcaaagcgctgcacacagttctcggtggcgccttcaacagcatctttggggga

SEQ ID NO: 332598 - DNA, 75 bp, Artificial Sequence
  Synthetic
tgggtgtagccttggcttggttgggcctgaacatgaggaaccctaccatgtccatgagcttcctcctggctgggg

SEQ ID NO: 332599 - DNA, 75 bp, Artificial Sequence
  Synthetic
aaaaatgacacaggcacttacatagttgaacttctggtcactgacctgaggaactgctcatggcctgctagccac

SEQ ID NO: 332600 - DNA, 75 bp, Artificial Sequence
  Synthetic
agatggccatgtggaggagtgcagtgacagaactcaacctggctttggcggaaggagacgcaaacctcactgtgg

SEQ ID NO: 332601 - DNA, 75 bp, Artificial Sequence
  Synthetic
ctaccggggcggcgttcctggcctactgaagaaaggaaaagacattaaggtctcttggaagagttggggccagtc

SEQ ID NO: 332602 - DNA, 75 bp, Artificial Sequence
  Synthetic
aatgatctggagcatccccgaggctccccgccgcttcatggtgggcacggagggaggaaatgagtgcccattgga

SEQ ID NO: 332603 - DNA, 75 bp, Artificial Sequence
  Synthetic
agggaggaaatgagtgcccattggaaagaaggaagacaggcgtcttcacggtggcggaattcggagttggtctga

SEQ ID NO: 332604 - DNA, 75 bp, Artificial Sequence
  Synthetic
acaggaaccaacacatgaatgtgacactggagtgatgggggctgccgtcaagaatggcatggcggtccacactga

SEQ ID NO: 332605 - DNA, 75 bp, Artificial Sequence
  Synthetic
tcaatggtggtggcagacaatggagagctgcttagtgaggggggcattcccggaatagtggctttgtttgtggtc

SEQ ID NO: 332606 - DNA, 75 bp, Artificial Sequence
  Synthetic
aaaaatgacactggaacttacatagttgaactattggtcactgacttgagaaactgctcatggcctgccagccac

SEQ ID NO: 332607 - DNA, 75 bp, Artificial Sequence
  Synthetic
cactgttacaggctgtgtttgagttgagggttggcctgctcagcgcttttgcactgcgcagcaacctcaccgtca

SEQ ID NO: 332608 - DNA, 75 bp, Artificial Sequence
  Synthetic
tgtcctggcacgaaagttaccataagtgctgactgtgacaaacgaggagcttctgtgaggagcaccacagagagt

SEQ ID NO: 332609 - DNA, 75 bp, Artificial Sequence
  Synthetic
gtgctgactgtgacaaacgaggagcttctgtgaggagcaccacagagagtggcaaggtgatcccggaatggtgct

SEQ ID NO: 332610 - DNA, 75 bp, Artificial Sequence
  Synthetic
gctctggaatcagactgctggcgttttgggagctgtcagctcacagaggaagacgatctttcagtgaaccactaa

SEQ ID NO: 332611 - DNA, 75 bp, Artificial Sequence
  Synthetic
ttgggagctgtcagctcacagaggaagacgatctttcagtgaaccactaactgtggtaggagtcatgctaacact

SEQ ID NO: 332612 - DNA, 75 bp, Artificial Sequence
  Synthetic
ggaaatggggagacgcattggccatgggggcattgattttcagagcctgcacggcagaggaaaagactggtgttg

SEQ ID NO: 332613 - DNA, 75 bp, Artificial Sequence
  Synthetic
gacattccgaacggggactgactgctggtatgccatggaaatacgcccggtccacgatcaggggggtcttgttcg

SEQ ID NO: 332614 - DNA, 75 bp, Artificial Sequence
  Synthetic
cctcgaatatgtcatccggaggagaccggccacagggacagcggttgtgtggggaggcgttgtggttcttgcact

SEQ ID NO: 332615 - DNA, 75 bp, Artificial Sequence
  Synthetic
ttcgaggttaaggacggtgtctacaggattttcagccccggcttgttctggggtcagaaccaggtgggagttggc

SEQ ID NO: 332616 - DNA, 75 bp, Artificial Sequence
  Synthetic
cggtggggatcacattccatcttgagctgggaccagagattgtggccctgacgctgctccaggccgtgttcgagc

SEQ ID NO: 332617 - DNA, 75 bp, Artificial Sequence
  Synthetic
ttggggcaataccaattgatttggtaaaaggaacatcaggcagccccattctcaacgcccagggagtggttgtgg

SEQ ID NO: 332618 - DNA, 75 bp, Artificial Sequence
  Synthetic
tgcactgcgtagaggcctcaccgtccgagagatggtgacaatttacttcctcttgttggtcttggagttggggtt

SEQ ID NO: 332619 - DNA, 75 bp, Artificial Sequence
  Synthetic
tttccactggtccggcatccttggtgtgatgggattgtggacgctgtcggaaatgctgaggacggctcggagatc

SEQ ID NO: 332620 - DNA, 75 bp, Artificial Sequence
  Synthetic
cagggccctactgggctgatgtcaaagaggacgttgtatgctatggtggagcctggagtcttgaggagaagtgga

SEQ ID NO: 332621 - DNA, 75 bp, Artificial Sequence
  Synthetic
gtggcctcggcctgctcggtctggagattgatcaggggacacagggaacagaaaggactgtcctggattgtccct

SEQ ID NO: 332622 - DNA, 75 bp, Artificial Sequence
  Synthetic
gattgatcaggggacacagggaacagaaaggactgtcctggattgtccctttggctggactaatggggggagagg

SEQ ID NO: 332623 - DNA, 75 bp, Artificial Sequence
  Synthetic
agacggtcatttagtgaaccactgactgtcgtgggagtcatgctgacactggctggcggcatgatgcgccacact

SEQ ID NO: 332624 - DNA, 75 bp, Artificial Sequence
  Synthetic
cgggtccggcaggattcaatgggaaacttccacctgacggagcttgagaaagaagagagagtgatggctttttgg

SEQ ID NO: 332625 - DNA, 75 bp, Artificial Sequence
  Synthetic
atgcaacctatgtcaacagacgcctgctcccgcaggggagacagaattgggaagtggcaatcatggatgaagccc

SEQ ID NO: 332626 - DNA, 75 bp, Artificial Sequence
  Synthetic
agtgatgggactatggacactatcagaaatgatgagatcggcccgaagatctgacttggtcttctccggacaggg

SEQ ID NO: 332627 - DNA, 75 bp, Artificial Sequence
  Synthetic
ttcgaggtcagggacggtgtctacaggatcttcagcccgggtctgctctggggccaacgtcaggtgggagtcgga

SEQ ID NO: 332628 - DNA, 75 bp, Artificial Sequence
  Synthetic
tatgaggggcgtaccgcatggttcgttccctcgattgcaaaaggtggcatcatagcccgcaccctgagacaaaaa

SEQ ID NO: 332629 - DNA, 75 bp, Artificial Sequence
  Synthetic
gcaggtccatattgggctgatgtcaaggaagacgttgtgtgctatggtggagcctggagcctggaggaaaaatgg

SEQ ID NO: 332630 - DNA, 75 bp, Artificial Sequence
  Synthetic
ggtgcatcagtgccagcctggagaactgctcttggacacagggagaaggatgggagcaataccgatagacctggc

SEQ ID NO: 332631 - DNA, 75 bp, Artificial Sequence
  Synthetic
ctgaatgctcagggagcagtggtgggactgtatggaaacggactgaaaaccaatgagacttatgtcagcagcatt

SEQ ID NO: 332632 - DNA, 75 bp, Artificial Sequence
  Synthetic
gactgtatggaaacggactgaaaaccaatgagacttatgtcagcagcattgctcaaggggaagctgaaaaaagcc

SEQ ID NO: 332633 - DNA, 75 bp, Artificial Sequence
  Synthetic
tctgggcgtcgcagcttcggagatgttctgacaggaatgtcgggagttcctgagcttttgcggcacagatgcgtc

SEQ ID NO: 332634 - DNA, 75 bp, Artificial Sequence
  Synthetic
gatgcatgaggagcctggcagcagggcaatgaagatggctgagagagatgctccagaggcctttttgacggtggt

SEQ ID NO: 332635 - DNA, 75 bp, Artificial Sequence
  Synthetic
caaatcacagtgctggacatgcacccaggctctgggaagacccacagagtcctcccggagctcatccgccaatgc

SEQ ID NO: 332636 - DNA, 75 bp, Artificial Sequence
  Synthetic
attgacagacgcctgaggactctggtgctggcaccaactcgcgtggtgctcaaggaaatggaacgtgcactgaat

SEQ ID NO: 332637 - DNA, 75 bp, Artificial Sequence
  Synthetic
gggaagagagtcaggtttcactctcccgcggtaagtgaccaacaagtgggaggggcaattgtcgatgtcatgtgt

SEQ ID NO: 332638 - DNA, 75 bp, Artificial Sequence
  Synthetic
tgatgctgggcacgctggtcctgctggcctccttgctactcttgtgggcaggtggcgtcggctatgggaatatgg

SEQ ID NO: 332639 - DNA, 75 bp, Artificial Sequence
  Synthetic
tgctcccacaggggagacaaaactgggaagtggcaattatggatgaagcccactggacggatccacacagcatag

SEQ ID NO: 332640 - DNA, 75 bp, Artificial Sequence
  Synthetic
cactggacggatccacacagcatagctgccaggggtcatttgtatactctggcaaaagaaaacaagtgcgctttg

SEQ ID NO: 332641 - DNA, 75 bp, Artificial Sequence
  Synthetic
ggaagagtgagcccttcccggagtccaatggagccatcaccagtgaagagaaacagatccctgagggagagtggc

SEQ ID NO: 332642 - DNA, 75 bp, Artificial Sequence
  Synthetic
gtgatgggtttgactggatcaccgagtatgaggggcgaaccgcctggtttgttccatcgattgcaaagggtggtg

SEQ ID NO: 332643 - DNA, 75 bp, Artificial Sequence
  Synthetic
agggaaaagcgtgatttgcttgaacagcaaaacctttgagaaggactacaccagagtgagggatgaaaagcctga

SEQ ID NO: 332644 - DNA, 75 bp, Artificial Sequence
  Synthetic
gaaatgggggccaatctcgacgtgagccgtgttatagatgggcgaacaaacatcaagccggaagaggttgacggg

SEQ ID NO: 332645 - DNA, 75 bp, Artificial Sequence
  Synthetic
gggcatagactctggctaagggcttctgggagtaggcgtggtggctctgagggggacactctcggtgacttgtgg

SEQ ID NO: 332646 - DNA, 75 bp, Artificial Sequence
  Synthetic
catcaagccggaagaggttgacgggagagttgagctcatcgggaccaggcgtgtgaccacggcctctgcagcaca

SEQ ID NO: 332647 - DNA, 75 bp, Artificial Sequence
  Synthetic
cactggcatcctggagacggaaagggacaaggcgcgggaactcctcaggagaggggagaccaacatggggctagc

SEQ ID NO: 332648 - DNA, 75 bp, Artificial Sequence
  Synthetic
cttctacggaccagaacaggacaagatgccagaggtggcaggccacttccgacttaccgaagagaagagaaagca

SEQ ID NO: 332649 - DNA, 75 bp, Artificial Sequence
  Synthetic
ggccctgaggaaaatgcagtggatgaggccaatggagacctggtcaccttcaggagcccaaatggggctgaaagg

SEQ ID NO: 332650 - DNA, 75 bp, Artificial Sequence
  Synthetic
cgcgcatgttcagagaaggacgtgacatcagagaatttgtggcgtacgcttcagggcggcgcagcatcggagacg

SEQ ID NO: 332651 - DNA, 75 bp, Artificial Sequence
  Synthetic
gtcaaggaaacttttggctcggtttggagaccagagagggccaaccagggtgcctgaacttgacctgggagttgg

SEQ ID NO: 332652 - DNA, 75 bp, Artificial Sequence
  Synthetic
tcagggcggcgcagcatcggagacgtgctgacaggaatgtcgggggtacccgagcttctgcgtcacagatgtgtc

SEQ ID NO: 332653 - DNA, 75 bp, Artificial Sequence
  Synthetic
gacaaggtgaaagaacaagacgtacaagagaggatcagagcgttgcgggagcaatacagcgaaacctggcacatg

SEQ ID NO: 332654 - DNA, 75 bp, Artificial Sequence
  Synthetic
tcaagaaaactcttggcccggttcggggaccagaggggacccaccagggtgcctgagctggacctcggagttggg

SEQ ID NO: 332655 - DNA, 75 bp, Artificial Sequence
  Synthetic
aaccctgggtgtcatctggtgcttcgttgtccggacatcgataagccgcatgatgctcggaacgctggtactgct

SEQ ID NO: 332656 - DNA, 75 bp, Artificial Sequence
  Synthetic
ggcctccctagcactcttgtgggctggtggtgtcagctacgggaacatggccggagtggccctcattttctacac

SEQ ID NO: 332657 - DNA, 75 bp, Artificial Sequence
  Synthetic
tgatcaatggagtcgtgaaacttctcagctggccatggaacgcgcgggaggatgtcgtgcgaatggccatgactg

SEQ ID NO: 332658 - DNA, 75 bp, Artificial Sequence
  Synthetic
gcaggaaaacagagaagcagtgatgacaacaagctggcttactttctgttgactctctgcagtctggctggattg

SEQ ID NO: 332659 - DNA, 75 bp, Artificial Sequence
  Synthetic
acaacaagctggcttactttctgttgactctctgcagtctggctggattggttgccgccaacgagatggggttcc

SEQ ID NO: 332660 - DNA, 75 bp, Artificial Sequence
  Synthetic
caaacatagacatccagccagcaaggtcctggggaacttatgtgttggtggtttctctcttcactccatacatca

SEQ ID NO: 332661 - DNA, 75 bp, Artificial Sequence
  Synthetic
tgaaggtcgcgaggccctcccgtgatggaggctgcatcatggatgtcatcacaagaagagaccaaagaggctcgg

SEQ ID NO: 332662 - DNA, 75 bp, Artificial Sequence
  Synthetic
ggagtggtgtcactggtaggggccacacccacctctttagtggtgggtgttgggttggccgcatttcacttggcc

SEQ ID NO: 332663 - DNA, 75 bp, Artificial Sequence
  Synthetic
caccctcaccaacataaaggtgcaactaatccgaatgatggaaggggaaggggtcatagaggcagcggatgcaca

SEQ ID NO: 332664 - DNA, 75 bp, Artificial Sequence
  Synthetic
ccaatggtggatggggacgtcatcaacccgtttggggaaggggagacaaaaccagccctgtatgagaggaaaatg

SEQ ID NO: 332665 - DNA, 75 bp, Artificial Sequence
  Synthetic
accagccctgtatgagaggaaaatgagcctggttctggcagtggtgctttgtctgatggcggtagtcatgaacag

SEQ ID NO: 332666 - DNA, 75 bp, Artificial Sequence
  Synthetic
accaggaaagacattggggagtgggagcattcggttggcttctcgaactgggaggaggttcccttctgctcacac

SEQ ID NO: 332667 - DNA, 75 bp, Artificial Sequence
  Synthetic
gtctgatggcggtagtcatgaacagaacggtggcttccatcacggaagcctcagccgtggggctggcggcagctg

SEQ ID NO: 332668 - DNA, 75 bp, Artificial Sequence
  Synthetic
atgggcgtgccctcatagtgccatgccgagaccaagatgaactggttggaagagcccgcgtctcaccagggtgcg

SEQ ID NO: 332669 - DNA, 75 bp, Artificial Sequence
  Synthetic
cacactgtggacaatgccagtggcatgtggcttgagcggcgtggtcaggggcagcctttgggggtttttgcccct

SEQ ID NO: 332670 - DNA, 75 bp, Artificial Sequence
  Synthetic
tgtggcttgagcggcgtggtcaggggcagcctttgggggtttttgccccttgggcaccgactctggcttcgggcc

SEQ ID NO: 332671 - DNA, 75 bp, Artificial Sequence
  Synthetic
agggagacacacttggtgatctctggaaacagagattgaacagctgcaccaaggaagaattctttgtctacaggc

SEQ ID NO: 332672 - DNA, 75 bp, Artificial Sequence
  Synthetic
cggtctcacgagggacggcaaaactggcctggctcgaggagcgtggctatgcaaccctcaagggggaagtggtgg

SEQ ID NO: 332673 - DNA, 75 bp, Artificial Sequence
  Synthetic
gaatggatgtctttagcatgcagccacatcgggctgacaccatcatgtgtgacatcggagaaagcagcccggatg

SEQ ID NO: 332674 - DNA, 75 bp, Artificial Sequence
  Synthetic
ccgctgtggagggtgagaggacaaggagagtgatattgctcatggagcaatggaaaaaccggaaccccacggcta

SEQ ID NO: 332675 - DNA, 75 bp, Artificial Sequence
  Synthetic
gagagtgatattgctcatggagcaatggaaaaaccggaaccccacggctacttgtgtgtttaaggtgctggcccc

SEQ ID NO: 332676 - DNA, 75 bp, Artificial Sequence
  Synthetic
gtggaggactggtgaggacccctttctcaaggaactcaacccatgaaatgtactactcaaccgctatcactggga

SEQ ID NO: 332677 - DNA, 75 bp, Artificial Sequence
  Synthetic
acatcgtgaactccgtcaacatccagtcaaggaaactcctagcccggtttggagaccagagaggacccaccaggg

SEQ ID NO: 332678 - DNA, 75 bp, Artificial Sequence
  Synthetic
gatggggattttgtggcatgccatagctggcactgccagaagccccgtcttgaagtctttctggaattcagttcc

SEQ ID NO: 332679 - DNA, 75 bp, Artificial Sequence
  Synthetic
ggcagtactggggcagttaccgaaatgcgccaactggctcagcggcgtctttgatcaatggagttgtgaaactcc

SEQ ID NO: 332680 - DNA, 75 bp, Artificial Sequence
  Synthetic
tgaagtctttctggaattcagtcccactgaaacaggccatggcagcactccggaaaattaaaaaggcagtgagca

SEQ ID NO: 332681 - DNA, 75 bp, Artificial Sequence
  Synthetic
cggaaaatcaagaaggcagtgagtaccttgatggtaggtttgcaaaaacgtgggaaacggaggtcggcaacagac

SEQ ID NO: 332682 - DNA, 75 bp, Artificial Sequence
  Synthetic
ccttgatggtaggtttgcaaaaacgtgggaaacggaggtcggcaacagactggacgagctggctgctggttgtta

SEQ ID NO: 332683 - DNA, 75 bp, Artificial Sequence
  Synthetic
tggcaaaagaaggtcagcagcagactggacaagttggttgctggttctggttctggtgggggtgacacttgcagc

SEQ ID NO: 332684 - DNA, 75 bp, Artificial Sequence
  Synthetic
aacagtgcggaaagaaagggacggcactaccgtgattagagctgaaggaaaggatgcagcaactcaggtgcgcgt

SEQ ID NO: 332685 - DNA, 75 bp, Artificial Sequence
  Synthetic
actaccgtgattagagctgaaggaaaggatgcagcaactcaggtgcgcgtggagaacggcacctgtgtgattttg

SEQ ID NO: 332686 - DNA, 75 bp, Artificial Sequence
  Synthetic
atgactggatcctggaacgactggcacaaaagagcaaaccacgaatgtgcagcaaagaggaattcatagcaaagg

SEQ ID NO: 332687 - DNA, 75 bp, Artificial Sequence
  Synthetic
acaaaagagcaaaccacgaatgtgcagcaaagaggaattcatagcaaaggtgaaatctagtgcggccctgggggc

SEQ ID NO: 332688 - DNA, 75 bp, Artificial Sequence
  Synthetic
tgaaatctagtgcggccctgggggcctggtccgatgagcagaacagatggtcaagtgcgaaagaggctgtggagg

SEQ ID NO: 332689 - DNA, 75 bp, Artificial Sequence
  Synthetic
gaccatagaccagggggaggaaccagttgacgtggattgcttttgcagaaatgtcgatggagtctacttggagta

SEQ ID NO: 332690 - DNA, 75 bp, Artificial Sequence
  Synthetic
tcaagtgcgaaagaggctgtggaggaccccgtcttctggcagcttgtggatgaggagagagagagacaccttgcc

SEQ ID NO: 332691 - DNA, 75 bp, Artificial Sequence
  Synthetic
gggagatgcgcccactgcgtgtacaacatgatgggcaagagagagaagaagcttggagagttcggagtggccaag

SEQ ID NO: 332692 - DNA, 75 bp, Artificial Sequence
  Synthetic
tcaagaacaagacgttcagtgttgatcccgtcccacgctcagggtgacctcacgggaagggggcacaaatggttg

SEQ ID NO: 332693 - DNA, 75 bp, Artificial Sequence
  Synthetic
acatgatgggcaagagagagaagaagcttggagagttcggagtggccaagggaagtcgagccatctggtacatgt

SEQ ID NO: 332694 - DNA, 75 bp, Artificial Sequence
  Synthetic
tcccgtcccacgctcagggtgacctcacgggaagggggcacaaatggttggagggagattcactgcgaactcacc

SEQ ID NO: 332695 - DNA, 75 bp, Artificial Sequence
  Synthetic
tgaagcactcggattcttgaatgaagaccattgggcctccagagagtccagtggagctggagtggaaggaataag

SEQ ID NO: 332696 - DNA, 75 bp, Artificial Sequence
  Synthetic
gaaaaacaaggcgctgaccctagcggtgattgccgtcgtgtggatgaccgtggaaagtgtggtgactaggaccgc

SEQ ID NO: 332697 - DNA, 75 bp, Artificial Sequence
  Synthetic
gaccattgggcctccagagagtccagtggagctggagtggaaggaataagcctgaactacctgggctggcactta

SEQ ID NO: 332698 - DNA, 75 bp, Artificial Sequence
  Synthetic
gctccggtttatgcctcacgatgcacccatctggaaaacagggattttgtcactggcactcaggggaccacacgt

SEQ ID NO: 332699 - DNA, 75 bp, Artificial Sequence
  Synthetic
tggctgggacaccaaggttaccaatgcagatctagaggatgaggagcaaatcttgcgttacttggagggtgaaca

SEQ ID NO: 332700 - DNA, 75 bp, Artificial Sequence
  Synthetic
caaaaggcataccacgcaaaagtggtgaaagttgccaggccctcccgtgatggaggctgcattatggatgttatc

SEQ ID NO: 332701 - DNA, 75 bp, Artificial Sequence
  Synthetic
gaagccctcgatggacgtgtggcttgactccatctaccaggagaatcctgccaaaacacgtgagtactgcctgca

SEQ ID NO: 332702 - DNA, 75 bp, Artificial Sequence
  Synthetic
gactccatctaccaggagaatcctgccaaaacacgcgagtactgtctccacgccaagttgtcggacaccaaggtt

SEQ ID NO: 332703 - DNA, 75 bp, Artificial Sequence
  Synthetic
tgaaagttgccaggccctcccgtgatggaggctgcattatggatgttatcacgaggagagaccagaggggatcag

SEQ ID NO: 332704 - DNA, 75 bp, Artificial Sequence
  Synthetic
ccgccacccttgctgaagagcaccagagcggtacagtgtgcaagagagaccagagtgatcgaggttggggaaatc

SEQ ID NO: 332705 - DNA, 75 bp, Artificial Sequence
  Synthetic
cacccttaccaacataaaggtgcaattgatccgaatgatggagggggagggagtcatagaggcagcagacgcaca

SEQ ID NO: 332706 - DNA, 75 bp, Artificial Sequence
  Synthetic
gagcggtacagtgtgcaagagagaccagagtgatcgaggttggggaaatcattgtggactgtttgggaaaggcag

SEQ ID NO: 332707 - DNA, 75 bp, Artificial Sequence
  Synthetic
tgtgaagcaaaaaagaaagccactggacatgtgtatgacgctaataagatcgtgtacacagtcaaggttgagcca

SEQ ID NO: 332708 - DNA, 75 bp, Artificial Sequence
  Synthetic
gacatgtgtatgacgctaataagatcgtgtacacagtcaaggttgagccacacacgggggactacgtcgctgcta

SEQ ID NO: 332709 - DNA, 75 bp, Artificial Sequence
  Synthetic
tctactttctgaatgacatggccaagaccaggaaggacattggagaatgggagcactcggtcggattttcgagtt

SEQ ID NO: 332710 - DNA, 75 bp, Artificial Sequence
  Synthetic
gaccaggaaggacattggagaatgggagcactcggtcggattttcgagttgggaggcggtcccattctgttcaca

SEQ ID NO: 332711 - DNA, 75 bp, Artificial Sequence
  Synthetic
agcgtccttcacggtttcctcggaaaagaccatattaaccatgggagactatggagatgtatccctgttgtgcag

SEQ ID NO: 332712 - DNA, 75 bp, Artificial Sequence
  Synthetic
aagaccatattaaccatgggagactatggagatgtatccctgttgtgcagagtggccagcggcgttgacctggct

SEQ ID NO: 332713 - DNA, 75 bp, Artificial Sequence
  Synthetic
gatgggcgtgccctgattgtgccgtgccgagaccaggatgaactggttgggagggctcgcgtctcaccgggctgc

SEQ ID NO: 332714 - DNA, 75 bp, Artificial Sequence
  Synthetic
gccgagaccaggatgaactggttgggagggctcgcgtctcaccgggctgcggctggagtgtccgcgagactgctt

SEQ ID NO: 332715 - DNA, 75 bp, Artificial Sequence
  Synthetic
agacctcggaacacctgccgacagcatggcaggttcatcgagactggttcaatgacctggctctgccatggagac

SEQ ID NO: 332716 - DNA, 75 bp, Artificial Sequence
  Synthetic
atggcaggttcatcgagactggttcaatgacctggctctgccatggagacacgaaggggtacagaactggaacaa

SEQ ID NO: 332717 - DNA, 75 bp, Artificial Sequence
  Synthetic
gtggctgctgagctatttccatcggcgtgacctgaggacacttgggctcgccatttgctcggcggtgcccgtgga

SEQ ID NO: 332718 - DNA, 75 bp, Artificial Sequence
  Synthetic
gctccgcatgccgtaaagatggacgtctacaaccttggggaccagactggagtattgctgaaatcactcgctggc

SEQ ID NO: 332719 - DNA, 75 bp, Artificial Sequence
  Synthetic
cgtgacctgaggacacttgggctcgccatttgctcggcggtgcccgtggactgggtccccaccggccgtacaacc

SEQ ID NO: 332720 - DNA, 75 bp, Artificial Sequence
  Synthetic
tctacaaccttggggaccagactggagtattgctgaaatcactcgctggcgttcctgtggcgcacattgatggaa

SEQ ID NO: 332721 - DNA, 75 bp, Artificial Sequence
  Synthetic
tggagcattcatgccagtggagcttggatgaccacagaggacatgctggatgtctggaaccgagtgtggattctg

SEQ ID NO: 332722 - DNA, 75 bp, Artificial Sequence
  Synthetic
tgtctggaaccgagtgtggattctggacaaccccttcatgcagaacaaggaaaaggtcacagagtggagagacat

SEQ ID NO: 332723 - DNA, 75 bp, Artificial Sequence
  Synthetic
cgtgacatgcgaggtggggctggaaaagctcaagatgaaaggcctcacatacacagtgtgtgacaagacgaaatt

SEQ ID NO: 332724 - DNA, 75 bp, Artificial Sequence
  Synthetic
aagctcaagatgaaaggcctcacatacacagtgtgtgacaagacgaaatttacatggaagagaaccccaacagac

SEQ ID NO: 332725 - DNA, 75 bp, Artificial Sequence
  Synthetic
acacaatgtgcgacaagacgaaattcacgtggaagagaattccaactgacagtggacatgacacagtggtcatgg

SEQ ID NO: 332726 - DNA, 75 bp, Artificial Sequence
  Synthetic
ggaaggagagggctgagtgggccaagaacatttggggagcggtggaaaaggtcaggaaaatgatagggcctgaaa

SEQ ID NO: 332727 - DNA, 75 bp, Artificial Sequence
  Synthetic
aagttgcgttctctggaaccaaaccctgcaggatcccagtgagggcagttgcgcacggttctcccgacgtgaatg

SEQ ID NO: 332728 - DNA, 75 bp, Artificial Sequence
  Synthetic
ctgcaggatcccagtgagggcagttgcgcacggttctcccgacgtgaatgtggctatgttgattacgcccaaccc

SEQ ID NO: 332729 - DNA, 75 bp, Artificial Sequence
  Synthetic
gtcaggaaaatgatagggcctgaaaagtttagggactacctttcctgcatggaccgacatgacttgcactgggag

SEQ ID NO: 332730 - DNA, 75 bp, Artificial Sequence
  Synthetic
ttcatagagatgcagttacctccaggggataacatcatctatgtcggggaacttagtcaccaatggttccagaag

SEQ ID NO: 332731 - DNA, 75 bp, Artificial Sequence
  Synthetic
gggataacatcatctatgtcggggaacttagtcaccaatggttccagaaggggagcagcattggaagggtcttcc

SEQ ID NO: 332732 - DNA, 75 bp, Artificial Sequence
  Synthetic
gagacaatatcatctatgtcggggaactgagtcaccaatggttccaaaaagggagtagcattggaagggtctttc

SEQ ID NO: 332733 - DNA, 75 bp, Artificial Sequence
  Synthetic
actgacagtgattggagaacacgcctgggatttcggctccactggtggttttctggcttcggttggcaaggcgtt

SEQ ID NO: 332734 - DNA, 75 bp, Artificial Sequence
  Synthetic
tgggatttcggctccactggtggttttctggcttcggttggcaaggcgttgcacacagtccttggaggagccttc

SEQ ID NO: 332735 - DNA, 75 bp, Artificial Sequence
  Synthetic
actgacagtgatcggagaacacgcctgggattttggctcaactggtggattcctgacttcggttggtaaggcgct

SEQ ID NO: 332736 - DNA, 75 bp, Artificial Sequence
  Synthetic
tcttgcccaagattttgattggagcagccttggcctggttgggcttgaacatgcggaacccaaccatgtccatga

SEQ ID NO: 332737 - DNA, 75 bp, Artificial Sequence
  Synthetic
aatggtcgatcccgacgtagggcactctgtaaaactttgtgagaccccctgcatcatgacaaggcctaacatgat

SEQ ID NO: 332738 - DNA, 75 bp, Artificial Sequence
  Synthetic
gcatcatgacaaggcctaacatgatgcacgaaagggaggcccccggaagcgagcttccgggaggagggaagggag

SEQ ID NO: 332739 - DNA, 75 bp, Artificial Sequence
  Synthetic
agccttggcctggttgggcttgaacatgcggaacccaaccatgtccatgagctttctcctggctggggggctagt

SEQ ID NO: 332740 - DNA, 75 bp, Artificial Sequence
  Synthetic
gctgacgttggttgcgctgtggacactgaacggatggagctccgatgtggtgagggactggttgtgtggagggaa

SEQ ID NO: 332741 - DNA, 75 bp, Artificial Sequence
  Synthetic
tctggccatgacactcggagtcggagctgatgttggctgtgctgtggacaccgaacggatggagctccgttgtgg

SEQ ID NO: 332742 - DNA, 75 bp, Artificial Sequence
  Synthetic
ctgaacggatggagctccgatgtggtgagggactggttgtgtggagggaagtctcagagtggtatgacaactatg

SEQ ID NO: 332743 - DNA, 75 bp, Artificial Sequence
  Synthetic
tgagggtctggttgtgtggagggaggtttccgagtggtatgacaattatgcatactaccctgagacaccaggagc

SEQ ID NO: 332744 - DNA, 75 bp, Artificial Sequence
  Synthetic
tcttgcctcagccataaaggaagcctttgaggagggaacctgtggcatagtaccccaaaatagacttgaaatggc

SEQ ID NO: 332745 - DNA, 75 bp, Artificial Sequence
  Synthetic
tgcttcggacagcattagcagcggttggtttgaaagagatattcttttgtttctaccagtcgtgaacgtgttgag

SEQ ID NO: 332746 - DNA, 75 bp, Artificial Sequence
  Synthetic
tttgaggagggaacctgtggcatagtaccccaaaatagacttgaaatggccatgtggaggagctcagcgacagaa

SEQ ID NO: 332747 - DNA, 75 bp, Artificial Sequence
  Synthetic
ttcgaggagggaacttgtggcatagtgccccaaaacagacttgaaatggccatgtggagaagctcggcgacagaa

SEQ ID NO: 332748 - DNA, 75 bp, Artificial Sequence
  Synthetic
acgcaaatctcacagtggtggtggacaaactcgaccccactgattaccgaggcggcatccctggcctgttaaaga

SEQ ID NO: 332749 - DNA, 75 bp, Artificial Sequence; identical to SEQ ID NO: 330953
  Synthetic

SEQ ID NO: 332750 - DNA, 75 bp, Artificial Sequence
  Synthetic
caaactcgaccccactgattaccgaggcggcatccctggcctgttaaagaaggggaaagacataaaggtttcttg

SEQ ID NO: 332751 - DNA, 75 bp, Artificial Sequence
  Synthetic
tggagcatccccgaggcttcccgccgttttatggtgggaacagagggaagcaatgagtgtccactagaaagaagg

SEQ ID NO: 332752 - DNA, 75 bp, Artificial Sequence
  Synthetic
tgccgtagctggcaccgcgagaaaccccgtattgaaggcgttctggaactcagtccctctgaaacaggccacagc

SEQ ID NO: 332753 - DNA, 75 bp, Artificial Sequence
  Synthetic
caatgagtgtccactagaaagaaggaaaacaggtgtcttcacagtggcagaattcggggttggcttgagaacaaa

SEQ ID NO: 332754 - DNA, 75 bp, Artificial Sequence
  Synthetic
gtgagtgccctaatggttggcttgcaaaaacgtgggaaaaggaggtcagcgacggactggatgagctggttgctg

SEQ ID NO: 332755 - DNA, 75 bp, Artificial Sequence
  Synthetic
gtcattactctgttggggatgacgcttgctgcaacggtgaggaaagaaagggacggctcaactgtgatcagagct

SEQ ID NO: 332756 - DNA, 75 bp, Artificial Sequence
  Synthetic
acacaggcacctacatagtggaacttctagttacagacttgaggaactgctcgtggccagccagccacaccatcg

SEQ ID NO: 332757 - DNA, 75 bp, Artificial Sequence
  Synthetic
tctagttacagacttgaggaactgctcgtggccagccagccacaccatcgacaatgctgaggtggtggactctga

SEQ ID NO: 332758 - DNA, 75 bp, Artificial Sequence
  Synthetic
gatcctggctactgacatggggtcatggtgtgatgattcactgtcctatgagtgtgtgaccatagatcaaggaga

SEQ ID NO: 332759 - DNA, 75 bp, Artificial Sequence
  Synthetic
tggtgtgatgattcactgtcctatgagtgtgtgaccatagatcaaggagaagagcctgttgacgtggattgtttt

SEQ ID NO: 332760 - DNA, 75 bp, Artificial Sequence
  Synthetic
tacctgggtattcagaacaagtgaaaggaccatggaagtactcgcccattcgagtcacaagagaagagtgccccg

SEQ ID NO: 332761 - DNA, 75 bp, Artificial Sequence
  Synthetic
ggaaggctcacggacaaggcgctcagtgctgatcccgtcccatgctcagggagagctgacggggaggggacacaa

SEQ ID NO: 332762 - DNA, 75 bp, Artificial Sequence
  Synthetic
ttgtgataaaaggggggcctctgtgaggagcaccacagagagtggcaaggtgataccggagtggtgttgccgaac

SEQ ID NO: 332763 - DNA, 75 bp, Artificial Sequence
  Synthetic
gagagctgacggggaggggacacaaatggctagaaggagactcgctgcgaacacacctcactagagttgagggat

SEQ ID NO: 332764 - DNA, 75 bp, Artificial Sequence
  Synthetic
aggagcaccacagagagtggcaaggtgataccggagtggtgttgccgaacgtgcacactgcccccagtgacattt

SEQ ID NO: 332765 - DNA, 75 bp, Artificial Sequence
  Synthetic
ccatggaaatacgcccagttcacgaccagggagggctcgtgcgctcaatggtggtggcggataacggagagctgt

SEQ ID NO: 332766 - DNA, 75 bp, Artificial Sequence
  Synthetic
ccagggagggctcgtgcgctcaatggtggtggcggataacggagagctgttaagtgaaggtggggttcccggaat

SEQ ID NO: 332767 - DNA, 75 bp, Artificial Sequence
  Synthetic
tatgtcatccggaggaggccagccactggaacaacagccatgtggggaggcatcgtcgtccttgcactactcgtc

SEQ ID NO: 332768 - DNA, 75 bp, Artificial Sequence
  Synthetic
ctggaacaacagccatgtggggaggcatcgtcgtccttgcactactcgtcaccggtttggtaaagatcgagagct

SEQ ID NO: 332769 - DNA, 75 bp, Artificial Sequence
  Synthetic
gattacattccatcttgagctggggccagagatcgtggctctgacgctgcttcaggctgtgttcgagttgagggt

SEQ ID NO: 332770 - DNA, 75 bp, Artificial Sequence
  Synthetic
ccagagatcgtggctctgacgctgcttcaggctgtgttcgagttgagggtgggcctgcttagcgcttttgcattg

SEQ ID NO: 332771 - DNA, 75 bp, Artificial Sequence
  Synthetic
tggtaaccatttacttccttctgctggtcttggagctgggattgccgggcgaaggccttggggggctctggaaat

SEQ ID NO: 332772 - DNA, 75 bp, Artificial Sequence
  Synthetic
ggtcttggagctgggattgccgggcgaaggccttggggggctctggaaatggggtgacgccctggccatgggggc

SEQ ID NO: 332773 - DNA, 75 bp, Artificial Sequence
  Synthetic
gccacaggacatgtgtacgacgccaacaaaatagtgtacacggtcaaagtcgaaccacacacgggagactatgtt

SEQ ID NO: 332774 - DNA, 75 bp, Artificial Sequence
  Synthetic
gagggaaagactggtgttggactcctgctcatggctctcatgacacagcaggacctcgcgatcgcacactatgga

SEQ ID NO: 332775 - DNA, 75 bp, Artificial Sequence
  Synthetic
tgctcatggctctcatgacacagcaggacctcgcgatcgcacactatggactcatgctctttttgggtgtggctt

SEQ ID NO: 332776 - DNA, 75 bp, Artificial Sequence
  Synthetic
ccgaggacatagagaacaaaaggggttgtcctggattgtccccatggccaggttacttggaggagagggctctgg

SEQ ID NO: 332777 - DNA, 75 bp, Artificial Sequence
  Synthetic
catgttgttcaatctggaaactgattcgaggacacagagaacagaagggactgacttgggttgtccccctggccg

SEQ ID NO: 332778 - DNA, 75 bp, Artificial Sequence
  Synthetic
ttgtcctggattgtccccatggccaggttacttggaggagagggctctggaatcagattgctggctttctgggag

SEQ ID NO: 332779 - DNA, 75 bp, Artificial Sequence
  Synthetic
cttttagcgaaccgttgaccgttgtgggagtcatgctcaccttggccagcggcatgatgcggcacacctctcagg

SEQ ID NO: 332780 - DNA, 75 bp, Artificial Sequence
  Synthetic
cattcagtgaaccactgactgttgtgggagtcatgctaaccctggccagcggcatgatgcggcacacctctcagg

SEQ ID NO: 332781 - DNA, 75 bp, Artificial Sequence
  Synthetic
atttggggctcctcacgctgtcaagatggacgtgtacaacctcggagaccagactggagtgttactgaaggctct

SEQ ID NO: 332782 - DNA, 75 bp, Artificial Sequence
  Synthetic
ctcattccttctgctcatgctggtgctggggacaaggaagatgcaattggtggctgaatggagtggctgtgtgga

SEQ ID NO: 332783 - DNA, 75 bp, Artificial Sequence
  Synthetic
ctggggacaaggaagatgcaattggtggctgaatggagtggctgtgtggagtggcacccagagctaatgaatgaa

SEQ ID NO: 332784 - DNA, 75 bp, Artificial Sequence
  Synthetic
tggctgaatggagtggctgtgtggagtggcacccagaactgatgaatgaaggtggagaggtgagcctgcgggtcc

SEQ ID NO: 332785 - DNA, 75 bp, Artificial Sequence
  Synthetic
ggattgtggacactgtcagaaatgctgaggacggctcggagatcagacttggtcttttctggacaggggagagga

SEQ ID NO: 332786 - DNA, 75 bp, Artificial Sequence
  Synthetic
ggcagtggcacatggatctccagatgtgaacgtggccatgctgataacgccaaacccaacaattgaaaacaatgg

SEQ ID NO: 332787 - DNA, 75 bp, Artificial Sequence
  Synthetic
tgaggacggctcggagatcagacttggtcttttctggacaggggagaggagagcgcggtgacaagccttttgagg

SEQ ID NO: 332788 - DNA, 75 bp, Artificial Sequence
  Synthetic
cccccaggggataacatcatctatgttggggaactgagtcatcaatggttccaaaaagggagcagcatcggaagg

SEQ ID NO: 332789 - DNA, 75 bp, Artificial Sequence
  Synthetic
cagtccggggctgttctgggggcagcgccaggtgggagttggctacggctctaagggtgtcctacacacgatgtg

SEQ ID NO: 332790 - DNA, 75 bp, Artificial Sequence
  Synthetic
cgccaggtgggagttggctacggctctaagggtgtcctacacacgatgtggcacgtgacgagaggagcggcgctg

SEQ ID NO: 332791 - DNA, 75 bp, Artificial Sequence
  Synthetic
tagaaagactgacagtgataggagagcacgcctgggacttcggttctgctggaggctttctaagttcaattggga

SEQ ID NO: 332792 - DNA, 75 bp, Artificial Sequence
  Synthetic
cctactgggctgatgtcagggaggatgttgtgtgttacggtggtgcctggagccttgaggaaaagtggagaggtg

SEQ ID NO: 332793 - DNA, 75 bp, Artificial Sequence
  Synthetic
tgttgtgtgttacggtggtgcctggagccttgaggaaaagtggagaggtgagacagtgcaggtccatgccttccc

SEQ ID NO: 332794 - DNA, 75 bp, Artificial Sequence
  Synthetic
cagtgccagcccggggagctgcttctggacacagggaggaggataggggcagtaccaattgacctggcaaaggga

SEQ ID NO: 332795 - DNA, 75 bp, Artificial Sequence
  Synthetic
accggggagagcccatgaggtgcatcaatgtcagcccggggaactgctcctggacacaggtaggaggataggggc

SEQ ID NO: 332796 - DNA, 75 bp, Artificial Sequence
  Synthetic
tccatgagctttctcttggctggaggtctggtcttggccatgacccttggagtgggggcggatgttggctgcgct

SEQ ID NO: 332797 - DNA, 75 bp, Artificial Sequence
  Synthetic
tggacacagggaggaggataggggcagtaccaattgacctggcaaagggaacctctggcagccccatccttaact

SEQ ID NO: 332798 - DNA, 75 bp, Artificial Sequence
  Synthetic
agtgggggcggatgttggctgcgctgtggacacggaacgaatggagctccgctgtggcgagggcctggtcgtgtg

SEQ ID NO: 332799 - DNA, 75 bp, Artificial Sequence
  Synthetic
tgggaatggactgaaaaccaatgaaacctatgtcagcagtattgctcagggtgaagccgagaaaagtcgacccaa

SEQ ID NO: 332800 - DNA, 75 bp, Artificial Sequence
  Synthetic
acctatgtcagcagtattgctcagggtgaagccgagaaaagtcgacccaatcttccacaggcggttactggcaca

SEQ ID NO: 332801 - DNA, 75 bp, Artificial Sequence
  Synthetic
gagagaggtctcagaatggtatgacaactatgcctactacccggagacaccgggggcccttgcatcagccataaa

SEQ ID NO: 332802 - DNA, 75 bp, Artificial Sequence
  Synthetic
tgggaatggactgaagaccaatgaaacctacgtcagcagcattgctcagggtgaggctgaaaaaagtcgacccaa

SEQ ID NO: 332803 - DNA, 75 bp, Artificial Sequence
  Synthetic
ggcgtagtcccccagaacaggctcgagatggccatgtggagaagctcggtcacagagctgaatctggctctggcg

SEQ ID NO: 332804 - DNA, 75 bp, Artificial Sequence
  Synthetic
tgggaagacccacagagtcctcccggagctcatccgccaatgcattgacagacgcctgagaacgctagtgctggc

SEQ ID NO: 332805 - DNA, 75 bp, Artificial Sequence
  Synthetic
tggtggacaagtttgaccccactgactaccgaggtggtgtccctggtttactgaaaaaaggaaaggacataaaag

SEQ ID NO: 332806 - DNA, 75 bp, Artificial Sequence
  Synthetic
ctaccgaggtggtgtccctggtttactgaaaaaaggaaaggacataaaagtctcctggaaaagctggggccattc

SEQ ID NO: 332807 - DNA, 75 bp, Artificial Sequence
  Synthetic
atggagcgtgcgctgagtgggaagagagtcaggttccactctcccgcggttggagaccaacaggtgggaggggct

SEQ ID NO: 332808 - DNA, 75 bp, Artificial Sequence
  Synthetic
tctcctggaaaagctggggccattcaatgatctggagcattcctgaggccccccgtcgtttcatggtgggcacgg

SEQ ID NO: 332809 - DNA, 75 bp, Artificial Sequence
  Synthetic
gagtcaggttccactctcccgcggttggagaccaacaggtgggaggggctatcgtcgacgtgatgtgtcatgcaa

SEQ ID NO: 332810 - DNA, 75 bp, Artificial Sequence
  Synthetic
gcaatcatggatgaagcccattggacagatccacacagcatagctgctaggggtcacctgtacacattggccaaa

SEQ ID NO: 332811 - DNA, 75 bp, Artificial Sequence
  Synthetic
gagacggaagacaggtgttttcacggtggcagaattcggggttggcctgagaacaaaggtcttcttggatttcag

SEQ ID NO: 332812 - DNA, 75 bp, Artificial Sequence
  Synthetic
gggtcacctgtacaccttggccaaggaaaataaatgtgccctggttcttatgacagcaacgccacccgggaagag

SEQ ID NO: 332813 - DNA, 75 bp, Artificial Sequence
  Synthetic
tgacggcaacgccccccggaaagagtgagcccttcccagaatctaacggggcaatcacaagtgaagagaagcaga

SEQ ID NO: 332814 - DNA, 75 bp, Artificial Sequence
  Synthetic
acaggagtgatgggagctgccgtcaagaacggcatggcaatccacacagatcaaagtctctggatgagatcaatg

SEQ ID NO: 332815 - DNA, 75 bp, Artificial Sequence
  Synthetic
tgagcccttcccagaatctaacggggcaatcacaagtgaagagaagcagatccctgatggagagtggcgtgacgg

SEQ ID NO: 332816 - DNA, 75 bp, Artificial Sequence
  Synthetic
gggcgcaccgcatggttcgtcccctcgattgcaaagggtggcgtcattgcccgcaccttgagacagaaagggaaa

SEQ ID NO: 332817 - DNA, 75 bp, Artificial Sequence
  Synthetic
cgattgcaaagggtggcgtcattgcccgcaccttgagacagaaagggaaaagcgtgatctgcctgaatagcaaga

SEQ ID NO: 332818 - DNA, 75 bp, Artificial Sequence
  Synthetic
cctggcaggacccagatcctggtacaacaggatacccggttattcagaacaggtgaaagggccatggaagcacac

SEQ ID NO: 332819 - DNA, 75 bp, Artificial Sequence
  Synthetic
aagagatgaaaagcccgacttcgtggtaacaacggatatttctgaaatgggggccaaccttgatgtgagccgtgt

SEQ ID NO: 332820 - DNA, 75 bp, Artificial Sequence
  Synthetic
aggtgaaagggccatggaagcacacgcctatccgagtcatcagagaggagtgtcccggcacgaccgttaccatca

SEQ ID NO: 332821 - DNA, 75 bp, Artificial Sequence
  Synthetic
tgtcccggcacgaccgttaccatcaacgccaagtgtgacaaaagaggagcatctgtgaggagtaccacagagagt

SEQ ID NO: 332822 - DNA, 75 bp, Artificial Sequence
  Synthetic
ggcaaggttatcccagaatggtgctgccgagcgtgcacaatgccaccagtgacgttccggactggaactgattgc

SEQ ID NO: 332823 - DNA, 75 bp, Artificial Sequence
  Synthetic
gggagagtcggcagacaagaaggacgaacagatgagtacatatactctggacagtgtgatgatgatgacagtgga

SEQ ID NO: 332824 - DNA, 75 bp, Artificial Sequence
  Synthetic
gaacagatgagtacatatactctggacagtgtgatgatgatgacagtggactggtgcaatggaaggaggcgcaga

SEQ ID NO: 332825 - DNA, 75 bp, Artificial Sequence
  Synthetic
tccatgaccagggggggcttgttcgctcaatggtggttgcggacaacggtgaattacttagtgagggaggggtcc

SEQ ID NO: 332826 - DNA, 75 bp, Artificial Sequence
  Synthetic
gcggggacctgtggccaccttttatggaccagagcaggacaggatgccggaggtagcaggtcacttccggctcac

SEQ ID NO: 332827 - DNA, 75 bp, Artificial Sequence
  Synthetic
ccggaatagtggcattgtttgtggtccttgaatacatcatccgtaggagaccctccacgggaacaacggttgtgt

SEQ ID NO: 332828 - DNA, 75 bp, Artificial Sequence
  Synthetic
ccttgaatacatcatccgtaggagaccctccacgggaacaacggttgtgtgggggggcatcgtcgtactcgctct

SEQ ID NO: 332829 - DNA, 75 bp, Artificial Sequence
  Synthetic
ggaccagagcaggacaggatgccggaggtagcaggtcacttccggctcaccgaagagaaaaggaagcattttcgg

SEQ ID NO: 332830 - DNA, 75 bp, Artificial Sequence
  Synthetic
cgccgtggttggcatggcatgtagcggcaaatgtgtctagtgtgacaagccgaagctggacgtgggagggtcctg

SEQ ID NO: 332831 - DNA, 75 bp, Artificial Sequence
  Synthetic
gagagcctggtgcgctatgtggtggcagtggggatcacattccaccttgagctaggaccagagatcgtggccttg

SEQ ID NO: 332832 - DNA, 75 bp, Artificial Sequence
  Synthetic
catcttctcacccattgtgacttcacgccatggttggcatggcacgtcgcagcaaacgtgtctagtgtgacaagt

SEQ ID NO: 332833 - DNA, 75 bp, Artificial Sequence
  Synthetic
ggcaaatgtgtctagtgtgacaagccgaagctggacgtgggagggtcctgaggagaatgcagtggatgaggccaa

SEQ ID NO: 332834 - DNA, 75 bp, Artificial Sequence
  Synthetic
ccgaatggagctgaaagaacactgaggccagtgtggagagatgcgcgcatgttcagagaaggacgtgacatcaga

SEQ ID NO: 332835 - DNA, 75 bp, Artificial Sequence
  Synthetic
tggcatgtctggggttcctgagcttctgcgccatagatgtgtcagcgccatggacgttttctacacactaatgca

SEQ ID NO: 332836 - DNA, 75 bp, Artificial Sequence
  Synthetic
ctgcgccatagatgtgtcagcgccatggacgttttctacacactaatgcatgaggaacctggtagcagggcaatg

SEQ ID NO: 332837 - DNA, 75 bp, Artificial Sequence
  Synthetic
cacggcagaaggaaagactggagcggggctcttgctcatggctctcatgacacagcaggatgtggtgactgtgca

SEQ ID NO: 332838 - DNA, 75 bp, Artificial Sequence
  Synthetic
cacagcaggatgtggtgactgtgcatcatggactggtgtgctttctgagtgtagcttcggcttgctcggtctgga

SEQ ID NO: 332839 - DNA, 75 bp, Artificial Sequence
  Synthetic
aggctttcctgacgatggcggaaatgctggtattgggcctggccactcttggtgtcgtgtggtgtttcgttgttc

SEQ ID NO: 332840 - DNA, 75 bp, Artificial Sequence
  Synthetic
gtagcttcggcttgctcggtctggaggctgctcaagggacacagagagcagaagggattgacctggattgtcccc

SEQ ID NO: 332841 - DNA, 75 bp, Artificial Sequence
  Synthetic
ggctgctcaagggacacagagagcagaagggattgacctggattgtccccctggctagattgcttgggggagagg

SEQ ID NO: 332842 - DNA, 75 bp, Artificial Sequence
  Synthetic
gctggtattgggcctggccactcttggtgtcgtgtggtgtttcgttgttcgcacctcaatcagccgcatgatgct

SEQ ID NO: 332843 - DNA, 75 bp, Artificial Sequence
  Synthetic
gctctggaatcaggctgctggcgttttgggagctggcagctcacagaggaagacgatctttcagtgaaccactaa

SEQ ID NO: 332844 - DNA, 75 bp, Artificial Sequence
  Synthetic
ttggcgctcttgtgggctggcggagtcagttatgggaacatggcaggagtggctctcattttctacacgctgctc

SEQ ID NO: 332845 - DNA, 75 bp, Artificial Sequence
  Synthetic
tcagttatgggaacatggcaggagtggctctcattttctacacgctgctcacggtgcttcagcctgaggcgggga

SEQ ID NO: 332846 - DNA, 75 bp, Artificial Sequence
  Synthetic
gctggcttacttcctgttgacgctctgcagcctggctggactggttgccgccaatgagatgggattcttggagag

SEQ ID NO: 332847 - DNA, 75 bp, Artificial Sequence
  Synthetic
cagtggcctcgtttctcttgttgatgctggtgctggggacaagaaagatgcagctggttgccgaatggagtggct

SEQ ID NO: 332848 - DNA, 75 bp, Artificial Sequence
  Synthetic
gctggtgctggggacaagaaagatgcagctggttgccgaatggagtggctgcgtggaatggcatccggaactagt

SEQ ID NO: 332849 - DNA, 75 bp, Artificial Sequence
  Synthetic
tgcagcctggctggactggttgccgccaatgagatgggattcttggagaggaccaaggcggacctgtccacagtg

SEQ ID NO: 332850 - DNA, 75 bp, Artificial Sequence
  Synthetic
ggtcgtggggtgagtggacgaacatagatatccagccggcgaggtcttggggaacctacgtgctggtggtctccc

SEQ ID NO: 332851 - DNA, 75 bp, Artificial Sequence
  Synthetic
agatatccagccggcgaggtcttggggaacctacgtgctggtggtctccctcttcacaccatacataatccacca

SEQ ID NO: 332852 - DNA, 75 bp, Artificial Sequence
  Synthetic
gttaatagtgctgtggcaaccggggcacaggccatgagggacctcggggggggtgctccattcttcggagtggca

SEQ ID NO: 332853 - DNA, 75 bp, Artificial Sequence
  Synthetic
cacaggccatgagggacctcggggggggtgctccattcttcggagtggcagggcacgtaatggccttgggagtgg

SEQ ID NO: 332854 - DNA, 75 bp, Artificial Sequence
  Synthetic
ttcgaggttaaggacggtgtctacaggattttcagccccggcttgttctggggtcagaaccaagtgggagttggc

SEQ ID NO: 332855 - DNA, 75 bp, Artificial Sequence
  Synthetic
ctccctggtggtgggtgttggcctggctgcgttccacctggccattgtggtgtccggactagaggccgaattaac

SEQ ID NO: 332856 - DNA, 75 bp, Artificial Sequence
  Synthetic
gctgcgttccacctggccattgtggtgtccggactagaggccgaattaacacaaagagcccacaaggtcttcttc

SEQ ID NO: 332857 - DNA, 75 bp, Artificial Sequence
  Synthetic
tggatggggatgtcattaatccatttggggaaggggaggcaaaacctgctttgtacgaaagaaagatgagcctgg

SEQ ID NO: 332858 - DNA, 75 bp, Artificial Sequence
  Synthetic
tggggaaggggaggcaaaacctgctttgtacgaaagaaagatgagcctggtcttggcgatagtgctttgcttgat

SEQ ID NO: 332859 - DNA, 75 bp, Artificial Sequence
  Synthetic
ccttccatcacagaggcttcggccgtggggctggcagcagtgggtcaactgctcagaccggaggcagacacgctg

SEQ ID NO: 332860 - DNA, 75 bp, Artificial Sequence
  Synthetic
tggggctggcagcagtgggtcaactgctcagaccggaggcagacacgctgtggacgatgcctgtggcttgtggct

SEQ ID NO: 332861 - DNA, 75 bp, Artificial Sequence
  Synthetic
ttgattcttgacaccggaaggaagcttggggcaataccaattgatttggtaaaaggaacatcaggcagccccatt

SEQ ID NO: 332862 - DNA, 75 bp, Artificial Sequence
  Synthetic
ctggggtttcttaccccttgggcacagactctggctcagggcctctgggagcaggcgcggcggctccgatggaga

SEQ ID NO: 332863 - DNA, 75 bp, Artificial Sequence
  Synthetic
agactctggctcagggcctctgggagcaggcgcggcggctccgatggagacactctcggtgacttatggaaacgg

SEQ ID NO: 332864 - DNA, 75 bp, Artificial Sequence
  Synthetic
taatgagacctacgtcagcagcattgctcagggggaagcggagaagagtcgacccaacctcccacaggctgttgt

SEQ ID NO: 332865 - DNA, 75 bp, Artificial Sequence
  Synthetic
gacccaacctcccacaggctgttgtgggcacgggctggacatcaaagggtcagatcacagtgctggacatgcacc

SEQ ID NO: 332866 - DNA, 75 bp, Artificial Sequence
  Synthetic
agttctttgcctataggcgcactggcatcttggagacagaacgggacaaggcgagggaactcctgaggagaggag

SEQ ID NO: 332867 - DNA, 75 bp, Artificial Sequence
  Synthetic
catcttggagacagaacgggacaaggcgagggaactcctgaggagaggagagaccaacatggggctggccgtctc

SEQ ID NO: 332868 - DNA, 75 bp, Artificial Sequence
  Synthetic
cttgaggaaagaggttatgcgactctcaagggtgaagtggtggaccttggatgtggaagaggtggctggtcctac

SEQ ID NO: 332869 - DNA, 75 bp, Artificial Sequence
  Synthetic
caaagaaatggagcgcgccttgaatgggaaacgggtcaggttccactcaccagcagtcagtgaccaacaggctgg

SEQ ID NO: 332870 - DNA, 75 bp, Artificial Sequence
  Synthetic
tcaagggtgaggtcgtggaccttggatgtggaagaggcggctggtcctactatgcggcctctcgaccggctgtca

SEQ ID NO: 332871 - DNA, 75 bp, Artificial Sequence
  Synthetic
tgaatgtcagagcatacacaataggcgggaaaggacatgagaccccaaagatggtgacaagcctgggttggaacc

SEQ ID NO: 332872 - DNA, 75 bp, Artificial Sequence
  Synthetic
tggaaagggacacgagaccccaaagatggtgacaagcctgggttggaacctgatcaagttcagagcgggaatgga

SEQ ID NO: 332873 - DNA, 75 bp, Artificial Sequence
  Synthetic
ggaggtggcaatcatggacgaggcccactggacggacccccacagcatagctgccagaggtcatttgtacactct

SEQ ID NO: 332874 - DNA, 75 bp, Artificial Sequence
  Synthetic
gtcttgatgacagcgacacctcctggtaagagtgaaccctttccggagtctaacggagccattactagtgaggaa

SEQ ID NO: 332875 - DNA, 75 bp, Artificial Sequence
  Synthetic
atcgcaaccccacggccgcttgtgtgttcaaggtactggccccctaccgcccagaggtcatagaggcactgcaca

SEQ ID NO: 332876 - DNA, 75 bp, Artificial Sequence
  Synthetic
gttcaaggtactggccccctaccgcccagaggtcatagaggcactgcacagattccaactgcagtggggtggagg

SEQ ID NO: 332877 - DNA, 75 bp, Artificial Sequence
  Synthetic
gtgacgggtttgactggatcactgagtatgaagggcgcaccgcctggtttgtcccttcgattgcaaaaggtggtg

SEQ ID NO: 332878 - DNA, 75 bp, Artificial Sequence
  Synthetic
aattcaactcatgaaatgtactactcgactgcggtcaccgggaacattgtgaactctgtcaacatccagtccaga

SEQ ID NO: 332879 - DNA, 75 bp, Artificial Sequence
  Synthetic
cgactgcggtcaccgggaacattgtgaactctgtcaacatccagtccagaaaactcctggcccggtttggggacc

SEQ ID NO: 332880 - DNA, 75 bp, Artificial Sequence
  Synthetic
gagatgggagccaaccttgacgtgagccgcgtcatagatgggaggacaaacatcaagcctgaggaggttgatggg

SEQ ID NO: 332881 - DNA, 75 bp, Artificial Sequence
  Synthetic
gttggacttaggagttgggacccggtgtgtggtcttagccgaagacaaagtgaaagaaaaagatgtgcaggaaag

SEQ ID NO: 332882 - DNA, 75 bp, Artificial Sequence
  Synthetic
tgtgtggtcttagccgaagacaaagtgaaagaaaaagatgtgcaggaaaggatcaatgcgctgcgagaacaatat

SEQ ID NO: 332883 - DNA, 75 bp, Artificial Sequence
  Synthetic
aacacccatataggacctggcagtactggggtagctaccgcactgcgccaaccggttcagcggcgtcactgatca

SEQ ID NO: 332884 - DNA, 75 bp, Artificial Sequence
  Synthetic
ctggggtagctaccgcactgcgccaaccggttcagcggcgtcactgatcaatggagttgtgaaacttcttagttg

SEQ ID NO: 332885 - DNA, 75 bp, Artificial Sequence
  Synthetic
caaccttgcgggggcccgtggccaccttctatggaccagaacaggacaagatgccggaggtggccggtcactttc

SEQ ID NO: 332886 - DNA, 75 bp, Artificial Sequence
  Synthetic
gtgcgcatggccatgactgacaccacggcctttggacagcagcgagtattcaaggagaaggttgacaccaaggct

SEQ ID NO: 332887 - DNA, 75 bp, Artificial Sequence
  Synthetic
cggcctttggacagcagcgagtattcaaggagaaggttgacaccaaggctcaggagccacagcccggcacaaagg

SEQ ID NO: 332888 - DNA, 75 bp, Artificial Sequence
  Synthetic
gattctggagcgactggcgcggaaaagcaaaccacgaatgtgcagcaaggaggaattcatagcaaaagtgaaatc

SEQ ID NO: 332889 - DNA, 75 bp, Artificial Sequence
  Synthetic
gatgagcagaacaggtgggcaagcgcaaaggaggccgtggaggaccctgccttctggaaactcgtggatgaagaa

SEQ ID NO: 332890 - DNA, 75 bp, Artificial Sequence
  Synthetic
caaaggaggccgtggaggaccctgccttctggaaactcgtggatgaagaaagagagaggcatcttaccgggagat

SEQ ID NO: 332891 - DNA, 75 bp, Artificial Sequence
  Synthetic
gagtttggagtagccaaaggaagtcgagccatatggtacatgtggctagggagccggttcctagagttcgaggct

SEQ ID NO: 332892 - DNA, 75 bp, Artificial Sequence
  Synthetic
ggagcttttgcggcacagatgcgtcagtgccctggatgtcttctacacactcatgcatgaggaacctggcagcag

SEQ ID NO: 332893 - DNA, 75 bp, Artificial Sequence
  Synthetic
tcatgcatgaggaacctggcagcagggcaatgagaatggcggagagagatgccccagaggcctttctgactatgg

SEQ ID NO: 332894 - DNA, 75 bp, Artificial Sequence
  Synthetic
gggcctctagggggtccagtggagctggagtggagggaatcagcctaaactacctgggctggtacctcaaagggt

SEQ ID NO: 332895 - DNA, 75 bp, Artificial Sequence
  Synthetic
tggagtggagggaatcagcctaaactacctgggctggtacctcaaagggttgtcaacactggaaggaggcctctt

SEQ ID NO: 332896 - DNA, 75 bp, Artificial Sequence
  Synthetic
gacaccaaggtcactaacgcagacttagaggatgaagagcagatcctgcggtacatggagggtgaacacaaacaa

SEQ ID NO: 332897 - DNA, 75 bp, Artificial Sequence
  Synthetic
gtacatggagggtgaacacaaacaactggcaaccacaataatgcagaaggcataccacgccaaggtggtgaaggt

SEQ ID NO: 332898 - DNA, 75 bp, Artificial Sequence
  Synthetic
gagaccaaaggggttcaggtcaggttgtgacttatgccctcaacacccttaccaacataaaggtgcagttaatcc

SEQ ID NO: 332899 - DNA, 75 bp, Artificial Sequence
  Synthetic
agaggcctcagatgcacataatccaagactactccgagtggaacgatggctgagagaacatggagaagaacgcct

SEQ ID NO: 332900 - DNA, 75 bp, Artificial Sequence
  Synthetic
agactactccgagtggaacgatggctgagagaacatggagaagaacgcctcggaaggatgcttgtgagtggtgat

SEQ ID NO: 332901 - DNA, 75 bp, Artificial Sequence
  Synthetic
tgaggaaccatggagaagaacgtctcggaagaatgctcgtgagcggtgatgattgtgtggtgagaccggtggatg

SEQ ID NO: 332902 - DNA, 75 bp, Artificial Sequence
  Synthetic
acagattcggcaaagcgctctactttctgaacgacatggcaaagaccaggaaggacattggagaatgggagcact

SEQ ID NO: 332903 - DNA, 75 bp, Artificial Sequence
  Synthetic
tctgaacgacatggcaaagaccaggaaggacattggagaatgggagcactcggctggttttgcgagctgggagga

SEQ ID NO: 332904 - DNA, 75 bp, Artificial Sequence
  Synthetic
cacgagctggtgatgaaagacgggcgagctctgatagtgccgtgccgagaccaggatgaactggttggaagagcc

SEQ ID NO: 332905 - DNA, 75 bp, Artificial Sequence
  Synthetic
gagctctgatagtgccgtgccgagaccaggatgaactggttggaagagcccgagtatcaccagggtgcggctgga

SEQ ID NO: 332906 - DNA, 75 bp, Artificial Sequence
  Synthetic
cccatggtggatggggatgtcatcaacccattcggggagggggaggcaaaacctgctctatatgaaaggaaaatg

SEQ ID NO: 332907 - DNA, 75 bp, Artificial Sequence
  Synthetic
aaaagcttacgggcagatgtggttgctgagttacttccatcggcgtgacttgaggacgcttgggcttgccatctg

SEQ ID NO: 332908 - DNA, 75 bp, Artificial Sequence
  Synthetic
ctgagttacttccatcggcgtgacttgaggacgcttgggcttgccatctgctcagcggtgccagtcgactgggtt

SEQ ID NO: 332909 - DNA, 75 bp, Artificial Sequence
  Synthetic
tcagctgtgggactggcagcagcgggacagctgcttaggccggaggctgacacactgtggacgatgccggttgct

SEQ ID NO: 332910 - DNA, 75 bp, Artificial Sequence
  Synthetic
aacagggtgtggattttggacaatcccttcatgcaaaacaaagaaaaggttgcggaatggagggatgtcccgtat

SEQ ID NO: 332911 - DNA, 75 bp, Artificial Sequence
  Synthetic
gacagctgcttaggccggaggctgacacactgtggacgatgccggttgcttgtggcatgagtggtgtggtcaggg

SEQ ID NO: 332912 - DNA, 75 bp, Artificial Sequence
  Synthetic
tggagagctcaataatctaaaaccagactgtgatggagcagaacctggggtgctcgttaaaaattgcccagaacc

SEQ ID NO: 332913 - DNA, 75 bp, Artificial Sequence
  Synthetic
tgacaaggctagagagttgctcagaagaggagagaccaatatgggattggctgtctctcggggcacggcaaagct

SEQ ID NO: 332914 - DNA, 75 bp, Artificial Sequence
  Synthetic
ctgtctctcggggcacggcaaagcttgcctggcttgaggaacgcggatatgccaccctcaagggagaggtggtag

SEQ ID NO: 332915 - DNA, 75 bp, Artificial Sequence
  Synthetic
tgcttcggatagcaacagcagcgacaggtttgagagagacaatctttcacttgatcagtcgtgaacgtgttgaga

SEQ ID NO: 332916 - DNA, 75 bp, Artificial Sequence
  Synthetic
tggaacttgattaaattcagatcaggaatggacgtgttcagcatgcagccacaccgggctgacactgtcatgtgt

SEQ ID NO: 332917 - DNA, 75 bp, Artificial Sequence
  Synthetic
gaatggacgtgttcagcatgcagccacaccgggctgacactgtcatgtgtgacatcggagagagcagcccagatg

SEQ ID NO: 332918 - DNA, 75 bp, Artificial Sequence
  Synthetic
cggaagcatgcttccgggaggagggaagagagaaattggcagctctcttcaggatttttcctcctcctataccaa

SEQ ID NO: 332919 - DNA, 75 bp, Artificial Sequence
  Synthetic
ccgctgtggagggtgagaggacaaggaaagtgatattgctcatggagcaatggaaaaataggaaccccacggctg

SEQ ID NO: 332920 - DNA, 75 bp, Artificial Sequence
  Synthetic
tgagcaccctgatggtaggtctgcaaagacgtggcaaaagaaggtcggcagtagactggacaggttggttgctgg

SEQ ID NO: 332921 - DNA, 75 bp, Artificial Sequence
  Synthetic
gcgtgtggaaaatggcacctgtgtgatcctggccacggatatgggatcatggtgtgatgactcactaacctatga

SEQ ID NO: 332922 - DNA, 75 bp, Artificial Sequence
  Synthetic
gcaggaatgttgatggagtttacctggagtatgggcggtgtggaaaacaagaaggatcaagaacaaggcgttcag

SEQ ID NO: 332923 - DNA, 75 bp, Artificial Sequence
  Synthetic
gacgaggaacacccgtaccggacatggcagtactggggtagttaccgcacggcaccaaccggctcggcggcgtca

SEQ ID NO: 332924 - DNA, 75 bp, Artificial Sequence
  Synthetic
ggcaccaaccggctcggcggcgtcactgatcaatggggttgtgaaacttctcagctggccatggaacgcacggga

SEQ ID NO: 332925 - DNA, 75 bp, Artificial Sequence
  Synthetic
tcagctggccatggaacgcacgggaagatgtggtgcgcatggccatgactgacacaacggctttcggacagcaga

SEQ ID NO: 332926 - DNA, 75 bp, Artificial Sequence
  Synthetic
gacacaacggctttcggacagcagagagtgttcaaggataaagttgacacaaaggcacaagagcctcagcccggt

SEQ ID NO: 332927 - DNA, 75 bp, Artificial Sequence
  Synthetic
ttggtcagatgagcaaaacagatgggcaagtgcaagggaggctgtagaggatcctgcattctggcacctcgtgga

SEQ ID NO: 332928 - DNA, 75 bp, Artificial Sequence
  Synthetic
cgaggctcttggattcttgaatgaagaccattgggcctctagagagtccagtggagctggagttgagggaataag

SEQ ID NO: 332929 - DNA, 75 bp, Artificial Sequence
  Synthetic
ggaaacatgaaggagcacagaactggaacaatgcggaacggctggttgagtttggagctccacatgctgtgaaaa

SEQ ID NO: 332930 - DNA, 75 bp, Artificial Sequence
  Synthetic
gaaattcacgtggaaaagaattccaacagacagtggacatgacacagtggtcatggaagttgcgttctctgggac

SEQ ID NO: 332931 - DNA, 75 bp, Artificial Sequence
  Synthetic
ctaatccgaatgatggagggggagggggtcatagaggcagcggatgcacacaacccgagactgcttcgagtggag

SEQ ID NO: 332932 - DNA, 75 bp, Artificial Sequence
  Synthetic
gggtcatagaggcagcggatgcacacaacccgagactgcttcgagtggagcgctggctgaaagaacatggagaag

SEQ ID NO: 332933 - DNA, 75 bp, Artificial Sequence
  Synthetic
agcgtcttggaagaatgctcgtcagtggtgacgattgtgtggtgaggcccttggatgacagatttggcaaagcac

SEQ ID NO: 332934 - DNA, 75 bp, Artificial Sequence
  Synthetic
gggaggaggtccccttttgttcacaccatttccacgagctagtgatgaaggacggacgcgccctggtggtgccgt

SEQ ID NO: 332935 - DNA, 75 bp, Artificial Sequence
  Synthetic
gagggcgcgcatctcaccagggtgcggctggagtgtccgcgagacggcctgcctttcaaaagcctacgggcagat

SEQ ID NO: 332936 - DNA, 75 bp, Artificial Sequence
  Synthetic
cgagacctgaggacgctcgggcttgccatcaactcagcagtgcctgtcgattgggttcctaccggccgcacgaca

SEQ ID NO: 332937 - DNA, 75 bp, Artificial Sequence
  Synthetic
aaacccagactgtgacagagcaaaacccggagggctcgtaaaagattgtccggaaccaaaaggaaagcaagcaac

SEQ ID NO: 332938 - DNA, 75 bp, Artificial Sequence
  Synthetic
aaaacccggagggctcgtaaaagattgtccggaaccaaaaggaaagcaagcaacttatggaatgctgcggcagcg

SEQ ID NO: 332939 - DNA, 75 bp, Artificial Sequence
  Synthetic
agattttcttgcacgtgcgtgcgtttgcttcgaatagcaacagcagcgacgggtttgagagagacaatttttcgc

SEQ ID NO: 332940 - DNA, 75 bp, Artificial Sequence
  Synthetic
ggatttttcctcctcctataccaaattccccctcaatagagggggggcggttcttgttctccctgagccaccatc

SEQ ID NO: 332941 - DNA, 75 bp, Artificial Sequence
  Synthetic
ctcgtcactggtctggtaaagatcgaaagcttagtgcgttatgtcgtggcagttgggatcacatttcatcttgag

SEQ ID NO: 332942 - DNA, 75 bp, Artificial Sequence
  Synthetic
ggtgtgatgactcattaacctatgagtgtgtaaccatagaccagggggaggaaccagttgacgtggattgctttt

SEQ ID NO: 332943 - DNA, 75 bp, Artificial Sequence
  Synthetic
gggcagcgtcaagtgggagttggctatggttccaaaggtgtcctacacacgatgtggcatgtgacgagaggggcg

SEQ ID NO: 332944 - DNA, 75 bp, Artificial Sequence
  Synthetic
cccccaggagacaacatcatctatgttggggaactgagttatcaatggttccaaaaagggagtagcatcggaaga

SEQ ID NO: 332945 - DNA, 75 bp, Artificial Sequence
  Synthetic
tcatggaggttgcgttctctgggaccaaaccctgtaggatcccggtgagggccgtggcacacggctctccagatg

SEQ ID NO: 332946 - DNA, 75 bp, Artificial Sequence
  Synthetic
tgatggattcgactggatcaccgagtatgaggggcgtaccgcatggttcgttccctcgattgcaaaaggtggcat

SEQ ID NO: 332947 - DNA, 75 bp, Artificial Sequence
  Synthetic
ggcgctgcacacagttcttggtggtgccttcaacagcctgtttggaggagtagggtttttgcctaagatcctagt

SEQ ID NO: 332948 - DNA, 75 bp, Artificial Sequence
  Synthetic
gggctcctgctcatggctctcatgacacagcaggatgtggtgactgtgcatcatggactggtgtgcttcctgagt

SEQ ID NO: 332949 - DNA, 75 bp, Artificial Sequence
  Synthetic
tatcgaggtggcattcctgggctgctaaagaaggggaaagacataaaggtttcttggaagagctggggccactca

SEQ ID NO: 332950 - DNA, 75 bp, Artificial Sequence
  Synthetic
atgatctggagtgtccccgaggccccccgccggttcatggtgggaacagagggaagcagtgagtgcccactagag

SEQ ID NO: 332951 - DNA, 75 bp, Artificial Sequence
  Synthetic
aattgctcatggccggctagccacaccattgacaatgctgaggtggtggactcagagctcttccttccagccagt

SEQ ID NO: 332952 - DNA, 75 bp, Artificial Sequence
  Synthetic
ccattgacaatgctgaggtggtggactcagagctcttccttccagccagtctggcagggcccagatcctggtata

SEQ ID NO: 332953 - DNA, 75 bp, Artificial Sequence
  Synthetic
tggccgccaatgagatgggatttctggagaagaccaaggcggacctgtccacggtgttgtggagtgaacatgagg

SEQ ID NO: 332954 - DNA, 75 bp, Artificial Sequence
  Synthetic
agctgcttagtgaggggggcattcccgggatagtggctttgtttgtggtccttgagtacgtcattcggaggaggc

SEQ ID NO: 332955 - DNA, 75 bp, Artificial Sequence
  Synthetic
gggaggcattgttgtccttgcattgctcgtcactggtctggtgagaatcgagagcctggtgcgttatgtcgtggc

SEQ ID NO: 332956 - DNA, 75 bp, Artificial Sequence
  Synthetic
gcactgcgcagcaacctcactgtcagagagatggtaaccatctactttcttctgctagttttggagctgggattg

SEQ ID NO: 332957 - DNA, 75 bp, Artificial Sequence
  Synthetic
ggagcttttgcggcacagatgcgtcagtgccctggacgtcttctacacactcatgcatgagaaacctgacagcag

SEQ ID NO: 332958 - DNA, 75 bp, Artificial Sequence
  Synthetic
cttccactggtccggcatccttggtgtgatgggattgtggacgctgtcggaaatgctgaggacggctcgaagatc

SEQ ID NO: 332959 - DNA, 75 bp, Artificial Sequence
  Synthetic
gaaatccaatgcagctctgggggcttggtctgatgagcagaacaggtggtcaagtgcaaaagaggctgtggagga

SEQ ID NO: 332960 - DNA, 75 bp, Artificial Sequence
  Synthetic
agatcacagtgctggacatgcacccaggctctgggaagacccacagagtcctcccggagctcattcgccaatgca

SEQ ID NO: 332961 - DNA, 75 bp, Artificial Sequence
  Synthetic
gctggagcgtccgtgaaactgcctgcctttcaaaagcttacgggcagatgtggctgctgagttacttccaccggc

SEQ ID NO: 332962 - DNA, 75 bp, Artificial Sequence
  Synthetic
ccgtacctccccaaatcccatgacatgctgtgttcctcccttgttgggaggaaagagagggcagagtgggccaag

SEQ ID NO: 332963 - DNA, 75 bp, Artificial Sequence
  Synthetic
gttcaaggactacctttcctgtatggaccggcatgacttgcactgggagctcaaactggagagctcaataatcta

SEQ ID NO: 332964 - DNA, 75 bp, Artificial Sequence
  Synthetic
ggaaaaagcgtgatctgtctgaacagcaagacctttgaaaaggactactccagagtgagagatgagaaacccgac

SEQ ID NO: 332965 - DNA, 75 bp, Artificial Sequence
  Synthetic
gtgatgcggcagcgcgcgagagcgacggggaaatggtcgcacccgacgcaccatccatgaagaaacgtttcgtga

SEQ ID NO: 332966 - DNA, 75 bp, Artificial Sequence
  Synthetic
atcaaaccggaagaggttgatgggagagttgagctcacagggaccagacgtgtgaccacggcctctgcggcccaa

SEQ ID NO: 332967 - DNA, 75 bp, Artificial Sequence
  Synthetic
tgagagtggcgacgggaaaatggtcgatcccgacgtagggcactctgtcaaactttgtgagacccccggcaccat

SEQ ID NO: 332968 - DNA, 75 bp, Artificial Sequence
  Synthetic
cgccgtgggagagtcggaagacaggaaggaagaacagatgaatacatatactctggacagtgtgatgatgatgat

SEQ ID NO: 332969 - DNA, 75 bp, Artificial Sequence
  Synthetic
tttgcttcggatagcaacagcagcgacaggtttgagagagacaatctttcgcttgatcagtcgtgaacgtgttga

SEQ ID NO: 332970 - DNA, 75 bp, Artificial Sequence
  Synthetic
acaggtttgagagagacaatctttcgcttgatcagtcgtgaacgtgttgagaaaaagacagcttaggagaacaag

SEQ ID NO: 332971 - DNA, 75 bp, Artificial Sequence
  Synthetic
cgaagaagacgcgtcaatctagggtccaaatgccaaatggactcgtgttgatgcgcatgatggggattttatggc

SEQ ID NO: 332972 - DNA, 75 bp, Artificial Sequence
  Synthetic
ggttgttgctctgttgggagcggcacttgcagccacagtgcgtaaggaaagagatggcaccaccgtgatcagagc

SEQ ID NO: 332973 - DNA, 75 bp, Artificial Sequence
  Synthetic
cctcggagaagaccatcttgaccatgggagactacggagacgtgtccttgttatgcagagtagccagcggcgttg

SEQ ID NO: 332974 - DNA, 75 bp, Artificial Sequence
  Synthetic
gaggggagaccaacatggggctagctgtgtcacggggcacggctaaactcgcctggcttgaggaacgaggttacg

SEQ ID NO: 332975 - DNA, 75 bp, Artificial Sequence
  Synthetic
gggccgtggcacacggctctccagatgtgaacgtggccatgttgataacacccaaccccacaatcgaaaacaatg

SEQ ID NO: 332976 - DNA, 75 bp, Artificial Sequence
  Synthetic
tgtgaacgtggccatgttgataacacccaaccccacaatcgaaaacaatggtggtggtttcatagaaatgcagtt

SEQ ID NO: 332977 - DNA, 75 bp, Artificial Sequence
  Synthetic
caccgagctgacaccatcatgtgtgacatcggagagagcaacccagatgccgtggtggagggtgagaggacacgg

SEQ ID NO: 332978 - DNA, 75 bp, Artificial Sequence
  Synthetic
cggaggactggtgaggacccctttctcgaggaactcaacccatgaaatgtattactcgactgctgtcactggaaa

SEQ ID NO: 332979 - DNA, 75 bp, Artificial Sequence
  Synthetic
cttggagagtttggagtggccaaaggaagccgagccatatggtacatgtggctggggagccgcttcctggagttc

SEQ ID NO: 332980 - DNA, 75 bp, Artificial Sequence
  Synthetic
cctacgctacatggagggtgaacacaagcaactggcggctacaataatgcagaaggcataccacgctaaagtggt

SEQ ID NO: 332981 - DNA, 75 bp, Artificial Sequence
  Synthetic
aaaagtagcccggccctcccgagatggaggctgtgtcatggatgtcatcacaagaagagaccaaagaggctcagg

SEQ ID NO: 332982 - DNA, 75 bp, Artificial Sequence
  Synthetic
caagaagagaccaaagaggctcagggcaggttgtgacttatgccctcaacacccttaccaacataaaggttcagc

SEQ ID NO: 332983 - DNA, 75 bp, Artificial Sequence
  Synthetic
acccttaccaacataaaggttcagctgatccgtatgatggagggggagggagtcattgaggcctcggacgcacat

SEQ ID NO: 332984 - DNA, 75 bp, Artificial Sequence
  Synthetic
gcagttgggatcacatttcatcttgagctggggccagagattgtggctctgacactgttacaggctgtgtttgag

SEQ ID NO: 332985 - DNA, 75 bp, Artificial Sequence
  Synthetic
gctgctggcaggactggcggcttcagcctttcactggtccggcatccttggtgtgatgggattgtggacgctgtc

SEQ ID NO: 332986 - DNA, 75 bp, Artificial Sequence
  Synthetic
tcaggaagatgatcggacaagagaagtttaaggactacctttcctgcatggaccggcatgacttgcactgggagc

SEQ ID NO: 332987 - DNA, 75 bp, Artificial Sequence
  Synthetic
agagcgacggggaaatggtcgcacccgacgcaccatccatgaagaaatgtttcgtgagaccccccggccagtgaa

SEQ ID NO: 332988 - DNA, 75 bp, Artificial Sequence
  Synthetic
gagtcgccgttgtggttgtgctcctctgcctggctccggtttatgcgtcacgatgcacacatctggagaacaggg

SEQ ID NO: 332989 - DNA, 75 bp, Artificial Sequence
  Synthetic
aagagaccagagcgatcgaggctggggcaaccattgcggactgtttggaaagggcagcattgtgacttgcgtgaa

SEQ ID NO: 332990 - DNA, 75 bp, Artificial Sequence
  Synthetic
cgacggcctggcaggtccatcgtgactggttcaatgatctggctctaccgtggaaacatgaaggagcgcaacact

SEQ ID NO: 332991 - DNA, 75 bp, Artificial Sequence
  Synthetic
ctggttcaatgatctggctctaccgtggaaacatgaaggagcgcaacactggaacaatgctgagcgactggttga

SEQ ID NO: 332992 - DNA, 75 bp, Artificial Sequence
  Synthetic
atgatgcttggcacgctggtactgctggcctctttggcgctcctgtgggctggcggtgtaagctacgggaacatg

SEQ ID NO: 332993 - DNA, 75 bp, Artificial Sequence
  Synthetic
caaaccccaccattgagaacaatggaggtggcttcatagagatgcagctacccccaggggacaacatcatttatg

SEQ ID NO: 332994 - DNA, 75 bp, Artificial Sequence
  Synthetic
cagttcctctgaaacaggccacggcagcactccggaaaatcaagaaggcagtgagcgctttgatggtaggcttgc

SEQ ID NO: 332995 - DNA, 75 bp, Artificial Sequence
  Synthetic
agtgggggctgatgttggttgtgccgtagacaccgagcgaatggaactccgctgtggtgagggcctggttgtgtg

SEQ ID NO: 332996 - DNA, 75 bp, Artificial Sequence
  Synthetic
aactacgcatactacccggaaacgccaggagcgctagcatcggccataaaggaaacgtttgaggagggaaattgt

SEQ ID NO: 332997 - DNA, 75 bp, Artificial Sequence
  Synthetic
cgatgcacacatctggagaacagggattttgtcactggcactcagggaaccacgagagtgactctggtgttggag

SEQ ID NO: 332998 - DNA, 75 bp, Artificial Sequence
  Synthetic
aacccggccaaaacacgcgagtactgtctgcatgccaagctatcggacaccaaggttgcagccagatgcccaaca

SEQ ID NO: 332999 - DNA, 75 bp, Artificial Sequence
  Synthetic
cacaccgagctgataccatcatgtgtgacattggagaaagcaacccagatgccgtggtggagggtgagaggacac

SEQ ID NO: 333000 - DNA, 75 bp, Artificial Sequence
  Synthetic
ggtggcttgtgaggcaaagaagaaggccactggacatgtgtatgaccctaacaagatcgtgtaccccgttaaggt

SEQ ID NO: 333001 - DNA, 75 bp, Artificial Sequence
  Synthetic
gagctgctcagtgaggggggagttcccggaattgtggcactgtttgtggtcctcgaatatgtcatccggaggaga

SEQ ID NO: 333002 - DNA, 75 bp, Artificial Sequence
  Synthetic
actgcacagattccaactgcagtggggcggaggactggtgaggacccctttctcgagaaactcaacccatgagat

SEQ ID NO: 333003 - DNA, 75 bp, Artificial Sequence
  Synthetic
gtattactcgactgctgtcactggaaacattgtgaattctgtcaacatccagtcaaggaaactcctggcccggtt

SEQ ID NO: 333004 - DNA, 75 bp, Artificial Sequence
  Synthetic
gccgggtgagagtcttgagggtctctggaaatggggtgacgcactggccatgggggctctgatttttcgagcttg

SEQ ID NO: 333005 - DNA, 75 bp, Artificial Sequence
  Synthetic
ggaacaatgctgagcgactggttgaatttggagctccgcatgccgttaaaatggacgtgtataaccttggagatc

SEQ ID NO: 333006 - DNA, 75 bp, Artificial Sequence
  Synthetic
aacagtatggtgagacctggcacatggacagagagcacccgtacaggacctggcagtactggggcagctaccgta

SEQ ID NO: 333007 - DNA, 75 bp, Artificial Sequence
  Synthetic
tgctggggttcctgtggcgcacattgatggaacaaagtaccacctaaaaagcggccatgtaacatgcgaggttgg

SEQ ID NO: 333008 - DNA, 75 bp, Artificial Sequence
  Synthetic
agaagagagagtgatggctttttggttacttgctgggcttgcggcttcggccctccattggtcagggattcttgg

SEQ ID NO: 333009 - DNA, 75 bp, Artificial Sequence
  Synthetic
cctgaacatgaggaaccccaccatgtccatgagcttcctcttggctgggggactggtcctggctatgacacttgg

SEQ ID NO: 333010 - DNA, 75 bp, Artificial Sequence
  Synthetic
ggccttttttacgcagatgacacagccggctgggataccaaggtcactaacgcagacctagaggatgaagagcag

SEQ ID NO: 333011 - DNA, 75 bp, Artificial Sequence
  Synthetic
aggggcaattgtcgatgtcatgtgccatgccacctatgtcaacagacggttgctcccacaggggagacaaaactg

SEQ ID NO: 333012 - DNA, 75 bp, Artificial Sequence
  Synthetic
cactggacggatccacacagcatagctgccaggggccatttgtacactctagcaaaagaaaacaaatgcgctctg

SEQ ID NO: 333013 - DNA, 75 bp, Artificial Sequence
  Synthetic
caactttacgaggacctgtggccaccttctacggaccagaacaggacaagatgccagaggtggcaggccacttcc

SEQ ID NO: 333014 - DNA, 75 bp, Artificial Sequence
  Synthetic
gacttaccgaagagaagagaaagcactttcgacaccttctcacccattgcgacttcacaccgtggttggcatggc

SEQ ID NO: 333015 - DNA, 75 bp, Artificial Sequence
  Synthetic
gacaagccgaaactggacatgggagggcccagaggaaaatgcagtggatgaggccaatggagacctggtcacctt

SEQ ID NO: 333016 - DNA, 75 bp, Artificial Sequence
  Synthetic
gagctgctcagtgagggaggagttcccggaattgtggcactctttgtggtcctcgaatacgtcatccggaggaga

SEQ ID NO: 333017 - DNA, 75 bp, Artificial Sequence
  Synthetic
tggaagtggggtgacgcgctggccatgggggcgttgattttccgagcttgcaccgcagagggaaaggctggagtc

SEQ ID NO: 333018 - DNA, 75 bp, Artificial Sequence
  Synthetic
tgggggcgttgattttccgagcttgcaccgcagagggaaaggctggagtcggactcctgctcatgcccctcctca

SEQ ID NO: 333019 - DNA, 75 bp, Artificial Sequence
  Synthetic
ctatggactcataatcttcctgggcgtggcttcggtttgctcggtctggagattaattaggggacatagggaaca

SEQ ID NO: 333020 - DNA, 75 bp, Artificial Sequence
  Synthetic
gaagggactgtcctggatagtccctttggccggactagtggggggagagggctctggaatcaggctgttatcttt

SEQ ID NO: 333021 - DNA, 75 bp, Artificial Sequence
  Synthetic
aaggagacacacttggtgatctctggaaacagagattgaacagctgcactaaggaagaattctttgtctacaggc

SEQ ID NO: 333022 - DNA, 75 bp, Artificial Sequence
  Synthetic
cgggtccggcaggattcaatgggaaacttccacctgacggagcttgagaaagaagagagagtgatggccttttgg

SEQ ID NO: 333023 - DNA, 75 bp, Artificial Sequence
  Synthetic
acttccacctgacggagcttgagaaagaagagagagtgatggccttttggttacttgctgggcttgcggcttcgg

SEQ ID NO: 333024 - DNA, 75 bp, Artificial Sequence
  Synthetic
tgcgcatgatggggatcttgtggcatgccatagctggtactgccagaagccccgttttgaagtccttctggaatt

SEQ ID NO: 333025 - DNA, 75 bp, Artificial Sequence
  Synthetic
agcactacggaaaattaaaaaggcagtgagcactctgatgataggcttgcaaagacgtggaaagaagaggtcaac

SEQ ID NO: 333026 - DNA, 75 bp, Artificial Sequence
  Synthetic
gtgagcactctgatgataggcttgcaaagacgtggaaagaagaggtcaacaacagattggatgggttggctgctt

SEQ ID NO: 333027 - DNA, 75 bp, Artificial Sequence
  Synthetic
gacattggagaaagcagcccggatgccgctgtggaaggtgagaggacaaggagagtgatattgctcatggagcaa

SEQ ID NO: 333028 - DNA, 75 bp, Artificial Sequence
  Synthetic
tgcgcgtggagaacggcacctgtgtgatactggccacggacatggggtcatggtgtgacgactcactgtcctatg

SEQ ID NO: 333029 - DNA, 75 bp, Artificial Sequence
  Synthetic
ggaagggtcaaggacaaggcgttcagtgttgattccgtcccatgcccagggagagcttactggaagaggacacaa

SEQ ID NO: 333030 - DNA, 75 bp, Artificial Sequence
  Synthetic
ggtgcatcagtgccagcctggagaactgctcttggatacagggagaaggacgggagcagtacttatcgacctttc

SEQ ID NO: 333031 - DNA, 75 bp, Artificial Sequence
  Synthetic
gactgtatggaaatggactgaaaaccaatgagacttatgtcagcagcattgctcaaggagaggcggaaaaaagcc

SEQ ID NO: 333032 - DNA, 75 bp, Artificial Sequence
  Synthetic
ttgaccgtggaaagtgtggtgactcgagtcaccgttgtggttgtgctcttctgcctagctccggtttacgcgtca

SEQ ID NO: 333033 - DNA, 75 bp, Artificial Sequence
  Synthetic
ggcagtattggggcagttaccgaactgcgccaactggctcagcggcgtctctgatcaatggagttgtgaaactcc

SEQ ID NO: 333034 - DNA, 75 bp, Artificial Sequence
  Synthetic
caaggaaatggaacgtgcactgactgggaagagagtcaggttcctctctcccgcggtaagtgaccaacagatggg

SEQ ID NO: 333035 - DNA, 75 bp, Artificial Sequence
  Synthetic
cacaccacctatgtcaacagacggttgctcccgcaggggagacaaaactgggaggtggcaaccattgatgaagcc

SEQ ID NO: 333036 - DNA, 75 bp, Artificial Sequence
  Synthetic
tgctcccgcaggggagacaaaactgggaggtggcaaccattgatgaagcccactggacagatccgcacagcatag

SEQ ID NO: 333037 - DNA, 75 bp, Artificial Sequence
  Synthetic
ggcaatcactgcggattatttggaaaaggcagcattgtgacttgtgtcaaggtggcttgtgaggcaaagaagaag

SEQ ID NO: 333038 - DNA, 75 bp, Artificial Sequence
  Synthetic
atggatgtgtacaaccttggagaccagactggagtgctgctgaaatcactcgctggggttcctatagcgcacatt

SEQ ID NO: 333039 - DNA, 75 bp, Artificial Sequence
  Synthetic
agactggagtgctgctgaaatcactcgctggggttcctatagcgcacattgatggagcaaagtaccacctaaaaa

SEQ ID NO: 333040 - DNA, 75 bp, Artificial Sequence
  Synthetic
ctttcgacaccttctcacccattgtgacttcacaccgtggctggcatggcatgtcgcagcgaatgtgtccagtgt

SEQ ID NO: 333041 - DNA, 75 bp, Artificial Sequence
  Synthetic
actagaaaagcttaagatgaagggtctcacatacacaatgtgtgacaaaacgaagttcacatggaagcggacccc

SEQ ID NO: 333042 - DNA, 75 bp, Artificial Sequence
  Synthetic
cgcaatgaggatggcggagagagacgccccagaggcatttctcacgctggtggagatgatggtgctcggcctggc

SEQ ID NO: 333043 - DNA, 75 bp, Artificial Sequence
  Synthetic
gtttttcaaaagaccaggaagggcatcgagagactgacagtgataggagaacacgcctgggactttggttccact

SEQ ID NO: 333044 - DNA, 75 bp, Artificial Sequence
  Synthetic
tccgtatctccctaaggctcaagatatgctgtgttcctcccttgttggaaggagggagagggctgagtgggccaa

SEQ ID NO: 333045 - DNA, 75 bp, Artificial Sequence
  Synthetic
ggaccgacatgacttgcactgggagctcagattggagagctcaatcatctaaaaccaaagtgtgacagagcaaaa

SEQ ID NO: 333046 - DNA, 75 bp, Artificial Sequence
  Synthetic
ctcagattggagagctcaatcatctaaaaccaaagtgtgacagagcaaaacctggagggctcgtgaaacattgtc

SEQ ID NO: 333047 - DNA, 75 bp, Artificial Sequence
  Synthetic
aacacttcgtgagacccccccggccagtggagggggaagctggtcaggggtgaaagcacccccagagtgcactat

SEQ ID NO: 333048 - DNA, 75 bp, Artificial Sequence
  Synthetic
agattttcttgcacgtgcgtgcgtttgcttcggatagcaaccgcagcgacagttttgagagagacaatctttcgc

SEQ ID NO: 333049 - DNA, 75 bp, Artificial Sequence
  Synthetic
gtggcggaatttggggttggcctgagaacaaaggtcttcctggatttcagacaggaaccaacacacgaatgtgac

SEQ ID NO: 333050 - DNA, 75 bp, Artificial Sequence
  Synthetic
gaacaaaggtcttcctggatttcagacaggaaccaacacacgaatgtgacactggagtgatgggggctgctgtca

SEQ ID NO: 333051 - DNA, 75 bp, Artificial Sequence
  Synthetic
ccgtgttgaagtctttctggaaatcagttccactgaaacaggctacggcagcactccggaaaattaagaaggcag

SEQ ID NO: 333052 - DNA, 75 bp, Artificial Sequence
  Synthetic
aaactgttcatggcctgccagccacaccatcgacaatgccgaggtcgtggattcagagcttttccttccggccag

SEQ ID NO: 333053 - DNA, 75 bp, Artificial Sequence
  Synthetic
gcggtcatgagtgtcaaagcatacacaattggcggaaagggacatgaaaccccaaagatggtgacaagcctgggc

SEQ ID NO: 333054 - DNA, 75 bp, Artificial Sequence
  Synthetic
aggtgaaaggaccatggaagtactcgcccatccgggtcacaagggaggagtgtcctggcacaaaagtcaccataa

SEQ ID NO: 333055 - DNA, 75 bp, Artificial Sequence
  Synthetic
ttctgtgaggagcaccacggaaagtggcaaggtgatcccggagtggtgctgtcggacatgcacactaccgccagt

SEQ ID NO: 333056 - DNA, 75 bp, Artificial Sequence
  Synthetic
ggcaaggtgatcccggagtggtgctgtcggacatgcacactaccgccagtaactttccgcacagggactgactgc

SEQ ID NO: 333057 - DNA, 75 bp, Artificial Sequence
  Synthetic
gaaccggttgacgtggattgcttttgcaggaatgttgacggagtttacctggagtatgggcggtgtggaaaacaa

SEQ ID NO: 333058 - DNA, 75 bp, Artificial Sequence
  Synthetic
aactcggtgtgtggttttggcagaggacagagtgagagaaaaggatgtgcaggagaggatcagagcgttgaagga

SEQ ID NO: 333059 - DNA, 75 bp, Artificial Sequence
  Synthetic
tccacgaccaggggggtcttgttcgctcaatggtggtggcggacaacggagagctgctcagtgaggggggggttc

SEQ ID NO: 333060 - DNA, 75 bp, Artificial Sequence
  Synthetic
gaaggatcaagaacaaggcgttcagtgctgatcccgtcccacgctcagggagatctcacaggaaggggacacaaa

SEQ ID NO: 333061 - DNA, 75 bp, Artificial Sequence
  Synthetic
ctcaatggtggtggcggacaacggagagctgctcagtgaggggggggttcctggaatcgtggcattgtttgtggt

SEQ ID NO: 333062 - DNA, 75 bp, Artificial Sequence
  Synthetic
ccggccacaggcacagcggttgtgtggggaggcgttgtggtttttgcattgcttgtcactggaatggtcaagatt

SEQ ID NO: 333063 - DNA, 75 bp, Artificial Sequence
  Synthetic
cgcacctcactagagttgagggatgggtctggaagaataaaatactcaccctggcggtgatcgccgttgtgtggc

SEQ ID NO: 333064 - DNA, 75 bp, Artificial Sequence
  Synthetic
ggggaggcgttgtggtttttgcattgcttgtcactggaatggtcaagattgagagcttggtgcggtatgtcgtgg

SEQ ID NO: 333065 - DNA, 75 bp, Artificial Sequence
  Synthetic
tcagctggccatggaacgcacgggaagatgttgtgcgcatggctatgactgatcctacacccgcttggcagcaga

SEQ ID NO: 333066 - DNA, 75 bp, Artificial Sequence
  Synthetic
gttggggccagagatcgtggccctgacgctgcttcaggccgttttcgagctgagggtgggcctgctcagcgcatt

SEQ ID NO: 333067 - DNA, 75 bp, Artificial Sequence
  Synthetic
acgctgcttcaggccgttttcgagctgagggtgggcctgctcagcgcattcgcactgcgcagaagtctcactgtt

SEQ ID NO: 333068 - DNA, 75 bp, Artificial Sequence
  Synthetic
tgggaggatgcgtcaccataacagctgaggggaagccctcgatggatgtgtggcttgactccatctaccaggaga

SEQ ID NO: 333069 - DNA, 75 bp, Artificial Sequence
  Synthetic
tcttgttggtcttggagctggggctgccgggtgagagccttgagggtctttggaaatggggtgatgcactggcca

SEQ ID NO: 333070 - DNA, 75 bp, Artificial Sequence
  Synthetic
tcaaatgcgaaagaggccgtggaggaccccgttttctggcagctggtggatgaagagagagagagagaccttgcc

SEQ ID NO: 333071 - DNA, 75 bp, Artificial Sequence
  Synthetic
ccttcacgcaaagctatcggacaccaaagtcgcggccagatgcccaacaatgggacctgccactttggctgaaga

SEQ ID NO: 333072 - DNA, 75 bp, Artificial Sequence
  Synthetic
ctatggactcataatcttcctgggtgtggcttcggcttgctcggtctggagattgatcaggggacacagggaaca

SEQ ID NO: 333073 - DNA, 75 bp, Artificial Sequence
  Synthetic
gcttggagagtttggagtgtccaagggaagccgagccatgtggtacatgtggctgggaagccgctttcaggagtt

SEQ ID NO: 333074 - DNA, 75 bp, Artificial Sequence
  Synthetic
ttggccggactaatggggggagagggttctggaatcaggctgctagctttctgggagctgtcaacccacagaggg

SEQ ID NO: 333075 - DNA, 75 bp, Artificial Sequence
  Synthetic
cgggtccggcaggactcaatgggaaactttcacctgacggagctcgagaaagaggagagagtgatggctttttgg

SEQ ID NO: 333076 - DNA, 75 bp, Artificial Sequence
  Synthetic
tggaggctgcatcatggatgttatcacgagaagagaccagagaggatcagtccaggttgtgacctatgctctcaa

SEQ ID NO: 333077 - DNA, 75 bp, Artificial Sequence
  Synthetic
atggaaccaagtaccacctgaaaagtggccacgtgacatgcgaggtaggactagaaaaacttaagatgaaaggtc

SEQ ID NO: 333078 - DNA, 75 bp, Artificial Sequence
  Synthetic
gaaattcacgtggaaaagaattccaacagacagtggacatgacacagtggtcatggaggttgcgttctctgggac

SEQ ID NO: 333079 - DNA, 75 bp, Artificial Sequence
  Synthetic
acagacagtggacatgacacagtggtcatggaggttgcgttctctgggaccaaaccctgtaggatcccggtgagg

SEQ ID NO: 333080 - DNA, 75 bp, Artificial Sequence
  Synthetic
ggtggtttcatagaaatgcagttacctccaggagacaatatcatctatgttggggaactgagtcaccaatggttc

SEQ ID NO: 333081 - DNA, 75 bp, Artificial Sequence
  Synthetic
gggaagagagtcaggttccactctcccgcggtcagtgaccaacagatgggaggggcaatcgtcgacgtcatgtgt

SEQ ID NO: 333082 - DNA, 75 bp, Artificial Sequence
  Synthetic
agagcgacggggaaatggtcgcacccgacgcaccatccatgaagcaacacttcgtgagacccccccggccagtag

SEQ ID NO: 333083 - DNA, 75 bp, Artificial Sequence
  Synthetic
ggaggtggcaatcatggatgaagcccattggacagatccacacagcatagccgccagaggtcatttgtacactct

SEQ ID NO: 333084 - DNA, 75 bp, Artificial Sequence
  Synthetic
ttcgtgagacccccccggccagtagagggggaagctggtcaggggtaaaaacacccccagagtgcactacggcag

SEQ ID NO: 333085 - DNA, 75 bp, Artificial Sequence
  Synthetic
gagaccttcgaggagggaacttgtggcatagtgccccaaaacagacttgaaatggccatgtggaggagttcggcg

SEQ ID NO: 333086 - DNA, 75 bp, Artificial Sequence
  Synthetic
gtcctcatgacagcaacaccgcctgggaagagtgatcccttcccagagtccaacggagccatcaccagtgaagag

SEQ ID NO: 333087 - DNA, 75 bp, Artificial Sequence
  Synthetic
tatcgaggcggcattcctggattgctaaaaaaggggaaagacataaaggtctcttggaagagttggggccactca

SEQ ID NO: 333088 - DNA, 75 bp, Artificial Sequence
  Synthetic
gtatgaagggcgcaccgcctggttcgttccatcgattgcaaagggtggtgtcatcgctcgaaccttgagacaaaa

SEQ ID NO: 333089 - DNA, 75 bp, Artificial Sequence
  Synthetic
agcaaaacctttgagaaagactacaccagagtaagagatgaaaaacccgattttgtggtgacgaccgacatatct

SEQ ID NO: 333090 - DNA, 75 bp, Artificial Sequence
  Synthetic
tggcagagtttggagttggcctgagaacaaaagtatttttggacttcagacaggaatcaacacacgagtgtgaca

SEQ ID NO: 333091 - DNA, 75 bp, Artificial Sequence
  Synthetic
gaaatgggagccaaccttgatgtgagccgggttatcgatgggcgaacgaacatcaagcctgaagaggttgatggg

SEQ ID NO: 333092 - DNA, 75 bp, Artificial Sequence
  Synthetic
caggaatcaacacacgagtgtgacacaggagtgatgggggctgctgtcaagaatggcatggcagtccacacagac

SEQ ID NO: 333093 - DNA, 75 bp, Artificial Sequence
  Synthetic
gaaggacgaacagatgaatacatatactctggacagtgtgatgatgatgacagtggactcgtgcagtggaaggag

SEQ ID NO: 333094 - DNA, 75 bp, Artificial Sequence
  Synthetic
caactttacgaggaccagtggccaccttctacggaccagaacaggacaagatgccagaggtggcaggccacttcc

SEQ ID NO: 333095 - DNA, 75 bp, Artificial Sequence
  Synthetic
cgcacctcactagagttgagggatgggtctggaagaataaagtactcaccctggcggtgatcgccgttgtgtggc

SEQ ID NO: 333096 - DNA, 75 bp, Artificial Sequence
  Synthetic
agtgaaaggaccatggaagtactcgcccatccgagtaacaagagaagagtgccctggcacgagggtcaccataaa

SEQ ID NO: 333097 - DNA, 75 bp, Artificial Sequence
  Synthetic
tctgtgaggagcaccacagagagtggcaaggtgattccagagtggtgctgccgaacgtgcacactacctccagtg

SEQ ID NO: 333098 - DNA, 75 bp, Artificial Sequence
  Synthetic
aggccaatggagatctggtcaccttcaggagcccgaatggagctgaaagaactctcaggccggtgtggaaggacg

SEQ ID NO: 333099 - DNA, 75 bp, Artificial Sequence
  Synthetic
agcgccttggatgtcttctacacgctgatgcatgaggagcctggcagtcgggcaatgaggatggccgagagagat

SEQ ID NO: 333100 - DNA, 75 bp, Artificial Sequence
  Synthetic
aaccctgggtgtcatctggtgcttcgtggtccgaacttcgataagccgcatgatgctcgggacactggtactgct

SEQ ID NO: 333101 - DNA, 75 bp, Artificial Sequence
  Synthetic
gggggtgtcagttacgggaacatggctggagtggctctcatcttctacacactgctaacggtgttgcagcccgag

SEQ ID NO: 333102 - DNA, 75 bp, Artificial Sequence
  Synthetic
ctggagtggctctcatcttctacacactgctaacggtgttgcagcccgaggcaggaaaacagagaagcagtgatg

SEQ ID NO: 333103 - DNA, 75 bp, Artificial Sequence
  Synthetic
gaccctgtgcagtctggctggattggttgccgccaatgagatggggttccttgaaagaaccaaggcggatctgtc

SEQ ID NO: 333104 - DNA, 75 bp, Artificial Sequence
  Synthetic
tatggactcatgctcttcttgggcgtggcctcatgttgctcaatctggaaactgattcgaggacacagagaacag

SEQ ID NO: 333105 - DNA, 75 bp, Artificial Sequence
  Synthetic
gagccgcggtcatggggtgagtggacgaacattgacattcagccggcgaggtcttggggaacctatgtgctggtg

SEQ ID NO: 333106 - DNA, 75 bp, Artificial Sequence
  Synthetic
cgaacattgacattcagccggcgaggtcttggggaacctatgtgctggtggtgtctctcttcactccatatatca

SEQ ID NO: 333107 - DNA, 75 bp, Artificial Sequence
  Synthetic
actgattcgaggacacagagaacagaagggactgacttggattgtccctttggccgggttactcggaggagaggg

SEQ ID NO: 333108 - DNA, 75 bp, Artificial Sequence
  Synthetic
ctcaggaggctctttgcgcgctcgccgtagcttcgttcctcctgctcatgctggtgctagggacaaggaagatgc

SEQ ID NO: 333109 - DNA, 75 bp, Artificial Sequence
  Synthetic
tgggctggctgcatttcacttggccatcgtggtgtctggattggaggctgaactgacacaaagagcccacaaggt

SEQ ID NO: 333110 - DNA, 75 bp, Artificial Sequence
  Synthetic
tgtggagtggcacccagaactgatgaatgaaggtggagaggtgagcctgcgggtccggcaggattcaatgggaaa

SEQ ID NO: 333111 - DNA, 75 bp, Artificial Sequence
  Synthetic
aatgaaggtggagaggtgagcctgcgggtccggcaggattcaatgggaaacttccacctgacagagcttgagaaa

SEQ ID NO: 333112 - DNA, 75 bp, Artificial Sequence
  Synthetic
acagaactgaacctggctttggcggagggagacgcaaatctcacagtggtggtggacaaactcgatcccacagat

SEQ ID NO: 333113 - DNA, 75 bp, Artificial Sequence
  Synthetic
agacttggtcttctctggacaaggaggacgtgagcgtggtgacaggccctttgaggtcaaggatggcgtctacag

SEQ ID NO: 333114 - DNA, 75 bp, Artificial Sequence
  Synthetic
tgtggcttgagcggtgtggttaggggcagcctttgggggtttttgccccttgggcaccggctctggcttcgggct

SEQ ID NO: 333115 - DNA, 75 bp, Artificial Sequence
  Synthetic
gcagcctttgggggtttttgccccttgggcaccggctctggcttcgggcttctgggagcaggcgtggtggttctg

SEQ ID NO: 333116 - DNA, 75 bp, Artificial Sequence
  Synthetic
atggttccaaaggtgtcctacacacgatgtggcatgtgacgagaggggcggcgttgtccattgatgacgccgtcg

SEQ ID NO: 333117 - DNA, 75 bp, Artificial Sequence
  Synthetic
gaaacagaggctgaacagctgcaccaaggaggaattctttgtttacaggcgcactggcattctggagacggaaag

SEQ ID NO: 333118 - DNA, 75 bp, Artificial Sequence
  Synthetic
aaggaggaattctttgtttacaggcgcactggcattctggagacggaaagagacaaggccagagagctgctaagg

SEQ ID NO: 333119 - DNA, 75 bp, Artificial Sequence
  Synthetic
cagtctcgcgagggacggcaaaactggcctggctcgaagaacgcggctacgcaactctcaaaggggaagtggtgg

SEQ ID NO: 333120 - DNA, 75 bp, Artificial Sequence
  Synthetic
gtcctactatgcggcttctcgaccggcggtcatgaatgtcaaagcatacacaattggcggaaaaggacatgaggc

SEQ ID NO: 333121 - DNA, 75 bp, Artificial Sequence
  Synthetic
ggaaatggggagatgcactggccatgggggcattgattttcagagcttgcacagcagaggaaaagaccggtgttg

SEQ ID NO: 333122 - DNA, 75 bp, Artificial Sequence
  Synthetic
aaggaaatggagcgtgccttgaatgggaagagagtcaggttccattctcctgcagttggagatcaacaagtggga

SEQ ID NO: 333123 - DNA, 75 bp, Artificial Sequence
  Synthetic
acatcgtgaactccgtcaacatccagtcaaggaaactcctagcccggtttggagaccagagaggacccaccagag

SEQ ID NO: 333124 - DNA, 75 bp, Artificial Sequence
  Synthetic
aactcggtgcgtggttttggctgaggacagagtgagagaaaaagatgtgcaggagaggatcagagcgttgaggga

SEQ ID NO: 333125 - DNA, 75 bp, Artificial Sequence
  Synthetic
gggtccggcaggactcaatgggaaacttccacctgacagagcttgagaaagaggaaagagtgatggctttttggc

SEQ ID NO: 333126 - DNA, 75 bp, Artificial Sequence
  Synthetic
tatgaggggcgtaccgcatggttcgtcccctcgattgcaaaaggtggcatcatagcacgtaccctgagacaaaaa

SEQ ID NO: 333127 - DNA, 75 bp, Artificial Sequence
  Synthetic
ttcgtggtcacaaccgacatatctgaaatgggggccaacctcgatgtgagccgtgtcatagatggacgaacaaac

SEQ ID NO: 333128 - DNA, 75 bp, Artificial Sequence
  Synthetic
atcaaaccggaagaggttgatgggcgagttgagctcacagggaccagacgtgtgaccacggcctctgcggcccaa

SEQ ID NO: 333129 - DNA, 75 bp, Artificial Sequence
  Synthetic
tgtgaccacggcctctgcggcccaacgccgtgggagagtcggaagacaggagggaagaacagatgaatacatata

SEQ ID NO: 333130 - DNA, 75 bp, Artificial Sequence
  Synthetic
ctctggacagtgtgatgatgatgacagtggacttgtgcagtggaaggaagcgcagatacttcttgacaacataac

SEQ ID NO: 333131 - DNA, 75 bp, Artificial Sequence
  Synthetic
accctgtcttctggcacctcgtggacgaagagagggagagacaccttgccgggaggtgcgcccactgcgtgtaca

SEQ ID NO: 333132 - DNA, 75 bp, Artificial Sequence
  Synthetic
tgccagaggttgcaggtcatttccgcctcactgaagagaaaagaaagcattttcgacatcttctcacccactgtg

SEQ ID NO: 333133 - DNA, 75 bp, Artificial Sequence
  Synthetic
gtggagctggagtggagggaataagcctgaactacctgggctggcacctaaaaaaattgtcaaccctgaatggag

SEQ ID NO: 333134 - DNA, 75 bp, Artificial Sequence
  Synthetic
aggagcccgaatggggctgaaagaacattgaggccagtgtggagggatgcgcgcatgttcagagagggacgtgac

SEQ ID NO: 333135 - DNA, 75 bp, Artificial Sequence
  Synthetic
tggttgggacaccaaggttaccaatgcagatttagaggatgaggagcaaattttacgctacatggagggtgagca

SEQ ID NO: 333136 - DNA, 75 bp, Artificial Sequence
  Synthetic
gcagatttagaggatgaggagcaaattttacgctacatggagggtgagcatagacagctggcggccacaataatg

SEQ ID NO: 333137 - DNA, 75 bp, Artificial Sequence
  Synthetic
tgaaggtcgccagaccttcccgtgatggaggctgcatcatggatgtcatcacaagaagagaccagagaggatcag

SEQ ID NO: 333138 - DNA, 75 bp, Artificial Sequence
  Synthetic
gatgcatgaggagcctggcagtagagcaatgaagatggccgagagagatgctccagaggccttcttgacggtggt

SEQ ID NO: 333139 - DNA, 75 bp, Artificial Sequence
  Synthetic
caccctcaccaacataaaggtgcagttgatccgaatgatggaaggggaaggggtcatagaggcatcggatgcaca

SEQ ID NO: 333140 - DNA, 75 bp, Artificial Sequence
  Synthetic
attgatgacaggtttgggaaagcgctttactttctgaatgacatggccaagaccaggaaggacattggggaatgg

SEQ ID NO: 333141 - DNA, 75 bp, Artificial Sequence
  Synthetic
ctgcgagggccttattgacggtcgtagaggtgatgggggtcggcctggctactctcggcctcgtttggtgctttg

SEQ ID NO: 333142 - DNA, 75 bp, Artificial Sequence
  Synthetic
gtggctgctgagctatttccatcggcgtgacttgaggacacttgggcttgccatttgctcggcggtacccgtgga

SEQ ID NO: 333143 - DNA, 75 bp, Artificial Sequence
  Synthetic
tggagcattcatgccagtggagcctggatgaccacagaggacatgctggatgtctggaaccgggtgtggattttg

SEQ ID NO: 333144 - DNA, 75 bp, Artificial Sequence
  Synthetic
ttcttctcggcaatggtacgcaatcccatggtggatggagacgtcatcaatccatttggagagggagaggcaaaa

SEQ ID NO: 333145 - DNA, 75 bp, Artificial Sequence
  Synthetic
cctggagggctcgttaaatattgtccagaaccaaaaaccacagcaagcaacccacagaaaaggcgagacctcgga

SEQ ID NO: 333146 - DNA, 75 bp, Artificial Sequence
  Synthetic
gggcacagactctggctcagggcttctgggagtaggcgtggcggctctgaaggggacactcttggtgacttgtgg

SEQ ID NO: 333147 - DNA, 75 bp, Artificial Sequence
  Synthetic
cactggcatcctggagacggaaagggacaaggcgcgggaactcctcaggagaggggagaccaacatggggctggc

SEQ ID NO: 333148 - DNA, 75 bp, Artificial Sequence
  Synthetic
gaggggagaccaacatggggctggcggtgtcacggggcacggcaaaacttgcctggcttgaggaacgaggttacg

SEQ ID NO: 333149 - DNA, 75 bp, Artificial Sequence
  Synthetic
agattttcttgcacgtgtatgcgtttgctccggatagcaacagcagcgaggtttgagagagataatttttcgctt

SEQ ID NO: 333150 - DNA, 75 bp, Artificial Sequence
  Synthetic
ggaagaaccgtaaccccacggccacctgtgtcttcaaagtgctggccccgtaccgcccagaggtcatagaagcac

SEQ ID NO: 333151 - DNA, 75 bp, Artificial Sequence
  Synthetic
ctgtgtcttcaaagtgctggccccgtaccgcccagaggtcatagaagcactgcacagattccaactgcagtgggg

SEQ ID NO: 333152 - DNA, 75 bp, Artificial Sequence
  Synthetic
gggaccagaggggacccaccagggtgcctgagctggaccttggagttgggactcggtgtgttgttttggctgagg

SEQ ID NO: 333153 - DNA, 75 bp, Artificial Sequence
  Synthetic
acaaggtgaaagaaaaagatgtgcaggagaggatcagtgcgttgcgggaacagtatggtgagacctggcacatgg

SEQ ID NO: 333154 - DNA, 75 bp, Artificial Sequence
  Synthetic
cagtatggtgagacctggcacatggacagagagcacccgtacaggacctggcagtactggggcagctaccgcacc

SEQ ID NO: 333155 - DNA, 75 bp, Artificial Sequence
  Synthetic
atgaccagggagggcttgttcgctcaatggtggtggcagacaatggagagctgcttagtgaggggggcattcccg

SEQ ID NO: 333156 - DNA, 75 bp, Artificial Sequence
  Synthetic
tgattaatggagtcgtgaaacttctcagctggccatggaacgcgcgggaggatgtcgtgcgaatggccatgactg

SEQ ID NO: 333157 - DNA, 75 bp, Artificial Sequence
  Synthetic
tggctgctgagcaacttccaacggcgcgacttgcgaacgcttggactcgccatctcttcggcggtgcccgtcgac

SEQ ID NO: 333158 - DNA, 75 bp, Artificial Sequence
  Synthetic
accactgggcctctagggggtccagtggatctggagtggagggaataagcctgaactacctgggctggcatctta

SEQ ID NO: 333159 - DNA, 75 bp, Artificial Sequence
  Synthetic
cagacctagaggatgaagagcagctcctacgctacatggagggtgaacacaagcaactggcggctacaataatgc

SEQ ID NO: 333160 - DNA, 75 bp, Artificial Sequence
  Synthetic
aagcaactggcggctacaataatgcagaaggcataccacgctaaagtggtgaaagttgcccggccctcccgagat

SEQ ID NO: 333161 - DNA, 75 bp, Artificial Sequence
  Synthetic
gtggtatcgctagttggtgcaacgccaacatccttggtggttggtgttggtctggcggcgttccacctggccatt

SEQ ID NO: 333162 - DNA, 75 bp, Artificial Sequence
  Synthetic
agtcattgaggcctcggacgcacacaacccaagactacttcgagtggaacgatggctgagagatcatggagaaga

SEQ ID NO: 333163 - DNA, 75 bp, Artificial Sequence
  Synthetic
ctactttctgaatgacatggcaaaaaccaggaaagacattggggaatgggagcattcggttggcttttcgaactg

SEQ ID NO: 333164 - DNA, 75 bp, Artificial Sequence
  Synthetic
gcgacttgcgaacgcttggactcgccatctgttcggcggtgcccgtcgactgggtccctactggccgcacgacct

SEQ ID NO: 333165 - DNA, 75 bp, Artificial Sequence
  Synthetic
catctgttcggcggtgcccgtcgactgggtccctactggccgcacgacctggagcattcatgctagcggagcctg

SEQ ID NO: 333166 - DNA, 75 bp, Artificial Sequence
  Synthetic
tgggtccctactggccgcacgacctggagcattcatgctagcggagcctggatgaccacagaggacatgctggat

SEQ ID NO: 333167 - DNA, 75 bp, Artificial Sequence
  Synthetic
ggagcattcatgctagcggagcctggatgaccacagaggacatgctggatgtctggaacagggtgtggattctgg

SEQ ID NO: 333168 - DNA, 75 bp, Artificial Sequence
  Synthetic
aaaccagactgtgactgagcaaaacctggagtgctcgttaaacattgtccagaaccaaaaaccacagcaaaccaa

SEQ ID NO: 333169 - DNA, 75 bp, Artificial Sequence
  Synthetic
gactggggtgagggccaggaagcgaggccacagagcatggaatgatgcggcagcgcgcgagagcgacggggaaat

SEQ ID NO: 333170 - DNA, 75 bp, Artificial Sequence
  Synthetic
ggtcgcacccgacgcaccatccatgaagaaacgtttcgtgagaccccccgaccagtggaggggaaagctggccgg

SEQ ID NO: 333171 - DNA, 75 bp, Artificial Sequence
  Synthetic
attttctgaatgacatggccaaaaccaggaaagacattggagagtgggagcattcggttggcttctcgaactggg

SEQ ID NO: 333172 - DNA, 75 bp, Artificial Sequence
  Synthetic
cggttcttgttctccctgagccaccatcacccagacacagatagtctgacaaggaggtgatgtgtgactcggaaa

SEQ ID NO: 333173 - DNA, 75 bp, Artificial Sequence
  Synthetic
agatttcttgcacgtgcgtgcgtttgcttcggatagcaacagcagcgacaggtttgagagaggcgatctttcgct

SEQ ID NO: 333174 - DNA, 75 bp, Artificial Sequence
  Synthetic
gctgctgagttacttccaccggcgcgacttgcggacgcttggacttgccatctgttcggcggtgcccattgactg

SEQ ID NO: 333175 - DNA, 75 bp, Artificial Sequence
  Synthetic
aacagctcgtcaacagcgctgttgcaactggagcccaggccatgcgagacctcggaggaggggctccattttttg

SEQ ID NO: 333176 - DNA, 75 bp, Artificial Sequence
  Synthetic
cgcatgatggggattttatggcacgccgtagccggcactgctagaagtcccgtgttgaagtctttctggaattca

SEQ ID NO: 333177 - DNA, 75 bp, Artificial Sequence
  Synthetic
ccgtagccggcactgctagaagtcccgtgttgaagtctttctggaattcagttccactgaaacaggccacggcag

SEQ ID NO: 333178 - DNA, 75 bp, Artificial Sequence
  Synthetic
tgttgtcctaataggagtgacacttgcggccacagtacggaaagaaagagacggtactaccgtgatcagagctga

SEQ ID NO: 333179 - DNA, 75 bp, Artificial Sequence
  Synthetic
gtgtgatgactcactaacctatgagtgtgtgaccatagaccagggggaggaaccggttgacgtggattgcttttg

SEQ ID NO: 333180 - DNA, 75 bp, Artificial Sequence
  Synthetic
acacacctcactagagttgaaggatgggtctggaagaacaagctacctgccttggcgatggttatcgttgtgtgg

SEQ ID NO: 333181 - DNA, 75 bp, Artificial Sequence
  Synthetic
agatgggcgcgccctcatagtgccatgccgagaccaagatgaactggttggaagagcccgcgtctcaccgggttg

SEQ ID NO: 333182 - DNA, 75 bp, Artificial Sequence
  Synthetic
cgtcttgtgaggcaaaaaagaaagccacaggacacgtgtatgacgccaacaaaattgtgtacacagtcaaagtag

SEQ ID NO: 333183 - DNA, 75 bp, Artificial Sequence
  Synthetic
tgcagagtcgccagcggcgttgaccttgctcagaccgtcattttggagcttgacaagacctcagagcacctaccg

SEQ ID NO: 333184 - DNA, 75 bp, Artificial Sequence
  Synthetic
tgacaagacctcagagcacctaccgacggcctggcaggtccaccgggactggttcaatgacttggccttgccgtg

SEQ ID NO: 333185 - DNA, 75 bp, Artificial Sequence
  Synthetic
ggggaactgagtcaccaatggttccaaaaagggagtagtattggaagggtctttcaaaaaaccaggaaaggcata

SEQ ID NO: 333186 - DNA, 75 bp, Artificial Sequence
  Synthetic
aaaaagggagtagtattggaagggtctttcaaaaaaccaggaaaggcatagaaaggttgacagtgatcggagaac

SEQ ID NO: 333187 - DNA, 75 bp, Artificial Sequence
  Synthetic
cgaggccacagatcatggaatgatgcggcagcgcgcgagagcgacggggaagtggtcgcacccgacgcaccatcc

SEQ ID NO: 333188 - DNA, 75 bp, Artificial Sequence
  Synthetic
tgagggtgggtttgctcagcgcattcgcactgcgcagaagcctcaccgtccgagagatggtgaccatctactttc

SEQ ID NO: 333189 - DNA, 75 bp, Artificial Sequence
  Synthetic
gggagacgcaaatctcacagtggtggtggacaaactcgatcccacagattatcgaggtggcattcctggcttgct

SEQ ID NO: 333190 - DNA, 75 bp, Artificial Sequence
  Synthetic
tcttggaagagctggggccactcgatgatctggagtgtccccgaggccccccggcggtttatggtgggaacagag

SEQ ID NO: 333191 - DNA, 75 bp, Artificial Sequence
  Synthetic
tggcggggcccagatcctggtacaacaggatacctgggtactcagaacaagtgaaaggaccatggaagtactcgc

SEQ ID NO: 333192 - DNA, 75 bp, Artificial Sequence
  Synthetic
aaactggggtgttgctgaagtcacttgctggggttcctgtggcgcacattgatggaacaaagtaccacctaaaaa

SEQ ID NO: 333193 - DNA, 75 bp, Artificial Sequence
  Synthetic
gagcttagtgcgctatgtcgtggcagttgggatcacattccatcttgagctggggccggagattgtggctctgac

SEQ ID NO: 333194 - DNA, 75 bp, Artificial Sequence
  Synthetic
ggggcattgattttcagagcttgcacagcagaggaaaagaccggcgttggacttctgctcatggctctcatgaca

SEQ ID NO: 333195 - DNA, 75 bp, Artificial Sequence
  Synthetic
ccccgccgcttcatggtgggcacggagggaggaaatgagtgcccattggagagaaggaagacaggtgtcttcacg

SEQ ID NO: 333196 - DNA, 75 bp, Artificial Sequence
  Synthetic
gaaccccggccatggagtgaatggacgaatgtggacatccagccagcgaggtcctgggggacctatgtgctggtg

SEQ ID NO: 333197 - DNA, 75 bp, Artificial Sequence
  Synthetic
accatcgacaatgctgaggtcgtggattcagagcttttccttccagctagcctggcagggcctaggtcctggtac

SEQ ID NO: 333198 - DNA, 75 bp, Artificial Sequence
  Synthetic
ggggaggcgttgtggttcttgcactgctcgtcactggaatggtcaagattgagagcttggtgcgatacgtcgtgg

SEQ ID NO: 333199 - DNA, 75 bp, Artificial Sequence
  Synthetic
gctcgtcactggaatggtcaagattgagagcttggtgcgatacgtcgtggcggtggggatcacattccatctcga

SEQ ID NO: 333200 - DNA, 75 bp, Artificial Sequence
  Synthetic
accaaccttccgccagccgtcagtggcacgggttggacggcaaaagggcagatcacagtgctggacatgcaccca

SEQ ID NO: 333201 - DNA, 75 bp, Artificial Sequence
  Synthetic
accaaccttccgcctgccgtcagtggcacgggttggacggcaaaagggcagatcacagtgctggacatgcaccca

SEQ ID NO: 333202 - DNA, 75 bp, Artificial Sequence
  Synthetic
accaaccttccgcccgccgtcagtggcacgggttggacggcaaaagggcagatcacagtgctggacatgcaccca

SEQ ID NO: 333203 - DNA, 75 bp, Artificial Sequence
  Synthetic
accaaccttccgccggccgtcagtggcacgggttggacggcaaaagggcagatcacagtgctggacatgcaccca

SEQ ID NO: 333204 - DNA, 75 bp, Artificial Sequence
  Synthetic
ctggacggatccacatagcatagccgcacggggtcacttgtacaccctggctaaagaaaacaaatgtgccctggt

SEQ ID NO: 333205 - DNA, 75 bp, Artificial Sequence
  Synthetic
tgaaatcaaatgcagccttgggagcttggtcagatgagcaaaacagatgggcaagtgcaagagaggctgtagagg

SEQ ID NO: 333206 - DNA, 75 bp, Artificial Sequence
  Synthetic
tcctacggtacatggagggtgagcacaaacaattggcaaccacaataatgcaaaaagcataccatgccaaagttg

SEQ ID NO: 333207 - DNA, 75 bp, Artificial Sequence
  Synthetic
ttttacgccgtggttggcatggcacgtcgcggcaaacgtgtctagtgtgacaagccggaactggacatgggaagg

SEQ ID NO: 333208 - DNA, 75 bp, Artificial Sequence
  Synthetic
ggatgaccacagaagacatgctggacgtctggaaccgggtgtggattttggacaaccctttcatgcagaacaagg

SEQ ID NO: 333209 - DNA, 75 bp, Artificial Sequence
  Synthetic
ggagcccgaatggggctgaaagaacactgaggccagtgtggagggatgcgcgcatgttcagagagggacgtgaca

SEQ ID NO: 333210 - DNA, 75 bp, Artificial Sequence
  Synthetic
tggaacttgatcaagtttagagcaggaatggatgtgttcagcatgcaaccacatcgggctgacaccatcatgtgt

SEQ ID NO: 333211 - DNA, 75 bp, Artificial Sequence
  Synthetic
ggctggagtgtccgcgagacggcttgtctttcaaaagcctacggacaaatgtggctgctgagctatttccatcgg

SEQ ID NO: 333212 - DNA, 75 bp, Artificial Sequence
  Synthetic
ccaacctctttggtggttggtgttggcctggcggcgttccacctggccattgtagtgtccggactagaggctgag

SEQ ID NO: 333213 - DNA, 75 bp, Artificial Sequence
  Synthetic
catactatgcagcttctcgaccagctgttatgagtgtcaaagcctatacaattggtggaaagggacatgagaccc

SEQ ID NO: 333214 - DNA, 75 bp, Artificial Sequence
  Synthetic
aagtgatacttctcatggaacagtggaaaaaccgtaaccccacggctacctgtgtgttcaaagtactggccccgt

SEQ ID NO: 333215 - DNA, 75 bp, Artificial Sequence
  Synthetic
aacagactggatgggctggctgctcgtcactgttttgctgggggttacactcgcggcaacagtacggaaggaagg

SEQ ID NO: 333216 - DNA, 75 bp, Artificial Sequence
  Synthetic
caaggtgaaagaaaaagatgtgcaggagaggattagtgcgttgcgggaacagtatggtgagacctggcacatgga

SEQ ID NO: 333217 - DNA, 75 bp, Artificial Sequence
  Synthetic
ttgagtatggacggtgtggaaaacaggaaggatcaaggacaaggcgctcagtgctgattccgtcccatgcccagg

SEQ ID NO: 333218 - DNA, 75 bp, Artificial Sequence
  Synthetic
ggggattatggagatgtgtccttgttgtgcagagtcgccagtggcgttgacttggctcagactgtcattcttgag

SEQ ID NO: 333219 - DNA, 75 bp, Artificial Sequence
  Synthetic
gactggattctggaacgattggcacgaaaaagcaaaccacggatgtgcagcagagaggaattcatagcgaaagtg

SEQ ID NO: 333220 - DNA, 75 bp, Artificial Sequence
  Synthetic
gcggccatgtaacatgcgaggttggactagaaaagctcaaaatgaagggtctcacatacacaatgtgtgacaaaa

SEQ ID NO: 333221 - DNA, 75 bp, Artificial Sequence
  Synthetic
gccgccaatgagacccacagtgggaggaagacggcatccttcacggtctcttcagaaaaaaccatcttgactatg

SEQ ID NO: 333222 - DNA, 75 bp, Artificial Sequence
  Synthetic
gaaggagacgcaaacctcacggtggtggtggacaaactcgatcccaccgactaccgaggcggcgttcctggcctg

SEQ ID NO: 333223 - DNA, 75 bp, Artificial Sequence
  Synthetic
atggctgagagatcatggagaggagcgtctcggaagaatgcttgtgagcggtgacgactgtgtggtgaggccggt

SEQ ID NO: 333224 - DNA, 75 bp, Artificial Sequence
  Synthetic
ccaggaaagatattggggaatgggagcattcggttggcttctcgaactgggaggaggttcctttctgctcacacc

SEQ ID NO: 333225 - DNA, 75 bp, Artificial Sequence
  Synthetic
ttgaattattggtcactgacttgagaaactgctcatggccagccagtcacaccatcgacaatgctgaggtcgtgg

SEQ ID NO: 333226 - DNA, 75 bp, Artificial Sequence
  Synthetic
caaactggagagctcaataatctaaaaccagactgtgactgagcaaaacctggagtgctcgttaaatattgtcca

SEQ ID NO: 333227 - DNA, 75 bp, Artificial Sequence
  Synthetic
atgctcttggatacagggagaaggatgggagcagtacctatcgacctagccaagggaacatttggcagccccatc

SEQ ID NO: 333228 - DNA, 75 bp, Artificial Sequence
  Synthetic
tcttgttggtcttggagctagggttgccgggtgagagctttgaaggtctctggaaatggggtgacgcattggcta

SEQ ID NO: 333229 - DNA, 75 bp, Artificial Sequence
  Synthetic
aacacgtcagtgagagtggcgacgggaaaatggtcgatcccgacgtagggcattctgttaaactttgtgagaccc

SEQ ID NO: 333230 - DNA, 75 bp, Artificial Sequence
  Synthetic
aaacgagggtggagaggtgagcttgcgggtccggcaggattcaatgggaaactttcacctgacggagcttgagaa

SEQ ID NO: 333231 - DNA, 75 bp, Artificial Sequence
  Synthetic
ccagatgccaaatggactcgtgttgatgcgcatgatggggattttatggcatgccgtagctggcactgctagaag

SEQ ID NO: 333232 - DNA, 75 bp, Artificial Sequence
  Synthetic
tcagttcccttgaaacaggctacggcggcactccggaagatcaagaaggcagtgagcactctgatggtgggattg

SEQ ID NO: 333233 - DNA, 75 bp, Artificial Sequence
  Synthetic
agtgagcactctgatggtgggattgcaaagacgtggcaaaagaaggtcagtggtagactggacaggttggttgtt

SEQ ID NO: 333234 - DNA, 75 bp, Artificial Sequence
  Synthetic
ccttcccaccggggagggcccatgaggtgcatcagtgccagcctggagaactgctcttggacacagggagaagga

SEQ ID NO: 333235 - DNA, 75 bp, Artificial Sequence
  Synthetic
tgaaggaaaagatgcggcaacccaggtgcgtgtggaaaatggcacctgtgtgatcctggccacggatatgggatc

SEQ ID NO: 333236 - DNA, 75 bp, Artificial Sequence
  Synthetic
aggggcaatcgtcgatgtcatgtgccacgccacctatgtcaacagacggttgctcccgcaggggagacaaaactg

SEQ ID NO: 333237 - DNA, 75 bp, Artificial Sequence
  Synthetic
ggcaaaagaaaacaaatgcgctttggtcctcatgacggcaacaccgcctgggaagagtgagcccttcccggagtc

SEQ ID NO: 333238 - DNA, 75 bp, Artificial Sequence
  Synthetic
gacgcatctcactagagttgagggatgggtctggaagaacaaagtgctcaccctggcagtgatcgccattgtgtg

SEQ ID NO: 333239 - DNA, 75 bp, Artificial Sequence
  Synthetic
gctgctaacggtgttgcagcctgaagcaggaaaacagagaagcagtgatgacaacaagctggcttactttctgtt

SEQ ID NO: 333240 - DNA, 75 bp, Artificial Sequence
  Synthetic
agagagaccagagtgatcgcggctggggtaatcattgtggattatttgggaaaggcagtattgtgacctgtgtca

SEQ ID NO: 333241 - DNA, 75 bp, Artificial Sequence
  Synthetic
ggcctggctcgaggagcgcggctatgcaactctcaaaggggaagtggtagaccttggatgtggaagaggtggctg

SEQ ID NO: 333242 - DNA, 75 bp, Artificial Sequence
  Synthetic
agccacaggacatgtgtatgacgctaacaaaatcgtgtacacggttaaagtagagccgcacacgggggattatgt

SEQ ID NO: 333243 - DNA, 75 bp, Artificial Sequence
  Synthetic
aacaaaatcgtgtacacggttaaagtagagccgcacacgggggattatgtcgctgcgaatgagacccacagcgga

SEQ ID NO: 333244 - DNA, 75 bp, Artificial Sequence
  Synthetic
ctggagtggccctcatcttctacacgttgctaacggtgttgcagcctgaggcaggaaaacagagaagcagtgatg

SEQ ID NO: 333245 - DNA, 75 bp, Artificial Sequence
  Synthetic
cctcggagaagaccatcctgaccatgggagactacggagacgtgtccttgttgtgccgagtggccagcggtgttg

SEQ ID NO: 333246 - DNA, 75 bp, Artificial Sequence
  Synthetic
acttgataagacttcagaacacctacccacggcctggcaggtccaccgggactggttcaatgatctggccctgcc

SEQ ID NO: 333247 - DNA, 75 bp, Artificial Sequence
  Synthetic
ataccgcccagaggtgatagaagcactgcacaggtttcaattgcagtggggtggtggactggtgaggaacccttt

SEQ ID NO: 333248 - DNA, 75 bp, Artificial Sequence
  Synthetic
cagactggagtgttgctcaaatcacttgctggcgttcccgtggcacacattgatggaaccaagtaccacctaaaa

SEQ ID NO: 333249 - DNA, 75 bp, Artificial Sequence
  Synthetic
tcacctggccatggaacgcaagggaggatgttgtacgcatggctatgactgacaccacggcttttgggcagcaga

SEQ ID NO: 333250 - DNA, 75 bp, Artificial Sequence
  Synthetic
gtctgatggcggtggtcatgaacagaacggtggcttccatcacggaagcctcagccgtggggctggcggcagttg

SEQ ID NO: 333251 - DNA, 75 bp, Artificial Sequence
  Synthetic
tccaaaaagggagcagcattggaagggtctttcaaaagaccaggaagggcatagaaagactgacagtgattggag

SEQ ID NO: 333252 - DNA, 75 bp, Artificial Sequence
  Synthetic
tggcatagtgccccaaaacagacttgaaatggccatgtggaggagctcagcgacagaactgaacctggctctggc

SEQ ID NO: 333253 - DNA, 75 bp, Artificial Sequence
  Synthetic
aaagctaaactgtgatagagctaaacctggagggctcgtaaaacattgtccagaaccaaaaatcacagcaagcaa

SEQ ID NO: 333254 - DNA, 75 bp, Artificial Sequence
  Synthetic
gaaatggccatgtggaggagctcagcgacagaactgaacctggctctggcggaaggagacgcaaatctcacagtg

SEQ ID NO: 333255 - DNA, 75 bp, Artificial Sequence
  Synthetic
cacaggagtgatgggggctgctgtcaagaatggcatggcagtccacacagaccagagcctctggatgaaatccgt

SEQ ID NO: 333256 - DNA, 75 bp, Artificial Sequence
  Synthetic
ggcaacacgccagtgagattgccaaattccccctcaatagagggggggcggttcttgttctccctgagcctccat

SEQ ID NO: 333257 - DNA, 75 bp, Artificial Sequence
  Synthetic
gttcttgttctccctgagcctccatcactctgaaacatattgagagacaaggaggtgatatatgactcggaaaaa

SEQ ID NO: 333258 - DNA, 75 bp, Artificial Sequence
  Synthetic
caccatcgataatgctgaggtggtggactcagagctcttccttccagccagtctagcagggcccagatcttggta

SEQ ID NO: 333259 - DNA, 75 bp, Artificial Sequence
  Synthetic
ttgatccgaatgatggagggggaaggagtcatagaggcatcagacgcacataacccaagactactccgtgtggaa

SEQ ID NO: 333260 - DNA, 75 bp, Artificial Sequence
  Synthetic
gccagccactggaacaacggctatgtggggaggcattgtcgtccttgcattgctcgtcactggtctggtaaggat

SEQ ID NO: 333261 - DNA, 75 bp, Artificial Sequence
  Synthetic
tggtgacgactgtgtggtgagaccaattgatgacaggtttgggaaagcgctttactttctgaatgacatggccaa

SEQ ID NO: 333262 - DNA, 75 bp, Artificial Sequence
  Synthetic
cgagagcttagtgcgctatgttgtggcagttgggatcacatttcatcttgagctgaggccagagattgttgctct

SEQ ID NO: 333263 - DNA, 75 bp, Artificial Sequence
  Synthetic
tgggacctgccactttggctgaagagcaccagagtggcacagtgtgtaagagagaccagagtgatcgaggctggg

SEQ ID NO: 333264 - DNA, 75 bp, Artificial Sequence
  Synthetic
ctgagggttggcctgctcagcgcttttgcattgcgcagcaacctcaccgtcagagagatggtaaccatctatttc

SEQ ID NO: 333265 - DNA, 75 bp, Artificial Sequence
  Synthetic
gggaagaggtcccattctgttcacaccatttccacgagctggtgatgaaagatgggcgtgccctggtggtgccgt

SEQ ID NO: 333266 - DNA, 75 bp, Artificial Sequence
  Synthetic
aagctgattcgagggcacagagagcagaaaggactgacttggattatccctttagccgggctgctcggaggagag

SEQ ID NO: 333267 - DNA, 75 bp, Artificial Sequence
  Synthetic
atgttgtgctcctcccttgttggaaggaaggagagggctgagtgggccaagaacatttggggagcggtggaaaag

SEQ ID NO: 333268 - DNA, 75 bp, Artificial Sequence
  Synthetic
gaacatttggggagcggtggaaaaggtcaggaagatggtggggcctgaaaagtttagggactacctttcctgcat

SEQ ID NO: 333269 - DNA, 75 bp, Artificial Sequence
  Synthetic
tggccagcggcatgatgcggcacacctcccaggaggccctttgcgcactcgccatggcttcgttccttttgctca

SEQ ID NO: 333270 - DNA, 75 bp, Artificial Sequence
  Synthetic
gtcaggaagatggtggggcctgaaaagtttagggactacctttcctgcatggaccgacatgacttgcactgggag

SEQ ID NO: 333271 - DNA, 75 bp, Artificial Sequence
  Synthetic
aaagctaaactgtgacagagcaaaacctggagggctcgtaaaacattgtccagaaccaaaaaccacagcaagcaa

SEQ ID NO: 333272 - DNA, 75 bp, Artificial Sequence
  Synthetic
tgtgtggagtggcacccagaactggtgaatgaaggtggagaggtgagcctgcgggtccggcaggatgcaatggga

SEQ ID NO: 333273 - DNA, 75 bp, Artificial Sequence
  Synthetic
aagaggagagagtgatggctttttggctgctggcagggctggcggcttcagcctttcactggtccggcatccttg

SEQ ID NO: 333274 - DNA, 75 bp, Artificial Sequence
  Synthetic
cacgccagtgagagtggcgacgggaaaatggtcgatcccgacgtagggcactctgtaaaactttgtgagaccccc

SEQ ID NO: 333275 - DNA, 75 bp, Artificial Sequence
  Synthetic
ctctgtaaaactttgtgagaccccctgcatcatgacaaggcctaacatgatgcacgaaggggaggcccccggaag

SEQ ID NO: 333276 - DNA, 75 bp, Artificial Sequence
  Synthetic
gagcctggagccttgaggagaagtggaaaggtgagacagtgcaagtccatgccttcccaccggggagagctcatg

SEQ ID NO: 333277 - DNA, 75 bp, Artificial Sequence
  Synthetic
ttggcacaggctggacagcaaaagggcagatcacagtgctggacatgcacccaggctctgggaagacccacagag

SEQ ID NO: 333278 - DNA, 75 bp, Artificial Sequence
  Synthetic
tgagctgaacctggagggctcattaaacattgtccagacaaaacaaaattgaagtgactcggaaaaacacccgca

SEQ ID NO: 333279 - DNA, 75 bp, Artificial Sequence
  Synthetic
ctgctcccgcaggggagacagaactgggaagtggcaatcatggatgaagcccattggacggatccacatagcata

SEQ ID NO: 333280 - DNA, 75 bp, Artificial Sequence
  Synthetic
gggaagtggcaatcatggatgaagcccattggacggatccacatagcatagccgctcggggtcacttatacactc

SEQ ID NO: 333281 - DNA, 75 bp, Artificial Sequence
  Synthetic
agttcttatgacggcaacgccacctgggaagagcgaaccattcccagaatccaacggagcaatcaccagtgaaga

SEQ ID NO: 333282 - DNA, 75 bp, Artificial Sequence
  Synthetic
gggaagagcgaaccattcccagaatccaacggagcaatcaccagtgaagagaaacagatccctgatggggagtgg

SEQ ID NO: 333283 - DNA, 75 bp, Artificial Sequence
  Synthetic
tggatctggagtggaaggaataagcttgaactacctgggctggcatctcaaagggttgtcaacattggaaggagg

SEQ ID NO: 333284 - DNA, 75 bp, Artificial Sequence
  Synthetic
tgaaatgggggccaaccttgatgtgagccgtgtcatagatgggcgaacaaacatcaaaccggaagaggttgatgg

SEQ ID NO: 333285 - DNA, 75 bp, Artificial Sequence
  Synthetic
gagagatcagagtgatcgaggctggggcaaccactgtggactgtttggaaaaggtagcattgtggcctgtgtcaa

SEQ ID NO: 333286 - DNA, 75 bp, Artificial Sequence
  Synthetic
tcaggagcccgaatggggctgaaagaacactgaggccagtgtggagggatgcgcgtatgttcagagaaggacgtg

SEQ ID NO: 333287 - DNA, 75 bp, Artificial Sequence
  Synthetic
gagggaaccaagtaccacctgaagagtggccatgtgacctgcgaagtgggactggaaaaactgaagatgaaaggt

SEQ ID NO: 333288 - DNA, 75 bp, Artificial Sequence
  Synthetic
cgctgctaacagtgctgcagcctgaggcagggaaacagagaagcagtgatgacaacaagttggcttactttttgt

SEQ ID NO: 333289 - DNA, 75 bp, Artificial Sequence
  Synthetic
agtggccgccaatgaaatgggatttctggagaagactaaggcggacctgtccacggtgctgtggagtgaacacga

SEQ ID NO: 333290 - DNA, 75 bp, Artificial Sequence
  Synthetic
ctggagaagactaaggcggacctgtccacggtgctgtggagtgaacacgaggagccgcggtcgtgggaagagtgg

SEQ ID NO: 333291 - DNA, 75 bp, Artificial Sequence
  Synthetic
gttcctggggaacctacgtgctagtggtctccctgttcacaccatacataatccaccaacttcagaccaagatcc

SEQ ID NO: 333292 - DNA, 75 bp, Artificial Sequence
  Synthetic
tggaaatggggtgatgcactggccatgggggcgctgatattcagggcttgcacggcagaaggaaagactggagcg

SEQ ID NO: 333293 - DNA, 75 bp, Artificial Sequence
  Synthetic
actcttggcgtcgtctggtgctttgttgttcgcacctcaatcagtcgcatgatgcttggcacgctggtactgctg

SEQ ID NO: 333294 - DNA, 75 bp, Artificial Sequence
  Synthetic
atgtgtgttcaaagtactggccccgtaccgcccagaagtcatagaagcactgcatagattccaactgcagtgggg

SEQ ID NO: 333295 - DNA, 75 bp, Artificial Sequence
  Synthetic
aacatcgtgaattcagtcaacattcaatcaagaaaactcctggcccggttcggggaccagaggggacccactagg

SEQ ID NO: 333296 - DNA, 75 bp, Artificial Sequence
  Synthetic
gctggagcatccgtgaaactgcctgcctctcaaaagcttatgggcagatgtggctgctgagttatttccaccggc

SEQ ID NO: 333297 - DNA, 75 bp, Artificial Sequence
  Synthetic
agattttcttgcacgtgcgtgcgtttgctccggatagcaatagcagcgacaggtttgagagaggtaatctttcgc

SEQ ID NO: 333298 - DNA, 75 bp, Artificial Sequence
  Synthetic
gtcaagcgcaaaagaggctgtggaggatcctgcattctggcaactcgtagatgaagagagagagagacacctcgc

SEQ ID NO: 333299 - DNA, 75 bp, Artificial Sequence
  Synthetic
tgagtaccttgatggtaggtttgcaaagacgtggcaaaaggaggtcagcagcagactggacaggttggttgctgg

SEQ ID NO: 333300 - DNA, 75 bp, Artificial Sequence
  Synthetic
ggaccactgggcctctagggggtctagtggatcaggagtagagggaataagcttgaactacctgggttggtacct

SEQ ID NO: 333301 - DNA, 75 bp, Artificial Sequence
  Synthetic
tgcagccacagtgcggaaagaaagggacggcaccaccgtgatcagagctgaaggaaaagatgcggcaacccaggt

SEQ ID NO: 333302 - DNA, 75 bp, Artificial Sequence
  Synthetic
tgttgatcccgtctcacgcccagggggacctcacaggaaggggacacaaatggttggagggagactcactgcgga

SEQ ID NO: 333303 - DNA, 75 bp, Artificial Sequence
  Synthetic
acacccttaccaacataaaggttcagctgattcgaatgatggaaggggagggagtcattgaggcctcagatgcac

SEQ ID NO: 333304 - DNA, 75 bp, Artificial Sequence
  Synthetic
gaacgtctcggaagaatgcttgtgagcggcgatgactgcgtggtgaggccagtggatgataggttcagcagggcg

SEQ ID NO: 333305 - DNA, 75 bp, Artificial Sequence
  Synthetic
gttgctgacggtgctgcagcctgaagcgggaaaacagagaagcagtgacgacaacaaactggcatattttttgct

SEQ ID NO: 333306 - DNA, 75 bp, Artificial Sequence
  Synthetic
aaaccaggaaagacattggggaatgggagcattcggttgcattctcgaactgggaggagttccctttctgctcac

SEQ ID NO: 333307 - DNA, 75 bp, Artificial Sequence
  Synthetic
gccgtggcacacggctctccagatgtgaatgtggcaatgttgataacacccaaccccacaatcgaaaccaatggt

SEQ ID NO: 333308 - DNA, 75 bp, Artificial Sequence
  Synthetic
attaaatattgtccagacaaaacaaaactgaaatgactaataacaatggaaagaggctgagcaaaaggtcccagt

SEQ ID NO: 333309 - DNA, 75 bp, Artificial Sequence
  Synthetic
ggcgctgcacacagttcttggcggcgcctttaatagcctgtttggaggagtagggttcttgcccaagatcctagt

SEQ ID NO: 333310 - DNA, 75 bp, Artificial Sequence
  Synthetic
ccatgagcttcctcctggccggaggactggttctggccatgacactcggagtcggagccgatgttggttgcgctg

SEQ ID NO: 333311 - DNA, 75 bp, Artificial Sequence
  Synthetic
acagaactgaacttggctttggcggagggagacgcaaacctcacagtggtggtggacaaacttgatcccacagac

SEQ ID NO: 333312 - DNA, 75 bp, Artificial Sequence
  Synthetic
tggtttgaaagagatattcttttgtttctaccagtcgtgaacgtgttgagaaaaagacagcttaggagaacaaga

SEQ ID NO: 333313 - DNA, 75 bp, Artificial Sequence
  Synthetic
tgcgtgtggagaatggcacctgtgtgatcctggctactgacatggggtcatggtgtgatgattcactgtcctatg

SEQ ID NO: 333314 - DNA, 75 bp, Artificial Sequence
  Synthetic
aagaagttgtcaaccctgaatggaggactcttctatgcagatgacacagctggctgggacacgaaagttaccaat

SEQ ID NO: 333315 - DNA, 75 bp, Artificial Sequence
  Synthetic
tggagtatggacgctgtgggaaacaggaaggctcacggacaaggcgctcagtgctgatcccatcccatgctcagg

SEQ ID NO: 333316 - DNA, 75 bp, Artificial Sequence
  Synthetic
agttgggatcacatttcaccttgagctggggccagagattgtggccctgacattgttacaggctgtgtttgagtt

SEQ ID NO: 333317 - DNA, 75 bp, Artificial Sequence
  Synthetic
ctctggagtcagattgctggctttttgggagctggccatccatggaaggagacggtcgttcagcgaaccactgac

SEQ ID NO: 333318 - DNA, 75 bp, Artificial Sequence
  Synthetic
tgttgtgggagtcatgctaacactggccagcggcatgatgcggcatacctcccaggaggccctctgcgcgcttgc

SEQ ID NO: 333319 - DNA, 75 bp, Artificial Sequence
  Synthetic
cgctggggttcctgtggcacacattgagggaaccaagtaccacctgaagagtggccatgtgacatgcgaagtggg

SEQ ID NO: 333320 - DNA, 75 bp, Artificial Sequence
  Synthetic
ggacgtgagcgtggtgacaggccctttgaggtcaaggatggcgtctacagaatcttcagcccaggactgctctgg

SEQ ID NO: 333321 - DNA, 75 bp, Artificial Sequence
  Synthetic
aatcttcagcccaggactgctctgggggcagcgccaagtgggagttggctatggctctaaaggtgtcctacacac

SEQ ID NO: 333322 - DNA, 75 bp, Artificial Sequence
  Synthetic
taggagtggcattggcttggttgggcctgaacatgagaaaccctacaatgtccatgagctttctcttggctggag

SEQ ID NO: 333323 - DNA, 75 bp, Artificial Sequence
  Synthetic
tgctcctggacacaggtaggaggataggggcagtgccaattgatttggcaaaggggacatctggcagccccatcc

SEQ ID NO: 333324 - DNA, 75 bp, Artificial Sequence
  Synthetic
ggtctggaagaataaaatactcaccctggcggtgatcgtcgttgtgaggcagaccgtggaaagtgtggtgactag

SEQ ID NO: 333325 - DNA, 75 bp, Artificial Sequence
  Synthetic
ccaaagtctctggatgagatcaatgaaaaatgacacaggcacttacatagttgaacttttggtcactgacctgag

SEQ ID NO: 333326 - DNA, 75 bp, Artificial Sequence
  Synthetic
caaaccctgtaggatcccggtgagggccgtggcacacggctctccagatgtgaacgtggctatgttgataacacc

SEQ ID NO: 333327 - DNA, 75 bp, Artificial Sequence
  Synthetic
tgtcgcggcaaacgtgtctagtgtgacaagtcggaactggacgtgggaaggtcctgaggagaatactgtggatga

SEQ ID NO: 333328 - DNA, 75 bp, Artificial Sequence
  Synthetic
gcttgtcaccgggatggtcaggatagagagcctggtgcgctatgtggtggcagtggggatcacattccaccttga

SEQ ID NO: 333329 - DNA, 75 bp, Artificial Sequence
  Synthetic
cagtggggatcacattccaccttgagctagggccagagatcgtggccttgatgctactccaggctgtgtttgagc

SEQ ID NO: 333330 - DNA, 75 bp, Artificial Sequence
  Synthetic
gaatggcatggcagtccacacagaccagagcctctggatgaaatccgtgagaaatgaaacagggacctacatagt

SEQ ID NO: 333331 - DNA, 75 bp, Artificial Sequence
  Synthetic
gccgggtgcgagccttgaggatttctggaaatggggtgatgcattggccatgggggcgctgatattcagggcttg

SEQ ID NO: 333332 - DNA, 75 bp, Artificial Sequence
  Synthetic
gatgcttggcacgctggtactgctggcctctctggcgctcctgtgggccggtggtgtaagctacgggaacatggc

SEQ ID NO: 333333 - DNA, 75 bp, Artificial Sequence
  Synthetic
caacatcgacatccagcctgcacgctcctggggaacttatgtgctagtggtctccctgttcacaccatacataat

SEQ ID NO: 333334 - DNA, 75 bp, Artificial Sequence
  Synthetic
tgggagctggccatccatggaaggagacgttcattcagtgaaccactgactgttgtgggagtcatgctaaccctg

SEQ ID NO: 333335 - DNA, 75 bp, Artificial Sequence
  Synthetic
cgggtccgtcaggacgcgatgggaaactttcacttgactgagctcgagaaagaagagagaatgatggctttttgg

SEQ ID NO: 333336 - DNA, 75 bp, Artificial Sequence
  Synthetic
cgatgtggcacgtgacgagaggagcggcgctgtctattgatgatgctgtggccggtccctactgggctgatgtga

SEQ ID NO: 333337 - DNA, 75 bp, Artificial Sequence
  Synthetic
cctcactgaagagaaaagaaagcactttcgacatcttctcacccactgtgacttcacgccgtggctagcatggca

SEQ ID NO: 333338 - DNA, 75 bp, Artificial Sequence
  Synthetic
gagcttctgcgccacagatgtgttagtgccatggatgtcttctacacactgatgcatgaggagcctggcagtaga

SEQ ID NO: 333339 - DNA, 75 bp, Artificial Sequence
  Synthetic
tcctactatgcagcctctcgaccggctgtcatgagcgtcaaggcctacacaattggtggaaaggggcatgagacc

SEQ ID NO: 333340 - DNA, 75 bp, Artificial Sequence
  Synthetic
tcgtccgcacttcgatcaaccggatgatgctcggcacgccggtactgctggcctccttggcactcttgtgggcag

SEQ ID NO: 333341 - DNA, 75 bp, Artificial Sequence
  Synthetic
aatggatgtgttcagcatgcagccacaccgagctgataccatcatgtgtgacatcggagaaagcaacccagatgc

SEQ ID NO: 333342 - DNA, 75 bp, Artificial Sequence
  Synthetic
cactggacggacccccacagcatagctgccagaggtcatttgtacactctggcaaaagaaaacaagtgtgcactg

SEQ ID NO: 333343 - DNA, 75 bp, Artificial Sequence
  Synthetic
gcgcaaatacttcttgacaacataacaaccttgcgggggcccgtggccaccttctatggaccagaacaggacaag

SEQ ID NO: 333344 - DNA, 75 bp, Artificial Sequence
  Synthetic
aattggtggaaagggacatgagactccaaagatggtgacaagcctgggttggaacctgatcaagttcagagcggg

SEQ ID NO: 333345 - DNA, 75 bp, Artificial Sequence
  Synthetic
cacggatcgaagctggacatgggaagggccggaggcaaatgccgtggatgaggccagtggtgacttggtcacctt

SEQ ID NO: 333346 - DNA, 75 bp, Artificial Sequence
  Synthetic
aaaagttgcccggccctcccgagatggaggctgtattatggatgtcatcacaagaagagaccaaaggggttcagg

SEQ ID NO: 333347 - DNA, 75 bp, Artificial Sequence
  Synthetic
accctcaccaacataaaggttcagctgatccgaatgatggagggggagggagtcattgaggcctcggacgcacac

SEQ ID NO: 333348 - DNA, 75 bp, Artificial Sequence
  Synthetic
gtgtctctgtttacaccttacatcatccaccaactgcagaccaaaatccaacaacttgtcaacagtgccgtggca

SEQ ID NO: 333349 - DNA, 75 bp, Artificial Sequence
  Synthetic
tggcttggcggcactccatctggccattgtggtgtctggtttggaggctgaattaacacagagagctcataaggt

SEQ ID NO: 333350 - DNA, 75 bp, Artificial Sequence
  Synthetic
gtgacctgcggacgcttggccttgccatctgttcggcggtacctatcgactgggtccccactggccgcacgacct

SEQ ID NO: 333351 - DNA, 75 bp, Artificial Sequence
  Synthetic
tgggcatagactctggcttcgagcttctgggggtaggcgtggtggttctgagggagacacgcttggagatctctg

SEQ ID NO: 333352 - DNA, 75 bp, Artificial Sequence
  Synthetic
gagctctttaaacaaaaatgccagaattgagctgaacctggagggctcattaaacattgtccagacaaaacaaaa

SEQ ID NO: 333353 - DNA, 75 bp, Artificial Sequence
  Synthetic
tcacagaaacagagctcggactggagagctctttaaacaaaaatgccagaattgagctgaacctggagggctcat

SEQ ID NO: 333354 - DNA, 75 bp, Artificial Sequence
  Synthetic
atcttggatgtggaaggggcggctggtcctattatgcggcatcccgaccggcagtcatgagtgtcagggcataca

SEQ ID NO: 333355 - DNA, 75 bp, Artificial Sequence
  Synthetic
gcagtcatgagtgtcagggcatacaccattggtggaagagggcacgaggctccaaagatggtaacaagcctgggt

SEQ ID NO: 333356 - DNA, 75 bp, Artificial Sequence
  Synthetic
gaaagtgatattgctcatggagcaatggaaaaacaggaaccccacggctgcctgtgtgttcaaggtgctggcccc

SEQ ID NO: 333357 - DNA, 75 bp, Artificial Sequence
  Synthetic
atatcgcccagaagtgatagaagcactgcacagattccaactgcaatggggggggggtctggtgaggaccccttt

SEQ ID NO: 333358 - DNA, 75 bp, Artificial Sequence
  Synthetic
tgcctgaacttgacctgggagttggaactcggtgtgtggtcttggctgaggacaaggtgaaagaacaagacgtac

SEQ ID NO: 333359 - DNA, 75 bp, Artificial Sequence
  Synthetic
gacgaggaacacccgtaccggacatggcagtactggggcagctaccgcacggcaccaaccggctcggcggcgtca

SEQ ID NO: 333360 - DNA, 75 bp, Artificial Sequence
  Synthetic
gggagatgcgcgcactgcgtgtacaacatgatgggcaagagagagaagaaactgggagagttcggagtggcgaaa

SEQ ID NO: 333361 - DNA, 75 bp, Artificial Sequence
  Synthetic
gaaggagactcgttgcgaacacacctcactagagttgaaggatgggtctggaagaacaagctacttgccttggcg

SEQ ID NO: 333362 - DNA, 75 bp, Artificial Sequence
  Synthetic
gatgtgttaccataacagctgaggggaagccttcaatggatgtgtggcttgacgccatttaccaggagaaccctg

SEQ ID NO: 333363 - DNA, 75 bp, Artificial Sequence
  Synthetic
gaccaggaaggacattggggaatgggagcactcggccggcttttcaagctgggaggaggtccccttttgttcaca

SEQ ID NO: 333364 - DNA, 75 bp, Artificial Sequence
  Synthetic
gagggcgcgcatctcaccggggtgcggctggagtgtccgcgagacggcctgcctttcaaaagcctacgggcagat

SEQ ID NO: 333365 - DNA, 75 bp, Artificial Sequence
  Synthetic
ggcatccttcacagtttcttcagagaaaaccattctgactatgggtgagtatggagatgtgtctttgttgtgcag

SEQ ID NO: 333366 - DNA, 75 bp, Artificial Sequence
  Synthetic
ttgggttcctaccggccgcacgacatggagcatccatgccagtggggcctggatgaccacagaagacatgctgga

SEQ ID NO: 333367 - DNA, 75 bp, Artificial Sequence
  Synthetic
cgtctggaaccgagtgtggattttggacaaccctttcatgcagaacaaggaaaaggtcatggagtggagggatgt

SEQ ID NO: 333368 - DNA, 75 bp, Artificial Sequence
  Synthetic
atgttatgttcctcccttgttgggaggaaagaaagagcagaatgggccaagaacatctggggagcggtggaaaag

SEQ ID NO: 333369 - DNA, 75 bp, Artificial Sequence
  Synthetic
ggaccgccatgacctgcactgggagctcagactggagagctcaataatctaaacccagactgtgaccaatacttc

SEQ ID NO: 333370 - DNA, 75 bp, Artificial Sequence
  Synthetic
tttcctcctcctatacaaaattccccctcggtagagggggggcggttcttgttctccctgagccaccatcaccca

SEQ ID NO: 333371 - DNA, 75 bp, Artificial Sequence
  Synthetic
agattttcttgcacgtgcatgcgtttgcttcggacagcattagcagcggttggtttgaaagagatattcttttgt

SEQ ID NO: 333372 - DNA, 75 bp, Artificial Sequence
  Synthetic
gtttacacgccaagttgtcggacactaaggttgcagccagatgcccaacgatgggaccagccactttggctgaag

SEQ ID NO: 333373 - DNA, 75 bp, Artificial Sequence
  Synthetic
cttggcccagaccgtcatccttgagcttgacaagacagtggaacaccttccaacggcttggcaggtccacaggga

SEQ ID NO: 333374 - DNA, 75 bp, Artificial Sequence
  Synthetic
gttattccttccggcgagcctggcaggacccagatcctggtacaacaggatacccggttattcagaacaggtgaa

SEQ ID NO: 333375 - DNA, 75 bp, Artificial Sequence
  Synthetic
cttacgtacacaatgtgtgacaaaacaaagttcacatggaagagagctccaacagacagtgggcatgacacagtg

SEQ ID NO: 333376 - DNA, 75 bp, Artificial Sequence
  Synthetic
caaagccctgtaggatcccagtcagggcagtggcacatggatctccagatgtgaacgtggccatgctgataacgc

SEQ ID NO: 333377 - DNA, 75 bp, Artificial Sequence
  Synthetic
ggaggctttctgagttcaattgggaaggcggtgcatacggtccttggtggtgctttcaacagcatcttcggggga

SEQ ID NO: 333378 - DNA, 75 bp, Artificial Sequence
  Synthetic
tccaggctgtgtttgagctgagggtgggtttgctcagcgcatttgcactgcgcagaagcctcaccgtccgagaga

SEQ ID NO: 333379 - DNA, 75 bp, Artificial Sequence
  Synthetic
agaacggcatggcaatccacacagatcaaagtctctggatgagatcaatgaaaaatgacacaggcacttacatag

SEQ ID NO: 333380 - DNA, 75 bp, Artificial Sequence
  Synthetic
gaagggattgacctggattgtccccctggctagattgcttgggggagagggctctggaatcagactgctggcgtt

SEQ ID NO: 333381 - DNA, 75 bp, Artificial Sequence
  Synthetic
ctttgatggtaggcttgcaaagacgtggaaaaaagaggtcaacaacagattggatgggctggctgcttgtcactg

SEQ ID NO: 333382 - DNA, 75 bp, Artificial Sequence
  Synthetic
aacagtacggaaggaaggggacggcaccactgtgatcagggctgaaggaaaggacgcagcaactcaggtgcgcgt

SEQ ID NO: 333383 - DNA, 75 bp, Artificial Sequence
  Synthetic
aggacgcagcaactcaggtgcgcgtggagaacggcacctgtgtgatattggccacggacatggggtcatggtgtg

SEQ ID NO: 333384 - DNA, 75 bp, Artificial Sequence
  Synthetic
tgtgatgggactgtggacgctcacggaaatgctgaggtcatcccgaaggtctgacctggttttctctggacaggg

SEQ ID NO: 333385 - DNA, 75 bp, Artificial Sequence
  Synthetic
gaaggagattcattgcgaacgcatctcaccagagttgaagggtgggtttggaaaaacaaactacttgccctggca

SEQ ID NO: 333386 - DNA, 75 bp, Artificial Sequence
  Synthetic
tcaccagagttgaagggtgggtttggaaaaacaaactacttgccctggcagtggtagccgttgtgtggttgaccg

SEQ ID NO: 333387 - DNA, 75 bp, Artificial Sequence
  Synthetic
acaggggagacaaaattgggaggtggcaatcatggatgaggcccactggacggacccccacagcatagctgccag

SEQ ID NO: 333388 - DNA, 75 bp, Artificial Sequence
  Synthetic
caggctcggggaagacccacagagtcctcccggagctcattcgccaatgcattgacaggcgcctgagaacgttgg

SEQ ID NO: 333389 - DNA, 75 bp, Artificial Sequence
  Synthetic
gagtggtacggtgtgcaagagagaccagagtgaccgaggctggggcaatcactgcggattgtttggaaagggcag

SEQ ID NO: 333390 - DNA, 75 bp, Artificial Sequence
  Synthetic
cagagtgaccgaggctggggcaatcactgcggattgtttggaaagggcagtattgtgacctgcgtcaaggcggcc

SEQ ID NO: 333391 - DNA, 75 bp, Artificial Sequence
  Synthetic
agtgtgatctgtttgaacagcaaaacctttgaaaaggactactccagagtgagggatgagaagcctgactttgtg

SEQ ID NO: 333392 - DNA, 75 bp, Artificial Sequence
  Synthetic
tgtgaggcaaagaagaaggccactggacatgtgtatgacgccaacaagatcgtgtacaccgttaaggttgagcca

SEQ ID NO: 333393 - DNA, 75 bp, Artificial Sequence
  Synthetic
cgtgtacaccgttaaggttgagccacacacgggggactatgttgccgccaatgaaacccacagtgggaggaagac

SEQ ID NO: 333394 - DNA, 75 bp, Artificial Sequence
  Synthetic
cacacgggggactatgttgccgccaatgaaacccacagtgggaggaagacggcatccttcacggtctcctcagaa

SEQ ID NO: 333395 - DNA, 75 bp, Artificial Sequence
  Synthetic
acggcgcggaagagttggtcggcaagacggacgaacagatgaatacatatactctggacagtgtgatgatgatga

SEQ ID NO: 333396 - DNA, 75 bp, Artificial Sequence
  Synthetic
actggcatatttcttgctgacgctctgcagccttgctggactggttgcagccaatgagatgggttttctggagaa

SEQ ID NO: 333397 - DNA, 75 bp, Artificial Sequence
  Synthetic
cctggctatgacacttggagtgggtgctgatgttggttgtgccgtggacaccgagcgaatggaactccgctgtgg

SEQ ID NO: 333398 - DNA, 75 bp, Artificial Sequence
  Synthetic
tgcagccttgctggactggttgcagccaatgagatgggttttctggagaagaccaaggcagacttgtccacggtg

SEQ ID NO: 333399 - DNA, 75 bp, Artificial Sequence
  Synthetic
gaagagttggggccaatcaatgatctggagcatccccgaggctccccgccgcttcatggtgggcacggagggagg

SEQ ID NO: 333400 - DNA, 75 bp, Artificial Sequence
  Synthetic
aggtgcccccttctttggtgtggcgggacatgtcatgaccctcggggtggtgtcactgattggggccactcccac

SEQ ID NO: 333401 - DNA, 75 bp, Artificial Sequence
  Synthetic
ctctggatgaaatctgtgaaaaatgacactggaacctacatagttgaattattggtcactgacttgagaaactgc

SEQ ID NO: 333402 - DNA, 75 bp, Artificial Sequence
  Synthetic
acactggaacctacatagttgaattattggtcactgacttgagaaactgctcatggcctgccagtcacaccatcg

SEQ ID NO: 333403 - DNA, 75 bp, Artificial Sequence
  Synthetic
gtcggtggtcatgaaccgaacggtggcctccataacagaggcttcagctgtgggactggcagcagcgggacagct

SEQ ID NO: 333404 - DNA, 75 bp, Artificial Sequence
  Synthetic
ctgtgataaacgaggagcttctgtgaggagcaccacggagagtggcaaggtgatcccggaatggtgctgccggac

SEQ ID NO: 333405 - DNA, 75 bp, Artificial Sequence
  Synthetic
gggggggtctggtgaggacccctttttcaaggaactccacccatgagatgtattactcaacagctgtcactggga

SEQ ID NO: 333406 - DNA, 75 bp, Artificial Sequence
  Synthetic
tggtgcgatacgtcgtggcggtggggatcacattccatctcgagctgggaccagagattgtggccctgacgctgc

SEQ ID NO: 333407 - DNA, 75 bp, Artificial Sequence
  Synthetic
ttcaggccgtgttcgagctgagggtgggcctgctcagcgctttcgcactgcgcagaggcctcactgtccgagaga

SEQ ID NO: 333408 - DNA, 75 bp, Artificial Sequence
  Synthetic
tggtgacaatctacttcctcttgttggtcttggagctggggttgccgggtgagagtcttgagggtctctggagat

SEQ ID NO: 333409 - DNA, 75 bp, Artificial Sequence
  Synthetic
aaaggcacaggagcctcagcccggtacaagagtcatcatgagagcagtaaatgattggattttggaacgactggc

SEQ ID NO: 333410 - DNA, 75 bp, Artificial Sequence
  Synthetic
gagggaaaagctggtgtcggactcctgctgatggccctcatgacacagcgggacttggtgaccgtgcactatgga

SEQ ID NO: 333411 - DNA, 75 bp, Artificial Sequence
  Synthetic
cttgaactacctgggctggcacctcaagaagttgtcagccctgaatggaggactcttctatgcagatgacacagc

SEQ ID NO: 333412 - DNA, 75 bp, Artificial Sequence
  Synthetic
agcgaaacctggcacatggacgaggaacacccgtaccggacatggcagtactggggcagctaccgcacggcacca

SEQ ID NO: 333413 - DNA, 75 bp, Artificial Sequence
  Synthetic
gccatggaacgcacgggaagacgtggtgcgcatggccatgactgacacaacggctttcggacagcagagagtgtt

SEQ ID NO: 333414 - DNA, 75 bp, Artificial Sequence
  Synthetic
ggtcttctccggacagggggggcgcgagcgaggtgatagacctttcgaggtcagggacggtgtctacaggatctt

SEQ ID NO: 333415 - DNA, 75 bp, Artificial Sequence
  Synthetic
gattttggaacgactggcgcagaaaagcaaaccgcgcatgtgcagcaaagaggaattcatagcaaaagtgaaatc

SEQ ID NO: 333416 - DNA, 75 bp, Artificial Sequence
  Synthetic
cccggagggctcgtaaaagattgtccggaaccaaaagaaaagcaagcaacttatagagatagagctcggactgga

SEQ ID NO: 333417 - DNA, 75 bp, Artificial Sequence
  Synthetic
gggtggaccgcaaagggccaaatcacagtgctggacatgcacccaggctctgggaagacccacagagtcctcccg

SEQ ID NO: 333418 - DNA, 75 bp, Artificial Sequence
  Synthetic
gagctctttaaacaaaaaaaaaaaaaaaaaaaaaaaaaaaaaaaaaaaaaaaaaaaaaagaagccagaattgagc

SEQ ID NO: 333419 - DNA, 75 bp, Artificial Sequence
  Synthetic
tgaacctggagagctcattaaatacagtccagacaaaacaaaacatgacaaagcaaagaggctgagctaaaagtt

SEQ ID NO: 333420 - DNA, 75 bp, Artificial Sequence
  Synthetic
cgacgtagggcactctggaaaattttgtgagaccccctgcatcatgataaggccgaacatggtgcatgaaagggg

SEQ ID NO: 333421 - DNA, 75 bp, Artificial Sequence
  Synthetic
cacgagctagtgatgaaggacggacgcaccctggtggtgccgtgccgagaccaagatgaactcgttgggagggcg

SEQ ID NO: 333422 - DNA, 75 bp, Artificial Sequence
  Synthetic
ctcgtgcagtggaaggaggcgcagatactcctcgataacataacaactttacgaggacctgtggccaccttctac

SEQ ID NO: 333423 - DNA, 75 bp, Artificial Sequence
  Synthetic
cacggcctccgcagcgcaacgccgtgggagagtcggcagacatgaaggacgaacagatgaatacatatactctgg

SEQ ID NO: 333424 - DNA, 75 bp, Artificial Sequence
  Synthetic
ctgagctacttccatcggcgagacctgaggacactcgggcttgccatcaactcagcagtgcctgtcgattgggtt

SEQ ID NO: 333425 - DNA, 75 bp, Artificial Sequence
  Synthetic
cgaagctggacatgggaaggcccagaggaaaatgcagtggacgaggccaatggagatctggtcaccttcaggagc

SEQ ID NO: 333426 - DNA, 75 bp, Artificial Sequence
  Synthetic
gaatttgtggcgtacgcttcagggcggcgcagcatcggagacgtgctgacagggatgtcgggggtacccgagctt

SEQ ID NO: 333427 - DNA, 75 bp, Artificial Sequence
  Synthetic
ttcaaggactatctctcctgtatggaccgccatgacctgcactgggagctcagactggagagctcaataatctaa

SEQ ID NO: 333428 - DNA, 75 bp, Artificial Sequence
  Synthetic
gatggtgcttggcctggcaaccctgggtgtcatctggtgcttcgttgtccgaacttcgataagccgcatgatgct

SEQ ID NO: 333429 - DNA, 75 bp, Artificial Sequence
  Synthetic
agattttcttgcacgtgcgtgcgcttgcttcggatagcaacagcagcgacaggtttgagagagacactctttcgt

SEQ ID NO: 333430 - DNA, 75 bp, Artificial Sequence
  Synthetic
aacagagaagcagtgatgacaacaagctggcttactttctgttgactctctgcagtctggctggattggtcgccg

SEQ ID NO: 333431 - DNA, 75 bp, Artificial Sequence
  Synthetic
gggcacgtaatgtccctgggagtggtgtcactggtacggggcacacccacttctttggtagtgggtgttgggctg

SEQ ID NO: 333432 - DNA, 75 bp, Artificial Sequence
  Synthetic
caacggcttggcaggtccacagggactggttcaatgatctggctctgccatggaaacatgagggagcgcaaaact

SEQ ID NO: 333433 - DNA, 75 bp, Artificial Sequence
  Synthetic
acaaagagcccacaaggtcttcttctcggcaatggtacgcaacccaatggtggatggggacgtcatcaacccgtt

SEQ ID NO: 333434 - DNA, 75 bp, Artificial Sequence
  Synthetic
tggatggggacgtcatcaacccgtttgggacgggggagacaaaaccagccctgtacgagaggaaaatgagtctgg

SEQ ID NO: 333435 - DNA, 75 bp, Artificial Sequence
  Synthetic
gctagagagctgctaaggaagggggaaaccaacatggggctggcggtctcacgagggacggcaaaactggcctgg

SEQ ID NO: 333436 - DNA, 75 bp, Artificial Sequence
  Synthetic
agaaaggctgacagtgatcggagaacacgcctgggattttggctctactggtggcttcctgacctcggttggtaa

SEQ ID NO: 333437 - DNA, 75 bp, Artificial Sequence
  Synthetic
caagagccccagcctggcacaaaggtcatcatgagagcagtgaatgattggatcctggaacgactggcgcaaaag

SEQ ID NO: 333438 - DNA, 75 bp, Artificial Sequence
  Synthetic
taaaaaaggggaaagacataaaggtatcttggaagagctggggccattcgatgatctggagcgtccccgaggctc

SEQ ID NO: 333439 - DNA, 75 bp, Artificial Sequence
  Synthetic
ttacatggagggtgagcacagacagctagcggccacaataatgcaaaaggcataccacgcaaaagtagtgaaagt

SEQ ID NO: 333440 - DNA, 75 bp, Artificial Sequence
  Synthetic
agaaggaaaacaggtgtcttcacggtggcagagtttggagttggcctgagaacaaaagtatttttggacttcaga

SEQ ID NO: 333441 - DNA, 75 bp, Artificial Sequence
  Synthetic
aaaagcttacggacaaatgtggctgctgagctatttccatcggcgtgacttgaggacactcgggctcgctatttg

SEQ ID NO: 333442 - DNA, 75 bp, Artificial Sequence
  Synthetic
agacaaattcctgatggggagtggcgtgacgggtttgactggatcactgagtatgaggggcgcaccgcctggttt

SEQ ID NO: 333443 - DNA, 75 bp, Artificial Sequence
  Synthetic
ctgagctatttccatcggcgtgacttgaggacactcgggctcgctatttgctcggcggtacccgtggactgggtc

SEQ ID NO: 333444 - DNA, 75 bp, Artificial Sequence
  Synthetic
tggggagcggtggaaaaggtcaggaagatgatagggcctgaaaagtttaaggactacctttcctgcatggaccga

SEQ ID NO: 333445 - DNA, 75 bp, Artificial Sequence
  Synthetic
tttaaggactacctttcctgcatggaccgacatgacttgcactgggagctcagattggagagctcaattatctaa

SEQ ID NO: 333446 - DNA, 75 bp, Artificial Sequence
  Synthetic
gccagcggcatgatgcggcacacctctcaggaggctctttgcgcgctcgccgtggcttcgttccttctgctcatg

SEQ ID NO: 333447 - DNA, 75 bp, Artificial Sequence
  Synthetic
aaccctgggtgtcatctggtgcttcgtcgtccggacttcgatcagccgtatgatgctgggcacactggtcctgat

SEQ ID NO: 333448 - DNA, 75 bp, Artificial Sequence
  Synthetic
ggtggcgtcggctatgggaacatggccggagtggctctcatcttctacacgttgctgacggtgctgcagcccgag

SEQ ID NO: 333449 - DNA, 75 bp, Artificial Sequence
  Synthetic
gcgttgtccattgatgacgccgtcgcagggccctactgggctgatgtcaaagaggacgttgtatgctacggtgga

SEQ ID NO: 333450 - DNA, 75 bp, Artificial Sequence
  Synthetic
agattacagtgctggacatgcacccaggctctgggaagacccacagagtcctcccggagctcattcgccaatgca

SEQ ID NO: 333451 - DNA, 75 bp, Artificial Sequence
  Synthetic
cttggtctgatgagcagaacaggtggtcaagtgcaaaagaggctgtggaggatcccgcattctggcagctcgtgg

SEQ ID NO: 333452 - DNA, 75 bp, Artificial Sequence
  Synthetic
agggaggaattcttcgtgtacaggcgcactggcatcctggagacggaacgtgacaaggctagagagttgctcaga

SEQ ID NO: 333453 - DNA, 75 bp, Artificial Sequence
  Synthetic
tggaggctgcatcatggatgtcatcacaagaagagatcaaagaggctcgggccaggttgtgacctatgcccttaa

SEQ ID NO: 333454 - DNA, 75 bp, Artificial Sequence
  Synthetic
tcctggggaacttacgtgttggtggtctccctgttcacaccttacataatccaccaacttcagaccaagattcaa

SEQ ID NO: 333455 - DNA, 75 bp, Artificial Sequence
  Synthetic
ttacagagatagagctcggactggagagctctttaaacaaaaaagccagaattgagctgaacctggagagctcat

SEQ ID NO: 333456 - DNA, 75 bp, Artificial Sequence
  Synthetic
attgagctgaacctggagagctcattaaacatagtccagacaaaacaaaacatgacaaagcaaagaggctgagct

SEQ ID NO: 333457 - DNA, 75 bp, Artificial Sequence
  Synthetic
tgcgtttgcttcggatagcattagcagcgacaggtttggaagagacattgtttcgtttctaccagtcgtgaacgt

SEQ ID NO: 333458 - DNA, 75 bp, Artificial Sequence
  Synthetic
tcatactatgcagcctctcgaccggctgtcatgagtgtcaaagcctacacaattggtggaaagggacatgagact

SEQ ID NO: 333459 - DNA, 75 bp, Artificial Sequence
  Synthetic
ccagagtgcattacggcagcacgccagtgagagtggcgacgggaaaatggtcgatcccgacgtagggcactctga

SEQ ID NO: 333460 - DNA, 75 bp, Artificial Sequence
  Synthetic
gtggcatgccatagctggcactgctagaagccccgttttgaaatccttctggaattcagttcctctgaaacaggc

SEQ ID NO: 333461 - DNA, 75 bp, Artificial Sequence
  Synthetic
tgctccggatagcaacagcagcgaggtttgagagagataatttctcgtttgaccagtcgtgaacgtgttgagaaa

SEQ ID NO: 333462 - DNA, 75 bp, Artificial Sequence
  Synthetic
acagggactttgtcactggcactcagggaaccacgagagtgactctggtgttggagctgggcggatgtgtcacga

SEQ ID NO: 333463 - DNA, 75 bp, Artificial Sequence
  Synthetic
caagtgcaaaagaggctgtggaggatcccgcattctggcagctcgtggatgaagagagagagagacacctcgctg

SEQ ID NO: 333464 - DNA, 75 bp, Artificial Sequence
  Synthetic
atgccaacaagatcgtgtataccgtcaaggtagagccacacacgggggactatgttgccgccaatgaaacccata

SEQ ID NO: 333465 - DNA, 75 bp, Artificial Sequence
  Synthetic
tatgttgccgccaatgaaacccatagtgggaggaagacggcatcattcacggtttcctcggaaaagaccattttg

SEQ ID NO: 333466 - DNA, 75 bp, Artificial Sequence
  Synthetic
aacccaagactacttcgagtggaacgatggctgagagaccatggagaagaacgtcttggaagaatgcttgtgagc

SEQ ID NO: 333467 - DNA, 75 bp, Artificial Sequence
  Synthetic
cttgagcttgacaagactctggaacaccttccgacagcttggcaggtccatcgggactggttcaatgatctggct

SEQ ID NO: 333468 - DNA, 75 bp, Artificial Sequence
  Synthetic
cctttcaaaagcttatgggcagatgtggctgctgagttacttccaccggcgcgacttgcgaacgcttggactcgc

SEQ ID NO: 333469 - DNA, 75 bp, Artificial Sequence
  Synthetic
gaccccaacagacagcggacatgacacagtggtcatggaggtcacgttctctggaacaaaaccttgcaggatccc

SEQ ID NO: 333470 - DNA, 75 bp, Artificial Sequence
  Synthetic
gggttcttgcctaagatcctagtgggagtggtcctggcctggttgggcctgaacatgaggaatccgaccatgtcc

SEQ ID NO: 333471 - DNA, 75 bp, Artificial Sequence
  Synthetic
agattttttttgacgtgcgtgcgtttgcttcggatagcaaccggagcgacagttttgagagagacaatctttcgc

SEQ ID NO: 333472 - DNA, 75 bp, Artificial Sequence
  Synthetic
tggccatgtggagaagctcggcgacagaactgaatctggccttggcggagggagacgcaaatctcacagtggtgg

SEQ ID NO: 333473 - DNA, 75 bp, Artificial Sequence
  Synthetic
gagcctctggatgaaatccgtgagaaatgacacagggacctacatagtggaacttctggttactgacctgagaaa

SEQ ID NO: 333474 - DNA, 75 bp, Artificial Sequence
  Synthetic
cactgaccaaagcctctggatgaaatctgtgaaaaatgacactggaacttacatagttgaactattggtcactga

SEQ ID NO: 333475 - DNA, 75 bp, Artificial Sequence
  Synthetic
tcgtggattcagagcttttccttccagctagcctagcagggcctaggtcctggtacaacaggatacctgggtacg

SEQ ID NO: 333476 - DNA, 75 bp, Artificial Sequence
  Synthetic
ccataagtgccgactgtgacaaacgaggggcttctgtgagaagcaccacggagagtggcaaagtgatcccggaat

SEQ ID NO: 333477 - DNA, 75 bp, Artificial Sequence
  Synthetic
actacgcagcaacctcactgtcagagagatggtaaccatctacttccttctgctggttttggagttgggattgcc

SEQ ID NO: 333478 - DNA, 75 bp, Artificial Sequence
  Synthetic
aagattgagagcttggtgcgatacgttgtggcggtggggataacattccatctcgagctggggccagagattgtg

SEQ ID NO: 333479 - DNA, 75 bp, Artificial Sequence
  Synthetic
agcttgcacctcagagggaaaagcaggtgtcggactcctgctgatggccctcatgacgcagcgggacttggtgac

SEQ ID NO: 333480 - DNA, 75 bp, Artificial Sequence
  Synthetic
cgtgcaccacggactcatattcttcctaggtgtggcttcggcttgctcggtctggagattgatcaggggacacag

SEQ ID NO: 333481 - DNA, 75 bp, Artificial Sequence
  Synthetic
gacactggctggcggcatgatgcgccacacttcccaggaggctttgtgcgcactcgcagtggcttcattcctcct

SEQ ID NO: 333482 - DNA, 75 bp, Artificial Sequence
  Synthetic
actcatgctagtattggggacaagaaagatgcagctggtggctgaatggagtggctgtgtagaatggcacccgga

SEQ ID NO: 333483 - DNA, 75 bp, Artificial Sequence
  Synthetic
gaagctcttggcttcttgaatgaggaccactgggcctctagggggtccagtggatctggagtggagggaataagc

SEQ ID NO: 333484 - DNA, 75 bp, Artificial Sequence
  Synthetic
ccgagaccaagatgaactggttggaagagcccgcgtctcaccaggctgcggctggagcgtccgcgaaactgcctg

SEQ ID NO: 333485 - DNA, 75 bp, Artificial Sequence
  Synthetic
agagcccgcgtctcaccaggctgcggctggagcgtccgcgaaactgcctgcctttcaaaggcttatgggcagatg

SEQ ID NO: 333486 - DNA, 75 bp, Artificial Sequence
  Synthetic
tgcacacgatgtggcacgtgacgagaggagcggcgttatccatcaatgacgccgtggtaggtccgtactgggctg

SEQ ID NO: 333487 - DNA, 75 bp, Artificial Sequence
  Synthetic
aaatggaaaggtgagacagtgcaggtccatgccttcccaccggggagggcccatgaggtgcatcagtgccagcct

SEQ ID NO: 333488 - DNA, 75 bp, Artificial Sequence
  Synthetic
ccatgaggtgcatcagtgccagcctggagaactgctcttggacacagggagaaggatgggagcagtaccgatcga

SEQ ID NO: 333489 - DNA, 75 bp, Artificial Sequence
  Synthetic
gcaggaatgttgatggagtctacctggagtatgggcggtgtggaaaacaagaaggatcaagaacaaggcgctcag

SEQ ID NO: 333490 - DNA, 75 bp, Artificial Sequence
  Synthetic
ctgctaatgagactcacagtggaagaaaaacagcgtccttcacggtctcctcggagaaaaccatcttgaccatgg

SEQ ID NO: 333491 - DNA, 75 bp, Artificial Sequence
  Synthetic
ctggggaacttacgtgctggtggtctctttgttcacaccatacataattcaccaacttcagaccaagatccaaca

SEQ ID NO: 333492 - DNA, 75 bp, Artificial Sequence
  Synthetic
acataacaactttacggggacctgtggccaccttctacggaccagaacaggacaaaatgccagaggtggcgggcc

SEQ ID NO: 333493 - DNA, 75 bp, Artificial Sequence
  Synthetic
aaagcactttcgacaccttctcacccactgcgacttcacaccatggttggcatggcatgtcgcagcgaatgtgtc

SEQ ID NO: 333494 - DNA, 75 bp, Artificial Sequence
  Synthetic
gctgtgggactggcggcagcgggacaactgctcagaccagaggcggataccctgtggacgatgccagtggcctgt

SEQ ID NO: 333495 - DNA, 75 bp, Artificial Sequence
  Synthetic
gagacgtgctgacaggaatgtcgggggtacccgagctcctgcgtcacagatgtgttagcgccctggacgtcttct

SEQ ID NO: 333496 - DNA, 75 bp, Artificial Sequence
  Synthetic
ccccctcaacagagggggggcggttcttgttctccctgagccaccatcacccagacacagcatagtctggcaagg

SEQ ID NO: 333497 - DNA, 75 bp, Artificial Sequence
  Synthetic
agagagcacccgtacaggacctggcagtactggggcagctaccgcaccgcgccaaccgggtcagcggcgtcactg

SEQ ID NO: 333498 - DNA, 75 bp, Artificial Sequence
  Synthetic
cttgttctccctgagccaccatcacccagacacagcatagtctggcaaggagggagaggactcggaaaaacaccg

SEQ ID NO: 333499 - DNA, 75 bp, Artificial Sequence
  Synthetic
gggttgtcaacactggaaggaggccttttctacgcggatgacacagccggctgggacaccaaggtcaccaacgca

SEQ ID NO: 333500 - DNA, 75 bp, Artificial Sequence
  Synthetic
gattcaacagcttgtcaacagtgccgtagcctccggggcacaggccatgagagaccttggggggggaactccctt

SEQ ID NO: 333501 - DNA, 75 bp, Artificial Sequence
  Synthetic
aagtagcccggccctcccgagatgggggctgtgtcatggatgtcatcacaagaagagaccaaagacgcacagagc

SEQ ID NO: 333502 - DNA, 75 bp, Artificial Sequence
  Synthetic
ctgctaatgagacccacagtggaagaaaaacagcgtccttcacggtttcctcggagaagaccatcttgaccatgg

SEQ ID NO: 333503 - DNA, 75 bp, Artificial Sequence
  Synthetic
ctggaacagggtgtggattctggacaaccccttcatgcacagcaaagaaaagattgtggaatggagggatgtccc

SEQ ID NO: 333504 - DNA, 75 bp, Artificial Sequence
  Synthetic
catctggggagcagtagagaaagtcaggaagatgatcggacaagagaagttcaaggactacctttcctgcatgga

SEQ ID NO: 333505 - DNA, 75 bp, Artificial Sequence
  Synthetic
aaactggagagctcaataatctaaaactagattgtgactgagcacaacctggagtgctcgttaaacattgtccag

SEQ ID NO: 333506 - DNA, 75 bp, Artificial Sequence
  Synthetic
gagcaatggaaaaaccggaaccccacggctgcctgtgtgtttaaagtgctggccccataccgcccagaggtgata

SEQ ID NO: 333507 - DNA, 75 bp, Artificial Sequence
  Synthetic
gaagcactacacagattccaactgcagtggggtggtggactggtgaggacccctttctcaaggaactcaacccat

SEQ ID NO: 333508 - DNA, 75 bp, Artificial Sequence
  Synthetic
gctgaggacagagtgagagaaaaagatgtgcaggagaggatcagagcgttgaaggaacagtacggtgaaacctgg

SEQ ID NO: 333509 - DNA, 75 bp, Artificial Sequence
  Synthetic
agggggcaaaccggtcgggggtgagagatgcccccagagtgcattacggcagcacgtcagtgagagtggcgggag

SEQ ID NO: 333510 - DNA, 75 bp, Artificial Sequence
  Synthetic
agattttcttgcacgtgcgtgcgtttgcttcggatagcattagcagcggcaggtttgaaagagacattcttttgt

SEQ ID NO: 333511 - DNA, 75 bp, Artificial Sequence
  Synthetic
gaagaagcttggagagtttggagtggccaagggaagccgagccatttggtacatgtggctgggaagccgcttcct

SEQ ID NO: 333512 - DNA, 75 bp, Artificial Sequence
  Synthetic
tgccatagcaggcaccgctagaagccccgtattgaaatccttctggaattcagttcctctgaaacaggccacggc

SEQ ID NO: 333513 - DNA, 75 bp, Artificial Sequence
  Synthetic
aaggaggcctcttctatgcggatgacacggctggctgggataccaaggttaccaatgcagatctcgaggatgaag

SEQ ID NO: 333514 - DNA, 75 bp, Artificial Sequence
  Synthetic
cccgtattgaaatccttctggaattcagttcctctgaaacaggccacggcagcactccggaaaatcaaaagagca

SEQ ID NO: 333515 - DNA, 75 bp, Artificial Sequence
  Synthetic
agaagcgcgggaaacggagatcggtaacagactggacgagctggctgctggtcgccattctactgggggtgacac

SEQ ID NO: 333516 - DNA, 75 bp, Artificial Sequence
  Synthetic
aacagactggacgagctggctgctggtcgccattctactgggggtgacactcgcggcaaccgtgcgaaaagaaag

SEQ ID NO: 333517 - DNA, 75 bp, Artificial Sequence
  Synthetic
gagggaaaggatgcggcaacccaggtgcgtgtggagaacggcacctgtgtgatcctggctacggacatgggatca

SEQ ID NO: 333518 - DNA, 75 bp, Artificial Sequence
  Synthetic
tgcgtgtggagaacggcacctgtgtgatcctggctacggacatgggatcatggtgtgatgactcactctcatacg

SEQ ID NO: 333519 - DNA, 75 bp, Artificial Sequence
  Synthetic
ggaaccggttgatgtggattgcttctgcagaaatgtcgacggagtctacctggagtatggacggtgtggaaaaca

SEQ ID NO: 333520 - DNA, 75 bp, Artificial Sequence
  Synthetic
tgcagaaatgtcgacggagtctacctggagtatggacggtgtggaaaacaggaaggatcaagaacaaggcggtca

SEQ ID NO: 333521 - DNA, 75 bp, Artificial Sequence
  Synthetic
agaccaattgatgacaggttcgggcgagcactgtactttctgaatgacatggccaagaccaggaaggacatcggg

SEQ ID NO: 333522 - DNA, 75 bp, Artificial Sequence
  Synthetic
gagacctcacgggaaggggacacaaatggctggaaggagattcactgcgcacgcaccttacgagagttgagggat

SEQ ID NO: 333523 - DNA, 75 bp, Artificial Sequence
  Synthetic
atggctggaaggagattcactgcgcacgcaccttacgagagttgagggatgggtttggaaaaacaaagtgctagc

SEQ ID NO: 333524 - DNA, 75 bp, Artificial Sequence
  Synthetic
atgaaagatgggcgtgccctggtggtgccgtgccgagaccaggatgaactggttggaagggctcgcgtctcaccg

SEQ ID NO: 333525 - DNA, 75 bp, Artificial Sequence
  Synthetic
ttgaccgtggaaagcgtggtaactagagtagccgttgtggctgtgctcttgtgcctagctccggtttacgcttca

SEQ ID NO: 333526 - DNA, 75 bp, Artificial Sequence
  Synthetic
gagtagccgttgtggctgtgctcttgtgcctagctccggtttacgcttcacgatgcactcacctggaaaataggg

SEQ ID NO: 333527 - DNA, 75 bp, Artificial Sequence
  Synthetic
tgtaccaggacgccactgcgactggggtgagggccaggaagcgaggccacagagcatggaatgatgcggcagcgc

SEQ ID NO: 333528 - DNA, 75 bp, Artificial Sequence
  Synthetic
catcggcgtgacctgaggacacttgggctcgccatttgctcggcggtacccgtggattgggtccctactggccgc

SEQ ID NO: 333529 - DNA, 75 bp, Artificial Sequence
  Synthetic
cacgcgggtgactctggtgctggagttgggtggatgcgtcactataacagctgaggggaaaccctcgatggacgt

SEQ ID NO: 333530 - DNA, 75 bp, Artificial Sequence
  Synthetic
ttgggtggatgcgtcactataacagctgaggggaaaccctcgatggacgtgtggcttgactccatctaccaagag

SEQ ID NO: 333531 - DNA, 75 bp, Artificial Sequence
  Synthetic
agattttcttgcacgtgcatgcgtttgcttcggatagcaacagcagcgacaggcttgagagagacaatctttcgt

SEQ ID NO: 333532 - DNA, 75 bp, Artificial Sequence
  Synthetic
gagcgtggatgaccacagaagacatgctggatgtctggaaccgagtgtggattatggacaaccccttcatgcaga

SEQ ID NO: 333533 - DNA, 75 bp, Artificial Sequence
  Synthetic
tgcttcggatagcaacagcagcgacaggcttgagagagacaatctttcgtttgatcagtcgtgaacgtgttgaga

SEQ ID NO: 333534 - DNA, 75 bp, Artificial Sequence
  Synthetic
gcctccatgccaagctctctgacactaaggttgcagccaggtgccctacaatggggcctgccaccctcgctgagg

SEQ ID NO: 333535 - DNA, 75 bp, Artificial Sequence
  Synthetic
taaggttgcagccaggtgccctacaatggggcctgccaccctcgctgaggagcatcagagtggaacggtatgcaa

SEQ ID NO: 333536 - DNA, 75 bp, Artificial Sequence
  Synthetic
gctggatgtctggaaccgagtgtggattatggacaaccccttcatgcagaacaaggaaagggttacggaatggag

SEQ ID NO: 333537 - DNA, 75 bp, Artificial Sequence
  Synthetic
catgacatgttgtgttcctcccttgttggaaggaaagagagggctgagtgggccaagaacatctggggagcggtg

SEQ ID NO: 333538 - DNA, 75 bp, Artificial Sequence
  Synthetic
ggaaaccactgtgggttgtttggaaagggtagcattgtgacttgtgtcaaggcgtcctgtgaggcaaaaaagaaa

SEQ ID NO: 333539 - DNA, 75 bp, Artificial Sequence
  Synthetic
agggtagcattgtgacttgtgtcaaggcgtcctgtgaggcaaaaaagaaagccactggacatgtatatgacgcaa

SEQ ID NO: 333540 - DNA, 75 bp, Artificial Sequence
  Synthetic
tgagccacacacgggggactatgtcgccgccaatgagacccacagtgggagaaagacagcatccttcacggtctc

SEQ ID NO: 333541 - DNA, 75 bp, Artificial Sequence
  Synthetic
gccgccaatgagacccacagtgggagaaagacagcatccttcacggtctcttcagagaaaaccatcttgaccatg

SEQ ID NO: 333542 - DNA, 75 bp, Artificial Sequence
  Synthetic
tgtgcagagtcgctagtggtgttgacctggctcagaccgtcattctggagctagacaagaccttggaacaccttc

SEQ ID NO: 333543 - DNA, 75 bp, Artificial Sequence
  Synthetic
tggttagaaggggattcactgcggacgcacctcactagagttgaaggatgggtctggaagaacaaaatactcacc

SEQ ID NO: 333544 - DNA, 75 bp, Artificial Sequence
  Synthetic
aataaaacagacatgactacaaaggaaagaggctgagcaaaggtcctaaatgaccagaccatccgcactgcgggc

SEQ ID NO: 333545 - DNA, 75 bp, Artificial Sequence
  Synthetic
cctggctcagaccgtcattctggagctagacaagaccttggaacaccttccgacggcctggcaggtccatcgaga

SEQ ID NO: 333546 - DNA, 75 bp, Artificial Sequence
  Synthetic
tggaaacatgagggagcgcagaattggaacaacgcggagcgactggtcgagtttggagcccctcatgctgtgaag

SEQ ID NO: 333547 - DNA, 75 bp, Artificial Sequence
  Synthetic
cacagaccatggaatgctgcggcagcgcgcgagagcgacggggaaatggtcgcacccgacgcaccatccatgaag

SEQ ID NO: 333548 - DNA, 75 bp, Artificial Sequence
  Synthetic
ggaacaacgcggagcgactggtcgagtttggagcccctcatgctgtgaagatggatgtgtacaatcttggagatc

SEQ ID NO: 333549 - DNA, 75 bp, Artificial Sequence
  Synthetic
cgctggtgttcctgtggcccacattgatggaaccaagtaccacctgaaaagtggtcatgtgacatgcgaggttgg

SEQ ID NO: 333550 - DNA, 75 bp, Artificial Sequence
  Synthetic
gatggaaccaagtaccacctgaaaagtggtcatgtgacatgcgaggttgggctggaaaaactcaagatgaaaggt

SEQ ID NO: 333551 - DNA, 75 bp, Artificial Sequence
  Synthetic
cgaagttcacatggaagagaatcccgacggacagcggacatgacacagtggtcatggaggttgcattctctggaa

SEQ ID NO: 333552 - DNA, 75 bp, Artificial Sequence
  Synthetic
gacggacagcggacatgacacagtggtcatggaggttgcattctctggaacgaagccctgcaggatcccagtgag

SEQ ID NO: 333553 - DNA, 75 bp, Artificial Sequence
  Synthetic
gtaaacgtagccatgttgataacacccaaccctacaattgaaaataacggaggtggcttcatagagatgcaacta

SEQ ID NO: 333554 - DNA, 75 bp, Artificial Sequence
  Synthetic
ccaaccctacaattgaaaataacggaggtggcttcatagagatgcaactacctccaggggacaacatcatctatg

SEQ ID NO: 333555 - DNA, 75 bp, Artificial Sequence
  Synthetic
cttgctcagactgtcatcttggagcttgacaagacctcagaacacctaccgacggcctggcaggtccaccgggac

SEQ ID NO: 333556 - DNA, 75 bp, Artificial Sequence
  Synthetic
ttgacaagacctcagaacacctaccgacggcctggcaggtccaccgggactggttcaatgatctggccctgccgt

SEQ ID NO: 333557 - DNA, 75 bp, Artificial Sequence
  Synthetic
ccaaaagggaagcagcattggaagggtcttccaaaagaccagaaggggcatagaaagactgacagtgataggaga

SEQ ID NO: 333558 - DNA, 75 bp, Artificial Sequence
  Synthetic
gtcttccaaaagaccagaaggggcatagaaagactgacagtgataggagagcatgcctgggactttggttccact

SEQ ID NO: 333559 - DNA, 75 bp, Artificial Sequence
  Synthetic
aggcgctgcacacagtccttggcggtgcctttaacagcctgtttggaggagtgggtttcatccccaagctcctgt

SEQ ID NO: 333560 - DNA, 75 bp, Artificial Sequence
  Synthetic
tgcctttaacagcctgtttggaggagtgggtttcatccccaagctcctgttgggagtagccttggcgtggttggg

SEQ ID NO: 333561 - DNA, 75 bp, Artificial Sequence
  Synthetic
tccatgagcttcctcctggctggaggattggtcctggctatgacacttggagtgggagctgatgtcggctgcgct

SEQ ID NO: 333562 - DNA, 75 bp, Artificial Sequence
  Synthetic
gattggtcctggctatgacacttggagtgggagctgatgtcggctgcgctgtggacacagagcgaatggagctcc

SEQ ID NO: 333563 - DNA, 75 bp, Artificial Sequence
  Synthetic
gagggaggtctcagagtggtacgacaactacgcatactacccagaaacgccgggagcccttgcctccgccattaa

SEQ ID NO: 333564 - DNA, 75 bp, Artificial Sequence
  Synthetic
aactacgcatactacccagaaacgccgggagcccttgcctccgccattaaggaaacattcgaagaaggaaactgt

SEQ ID NO: 333565 - DNA, 75 bp, Artificial Sequence
  Synthetic
aaatggccatgtggaggagctcatcaactgaactgaatttggccctggcggaaggagatgcaaacctcacagtgg

SEQ ID NO: 333566 - DNA, 75 bp, Artificial Sequence
  Synthetic
aactgaactgaatttggccctggcggaaggagatgcaaacctcacagtggtggtggacaaactcgatcccaccga

SEQ ID NO: 333567 - DNA, 75 bp, Artificial Sequence
  Synthetic
ggaactgggtggatgtgttaccataacagctgaggggaagccttcaatggatgtgtggcttgacgccatttacca

SEQ ID NO: 333568 - DNA, 75 bp, Artificial Sequence
  Synthetic
ctaaagaaggggaaagacataaaggtgtcctggaagagctggggtcaggcaatgatttggagcattcccgaggct

SEQ ID NO: 333569 - DNA, 75 bp, Artificial Sequence
  Synthetic
tgtcctggaagagctggggtcaggcaatgatttggagcattcccgaggctccccgccgtttcatggtgggcacgg

SEQ ID NO: 333570 - DNA, 75 bp, Artificial Sequence
  Synthetic
gagaaggaaaacaggcgtcttcacagtggcagagtttggggttggcttgagaacaaaagtgttcttggacttcag

SEQ ID NO: 333571 - DNA, 75 bp, Artificial Sequence
  Synthetic
gtggcagagtttggggttggcttgagaacaaaagtgttcttggacttcagacaggaatcgacacatgagtgtgac

SEQ ID NO: 333572 - DNA, 75 bp, Artificial Sequence
  Synthetic
tggacactgaacggatggagctccgttgtggtgagggtctggttgtgtggagggaggtatccgagtggtatgaca

SEQ ID NO: 333573 - DNA, 75 bp, Artificial Sequence
  Synthetic
agaatggcatggcggtacacacagaccaaagcctctggatgaagtccgtgagaaatgacacgggaacttacatag

SEQ ID NO: 333574 - DNA, 75 bp, Artificial Sequence
  Synthetic
ccaaagcctctggatgaagtccgtgagaaatgacacgggaacttacatagttgaactcctggtcaccgatctgag

SEQ ID NO: 333575 - DNA, 75 bp, Artificial Sequence
  Synthetic
accatcgacaacgctgaggtggtggattcagagctcttcctcccggccagcctagcagggcctagatcctggtac

SEQ ID NO: 333576 - DNA, 75 bp, Artificial Sequence
  Synthetic
attcagagctcttcctcccggccagcctagcagggcctagatcctggtacaacaggatacctggatactcggagc

SEQ ID NO: 333577 - DNA, 75 bp, Artificial Sequence
  Synthetic
acccattcgagtcacaagagaggagtgtcctggcacgaaggtcaccataagtgctgattgtgacaaaagaggtgc

SEQ ID NO: 333578 - DNA, 75 bp, Artificial Sequence
  Synthetic
tgtcctggcacgaaggtcaccataagtgctgattgtgacaaaagaggtgcttctgtgaggagcaccacagagagt

SEQ ID NO: 333579 - DNA, 75 bp, Artificial Sequence
  Synthetic
gccgaacgtgcacattacctccagtgacgttccgcacagggacagactgttggtatgccatggaaatacgcccgg

SEQ ID NO: 333580 - DNA, 75 bp, Artificial Sequence
  Synthetic
gacgttccgcacagggacagactgttggtatgccatggaaatacgcccggttcatgaccaaggggggctcgtccg

SEQ ID NO: 333581 - DNA, 75 bp, Artificial Sequence
  Synthetic
gagctgcttagtgaaggaggagtccctggaatagtggctttgtttgtggtccttgaatacgtcatccggaggagg

SEQ ID NO: 333582 - DNA, 75 bp, Artificial Sequence
  Synthetic
ctggaatagtggctttgtttgtggtccttgaatacgtcatccggaggaggcctgctacgggaacaacggctgtgt

SEQ ID NO: 333583 - DNA, 75 bp, Artificial Sequence
  Synthetic
gcttgtcactggattggtcaaagttgagagcttggtgcgctatgttgtagcagtcgggatcacattccatcttga

SEQ ID NO: 333584 - DNA, 75 bp, Artificial Sequence
  Synthetic
gagagcttggtgcgctatgttgtagcagtcgggatcacattccatcttgagctggggccagagatagtggctctg

SEQ ID NO: 333585 - DNA, 75 bp, Artificial Sequence
  Synthetic
tgagggtgggcttgctcagcgcctttgcactgcgcagaagcctcactgtgcgggagatggtaaccatctattttc

SEQ ID NO: 333586 - DNA, 75 bp, Artificial Sequence
  Synthetic
tgcactgcgcagaagcctcactgtgcgggagatggtaaccatctattttctcctgttggtgctggaactgggact

SEQ ID NO: 333587 - DNA, 75 bp, Artificial Sequence
  Synthetic
tggaggtggggcgacgcactggccatgggggctctgatttttagagcctgcacagcggaggggaaaaccggtgtc

SEQ ID NO: 333588 - DNA, 75 bp, Artificial Sequence
  Synthetic
tgggggctctgatttttagagcctgcacagcggaggggaaaaccggtgtcggactcttgctcatggcgctcatga

SEQ ID NO: 333589 - DNA, 75 bp, Artificial Sequence
  Synthetic
ttatggactcatgctctttctgggcatggcttcgtgctgttcagtttggagattgatccgaggacacagagaaca

SEQ ID NO: 333590 - DNA, 75 bp, Artificial Sequence
  Synthetic
atggcttcgtgctgttcagtttggagattgatccgaggacacagagaacagaaaggactgtcatggaccgtccct

SEQ ID NO: 333591 - DNA, 75 bp, Artificial Sequence
  Synthetic
gctcgggaatcagattgctggctttttgggagctggcggcccacagagggagacggtcatttagtgaaccactaa

SEQ ID NO: 333592 - DNA, 75 bp, Artificial Sequence
  Synthetic
tgggagctggccatccatggaaggagacggtcattcagtgaaccactgactgttgtgggagtcatgctaaccctg

SEQ ID NO: 333593 - DNA, 75 bp, Artificial Sequence
  Synthetic
ttgggagctggcggcccacagagggagacggtcatttagtgaaccactaactgttgtgggagtcatgctaacctt

SEQ ID NO: 333594 - DNA, 75 bp, Artificial Sequence
  Synthetic
tcccaagaggctctctgcgcacttgcagtggcttcgtttctcctgctcatgctggtactggggacaaggaagatg

SEQ ID NO: 333595 - DNA, 75 bp, Artificial Sequence
  Synthetic
cagtggcttcgtttctcctgctcatgctggtactggggacaaggaagatgcagctggtggctgaatggagtggct

SEQ ID NO: 333596 - DNA, 75 bp, Artificial Sequence
  Synthetic
gaatgagggtggagaggtgagcctgcgagtccgacaggactcaatgggaaactttcacctgacagagcttgagaa

SEQ ID NO: 333597 - DNA, 75 bp, Artificial Sequence
  Synthetic
cgagtccgacaggactcaatgggaaactttcacctgacagagcttgagaaagaggagagagtgatggctttttgg

SEQ ID NO: 333598 - DNA, 75 bp, Artificial Sequence
  Synthetic
cctttcactggtcaggcattcttggtgtgatgggactgtggacgctgtcagaaatgctaaaaacggcgcgaagat

SEQ ID NO: 333599 - DNA, 75 bp, Artificial Sequence
  Synthetic
tgtgatgggactgtggacgctgtcagaaatgctaaaaacggcgcgaagatctgatctggtattctccggacaggg

SEQ ID NO: 333600 - DNA, 75 bp, Artificial Sequence
  Synthetic
tttgaggtcaaagacggtgtctacagaatcttcagcccgggattgctttgggggcagcgccaggtgggagtcggc

SEQ ID NO: 333601 - DNA, 75 bp, Artificial Sequence
  Synthetic
ccttcccaccggggaaggcccatgaggtgcaccagtgtcagcctggggagctgctcttggatacagggagaagga

SEQ ID NO: 333602 - DNA, 75 bp, Artificial Sequence
  Synthetic
aaaagggacatctggcagccccattctcaactctcagggagtggtcgtggggctgtatggcaatggactgaagac

SEQ ID NO: 333603 - DNA, 75 bp, Artificial Sequence
  Synthetic
ctcaactctcagggagtggtcgtggggctgtatggcaatggactgaagaccaacgagacctacgtcagcagcatc

SEQ ID NO: 333604 - DNA, 75 bp, Artificial Sequence
  Synthetic
gacccaatcttccacaagcggtcattggcacgggctggacatcaaagggccaaattacagtgctggacatgcatc

SEQ ID NO: 333605 - DNA, 75 bp, Artificial Sequence
  Synthetic
tggcacgggctggacatcaaagggccaaattacagtgctggacatgcatccaggctctgggaagacccacagagt

SEQ ID NO: 333606 - DNA, 75 bp, Artificial Sequence
  Synthetic
attgatagacgcctgaggacgctggtgctggccccaacgcgtgtggtgcttaaagaaatggagcgcgcgttgagt

SEQ ID NO: 333607 - DNA, 75 bp, Artificial Sequence
  Synthetic
ggaaagagagtcaggttccactctcccgctgttggagatcaccagggggggggggccatcgtcgatgtgatgtgt

SEQ ID NO: 333608 - DNA, 75 bp, Artificial Sequence
  Synthetic
tgctcccgcaggggagacagaactgggaggtggcgatcatggatgaagcccattggacagatccacacagcatag

SEQ ID NO: 333609 - DNA, 75 bp, Artificial Sequence
  Synthetic
ggaggtggcgatcatggatgaagcccattggacagatccacacagcatagctgccaggggtcacctgtacactct

SEQ ID NO: 333610 - DNA, 75 bp, Artificial Sequence
  Synthetic
gttctcatgacagcaacgccacctgggaagagtgaaccctttccggaatccaatggagcaatcaccagtgaggaa

SEQ ID NO: 333611 - DNA, 75 bp, Artificial Sequence
  Synthetic
ggaagagtgaaccctttccggaatccaatggagcaatcaccagtgaggaaaagcaaatccctgatggagaatggc

SEQ ID NO: 333612 - DNA, 75 bp, Artificial Sequence
  Synthetic
atatgaggggcgcactgcatggtttgttccctcgattgcaaagggtggtgtcatcgcccgcaccttgagacaaaa

SEQ ID NO: 333613 - DNA, 75 bp, Artificial Sequence
  Synthetic
acttcacgccgtggctagcatggcacgtcgcagcaaacgtgtctagtgtgacaagtcggaattggacgtgggaag

SEQ ID NO: 333614 - DNA, 75 bp, Artificial Sequence
  Synthetic
gttccctcgattgcaaagggtggtgtcatcgcccgcaccttgagacaaaaaggaaaaagcgtgatttgtctgaat

SEQ ID NO: 333615 - DNA, 75 bp, Artificial Sequence
  Synthetic
ccagagtaagagatgaaaaacccgactttgtggtgacgactgatatatctgagatgggggccaacctcgatgtga

SEQ ID NO: 333616 - DNA, 75 bp, Artificial Sequence
  Synthetic
gccgcgttatagacgggcgaacaaacatcaagccagaagaggttgatgggagagtcgagctcacagggaccagac

SEQ ID NO: 333617 - DNA, 75 bp, Artificial Sequence
  Synthetic
caaccctgcggggacctgtggccactttttatggaccagagcaggacaagatgccggaggtggcaggtcacttcc

SEQ ID NO: 333618 - DNA, 75 bp, Artificial Sequence
  Synthetic
tttttatggaccagagcaggacaagatgccggaggtggcaggtcacttccgactcactgaagagaagaggaagca

SEQ ID NO: 333619 - DNA, 75 bp, Artificial Sequence
  Synthetic
gatttcacaccatggctagcatggcatgtcgcggcaaatgtgtccagtgtgacaagtcggaattggacatgggaa

SEQ ID NO: 333620 - DNA, 75 bp, Artificial Sequence
  Synthetic
atgtcgcggcaaatgtgtccagtgtgacaagtcggaattggacatgggaaggtcctgaggaaaatgcagtggacg

SEQ ID NO: 333621 - DNA, 75 bp, Artificial Sequence
  Synthetic
acactgaggccagtgtggagagatgcgcgcatgttcagagaaggacgtgacatcagagaattcgtcgcgtacgct

SEQ ID NO: 333622 - DNA, 75 bp, Artificial Sequence
  Synthetic
gtagcagggcatgtgatggctttgggagtggtatcgctagttggcgcaacgccaacctctttggtggttggcgtt

SEQ ID NO: 333623 - DNA, 75 bp, Artificial Sequence
  Synthetic
tgttgacgggaatgtctggggttccagagcttctgcgacatagatgtgtcagcgccatggatgttttctacacgc

SEQ ID NO: 333624 - DNA, 75 bp, Artificial Sequence
  Synthetic
agagcttctgcgacatagatgtgtcagcgccatggatgttttctacacgctgatgcatgaggaacctggcagcag

SEQ ID NO: 333625 - DNA, 75 bp, Artificial Sequence
  Synthetic
atggaaaggtgaaacagtacaggtccatgccttcccaccggggaaggcccatgaggtgcatcagtgccagcctgg

SEQ ID NO: 333626 - DNA, 75 bp, Artificial Sequence
  Synthetic
gctccagaggctttcttgacgctggtggaaatgatggtacttggcttggcaactctcggtgtcgtctggtgcttt

SEQ ID NO: 333627 - DNA, 75 bp, Artificial Sequence
  Synthetic
tggaaatgatggtacttggcttggcaactctcggtgtcgtctggtgctttgtcgtccgggcctcaatcagccgca

SEQ ID NO: 333628 - DNA, 75 bp, Artificial Sequence
  Synthetic
ggcctccctggcgctcctttgggctggcggggttggctacgggaacatggctggagtggccctcattttttacac

SEQ ID NO: 333629 - DNA, 75 bp, Artificial Sequence
  Synthetic
ggcggggttggctacgggaacatggctggagtggccctcattttttacacgctgctgacggtgttgcagcccgaa

SEQ ID NO: 333630 - DNA, 75 bp, Artificial Sequence
  Synthetic
acaacaaactggcatattttctgttgacgctctgcagtctagcaggactggtcgccgccaatgagatggggttcc

SEQ ID NO: 333631 - DNA, 75 bp, Artificial Sequence
  Synthetic
gacgctctgcagtctagcaggactggtcgccgccaatgagatggggttcctggagagaaccaaagcggatctgtc

SEQ ID NO: 333632 - DNA, 75 bp, Artificial Sequence
  Synthetic
gagccgcggtcatggggtgagtggacgaacatagacatccagccggcgaggtcatggggaacttatgtgctggtg

SEQ ID NO: 333633 - DNA, 75 bp, Artificial Sequence
  Synthetic
cgaacatagacatccagccggcgaggtcatggggaacttatgtgctggtggtttcccttttcacaccatacataa

SEQ ID NO: 333634 - DNA, 75 bp, Artificial Sequence
  Synthetic
acagcttgtcaacagcgccgtcgcgactggagcacaggccatgagagacctcggagggggaaccccattcttcgg

SEQ ID NO: 333635 - DNA, 75 bp, Artificial Sequence
  Synthetic
actggagcacaggccatgagagacctcggagggggaaccccattcttcggggtggcagggcatgtgatggccctg

SEQ ID NO: 333636 - DNA, 75 bp, Artificial Sequence
  Synthetic
tgtggtggagggtgagcggacacggaaagtgatactactcatggagcagtggaaaaatcgtaaccccacggctac

SEQ ID NO: 333637 - DNA, 75 bp, Artificial Sequence
  Synthetic
cgccgacttctctagtggtgggtgttggtttggcagcgttccatttggccattgtggtgtccggattagaggctg

SEQ ID NO: 333638 - DNA, 75 bp, Artificial Sequence
  Synthetic
tggtttggcagcgttccatttggccattgtggtgtccggattagaggctgaattgacacaaagagcccacaaggt

SEQ ID NO: 333639 - DNA, 75 bp, Artificial Sequence
  Synthetic
cccatggtggacggggatgtcattaacccgtttggagagggggaagcaaaacctgccttgtacgagaggaagatg

SEQ ID NO: 333640 - DNA, 75 bp, Artificial Sequence
  Synthetic
acccgtttggagagggggaagcaaaacctgccttgtacgagaggaagatgagcctggtcttggcagtggcgctgt

SEQ ID NO: 333641 - DNA, 75 bp, Artificial Sequence
  Synthetic
gggaccagaggggacccaccagggtgcctgagctggaccttggagttgggactcggtgtgttgtcttggctgagg

SEQ ID NO: 333642 - DNA, 75 bp, Artificial Sequence
  Synthetic
gcctgagctggaccttggagttgggactcggtgtgttgtcttggctgaggacaaggtgaaagaaaaagatgtgca

SEQ ID NO: 333643 - DNA, 75 bp, Artificial Sequence
  Synthetic
aacggtggcctccatcacagaggcttcggctgtgggtttggcggcagcgggacagctgcttagaccggaggcgga

SEQ ID NO: 333644 - DNA, 75 bp, Artificial Sequence
  Synthetic
tcggctgtgggtttggcggcagcgggacagctgcttagaccggaggcggacaccttgtggacgatgccagtggcc

SEQ ID NO: 333645 - DNA, 75 bp, Artificial Sequence
  Synthetic
gcagcctctgggggtttctgcctctcgggcacagactttggttaagggcttctgggagcaggcgcggcggttctg

SEQ ID NO: 333646 - DNA, 75 bp, Artificial Sequence
  Synthetic
cgggcacagactttggttaagggcttctgggagcaggcgcggcggttctgacggagacactcttggagacctctg

SEQ ID NO: 333647 - DNA, 75 bp, Artificial Sequence
  Synthetic
tggtctgatgagcagaacaggtggtcaagcgcaaaagaggctgtggaggatcccgcattttggcagctcgtggat

SEQ ID NO: 333648 - DNA, 75 bp, Artificial Sequence
  Synthetic
gtacgggcatcctggagacggaacgagacaaggctagggaactcctaaggagaggggaaaccaacatggggttgg

SEQ ID NO: 333649 - DNA, 75 bp, Artificial Sequence
  Synthetic
agggaagagttcttcatctacagacgtacgggcatcctggagacggaacgagacaaggctagggaactcctaagg

SEQ ID NO: 333650 - DNA, 75 bp, Artificial Sequence
  Synthetic
cgcctggcttgaggaacgtggttatgcaactctcaagggcgaagtggtggaccttggatgtggaaggggcggctg

SEQ ID NO: 333651 - DNA, 75 bp, Artificial Sequence
  Synthetic
gtcctactacgcggcctctcgcccgtccgtcatgagtgtcaaggcatacacaattggtggaaggggacacgagac

SEQ ID NO: 333652 - DNA, 75 bp, Artificial Sequence
  Synthetic
aagggttgtcaacactggaaggaggccttttttacgcagatgacacagccggatgggataccaaggtcactaatg

SEQ ID NO: 333653 - DNA, 75 bp, Artificial Sequence
  Synthetic
gacgcacgcatgttcaaagagggacgtgacatcaaagagttcgtggcgtacgcgtctgggcgtcgcagcttcgga

SEQ ID NO: 333654 - DNA, 75 bp, Artificial Sequence
  Synthetic
gaaagtgatactactcatggaacagtggaaaaaccggaatccaacggccacctgcgtgtttaaggtgttagcccc

SEQ ID NO: 333655 - DNA, 75 bp, Artificial Sequence
  Synthetic
tggaaaaaccggaatccaacggccacctgcgtgtttaaggtgttagccccataccgtccagaggtcatagaggca

SEQ ID NO: 333656 - DNA, 75 bp, Artificial Sequence
  Synthetic
gcggagggctggtgagaactcctttctcgaggaactcaacccatgaaatgtattactcaaccgctgtcactggga

SEQ ID NO: 333657 - DNA, 75 bp, Artificial Sequence
  Synthetic
ctcgaggaactcaacccatgaaatgtattactcaaccgctgtcactgggaacattgtgaactcggtcaacattca

SEQ ID NO: 333658 - DNA, 75 bp, Artificial Sequence
  Synthetic
tggcaaccctgggtgtcatctggtgcttcgtcgtccggacttcaatcagccgtatgatgctgggcacgctggtcc

SEQ ID NO: 333659 - DNA, 75 bp, Artificial Sequence
  Synthetic
ggagaccagaggggacctactagggtgccagaactggatttgggggttgggactcggtgtgtggttttggctgat

SEQ ID NO: 333660 - DNA, 75 bp, Artificial Sequence
  Synthetic
tgccagaactggatttgggggttgggactcggtgtgtggttttggctgatgacaaggtgaaagagaaagatgtgc

SEQ ID NO: 333661 - DNA, 75 bp, Artificial Sequence
  Synthetic
gatggctgagagatcatggagaagaacgtctcggaagaatgcttgtgagcggcgatgactgtgtggtgaggccag

SEQ ID NO: 333662 - DNA, 75 bp, Artificial Sequence
  Synthetic
aacccaagactgtttcgagtggaacgatggctgagagatcatggagaagaacgtctcggaagaatgcttgtgagc

SEQ ID NO: 333663 - DNA, 75 bp, Artificial Sequence
  Synthetic
acagtacggtgagacctggcatgtggatggagaacatccatacaggacctggcagtactggggtagctatcgcac

SEQ ID NO: 333664 - DNA, 75 bp, Artificial Sequence
  Synthetic
gatggagaacatccatacaggacctggcagtactggggtagctatcgcactgcgccaaccggctcagcggcgtca

SEQ ID NO: 333665 - DNA, 75 bp, Artificial Sequence
  Synthetic
tcagctggccatggaacgcgcgagaggatgttgtgcgcatggccatgaccgacaccacggcctttggacagcagc

SEQ ID NO: 333666 - DNA, 75 bp, Artificial Sequence
  Synthetic
ggatgttgtgcgcatggccatgaccgacaccacggcctttggacagcagcgcgtgttcaaggacaaggttgacac

SEQ ID NO: 333667 - DNA, 75 bp, Artificial Sequence
  Synthetic
acaaaagtcatcatgagggcagtgaatgactggatgttggacagactggcacagaagagcagaccgcggatgtgc

SEQ ID NO: 333668 - DNA, 75 bp, Artificial Sequence
  Synthetic
atgactggatgttggacagactggcacagaagagcagaccgcggatgtgcagcagagaggaattcatagccaaag

SEQ ID NO: 333669 - DNA, 75 bp, Artificial Sequence
  Synthetic
atggtctgatgagcagaacaggtggtcaagcgccagggaggctgttgaggaccccgccttctggcaactcgtgga

SEQ ID NO: 333670 - DNA, 75 bp, Artificial Sequence
  Synthetic
tcaagcgccagggaggctgttgaggaccccgccttctggcaactcgtggatgaggagagagagagacacctggcc

SEQ ID NO: 333671 - DNA, 75 bp, Artificial Sequence
  Synthetic
ggccattgtggtgtctggtctggaggctgaattaacacagagagctcacaaggtctttttctctgcaatggtgcg

SEQ ID NO: 333672 - DNA, 75 bp, Artificial Sequence
  Synthetic
acatgatgggcaagagagagaagaaacttggagagtttggagtggccaaaggaagccgagccatatggtacatgt

SEQ ID NO: 333673 - DNA, 75 bp, Artificial Sequence
  Synthetic
gaccactgggcttccagagaatccagtggagctggggtggagggaataagcctgaactacctaggctggcatctc

SEQ ID NO: 333674 - DNA, 75 bp, Artificial Sequence
  Synthetic
gtggagctggggtggagggaataagcctgaactacctaggctggcatctcaaaaggttgtcaacactggaaggag

SEQ ID NO: 333675 - DNA, 75 bp, Artificial Sequence
  Synthetic
gcgggacagctgcttagaccggaggctgacacactgtggacgatgccggttgcttgtggcatgagtggtgtggtc

SEQ ID NO: 333676 - DNA, 75 bp, Artificial Sequence
  Synthetic
tggctgggacaccaaggtcacaaacgcagacctagaggatgaagagcagatcctacgctacatggagggtgaaca

SEQ ID NO: 333677 - DNA, 75 bp, Artificial Sequence
  Synthetic
gcagacctagaggatgaagagcagatcctacgctacatggagggtgaacacaggcagctggcagccacaataatg

SEQ ID NO: 333678 - DNA, 75 bp, Artificial Sequence
  Synthetic
tgaaggtagcccggccctctcgtgagggaggctgcgttatggatgtcatcacaagaagagaccagagaggctcgg

SEQ ID NO: 333679 - DNA, 75 bp, Artificial Sequence
  Synthetic
gggaggctgcgttatggatgtcatcacaagaagagaccagagaggctcggggcaggttgtgacctacgccctcaa

SEQ ID NO: 333680 - DNA, 75 bp, Artificial Sequence
  Synthetic
ctgatccgaatgatggagggagagggggttgtggaagcatcagatgcgcacaacccaagactgctccgagtggaa

SEQ ID NO: 333681 - DNA, 75 bp, Artificial Sequence
  Synthetic
gggttgtggaagcatcagatgcgcacaacccaagactgctccgagtggaacgatggttgaaagaacacggagaag

SEQ ID NO: 333682 - DNA, 75 bp, Artificial Sequence
  Synthetic
tggtgatgactgtgtggtgaggccggtggatgacagatttggtagagccctctactttctgaatgacatggcaaa

SEQ ID NO: 333683 - DNA, 75 bp, Artificial Sequence
  Synthetic
gtggatgacagatttggtagagccctctactttctgaatgacatggcaaagaccaggaaggacattggggaatgg

SEQ ID NO: 333684 - DNA, 75 bp, Artificial Sequence
  Synthetic
gggaggaagttcctttctgctcacaccattttcacgagctggtgatgaaagatggacgcgccctgatagtgccat

SEQ ID NO: 333685 - DNA, 75 bp, Artificial Sequence
  Synthetic
ccattttcacgagctggtgatgaaagatggacgcgccctgatagtgccatgccgagatcaggatgaactggttgg

SEQ ID NO: 333686 - DNA, 75 bp, Artificial Sequence
  Synthetic
ctttaaacaaaaatgccagaattgagctgaacctggagggctcattaaacattgtccagacaaaacaaaattgaa

SEQ ID NO: 333687 - DNA, 75 bp, Artificial Sequence
  Synthetic
ggctggagtgtccgtgagacggcttgcctgtcaaaagcatatgggcaaatgtggttactgagctacttccaccga

SEQ ID NO: 333688 - DNA, 75 bp, Artificial Sequence
  Synthetic
gcctgtcaaaagcatatgggcaaatgtggttactgagctacttccaccgacgtgacctgaggacgcttggacttg

SEQ ID NO: 333689 - DNA, 75 bp, Artificial Sequence
  Synthetic
ctgggttcccactggtcgcacgacctggagcattcatgctagtggagcctggatgacaacagaggacatgctgga

SEQ ID NO: 333690 - DNA, 75 bp, Artificial Sequence
  Synthetic
tggagcattcatgctagtggagcctggatgacaacagaggacatgctggacgtctggaacagggtgtggatcctg

SEQ ID NO: 333691 - DNA, 75 bp, Artificial Sequence
  Synthetic
tacagtcgaggaaacttttggctcggtttggagaccagagagggccaaccagggtgcctgaacttgacctgggag

SEQ ID NO: 333692 - DNA, 75 bp, Artificial Sequence
  Synthetic
aaagggttgcggaatggagggatgttccgtatctccccaaagcccatgacatgctatgctcctcccttgttggga

SEQ ID NO: 333693 - DNA, 75 bp, Artificial Sequence
  Synthetic
atgctatgctcctcccttgttgggaggaaggagagggcagaatgggccaagaacatctggggagcagtggagaaa

SEQ ID NO: 333694 - DNA, 75 bp, Artificial Sequence
  Synthetic
ggaccggcatgacttgcactgggagctcaaactggagagctcaataatctaaagccagaatgtgacagagcaaaa

SEQ ID NO: 333695 - DNA, 75 bp, Artificial Sequence
  Synthetic
cggaaaatcaagaaggcagtgagcaccctgatggtaggcttgcaaagacgtggcaaaagaaggtcagcagtagat

SEQ ID NO: 333696 - DNA, 75 bp, Artificial Sequence
  Synthetic
cagaaccaaaaactgggggcctggaggcgaggccacagagcatggaatgatgcggcagcgcgcgagagcgacggg

SEQ ID NO: 333697 - DNA, 75 bp, Artificial Sequence
  Synthetic
ccctgatggtaggcttgcaaagacgtggcaaaagaaggtcagcagtagattggacaggttggttgctggtcattg

SEQ ID NO: 333698 - DNA, 75 bp, Artificial Sequence
  Synthetic
gagatggtcgtacccgacgcatcatccatgaagcaacatttcgtgagaccctccggccggtagagggggaagccg

SEQ ID NO: 333699 - DNA, 75 bp, Artificial Sequence
  Synthetic
atgtggctggggagtcgctttctggagttcgaggctcttggattcttgaatgaagaccattgggcctctagagag

SEQ ID NO: 333700 - DNA, 75 bp, Artificial Sequence
  Synthetic
agattttcttgcacgtgcgtgcgtttgcttcggatagcaacagcagcgacaggtttgagagagacaatctttcgc

SEQ ID NO: 333701 - DNA, 75 bp, Artificial Sequence
  Synthetic
gcactccggaaaattaagaaggcagtgagcactctgatggtaggtttgcaaagacgtggcaaaagaaggtctgca

SEQ ID NO: 333702 - DNA, 75 bp, Artificial Sequence
  Synthetic
tgagcactctgatggtaggtttgcaaagacgtggcaaaagaaggtctgcagtaaattggacaggttggttgctgg

SEQ ID NO: 333703 - DNA, 75 bp, Artificial Sequence
  Synthetic
agccacagtgcggaaagagagagacggcaccactgtgatcagagctgaaggaaaagacgcggcaactcaggtgcg

SEQ ID NO: 333704 - DNA, 75 bp, Artificial Sequence
  Synthetic
ctggccacggatatgggatcatggtgtgatgactcactaacttatgagtgtgtgaccatagaccagggggaagaa

SEQ ID NO: 333705 - DNA, 75 bp, Artificial Sequence
  Synthetic
tgtgaggcgaaaaagaaagccacaggacatgtgtatgacgctaacaagattgtgtacacggttaaagtagagccg

SEQ ID NO: 333706 - DNA, 75 bp, Artificial Sequence
  Synthetic
agacctcagaacacctaccgacggcctggcaggtgcatcgggattggttcaatgatttggccctgccgtggaaac

SEQ ID NO: 333707 - DNA, 75 bp, Artificial Sequence
  Synthetic
gcctgcctttcaaaagcctacgggcagatgtggctgctgagctacttccatcggcgagacctgaggacgctcggg

SEQ ID NO: 333708 - DNA, 75 bp, Artificial Sequence
  Synthetic
gtcgcggccagatgccccacaatgggacctgccactttggctgaagagcaccagagtggcacagtgtgtaagaga

SEQ ID NO: 333709 - DNA, 75 bp, Artificial Sequence
  Synthetic
cacaatcgaaaccaatggtggtggcttcatagaaatgcagttacctccaggagacaacatcatccatgtcgggga

SEQ ID NO: 333710 - DNA, 75 bp, Artificial Sequence
  Synthetic
aaaagaccaggaaaggcatagaaaggctgacagtgatcggagaacacgcctgggactttggctcaactggtggct

SEQ ID NO: 333711 - DNA, 75 bp, Artificial Sequence
  Synthetic
gggcaaaccggtcaggggtgagggatgcccccagagtgcattacggcagcacgccagtgagagtggcgacgggaa

SEQ ID NO: 333712 - DNA, 75 bp, Artificial Sequence
  Synthetic
tggagtgttgcttaaatcacttgctggtgttcctgtggcgcacattgatgggaccaagtaccacctgaaaagtgg

SEQ ID NO: 333713 - DNA, 75 bp, Artificial Sequence
  Synthetic
ttcgaggagggaacctgtggcatagtgcctcaaaacagacttgaaatgaccatgtggaggagctcggcgacagaa

SEQ ID NO: 333714 - DNA, 75 bp, Artificial Sequence
  Synthetic
tgcctcaaaacagacttgaaatgaccatgtggaggagctcggcgacagaactgaacttggctttggcggagggag

SEQ ID NO: 333715 - DNA, 75 bp, Artificial Sequence
  Synthetic
acgtggccatgttgataacacccaaccccacaatcgagaacaatggtggtggtttcatagaaatgcagttgcctc

SEQ ID NO: 333716 - DNA, 75 bp, Artificial Sequence
  Synthetic
agtttggagttggtctgagaacaaaagtatttctagacttcagacaggagtcaacacatgagtgtgacacaggag

SEQ ID NO: 333717 - DNA, 75 bp, Artificial Sequence
  Synthetic
ggacaagctcgatcccacagattatcggggtggcattcctggcttgctgaagaaggggaaagacataaaggtttc

SEQ ID NO: 333718 - DNA, 75 bp, Artificial Sequence
  Synthetic
agaaggggaaagacataaaggtttcctggaagagctggggccactcaatgatctggagtgtccccgaggctcccc

SEQ ID NO: 333719 - DNA, 75 bp, Artificial Sequence
  Synthetic
tatgtcatccggaggaggccagccactggaacaacggctatgtggggaggcatcgtcgtccttgcattgctcgtc

SEQ ID NO: 333720 - DNA, 75 bp, Artificial Sequence
  Synthetic
tgtggcttgactccatctaccaggagaaccctgccaaaacacgtgagtactgccttcacgcaaagctatcggata

SEQ ID NO: 333721 - DNA, 75 bp, Artificial Sequence
  Synthetic
ccagagattgtggctctgacactgttacaagctgtgtttgagttgagggttggcttgctcagcgcttttgcactg

SEQ ID NO: 333722 - DNA, 75 bp, Artificial Sequence
  Synthetic
gagggccttggggccctctggaaatggggagatgcactggctatgggggcattgattttcagagcttgtacagca

SEQ ID NO: 333723 - DNA, 75 bp, Artificial Sequence
  Synthetic
tgaccagggagggcttgtccgctcaatggtggtggcagacaatggagagctgctcagtgaggggggcatccccgg

SEQ ID NO: 333724 - DNA, 75 bp, Artificial Sequence
  Synthetic
ggcatgatgcggcacacctctcaggaggcactttgtgcgctcgccgtggcttcgttccttctgctcatgctggta

SEQ ID NO: 333725 - DNA, 75 bp, Artificial Sequence
  Synthetic
aatagtggctctgtttgtggtccttgaatatgtcattcggaggaggccagccactgggacaacggccatgtgggg

SEQ ID NO: 333726 - DNA, 75 bp, Artificial Sequence
  Synthetic
ggtgggcctgctcagcgcttttgcgctgcgcagcaacctcaccgtcagagagatggtaaccatctacttccttct

SEQ ID NO: 333727 - DNA, 75 bp, Artificial Sequence
  Synthetic
gcagaggaaaagaccggtgttggacttctgctcatggctctcatgacacagcaagacctggcgattgcacattat

SEQ ID NO: 333728 - DNA, 75 bp, Artificial Sequence
  Synthetic
cgccaagtgggagttggctatggctctaaaggtgtcttacacacgatgtggcatgtgacaagaggggcggcgttg

SEQ ID NO: 333729 - DNA, 75 bp, Artificial Sequence
  Synthetic
cctcatgttgctcaatctggaaactgattcgaggacacagagaacagaagggactgacttggattgtccctttgg

SEQ ID NO: 333730 - DNA, 75 bp, Artificial Sequence
  Synthetic
gattcgaggacacagagaacagaagggactgacttggattgtccctttggccgggctactcggaggagagggctc

SEQ ID NO: 333731 - DNA, 75 bp, Artificial Sequence
  Synthetic
agcggcatgatgcggcatacctcccaggaggctctttgcgcgctcgccgtggcttcgttccttctgcttatgttg

SEQ ID NO: 333732 - DNA, 75 bp, Artificial Sequence
  Synthetic
gctaaaaaaggggaaagacataaaggtttcttggaagagctggggccactcaatgatctggagtgtccccgaggc

SEQ ID NO: 333733 - DNA, 75 bp, Artificial Sequence
  Synthetic
tccaacccgtgtggtgctcaaggaaatggagcgtgctttgaatgggaagagagtcaggttccattctcctgcagt

SEQ ID NO: 333734 - DNA, 75 bp, Artificial Sequence
  Synthetic
atgggattgtggacgctgtcagaaatgctgagaacggctcgaagatcagacttggtcttctctggacagggagga

SEQ ID NO: 333735 - DNA, 75 bp, Artificial Sequence
  Synthetic
tcactggtccggcatccttggtgtgatgggattgtggacgctgtcagaaatgctgagaacggctcgaagatcaga

SEQ ID NO: 333736 - DNA, 75 bp, Artificial Sequence
  Synthetic
aggtcaaggatggcgtctacagaatcttcagcccaggactgctctgggggcagcgccaagtgggagttggctatg

SEQ ID NO: 333737 - DNA, 75 bp, Artificial Sequence
  Synthetic
ggacgttgtatgctacggtggagcctggagtcttgaggagaagtggaaaggtgagacagtgcaggtccatgcctt

SEQ ID NO: 333738 - DNA, 75 bp, Artificial Sequence
  Synthetic
tttcgactggatcaccgagtatgaagggcgcaccgcatggtttgtcccctcgattgcaaagggtggcaccatagc

SEQ ID NO: 333739 - DNA, 75 bp, Artificial Sequence
  Synthetic
cccggaatagtggccttgtttgtggtcctcgagtatgtcatccggaggaggccagccactggaacaacggctatg

SEQ ID NO: 333740 - DNA, 75 bp, Artificial Sequence
  Synthetic
ggaccggaacaggacaagatgccagaggtggcaggttacttccgcctcacagaagagaaaagaaagcacttccga

SEQ ID NO: 333741 - DNA, 75 bp, Artificial Sequence
  Synthetic
aggtggcaggttacttccgcctcacagaagagaaaagaaagcacttccgacatcttctcacccactgtgacttca

SEQ ID NO: 333742 - DNA, 75 bp, Artificial Sequence
  Synthetic
agttggagatcaacaggtgggaggggctatcgtcgatgtgatgtgccatgcaacctatgtcaacagacgcctgct

SEQ ID NO: 333743 - DNA, 75 bp, Artificial Sequence
  Synthetic
gatggtgctcggcctggccactcttggtgtcgtttggtgctttgttgttcgcacctcaatcagtcgcatgatgct

SEQ ID NO: 333744 - DNA, 75 bp, Artificial Sequence
  Synthetic
ccaatgaaatgggattcctggagaagactaaagcggatctgtccacagtgttgtggagtgaacatgaagagttgc

SEQ ID NO: 333745 - DNA, 75 bp, Artificial Sequence
  Synthetic
tatggaccagagcaggacaaaatgccagaggtggcaggtcatttccgcctcactgaagagaaaagaaagcacttt

SEQ ID NO: 333746 - DNA, 75 bp, Artificial Sequence
  Synthetic
ggaacttatgtgctagtggtctccctgttcacaccatacataattcatcaacttcagacaaaaatccaacagctc

SEQ ID NO: 333747 - DNA, 75 bp, Artificial Sequence
  Synthetic
cgacaccttctcacccactgtgacttcacaccgtggctagcatggcacgtcgcggcaaacgtgtctagtgtgaca

SEQ ID NO: 333748 - DNA, 75 bp, Artificial Sequence
  Synthetic
tggagagggagagacaaaacctgctttgtatgagagaaaaatgagtctggtcttggccatagtgctctgcttgat

SEQ ID NO: 333749 - DNA, 75 bp, Artificial Sequence
  Synthetic
gggaagagcgaacccttcccagagtccaacggagcaatttccagtgaagagaagcagatccctgatggggagtgg

SEQ ID NO: 333750 - DNA, 75 bp, Artificial Sequence
  Synthetic
aagctcaatggctgtaccaaagaagaattctttgtctacaggcgcactggcatcctggagacagaaagggacaaa

SEQ ID NO: 333751 - DNA, 75 bp, Artificial Sequence
  Synthetic
gaagaccaaggcggacctgtccacagtgttgtggagtgaacatgaggagttgcggtcgtgggaagagtggaccaa

SEQ ID NO: 333752 - DNA, 75 bp, Artificial Sequence
  Synthetic
agcgcagatacttcttgacaacataacaacactgcgggggcctgtggccaccttctatggaccagagcaggacaa

SEQ ID NO: 333753 - DNA, 75 bp, Artificial Sequence
  Synthetic
tgatcaagttcagagcgggaatggatgtgttcagcatgcagccacaccgagctgacaccatcatgtgtgacatcg

SEQ ID NO: 333754 - DNA, 75 bp, Artificial Sequence
  Synthetic
gagaaagcaacccagatgccgtggtggagggtgagaggacacggaaagtgatactactcatggaacagtggaaaa

SEQ ID NO: 333755 - DNA, 75 bp, Artificial Sequence
  Synthetic
ctcagggagacgcagctttggagacgtgctgagcggaatgtccggggttcctgagcttctgcgccacagatgtgt

SEQ ID NO: 333756 - DNA, 75 bp, Artificial Sequence
  Synthetic
ctgtgggactggcggcagcgggacaactgctcagaccagaggtggacaccctgtggacgatgccagtggcctgtg

SEQ ID NO: 333757 - DNA, 75 bp, Artificial Sequence
  Synthetic
catagactctggctcagggcttctgggagtaggcgtggcggctctgagggggacaccctcggtgacttgtggaaa

SEQ ID NO: 333758 - DNA, 75 bp, Artificial Sequence
  Synthetic
gggcaagagagaaaagaagcttggagagtttggagtggccaaaggaagccgagccatatggtacatgtggctggg

SEQ ID NO: 333759 - DNA, 75 bp, Artificial Sequence
  Synthetic
tgtgtttaaagtgctggctccgtaccgcccagaggtcatagaggcactgcacaggttccaactgcagtggggcgg

SEQ ID NO: 333760 - DNA, 75 bp, Artificial Sequence
  Synthetic
gaacggtgccttccatcaccgaggcttctgctgtgggactggcggcagcgggacaactgctcagaccagaggcgg

SEQ ID NO: 333761 - DNA, 75 bp, Artificial Sequence
  Synthetic
tgtgacttatgccctcaataccctcaccaacataaaggttcagctgatccggatgatggagggggagggagtcat

SEQ ID NO: 333762 - DNA, 75 bp, Artificial Sequence
  Synthetic
tgagagatcatggagaagaacgtctcggaagaatgcttgtgagcggcgatgactgtgtggtgaggccgttggacg

SEQ ID NO: 333763 - DNA, 75 bp, Artificial Sequence
  Synthetic
cataccgcccagaggtcatagaagcactgcatagattccaattgcagtggggcggaggactggtgaggacccctt

SEQ ID NO: 333764 - DNA, 75 bp, Artificial Sequence
  Synthetic
aacattgtgaattctgtcaacatccagtcaaggaaactcctggcccggttcggggaccagaggggacccaccagg

SEQ ID NO: 333765 - DNA, 75 bp, Artificial Sequence
  Synthetic
agcttggagagttcggagtggccaaaggaagccgggccatatggtacatgtggctggggagtcgctttctggagt

SEQ ID NO: 333766 - DNA, 75 bp, Artificial Sequence
  Synthetic
atggaggctgcatcatggatgtcatcacaagaagagaccaaagaggttcaggacaggttgtgacttatgccctca

SEQ ID NO: 333767 - DNA, 75 bp, Artificial Sequence
  Synthetic
cacaagaagagaccaaagaggttcaggacaggttgtgacttatgccctcaacacccttaccaacataaaggttca

SEQ ID NO: 333768 - DNA, 75 bp, Artificial Sequence
  Synthetic
ttcaaaagcctatgggcagatgtggctgctgagttacttccaccggcgcgacctgcgaacgcttggactcgccat

SEQ ID NO: 333769 - DNA, 75 bp, Artificial Sequence
  Synthetic
ctgctgagttacttccaccggcgcgacctgcgaacgcttggactcgccatttgctcggcggtgcccgtcgactgg

SEQ ID NO: 333770 - DNA, 75 bp, Artificial Sequence
  Synthetic
gaccacagaggacatgctggatgtctggaacagggtgtggatcctggacaaccccttcatgcacagcaaagaaaa

SEQ ID NO: 333771 - DNA, 75 bp, Artificial Sequence
  Synthetic
gcggtgatgattgtgtggtgaggccagtggatgataggttcagcagggcgctctacttcttgaacgacatggcaa

SEQ ID NO: 333772 - DNA, 75 bp, Artificial Sequence
  Synthetic
tgtgttcctcccttgttgggaggaaagagagggcagagtgggccaagaacatctggggagcagtagagaaagtca

SEQ ID NO: 333773 - DNA, 75 bp, Artificial Sequence
  Synthetic
gaaacggaggctgaacaactgcaccagggaggaattctttgtgtacaggcgcactggcatcctggagacggaacg

SEQ ID NO: 333774 - DNA, 75 bp, Artificial Sequence
  Synthetic
acattgtccagacaaaacaaaattgaaatgaccaagaatggaaagaggctgagcaaaaggtcccaatgtgccaga

SEQ ID NO: 333775 - DNA, 75 bp, Artificial Sequence
  Synthetic
ctcagactggagagctcaataatctaaacccatactgtgacagagcaaaacccggagggctcgtaaaaaattgtc

SEQ ID NO: 333776 - DNA, 75 bp, Artificial Sequence
  Synthetic
gacggcaccaccgtgatcagagctgaaggaaaagacgcggcaactcaggtgcgtgtggaaaatggcacctgtgtg

SEQ ID NO: 333777 - DNA, 75 bp, Artificial Sequence
  Synthetic
gcaccggtctacgcttcgcgttgcacacacttggaaaacagggactttgtgactggtactcaggggactacgagg

SEQ ID NO: 333778 - DNA, 75 bp, Artificial Sequence
  Synthetic
agatctcacaggaaggggacacaaatggttagaaggggattcactgcggacgcacctcactagagttgaaggatg

SEQ ID NO: 333779 - DNA, 75 bp, Artificial Sequence
  Synthetic
aatagcatcttcgggggagtggggtttctaccaaagcttttattaggagtggcattggcttggttgggcctgaac

SEQ ID NO: 333780 - DNA, 75 bp, Artificial Sequence
  Synthetic
gagggatcagagtgatcgaggctggggcaaccactgcggactgtttggaaagggtagcatcgtggcctgtgttaa

SEQ ID NO: 333781 - DNA, 75 bp, Artificial Sequence
  Synthetic
tgaggggaagccctcaatggatgtgtggcttgactccatctaccaggagaatcctgccaaaacacgtgagtactg

SEQ ID NO: 333782 - DNA, 75 bp, Artificial Sequence
  Synthetic
tggcttgactccatctaccaggagaatcctgccaaaacacgtgagtactgccttcacgcaaagctatcggatacc

SEQ ID NO: 333783 - DNA, 75 bp, Artificial Sequence
  Synthetic
ggtcttcttggatttcagacaggaaccaacacatgagtgtgacacaggagtgatgggagctgccgtcaagaacgg

SEQ ID NO: 333784 - DNA, 75 bp, Artificial Sequence
  Synthetic
ggaaacatgagggagcacaaaactggaacaatgcggaacggctggttgagtttggagctccacacgccgtgaaaa

SEQ ID NO: 333785 - DNA, 75 bp, Artificial Sequence
  Synthetic
cgcagaagcctcaccgtccgagagatggtgaccacctactttcttttgctggtcctggaattggggctgccgggt

SEQ ID NO: 333786 - DNA, 75 bp, Artificial Sequence
  Synthetic
gtggtttcctgacttcggttggtaaggcgctgcacacagttcttggcggtgcctttaacagcctttttggaggag

SEQ ID NO: 333787 - DNA, 75 bp, Artificial Sequence
  Synthetic
ctgaacatgaggaatccgaccatgtccatgagcttcctcctggctggaggactggttctggccatgacactcgga

SEQ ID NO: 333788 - DNA, 75 bp, Artificial Sequence
  Synthetic
ccggcttggcagcttcggccattcattggtcaggcattcttggtgtgatgggactgtggacgctcacggaaatgc

SEQ ID NO: 333789 - DNA, 75 bp, Artificial Sequence
  Synthetic
cagccactgggacaacggccatgtggggaggcatagtcgtctttgcactgctcgtcactggtctggtaaggatcg

SEQ ID NO: 333790 - DNA, 75 bp, Artificial Sequence
  Synthetic
cctatgtcaacagacggctactcccacaggggagacaaaattgggaggtggcaatcatggatgaggcccactgga

SEQ ID NO: 333791 - DNA, 75 bp, Artificial Sequence
  Synthetic
tcgcaccttgagacagaaggggaaaagtgtgatctgtttgaacagcaaaacctttgaaaaggactactccagagt

SEQ ID NO: 333792 - DNA, 75 bp, Artificial Sequence
  Synthetic
ctccggagtcaggttgctagctttttgggagctggctatccatggaaagagacggtcatttagtgaaccactgac

SEQ ID NO: 333793 - DNA, 75 bp, Artificial Sequence
  Synthetic
aggcctttctgactatggttgagatgatggtgctgggtttggcaaccctgggtgtcatctggtgcttcgtcgtcc

SEQ ID NO: 333794 - DNA, 75 bp, Artificial Sequence
  Synthetic
ggccatggagtgaatggacgaatgtggacatccagccagcgaggtcctggggaacctatgtgctggtggtgtctc

SEQ ID NO: 333795 - DNA, 75 bp, Artificial Sequence
  Synthetic
aggtgcccccttctttggtgtggcgggacatgtcatgacccttggggtggtgtcactgattggggctactcccac

SEQ ID NO: 333796 - DNA, 75 bp, Artificial Sequence
  Synthetic
gttggccccaacccgtgtggtgctcaaggaaatggagcgtgccttgaatgggaagagggtcaggttccattctcc

SEQ ID NO: 333797 - DNA, 75 bp, Artificial Sequence
  Synthetic
tagaggatgaagaacagatcctacggtacatggagggtgagcacaaacaattggcaaccacaataatgcaaaaag

SEQ ID NO: 333798 - DNA, 75 bp, Artificial Sequence
  Synthetic
cactgaggccagtgtggagggatgcgcgcatgttcagagaaggacgtgacatcagagagtttgttgcgtatgcct

SEQ ID NO: 333799 - DNA, 75 bp, Artificial Sequence
  Synthetic
attgagctgaacctggagagctcattaaatatagtccagacaaaacaaaacatgacaaagcaaagaggctgagct

SEQ ID NO: 333800 - DNA, 75 bp, Artificial Sequence
  Synthetic
gcaatgaagatggccgagagagatgctccagaggccttcttgacggtggcagagatgatggtgctcggcctggcc

SEQ ID NO: 333801 - DNA, 75 bp, Artificial Sequence
  Synthetic
gcgtttgcttcggacagcattagcagcggttggtttgaaagagatattcttttgtttctaccagtcgtgaacgtg

SEQ ID NO: 333802 - DNA, 75 bp, Artificial Sequence
  Synthetic
gttgatgcgcatgatggggatcttgtggcatgccgtagctggcaccgcgagaaaccccgtattgaaggcgttctg

SEQ ID NO: 333803 - DNA, 75 bp, Artificial Sequence
  Synthetic
tcctggggaacttacgtgctggtggtctccctgttcacaccatacattatccaccaacttcagaccaagatccaa

SEQ ID NO: 333804 - DNA, 75 bp, Artificial Sequence
  Synthetic
ccaccaacttcagaccaagatccaacagctcgtcaacagcgctgttgcaactggagcccaggccatgcgagacct

SEQ ID NO: 333805 - DNA, 75 bp, Artificial Sequence
  Synthetic
gtagcagggcatgtaatggctttgggcgtggtatcgctagttggagcaacgccaacctccttggttgttggcgtt

SEQ ID NO: 333806 - DNA, 75 bp, Artificial Sequence
  Synthetic
ttgtggtgtctggactagaggctgagttgactcaaagagcccataaagtcttcttctcggcaatggttcgcaatc

SEQ ID NO: 333807 - DNA, 75 bp, Artificial Sequence
  Synthetic
gcctggtcctggcgatagtgctttgcttgatgtcggtggtcatgaacagaacggtgccttccatcaccgaggctt

SEQ ID NO: 333808 - DNA, 75 bp, Artificial Sequence
  Synthetic
gcagggcatgtaatggctttgggcgtggtatcgctagttggcgcaacgccaacctctttggtggttggcgttggt

SEQ ID NO: 333809 - DNA, 75 bp, Artificial Sequence
  Synthetic
tcgaggaactcaacccatgaaatgtattactcgactgctgtcactggaaacattgtgaattctgtcaacatccaa

SEQ ID NO: 333810 - DNA, 75 bp, Artificial Sequence
  Synthetic
gcagagaggaattcatagcaaaagtgaagtccaatgcggctctgggggcctggtccgatgagcagaacaggtggt

SEQ ID NO: 333811 - DNA, 75 bp, Artificial Sequence
  Synthetic
accactgggcctccagggggtccagtggatctggagtggagggaataagcttgaactacctgggctggtacctca

SEQ ID NO: 333812 - DNA, 75 bp, Artificial Sequence
  Synthetic
tggatctggagtggagggaataagcttgaactacctgggctggtacctcaaagggttgtcaacactggaaggagg

SEQ ID NO: 333813 - DNA, 75 bp, Artificial Sequence
  Synthetic
aaaggttgcccggccctcccgagacggaggctgcgttatggatgtcatcactagaagagaccaaagaggttcagg

SEQ ID NO: 333814 - DNA, 75 bp, Artificial Sequence
  Synthetic
caaagttcacatggaagagagctccaacagacagtgggcatgatacagtggtcatggaagtcacattctctggaa

SEQ ID NO: 333815 - DNA, 75 bp, Artificial Sequence
  Synthetic
acactggccagcggcatgatgcgacacacctcccaggaggctctctgtgcactcgcagtggcctcgtttctcttg

SEQ ID NO: 333816 - DNA, 75 bp, Artificial Sequence
  Synthetic
ggagcggcgctgtctattgatgatgctgtggccggtccctactgggctgatgtgagggaagatgtcgtgtgctac

SEQ ID NO: 333817 - DNA, 75 bp, Artificial Sequence
  Synthetic
ggctatacggaaatggcctaaaaactaatgagacctacgtcagcagcattgctcaaggggaagcggagaagagtc

SEQ ID NO: 333818 - DNA, 75 bp, Artificial Sequence
  Synthetic
aatggacgtgtacaaccttggagaccagactggagtgttgctcaaatcacttgctggtgttcctgtggcgcacat

SEQ ID NO: 333819 - DNA, 75 bp, Artificial Sequence
  Synthetic
tccaaaaagggagtagcattggaagggtttttcaaaaaaccagaaaaggcatagaaaggctgacagtgatcggag

SEQ ID NO: 333820 - DNA, 75 bp, Artificial Sequence
  Synthetic
ctttcgactcactgaagagaaaagaaagcacttccgacatcttctcacccattgtgacttcacaccgtggctggc

SEQ ID NO: 333821 - DNA, 75 bp, Artificial Sequence
  Synthetic
ggagagaggtatccgagtggtatgacaattatgcatactacccggagacaccaggagctcttgcttcggccataa

SEQ ID NO: 333822 - DNA, 75 bp, Artificial Sequence
  Synthetic
caattatgcatactacccggagacaccaggagctcttgcttcggccataaaggagaccttcgaggagggaacttg

SEQ ID NO: 333823 - DNA, 75 bp, Artificial Sequence
  Synthetic
ccaggagctcttgcttcggccataaaggagaccttcgaggagggaacttgtggcatagtgccccagaacagactt

SEQ ID NO: 333824 - DNA, 75 bp, Artificial Sequence
  Synthetic
gtggtggacaaactcgaccccacagattatcgaggtggcattcctggcttgctaaaaaaggggaaagacataaag

SEQ ID NO: 333825 - DNA, 75 bp, Artificial Sequence
  Synthetic
caagtgaaaggaccatggaagtactcgcccatccgagtgacaagagaagagtgccctggcacgagggtcaccata

SEQ ID NO: 333826 - DNA, 75 bp, Artificial Sequence
  Synthetic
ccggtacaagagtcatcatgagagcagtaaatgattggattttggaacgactggcgcagaaaagcaaaccgcgca

SEQ ID NO: 333827 - DNA, 75 bp, Artificial Sequence
  Synthetic
cccactacgggactgcttcatagcggtttgtggggggaggctaggaggcgaagccacagatcatggaatgatgcg

SEQ ID NO: 333828 - DNA, 75 bp, Artificial Sequence
  Synthetic
aggtgcatcaatgtcagcccggagaactgctcctggacacaggtaggaggataggggcagtgccaattgatttgg

SEQ ID NO: 333829 - DNA, 75 bp, Artificial Sequence
  Synthetic
agattttcttgcacgtgcgtgcgtttgcttcggatagcatcagcagcggcaggtttggaagagacatcgtctcgt

SEQ ID NO: 333830 - DNA, 75 bp, Artificial Sequence
  Synthetic
acagcttgtcaacagtgccgtggcctccggggcgcaggccatgagagaccttgggggggggactcccttcttcgg

SEQ ID NO: 333831 - DNA, 75 bp, Artificial Sequence
  Synthetic
gaagcagatccctgatggggagtggcgtgatggattcgactggatcaccgagtatgaggggcgtaccgcatggtt

SEQ ID NO: 333832 - DNA, 75 bp, Artificial Sequence
  Synthetic
ctcagattggagagctcaattatctaaagctaaattgtgacagagcaaaacctggagggctcgtaaaacattgtc

SEQ ID NO: 333833 - DNA, 75 bp, Artificial Sequence
  Synthetic
ttttggacaaccctttcatgcagaacaaggaaaaggtcatggagtggagggatgttccgtacctccctaaagctc

SEQ ID NO: 333834 - DNA, 75 bp, Artificial Sequence
  Synthetic
aggtcctgaggagaacaccgtggacgaggccaatggagatctggtcaccttcaggagcccgaatggggctgaaag

SEQ ID NO: 333835 - DNA, 75 bp, Artificial Sequence
  Synthetic
gaggccaatggagatctggtcaccttcaggagcccgaatggggctgaaagaacattgaggccagtgtggagggat

SEQ ID NO: 333836 - DNA, 75 bp, Artificial Sequence
  Synthetic
aatctaaacccagactgtgacagagcaaaacccggagggctcgtaaaagattgtccggaaccaaaaggaaagcaa

SEQ ID NO: 333837 - DNA, 75 bp, Artificial Sequence
  Synthetic
gaccccctgcatcatgataaggccgaacatggtgcatgaaaggggaggcccccggaagcacgcttccgggaggag

SEQ ID NO: 333838 - DNA, 75 bp, Artificial Sequence
  Synthetic
cttgttctccctgagccaccatcacccagacacagcatagtctgacaaggaggtgatgagtgactcgaaaaaaca

SEQ ID NO: 333839 - DNA, 75 bp, Artificial Sequence
  Synthetic
tgcttcggatagcatcagcagcggcaggtttggaagagacattgtctcgtttctactagtcgtgaacgtgttgag

SEQ ID NO: 333840 - DNA, 75 bp, Artificial Sequence
  Synthetic
ttgaccgtggaaagtgtggtgacccgagtcgccattgtggttgtgctcctttgcctggctccggtttatgcgtca

SEQ ID NO: 333841 - DNA, 75 bp, Artificial Sequence
  Synthetic
ctgaggggaagccctcaatggatgtgtggctcgattccatctatcaggagaacccggccaaaacacgcgagtact

SEQ ID NO: 333842 - DNA, 75 bp, Artificial Sequence
  Synthetic
ggcaatcactgcggattgtttggaaagggcagtattgtgacctgcgtcaaggcggcttgtggggcaaagaagaag

SEQ ID NO: 333843 - DNA, 75 bp, Artificial Sequence
  Synthetic
tgtgcagagtcgccagtggcgttgacttggctcagactgtcattcttgagcttgacaagactctggaacaccttc

SEQ ID NO: 333844 - DNA, 75 bp, Artificial Sequence
  Synthetic
aggatgtcgtgcgaatggccatgactgacaccacagcctttggacagcagcgagtgttcaaagagaaggttgaca

SEQ ID NO: 333845 - DNA, 75 bp, Artificial Sequence
  Synthetic
ggaaacgtttgaggagggaaattgtggcatagtaccacaaaacagacttgagatggccatgtggaggagtgcagt

SEQ ID NO: 333846 - DNA, 75 bp, Artificial Sequence
  Synthetic
atagagggggggcggttcttgttctccctgagccaccatcacccagacacagatagtctgacaaggaggtgatgt

SEQ ID NO: 333847 - DNA, 75 bp, Artificial Sequence
  Synthetic
gtctgatgtcggtagtcatgaacagaacggtggcttccatcactgaagcctcagccgtggggctggcggcggctg

SEQ ID NO: 333848 - DNA, 75 bp, Artificial Sequence
  Synthetic
caaatgccaaatggactcgtgttgatgcgcatgatggggatcttgtggcatgccatagctggcactgccagaagc

SEQ ID NO: 333849 - DNA, 75 bp, Artificial Sequence
  Synthetic
cagttcctctgaaacaggccacggcagcactacggaaaatcaaaaaggcagtgagcactttgatggtaggcttgc

SEQ ID NO: 333850 - DNA, 75 bp, Artificial Sequence
  Synthetic
gaaatgatgagatcggcccgaagatctgacttggtcttctccggacagggggggcgcgagcgaggtgacagacct

SEQ ID NO: 333851 - DNA, 75 bp, Artificial Sequence
  Synthetic
gggccaacggcaggtgggagtcggatatggcttcaagggtgttctgcacacgatgtggcatgtgacaagaggagc

SEQ ID NO: 333852 - DNA, 75 bp, Artificial Sequence
  Synthetic
gatattggccacggacatggggtcatggtgtgacgactcactgtcctatgagtgtgtgaccatagaccaggggga

SEQ ID NO: 333853 - DNA, 75 bp, Artificial Sequence
  Synthetic
agaaccggttgatgtggattgcttttgcagaaatgttgatggggtctaccttgagtatggacggtgtggaaaaca

SEQ ID NO: 333854 - DNA, 75 bp, Artificial Sequence
  Synthetic
caagggaacatctggcagccccatccttaacgctcaaggagcggtggtgggactgtatggaaacggactgaagac

SEQ ID NO: 333855 - DNA, 75 bp, Artificial Sequence
  Synthetic
gacccaacctcccgcaggctgtcgtgggcacggggtggaccgcaaagggccaaatcacagtgctggacatgcacc

SEQ ID NO: 333856 - DNA, 75 bp, Artificial Sequence
  Synthetic
gggcacggggtggaccgcaaagggccaaatcacagtgctggacatgcacccaggctctgggaagacccacagagt

SEQ ID NO: 333857 - DNA, 75 bp, Artificial Sequence
  Synthetic
cacgagagtgactctggtgttggagctgggtggatgtgtcacgatcactgctgaggggaagccctcaatggatgt

SEQ ID NO: 333858 - DNA, 75 bp, Artificial Sequence
  Synthetic
gcctcttctacgcggatgacacggctggctgggacaccaaggtcaccaatgcagatctagaggatgaggagcaga

SEQ ID NO: 333859 - DNA, 75 bp, Artificial Sequence
  Synthetic
caaggttgcggccagatgcccaacaatggggcccgccactctggctgaagagcatcagagtggtacggtgtgcaa

SEQ ID NO: 333860 - DNA, 75 bp, Artificial Sequence
  Synthetic
agcaaaacctttgagaaggattacaccagagtgagagatgaaaagcctgactttgtggtgacgaccgacatatct

SEQ ID NO: 333861 - DNA, 75 bp, Artificial Sequence
  Synthetic
ctcagaaaaaaccatcttgactatgggggattatggagatgtgtccttgttgtgcagagtcgccagtggcgttga

SEQ ID NO: 333862 - DNA, 75 bp, Artificial Sequence
  Synthetic
tgtgcagagtcgccagtggcgttgacctggctcagactgtcattcttgagcttgacaagactctggaacaccttc

SEQ ID NO: 333863 - DNA, 75 bp, Artificial Sequence
  Synthetic
ggcccagaggaaaatgcagtggacgaggccaatggagatctggtcaccttcaggagcccaaatggggctgaaaga

SEQ ID NO: 333864 - DNA, 75 bp, Artificial Sequence
  Synthetic
cctggagggctcgcaaaacatagcaacacttcgtgagacccccccggccagtggaggggaagctggtcaggggtg

SEQ ID NO: 333865 - DNA, 75 bp, Artificial Sequence
  Synthetic
ctcacatacacaatgtgtgacaaaacgaagttcgcatggaagcggaccccaacagatagcggacatgacacagtg

SEQ ID NO: 333866 - DNA, 75 bp, Artificial Sequence
  Synthetic
cgaagttcgcatggaagcggaccccaacagatagcggacatgacacagtggtcatggaagtcacgttctctggaa

SEQ ID NO: 333867 - DNA, 75 bp, Artificial Sequence
  Synthetic
gtcatggaagtcacgttctctggaacaaaaccttgcaggatcccagtacgggcagtggcacacggctctccagat

SEQ ID NO: 333868 - DNA, 75 bp, Artificial Sequence
  Synthetic
ggcagtggcacacggctctccagatgtaaatgtggccatgctgataacaccaaaccccaccattgagaacaacgg

SEQ ID NO: 333869 - DNA, 75 bp, Artificial Sequence
  Synthetic
aggtggcttcatagagatgcagctacccccaggggacaacattatttatgtcggggagctaagccatcagtggtt

SEQ ID NO: 333870 - DNA, 75 bp, Artificial Sequence
  Synthetic
gactctctgcagtctggctggattggtcgccgccaatgagatggggttccttgagagaaccaaggcggatctgtc

SEQ ID NO: 333871 - DNA, 75 bp, Artificial Sequence
  Synthetic
tccaccaacttcagaccaagattcaacagcttgtcaacagtgccgtagcctccggggcacaggccatgagagacc

SEQ ID NO: 333872 - DNA, 75 bp, Artificial Sequence
  Synthetic
agtgggtgctgatgttggttgtgccgtggacaccgagcgaatggaactccgctgtggtgagggcctagttgtgtg

SEQ ID NO: 333873 - DNA, 75 bp, Artificial Sequence
  Synthetic
ggagtggtgtcactggtaggggccacacccacctctttggtagtgggtgttgggctggctgcatttcatttggcc

SEQ ID NO: 333874 - DNA, 75 bp, Artificial Sequence
  Synthetic
gagggaagtctccgagtggtacgacaactacgcatactacccagaaacgccaggagcgctagcatcggccataaa

SEQ ID NO: 333875 - DNA, 75 bp, Artificial Sequence
  Synthetic
gtctgatggcggtggtcatgaacagaacggtggcttccatcacggaagcctcagccgtggggctggcggcagccg

SEQ ID NO: 333876 - DNA, 75 bp, Artificial Sequence
  Synthetic
gaaggagacgcaaacctcacggtggtggtggacaaactcgatcccaccgactaccggggcggtgttcctggccta

SEQ ID NO: 333877 - DNA, 75 bp, Artificial Sequence
  Synthetic
agggagacacacttggtgacctctggaaacagagactgaacagctgcaccaaggaggaattctttgtctacagac

SEQ ID NO: 333878 - DNA, 75 bp, Artificial Sequence
  Synthetic
actggagtgatgggggctgccgtcaagaatggcatggcggtccacactgaccaaagcctctggatgaaatctgtg

SEQ ID NO: 333879 - DNA, 75 bp, Artificial Sequence
  Synthetic
ccaaagcctctggatgaaatctgtgaaaaatgacactggaacttacatagttgaattattggttactgacttgag

SEQ ID NO: 333880 - DNA, 75 bp, Artificial Sequence
  Synthetic
ggaactgggaggatgcgtcaccataacagctgaggggaagccctcgatggatgtgtggcttgactccatctacca

SEQ ID NO: 333881 - DNA, 75 bp, Artificial Sequence
  Synthetic
aacaggatacctgggtatgcagaacaggtgaaaggaccatggaagtactcgcccatccgagtcacaagggaggag

SEQ ID NO: 333882 - DNA, 75 bp, Artificial Sequence
  Synthetic
aggtgaaaggaccatggaagtactcgcccatccgagtcacaagggaggagtgccctggcacgaaagtcaccataa

SEQ ID NO: 333883 - DNA, 75 bp, Artificial Sequence
  Synthetic
ttctgtgaggagcaccacggagagcggcaaggtgatcccggaatggtgctgccggacatgcacactaccgccagt

SEQ ID NO: 333884 - DNA, 75 bp, Artificial Sequence
  Synthetic
ggcaaggtgatcccggaatggtgctgccggacatgcacactaccgccagtgacgttccgcacggggactgactgc

SEQ ID NO: 333885 - DNA, 75 bp, Artificial Sequence
  Synthetic
gacgttccgcacggggactgactgctggtatgccatggaaatacgcccggtccacgaccaggggggtcttgttcg

SEQ ID NO: 333886 - DNA, 75 bp, Artificial Sequence
  Synthetic
ccggaattgtggcactgtttgtggtcctcgaatatgtcatccggaggagaccagctacagggacagcggtcgtgt

SEQ ID NO: 333887 - DNA, 75 bp, Artificial Sequence
  Synthetic
acatcgtgaactctgtcaacatccagtctaggaaactcctagcccggtttggggaccagagaggacccactagag

SEQ ID NO: 333888 - DNA, 75 bp, Artificial Sequence
  Synthetic
ggaagaaaaacagcgtccttcacggtttcctcggagaagaccatcttgaccatgggagactacggagacgtgtcc

SEQ ID NO: 333889 - DNA, 75 bp, Artificial Sequence
  Synthetic
gctcgtcaccggaatggtcaagattgagagtttggtgcgatacgtcgtggcggtggggatcacattccatctcga

SEQ ID NO: 333890 - DNA, 75 bp, Artificial Sequence
  Synthetic
gagagtttggtgcgatacgtcgtggcggtggggatcacattccatctcgagttggggccagagattgtggccctg

SEQ ID NO: 333891 - DNA, 75 bp, Artificial Sequence
  Synthetic
tgagggtgggcctgctcagcgctttcgcactgcgcagaggcctcactgtccgagagatggtgacaatctacttcc

SEQ ID NO: 333892 - DNA, 75 bp, Artificial Sequence
  Synthetic
tactgctggtcttggagctagggttgccaggtgagagctttgagggtctctggaaatggggtgacgccttggcca

SEQ ID NO: 333893 - DNA, 75 bp, Artificial Sequence
  Synthetic
tgggggcgctgatattccgagcttgcaccgcagaggggaaagctggtgtcggactcctgctgatggccctcatga

SEQ ID NO: 333894 - DNA, 75 bp, Artificial Sequence
  Synthetic
cacttgctggtgttcctgtggcgcacattgatggaaccaagtaccacctgaaaagtggccacgtgacatgcgagg

SEQ ID NO: 333895 - DNA, 75 bp, Artificial Sequence
  Synthetic
ctgtcgtgggagtcatgctgacactggctggcggcatgatgcgccacacttcccaggaggctttgtgcgcactcg

SEQ ID NO: 333896 - DNA, 75 bp, Artificial Sequence
  Synthetic
gctagtgttggggacaaggaagatgcagctagtggctgaatggagtggctgtgtagaatggcacccggaactggt

SEQ ID NO: 333897 - DNA, 75 bp, Artificial Sequence
  Synthetic
gagaacacgcctgggattttggctctactggtggtttcctgacctcggttggtaaggcgctgcacacagttcttg

SEQ ID NO: 333898 - DNA, 75 bp, Artificial Sequence
  Synthetic
ggtaaggcgctgcacacagttcttggcggtgcctttaacagcctttttggaggagtggggttcttgcccaagatc

SEQ ID NO: 333899 - DNA, 75 bp, Artificial Sequence
  Synthetic
ccttccactggtcggggattcttggagtgatgggactgtggacgctatcagaaatgatgagatcggcccgaagat

SEQ ID NO: 333900 - DNA, 75 bp, Artificial Sequence
  Synthetic
ttggtccgaatgatggagggggagggagtcatagaggcatcagacgcacacaacccaagattactccgtgtggaa

SEQ ID NO: 333901 - DNA, 75 bp, Artificial Sequence
  Synthetic
agtgatgggactgtggacgctatcagaaatgatgagatcggcccgaagatctgacttggtcttctccggacaggg

SEQ ID NO: 333902 - DNA, 75 bp, Artificial Sequence
  Synthetic
agcctggagcctagaggaaaaatggaaaggtgagatagtgcaggtccatgccttcccaccggggagggcccatga

SEQ ID NO: 333903 - DNA, 75 bp, Artificial Sequence
  Synthetic
ctgaatgctcaaggagcagtggtgggactgtatggaaacggactgaaaaccaatgagacttatgtcagcagcatt

SEQ ID NO: 333904 - DNA, 75 bp, Artificial Sequence
  Synthetic
gctcaaggagaggttgaaaaaagccgacccaacctcccgcaggctgtcgtgggcacggggtggaccgcaaagggc

SEQ ID NO: 333905 - DNA, 75 bp, Artificial Sequence
  Synthetic
tgttggcaccaactcgcgtggtgctcaaggaaatggaacgtgcactgaatgggaagagagtcaggttccactctc

SEQ ID NO: 333906 - DNA, 75 bp, Artificial Sequence
  Synthetic
caaggaaatggaacgtgcactgaatgggaagagagtcaggttccactctcccgcggtaagtgaccaacaggtggg

SEQ ID NO: 333907 - DNA, 75 bp, Artificial Sequence
  Synthetic
gggaagagagtcaggttccactctcccgcggtaagtgaccaacaggtgggaggggcaatcgtcgatgtcatgtgc

SEQ ID NO: 333908 - DNA, 75 bp, Artificial Sequence
  Synthetic
agaggctgagcaaaggtcctgaatgaccagaccgttcgcactgcgggctgggacgggggccagaaggcgaggcca

SEQ ID NO: 333909 - DNA, 75 bp, Artificial Sequence
  Synthetic
cattggacagatccacatagcatagccgccaggggtcatttgtatactctggcaaaagaaaacaaatgcgctttg

SEQ ID NO: 333910 - DNA, 75 bp, Artificial Sequence
  Synthetic
aaacagatccctgagggagagtggcgtgacgggtttgactggatcaccgagtatgaagggcgcaccgcttggttc

SEQ ID NO: 333911 - DNA, 75 bp, Artificial Sequence
  Synthetic
gtgacgggtttgactggatcaccgagtatgaagggcgcaccgcttggttcgttccatcgattgcaaagggtggtg

SEQ ID NO: 333912 - DNA, 75 bp, Artificial Sequence
  Synthetic
cccctgcatcatgacaaggcctaacatgatgcacgaaggggaggcccccggaagcatgcttccgggaggagggaa

SEQ ID NO: 333913 - DNA, 75 bp, Artificial Sequence
  Synthetic
gccgtgtcatagatgggcgaacaaacatcaagccggaagaggttgacgggagagttgagctcaccgggaccaggc

SEQ ID NO: 333914 - DNA, 75 bp, Artificial Sequence
  Synthetic
actctggacagtgtgatgatgatgacagtggactcgtgcagtggaaggaagcgcagatactcctcgataacataa

SEQ ID NO: 333915 - DNA, 75 bp, Artificial Sequence
  Synthetic
caactttacgaggacctgtggccaccttctatggaccagagcaggacaaaatgccagaggtggcaggccacttcc

SEQ ID NO: 333916 - DNA, 75 bp, Artificial Sequence
  Synthetic
ggcccagaggaaaacgcagtggatgaggccaatggagatctggtcaccttcaggagcccgaatggggctgaaaga

SEQ ID NO: 333917 - DNA, 75 bp, Artificial Sequence
  Synthetic
aggccaatggagatctggtcaccttcaggagcccgaatggggctgaaagaacgctgaggccggtgtggagagatg

SEQ ID NO: 333918 - DNA, 75 bp, Artificial Sequence
  Synthetic
agcgccctggatgtcttctacacgttgatgcatgaggaacctggcagccgggcaatgaggatggcggagagagac

SEQ ID NO: 333919 - DNA, 75 bp, Artificial Sequence
  Synthetic
aaagacgtggaaaaaagaggtcaacaacagattggatgggctggctgcttgtcactgtcttgctgggagttacat

SEQ ID NO: 333920 - DNA, 75 bp, Artificial Sequence
  Synthetic
tcatgctggtgctagggacaaggaagatgcagttagtggctgaatggagtggctgtgtggagtggcacccagaac

SEQ ID NO: 333921 - DNA, 75 bp, Artificial Sequence
  Synthetic
cctggcagtggtggccgttgtgtggttgaccgtggaaagtgtggtgacccgagtcgccgttgtggttgtgctcct

SEQ ID NO: 333922 - DNA, 75 bp, Artificial Sequence
  Synthetic
acaacaagctggcttactttctgctgactctctgcagtctggctggattggtcgccgccaatgaaatggggttcc

SEQ ID NO: 333923 - DNA, 75 bp, Artificial Sequence
  Synthetic
ctgcctggctccggtttatgcgtcgcgatgcacacatctggagaacagggattttgtcactggcactcagggaac

SEQ ID NO: 333924 - DNA, 75 bp, Artificial Sequence
  Synthetic
cacagtgctgtggagcgaacaggaggagccgcggtcatggggtgagtggacaaacatagacatccagccagcaag

SEQ ID NO: 333925 - DNA, 75 bp, Artificial Sequence
  Synthetic
gagccgcggtcatggggtgagtggacaaacatagacatccagccagcaaggtcctgggggacttatgtgctggtg

SEQ ID NO: 333926 - DNA, 75 bp, Artificial Sequence
  Synthetic
caaacatagacatccagccagcaaggtcctgggggacttatgtgctggtggtgtctctcttcactccatacatca

SEQ ID NO: 333927 - DNA, 75 bp, Artificial Sequence
  Synthetic
tgagccacacacgggggactacgttgccgccaatgaaacccacagtgggcggaagacggcatccttcacggtctc

SEQ ID NO: 333928 - DNA, 75 bp, Artificial Sequence
  Synthetic
atcgtggtgtctggattggaggctgaattgacacaaagagcccacaaggtcttcttctcggcaatggtacgaaac

SEQ ID NO: 333929 - DNA, 75 bp, Artificial Sequence
  Synthetic
cacactgtggacaatgccagtggcctgtggcttgagcggtgtggttaggggcagcctttgggggtttttgcccct

SEQ ID NO: 333930 - DNA, 75 bp, Artificial Sequence
  Synthetic
atgcattgacagacgcctaaggacattggtgttggccccaacccgtgtggtgctcaaggaaatggagcgtgcctt

SEQ ID NO: 333931 - DNA, 75 bp, Artificial Sequence
  Synthetic
tctgggagcaggcgaggtggctctgagggagacacacttggcgacctctggaaacagagactgaacagctgcacc

SEQ ID NO: 333932 - DNA, 75 bp, Artificial Sequence
  Synthetic
gggggtttcttggcttcggtgggcaaagcgctgcacacagttctcggtggcgcttttaacagcatctttgggggg

SEQ ID NO: 333933 - DNA, 75 bp, Artificial Sequence
  Synthetic
gaaacagagactgaacagctgcaccaaggaggaattctttgtctacagacgcactggcattctggagacggagag

SEQ ID NO: 333934 - DNA, 75 bp, Artificial Sequence
  Synthetic
aagggggaaaccaacatggggctggcggtctcacgagggacggcaaaactggcctggctcgaggaacgcggctat

SEQ ID NO: 333935 - DNA, 75 bp, Artificial Sequence
  Synthetic
atagccgctcggggtcacttgtacaccctggctaaagaaaacaaatgtgccctggttcttatgacggcaacgcca

SEQ ID NO: 333936 - DNA, 75 bp, Artificial Sequence
  Synthetic
tggtggacaaactcgatcccactgactaccggggcggcgttcctggcctactgaagaagggaaaagacattaagg

SEQ ID NO: 333937 - DNA, 75 bp, Artificial Sequence
  Synthetic
ataccgcccagaggtgatagaagcactacacagatttcaactgcagtggggtggtggactggtgaggaccccttt

SEQ ID NO: 333938 - DNA, 75 bp, Artificial Sequence
  Synthetic
acattgtgaactccgtcaacatccagtcaaggaaactcctagcccggtttggagaccagagaggacccaccagag

SEQ ID NO: 333939 - DNA, 75 bp, Artificial Sequence
  Synthetic
gtcaaggaaactcctagcccggtttggagaccagagaggacccaccagagtgcctgagctggatctgggaatcgg

SEQ ID NO: 333940 - DNA, 75 bp, Artificial Sequence
  Synthetic
caagatgccagaggtggcaggtcatttccgcctcactgaagagaaaagaaagcattttcgacatcttctcaccca

SEQ ID NO: 333941 - DNA, 75 bp, Artificial Sequence
  Synthetic
gacaccacagctttcgggcagcagagggtgttcaaggagaaggttgacaccaaggctcaagagccccagcctggc

SEQ ID NO: 333942 - DNA, 75 bp, Artificial Sequence
  Synthetic
caaggctcaagagccccagcctggcacaaaggtcatcatgagagcggtgaatgactggatcctggaacgactggc

SEQ ID NO: 333943 - DNA, 75 bp, Artificial Sequence
  Synthetic
tcaaatgcgaaagaggctgtggaggaccccgttttctggcagcttgtggacgaagagagagagagacaccttgcc

SEQ ID NO: 333944 - DNA, 75 bp, Artificial Sequence
  Synthetic
agatgctccagaggccttcttgacggtggtagagatgatggtgctcggcctggctactcttggcgtcgtttggtg

SEQ ID NO: 333945 - DNA, 75 bp, Artificial Sequence
  Synthetic
gcttggagagtttggagtggccaagggcagccgagccatctggtacatgtggctgggaagccgctttctagagtt

SEQ ID NO: 333946 - DNA, 75 bp, Artificial Sequence
  Synthetic
gaccactgggcctctagagagtccagtggagctggagtggaaggaataagcctgaactacctgggctggcaccta

SEQ ID NO: 333947 - DNA, 75 bp, Artificial Sequence
  Synthetic
ggtggtctccctgttcacaccatacataatccaccaacttcagaccaagatccaacagctcgtcaacagcgctgt

SEQ ID NO: 333948 - DNA, 75 bp, Artificial Sequence
  Synthetic
tggaggctgcatcatggatgtcatcacgagaagagaccagaggggatcaggccaggttgtgacctatgctctcaa

SEQ ID NO: 333949 - DNA, 75 bp, Artificial Sequence
  Synthetic
gagtcatagaggcttcagacgcacataaccccagactactccgtgtggaacgatggctgaaagaacatggagaag

SEQ ID NO: 333950 - DNA, 75 bp, Artificial Sequence
  Synthetic
gagcactcggtcggattttcgagctgggaagaggtcccattctgttcacaccatttccacgagctggtgatgaaa

SEQ ID NO: 333951 - DNA, 75 bp, Artificial Sequence
  Synthetic
ctgggtccctaccggccgcacaacctggagcattcatgccagtggagcttggatgaccacagaggacatgctgga

SEQ ID NO: 333952 - DNA, 75 bp, Artificial Sequence
  Synthetic
aaaaggtcacagagtggagagacattccgtatctccccaaggcccatgacatgttgtgctcctcccttgttggaa

SEQ ID NO: 333953 - DNA, 75 bp, Artificial Sequence
  Synthetic
gatgccgtggtggagggtgagaggacacggaaagtgattctactcatggaacagtggaaaaaccgtaaccccacg

SEQ ID NO: 333954 - DNA, 75 bp, Artificial Sequence
  Synthetic
tgatgcatgaggaacctggcagccgggcaatgaggatggcggagagagacgctccagaggcttttctcacgatgg

SEQ ID NO: 333955 - DNA, 75 bp, Artificial Sequence
  Synthetic
ccccgtaccgcccagaggtcatagaagcactgcacagattccaactgcagtggggcggaggactggtgaggaccc

SEQ ID NO: 333956 - DNA, 75 bp, Artificial Sequence
  Synthetic
acctcactagagttgaaggatgggtctggaagaacaaagtactcaccctggcggtgatcgccgttgtgtggctga

SEQ ID NO: 333957 - DNA, 75 bp, Artificial Sequence
  Synthetic
agcccttgcctcggccataaaagagaccttcgaggagggaacttgtggcatagtgccccaaaacagacttgaaat

SEQ ID NO: 333958 - DNA, 75 bp, Artificial Sequence
  Synthetic
aactcggtgcgtggtcttggctgaggacaaagtgagagaaaaagatgtgcaggagaggatcagagcgttgaggga

SEQ ID NO: 333959 - DNA, 75 bp, Artificial Sequence
  Synthetic
ggaacgatggctgagagatcatggagaagaacgtctcggaagaatgctcgtgagcggcgatgactgtgtggtgag

SEQ ID NO: 333960 - DNA, 75 bp, Artificial Sequence
  Synthetic
tgcgccaactggctcagcggcgtctctgatcaatggagttgtgaaactcctcagctggccatggaacgcacggga

SEQ ID NO: 333961 - DNA, 75 bp, Artificial Sequence
  Synthetic
agatgttgtacgcatggctatgactgacaccacagctttcgggcagcagagggtgttcaaggagaaggttgacac

SEQ ID NO: 333962 - DNA, 75 bp, Artificial Sequence
  Synthetic
ctcagattggagagctcaatcatctaaaatcaaagtgtgacagagcaaaacctggaaggctcgtaaaatattgtc

SEQ ID NO: 333963 - DNA, 75 bp, Artificial Sequence
  Synthetic
cgagagcgacggggaaatggtcgcacccgacgcaccatccatgaagaaacgtttcgtgagaccccccgaccagtg

SEQ ID NO: 333964 - DNA, 75 bp, Artificial Sequence
  Synthetic
agcactgcggaagatcaaaaggacagtgagtgccctaatggttggcttgcaaaaacgtgggaaaaggaggtcagc

SEQ ID NO: 333965 - DNA, 75 bp, Artificial Sequence
  Synthetic
ggttgcatcatggatgtcatcactagaagagaccaaagaggttcaggacaggttgtgacttatgccctcaacacc

SEQ ID NO: 333966 - DNA, 75 bp, Artificial Sequence
  Synthetic
ccagactgtgattgagcaaaacctggagtgctcgttaaacgttgtccagaaccaaaaaagaaacgtttcgtgaga

SEQ ID NO: 333967 - DNA, 75 bp, Artificial Sequence
  Synthetic
gggtcgccgttctggttgtgctcctgtgtttggcaccggtctacgcttcgcgttgcacacacttggaaaacaggg

SEQ ID NO: 333968 - DNA, 75 bp, Artificial Sequence
  Synthetic
cgggaaggccattctgaaaggaaaggggggcggtccccctcgacgagtgtcgaaagagaccgcgaagaagacgcg

SEQ ID NO: 333969 - DNA, 75 bp, Artificial Sequence
  Synthetic
aacaggccacggcagcactccggaaaattaagaaggcagtgagcaccctgatggtaggtctgcaaagacgtggca

SEQ ID NO: 333970 - DNA, 75 bp, Artificial Sequence
  Synthetic
acaggttccaactgcagtggggcggaggactggtgaggaccccgttttcgaggaactcaacccatgaaatgtatt

SEQ ID NO: 333971 - DNA, 75 bp, Artificial Sequence
  Synthetic
ggtgtggaaaacaagaaggatcaagaacaaggcgttcagtgctgatcccatcccacgctcagggagatctcacag

SEQ ID NO: 333972 - DNA, 75 bp, Artificial Sequence
  Synthetic
gaaggggacataaatggctagaaggggattcattgcggactcacctcactagagttgagggatgggtttggaaga

SEQ ID NO: 333973 - DNA, 75 bp, Artificial Sequence
  Synthetic
tggtggtgctcttgtgcctggctccggtttatgcctcacggtgcacacatctggaaaacagggattttgttactg

SEQ ID NO: 333974 - DNA, 75 bp, Artificial Sequence
  Synthetic
ggtttatgcctcacggtgcacacatctggaaaacagggattttgttactggcactcaggggaccactcgtgtgac

SEQ ID NO: 333975 - DNA, 75 bp, Artificial Sequence
  Synthetic
agaccaagatgaactggttggaagagcccgcgtctcaccagggtgcggctggagcgtccgtgaaactgcctgcct

SEQ ID NO: 333976 - DNA, 75 bp, Artificial Sequence
  Synthetic
actttggctgaagagcaccagagcggcacagtgtgcaagagagaccagagtgatcgaggctggggtaatcattgt

SEQ ID NO: 333977 - DNA, 75 bp, Artificial Sequence
  Synthetic
ggattatttggaaaaggcagcattgtgacctgtgtcaaggcgtcttgtgaggcaaaaaagaaagccacaggacac

SEQ ID NO: 333978 - DNA, 75 bp, Artificial Sequence
  Synthetic
tgacctgtgtcaaggcgtcttgtgaggcaaaaaagaaagccacaggacacgtgtatgacgctaacaaaattgtgt

SEQ ID NO: 333979 - DNA, 75 bp, Artificial Sequence
  Synthetic
agattttcttgcacgtgcgtgcgtttgctccggatagcaacagcagcgacaggtttgagagaggcgatctttcgc

SEQ ID NO: 333980 - DNA, 75 bp, Artificial Sequence
  Synthetic
catgcgaggtaggactagaaaaacttaagatgaaaggtcttacatacacaatgtgcgacaagacgaaattcacgt

SEQ ID NO: 333981 - DNA, 75 bp, Artificial Sequence
  Synthetic
cgcacctcactagagttgaaggatgggtctggaagaacaagatactcaccctggcggtgatcgccgttgtgtggc

SEQ ID NO: 333982 - DNA, 75 bp, Artificial Sequence
  Synthetic
ggaggagttcggcgacagaactgaacctggctttggcggagggagacgcaaatctcacagtagtggtggacaaac

SEQ ID NO: 333983 - DNA, 75 bp, Artificial Sequence
  Synthetic
gtcctattatgcggcatcccgaccggcagtcatgagtgtcaaggcatacaccattggtggaagagggcacgaggc

SEQ ID NO: 333984 - DNA, 75 bp, Artificial Sequence
  Synthetic
gccggctagccacaccatcgacaatgctgaggtggtggactcagagctcttccttccggccagtctggcggggcc

SEQ ID NO: 333985 - DNA, 75 bp, Artificial Sequence
  Synthetic
gtcgaggaaacttttggctcggtttggagaccagagagggccaaccagggtgcccgaacttgacctgggcgttgg

SEQ ID NO: 333986 - DNA, 75 bp, Artificial Sequence
  Synthetic
ggggacagactgttggtatgccatggaaatacgtcctgttcatgaccagggagggcttgtccgctcaatggtggt

SEQ ID NO: 333987 - DNA, 75 bp, Artificial Sequence
  Synthetic
tgctcagcgcttttgcgctgcgcagcaacctcaccgtcagagagatggtaaccatctacttccttctgctggttc

SEQ ID NO: 333988 - DNA, 75 bp, Artificial Sequence
  Synthetic
accatctacttccttctgctggttctggagctgggattgccaagcgagggccttggggccctctggaaatgggga

SEQ ID NO: 333989 - DNA, 75 bp, Artificial Sequence
  Synthetic
gatgcactggctatgggggcattgattttcagagcttgcacagcagaggaaaagaccggtgttggacttctgctc

SEQ ID NO: 333990 - DNA, 75 bp, Artificial Sequence
  Synthetic
gatggcgtctacagaatcttcagcccaggactgctttgggggcagcgtcaagtgggagttggctatggttccaaa

SEQ ID NO: 333991 - DNA, 75 bp, Artificial Sequence
  Synthetic
cgatgtgatgtgccatgcaacctatgtcaacagacgcctgctcccgcaggggagacagaactgggaagtggcaat

SEQ ID NO: 333992 - DNA, 75 bp, Artificial Sequence
  Synthetic
cagcctctggggatttttgccccttgggcacagactctggctcagggcttctgggagtaggcgtggcggctctga

SEQ ID NO: 333993 - DNA, 75 bp, Artificial Sequence
  Synthetic
gtgtggagggatgcgcgcatgttcagagagggacgtgacatcagagagttcgtcgcgtatgcctcagggagacgc

SEQ ID NO: 333994 - DNA, 75 bp, Artificial Sequence
  Synthetic
tcattttctacacgttgctgacggtgctgcagcctgaggcgggaaaacagagaagcagcgatgacaacaagttgg

SEQ ID NO: 333995 - DNA, 75 bp, Artificial Sequence
  Synthetic
aggcggacctgtccacggtgttgtggagtgaacatgaggaggtgcggtcgtgggaagagtggaccaacatcgaca

SEQ ID NO: 333996 - DNA, 75 bp, Artificial Sequence
  Synthetic
ggagacgtcatcaatccatttggagagggagaggcaaaacctgctctatatgagagaaaaatgagcctggtcttg

SEQ ID NO: 333997 - DNA, 75 bp, Artificial Sequence
  Synthetic
ggcgtggtcaggggcagtctctggggattcttgccccttgggcacagactctggctcagggcttctgggagtagg

SEQ ID NO: 333998 - DNA, 75 bp, Artificial Sequence
  Synthetic
ttgttcgcacctcaatcagtcgcatgatgcttggcacgctggtactgctggcctctttggcgctcctgtgggctg

SEQ ID NO: 333999 - DNA, 75 bp, Artificial Sequence
  Synthetic
gatgcttggcacgctggtactgctggcctctttggcgctcctgtgggctggtggtgtgagctacgggaacatggc

SEQ ID NO: 334000 - DNA, 75 bp, Artificial Sequence
  Synthetic
ggaacgaggttacgcaactctcaagggtgaggtcgtggaccttggatgtggaagaggcggctggtcatactatgc

SEQ ID NO: 334001 - DNA, 75 bp, Artificial Sequence
  Synthetic
taccatcatgtgtgacattggagaaagcaacccagatgccgtggtggagggtgagaggacacggaaagtgattct

SEQ ID NO: 334002 - DNA, 75 bp, Artificial Sequence
  Synthetic
aacccatgagatgtattactcgactgctgtcactggaaacattgtgaattctgtcaacatccagtcaaggaaact

SEQ ID NO: 334003 - DNA, 75 bp, Artificial Sequence
  Synthetic
gccgcgtcatagatgggaggacaaacatcaagcctgaggaggttgatgggaaggtcgagctcaccgggaccaggc

SEQ ID NO: 334004 - DNA, 75 bp, Artificial Sequence
  Synthetic
agaaggttgacaccaaggctcaggagcctcagcctggcacaaaggtcatcatgagagcagtgaatgactggatcc

SEQ ID NO: 334005 - DNA, 75 bp, Artificial Sequence
  Synthetic
ggcagctcgtggatgaagagagagagagacacctcgctgggagatgcgcccactgtgtgtataacatgatgggca

SEQ ID NO: 334006 - DNA, 75 bp, Artificial Sequence
  Synthetic
gctttctggagttcgaagctcttggctttttgaatgaggaccactgggcctctagggggtccagtggatctggag

SEQ ID NO: 334007 - DNA, 75 bp, Artificial Sequence
  Synthetic
tgcacagattccaactgcagtggggcggaggactagtgaggacccctttttcgaggaactcaacccatgagatgt

SEQ ID NO: 334008 - DNA, 75 bp, Artificial Sequence
  Synthetic
caaggtcactaacgcagacctagaggatgaagagcagctcttacgctacatggagggtgaacacaagcaactggc

SEQ ID NO: 334009 - DNA, 75 bp, Artificial Sequence
  Synthetic
tggagggtgaacacaagcaactggcggctacaataatgcagaaggcataccacgccaaagtggtaaaagttgccc

SEQ ID NO: 334010 - DNA, 75 bp, Artificial Sequence
  Synthetic
gctggtgatgaaagatgggcgcgccctcatagtgccatgccgagaccaagatgaactggttggaagagcccgcgt

SEQ ID NO: 334011 - DNA, 75 bp, Artificial Sequence
  Synthetic
aatggagggatgtcccgtacctccccaaatcccatgacatgctgtgctcctcccttgttgggaggaaagagaggg

SEQ ID NO: 334012 - DNA, 75 bp, Artificial Sequence
  Synthetic
acctttcctgcatggaccggcatgacttgcattgggagctcaaactggagagctcaataatctaaaaccagactg

SEQ ID NO: 334013 - DNA, 75 bp, Artificial Sequence
  Synthetic
agctcaataatctaaaaccagactgtgactgagcaaaacctggagtgctcgttaaacattgtccagaaccaaaaa

SEQ ID NO: 334014 - DNA, 75 bp, Artificial Sequence
  Synthetic
ctactttctgaatgacatggcaaaaaccaggaaagatattggggaatgggagcattcggttggcttctcgaactg

SEQ ID NO: 334015 - DNA, 75 bp, Artificial Sequence
  Synthetic
gtgacttgcgaacgcttggactcgccatctgcttggcggtgcccgttgactgggtccctactggccgcacgacct

SEQ ID NO: 334016 - DNA, 75 bp, Artificial Sequence
  Synthetic
atggttaccgttgtgtggttgaccctggagagtgtggtgaccagggtcgccgttctggttgtgctcctgtgtttg

SEQ ID NO: 334017 - DNA, 75 bp, Artificial Sequence
  Synthetic
cgttctggttgtgctcctgtgtttggcaccggtctacgcttcgcgttgcacacacttggaaaacagggactttgt

SEQ ID NO: 334018 - DNA, 75 bp, Artificial Sequence
  Synthetic
agattttcttgcacgtgcgtgcgtttgcttcggatagcattagcagcgacaggtttgagagagataatttttcgc

SEQ ID NO: 334019 - DNA, 75 bp, Artificial Sequence
  Synthetic
ggtctggaagaacaaagtgctcaccctggcggtgatcgccattgtgtggctgaccgtggaaagcgtggtgaccag

SEQ ID NO: 334020 - DNA, 75 bp, Artificial Sequence
  Synthetic
ttttgttactggcactcagggaaccactcgtgtgactctggtgctggaactgggaggatgcgtcaccataacagc

SEQ ID NO: 334021 - DNA, 75 bp, Artificial Sequence
  Synthetic
gcgtcctgtgaggcaaaaaagaaggccacaggacacgtgtatgatgccaacaaaattgtgtacacggttaaagta

SEQ ID NO: 334022 - DNA, 75 bp, Artificial Sequence
  Synthetic
tttggtcactgacctgaggaactgctcatggcctgctagccacactatcgataatgctgacgtggtggactcgga

SEQ ID NO: 334023 - DNA, 75 bp, Artificial Sequence
  Synthetic
cgaagctggacatgggaagggccggaggcaaatgccgtggatgaggccagtggtgacttggtcacctttaggagc

SEQ ID NO: 334024 - DNA, 75 bp, Artificial Sequence
  Synthetic
gcacgtgacgagaggagcagcgctgtccattgatgacgccgtggcggggccttactgggctgatgtcagggagga

SEQ ID NO: 334025 - DNA, 75 bp, Artificial Sequence
  Synthetic
agagaaaggcacctcatggggagatgcgcgcactgcgtgtacaacatgatgggcaagagagagaagaaactggga

SEQ ID NO: 334026 - DNA, 75 bp, Artificial Sequence
  Synthetic
gttgacacaaagagcccacaaagtcttcttctcggcaatggtgcgcaatcccatggtggatggagacgtcatcaa

SEQ ID NO: 334027 - DNA, 75 bp, Artificial Sequence
  Synthetic
gaggggagaccaacatggggctggctgtgtcacggggcacggctaaacttgcctggcttgaggaacgaggttacg

SEQ ID NO: 334028 - DNA, 75 bp, Artificial Sequence
  Synthetic
tgtgtcacggggcacggctaaacttgcctggcttgaggaacgaggttacgcaactctcaagggtgaggtcgtgga

SEQ ID NO: 334029 - DNA, 75 bp, Artificial Sequence
  Synthetic
tgtagtggtggtgctcttgtgcctggctccggtttatgcctcacggtgcacacatctggaaaacagggattttgt

SEQ ID NO: 334030 - DNA, 75 bp, Artificial Sequence
  Synthetic
cattgtgacctgtgtcaaggcgtcttgtgaggcaaaaaagaaagcaacaggacacgtgtatgacgccaacaaaat

SEQ ID NO: 334031 - DNA, 75 bp, Artificial Sequence
  Synthetic
catacgggggattacgtcgctgctaatgagactcacagtggaagaaaaacagcgtccttcacggtttcctcggag

SEQ ID NO: 334032 - DNA, 75 bp, Artificial Sequence
  Synthetic
gaggctgagcaaaaggtcccaatgcaccagaacgcttgcatagcgactggggtgagggccaggaagtgaggccac

SEQ ID NO: 334033 - DNA, 75 bp, Artificial Sequence
  Synthetic
aaacacccccagagtgccccacggcaacacgtcagtgagagtggcgacgggaaaatggtcgatcccgacgtaggg

SEQ ID NO: 334034 - DNA, 75 bp, Artificial Sequence
  Synthetic
agattttcttgcacgtgcgtgcgtttgctccggatagcaacagcagcgacaggtttgagagagacaatctttcgc

SEQ ID NO: 334035 - DNA, 75 bp, Artificial Sequence
  Synthetic
tgctccggatagcaacagcagcgacaggtttgagagagacaatctttcgcttgatcagtcgtgaacgtgttgaga

SEQ ID NO: 334036 - DNA, 75 bp, Artificial Sequence
  Synthetic
cagtgagtgcccactagagagaaggaaaacaggtgtcttcacggtggcagagtttggagttggcctgagaacaaa

SEQ ID NO: 334037 - DNA, 75 bp, Artificial Sequence
  Synthetic
catggcagtccacacagaccagagcctctggatgaaatccgtgagaaatgacacagggacctacatagtggaact

SEQ ID NO: 334038 - DNA, 75 bp, Artificial Sequence
  Synthetic
cttgctcagaccgtcatcctggagcttgacaagacctcagaacacctaccgacggcctggcaggtccaccgggac

SEQ ID NO: 334039 - DNA, 75 bp, Artificial Sequence
  Synthetic
gaacaatgcggaacggctggttgagtttggagctccacacgctgtgaaaatggacgtgtacaaccttggagacca

SEQ ID NO: 334040 - DNA, 75 bp, Artificial Sequence
  Synthetic
tacaggctgtgtttgagttgagggtgggcctgctcagcgcttttgcgctgcgcagcaacctcaccgtcagagaga

SEQ ID NO: 334041 - DNA, 75 bp, Artificial Sequence
  Synthetic
tgctcatggctctcatgacacagcaagacctggcgattgcacattatggactcatgctcttcctgggcgtggcct

SEQ ID NO: 334042 - DNA, 75 bp, Artificial Sequence
  Synthetic
ctccaggagataatatcatctatgttggggaactgagtcaccaatggttccaaaaagggagtagcattggaaggg

SEQ ID NO: 334043 - DNA, 75 bp, Artificial Sequence
  Synthetic
actggttctggccatgacactcggagtgggagctgatgttggctgtgctgtggacactgaacggatggagctccg

SEQ ID NO: 334044 - DNA, 75 bp, Artificial Sequence
  Synthetic
gaaaacaaatgtgccctggttcttatgacggcaacgccacccgggaagagcgagcccttcccagagtccaacgga

SEQ ID NO: 334045 - DNA, 75 bp, Artificial Sequence
  Synthetic
tggagatctggtcaccttcaggagcccgaatggggctgaaagaacactgaggccagtgtggagggatgcgcgcat

SEQ ID NO: 334046 - DNA, 75 bp, Artificial Sequence
  Synthetic
acggtgctgcagcctgaggcgggaaaacagagaagcagtgatgacaacaagttggcctactttctgttgacgctc

SEQ ID NO: 334047 - DNA, 75 bp, Artificial Sequence
  Synthetic
gaagtggcaatcatggatgaagctcattggacagatccacacagcatagccgctcggggtcacttgtacaccctg

SEQ ID NO: 334048 - DNA, 75 bp, Artificial Sequence
  Synthetic
gtcctactatgcggcatcccgaccagcagtcatgagtgtcaaagcatacaccatcggtggaagagggcacgaagc

SEQ ID NO: 334049 - DNA, 75 bp, Artificial Sequence
  Synthetic
tgagcggcgtggtcaggggcagcctctggggattcttgccccttgggcatagactctggctcagggcttctggga

SEQ ID NO: 334050 - DNA, 75 bp, Artificial Sequence
  Synthetic
ggagggtgagaggacacggaaagtgatactgctcatggagcagtggaaaaaccgtaaccccacggctacctgtgt

SEQ ID NO: 334051 - DNA, 75 bp, Artificial Sequence
  Synthetic
gagtggtatctctagttggtgcaacgccaacctctttggtggttggtgttggtctggcggcgttccacctggcca

SEQ ID NO: 334052 - DNA, 75 bp, Artificial Sequence
  Synthetic
gccaacctctttggtggttggtgttggtctggcggcgttccacctggccattgtggtgtccggactagaggctga

SEQ ID NO: 334053 - DNA, 75 bp, Artificial Sequence
  Synthetic
aaacggaagctcaatggctgtaccaaggaagagttcttcgcctataggcgcactggcatcctggagacggaaagg

SEQ ID NO: 334054 - DNA, 75 bp, Artificial Sequence
  Synthetic
atgaccagggagggcttgttcgctcaatggtggtggctgacaatggagagctgctcagcgagggttgcattcccg

SEQ ID NO: 334055 - DNA, 75 bp, Artificial Sequence
  Synthetic
tggagtggagggaataagcttgaactacctgggctggtaccttaaagggttgtcaacactggaaggaggcctttt

SEQ ID NO: 334056 - DNA, 75 bp, Artificial Sequence
  Synthetic
gaccggcatgacttgcactgggagctcaaactggagagctcaataatctaaaaccagactgtgactcggaaaaac

SEQ ID NO: 334057 - DNA, 75 bp, Artificial Sequence
  Synthetic
tctgaatgacatggcaaaaaccaggaaagatgttggggaatgggagcattcggttggcttctcgaactgggagga

SEQ ID NO: 334058 - DNA, 75 bp, Artificial Sequence
  Synthetic
ctccccaaatcccacgacatgctgtgttcctcccttgttgggaggaaagagagggcagagtgggccaagaacatc

SEQ ID NO: 334059 - DNA, 75 bp, Artificial Sequence
  Synthetic
aagggttgtcaacactggaaggaggccttttttacgcagatgacacagccggctgggataccaaggtcactaacg

SEQ ID NO: 334060 - DNA, 75 bp, Artificial Sequence
  Synthetic
acaggttgtgacttatgccctcaacacccttaccaacataaaggttcaactaatccgaatgatggagggggaggg

SEQ ID NO: 334061 - DNA, 75 bp, Artificial Sequence
  Synthetic
acccttaccaacataaaggttcaactaatccgaatgatggagggggagggagtcattgaggcctcggacgcacat

SEQ ID NO: 334062 - DNA, 75 bp, Artificial Sequence
  Synthetic
tatgaggggcgcaccgcatggttcgtcccctcgattgcaaaaggtggcatcatagcccgcaccctgagacaaaaa

SEQ ID NO: 334063 - DNA, 75 bp, Artificial Sequence
  Synthetic
tggctgctgagttacttccaccggcgcgacctgcgaacgcttggactcgccatctgttcggcggtgcccgtcgac

SEQ ID NO: 334064 - DNA, 75 bp, Artificial Sequence
  Synthetic
aaaccagactaaaaacaaaacacacccccggagtgccctacggcaacacgtcagtgagagtggcgacgggaaaat

SEQ ID NO: 334065 - DNA, 75 bp, Artificial Sequence
  Synthetic
ccccggagtgccctacggcaacacgtcagtgagagtggcgacgggaaaatggtcgaccccgacgtagggcattct

SEQ ID NO: 334066 - DNA, 75 bp, Artificial Sequence
  Synthetic
agcattcggttggcttttcgaactgggaagaggttcccttctgctcacaccacttccacgagttggtgatgaaag

SEQ ID NO: 334067 - DNA, 75 bp, Artificial Sequence
  Synthetic
cgtgaacgtgttgagaaaaagacagcttaggagaacaagagctggggatggccgggaaggccattctgaaaggaa

SEQ ID NO: 334068 - DNA, 75 bp, Artificial Sequence
  Synthetic
tgactgtggaaagtgtggtgactagggtcgccgtagtggtggtgctcttgtgcctggctccggtttatgcctcac

SEQ ID NO: 334069 - DNA, 75 bp, Artificial Sequence
  Synthetic
caaaagaaggtcggcagtagactggacaggttggttgctggttgttgtcctgttgggagtgacacttgcagccac

SEQ ID NO: 334070 - DNA, 75 bp, Artificial Sequence
  Synthetic
acaggttggttgctggttgttgtcctgttgggagtgacacttgcagccacagtgcggaaggaaagagatggcacc

SEQ ID NO: 334071 - DNA, 75 bp, Artificial Sequence
  Synthetic
accgtgatcagagctgaaggaaaagatgcggcaacccaggtgcgtgtggaaaatggcacctgtgtgatcctggcc

SEQ ID NO: 334072 - DNA, 75 bp, Artificial Sequence
  Synthetic
gtggtagccgttgtgtggttgaccgtggaaagtgtggtgacccgagtcgccattgtggttgtgctcctctgtctg

SEQ ID NO: 334073 - DNA, 75 bp, Artificial Sequence
  Synthetic
gattccatctaccaggagaacccggccaagacacgcgagtactgtctgcatgccaagctgtcggacaccaaggtt

SEQ ID NO: 334074 - DNA, 75 bp, Artificial Sequence
  Synthetic
ccgccgctctggctgaagagcatcagagtggcacggtgtgcaagagagaccagagtgaccgaggttggggtaacc

SEQ ID NO: 334075 - DNA, 75 bp, Artificial Sequence
  Synthetic
atcgccgttgtgtggctgaccgtggaaagtgtggtgactcgggtcgccgtagtggtggtgctcttgtgcctggct

SEQ ID NO: 334076 - DNA, 75 bp, Artificial Sequence
  Synthetic
gagtggcacggtgtgcaagagagaccagagtgaccgaggttggggtaaccattgcggattgtttggaaagggtag

SEQ ID NO: 334077 - DNA, 75 bp, Artificial Sequence
  Synthetic
cacacgggggactacgttgccgccaatgaaacccacagtgggaggaaaacggcatccttcacggtatcctcagaa

SEQ ID NO: 334078 - DNA, 75 bp, Artificial Sequence
  Synthetic
tgaaaaaggggaaagacataaaggtttcttggaagagttggggccactcaatgatctggagcgtccccgaggccc

SEQ ID NO: 334079 - DNA, 75 bp, Artificial Sequence
  Synthetic
ctggcaggtccatcgtgactggttcaatgatctggctctaccgtggaaacacgaaggagcgcaacaatggaacaa

SEQ ID NO: 334080 - DNA, 75 bp, Artificial Sequence
  Synthetic
aatgatctggctctaccgtggaaacacgaaggagcgcaacaatggaacaatgctgagcgactggttgaatttgga

SEQ ID NO: 334081 - DNA, 75 bp, Artificial Sequence
  Synthetic
tgctgagcgactggttgaatttggagctccgcatgccgttaaaatggacgtgtataaccttggagatcaaactgg

SEQ ID NO: 334082 - DNA, 75 bp, Artificial Sequence
  Synthetic
agccagcggtgttgaccttgctcagaccgtcatcctggagcttgacaagacctcagaacacctaccgacggcctg

SEQ ID NO: 334083 - DNA, 75 bp, Artificial Sequence
  Synthetic
aggtcacgttctctggaacaaaaccttgcaggattccagtgcgggcagtggcacacggctctccagatgtaaatg

SEQ ID NO: 334084 - DNA, 75 bp, Artificial Sequence
  Synthetic
ttcatagagatgcagctacccccaggggacaacatcatctatgtcggggaactaagccatcagtggttccagaag

SEQ ID NO: 334085 - DNA, 75 bp, Artificial Sequence
  Synthetic
tcttgacttcggtaggcaaagcgctgcacacagtcctcggcggtgccttcaacagcatctttgggggagtggggt

SEQ ID NO: 334086 - DNA, 75 bp, Artificial Sequence
  Synthetic
gcacacagtcctcggcggtgccttcaacagcatctttgggggagtggggtttctgcccaagctcctgttgggtgt

SEQ ID NO: 334087 - DNA, 75 bp, Artificial Sequence
  Synthetic
agccttggcctggttgggcctgaacatgaggaaccccaccatgtccatgagcttcctcttggctgggggactggt

SEQ ID NO: 334088 - DNA, 75 bp, Artificial Sequence
  Synthetic
aaaccagaaaaggcatagaaaggctgacagtgatcggagaacatgcctgggattttggctctactggtggtttcc

SEQ ID NO: 334089 - DNA, 75 bp, Artificial Sequence
  Synthetic
aaatgagtgcccattggagagaaggaagacaggtgtcttcacggtggcggaatttggggttggtctgagaacaaa

SEQ ID NO: 334090 - DNA, 75 bp, Artificial Sequence
  Synthetic
aagacaggtgtcttcacggtggcggaatttggggttggtctgagaacaaaggtctttttggacttcagacaggaa

SEQ ID NO: 334091 - DNA, 75 bp, Artificial Sequence
  Synthetic
gggcctaggtcctggtacaacaggatacctgggtatgcagaacaggtgaaaggaccatggaagtactcgcccatc

SEQ ID NO: 334092 - DNA, 75 bp, Artificial Sequence
  Synthetic
ccaaacagcttttggagtagtgcgtgtgaacgtaaacacagtttgaacgttttttggatagagacaactatgtct

SEQ ID NO: 334093 - DNA, 75 bp, Artificial Sequence
  Synthetic
tcaccaggccttaaaagccttcaaggattttgcgagtggaaagagatcagcgatagggatccttgaggtcttcag

SEQ ID NO: 334094 - DNA, 75 bp, Artificial Sequence
  Synthetic
tttttggatagagacaactatgtctaacaaaaaaccaggaagacccggctcaggccgggttgtcaatatgctaaa

SEQ ID NO: 334095 - DNA, 75 bp, Artificial Sequence
  Synthetic
aacaaaaaaccaggaagacccggctcaggccgggttgtcaatatgctaaagcgcggaacgtcccgcggaaatccg

SEQ ID NO: 334096 - DNA, 75 bp, Artificial Sequence
  Synthetic
caggccgggttgtcaatatgctaaagcgcggaacgtcccgcggaaatccgctagcgcggataaagaggacgattg

SEQ ID NO: 334097 - DNA, 75 bp, Artificial Sequence
  Synthetic
gcgcggaacgtcccgcggaaatccgctagcgcggataaagaggacgattgatggggtcctgagaggagcaggacc

SEQ ID NO: 334098 - DNA, 75 bp, Artificial Sequence
  Synthetic
ctggaggaactgcctgagacacttgaaacatttttactggtgttcatgatgacagtcgcctctatgggggtgttc

SEQ ID NO: 334099 - DNA, 75 bp, Artificial Sequence
  Synthetic
cataaggtttgtgctggctctactgactttcttcaagtttacagccctgaggccaaccattggaatgctgaagag

SEQ ID NO: 334100 - DNA, 75 bp, Artificial Sequence
  Synthetic
atggggtcctgagaggagcaggacccataaggtttgtgctggctctactgactttcttcaagtttacagccctga

SEQ ID NO: 334101 - DNA, 75 bp, Artificial Sequence
  Synthetic
agaagttcgcctgtgtgaacttattccaaacagcttttggagtagtgcgtgtgaacgtaaacacagtttgaacgt

SEQ ID NO: 334102 - DNA, 75 bp, Artificial Sequence
  Synthetic
gcgactaaacatctgaaaagcttcaagcgtgacattggacagatgctcgacggactgaataagcggaaggcgaaa

SEQ ID NO: 334103 - DNA, 75 bp, Artificial Sequence
  Synthetic
tcattatgttactcccgatagttgctgggctgaagcttggaaactataatggtagagttttggccactttaaata

SEQ ID NO: 334104 - DNA, 75 bp, Artificial Sequence
  Synthetic
tgggactaatgtgtcaggatgacataacgtatctgtgcccaaagttggagtacggctacgaacctgaagacatag

SEQ ID NO: 334105 - DNA, 75 bp, Artificial Sequence
  Synthetic
ttctggaaggaggttcatgtgtgaccattacggcaaaagacaggccgaccatagacatcaagatgatgaatatgg

SEQ ID NO: 334106 - DNA, 75 bp, Artificial Sequence
  Synthetic
accacagccgttgctatgtgccatctgttgaggaaaaactggttggctggggcctctctagcatggactataact

SEQ ID NO: 334107 - DNA, 75 bp, Artificial Sequence
  Synthetic
cggaatctccaggcagggaccttgcgtcgaggaggaggaactggcagaactttgggggaagcatggaaggcccag

SEQ ID NO: 334108 - DNA, 75 bp, Artificial Sequence
  Synthetic
tcccaaggcaacttatgctgaatacatatgcaaaaaagattttgtggacaggggttggggcaatggctgtggctt

SEQ ID NO: 334109 - DNA, 75 bp, Artificial Sequence
  Synthetic
tgtgctacattaaagcaggttcaggaagtgagaggttacacaaaaggagggccagggcatgaggaaccagtgatg

SEQ ID NO: 334110 - DNA, 75 bp, Artificial Sequence
  Synthetic
ttatggtaccgtcacactcgaatgtgaaccccgatctggggttgacatggggcaattctatgtctttaccatgaa

SEQ ID NO: 334111 - DNA, 75 bp, Artificial Sequence
  Synthetic
gactggtttcatgatctcaacttaccatggacagggtcatcagcggggacgtggcaaaacaaagagtcattgata

SEQ ID NO: 334112 - DNA, 75 bp, Artificial Sequence
  Synthetic
agggaagacaggtcttggagctatggtcatggccacagtcacggttttgttatggatagcagaagtcccagccca

SEQ ID NO: 334113 - DNA, 75 bp, Artificial Sequence
  Synthetic
catggacagggtcatcagcggggacgtggcaaaacaaagagtcattgatagaatttgaggaggcccacgccacca

SEQ ID NO: 334114 - DNA, 75 bp, Artificial Sequence
  Synthetic
acaagaaggagccctccatgcagcattggcgggagctattccagtgaagtactctggaagcaaattggaaatgac

SEQ ID NO: 334115 - DNA, 75 bp, Artificial Sequence
  Synthetic
tgatgggccctgtagagttcctatatccatgtcggcagatctgaatgacatgacaccagttggacgcctgataac

SEQ ID NO: 334116 - DNA, 75 bp, Artificial Sequence
  Synthetic
agtcaacccatacgtgtcgacctcctccacgggtgccaagataatggtggaagtggaacctccattcggggattc

SEQ ID NO: 334117 - DNA, 75 bp, Artificial Sequence
  Synthetic
caaaggatggttgctttgggtgacactgcatgggattttggctcagttgggggtgtactcacttccattgggaaa

SEQ ID NO: 334118 - DNA, 75 bp, Artificial Sequence
  Synthetic
tatgacttttctagcagtaggaggaattttagtctttctggcagtaaatgtcaatgctgatacggggtgctcaat

SEQ ID NO: 334119 - DNA, 75 bp, Artificial Sequence
  Synthetic
aggcgttgaaggacttggactccaaaagttggggtatgtgctgcgtgacatttcggccaaagaaggaggacttat

SEQ ID NO: 334120 - DNA, 75 bp, Artificial Sequence
  Synthetic
cacaacatgtgggtaagcatcaaacatgagttgaacgcgatcttggaagacaacgccattgacttgactgtggtg

SEQ ID NO: 334121 - DNA, 75 bp, Artificial Sequence
  Synthetic
aaagatggaaccaatgcacagagctgttgcagaaccactcattaaatttgcctacatgaataaggtggtgaaggt

SEQ ID NO: 334122 - DNA, 75 bp, Artificial Sequence
  Synthetic
cgttgatggagagctcatgtacggatggaagaaatgggggaagagtatttttagcagcccgaaaatgtcaaacaa

SEQ ID NO: 334123 - DNA, 75 bp, Artificial Sequence
  Synthetic
ttttggagtcttgttgacagagagagagaactgcacttgcaagggaagtgtgagacctgcatttacaacatgatg

SEQ ID NO: 334124 - DNA, 75 bp, Artificial Sequence
  Synthetic
gaacaggttgtcagccatggcagtcagtggggatgactgtgtggtgaaaccagcggatgacagattcgccacagc

SEQ ID NO: 334125 - DNA, 75 bp, Artificial Sequence
  Synthetic
taatggaagctggaaactggagagagctgtgctgggcgaggtgaagtcatgcacatggccggaaacccacacact

SEQ ID NO: 334126 - DNA, 75 bp, Artificial Sequence
  Synthetic
gaactcatcatacctaaaacattgggaggaccgaagagtcatcacaacacgaggacaggatacaaagttcagagc

SEQ ID NO: 334127 - DNA, 75 bp, Artificial Sequence
  Synthetic
ttgtaatagacttcgactactgccctggaacaactgtcacaataacgagctcgtgccgcgacagagggccttcag

SEQ ID NO: 334128 - DNA, 75 bp, Artificial Sequence
  Synthetic
tggaacaactgtcacaataacgagctcgtgccgcgacagagggccttcagctaggacaacgacagcgagtgggaa

SEQ ID NO: 334129 - DNA, 75 bp, Artificial Sequence
  Synthetic
ataaatatataaattagcatttgtttgaatagataggaagaggaagtcaggccagggaatccctgccaccggatg

SEQ ID NO: 334130 - DNA, 75 bp, Artificial Sequence
  Synthetic
ctgttgctgatggctttggtcctgtttggaggaatcacgtacagtgatctggtcaagtacgtcattctagtggca

SEQ ID NO: 334131 - DNA, 75 bp, Artificial Sequence
  Synthetic
atttgtttgaagagataggaagaggaagtcaggccagggaatccctgccaccggatgttggatgacggtgctgtc

SEQ ID NO: 334132 - DNA, 75 bp, Artificial Sequence
  Synthetic
tgaacatgagtataccaacattactcaactccggagccatggcctggctcttgctgagagccgtgtttgaaggga

SEQ ID NO: 334133 - DNA, 75 bp, Artificial Sequence
  Synthetic
caactccggagccatggcctggctcttgctgagagccgtgtttgaagggacggttagctcctttgctctgccact

SEQ ID NO: 334134 - DNA, 75 bp, Artificial Sequence
  Synthetic
agaatagtggggatagatgtggtgagaataggtgtgctaaccctgggaatcctctcactattgaaagagaggagc

SEQ ID NO: 334135 - DNA, 75 bp, Artificial Sequence
  Synthetic
gaaagcaaggcccaacctagagtcaagctgtaactctaggggaaggactagaggttagaggagaccccttgcgag

SEQ ID NO: 334136 - DNA, 75 bp, Artificial Sequence
  Synthetic
aaatggccgaggaatggctagctaggggcgttgaagagttctgtataaaagtgctttgtccctacatgccagcgg

SEQ ID NO: 334137 - DNA, 75 bp, Artificial Sequence
  Synthetic
ccggctcaggccgggtagtcaatatgctaaagcgcggaacgtcccgcggaaatccgttagcgcggataaagagga

SEQ ID NO: 334138 - DNA, 75 bp, Artificial Sequence
  Synthetic
gtgtttgctggtctgcacatggtgctgaaaccagtgacacggagagggtggccagtcagtgaggctttgactgct

SEQ ID NO: 334139 - DNA, 75 bp, Artificial Sequence
  Synthetic
gccagtcagtgaggctttgactgctgtgggattgacattcgcgttggcaggaggaatagcccagtttgatgacag

SEQ ID NO: 334140 - DNA, 75 bp, Artificial Sequence
  Synthetic
aggacccataaggtttgtgttagctttactgacttttttcaagtttacagcacttaagccaaccattgggatgct

SEQ ID NO: 334141 - DNA, 75 bp, Artificial Sequence
  Synthetic
gaggaatagcccagtttgatgacagcagcatggcgattccattagccgttggcgggattatgctggtggtggcag

SEQ ID NO: 334142 - DNA, 75 bp, Artificial Sequence
  Synthetic
ttactgacttttttcaagtttacagcacttaagccaaccattgggatgctgaagagatggaagctagttggggtt

SEQ ID NO: 334143 - DNA, 75 bp, Artificial Sequence
  Synthetic
gttttaagcgtgacattggacagatgcttgatggactgaacaaaaggaagacaaaacgtcgggggggaagctgcc

SEQ ID NO: 334144 - DNA, 75 bp, Artificial Sequence
  Synthetic
gcttgatggactgaacaaaaggaagacaaaacgtcgggggggaagctgcccttgggttgttatgttactcccgat

SEQ ID NO: 334145 - DNA, 75 bp, Artificial Sequence
  Synthetic
agattactgaacgatcctggtgtgtcgctcggtgtttgggcctttcgaactgggcttattctgttatcttcatac

SEQ ID NO: 334146 - DNA, 75 bp, Artificial Sequence
  Synthetic
tacaatggcagaaccttagctaccttgaacaagacagatgtgtcagacacgctgatcattccaacggcgaccggc

SEQ ID NO: 334147 - DNA, 75 bp, Artificial Sequence
  Synthetic
tgaacaagacagatgtgtcagacacgctgatcattccaacggcgaccggcagtaatggatgtgttgtgcgtgctc

SEQ ID NO: 334148 - DNA, 75 bp, Artificial Sequence
  Synthetic
ggcaaaacaacgaggaggagtcatctgggatgtgccagctccaaaggaaaggaagagagccgaagtaggcaatgg

SEQ ID NO: 334149 - DNA, 75 bp, Artificial Sequence
  Synthetic
tgggatgtgccagctccaaaggaaaggaagagagccgaagtaggcaatggagttttccggattatggcaagagga

SEQ ID NO: 334150 - DNA, 75 bp, Artificial Sequence
  Synthetic
tgacataacttacctatgcccaaagttagagtacggctacgaaccggaggacatagactgttggtgcaatgaaac

SEQ ID NO: 334151 - DNA, 75 bp, Artificial Sequence
  Synthetic
ttagagtacggctacgaaccggaggacatagactgttggtgcaatgaaactgagatatacatccactacggaaga

SEQ ID NO: 334152 - DNA, 75 bp, Artificial Sequence
  Synthetic
ctgttagggaaataccaggctggagtgggagtcatgcatgagggagtgtttcacaccatgtggcacgtgacgaat

SEQ ID NO: 334153 - DNA, 75 bp, Artificial Sequence
  Synthetic
tgggagtcatgcatgagggagtgtttcacaccatgtggcacgtgacgaatggggccgttattcaagcaggagaag

SEQ ID NO: 334154 - DNA, 75 bp, Artificial Sequence
  Synthetic
ggtctagaagatcagtgaatgtccaccaccatggagagagcctgctggaggccaagaacacgccgtggatggatt

SEQ ID NO: 334155 - DNA, 75 bp, Artificial Sequence
  Synthetic
ccaccatggagagagcctgctggaggccaagaacacgccgtggatggattcgaccaaagccacgaaatacctcac

SEQ ID NO: 334156 - DNA, 75 bp, Artificial Sequence
  Synthetic
aaccctgggtatgctctcgcagccattgttataggatggaacctgggaacgacgaggggtcaaaaaataatcttc

SEQ ID NO: 334157 - DNA, 75 bp, Artificial Sequence
  Synthetic
ttgttataggatggaacctgggaacgacgaggggtcaaaaaataatcttcacaattatgctaatgctgatcgctc

SEQ ID NO: 334158 - DNA, 75 bp, Artificial Sequence
  Synthetic
gatgcaaaaccgggactttgtagagggagtgaacggcgttgagtggattgatgttgtgctggaaggaggatcatg

SEQ ID NO: 334159 - DNA, 75 bp, Artificial Sequence
  Synthetic
ctatcattgacaaggaaggacaggtggttggcctctatggtaatggaatcctggtggcttcaggcgattttgtca

SEQ ID NO: 334160 - DNA, 75 bp, Artificial Sequence
  Synthetic
ggagtgaacggcgttgagtggattgatgttgtgctggaaggaggatcatgcgtgaccattacagccaaagacagg

SEQ ID NO: 334161 - DNA, 75 bp, Artificial Sequence
  Synthetic
acatggaggctacggagttagcagtcgtaagatcttattgctacgagccgaaagtgtcagatgttacgacagaac

SEQ ID NO: 334162 - DNA, 75 bp, Artificial Sequence
  Synthetic
cgtaagatcttattgctacgagccgaaagtgtcagatgttacgacagaacccagatgtccgaccatgggagaagc

SEQ ID NO: 334163 - DNA, 75 bp, Artificial Sequence
  Synthetic
ttgacaaacgattaagaacagctgtcttggctccgactcgggtggtggccgctgaaatagcggaagcactgaaag

SEQ ID NO: 334164 - DNA, 75 bp, Artificial Sequence
  Synthetic
aactacatttgtaagaaagattttgttgacaggggttggggcaacggctgcggtttgttcggaaaggggagcata

SEQ ID NO: 334165 - DNA, 75 bp, Artificial Sequence
  Synthetic
cttggctccgactcgggtggtggccgctgaaatagcggaagcactgaaaggacttccagtacggtatctgactcc

SEQ ID NO: 334166 - DNA, 75 bp, Artificial Sequence
  Synthetic
ttgacaggggttggggcaacggctgcggtttgttcggaaaggggagcatacagacgtgtgccaagtttgactgca

SEQ ID NO: 334167 - DNA, 75 bp, Artificial Sequence
  Synthetic
gcaaaaggaaaatgtccaatttgaagtggcggttttcatgcatggttccacagaagtaagcacctatcacaatta

SEQ ID NO: 334168 - DNA, 75 bp, Artificial Sequence
  Synthetic
gcagctagatttgtgataacaccaaaaagtcctgtctatactgctgagttggaagactatggcgctgtcacactc

SEQ ID NO: 334169 - DNA, 75 bp, Artificial Sequence
  Synthetic
aaagtcctgtctatactgctgagttggaagactatggcgctgtcacactcgagtgtgaaccccgatctggagttg

SEQ ID NO: 334170 - DNA, 75 bp, Artificial Sequence
  Synthetic
tattcatgacagccacacctccaggtacaactgaggcatttccggactccaactcgccaataacagacattgaag

SEQ ID NO: 334171 - DNA, 75 bp, Artificial Sequence
  Synthetic
tatgaacacaaaaagctggcttgttaatagagactggtttcatgacctcaatttaccatggacagggtcatcagc

SEQ ID NO: 334172 - DNA, 75 bp, Artificial Sequence
  Synthetic
aatagagactggtttcatgacctcaatttaccatggacagggtcatcagcgggaacatggcaaaacagagagtca

SEQ ID NO: 334173 - DNA, 75 bp, Artificial Sequence
  Synthetic
tttcaaggaaagactgtatggtttgtccccagtgtgaagtctggcaatgagattgccgtgtgcttgacaaaggcc

SEQ ID NO: 334174 - DNA, 75 bp, Artificial Sequence
  Synthetic
ctaccaaacagtcggtagtggccttggcatcgcaggaaggagcccttcatgcagcattggcaggagccattccag

SEQ ID NO: 334175 - DNA, 75 bp, Artificial Sequence
  Synthetic
ggcatcgcaggaaggagcccttcatgcagcattggcaggagccattccagtgaagtattctggaagaaagctgga

SEQ ID NO: 334176 - DNA, 75 bp, Artificial Sequence
  Synthetic
tttgtgataaccactgacatctcagaaatgggagcgaactttggagcgcaacgggtcatagatagtcggaagtgc

SEQ ID NO: 334177 - DNA, 75 bp, Artificial Sequence
  Synthetic
agggtgaaaatgcagggcttgaaattgaaaggaatgacttatccaatgtgtagcaacacattctccctggcgaag

SEQ ID NO: 334178 - DNA, 75 bp, Artificial Sequence
  Synthetic
tgaaaggaatgacttatccaatgtgtagcaacacattctccctggcgaagaatcctactgacactggacatggca

SEQ ID NO: 334179 - DNA, 75 bp, Artificial Sequence
  Synthetic
gagaaggaagtgtgcaaatgaatggaccagttcctataacatcagccagtgcagcccagcgtcgtggacgggttg

SEQ ID NO: 334180 - DNA, 75 bp, Artificial Sequence
  Synthetic
gggctctgatgggccatgcagagttcccatctccatgtcggcggacctgaacgacatgacaccagttggacgtct

SEQ ID NO: 334181 - DNA, 75 bp, Artificial Sequence
  Synthetic
cccatctccatgtcggcggacctgaacgacatgacaccagttggacgtctgataacagtcaatccatatgtgtca

SEQ ID NO: 334182 - DNA, 75 bp, Artificial Sequence
  Synthetic
tggtagaggttgaacctccgttcggagactcattcatcctggcgggaagtggaaaagaacagattagataccagt

SEQ ID NO: 334183 - DNA, 75 bp, Artificial Sequence
  Synthetic
agactcattcatcctggcgggaagtggaaaagaacagattagataccagtggcacagaagtgggagcacaattgg

SEQ ID NO: 334184 - DNA, 75 bp, Artificial Sequence
  Synthetic
ggagcacagagaatggttgccctaggtgacacagcatgggattttggatctgtcggaggtgtgctgacctccatt

SEQ ID NO: 334185 - DNA, 75 bp, Artificial Sequence
  Synthetic
gtgacacagcatgggattttggatctgtcggaggtgtgctgacctccattgggaaaggcattcaccaggtttttg

SEQ ID NO: 334186 - DNA, 75 bp, Artificial Sequence
  Synthetic
tactgttctggaagacaataacccagtggagttatggacaaagtcaggtgagaagaaaatcttgaagccccggtg

SEQ ID NO: 334187 - DNA, 75 bp, Artificial Sequence
  Synthetic
gtggagttatggacaaagtcaggtgagaagaaaatcttgaagccccggtggagagatggaagattgtgggcagat

SEQ ID NO: 334188 - DNA, 75 bp, Artificial Sequence
  Synthetic
gggaatgtcatggatcactcaaggcatgttgggaatactgttgttgtggatgggcctaaatgcaagggacagatc

SEQ ID NO: 334189 - DNA, 75 bp, Artificial Sequence
  Synthetic
gagagatggaagattgtgggcagatcaccaggccttaaaagccttcaaggattttgcgagtggaaagagatcagc

SEQ ID NO: 334190 - DNA, 75 bp, Artificial Sequence
  Synthetic
atgttgggaatactgttgttgtggatgggcctaaatgcaagggacagatccatttctatgacatttttagctgtg

SEQ ID NO: 334191 - DNA, 75 bp, Artificial Sequence
  Synthetic
attttgcgagtggaaagagatcagcgatagggattcttgaggttttcagaatgcttcctgaccacttcgctcaca

SEQ ID NO: 334192 - DNA, 75 bp, Artificial Sequence
  Synthetic
tcaatgttaatgctgacatgggatgttcaattgacctgaccaggaaagagctgcagtgcggacagggcatgttca

SEQ ID NO: 334193 - DNA, 75 bp, Artificial Sequence
  Synthetic
ttcaattgacctgaccaggaaagagctgcagtgcggacagggcatgttcattttcaacgacgttgaggcctggaa

SEQ ID NO: 334194 - DNA, 75 bp, Artificial Sequence
  Synthetic
gaatgacagaatccatggacaacatatacatgctgactacagctgagaaagggagcagggcccacagagaagccc

SEQ ID NO: 334195 - DNA, 75 bp, Artificial Sequence
  Synthetic
acgccaaggaaacttgccaaggttgtggcggaagcatatgaagctggaatctgtggtgtgcgatcagttagcagg

SEQ ID NO: 334196 - DNA, 75 bp, Artificial Sequence
  Synthetic
tggcggaagcatatgaagctggaatctgtggtgtgcgatcagttagcaggcttgagcacaacatgtgggcgagca

SEQ ID NO: 334197 - DNA, 75 bp, Artificial Sequence
  Synthetic
ggaagataacagcattgatttgactgtagtagttgaagagaacccaggaaggtataggagaactaaccagaggct

SEQ ID NO: 334198 - DNA, 75 bp, Artificial Sequence
  Synthetic
gtagtagttgaagagaacccaggaaggtataggagaactaaccagaggctatcgaatgttgagggagaactcaca

SEQ ID NO: 334199 - DNA, 75 bp, Artificial Sequence
  Synthetic
tctctattgctgatgattgttttgatcccagaaccagagagacagagatcgcagacggatagtcacttggctgtt

SEQ ID NO: 334200 - DNA, 75 bp, Artificial Sequence
  Synthetic
acatttttagcagcccgaagatgtcaaacaatacttttgtcattgatggaccaagaaccaaggagtgcccagatg

SEQ ID NO: 334201 - DNA, 75 bp, Artificial Sequence
  Synthetic
aaacaatacttttgtcattgatggaccaagaaccaaggagtgcccagatgagagaagggcatggaatagtatgaa

SEQ ID NO: 334202 - DNA, 75 bp, Artificial Sequence
  Synthetic
ctatccacgaaagtgtggatggagatgcgaccagaaaatacaaccgattgtgacaccgctgtaatgggaacatca

SEQ ID NO: 334203 - DNA, 75 bp, Artificial Sequence
  Synthetic
tgcgaccagaaaatacaaccgattgtgacaccgctgtaatgggaacatcaattaaaggaaacagagctgtgcata

SEQ ID NO: 334204 - DNA, 75 bp, Artificial Sequence
  Synthetic
tcacaacaatggaagctggaagttagaaagagccgtgctaggcgaggtgaaatcatgcacatggccggaaactca

SEQ ID NO: 334205 - DNA, 75 bp, Artificial Sequence
  Synthetic
gaaagagccgtgctaggcgaggtgaaatcatgcacatggccggaaactcacacattgtggagtgatagtgttgtg

SEQ ID NO: 334206 - DNA, 75 bp, Artificial Sequence
  Synthetic
acagttcacaatgacaacaacggtctcggcagtcatgatggtcatactgcattatgcatttttggtgccaggctg

SEQ ID NO: 334207 - DNA, 75 bp, Artificial Sequence
  Synthetic
cattaggaggaccgaaaagtcatcacaacactaggacaggatacaaggttcagagttccggaccatgggacgaga

SEQ ID NO: 334208 - DNA, 75 bp, Artificial Sequence
  Synthetic
caacactaggacaggatacaaggttcagagttccggaccatgggacgagaaggaaatcaaaatagactttgacta

SEQ ID NO: 334209 - DNA, 75 bp, Artificial Sequence
  Synthetic
cagaggagaactgctgcaggtgtgatgaaaaatcccgtggttgatggcatagtggctacagatgttccagacctt

SEQ ID NO: 334210 - DNA, 75 bp, Artificial Sequence
  Synthetic
acgagttcatgccgagacagagggccttcagctaggacaacaacagcaagtgggaaattgataacagattggtgc

SEQ ID NO: 334211 - DNA, 75 bp, Artificial Sequence
  Synthetic
cttcagctaggacaacaacagcaagtgggaaattgataacagattggtgctgcagatcttgcaccactccaccac

SEQ ID NO: 334212 - DNA, 75 bp, Artificial Sequence
  Synthetic
agaaattgggtcaatgtgtgctagtgggaattgccttagtggcggtgttcctaacaccaaatacgctaaccttga

SEQ ID NO: 334213 - DNA, 75 bp, Artificial Sequence
  Synthetic
ctggtacggaatggaaattaggccaaccgtccacggagacgacatgttgattaaatcaaaggtcgtggccttcca

SEQ ID NO: 334214 - DNA, 75 bp, Artificial Sequence
  Synthetic
accgtccacggagacgacatgttgattaaatcaaaggtcgtggccttccagggggatggcatggagcccatgcag

SEQ ID NO: 334215 - DNA, 75 bp, Artificial Sequence
  Synthetic
cagctcaagaggtcttgagaaagcgcatgacggcttcaatcgcttggccagccctcctgttgttgatggctttag

SEQ ID NO: 334216 - DNA, 75 bp, Artificial Sequence
  Synthetic
catgacggcttcaatcgcttggccagccctcctgttgttgatggctttagttttatttggaggagtcacttacgg

SEQ ID NO: 334217 - DNA, 75 bp, Artificial Sequence
  Synthetic
ttgggggaggcatggaaggcccagcttaatcaactgacccggcaagagtttatggaataccggaaagacgggatc

SEQ ID NO: 334218 - DNA, 75 bp, Artificial Sequence
  Synthetic
gacttgtcagctctgtttgggagaaaaaacgaaagccatcaagaaacctggagtatgccttggccggatttgaga

SEQ ID NO: 334219 - DNA, 75 bp, Artificial Sequence
  Synthetic
gtggcagtcgcattcgctgagagcaacacaggtggtgacattgtgcacttggccatagtggcggtattcaacatt

SEQ ID NO: 334220 - DNA, 75 bp, Artificial Sequence
  Synthetic
ttaatcaactgacccggcaagagtttatggaataccggaaagacgggatcattgaagtagatagagctgctgcaa

SEQ ID NO: 334221 - DNA, 75 bp, Artificial Sequence
  Synthetic
acacaggtggtgacattgtgcacttggccatagtggcggtattcaacattcaaccaggcttattgattggattct

SEQ ID NO: 334222 - DNA, 75 bp, Artificial Sequence
  Synthetic
ggaaagcagattgcttggcgttgcgctagcactcataacagtggcgatgagagatttgaacatgagcataccaac

SEQ ID NO: 334223 - DNA, 75 bp, Artificial Sequence
  Synthetic
ctagcactcataacagtggcgatgagagatttgaacatgagcataccaacactgctcaactctggagccatggcc

SEQ ID NO: 334224 - DNA, 75 bp, Artificial Sequence
  Synthetic
aagggacggcaagttcccttgctctgccacttgtcagctcgctggctccagggctcagaatagtagggatagatg

SEQ ID NO: 334225 - DNA, 75 bp, Artificial Sequence
  Synthetic
gccacttgtcagctcgctggctccagggctcagaatagtagggatagatgtggtgagaataggcgtgttaactct

SEQ ID NO: 334226 - DNA, 75 bp, Artificial Sequence
  Synthetic
cccagagctatggctggaacattgtgacattaaagagtggggttaatgttcatttcaagccgactgaaccatctg

SEQ ID NO: 334227 - DNA, 75 bp, Artificial Sequence
  Synthetic
catttcaagccgactgaaccatctgacacactgctgtgtgacataggtgaagcttcacccgtcccagaaattgaa

SEQ ID NO: 334228 - DNA, 75 bp, Artificial Sequence
  Synthetic
aggaacaatgctatggcaaaaaagaaaggaggcatgcttctgggagtcgcgtgtgccacagccggaattgctagc

SEQ ID NO: 334229 - DNA, 75 bp, Artificial Sequence
  Synthetic
acacactgctgtgtgacataggtgaagcttcacccgtcccagaaattgaatctgccagaacaatcagggtgctgc

SEQ ID NO: 334230 - DNA, 75 bp, Artificial Sequence
  Synthetic
aaggaggcatgcttctgggagtcgcgtgtgccacagccggaattgctagccctttggtgtttgcaggtttgcaca

SEQ ID NO: 334231 - DNA, 75 bp, Artificial Sequence
  Synthetic
agggtggcccgtcagtgaagctttgactgccgtaggattgacatttgcgttggcaggaggaatcgctcagtttga

SEQ ID NO: 334232 - DNA, 75 bp, Artificial Sequence
  Synthetic
actgccgtaggattgacatttgcgttggcaggaggaatcgctcagtttgatgatagcagcatggcgatcccattg

SEQ ID NO: 334233 - DNA, 75 bp, Artificial Sequence
  Synthetic
gctgaaatggggaggtggtttggttagggtgccactctcgcgtaattcaacacatgagatgtactgggtgagcgg

SEQ ID NO: 334234 - DNA, 75 bp, Artificial Sequence
  Synthetic
tggcagtggtaaccggtttctccacagatctgtggctagagaaagcgagcgacatctcgtggagtgaggaagcaa

SEQ ID NO: 334235 - DNA, 75 bp, Artificial Sequence
  Synthetic
agatctgtggctagagaaagcgagcgacatctcgtggagtgaggaagcaagagtgactggggcatcacagagatt

SEQ ID NO: 334236 - DNA, 75 bp, Artificial Sequence
  Synthetic
gtggacttgggttcagggaccagagctgtgagctgcacaagacagaggactgactggggaatggtcgctgatagg

SEQ ID NO: 334237 - DNA, 75 bp, Artificial Sequence
  Synthetic
aacatgaaattgctgaatgaccctggagtgtcgttcagtgtttgggcttttcgaactggacttattctgctatct

SEQ ID NO: 334238 - DNA, 75 bp, Artificial Sequence
  Synthetic
tgactggggaatggtcgctgatagggtgaagaatttggccagagaatatgctccgtcttggcattatgaccaaga

SEQ ID NO: 334239 - DNA, 75 bp, Artificial Sequence
  Synthetic
gagtgtcgttcagtgtttgggcttttcgaactggacttattctgctatcttcatacaacccatacttattgccat

SEQ ID NO: 334240 - DNA, 75 bp, Artificial Sequence
  Synthetic
ttagcagcccgaagatgtcaaataacacatttgtcatcgatggaccaaaaactaaagagtgccaagatgatagaa

SEQ ID NO: 334241 - DNA, 75 bp, Artificial Sequence
  Synthetic
aacgaaggctaagcaacgaggaggagtcatatgggatgttccagccccaaaagaaagaaagaaggttgaggtggg

SEQ ID NO: 334242 - DNA, 75 bp, Artificial Sequence
  Synthetic
gtcatatgggatgttccagccccaaaagaaagaaagaaggttgaggtgggtaacggagtcttccggatcatggca

SEQ ID NO: 334243 - DNA, 75 bp, Artificial Sequence
  Synthetic
tccttttgggcaacagcgcgtttttaaagaaaaggttgataccaaagccccagaaccacctgcaggaacagctag

SEQ ID NO: 334244 - DNA, 75 bp, Artificial Sequence
  Synthetic
ctggcgtaggagtcatgcatgagggagtgttccacaccatgtggcacgtgacgaacggggctgtcattcaagtgg

SEQ ID NO: 334245 - DNA, 75 bp, Artificial Sequence
  Synthetic
agtgttccacaccatgtggcacgtgacgaacggggctgtcattcaagtgggagaaggaacactggttccatattg

SEQ ID NO: 334246 - DNA, 75 bp, Artificial Sequence
  Synthetic
gatcagagctctcattggtcctgagcactatgtagattatatgccaactctaaataggttcaaacccattgaaag

SEQ ID NO: 334247 - DNA, 75 bp, Artificial Sequence
  Synthetic
tcctatggtggaccatggaaactggggaagcagtggaatggagtggatgaagtgcaagtcatcgttgtgcagcca

SEQ ID NO: 334248 - DNA, 75 bp, Artificial Sequence
  Synthetic
agtgcaagtcatcgttgtgcagccaggtaaggaggtcatgaacgtgcagactcagcccggaattttcaagactca

SEQ ID NO: 334249 - DNA, 75 bp, Artificial Sequence
  Synthetic
cagggaagcggttgaggatcctgagttttggagtcttgttgacagagagagagaactgcacctgcaagggaagtg

SEQ ID NO: 334250 - DNA, 75 bp, Artificial Sequence
  Synthetic
cttgattacccaacaggaacctctggatcacccataattgacaaggaaggacaagtggttggcctttatggcaac

SEQ ID NO: 334251 - DNA, 75 bp, Artificial Sequence
  Synthetic
gatcacccataattgacaaggaaggacaagtggttggcctttatggcaacgggatcttggtaggttcaggcgatt

SEQ ID NO: 334252 - DNA, 75 bp, Artificial Sequence
  Synthetic
ctgcatttcctcaacagtatgtctaaggtgaggaaagatactcaggaatggaagccctcaaccggttggagaaac

SEQ ID NO: 334253 - DNA, 75 bp, Artificial Sequence
  Synthetic
gaagaaggaagaagaagttccccaggtgtttgatgagagcatgttgcggaaaaggcaactaacggttcttgacct

SEQ ID NO: 334254 - DNA, 75 bp, Artificial Sequence
  Synthetic
gtgtttgatgagagcatgttgcggaaaaggcaactaacggttcttgacctgcacccaggctcggggaaaactcga

SEQ ID NO: 334255 - DNA, 75 bp, Artificial Sequence
  Synthetic
agaacatatacactccaattatgcagattagagctctcattggccctgagcactatgtagattacatgccaactc

SEQ ID NO: 334256 - DNA, 75 bp, Artificial Sequence
  Synthetic
aattggggtatgtgctgcgtgacatctcggccaaagaaggaggacttatgtacgcagacgacacggctggatggg

SEQ ID NO: 334257 - DNA, 75 bp, Artificial Sequence
  Synthetic
gcgcaattgacaagcggctaagaacagccgtcttggctccgacacgagtggtggccgctgaaatagcggaagcac

SEQ ID NO: 334258 - DNA, 75 bp, Artificial Sequence
  Synthetic
agaagtccatctgtgtgaacttattccaaacagcttttggagtagtgcgtgtgaacgtaaacacagtttgaacgt

SEQ ID NO: 334259 - DNA, 75 bp, Artificial Sequence
  Synthetic
acactagaataaccaaggctgatttggaaaacgaagccatcattttggaaaagatggaaccaatgcacagagctg

SEQ ID NO: 334260 - DNA, 75 bp, Artificial Sequence
  Synthetic
atggaagttggttggagttaatgaggcgaccaaacatctgaaaagcttcaagcgtgacattgggcagatgctcga

SEQ ID NO: 334261 - DNA, 75 bp, Artificial Sequence
  Synthetic
agccgtcttggctccgacacgagtggtggccgctgaaatagcggaagcactgaaagggttaccaatacggtattt

SEQ ID NO: 334262 - DNA, 75 bp, Artificial Sequence
  Synthetic
actggcacggagatagtagacgtgatgtgccacgcaaccttgacagcgcggttgctcacaccccagcgagtgcca

SEQ ID NO: 334263 - DNA, 75 bp, Artificial Sequence
  Synthetic
tcgcagaaccactcattaaatttgcctacatgaataaggtggtgaaggtaatgcgaccgggacgtgatgggaaaa

SEQ ID NO: 334264 - DNA, 75 bp, Artificial Sequence
  Synthetic
atgcgaccgggacgtgatgggaaaacagtcatggatgtcatctcgcgggaagaccagaggggaagtggacaggtt

SEQ ID NO: 334265 - DNA, 75 bp, Artificial Sequence
  Synthetic
tgtgccacgcaaccttgacagcgcggttgctcacaccccagcgagtgccaaattacaacttgttcattatggatg

SEQ ID NO: 334266 - DNA, 75 bp, Artificial Sequence
  Synthetic
cagtcatggatgtcatctcgcgggaagaccagaggggaagtggacaggttgtgacttatgctcttaacactttca

SEQ ID NO: 334267 - DNA, 75 bp, Artificial Sequence
  Synthetic
cattgccgccagaggatacatatcaacaaaggtggaattgggagaagcggctgcaatttttatgactgccacacc

SEQ ID NO: 334268 - DNA, 75 bp, Artificial Sequence
  Synthetic
acaaaggtggaattgggagaagcggctgcaatttttatgactgccacacctccaggcacaaccgacgcctttcca

SEQ ID NO: 334269 - DNA, 75 bp, Artificial Sequence
  Synthetic
ctccccgaggaaacagagcgcctaaagaaaggaaaggaaaagcgcatccaagaatggctccaaaagaatggagag

SEQ ID NO: 334270 - DNA, 75 bp, Artificial Sequence
  Synthetic
ttgaggaacaaattcctgacagggcttggaattccgggtatgaatggataacggattttcaaggaaggaccgtgt

SEQ ID NO: 334271 - DNA, 75 bp, Artificial Sequence
  Synthetic
aacaggttgtcagccatggcagtcagcggggatgattgtgtggtgaaaccagcagatgacagattcgccacagca

SEQ ID NO: 334272 - DNA, 75 bp, Artificial Sequence
  Synthetic
ttggaattccgggtatgaatggataacggattttcaaggaaggaccgtgtggttcgtccccagtgtgaaatctgg

SEQ ID NO: 334273 - DNA, 75 bp, Artificial Sequence
  Synthetic
ctgcacttcctcaacagcatgtctaaggtgaggaaagatactcaggaatggaagccctcaaccggttggagaaac

SEQ ID NO: 334274 - DNA, 75 bp, Artificial Sequence
  Synthetic
aaggctggaaagagagtgatccagctgaacaggaagagttttgactcagagtacccaaaatgcaagagtggagaa

SEQ ID NO: 334275 - DNA, 75 bp, Artificial Sequence
  Synthetic
tgaacaggaagagttttgactcagagtacccaaaatgcaagagtggagaatgggattttgtgataaccactgata

SEQ ID NO: 334276 - DNA, 75 bp, Artificial Sequence
  Synthetic
tggcaagaagtacccttttgctcacaccatttccacgagctgcaaatgaaagatggcagaaagattgtggttcca

SEQ ID NO: 334277 - DNA, 75 bp, Artificial Sequence
  Synthetic
agcgcagcgggtcatagacagtcggaagtgcatcaaaccagtgatcattgaggacggagaaggaagcgtgcaaat

SEQ ID NO: 334278 - DNA, 75 bp, Artificial Sequence
  Synthetic
aagtgcatcaaaccagtgatcattgaggacggagaaggaagcgtgcaaatgaacgggccagttcctataacatca

SEQ ID NO: 334279 - DNA, 75 bp, Artificial Sequence
  Synthetic
gagttggaagggatgtgacacagattggggatgaataccattattcaggaccaaccagtgaggatgatcacgact

SEQ ID NO: 334280 - DNA, 75 bp, Artificial Sequence
  Synthetic
tggggatgaataccattattcaggaccaaccagtgaggatgatcacgactttgcacactggaaagaagccaagat

SEQ ID NO: 334281 - DNA, 75 bp, Artificial Sequence
  Synthetic
gtggtcaatccatggaaaaggtgagtggatgacttctgaagacatgctggcagtgtggaacagggtgtggattga

SEQ ID NO: 334282 - DNA, 75 bp, Artificial Sequence
  Synthetic
gatggattagttgcccagttgtacggcccggagagggacaaagttgatgcaattgatggggaatttaggttgagg

SEQ ID NO: 334283 - DNA, 75 bp, Artificial Sequence
  Synthetic
gcccggagagggacaaagttgatgcaattgatggggaatttaggttgaggaccgagcagaggaaacattttgtgg

SEQ ID NO: 334284 - DNA, 75 bp, Artificial Sequence
  Synthetic
ctccccatgattctgaagagtgccattgacaaacgattaagaacagctgtcttggctccgactcgggtggtggcc

SEQ ID NO: 334285 - DNA, 75 bp, Artificial Sequence
  Synthetic
cgtctggatatcgtataaggttgctgaagctgggataagttacaatgatcggcggtggtgctttgacgggccctc

SEQ ID NO: 334286 - DNA, 75 bp, Artificial Sequence
  Synthetic
catcgagctagatccacctgggccgagaacatatacaccccaattatgcagatcagagctctcattggccctgag

SEQ ID NO: 334287 - DNA, 75 bp, Artificial Sequence
  Synthetic
gaagctgggataagttacaatgatcggcggtggtgctttgacgggccctcatgcaatactgtcctggaagacaac

SEQ ID NO: 334288 - DNA, 75 bp, Artificial Sequence
  Synthetic
caggtgagaagaaaaccttgaaacccaggtggagagatggaagattatgggcagatcaccaggccctaaaggctt

SEQ ID NO: 334289 - DNA, 75 bp, Artificial Sequence
  Synthetic
ctggagtgaaggtgtcttgtaaatacatgaggtatgtgtaaaaatgtatataaagtagtgttagtttagagcaat

SEQ ID NO: 334290 - DNA, 75 bp, Artificial Sequence
  Synthetic
caggtggagagatggaagattatgggcagatcaccaggccctaaaggctttcaaagacttcgcaagtgggaagag

SEQ ID NO: 334291 - DNA, 75 bp, Artificial Sequence
  Synthetic
ttcagaatgctccctgaccacttcgcacacagaatgacagaatccatggacaacatatacatgctgaccacagct

SEQ ID NO: 334292 - DNA, 75 bp, Artificial Sequence
  Synthetic
ggatgacggtgctgtctgcgttccaaccccaggaggactgggttaacaaatctgggtgcatggaggagctaagcg

SEQ ID NO: 334293 - DNA, 75 bp, Artificial Sequence
  Synthetic
cacacagaatgacagaatccatggacaacatatacatgctgaccacagctgagagaggaagcagagcgcacagag

SEQ ID NO: 334294 - DNA, 75 bp, Artificial Sequence
  Synthetic
gctcgaaacattcttactggtgttcatgatgacagtcgcctcgatgggggtgttcctattttttgtccagaggag

SEQ ID NO: 334295 - DNA, 75 bp, Artificial Sequence
  Synthetic
atgatgacagtcgcctcgatgggggtgttcctattttttgtccagaggagaggcctggggaagacaggccttgga

SEQ ID NO: 334296 - DNA, 75 bp, Artificial Sequence
  Synthetic
agacacgccccaggaggactgggaaaacaaagccaaaatggcccccacggcctgaaatgatggagctggtgtgac

SEQ ID NO: 334297 - DNA, 75 bp, Artificial Sequence
  Synthetic
aacaaagccaaaatggcccccacggcctgaaatgatggagctggtgtgaccatcatggagggactagaggttaga

SEQ ID NO: 334298 - DNA, 75 bp, Artificial Sequence
  Synthetic
tgttgttgtgggtggcagaagtcccggcccagaagatagctggcgtgcttctcatctctctgttgcttatgattg

SEQ ID NO: 334299 - DNA, 75 bp, Artificial Sequence
  Synthetic
ggcccagaagatagctggcgtgcttctcatctctctgttgcttatgattgtactgattccggagccagagagaca

SEQ ID NO: 334300 - DNA, 75 bp, Artificial Sequence
  Synthetic
gccgtgttcatgatcattgtcttgttagtggtgggcgctgtggcgtcgaatgaaatgggctggttagagcaaaca

SEQ ID NO: 334301 - DNA, 75 bp, Artificial Sequence
  Synthetic
caagaaacagcatattgacacctgggatagactaggagaccctctgtcctaacaacaccagccacttggcacaga

SEQ ID NO: 334302 - DNA, 75 bp, Artificial Sequence
  Synthetic
gatagactaggagaccctctgtcctaacaacaccagccacttggcacagatcgccgaaagtgtggctggtggtgg

SEQ ID NO: 334303 - DNA, 75 bp, Artificial Sequence
  Synthetic
tagtggtgggcgctgtggcgtcgaatgaaatgggctggttagagcaaacaaaaaaggatttgtcaactctgtttg

SEQ ID NO: 334304 - DNA, 75 bp, Artificial Sequence
  Synthetic
aacttggagcgtaccttggccagacttgagaccagcaacagcatgggcagcctatgcaggagccactacattcct

SEQ ID NO: 334305 - DNA, 75 bp, Artificial Sequence
  Synthetic
ttgagaccagcaacagcatgggcagcctatgcaggagccactacattcctgacccctttgctaaaacaccttata

SEQ ID NO: 334306 - DNA, 75 bp, Artificial Sequence
  Synthetic
tcatggcgatgacggcacaggctggagcactattcggactgggaaaaggcatgccctttgtcaaagcagatttgt

SEQ ID NO: 334307 - DNA, 75 bp, Artificial Sequence
  Synthetic
agcactattcggactgggaaaaggcatgccctttgtcaaagcagatttgtcagtgcccctgctccttttggggtg

SEQ ID NO: 334308 - DNA, 75 bp, Artificial Sequence
  Synthetic
aacgtatctgtgcccaaagttggagtacggctacgaacctgaagacatagactgctggtgcaatgagactgagat

SEQ ID NO: 334309 - DNA, 75 bp, Artificial Sequence
  Synthetic
acggtctcagcagtcatgatggtcatactgcattacgcatttttggtgccaggttggcaagcagaagctatgaga

SEQ ID NO: 334310 - DNA, 75 bp, Artificial Sequence
  Synthetic
tactgcattacgcatttttggtgccaggttggcaagcagaagctatgagatcagctcagaggagaactgccgcag

SEQ ID NO: 334311 - DNA, 75 bp, Artificial Sequence
  Synthetic
tggcatagtggccacagatgttccagaccttgaggccagcactcccatcacggaaaagaaattgggtcaatgtgt

SEQ ID NO: 334312 - DNA, 75 bp, Artificial Sequence
  Synthetic
aacacgccgtggatggattcgaccaaagccactaaatatctcacgaaggttgagaactgggcgttgagaaatcct

SEQ ID NO: 334313 - DNA, 75 bp, Artificial Sequence
  Synthetic
tgagaactgggcgttgagaaatcctgggtatgctcttgctgccattttcataggctggaatctgggaacgacgag

SEQ ID NO: 334314 - DNA, 75 bp, Artificial Sequence
  Synthetic
atgttaatgttaattgccccagcgtacagcttcagctgtctggggatgcagaaccgagactttgttgagggagtg

SEQ ID NO: 334315 - DNA, 75 bp, Artificial Sequence
  Synthetic
acagcttcagctgtctggggatgcagaaccgagactttgttgagggagtgaatggtgttgagtggatcgatgtcg

SEQ ID NO: 334316 - DNA, 75 bp, Artificial Sequence
  Synthetic
ccttgaccgagtttggaatgctaacctccgcagcttcagtgacactcattgaaggagctgcaggccgcatttgga

SEQ ID NO: 334317 - DNA, 75 bp, Artificial Sequence
  Synthetic
gaccttgaggccagcactcccatcacggaaaagaaattgggtcaatgtgtgttggtgggaacagctttggtggcg

SEQ ID NO: 334318 - DNA, 75 bp, Artificial Sequence
  Synthetic
ctccgcagcttcagtgacactcattgaaggagctgcaggccgcatttggaatgcaactacagccgtcgccatgtg

SEQ ID NO: 334319 - DNA, 75 bp, Artificial Sequence
  Synthetic
atagacgtcaagatgatgaacatggaggctacagaattagcggttgtgagatcttactgctatgagccgaaagtg

SEQ ID NO: 334320 - DNA, 75 bp, Artificial Sequence
  Synthetic
gctggggcctctctggcgtggaccataacccggaatctccaggcagggaccttacgtagaggaggggggactggc

SEQ ID NO: 334321 - DNA, 75 bp, Artificial Sequence
  Synthetic
taacccggaatctccaggcagggaccttacgtagaggaggggggactggcagaaccctgggtgaggcatggaaag

SEQ ID NO: 334322 - DNA, 75 bp, Artificial Sequence
  Synthetic
agagtttatggaataccggaaagatgggattcttgaagtagacagagccgcggcaaaaagagcccgccgtgaagg

SEQ ID NO: 334323 - DNA, 75 bp, Artificial Sequence
  Synthetic
gggattcttgaagtagacagagccgcggcaaaaagagcccgccgtgaagggaatgtgacaggagggcatccagtt

SEQ ID NO: 334324 - DNA, 75 bp, Artificial Sequence
  Synthetic
aagcagaaggcaggattgtgcagaaggaaaacgtccagtttgaagttgcagttttcatacatggttccacggaag

SEQ ID NO: 334325 - DNA, 75 bp, Artificial Sequence
  Synthetic
ggcttgtggaacgcgggtttcttaaaccaagaggcaaagttgtggatctaggctgtggccgaggaggctggagct

SEQ ID NO: 334326 - DNA, 75 bp, Artificial Sequence
  Synthetic
accaagaggcaaagttgtggatctaggctgtggccgaggaggctggagctattactgcgccaccttgaagcaagt

SEQ ID NO: 334327 - DNA, 75 bp, Artificial Sequence
  Synthetic
ggagggcccgggcatgaagaaccagtaatgactcagagctatggctggaatatcgtgacattgaagagtggggtc

SEQ ID NO: 334328 - DNA, 75 bp, Artificial Sequence
  Synthetic
taatgactcagagctatggctggaatatcgtgacattgaagagtggggtcaacgtccattttaaaccgactgagc

SEQ ID NO: 334329 - DNA, 75 bp, Artificial Sequence
  Synthetic
aaaatgcagggtttgaagctgaaaggaatgacctacccgatgtgtagcaatacattttccctagtgaagaatcct

SEQ ID NO: 334330 - DNA, 75 bp, Artificial Sequence
  Synthetic
aggtgaatcttcacccgttccagaaattgaatctgccaggacaatacgggtactgcagatggctgaggagtggct

SEQ ID NO: 334331 - DNA, 75 bp, Artificial Sequence
  Synthetic
attgaatctgccaggacaatacgggtactgcagatggctgaggagtggctagccaggggagttgaagagttctgc

SEQ ID NO: 334332 - DNA, 75 bp, Artificial Sequence
  Synthetic
cagcagttataaaggagctggaaagattgcagttgaaatggggaggcggcttagtcagagtgccactctcgcgca

SEQ ID NO: 334333 - DNA, 75 bp, Artificial Sequence
  Synthetic
attgcagttgaaatggggaggcggcttagtcagagtgccactctcgcgcaactccacgcacgagatgtattgggt

SEQ ID NO: 334334 - DNA, 75 bp, Artificial Sequence
  Synthetic
aacagcgtcaacacagtgagccaaatgctaattaacagaatgcacagaactaaccgcaatgggcccaggtacgaa

SEQ ID NO: 334335 - DNA, 75 bp, Artificial Sequence
  Synthetic
gtcatggattactcaaggcatgttgggggcactgctattgtggatggggctgaatgcaagggacagatccatttc

SEQ ID NO: 334336 - DNA, 75 bp, Artificial Sequence
  Synthetic
ctcaagtgggaatgtgacaaatagtattaatacagtaagccaaatgctgattaacaggatgcacaaaactaaccg

SEQ ID NO: 334337 - DNA, 75 bp, Artificial Sequence
  Synthetic
tgctaattaacagaatgcacagaactaaccgcaatgggcccaggtacgaagaagatgcggacttgggctcaggaa

SEQ ID NO: 334338 - DNA, 75 bp, Artificial Sequence
  Synthetic
gaggactgattggggaatggttgctgatagagtgaaaaatttggccaaagagtacgctccatcctggcattatga

SEQ ID NO: 334339 - DNA, 75 bp, Artificial Sequence
  Synthetic
tcaatgccgacacggggtgctcaatcgacttggctaggaaagaattgaaatgtggacaaggcatgtttgtcttca

SEQ ID NO: 334340 - DNA, 75 bp, Artificial Sequence
  Synthetic
gatagagtgaaaaatttggccaaagagtacgctccatcctggcattatgaccaagataacccctataagacttgg

SEQ ID NO: 334341 - DNA, 75 bp, Artificial Sequence
  Synthetic
acgatgttgaggcttggaaggataattataagtactatccatccacaccgaggagacttgccaaagtcgtggcag

SEQ ID NO: 334342 - DNA, 75 bp, Artificial Sequence
  Synthetic
aagccacaggctcagccagctcaatggtcaatggagttgtcagaatcctgtcaaaaccctgggacactttgcaga

SEQ ID NO: 334343 - DNA, 75 bp, Artificial Sequence
  Synthetic
ggtcaatggagttgtcagaatcctgtcaaaaccctgggacactttgcagaacgtggtgaacatggccatgacgga

SEQ ID NO: 334344 - DNA, 75 bp, Artificial Sequence
  Synthetic
gttttcaaagagaaggttgacactaaggctccagagccccctgcaggaactgccagggtcatgaacattgtggca

SEQ ID NO: 334345 - DNA, 75 bp, Artificial Sequence
  Synthetic
cagtcatggatgtcatctcgcgggaagaccagaggggaagtggacaggttgtgacctatgctctcaacactttca

SEQ ID NO: 334346 - DNA, 75 bp, Artificial Sequence
  Synthetic
aggctccagagccccctgcaggaactgccagggtcatgaacattgtggcaagatggatgtggaactttgttggta

SEQ ID NO: 334347 - DNA, 75 bp, Artificial Sequence
  Synthetic
aaaggaagagtttatagaaaaggtgaacagcaatgcagccctaggggccatgtttgaagagcaacacaaatggac

SEQ ID NO: 334348 - DNA, 75 bp, Artificial Sequence
  Synthetic
aacagcaatgcagccctaggggccatgtttgaagagcaacacaaatggaccagtgcaagggaggcagttgaggat

SEQ ID NO: 334349 - DNA, 75 bp, Artificial Sequence
  Synthetic
ggaaatagagctgtgcacagtgacctgagctattggatagagagcaagaataatggaagctggaaactggagaga

SEQ ID NO: 334350 - DNA, 75 bp, Artificial Sequence
  Synthetic
gggaaagagaactccatctgcaaggaaagtgtgagacttgcatttacaacatgatgggtaagcgagaaaagaaga

SEQ ID NO: 334351 - DNA, 75 bp, Artificial Sequence
  Synthetic
aaagtgtgagacttgcatttacaacatgatgggtaagcgagaaaagaagatgggggagtttggaaaagcaaaagg

SEQ ID NO: 334352 - DNA, 75 bp, Artificial Sequence
  Synthetic
gaggaccgaagagtcatcacaacacgaggacaggatacaaggttcagagttccggaccgtgggatgagaaagaga

SEQ ID NO: 334353 - DNA, 75 bp, Artificial Sequence
  Synthetic
cttggggctagatttctggagtttgaagctttaggtttcctgaatgaggaccattggatgagtagggagaacacc

SEQ ID NO: 334354 - DNA, 75 bp, Artificial Sequence
  Synthetic
aagctttaggtttcctgaatgaggaccattggatgagtagggagaacaccaagggaggcgttgaaggacttggac

SEQ ID NO: 334355 - DNA, 75 bp, Artificial Sequence
  Synthetic
tgacatctcagctaaggaagggggactcatgtacgctgatgacacggccgggtgggacactagaataaccaaggc

SEQ ID NO: 334356 - DNA, 75 bp, Artificial Sequence
  Synthetic
ctcatgtacgctgatgacacggccgggtgggacactagaataaccaaggcggacttggaaaatgaggccataatc

SEQ ID NO: 334357 - DNA, 75 bp, Artificial Sequence
  Synthetic
gggctgttgctgaaccactcattaaatttgcttacatgaataaggtggtgaaggtgatgcggccgggacgtgatg

SEQ ID NO: 334358 - DNA, 75 bp, Artificial Sequence
  Synthetic
atttgcttacatgaataaggtggtgaaggtgatgcggccgggacgtgatgggaaaacagtcatggatgtcatctc

SEQ ID NO: 334359 - DNA, 75 bp, Artificial Sequence
  Synthetic
caggtcgtgacctatgctctcaacactttcacgaatctgtgcgtccagcttatcagatgcatggagggggaggag

SEQ ID NO: 334360 - DNA, 75 bp, Artificial Sequence
  Synthetic
ggtcaagtacgtcattctagtggcagctgcatttgctgagagcaatacaggtggtgacattgtgcacttggccat

SEQ ID NO: 334361 - DNA, 75 bp, Artificial Sequence
  Synthetic
tggaagaaatgggggaaaagtatttttagcagcccgaagatgtcaaataacacatttgtcatcgatggaccaaag

SEQ ID NO: 334362 - DNA, 75 bp, Artificial Sequence
  Synthetic
ctttcacgaatctgtgcgtccagcttatcagatgcatggagggggaggagctactgctccccgaagagacggagc

SEQ ID NO: 334363 - DNA, 75 bp, Artificial Sequence
  Synthetic
catccaagagtggcttcaaaagaatggagaaaataggctgtcagccatggctgtcagtggagacgattgtgtggt

SEQ ID NO: 334364 - DNA, 75 bp, Artificial Sequence
  Synthetic
ggagaaaataggctgtcagccatggctgtcagtggagacgattgtgtggtaaaaccagcagatgatagattcgcc

SEQ ID NO: 334365 - DNA, 75 bp, Artificial Sequence
  Synthetic
tgttagcttgctggctccagggctcagaatagtggggatagatgtggtgagaataggtgtgctaaccctgggaat

SEQ ID NO: 334366 - DNA, 75 bp, Artificial Sequence
  Synthetic
tgtccaaggtgaggaaggacattcaggaatggaaaccctcaaccggttggagaaactggcaagaagtccctttct

SEQ ID NO: 334367 - DNA, 75 bp, Artificial Sequence
  Synthetic
ggaatggaaaccctcaaccggttggagaaactggcaagaagtccctttctgttcacaccatttccatgagctgca

SEQ ID NO: 334368 - DNA, 75 bp, Artificial Sequence
  Synthetic
cctctcactattgaaagagaggagcaatgcaatggcaaaaaagaagggaggcatgctcctgggagtggcatgcgc

SEQ ID NO: 334369 - DNA, 75 bp, Artificial Sequence
  Synthetic
gtcccatgtcgcgatcaggatgagttaattggaagggctagactctcaccaggatctggttggtcgctaacagaa

SEQ ID NO: 334370 - DNA, 75 bp, Artificial Sequence
  Synthetic
taattggaagggctagactctcaccaggatctggttggtcgctaacagaaacggcgtgcttgagcaaagcatacg

SEQ ID NO: 334371 - DNA, 75 bp, Artificial Sequence
  Synthetic
cagcatggcgattccattagccgttggcgggattatgctggtggtggcagtggtaacaggcttctctacagactt

SEQ ID NO: 334372 - DNA, 75 bp, Artificial Sequence
  Synthetic
atggctagagaaagcgagcgacatctcgtggagtgaggaggcgagggtgactggagcatcacagagatttgatgt

SEQ ID NO: 334373 - DNA, 75 bp, Artificial Sequence
  Synthetic
ccacaggagggatcttagactgatggcaaatgcgatctgttcatctgtccctgtatcatgggttcccacaggaag

SEQ ID NO: 334374 - DNA, 75 bp, Artificial Sequence
  Synthetic
atgtctaaccaaaaaccaggaagacccggctcaggtcgggttgtcaatatgctaaagcgcggaacgtcccgcgga

SEQ ID NO: 334375 - DNA, 75 bp, Artificial Sequence
  Synthetic
gcaaatgcgatctgttcatctgtccctgtatcatgggttcccacaggaagaacaacgtggtcaatccacggaaag

SEQ ID NO: 334376 - DNA, 75 bp, Artificial Sequence
  Synthetic
tgctagcagtatggaacagagtgtggattgaggaaaatgaacacatggaagacaagaccccagtaacctcatgga

SEQ ID NO: 334377 - DNA, 75 bp, Artificial Sequence
  Synthetic
gattgaggaaaatgaacacatggaagacaagaccccagtaacctcatggaatgaaataccataccttggaaagag

SEQ ID NO: 334378 - DNA, 75 bp, Artificial Sequence
  Synthetic
caggaatttttaagactcaatatggtgaagttggagctgtgtccctcgattacccaacgggaacctctggatcac

SEQ ID NO: 334379 - DNA, 75 bp, Artificial Sequence
  Synthetic
tgaagttggagctgtgtccctcgattacccaacgggaacctctggatcacctatcattgacaaggaaggacaggt

SEQ ID NO: 334380 - DNA, 75 bp, Artificial Sequence
  Synthetic
gcgaaacgtcggggggggagttgctcttggatcattatgttactcccgatagttgctgggctgaagcttggaaac

SEQ ID NO: 334381 - DNA, 75 bp, Artificial Sequence
  Synthetic
gtcggtcaccgagccagatccacttgggccgagaacatatacaccccgatcatgcagatcagagccctcatcggc

SEQ ID NO: 334382 - DNA, 75 bp, Artificial Sequence
  Synthetic
agttgctgggctgaagcttggaaactataatggcagagttttggccactttaaataagactgatgtatcagactt

SEQ ID NO: 334383 - DNA, 75 bp, Artificial Sequence
  Synthetic
cctgaacactatgtggattatatgccaaccctcaataggttcaaacccattgaaagctggagtgagggcgttttg

SEQ ID NO: 334384 - DNA, 75 bp, Artificial Sequence
  Synthetic
acagagataatagatgtgatgtgtcacgcgactttgacggcgcggctgctcacacctcagcgagtgccgaattac

SEQ ID NO: 334385 - DNA, 75 bp, Artificial Sequence
  Synthetic
aatgacctcaggtcatcttaaatgcagggttaaaatgcagggtttgaagctgaaaggaatgacctacccgatgtg

SEQ ID NO: 334386 - DNA, 75 bp, Artificial Sequence
  Synthetic
acgggtcatagatagtcggaagtgcattaaaccagtgattattgaggatggagaaggaagcgtgcaaatgaatgg

SEQ ID NO: 334387 - DNA, 75 bp, Artificial Sequence
  Synthetic
agttgggggtgtactcacttccattgggaaaggcattcatcaggttttcggctcagcatttaaaagcttatttgg

SEQ ID NO: 334388 - DNA, 75 bp, Artificial Sequence
  Synthetic
agcgaggatgatcatgatttcgctcattggaaagaggccaagatactgctggacaacattaacatgccagatggg

SEQ ID NO: 334389 - DNA, 75 bp, Artificial Sequence
  Synthetic
gctcagcatttaaaagcttatttggaggaatgtcatggattactcaaggcatgttgggggcactgctattgtgga

SEQ ID NO: 334390 - DNA, 75 bp, Artificial Sequence
  Synthetic
gggaaaggcattcatcaggttttcggctcagcatttaaaagcttatttggaggaatgtcatggattactcaaggc

SEQ ID NO: 334391 - DNA, 75 bp, Artificial Sequence
  Synthetic
tgaggacaggagacctccctgtctggatatcgtacaaggtcgctgaagctgggataagttacaatgaccggcggt

SEQ ID NO: 334392 - DNA, 75 bp, Artificial Sequence
  Synthetic
tacggatggaagaaatgggggaaaagtatttttagcagcccgaagatgtcaaataatacatttgtcatcgatgga

SEQ ID NO: 334393 - DNA, 75 bp, Artificial Sequence
  Synthetic
aacattcttactggtgtttatgatgacagtcgcctccatgggggtgttcttgttctttgttcagaggagaggctt

SEQ ID NO: 334394 - DNA, 75 bp, Artificial Sequence
  Synthetic
tgtaggtcttgcaccaccccaccactgagatttgttacaaaaagtggatgctggtatgggatggaaattcggcca

SEQ ID NO: 334395 - DNA, 75 bp, Artificial Sequence
  Synthetic
tgagatttgttacaaaaagtggatgctggtatgggatggaaattcggccaactgctcacggagacgacatgttga

SEQ ID NO: 334396 - DNA, 75 bp, Artificial Sequence
  Synthetic
gtcatggccacagttacggttttgttatggatagcagaagtcccggcccagaagattgccggtgtgcttctagtt

SEQ ID NO: 334397 - DNA, 75 bp, Artificial Sequence
  Synthetic
gcagacggatagtcacttggctgttttcatgattgttgtcttgttagtggtgggtgctgtggcgtcaaatgaaat

SEQ ID NO: 334398 - DNA, 75 bp, Artificial Sequence
  Synthetic
gacatctcgtggagtgaggaggcgagggtgactggagcatcacagagatttgatgtggaaattgatcaggacggt

SEQ ID NO: 334399 - DNA, 75 bp, Artificial Sequence
  Synthetic
gacaggagggcacccagtttcacgaggcacggcaaagttgaggtggctcgtggagcgtgggtttctcaaaccaag

SEQ ID NO: 334400 - DNA, 75 bp, Artificial Sequence
  Synthetic
agggtgccactctcgcgtaattcaacacatgagatgtactgggtgagcggctcaagtgggaatgtgacaaatagt

SEQ ID NO: 334401 - DNA, 75 bp, Artificial Sequence
  Synthetic
catggaagctacgaagtgaaagccacaggctcagccagctcaatggttaatggggtagttaggatactgtcaaaa

SEQ ID NO: 334402 - DNA, 75 bp, Artificial Sequence
  Synthetic
ccttgggacaccttgcaaaacgtggtaaatatggccatgacggacaccactccttttgggcaacagcgcgttttt

SEQ ID NO: 334403 - DNA, 75 bp, Artificial Sequence
  Synthetic
caacatatacatgctgactacagctgagaaagggagcagggcccacagagaagccctggaggaactgcctgagac

SEQ ID NO: 334404 - DNA, 75 bp, Artificial Sequence
  Synthetic
agaacatatacaccccaattatgcagatcagagctctcattggccctgagcactatgtagattacatgccaactc

SEQ ID NO: 334405 - DNA, 75 bp, Artificial Sequence
  Synthetic
ttttgttatggatagcagaagtcccggcccagaagattgccggtgtgcttctagtttctctattgctgatgattg

SEQ ID NO: 334406 - DNA, 75 bp, Artificial Sequence
  Synthetic
ggaaagcgagaaaagaagatgggagagttcgggaaagcaaaaggtagtagagctatttggtacatgtggctcggg

SEQ ID NO: 334407 - DNA, 75 bp, Artificial Sequence
  Synthetic
agttcgggaaagcaaaaggtagtagagctatttggtacatgtggctcggggccagattcctagagttcgaagcct

SEQ ID NO: 334408 - DNA, 75 bp, Artificial Sequence
  Synthetic
ttttgatcccagaaccagagagacagagatcgcagacggatagtcatttggctgttttcatgattgttgtcttgt

SEQ ID NO: 334409 - DNA, 75 bp, Artificial Sequence
  Synthetic
gtgtgatgaaaaatcccgtggttgatggcatagtggctacagatgttccagaccttgaggccagcactcctatta

SEQ ID NO: 334410 - DNA, 75 bp, Artificial Sequence
  Synthetic
ttacatgaacaaggtggtgaaggtaatgcgaccgggacgtgatgggaaaacagtcatggatgtcatctcgcggga

SEQ ID NO: 334411 - DNA, 75 bp, Artificial Sequence
  Synthetic
agaccagaggggaagtggacaggttgtgacttatgctctcaacactttcacgaacctgtgcgtccagctcattag

SEQ ID NO: 334412 - DNA, 75 bp, Artificial Sequence
  Synthetic
aacaggttgtcagccatggcagttagcggggatgattgtgtggtgaaaccagcagatgacagattcgccacagca

SEQ ID NO: 334413 - DNA, 75 bp, Artificial Sequence
  Synthetic
aatatgctccgtcttggcattatgaccaagacaatccttacaagacttggaactatcatggaagctacgaagtga

SEQ ID NO: 334414 - DNA, 75 bp, Artificial Sequence
  Synthetic
aagccttgggcttcttgaacgaggatcactggatgagcagggaaaacactaaaggaggtgttgaaggacttggac

SEQ ID NO: 334415 - DNA, 75 bp, Artificial Sequence
  Synthetic
gatcagagctctcattggccctgagcactatgtagattacatgccaactctaaacaggttcaaacccattgaaag

SEQ ID NO: 334416 - DNA, 75 bp, Artificial Sequence
  Synthetic
ctggagtgaaggtgtcttgtaaatacatgaggtaggtgtaaaaatgtatataaagtagtgttagtttagagcaat

SEQ ID NO: 334417 - DNA, 75 bp, Artificial Sequence
  Synthetic
taaagtagtgttagtttagagcaataaacatataaattagcatttgtttgaagagataggaagaggaagtcaggc

SEQ ID NO: 334418 - DNA, 75 bp, Artificial Sequence
  Synthetic
ctttcacgaacctgtgcgtccagctcattagatgtatggaaggggaggagctgctgctccccgaggaaacagagc

SEQ ID NO: 334419 - DNA, 75 bp, Artificial Sequence
  Synthetic
aagagataggaagaggaagtcaggccagggaatccctgccaccggatgttggatgacggtgctgtctgcgttcca

SEQ ID NO: 334420 - DNA, 75 bp, Artificial Sequence
  Synthetic
tggctcacgaagtgccctggaccagtgtcgggccacaggttttgtgccactagcgtgcagtgcagcccggacaaa

SEQ ID NO: 334421 - DNA, 75 bp, Artificial Sequence
  Synthetic
cctgagcactatgtagattacatgccaactctaaataggttcaaacccattgaaagctggagtgaaggtgtcttg

SEQ ID NO: 334422 - DNA, 75 bp, Artificial Sequence
  Synthetic
catcatggagggactagaggttagaggagaccccgtggaaagaaagcaaggcccaacctagagtcaagctgtaac

SEQ ID NO: 334423 - DNA, 75 bp, Artificial Sequence
  Synthetic
tccacgggtgccaagataatggtggaaatggaacctccattcggggattcattcatcttagtaggaagtggaaaa

SEQ ID NO: 334424 - DNA, 75 bp, Artificial Sequence
  Synthetic
agaagtttatctgtgtgaacttattccaaacagcttttggagtagtgcgtgtgaacgtaaacacagtttgaacgt

SEQ ID NO: 334425 - DNA, 75 bp, Artificial Sequence
  Synthetic
caacgccattgacttgactgtggtggttgaaaaaaatcctgcaacatacaggaaaaccgatcagaggctgccgaa

SEQ ID NO: 334426 - DNA, 75 bp, Artificial Sequence
  Synthetic
gttcatctgtgtgaacttattccaaacagcttttggagtagtgcgtgtgaacgtaaacacagtttgaacgttttt

SEQ ID NO: 334427 - DNA, 75 bp, Artificial Sequence
  Synthetic
ttagcagcccgaagatgtcaaataatacatttgtcatcgatggaccaaaaactaaagagtgccaagatgacagaa

SEQ ID NO: 334428 - DNA, 75 bp, Artificial Sequence
  Synthetic
atactttgggtttggaatgttgtccacaaaggtatggatggaaatgcgaacacaaaatataactgattgtgacac

SEQ ID NO: 334429 - DNA, 75 bp, Artificial Sequence
  Synthetic
ggaaataaagctgtgcacagtgacctgagctattggataaagagcaagaatactgtaagctggaaactggagaga

SEQ ID NO: 334430 - DNA, 75 bp, Artificial Sequence
  Synthetic
tcttcaagtttacagccctgaggccaaccattggaatgctgaagagatggaagctggttggagttaatgaggcga

SEQ ID NO: 334431 - DNA, 75 bp, Artificial Sequence
  Synthetic
gcccaaccatgggagaggctcataatcccaaggcaacttatgctgaatacatatgcaaaaaagattttgtggaca

SEQ ID NO: 334432 - DNA, 75 bp, Artificial Sequence
  Synthetic
tgtgccaagtttgactgcacaaagaaagcagaaggcaggattgtgcagaaggaaaacgtccagtttgaagttgca

SEQ ID NO: 334433 - DNA, 75 bp, Artificial Sequence
  Synthetic
gagttttggccactttaaataagactgatgtatcagacttgctagtcattccaacaacggctggcagcaatggat

SEQ ID NO: 334434 - DNA, 75 bp, Artificial Sequence
  Synthetic
cacggcatggacggaggtctaggagatcggtgaacgtgcatcaccatggagagagtctacttgaggccaagaaca

SEQ ID NO: 334435 - DNA, 75 bp, Artificial Sequence
  Synthetic
acggcaaaagacaggccgaccatagacgtcaagatgatgaacatggaggctacggaattagcggttgtgagatct

SEQ ID NO: 334436 - DNA, 75 bp, Artificial Sequence
  Synthetic
tgtggacaaggcatgtttgtcttcaacgatgttgaggcttggaaggataattataagtactatccatccacacca

SEQ ID NO: 334437 - DNA, 75 bp, Artificial Sequence
  Synthetic
agtgagaggttacacaaagggagggccaggacatgaggaaccagtgatgactcagagctatggctggaacattgt

SEQ ID NO: 334438 - DNA, 75 bp, Artificial Sequence
  Synthetic
aggagacttgccaaaatcatggtagaagctcatgaggctggaatttgtggcatacgatcagtcagcaggctcgag

SEQ ID NO: 334439 - DNA, 75 bp, Artificial Sequence
  Synthetic
ttggggcaatggctgtggcttgtttggaaaggggagcatacagacatgtgccaagtttgactgcacaaagaaagc

SEQ ID NO: 334440 - DNA, 75 bp, Artificial Sequence
  Synthetic
ctacaccgctgagatggaggattatggtaccgtcacactcgaatgtgaaccccgatctggggttgacatggggca

SEQ ID NO: 334441 - DNA, 75 bp, Artificial Sequence
  Synthetic
tgaacatgagtgtaccaacattactcaactccggggccatggcctggctcttgctgagagccgtgtttgaaggga

SEQ ID NO: 334442 - DNA, 75 bp, Artificial Sequence
  Synthetic
tgggagcacaattggaaaagcttttacgtcaacactcaaaggagcacaaaggatggttgctttgggtgacactgc

SEQ ID NO: 334443 - DNA, 75 bp, Artificial Sequence
  Synthetic
gggtacgctcttgctgccattttcataggctggaatctgggaacgacgagaagccaaaagataattttcacaatt

SEQ ID NO: 334444 - DNA, 75 bp, Artificial Sequence
  Synthetic
agactgatgtatcagacttgctagtcattccaacaacggccggcagcaatgaatgcgtcgcacgtgctctagatg

SEQ ID NO: 334445 - DNA, 75 bp, Artificial Sequence
  Synthetic
tagtcttcctggcagtaaatgtcaatgccgacacggggtgctcaatcgacttggctaggaaagaattgaaatgtg

SEQ ID NO: 334446 - DNA, 75 bp, Artificial Sequence
  Synthetic
cgatcagtcagcaggctcgagcacaacatgtgggtaagcatcaaacatgagttgaacgcgatcttggaagacaac

SEQ ID NO: 334447 - DNA, 75 bp, Artificial Sequence
  Synthetic
gttgaacgcgatcttggaagacaacgccattgacttgactgtggtggttgaagaaaatcctggaagatacaggaa

SEQ ID NO: 334448 - DNA, 75 bp, Artificial Sequence
  Synthetic
cttacgatcagtcagcaggctcgagcacaacatgtgggtaagcatcagacatgagttgaacgcgatcttggaaga

SEQ ID NO: 334449 - DNA, 75 bp, Artificial Sequence
  Synthetic
aaatacaactgattgtgacaccgcagtaatgggcacagcaattaaaggaaatagagctgtgcacagtgacctgag

SEQ ID NO: 334450 - DNA, 75 bp, Artificial Sequence
  Synthetic
ggcagtaaagagggagcataccggaacagagataatagatgtgatgtgtcacgcgactttgacagcgcggctgct

SEQ ID NO: 334451 - DNA, 75 bp, Artificial Sequence
  Synthetic
attttgcgagtggaaagagatcagcaatagggatccttgaggttttcagaatgcttcctgaccatttcgctcaca

SEQ ID NO: 334452 - DNA, 75 bp, Artificial Sequence
  Synthetic
ggaagagctttgactcagagtatcctaaatgcaagagtggagaatgggattttgtgataaccactgacatctcag

SEQ ID NO: 334453 - DNA, 75 bp, Artificial Sequence
  Synthetic
gttgaggaaaaactggctggccggggcctctctagcatggactataactcggaatctccaggcagggaccctgcg

SEQ ID NO: 334454 - DNA, 75 bp, Artificial Sequence
  Synthetic
tgaataccactactcaggaccaaccagcgaggatgatcatgattttgctcattggaaagaggccaagatactgct

SEQ ID NO: 334455 - DNA, 75 bp, Artificial Sequence
  Synthetic
cggtgtttgggcctttcgaactgggcttattctgttatcttcatacaacccatacttcctgccactgactctggc

SEQ ID NO: 334456 - DNA, 75 bp, Artificial Sequence
  Synthetic
caatgacagcacaggctggagcactgtttggactagggaagggtatgccttttgtcaaagcagacttgtcagtac

SEQ ID NO: 334457 - DNA, 75 bp, Artificial Sequence
  Synthetic
actggtcccatattgggcgagtgtacgtaatgatctaatttcctatggtggaccatggaaattggggaagcaatg

SEQ ID NO: 334458 - DNA, 75 bp, Artificial Sequence
  Synthetic
gttgaggaaaaactggttggctggggcctctctagcatggactataactcggaacctccaggcagggaccttgcg

SEQ ID NO: 334459 - DNA, 75 bp, Artificial Sequence
  Synthetic
aaagaaaaggttgataccaaagccccagaaccacctgcaggaacagctagggtcatgaacatcgtggcaagatgg

SEQ ID NO: 334460 - DNA, 75 bp, Artificial Sequence
  Synthetic
gatcactcaaggggagaagaaggaagaagaagttcctcaggtgtttgacgaaaacatgctgcgaaaaaggcaact

SEQ ID NO: 334461 - DNA, 75 bp, Artificial Sequence
  Synthetic
gaagaagttcctcaggtgtttgacgaaaacatgctgcgaaaaaggcaactaacagtgctggacctacatccaggt

SEQ ID NO: 334462 - DNA, 75 bp, Artificial Sequence
  Synthetic
cagaaccacctgcaggaacagctagggtcatgaacatcgtggcaagatggatgtggaactttgttggcagaaata

SEQ ID NO: 334463 - DNA, 75 bp, Artificial Sequence
  Synthetic
ggtcatgaacatcgtggcaagatggatgtggaactttgttggcagaaataaacaaccgaggatgtgtacaaaaga

SEQ ID NO: 334464 - DNA, 75 bp, Artificial Sequence
  Synthetic
cctcagcgagtgccgaattacaacttgttcattatggatgaggctcacttcacagaccccgccagtattgctgcc

SEQ ID NO: 334465 - DNA, 75 bp, Artificial Sequence
  Synthetic
tgttcattatggatgaggctcacttcacagaccccgccagtattgctgccagaggatatatatcaacaaaggtgg

SEQ ID NO: 334466 - DNA, 75 bp, Artificial Sequence
  Synthetic
taaagtagtgttagtttagagtaataaatatatagactagcagtgaatatatgaggtaggtgtaaaaatgtatat

SEQ ID NO: 334467 - DNA, 75 bp, Artificial Sequence
  Synthetic
gagttttgactcagagtatcctaaatgcaagagtggagaatgggattttgtgataaccactgacatctcagaaat

SEQ ID NO: 334468 - DNA, 75 bp, Artificial Sequence
  Synthetic
accccagtgacttcatggaacgaagtgccataccttggaaagagggaagatggctggtgtggtagtctgattgga

SEQ ID NO: 334469 - DNA, 75 bp, Artificial Sequence
  Synthetic
gtcatagatagtcggaagtgcatcaaaccagtgattattgaggatggagaaggaagcgtgcaaatgaatggacca

SEQ ID NO: 334470 - DNA, 75 bp, Artificial Sequence
  Synthetic
agaacatatacaccccaattatgcagatcagagctctcattggccctgagcactatgtagattacatgccaactt

SEQ ID NO: 334471 - DNA, 75 bp, Artificial Sequence
  Synthetic
ctttgatggaccctcatgcaatactgttctggaagacaataacccagtggagttatggacaaagtcaggtgagaa

SEQ ID NO: 334472 - DNA, 75 bp, Artificial Sequence
  Synthetic
agaagttcatctgtgtgaactcattccaaacagctttttggagtagtgcgtgtgaacgtaaacacagtttgaacg

SEQ ID NO: 334473 - DNA, 75 bp, Artificial Sequence
  Synthetic
ccaaacagctttttggagtagtgcgtgtgaacgtaaacacagtttgaacgttttttggatagagacaactatgtc

SEQ ID NO: 334474 - DNA, 75 bp, Artificial Sequence
  Synthetic
gtttggaaaggggagtatacagacatgtgccaagtttgactgcacaaagaaagcagaaggcaggattgtgcagaa

SEQ ID NO: 334475 - DNA, 75 bp, Artificial Sequence
  Synthetic
acgtcggggggagagttgctcttgggtcatcatgttactcccgatagttgctgggctgaagcttggaaactataa

SEQ ID NO: 334476 - DNA, 75 bp, Artificial Sequence
  Synthetic
tgctgtggcgtcaaatgaaatgggttggctagagcaaacaaagaaggacttgtcagctctgttcgggaggaaaag

SEQ ID NO: 334477 - DNA, 75 bp, Artificial Sequence
  Synthetic
gactgctggtgcaatgagactgagatatacattcattatgggagatgcaccccttcacggcatggacggaggtct

SEQ ID NO: 334478 - DNA, 75 bp, Artificial Sequence
  Synthetic
ccagcactcctattacagagaagaaattgggtcaatgtgtgctagtgggaatagccttagtggcggtgttcctaa

SEQ ID NO: 334479 - DNA, 75 bp, Artificial Sequence
  Synthetic
gtttggaatgttgacctctgccgcttcggtgacactaattgagggagctgcaggtcgtatttggaacgcaaccac

SEQ ID NO: 334480 - DNA, 75 bp, Artificial Sequence
  Synthetic
gtcggacgtgacgacagaatccagatgcccaaccatgggagaggctcataatcccaaggcaacttacgctgaata

SEQ ID NO: 334481 - DNA, 75 bp, Artificial Sequence
  Synthetic
aggacccatcaggtttgtgttagctttactgacctttttcaagtttacagcacttaagccaaccattgggatgct

SEQ ID NO: 334482 - DNA, 75 bp, Artificial Sequence
  Synthetic
ttactgacctttttcaagtttacagcacttaagccaaccattgggatgctgaagagatggaagctagttggagtt

SEQ ID NO: 334483 - DNA, 75 bp, Artificial Sequence
  Synthetic
gcgtgggtttctcaaaccaagaggcaaagttgtggacttaggctgcggcagaggaggctggagttactactgtgc

SEQ ID NO: 334484 - DNA, 75 bp, Artificial Sequence
  Synthetic
gttttaagcgtgacattggacagatgcttgacggactgaacaagaggaaggcaaaacgtcgggggggaagctgcc

SEQ ID NO: 334485 - DNA, 75 bp, Artificial Sequence
  Synthetic
gaggaggctggagttactactgtgcaacattaaagcaggttcaggaagtgagaggttacacaaaaggagggccag

SEQ ID NO: 334486 - DNA, 75 bp, Artificial Sequence
  Synthetic
gcttgacggactgaacaagaggaaggcaaaacgtcgggggggaagctgcccttgggtcatcatgctactcccgat

SEQ ID NO: 334487 - DNA, 75 bp, Artificial Sequence
  Synthetic
tacaatggtagagtcttggctactttgaataaaacagatgtgtcagacatgttgatcattccaacgacgactggc

SEQ ID NO: 334488 - DNA, 75 bp, Artificial Sequence
  Synthetic
tgaataaaacagatgtgtcagacatgttgatcattccaacgacgactggcagcaatggatgtgttgtgcgtgctc

SEQ ID NO: 334489 - DNA, 75 bp, Artificial Sequence
  Synthetic
tgacataacgtacctgtgcccaaagttggagtacggttatgaaccagaggacatagactgctggtgcaatgaaac

SEQ ID NO: 334490 - DNA, 75 bp, Artificial Sequence
  Synthetic
ttggagtacggttatgaaccagaggacatagactgctggtgcaatgaaactgaaatatacattcattacgggaga

SEQ ID NO: 334491 - DNA, 75 bp, Artificial Sequence
  Synthetic
ggtctagaagatcagtgaacgtgcatcaccatggagagagcctgctggaggccaagaacacgccgtggatggatt

SEQ ID NO: 334492 - DNA, 75 bp, Artificial Sequence
  Synthetic
tcaccatggagagagcctgctggaggccaagaacacgccgtggatggattcgaccaaggccacaaaatatctcac

SEQ ID NO: 334493 - DNA, 75 bp, Artificial Sequence
  Synthetic
aaccctgggtatgctcttgcagccatttttataggctggaacctgggaacgacgagaggtcagaaaataattttc

SEQ ID NO: 334494 - DNA, 75 bp, Artificial Sequence
  Synthetic
caggatgcacaaaaccaaccgcaatggacccaggtatgaagaagatgtggacttgggttcagggaccagagctgt

SEQ ID NO: 334495 - DNA, 75 bp, Artificial Sequence
  Synthetic
tttttataggctggaacctgggaacgacgagaggtcagaaaataattttcacaatcatgctaatgttgatcgccc

SEQ ID NO: 334496 - DNA, 75 bp, Artificial Sequence
  Synthetic
gatgcaaaacagagactttgtcgagggagtgaatggcgttgaatggattgatgttgttctggaaggaggatcatg

SEQ ID NO: 334497 - DNA, 75 bp, Artificial Sequence
  Synthetic
agaagtgggagcacaattggaaaagctttcacgtcaacactcaaaggagcacaaaggatggttgctttgggtgac

SEQ ID NO: 334498 - DNA, 75 bp, Artificial Sequence
  Synthetic
ggagtgaatggcgttgaatggattgatgttgttctggaaggaggatcatgtgtgaccatcacagcaaaagacagg

SEQ ID NO: 334499 - DNA, 75 bp, Artificial Sequence
  Synthetic
acatggaggctacggagttggcggttgtaagatcttactgctatgaaccgaaagtgtcagatgtgacgacggaac

SEQ ID NO: 334500 - DNA, 75 bp, Artificial Sequence
  Synthetic
gtagttaggatactgtcaaaaccttgggacaccttgcaaaacgtggtgaatatggccatgacggacaccactcct

SEQ ID NO: 334501 - DNA, 75 bp, Artificial Sequence
  Synthetic
ccagatgcccgactatgggggaagctcataaccccaaagcaacttatgctgactatatatgcaaaaaagattttg

SEQ ID NO: 334502 - DNA, 75 bp, Artificial Sequence
  Synthetic
cagacatgtgccaagtttgactgcacaaagaaggcagaaggcaggattgtgcagaaggaaaacgtccaatttgag

SEQ ID NO: 334503 - DNA, 75 bp, Artificial Sequence
  Synthetic
cagaagtaagtacttaccacaattacccagttcagcagtcactaaaacacgcagctagatttgtgataacaccaa

SEQ ID NO: 334504 - DNA, 75 bp, Artificial Sequence
  Synthetic
aaagtccagtttacactgctgaattgggagactatggcgctgtcacactcgagtgtgaaccccgatctggagtcg

SEQ ID NO: 334505 - DNA, 75 bp, Artificial Sequence
  Synthetic
cgggaaagcaaaaggtagtagagctatttggtacatgtggctcggggccagattcctagagttcgaagccttggg

SEQ ID NO: 334506 - DNA, 75 bp, Artificial Sequence
  Synthetic
ccaccaaacagtcagtagtggccctggcgtcacaggaaggagcccttcatgcagcattagcaggagccattccag

SEQ ID NO: 334507 - DNA, 75 bp, Artificial Sequence
  Synthetic
ggcgtcacaggaaggagcccttcatgcagcattagcaggagccattccagtgaagtactccgggagtaagctgga

SEQ ID NO: 334508 - DNA, 75 bp, Artificial Sequence
  Synthetic
agagtgaaaatgcagggtttgaaattgaaaggaatgacctacccaatgtgcagcaacacattctccctggcgaag

SEQ ID NO: 334509 - DNA, 75 bp, Artificial Sequence
  Synthetic
tgaaaggaatgacctacccaatgtgcagcaacacattctccctggcgaagaatcctactgacactgggcatggta

SEQ ID NO: 334510 - DNA, 75 bp, Artificial Sequence
  Synthetic
aggttccgatgggccatgcagagttcctatctccatgtcggcagacctgaatgatatgacaccagttggacgttt

SEQ ID NO: 334511 - DNA, 75 bp, Artificial Sequence
  Synthetic
tgtggagtgacagcgttgtggagagtgaactcatcatacctaaaacattgggaggaccgaagagtcatcacaaca

SEQ ID NO: 334512 - DNA, 75 bp, Artificial Sequence
  Synthetic
gataacagttaatccatacgtgtcaacttcatccacaggtgccaagatcatggtagaagtggaacctccgttcgg

SEQ ID NO: 334513 - DNA, 75 bp, Artificial Sequence
  Synthetic
ggcatagaagtgggagcacaattggaaaagctttcacgtcaacactcaaaggagcacaaaggatggttgccttag

SEQ ID NO: 334514 - DNA, 75 bp, Artificial Sequence
  Synthetic
ggatgattgtgtggtgaaaccagcagatgacagattcgccacagcactgcatttcctcaacagcatgtctaaggt

SEQ ID NO: 334515 - DNA, 75 bp, Artificial Sequence
  Synthetic
tgttggaggtgtactgacttccatcgggaaaggcattcaccaggtttttggctcagcatttaaaagcttattcgg

SEQ ID NO: 334516 - DNA, 75 bp, Artificial Sequence
  Synthetic
gggaaaggcattcaccaggtttttggctcagcatttaaaagcttattcggaggaatgtcatggatcactcaaggt

SEQ ID NO: 334517 - DNA, 75 bp, Artificial Sequence
  Synthetic
tttccacgagctgcaaatgaaagatggcagaaagattgtggttccatgtcgagaccaggatgaactaattggaag

SEQ ID NO: 334518 - DNA, 75 bp, Artificial Sequence
  Synthetic
tcacggagacgacatgttgatcaaatcaaaggtcatggcttttcaagggggtggcatggaacctatgcaattggg

SEQ ID NO: 334519 - DNA, 75 bp, Artificial Sequence
  Synthetic
tgggactaaatgcgagggacagatccatttctataacatttttagctgtaggaggaatcttggtctttttggcgg

SEQ ID NO: 334520 - DNA, 75 bp, Artificial Sequence
  Synthetic
agccaggctctctccagggtctggctggtcactaacagaaacagcatgcctgagcaaagcatacgctcagatgtg

SEQ ID NO: 334521 - DNA, 75 bp, Artificial Sequence
  Synthetic
gatgctcgtcatgattgtagcagcccaggagattttgagaaggcgcatgacggctccaattgcttggtcagcgct

SEQ ID NO: 334522 - DNA, 75 bp, Artificial Sequence
  Synthetic
catttctataacatttttagctgtaggaggaatcttggtctttttggcggttaatgttaatgccgacatgggatg

SEQ ID NO: 334523 - DNA, 75 bp, Artificial Sequence
  Synthetic
ctgaagtgcggacagggcatgttcatcttcaacgacgttgaggcttggaaggataactacaagtattatccatct

SEQ ID NO: 334524 - DNA, 75 bp, Artificial Sequence
  Synthetic
tcttcaacgacgttgaggcttggaaggataactacaagtattatccatctacaccaaggaaacttgctaaggttg

SEQ ID NO: 334525 - DNA, 75 bp, Artificial Sequence
  Synthetic
gtggaacagggtgtggattgaagaaaatgaacacatggaagacaaaaccccagtgacttcatggaacgaagtgcc

SEQ ID NO: 334526 - DNA, 75 bp, Artificial Sequence
  Synthetic
ttgtggtgtacggtcagttagcaggctagagcacaacatgtgggcgagcatcaaacatgagctgaacgcgatcct

SEQ ID NO: 334527 - DNA, 75 bp, Artificial Sequence
  Synthetic
ctagagcacaacatgtgggcgagcatcaaacatgagctgaacgcgatcctggaagataacagcatcgacttgact

SEQ ID NO: 334528 - DNA, 75 bp, Artificial Sequence
  Synthetic
ggtataggaggactaaccagaggctatcgaacgttgagggggagctcacatttggatggaagaaatggggaaaaa

SEQ ID NO: 334529 - DNA, 75 bp, Artificial Sequence
  Synthetic
atcgaacgttgagggggagctcacatttggatggaagaaatggggaaaaaacatttttagcagcccgaaaatgtc

SEQ ID NO: 334530 - DNA, 75 bp, Artificial Sequence
  Synthetic
cagaatagtggggatagatgtggtgagaataggtgtgctaaccctggggatcctctcactattgaaagagaggag

SEQ ID NO: 334531 - DNA, 75 bp, Artificial Sequence
  Synthetic
ccaagaaccaaggagtgcccagatgagaaaagagcgtggaacagcatgaagattgaggactttggatttggggtg

SEQ ID NO: 334532 - DNA, 75 bp, Artificial Sequence
  Synthetic
agaaaagagcgtggaacagcatgaagattgaggactttggatttggggtgttatccacaaaggtatggatggaga

SEQ ID NO: 334533 - DNA, 75 bp, Artificial Sequence
  Synthetic
tgacaccgctgtgatgggtacagcaattaaaggaaacagagctgtgcatagtgacttgagctattggatagagag

SEQ ID NO: 334534 - DNA, 75 bp, Artificial Sequence
  Synthetic
attaaaggaaacagagctgtgcatagtgacttgagctattggatagagagtcacaacaatggaagttggaagtta

SEQ ID NO: 334535 - DNA, 75 bp, Artificial Sequence
  Synthetic
agtcatgcacatggccggaaacccacacattgtggagtgacagtgttgtggagagtgagcttatcatacccaaaa

SEQ ID NO: 334536 - DNA, 75 bp, Artificial Sequence
  Synthetic
cacattgtggagtgacagtgttgtggagagtgagcttatcatacccaaaacattgggaggaccgaaaagccatca

SEQ ID NO: 334537 - DNA, 75 bp, Artificial Sequence
  Synthetic
agggggtggcatggaacctatgcaattgggaatgctcgtcatgattgtagcagcccaggagattttgagaaggcg

SEQ ID NO: 334538 - DNA, 75 bp, Artificial Sequence
  Synthetic
cagagttccggaccatgggacgagaaggaaattaaaatagacttcgactactgtccggggacaaccgtcacggtg

SEQ ID NO: 334539 - DNA, 75 bp, Artificial Sequence
  Synthetic
aggaaattaaaatagacttcgactactgtccggggacaaccgtcacggtgacgagctcatgccgagacagagggc

SEQ ID NO: 334540 - DNA, 75 bp, Artificial Sequence
  Synthetic
tgggaaattaataacagattggtgctgcagatcttgcactactccaccactgagatttgtcacgaaaagtggatg

SEQ ID NO: 334541 - DNA, 75 bp, Artificial Sequence
  Synthetic
tgcagatcttgcactactccaccactgagatttgtcacgaaaagtggatgctggtacggaatggaaattaggcca

SEQ ID NO: 334542 - DNA, 75 bp, Artificial Sequence
  Synthetic
ttaaatcaaaggtcgtggcttttcaaggggatggcatggagcccatgcagttggggatactagtcataattatag

SEQ ID NO: 334543 - DNA, 75 bp, Artificial Sequence
  Synthetic
aggggatggcatggagcccatgcagttggggatactagtcataattatagcagctcaagaggtcctgagaaggcg

SEQ ID NO: 334544 - DNA, 75 bp, Artificial Sequence
  Synthetic
tcactcttgctgctgatggctttagttctatttggaggagtcacttacagtgacctggtcaaatacgtcatctta

SEQ ID NO: 334545 - DNA, 75 bp, Artificial Sequence
  Synthetic
ttctatttggaggagtcacttacagtgacctggtcaaatacgtcatcttagtggcagtcgcattcgctgagagca

SEQ ID NO: 334546 - DNA, 75 bp, Artificial Sequence
  Synthetic
tggtggaccatggaaattggggaagcaatggaatggcgtagatgaagtgcaagtcatcgtcgtgcaaccaggcaa

SEQ ID NO: 334547 - DNA, 75 bp, Artificial Sequence
  Synthetic
ggccatagtggcagcattcaacatccagccaggcttattgattggattcctattgaggaggaggtggagcaacca

SEQ ID NO: 334548 - DNA, 75 bp, Artificial Sequence
  Synthetic
aagtcatcgtcgtgcaaccaggcaaagaagtcataaatgtgcagacccaaccaggaatttttaagactcaatatg

SEQ ID NO: 334549 - DNA, 75 bp, Artificial Sequence
  Synthetic
cagccaggcttattgattggattcctattgaggaggaggtggagcaaccaggaaagcagattgcttggcgttgca

SEQ ID NO: 334550 - DNA, 75 bp, Artificial Sequence
  Synthetic
gagatttgaacatgagtataccaacattactcaactctggagccatggcctggctcttgcttagagccgtgtttg

SEQ ID NO: 334551 - DNA, 75 bp, Artificial Sequence
  Synthetic
tggttggtctctatggtaatggaatcctggtgggttcaggcgattttgtcagcatgattactcaaggggaaaaga

SEQ ID NO: 334552 - DNA, 75 bp, Artificial Sequence
  Synthetic
attactcaactctggagccatggcctggctcttgcttagagccgtgtttgaagggacagcaagctcccttgctct

SEQ ID NO: 334553 - DNA, 75 bp, Artificial Sequence
  Synthetic
agaagtccatctgtgtgaacttattccaaacagttttttggagtagtgcgtgtgaacgtaaacacagtttgaacg

SEQ ID NO: 334554 - DNA, 75 bp, Artificial Sequence
  Synthetic
gctggggcctctctagcatggactataactcggaacctccaggcagggaccttgcgtcggggagggggaactggc

SEQ ID NO: 334555 - DNA, 75 bp, Artificial Sequence
  Synthetic
tgacgaaaacatgctgcggaaaaggcaactgacagtgctggacctacatccaggttcaggaaagaccagaaaggt

SEQ ID NO: 334556 - DNA, 75 bp, Artificial Sequence
  Synthetic
gggctcagaataatagggatagatgtggtgaggattggtgtgctaaccctggggatcctctcattattgaaagag

SEQ ID NO: 334557 - DNA, 75 bp, Artificial Sequence
  Synthetic
tggtgaggattggtgtgctaaccctggggatcctctcattattgaaagagaggaacaatgcgatggcaaaaaaga

SEQ ID NO: 334558 - DNA, 75 bp, Artificial Sequence
  Synthetic
aagcgtgacattggacagatgctcgacggactgaataagcggaaggcgaaacgtcggggggggagttgctcttgg

SEQ ID NO: 334559 - DNA, 75 bp, Artificial Sequence
  Synthetic
gtgtgccaccgccggaatcgctagccccttggtgtttgcaggtttgcacatggtgttaaaaccggtgacacggag

SEQ ID NO: 334560 - DNA, 75 bp, Artificial Sequence
  Synthetic
cccttggtgtttgcaggtttgcacatggtgttaaaaccggtgacacggagaggatggcccgtcagtgaagctttg

SEQ ID NO: 334561 - DNA, 75 bp, Artificial Sequence
  Synthetic
tggcaggaggaattgcccagtttgatgatagcagcatggcgatcccattggccgtcggcgggataatgctagtgg

SEQ ID NO: 334562 - DNA, 75 bp, Artificial Sequence
  Synthetic
tgatagcagcatggcgatcccattggccgtcggcgggataatgctagtggtggcagtggtaacaggtttctccac

SEQ ID NO: 334563 - DNA, 75 bp, Artificial Sequence
  Synthetic
ctgccagaggatatatatcaacaaaggtggaactgggagaggcagctgcaatattcatgacagccacacctccag

SEQ ID NO: 334564 - DNA, 75 bp, Artificial Sequence
  Synthetic
gacatctcgtggagtgaggaagcaagagtgactggggcatcacagagatttgatgtggaaattgatcaggacggc

SEQ ID NO: 334565 - DNA, 75 bp, Artificial Sequence
  Synthetic
gagtgactggggcatcacagagatttgatgtggaaattgatcaggacggcaacatgaaattgctgaatgaccctg

SEQ ID NO: 334566 - DNA, 75 bp, Artificial Sequence
  Synthetic
caactcgccaataacagacattgaagagcaaatccctgatagagcttggaactctgggtatgagtggataacaga

SEQ ID NO: 334567 - DNA, 75 bp, Artificial Sequence
  Synthetic
tcgaactgggctcattttgctatcctcatacaacccatacttattgccattgacgttggcaggttactggatgac

SEQ ID NO: 334568 - DNA, 75 bp, Artificial Sequence
  Synthetic
ctttcaaggaaagactgtatggtttgtccccagcgtgaagtctggtaatgagattgccgtgtgcttgacaaaggc

SEQ ID NO: 334569 - DNA, 75 bp, Artificial Sequence
  Synthetic
tcatacaacccatacttattgccattgacgttggcaggttactggatgacaacgaaggctaaacaacgaggagga

SEQ ID NO: 334570 - DNA, 75 bp, Artificial Sequence
  Synthetic
aagaaagaaagaaagccgaggtgggcaacggagtctttcggatcatggcaagagggttgctagggaaataccaag

SEQ ID NO: 334571 - DNA, 75 bp, Artificial Sequence
  Synthetic
caacggagtctttcggatcatggcaagagggttgctagggaaataccaagctggcgttggagtcatgcatgaggg

SEQ ID NO: 334572 - DNA, 75 bp, Artificial Sequence
  Synthetic
acgaacggggctgtcatccaagcgggagaaggaacactggtcccatattgggcgagtgtgcgcaacgacctaatc

SEQ ID NO: 334573 - DNA, 75 bp, Artificial Sequence
  Synthetic
ggaagcagtggaatggagtggacgaagtgcaagtcatcgttgtgcaaccaggtaaggaggttatgaatgtgcaga

SEQ ID NO: 334574 - DNA, 75 bp, Artificial Sequence
  Synthetic
agtgcaagtcatcgttgtgcaaccaggtaaggaggttatgaatgtgcagactcagccaggaattttcaaaactca

SEQ ID NO: 334575 - DNA, 75 bp, Artificial Sequence
  Synthetic
gatcacccataattgataaggaaggacaagtggttggcctttatggcaacgggatcttggtgggttcaggtgatt

SEQ ID NO: 334576 - DNA, 75 bp, Artificial Sequence
  Synthetic
gaagaaggaggaagaagttccccaggtgtttgatgaaaacatgttgcgtaaaaggcagctaacggttctggacct

SEQ ID NO: 334577 - DNA, 75 bp, Artificial Sequence
  Synthetic
gtgtttgatgaaaacatgttgcgtaaaaggcagctaacggttctggacctgcacccaggctcgggaaaaacccga

SEQ ID NO: 334578 - DNA, 75 bp, Artificial Sequence
  Synthetic
gtgcaattgacaaacggctaagaacagccgtcttggctccgacgcgggtggtggcagctgaaatagcggaagcac

SEQ ID NO: 334579 - DNA, 75 bp, Artificial Sequence
  Synthetic
agccgtcttggctccgacgcgggtggtggcagctgaaatagcggaagcactgaaagggctaccaatacggtatct

SEQ ID NO: 334580 - DNA, 75 bp, Artificial Sequence
  Synthetic
tcaccaggccttaaaagccttcaaggattttgcgagtggaaagagatcagcgatagggatccttgaggttttcag

SEQ ID NO: 334581 - DNA, 75 bp, Artificial Sequence
  Synthetic
accggcacggagatagtagacgtgatgtgccatgcaaccttgacagcgcggctgctcacaccacagcgagtgcca

SEQ ID NO: 334582 - DNA, 75 bp, Artificial Sequence
  Synthetic
gtggtggaattgtcttatgcaggtactgatgggccctgtagagttcccatatccatgtcggcagatctgaatgac

SEQ ID NO: 334583 - DNA, 75 bp, Artificial Sequence
  Synthetic
tgtgccatgcaaccttgacagcgcggctgctcacaccacagcgagtgccaaattacaacttatttatcatggatg

SEQ ID NO: 334584 - DNA, 75 bp, Artificial Sequence
  Synthetic
tcacaccatgtggcacgtgacgaacggggccgttattcaagcaggagaaggaacactggtcccatattgggcgag

SEQ ID NO: 334585 - DNA, 75 bp, Artificial Sequence
  Synthetic
cattgccgctagaggatacatatcaacaaaggtggaactgggagaggcagctgcaattttcatgactgctacacc

SEQ ID NO: 334586 - DNA, 75 bp, Artificial Sequence
  Synthetic
gacagtcgcctccatgggggtgttcttgttctttgttcagaggagaggcttagggaagacaggtcttggagctat

SEQ ID NO: 334587 - DNA, 75 bp, Artificial Sequence
  Synthetic
acaaaggtggaactgggagaggcagctgcaattttcatgactgctacacctccaggcacaactgacgcctttcca

SEQ ID NO: 334588 - DNA, 75 bp, Artificial Sequence
  Synthetic
ttgaagaacagattcctgatagagcttggaactccgggtatgagtggataacggattttcaaggaaggaccgtgt

SEQ ID NO: 334589 - DNA, 75 bp, Artificial Sequence
  Synthetic
ttggaactccgggtatgagtggataacggattttcaaggaaggaccgtgtggttcgttcccagcgtgaaatctgg

SEQ ID NO: 334590 - DNA, 75 bp, Artificial Sequence
  Synthetic
ttctctattgctgatgattgttctgatcccagaaccagagagacagagatcgcagacggatagtcacttggctgt

SEQ ID NO: 334591 - DNA, 75 bp, Artificial Sequence
  Synthetic
aaggccgggaagaaggtgatccagctaaataggaagagttttgactcagagtacccaaaatgcaagagtggagaa

SEQ ID NO: 334592 - DNA, 75 bp, Artificial Sequence
  Synthetic
taaataggaagagttttgactcagagtacccaaaatgcaagagtggagaatgggatttcgtgataactactgaca

SEQ ID NO: 334593 - DNA, 75 bp, Artificial Sequence
  Synthetic
agcgcagcgggtcatagatagtcggaagtgcatcaaaccggtgattattgaagatggagaaggaagcgtgcaaat

SEQ ID NO: 334594 - DNA, 75 bp, Artificial Sequence
  Synthetic
aagtgcatcaaaccggtgattattgaagatggagaaggaagcgtgcaaatgaatggcccagttcctataacatca

SEQ ID NO: 334595 - DNA, 75 bp, Artificial Sequence
  Synthetic
gagttggaagggatgtgacacagattggagacgaataccattactcaggaccaaccagtgaggatgaccatgact

SEQ ID NO: 334596 - DNA, 75 bp, Artificial Sequence
  Synthetic
gtgaacgtgaacacagtttgaacgttttttggatagagacaactatgtctaacaaaaaaccaggaagacccggct

SEQ ID NO: 334597 - DNA, 75 bp, Artificial Sequence
  Synthetic
tggagacgaataccattactcaggaccaaccagtgaggatgaccatgactttgcgcattggaaagaggccaagat

SEQ ID NO: 334598 - DNA, 75 bp, Artificial Sequence
  Synthetic
ggttgaagaaaatcctggaagatacaggaaaaccaatcagaggctgccgaacgttgatggagagctcatgtacgg

SEQ ID NO: 334599 - DNA, 75 bp, Artificial Sequence
  Synthetic
gatgggttggtcgcccagttgtatggcccggagcgggataaagttgatgcaattgatggggaatttaggctgagg

SEQ ID NO: 334600 - DNA, 75 bp, Artificial Sequence
  Synthetic
gcccggagcgggataaagttgatgcaattgatggggaatttaggctgaggaccgagcagaggaaacattttgtgg

SEQ ID NO: 334601 - DNA, 75 bp, Artificial Sequence
  Synthetic
tgtctggatatcgtacaaggtcgctgaagctgggataagttataatgataggcggtggtgctttgacgggccttc

SEQ ID NO: 334602 - DNA, 75 bp, Artificial Sequence
  Synthetic
gaagctgggataagttataatgataggcggtggtgctttgacgggccttcatgtaatactgtcctggaagacaac

SEQ ID NO: 334603 - DNA, 75 bp, Artificial Sequence
  Synthetic
caggtgagaagaaaaccttgaagccccggtggagggatggaagattatgggcagatcaccaggccttaaaggcct

SEQ ID NO: 334604 - DNA, 75 bp, Artificial Sequence
  Synthetic
ccggtggagggatggaagattatgggcagatcaccaggccttaaaggccttcaaggacttcgcaagcgggaagag

SEQ ID NO: 334605 - DNA, 75 bp, Artificial Sequence
  Synthetic
cacacaggatgacagaatccatggacaacatatacatgctgaccacagctgagaaaggaagcagagcgcacaggg

SEQ ID NO: 334606 - DNA, 75 bp, Artificial Sequence
  Synthetic
acttgaaacattcctactggtatttatgatgacagtcgcctctatgggggtgttcctattttttgtccagaggag

SEQ ID NO: 334607 - DNA, 75 bp, Artificial Sequence
  Synthetic
atgatgacagtcgcctctatgggggtgttcctattttttgtccagaggagaggtctggggaagacaggccttgga

SEQ ID NO: 334608 - DNA, 75 bp, Artificial Sequence
  Synthetic
tgttgttgtgggtggcagaagtcccggcccagaagatagctggcgtgcttctaatttctctgctgctgatgattg

SEQ ID NO: 334609 - DNA, 75 bp, Artificial Sequence
  Synthetic
ggcccagaagatagctggcgtgcttctaatttctctgctgctgatgattgtcttgattccggagccagagagaca

SEQ ID NO: 334610 - DNA, 75 bp, Artificial Sequence
  Synthetic
gccgtgtttatgatcattgtcttgttagtggtgggcgccgtggcgtcaaatgaaatgggctggctagagcaaaca

SEQ ID NO: 334611 - DNA, 75 bp, Artificial Sequence
  Synthetic
tagtggtgggcgccgtggcgtcaaatgaaatgggctggctagagcaaacaaaaaaggacttgtcaactctgtttg

SEQ ID NO: 334612 - DNA, 75 bp, Artificial Sequence
  Synthetic
aacttggagcgtgccttggccagacttgagaccagcgacggcatgggcagcctatgctggagctaccacattcct

SEQ ID NO: 334613 - DNA, 75 bp, Artificial Sequence
  Synthetic
ttgagaccagcgacggcatgggcagcctatgctggagctaccacattcctgactcctttgctgaaacacctcata

SEQ ID NO: 334614 - DNA, 75 bp, Artificial Sequence
  Synthetic
tcatggcaatgacggcacaggctggagcactatttggactaggaaaaggcatgccctttgtcaaagcggatttgt

SEQ ID NO: 334615 - DNA, 75 bp, Artificial Sequence
  Synthetic
agcactatttggactaggaaaaggcatgccctttgtcaaagcggatttgtcagtgcccctgcttctcttagggtg

SEQ ID NO: 334616 - DNA, 75 bp, Artificial Sequence
  Synthetic
acggtttcggcagtcatgatggtcatattgcactatgcatttttggtgccaggctggcaggcagaagccatgagg

SEQ ID NO: 334617 - DNA, 75 bp, Artificial Sequence
  Synthetic
tattgcactatgcatttttggtgccaggctggcaggcagaagccatgaggtcagcccagaggagaacagccgcag

SEQ ID NO: 334618 - DNA, 75 bp, Artificial Sequence
  Synthetic
gaccttgaggccagcactcccattacggaaaagaaattgggtcaatgtgtgttagtgggaacagctttggtggcg

SEQ ID NO: 334619 - DNA, 75 bp, Artificial Sequence
  Synthetic
ccttgaccgagtttggaatgctgacctccacagcctcagtgacactcattgaaggagccgcaggtcgtatctgga

SEQ ID NO: 334620 - DNA, 75 bp, Artificial Sequence
  Synthetic
ctccacagcctcagtgacactcattgaaggagccgcaggtcgtatctggaatgcaaccacggctgttgccatgtg

SEQ ID NO: 334621 - DNA, 75 bp, Artificial Sequence
  Synthetic
gctggggcctctctagcgtggaccataacccggaatcttcaggcagggaccttacgtagaggagggggggctggc

SEQ ID NO: 334622 - DNA, 75 bp, Artificial Sequence
  Synthetic
taacccggaatcttcaggcagggaccttacgtagaggagggggggctggcaggaccttgggggaggcatggaagg

SEQ ID NO: 334623 - DNA, 75 bp, Artificial Sequence
  Synthetic
gatgtggaactttgttggcagaaacaaacaaccaaggatgtgtacaaaagaagagttcatagagaaggtgaatag

SEQ ID NO: 334624 - DNA, 75 bp, Artificial Sequence
  Synthetic
aaacaaccaaggatgtgtacaaaagaagagttcatagagaaggtgaatagtaacgcagccctgggggccatgttt

SEQ ID NO: 334625 - DNA, 75 bp, Artificial Sequence
  Synthetic
agagtttatggaataccggaaagatgggattattgaagtagatagagccgcggcaaaaagagcccgccgtgaagg

SEQ ID NO: 334626 - DNA, 75 bp, Artificial Sequence
  Synthetic
gggattattgaagtagatagagccgcggcaaaaagagcccgccgtgaagggaatgtgacaggagggcatccagtc

SEQ ID NO: 334627 - DNA, 75 bp, Artificial Sequence
  Synthetic
ggcttgtggaacgtgggttcctcaaaccaagaggcagagttgtggacctaggctgtggccgaggaggctggagct

SEQ ID NO: 334628 - DNA, 75 bp, Artificial Sequence
  Synthetic
accaagaggcagagttgtggacctaggctgtggccgaggaggctggagctattactgcgccactttaaagcaagt

SEQ ID NO: 334629 - DNA, 75 bp, Artificial Sequence
  Synthetic
gtgaagttggagctgtgttcctcgattacccaacgggaacctctggatcacccattattgacaaggaaggacagg

SEQ ID NO: 334630 - DNA, 75 bp, Artificial Sequence
  Synthetic
ggagggccagggcatgaggaaccagtaatgactcaaagctatggctggaatattgtgacattgaagagtggggtc

SEQ ID NO: 334631 - DNA, 75 bp, Artificial Sequence
  Synthetic
taatgactcaaagctatggctggaatattgtgacattgaagagtggggtcaacgtccattttaaaccaactgagc

SEQ ID NO: 334632 - DNA, 75 bp, Artificial Sequence
  Synthetic
aggcgttgaaggacttggactccaaaaattggggtatgtgctgcgtgacatctcggccaaagaaggaggacttat

SEQ ID NO: 334633 - DNA, 75 bp, Artificial Sequence
  Synthetic
aggtgaatcgtcacccgttccagaaatcgaatctgccaggacgatacgagtactgcagatggccgaggaatggct

SEQ ID NO: 334634 - DNA, 75 bp, Artificial Sequence
  Synthetic
atcgaatctgccaggacgatacgagtactgcagatggccgaggaatggctagccaggggagttgaagagttctgt

SEQ ID NO: 334635 - DNA, 75 bp, Artificial Sequence
  Synthetic
cagcagtcataaaagagttggaaaaattgcagttgaaatggggaggtggcttagtcagggtaccactctcgcgca

SEQ ID NO: 334636 - DNA, 75 bp, Artificial Sequence
  Synthetic
attgcagttgaaatggggaggtggcttagtcagggtaccactctcgcgcaactccacgcatgagatgtattgggt

SEQ ID NO: 334637 - DNA, 75 bp, Artificial Sequence
  Synthetic
aacagcgtcaatacagtgagccaaatgctaatcaacagaatgcatagaactaaccgcaatggacccaggtatgaa

SEQ ID NO: 334638 - DNA, 75 bp, Artificial Sequence
  Synthetic
tgctaatcaacagaatgcatagaactaaccgcaatggacccaggtatgaagaagatgcagatttgggttcaggga

SEQ ID NO: 334639 - DNA, 75 bp, Artificial Sequence
  Synthetic
gaggactgattgggaaatggtcgctgatagagtgaagaatttagctaaagaatatgctccatcctggcattatga

SEQ ID NO: 334640 - DNA, 75 bp, Artificial Sequence
  Synthetic
gatagagtgaagaatttagctaaagaatatgctccatcctggcattatgaccaagacaacccctataagacctgg

SEQ ID NO: 334641 - DNA, 75 bp, Artificial Sequence
  Synthetic
aaggtgaggaaagatactcaggaatggaagccctcaaccggttggagaaactggcaagaagtccccttttgctca

SEQ ID NO: 334642 - DNA, 75 bp, Artificial Sequence
  Synthetic
aggccacaggctcagccagctcaatggtcaatggagttgttagaatcctgtcaaaaccctgggacactttgcaga

SEQ ID NO: 334643 - DNA, 75 bp, Artificial Sequence
  Synthetic
ggtcaatggagttgttagaatcctgtcaaaaccctgggacactttgcagaatgtggtgaacatggccatgacgga

SEQ ID NO: 334644 - DNA, 75 bp, Artificial Sequence
  Synthetic
gtgttcaaagaaaaggttgacaccaaagctccggaaccccccgcaggaactgccagagtcatgaacatcgtggca

SEQ ID NO: 334645 - DNA, 75 bp, Artificial Sequence
  Synthetic
aagctccggaaccccccgcaggaactgccagagtcatgaacatcgtggcaagatggatgtgggactttgttggta

SEQ ID NO: 334646 - DNA, 75 bp, Artificial Sequence
  Synthetic
aaaagaagagtttatagaaaaagtgaacagcaatgcagccctaggggctatgtttgaggagcaacataaatggac

SEQ ID NO: 334647 - DNA, 75 bp, Artificial Sequence
  Synthetic
aacagcaatgcagccctaggggctatgtttgaggagcaacataaatggaccagtgctagggaagcagttgaagat

SEQ ID NO: 334648 - DNA, 75 bp, Artificial Sequence
  Synthetic
gggaaagagaactgcacctacagggaaagtgtgagacttgcatttacaacatgatgggaaagcgagaaaagaaga

SEQ ID NO: 334649 - DNA, 75 bp, Artificial Sequence
  Synthetic
aaagtgtgagacttgcatttacaacatgatgggaaagcgagaaaagaagatgggggagttcggaaaagcaaaagg

SEQ ID NO: 334650 - DNA, 75 bp, Artificial Sequence
  Synthetic
gtgccataccttggaaagagggaagatggctggtgtggtagtctgattgggcatcgagctagatctacctgggcc

SEQ ID NO: 334651 - DNA, 75 bp, Artificial Sequence
  Synthetic
cttggggccagatttctggagtttgaagctttagggttcttgaatgaggaccattggatgagcagggagaacacc

SEQ ID NO: 334652 - DNA, 75 bp, Artificial Sequence
  Synthetic
aagctttagggttcttgaatgaggaccattggatgagcagggagaacaccaggggaggtgttgaaggacttggac

SEQ ID NO: 334653 - DNA, 75 bp, Artificial Sequence
  Synthetic
tgacatctcagctaaggaagggggacttatgtatgctgatgacacagccgggtgggatactagaataaccaaggc

SEQ ID NO: 334654 - DNA, 75 bp, Artificial Sequence
  Synthetic
gctggagtgaaggtgtcttgtaaatacatgaggtaggcgtaaaaaaaaaaatgtatataaagtagtgttagttta

SEQ ID NO: 334655 - DNA, 75 bp, Artificial Sequence
  Synthetic
cttatgtatgctgatgacacagccgggtgggatactagaataaccaaggcggacctggaaaatgaggccataatt

SEQ ID NO: 334656 - DNA, 75 bp, Artificial Sequence
  Synthetic
gggccgttgcggaaccactcatcaaatttgcctatatgaataaggtggtgaaggtgatgcggccgggacgtgatg

SEQ ID NO: 334657 - DNA, 75 bp, Artificial Sequence
  Synthetic
atttgcctatatgaataaggtggtgaaggtgatgcggccgggacgtgatgggaaaacagttatggatgtcatttc

SEQ ID NO: 334658 - DNA, 75 bp, Artificial Sequence
  Synthetic
caggtcgtgacttatgccctcaacactttcacgaatctttgcgtccaacttattaggtgcatggagggggaggag

SEQ ID NO: 334659 - DNA, 75 bp, Artificial Sequence
  Synthetic
ctttcacgaatctttgcgtccaacttattaggtgcatggagggggaggagctactgctccccgaagagacggaac

SEQ ID NO: 334660 - DNA, 75 bp, Artificial Sequence
  Synthetic
catccaagagtggctccaaaagaatggagagaataggttgtcggctatggctgtcagtggagacgattgtgtggt

SEQ ID NO: 334661 - DNA, 75 bp, Artificial Sequence
  Synthetic
ggagagaataggttgtcggctatggctgtcagtggagacgattgtgtggtgaaaccagcagatgacagattcgcc

SEQ ID NO: 334662 - DNA, 75 bp, Artificial Sequence
  Synthetic
aatccgctagcgcggataaagaggacgattgatggggtcctgagaggagcaggacccataaggtttgtgctggct

SEQ ID NO: 334663 - DNA, 75 bp, Artificial Sequence
  Synthetic
tgtctaaggtaaggaaggacactcaagaatggaagccctcaaccggttggagaaactggcaggaagtccccttct

SEQ ID NO: 334664 - DNA, 75 bp, Artificial Sequence
  Synthetic
agaatggaagccctcaaccggttggagaaactggcaggaagtccccttctgttcgcaccatttccatgagttgca

SEQ ID NO: 334665 - DNA, 75 bp, Artificial Sequence
  Synthetic
ctactgactttcttcaagtttacagccctgaggccaaccattggaatgctgaagagatggaagctggttggagtc

SEQ ID NO: 334666 - DNA, 75 bp, Artificial Sequence
  Synthetic
gtcccatgtcgagatcaggatgaattaattggaagagctaggctctcgccaggttctggttggtcgctaacagaa

SEQ ID NO: 334667 - DNA, 75 bp, Artificial Sequence
  Synthetic
taattggaagagctaggctctcgccaggttctggttggtcgctaacagaaacagcatgcctgagcaaagcatatg

SEQ ID NO: 334668 - DNA, 75 bp, Artificial Sequence
  Synthetic
ccacaggagggaccttagactgatggcaaatgcgatctgttcatctgtccctgtatcatgggttcccacagggag

SEQ ID NO: 334669 - DNA, 75 bp, Artificial Sequence
  Synthetic
gcaaatgcgatctgttcatctgtccctgtatcatgggttcccacagggagaacaacgtggtcaattcatggaaag

SEQ ID NO: 334670 - DNA, 75 bp, Artificial Sequence
  Synthetic
agcaatggatgcgtcgtacgtgctctagatgtgggactaatgtgtcaggatgacataacgtatctgtgcccaaag

SEQ ID NO: 334671 - DNA, 75 bp, Artificial Sequence
  Synthetic
tgctcgcggtgtggaatagagtgtggattgaagaaaatgaatacatggaagacaagaccccagtaacctcatgga

SEQ ID NO: 334672 - DNA, 75 bp, Artificial Sequence
  Synthetic
gattgaagaaaatgaatacatggaagacaagaccccagtaacctcatggaatgaaataccataccttggaaagag

SEQ ID NO: 334673 - DNA, 75 bp, Artificial Sequence
  Synthetic
atcggtcaccgagctagatccacctgggccgagaatatatacaccccaatcatgcagatcagagccctcatcggc

SEQ ID NO: 334674 - DNA, 75 bp, Artificial Sequence
  Synthetic
tcaccatggagagagtctacttgaggccaagaacacgccgtggatggattcgaccaaagccactaaatatctcac

SEQ ID NO: 334675 - DNA, 75 bp, Artificial Sequence
  Synthetic
cccgagcactatgtggattacatgccaaccctcaataggttcaaacctattgaaagctggagtgagggcgtcttg

SEQ ID NO: 334676 - DNA, 75 bp, Artificial Sequence
  Synthetic
ggccaaccattggaatgctgaagagatggaagctggttggagttaatgaggcgaccaaacatctgaaaagcttca

SEQ ID NO: 334677 - DNA, 75 bp, Artificial Sequence
  Synthetic
tgtgagatcttactgctatgagccgaaagtgtcggacgtgacgacagaatccagatgcccaaccatgggagaggc

SEQ ID NO: 334678 - DNA, 75 bp, Artificial Sequence
  Synthetic
gttgcagttttcatacatggttccacggaagcgagcacctaccacaattattcagcccagcagtcgctgaaacat

SEQ ID NO: 334679 - DNA, 75 bp, Artificial Sequence
  Synthetic
ggaggattatggtaccgtcacactcgaatgtgaaccccgatctggggttgacatggggcaattctatgtttttac

SEQ ID NO: 334680 - DNA, 75 bp, Artificial Sequence
  Synthetic
tgaaaggaatgacctacccgatgtgtagcaatacattttccctagtgaagaatcctaccgacactgggcatggca

SEQ ID NO: 334681 - DNA, 75 bp, Artificial Sequence
  Synthetic
aatcctaccgacactgggcatggcactgtcgtggtggaattgtcttatgcaggtaccgatgggccctgtagagtt

SEQ ID NO: 334682 - DNA, 75 bp, Artificial Sequence
  Synthetic
aagaatggctccaaaagaatggagagaacaggttgtcagccatggcagtcagtggggatgattgtgtggtgaaac

SEQ ID NO: 334683 - DNA, 75 bp, Artificial Sequence
  Synthetic
cccatatccatgtcggcagatctgaatgacatgacaccagttggacgcttgataacagtcaacccatacgtgtcg

SEQ ID NO: 334684 - DNA, 75 bp, Artificial Sequence
  Synthetic
acctcctccacgggtgccaagataatggtggaagtggaacctccattcggggattcattcatcttagtaggaagt

SEQ ID NO: 334685 - DNA, 75 bp, Artificial Sequence
  Synthetic
tggtggaagtggaacctccattcggggattcattcatcttagtaggaagtggaaaaggacagatcaggtaccagt

SEQ ID NO: 334686 - DNA, 75 bp, Artificial Sequence
  Synthetic
ggacaacattaacatgccagatgggctggttgcccagttgtacggcccagagcgggacaaggttgatgcaattga

SEQ ID NO: 334687 - DNA, 75 bp, Artificial Sequence
  Synthetic
atgttgggggcactgctattgtggatggggctgaatgcaagggacagatccatttctatgacttttctagccgta

SEQ ID NO: 334688 - DNA, 75 bp, Artificial Sequence
  Synthetic
ttaatcaactgacccggcaagagtttatggaataccggaaagacgggattattgaagtagatagagctgctgcaa

SEQ ID NO: 334689 - DNA, 75 bp, Artificial Sequence
  Synthetic
acaccaaggagacttgccaaagtcgtggcagaagctcatgaggctggaatttgtggcatacgatcagtcagcagg

SEQ ID NO: 334690 - DNA, 75 bp, Artificial Sequence
  Synthetic
ccaaaaactaaagagtgcccagatgagagaagagcatggaatagtatgaagattgaagactttgggtttggagtg

SEQ ID NO: 334691 - DNA, 75 bp, Artificial Sequence
  Synthetic
gattgaagactttgggtttggagtgttgtccacaaaggtatggatggaaatgcgaacagaaaatacaactgattg

SEQ ID NO: 334692 - DNA, 75 bp, Artificial Sequence
  Synthetic
agtcatgcacatggccggaaacccacacactgtggagtgacagcgttgtggagagtgaactcatcatacctaaaa

SEQ ID NO: 334693 - DNA, 75 bp, Artificial Sequence
  Synthetic
agaagttcatctgtgtgaacttattccaaacagtttttgggatagtgcgtgtgaacgtaaacacagtttgaacgt

SEQ ID NO: 334694 - DNA, 75 bp, Artificial Sequence
  Synthetic
cagcccaggagattttgagaaggcgcatgacggctccaattgcttggtcagcgctgctgttgctgatggctttgg

SEQ ID NO: 334695 - DNA, 75 bp, Artificial Sequence
  Synthetic
ggatgtgtcgtgcgagctctagatgtgggactgatgtgtcaggatgacataacgtacctgtgcccaaagttggag

SEQ ID NO: 334696 - DNA, 75 bp, Artificial Sequence
  Synthetic
agaagtttatctgtgtgaacttattccaaacagttttttggagtagtgcgtgtgaacgtaaacacagtttgaacg

SEQ ID NO: 334697 - DNA, 75 bp, Artificial Sequence
  Synthetic
cagccaggtttactgattggattcctactgaggaggaagtggagcaatcaggaaagcagattgcttggcgttgcg

SEQ ID NO: 334698 - DNA, 75 bp, Artificial Sequence
  Synthetic
tactgaggaggaagtggagcaatcaggaaagcagattgcttggcgttgcgttagcactcataacagtggcaatga

SEQ ID NO: 334699 - DNA, 75 bp, Artificial Sequence
  Synthetic
agggaggcatgctcctgggagtggcatgcgctaccgctggaatcgctagccctttggtgtttgctggtctgcaca

SEQ ID NO: 334700 - DNA, 75 bp, Artificial Sequence
  Synthetic
tacaaagagctggcttgttaacagagactggtttcatgacctcaacttaccatggacagggtcatcagcggggac

SEQ ID NO: 334701 - DNA, 75 bp, Artificial Sequence
  Synthetic
tcgaactgggcttattctgttatcttcatacaacccatacttcctgccactgactctggcaggttactggatgac

SEQ ID NO: 334702 - DNA, 75 bp, Artificial Sequence
  Synthetic
acacattttccctagtgaagaatcctaccgacactgggcatggcactgttgtggtggaattgtcttatgcaggta

SEQ ID NO: 334703 - DNA, 75 bp, Artificial Sequence
  Synthetic
aagtggaacctccattcggggattcatttattttagtaggaagtggaaaaggacagattaggtaccagtggcata

SEQ ID NO: 334704 - DNA, 75 bp, Artificial Sequence
  Synthetic
ggaatcctggtgggttcaggcgattttgtcagtatgatcactcaaggggagaagaaggaagaagaagttcctcag

SEQ ID NO: 334705 - DNA, 75 bp, Artificial Sequence
  Synthetic
acatccaggttcaggaaagaccagaaaggtcctccccatgattctgaagagcgccattgacaaacgattaagaac

SEQ ID NO: 334706 - DNA, 75 bp, Artificial Sequence
  Synthetic
ttacaagtactatccatccacaccaaggagacttgccaaagtcgtggcagaagctcatgaggctggaatttgtgg

SEQ ID NO: 334707 - DNA, 75 bp, Artificial Sequence
  Synthetic
tgtgtcacgcgactttgacagcgcggctgctcacacctcagcgagtgccgaattacaacttgttcattatggatg

SEQ ID NO: 334708 - DNA, 75 bp, Artificial Sequence
  Synthetic
ttggaattctgggtatgagtggataacagactttcaaggaaagactgtatggtttgtccccagcgtgaagtctgg

SEQ ID NO: 334709 - DNA, 75 bp, Artificial Sequence
  Synthetic
gaatggaccagttcctataacatcagccagtgcagcccagcgtcgtggacgggttggaagggatgtaacacaaat

SEQ ID NO: 334710 - DNA, 75 bp, Artificial Sequence
  Synthetic
gggttggaagggatgtaacacaaattggagatgaataccactactcaggaccaaccagcgaggatgatcatgatt

SEQ ID NO: 334711 - DNA, 75 bp, Artificial Sequence
  Synthetic
tgggatggaaattcggccaattgtccacggagacgacatgttgatcaaatcaaaggtcatggcttttcaaggggg

SEQ ID NO: 334712 - DNA, 75 bp, Artificial Sequence
  Synthetic
gatgggctggttgcccagttgtacggcccagagcgggacaaggttgacgcaattgatggggaattcagactgagg

SEQ ID NO: 334713 - DNA, 75 bp, Artificial Sequence
  Synthetic
gcccagagcgggacaaggttgacgcaattgatggggaattcagactgaggactgagcagaggaaacactttgtgg

SEQ ID NO: 334714 - DNA, 75 bp, Artificial Sequence
  Synthetic
ctgttgctgatggctttggtcctgtttggaggaatcacgtacagtgatctggtcaagtacgtcatcctagtggca

SEQ ID NO: 334715 - DNA, 75 bp, Artificial Sequence
  Synthetic
aggtggtgacattgtgcacttggccatggtggctgcttttaacatccagccaggtttactgattggattcctact

SEQ ID NO: 334716 - DNA, 75 bp, Artificial Sequence
  Synthetic
atcagcgatagggatccttgaggttttcagaatgcttcctgaccacttcgctcacagaatgacagaatccatgga

SEQ ID NO: 334717 - DNA, 75 bp, Artificial Sequence
  Synthetic
atgatgacagtcgcctccatgggggtgttcttgttctttgttcagaggagaggcttagggaagacaggtcttgga

SEQ ID NO: 334718 - DNA, 75 bp, Artificial Sequence
  Synthetic
aagaaggacttgtcagctctgttcgggaggaaaagcgatagtcatcaagaaacctggagcatgccttggccggat

SEQ ID NO: 334719 - DNA, 75 bp, Artificial Sequence
  Synthetic
ttgagaccagcgacggcatgggcggcctacgcaggagctacaacatttctgactcccttgctaaaacacctcata

SEQ ID NO: 334720 - DNA, 75 bp, Artificial Sequence
  Synthetic
cctacgcaggagctacaacatttctgactcccttgctaaaacacctcataataacagagtatgtgaacttttcac

SEQ ID NO: 334721 - DNA, 75 bp, Artificial Sequence
  Synthetic
agcactatttggactagggaaaggcatgccttttgtcaaagcagacttgtcagtacccctgctactcttagggtg

SEQ ID NO: 334722 - DNA, 75 bp, Artificial Sequence
  Synthetic
tactgcattatgcatttttggtgccaggctggcaagcagaagccatgaggtcggcccagaggagaactgctgcag

SEQ ID NO: 334723 - DNA, 75 bp, Artificial Sequence
  Synthetic
tggcatagtggctacagatgttccagaccttgaagccagcactcctattacagagaagaaattgggtcaatgtgt

SEQ ID NO: 334724 - DNA, 75 bp, Artificial Sequence
  Synthetic
attacccaacgggaacctctggatcacctatcattgacaaggaaggacaggtggttggcctctatggtaatggaa

SEQ ID NO: 334725 - DNA, 75 bp, Artificial Sequence
  Synthetic
acttcacagaccctgccagtattgctgccagaggatatatatcaacaaaggtggaactgggagaggcagctgcaa

SEQ ID NO: 334726 - DNA, 75 bp, Artificial Sequence
  Synthetic
tcaggaagtgagaggttacacaaaaggagggccagggcatgaggaaccagtgatgacccagagctatggctggaa

SEQ ID NO: 334727 - DNA, 75 bp, Artificial Sequence
  Synthetic
agctaggggcgttgaagagttctgcataaaagtgctttgtccctacatgccagcggtcataaaagaattggaaag

SEQ ID NO: 334728 - DNA, 75 bp, Artificial Sequence
  Synthetic
atacatgctgactacagctgagaaagggagtagggcccacagagaagccctggaggaactgcctgagacacttga

SEQ ID NO: 334729 - DNA, 75 bp, Artificial Sequence
  Synthetic
gaaacaaacaaccgaggatgtgtacaaaagaagagttcatagagaaggtgaatagtaacgcagccctgggggcca

SEQ ID NO: 334730 - DNA, 75 bp, Artificial Sequence
  Synthetic
aatagtaacgcagccctgggggccatgtttgaggagcaacacaaatgggccagcgccagggaagcggttgaggat

SEQ ID NO: 334731 - DNA, 75 bp, Artificial Sequence
  Synthetic
agtggctacagatgttccagaccttgaggccagcactcctattacagaaaagaaattgggtcaatgcgtgctagt

SEQ ID NO: 334732 - DNA, 75 bp, Artificial Sequence
  Synthetic
ctaacaccaaacacgctaactttgaccgagtttggaatgttgacctctgccgcttcggtgacattaattgaggga

SEQ ID NO: 334733 - DNA, 75 bp, Artificial Sequence
  Synthetic
aaaggaggtgttgaaggacttggactccaaaaattggggtatgtgctgcgtgacatctcggccaaagaaggagga

SEQ ID NO: 334734 - DNA, 75 bp, Artificial Sequence
  Synthetic
ttggaaaagatggaaccaatgcacagagctgtcgcagaaccactcattaaatttgcctacatgaataaggtggtg

SEQ ID NO: 334735 - DNA, 75 bp, Artificial Sequence
  Synthetic
cattagatgtatggaaggggaggagttgctgctccccgaggaaacagagcgcctaaagaaaggaaaggaaaagcg

SEQ ID NO: 334736 - DNA, 75 bp, Artificial Sequence
  Synthetic
agagtgccactctcgcgcaattcaacgcatgagatgtactgggtgagcggctcaagtgggaatgtgacaaatagt

SEQ ID NO: 334737 - DNA, 75 bp, Artificial Sequence
  Synthetic
acagcatgcctgagcaaagcatacgctcagatgtggttattgatgtacttccacaggagggacctcagactaatg

SEQ ID NO: 334738 - DNA, 75 bp, Artificial Sequence
  Synthetic
gcaaacgccatctgctcatctgtccctgtctcatgggtccccacaggaaggacaacgtggtcaatccatggaaaa

SEQ ID NO: 334739 - DNA, 75 bp, Artificial Sequence
  Synthetic
ggaagatggctggtgtggtagtctgattggacatcgagctagatccacctgggccgagaacatatacaccccaat

SEQ ID NO: 334740 - DNA, 75 bp, Artificial Sequence
  Synthetic
cgaccgcttcggtgacactaattgagggagctgcaggtcgtatttggaacgcaactaccgctgttgctatgtgcc

SEQ ID NO: 334741 - DNA, 75 bp, Artificial Sequence
  Synthetic
cctgagcgctatgtagattacatgccaactctaaacaggttcaaacccattgaaagctggagtgaaggtgtcttg

SEQ ID NO: 334742 - DNA, 75 bp, Artificial Sequence
  Synthetic
agaagttcatctgtgtgaacttattccaaacagttttttgggatagtgcgtgtgaacgtaaacacagtttgaacg

SEQ ID NO: 334743 - DNA, 75 bp, Artificial Sequence
  Synthetic
ctgggctgaaacttggaaattataatggtagagttttggccactttaaacaagactgatgtgtcagacttgctag

SEQ ID NO: 334744 - DNA, 75 bp, Artificial Sequence
  Synthetic
agaaaggaaaggagaagcgcatccaagaatggctccaaaagaatggagagaacaggttgtcagccatggcagtca

SEQ ID NO: 334745 - DNA, 75 bp, Artificial Sequence
  Synthetic
tgggtacgcccttgctgccatcttcataggctggaacttgggaacgacgagaagccagaagataattttcacaat

SEQ ID NO: 334746 - DNA, 75 bp, Artificial Sequence
  Synthetic
aaagcagaaggcaggatcgtgcagaaggaaaacgtccagtttgaagttgcagtttttatacatggttccacggaa

SEQ ID NO: 334747 - DNA, 75 bp, Artificial Sequence
  Synthetic
tgccataccttggaaagagggaagatggctggtgtggtagtctgattggacaccgagccagatccacctgggccg

SEQ ID NO: 334748 - DNA, 75 bp, Artificial Sequence
  Synthetic
gcgagcacctaccacaattattcagcccagcagtcgctgaaacatgccgctagattcgtgataacgcccaaaagt

SEQ ID NO: 334749 - DNA, 75 bp, Artificial Sequence
  Synthetic
taaataggttcaaacccattgaaagctggagtgaaggtgttttgtaaatatatgaggtaggtgtaaaaatgtatg

SEQ ID NO: 334750 - DNA, 75 bp, Artificial Sequence
  Synthetic
tgaaaccagcagatgacagattcgccacagcactgcacttcctcaacagcatgtctaaggtgaggaaagatactc

SEQ ID NO: 334751 - DNA, 75 bp, Artificial Sequence
  Synthetic
ccagcagtcgctgaaacatgccgctagattcgttataacgcccaaaagtcccgtctacactgctgagatggagga

SEQ ID NO: 334752 - DNA, 75 bp, Artificial Sequence
  Synthetic
ccgtctacactgctgagatggaggattatggtaccgtcacactcgaatgtgaaccccgatctggggttgacatgg

SEQ ID NO: 334753 - DNA, 75 bp, Artificial Sequence
  Synthetic
catttattttagtaggaagtggaaaaggacagattaggtaccagtggcatagaagtgggagtacaattggaaaag

SEQ ID NO: 334754 - DNA, 75 bp, Artificial Sequence
  Synthetic
cacattttccctagtgaagaatcctaccgacactgggcatggcactgtcgtggtggaattgtcttatgcaggtac

SEQ ID NO: 334755 - DNA, 75 bp, Artificial Sequence
  Synthetic
ctatgacctttctagtcgtaggaggaattttagtcttcttggcagtaaatgtcaatgccgacacggggtgctcaa

SEQ ID NO: 334756 - DNA, 75 bp, Artificial Sequence
  Synthetic
ccaactttaaacaggttcaaacccattgaaagctggagtgaaggtgtcttgtaaatacatgaggtaggtgtaaaa

SEQ ID NO: 334757 - DNA, 75 bp, Artificial Sequence
  Synthetic
ttgaaagctggagtgaaggtgtcttgtaaatacatgaggtaggtgtaaaaaatgtatataaagtagtgttagttt

SEQ ID NO: 334758 - DNA, 75 bp, Artificial Sequence
  Synthetic
ccctgagcactatgtggattacatgccaactttaaacaggttcaaacccattgaaagctggagtgaaggtgtctt

SEQ ID NO: 334759 - DNA, 75 bp, Artificial Sequence
  Synthetic
gcatacgatcagtcagcaggcttgagcacaatatgtgggtaagcatcaaacatgagttgaatgcgatcttggaag

SEQ ID NO: 334760 - DNA, 75 bp, Artificial Sequence
  Synthetic
tttagcagcccgaagatgtcaaataatacatttgtcattgatggaccaaaaactagagagtgcccagatgagaga

SEQ ID NO: 334761 - DNA, 75 bp, Artificial Sequence
  Synthetic
ctgagctattggatagagagcaagaataatggaagctggaaactggagagggctgtgttgggcgaggtgaagtca

SEQ ID NO: 334762 - DNA, 75 bp, Artificial Sequence
  Synthetic
ctggaacaactgtcacagtaacgagctcgtgccgcgacagagggccttcagctaggacaacaacagcgagtggga

SEQ ID NO: 334763 - DNA, 75 bp, Artificial Sequence
  Synthetic
gctaggacaacaacagcgagtgggaaattgataacagattggtgttgtaggtcttgcaccatcccaccactgaga

SEQ ID NO: 334764 - DNA, 75 bp, Artificial Sequence
  Synthetic
agctgcatttgctgagagcaatacaggtggtgacattgtgcacttggccatggtggctgcttttaacattcagcc

SEQ ID NO: 334765 - DNA, 75 bp, Artificial Sequence
  Synthetic
taaactccggagccatggcctggctcttgctgagagccgtgtttgaagggacggttagctcctttgccctgccgc

SEQ ID NO: 334766 - DNA, 75 bp, Artificial Sequence
  Synthetic
atggaagctggttggagtcaatgaggcgaccaaacatttgaaaagcttcaagcgtgacattggacagatgctcga

SEQ ID NO: 334767 - DNA, 75 bp, Artificial Sequence
  Synthetic
tcgctcggcgtttgggcctttcgaactgggcttattctgctatcttcatacaacccatatttcctgccattgact

SEQ ID NO: 334768 - DNA, 75 bp, Artificial Sequence
  Synthetic
aggaagagagccgaagtaggcaatggagttttccgaattatggcaagaggactgttaggaaaataccaggctggg

SEQ ID NO: 334769 - DNA, 75 bp, Artificial Sequence
  Synthetic
aacaatcagtggtggctttggcatcacaagaaggagccctccatgcagcattggcgggagctattccagtgaggt

SEQ ID NO: 334770 - DNA, 75 bp, Artificial Sequence
  Synthetic
tggttggcctctatggtaatggaattctggtgggttcaggcgattttgtcagcatgattactcaaggggagaaga

SEQ ID NO: 334771 - DNA, 75 bp, Artificial Sequence
  Synthetic
ggacagatcaggtaccagtggcatagaagtgggagcacaattggaaaagctttcacgtcaacactcaaaggagca

SEQ ID NO: 334772 - DNA, 75 bp, Artificial Sequence
  Synthetic
ctttcaaggaaagactgtatggtttgtccccagcgtgaagtctggtaatgagatcgccgtgtgcttgacaaaggc

SEQ ID NO: 334773 - DNA, 75 bp, Artificial Sequence
  Synthetic
aggaagagttttgactcagagtatcctaagtgcaagagtggagaatgggatttcgtgataaccactgacatctca

SEQ ID NO: 334774 - DNA, 75 bp, Artificial Sequence
  Synthetic
gaccagttccaataacatcagccagtgcagcccagcgtcgtggacgggttggaagggatgtgacacaaattggag

SEQ ID NO: 334775 - DNA, 75 bp, Artificial Sequence
  Synthetic
agtggaaacaggcagcaaagatggcttccaaccaccctgtaaggtcgttcagcgaggtctgctgtgccgaggcaa

SEQ ID NO: 334776 - DNA, 75 bp, Artificial Sequence
  Synthetic
tgcacaggagcactagccatgaggatcttcaaccaagcatacaaatactcctacatggccttaggtgtgaacagg

SEQ ID NO: 334777 - DNA, 75 bp, Artificial Sequence
  Synthetic
gagcagcaatcatacagatggaaaacaaccctgatgaaacagtgtgcaacaggatttggaagattcacagagatc

SEQ ID NO: 334778 - DNA, 75 bp, Artificial Sequence
  Synthetic
agaaccaggtttctagaagaaaacaacataataccacttcttaccaatcagggagcaccaccagtccacagcttc

SEQ ID NO: 334779 - DNA, 75 bp, Artificial Sequence
  Synthetic
tacagtcaagcaacctcactactacagtgcaagttatgatggtataccggttcatctcaaagagggtgcctgaag

SEQ ID NO: 334780 - DNA, 75 bp, Artificial Sequence
  Synthetic
tcgaccatgcacctagatgaaattgcactccgaagacacctgggcctcatagacgaagacaccatcaggaggatc

SEQ ID NO: 334781 - DNA, 75 bp, Artificial Sequence
  Synthetic
gctgctttgctattctgtctggggtcaatactgggatgtacaaccctagagaacttaagcggagttatgtccaat

SEQ ID NO: 334782 - DNA, 75 bp, Artificial Sequence
  Synthetic
atgaacccaaccaacccaattactcaaagaagcgatccatctatgttcttcaggatagaaaacaagatgccccag

SEQ ID NO: 334783 - DNA, 75 bp, Artificial Sequence
  Synthetic
ctctgtctactgggacttcctgcgaatttctgagatcgcttgacaagcttgccaagaatttgttggctgtgcatg

SEQ ID NO: 334784 - DNA, 75 bp, Artificial Sequence
  Synthetic
atggtagaggactacagcgtccccagttgctacaaatacactttgtcccggaatagaacaattcaagacaagccc

SEQ ID NO: 334785 - DNA, 75 bp, Artificial Sequence
  Synthetic
tttgttctgacgtgaaaatgtccctaaataagaggcaggtaatagacttcttaagtggagaagaggacccagcac

SEQ ID NO: 334786 - DNA, 75 bp, Artificial Sequence
  Synthetic
cacaagaccctactgaacaaagaggagaggtaccaaagggtcaccgcactagtgaacaaactgttcccagaggtg

SEQ ID NO: 334787 - DNA, 75 bp, Artificial Sequence
  Synthetic
tccacactgctgagcatcttactagtctagccttagatgacagcccttctgcagtggtgtacagcggctggcaac

SEQ ID NO: 334788 - DNA, 75 bp, Artificial Sequence
  Synthetic
ctaatccaggaagcaactgccccagggactgtcaaagagagcttaaagaggaggctgtctctcctggtggagagg

SEQ ID NO: 334789 - DNA, 75 bp, Artificial Sequence
  Synthetic
aagaagcaattaaacttcacaacaccatcaggaaaatcgccaccatgaggcctgcagacagcaaggcagggagat

SEQ ID NO: 334790 - DNA, 75 bp, Artificial Sequence
  Synthetic
tcggatctggacgaggatcggaagaggagaattctctccaagatcccgtaggagacgagaggctcggaagggagg

SEQ ID NO: 334791 - DNA, 75 bp, Artificial Sequence
  Synthetic
gaggatcggaagaggagaattctctccaagatcccgtaggagacgagaggctcggaagggagggttagcaaaaaa

SEQ ID NO: 334792 - DNA, 75 bp, Artificial Sequence
  Synthetic
tctactctgacatcctctctgcctgtgaccagaccaaggagttgctggacgcgttcgatcaagggaagctagcct

SEQ ID NO: 334793 - DNA, 75 bp, Artificial Sequence
  Synthetic
cgtctacctcatggaaaaaccagaccacatagacaacagagtatgggatctatcagaaacgcaagaagactggat

SEQ ID NO: 334794 - DNA, 75 bp, Artificial Sequence
  Synthetic
acgacagagacgttgtgctcatcggatggatggatgagatcatcaaaatcttctcaaaaccagattatctggagg

SEQ ID NO: 334795 - DNA, 75 bp, Artificial Sequence
  Synthetic
cacccaaacccacgggtacgtgaggagggtggtggaatgctggaaatacaccatatgttgtctgataagcaacat

SEQ ID NO: 334796 - DNA, 75 bp, Artificial Sequence
  Synthetic
cgaagggggtttcatatcaagtcctcaagaacgtcagcaacaaagttgcacttctccgagaaagcatatggtggg

SEQ ID NO: 334797 - DNA, 75 bp, Artificial Sequence
  Synthetic
gcacacatacaaagggtctcctcagtatgacgtctacaagtggcaagacagagggaccatagaatggttgtgcag

SEQ ID NO: 334798 - DNA, 75 bp, Artificial Sequence
  Synthetic
ttacagagctggaagggaaggagtatcttttcttcgatgagtcctggtacttatatggaatttctgctttttcag

SEQ ID NO: 334799 - DNA, 75 bp, Artificial Sequence
  Synthetic
caagaagaatgtacaatacccagaaagggacactcccgacctatacgacaatgaaaagtcacttgcttataaggt

SEQ ID NO: 334800 - DNA, 75 bp, Artificial Sequence
  Synthetic
actactgattgctgacctcactgagcactcaccgacttctggaatgtataatgaccttgccttcaacctagaggg

SEQ ID NO: 334801 - DNA, 75 bp, Artificial Sequence
  Synthetic
agcaaaaacaggcagtcaaaatggctacagaccagatggacatctcgggccctcctccaaagaaacagcatgtgg

SEQ ID NO: 334802 - DNA, 75 bp, Artificial Sequence
  Synthetic
tggaatttctgctttttcagatggtgttccgggctgtgaggacttcaattgctaaaaaactgccttgatttctct

SEQ ID NO: 334803 - DNA, 75 bp, Artificial Sequence
  Synthetic
agaagccgaagaatcatgtgcactactacttagaggaagccaactgcaagacataaagggatatatctgcagggc

SEQ ID NO: 334804 - DNA, 75 bp, Artificial Sequence
  Synthetic
acacagagagtcagatcccaaagatgtacgagatgatcagggaccagatgcgcactttggcatcgacacacaaaa

SEQ ID NO: 334805 - DNA, 75 bp, Artificial Sequence
  Synthetic
catggagtgggtaataacaaccaacaggactcaagaagtactggaaacaataagtggggaagcaaaacttcagtt

SEQ ID NO: 334806 - DNA, 75 bp, Artificial Sequence
  Synthetic
tccccctgaacattgaccacaactgcgaggttatcgggtccatcataatggctgcctgtacaaacaacagagacc

SEQ ID NO: 334807 - DNA, 75 bp, Artificial Sequence
  Synthetic
cacaatcggaagtggattcgaagagctcctcagaagagacactgattggggggtcattccagagccaaaagtcga

SEQ ID NO: 334808 - DNA, 75 bp, Artificial Sequence
  Synthetic
tgagaccagtggataagtactggtttctaatgggccctgcaggggcggaagttatgaccgaagtggagattgaca

SEQ ID NO: 334809 - DNA, 75 bp, Artificial Sequence
  Synthetic
accagggatccccaaactagaaggcagaagatggtcccagataaaaaggcttccactcctgaaggagcagtctgg

SEQ ID NO: 334810 - DNA, 75 bp, Artificial Sequence
  Synthetic
ttcaaccacaacttcaatgggcaaaaggagctgtccatgacccgaaatacaaggggcaatggtatccattccttg

SEQ ID NO: 334811 - DNA, 75 bp, Artificial Sequence
  Synthetic
aacccccagttcttggaaagcactactattgggagcagactcggaatacatagtttgtccacctgggacagatca

SEQ ID NO: 334812 - DNA, 75 bp, Artificial Sequence
  Synthetic
cacttctacagatctccaacaagaccaaagataccatcttgtggcagaaataccccgtcacccaggagctagaga

SEQ ID NO: 334813 - DNA, 75 bp, Artificial Sequence
  Synthetic
agaagtaatctcctggatatgctcacaatccacatacctgtgtcagagagaatccaaatcgactcctcggtcggt

SEQ ID NO: 334814 - DNA, 75 bp, Artificial Sequence
  Synthetic
ttagcaactcccttgagatctacgccaacggtcacggcatcaaagaccggcttaagaacagcaggcccaggtctg

SEQ ID NO: 334815 - DNA, 75 bp, Artificial Sequence
  Synthetic
attggagtgcttcactttcagcctgcaggccttctctgagggcaactctgtcaggtcaaggatacccgaagatct

SEQ ID NO: 334816 - DNA, 75 bp, Artificial Sequence
  Synthetic
tcgggcctctcgtccaccttctccacttgaagaggctccaagaaaatccaccaaagaaccccaaaacaaagaagc

SEQ ID NO: 334817 - DNA, 75 bp, Artificial Sequence
  Synthetic
aatagcctttgggataaacaagaagaatgagaaaaagaactcagcaatggcatctgccaccggaaactggaagcg

SEQ ID NO: 334818 - DNA, 75 bp, Artificial Sequence
  Synthetic
ccttagaatcccctgctgtcaatgggatacggaagagcatcgtcgggcacctcaagcgccaatgcatcggtgaga

SEQ ID NO: 334819 - DNA, 75 bp, Artificial Sequence
  Synthetic
atctgagtatgccttagaaccagaatcactacctgactgggtcgacgaagaaatcatactgctcaggggagaaac

SEQ ID NO: 334820 - DNA, 75 bp, Artificial Sequence
  Synthetic
cccaaaaggcaatgatcaaccagtttgagatggggaggtgggagtctctatccacatttgctgcctctctgctgg

SEQ ID NO: 334821 - DNA, 75 bp, Artificial Sequence
  Synthetic
ggacgagctctgggtggacttagagaagaatgccatctacacagaggtggatggggtggcagaaggcctggtaga

SEQ ID NO: 334822 - DNA, 75 bp, Artificial Sequence
  Synthetic
caataaagcctcggatcgagaaccacttcgtgctgacgtacccactgatagccaactgcgaggattttgccgggg

SEQ ID NO: 334823 - DNA, 75 bp, Artificial Sequence
  Synthetic
caaatacatagagatagtaggcaggaccaaagctgcctctgtcatagagaagtggcaggttgctaccaccagagt

SEQ ID NO: 334824 - DNA, 75 bp, Artificial Sequence
  Synthetic
caacgctgtctgacgagtgggtgtttaaggcgatggagaagatctcgaacaagaaaacactacgagtttgcgggc

SEQ ID NO: 334825 - DNA, 75 bp, Artificial Sequence
  Synthetic
gttctcccaactgcatacagacagaagcagagtaactgcctgccctatcataaccagagacccctctggaaactg

SEQ ID NO: 334826 - DNA, 75 bp, Artificial Sequence
  Synthetic
cagatgagaagtggatcagcttcatgaaccagatctacatccacagtgtattccagaccacaggcgaagatctgg

SEQ ID NO: 334827 - DNA, 75 bp, Artificial Sequence
  Synthetic
ccagttctgggggatggtccttcttggtcctcaccacgttaaaagagacacagacaatgcccccctgttgactgc

SEQ ID NO: 334828 - DNA, 75 bp, Artificial Sequence
  Synthetic
gagttttagagtgggtgttcggaggcaggttctgccagaggaaggaatttggccggtactgcaagaagtctcaaa

SEQ ID NO: 334829 - DNA, 75 bp, Artificial Sequence
  Synthetic
tgaagtaataggggaagactcggcttccaaatatcctaagcactgcatcttcgaaatgaatgtaaacaaccaaaa

SEQ ID NO: 334830 - DNA, 75 bp, Artificial Sequence
  Synthetic
ccaaggtcatcgggctgttcaccttccaatacgagtactggtcaaagcctctgaagtctgccccaagatcgatag

SEQ ID NO: 334831 - DNA, 75 bp, Artificial Sequence
  Synthetic
ctacctgctagcactaaagataacctcctgctcacgtaataagctatacacattctccagcattagaagagtatt

SEQ ID NO: 334832 - DNA, 75 bp, Artificial Sequence
  Synthetic
aagggtcaaaaaggggccagatctcgtgcagaccttctttcaaaggaaagcgcccctcttacaacaatttcacca

SEQ ID NO: 334833 - DNA, 75 bp, Artificial Sequence
  Synthetic
gatacagcctgcctccatgttttcacaagtggttctctctagggctgctgagaacaatgcattgaatgtagaggt

SEQ ID NO: 334834 - DNA, 75 bp, Artificial Sequence
  Synthetic
gcatagacgccctgcagtctgcctctgggtctcaaaccgtcagcttctatgatcaagtcagagaagaatgccaga

SEQ ID NO: 334835 - DNA, 75 bp, Artificial Sequence
  Synthetic
gaatccagaagtgcagctgtacatagggggagcccagagagggatgactttgtaccagtggatcagaacgatact

SEQ ID NO: 334836 - DNA, 75 bp, Artificial Sequence
  Synthetic
agtacatggacctaaaagtggaggggacaacctgcttctaccgaaagggcggccatgtagaggtggaattccctg

SEQ ID NO: 334837 - DNA, 75 bp, Artificial Sequence
  Synthetic
atgtctggagttcttgatggcaatttacaacaatccacaaatggaggggttccttgcaaatatgagaaggctgca

SEQ ID NO: 334838 - DNA, 75 bp, Artificial Sequence
  Synthetic
ttccctgggagcgcccactgcaacacatacctgttcggttgatttttgtttccaaaaaactgccttgatttctct

SEQ ID NO: 334839 - DNA, 75 bp, Artificial Sequence
  Synthetic
agcaaaaacaagcacttgacatgacagacaggcccgaccacatagacagcagagtatgggagctgtcagaaacac

SEQ ID NO: 334840 - DNA, 75 bp, Artificial Sequence
  Synthetic
catgtccagacatgccatgttggaaagaagacaagttttcatcccttttgggtcaatgcctgaagaaaaagtgaa

SEQ ID NO: 334841 - DNA, 75 bp, Artificial Sequence
  Synthetic
aggaagactggatcacccaagtccacggacacgtcaggagagtggtagaatgctggaaatacaccatatgctgtc

SEQ ID NO: 334842 - DNA, 75 bp, Artificial Sequence
  Synthetic
tgaatgtataataaacaacccaatagtggcataccttgctaagggctggaacagcatgccaaatgtgtattactg

SEQ ID NO: 334843 - DNA, 75 bp, Artificial Sequence
  Synthetic
tgataagcaacatgcacactcacaggggagcaccacaatatgatgtcttcaagtggcaggacaggagcaccatag

SEQ ID NO: 334844 - DNA, 75 bp, Artificial Sequence
  Synthetic
atgtaccgctcagaagaacctgctgatctagaaagaaccctaggggctctagcacaagaatacaatgaagcctgc

SEQ ID NO: 334845 - DNA, 75 bp, Artificial Sequence
  Synthetic
cataccttgctaagggctggaacagcatgccaaatgtgtattactgaagcaatagaaatttctggaaaaaagtgc

SEQ ID NO: 334846 - DNA, 75 bp, Artificial Sequence
  Synthetic
aatggatatgtagcaagaaaaaagtccaatacccggaaagagacacaccagatctgtatgacaatgaacgggcag

SEQ ID NO: 334847 - DNA, 75 bp, Artificial Sequence
  Synthetic
aacgaggcgcccaaggaaatggagaaactcttcactgattacaacacattcaagcggtacacaacgagcaaaaag

SEQ ID NO: 334848 - DNA, 75 bp, Artificial Sequence
  Synthetic
ttgcatacaaggtacttctggtttctgatctctctgaccattctcctacatcaggcatttaccacgacctagcct

SEQ ID NO: 334849 - DNA, 75 bp, Artificial Sequence
  Synthetic
gaccatgcccctcaaatgaggctggtgtattcagtgcggaaaccatggcccatcagcataaatccgagcaaagag

SEQ ID NO: 334850 - DNA, 75 bp, Artificial Sequence
  Synthetic
tcaatttagaaggggaggcagaagaatcttgtgcattggtgctaagagggagccaactgcaagacataaaggggt

SEQ ID NO: 334851 - DNA, 75 bp, Artificial Sequence
  Synthetic
atccctccgatgttcaatggaaccagactcaaagactctatactggacctaggagaatcaaggaaaaccagagcg

SEQ ID NO: 334852 - DNA, 75 bp, Artificial Sequence
  Synthetic
ttttgtgcagggcactggaatgggttgtgtcaaacaatctaacacaggaggttgtggaaactatcagtggggagg

SEQ ID NO: 334853 - DNA, 75 bp, Artificial Sequence
  Synthetic
aacatagtagtgccagattattgggcaaagtatgggtcccttgctgagaaggatgttgtggatgccctcctatat

SEQ ID NO: 334854 - DNA, 75 bp, Artificial Sequence
  Synthetic
ccaagctccaattttctgtaggcaccactttcaggaccttactgaagagagacacagattggaatgtgataccta

SEQ ID NO: 334855 - DNA, 75 bp, Artificial Sequence
  Synthetic
gcagaagacttaaaagtcaagaggttcttcagcactgagtggggagagatcaggtatgggaggatgctcccttac

SEQ ID NO: 334856 - DNA, 75 bp, Artificial Sequence
  Synthetic
ctcccagagtagaacccaatgtcccaaggattgaaggaaggaggtggacacagatgaagaaacttcctttgctaa

SEQ ID NO: 334857 - DNA, 75 bp, Artificial Sequence
  Synthetic
agaaaaccagtccaggcatgccccacaattgaagatgtaaactcaacctccattccccatactctgatgcaagta

SEQ ID NO: 334858 - DNA, 75 bp, Artificial Sequence
  Synthetic
aagaaaaagagggcccacccgcccatggagggctctattgctgggagtcagaatacatcgagtgtcccccggaac

SEQ ID NO: 334859 - DNA, 75 bp, Artificial Sequence
  Synthetic
ttctgtccacaatacacaaccctagatagtagacggaaagcccacatgggggcagtggacaaactgaaaagagta

SEQ ID NO: 334860 - DNA, 75 bp, Artificial Sequence
  Synthetic
agaccaagaggccatctcttggatacactctcagtctgagattgaatgcattagggaatcaaatctaccccagca

SEQ ID NO: 334861 - DNA, 75 bp, Artificial Sequence
  Synthetic
atggagcccatctgcaaggtacagactcaagagtcggcagtccacattgcacggtctcttatagacggcggaaaa

SEQ ID NO: 334862 - DNA, 75 bp, Artificial Sequence
  Synthetic
tcagtcatcacctgcctaacgtcaagccttcaatcatttgcagaggggaacccgtagatcttgcatttggcataa

SEQ ID NO: 334863 - DNA, 75 bp, Artificial Sequence
  Synthetic
aagtggttacctacggttgtggaccacacccccagaactgcagagttagctcacttcctatgcagcaaataccat

SEQ ID NO: 334864 - DNA, 75 bp, Artificial Sequence
  Synthetic
gccttcaatcatttgcagaggggaacccgtagatcttgcatttggcataaacaaaaagcaagagaagcagtctgc

SEQ ID NO: 334865 - DNA, 75 bp, Artificial Sequence
  Synthetic
ttcatcttcagcctctggagagtggaaaagagcagaatatcaagtggaagaaatgtccttgccgccctgggtaga

SEQ ID NO: 334866 - DNA, 75 bp, Artificial Sequence
  Synthetic
tacgtccataccaatacccacgacctgagtgacacaaggtccatagacaacctctgtggggaattggttaaaagg

SEQ ID NO: 334867 - DNA, 75 bp, Artificial Sequence
  Synthetic
ggaagagatggtcctactcaggagtgaccaagaagacaactggatagagctagagaaaaatgcgatttacactga

SEQ ID NO: 334868 - DNA, 75 bp, Artificial Sequence
  Synthetic
tcactaaagtgcagaagcccaagagaaacactaatagcaaacttggacaaaataactatacaagggagaccaatg

SEQ ID NO: 334869 - DNA, 75 bp, Artificial Sequence
  Synthetic
ggttgatggagtagcagaagggctggtggacaagtacatagtgatagtgggcagaacaaaagtggcatctgtcat

SEQ ID NO: 334870 - DNA, 75 bp, Artificial Sequence
  Synthetic
aaggaagtgctagcagaccatgaaggagagctgccttatcttgggatttgcagagtggccattggcttaagtact

SEQ ID NO: 334871 - DNA, 75 bp, Artificial Sequence
  Synthetic
agagaaatggcaaattgttgccacccggaccttctcacaactgcacaccgaaatcgtagcagaaattacagcttg

SEQ ID NO: 334872 - DNA, 75 bp, Artificial Sequence
  Synthetic
caccataccatgaagataaggagtacaaagttttccatcctgtctagtgacaaccctcggttcgaggtgaagaaa

SEQ ID NO: 334873 - DNA, 75 bp, Artificial Sequence
  Synthetic
ccccataatcaccagagacccatcaggcaattgccaattctgggggatggtactgcttgggccccatcatgtaaa

SEQ ID NO: 334874 - DNA, 75 bp, Artificial Sequence
  Synthetic
atcttctctcttagtccggaagtaagagtgaccatcccctacaggagatttaaggggaaagcgaaggtcttcttc

SEQ ID NO: 334875 - DNA, 75 bp, Artificial Sequence
  Synthetic
gagagacacagacaatgctccgctgcttatagcggagataatgggagaagacacagaagagaagtaccctaagca

SEQ ID NO: 334876 - DNA, 75 bp, Artificial Sequence
  Synthetic
cagaatgaccagattcaaggatacttcagctgcacagaccgaaagatcgaagaaatcaaagtcagtgcaccagac

SEQ ID NO: 334877 - DNA, 75 bp, Artificial Sequence
  Synthetic
cagcgtattttctctaaaggaagagaaacagtttctgctctctctgaagataacctctttttcgaggaataaact

SEQ ID NO: 334878 - DNA, 75 bp, Artificial Sequence
  Synthetic
aactcacccctcctcgagacaatactagacatctgttattatggtgccttcatagagcccggatttgaacagact

SEQ ID NO: 334879 - DNA, 75 bp, Artificial Sequence
  Synthetic
aaacagtttctgctctctctgaagataacctctttttcgaggaataaactgtacacattctccggcattagaaga

SEQ ID NO: 334880 - DNA, 75 bp, Artificial Sequence
  Synthetic
tttgggttctatccagcagggaagaaagaatttgttgacaacttttttatgcaccactcaaaagaccaccgcgcc

SEQ ID NO: 334881 - DNA, 75 bp, Artificial Sequence
  Synthetic
gttttgatacagccagcatcaatttactcacaagttgtactctctagggcagctgagaacaacagcctcaattta

SEQ ID NO: 334882 - DNA, 75 bp, Artificial Sequence
  Synthetic
ttcttgctacatatgggcttggacaaggaccttagcctccctctttcaccagaactcaattggaaggaacctgcc

SEQ ID NO: 334883 - DNA, 75 bp, Artificial Sequence
  Synthetic
gaggtaaacccagagatccagctgtacctagaaggcgctcagagggggatgactctctaccaacgggtccggatg

SEQ ID NO: 334884 - DNA, 75 bp, Artificial Sequence
  Synthetic
ttaagcaaagtctgcagagtgtctgagatggacactacagtacagccctacacatcttccgccagagaatttgtc

SEQ ID NO: 334885 - DNA, 75 bp, Artificial Sequence
  Synthetic
atcctatgtttggaatttctgatggcaatttacaacaaccctcagatggaaggctttcttgcaaacatgagacga

SEQ ID NO: 334886 - DNA, 75 bp, Artificial Sequence
  Synthetic
ttgggagagactctcaatgtgtacacacaacacgaaaaaggcttagagcttctgatctgcccaacggagataagg

SEQ ID NO: 334887 - DNA, 75 bp, Artificial Sequence
  Synthetic
ctccatatgtccgagcacgccatgatggaaagaagacaggtcttcctaccttttgggtcaagaccagaagacaaa

SEQ ID NO: 334888 - DNA, 75 bp, Artificial Sequence
  Synthetic
tggaaagaagacaggtcttcctaccttttgggtcaagaccagaagacaaagttagcttatttggcaaaaggctgg

SEQ ID NO: 334889 - DNA, 75 bp, Artificial Sequence
  Synthetic
accaccaaagggcccctacctccaggaactaacttaagcgaaagtgaattcatagacatctaccaggatcctttc

SEQ ID NO: 334890 - DNA, 75 bp, Artificial Sequence
  Synthetic
aaaaggctggaacagcatgcctaatgtgtactactagagaggggtattgcaagaaaaaagtgctttgatttctct

SEQ ID NO: 334891 - DNA, 75 bp, Artificial Sequence
  Synthetic
agcaaaaacaagcgatggacagagaagaacccgcggaatcagagtgcaccttaagagctcttgtagaagagtaca

SEQ ID NO: 334892 - DNA, 75 bp, Artificial Sequence
  Synthetic
agcagggcaaaaagcctgatcaagtctacgatattgcatccagaaaggtgcagggagtttgtcggaaatatgctt

SEQ ID NO: 334893 - DNA, 75 bp, Artificial Sequence
  Synthetic
atggagcatgcaaggaagcaccgaaagagatgtcgaagcaattcacagactacaacacattcaaaaggtatacca

SEQ ID NO: 334894 - DNA, 75 bp, Artificial Sequence
  Synthetic
gaggaataccaagatcctgcagagactactgtccaaagcttggttcccataaacacatggggaaggagtgcaaaa

SEQ ID NO: 334895 - DNA, 75 bp, Artificial Sequence
  Synthetic
caagcaagaaggatcatgcaccccagatgagactagtgtattcagtgagaaaaccatggccaatcagcatgactc

SEQ ID NO: 334896 - DNA, 75 bp, Artificial Sequence
  Synthetic
aggaaattacaggaagagatcaccaatgaccctgaatggcactcatgcccaagaaagagagcaaagttgacatac

SEQ ID NO: 334897 - DNA, 75 bp, Artificial Sequence
  Synthetic
ccagcaaggagatccctctggtgttcaacgggaccaaactaaaagatactatcctggacctaggagaatccaaga

SEQ ID NO: 334898 - DNA, 75 bp, Artificial Sequence
  Synthetic
ctcgcagtggtggctggaagccttcaagacaaagacaaaaggcaaaccaatgtaccgaggtcattcatgctcaga

SEQ ID NO: 334899 - DNA, 75 bp, Artificial Sequence
  Synthetic
gaaccagggcaaacatagtagtaccagattactggtccaagtacggaagccagaccagcctagaagtagttaacg

SEQ ID NO: 334900 - DNA, 75 bp, Artificial Sequence
  Synthetic
ggatcacaaatagaatacgatatgaaatcaaccaggggcttagtggtggacacctccaacaggataattgttgga

SEQ ID NO: 334901 - DNA, 75 bp, Artificial Sequence
  Synthetic
ccattctatatgcggaagacttgaaagtacagagatttttcagcacagaatggggtgagatccgctacggaagaa

SEQ ID NO: 334902 - DNA, 75 bp, Artificial Sequence
  Synthetic
ggtgagaccatcctgagagatgggcaaggagggccagaaggctatattcagactggggtctttgaagaacagccc

SEQ ID NO: 334903 - DNA, 75 bp, Artificial Sequence
  Synthetic
tgctccccttcagaaagcctgtacaggcatgtcccactatagaggaggtaaatccggcttctataccacatactc

SEQ ID NO: 334904 - DNA, 75 bp, Artificial Sequence
  Synthetic
aaatgttatttggttgacagtccagaccatggactggcgatggatctgtccaggttttgtgtgcaatcgcaggga

SEQ ID NO: 334905 - DNA, 75 bp, Artificial Sequence
  Synthetic
tgctgcaagtgttctgcccccaatacaccactctagacagcaagaggaaagcacacatgggagcagtagagaagc

SEQ ID NO: 334906 - DNA, 75 bp, Artificial Sequence
  Synthetic
aggttcttccaatatgaaaagaagatatctgtgtgggaagagactgacaacatcaaagccaccatagatgcacag

SEQ ID NO: 334907 - DNA, 75 bp, Artificial Sequence
  Synthetic
tgaaaagagtcatggaacccatttgtaaggtgcagacacaagaatctgcagtacacattgccagatctcttattg

SEQ ID NO: 334908 - DNA, 75 bp, Artificial Sequence
  Synthetic
agggacctcaagcgcaggagggacattgaggagatggtgtccaagaggagaaaagcggagtaaccagaggattgt

SEQ ID NO: 334909 - DNA, 75 bp, Artificial Sequence
  Synthetic
ggcagtcaaaatggctacggaccagatggatctgtcgggacctcccacaaagaaacctcatgtggagaacgaaag

SEQ ID NO: 334910 - DNA, 75 bp, Artificial Sequence
  Synthetic
acagcaacaaaaagtggctgcccaccgttgtagaccacacccccaggactgctgagatggcacatttcttgtgca

SEQ ID NO: 334911 - DNA, 75 bp, Artificial Sequence
  Synthetic
ggagggacattgaggagatggtgtccaagaggagaaaagcggagtaaccagaggattgtttatccaaaaattgcc

SEQ ID NO: 334912 - DNA, 75 bp, Artificial Sequence
  Synthetic
tcagataccgaagatgtacgagatgataagggaccagatgaagacccttgcatctactcacaatatccccctgac

SEQ ID NO: 334913 - DNA, 75 bp, Artificial Sequence
  Synthetic
gcaaatatcactatgtgcataccaacacacaagatctaagcgacacgcgctccatagacaatctatgcggagaac

SEQ ID NO: 334914 - DNA, 75 bp, Artificial Sequence
  Synthetic
catagaccacaactgtgaagtcttgggatccataatcatggctgcctgcacaaacaacagagatctccgcccagt

SEQ ID NO: 334915 - DNA, 75 bp, Artificial Sequence
  Synthetic
ttgtgaagagatctctgaagtgcagatgcccaaaggagactctggtcgccaacctagacaagatcaccatacaag

SEQ ID NO: 334916 - DNA, 75 bp, Artificial Sequence
  Synthetic
agacaagtactggttcttcatggggcaaccaggggcagaagtgatgaccgaagtggaaattgacatacagcctca

SEQ ID NO: 334917 - DNA, 75 bp, Artificial Sequence
  Synthetic
ggagaccgatgagggaagtgcttgctgaccacgatggggagctcccctacctgggaatatgccgagtggctatgg

SEQ ID NO: 334918 - DNA, 75 bp, Artificial Sequence
  Synthetic
gatgcaatgggcaaaaggggccgtgcatgacccaaagtacaaagggcagtggtaccctttcttagcactgctcca

SEQ ID NO: 334919 - DNA, 75 bp, Artificial Sequence
  Synthetic
gtctcagtacacaccacacaatgaagattaggagcaccaagttctctatccttaacagtgaccaccctcgcattg

SEQ ID NO: 334920 - DNA, 75 bp, Artificial Sequence
  Synthetic
gctgtcaaacaaaacaaaggacaccatactctggcaaaagtacccggtcactcaagaactggaactgaacaattc

SEQ ID NO: 334921 - DNA, 75 bp, Artificial Sequence
  Synthetic
aggtgaaaaaggtcttctcattgagcccggatgtgcaagtgaccataccttataggagattcaaagggaaagcga

SEQ ID NO: 334922 - DNA, 75 bp, Artificial Sequence
  Synthetic
tctggagatatatgccaatggccatggtatcaaagatcgactaaagaacagccgcccccgatcagtagggccact

SEQ ID NO: 334923 - DNA, 75 bp, Artificial Sequence
  Synthetic
aggtctatttccaaaacgaccagattcaaggatatttcagctgcacagacaggcagatagatgagatcaagatta

SEQ ID NO: 334924 - DNA, 75 bp, Artificial Sequence
  Synthetic
cgtccatctccttcatctcaaaaggctccaagagaatcctccgaagaacccaaagacaaagaaacatttggagtc

SEQ ID NO: 334925 - DNA, 75 bp, Artificial Sequence
  Synthetic
gtgcccccaagaacgcacccctactagaacccctacttgacatctgctactatggatccttcatagaaccgggct

SEQ ID NO: 334926 - DNA, 75 bp, Artificial Sequence
  Synthetic
caatgcagtcaacggcattaggaagagcatagtgagccacctcaaaagacagtgcatcggagagacacaaaaggc

SEQ ID NO: 334927 - DNA, 75 bp, Artificial Sequence
  Synthetic
ttgaacagaccttcggattttacccagccggaaagagagaatttgtggacagtttcttcatgcatcactccaaag

SEQ ID NO: 334928 - DNA, 75 bp, Artificial Sequence
  Synthetic
aatgatcaatcagtttgagatggggaggtgggagtctctatcgaccttcgctgcctctctcctggctatcaagcc

SEQ ID NO: 334929 - DNA, 75 bp, Artificial Sequence
  Synthetic
accacaaggccttcttgatccacatgggccttgacaaggatctgagcctccctctgtcaccagaactcaattgga

SEQ ID NO: 334930 - DNA, 75 bp, Artificial Sequence
  Synthetic
gaggatcgagaaccacttcgtcctaacataccccctggtggccaattgcgaagacttcgctggagcaacactgtc

SEQ ID NO: 334931 - DNA, 75 bp, Artificial Sequence
  Synthetic
aagagccagctcttagcaaagtctgccgtgtgacagagctagacagcaccgtacagccgtacacctctgccacta

SEQ ID NO: 334932 - DNA, 75 bp, Artificial Sequence
  Synthetic
cgatgagtgggtttttaaaaccatggagaagatcgcaagaaaggggactctacgcatatgtggtcctgatgaaaa

SEQ ID NO: 334933 - DNA, 75 bp, Artificial Sequence
  Synthetic
gagagtttgtgctgggagaaacgctcaatgtatacacccaacatgagaatggacttgaactgctcatatgcccca

SEQ ID NO: 334934 - DNA, 75 bp, Artificial Sequence
  Synthetic
atgggcaagcttcatcaaccagatcactatccactgcgtttttcaaaccgccggcgaagatctgggggttctaga

SEQ ID NO: 334935 - DNA, 75 bp, Artificial Sequence
  Synthetic
cagagataaggagtacgagaggtcctcttcctccaggaaccaacctgagcggcagtgaattcatagatatatacc

SEQ ID NO: 334936 - DNA, 75 bp, Artificial Sequence
  Synthetic
gtgggtctttgggggccgcttcaaccaaaggaaagaattcggcaggtattgcaagaaatctcagacaaaggtgat

SEQ ID NO: 334937 - DNA, 75 bp, Artificial Sequence
  Synthetic
aagaccctttcagcagagccaaaagcctgctgaagtccaccatactgcacgcagagagatgcaaagagttcgttg

SEQ ID NO: 334938 - DNA, 75 bp, Artificial Sequence
  Synthetic
tggcctgttcgccttccaatacgtgcactggtctaagcctctgaaagcggctccaagatctatcgaaggtgcaaa

SEQ ID NO: 334939 - DNA, 75 bp, Artificial Sequence
  Synthetic
gcaacatgctcgaagagtaccaagaccctgcagagacgaccgtgcaaagtctagtgcccattaacacttggggga

SEQ ID NO: 334940 - DNA, 75 bp, Artificial Sequence
  Synthetic
gagaggccagatttcgtgcagaccttctttcaaagggaaacgcccatcatacaacaacttcaccagcatagatgc

SEQ ID NO: 334941 - DNA, 75 bp, Artificial Sequence
  Synthetic
aaagtgccaagagaaagctacaagaggaaatcaccagcgatccagactggcaccagtgtccaagaaagcgagcaa

SEQ ID NO: 334942 - DNA, 75 bp, Artificial Sequence
  Synthetic
tatacagtctgcatcaagttctcaggccaccaacttctacgaccaagtgagagaggaatgccagaaatacatgga

SEQ ID NO: 334943 - DNA, 75 bp, Artificial Sequence
  Synthetic
agatgtcttaccttgctataatagcaggtagtatccaagacagagacaagaagcaaacaaatgttcctcgggctt

SEQ ID NO: 334944 - DNA, 75 bp, Artificial Sequence
  Synthetic
tctgcgtgtcgaaggcaccacttgcttctacaagaagggcgggaccaccgagatcgaattccctgggagcctcag

SEQ ID NO: 334945 - DNA, 75 bp, Artificial Sequence
  Synthetic
tcatgcttaggggatcgcaaatagagtacgacatgaaagccaccagagggcttgtggtggacaccaccaatagga

SEQ ID NO: 334946 - DNA, 75 bp, Artificial Sequence
  Synthetic
accaccgagatcgaattccctgggagcctcagctgcaacacgtacctgtttggttaggttgtattttccaaaaaa

SEQ ID NO: 334947 - DNA, 75 bp, Artificial Sequence
  Synthetic
gatgtttcttcagacagcactgttgctgctttccttagggggggcagtacctgattgcaacacaaaaacagcaac

SEQ ID NO: 334948 - DNA, 75 bp, Artificial Sequence
  Synthetic
tcatagtagggggtgaaacagtcctgagagagggcaaaggagggcccgaagggtatgtccaaacaggggtgtttg

SEQ ID NO: 334949 - DNA, 75 bp, Artificial Sequence
  Synthetic
cggaccatacgtgttggaccggtacaggccaaaaccagtcacagtctcgaagaagcagtactccgcaacaaggca

SEQ ID NO: 334950 - DNA, 75 bp, Artificial Sequence
  Synthetic
aggagcaacccaggtgctacctagtagacactccagaccacggattgtcgatgggcctctccagattctgtgtac

SEQ ID NO: 334951 - DNA, 75 bp, Artificial Sequence
  Synthetic
agaagcagtactccgcaacaaggcacaccactacagcacagaatgagcgccttaccgctggttatcgcacagcct

SEQ ID NO: 334952 - DNA, 75 bp, Artificial Sequence
  Synthetic
actctcaaggtcggtactttcaatacgagaagaagatctctatatgggaggagaccgacaacatcaaagcgacta

SEQ ID NO: 334953 - DNA, 75 bp, Artificial Sequence
  Synthetic
gggtggcttactgctataacggtggcctcgttgattctaatactggttgtaatgctcggctattgcattacccgc

SEQ ID NO: 334954 - DNA, 75 bp, Artificial Sequence
  Synthetic
tcgactcccagagggacctgaagagaaggagggatatagaggagatggtcagcaagagggcaaggattgtgtagt

SEQ ID NO: 334955 - DNA, 75 bp, Artificial Sequence
  Synthetic
ccagcagagatgagctactgctttggggttcctctcaccaatgttcgtacggtgacacctgccacgattgctggg

SEQ ID NO: 334956 - DNA, 75 bp, Artificial Sequence
  Synthetic
agcaagagggcaaggattgtgtagtcgcagaacgggagtacagcttttttcttgaaaaatcgccttgatttctct

SEQ ID NO: 334957 - DNA, 75 bp, Artificial Sequence
  Synthetic
agcaaaaacaagcagatgttccttcagactgcactgcttctgctatccttaggggtagcagaacctgactgcaat

SEQ ID NO: 334958 - DNA, 75 bp, Artificial Sequence
  Synthetic
gaagtgattcctatgcctgcctgggacagctggaccctgccaaacactgggcgcctagaaaggagctcatccgaa

SEQ ID NO: 334959 - DNA, 75 bp, Artificial Sequence
  Synthetic
acaaaaacagccacaggcccatatatattggacagatataaacccaagccagtcactgtatccaagaagttgtat

SEQ ID NO: 334960 - DNA, 75 bp, Artificial Sequence
  Synthetic
gagatgctaactggaaatttgcattccacatgtgcaacatcgactggagatgcggtgtcaccacctcccccgtat

SEQ ID NO: 334961 - DNA, 75 bp, Artificial Sequence
  Synthetic
agtcactgtatccaagaagttgtattcggccaccagatacacaacctctgcacaaaatgagctacttaccgctgg

SEQ ID NO: 334962 - DNA, 75 bp, Artificial Sequence
  Synthetic
tcttcaatctgcagtgggtaaagaatgaggtcaaggtcagcactctactaccgaatggaagcactgttgaacatc

SEQ ID NO: 334963 - DNA, 75 bp, Artificial Sequence
  Synthetic
ttatcgcacagcctgggtggcttactgctataacggtggcctcgttgattctaatactggttgtaatgctaggct

SEQ ID NO: 334964 - DNA, 75 bp, Artificial Sequence
  Synthetic
aggcagggacgcctttattctggactgagaacgatttctcttacataatagaagatgcctttgagataattcaag

SEQ ID NO: 334965 - DNA, 75 bp, Artificial Sequence
  Synthetic
actgcattacccgcccagcagagatgagttactgctttggggatcatctcaccagtgttcatacggggacatctg

SEQ ID NO: 334966 - DNA, 75 bp, Artificial Sequence
  Synthetic
aggacatacaagtgagttgttttgtggaccctgagtactggatgggaagcaagaagacaaagaaggccttctgcc

SEQ ID NO: 334967 - DNA, 75 bp, Artificial Sequence
  Synthetic
ccatgattgctgggggagcgattcctatgcatgcctgggacagctggaccctgccaaacattgggcgccaaggaa

SEQ ID NO: 334968 - DNA, 75 bp, Artificial Sequence
  Synthetic
aagatgggtccagtttctttgaagtgacatcccaccaattctgtcaccaatatgcatgctacaacttctctaaag

SEQ ID NO: 334969 - DNA, 75 bp, Artificial Sequence
  Synthetic
ggagctcgtcagaagagatgctaactggaaattcgcataccatatgtgcaacatcgactggagatgcggagtcac

SEQ ID NO: 334970 - DNA, 75 bp, Artificial Sequence
  Synthetic
acgagctccttgaatctgtgtacaaagaaagggcgcacgagaagagcaaagcattgcccttcgggaacaaaagtt

SEQ ID NO: 334971 - DNA, 75 bp, Artificial Sequence
  Synthetic
cacctcccccgtattcttcaatttgcagtgggtaaagaatgaagtaaaggtcagcactcttctgcctaatggaag

SEQ ID NO: 334972 - DNA, 75 bp, Artificial Sequence
  Synthetic
ggactgtagttacagcttctctggacgaccttcatgctctcagtgctgcccaggcatttgaactagaggggctgc

SEQ ID NO: 334973 - DNA, 75 bp, Artificial Sequence
  Synthetic
cactgtggaacactctgctggggagcctctgttctggactgagaaggacttctcatatctggtcaaagacaattt

SEQ ID NO: 334974 - DNA, 75 bp, Artificial Sequence
  Synthetic
gtgcatcttttgctgaattggactccagatttagacaactgtcagaaatcttggacacagtcatttccagtatag

SEQ ID NO: 334975 - DNA, 75 bp, Artificial Sequence
  Synthetic
cgaaatacagagggaagaagtaaaaatcagctgcttcgtagatccagactattgggtaggagaaaggaagaccaa

SEQ ID NO: 334976 - DNA, 75 bp, Artificial Sequence
  Synthetic
caaaaatagatgaacgcttaatcggcaggctaattaaggctccagtttcaagcagattcatttctgaagacaagt

SEQ ID NO: 334977 - DNA, 75 bp, Artificial Sequence
  Synthetic
gaaagcgttttgccaagacgggaccaacttcttcgaagtgacttcacaccaattttgtcatcaatatgcatgtta

SEQ ID NO: 334978 - DNA, 75 bp, Artificial Sequence
  Synthetic
tcctccttcatcagtgtgtggacagtgtcgccaacaacaccaactgtgtaggagatagtgcatacattgacggaa

SEQ ID NO: 334979 - DNA, 75 bp, Artificial Sequence
  Synthetic
caacttctctaaggacgaactgctggaagctgtctacaaagaaagagctcacgagaaaagcaaggacctgccctt

SEQ ID NO: 334980 - DNA, 75 bp, Artificial Sequence
  Synthetic
gatggaccagagctggaactcatcacccgtgcacaactctgcaggaagaacctacagctatagacatttacaact

SEQ ID NO: 334981 - DNA, 75 bp, Artificial Sequence
  Synthetic
tggtaataaaagctggactgtggtgacagcctccatagatgacctccacgcactcagtgcagcacaggcatttga

SEQ ID NO: 334982 - DNA, 75 bp, Artificial Sequence
  Synthetic
tcagcgctttgtggtacccttctgcagcagaaatagacttcagggggactgtccaatctgaggatggttgggcat

SEQ ID NO: 334983 - DNA, 75 bp, Artificial Sequence
  Synthetic
gctggaagggctcagagcatcttttgctgaactggattcacgatttaggcagctgtcagaaattttggacacagt

SEQ ID NO: 334984 - DNA, 75 bp, Artificial Sequence
  Synthetic
ttgtggttaagtccaaggatgctctcatccagaccatgatgtatactaagaacggtggtaaaggcacctctctta

SEQ ID NO: 334985 - DNA, 75 bp, Artificial Sequence
  Synthetic
gatatccagtatcgccaagatcgacgagagacttatcggcagactgatcaaagcacccgtttctagcagattcat

SEQ ID NO: 334986 - DNA, 75 bp, Artificial Sequence
  Synthetic
cagacctcttggactatccttctggttggcttaaaggacaactagggggactgctatatgggaacatcggggtgt

SEQ ID NO: 334987 - DNA, 75 bp, Artificial Sequence
  Synthetic
ctcagaggacaagtttctgctacatcagtgcgtggacagtgtggccaacaacaccaactgcgtgggagacagtgc

SEQ ID NO: 334988 - DNA, 75 bp, Artificial Sequence
  Synthetic
ggggtgtatctgcttgttgcttttgcttttctcataataatcaagcttatcaagggggcaggactttgctaaaaa

SEQ ID NO: 334989 - DNA, 75 bp, Artificial Sequence
  Synthetic
atatgtggacggcaggtggacccatgttggggacaaccatccttgcacaaccgtggtagatgaaccaataggcat

SEQ ID NO: 334990 - DNA, 75 bp, Artificial Sequence
  Synthetic
agtcaaaatggcgaccagccttccagtcagagcctttagcgaggtctgctgtcaggaggcaaaggcggctataat

SEQ ID NO: 334991 - DNA, 75 bp, Artificial Sequence
  Synthetic
tgacatctataacttcagtgccctctggtacccttctgccgccgaagtcgattttaggggaactgtccagtcaga

SEQ ID NO: 334992 - DNA, 75 bp, Artificial Sequence
  Synthetic
acaaatggagaacaatcccgatgagaccgtatgcaacagaatatggaaaatccacagggacatgcagtcgagtga

SEQ ID NO: 334993 - DNA, 75 bp, Artificial Sequence
  Synthetic
agatggttggtcttttgtggtcaaatctaaagacgcgctcatccagaccatgatgtacaccaaaaacggcggtaa

SEQ ID NO: 334994 - DNA, 75 bp, Artificial Sequence
  Synthetic
tttaacaaccactgtccaagttatgatggtctaccgattcatctctaagagagtacctgaaggttgtttcacaat

SEQ ID NO: 334995 - DNA, 75 bp, Artificial Sequence
  Synthetic
agggacttctctcacggacctcttggactacccttctggttggcttaaggggcagctggggggcttgctatatgg

SEQ ID NO: 334996 - DNA, 75 bp, Artificial Sequence
  Synthetic
tctgtccggaatcaacacgagcctgtataatcccagagagctcaaaaggagctatgtccaagcaatatccaccgg

SEQ ID NO: 334997 - DNA, 75 bp, Artificial Sequence
  Synthetic
caatatcggtgtgtacttgttaattgctttcgcttttgtgctattgatcagactaattaagagtgctggattatg

SEQ ID NO: 334998 - DNA, 75 bp, Artificial Sequence
  Synthetic
cacatcctgcgaattcctaaagtccttggacaagcttgccagaaacctcttggcagtgcatgtatgctctgacgt

SEQ ID NO: 334999 - DNA, 75 bp, Artificial Sequence
  Synthetic
agtggaaacaggcagtggagatggcttccaacctaccagtgaggtctttcagcgaagtctgctgtgctgaggcac

SEQ ID NO: 335000 - DNA, 75 bp, Artificial Sequence
  Synthetic
gaaaatgtccctgagcaagcgtcaggtcatagactttctcagtggtgaaaacgacccagcactgcacgcagcaga

SEQ ID NO: 335001 - DNA, 75 bp, Artificial Sequence
  Synthetic
tgctttcgcttttgtgctattgatcagactaattaagagtgctggattatgctaaaaaactgctttgatatctca

SEQ ID NO: 335002 - DNA, 75 bp, Artificial Sequence
  Synthetic
tgctttcgcttttgtgctattgatcagactaattaagagtgctggattatgctaaaaaactgctttgatatctct

SEQ ID NO: 335003 - DNA, 75 bp, Artificial Sequence
  Synthetic
tgctttcgcttttgtgctattgatcagactaattaagagtgctggattatgctaaaaaactgctttgatatctcc

SEQ ID NO: 335004 - DNA, 75 bp, Artificial Sequence
  Synthetic
tgctttcgcttttgtgctattgatcagactaattaagagtgctggattatgctaaaaaactgctttgatatctcg

SEQ ID NO: 335005 - DNA, 75 bp, Artificial Sequence
  Synthetic
gggcggctataatacagatggagaacaaccccgacgaaaccgtgtgtaataggatctggaagatccaccgggacc

SEQ ID NO: 335006 - DNA, 75 bp, Artificial Sequence
  Synthetic
acatctcaccagcctggccctagacgacagtccctctgcagtcatgtacagcggatggcaacaagaagctgtgaa

SEQ ID NO: 335007 - DNA, 75 bp, Artificial Sequence
  Synthetic
tacagtcaagtgacctcaccaccactgtgcaagtaatgatggtgtatcgtttcatatcaaaacgggtgccagaag

SEQ ID NO: 335008 - DNA, 75 bp, Artificial Sequence
  Synthetic
gctgcacaacaccatcaggaaaattgccaccatgaggcccgcagattgcaaagcaggcaaattctactcagatat

SEQ ID NO: 335009 - DNA, 75 bp, Artificial Sequence
  Synthetic
gctgcttcgccatcctttctggtgtgaacactggaatgtacaacccaagagagcttaaacgaagttatgtgcaat

SEQ ID NO: 335010 - DNA, 75 bp, Artificial Sequence
  Synthetic
cttgtcggcttgtgaccagaccaaggagctgctcgattcctttgaccaggggaagctctcctacgaccgggatgt

SEQ ID NO: 335011 - DNA, 75 bp, Artificial Sequence
  Synthetic
ccctgtcttcaggaacctcctgtgagtttctgagatcattagacaagctagcaaagaacttgctggctgtacatg

SEQ ID NO: 335012 - DNA, 75 bp, Artificial Sequence
  Synthetic
tgtgctgattggttggatggatgagatcatcaaaatcttctccaaacctgattaccttgaggccaagggggtgtc

SEQ ID NO: 335013 - DNA, 75 bp, Artificial Sequence
  Synthetic
tctgctctgatgtgaagatgtccctcaacaaaaggcaggtgatagattttataagcggtgaagaagatcccaccc

SEQ ID NO: 335014 - DNA, 75 bp, Artificial Sequence
  Synthetic
ttaccaggttctgaagaatgtcagcaataaggtggcgctgctcagagaaagcatttggtgggtcacagagttgga

SEQ ID NO: 335015 - DNA, 75 bp, Artificial Sequence
  Synthetic
tccacacagcagagcatctaacaagcttggccctggatgacagcccttctgcagtggtgtacagtggatggcagc

SEQ ID NO: 335016 - DNA, 75 bp, Artificial Sequence
  Synthetic
cggcaatgaatacctgttctttgatgattcttggtacttacatgggatttctgccttttcagatggtgtgcctgg

SEQ ID NO: 335017 - DNA, 75 bp, Artificial Sequence
  Synthetic
aggaagcgatcaagcttcacaacaccatcaggaaaattgctacgatgaggcctgcagactgcaaagcagggaagt

SEQ ID NO: 335018 - DNA, 75 bp, Artificial Sequence
  Synthetic
agcaaaaacaggcgctccaaacacaatgaacctgttcaccccacgctcagagatcaatcccaccaccactcagga

SEQ ID NO: 335019 - DNA, 75 bp, Artificial Sequence
  Synthetic
ttggtacttacatgggatttctgccttttcagatggtgtgcctggatatgaggacttcattcactaaaaaactgc

SEQ ID NO: 335020 - DNA, 75 bp, Artificial Sequence
  Synthetic
tctactcggacatcttatccgcctgcgaccagacaaaagaacttctagacgccttcgaccagggaaaacttgcct

SEQ ID NO: 335021 - DNA, 75 bp, Artificial Sequence
  Synthetic
gctactatacgcctacacaggaccggcgcccgttgcttatggcacaagaaccagagcagtattagagaacataat

SEQ ID NO: 335022 - DNA, 75 bp, Artificial Sequence
  Synthetic
atgaccgagacgtagtgctcatcgggtggatggatgagatcatcaaaatcttctcaaaacctgattatctggagg

SEQ ID NO: 335023 - DNA, 75 bp, Artificial Sequence
  Synthetic
cagaccttaccaatacttctacaaagaacccaatgtccagagagctctagacatcaagacaggatgcaaggagcc

SEQ ID NO: 335024 - DNA, 75 bp, Artificial Sequence
  Synthetic
cgaagggagtctcatatcaggtcctcaagaacgtcagcaacaaagtcgcccttctccgggaaagcatttggtggg

SEQ ID NO: 335025 - DNA, 75 bp, Artificial Sequence
  Synthetic
agaagatataaatgtggaaggtcctagcagtggatttcacaccgcaagtgtgttaaagctagctgacaatttctt

SEQ ID NO: 335026 - DNA, 75 bp, Artificial Sequence
  Synthetic
ttacagaattagatggaagagaatatctcttcttcgatgagtcttggtacttacatggcatgtctgctttttcag

SEQ ID NO: 335027 - DNA, 75 bp, Artificial Sequence
  Synthetic
tagaaaatacaggcctgctatggaaaaattgaagtactggatacttgtaaagcttccgaagctcaagtatgcaga

SEQ ID NO: 335028 - DNA, 75 bp, Artificial Sequence
  Synthetic
tggcatgtctgctttttcagatggtgtgcctggatacgaagacttcatttactaaaaaactgccttgatttctct

SEQ ID NO: 335029 - DNA, 75 bp, Artificial Sequence
  Synthetic
agtggaaacaggcagtgagaatggcttccaacttaccagtgaggtctttcagcgaggtctgctgcgctgaagcac

SEQ ID NO: 335030 - DNA, 75 bp, Artificial Sequence
  Synthetic
gctgagcaagggcaggcagacctacagttttatacacaaaaggaacctcccagcacctatcgccctagaagagac

SEQ ID NO: 335031 - DNA, 75 bp, Artificial Sequence
  Synthetic
gggcggcgataatacagatggagaacaaccctgatgagactgtatgtaataggatttggaagattcaccgggacc

SEQ ID NO: 335032 - DNA, 75 bp, Artificial Sequence
  Synthetic
agtggagttcttagaacaaaatctaagaagaaaaataggcccaaccctcctatcttactgccaggcgattgcaga

SEQ ID NO: 335033 - DNA, 75 bp, Artificial Sequence
  Synthetic
tacagtcaagtgacctcaccaccactgtgcaagttatgatggtataccgcttcatatcaaaacgagtgccagagg

SEQ ID NO: 335034 - DNA, 75 bp, Artificial Sequence
  Synthetic
cgtgatggagctagatgagaccacttatgaaggcgcgagagatcccaggccctgggacatccagctagaagagat

SEQ ID NO: 335035 - DNA, 75 bp, Artificial Sequence
  Synthetic
ggtgcttcgccatcctttccggtgtgaacactgggatgtataacccgagagagctaaaaaggagctatgtacagt

SEQ ID NO: 335036 - DNA, 75 bp, Artificial Sequence
  Synthetic
cgactcagatgaagaagaccctctgttcagacaagtaggtagggaagagacctacaccatcaagttcagcagaga

SEQ ID NO: 335037 - DNA, 75 bp, Artificial Sequence
  Synthetic
ctctgtcctcagggacctcctgcgagtttttgaggtctttggacaagctagcgaagaacttgttggccgtgcacg

SEQ ID NO: 335038 - DNA, 75 bp, Artificial Sequence
  Synthetic
agaactatgggaccagatgagaaccttgaatactatgtgcaaacacctagagagagggaggttaaacagaaggac

SEQ ID NO: 335039 - DNA, 75 bp, Artificial Sequence
  Synthetic
tctgctctgatgtgaagatgtccctcaacaagagacaagtgatagattttataagtggagaagaagaccccactc

SEQ ID NO: 335040 - DNA, 75 bp, Artificial Sequence
  Synthetic
catagctacccccagcatgttgataagagggtttgtaaaaattgtagaggatgcagccaaagagatcctcgagaa

SEQ ID NO: 335041 - DNA, 75 bp, Artificial Sequence
  Synthetic
tccacacagcagaacacctaacaagcctggccctagatgacagtccttctgcagtggtgtacagtggatggcagc

SEQ ID NO: 335042 - DNA, 75 bp, Artificial Sequence
  Synthetic
tgtccctacctctggagtgccagtgggaggagaagaaaaattggccaagctcgccagcaagcaaacctttcacac

SEQ ID NO: 335043 - DNA, 75 bp, Artificial Sequence
  Synthetic
aggaggcgataaagctgcacaacacaattcgaaaaatcgccacaatgaggcctgcagactgcaaagcgggaaagt

SEQ ID NO: 335044 - DNA, 75 bp, Artificial Sequence
  Synthetic
agcagtcacaggagagctgagcggcgatcaagaaaagttcaatgagtgtttggacccagatgcaatgcgcctcat

SEQ ID NO: 335045 - DNA, 75 bp, Artificial Sequence
  Synthetic
tctactccgacatcctctccgcctgcgaccagacaaaggagctgttggatgctttcgaccaaggaaagctcgcct

SEQ ID NO: 335046 - DNA, 75 bp, Artificial Sequence
  Synthetic
gtggaccgtgttcttgagaaagctagggtgccctgactggataatggagttgttcaatataccatttatggtatt

SEQ ID NO: 335047 - DNA, 75 bp, Artificial Sequence
  Synthetic
acgatcgggatgtagtgctcatcggatggatggatgagatcatcaaaatcttctcaaagcctgattatctggagg

SEQ ID NO: 335048 - DNA, 75 bp, Artificial Sequence
  Synthetic
caagtcaaagttagcagacatgggagaaggattagtatacaccaaagggaaactcactgacagaaaaccattggg

SEQ ID NO: 335049 - DNA, 75 bp, Artificial Sequence
  Synthetic
cgaaaggagtctcataccaggtcctcaagaacgtcagcaataaagtcgcccttctccgggaaagcatctggtggg

SEQ ID NO: 335050 - DNA, 75 bp, Artificial Sequence
  Synthetic
agaaatgccttcagagtttgacgatcttgtgaggaatgtggtgggcaacagcatttcgtgcaggctgggaatgtt

SEQ ID NO: 335051 - DNA, 75 bp, Artificial Sequence
  Synthetic
catgggaatgtacaacctcacgtcgactctgcttgcactgatctcaatagagagagaagagctcacaggatcgca

SEQ ID NO: 335052 - DNA, 75 bp, Artificial Sequence
  Synthetic
cgtggagagtagtgatgacttcatccacttcttcaactgcaagacacatgaagagatgttcaaacaggcggagac

SEQ ID NO: 335053 - DNA, 75 bp, Artificial Sequence
  Synthetic
ttacagaattagatggaagagaatatctcttcttcgatgagtcttggtacttacatggcatgtctgcttttttca

SEQ ID NO: 335054 - DNA, 75 bp, Artificial Sequence
  Synthetic
tggcatgtctgctttttcagatggtgtgcctggatatgaagacttcatttgctaaaaaactgccttgatttctct

SEQ ID NO: 335055 - DNA, 75 bp, Artificial Sequence
  Synthetic
actccgactgactttgaaactagttggcatcaacatgtctccttccaaatgcatattgatcagccctgcagggat

SEQ ID NO: 335056 - DNA, 75 bp, Artificial Sequence
  Synthetic
ggcatgtctgcttttttcagatggtgtgcctggatacgaagacttcatttactaaaaaactgccttgatttctct

SEQ ID NO: 335057 - DNA, 75 bp, Artificial Sequence
  Synthetic
aggagagttcaactccaaattccatcaccgtgactttgtggggaacgtggccaccgaactaccagcattggttcc

SEQ ID NO: 335058 - DNA, 75 bp, Artificial Sequence
  Synthetic
gaatgggacaaacccaatgacagacttggcaatgggcctaaatgtgatcaagcattctgtcaacaccggtcaaat

SEQ ID NO: 335059 - DNA, 75 bp, Artificial Sequence
  Synthetic
aagaaaaagagggcccacccagcccatggagggctctattgctgggagcagactcagaatacatcgtgtgtcccc

SEQ ID NO: 335060 - DNA, 75 bp, Artificial Sequence
  Synthetic
gaacctatgcactggagcattagccatgagaatcttcaaccatgcctacaaatatgcatatatggcattaggggt

SEQ ID NO: 335061 - DNA, 75 bp, Artificial Sequence
  Synthetic
ccggaacagaccaagaggccatctcttggatacactctcagtctgagattgaatgcattagggaatccaaatcta

SEQ ID NO: 335062 - DNA, 75 bp, Artificial Sequence
  Synthetic
aaccagaaggacccgattcatggaagaaaatgcaatcacccctctgctgacaaatcagggggcctccccagtaca

SEQ ID NO: 335063 - DNA, 75 bp, Artificial Sequence
  Synthetic
ccccagcatcagtcatcacctgcctaacgtcaagccttcaatcatttgcagaggggaacccagtgagatctagga

SEQ ID NO: 335064 - DNA, 75 bp, Artificial Sequence
  Synthetic
cagcttctccaccatgcatctggacgaagtggcactcagacgccatctgggccttctagacgaagagaccctgag

SEQ ID NO: 335065 - DNA, 75 bp, Artificial Sequence
  Synthetic
tacacgaagacatcattgcatttggcataaacaaaaagcaagagaagaagcagtctgcttcatcttcagcctctg

SEQ ID NO: 335066 - DNA, 75 bp, Artificial Sequence
  Synthetic
gagaatactgaacccgaacaacccagttactcaaaagggggacccttccatgttctttagaatagagaacaagat

SEQ ID NO: 335067 - DNA, 75 bp, Artificial Sequence
  Synthetic
gccccagatcatggaagactacagtgtgcctagctgctttaaatacaccttgtctcggaatagaaccattcagga

SEQ ID NO: 335068 - DNA, 75 bp, Artificial Sequence
  Synthetic
caaaccccacaaggctttactaaacaaagaagagagatatcaaagagtgacctctatcataaacaagctgttccc

SEQ ID NO: 335069 - DNA, 75 bp, Artificial Sequence
  Synthetic
cgaggtgctcatccaagaggcatctgctccaggcacggtcagagagagccttaagagaaggcttgagctggtggt

SEQ ID NO: 335070 - DNA, 75 bp, Artificial Sequence
  Synthetic
tctgtcatagaaaaatggcaaattgctgccacccggaccttctcacaactgcacaccgatcgtagcagaattaca

SEQ ID NO: 335071 - DNA, 75 bp, Artificial Sequence
  Synthetic
ctgccacccggaccttctcacaactgcacaccgatcgtagcagaattacagcttgccccataatcaccagagacc

SEQ ID NO: 335072 - DNA, 75 bp, Artificial Sequence
  Synthetic
ggagaggtctgacctggacgaggagaggaagaagaggatcctttccaggatcttctgaatgggcacatcactaca

SEQ ID NO: 335073 - DNA, 75 bp, Artificial Sequence
  Synthetic
atcctttccaggatcttctgaatgggcacatcactacactagttttcttttgtaaaaaagcgccttgatttctct

SEQ ID NO: 335074 - DNA, 75 bp, Artificial Sequence
  Synthetic
cgctgcttatagcggagataatgggagaagacacagaagagaagtaccctaagcacagcgtattttctctaaagg

SEQ ID NO: 335075 - DNA, 75 bp, Artificial Sequence
  Synthetic
ttgaagggaaacagtttctgctctctctgaagataacctctttttcgaggaataaactgtacacattctccaaca

SEQ ID NO: 335076 - DNA, 75 bp, Artificial Sequence
  Synthetic
tctgaagataacctctttttcgaggaataaactgtacacattctccaacattagaagagttttgatacagccagc

SEQ ID NO: 335077 - DNA, 75 bp, Artificial Sequence
  Synthetic
tctgatggcaatttacaacaaccctcagatggaaggctttcttgcaaacatgagacgactccatatgtccaggca

SEQ ID NO: 335078 - DNA, 75 bp, Artificial Sequence
  Synthetic
tgccatgatggaaagaagacaggtcttcctaccttttgggtcaagaccagaagacaaagttaacgagtgcataat

SEQ ID NO: 335079 - DNA, 75 bp, Artificial Sequence
  Synthetic
aagacaaagttaacgagtgcataatcaacaacccaatagtggcttatttggcaaaaggctggaacagcatgccta

SEQ ID NO: 335080 - DNA, 75 bp, Artificial Sequence
  Synthetic
ggcactcatcttctcaaaatgaacctgtttacacctttaacagaactaaatcccactgcaacccaagaactattg

SEQ ID NO: 335081 - DNA, 75 bp, Artificial Sequence
  Synthetic
tatgcctatacaggtccggcacctgtggcttacgggacaagaaccagagcagttcttgagaacataataagacca

SEQ ID NO: 335082 - DNA, 75 bp, Artificial Sequence
  Synthetic
tatcaatacttctataaagaacccaacgtgaaaagagcccttgaaataaaaacaggatgcaaggaagcaggagag

SEQ ID NO: 335083 - DNA, 75 bp, Artificial Sequence
  Synthetic
ataaatgtggaaggtccaagcagtggattccacacagccagtgtgttgcagttcgcagaaaacttcttcaagaag

SEQ ID NO: 335084 - DNA, 75 bp, Artificial Sequence
  Synthetic
tataggactgccatggaaaaactcaaatattggatactggtgaagctccccaagctcaagtacgcagagctgagc

SEQ ID NO: 335085 - DNA, 75 bp, Artificial Sequence
  Synthetic
aaagggagacagacatacagcttcatccataaaaggaacctaccagcacccatagcactagaagaaactgtagaa

SEQ ID NO: 335086 - DNA, 75 bp, Artificial Sequence
  Synthetic
ttccttgagcagaacctgaagaggaagataggaccgacgctcctgtcctactgccaagcaatagctgatgtaatg

SEQ ID NO: 335087 - DNA, 75 bp, Artificial Sequence
  Synthetic
gagatggagaggacctattatgagaccacaagagacccaagaccctgggaagtcatcctggaagagattgattcc

SEQ ID NO: 335088 - DNA, 75 bp, Artificial Sequence
  Synthetic
gatgaagaagaccctctgttcaaatacaaaaggagggaagaggtttacaccataaaattcaccaaagaggagctt

SEQ ID NO: 335089 - DNA, 75 bp, Artificial Sequence
  Synthetic
tgggaccagatgaggaccctaaacaccatgtggaaacacctagagagggggcggctaaacagaaggacaatagca

SEQ ID NO: 335090 - DNA, 75 bp, Artificial Sequence
  Synthetic
acccccagcatgctcataagaggatttgtgaaaatcgttgaggatgccgctagagaaatcctggagaacatcccc

SEQ ID NO: 335091 - DNA, 75 bp, Artificial Sequence
  Synthetic
acatcaggggtcccggtagggggagaagagaaactcgcaaaacttgccagcaagcaaactttccacactcaagtc

SEQ ID NO: 335092 - DNA, 75 bp, Artificial Sequence
  Synthetic
actggagagctaagcggagatcaagagaagttcaacgaatgccttgacccggatgccatgaggctcatgtggaca

SEQ ID NO: 335093 - DNA, 75 bp, Artificial Sequence
  Synthetic
gtgttcctgaggaaactagggtgtccagactggatcgtaaagctgttcaacatccccttcatggtgtttaagtcc

SEQ ID NO: 335094 - DNA, 75 bp, Artificial Sequence
  Synthetic
aaactggcagagatgggagaaggcctggtctatcagaaagggaagttgtcagagaggaaaaagctaggagaagaa

SEQ ID NO: 335095 - DNA, 75 bp, Artificial Sequence
  Synthetic
ccttcagagtttgacgatctggttccaaacatagttggtaacagcatctcctgtagactagggatgttcatgggg

SEQ ID NO: 335096 - DNA, 75 bp, Artificial Sequence
  Synthetic
atgtacaacctgacctccactctactggcactcatatcaatagagagagaggaaatcactgggtcccatgtggaa

SEQ ID NO: 335097 - DNA, 75 bp, Artificial Sequence
  Synthetic
agtagtgatgacttcatccacttcttcaactgccagacccacgatgagatgtttcaccaagcggagactcttaga

SEQ ID NO: 335098 - DNA, 75 bp, Artificial Sequence
  Synthetic
atgacgctaaagttagtggggataaacatgtctccatccaaatgcattctaatcagcccagcaggaataggagaa

SEQ ID NO: 335099 - DNA, 75 bp, Artificial Sequence
  Synthetic
ttcaactccaaattccatcacagagacttcgtgggtaatgtcgcaactgaactccctgctcttgtcccaaatgga

SEQ ID NO: 335100 - DNA, 75 bp, Artificial Sequence
  Synthetic
acaaacccaatgaccgatcttgctatgggtctgaatgtcataaagcattctgtgaacacggggcagatgaatctc

SEQ ID NO: 335101 - DNA, 75 bp, Artificial Sequence
  Synthetic
tagtagtggactccctgcttacaacagaagagactactactactatatagaaatctttcagacaaagatgactca

SEQ ID NO: 335102 - DNA, 75 bp, Artificial Sequence
  Synthetic
agggaaaatgactcccgaagagctaaagaaattagaacatgagtacaatcaaactgagaaggcattgacagagtc

SEQ ID NO: 335103 - DNA, 75 bp, Artificial Sequence
  Synthetic
atctcagaaactgattcaagagatagatcaagctggtcaaaaccctgactccatccaacaacagtccataaaaca

SEQ ID NO: 335104 - DNA, 75 bp, Artificial Sequence
  Synthetic
gagatctgatgttgttgatgcttacaggaacaaattgaaagagttgcagggcatgattgctgccgggcaagctat

SEQ ID NO: 335105 - DNA, 75 bp, Artificial Sequence
  Synthetic
gcttgctgaagaggcaaaaaagaaaagaaagccagatgtgccgggggttgaagaaggtgattatctcactgcaaa

SEQ ID NO: 335106 - DNA, 75 bp, Artificial Sequence
  Synthetic
gtcatcccttcggtatgggaacgttgtcgacctcaatccactcagcctagaagaacctgcaggccaaactgccaa

SEQ ID NO: 335107 - DNA, 75 bp, Artificial Sequence
  Synthetic
ttggggaaagatattcgaatacattttgacccttacacaggttcttctccttaaaggcctctacatcttgaccac

SEQ ID NO: 335108 - DNA, 75 bp, Artificial Sequence
  Synthetic
ccgaggaagacagactagtaaagacaacaaaggtactagaatcaagcttaaggatgactcatgcatggaggaccg

SEQ ID NO: 335109 - DNA, 75 bp, Artificial Sequence
  Synthetic
gaatgggataaaacaacacaagtacctttacatatcccttccaacaagccaatcttccatccaagatgatgaact

SEQ ID NO: 335110 - DNA, 75 bp, Artificial Sequence
  Synthetic
cacacctggacgttttaggacaatgatctcaggactcttgccaaatgagataaaggcaaaaaagctgatgagccc

SEQ ID NO: 335111 - DNA, 75 bp, Artificial Sequence
  Synthetic
tgtaatgggtgtcattggttttcaacatttagctgaggcttggccaggtgcaatggaaaagatgttgagtgacca

SEQ ID NO: 335112 - DNA, 75 bp, Artificial Sequence
  Synthetic
gtgtgaatatatgaccaaggataaagcaaacccatcaaatagcactaatagggtttatttccgaacacgtcaggc

SEQ ID NO: 335113 - DNA, 75 bp, Artificial Sequence
  Synthetic
ttttattaaagttattctctaatttcttcatcttctttattttctagttgtgtatcccggagcatactactacta

SEQ ID NO: 335114 - DNA, 75 bp, Artificial Sequence
  Synthetic
ctactactatgtataagtgcaactgagcacaagcccattttgctcaattgtccacattatggtgttattggggct

SEQ ID NO: 335115 - DNA, 75 bp, Artificial Sequence
  Synthetic
ccaagttgatgcacttaatttgcctgatatctcagcactgagaatgtttgctgaccaaaattataaaataccagc

SEQ ID NO: 335116 - DNA, 75 bp, Artificial Sequence
  Synthetic
agatattgagtcagaagccaccccatggttatttgcaaatgcaccagaccgatgccctcctactgttcttcaagt

SEQ ID NO: 335117 - DNA, 75 bp, Artificial Sequence
  Synthetic
aaaaacaaaaacaattttgggtaataacccacttctgtgattctttgtcttttgttcttgcggagtctactacta

SEQ ID NO: 335118 - DNA, 75 bp, Artificial Sequence
  Synthetic
ggcaggtatcccggaacttggtgctttccttgcactcatgcaggacatacggggtgggattcttgcctctagtct

SEQ ID NO: 335119 - DNA, 75 bp, Artificial Sequence
  Synthetic
tcgtggaacaggagaagagaagatagctaagaaatcatcattctatcaatcatatgtgagaagaacacaatcaat

SEQ ID NO: 335120 - DNA, 75 bp, Artificial Sequence
  Synthetic
gggtgttaactgtgatcagaagatcatccacatctttatggattacttgggctcatattgtgttgaccactttaa

SEQ ID NO: 335121 - DNA, 75 bp, Artificial Sequence
  Synthetic
gtgatgatcatagtgatcgtagatcctctagaatccatatcattggacacagaaacataactacagtgggcagta

SEQ ID NO: 335122 - DNA, 75 bp, Artificial Sequence
  Synthetic
tatggagaggccatatagacacatggggaagtgttgtagaaacagatgactgcactatcttctgcacccttgcag

SEQ ID NO: 335123 - DNA, 75 bp, Artificial Sequence
  Synthetic
ccttggtgatgatatggatccagaactcaaggccaaggctcaggccctacttgagaagaaagtaaaggagatttc

SEQ ID NO: 335124 - DNA, 75 bp, Artificial Sequence
  Synthetic
aagtcaggagcctattaaactgtaattaaccgatactcttattctgtaaatagtttaaactgcttttaatgcttt

SEQ ID NO: 335125 - DNA, 75 bp, Artificial Sequence
  Synthetic
gcttgcttgcttactaacttgcttactcctaaccccgttagctttccccactactaaccccaagttatttgatct

SEQ ID NO: 335126 - DNA, 75 bp, Artificial Sequence
  Synthetic
aaccccgttagctttccccactactaaccccaagttatttgatctctaattgttgtataggggtgtctactacta

SEQ ID NO: 335127 - DNA, 75 bp, Artificial Sequence
  Synthetic
tagtagtagactccctgcttacaacagaagagactactactaatatagaaaccatttttcagacaaagatggctc

SEQ ID NO: 335128 - DNA, 75 bp, Artificial Sequence
  Synthetic
aagggaaaataactcctgaagagctaaaaaaattagagcttgaatacaaccaaactgagaaggcattaacagaat

SEQ ID NO: 335129 - DNA, 75 bp, Artificial Sequence
  Synthetic
cctctcaaaaactaattcaggagatcgaccaggcaggacaaaatccagattccattcagcagcagtctattaagc

SEQ ID NO: 335130 - DNA, 75 bp, Artificial Sequence
  Synthetic
cgaccaggcaggacaaaatccagattccattcagcagcagtctattaagcaaaggtctgatgttgtaaatgcgta

SEQ ID NO: 335131 - DNA, 75 bp, Artificial Sequence
  Synthetic
ataaaaaataaaaaataaaaaataaaaataatgaataaaaaaataaaaataaataaaaataataaaaaatataaa

SEQ ID NO: 335132 - DNA, 75 bp, Artificial Sequence
  Synthetic
taggaataagctgaaggaactacaagggatgattgctgcagggcaggctatgcttgctgaggaagcaaagaaaaa

SEQ ID NO: 335133 - DNA, 75 bp, Artificial Sequence
  Synthetic
aaataatgaataaaaaaataaaaataaataaaaataataaaaaatataaaaaaataaaaataaaaaaacaacaca

SEQ ID NO: 335134 - DNA, 75 bp, Artificial Sequence
  Synthetic
gaggaagcctgatgtgcctggtgttgaagaaggggactatctcacagcaaaatcatcacttcgttatggaaatgt

SEQ ID NO: 335135 - DNA, 75 bp, Artificial Sequence
  Synthetic
ctactactaaatatatgtgcaactgagcacaggcctatcctgttaaactgtccccactatggtgtcactgaggct

SEQ ID NO: 335136 - DNA, 75 bp, Artificial Sequence
  Synthetic
ggtagaccttaacccgcttaacttaaaagaacctgcggggcaaactgctaactggggaaagatatttgagtatat

SEQ ID NO: 335137 - DNA, 75 bp, Artificial Sequence
  Synthetic
gaatatgtctggggaactacaagacttggacattttccactagatgaggtaaaaaatatggtatttgaaacaaca

SEQ ID NO: 335138 - DNA, 75 bp, Artificial Sequence
  Synthetic
actggggaaagatatttgagtatatcctaacccttacacaggtcttactgctaaaaggcctttacatcctgacta

SEQ ID NO: 335139 - DNA, 75 bp, Artificial Sequence
  Synthetic
ttggacattttccactagatgaggtaaaaaatatggtatttgaaacaacatgttcctttggtctacctgcacatg

SEQ ID NO: 335140 - DNA, 75 bp, Artificial Sequence
  Synthetic
aaagatgattcatgcatggaaaataggaatgggattaaacagcacaaatatctttacatatctctgcccacaagt

SEQ ID NO: 335141 - DNA, 75 bp, Artificial Sequence
  Synthetic
gggacttcaggtgagtattttgaaaagattgctagccatacggaaacagaaggtgatttcaaaagtttatgtaca

SEQ ID NO: 335142 - DNA, 75 bp, Artificial Sequence
  Synthetic
cagtcttccatccaagatgatgagctcacacctggacgttttaggacaatgatctcaggactcttaccaaatgaa

SEQ ID NO: 335143 - DNA, 75 bp, Artificial Sequence
  Synthetic
ataaaggcaaaaaaattaatgagtcctgtaatgggtgttattggatttcaacatttagctgaagcctggccagat

SEQ ID NO: 335144 - DNA, 75 bp, Artificial Sequence
  Synthetic
agacatgtgtgtactgtatagaagtaacatcaaagtaccaattatatttaagaaaacacactgtataaaatcaat

SEQ ID NO: 335145 - DNA, 75 bp, Artificial Sequence
  Synthetic
gcaatggaaaaaatgttgagtgaccagtgcgaatacatgactaaagacaaagcaaacccttcaaacagtacaaat

SEQ ID NO: 335146 - DNA, 75 bp, Artificial Sequence
  Synthetic
gctaaatgaagggaaatgcttccaaccagactttacaattccttatagtcctaagatacacactaggatgaacct

SEQ ID NO: 335147 - DNA, 75 bp, Artificial Sequence
  Synthetic
agagtctattttcggacacgtcaagcccaagttgatgctcttaacctacctgacatctctgcattgaggatgttt

SEQ ID NO: 335148 - DNA, 75 bp, Artificial Sequence
  Synthetic
cccaagttgatgctcttaacctacctgacatctctgcattgaggatgtttgctgatcaaaattataaaatcccag

SEQ ID NO: 335149 - DNA, 75 bp, Artificial Sequence
  Synthetic
tcctgtcttatgtatgcttatgcccacagatggtcaggcagaaggaacaaaagaaattgttggacagacatcttg

SEQ ID NO: 335150 - DNA, 75 bp, Artificial Sequence
  Synthetic
acagatggtcaggcagaaggaacaaaagaaattgttggacagacatcttgtacagatataaaattggctagctgg

SEQ ID NO: 335151 - DNA, 75 bp, Artificial Sequence
  Synthetic
ctgaccttgaatcagaggctaccccgtggctgtttgctaatgcaccagacagatgccccccaactgttctacagg

SEQ ID NO: 335152 - DNA, 75 bp, Artificial Sequence
  Synthetic
tggcaggcatccctgagcttggtgcatttcttgcactcatgcaagacatacggagtgggatccttgcctctagcc

SEQ ID NO: 335153 - DNA, 75 bp, Artificial Sequence
  Synthetic
atttcttgcactcatgcaagacatacggagtgggatccttgcctctagcctccgtggaacagctgaagaaaaaat

SEQ ID NO: 335154 - DNA, 75 bp, Artificial Sequence
  Synthetic
caagatgagacaaattaagcttaatttgaagtttagaactaaccctcaaggtgatgatcatagtgatcgtagatc

SEQ ID NO: 335155 - DNA, 75 bp, Artificial Sequence
  Synthetic
gtgatgatcatagtgatcgtagatcttctagaattcatatcatcggacataagaacataactacagtgagtaata

SEQ ID NO: 335156 - DNA, 75 bp, Artificial Sequence
  Synthetic
agccaaaaagtcatcattttaccaatcttatgttagaaggacacaatcaatgggtgtgaactgtgaccaaaaaat

SEQ ID NO: 335157 - DNA, 75 bp, Artificial Sequence
  Synthetic
acctcggtgatgatatggatccggagcttaaggctaaagctcaggcattacttgagaaaaaagtaaaggagatat

SEQ ID NO: 335158 - DNA, 75 bp, Artificial Sequence
  Synthetic
agaaacctgtactgtttttaggttatacgccaactatgagctggacaacatgtgggacgagttatgttcctgcag

SEQ ID NO: 335159 - DNA, 75 bp, Artificial Sequence
  Synthetic
caagccaagaacctattaaactgtaacctggtaaatataaatagcttgaaaatagttttctttgcttcaaatgct

SEQ ID NO: 335160 - DNA, 75 bp, Artificial Sequence
  Synthetic
tatggagaggccacatagacacatgggggagtgttgtagaaacagatgactgcactattttttgcactcttactg

SEQ ID NO: 335161 - DNA, 75 bp, Artificial Sequence
  Synthetic
ttgcttgcttgcttactaacctgtttgatcagaacccccgcttagctttccccgctactaaccccaacttatttg

SEQ ID NO: 335162 - DNA, 75 bp, Artificial Sequence
  Synthetic
gcccgggtgcaagctgtgaggcattctcaagttcagggatcttttcgttgaattctacaacatgccttatcccac

SEQ ID NO: 335163 - DNA, 75 bp, Artificial Sequence
  Synthetic
ccccgcttagctttccccgctactaaccccaacttatttgatctcactacttgtttttacaggaaggtactacta

SEQ ID NO: 335164 - DNA, 75 bp, Artificial Sequence
  Synthetic
atacccataggttcaagggtttaggggaccaagtgacttttatgtgtcagagggttgattttgatttggaatttt

SEQ ID NO: 335165 - DNA, 75 bp, Artificial Sequence
  Synthetic
atagagaaaacaccagcaatacatacctgcattcaagatgcagagatattatgagattagagataggatacacgg

SEQ ID NO: 335166 - DNA, 75 bp, Artificial Sequence
  Synthetic
tagtagtatactccggaaatagacaatagagaaaacaccagcaatacatacctgcattcaagatgcagagatatt

SEQ ID NO: 335167 - DNA, 75 bp, Artificial Sequence
  Synthetic
ggaccaagtgacttttatgtgtcagagggttgattttgatttggaattttattgtaatggcagacacaaagttat

SEQ ID NO: 335168 - DNA, 75 bp, Artificial Sequence
  Synthetic
ccttgagccagggggtgtaggggcaattgaatgcattgatctcctagactctttatatgctataaggcatgatct

SEQ ID NO: 335169 - DNA, 75 bp, Artificial Sequence
  Synthetic
aattgatgagatgataaagcatgattggtctgataacaaggacaaggaaacacctatatctgatgtgttgatcta

SEQ ID NO: 335170 - DNA, 75 bp, Artificial Sequence
  Synthetic
gttccaggtttccatgggtttacagcagtctgtctcataacaacattttgttttggttggctgtggatccctgga

SEQ ID NO: 335171 - DNA, 75 bp, Artificial Sequence
  Synthetic
cagtctgtctcataacaacattttgttttggttggctgtggatccctggagctacatggggaatattgcaaatac

SEQ ID NO: 335172 - DNA, 75 bp, Artificial Sequence
  Synthetic
tgcaggtattcctctagatctgattacaggtatggaaaaaatcagaattacagatcatcctacagggaagacact

SEQ ID NO: 335173 - DNA, 75 bp, Artificial Sequence
  Synthetic
gcaccagtttttcaaatccacacctgataattacaaaattgagggcaatattatcaagttcatagaggtgacagt

SEQ ID NO: 335174 - DNA, 75 bp, Artificial Sequence
  Synthetic
aagcgcatcctaacaaaaataaaggcagaatacagatctaccattggtgacacaagctgtgattactgtaagcat

SEQ ID NO: 335175 - DNA, 75 bp, Artificial Sequence
  Synthetic
gactgtcgatgtagacaaaggtatatatgaaaaaaagaaaaaataccagggcggatttaaccagattcaagtgga

SEQ ID NO: 335176 - DNA, 75 bp, Artificial Sequence
  Synthetic
attggataaatattggcagcaaggtaaattgcctaacaagtatacaataacatatgatattgtagcagttaaagc

SEQ ID NO: 335177 - DNA, 75 bp, Artificial Sequence
  Synthetic
gaagtttatcattcacctactgctctccaagaacacttcaaaatgtgtccattaattgataggtttaataaaaca

SEQ ID NO: 335178 - DNA, 75 bp, Artificial Sequence
  Synthetic
tgatgggtctaacttatcgacgcagtggcctagtacacgatcaccaggggttgttcaacatatgagaatggtgca

SEQ ID NO: 335179 - DNA, 75 bp, Artificial Sequence
  Synthetic
attaaggatcagatttttaaaacaagcacaaagccacatagtactttatataagaagctgtgtgtcttcagatat

SEQ ID NO: 335180 - DNA, 75 bp, Artificial Sequence
  Synthetic
agctgaaattcagtatgtaagagaaagacttataagaagtaatgaaaaaagtgcccttgaatccatgtttaacct

SEQ ID NO: 335181 - DNA, 75 bp, Artificial Sequence
  Synthetic
taaatttcatacacatgttgagcgggagttcaagtatgtcctgccggagtacccagatgttcctgattgtgaggc

SEQ ID NO: 335182 - DNA, 75 bp, Artificial Sequence
  Synthetic
gaggtagtgaacttggagccagagtggaatgataatgttcatggggttggtttgcataaaatgacaacagatatt

SEQ ID NO: 335183 - DNA, 75 bp, Artificial Sequence
  Synthetic
cgaccaggacagactcctttcacatctgaaaggatggcttactaagaagcagactttttcttttcatgaggtcac

SEQ ID NO: 335184 - DNA, 75 bp, Artificial Sequence
  Synthetic
gaattagatttttctataccatcatcttcaaaatttacatataagaggtttttagagagtcctgttggtgagaca

SEQ ID NO: 335185 - DNA, 75 bp, Artificial Sequence
  Synthetic
tggtgaaagaataagtcaagccttcaaaaaatatgaggctgaacaagaagatatgtacccaaaatcacggaaacc

SEQ ID NO: 335186 - DNA, 75 bp, Artificial Sequence
  Synthetic
agaatgcaatttgccctaaagatatcacagcagaaaacaatcgcatcaattcaaaaacttggccattgggttgat

SEQ ID NO: 335187 - DNA, 75 bp, Artificial Sequence
  Synthetic
gagaaattttctactcttgcaaattggattacaatctgagtataatcctatgactatatctatggcacaggttga

SEQ ID NO: 335188 - DNA, 75 bp, Artificial Sequence
  Synthetic
cacaaaattggctgctagtatcatcatcagtgagccacctgaaacacctgtacaggctcttgtaaaggatgtttg

SEQ ID NO: 335189 - DNA, 75 bp, Artificial Sequence
  Synthetic
ttataactacatgatgttagataatatcgaaattaataattactatagtccagctcatttatttgacaaaactag

SEQ ID NO: 335190 - DNA, 75 bp, Artificial Sequence
  Synthetic
aacagtcataaaacttatccaaatagattatgagcgagaagtatgtattcagctgggaagctatagtgagtgcaa

SEQ ID NO: 335191 - DNA, 75 bp, Artificial Sequence
  Synthetic
aaatgtcccagaaccaggttgtctaaaaatcaatatgagttcattggatgaagcatcaaaaagtatcatagagca

SEQ ID NO: 335192 - DNA, 75 bp, Artificial Sequence
  Synthetic
gattatgagcgagaagtatgtattcagctgggaagctatagtgagtgcaagcgagttacaggtaatgattgctta

SEQ ID NO: 335193 - DNA, 75 bp, Artificial Sequence
  Synthetic
aactaaaggttcccaggataaaggaagctctgaaatagagtcacttcaccctggggctcagtcagaggctaatac

SEQ ID NO: 335194 - DNA, 75 bp, Artificial Sequence
  Synthetic
agtacaaatggggtcaaagtctgcctcttaagcactactgtcaaacttggttcaacagacacgttagtcttcttc

SEQ ID NO: 335195 - DNA, 75 bp, Artificial Sequence
  Synthetic
atctattagtattatagaaaagatcctaacaaaccttgaaatgcatgtggcaactgatgctgaagatataactag

SEQ ID NO: 335196 - DNA, 75 bp, Artificial Sequence
  Synthetic
ttatagaaaaaggtcccctgtagacacactcctagaaagatttataaaaagtgaaacagaaaaatacttgattaa

SEQ ID NO: 335197 - DNA, 75 bp, Artificial Sequence
  Synthetic
gtgatgttaacagaaaatggtgaatataattgccctgattttactggaaattttgagagggtttgtaggtttgca

SEQ ID NO: 335198 - DNA, 75 bp, Artificial Sequence
  Synthetic
agttttaaagaaaactgtaggttggcatctagggcacttagtgagggatgtgactgagagcatgatcgcccatgc

SEQ ID NO: 335199 - DNA, 75 bp, Artificial Sequence
  Synthetic
gtaatacagtttcaggttatcagcgctatcttgctaccaaagactcattcttctcaataaatatgactgatccaa

SEQ ID NO: 335200 - DNA, 75 bp, Artificial Sequence
  Synthetic
aggtttaaaaaggtcaaagttttggtcactctcaggttttcatcaaggtaatgttctgttaattatgatgccgtc

SEQ ID NO: 335201 - DNA, 75 bp, Artificial Sequence
  Synthetic
tcttagaaagaagtaaacttgaatggtatgaccctgatgcaacatctcgtgatcatattaatgttcaaataacaa

SEQ ID NO: 335202 - DNA, 75 bp, Artificial Sequence
  Synthetic
aaaatcactagaagtctctaatgctcatgtaagattcactctagttcacaaagagggttttggctgtgtagatcc

SEQ ID NO: 335203 - DNA, 75 bp, Artificial Sequence
  Synthetic
aggatctggactttgagaatctaggggaaaatccctgtaaagtaactttaaaagtcctgagcatagatggggctt

SEQ ID NO: 335204 - DNA, 75 bp, Artificial Sequence
  Synthetic
catgtaagattcactctagttcacaaagagggttttggctgtgtagatcctgacaatattgattcaaggaagtcc

SEQ ID NO: 335205 - DNA, 75 bp, Artificial Sequence
  Synthetic
aagagggttttggctgtgtagatcctgacaatattgattcaaggaagtccatccatggtgtgattggggtatact

SEQ ID NO: 335206 - DNA, 75 bp, Artificial Sequence
  Synthetic
ggggttctgagacaggcttctccttgaactgtaaggtatcattacttgaatgcaacagttttatcactgttatta

SEQ ID NO: 335207 - DNA, 75 bp, Artificial Sequence
  Synthetic
caaaaccaatgacacttgatctcaacaggcttcttgccctaaatatttgctttgagaaggcattcttagcaactg

SEQ ID NO: 335208 - DNA, 75 bp, Artificial Sequence
  Synthetic
aagcctgtgacaaggctatgtgctatggtgcaagttcacaaacactccaacgtggagataatacagtgagtatcc

SEQ ID NO: 335209 - DNA, 75 bp, Artificial Sequence
  Synthetic
cagtttggtttcagtatttcactgaggatcaaggtatgtttcctttacagtcctcaatcaagagtgtctttgctt

SEQ ID NO: 335210 - DNA, 75 bp, Artificial Sequence
  Synthetic
cgtggagataatacagtgagtatccagggcagaggtggacatagtggttctaaatttaaatgctgccatgaagaa

SEQ ID NO: 335211 - DNA, 75 bp, Artificial Sequence
  Synthetic
tcctcaatcaagagtgtctttgcttataagctacttcttgcaatgacacaaaagatgaaggtctgtgcactgttt

SEQ ID NO: 335212 - DNA, 75 bp, Artificial Sequence
  Synthetic
ataagctacttcttgcaatgacacaaaagatgaaggtctgtgcactgtttgataatcttaggtaccttataccac

SEQ ID NO: 335213 - DNA, 75 bp, Artificial Sequence
  Synthetic
catgcacggctagttattccggtgctgctagcctcattgaaaaatttgtgaaaagaccatttaagagctcattgg

SEQ ID NO: 335214 - DNA, 75 bp, Artificial Sequence
  Synthetic
gaaatttattcagatgggtcaggagagtgccgaattgcttgctggttatctaaaactagtgagtggttcatggga

SEQ ID NO: 335215 - DNA, 75 bp, Artificial Sequence
  Synthetic
tgctagcctcattgaaaaatttgtgaaaagaccatttaagagctcattggaagtatatgcttatgtaaaatcaaa

SEQ ID NO: 335216 - DNA, 75 bp, Artificial Sequence
  Synthetic
taaaactagtgagtggttcatgggaatattgcctggcaactggttagttatagtggtactggtcgtaataatgat

SEQ ID NO: 335217 - DNA, 75 bp, Artificial Sequence
  Synthetic
agagctactgattagccttgctcaaaacaataaattcgggtattactcaaaagtaagaatgttaggtttaacagt

SEQ ID NO: 335218 - DNA, 75 bp, Artificial Sequence
  Synthetic
tgatcaatcaagcgttggtgcaactggaatatatccttctttagtttgtcacacggtataccggcattacaagtc

SEQ ID NO: 335219 - DNA, 75 bp, Artificial Sequence
  Synthetic
aatgattctcattaatgcttactatatcactgcttgctacataaaaataaaaaataaaaaaataaaaaaacaata

SEQ ID NO: 335220 - DNA, 75 bp, Artificial Sequence
  Synthetic
acttatctcagaaataactacttgctttttcttgtttgaaaaaggtcttcgtggtacaatgacagaagaagctaa

SEQ ID NO: 335221 - DNA, 75 bp, Artificial Sequence
  Synthetic
gatacacctagagactgttgaatgggcaaataattttaagggtaaagagatgaaatatggcaaagacctagttga

SEQ ID NO: 335222 - DNA, 75 bp, Artificial Sequence
  Synthetic
gtctggttatgatattgaacaattaattgatggtgaaattattcccgaacagcagttatactgtaaaaatgttat

SEQ ID NO: 335223 - DNA, 75 bp, Artificial Sequence
  Synthetic
tgttcataacccccgcttagctttccccgctactaaccccaagttatttgatctctctaattgttgtatagggag

SEQ ID NO: 335224 - DNA, 75 bp, Artificial Sequence
  Synthetic
aaagttggctacaattgaactaaataaggtcttaacatcaaaaagtcaagtcatctccaattcaatcatgaataa

SEQ ID NO: 335225 - DNA, 75 bp, Artificial Sequence
  Synthetic
acattgggaagaaccttactttagccagactaggaacataagcctaaagggtatgtctggagaattacaagaaga

SEQ ID NO: 335226 - DNA, 75 bp, Artificial Sequence
  Synthetic
ctactactaaatatatgtgcaactgagcacaggcctatcttgctaaactgtccccactatggtgtcactgatgct

SEQ ID NO: 335227 - DNA, 75 bp, Artificial Sequence
  Synthetic
tggtcacttagcatctagctacactttaattgaagcgatacgctatctgaacaaggcaaagcgaaatccaacagt

SEQ ID NO: 335228 - DNA, 75 bp, Artificial Sequence
  Synthetic
gaatatgtctggggaactacaagacttggacatttcccactggatgaggtaaaaaacatggtatttgaaacaaca

SEQ ID NO: 335229 - DNA, 75 bp, Artificial Sequence
  Synthetic
gctagaactttataatgaaactagagatattcgtgcacaggctaggatagtaagaaaacatcaaagaacagaagc

SEQ ID NO: 335230 - DNA, 75 bp, Artificial Sequence
  Synthetic
tgttcttttggtctacctgcacatgacccaatgacacaaatgaaagtagtaacttggaaagagaaagaaacccat

SEQ ID NO: 335231 - DNA, 75 bp, Artificial Sequence
  Synthetic
tgatagaggtttttttattactacattaccaacccgagttagactcgagattattgaggattattttgattctat

SEQ ID NO: 335232 - DNA, 75 bp, Artificial Sequence
  Synthetic
gggacttcaggtgagtactttgaaaaaattgccagccatacggaaacagagggtgatttcaaaagtttatgtacg

SEQ ID NO: 335233 - DNA, 75 bp, Artificial Sequence
  Synthetic
atcaaagaatgttcaggaggagtatatttcttatggaggtgagaagaaaatccttcagattcagggttctctaga

SEQ ID NO: 335234 - DNA, 75 bp, Artificial Sequence
  Synthetic
aaaagcattaagatgggcctctgggacaagtactatatctttatcaacaggtgaacaaataacattcaaaaggaa

SEQ ID NO: 335235 - DNA, 75 bp, Artificial Sequence
  Synthetic
tgtgatgttgaagtcatagttgtagtaagggcagtccattgcttgacacaggacatgtgtgtactgtacagaagt

SEQ ID NO: 335236 - DNA, 75 bp, Artificial Sequence
  Synthetic
gctaatgtatgtaagtgcagatgcaacgaaatggtcacctggagataattcagcaaaattccgactatttacatc

SEQ ID NO: 335237 - DNA, 75 bp, Artificial Sequence
  Synthetic
aacatcaaagtaccaattgtattcaagaaaacacactgtataaaatcaatgttaagtgaagggaaatgcttccag

SEQ ID NO: 335238 - DNA, 75 bp, Artificial Sequence
  Synthetic
gttaagtgaagggaaatgcttccagccagattttacaatcccttatagtcctaaaatacacactaggatgaacct

SEQ ID NO: 335239 - DNA, 75 bp, Artificial Sequence
  Synthetic
acatatccatgatggtttaaaggatagacgattaaagcattgtgtcattgatgcactgaaaggtatttatgaaac

SEQ ID NO: 335240 - DNA, 75 bp, Artificial Sequence
  Synthetic
agagttttttatttcaaggcgattaagaggctatattgaaaatatggagaagttagagcataatgttcaagagtt

SEQ ID NO: 335241 - DNA, 75 bp, Artificial Sequence
  Synthetic
tttagatttttttgaccattcaaaaggtagatcaggtctcgtgaggggtaactggttgcagggaaacttaaataa

SEQ ID NO: 335242 - DNA, 75 bp, Artificial Sequence
  Synthetic
ctatgatctttgtacatagcaacatcaaaatgaggcaaattaaacttaatttgaagtttaggaccaaccctcaag

SEQ ID NO: 335243 - DNA, 75 bp, Artificial Sequence
  Synthetic
gtgctcttcattattctctgttgctataagttttctatttaaagagatgtggtcaaaactatttcctgaattaga

SEQ ID NO: 335244 - DNA, 75 bp, Artificial Sequence
  Synthetic
ctgttttattgagtttgcccatcactctgatgatgctttgtttatttatggttatttggagcctgaaggtgatgg

SEQ ID NO: 335245 - DNA, 75 bp, Artificial Sequence
  Synthetic
agcaaaacacattaacagcctttaaaggtgcaacagattatacgtctttattatataatgtgcaatccacagaca

SEQ ID NO: 335246 - DNA, 75 bp, Artificial Sequence
  Synthetic
atctgattggtacttatatgttactcaaaagatacaagcaggtgagctatattggcattctgtcaatacagaaat

SEQ ID NO: 335247 - DNA, 75 bp, Artificial Sequence
  Synthetic
agaaacctatactgttcttaggttacacgccaactatgagctggacaacatgtgggacaagttatgttcctgctg

SEQ ID NO: 335248 - DNA, 75 bp, Artificial Sequence
  Synthetic
gtggaagacaatgttcaatatgcatgaatatctactactgttgggctctgtaaaggtctctcctaagaaaactac

SEQ ID NO: 335249 - DNA, 75 bp, Artificial Sequence
  Synthetic
tgtttcaccaactaatgctgaatttttatcaacattttttgaaggctgtgcagtttctattccattttcaaagat

SEQ ID NO: 335250 - DNA, 75 bp, Artificial Sequence
  Synthetic
tgcactatcttctgcacccttactggcccgggtgcaagctgtgaagctttctcaagctcagggattttttcattg

SEQ ID NO: 335251 - DNA, 75 bp, Artificial Sequence
  Synthetic
cttattaggtgcactatctgatttgcctggtttaggtttctttgatgacttggctgcatcacagtctcgttgtgt

SEQ ID NO: 335252 - DNA, 75 bp, Artificial Sequence
  Synthetic
aaaagctctagacatgggagcatcacctcaggttgcccagttagcagttaatttaacaaattccaaggttgagcg

SEQ ID NO: 335253 - DNA, 75 bp, Artificial Sequence
  Synthetic
cgggtcgattttgatttggaattttattgtaatggcagacacaaagttattcggacaaaaacacttgtaataggc

SEQ ID NO: 335254 - DNA, 75 bp, Artificial Sequence
  Synthetic
attgtatggtactgcaccaggtatggcaaacaatccttgtaactatatagaccttgatcgagataagatacctat

SEQ ID NO: 335255 - DNA, 75 bp, Artificial Sequence
  Synthetic
caatgcatacatacacttactagtttcttttcattatttcccagtattgcacactcactggctgttgaaatctgt

SEQ ID NO: 335256 - DNA, 75 bp, Artificial Sequence
  Synthetic
atgtttaggtggtattggctcttcctccatattggaacttgcaactgcaggaattgggatgtctgataaacttgt

SEQ ID NO: 335257 - DNA, 75 bp, Artificial Sequence
  Synthetic
gttccaggtttccatggatttacagcagtttgtctcgtaacaacattttgttttggttggctgtggatccctgga

SEQ ID NO: 335258 - DNA, 75 bp, Artificial Sequence
  Synthetic
tctaaaaaatgctctaatttcatttagacatacaaaacagctaaaagacaagtatattttgggaatatacaaatt

SEQ ID NO: 335259 - DNA, 75 bp, Artificial Sequence
  Synthetic
gcaacatggggaatattacagatattgaagattatagtcttattcattacaaatagcaccatggatcagaggttc

SEQ ID NO: 335260 - DNA, 75 bp, Artificial Sequence
  Synthetic
tgaagattatagtcttattcattacaaatagcaccatggatcagaggttcaaacgcatcctaacaaaaataaagg

SEQ ID NO: 335261 - DNA, 75 bp, Artificial Sequence
  Synthetic
cctcatgttattagctcaagaaacatttcaacatgagcgattaggggagttctctttcttgggtaaagtccaatg

SEQ ID NO: 335262 - DNA, 75 bp, Artificial Sequence
  Synthetic
gaaagtattcataccaaagaatgaatttgagttctctaatctttttagtattaattatttaagtcaatggtctgc

SEQ ID NO: 335263 - DNA, 75 bp, Artificial Sequence
  Synthetic
agaacatcctgtatatgattatataattccacaattaagagatgacttgctagtttatcttgtcaggaagttaaa

SEQ ID NO: 335264 - DNA, 75 bp, Artificial Sequence
  Synthetic
tccaagaacacttcaaaatgtgtccattaattgataggtttaataagacaattaaagatcagattttaaagacaa

SEQ ID NO: 335265 - DNA, 75 bp, Artificial Sequence
  Synthetic
tgatccaagcattgttacagctatgacattacaatcacctctgcagcttagattccgtatgcaggcaaaacaaca

SEQ ID NO: 335266 - DNA, 75 bp, Artificial Sequence
  Synthetic
gattccgtatgcaggcaaaacaacacctccctgtgtgcaaatataatgacaattgggttacttttagaacagttc

SEQ ID NO: 335267 - DNA, 75 bp, Artificial Sequence
  Synthetic
cctccctgtgtgcaaatataatgacaattgggttacttttagaacagttctgctgctgctcatgagtatgcataa

SEQ ID NO: 335268 - DNA, 75 bp, Artificial Sequence
  Synthetic
tatgggtcacacttctattttttcaactaataatatgggctgctagtgcagaggtagtgaatttagagccagaat

SEQ ID NO: 335269 - DNA, 75 bp, Artificial Sequence
  Synthetic
atatgtcccaaatgaaattgatctgggcctcttcaatactttagtgtcatgtacattttcaaaagaatttgcatg

SEQ ID NO: 335270 - DNA, 75 bp, Artificial Sequence
  Synthetic
ggaatgataatgttcatggggttggtttgcataaaatgataacagatatcgaattagacttttctataccatcgt

SEQ ID NO: 335271 - DNA, 75 bp, Artificial Sequence
  Synthetic
gaaagactttatcagcaacactgagtgtgaagttatcatgtcaaggaaaattcatagagcaaaggttgcaagggt

SEQ ID NO: 335272 - DNA, 75 bp, Artificial Sequence
  Synthetic
cttcaaaatttacatataagagatttttagagagtcctgttggtgagacaagaatgcaatttgctttaaaggtat

SEQ ID NO: 335273 - DNA, 75 bp, Artificial Sequence
  Synthetic
atttactgtcaaggaacgagatcaaattatccaaaatccaatttctgtggtaattgcttataagtttgctgttgg

SEQ ID NO: 335274 - DNA, 75 bp, Artificial Sequence
  Synthetic
agaatgcaatttgctttaaaggtatcacagcagaagacaattgcatcaatccagaaactaggccactgggttgat

SEQ ID NO: 335275 - DNA, 75 bp, Artificial Sequence
  Synthetic
cacaaatgagataaaggacgttttggataaggctaaattccctgattctttaagtagtgatttgaagttattgta

SEQ ID NO: 335276 - DNA, 75 bp, Artificial Sequence
  Synthetic
tgaaggtgtttatagggaactggggctggacataaatgatccatctgtaatgaaacgagtagcacctatgttgta

SEQ ID NO: 335277 - DNA, 75 bp, Artificial Sequence
  Synthetic
acgtgttctaaagaacatgattttgaataccagacagcttgggcatgtaatcctggagactgccctggaataaac

SEQ ID NO: 335278 - DNA, 75 bp, Artificial Sequence
  Synthetic
caagactagtcgatctaggattgtaatagtgaatggcaatgtcgaaggaacagcagagagtatctgcacctactg

SEQ ID NO: 335279 - DNA, 75 bp, Artificial Sequence
  Synthetic
acaggatgtacagcatgtggcctctacttagacaagccaaaatctatagcaacagtcataaaacttattcaaata

SEQ ID NO: 335280 - DNA, 75 bp, Artificial Sequence
  Synthetic
gttaagatcaatctcttatgttaagcaaataaagattatcccgcatgcagaagtccttaaagctgtctcaatttt

SEQ ID NO: 335281 - DNA, 75 bp, Artificial Sequence
  Synthetic
gattatgagcgagaagtatgcgttcaactgggaagctataatgagtgtaagcgagttacaggcaatgattgctta

SEQ ID NO: 335282 - DNA, 75 bp, Artificial Sequence
  Synthetic
tagtaaaggggagtttatacaggaagataaacagctagctgctctaaggctgtgtatagaaatatggaggtgggg

SEQ ID NO: 335283 - DNA, 75 bp, Artificial Sequence
  Synthetic
taaatataacagagttgatatcaatgattggtttgctgccttatggtttgaaggtaagactctctgggactggtt

SEQ ID NO: 335284 - DNA, 75 bp, Artificial Sequence
  Synthetic
gtattatttccagcggaaaggtgtgcctcttgtagatcctgaaatacaatgtgctgggctaatgatgtatgatct

SEQ ID NO: 335285 - DNA, 75 bp, Artificial Sequence
  Synthetic
gcaatacagtttcaggttatcagcgctatcttgctaccaaggactcattcttctcaattaatatgactgatccaa

SEQ ID NO: 335286 - DNA, 75 bp, Artificial Sequence
  Synthetic
attaagagatatgacatgtttgcagatgcatgcaaataggagagcatattctgggaagcaatatgatgcatattg

SEQ ID NO: 335287 - DNA, 75 bp, Artificial Sequence
  Synthetic
tcttagaaagaagtaaacttgagtggtatgaccctgatgcaacatcccgtgatcatattaatgttcaaataacaa

SEQ ID NO: 335288 - DNA, 75 bp, Artificial Sequence
  Synthetic
catgcaaacatataatgaggaaacaaaactttatgaaggtgatttaagagttgtgtttaattttggaatagattg

SEQ ID NO: 335289 - DNA, 75 bp, Artificial Sequence
  Synthetic
aggatttggactttgagaacctaggggagaatccctgtaaagtaactttaaaagtcctgagcatagatggggctt

SEQ ID NO: 335290 - DNA, 75 bp, Artificial Sequence
  Synthetic
tgcaagacttgaaatcttttgggaaaaacagacttatatccttgaaacatctatcactagtaaaccggttcttcg

SEQ ID NO: 335291 - DNA, 75 bp, Artificial Sequence
  Synthetic
agttttaatgcaagaagtgtctactgaattgcaacggtgtggtttaaaatttgatacaatacagagtatgggatt

SEQ ID NO: 335292 - DNA, 75 bp, Artificial Sequence
  Synthetic
cgtggagataacacagtgagtattcagggcagaggtggacatagtggttccaaatttaaatgctgtcatgaagaa

SEQ ID NO: 335293 - DNA, 75 bp, Artificial Sequence
  Synthetic
caaatcagttgttttgtttaagacagattcaggatttgaatgggggaaaccaaatgtaccttgcattatttttaa

SEQ ID NO: 335294 - DNA, 75 bp, Artificial Sequence
  Synthetic
gattgtgctgaagaaggtttattggctgaagctccacatttagctagagtaaaatccgttgatgttgatacaagt

SEQ ID NO: 335295 - DNA, 75 bp, Artificial Sequence
  Synthetic
gaattgtgctttacgcccgaaccttagaaataagcaagtattaaacaaggaatttattattactattcttgataa

SEQ ID NO: 335296 - DNA, 75 bp, Artificial Sequence
  Synthetic
gaaatttattcagatgggtcaggggagtgccggattacttgctggttatctaaaaccagtgagtggtttatggga

SEQ ID NO: 335297 - DNA, 75 bp, Artificial Sequence
  Synthetic
aatttattattactattcttgataatggttttaaggtaattgcccagcaagacttagatagtaatcggttccagt

SEQ ID NO: 335298 - DNA, 75 bp, Artificial Sequence
  Synthetic
taaaaccagtgagtggtttatgggaatattatctggcaattggttagttatagtggtactggtagtgataatgat

SEQ ID NO: 335299 - DNA, 75 bp, Artificial Sequence
  Synthetic
tggttttaaggtaattgcccagcaagacttagatagtaatcggttccagttggcacatgcatttcataacttgcg

SEQ ID NO: 335300 - DNA, 75 bp, Artificial Sequence
  Synthetic
tgatataaggtatcaggcacttgaaacagtaaatacagtaaactttactgttgatgggaaaattttatatctaaa

SEQ ID NO: 335301 - DNA, 75 bp, Artificial Sequence
  Synthetic
cttactaatatcactgctttctactaacataaaaagcataaaatatataaaaatataataaaaaaataaaaaaat

SEQ ID NO: 335302 - DNA, 75 bp, Artificial Sequence
  Synthetic
tccaatcattgctgcaggtctaatcgagaacttcatgaagggcctacctgcagtcatccccccacaggcatatag

SEQ ID NO: 335303 - DNA, 75 bp, Artificial Sequence
  Synthetic
cactgctttctactaacataaaaagcataaaatatataaaaatataataaaaaaataaaaaaataaaaaaaaaaa

SEQ ID NO: 335304 - DNA, 75 bp, Artificial Sequence
  Synthetic
ccttattatgaaaaaagcaaaaattactgtagacctattcatgtttaataagcttttgggccttataaaccctga

SEQ ID NO: 335305 - DNA, 75 bp, Artificial Sequence
  Synthetic
aaatacatttaatatggatggtattgaaagtgatgatccagaatatagtactgtaactacactttctgtcaagga

SEQ ID NO: 335306 - DNA, 75 bp, Artificial Sequence
  Synthetic
tgcttgctgaggaagcaaagaagaagagaaaacctgatgtacctggtgttgaggaaggggattatctcacagcaa

SEQ ID NO: 335307 - DNA, 75 bp, Artificial Sequence
  Synthetic
gaggaaggggattatctcacagcaaagtcatcacttcgttatggaaatgtagtggaccttaacccgctaaactta

SEQ ID NO: 335308 - DNA, 75 bp, Artificial Sequence
  Synthetic
ttgggcagaggaaaaagatactgaagatgcggaggtggaagatgatgagtatgtcattgatttaaatgatattga

SEQ ID NO: 335309 - DNA, 75 bp, Artificial Sequence
  Synthetic
cttgaccctcacacaggttctactgctaaaaggtctttacatcctgactactcgtggtagacagaccagcaagga

SEQ ID NO: 335310 - DNA, 75 bp, Artificial Sequence
  Synthetic
ttttgataaggttgacactcttgctgacatccagcattttttgcaggatgaatcagcatacactgcggaccttgt

SEQ ID NO: 335311 - DNA, 75 bp, Artificial Sequence
  Synthetic
caacaagggaaccaggattaagctcaaagatgattcatgcatggaagacaggaatgggattaaacagcataaata

SEQ ID NO: 335312 - DNA, 75 bp, Artificial Sequence
  Synthetic
aattgatactgaggcgactgaatcaaagcgagtgcgtggtattgtaaaattgctagaacctattaagttaattaa

SEQ ID NO: 335313 - DNA, 75 bp, Artificial Sequence
  Synthetic
tctctacatatcccttcccacgagtcaatcttccatccaagatgatgaacttacacctggacgttttaggacaat

SEQ ID NO: 335314 - DNA, 75 bp, Artificial Sequence
  Synthetic
gagttgggtttcgaagggtctagcaatagaaaagatatatgatcctttggctgttatactcgttactcggtattt

SEQ ID NO: 335315 - DNA, 75 bp, Artificial Sequence
  Synthetic
gatctcaggcctcttgccaaatgaaataaaggcaaaaaagttgatgagtcctgtaatgggtgttattggattcca

SEQ ID NO: 335316 - DNA, 75 bp, Artificial Sequence
  Synthetic
ttctaagcaatactccttttcaaaagtaccattagctcagcttgacccgtataatttaaccgaacttgagagcat

SEQ ID NO: 335317 - DNA, 75 bp, Artificial Sequence
  Synthetic
acatttagctgaggcctggccagatgctattgagaagatgttgagtgatcagtgcgaatacatgaccaaagacaa

SEQ ID NO: 335318 - DNA, 75 bp, Artificial Sequence
  Synthetic
tgttagaggatggggagaattagtttgtgatcagttttatgagttagaccagcaagctcatgcctttatacaaag

SEQ ID NO: 335319 - DNA, 75 bp, Artificial Sequence
  Synthetic
aacaaataaagcgccggaagacctcacacctgattcacttttttcatttagacatgctgagctattattctcaag

SEQ ID NO: 335320 - DNA, 75 bp, Artificial Sequence
  Synthetic
gctgatcaaaattataaaatcccagctgaccttgaatcagaggccaccccatggctgtttgctaatgcaccagat

SEQ ID NO: 335321 - DNA, 75 bp, Artificial Sequence
  Synthetic
actcttcttgcctgatactgtttctgttttttattaaagttattctctaatttcttcatcttctttattttctag

SEQ ID NO: 335322 - DNA, 75 bp, Artificial Sequence
  Synthetic
gttttttattaaagttattctctaatttcttcatcttctttattttctagttgtgtattccggagcatactacta

SEQ ID NO: 335323 - DNA, 75 bp, Artificial Sequence
  Synthetic
tagtagtagactccgcaattacaagcagttaacaataaaatgatttctatagctaagttagctgtgtgtgtgagt

SEQ ID NO: 335324 - DNA, 75 bp, Artificial Sequence
  Synthetic
agctaagttagctgtgtgtgtgagtctactactatgtataagtgcaactgagcacaagcccattttgctcaattg

SEQ ID NO: 335325 - DNA, 75 bp, Artificial Sequence
  Synthetic
ctactactatgtataagtgcaactgagcacaagcccattttgctcaattgtccacattatggtgttgctggggct

SEQ ID NO: 335326 - DNA, 75 bp, Artificial Sequence
  Synthetic
gagtatgtctgggggactacaagaattggacacttcccactagatgaggttaaaaacatggtatttgagacaaca

SEQ ID NO: 335327 - DNA, 75 bp, Artificial Sequence
  Synthetic
tgctcttttggtctacctgcacatgaccctatgacacaaatgaaggtgataacttggaaagagaaggaaactcat

SEQ ID NO: 335328 - DNA, 75 bp, Artificial Sequence
  Synthetic
cttgagaaaaaagtaaaggagatatcaagccaggaacctattaaactgtgacctggtgaaataaataactttgta

SEQ ID NO: 335329 - DNA, 75 bp, Artificial Sequence
  Synthetic
ggtacttcaggggagtattttgataaagttgcaagtcacacagaaacagagggtgactttaaaagtttatgcaca

SEQ ID NO: 335330 - DNA, 75 bp, Artificial Sequence
  Synthetic
aatagttttctttacttctaatgctttgcttgcttgcttactaacctgcttattcataaaccccgcttaacttcc

SEQ ID NO: 335331 - DNA, 75 bp, Artificial Sequence
  Synthetic
aaaactcattatttgacatatcccttcaaaaatggaaattcatactgtttgaatgtccattgtaatcaaacacta

SEQ ID NO: 335332 - DNA, 75 bp, Artificial Sequence
  Synthetic
tgtgatgttgaagtcatagttattataagagctgtccactgcctaacacaagacatgtgtgtactttacagaagc

SEQ ID NO: 335333 - DNA, 75 bp, Artificial Sequence
  Synthetic
aatattaaaataccaattatatttaagaagactcactgtatcaaatcgatgctgaatgaaggaaaatgttttcaa

SEQ ID NO: 335334 - DNA, 75 bp, Artificial Sequence
  Synthetic
ccagatttcacaataccctatagcccaaaaatacacactaggatgaacttgcctgtcctatgtatgcttatgcca

SEQ ID NO: 335335 - DNA, 75 bp, Artificial Sequence
  Synthetic
acagatggccagccagaggggacaaaggagattgttggacagacatcatgcacagatataaagctggcaagttgg

SEQ ID NO: 335336 - DNA, 75 bp, Artificial Sequence
  Synthetic
tactcatgcctggtaggcgattattcaatgatctttgtacatagcgatataaatatgaggcaaataaaacttaac

SEQ ID NO: 335337 - DNA, 75 bp, Artificial Sequence
  Synthetic
ctaaaatttaggactaaccctcaaggcgatgatcatagtgatcgtagatcatctagaattcatattattgggcat

SEQ ID NO: 335338 - DNA, 75 bp, Artificial Sequence
  Synthetic
ataaaaataataaaaaaataatgaatatgaaaaaataaaaaaaaataaaaaaataaaaaaataaaaaaataaaaa

SEQ ID NO: 335339 - DNA, 75 bp, Artificial Sequence
  Synthetic
tatgaaaaaataaaaaaaaataaaaaaataaaaaaataaaaaaataaaaaaataaaaaaataaaaaaacaacaca

SEQ ID NO: 335340 - DNA, 75 bp, Artificial Sequence
  Synthetic
aagaacataaccacaataagcaataaacaaaacacactaacagccttcagaggtgcaacagattatacatcatta

SEQ ID NO: 335341 - DNA, 75 bp, Artificial Sequence
  Synthetic
ttgtataatgtgcaatctacagacaaaaaacctacactgtttctaggctacacaccaactatgagctggacaaca

SEQ ID NO: 335342 - DNA, 75 bp, Artificial Sequence
  Synthetic
tgtggcacaagttatgtccctgcagtttggagaggccatgtggacacctggggaagtgttatagaaacagatgac

SEQ ID NO: 335343 - DNA, 75 bp, Artificial Sequence
  Synthetic
tgtaccatattttgtactcttgcaggtccgggtgcaagctgtgaggcattttctagttcagggatcttttcacta

SEQ ID NO: 335344 - DNA, 75 bp, Artificial Sequence
  Synthetic
aattcaacaacatgtcttattccacatactcataggtttaaaggtttaggagaccaggttacttttatgtgtcag

SEQ ID NO: 335345 - DNA, 75 bp, Artificial Sequence
  Synthetic
cgggtagactttgatttagagttttactgtaatggtaggcataaagtcataagaacaaagactcttgtgataggt

SEQ ID NO: 335346 - DNA, 75 bp, Artificial Sequence
  Synthetic
caatgtatacacacattcactagcttcttttcactgttcccaagtattgcacactcactagctgttgaaatatgt

SEQ ID NO: 335347 - DNA, 75 bp, Artificial Sequence
  Synthetic
gttccaggcttccatggattcacagcagtttgtctcattacaacattttgttttggctggttgtggatccccgga

SEQ ID NO: 335348 - DNA, 75 bp, Artificial Sequence
  Synthetic
ataataagttcaggtactattcaaaagtgagaatgctagggttaacagttgatcaatctagtgtaggcgcaactg

SEQ ID NO: 335349 - DNA, 75 bp, Artificial Sequence
  Synthetic
gcaacatggatggtattacagatactgaaaattatagtcctttttataacaaatagtactatggatcagagattt

SEQ ID NO: 335350 - DNA, 75 bp, Artificial Sequence
  Synthetic
tggtacaatgacagaggaagctaagatccatttagagactgttgaatgggcaaacaattttaaagagaaagaagc

SEQ ID NO: 335351 - DNA, 75 bp, Artificial Sequence
  Synthetic
aaacgtattttgacaaaaataaaggcagagtataggtctactattggtgatacaagttgtgattactgcaagcat

SEQ ID NO: 335352 - DNA, 75 bp, Artificial Sequence
  Synthetic
gaatgtgcaacaaatttggaggcagacaaccatattatgtactgcaaacaaggcaaatgcccttactgtttaaat

SEQ ID NO: 335353 - DNA, 75 bp, Artificial Sequence
  Synthetic
gaagtctaccactcacctgctgctttacaagaacattttaaaatgtgtcctctcaccgatagattcaataaaaca

SEQ ID NO: 335354 - DNA, 75 bp, Artificial Sequence
  Synthetic
ataaaagatcaaatccttaagacaagcacgaagccacatagtagcttgtataaaaaattatgtgtgttcagatat

SEQ ID NO: 335355 - DNA, 75 bp, Artificial Sequence
  Synthetic
accaatagatgctacatctttacagtatgggttacacttttattttttcagcttgttatctgggctgcaagtgca

SEQ ID NO: 335356 - DNA, 75 bp, Artificial Sequence
  Synthetic
gaacatcccgtatacgattatattatcccacaattgagggatgatttattagtgtactttgtgcggaaattgaat

SEQ ID NO: 335357 - DNA, 75 bp, Artificial Sequence
  Synthetic
gaagtgatgaacttggagccagaatggaatgataatgtccacggagttggtgtgcataaaatgacaacagatgtt

SEQ ID NO: 335358 - DNA, 75 bp, Artificial Sequence
  Synthetic
gaactagatttttccataccttcttcctcaaaatttacatataagcgattcttggaaagccctgtaggtgagact

SEQ ID NO: 335359 - DNA, 75 bp, Artificial Sequence
  Synthetic
aagatgcaatttgccttaaaaatatctcaacagaaaacaatagcatcaattcaaaagctaggtcattgggttgac

SEQ ID NO: 335360 - DNA, 75 bp, Artificial Sequence
  Synthetic
tttgagtagtgatttaaagttgttatatgagggtgtatatagagaacttgggcttgatataaatgacccttccgt

SEQ ID NO: 335361 - DNA, 75 bp, Artificial Sequence
  Synthetic
gcacgctggaatactaggacagtgttccattgctatggggcctgctctaaatttgaatatccgtggaagagtgca

SEQ ID NO: 335362 - DNA, 75 bp, Artificial Sequence
  Synthetic
acatgttcgaaagaacatgattttgaataccaaacagcctgggcgtgtaacccaggagattgccctgggattaac

SEQ ID NO: 335363 - DNA, 75 bp, Artificial Sequence
  Synthetic
acaggatgcacagcttgtggcctttatctggataaaccaaaatctatagctactgttataaagctcattcaaata

SEQ ID NO: 335364 - DNA, 75 bp, Artificial Sequence
  Synthetic
gactatgagagggaagtttgtgttcagctaggtaactataatgagtgtaaacgagttactggaaatgactgctta

SEQ ID NO: 335365 - DNA, 75 bp, Artificial Sequence
  Synthetic
ctaaaaggcctttacatcctgactactcgtggtagacagaccagtaaggacaacaagggaacccggattaagctt

SEQ ID NO: 335366 - DNA, 75 bp, Artificial Sequence
  Synthetic
agcacaaatggagttaaagtctgtcttctaagcaccactgtcaaacttgggtcaacagacacattagttttcttt

SEQ ID NO: 335367 - DNA, 75 bp, Artificial Sequence
  Synthetic
gggccacttcaaggaggtgcagttgttttcaaaaattggtgcacgagtagctgtgtctacggggaccctggagat

SEQ ID NO: 335368 - DNA, 75 bp, Artificial Sequence
  Synthetic
ctgaccttgaatcagaagctaccccgtggttgtttgcctatgcaccagacagatgccccccaactgtcctacagg

SEQ ID NO: 335369 - DNA, 75 bp, Artificial Sequence
  Synthetic
gtcatgctaacagaaaatggggaatacaactgccctgattttaatggaaactttgagagaatttgtagatttgca

SEQ ID NO: 335370 - DNA, 75 bp, Artificial Sequence
  Synthetic
cagactcctgtttgtgagtatgggggtaacacagtttcaggctatcaacgatatcttgctactaaggattctttt

SEQ ID NO: 335371 - DNA, 75 bp, Artificial Sequence
  Synthetic
ccccgcttaactttccccgctactaaccccaagttatttgatctctctaattgttgtatagggagtctactacta

SEQ ID NO: 335372 - DNA, 75 bp, Artificial Sequence
  Synthetic
gctaaatgaagggaaatgcttccagccagactttacaatcccttatagtcctaagatacacaccacgatgaactt

SEQ ID NO: 335373 - DNA, 75 bp, Artificial Sequence
  Synthetic
ttctcaatcaatatgactgacccaattctagagaggagcaagcttgaatggtatgaccctgatgcaacatcccgt

SEQ ID NO: 335374 - DNA, 75 bp, Artificial Sequence
  Synthetic
ctatgatctttgtacatagcaacatcaagatgagacaaattaaacttaatttagagtttaggactaaccctcacg

SEQ ID NO: 335375 - DNA, 75 bp, Artificial Sequence
  Synthetic
gatcacattaatgttcaaataacaaaggacctagatttcgaaaacttgggtgaaaatccctgtagagtaactctt

SEQ ID NO: 335376 - DNA, 75 bp, Artificial Sequence
  Synthetic
aaagtcctgagcattgacggggcatggggttcagagacaggattttcactaaattgtaaagtctcattgcttgaa

SEQ ID NO: 335377 - DNA, 75 bp, Artificial Sequence
  Synthetic
tgtaatagctttattactgttataaaggcatgtgataaagccatgtgttatggtgcaagctcacagacccttcag

SEQ ID NO: 335378 - DNA, 75 bp, Artificial Sequence
  Synthetic
cgtggtgataatacagtaacaatccaagggagaggtggacatagtgggtctaagtttaaatgttgccatgaagaa

SEQ ID NO: 335379 - DNA, 75 bp, Artificial Sequence
  Synthetic
gactgtgctgaggaaggcttacttgctgaggctccacatctagcaagagtaaaatctgttgatgttgatacaagt

SEQ ID NO: 335380 - DNA, 75 bp, Artificial Sequence
  Synthetic
gagatttactcagatggttctggagaatgtcggatcacatgctggttatctaaaactagtgaatggttcatgggg

SEQ ID NO: 335381 - DNA, 75 bp, Artificial Sequence
  Synthetic
aaaataaaaaaataaaaaataaataaaattataaaaataaaaaaataaaaaaaaaacacatttttgggtaataat

SEQ ID NO: 335382 - DNA, 75 bp, Artificial Sequence
  Synthetic
attttatcaggtaattggttggtcattgtagtattagtggtaataatgatactcagtattatgctgttaagcttt

SEQ ID NO: 335383 - DNA, 75 bp, Artificial Sequence
  Synthetic
aaaaaaaaacacatttttgggtaataatccatttctgtaattctttgtcttttgttcttgcggagtctactacta

SEQ ID NO: 335384 - DNA, 75 bp, Artificial Sequence
  Synthetic
ttttgcccaagtaagaaacatcaggcttaatatagtgtattctcttatggctatctaatgttatggcttttcact

SEQ ID NO: 335385 - DNA, 75 bp, Artificial Sequence
  Synthetic
aacactactaagctgcatatatactaaactaataagaaatcataaaaaaataagtaaaaaaataaaaaaataaaa

SEQ ID NO: 335386 - DNA, 75 bp, Artificial Sequence
  Synthetic
aataaaaaaataaaaaaataaaaaaacaaaaacaattttgggtaataacccacttctgtgattctttgtcttttg

SEQ ID NO: 335387 - DNA, 75 bp, Artificial Sequence
  Synthetic
aaaaacaaaaacaattttgggtaataacccacttctgtgattctttgtcttttgttcttgcggagcatactacta

SEQ ID NO: 335388 - DNA, 75 bp, Artificial Sequence
  Synthetic
aagggaagataactcctgaagagctaaaaaaattagagcttgaatataaccaaactgagaaggcattaacagaat

SEQ ID NO: 335389 - DNA, 75 bp, Artificial Sequence
  Synthetic
caaactgagaaggcattaacagaatcctctcaaaaattaattcaggaaatcgaccaggctgggcaaaaccctgat

SEQ ID NO: 335390 - DNA, 75 bp, Artificial Sequence
  Synthetic
cttattaatatcattgctttctaccatcaccagcattaaaaataaacacatttttgggtaataacccatttctgt

SEQ ID NO: 335391 - DNA, 75 bp, Artificial Sequence
  Synthetic
tctattcagcagcagtctattaagcaaagatctgatgttgtagatgcctatagaaataagctgaaggaactacaa

SEQ ID NO: 335392 - DNA, 75 bp, Artificial Sequence
  Synthetic
tagtagtagattccggaaatagacaatagagaaaaataccataaaaaaactgcatttaacatgcagaggtattat

SEQ ID NO: 335393 - DNA, 75 bp, Artificial Sequence
  Synthetic
taaaaataaacacatttttgggtaataacccatttctgtaattctttgccttttgttcttgcgagtatactacta

SEQ ID NO: 335394 - DNA, 75 bp, Artificial Sequence
  Synthetic
gggatgattgctgcagggcaggctatgcttgctgaggaagcaaagaagaagaggaaacctgatgtgcctggtgtt

SEQ ID NO: 335395 - DNA, 75 bp, Artificial Sequence
  Synthetic
gaaatcagggatagaattcatggtcttgaaccagggggtgtaggggcaattgaatgcattgaccttttagattct

SEQ ID NO: 335396 - DNA, 75 bp, Artificial Sequence
  Synthetic
gaggaaacctgatgtgcctggtgttgaggaaggggattatctcacaacaaagtcatcacttcgttatggaaatgt

SEQ ID NO: 335397 - DNA, 75 bp, Artificial Sequence
  Synthetic
atatatgccattagacatgattttattgatgaaatgataaaacatgaatggtctgataataaagataaggaaaca

SEQ ID NO: 335398 - DNA, 75 bp, Artificial Sequence
  Synthetic
ggtggaccttaacccgctaaacttagaagagcctgcagggcagactgctaattggggaaagatatttgagtatat

SEQ ID NO: 335399 - DNA, 75 bp, Artificial Sequence
  Synthetic
cccatatctgatgtgttgatttacgcaggtatcccattagatttaattacaggtatggaaaaaattagaattaca

SEQ ID NO: 335400 - DNA, 75 bp, Artificial Sequence
  Synthetic
gaccaccccactggaaaaacactgcatcaattctttaaatcaacacctgataattacaaaattgaaggtactaca

SEQ ID NO: 335401 - DNA, 75 bp, Artificial Sequence
  Synthetic
taacaaggggaccaggattaagctcaaagatgattcatgcatggaagacaggaatgggattaaacagcacaaata

SEQ ID NO: 335402 - DNA, 75 bp, Artificial Sequence
  Synthetic
attaaatttattgaagtaacagttacagttgatgtagagaaaggtatatatgaaaaaaagaaaaaataccaaggt

SEQ ID NO: 335403 - DNA, 75 bp, Artificial Sequence
  Synthetic
tctttacatatctcttcccacaagtcaatcttccatccaggatgatgaacttacacctggacgttttaggacaat

SEQ ID NO: 335404 - DNA, 75 bp, Artificial Sequence
  Synthetic
ggattcaatcagattcaagttgaattagacaagtattggcaacaaggcaaattacccaataaatacacaatagca

SEQ ID NO: 335405 - DNA, 75 bp, Artificial Sequence
  Synthetic
gatctcaggactcttaccaaatgagataaaggcaaaaaaattgatgagtcctgtaatgggtgttattggattcca

SEQ ID NO: 335406 - DNA, 75 bp, Artificial Sequence
  Synthetic
acatttagctgaagcctggccagatgcaatggagaagatgttgagtgatcagtgcgaatatatgactaaagataa

SEQ ID NO: 335407 - DNA, 75 bp, Artificial Sequence
  Synthetic
gttcagcacatgagaatggttcaagctgaaatacaatatgtgagggaaagactcatacggggtaatgaaaaaagt

SEQ ID NO: 335408 - DNA, 75 bp, Artificial Sequence
  Synthetic
ctgaaatacaatatgtgagggaaagactcatacggggtaatgaaaaaagtgctcttgaatctatgtttaatctaa

SEQ ID NO: 335409 - DNA, 75 bp, Artificial Sequence
  Synthetic
aattccatacacatgtagagcgggaatttaaatatgtgctgcctgagtatccagatgttcctgactgtgaagcta

SEQ ID NO: 335410 - DNA, 75 bp, Artificial Sequence
  Synthetic
ctgaccttgaatcagaggctaccccatggttgtttgctaatgcaccagacagatgccccccaactgttctacaag

SEQ ID NO: 335411 - DNA, 75 bp, Artificial Sequence
  Synthetic
atcaggaaaaacttcttacacatctaaaggcatggcttacaaagaagcaaactttctcttttcatgaggttacag

SEQ ID NO: 335412 - DNA, 75 bp, Artificial Sequence
  Synthetic
tggcaggtatccctgagcttggtgcatttcttgcactcatgcaagacatacggagtgggatccttgcttctagtc

SEQ ID NO: 335413 - DNA, 75 bp, Artificial Sequence
  Synthetic
gtgaaaaaataagccaggcatttagagagtatgaagctgaacaagaaagcatgtatccaaagtcacggaaaccga

SEQ ID NO: 335414 - DNA, 75 bp, Artificial Sequence
  Synthetic
ttcgtggaacagcggaagagaaaatagccaaaaagtcatcgttctatcaatcttatgttaggaggacacaatcaa

SEQ ID NO: 335415 - DNA, 75 bp, Artificial Sequence
  Synthetic
ggaattttttattattgcaaatcggattgcagtctgaatataatcctatgactatttctatggcccaggttgaca

SEQ ID NO: 335416 - DNA, 75 bp, Artificial Sequence
  Synthetic
tgggtgtgaactgtgaccaaaaaattattcatatttttatggattacttgggttcatactgtgttgaccacttca

SEQ ID NO: 335417 - DNA, 75 bp, Artificial Sequence
  Synthetic
caaaattggctgcaagtattattatcagtgagccaactgaaacacctgtacaagccctttgtgaagatgtatgtt

SEQ ID NO: 335418 - DNA, 75 bp, Artificial Sequence
  Synthetic
acctcggtgatgatatggacccagagcttaaggctaaggctcaggcattacttgagaaaaaagtaaaggagatat

SEQ ID NO: 335419 - DNA, 75 bp, Artificial Sequence
  Synthetic
caagccaggaacctattaaactgtaatctggtaaaataaatagctttgtaaatagttttatttgcttctaatgct

SEQ ID NO: 335420 - DNA, 75 bp, Artificial Sequence
  Synthetic
gtgtaccagagccaggttgtttaaaaattaacatgagctcactagatgaaatgtcaaggagtattgtggaacaaa

SEQ ID NO: 335421 - DNA, 75 bp, Artificial Sequence
  Synthetic
aatagttttatttgcttctaatgctttgcttgcttgcttactaacctacttattcataacccccgcttaacttcc

SEQ ID NO: 335422 - DNA, 75 bp, Artificial Sequence
  Synthetic
atgtcaaggagtattgtggaacaaaccaaaggttcacaagataaaataagctctgaaatagaatcacttcatcct

SEQ ID NO: 335423 - DNA, 75 bp, Artificial Sequence
  Synthetic
ccccgcttaacttcccccgctactacccccaagttatttgatctctctaattgttgtacagggagtatactacta

SEQ ID NO: 335424 - DNA, 75 bp, Artificial Sequence
  Synthetic
tgggcacagtctgaagccaatacatctatcagtattgtagaaaaaattctgactaatttagaaatgcatgtggca

SEQ ID NO: 335425 - DNA, 75 bp, Artificial Sequence
  Synthetic
acaacctttcagacaaagatggctcaagggaaaatgactcccgaagagctgaaaaaattagagcttgaatacaat

SEQ ID NO: 335426 - DNA, 75 bp, Artificial Sequence
  Synthetic
actgatagtgaagatataactagttataggaaaagatctcctgtagacacactcttggagcggtttataaaaagt

SEQ ID NO: 335427 - DNA, 75 bp, Artificial Sequence
  Synthetic
caaactgagaaggcattaacagaatcttctcaaaaactgatccaggagattgaccaggctggacaaaatccggat

SEQ ID NO: 335428 - DNA, 75 bp, Artificial Sequence
  Synthetic
tccattcagcagcagtctattaagcaaaggtctgatgttgtagatgcttatagaaataagctgaaagaactacag

SEQ ID NO: 335429 - DNA, 75 bp, Artificial Sequence
  Synthetic
acagagagcatgattgcccatgcaggcttaaaacgatctaagttttggtcactttcaggcttccatcaaggtaat

SEQ ID NO: 335430 - DNA, 75 bp, Artificial Sequence
  Synthetic
gggatgattgctgcagggcaagctatgcttgctgaggaagcaaagaaaaagaggaaacctgatgtgcctggtgtt

SEQ ID NO: 335431 - DNA, 75 bp, Artificial Sequence
  Synthetic
gaggaaacctgatgtgcctggtgttgaggaaggggattatcttacagcaaaatcatcacttcgttatggaaatgt

SEQ ID NO: 335432 - DNA, 75 bp, Artificial Sequence
  Synthetic
ggtggaccttaacccgcttaacttagaagaacctgcggggcagactgccaactggggaaaaatatttgagtatat

SEQ ID NO: 335433 - DNA, 75 bp, Artificial Sequence
  Synthetic
gaaggttttggttgtgtggaccctgataatatcgattcaaagaaatcgataaatggggtgatttgggtttattcg

SEQ ID NO: 335434 - DNA, 75 bp, Artificial Sequence
  Synthetic
cttgaccctcacacaggtcttactgctaaaaggtctttacatcctgactactcgtggtcgacagaccagcaagga

SEQ ID NO: 335435 - DNA, 75 bp, Artificial Sequence
  Synthetic
aaaccaatgacattagatctaaataggcttcttgctctgaacatatgtttcgaaaaggcattccttgcaacagca

SEQ ID NO: 335436 - DNA, 75 bp, Artificial Sequence
  Synthetic
taacaagggaacccggattaagcttaaggatgattcatgcatggaagacaggaatggaattaaacaacacaaata

SEQ ID NO: 335437 - DNA, 75 bp, Artificial Sequence
  Synthetic
gtttggtttcaatacttcactgaagatcaagggatgtttcctttacagtcttcgattaagagtgtttttgcttat

SEQ ID NO: 335438 - DNA, 75 bp, Artificial Sequence
  Synthetic
tctttacatatctcttcccacaagtcaatcctccattcaagatgatgagctcacacctggacgttttaggacaat

SEQ ID NO: 335439 - DNA, 75 bp, Artificial Sequence
  Synthetic
aaactacttcttgcaatgacacagaaaatgaaagtatgtgcattgtttgataacctaaggtatttaataccttca

SEQ ID NO: 335440 - DNA, 75 bp, Artificial Sequence
  Synthetic
gatctcaggactcttaccaaatgaaataaaggcaaaaaagttgatgagtcctgtaatgggcgtcatcggattcca

SEQ ID NO: 335441 - DNA, 75 bp, Artificial Sequence
  Synthetic
acatttagctgaggcctggccagatgcaatggaaaagatgttgagtgatcagtgcgagtacatgactaaagacaa

SEQ ID NO: 335442 - DNA, 75 bp, Artificial Sequence
  Synthetic
gtctatgtctacacaaaatcaaaagagcttttaataagccttgctcaaaacaataagttcaggtactattcaaag

SEQ ID NO: 335443 - DNA, 75 bp, Artificial Sequence
  Synthetic
gtaaggatgctaggtttaacagttgatcaatctagtgtaggtgcaactgggatctacccatctttggtttgccat

SEQ ID NO: 335444 - DNA, 75 bp, Artificial Sequence
  Synthetic
cccaagttgatgctcttaacctacctgacatctctgcattaaggatgtttgctgatcaaaattataaaatcccag

SEQ ID NO: 335445 - DNA, 75 bp, Artificial Sequence
  Synthetic
actgtgtatcggcattatagatcactcatttctgaaattaccacttgtttctttctatttgaaaaaggacttcat

SEQ ID NO: 335446 - DNA, 75 bp, Artificial Sequence
  Synthetic
ctgaccttgaatcagaagctaccccatggttgtttgctaatgcaccagacagatgccccccaactgtcctacagg

SEQ ID NO: 335447 - DNA, 75 bp, Artificial Sequence
  Synthetic
ggcacgatgacagaggaagctaagatccatttagagactgttgaatgggcaaataattttaaagagaaagaagca

SEQ ID NO: 335448 - DNA, 75 bp, Artificial Sequence
  Synthetic
tccatttagagactgttgaatgggcaaataattttaaagagaaagaagcaaaatatggtaaaggcctagtagagt

SEQ ID NO: 335449 - DNA, 75 bp, Artificial Sequence
  Synthetic
atttcttgcactcatgcaagacatacggagtgggatccttgcttctagtcttcgtggaacagctgaagaaaagat

SEQ ID NO: 335450 - DNA, 75 bp, Artificial Sequence
  Synthetic
ttggatacactattgagcaattaattaatgatgagattattccagagcaacaattatactgtaagaatgtcataa

SEQ ID NO: 335451 - DNA, 75 bp, Artificial Sequence
  Synthetic
agctggcaacattagaattaaataaggttttgacatcaaaaggtcaagttatttctaactccataatgaataaac

SEQ ID NO: 335452 - DNA, 75 bp, Artificial Sequence
  Synthetic
ggttcatactgtgttgaccacttcaacctcggtgatgacatggatccagagcttaaggctaaagctcaggcatta

SEQ ID NO: 335453 - DNA, 75 bp, Artificial Sequence
  Synthetic
actgggaagaaccctatttcagccagaccaggaatataagtttaaaaggtatgtcaggtgaattacaggaagatg

SEQ ID NO: 335454 - DNA, 75 bp, Artificial Sequence
  Synthetic
cttgagaaaaaagtgaaagagatatcaagccaggaacctattaaattgtaacctggtaaaatagctaaccttgta

SEQ ID NO: 335455 - DNA, 75 bp, Artificial Sequence
  Synthetic
ggcatcttgcctctagttatacacttatagaggctatacgctacttaaataaagcaaagcggaatccaacggtat

SEQ ID NO: 335456 - DNA, 75 bp, Artificial Sequence
  Synthetic
aatagttttctttgtttctaatgctttgcttgcttgcttactaacctacttgttcataacccccgcttaactttc

SEQ ID NO: 335457 - DNA, 75 bp, Artificial Sequence
  Synthetic
tagaactttataatgaaactagagatatacgtgcacaagctcggatagtaagaaaacatcagaggacagaagctg

SEQ ID NO: 335458 - DNA, 75 bp, Artificial Sequence
  Synthetic
tgttcataacccccgcttaactttccccgctactaaccccaagttatttgatctctctaattgttgtacagggag

SEQ ID NO: 335459 - DNA, 75 bp, Artificial Sequence
  Synthetic
tagtagtagactccgcaattacaagcagttaacaataaaatgacttctatatttaagttggctgtttgcgcgagt

SEQ ID NO: 335460 - DNA, 75 bp, Artificial Sequence
  Synthetic
acagaggtttttttattacaacactaccaacccgagtccggttagaaattatagaagattattttgactctatat

SEQ ID NO: 335461 - DNA, 75 bp, Artificial Sequence
  Synthetic
ctactactaaatatatgtgcaactgagcacaggcctatcttgctgaactgtccccactatggtgtcactgaggct

SEQ ID NO: 335462 - DNA, 75 bp, Artificial Sequence
  Synthetic
caaagaatgttcaggaggaatatatatcttatgggggtgaaaaaaagattctccaaattcaaggctctctagaaa

SEQ ID NO: 335463 - DNA, 75 bp, Artificial Sequence
  Synthetic
tccccactatggtgtcactgaggctgaatatacctggggaactacaagacttggacattttccactggatgaggt

SEQ ID NO: 335464 - DNA, 75 bp, Artificial Sequence
  Synthetic
ctccaaattcaaggctctctagaaaaggctttgaggtgggcttcagggacaagcaccatatctttgtcaacaggt

SEQ ID NO: 335465 - DNA, 75 bp, Artificial Sequence
  Synthetic
aaaaaatatggtatttgaaacaacatgttcttttggtctacctgcacatgacccaatgacacaaatgaaggtggt

SEQ ID NO: 335466 - DNA, 75 bp, Artificial Sequence
  Synthetic
taatgtatgtaagtgcagatgcaactaaatggtctcctggggataactcagctaaattcagactattcacatcac

SEQ ID NO: 335467 - DNA, 75 bp, Artificial Sequence
  Synthetic
acccaatgacacaaatgaaggtggtaacttggaaagaaaaagaaacccatgggacttcaggcgagtattttgaaa

SEQ ID NO: 335468 - DNA, 75 bp, Artificial Sequence
  Synthetic
atattcatgatgggctgaaagatagacgattaaagcattgtcttattgatgcacttaagggcatcaatgaaacag

SEQ ID NO: 335469 - DNA, 75 bp, Artificial Sequence
  Synthetic
aaattgcaagccatacggaaacagaaggtgattttaaaagtttatgtactaaaacccattacttgacctatcctt

SEQ ID NO: 335470 - DNA, 75 bp, Artificial Sequence
  Synthetic
aaaacccattacttgacctatccttttaaaaatggaaattcttactgcttaaatgttcattgtaatcagactctt

SEQ ID NO: 335471 - DNA, 75 bp, Artificial Sequence
  Synthetic
aattttttatttcaaggagattacgaggctatatagagaatatggaaacattagaacacaatgttcaagagttct

SEQ ID NO: 335472 - DNA, 75 bp, Artificial Sequence
  Synthetic
aaatgttcattgtaatcagactctttgtgatgttgaagttatagttataataagggcagtccattgtctgacaca

SEQ ID NO: 335473 - DNA, 75 bp, Artificial Sequence
  Synthetic
ttaaaaatggaaattcttactgcttaaatgttcattgtaatcagactctttgtgatgttgaagttatagttataa

SEQ ID NO: 335474 - DNA, 75 bp, Artificial Sequence
  Synthetic
taagggcagtccattgtctgacacaggacatgtgtgtactgtatagaagtaatatcaaagtaccaattatattca

SEQ ID NO: 335475 - DNA, 75 bp, Artificial Sequence
  Synthetic
aggctatatagagaatatggaaacattagaacacaatgttcaagagttcttaaattttttagattactcaaaggg

SEQ ID NO: 335476 - DNA, 75 bp, Artificial Sequence
  Synthetic
agaaaacacactgtataaaatcaatgctaaatgaagggaaatgcttccagccagactttacaatcccttatagtc

SEQ ID NO: 335477 - DNA, 75 bp, Artificial Sequence
  Synthetic
tcctgtcctatgcatgctcatgcccacagatggtcaggcagaaggaacaaaagaaattgttggacagacatcctg

SEQ ID NO: 335478 - DNA, 75 bp, Artificial Sequence
  Synthetic
tacagatataaaattggctagctggtattcttgtttagtaggtgattattctatgatctttgtacatagcaacat

SEQ ID NO: 335479 - DNA, 75 bp, Artificial Sequence
  Synthetic
tattcttgtttagtaggtgattattctatgatctttgtacatagcaacatcaagatgagacaaattaaacttaat

SEQ ID NO: 335480 - DNA, 75 bp, Artificial Sequence
  Synthetic
ctatgatctttgtacatagcaacatcaagatgagacaaattaaacttaatttaaagtttaggactaaccctcaag

SEQ ID NO: 335481 - DNA, 75 bp, Artificial Sequence
  Synthetic
ttatataatgtgcaatctacagacaaaaaacccatactgttcttaggttatacgccaactatgagctggacaaca

SEQ ID NO: 335482 - DNA, 75 bp, Artificial Sequence
  Synthetic
tgcgggacgagttatgttcctgcagtatggagaggccatatagacacatggggaagtgttgtagaaacagatgac

SEQ ID NO: 335483 - DNA, 75 bp, Artificial Sequence
  Synthetic
tatggagaggccatatagacacatggggaagtgttgtagaaacagatgactgcactatcttctgcacccttacag

SEQ ID NO: 335484 - DNA, 75 bp, Artificial Sequence
  Synthetic
tgcactatcttctgcacccttacaggcccgggtgcaagctgtgaagcattctcaggctcggggattttttcactg

SEQ ID NO: 335485 - DNA, 75 bp, Artificial Sequence
  Synthetic
acacactaaacagttaaaagataaatacattttaggaatatttaaatttctcatgttattggcccaagagacaat

SEQ ID NO: 335486 - DNA, 75 bp, Artificial Sequence
  Synthetic
cgggtcgattttgatttggaattttattgtaacggcaggcacaaagttattaggacaaaaacacttgtaataggc

SEQ ID NO: 335487 - DNA, 75 bp, Artificial Sequence
  Synthetic
ttcacatgaacgattagggaatttttctttcttaggtaaagtgcaatggaaagtattcataccaaagaatgagtt

SEQ ID NO: 335488 - DNA, 75 bp, Artificial Sequence
  Synthetic
tctttcttaggtaaagtgcaatggaaagtattcataccaaagaatgagtttgaattttccaatcttgtcagcatc

SEQ ID NO: 335489 - DNA, 75 bp, Artificial Sequence
  Synthetic
tcattcattggctgttgaaatctgtgttccaggtttccatggatttacagcagtttgccttgtaacaacattttg

SEQ ID NO: 335490 - DNA, 75 bp, Artificial Sequence
  Synthetic
aattatttaaatcaatggtctagtgaacatcctgtatatgattatattatcccacaattaagggatgatttatta

SEQ ID NO: 335491 - DNA, 75 bp, Artificial Sequence
  Synthetic
ttttggttggctatggatccctggagcaacatggggaatattacaaatactaaagattatagtcttgtttgtaac

SEQ ID NO: 335492 - DNA, 75 bp, Artificial Sequence
  Synthetic
gtatatcttgtgcggaaattgaatgatcctagtattgttacagccatgacattgcagtccccgttgcagcttaga

SEQ ID NO: 335493 - DNA, 75 bp, Artificial Sequence
  Synthetic
gaatagcaccatggatcagaggttcaagcgcatcctaacaaaaataaaggcagagtatagatctaccattggtga

SEQ ID NO: 335494 - DNA, 75 bp, Artificial Sequence
  Synthetic
tttcgtatgcaggcaaaacaacaccttcctgtgtgtaaatataatgataattgggtaactttcagaacagtcctt

SEQ ID NO: 335495 - DNA, 75 bp, Artificial Sequence
  Synthetic
gctgctgcccatgaatatgcatctaagtatattccgaatgagattgacttagacctatttaatactttggtatct

SEQ ID NO: 335496 - DNA, 75 bp, Artificial Sequence
  Synthetic
ataaccatatcatgtactgcaaacaaggtaaatgcccttactgcttaaatgaagtttatcattcacctactgctc

SEQ ID NO: 335497 - DNA, 75 bp, Artificial Sequence
  Synthetic
tccaagaacatttcaaattgtgtccattaattgataggtttaataagacaattaaggatcaaatttttaagacga

SEQ ID NO: 335498 - DNA, 75 bp, Artificial Sequence
  Synthetic
atacacagagcaaaagtagctagagtgttcactgtaaaagagcgagatcagattattcaaaatccaatatctgtt

SEQ ID NO: 335499 - DNA, 75 bp, Artificial Sequence
  Synthetic
gcgtaaagccacatagtactttatataaaaaattatgtgttttcagatacacaaacagatgctacatatttacag

SEQ ID NO: 335500 - DNA, 75 bp, Artificial Sequence
  Synthetic
gtcattgcttataaatttgcagtcggtacaaatgagattaaagatgtactagacaaagctaaatttcctgattct

SEQ ID NO: 335501 - DNA, 75 bp, Artificial Sequence
  Synthetic
acaaacagatgctacatatttacagtgtgggttacacttttgttttttcaactaataatatgggctgctagtgca

SEQ ID NO: 335502 - DNA, 75 bp, Artificial Sequence
  Synthetic
gtacaaatgagattaaagatgtactagacaaagctaaatttcctgattctctaagtagtgatttaaagttgttat

SEQ ID NO: 335503 - DNA, 75 bp, Artificial Sequence
  Synthetic
atgaaggtgtatatagagagcttgggcttgatataaatgacccttctgtcatgaaaagagtagcaccaatgttat

SEQ ID NO: 335504 - DNA, 75 bp, Artificial Sequence
  Synthetic
cttgcacaaaatgacaacagatattgaattagacttttctataccatcttcttcaaaatttacctataagaggtt

SEQ ID NO: 335505 - DNA, 75 bp, Artificial Sequence
  Synthetic
gaattagacttttctataccatcttcttcaaaatttacctataagaggtttttagagagccctgtcggtgaaaca

SEQ ID NO: 335506 - DNA, 75 bp, Artificial Sequence
  Synthetic
actgctgagagtatatgtacttactggctgagatcaatttcatttgtcaagcaaataaagattataccgcatgct

SEQ ID NO: 335507 - DNA, 75 bp, Artificial Sequence
  Synthetic
agaatgcaatttgctatgaagatatcacagcagaagacaattgcatcaattcaaaaattaggccattgggttgat

SEQ ID NO: 335508 - DNA, 75 bp, Artificial Sequence
  Synthetic
cacagcagaagacaattgcatcaattcaaaaattaggccattgggttgatgcacgctggaataccagaacagtat

SEQ ID NO: 335509 - DNA, 75 bp, Artificial Sequence
  Synthetic
tgactggtttgctgctttgtggtttgaaggtaagaccctttgggactggttgtactattttcagcgaaaaggtgt

SEQ ID NO: 335510 - DNA, 75 bp, Artificial Sequence
  Synthetic
tcccggagactgccctggaataaacacaggatgtacagcatgtggtctctatttagacaagccaaaatctatagc

SEQ ID NO: 335511 - DNA, 75 bp, Artificial Sequence
  Synthetic
accccttattgacccagaaatacaatgcgctgggttaatgatgtatgaccttttgagggatatgacatgcttgca

SEQ ID NO: 335512 - DNA, 75 bp, Artificial Sequence
  Synthetic
aacagtcataaaacttattcaaatagattatgagcgagaagtatgtattcaactgggaagctataatgaatgtaa

SEQ ID NO: 335513 - DNA, 75 bp, Artificial Sequence
  Synthetic
ttttgagggatatgacatgcttgcagatgcatgcaaataggagggcatactctggtaaacaatatgatgcctatt

SEQ ID NO: 335514 - DNA, 75 bp, Artificial Sequence
  Synthetic
acgagttacaggtaatgattgcttaagtacaaatggggtcaaggtttgccttttaagcactactgtcaaacttgg

SEQ ID NO: 335515 - DNA, 75 bp, Artificial Sequence
  Synthetic
gtatgcaaacatataatgaggaaacaaaactatatgagggggatttaagagttgtatttaactttggaattgact

SEQ ID NO: 335516 - DNA, 75 bp, Artificial Sequence
  Synthetic
ttcaacagacacgttagtcttctttgggccacttcaagctggagcagttgtgtttaaaaactggtgcacaagcaa

SEQ ID NO: 335517 - DNA, 75 bp, Artificial Sequence
  Synthetic
gcgcacggcttgagattttttgggaaaaacaaacctatgttcttgaaacatccattaccagtaagcctgttctta

SEQ ID NO: 335518 - DNA, 75 bp, Artificial Sequence
  Synthetic
ctgcgtatatggtgaccctggggatgtaatgttaacagaaaatggtgaatataattgccctgattttaatggaaa

SEQ ID NO: 335519 - DNA, 75 bp, Artificial Sequence
  Synthetic
gggtgttaatgcaagaagtatcaactgagctacagcgctgtggtctaaaatttgatacagtgcaaagcatgggtt

SEQ ID NO: 335520 - DNA, 75 bp, Artificial Sequence
  Synthetic
ataattgccctgattttaatggaaattttgagagggtttgtaggtttgcacaaactcctgtttgtgaatatggag

SEQ ID NO: 335521 - DNA, 75 bp, Artificial Sequence
  Synthetic
tttgatacagtgcaaagcatgggtttcaggtcagtcgtgttgttcaaaacagactcaggatttgaatggggaaaa

SEQ ID NO: 335522 - DNA, 75 bp, Artificial Sequence
  Synthetic
gtaacacaatttcaggttatcagcgctatcttgctactaaagactcattcttctctattaatatgactgacccca

SEQ ID NO: 335523 - DNA, 75 bp, Artificial Sequence
  Synthetic
ttttagaaagaagtaaactcgagtggtatgatcttgatgcaacatctcgtgatcatattaatgtccagataacaa

SEQ ID NO: 335524 - DNA, 75 bp, Artificial Sequence
  Synthetic
gaatttattattactatattagataatggttttaaagcaattgctcagcaagacttagatagcaatagatttcaa

SEQ ID NO: 335525 - DNA, 75 bp, Artificial Sequence
  Synthetic
gtatgatcttgatgcaacatctcgtgatcatattaatgtccagataacaaaggatttgaccttcgagaacctacg

SEQ ID NO: 335526 - DNA, 75 bp, Artificial Sequence
  Synthetic
ttagcacatgcatatcataatcttcgtgatatacggtatcaagcgcttgagacagttaacacagtgaactttact

SEQ ID NO: 335527 - DNA, 75 bp, Artificial Sequence
  Synthetic
aaagtcctgagcatagatggggcatggggttctgaaacaggcttttccttgaactgtaaagtatcactgcttgaa

SEQ ID NO: 335528 - DNA, 75 bp, Artificial Sequence
  Synthetic
gtcgatggaaaagtattatatttaaatcccattattgcagcaggcttaattgaaaatttcatgaaagggctccct

SEQ ID NO: 335529 - DNA, 75 bp, Artificial Sequence
  Synthetic
tgcaatagttttatcactgttattaaagcttgtgacaaggctatgtgctatggtgcaagttcacaaacactccaa

SEQ ID NO: 335530 - DNA, 75 bp, Artificial Sequence
  Synthetic
gcagtcatccctccacaagcttatagcctgattatgaaaaaggcaaaaataactgttgacctatttatgttcaat

SEQ ID NO: 335531 - DNA, 75 bp, Artificial Sequence
  Synthetic
cgtggagataatacagtgagtattcagggcagaggtggacatagtggctccaaatttaaatgctgccatgaagaa

SEQ ID NO: 335532 - DNA, 75 bp, Artificial Sequence
  Synthetic
aagcttttggcccttataaatcctgagaacactttcaatatggagggtattgaaagtgatgaccctgaatacagc

SEQ ID NO: 335533 - DNA, 75 bp, Artificial Sequence
  Synthetic
gattgcgctgaagaaggtttattggctgaagctccacatttagctagagtaaaatcagttgatgttgatacaagt

SEQ ID NO: 335534 - DNA, 75 bp, Artificial Sequence
  Synthetic
agaacactttcaatatggagggtattgaaagtgatgaccctgaatacagcactgtaactacactttcggttaagg

SEQ ID NO: 335535 - DNA, 75 bp, Artificial Sequence
  Synthetic
aaaatcagttgatgttgatacaagtgaaatttattcagacggttcaggggagtgccgaattacttgctggttatc

SEQ ID NO: 335536 - DNA, 75 bp, Artificial Sequence
  Synthetic
aatgggcagaagaaaaagacattgaagatgctgaagttgaagatgatgaatatgtcattgacttaaatgacattg

SEQ ID NO: 335537 - DNA, 75 bp, Artificial Sequence
  Synthetic
agatgctgaagttgaagatgatgaatatgtcattgacttaaatgacattgattttgataaagttgatactcttgc

SEQ ID NO: 335538 - DNA, 75 bp, Artificial Sequence
  Synthetic
taaaactagtgagtggttcatgggaatattatctggtaactggttggttatagtggtactggtcgtaataatgat

SEQ ID NO: 335539 - DNA, 75 bp, Artificial Sequence
  Synthetic
actcagcatcatgcttcttagctttttttgcccaagtaaaaaacatcaggcttagcacaatgattctcattactg

SEQ ID NO: 335540 - DNA, 75 bp, Artificial Sequence
  Synthetic
cttagcacaatgattctcattactgcttattaatatcattgctttctaccatcagcagcattaaaaataaataaa

SEQ ID NO: 335541 - DNA, 75 bp, Artificial Sequence
  Synthetic
aaaacgagtgcgtggcattgtgaagttgttagaacctatcaagttaataaaaagctgggtctcaaaaggtttagc

SEQ ID NO: 335542 - DNA, 75 bp, Artificial Sequence
  Synthetic
atcagcagcattaaaaataaataaaaaaataaaaaaataataaaaaataaataaaaaaataaaaataaaaaaata

SEQ ID NO: 335543 - DNA, 75 bp, Artificial Sequence
  Synthetic
aatagaaaaaatatatgatccattagctgttatacttgtcactcggtatttttcaaagcagtattcattctcaaa

SEQ ID NO: 335544 - DNA, 75 bp, Artificial Sequence
  Synthetic
aaaaaacaacacatttttgggtaataacccatttctgtaattctttgtcttttgttcttgcggagtatactacta

SEQ ID NO: 335545 - DNA, 75 bp, Artificial Sequence
  Synthetic
agtgcccctagctcaattggacccatataatctcactgaacttgaaagtatagttagaggttggggtgaattagt

SEQ ID NO: 335546 - DNA, 75 bp, Artificial Sequence
  Synthetic
tagttagaggttggggtgaattagtctgtgatcaatttcatgagttagatcagcaggcccatgcttttatacaaa

SEQ ID NO: 335547 - DNA, 75 bp, Artificial Sequence
  Synthetic
agacatgctgagcttttgttttctagactttttttacctgatactgtctctgttttttactaaagttattctcta

SEQ ID NO: 335548 - DNA, 75 bp, Artificial Sequence
  Synthetic
tttttactaaagttattctctaactctttactttctttatttgttggttgtgtatcccggagcatactactacta

SEQ ID NO: 335549 - DNA, 75 bp, Artificial Sequence
  Synthetic
tagtagtagactccggaaatagacaatagagaaaaataccgtagaaaaactgcatttaacatgcagaggtactat

SEQ ID NO: 335550 - DNA, 75 bp, Artificial Sequence
  Synthetic
gaaatcagggataggattcatggccttgaaccagggggtgtaggggcaattgaatgtattgaccttttagactct

SEQ ID NO: 335551 - DNA, 75 bp, Artificial Sequence
  Synthetic
ctatatgccattagacatgatcttattgatgaaatgataaaacatgactggtctgataataaagataaggaaaca

SEQ ID NO: 335552 - DNA, 75 bp, Artificial Sequence
  Synthetic
cctatatctgatgtgttgatctacgcaggtatcccattagacttaattacaggtatggaaaaaattagaattaca

SEQ ID NO: 335553 - DNA, 75 bp, Artificial Sequence
  Synthetic
caggtatcccattagacttaattacaggtatggaaaaaattagaattacagaccaccctactgggaaaacactgc

SEQ ID NO: 335554 - DNA, 75 bp, Artificial Sequence
  Synthetic
atcaattctttaaatcaacacctgataattacaaaattgaaggcactacaatcaaatttattgaagtaacagtta

SEQ ID NO: 335555 - DNA, 75 bp, Artificial Sequence
  Synthetic
caagccaagaacctattaaactgtaacctggtaaatataaatagcttgtaaatagttttctttgcttctaatgct

SEQ ID NO: 335556 - DNA, 75 bp, Artificial Sequence
  Synthetic
acctggtaaatataaatagcttgtaaatagttttctttgcttctaatgctttgcttgcttgcttactaacttgtt

SEQ ID NO: 335557 - DNA, 75 bp, Artificial Sequence
  Synthetic
cagtcgatgtagagaaaggtatatatgaaaaaaagaaaaaataccaaggtgggttcaatcaaattcaagttgaat

SEQ ID NO: 335558 - DNA, 75 bp, Artificial Sequence
  Synthetic
ccccgcttagctttccccgctactaaccccaagttatttgatctctctaattgttgtacagggagcatactacta

SEQ ID NO: 335559 - DNA, 75 bp, Artificial Sequence
  Synthetic
tagtagtagactccggaaatagacaatagagaaaaatactaataaaaaaactgcattcaatatgcagaggtacta

SEQ ID NO: 335560 - DNA, 75 bp, Artificial Sequence
  Synthetic
tagacaagtattggcaacaaggcaaattacctaataaatacacaatagcatatgacattgtggcagttaaagctg

SEQ ID NO: 335561 - DNA, 75 bp, Artificial Sequence
  Synthetic
tctatatgccattagacatgatcttattgatgaaatgataaaacatgactggtctgataataaagataaggaaac

SEQ ID NO: 335562 - DNA, 75 bp, Artificial Sequence
  Synthetic
gctcttgaatctatgtttaatctaaaattccacacacatgtagagcgggaatttaaatatgtattacctgagtat

SEQ ID NO: 335563 - DNA, 75 bp, Artificial Sequence
  Synthetic
acccatatctgatgtgttgatctatgcaggtatcccattagatttgattacaggtatggaaaaaattagaattac

SEQ ID NO: 335564 - DNA, 75 bp, Artificial Sequence
  Synthetic
gcaggtatcccattagatttgattacaggtatggaaaaaattagaattacagaccatcctaccggaaagacactg

SEQ ID NO: 335565 - DNA, 75 bp, Artificial Sequence
  Synthetic
ccagatattcctgattgtgaagctaatcaagaaaaacttcttacacatctaaaggcatggcttacaaagaagcaa

SEQ ID NO: 335566 - DNA, 75 bp, Artificial Sequence
  Synthetic
catcaattctttaaatcaacacctgataattacaaaattgaaggcactacaatcaaatttattgaagtgacagtt

SEQ ID NO: 335567 - DNA, 75 bp, Artificial Sequence
  Synthetic
accttctcttttcatgaggttacaggtgaaaaaataagtcaggcatttagagagtatgaggctgagcaagagaac

SEQ ID NO: 335568 - DNA, 75 bp, Artificial Sequence
  Synthetic
acggtcgatgtagagaaaggtatatatgaaaagaagaaaaaataccaaggtgggttcaatcagatacaagtagaa

SEQ ID NO: 335569 - DNA, 75 bp, Artificial Sequence
  Synthetic
atgtatccgaagtcacgaaaaccaaggaattttttgttattacaaattggattacaggctgaatataatcctatg

SEQ ID NO: 335570 - DNA, 75 bp, Artificial Sequence
  Synthetic
ttagacaagtattggcaacaaggtaaattacctaataaatacacaatagtatatgatattgtggcagttaaggct

SEQ ID NO: 335571 - DNA, 75 bp, Artificial Sequence
  Synthetic
gatggatccaacttgtcaacacaatggcctagtacaaggtcaccaggtgttgttcaacacatgagaatggttcaa

SEQ ID NO: 335572 - DNA, 75 bp, Artificial Sequence
  Synthetic
gctgaaatacaatatgtaagggaaagactcatacgggttaatgaaaaaagtgctcttgaatctatgtttaactta

SEQ ID NO: 335573 - DNA, 75 bp, Artificial Sequence
  Synthetic
gtgtaccagagccaggttgtttgaaaattaatatgagctcgctagatgaaatgtcaaggagtattgtggaacaaa

SEQ ID NO: 335574 - DNA, 75 bp, Artificial Sequence
  Synthetic
atgtcaaggagtattgtggaacaaaccaaaggttcccaagataaaacaagctctgaaatagaatcacttcatcct

SEQ ID NO: 335575 - DNA, 75 bp, Artificial Sequence
  Synthetic
tccagatattcctgattgtgaagctaatcaggaaaaacttcttacacatctaaaggcatggcttacaaagaagca

SEQ ID NO: 335576 - DNA, 75 bp, Artificial Sequence
  Synthetic
aatcaggaaaaacttcttacacatctaaaggcatggcttacaaagaagcaaactttctctttccatgaggttaca

SEQ ID NO: 335577 - DNA, 75 bp, Artificial Sequence
  Synthetic
aactttctctttccatgaggttacaggtgaaaaaataagtcaggcatttagagagtatgaggctgagcaagagag

SEQ ID NO: 335578 - DNA, 75 bp, Artificial Sequence
  Synthetic
actgataatgaagatataactagttataggaaaagatcccctgtagacacactcttagagcggtttataaaaagc

SEQ ID NO: 335579 - DNA, 75 bp, Artificial Sequence
  Synthetic
catgtacccaaagtcacgaaaaccacggaattttttgttattacaaattggattacagtctgaatataatcctat

SEQ ID NO: 335580 - DNA, 75 bp, Artificial Sequence
  Synthetic
gagacagagaaatacttaattaaagtgttaaagaagactgtaggttggcatttgggtcacttaatacgggatgtt

SEQ ID NO: 335581 - DNA, 75 bp, Artificial Sequence
  Synthetic
acaaagttggctgcaagtattattatcagtgagtcacctgaaacacctgtacaagcccttgtgaaagatgtatgt

SEQ ID NO: 335582 - DNA, 75 bp, Artificial Sequence
  Synthetic
actttcaggcttccatcaaggtaatgttttgttggttatgctgccttcaaaatcactagaagtatctaatgctca

SEQ ID NO: 335583 - DNA, 75 bp, Artificial Sequence
  Synthetic
tacaattatatgatgttagataatatcgaaattaataattattatagtccagcccatctatttgacaaaactagg

SEQ ID NO: 335584 - DNA, 75 bp, Artificial Sequence
  Synthetic
tgtgaggtttattctagtacacaaggaaggttttggttgtgtagatcctgataatattgattcaaagaaatcaat

SEQ ID NO: 335585 - DNA, 75 bp, Artificial Sequence
  Synthetic
gaaggttttggttgtgtagatcctgataatattgattcaaagaaatcaataaatggtgtgatctgggtttattct

SEQ ID NO: 335586 - DNA, 75 bp, Artificial Sequence
  Synthetic
agtgtaccagagccaggttgtttaaaaatcaatatgagctcgttagatgaaatgtcaaggagtattgtggaacaa

SEQ ID NO: 335587 - DNA, 75 bp, Artificial Sequence
  Synthetic
tcgaaattaataattattatagtccagcccatctatttgacaaaactaggagtgtaccagagccaggttgtttaa

SEQ ID NO: 335588 - DNA, 75 bp, Artificial Sequence
  Synthetic
accaaaggttcacaagataaaacaaactctgaaatagaatcactccatccctgggcacagtctgaagccaataca

SEQ ID NO: 335589 - DNA, 75 bp, Artificial Sequence
  Synthetic
tgaaaaggcattccttgcaacagcagtttggtttcaatacttcactgaagatcaagggatgttccctttacagtc

SEQ ID NO: 335590 - DNA, 75 bp, Artificial Sequence
  Synthetic
ttcggttaagagtgtttttgcttataaactacttcttgcaatgacacagaaaatgaaagtatgtgcattatttga

SEQ ID NO: 335591 - DNA, 75 bp, Artificial Sequence
  Synthetic
aaactacttcttgcaatgacacagaaaatgaaagtatgtgcattatttgataaccctcagtatttaataccttca

SEQ ID NO: 335592 - DNA, 75 bp, Artificial Sequence
  Synthetic
aactgatactgaagatataactagttatagaaaaagatcccctgtagacacactcttggagcggtttataaaaag

SEQ ID NO: 335593 - DNA, 75 bp, Artificial Sequence
  Synthetic
tgtacagctagttattctggtgctgcaagtctcattgaaaaatttgttaagaggccatttaagagttcattagaa

SEQ ID NO: 335594 - DNA, 75 bp, Artificial Sequence
  Synthetic
tgagacagaaaaatacttaattaaagtattaaagaagactgtaggttggcatttgggtcacttaatacgggatgt

SEQ ID NO: 335595 - DNA, 75 bp, Artificial Sequence
  Synthetic
gtctatgtctacacgaaatcaaaagagcttttaataagccttgctcaaaacaataaatttaggtactattcaaaa

SEQ ID NO: 335596 - DNA, 75 bp, Artificial Sequence
  Synthetic
cacagagagcatgattgcccatgcaggcttgaaacgatctaagtattggtcactctcaggcttccatcaaggtaa

SEQ ID NO: 335597 - DNA, 75 bp, Artificial Sequence
  Synthetic
gtgagaatgttaggtttaacagttgatcaatctagtgtaggtgctactgggatttacccatccttggtttgccat

SEQ ID NO: 335598 - DNA, 75 bp, Artificial Sequence
  Synthetic
actgtgtatcggcattatagatcactcatttctgaaatcaccacttgtttttttctatttgaaaaaggacttcat

SEQ ID NO: 335599 - DNA, 75 bp, Artificial Sequence
  Synthetic
gataatattgattcaaagaaatcaataaatggtgtgatctggatttattcgaaaccaatgacattagacctgaat

SEQ ID NO: 335600 - DNA, 75 bp, Artificial Sequence
  Synthetic
ggtacgatgacagaggaagccaagatccatttagagactgtagaatgggcaaataattttaaagagaaagaagca

SEQ ID NO: 335601 - DNA, 75 bp, Artificial Sequence
  Synthetic
tccatttagagactgtagaatgggcaaataattttaaagagaaagaagcaaagtatggtaaaggcctagtagaat

SEQ ID NO: 335602 - DNA, 75 bp, Artificial Sequence
  Synthetic
ttgaaaaggcattccttgcaacagcagtttggtttcaatacttcactgaagatcaagggatgttccctttacagt

SEQ ID NO: 335603 - DNA, 75 bp, Artificial Sequence
  Synthetic
cttcaattaagagtgtttttgcttataaactacttcttgcaatgacacagaaaatgaaagtatgtgcactatttg

SEQ ID NO: 335604 - DNA, 75 bp, Artificial Sequence
  Synthetic
agcttgcaacattggaactaaataaggttttgacatcaaaaagccaagttatctctaactctataatgaataaac

SEQ ID NO: 335605 - DNA, 75 bp, Artificial Sequence
  Synthetic
aaaatgaaagtatgtgcactatttgataacctaaggtatttaataccttcatgtacagctagttattctggtgct

SEQ ID NO: 335606 - DNA, 75 bp, Artificial Sequence
  Synthetic
actgggaggaaccctatttcagccagaccaggaatataagtttaaaaggtatgtcaggcgaactacaggaagatg

SEQ ID NO: 335607 - DNA, 75 bp, Artificial Sequence
  Synthetic
agtctatgtctacataaaatcgaaagagcttctaataagccttgctcaaaataataagttcaggtactattcaaa

SEQ ID NO: 335608 - DNA, 75 bp, Artificial Sequence
  Synthetic
ggcatctagcttctagttatacacttatagaggctatacgctatttaaataaagtaaggcggaatccaacggtat

SEQ ID NO: 335609 - DNA, 75 bp, Artificial Sequence
  Synthetic
agtaagaatgttaggtttaacagttgatcaatctagtgtaggcgcaactgggatctacccatctttggtgtgcca

SEQ ID NO: 335610 - DNA, 75 bp, Artificial Sequence
  Synthetic
tagaactttataatgagactagagacatacgtgcacaagctaggatagtaaggaaacatcagaggacagaagctg

SEQ ID NO: 335611 - DNA, 75 bp, Artificial Sequence
  Synthetic
ggatctacccatctttggtgtgccatactgtgtatcggcattacagatcacttatttctgaaatcaccacttgtt

SEQ ID NO: 335612 - DNA, 75 bp, Artificial Sequence
  Synthetic
tactgtgtatcggcattacagatcacttatttctgaaatcaccacttgtttttttctctttgagaaagggcttca

SEQ ID NO: 335613 - DNA, 75 bp, Artificial Sequence
  Synthetic
acagaggtttttttattacgacactaccaacccgggtccggttagaaattatagaagattattttgattctatat

SEQ ID NO: 335614 - DNA, 75 bp, Artificial Sequence
  Synthetic
caaaaaatgtccaggaggaatatatatcttatgggggtgaaaaaaagatcctccaaatccaaggctctctagaaa

SEQ ID NO: 335615 - DNA, 75 bp, Artificial Sequence
  Synthetic
aaagtatggtaaagacctagtagagtttgggtacactattgagcatttaatcaatgatgaaattattccagagca

SEQ ID NO: 335616 - DNA, 75 bp, Artificial Sequence
  Synthetic
aggccttgaggtgggcttcagggacaagtaccatctctttgtcaacaggtgatcaaataacatttaaaagaaagc

SEQ ID NO: 335617 - DNA, 75 bp, Artificial Sequence
  Synthetic
acaattatactgtaaaaatgtcataaagttagcaacattggaattgaacaaggttttgacatcaaaaagccaagt

SEQ ID NO: 335618 - DNA, 75 bp, Artificial Sequence
  Synthetic
gctaaattcagactattcacatcacatattcatgatgggctaaaagatagacgattaaagcattgtgttattgat

SEQ ID NO: 335619 - DNA, 75 bp, Artificial Sequence
  Synthetic
tatttctaactctataatgaataaacactgggaggagccctatttcagccagaccaggaatataagtttaaaggg

SEQ ID NO: 335620 - DNA, 75 bp, Artificial Sequence
  Synthetic
atattcatgatgggctaaaagatagacgattaaagcattgtgttattgatgcactcaagggcatctatgaaacag

SEQ ID NO: 335621 - DNA, 75 bp, Artificial Sequence
  Synthetic
tatgtcaggtgaactacaggaagatggccatctagcttctagttatacacttatagaggctatacgctatttgaa

SEQ ID NO: 335622 - DNA, 75 bp, Artificial Sequence
  Synthetic
tagatttctttgattactcaaaaggtagatcaggtttagtgagaggtaattggttgcaaggaaatttaaacaagt

SEQ ID NO: 335623 - DNA, 75 bp, Artificial Sequence
  Synthetic
taaagcaaagcggaatccaacggtattagaactttacaatgagactagagatatacgtgcacaagctaggatagt

SEQ ID NO: 335624 - DNA, 75 bp, Artificial Sequence
  Synthetic
gctcttcattgttttctgtagctattagcttcttgtttaaggagatgtggtcgagattattcccagaattggatt

SEQ ID NO: 335625 - DNA, 75 bp, Artificial Sequence
  Synthetic
gttttattggatttgctcatcattctgatgatgctctattcatttatggatatctagaaccagaaggtgatggct

SEQ ID NO: 335626 - DNA, 75 bp, Artificial Sequence
  Synthetic
tatagaagattattttgattctatatcaaagaatgtccaggaggaatatatatcttatggaggtgaaaaaaagat

SEQ ID NO: 335627 - DNA, 75 bp, Artificial Sequence
  Synthetic
ctgattggtatctgtatgtaacacaaaagatacaagcaggtgaattatactggcattctgtgaacacggaaatgt

SEQ ID NO: 335628 - DNA, 75 bp, Artificial Sequence
  Synthetic
tctccaaattcaagggtccttagaaaaggctttaaggtgggcttcagggacaagcaccatctctttgtcaacagg

SEQ ID NO: 335629 - DNA, 75 bp, Artificial Sequence
  Synthetic
ggaagacaatgttcaacatgcatgaataccttttgctcctaggttctgtcaaagtctctcctaagaagaccactg

SEQ ID NO: 335630 - DNA, 75 bp, Artificial Sequence
  Synthetic
tgatcaaataacatttaaaagaaagttaatgtatgtaagtgcagatgcaactaaatggtctcctggggataactc

SEQ ID NO: 335631 - DNA, 75 bp, Artificial Sequence
  Synthetic
ctaaatggtctcctggggataactcagctaaattcagactattcacatcacatattcatgatgggctaaaagata

SEQ ID NO: 335632 - DNA, 75 bp, Artificial Sequence
  Synthetic
tctcaccaactaacgctgagtttttgtcaacattttttgagggatgtgcagtgtctatcccattttcaaaaattc

SEQ ID NO: 335633 - DNA, 75 bp, Artificial Sequence
  Synthetic
agctaaattcagactattcacatcacatattcatgatgggctaaaagatagacgattaaagcactgtgtcattga

SEQ ID NO: 335634 - DNA, 75 bp, Artificial Sequence
  Synthetic
tattaggtgcattatctgatttacctggattaggttttttcgatgatttggctgcatcacaatcacgttgtgtga

SEQ ID NO: 335635 - DNA, 75 bp, Artificial Sequence
  Synthetic
tgcactcaagggcatctatgagacagaattttttatttcaaggagattaagaggctatatagagaatatggaaga

SEQ ID NO: 335636 - DNA, 75 bp, Artificial Sequence
  Synthetic
gaggctatatagagaatatggaagaattagaacacaatgttcaagagttcttagatttctttgattactcaaagg

SEQ ID NO: 335637 - DNA, 75 bp, Artificial Sequence
  Synthetic
aggccctagacatgggagcttcacctcaagttgctcaactagctgttaatttaacaaattcgaaggttgagcgat

SEQ ID NO: 335638 - DNA, 75 bp, Artificial Sequence
  Synthetic
gtagatcaggtctagtgagaggtaattggttgcagggaaatttaaacaagtgctcttcactgttttctgtagcta

SEQ ID NO: 335639 - DNA, 75 bp, Artificial Sequence
  Synthetic
tatatggcacagcaccaggtatggctaataacccctgcaattatatagacttagaccgagacaagatacctatat

SEQ ID NO: 335640 - DNA, 75 bp, Artificial Sequence
  Synthetic
tcagcttcttgtttaaggagatgtggtcgagattatttcctgaattggattgttttattgaatttgctcatcatt

SEQ ID NO: 335641 - DNA, 75 bp, Artificial Sequence
  Synthetic
gtttgggtggtatcgggtcatcttctatactagaacttgcaactgcaggaattgggatgtctgataaactcgttc

SEQ ID NO: 335642 - DNA, 75 bp, Artificial Sequence
  Synthetic
cagatgatgctctatttatttatggttatcttgagccagaaggtgatggctctgattggtatctgtatgtaacac

SEQ ID NO: 335643 - DNA, 75 bp, Artificial Sequence
  Synthetic
ttatcttgagccagaaggtgatggctctgattggtatctgtatgtaacacaaaaaatacaagcaggtgaattata

SEQ ID NO: 335644 - DNA, 75 bp, Artificial Sequence
  Synthetic
taaaaaatgccttgatttcattccggcatactaaacagtcaaaagataaatacattttaggaatatataaatttc

SEQ ID NO: 335645 - DNA, 75 bp, Artificial Sequence
  Synthetic
tcatgttattggcccaagagacattcaaacatgagagattagggaatttttctttcttaggtaaagtgcaatgga

SEQ ID NO: 335646 - DNA, 75 bp, Artificial Sequence
  Synthetic
ctggcattctgtgaacacagagatgtggaaaacaatgttcaacatgcatgaataccttttactactaggttctgt

SEQ ID NO: 335647 - DNA, 75 bp, Artificial Sequence
  Synthetic
aataccttttactactaggttctgtcaaagtctctcctaagaagactactgtttcaccaactaatgctgaatttt

SEQ ID NO: 335648 - DNA, 75 bp, Artificial Sequence
  Synthetic
aggtatttataccaaagaatgagtttgaattttccaacctgttcagcattagttatttaaatcaatggtccagtg

SEQ ID NO: 335649 - DNA, 75 bp, Artificial Sequence
  Synthetic
tgtcaacattttttgagggatgtgcagtgtcaatcccattttcaaaaattctattaggtgcactatctgatttac

SEQ ID NO: 335650 - DNA, 75 bp, Artificial Sequence
  Synthetic
agtgtcaatcccattttcaaaaattctattaggtgcactatctgatttacctggattaggctttttcgatgattt

SEQ ID NO: 335651 - DNA, 75 bp, Artificial Sequence
  Synthetic
cccacaattgagggatgatttattagtgtatcttgtgcggaaattgaatgatcctagtattgttacagccatgac

SEQ ID NO: 335652 - DNA, 75 bp, Artificial Sequence
  Synthetic
ggctgcatcacagtcacgttgtgtgaaagccttagatatgggagcttcacctcaagttgctcaactggctgttaa

SEQ ID NO: 335653 - DNA, 75 bp, Artificial Sequence
  Synthetic
actacaatccccattacagcttagatttcgaatgcaggcaaaacagcaccttcctgtgtgtaaatataatgacaa

SEQ ID NO: 335654 - DNA, 75 bp, Artificial Sequence
  Synthetic
tctaacaaattcaaaggtcgagcgattatatggtacagcaccaggtatggctaataatccctgcaattatataga

SEQ ID NO: 335655 - DNA, 75 bp, Artificial Sequence
  Synthetic
ttgggtaacttttagaacagtccttgcggctgcccatgaatatgcatctaagtatatgcccaatgaaattgactt

SEQ ID NO: 335656 - DNA, 75 bp, Artificial Sequence
  Synthetic
agatctctttaatactttggtatcttgtacattttcaaaagaatttgcatggaaggattttataagcaacacaga

SEQ ID NO: 335657 - DNA, 75 bp, Artificial Sequence
  Synthetic
aattgggatgtctgataagctcgttctaaaaaatgccttaatttcattccgacacactaaacagttaaaagataa

SEQ ID NO: 335658 - DNA, 75 bp, Artificial Sequence
  Synthetic
atgtgaggttatattatcaagaaaaatacacagagcaaaagtagctagagtattcactgtaaaagaacgagatca

SEQ ID NO: 335659 - DNA, 75 bp, Artificial Sequence
  Synthetic
gataattcaaaatccaatatctgttgtcattgcgtataaatttgcagttggtacaaatgagattaaagatgtact

SEQ ID NO: 335660 - DNA, 75 bp, Artificial Sequence
  Synthetic
ctcatgttattggcccaagagacattccaacatgaacgattgggagaatttctcttcttaggtaaagtgcaatgg

SEQ ID NO: 335661 - DNA, 75 bp, Artificial Sequence
  Synthetic
gtacaaatgagattaaagatgtactagataaagctaaatttcctgattctttaagtagtgatttaaagttgttat

SEQ ID NO: 335662 - DNA, 75 bp, Artificial Sequence
  Synthetic
aaagtatttataccaaagaatgagtttgagttttccaacttgttcagcatcaattatttaaatcagtggtctagt

SEQ ID NO: 335663 - DNA, 75 bp, Artificial Sequence
  Synthetic
tcccacaattgagggatgatttattagtgtaccttgtgcggaaattgaatgatcctagtattgttacagccatga

SEQ ID NO: 335664 - DNA, 75 bp, Artificial Sequence
  Synthetic
ataagactagcaggtctaggattgtaattgtgaatggcaatgtggaaggaactgctgagagtatatgtacttact

SEQ ID NO: 335665 - DNA, 75 bp, Artificial Sequence
  Synthetic
gatcctagtattgttacagccatgacattgcagtctccgttgcagcttagatatcgtatgcaggcaaaacagcac

SEQ ID NO: 335666 - DNA, 75 bp, Artificial Sequence
  Synthetic
ggctaagatcaatttcgtttgtcaagcaaatcaagattatcccgcatgctgaggttttgaaggctgtttcaatct

SEQ ID NO: 335667 - DNA, 75 bp, Artificial Sequence
  Synthetic
cttcctgtgtgtaaatataatgacaattgggtaaccttcagaacagtccttgctgctgcccatgaatatgcatct

SEQ ID NO: 335668 - DNA, 75 bp, Artificial Sequence
  Synthetic
gaggttttgaaggctgtttcaatctttagtaaaggagagttcgtacaggaagataaacaattagctgctttgaga

SEQ ID NO: 335669 - DNA, 75 bp, Artificial Sequence
  Synthetic
tgctgctgcccatgaatatgcatctaagtatattccgaatgagatcgatttagatctgttcaatactttggtatc

SEQ ID NO: 335670 - DNA, 75 bp, Artificial Sequence
  Synthetic
ctgtgcattgaaatctggagatggggaaaatacaatagagtagacattaatgactggtttgctgctttgtggttt

SEQ ID NO: 335671 - DNA, 75 bp, Artificial Sequence
  Synthetic
gaaggtaaaaccctctgggactggttgtactattttcagcggaaaggtgtacctcttgttgacccagaaatacaa

SEQ ID NO: 335672 - DNA, 75 bp, Artificial Sequence
  Synthetic
aatacacagagcaaaggtagctagagtattcactgtaaaagagcgagaccagattattcaaaatccgatatctgt

SEQ ID NO: 335673 - DNA, 75 bp, Artificial Sequence
  Synthetic
tgtgctgggttaatgatgtatgaccttttgagggatatgacatgcttacagatgcatgcaaataggagggcttat

SEQ ID NO: 335674 - DNA, 75 bp, Artificial Sequence
  Synthetic
tctggtaaacagtatgatgcttactgtatgcaaacatataatgaggaaacaaaactttatgagggggatttaaga

SEQ ID NO: 335675 - DNA, 75 bp, Artificial Sequence
  Synthetic
tagacaaagcaaagtttcctgattctttgagtagtgatttaaagttgttgtatgagggtgtatatagagaacttg

SEQ ID NO: 335676 - DNA, 75 bp, Artificial Sequence
  Synthetic
ggcttgatataaatgacccttctgtcatgaaaagagtagcaccaatgttatataagactagcaggtctagaattg

SEQ ID NO: 335677 - DNA, 75 bp, Artificial Sequence
  Synthetic
tccattaccagtaagcctgttcttagggtattgatgcaagaagtatcaactgaactacagcgctgtggtttaaaa

SEQ ID NO: 335678 - DNA, 75 bp, Artificial Sequence
  Synthetic
taattgtgaatggcaatgttgaaggaactgctgagagtatatgtacttactggctgagatcaatttcgtttgtca

SEQ ID NO: 335679 - DNA, 75 bp, Artificial Sequence
  Synthetic
aactgctgagagtatatgtacttactggctgagatcaatttcgtttgtcaaacaaataaagattatcccgcatgc

SEQ ID NO: 335680 - DNA, 75 bp, Artificial Sequence
  Synthetic
tttgatacagtgcaaagcatgggttttaggtcagttgtgttgttcaaaacagactcagggtttgagtggggaaaa

SEQ ID NO: 335681 - DNA, 75 bp, Artificial Sequence
  Synthetic
aacaaataaagattatcccgcatgctgaggttttgaaggctgtttcaatctttagtaaaggagaattcgtacagg

SEQ ID NO: 335682 - DNA, 75 bp, Artificial Sequence
  Synthetic
ccaaatgtaccatgtattatttttaaaaactgtgcactacgcccaactcttcgaaataagcaggtgctaaataag

SEQ ID NO: 335683 - DNA, 75 bp, Artificial Sequence
  Synthetic
aagataagcaattagctgctttgagactgtgcattgaaatctggagatggggaaaatataatagagtagacatta

SEQ ID NO: 335684 - DNA, 75 bp, Artificial Sequence
  Synthetic
gaatttattattaccatattagataatggttttaaagcaattgcccagcaagacttagatagtaataggtttcaa

SEQ ID NO: 335685 - DNA, 75 bp, Artificial Sequence
  Synthetic
atgactggtttgctgctctgtggtttgaaggtaagaccctttgggactggttgtactattttcagcgaaaaggtg

SEQ ID NO: 335686 - DNA, 75 bp, Artificial Sequence
  Synthetic
ttgtactattttcagcgaaaaggtgtacctcttgttgacccagaaatacaatgcgctgggttaatgatgtatgat

SEQ ID NO: 335687 - DNA, 75 bp, Artificial Sequence
  Synthetic
gtgatatacggtatcaagcgattgagacagttaacacagtgaactttactgttgatggaaaagtattgtatttaa

SEQ ID NO: 335688 - DNA, 75 bp, Artificial Sequence
  Synthetic
cttttgagggatatgacatgtttacagatgcatgcaaataggagggcatactctggtaaacaatatgatgcttac

SEQ ID NO: 335689 - DNA, 75 bp, Artificial Sequence
  Synthetic
atcctattattgcagcaggcttaattgaaaattttatgaaaggactccctgcagtcatccctccacaagcttata

SEQ ID NO: 335690 - DNA, 75 bp, Artificial Sequence
  Synthetic
ctctggtaaacaatatgatgcttactgtatgcaaacatataatgaagaaacaaagctatatgagggggatttaag

SEQ ID NO: 335691 - DNA, 75 bp, Artificial Sequence
  Synthetic
gcctgattatgaaaaaggcaaaaataactgttgacctatttatgtttaacaagcttctggcccttataaatcctg

SEQ ID NO: 335692 - DNA, 75 bp, Artificial Sequence
  Synthetic
aactgttgacctatttatgtttaacaagcttctggcccttataaatcctgagaataccttcaacatggaaggtat

SEQ ID NO: 335693 - DNA, 75 bp, Artificial Sequence
  Synthetic
tgtgcaaggcttgagattttttgggaaaaacgaacctatgttcttgaaacatccattaccagtaagcctgttctt

SEQ ID NO: 335694 - DNA, 75 bp, Artificial Sequence
  Synthetic
atccattaccagtaagcctgttcttagggtattaatgcaagaagtatcaactgaactacagcgttgtggtttgaa

SEQ ID NO: 335695 - DNA, 75 bp, Artificial Sequence
  Synthetic
tgaaagtgatgaccctgaatatagtactgtaactacactttctgttaaggaatgggcagaagaaaaagacattga

SEQ ID NO: 335696 - DNA, 75 bp, Artificial Sequence
  Synthetic
atttgatacagtacaaagcatgggtttcaggtcagtcgtgttgttcaaaacagactcaggatttgagtggggaaa

SEQ ID NO: 335697 - DNA, 75 bp, Artificial Sequence
  Synthetic
agatgctgaggttgaagatgatgaatatgtcattgacttaaatgacatcgattttgataaagttgatacccttgc

SEQ ID NO: 335698 - DNA, 75 bp, Artificial Sequence
  Synthetic
ttcaggtcagtcgtgttgttcaaaacagactcaggatttgagtggggaaaaccaaatgtaccatgtattattttc

SEQ ID NO: 335699 - DNA, 75 bp, Artificial Sequence
  Synthetic
tgacattcaacatttcttacaagatgaatcagcatatacagcagaccttgttattgacaccgagtcagttgaatc

SEQ ID NO: 335700 - DNA, 75 bp, Artificial Sequence
  Synthetic
aaaaactgtgcactacgcccaactcttcgaaataagcaggtgctaaataaggaatttatcattactatattagat

SEQ ID NO: 335701 - DNA, 75 bp, Artificial Sequence
  Synthetic
aaaacgagtacgtggtattgtgaagttgctggaacctatcaagttaataaaaagttgggtctcaaaaggtttagc

SEQ ID NO: 335702 - DNA, 75 bp, Artificial Sequence
  Synthetic
aatggttttaaagcaattgcccagcaagacctagacagcaatagatttcaattagcacatgcataccataatctt

SEQ ID NO: 335703 - DNA, 75 bp, Artificial Sequence
  Synthetic
aatagaaaaaatatatgacccattagctgtcatacttgttactcggtatttttcaaagcagtattcattttcaaa

SEQ ID NO: 335704 - DNA, 75 bp, Artificial Sequence
  Synthetic
cgtgatatacgatatcaagcacttgagacagttaacacagtgaactttactgttgatggaaaagtattatattta

SEQ ID NO: 335705 - DNA, 75 bp, Artificial Sequence
  Synthetic
agtgcccttagctcaactagacccttataatctcactgaacttgaaagtatagttaggggttggggtgaactagt

SEQ ID NO: 335706 - DNA, 75 bp, Artificial Sequence
  Synthetic
aatcctattattgcagcaggtttaattgaaaatttcatgaagggacttcctgcagtcatccctccacaagcctat

SEQ ID NO: 335707 - DNA, 75 bp, Artificial Sequence
  Synthetic
tataatctcactgaacttgaaagtatagttaggggttggggtgaactagtctgtgaccaatttcatgagctagat

SEQ ID NO: 335708 - DNA, 75 bp, Artificial Sequence
  Synthetic
agtctaattatgaaaaaggcaaagataactgttgacctatttatgttcaataagcttctggcccttataaaccct

SEQ ID NO: 335709 - DNA, 75 bp, Artificial Sequence
  Synthetic
cagcaggctcatgcctttatacaaaggacaaataaagcacctgaagatcttacacctgactctcttttctcattc

SEQ ID NO: 335710 - DNA, 75 bp, Artificial Sequence
  Synthetic
ttgaaagtgatgaccctgaatatagtactgtaactacgctttctgttaaggaatgggcagaagaaaaagacattg

SEQ ID NO: 335711 - DNA, 75 bp, Artificial Sequence
  Synthetic
aggatgctgaagttgaagatgatgaatatgtcattgacttgaatgacattgattttgataaagttgatactcttg

SEQ ID NO: 335712 - DNA, 75 bp, Artificial Sequence
  Synthetic
ctgacattcaacattttttgcaagatgaatcagcatatacagccgatcttgttatcgacaccgaatcagttgaat

SEQ ID NO: 335713 - DNA, 75 bp, Artificial Sequence
  Synthetic
caaaacgagtacgtggcattgtgaagttgttagaacctatcaagttgataaaaagctgggtgtcaaaaggtttag

SEQ ID NO: 335714 - DNA, 75 bp, Artificial Sequence
  Synthetic
aaaagctgggtgtcaaaaggtttagcaatagaaaagatatatgacccattagctgttatacttgtcacccggtat

SEQ ID NO: 335715 - DNA, 75 bp, Artificial Sequence
  Synthetic
ttttcaaagcagtattcattttcaaaagtgcccttagctcaattagacccatataatctcactgaacttgaaagt

SEQ ID NO: 335716 - DNA, 75 bp, Artificial Sequence
  Synthetic
atagttagaggttggggtgaactagtctgtgaccaattttatgagttagatcagcaagctcatgcctttatacaa

SEQ ID NO: 335717 - DNA, 75 bp, Artificial Sequence
  Synthetic
aggacaaataaagcacctgaagatcttacacctgattctcttttctcattcagacatgctgagcttttgttttct

SEQ ID NO: 335718 - DNA, 75 bp, Artificial Sequence
  Synthetic
cagacatgctgagcttttgttttctagactttttttacctgacactgtctctgttttttactaaagttagtctct

SEQ ID NO: 335719 - DNA, 75 bp, Artificial Sequence
  Synthetic
tttttactaaagttagtctctaatgctttatattctttatttattgggtgtgtatcccggagcatactactacta

SEQ ID NO: 335720 - DNA, 75 bp, Artificial Sequence
  Synthetic
tgaaatcagggataggatccatggccttgaaccagggggtgtaggggcaattgaatgcattgaccttttagactc

SEQ ID NO: 335721 - DNA, 75 bp, Artificial Sequence
  Synthetic
aaattccacacacatgtagagcgggaatttaaatatgtgctacctgagtatccagatattcctgactgtgaagct

SEQ ID NO: 335722 - DNA, 75 bp, Artificial Sequence
  Synthetic
aatttaaatatgtgctacctgagtatccagatattcctgactgtgaagctaatcaggaaaaacttcttacacatc

SEQ ID NO: 335723 - DNA, 75 bp, Artificial Sequence
  Synthetic
catgtacccaaagtcgcgaaaaccacggaattttctgttattacaaatcggattacagtctgaatataatcctat

SEQ ID NO: 335724 - DNA, 75 bp, Artificial Sequence
  Synthetic
gactatttctatggcccaggttgatacaaagttggctgcaagtattattatcagtgagtcacctgaaacacctgt

SEQ ID NO: 335725 - DNA, 75 bp, Artificial Sequence
  Synthetic
aaatcactagaagtatctaatgctcatgtcagatttattctagtgcacaaggaaggttttggttgtgtggaccct

SEQ ID NO: 335726 - DNA, 75 bp, Artificial Sequence
  Synthetic
aaggaaacatcagaggacagaagcagacagaggtttttttattacgacactaccgacccgggttcggttagaaat

SEQ ID NO: 335727 - DNA, 75 bp, Artificial Sequence
  Synthetic
tttaacaaattcaaaggttgagcgattatatggtacagcaccaggtatggctaataatccctgcaattatataga

SEQ ID NO: 335728 - DNA, 75 bp, Artificial Sequence
  Synthetic
cttggatcgagacaaaatacctatatgtttgggtggtattgggtcatcttctatactagaacttgcaactgcagg

SEQ ID NO: 335729 - DNA, 75 bp, Artificial Sequence
  Synthetic
ctcatgttattggcccaagagacattccaacatgaacgattgggagaattctctttcttaggtaaagtgcaatgg

SEQ ID NO: 335730 - DNA, 75 bp, Artificial Sequence
  Synthetic
tcccacaattgagggatgatttattagtgtacttcgtgcggaaattgaatgatcctagtattgttacagccatga

SEQ ID NO: 335731 - DNA, 75 bp, Artificial Sequence
  Synthetic
cactgcagtctccgttgcagcttagatttcgtatgcaggcaaaacagcaccttcctgtgtgtaaatataatgaca

SEQ ID NO: 335732 - DNA, 75 bp, Artificial Sequence
  Synthetic
ttgtacattttcaaaagaatttgcatggaaggattttataagcaacactgaatgtgaggtcatattatcaagaaa

SEQ ID NO: 335733 - DNA, 75 bp, Artificial Sequence
  Synthetic
tggaaggattttataagcaacactgaatgtgaggtcatattatcaagaaaaatacacagagcaaaggtagctaga

SEQ ID NO: 335734 - DNA, 75 bp, Artificial Sequence
  Synthetic
tcagcaggctcatgcctttatacaaaggacaaataaagcacctgaagatcttacacctgattctcttttctcatt

SEQ ID NO: 335735 - DNA, 75 bp, Artificial Sequence
  Synthetic
ctactactaaatatatatgcaactgagcacaggcctatcctgctaaactgtccccactatggtgtcactgaggct

SEQ ID NO: 335736 - DNA, 75 bp, Artificial Sequence
  Synthetic
tccccactatggtgtcactgaggctgaatatatctggggaaccacaagacttggacatttcccactggacgaggt

SEQ ID NO: 335737 - DNA, 75 bp, Artificial Sequence
  Synthetic
acccaatgacacaaatgaaggtggtaacttggaaagaaaaagaaacccatgggacttcaggtgagtattttgaaa

SEQ ID NO: 335738 - DNA, 75 bp, Artificial Sequence
  Synthetic
gggacttcaggtgagtattttgaaaaaattgcaagccacacggaaacagaaggcgatttcaaaagtttatgtaca

SEQ ID NO: 335739 - DNA, 75 bp, Artificial Sequence
  Synthetic
taagggcagtccattgtttgacacaggatatgtgtgtgctgtatagaagtaatatcaaggtaccaatcatattta

SEQ ID NO: 335740 - DNA, 75 bp, Artificial Sequence
  Synthetic
ccagactttacaatcccttatagtcctaagatacacaccaggatgaaccttccggtcttatgcatgcttatgccc

SEQ ID NO: 335741 - DNA, 75 bp, Artificial Sequence
  Synthetic
ttgaagtttagaaccaaccctcaaggtgatgatcatagtgatcgtagatcctctagaatccatatcattggacac

SEQ ID NO: 335742 - DNA, 75 bp, Artificial Sequence
  Synthetic
gtgatgatcatagtgatcgtagatcctctagaatccatatcattggacacaagaacataactacagtgggcagta

SEQ ID NO: 335743 - DNA, 75 bp, Artificial Sequence
  Synthetic
agcaaaacacattaacagcctttaagggtgcaacagattatacatctttattatataatgtgcaatctacagaca

SEQ ID NO: 335744 - DNA, 75 bp, Artificial Sequence
  Synthetic
agaaacctatactgttcttaggttatacaccaactatgagctggacaacatgtgggacgagttatgttcctgcag

SEQ ID NO: 335745 - DNA, 75 bp, Artificial Sequence
  Synthetic
gcccaggtgcaagctgtgaagcattctcaagctcagggattttttcgctgaattctacaacatgccttatcccac

SEQ ID NO: 335746 - DNA, 75 bp, Artificial Sequence
  Synthetic
atactcatagatttaaaggtttaggggaccaagtgactttcatgtgtcagcgggttgattttgatttagaatttt

SEQ ID NO: 335747 - DNA, 75 bp, Artificial Sequence
  Synthetic
cgggttgattttgatttagaattttattgtaatggcagacacaaagttattagaacaaaaacacttgtaataggt

SEQ ID NO: 335748 - DNA, 75 bp, Artificial Sequence
  Synthetic
cagtgcatacatacatttactagtttcttttcattatttcctagtattgcacactcattggctgttgaaatctgt

SEQ ID NO: 335749 - DNA, 75 bp, Artificial Sequence
  Synthetic
gtcccaggttttcatgggtttacagcagtttgcctaataacaacattttgttttggttggctatggatccctgga

SEQ ID NO: 335750 - DNA, 75 bp, Artificial Sequence
  Synthetic
ttttggttggctatggatccctggagcaacatggggaatattacaaatactaaagattatagtcttgttcataac

SEQ ID NO: 335751 - DNA, 75 bp, Artificial Sequence
  Synthetic
gcaacatggggaatattacaaatactaaagattatagtcttgttcataacgaatagcaccatggatcagaggttt

SEQ ID NO: 335752 - DNA, 75 bp, Artificial Sequence
  Synthetic
gaatagcaccatggatcagaggtttaagcgcatcctaacaaaaataaaggcagaatatagatctaccatcggtga

SEQ ID NO: 335753 - DNA, 75 bp, Artificial Sequence
  Synthetic
aagcgcatcctaacaaaaataaaggcagaatatagatctaccatcggtgatacaagctgtgattactgtaagcat

SEQ ID NO: 335754 - DNA, 75 bp, Artificial Sequence
  Synthetic
gaatgtacaacaaacttagaagcagataaccacatcatgtactgtaaacaaggtaaatgcccttactgcttaaat

SEQ ID NO: 335755 - DNA, 75 bp, Artificial Sequence
  Synthetic
gaagtttaccactcacctactgctctccaagaacatttcaaaatgtgtccattaattgacaggtttaataagaca

SEQ ID NO: 335756 - DNA, 75 bp, Artificial Sequence
  Synthetic
tccaagaacatttcaaaatgtgtccattaattgacaggtttaataagacaattaaggatcagatttttaagacaa

SEQ ID NO: 335757 - DNA, 75 bp, Artificial Sequence
  Synthetic
gcacaaagccacatagtactttatataagaaattatgtgtctttagatatacaaacagatgctacatatttacag

SEQ ID NO: 335758 - DNA, 75 bp, Artificial Sequence
  Synthetic
taagaaattatgtgtctttagatatacaaacagatgctacatatttacagtgtgggtgatactgttattttttca

SEQ ID NO: 335759 - DNA, 75 bp, Artificial Sequence
  Synthetic
tttgcacaaaatgacaacagatattgaattagacttttctataccatcttcttcaaaattcacatataaaaggtt

SEQ ID NO: 335760 - DNA, 75 bp, Artificial Sequence
  Synthetic
tttagagagtcctgtcggtgagacaagaatgcaatttgctttgaagatatcgcagcagaagacgattgcatcaat

SEQ ID NO: 335761 - DNA, 75 bp, Artificial Sequence
  Synthetic
cgcagcagaagacgattgcatcaattcaaaaattaggccattgggttgatgcacgctggaataccagaacagttt

SEQ ID NO: 335762 - DNA, 75 bp, Artificial Sequence
  Synthetic
gcacgctggaataccagaacagtttttcattgctatggagcctgctcaaaatttgaatacccatggaaaagtgca

SEQ ID NO: 335763 - DNA, 75 bp, Artificial Sequence
  Synthetic
ttcattgctatggagcctgctcaaaatttgaatacccatggaaaagtgcaacatgctctaaagaacatgattttg

SEQ ID NO: 335764 - DNA, 75 bp, Artificial Sequence
  Synthetic
acatgctctaaagaacatgattttgaataccaaacagcctgggcatgtaatcccggagactgccctggaataaac

SEQ ID NO: 335765 - DNA, 75 bp, Artificial Sequence
  Synthetic
acaggatgtacagcatgtggtctttatttagacaaaccaaaatctatagcaacagtcataaaactcattcaaata

SEQ ID NO: 335766 - DNA, 75 bp, Artificial Sequence
  Synthetic
aacagtcataaaactcattcaaatagattatgagcgagaagtatgtatccaactaggaagctataatgaatgtaa

SEQ ID NO: 335767 - DNA, 75 bp, Artificial Sequence
  Synthetic
gcgagttacaagtaacgattgcttaagcacaaatggggtcaaggtttgccttttaagcactactgtcaaacttgg

SEQ ID NO: 335768 - DNA, 75 bp, Artificial Sequence
  Synthetic
ttcaacagacacgttagttttcttcgggccacttcaagctggagcagttgtgtttaagaattggtgcacaagcaa

SEQ ID NO: 335769 - DNA, 75 bp, Artificial Sequence
  Synthetic
gggccacttcaagctggagcagttgtgtttaagaattggtgcacaagcaactgtgtatatggtgaccctggggat

SEQ ID NO: 335770 - DNA, 75 bp, Artificial Sequence
  Synthetic
ggaacacagtttcaggttatcagcgctatcttgctaccaaagactcattcttctcaatcaatatgaccgatccaa

SEQ ID NO: 335771 - DNA, 75 bp, Artificial Sequence
  Synthetic
ttttagaaaggagtaaactagagtggtatgaccctgatgcaacatctcgtgatcatattaatgttcaaataacaa

SEQ ID NO: 335772 - DNA, 75 bp, Artificial Sequence
  Synthetic
aagacttggacttcgagaacctaggggagaatccctgtaaagtaactttaaaagtcctgagcatagacggggcat

SEQ ID NO: 335773 - DNA, 75 bp, Artificial Sequence
  Synthetic
ggggttctgagacaggcttttccttgaactgtaaggtatcactgcttgaatgcaatagttttatcactgttatta

SEQ ID NO: 335774 - DNA, 75 bp, Artificial Sequence
  Synthetic
cgtggagataatacagtgagtattcaaggcagaggtggacatagtggttccaaatttaaatgctgccatgaagaa

SEQ ID NO: 335775 - DNA, 75 bp, Artificial Sequence
  Synthetic
caaatttaaatgctgccatgaagaagattgtgctgaagaaggtttactggctgaagccccacatttagctagagt

SEQ ID NO: 335776 - DNA, 75 bp, Artificial Sequence
  Synthetic
taagacaagtgagtggtttatgggaatattatctggcaactggttggttatagtggtactagtcgtgataatgat

SEQ ID NO: 335777 - DNA, 75 bp, Artificial Sequence
  Synthetic
actcagcatcatgcttctcagctttttttgcccaagtaaaaaacatcaggcctaacacaatgattctcattgctg

SEQ ID NO: 335778 - DNA, 75 bp, Artificial Sequence
  Synthetic
cctaacacaatgattctcattgctgcttattaataccattgctttctaccatcagaaaaaacataaaaagcatta

SEQ ID NO: 335779 - DNA, 75 bp, Artificial Sequence
  Synthetic
ataaaaataaaaataaaaaaataatgaatatgaaaaaataaaaaataaaaaataaaaaataaaaaaatagttaaa

SEQ ID NO: 335780 - DNA, 75 bp, Artificial Sequence
  Synthetic
aatttaaaaaataaaaaactactcattcttgggcaataacccatttctgtgattctttgtcttttgttcttgcgg

SEQ ID NO: 335781 - DNA, 75 bp, Artificial Sequence
  Synthetic
aaaaaactactcattcttgggcaataacccatttctgtgattctttgtcttttgttcttgcggagtctactacta

SEQ ID NO: 335782 - DNA, 75 bp, Artificial Sequence
  Synthetic
tagtagtagactccggaaatagacaatagagaaaaataccaataaaacaactgcattcaacatgcagaggtatta

SEQ ID NO: 335783 - DNA, 75 bp, Artificial Sequence
  Synthetic
atagagaaaaataccaataaaacaactgcattcaacatgcagaggtattatgaaatcagggataggatccatggc

SEQ ID NO: 335784 - DNA, 75 bp, Artificial Sequence
  Synthetic
acccatatctgatgttctgatttacgcaggtattcctttagatttaattacaggtatggaaaaaattagaattac

SEQ ID NO: 335785 - DNA, 75 bp, Artificial Sequence
  Synthetic
agaccaccctactggaaaaacactgcaccaattctttaaatcaacacctgataattataaaattgaaggcaccac

SEQ ID NO: 335786 - DNA, 75 bp, Artificial Sequence
  Synthetic
aatcaaatttattgaagtgacagttacagtcgacgtagagaaaggtatatatgaaaaaaagaaaaaataccaagg

SEQ ID NO: 335787 - DNA, 75 bp, Artificial Sequence
  Synthetic
tgggttcaatcagattcaagtagaattagacaaatattggcaacaaggcaaattaccaaataaatacacaatagt

SEQ ID NO: 335788 - DNA, 75 bp, Artificial Sequence
  Synthetic
atatgacattgtggcagttaaggctgatggatctaacttgtcaacacaatggcctagtacaaggtcaccaggtgt

SEQ ID NO: 335789 - DNA, 75 bp, Artificial Sequence
  Synthetic
gatggatctaacttgtcaacacaatggcctagtacaaggtcaccaggtgttgttcagcacatgagaatggttcaa

SEQ ID NO: 335790 - DNA, 75 bp, Artificial Sequence
  Synthetic
gctgaaatacaatatgtgagggaaaggctcataagggttaatgaaaaaagtgctcttgaatctatgtttaatcta

SEQ ID NO: 335791 - DNA, 75 bp, Artificial Sequence
  Synthetic
ggctcataagggttaatgaaaaaagtgctcttgaatctatgtttaatctaaaattccacacacatgtagaacggg

SEQ ID NO: 335792 - DNA, 75 bp, Artificial Sequence
  Synthetic
tccagatattcctgactgtgaagctaatcaggaaaaacttcttacacatctaaaggcgtggcttacaaagaagca

SEQ ID NO: 335793 - DNA, 75 bp, Artificial Sequence
  Synthetic
aactttctctttccatgaggttacaggtgaaaaaataagtcatgcatttagagagtatgaagctgagcaagagag

SEQ ID NO: 335794 - DNA, 75 bp, Artificial Sequence
  Synthetic
catgtatccaaagtcacggaaaccacggaattttttgctattacaaatcggattacagtctgaatataaccctat

SEQ ID NO: 335795 - DNA, 75 bp, Artificial Sequence
  Synthetic
cggaattttttgctattacaaatcggattacagtctgaatataaccctatgactatttctatggcccaggttgat

SEQ ID NO: 335796 - DNA, 75 bp, Artificial Sequence
  Synthetic
acaaaattggctgcaagtattattatcagtgagtcacctgaaacacctgtacaagcccttgtaaaagatgtatgt

SEQ ID NO: 335797 - DNA, 75 bp, Artificial Sequence
  Synthetic
agtgtaccagagccaggttgtttaaaaatcaatatgagctcactagatgaaatgtcgaggagtattgtggaacaa

SEQ ID NO: 335798 - DNA, 75 bp, Artificial Sequence
  Synthetic
aatgtcgaggagtattgtggaacaaaccaaaggttcccaagataaaacaaactctgaaatagaatcactccatcc

SEQ ID NO: 335799 - DNA, 75 bp, Artificial Sequence
  Synthetic
ttgggcacagtctgaagccaatacatctattagtattgtagaaaaaattctgactaatttagaaatgcatgtggc

SEQ ID NO: 335800 - DNA, 75 bp, Artificial Sequence
  Synthetic
tgagacagaaaaatacttaattaaagtattaaggaagactgtaggttggcatttgggtcacttaatacgggatgt

SEQ ID NO: 335801 - DNA, 75 bp, Artificial Sequence
  Synthetic
atttgggtcacttaatacgggatgtcacagagagcatgattgctcatgcaggcttaaaacgatctaagttttggt

SEQ ID NO: 335802 - DNA, 75 bp, Artificial Sequence
  Synthetic
cactttcaggcttccatcaaggtaatgttctgttggttatgctgccttcaaaatcactagaagtatctaatgctc

SEQ ID NO: 335803 - DNA, 75 bp, Artificial Sequence
  Synthetic
aaatcactagaagtatctaatgctcatgtgagatttattctagtgcacaaggaaggttttggttgtgtggaccct

SEQ ID NO: 335804 - DNA, 75 bp, Artificial Sequence
  Synthetic
gataatattgattcaaagaaatcaataaatggtgtgatatgggtttattcgaaaccaatgacattagacctaaat

SEQ ID NO: 335805 - DNA, 75 bp, Artificial Sequence
  Synthetic
aggcttcttgctctgaacatatgctttgaaaaggcattccttgcaacagcagtttggtttcaatacttcactgaa

SEQ ID NO: 335806 - DNA, 75 bp, Artificial Sequence
  Synthetic
aaaatgaaagtatgtgcactatttgataacctaagatatcttataccatcatgtacggctagttattctggtgct

SEQ ID NO: 335807 - DNA, 75 bp, Artificial Sequence
  Synthetic
agtctatgtttacacaaaatcaaaagagcttttaataagccttgctcaaaataacaagttcaggtactattcaaa

SEQ ID NO: 335808 - DNA, 75 bp, Artificial Sequence
  Synthetic
ataacaagttcaggtactattcaaaagtaagaatgttaggtttaacagttgatcaatctagtgtaggtgcaactg

SEQ ID NO: 335809 - DNA, 75 bp, Artificial Sequence
  Synthetic
tactgtgtatcggcattacagatcacttatttctgaaatcaccacttgttttttcctatttgaaaaagggctgca

SEQ ID NO: 335810 - DNA, 75 bp, Artificial Sequence
  Synthetic
ttttcctatttgaaaaagggctgcacggtacaatgacagaggaagctaagatccatttagagactgttgaatggg

SEQ ID NO: 335811 - DNA, 75 bp, Artificial Sequence
  Synthetic
cggtacaatgacagaggaagctaagatccatttagagactgttgaatgggcaaataattttaaagagaaagaagc

SEQ ID NO: 335812 - DNA, 75 bp, Artificial Sequence
  Synthetic
aaagtatggtaaagacctagtggagtttggatacactattgagcacttaatcaatgatgagattattccagagca

SEQ ID NO: 335813 - DNA, 75 bp, Artificial Sequence
  Synthetic
acaattatactgtaaaaatgtcataaagttagcaacactggaattaaataaggttttgacatcgaaaagccaagt

SEQ ID NO: 335814 - DNA, 75 bp, Artificial Sequence
  Synthetic
tatttctaactctataatgaataaacattgggaggaaccctatttcagccagaccaggaatataagtttaaaagg

SEQ ID NO: 335815 - DNA, 75 bp, Artificial Sequence
  Synthetic
tatgtcaggtgaactacaggaagatggccatttagcttctagttatacgcttatagaggctatacgctatttaaa

SEQ ID NO: 335816 - DNA, 75 bp, Artificial Sequence
  Synthetic
aagaaaacatcagaggacagaagcagacagaggtttttttattacaacactaccaacccgggttcgattagaaat

SEQ ID NO: 335817 - DNA, 75 bp, Artificial Sequence
  Synthetic
tctccaaattcaaggctccctagaaaaggctttaaggtgggcgcctgggacaagcaccatatctttgtcaacagg

SEQ ID NO: 335818 - DNA, 75 bp, Artificial Sequence
  Synthetic
catattcatgatgggctaaaagatagacgtttaaagcattgtgttattgacgcactcaagggcatctatgaaacg

SEQ ID NO: 335819 - DNA, 75 bp, Artificial Sequence
  Synthetic
gaattttttatttcaaggagattacgaggctatatagagaatatggaagaattagaacacaatgttcaagagttt

SEQ ID NO: 335820 - DNA, 75 bp, Artificial Sequence
  Synthetic
ttagatttttttgattactcaaagggtagatcaggtctagtgaggggtaattggctgcaggggaatttaaacaag

SEQ ID NO: 335821 - DNA, 75 bp, Artificial Sequence
  Synthetic
tgctcttcattgttttctgtagctattagcttcttgtttaaggagatgtggtcgagattatttccagaattggat

SEQ ID NO: 335822 - DNA, 75 bp, Artificial Sequence
  Synthetic
tgttttattgagtttgctcatcactctgatgatgctctattcatttatggttatcttgagccagagggtgatgga

SEQ ID NO: 335823 - DNA, 75 bp, Artificial Sequence
  Synthetic
ttatcttgagccagagggtgatggatctgattggtatctatatgtaacacaaaagatacaagcaggtgaattata

SEQ ID NO: 335824 - DNA, 75 bp, Artificial Sequence
  Synthetic
aataccttttactactaggttctgtcaaagtctctcctaagaagactactgtttccccaactaatgctgagttct

SEQ ID NO: 335825 - DNA, 75 bp, Artificial Sequence
  Synthetic
ctggattgggttttttcgatgatttggctgcatcacagtcacgttgtgtgaaagccttagatatgggtgcttcac

SEQ ID NO: 335826 - DNA, 75 bp, Artificial Sequence
  Synthetic
ggctgcatcacagtcacgttgtgtgaaagccttagatatgggtgcttcacctcaagttgctcaactggctgttaa

SEQ ID NO: 335827 - DNA, 75 bp, Artificial Sequence
  Synthetic
tttaacaaattcaaaggttgagcgattatatggcacagcaccaggtatggctaataatccctgtaactatataga

SEQ ID NO: 335828 - DNA, 75 bp, Artificial Sequence
  Synthetic
ctatactagaacttgcaactgcaggaattgggatgtctgacaaactggttttaaaaaatgctttaatttcattcc

SEQ ID NO: 335829 - DNA, 75 bp, Artificial Sequence
  Synthetic
gacacactaaacagttaaaagataaatacattttaggaatatttaaatttctcatgttattggcccaagagacat

SEQ ID NO: 335830 - DNA, 75 bp, Artificial Sequence
  Synthetic
tccaacatgagcgatgcatggggatctctttcttaggtaaagtgcaatggaaagtattcataccaaagaatgagt

SEQ ID NO: 335831 - DNA, 75 bp, Artificial Sequence
  Synthetic
aaagtattcataccaaagaatgagtttgaattttccaacttgtttagcattaattatttaaatcaatggtctagt

SEQ ID NO: 335832 - DNA, 75 bp, Artificial Sequence
  Synthetic
gaacatcctgtatatgattatattatcccacaattgagggatgatttattagtgtatcttgtacggaaattgaat

SEQ ID NO: 335833 - DNA, 75 bp, Artificial Sequence
  Synthetic
tcccacaattgagggatgatttattagtgtatcttgtacggaaattgaatgatcctagtatcgttacagccatga

SEQ ID NO: 335834 - DNA, 75 bp, Artificial Sequence
  Synthetic
tgctgctgcccatgaatatgcatcaaaatatattccgaatgagattgacttagatctatttaatactttggtatc

SEQ ID NO: 335835 - DNA, 75 bp, Artificial Sequence
  Synthetic
aatacacagagcaaaggtagcaagggtattcactgtaaaagagcgagatcagattattcagaatcccatatctgt

SEQ ID NO: 335836 - DNA, 75 bp, Artificial Sequence
  Synthetic
tgtcattgcttataaatttgcagtcggcacaaatgagattaaagatgtactagacaaagcaaaatttcctgattc

SEQ ID NO: 335837 - DNA, 75 bp, Artificial Sequence
  Synthetic
tgaggttttgaaagctgtttcaatctttagtaaaggagagtttgtacaggaagataagcaattagctgctttgag

SEQ ID NO: 335838 - DNA, 75 bp, Artificial Sequence
  Synthetic
tttagtaaaggagagtttgtacaggaagataagcaattagctgctttgaggctgtgcattgaaatctggagatgg

SEQ ID NO: 335839 - DNA, 75 bp, Artificial Sequence
  Synthetic
aagataagcaattagctgctttgaggctgtgcattgaaatctggagatggggaaaatacaatagagtagacatta

SEQ ID NO: 335840 - DNA, 75 bp, Artificial Sequence
  Synthetic
tacctcttgttgacccagaaatacaatgtgcagggttgatgatgtatgatcttttgagggatatgacatgtttac

SEQ ID NO: 335841 - DNA, 75 bp, Artificial Sequence
  Synthetic
tgtatgcaaacatataatgaggaaacaaaactatatgagggggatttaagagttgtatttaactttggaattgat

SEQ ID NO: 335842 - DNA, 75 bp, Artificial Sequence
  Synthetic
agttgtatttaactttggaattgattgtgcaaggcttgagattttttgggaaaaacaaacctatgttcttgaaac

SEQ ID NO: 335843 - DNA, 75 bp, Artificial Sequence
  Synthetic
aaaaacaaacctatgttcttgaaacatccattaccagtaagcctgttcttagggtgttaatgcaggaagtttcaa

SEQ ID NO: 335844 - DNA, 75 bp, Artificial Sequence
  Synthetic
ctgaactacagcgttgtggtttaaaatttgatacagtgcaaagcatgggtttcaagtcagtcgtgctgttcaaaa

SEQ ID NO: 335845 - DNA, 75 bp, Artificial Sequence
  Synthetic
cagactcaggatttgagtgggggaaaccaaatataccatgtattatctttaaaaactgtgcactacgtccaaccc

SEQ ID NO: 335846 - DNA, 75 bp, Artificial Sequence
  Synthetic
ttcgaaataagcaggtactaaataaggaatttatcattactatattagataatgggtttaaagcaattgcccagc

SEQ ID NO: 335847 - DNA, 75 bp, Artificial Sequence
  Synthetic
aatgggtttaaagcaattgcccagcaagacttagatagcaatagattccaattagcacatgcatatcataatctt

SEQ ID NO: 335848 - DNA, 75 bp, Artificial Sequence
  Synthetic
cgtgatatacggtatcaagcacttgagacagttaacacagtgaactttactgttgatggaaaagtattatatttg

SEQ ID NO: 335849 - DNA, 75 bp, Artificial Sequence
  Synthetic
aatcctattattgcagcaggcttaattgaaaatttcatgaaaggactccctgcagtcatccctccacaagcttat

SEQ ID NO: 335850 - DNA, 75 bp, Artificial Sequence
  Synthetic
agtctgattatgaaaaaggcaaaaataactgttgacctatttatgttcaataagcttctggcccttataaatcct

SEQ ID NO: 335851 - DNA, 75 bp, Artificial Sequence
  Synthetic
aagatgctgaagttgaagatgatgaatatgtcatcgacttaaatgacattgattttgataaagttgacactcttg

SEQ ID NO: 335852 - DNA, 75 bp, Artificial Sequence
  Synthetic
caaaacgagtacgtggcattgtgaagttgttagaacctatcaagttaataaaaagctgggtctcaaaaggtttag

SEQ ID NO: 335853 - DNA, 75 bp, Artificial Sequence
  Synthetic
aaaagctgggtctcaaaaggtttagcaatagaaaagatatatgaccctttagctgttatacttgttactcggtac

SEQ ID NO: 335854 - DNA, 75 bp, Artificial Sequence
  Synthetic
atagtcagaggttggggtgagctagtctgtgaccaattttatgagttagaccagcaggctcatgcctttatacag

SEQ ID NO: 335855 - DNA, 75 bp, Artificial Sequence
  Synthetic
aggacaaataaagcacctgaggatcttacacctgactctcttttctcattcaggcatgccgagcttttgttttct

SEQ ID NO: 335856 - DNA, 75 bp, Artificial Sequence
  Synthetic
caggcatgccgagcttttgttttctagactttttctacctgatactgtctctgttttttactaaagttattctct

SEQ ID NO: 335857 - DNA, 75 bp, Artificial Sequence
  Synthetic
tttttactaaagttattctctaattctttattttctttatttattggttgtgtatcccggagcatactactacta

SEQ ID NO: 335858 - DNA, 75 bp, Artificial Sequence
  Synthetic
tagtagtagactccggaaattgacaatagagaaaaataccaataaaacaactgcattcaacatgcagaggtacta

SEQ ID NO: 335859 - DNA, 75 bp, Artificial Sequence
  Synthetic
catattcatgatgggctaaaagatagacgtttaaagcattgtgttattgatgcactcaagggtatctatgaaaca

SEQ ID NO: 335860 - DNA, 75 bp, Artificial Sequence
  Synthetic
tcaaacatgagcgatgcgtcaggatctctttcttaggtaaagtgcaatggaaagtattcataccaaagaatgagt

SEQ ID NO: 335861 - DNA, 75 bp, Artificial Sequence
  Synthetic
aaagtattcataccaaagaatgagtttgaatttgccaacttgttcagcattaattatttaaatcaatggtctagt

SEQ ID NO: 335862 - DNA, 75 bp, Artificial Sequence
  Synthetic
ctgaactgcagcgctgtggtttaaaatttgatacagtccaaagcatgggtttcaggtcagtcgtgctgttcaaaa

SEQ ID NO: 335863 - DNA, 75 bp, Artificial Sequence
  Synthetic
aatctgattatgaaaaaggcaaaaataactgttgacctatttatgtttaataaacttctggcccttataaatcct

SEQ ID NO: 335864 - DNA, 75 bp, Artificial Sequence
  Synthetic
gagaacaccttcaatatggaaggtattgaaagtgatgaccctgaatatagtactgtaactacgctttctgttaag

SEQ ID NO: 335865 - DNA, 75 bp, Artificial Sequence
  Synthetic
ctgacattcaacatttcttacaagatgaatcagcatatacagcagatcttgttattgacaccgagtcagttgaat

SEQ ID NO: 335866 - DNA, 75 bp, Artificial Sequence
  Synthetic
tagtagtagactccctgcttacaacagaagagactactactaatatatagacaacctttcagacaaagatggctc

SEQ ID NO: 335867 - DNA, 75 bp, Artificial Sequence
  Synthetic
cttgagaaaaaagtaaaggagatatcaagccaggaacctattaaattgtaacctggtaaaatagccaactttgta

SEQ ID NO: 335868 - DNA, 75 bp, Artificial Sequence
  Synthetic
tacagatataaaattagctagctggtattcttgtttagtaggtgattattctatgatctttgtacatagcaacat

SEQ ID NO: 335869 - DNA, 75 bp, Artificial Sequence
  Synthetic
taggacaaaaacacttgtaataggccaatgcatacatacattcactagtttcttttcattatttcctagtattgc

SEQ ID NO: 335870 - DNA, 75 bp, Artificial Sequence
  Synthetic
taaagataatagtcttgttcataacgaatagcaccatggatcagaggttcaagcgcatcctaacaaaaataaagg

SEQ ID NO: 335871 - DNA, 75 bp, Artificial Sequence
  Synthetic
cagagtatagatctaccattggtgatacaagctgtgattactgtaaacatgaatgtacaacaaacttagaagcag

SEQ ID NO: 335872 - DNA, 75 bp, Artificial Sequence
  Synthetic
actaataatatgggctgctagtgcagaagtagtgaacttagagccagagtggaatgataatgttcatggggttgg

SEQ ID NO: 335873 - DNA, 75 bp, Artificial Sequence
  Synthetic
gaattagacttttctataccatcttcttcaaaatttacctataagaggtttttagaaagtcctgttggtgaaaca

SEQ ID NO: 335874 - DNA, 75 bp, Artificial Sequence
  Synthetic
ttttgagagggtttgtaggtttgcacaaactcctatttgtgaatacggaggtaacacagtttcaggttatcagcg

SEQ ID NO: 335875 - DNA, 75 bp, Artificial Sequence
  Synthetic
gtaacacagtttcaggttatcagcgctatcttgctactaaagactcattcttctctattaatatgactgatccaa

SEQ ID NO: 335876 - DNA, 75 bp, Artificial Sequence
  Synthetic
ctatcttgctactaaagactcattcttctctattaatatgactgatccaattttagaaagaagtaaacttgagtg

SEQ ID NO: 335877 - DNA, 75 bp, Artificial Sequence
  Synthetic
gtatgatcctgatgcaacatctcgcgatcatattaatgttcagataacaaaggatttggacttcgagaacctagg

SEQ ID NO: 335878 - DNA, 75 bp, Artificial Sequence
  Synthetic
aggatttggacttcgagaacctaggggaaaatccctgtaaagtgactttaaaagtcctgagcatagatggggcat

SEQ ID NO: 335879 - DNA, 75 bp, Artificial Sequence
  Synthetic
ggaaaatccctgtaaagtgactttaaaagtcctgagcatagatggggcatggggttctgaaacaggcttttcctt

SEQ ID NO: 335880 - DNA, 75 bp, Artificial Sequence
  Synthetic
aagggaaaataactcccgaagagttaaaaaaattagagcttgaatataaccaaactgagaaggcactaacagaat

SEQ ID NO: 335881 - DNA, 75 bp, Artificial Sequence
  Synthetic
cctctcaaaaactaattcaggagatcgaccaggctgggcaaaatccggattctattcagcagcagtctattaaac

SEQ ID NO: 335882 - DNA, 75 bp, Artificial Sequence
  Synthetic
aaagatctgatgttgtagatgcttatagaaataagctgaaggagctacaaggaatgattgctgcagggcaggcta

SEQ ID NO: 335883 - DNA, 75 bp, Artificial Sequence
  Synthetic
gaggaaggggattatctcacagcaaagtcatcacttcgttatggaaatgttgtagaccttaacccgttaaactta

SEQ ID NO: 335884 - DNA, 75 bp, Artificial Sequence
  Synthetic
gaagagcctgcggggcagactgctaactggggaaagatatttgagtatatcttgaccctcacacaggttctactg

SEQ ID NO: 335885 - DNA, 75 bp, Artificial Sequence
  Synthetic
tctttacatatctcttcccacaagtcaatcttcaatccaagatgacgaacttacacctggacgttttaggacaat

SEQ ID NO: 335886 - DNA, 75 bp, Artificial Sequence
  Synthetic
gatctcagggctcttaccaaatgaaataaaggcaaaaaagttgatgagtcctgtaatgggtgttatcggattcca

SEQ ID NO: 335887 - DNA, 75 bp, Artificial Sequence
  Synthetic
gcatttagctgaggcctggccagatgccatggagaagatgttgagtgatcagtgcgaatacatgactaaagacaa

SEQ ID NO: 335888 - DNA, 75 bp, Artificial Sequence
  Synthetic
agcaaacccttcaaacagtacaaatagagtttatttccggacacgtcaagcccaagttgatgctcttaacctacc

SEQ ID NO: 335889 - DNA, 75 bp, Artificial Sequence
  Synthetic
tgacatctctgcattaaggatgtttgctgatcaaaattataaaatcccagctgaccttgaatcagaggccacccc

SEQ ID NO: 335890 - DNA, 75 bp, Artificial Sequence
  Synthetic
gctgatcaaaattataaaatcccagctgaccttgaatcagaggccaccccatggttatttgctaatgcaccagac

SEQ ID NO: 335891 - DNA, 75 bp, Artificial Sequence
  Synthetic
agatgccccccaactgttctacaggtagcaggtatccctgagcttggtgcatttcttgcactcatgcaagacata

SEQ ID NO: 335892 - DNA, 75 bp, Artificial Sequence
  Synthetic
atttcttgcactcatgcaagacatacgaagtgggatccttgcttcaagtcttcgtggaacagctgaagagaaaat

SEQ ID NO: 335893 - DNA, 75 bp, Artificial Sequence
  Synthetic
ttcgtggaacagctgaagagaaaatagctaaaaaatcatcattttatcaatcttatgttagaaggacacaatcaa

SEQ ID NO: 335894 - DNA, 75 bp, Artificial Sequence
  Synthetic
accttggtgacgatatggatccagagcttaaggctaaagctcaggcattgcttgagaaaaaagtaaaggaaatat

SEQ ID NO: 335895 - DNA, 75 bp, Artificial Sequence
  Synthetic
caagccaggaacccattaaactgtaacctggtaaaataaatagctttgtaaatagttttctttacttctaatgct

SEQ ID NO: 335896 - DNA, 75 bp, Artificial Sequence
  Synthetic
ttgcttgcctgcttactaacctgcttattcataacccctgcttaactttccccgctactaaccccaagttatttg

SEQ ID NO: 335897 - DNA, 75 bp, Artificial Sequence
  Synthetic
ccctgcttaactttccccgctactaaccccaagttatttgatctctctaattgttgtacagggagtatactacta

SEQ ID NO: 335898 - DNA, 75 bp, Artificial Sequence
  Synthetic
acaacctttcagacaaagatggctcaagggaaaatgactcccgaagagctaaaaaaattagagcttgaatacaac

SEQ ID NO: 335899 - DNA, 75 bp, Artificial Sequence
  Synthetic
ctgaccttgaatcagaagctaccccatggatgtttgcaaaagcaccagacagatgccccccaactgtcctacagg

SEQ ID NO: 335900 - DNA, 75 bp, Artificial Sequence
  Synthetic
aggtgattttaaaagtttatgtacaaaaacccattacttgacctatccttttaagaatggaaactcttactgctt

SEQ ID NO: 335901 - DNA, 75 bp, Artificial Sequence
  Synthetic
ctaagatacacaccaggatgaaccttcctgtcttatgcatgctcatgcccacagatggtcaggcagaaggaacaa

SEQ ID NO: 335902 - DNA, 75 bp, Artificial Sequence
  Synthetic
ctatgatctttgtacatagcaacatcaagatgagacaaattaaacttaatttgaagtttagggctaaccctcaag

SEQ ID NO: 335903 - DNA, 75 bp, Artificial Sequence
  Synthetic
gtgatgatcatagtgatcgtagatcttctagaattcatatcattggacacaagaacataactacagtgagcaata

SEQ ID NO: 335904 - DNA, 75 bp, Artificial Sequence
  Synthetic
aattctacaacatgccttatcccgcatactcatagatttaaaggtttaggggaccaagtgacttttatgtgtcag

SEQ ID NO: 335905 - DNA, 75 bp, Artificial Sequence
  Synthetic
aaaataataaaaaataataaaaaataaataataaaaaataaataaaaaataaaaaaataaaaaaataaaaaaata

SEQ ID NO: 335906 - DNA, 75 bp, Artificial Sequence
  Synthetic
aaaaaacaacacatttttgggtaataacccatttctgtaattctttgtcttttgttcttgcggagtctactacta

SEQ ID NO: 335907 - DNA, 75 bp, Artificial Sequence
  Synthetic
ataattgccctgattttaatggaaattttgagagggtttgtaggtttgcacaaactcctgttcgtgaatatggat

SEQ ID NO: 335908 - DNA, 75 bp, Artificial Sequence
  Synthetic
ttttagaaagaagtaaacttgagtggtatgatcctgatgcaacatctcgtgatcatattaacgttcagataacaa

SEQ ID NO: 335909 - DNA, 75 bp, Artificial Sequence
  Synthetic
gtatgatcctgatgcaacatctcgtgatcatattaacgttcagataacaaaggatttggacttcgagaacctagt

SEQ ID NO: 335910 - DNA, 75 bp, Artificial Sequence
  Synthetic
ctatgatctttgtacatagcaacatcaagatgagacaaattaaacttaatttgaagtttagaaccaccctcaaag

SEQ ID NO: 335911 - DNA, 75 bp, Artificial Sequence
  Synthetic
gcacgctggaacaccagaacagtttttcattgctatggagcctgctcaaaatttgaatacccatggaaaagtgca

SEQ ID NO: 335912 - DNA, 75 bp, Artificial Sequence
  Synthetic
ataaaaataaaaaataaaaaataaaaaaatgaataaaaaataaaataaaaaataaaaataataaaaaaataaaaa

SEQ ID NO: 335913 - DNA, 75 bp, Artificial Sequence
  Synthetic
aaaatgaataaaaaataaaataaaaaataaaaataataaaaaaataaaaaataaaaaataaaaaaacaacacatt

SEQ ID NO: 335914 - DNA, 75 bp, Artificial Sequence
  Synthetic
tagtagtagactccggaagtagacaatagagaaaacaccagcaatacatacctgcattcaagatgcagagatatt

SEQ ID NO: 335915 - DNA, 75 bp, Artificial Sequence
  Synthetic
aagagggttttggctgtgtagatcctgacaatattgattcaaggaagtccatcaatggtgtgatttgggtatact

SEQ ID NO: 335916 - DNA, 75 bp, Artificial Sequence
  Synthetic
ataagctacttcttgcaatgacacaaaagatgaaggtctgtgcactgtttgataatcttaggtatcttataccat

SEQ ID NO: 335917 - DNA, 75 bp, Artificial Sequence
  Synthetic
aattgggttacttttagaacagttcttgctgctgctcatgagtatgcattaaaatatgtcccaaatgaaattgat

SEQ ID NO: 335918 - DNA, 75 bp, Artificial Sequence
  Synthetic
caagacttagatagtaatcggttccagttggcacatgcataccataacttgcgtgatataaggtatcaggcactt

SEQ ID NO: 335919 - DNA, 75 bp, Artificial Sequence
  Synthetic
accaaggggaaaatcaagaaggatattgaacgtacgaaatagtagcagatatcgtgagcccagaagtggtgaatt

SEQ ID NO: 335920 - DNA, 75 bp, Artificial Sequence
  Synthetic
tatcatcaatcaggttgaaggcaatgtacccaccctcagtatccctcagtacaataaattcatctatgatacaaa

SEQ ID NO: 335921 - DNA, 75 bp, Artificial Sequence
  Synthetic
ccgcggtcgacaacgaccaagaaacattgcttctgggcacttgcacaggttgtctgtcctactactctgttactt

SEQ ID NO: 335922 - DNA, 75 bp, Artificial Sequence
  Synthetic
cccactcaccgaccaagatctccaagatatagataaattacaattcgaagctgagatcagtgggattgatgctat

SEQ ID NO: 335923 - DNA, 75 bp, Artificial Sequence
  Synthetic
cccactgtgcaaggatgtcttccgtgtttcgtgcgttcgagctctttaccttagagcaagaacagcaagaactcg

SEQ ID NO: 335924 - DNA, 75 bp, Artificial Sequence
  Synthetic
ccctgatcaagataaagtgagagttcttggacacttaactggcctccagctggcaagatctataacaggattgga

SEQ ID NO: 335925 - DNA, 75 bp, Artificial Sequence
  Synthetic
gaaatgacattgagatacctcctgaaacgttgagatcaaacattaaagtttgtatcttaaacagtcaggatcctc

SEQ ID NO: 335926 - DNA, 75 bp, Artificial Sequence
  Synthetic
tgaggtaacttctctcatgaatgatgcaatagtagaagcagattattctgctaattggataagtgaatgtctaaa

SEQ ID NO: 335927 - DNA, 75 bp, Artificial Sequence
  Synthetic
aaacacgtcatgatatgatgtgtttctgtctacgcttgattgctagcaactccgcacgcgctgcccacaaaactg

SEQ ID NO: 335928 - DNA, 75 bp, Artificial Sequence
  Synthetic
tacaaagttggacgatactttcctctatgcagcctggaacttactccttgacctatcctatcagctgtattatct

SEQ ID NO: 335929 - DNA, 75 bp, Artificial Sequence
  Synthetic
gtgccatcttgactttgcttaacttaccaactgccatgatgcaaaatcatatcaggattgcagaccgttctcctg

SEQ ID NO: 335930 - DNA, 75 bp, Artificial Sequence
  Synthetic
ccgcattttaggacagaatgccatcttggattatttatctattgtgctaagtagaatccctggcttagcattgtc

SEQ ID NO: 335931 - DNA, 75 bp, Artificial Sequence
  Synthetic
atgcggacattgaacgaattgaggtggatggcttcgagccaggaacttatcggcttcggcctaatgccaggactc

SEQ ID NO: 335932 - DNA, 75 bp, Artificial Sequence
  Synthetic
cggcattgctgctacgataagccacccaaaaatattaaggagattgattaacctagaaattgtcagaccatacaa

SEQ ID NO: 335933 - DNA, 75 bp, Artificial Sequence
  Synthetic
ccttgacaaatggagaaatcacagcgttgagcctaatggcaaatgatctccctgacacatacaccaatgacacac

SEQ ID NO: 335934 - DNA, 75 bp, Artificial Sequence
  Synthetic
ctcaccttatttggcaactctgaattacacaaaaatgacgtgtgatgcactcatgtggggtgcaagacatgtctt

SEQ ID NO: 335935 - DNA, 75 bp, Artificial Sequence
  Synthetic
cattcacaaaccacagagcagaaggggagaactgcgatgaaactgaacagttcttgaatgccatctacagtgttc

SEQ ID NO: 335936 - DNA, 75 bp, Artificial Sequence
  Synthetic
gagcaatattcgatctggatttgatatagaaattataatcccctccgaatgctcatctgagctttcagatagagt

SEQ ID NO: 335937 - DNA, 75 bp, Artificial Sequence
  Synthetic
tggttcagttatgggtcacggtttgcaaatgtatgacagcacatgaccagccaactggctctgatgagagaaggc

SEQ ID NO: 335938 - DNA, 75 bp, Artificial Sequence
  Synthetic
cctcaatctcattgcacggaagctctcactgctctgctgtctaactgcttctcaccatgagctaccacatgtgag

SEQ ID NO: 335939 - DNA, 75 bp, Artificial Sequence
  Synthetic
ttgctaaatatcagcaacaaggccgtttagatcagaaatatgcattacagcctgaactgagaagacaaattcaag

SEQ ID NO: 335940 - DNA, 75 bp, Artificial Sequence
  Synthetic
agggctgagcccagaactaaaatgcaaagtgcttactgaatatcttatatcaaagaagaatgagtatagtatcac

SEQ ID NO: 335941 - DNA, 75 bp, Artificial Sequence
  Synthetic
cctgtatcaggggaagcttaacaatccgacagttcttaacatatgagctgcaaactgcaaggaagcaaggtgcaa

SEQ ID NO: 335942 - DNA, 75 bp, Artificial Sequence
  Synthetic
agtaggggatgtcagagggtgggaaaccagtatacttgagcctaaaatatcggcatttccatgtaatatttatta

SEQ ID NO: 335943 - DNA, 75 bp, Artificial Sequence
  Synthetic
ttaccggcaggtactatgccatggtaggtgacattgggaaatacatcgacaatgccggaatgagtgcattcttta

SEQ ID NO: 335944 - DNA, 75 bp, Artificial Sequence
  Synthetic
tcttactagaaaagtgttgaattacattagagactcccctttcttacaacagcagttagctgactattatgacat

SEQ ID NO: 335945 - DNA, 75 bp, Artificial Sequence
  Synthetic
tgacaatgaggtttgctttagggacacgctggcctccattggctctatctgctttctctggagagctcttaaaac

SEQ ID NO: 335946 - DNA, 75 bp, Artificial Sequence
  Synthetic
cagatctagtgtgtattccaatattccagtgataaacaacagcactgaaggcagtgactccgagtttccttcaac

SEQ ID NO: 335947 - DNA, 75 bp, Artificial Sequence
  Synthetic
tgaaatcgttgatgcagctataccgaaacctgggcgagaaagccagatacatggcattgctagagatgcctgaaa

SEQ ID NO: 335948 - DNA, 75 bp, Artificial Sequence
  Synthetic
tctctgtatccttgactggctgaccccgttgttttcccaagctgataaagtgacaaaattccacactcctctgac

SEQ ID NO: 335949 - DNA, 75 bp, Artificial Sequence
  Synthetic
tgatggaatttgctccagccaattatccactttgctacagctatgcaatggggatagggagtgtacaagacccta

SEQ ID NO: 335950 - DNA, 75 bp, Artificial Sequence
  Synthetic
tgatagctcaccaatggttaaggacttgactttagtcgacccgcccatccatcatgtacttaggcctgtcgggtt

SEQ ID NO: 335951 - DNA, 75 bp, Artificial Sequence
  Synthetic
tgatgaggaactacacctttgcaaggcctttcttgaatcctgcatatttccaacttggagtcgagacagcaaaca

SEQ ID NO: 335952 - DNA, 75 bp, Artificial Sequence
  Synthetic
gtcatcaacttcatggtataaaggattgagtgtaatcaaggtattagacacactaccaatcctaagcggaaatca

SEQ ID NO: 335953 - DNA, 75 bp, Artificial Sequence
  Synthetic
gacaacaaggctctgtcgacaagagtatggctgaagaattgggcttaactgaagaggagaggcgggatatgtccg

SEQ ID NO: 335954 - DNA, 75 bp, Artificial Sequence
  Synthetic
tttgtacctagcagaaggaagtggggcgatgatgactgtgatagaatcaaaatattgcggaacaaaggcttttta

SEQ ID NO: 335955 - DNA, 75 bp, Artificial Sequence
  Synthetic
ccacggtaacacggcttacgacagggcgcggtgcaggacaagcccaggacatgataaacatcatgggtgccaggc

SEQ ID NO: 335956 - DNA, 75 bp, Artificial Sequence
  Synthetic
caacagtttattctctagtgggcagaatccgccccaaaggaacttccaaccattacccacccaattcatggagag

SEQ ID NO: 335957 - DNA, 75 bp, Artificial Sequence
  Synthetic
aagctgccgggggaagaggagcacaagggagggcgctcagaattgtggaagaagatgagaccacagatgatgaaa

SEQ ID NO: 335958 - DNA, 75 bp, Artificial Sequence
  Synthetic
tatagtctaccaaaatattcgttatgaggaggaccaaattggcacagatgaaccattttttgtaccactctggag

SEQ ID NO: 335959 - DNA, 75 bp, Artificial Sequence
  Synthetic
gtgtggatgatcaagcagatgacattcaaggtcgaccacttccacctgtacctgctccgattagggagatagact

SEQ ID NO: 335960 - DNA, 75 bp, Artificial Sequence
  Synthetic
cggatcatcagaggaaacagatctaagttgtgctgcctgcgtcaaccttatactcaaatcaataccatcaaggag

SEQ ID NO: 335961 - DNA, 75 bp, Artificial Sequence
  Synthetic
gggaagcaagaatagctgaaattgaagaacaaggtcagagaatgcgtgatcagggggttgggagactagtagaca

SEQ ID NO: 335962 - DNA, 75 bp, Artificial Sequence
  Synthetic
tgtatccattatgaatgtagacctagaggatattactcaaatgcagaatcctgaggtctctcgtgcagcaataaa

SEQ ID NO: 335963 - DNA, 75 bp, Artificial Sequence
  Synthetic
atcaggctcctaatgtgcaaaacaccagacaaaacacacaagacaatcaagcactcctagacctagacatctaac

SEQ ID NO: 335964 - DNA, 75 bp, Artificial Sequence
  Synthetic
tgtgatattactgtcagacatccttttaatgcctggcggtgtccttattttcaagacttatctatctccctttgc

SEQ ID NO: 335965 - DNA, 75 bp, Artificial Sequence
  Synthetic
tgtccgaccactctcatacactccaggttagaatctctgcaactggcccgctcctctgcaaagcagcatgcacca

SEQ ID NO: 335966 - DNA, 75 bp, Artificial Sequence
  Synthetic
taagttatccaacttctgcaagctacttcagatagctttctcacgatgtgtcttactccgatctgcctattctga

SEQ ID NO: 335967 - DNA, 75 bp, Artificial Sequence
  Synthetic
cgcctcaattcccacactccctatggctgcttttaagaaaaaacagaaattaacaagagacaggataagaggaca

SEQ ID NO: 335968 - DNA, 75 bp, Artificial Sequence
  Synthetic
cccagcatctgatgaagtcttcctagtggccatcaagtctgatttgcgatctctaacaggatcatttgatgagat

SEQ ID NO: 335969 - DNA, 75 bp, Artificial Sequence
  Synthetic
aaagccggtgagcccgaatagggtgaatccgtgtggctccctctattcggggtagtcaagtgctttacatttgac

SEQ ID NO: 335970 - DNA, 75 bp, Artificial Sequence
  Synthetic
tgccaaccaatcacggacagatgataaaagcttcacatgcatagaccccgaaatcctcacacagatcatagtcaa

SEQ ID NO: 335971 - DNA, 75 bp, Artificial Sequence
  Synthetic
tactgaaaaccttgagatctcaaggacaaatctgatcttcttatttcaaatctcttagttcttcattatctctta

SEQ ID NO: 335972 - DNA, 75 bp, Artificial Sequence
  Synthetic
cctcaataaccaacaacagagagttaaaaatattataaatgatcaagttaggacaggaaggtgtgatgttaacat

SEQ ID NO: 335973 - DNA, 75 bp, Artificial Sequence
  Synthetic
tttaacaatggatccttccccgagtgatgctgagatctctgcttggattgacaagggacttgacacagttgaaca

SEQ ID NO: 335974 - DNA, 75 bp, Artificial Sequence
  Synthetic
tgatgatcatatccaattaagccgactaggtacaagctctcagacaccaaagatattggaccttgagattgcctt

SEQ ID NO: 335975 - DNA, 75 bp, Artificial Sequence
  Synthetic
tttcctcagcgcttctacccaatctgtccggagcctggggaaatcaactataaagccagggaatacagaagagtt

SEQ ID NO: 335976 - DNA, 75 bp, Artificial Sequence
  Synthetic
tgatttcaatgatttcctcactcgggtcgtacagctgcttactaccttcctaaaagagttcatatctattcatga

SEQ ID NO: 335977 - DNA, 75 bp, Artificial Sequence
  Synthetic
ggtggctgcagcagaaaaagtggctgccaatacagccaaggggatcctgtctggtgttagaggcactaatccgga

SEQ ID NO: 335978 - DNA, 75 bp, Artificial Sequence
  Synthetic
tgatctagcgacagatcggaatagcctcttatttgattcttacaacttagacagaaaagggaaactaagcacaaa

SEQ ID NO: 335979 - DNA, 75 bp, Artificial Sequence
  Synthetic
ccctgcaaccagaccgaaggagaagcagaaaggatcgccagtcaaaatgcagcaccaagagcaagagagtgtata

SEQ ID NO: 335980 - DNA, 75 bp, Artificial Sequence
  Synthetic
caatcagattgtgactactcatattatgaatctgactgcacggaactggccactgcttccccctgcagtgaatgg

SEQ ID NO: 335981 - DNA, 75 bp, Artificial Sequence
  Synthetic
tgaagaggtcataccaactgagtctgctcccttgatccctaaaactactccaaagaaaccacctagaaacaaaga

SEQ ID NO: 335982 - DNA, 75 bp, Artificial Sequence
  Synthetic
gcaagtccgtaataatctagagctagggatatttcagtgcagctcaattgtttcttgggaagtattcttagacct

SEQ ID NO: 335983 - DNA, 75 bp, Artificial Sequence
  Synthetic
gaaggttatgtccatgatggctttgagtccgccggatgagagccttgatgagacacacgaggccgtatttaagag

SEQ ID NO: 335984 - DNA, 75 bp, Artificial Sequence
  Synthetic
gacccccatccgtaaacatatattgaagaggattgggagtcagattgtcagggatttgtttacttatcacctaat

SEQ ID NO: 335985 - DNA, 75 bp, Artificial Sequence
  Synthetic
ggggagtacctccaccacatggccgaggcgccaccggacagggggacacaggcgggaaatcgccatcagctgggc

SEQ ID NO: 335986 - DNA, 75 bp, Artificial Sequence
  Synthetic
cattaaattagataggtctgaacaaaagagaatttggaaggctattggaagtgtcatattgtctttcacacttga

SEQ ID NO: 335987 - DNA, 75 bp, Artificial Sequence
  Synthetic
aaccggaaccccgcgggtcacagaatggtgcaacccaatatgtcacccaatatcccaattcacctacaggggaac

SEQ ID NO: 335988 - DNA, 75 bp, Artificial Sequence
  Synthetic
caatgatattcccgatcatcacccagtgctgtttgaagaccctgatacgcctgagttcgatatctttggcgagga

SEQ ID NO: 335989 - DNA, 75 bp, Artificial Sequence
  Synthetic
ctgccggtgcgggtgctgtccagatgtctgctccttgtgtgagagagattatgcattacttgcagacattagaga

SEQ ID NO: 335990 - DNA, 75 bp, Artificial Sequence
  Synthetic
ggaactgtaaatgaatctgatttaacaaaaaaagcttaatttaagaaaaaaacctatattgattttccccttggt

SEQ ID NO: 335991 - DNA, 75 bp, Artificial Sequence
  Synthetic
cccggattgcgaatcttgattggaaagtagataaattactatcccagcagacaaccatcactcaaatcaagaacg

SEQ ID NO: 335992 - DNA, 75 bp, Artificial Sequence
  Synthetic
atcaacacaccatcaaggcttcactagctactatcgaggggctgataacaacaatcaagatcatggacccaggag

SEQ ID NO: 335993 - DNA, 75 bp, Artificial Sequence
  Synthetic
tagggcctggtgctacagcatcccaggcaaaacggattttcaaggaagccccagttgtaatcagtggccccatac

SEQ ID NO: 335994 - DNA, 75 bp, Artificial Sequence
  Synthetic
taggagataatccgataataggtgctgaagccattcaactagatgagctggcccgaccatccccagcaaagcctc

SEQ ID NO: 335995 - DNA, 75 bp, Artificial Sequence
  Synthetic
gacaggtcaaacaatccggcccgtcttctagtgccattgttggctataagtcaactcttcaatcattggtaaagg

SEQ ID NO: 335996 - DNA, 75 bp, Artificial Sequence
  Synthetic
agtgcatatccaaccccagcatgagacaaaaatttgatttggcaataagtaacatcaagagtgaacaggatttta

SEQ ID NO: 335997 - DNA, 75 bp, Artificial Sequence
  Synthetic
aacaggtccgcagagacatcattcgcagtgccacataaaatctcagaaatccccaacatcaccacgctcagctgc

SEQ ID NO: 335998 - DNA, 75 bp, Artificial Sequence
  Synthetic
aagcccgcaacccagcagacacacacctagccaacaccgatgccccaccctgcacgcaccaacaactgcctcgct

SEQ ID NO: 335999 - DNA, 75 bp, Artificial Sequence
  Synthetic
tcaaacctcaaagccgtatcgcatatctttaagaaaaaacttaaaatgggtccgaaccctatagaccccgggacg

SEQ ID NO: 336000 - DNA, 75 bp, Artificial Sequence
  Synthetic
cgccgcaatggctctccgtcaggcaaccatccccatcaacgttgacactgagagtgaaaagaacaacctaaatcc

SEQ ID NO: 336001 - DNA, 75 bp, Artificial Sequence
  Synthetic
atttccaattgtaccaatcaccaaagaagacgggtcacctacaggaaggcttgttaaacaattgagaataaagaa

SEQ ID NO: 336002 - DNA, 75 bp, Artificial Sequence
  Synthetic
cctaaccccaagaggttccacggagcttcctctcaccttcatcaacacctatggatttataaaaccgctgatgac

SEQ ID NO: 336003 - DNA, 75 bp, Artificial Sequence
  Synthetic
atatactgagttcttttcgactcacctcagaactccctcctgcctcactgcttgcatgatccccttcggtgctgg

SEQ ID NO: 336004 - DNA, 75 bp, Artificial Sequence
  Synthetic
accgttcattgagaatcctcaccggattcttgataaatgtgaccgtgtcaacattgtagtgaggaaaagcgcaag

SEQ ID NO: 336005 - DNA, 75 bp, Artificial Sequence
  Synthetic
tgtgaaagaggagatcatatttgacgtgaggcgacttcctcctttattcaatcgtcatcaaatatcagggaatcg

SEQ ID NO: 336006 - DNA, 75 bp, Artificial Sequence
  Synthetic
tctcatttgtgtgccgtctgagaagtatgtcaagtcacctggcaagatgattgcaggaactgattatgcctatca

SEQ ID NO: 336007 - DNA, 75 bp, Artificial Sequence
  Synthetic
aattgcttttgtatccttgacattctgccctgagagccaaaaattcagggtggcaaggccactgcaaaccattag

SEQ ID NO: 336008 - DNA, 75 bp, Artificial Sequence
  Synthetic
gtcaccaatcatgaggagtgtccagctggaggtgattctcaagatagactgtgcagcaaactcgcccttaaagag

SEQ ID NO: 336009 - DNA, 75 bp, Artificial Sequence
  Synthetic
atttctgataatatctcctaactcaaaggactgttttgcatctgtgtggttccatatctgcaatctgtatcgagg

SEQ ID NO: 336010 - DNA, 75 bp, Artificial Sequence
  Synthetic
gaataagccgttcaaggcttatgatgacacgtatttcagtcagaaatgccgagcaatgcagctagagtgtggaat

SEQ ID NO: 336011 - DNA, 75 bp, Artificial Sequence
  Synthetic
cgtggatatgtggggtcccacacttgttgtaaaggcacacggaaagatcccaaagatggcaagaccttttttcag

SEQ ID NO: 336012 - DNA, 75 bp, Artificial Sequence
  Synthetic
ctctaagggatggtcttgccatgcctttgctgatgcagcgcctaccttggcaaaggcattatggtctgtcggtgc

SEQ ID NO: 336013 - DNA, 75 bp, Artificial Sequence
  Synthetic
tcagatcacacaggtgaatgcaatcctgcaaccgtcagacttacaccagcttgtgcaaataagtgatgtcatctg

SEQ ID NO: 336014 - DNA, 75 bp, Artificial Sequence
  Synthetic
gccgaaagtcaagcttgatgagaaaatccagtcctatgcagctgcaaaatggaatcctttcaaaaaatcaaccaa

SEQ ID NO: 336015 - DNA, 75 bp, Artificial Sequence
  Synthetic
ttgagacgccatacataaactgcccagcatactcaagtcagctacacggaccacccaacccacacaacatcaagc

SEQ ID NO: 336016 - DNA, 75 bp, Artificial Sequence
  Synthetic
cccagatcccagccatcccagatcgcccaaaacactggaaaactgcctccctctctcccgacaatgctccgcaaa

SEQ ID NO: 336017 - DNA, 75 bp, Artificial Sequence
  Synthetic
ctcctgcgcttccacacactcccgcaccaccagctacacgagcacagcacacaatcaagagttttaataaaaaac

SEQ ID NO: 336018 - DNA, 75 bp, Artificial Sequence
  Synthetic
taaggggtatagcatagccggttaaccatggctagagcccgaacacatcaaagatcacccaggctcaaacctcag

SEQ ID NO: 336019 - DNA, 75 bp, Artificial Sequence
  Synthetic
gaggctctgccactacaaatcagggagatagccatgagaatcgctctaactgccgttattgtgagcattcacttt

SEQ ID NO: 336020 - DNA, 75 bp, Artificial Sequence
  Synthetic
gatctagcattccctatgaacaagaatagcctcttaagtgtcgggcttgtgcataaatcagtgaagaacctctat

SEQ ID NO: 336021 - DNA, 75 bp, Artificial Sequence
  Synthetic
ttttactctcagggctcaccatcgtacatcgtagtgaaactcgtaccgactcttggcaatgttcctgggaactgc

SEQ ID NO: 336022 - DNA, 75 bp, Artificial Sequence
  Synthetic
acactcaatagtcttgttaggtataaaagtacggtgtcatcacttctctctcctctcgcagagaacttagaatat

SEQ ID NO: 336023 - DNA, 75 bp, Artificial Sequence
  Synthetic
ctacagaagacgctgactgtttcccggggagggaggagaaggaggtttgctggagtggccataggattggctgca

SEQ ID NO: 336024 - DNA, 75 bp, Artificial Sequence
  Synthetic
ctgggtgttgcagcagccgcccaagcaacggcagcagtggccttggtagaagcaagacagaatgcagcccaaata

SEQ ID NO: 336025 - DNA, 75 bp, Artificial Sequence
  Synthetic
cagagtctctctgaagcaatacaaaacactaatcttgcagttaatgagctgaagactgcaataggagcatcagct

SEQ ID NO: 336026 - DNA, 75 bp, Artificial Sequence
  Synthetic
acagctatacaggcaattcaaacccagatcaacgaagtaattaatcctgcaataaatcgtctgagttgtgagatc

SEQ ID NO: 336027 - DNA, 75 bp, Artificial Sequence
  Synthetic
cttgatgcgcaacttgcatccatgctgaatctttatctgattcacctaaccacagttttccaaaatcaattgaca

SEQ ID NO: 336028 - DNA, 75 bp, Artificial Sequence
  Synthetic
aatcctgcattaacccccttgagtattcaatctcttcagagcttactccaaggtacctccagtgttctcactaat

SEQ ID NO: 336029 - DNA, 75 bp, Artificial Sequence
  Synthetic
attacatcaagttcgaaattagcacttaatgatgccttagtgacaggtttgatcacagggcaagtggttggatta

SEQ ID NO: 336030 - DNA, 75 bp, Artificial Sequence
  Synthetic
aacatgacctctcttcaaatagtcatagctgcatacgtaccaagtgttgcaaagttgtcaaatgctgtagtccac

SEQ ID NO: 336031 - DNA, 75 bp, Artificial Sequence
  Synthetic
aactttattcggattacaacttcagttaatggaacagaagtcattatccagtcacctactattattatggaacag

SEQ ID NO: 336032 - DNA, 75 bp, Artificial Sequence
  Synthetic
aatgaagtgatgtacgatctcaagacaggccattgcactgagagcgacctaaacatttactgtccgtatgtagat

SEQ ID NO: 336033 - DNA, 75 bp, Artificial Sequence
  Synthetic
gctcaactcttatctccgggtatgactaactgtattaacggtagactgaatgactgtaccttctctaaagtagta

SEQ ID NO: 336034 - DNA, 75 bp, Artificial Sequence
  Synthetic
gggtctttcccaactaggttcgcagcagttgaaggcgctatactggcaaactgcaaatatctgcaatgcaactgc

SEQ ID NO: 336035 - DNA, 75 bp, Artificial Sequence
  Synthetic
ttaactcctccctatattatcactccactgaatggagagatgatctcaatgattgacctgtcgaaatgccaacgt

SEQ ID NO: 336036 - DNA, 75 bp, Artificial Sequence
  Synthetic
ctagatcttggaacaattgtatttgatatcaacaaccctgtcaatgtcacattcaacggaaactatagagcagat

SEQ ID NO: 336037 - DNA, 75 bp, Artificial Sequence
  Synthetic
gtggggcagatgatcgttaccaatcctctagacatctctgcggaactcaaccaaatcaacacatcattgtctaat

SEQ ID NO: 336038 - DNA, 75 bp, Artificial Sequence
  Synthetic
gcacagggtttcctgtctaaaagtgatgcgtggttgcatgtatcccaatgggtaacaaactccgggactatattt

SEQ ID NO: 336039 - DNA, 75 bp, Artificial Sequence
  Synthetic
attattctaatcattgggctaatagttggcatagtgtatatgattatcaacacatatgtagtggttcaaatcatc

SEQ ID NO: 336040 - DNA, 75 bp, Artificial Sequence
  Synthetic
aaggagatcaaccgaatgagaacaagtgacagagcacatttgctcaagggatctatatcttcgatatccacttaa

SEQ ID NO: 336041 - DNA, 75 bp, Artificial Sequence
  Synthetic
aaggtcgaagggatgctgctcaatactatagcttagagtgatgttgtcagttataacctagtacgctttgttgtt

SEQ ID NO: 336042 - DNA, 75 bp, Artificial Sequence
  Synthetic
taaggaaaactaggcatatatgcaagataatgctagattatagtatactcaacaacagcgcttggagcccgactc

SEQ ID NO: 336043 - DNA, 75 bp, Artificial Sequence
  Synthetic
tgatactctgcagccctctccaattacgcaccaagggagcaatcatgtgggccaccagtgagagcaaggcaccca

SEQ ID NO: 336044 - DNA, 75 bp, Artificial Sequence
  Synthetic
tcccggccaattccaccctgaaccttgttgatgtcccccttgatgaaccacagacaatcaccaagcacaggaagc

SEQ ID NO: 336045 - DNA, 75 bp, Artificial Sequence
  Synthetic
aaaaaaggacaggtcgattggtattcagactacttagcttagtactgagtctgatgactgtgatccttgttcttg

SEQ ID NO: 336046 - DNA, 75 bp, Artificial Sequence
  Synthetic
tgattcttgctagctggagtcagaaaattaatgcatgtgccactaaggaagggttcaactcccttgatcttcaga

SEQ ID NO: 336047 - DNA, 75 bp, Artificial Sequence
  Synthetic
tttcaggactggtcaaatcaatcaatagcttaatcactgaggtgaaccagatcagcataacaacagctatcaact

SEQ ID NO: 336048 - DNA, 75 bp, Artificial Sequence
  Synthetic
tgcctataaagttgtctgattttgggaagtctatagttgatcaagtaacacaaatgattaggcagtgtaacgcag

SEQ ID NO: 336049 - DNA, 75 bp, Artificial Sequence
  Synthetic
tgtgtaaggggcctggtgagaaacctggaattcagaatattagaatcaacattcctaacaacttttctacctatc

SEQ ID NO: 336050 - DNA, 75 bp, Artificial Sequence
  Synthetic
ttgagttaaataatactgttaagtccatagaactgcagaggcgaccggctctactggctagaccgaatcctatac

SEQ ID NO: 336051 - DNA, 75 bp, Artificial Sequence
  Synthetic
ccaaaagttgttcacggttcccaagttacagtgtcaatttcggaatacattgttttgctcatgcaatcactgatc

SEQ ID NO: 336052 - DNA, 75 bp, Artificial Sequence
  Synthetic
aatcatgtgaattaagcgacaagacttattatagattggctataggaatatcagacaagaacctatctgaccctt

SEQ ID NO: 336053 - DNA, 75 bp, Artificial Sequence
  Synthetic
ccgatgtcaagtatattggagaggcatttacccctatgggacttcaggcaagaggctgctcggtcataagctcta

SEQ ID NO: 336054 - DNA, 75 bp, Artificial Sequence
  Synthetic
tatacggctgctatcttttgtgttctaagtctaatcaaggttatgaagctgatttccaaactcaagggtttcatc

SEQ ID NO: 336055 - DNA, 75 bp, Artificial Sequence
  Synthetic
aaatgtacatcctatttctttctcgcgatttgaagaccacactattcaatgatatgatatcctcaacaactgtgg

SEQ ID NO: 336056 - DNA, 75 bp, Artificial Sequence
  Synthetic
tttggaacggactctacccaggagaaggggcaggaatctggcatatggggtacttaatattccctctatggggag

SEQ ID NO: 336057 - DNA, 75 bp, Artificial Sequence
  Synthetic
ggatcaagataggaactcctgcaagcacaagcatcttaaactcaacacttgatctaccactcgtaggtcccagct

SEQ ID NO: 336058 - DNA, 75 bp, Artificial Sequence
  Synthetic
gtaagtctacgctcgaggaaaataatctaataaataaggacgtcttgttcagtccctactttggagaaagtgtga

SEQ ID NO: 336059 - DNA, 75 bp, Artificial Sequence
  Synthetic
tggtttttggattcctttcgtgttacatgttatccaatgttccaactcattgccaggttgaggtactgaattcat

SEQ ID NO: 336060 - DNA, 75 bp, Artificial Sequence
  Synthetic
cagtgctggggttcggatcaaggtcacagcttatggatctaaaggggatagtatatctatatatccagagtgcag

SEQ ID NO: 336061 - DNA, 75 bp, Artificial Sequence
  Synthetic
gctggtattcttacacacagttgtttagactctctttacaatctcgcggttacaagttgactgtgaaacagattc

SEQ ID NO: 336062 - DNA, 75 bp, Artificial Sequence
  Synthetic
gcagaattccgatatcaagtactactcgtccaggaacagctccctgtgatgtagtacacaattgtccatatacat

SEQ ID NO: 336063 - DNA, 75 bp, Artificial Sequence
  Synthetic
gcgcgacaggattattccaggccccgtggatagttaatggtgacagcattctagatagagatgtacggaatttag

SEQ ID NO: 336064 - DNA, 75 bp, Artificial Sequence
  Synthetic
tgtttgttcaagcatggtctggtaatttcaataccttccaaaaaggcctcatttctatctgcaaccagtatactt

SEQ ID NO: 336065 - DNA, 75 bp, Artificial Sequence
  Synthetic
gtccattaactacattgttagacaatgataacagcataatgagatcaaccaccacatattgttaccctagccttt

SEQ ID NO: 336066 - DNA, 75 bp, Artificial Sequence
  Synthetic
cagagtataatctacagtgccagtcatttatagaatggggtggtccagttgggaatcctataggtattcttgagg

SEQ ID NO: 336067 - DNA, 75 bp, Artificial Sequence
  Synthetic
tacattacatcatcaagttcaaatgatcaacaacagtttatgatcaatagctactttatctctgcttgtcttatt

SEQ ID NO: 336068 - DNA, 75 bp, Artificial Sequence
  Synthetic
aagataatttttcccaggttttctgagtagtctacatagattcctacctgtaagctcagtgaaatctacctagac

SEQ ID NO: 336069 - DNA, 75 bp, Artificial Sequence
  Synthetic
atttaagaaaaaactaaaggggaggggtaggaattcctctgcagcgatgatcattgtctcgatattcaccaacaa

SEQ ID NO: 336070 - DNA, 75 bp, Artificial Sequence
  Synthetic
gtccaagtgggccagaatggcgtgccccgagcaagtgatcctcccagaggtccacttggattcacctattgttag

SEQ ID NO: 336071 - DNA, 75 bp, Artificial Sequence
  Synthetic
aaacaaactgctctactacttaaaagtaggtgggctccctacgtccgatgaaggtatttgtgatacattattccc

SEQ ID NO: 336072 - DNA, 75 bp, Artificial Sequence
  Synthetic
taatatctcatgggatcgggtgaggagagaagaatcccgattgtcagcacggcttcaaaaagttagacagctatc

SEQ ID NO: 336073 - DNA, 75 bp, Artificial Sequence
  Synthetic
ttatgctagattaagctcatctgtaaattccccaagaagtccaaccgctaatctagatgttgaggtaatcctatg

SEQ ID NO: 336074 - DNA, 75 bp, Artificial Sequence
  Synthetic
gcctgaaataatcccgaacttaaagaggtacatattgacaagctgccttaatcgctttgcggatgccgagaaatg

SEQ ID NO: 336075 - DNA, 75 bp, Artificial Sequence
  Synthetic
tctgatttcggcaatgtcaccattggttcaaggaacaaagcttttgcttagtgagatgtgcaaaaaagtatcggg

SEQ ID NO: 336076 - DNA, 75 bp, Artificial Sequence
  Synthetic
gaaagatacactagtgacaaataatgtcaaagcttgccgcttccatggacaacacacaagacctcaatctgcgct

SEQ ID NO: 336077 - DNA, 75 bp, Artificial Sequence
  Synthetic
agacttctgccatatctatgatgccaatgaatataaagatgctttctatacttggttcctaatacgtcatcaaat

SEQ ID NO: 336078 - DNA, 75 bp, Artificial Sequence
  Synthetic
gagggctctaattctaaaaactcagaccaacctatcagtagaccttattactatcctagatgaaagagattactg

SEQ ID NO: 336079 - DNA, 75 bp, Artificial Sequence
  Synthetic
ctttattgtcacccctgagcttgtcacactggtagatagaaaagagactaggatgtcttattttacttttgagat

SEQ ID NO: 336080 - DNA, 75 bp, Artificial Sequence
  Synthetic
gactttgatggtgacagatatgatcgagggaaggatgaatatacttgcaattagtagtgccagctgttacctcca

SEQ ID NO: 336081 - DNA, 75 bp, Artificial Sequence
  Synthetic
accgctaaaagtcaacctccgctatttgtttgatatagtagatcaattatgtgctatcttgggacagaatgttta

SEQ ID NO: 336082 - DNA, 75 bp, Artificial Sequence
  Synthetic
ttcactcattgcaaatctcgagagcatggtatatgctgtgctacaactctctgatcctgttcctgatctcaaagg

SEQ ID NO: 336083 - DNA, 75 bp, Artificial Sequence
  Synthetic
agagtttctatcctttatcaactctgagatttatactatcctcacggatagcggtgagtttacagattgtgaggc

SEQ ID NO: 336084 - DNA, 75 bp, Artificial Sequence
  Synthetic
atatgcagtgatagataagcttaattcttgttaccttcaccttcctgctgacttagtcgctgagctgctgtgtat

SEQ ID NO: 336085 - DNA, 75 bp, Artificial Sequence
  Synthetic
catgagactctggggccaccctatgcttacttctgctactgctgccagaaaagttcgtgagtcaatgtgcgcacc

SEQ ID NO: 336086 - DNA, 75 bp, Artificial Sequence
  Synthetic
aaaagtaatcgatttgactacaaacctcaaaaccttagcattcttcaatgggatcataataaatggataccggag

SEQ ID NO: 336087 - DNA, 75 bp, Artificial Sequence
  Synthetic
gaggcatgatggtatatggcccaattgcactctcccacctttcgcttctctgagcttacaagagctgaggcatga

SEQ ID NO: 336088 - DNA, 75 bp, Artificial Sequence
  Synthetic
caactctgagctatcttatccctacatccttgcgcactggaaagagattgcaatgctggagtttgggaagagtat

SEQ ID NO: 336089 - DNA, 75 bp, Artificial Sequence
  Synthetic
agatgcggatccgggcgaggatctgagcatctttatgaaggataaggccataagtgccccaagaaaagactggct

SEQ ID NO: 336090 - DNA, 75 bp, Artificial Sequence
  Synthetic
tagtgtattccgaaagagcctgataaaacagcaatgtgaacaatgtagaatctctttacctcagccttataatcg

SEQ ID NO: 336091 - DNA, 75 bp, Artificial Sequence
  Synthetic
aagactgcttctcaattttctagctgatgaaacatttgatccctcaaaagagcttgaatatgtcacaagtggtgc

SEQ ID NO: 336092 - DNA, 75 bp, Artificial Sequence
  Synthetic
atatcttgatgatgattcgttctgtgcatcatattctttgaaggagaaagagatcaaagagactggaaggatctt

SEQ ID NO: 336093 - DNA, 75 bp, Artificial Sequence
  Synthetic
tgccaagctcaccaagaatatgagatcatgccaggtcattgcagaatctctcttggcggcccatgcaggtaagtt

SEQ ID NO: 336094 - DNA, 75 bp, Artificial Sequence
  Synthetic
tttcaaagagaatggagtggttctggaccagattagtattaccaaaacgcttctgactatgtcacagattgggat

SEQ ID NO: 336095 - DNA, 75 bp, Artificial Sequence
  Synthetic
tatatcaaaacattctcggcggactactcgaaacaacattacagtactaaataagtctgagaggcatcatctagg

SEQ ID NO: 336096 - DNA, 75 bp, Artificial Sequence
  Synthetic
tagacatgagacaaatgctaacctcagttccgggaagagagaagttcccaatgagacaactgaaataactgcttg

SEQ ID NO: 336097 - DNA, 75 bp, Artificial Sequence
  Synthetic
cttccttacaacagacttaagtaagtattgcctgaattggagataccagtctataattctttttgcaaaaagcat

SEQ ID NO: 336098 - DNA, 75 bp, Artificial Sequence
  Synthetic
gaatcaactgtatggctataatcatctattcgaatggattcatctaaggctcatgaggtctacgctctatgttgg

SEQ ID NO: 336099 - DNA, 75 bp, Artificial Sequence
  Synthetic
ggatccattcaacccacccaggaacttaacatcagcagatctcgatctcgtcgaaaatggtgatatctttattgt

SEQ ID NO: 336100 - DNA, 75 bp, Artificial Sequence
  Synthetic
ctctccaagagggggtattgaaggcttgtgtcagaaactctggacaatgatttccattgcagtaattgtcttatc

SEQ ID NO: 336101 - DNA, 75 bp, Artificial Sequence
  Synthetic
agctactgaagcgggcacaagagtgatgagcctagtgcaaggtgacaaccaggctatggcgattactacaatggt

SEQ ID NO: 336102 - DNA, 75 bp, Artificial Sequence
  Synthetic
accacgtgggcttcctcaccatgaaaagaaaagaatcgcatacgaaaatagccaaacctttataagaaggctcag

SEQ ID NO: 336103 - DNA, 75 bp, Artificial Sequence
  Synthetic
agaaaacaacttgggcatgggacatcatttaaaagaacaagaaactattgtaagttcagaattcctaatctatag

SEQ ID NO: 336104 - DNA, 75 bp, Artificial Sequence
  Synthetic
caagaggattatttacaacggaagaatactaaatcaatccctcaaaaatgttagcaagctttgcctcatagctga

SEQ ID NO: 336105 - DNA, 75 bp, Artificial Sequence
  Synthetic
tatactgggtgagagcactcaaacatcatgttcaaacttagccactacagtaatgagattgacagagaatggaat

SEQ ID NO: 336106 - DNA, 75 bp, Artificial Sequence
  Synthetic
tgagaaagatatatgtttctttttgaatcaataccttactgcaaaacagttggtatttgaccttcttttcccatt

SEQ ID NO: 336107 - DNA, 75 bp, Artificial Sequence
  Synthetic
gacaaagttgtttgaggaccagacatcctcggctttcttggaccacccaattcttgtgtcccgcctaattacaat

SEQ ID NO: 336108 - DNA, 75 bp, Artificial Sequence
  Synthetic
tcctgctcagcttggtggcctaaattactacgctttgacccgcttgttcaatcggaatataggagatccattaac

SEQ ID NO: 336109 - DNA, 75 bp, Artificial Sequence
  Synthetic
atctgcaattgctgatttgaagcgttatatcatcgctgggatgcttccaagatggatcctaaagaacctgattgc

SEQ ID NO: 336110 - DNA, 75 bp, Artificial Sequence
  Synthetic
gcgtgagccgggtgatggggactggaacacccttgcatcagatccttatgcactaaatatagactacttgtatcc

SEQ ID NO: 336111 - DNA, 75 bp, Artificial Sequence
  Synthetic
tcccaccacatttttgaagaaacatgctcaaagagtactcatggagggcagtgtcaacccaatgttaagtggtgt

SEQ ID NO: 336112 - DNA, 75 bp, Artificial Sequence
  Synthetic
gttcagtgagagtaacctacctgaagaaaattccctggcacgcttcctattggacagagatatagttatgcctag

SEQ ID NO: 336113 - DNA, 75 bp, Artificial Sequence
  Synthetic
ggttgctcatatcgtgttggagcagtctgtgtgtggtaggaagaaacaaatacaaggttatctggataccactag

SEQ ID NO: 336114 - DNA, 75 bp, Artificial Sequence
  Synthetic
aacaatcataaggtatgccatcaatagacaaccaattgggaatgcgaagctttgcaagattctagattacaatac

SEQ ID NO: 336115 - DNA, 75 bp, Artificial Sequence
  Synthetic
ttcatacctctcttacaatctagactatatctcaacacctgtaacctgtgttactatgagcatgtcttcttcatc

SEQ ID NO: 336116 - DNA, 75 bp, Artificial Sequence
  Synthetic
tctcttgaagctatgtagcatcgatctagcacgactagttagaagattatcttggaagtctttattaggtgggag

SEQ ID NO: 336117 - DNA, 75 bp, Artificial Sequence
  Synthetic
acaactagatggcctcgaaactccagatccaatagaattagttgaaggtgctttactgactaggggctctgcttg

SEQ ID NO: 336118 - DNA, 75 bp, Artificial Sequence
  Synthetic
cactcattgtatgtcagggaatagaaagtacacctggttcttcgtgccagcagggatagacataactgcagatcc

SEQ ID NO: 336119 - DNA, 75 bp, Artificial Sequence
  Synthetic
cgctgataatccgccagtcagggtgccgtacattgggtcaagaacagatgagagaagggtagcatcaatgagtta

SEQ ID NO: 336120 - DNA, 75 bp, Artificial Sequence
  Synthetic
tgttaaaggttcatcaagtgcacttaaagcagcactccgcctttgtggagtatatatctgggcattcggagatac

SEQ ID NO: 336121 - DNA, 75 bp, Artificial Sequence
  Synthetic
cgagaaaaactgggctgacgcggcacagttagcaaacactcgtgcacaattaagtctggatcagcttcatgtctt

SEQ ID NO: 336122 - DNA, 75 bp, Artificial Sequence
  Synthetic
aacacctctgcctacaactgccaacctcacacacaggcttgatgacgggctcactcagcaaaagtttactccagc

SEQ ID NO: 336123 - DNA, 75 bp, Artificial Sequence
  Synthetic
cagctcttatatgtattcatcctatgttcacatatccaatgatgatcaaaacttagaaatccaagatcggactgt

SEQ ID NO: 336124 - DNA, 75 bp, Artificial Sequence
  Synthetic
ggattcaaatttgatttaccaacaaataatgttgttaggactaggcataattgaaacttggctacaattgccgaa

SEQ ID NO: 336125 - DNA, 75 bp, Artificial Sequence
  Synthetic
tgaaatcaacatagaggactctacattacacctacacactgagtgttcatgttgtatcaaacaagtagatgcctg

SEQ ID NO: 336126 - DNA, 75 bp, Artificial Sequence
  Synthetic
ttataaatattcaacaggaaaaccacctaatttaaattgccgaccacaaactgacaaccgttacatatacttccc

SEQ ID NO: 336127 - DNA, 75 bp, Artificial Sequence
  Synthetic
acacacaagactatgtacaaggctttgattggacagaaaaagacaaacataacataacaacctacaaagaattct

SEQ ID NO: 336128 - DNA, 75 bp, Artificial Sequence
  Synthetic
ttttttacacattacttccccttttacagaactccaccccctaattcattaataatcagacgctattcctgggag

SEQ ID NO: 336129 - DNA, 75 bp, Artificial Sequence
  Synthetic
taactaaaggagcaggaaatccatttcacgcagaatggataacagcacaaaacccagtaatacacacagcaaaca

SEQ ID NO: 336130 - DNA, 75 bp, Artificial Sequence
  Synthetic
gagacacactagtataaaactaactacacagacgaatggctgagtttatcacgccagacggagacggcaacacaa

SEQ ID NO: 336131 - DNA, 75 bp, Artificial Sequence
  Synthetic
gtcctacacaaatagaacaaatatacaccgcttcaacaacaacattccaaaacaaaaaactaacagacctaccaa

SEQ ID NO: 336132 - DNA, 75 bp, Artificial Sequence
  Synthetic
cagtggcagccggctgatcttgggcgggagccgaaggtgagtgaaaccaccgaagtctaggggcaattcgggcta

SEQ ID NO: 336133 - DNA, 75 bp, Artificial Sequence
  Synthetic
cgccaggatatatatttataactccaacagtaagcttaagatacaacccatacaaagacctagcagaaagaaaca

SEQ ID NO: 336134 - DNA, 75 bp, Artificial Sequence
  Synthetic
gatcagtctggcggaccgggcaagaaacttaaaaacatattattttacaggtatgagcaaactactaacaccaac

SEQ ID NO: 336135 - DNA, 75 bp, Artificial Sequence
  Synthetic
aatgctactttgtaagaagcaaaataaatgcacacgggtgggacccagaacaacaccaagaattaataaacagtg

SEQ ID NO: 336136 - DNA, 75 bp, Artificial Sequence
  Synthetic
tatatacagcaacaaaggattagaaaacaactgggtaaacctaatatggaacagccatgatcttatctgtggctg

SEQ ID NO: 336137 - DNA, 75 bp, Artificial Sequence
  Synthetic
acctaccacaatggttactattatttggctacccagactacataaaaagaacacaaaactttgcattagtagaca

SEQ ID NO: 336138 - DNA, 75 bp, Artificial Sequence
  Synthetic
caacaacccctggaaacatctatcagacatcatagcaagacaaggaacacaactatgcctcccttcaactactac

SEQ ID NO: 336139 - DNA, 75 bp, Artificial Sequence
  Synthetic
caaattacatactagtagaccactgcccatacacaaatccagaaaaaacaccatttatacctttaagcacatcat

SEQ ID NO: 336140 - DNA, 75 bp, Artificial Sequence
  Synthetic
cgacgccgctacttctaccgacccagacgttatagaagacgatggtttacaacctggagacctagacaaactctt

SEQ ID NO: 336141 - DNA, 75 bp, Artificial Sequence
  Synthetic
ttatagaaggtagaagcccatacagtccttcagacacacatgaaccagatgaagaagaccaaaacaggtggtacc

SEQ ID NO: 336142 - DNA, 75 bp, Artificial Sequence
  Synthetic
cgaagaagatttcgaagacggcgatgggtaagaaaaagacgcttttttaaatataaaaaaagaaaactaaaaaag

SEQ ID NO: 336143 - DNA, 75 bp, Artificial Sequence
  Synthetic
catgctaccaatatcaacaagaatcaataaattcaatatgtcttagcggtccaggcacaccaaaaataccaaaag

SEQ ID NO: 336144 - DNA, 75 bp, Artificial Sequence
  Synthetic
attagactatcacaatggcaaccagacagtataagaaaatgtactataaaaggacaattatgcttactaacatgc

SEQ ID NO: 336145 - DNA, 75 bp, Artificial Sequence
  Synthetic
gaataacagcagaagcaaaagtaaaatattcctttaattttaagtggggtggtgacctaccaccaatgtctacaa

SEQ ID NO: 336146 - DNA, 75 bp, Artificial Sequence
  Synthetic
ggaattggaagaattaacaataactttactttaactgcagaaagctatgtacctatttctgaaccaggaggggga

SEQ ID NO: 336147 - DNA, 75 bp, Artificial Sequence
  Synthetic
ttacaaacccgacagaccagccaacatatgttgttcccaataacttcaatgaaacaacttcgttacagaatccaa

SEQ ID NO: 336148 - DNA, 75 bp, Artificial Sequence
  Synthetic
acctatttctgaaccaggagggggaggatggagtataatgcaaataactttaagagctttatatgacgaatacga

SEQ ID NO: 336149 - DNA, 75 bp, Artificial Sequence
  Synthetic
acattatagaaactggtggacaactagtaactgtggactaccattagtaaaatatacaggatgttctataaaatt

SEQ ID NO: 336150 - DNA, 75 bp, Artificial Sequence
  Synthetic
ccaccagaccagagcacttcttgtactcctttgacgaaaggaggggacaacttacagaaaaagctacaaaacgct

SEQ ID NO: 336151 - DNA, 75 bp, Artificial Sequence
  Synthetic
ttacaatagtaatgacactgactatatagtgactgtacaacgaacaggaccttttgaagttgacagagactcata

SEQ ID NO: 336152 - DNA, 75 bp, Artificial Sequence
  Synthetic
tgcttaaagactgggaaactaaagaaacttctttattgtctacagaatacagattcgcggagccaacacaaacac

SEQ ID NO: 336153 - DNA, 75 bp, Artificial Sequence
  Synthetic
cctaaacacacagccaagcagacacatgatgaacaaaaatagttttatagtaccaaaactaaatcctaacaaaaa

SEQ ID NO: 336154 - DNA, 75 bp, Artificial Sequence
  Synthetic
aagccccacaagaggacccgtcctcggaagaagaagaagagagcaacctcttcgagcgactcctccgacagcgaa

SEQ ID NO: 336155 - DNA, 75 bp, Artificial Sequence
  Synthetic
aagaaaaccatacataagaaaaaaatacaaaccaccagcactactacaaaacaaatggtactttgcacaagacat

SEQ ID NO: 336156 - DNA, 75 bp, Artificial Sequence
  Synthetic
ccaagcagctccagctcaagcgcagaataatacaaacattgaaagacctacaaaaattagaataactaacagcaa

SEQ ID NO: 336157 - DNA, 75 bp, Artificial Sequence
  Synthetic
actaaacacccctttaatactattcaccacatcatcctgctctctagaccaaatgtatgcaccaaatgaccaaat

SEQ ID NO: 336158 - DNA, 75 bp, Artificial Sequence
  Synthetic
aaacaccgtttacctatttccacctgaacaaaagaacagaagactaacaccatgggaaatacaagaagacaaaga

SEQ ID NO: 336159 - DNA, 75 bp, Artificial Sequence
  Synthetic
tagcacaaacataacttttttatcactaaacacaaacatttttcaaaacccatactgggaattagatgacaacca

SEQ ID NO: 336160 - DNA, 75 bp, Artificial Sequence
  Synthetic
aatagccaatttatttggcagaccacatagatactttttaaaagacattcctttctattgggatatacccccaga

SEQ ID NO: 336161 - DNA, 75 bp, Artificial Sequence
  Synthetic
accttactttcctaaagtaacaggcacaattaacaacataggcctatataccatggggaatggaggaaacataaa

SEQ ID NO: 336162 - DNA, 75 bp, Artificial Sequence
  Synthetic
gcctaaagtaaactttgatttaaattttcaataaagaaataaagggcaaggccccattaactcaaagtcggtgtc

SEQ ID NO: 336163 - DNA, 75 bp, Artificial Sequence
  Synthetic
aaatatgaaaaattggaaacaattaataccactatatcaaacacaattatacaaaaaagaacataatacaaatgg

SEQ ID NO: 336164 - DNA, 75 bp, Artificial Sequence
  Synthetic
tacctctttaagtttaactttactaaacggactccgcctccctaaatttgggcgccaaaagggggctccgccccc

SEQ ID NO: 336165 - DNA, 75 bp, Artificial Sequence
  Synthetic
aacagactggacaacaaatttcagtgatctatcacaaccaaacaaatgggctaacccattttcatacagtgcaca

SEQ ID NO: 336166 - DNA, 75 bp, Artificial Sequence
  Synthetic
taattaatattcaacaggaaaaccacataattagaattgccgaccacaaactgacaactgttgcgttaacttctc

SEQ ID NO: 336167 - DNA, 75 bp, Artificial Sequence
  Synthetic
gggctccgcccccttaaaccccagggggctccgccccctaaaacccccaagggggctacgcccccttacaccccc

SEQ ID NO: 336168 - DNA, 75 bp, Artificial Sequence
  Synthetic
cgaagaaactaatgacgtccaaatattttatggtacaccaccaacagaaacaacatataatacacaaccacaatt

SEQ ID NO: 336169 - DNA, 75 bp, Artificial Sequence
  Synthetic
cttttacaactgtacttctgcttttctagagccacacctactacttcattaataatcagacgctattcctgggag

SEQ ID NO: 336170 - DNA, 75 bp, Artificial Sequence
  Synthetic
acaaactataacaggactataccaagaatgcagatacaacccatttaaagacaaaggcacaggaaacatatttta

SEQ ID NO: 336171 - DNA, 75 bp, Artificial Sequence
  Synthetic
gagcatcacgagtatataactaagtacacagacgaatggctgagtttatcacgccagacggagacggcatcagaa

SEQ ID NO: 336172 - DNA, 75 bp, Artificial Sequence
  Synthetic
cttaaaaagcacaaaaacacaacaaggcagttttttatcactaccaacagacaatagaattctactaaaagactt

SEQ ID NO: 336173 - DNA, 75 bp, Artificial Sequence
  Synthetic
acgccagacggagacggcatcagaacactgactgccggctgatcttgggcgggagccgaaggtgagtgaaaccac

SEQ ID NO: 336174 - DNA, 75 bp, Artificial Sequence
  Synthetic
cccaatatggttagcaacatggggatggattagttggttactaaaatccaaaccagtacactacttagaagaaga

SEQ ID NO: 336175 - DNA, 75 bp, Artificial Sequence
  Synthetic
tggattagttggttactaaaatccaaaccagtacactacttagaagaagactatcatttagttatacaatcacca

SEQ ID NO: 336176 - DNA, 75 bp, Artificial Sequence
  Synthetic
cgaagtctaggggcaattcgggctagatcagtctggcggaacgggcaagaaacttaaaatataacattattttta

SEQ ID NO: 336177 - DNA, 75 bp, Artificial Sequence
  Synthetic
cagatatgagcagctttctaacaccatcagtatactcaaaaaatggcttagaaaaccaatggatgaatacaatct

SEQ ID NO: 336178 - DNA, 75 bp, Artificial Sequence
  Synthetic
tacatatatccaccaatgccatgttacgttccactagacaaatactttacacacaatgatggcaaaaacttaaca

SEQ ID NO: 336179 - DNA, 75 bp, Artificial Sequence
  Synthetic
acacaatgatggcaaaaacttaacagaaacagacaaagcacactggcatccaaaaatagaaatgcaattagaaac

SEQ ID NO: 336180 - DNA, 75 bp, Artificial Sequence
  Synthetic
tcaacacccacgacttaatgtgcggatgcaacgacaccattaaacacctgtttgcaattctaaaaagaaaaggtg

SEQ ID NO: 336181 - DNA, 75 bp, Artificial Sequence
  Synthetic
caaaaatagaaatgcaattagaaactctagcaaaatttgcagaaacaggaccagcagccccaaaaataaacaaac

SEQ ID NO: 336182 - DNA, 75 bp, Artificial Sequence
  Synthetic
aacaactatgcctcccttctactaccgaagacgctggtacccaaaccggtggagacgcacaagactacgatttag

SEQ ID NO: 336183 - DNA, 75 bp, Artificial Sequence
  Synthetic
aaaaacaaatacaaatacatgcattttataaattttattttaagtggggcggctgcccagcaccaatggaaaaca

SEQ ID NO: 336184 - DNA, 75 bp, Artificial Sequence
  Synthetic
aagaaggagatttagacgccctattcgcaaacgatttcgaagaagacgatgggtaagaagacgccgcttttttag

SEQ ID NO: 336185 - DNA, 75 bp, Artificial Sequence
  Synthetic
ttataaattttattttaagtggggcggctgcccagcaccaatggaaaacatctgcaacccagcagaacaagaaaa

SEQ ID NO: 336186 - DNA, 75 bp, Artificial Sequence
  Synthetic
ggctgcccagcaccaatggaaaacatctgcaacccagcagaacaagaaaaattccccaatcccaataacatcctc

SEQ ID NO: 336187 - DNA, 75 bp, Artificial Sequence
  Synthetic
atttaaaagaaaactaaaaaaaataagaatagaccaatggcaaccagagactattagaaaatgccatataaaagg

SEQ ID NO: 336188 - DNA, 75 bp, Artificial Sequence
  Synthetic
aaagaacttacgatcgagaatccagaaacaccaaaagaacattacatttacaaatttgacgaacgagacggactc

SEQ ID NO: 336189 - DNA, 75 bp, Artificial Sequence
  Synthetic
aaacttatgcttattaacctgtggtagaggaaatattaaccataactatatactaacatcagaaagctatgtacc

SEQ ID NO: 336190 - DNA, 75 bp, Artificial Sequence
  Synthetic
cttacagacgcagctacaaaaagacttaaaaaagacattgaaactacaaaatattttacagaatatggagcaaaa

SEQ ID NO: 336191 - DNA, 75 bp, Artificial Sequence
  Synthetic
ttaaaaaagacattgaaactacaaaatattttacagaatatggagcaaaagacatcctcctacaaatacagccac

SEQ ID NO: 336192 - DNA, 75 bp, Artificial Sequence
  Synthetic
tacatcagaaccgggagggggatcatggtcaattttacaaatcacaacaagagtattatacgatgaatacagagc

SEQ ID NO: 336193 - DNA, 75 bp, Artificial Sequence
  Synthetic
cacaaaaaacacaagaggagacaaccacggaagaaagcgaagaagagatcaaggagcagctccagcagctcaagc

SEQ ID NO: 336194 - DNA, 75 bp, Artificial Sequence
  Synthetic
agctagaaattggtggacaaaatcaaactcattactaccactaacaaaatacattagatgtaagctaaaatttta

SEQ ID NO: 336195 - DNA, 75 bp, Artificial Sequence
  Synthetic
agcaacgagaccacctcagacacagaatcaacagactaacaaaaaaccgaaaattattccctatactgtagatat

SEQ ID NO: 336196 - DNA, 75 bp, Artificial Sequence
  Synthetic
tagaagtgaccaaacagattacatagtaacgatacaaagaacaggcccatttgaagttacattagactcatactt

SEQ ID NO: 336197 - DNA, 75 bp, Artificial Sequence
  Synthetic
atttggtcaaagtactgtaaaaaaccgtagatttactccacatgaatttgaagatgaattacttgtatttagaat

SEQ ID NO: 336198 - DNA, 75 bp, Artificial Sequence
  Synthetic
aagcacacaacctagtagacacttaatgaaccacagagcatttatagtaccaaaactaggaagaggtccaaacaa

SEQ ID NO: 336199 - DNA, 75 bp, Artificial Sequence
  Synthetic
atggcgtagacgccctagaacatatatatttgacccccctgactataacctgtctgtaattgaacctattgtaaa

SEQ ID NO: 336200 - DNA, 75 bp, Artificial Sequence
  Synthetic
aaaaacatacataaaaaaaattgttaaaccaccagcactattccaaagtaagtggtacttttcacaagacatata

SEQ ID NO: 336201 - DNA, 75 bp, Artificial Sequence
  Synthetic
ctttgcattaaactttaaaggctaggccagcaaatattcacttgtcggtgtctatttattaaagtataaacctat

SEQ ID NO: 336202 - DNA, 75 bp, Artificial Sequence
  Synthetic
caacacaccactgtttatgcttacagtatcatcctgttcactagaccaaatgttcgctccacaagaccaaattag

SEQ ID NO: 336203 - DNA, 75 bp, Artificial Sequence
  Synthetic
gccagcaaatattcacttgtcggtgtctatttattaaagtataaacctatataaacatccaccacactccctaat

SEQ ID NO: 336204 - DNA, 75 bp, Artificial Sequence
  Synthetic
tctatttattaaagtataaacctatataaacatccaccacactccctaatacgcaggcgcacaagggggctccgc

SEQ ID NO: 336205 - DNA, 75 bp, Artificial Sequence
  Synthetic
cacaaatatatcactattttcacttaatactaatgtttttcaaataagcaactggcacaaacaaccatacacaac

SEQ ID NO: 336206 - DNA, 75 bp, Artificial Sequence
  Synthetic
gggctccgcccccttaaacccccagggggctccgccccctaaaacccccagggggctccgccccctaaaaccccc

SEQ ID NO: 336207 - DNA, 75 bp, Artificial Sequence
  Synthetic
taataaatattcaacaggaaaaccacctaatttaaattgccgaccacaaaccgtcacttagttcccctttttgca

SEQ ID NO: 336208 - DNA, 75 bp, Artificial Sequence
  Synthetic
aaaagcatcaggaactctagaaacatacttatactgttatcacaatggtcaccaagaagaaggacaaaaaaaatg

SEQ ID NO: 336209 - DNA, 75 bp, Artificial Sequence
  Synthetic
acaacttctgcttttttccaactgccggaaaaccacataatttgcatggctaaccacaaactgatatgctaatta

SEQ ID NO: 336210 - DNA, 75 bp, Artificial Sequence
  Synthetic
ggaaaacattgttttactaggtaacatgacaaactacactgatggaataaaatcaacaaaaacacaaataacgaa

SEQ ID NO: 336211 - DNA, 75 bp, Artificial Sequence
  Synthetic
acttccacaaaacaacttccccttttaaaaccacacctacaaattaattattaaacacagtcacatcctgggagg

SEQ ID NO: 336212 - DNA, 75 bp, Artificial Sequence
  Synthetic
accaatagatttatttaaacaagaaaataaaacaaactggggcaatgtttttactaacctaaaccaagaccacga

SEQ ID NO: 336213 - DNA, 75 bp, Artificial Sequence
  Synthetic
tactaccacactataataccaagtgcacttccgaatggctgagtttatgccgctagacggagaacgcatcagtta

SEQ ID NO: 336214 - DNA, 75 bp, Artificial Sequence
  Synthetic
tgtaataatatactatggaggaaaacctaaagaaaccgacacatggcaaaataatgcacctattttaccaataac

SEQ ID NO: 336215 - DNA, 75 bp, Artificial Sequence
  Synthetic
ctgactgcggactgaacttgggcgggtgccgaaggtgagtgaaaccaccgaagtcaaggggcaattcgggctagt

SEQ ID NO: 336216 - DNA, 75 bp, Artificial Sequence
  Synthetic
aagtttatatgtagaatgcagatacaatccttttaaagataaaggaacaggaaacaaagtttatttagtaccaac

SEQ ID NO: 336217 - DNA, 75 bp, Artificial Sequence
  Synthetic
tcagtctagcggaacgggcaagaaacttaaaattattttatttttcagatgagcgactgctttaaaccaacatgc

SEQ ID NO: 336218 - DNA, 75 bp, Artificial Sequence
  Synthetic
agactcaggattaggaacatttttaacattaccaacaaaaccagaattaataatacaagacctaccattatggtt

SEQ ID NO: 336219 - DNA, 75 bp, Artificial Sequence
  Synthetic
tacaacaacaaaacaaagcaaactcactggattaataacctgcatttaacccacgacctgatctgcttctgccca

SEQ ID NO: 336220 - DNA, 75 bp, Artificial Sequence
  Synthetic
aataacatggggatggatagaatggctaaaaaaaagtagaccagtagctcacattcaagaagaataccaagtagt

SEQ ID NO: 336221 - DNA, 75 bp, Artificial Sequence
  Synthetic
acaccaactagacacttattactagctttagcagaacaacaagaaacaattgaagtgtctaaacaagaaaaagaa

SEQ ID NO: 336222 - DNA, 75 bp, Artificial Sequence
  Synthetic
aatacaaagtaaatatatacatccacaattaccatgctatgtatttatagacaaatactttagacacccaccaga

SEQ ID NO: 336223 - DNA, 75 bp, Artificial Sequence
  Synthetic
aaaataacaagatgccttattactacagaagaagacggtacaactacagacgtcctagatggtatggacgaggtt

SEQ ID NO: 336224 - DNA, 75 bp, Artificial Sequence
  Synthetic
aggacaattatacaaaacagaactatcagaaacagacaaagtacactggcacccaaaatattcaatgcaaacaga

SEQ ID NO: 336225 - DNA, 75 bp, Artificial Sequence
  Synthetic
ggattagacgcccttttcgcagaagatttcgaagaaaaagaagggtaagacctacttatactactattcctctaa

SEQ ID NO: 336226 - DNA, 75 bp, Artificial Sequence
  Synthetic
acaattagaacttatatcagaaacaggaccagcagcaccaaaaataaacaacacaaaacaaatagaggcacacct

SEQ ID NO: 336227 - DNA, 75 bp, Artificial Sequence
  Synthetic
agcaatggcaaccgccatataaaagaacatgctatataaaaggacaagactgtttaatatactatagcaacttaa

SEQ ID NO: 336228 - DNA, 75 bp, Artificial Sequence
  Synthetic
taactatgactttttattcaagtggggaggaagcccagctccaatggaagcaattacagacccagcagaacagga

SEQ ID NO: 336229 - DNA, 75 bp, Artificial Sequence
  Synthetic
gactgggaatgaatagtacaatgtatgaaaaaagtattgtacctgtacattggccgggagggggttctttttctg

SEQ ID NO: 336230 - DNA, 75 bp, Artificial Sequence
  Synthetic
aaaattcccctcgcccagtaaccagctccaaggacttcagatcgagagtccagggaaaccaaaacaatactatct

SEQ ID NO: 336231 - DNA, 75 bp, Artificial Sequence
  Synthetic
taagcatgttaactttagatgccttgtatgatatacataaactttgtagaaactggtggacatccacaaaccaag

SEQ ID NO: 336232 - DNA, 75 bp, Artificial Sequence
  Synthetic
ttacacatttgacgaaaaacgcagcgaactcacaatgcctgctgcaaaaagacttaaaaaagactttacaactcc

SEQ ID NO: 336233 - DNA, 75 bp, Artificial Sequence
  Synthetic
acttaccactagtaagatataaaggatgcaaaataacattttatcaaagcacatttacagactacatagtaagaa

SEQ ID NO: 336234 - DNA, 75 bp, Artificial Sequence
  Synthetic
aacattttttacagactttggagcaaaagacatccccctcaaaacacaagaggaaacggagcaaacatcggagga

SEQ ID NO: 336235 - DNA, 75 bp, Artificial Sequence
  Synthetic
tacatacagaactaccagctaacagtaacaaactaacatacccaaacacacatccactaatgatgatgatgtcta

SEQ ID NO: 336236 - DNA, 75 bp, Artificial Sequence
  Synthetic
ggaagaaatcgaaacatcactcccgacagaagaccacctcaagcagcagctccagcgagcgagaatctactaccg

SEQ ID NO: 336237 - DNA, 75 bp, Artificial Sequence
  Synthetic
agtacaaacacattatacctagtagacaaacaagaagaaaaaagaaaccatacacaaaaatatttgtaaaaccac

SEQ ID NO: 336238 - DNA, 75 bp, Artificial Sequence
  Synthetic
agagcgaatccgaaagctcctaaaaacaaaaaaattattccccccttaacagacatgtttggtaaaccatataga

SEQ ID NO: 336239 - DNA, 75 bp, Artificial Sequence
  Synthetic
ctccgcaatttgaaaacaaatggtactttgctacagacctctacaaaattccattactacaaatacactgcacag

SEQ ID NO: 336240 - DNA, 75 bp, Artificial Sequence
  Synthetic
ttaaaccgtagattaactcctaaagaatttgaacaagagttacaagatgctaaaatttggaaaagacgacccaga

SEQ ID NO: 336241 - DNA, 75 bp, Artificial Sequence
  Synthetic
catgcaacttacaaaacccatttgtaaaaccagacaaattatcaaacaatgttacattatggtcactaaacacca

SEQ ID NO: 336242 - DNA, 75 bp, Artificial Sequence
  Synthetic
tattatttacatgataagcctgactataaacttgatgtacttgaacctcttgtaaacttcaatgtaaacttttca

SEQ ID NO: 336243 - DNA, 75 bp, Artificial Sequence
  Synthetic
taagcatacaaaatagaaacatgtcagtggatcaaggacaatcatggccatttaaaatactaggaacacaaagct

SEQ ID NO: 336244 - DNA, 75 bp, Artificial Sequence
  Synthetic
ttaaactataaattctaagccagcaaatattcacttgtcggtgtcagtttatataagtaaaaactttaataaaca

SEQ ID NO: 336245 - DNA, 75 bp, Artificial Sequence
  Synthetic
tttatttttacttttacaccggagcaaacctaccaggtgacacaacacaaataccagtagcagacctattaccac

SEQ ID NO: 336246 - DNA, 75 bp, Artificial Sequence
  Synthetic
tccactacctcccaaatacgcaggcgcaaaagggggctccgcccccttacacccccaagggggctccgccccctt

SEQ ID NO: 336247 - DNA, 75 bp, Artificial Sequence
  Synthetic
taacaaacccaagaataaacagaccaggacaatcactaaatgaggcaaaaattacagaccatattactttcacag

SEQ ID NO: 336248 - DNA, 75 bp, Artificial Sequence
  Synthetic
gctccgcccccttacacccccaagggggctccgcccccttacacccccaagggggctccgcccccttacaccccc

SEQ ID NO: 336249 - DNA, 75 bp, Artificial Sequence
  Synthetic
atacttctgcttttaatcattattattcatgaaataaattagtaaacaccgtaattccggggaggagactaagcc

SEQ ID NO: 336250 - DNA, 75 bp, Artificial Sequence
  Synthetic
atacttctgcttttaatcattattattcatgatataaattagtaaacaccgtaattccggggaggagactaagcc

SEQ ID NO: 336251 - DNA, 75 bp, Artificial Sequence
  Synthetic
atacttctgcttttaatcattattattcatgacataaattagtaaacaccgtaattccggggaggagactaagcc

SEQ ID NO: 336252 - DNA, 75 bp, Artificial Sequence
  Synthetic
atacttctgcttttaatcattattattcatgagataaattagtaaacaccgtaattccggggaggagactaagcc

SEQ ID NO: 336253 - DNA, 75 bp, Artificial Sequence
  Synthetic
aatacaaaaacaaatttacaaattattggggtaacccatttaataaacacattcaagaacacctagatatgatac

SEQ ID NO: 336254 - DNA, 75 bp, Artificial Sequence
  Synthetic
cactatattcagaaaacagatacattagaaacacatggtcacacacaaacacagacctaccattagtaagataca

SEQ ID NO: 336255 - DNA, 75 bp, Artificial Sequence
  Synthetic
tatactcactaaaaagtccagaagcaataaaaaacgaatggacaacagaaaacatgaaatggaaccaattaaaca

SEQ ID NO: 336256 - DNA, 75 bp, Artificial Sequence
  Synthetic
ataaaacacaaaataataatcccaagactaacaaaaggatacaacaaaaaaccatacaaaacaatacacattaaa

SEQ ID NO: 336257 - DNA, 75 bp, Artificial Sequence
  Synthetic
atgcaggaacaatggcattaacaccatttaacgagccaatattcacacaaatacaatataacccagatagagaca

SEQ ID NO: 336258 - DNA, 75 bp, Artificial Sequence
  Synthetic
aataccactatgccaaataagagcatcagcctgctccttaaatgaatggtatataaactacaagtcagttagtac

SEQ ID NO: 336259 - DNA, 75 bp, Artificial Sequence
  Synthetic
caggagaagacactcaattatacctactctctaacgctacaggaacaggatgggacccaccaggaattccagaat

SEQ ID NO: 336260 - DNA, 75 bp, Artificial Sequence
  Synthetic
taatactagaaggatttccactatggttaatatattggggatttgcagactttcaaaaaaacctaaaaaaagtaa

SEQ ID NO: 336261 - DNA, 75 bp, Artificial Sequence
  Synthetic
aaaataatgaacaacacacatgggaaaatacagtatttttaggaaacacattagacaaccaagagggcaaaacac

SEQ ID NO: 336262 - DNA, 75 bp, Artificial Sequence
  Synthetic
caaacatagacacaaattacatgttagtagcaaaaacaaaatttacacaaaaacctggcacattctacttagtaa

SEQ ID NO: 336263 - DNA, 75 bp, Artificial Sequence
  Synthetic
caaaagaaataaacttaaaatcaaaaggttcaaccacacaaaacataatgcaaaattatggaaaacaacaatggg

SEQ ID NO: 336264 - DNA, 75 bp, Artificial Sequence
  Synthetic
caaaagaaataaacttaaaatcaaaaggttcaaccacacaaaacataatgcaatattatggaaaacaacaatggg

SEQ ID NO: 336265 - DNA, 75 bp, Artificial Sequence
  Synthetic
caaaagaaataaacttaaaatcaaaaggttcaaccacacaaaacataatgcaacattatggaaaacaacaatggg

SEQ ID NO: 336266 - DNA, 75 bp, Artificial Sequence
  Synthetic
caaaagaaataaacttaaaatcaaaaggttcaaccacacaaaacataatgcaagattatggaaaacaacaatggg

SEQ ID NO: 336267 - DNA, 75 bp, Artificial Sequence
  Synthetic
caaaagaaataaacttaaaatcaaaaggttcaaccacacaatacataatgcaaaattatggaaaacaacaatggg

SEQ ID NO: 336268 - DNA, 75 bp, Artificial Sequence
  Synthetic
caaaagaaataaacttaaaatcaaaaggttcaaccacacaatacataatgcaatattatggaaaacaacaatggg

SEQ ID NO: 336269 - DNA, 75 bp, Artificial Sequence
  Synthetic
caaaagaaataaacttaaaatcaaaaggttcaaccacacaatacataatgcaacattatggaaaacaacaatggg

SEQ ID NO: 336270 - DNA, 75 bp, Artificial Sequence
  Synthetic
caaaagaaataaacttaaaatcaaaaggttcaaccacacaatacataatgcaagattatggaaaacaacaatggg

SEQ ID NO: 336271 - DNA, 75 bp, Artificial Sequence
  Synthetic
caaaagaaataaacttaaaatcaaaaggttcaaccacacaacacataatgcaaaattatggaaaacaacaatggg

SEQ ID NO: 336272 - DNA, 75 bp, Artificial Sequence
  Synthetic
caaaagaaataaacttaaaatcaaaaggttcaaccacacaacacataatgcaatattatggaaaacaacaatggg

SEQ ID NO: 336273 - DNA, 75 bp, Artificial Sequence
  Synthetic
caaaagaaataaacttaaaatcaaaaggttcaaccacacaacacataatgcaacattatggaaaacaacaatggg

SEQ ID NO: 336274 - DNA, 75 bp, Artificial Sequence
  Synthetic
caaaagaaataaacttaaaatcaaaaggttcaaccacacaacacataatgcaagattatggaaaacaacaatggg

SEQ ID NO: 336275 - DNA, 75 bp, Artificial Sequence
  Synthetic
caaaagaaataaacttaaaatcaaaaggttcaaccacacaagacataatgcaaaattatggaaaacaacaatggg

SEQ ID NO: 336276 - DNA, 75 bp, Artificial Sequence
  Synthetic
caaaagaaataaacttaaaatcaaaaggttcaaccacacaagacataatgcaatattatggaaaacaacaatggg

SEQ ID NO: 336277 - DNA, 75 bp, Artificial Sequence
  Synthetic
caaaagaaataaacttaaaatcaaaaggttcaaccacacaagacataatgcaacattatggaaaacaacaatggg

SEQ ID NO: 336278 - DNA, 75 bp, Artificial Sequence
  Synthetic
caaaagaaataaacttaaaatcaaaaggttcaaccacacaagacataatgcaagattatggaaaacaacaatggg

SEQ ID NO: 336279 - DNA, 75 bp, Artificial Sequence
  Synthetic
tactaaatgacacctttgtagaaggcaatagcccatatgaaaaacaacctttacctgaagacaacattaaatggt

SEQ ID NO: 336280 - DNA, 75 bp, Artificial Sequence
  Synthetic
aaataacacttggaaagtatacttctttaatgaagaactctttacctttttagaccaatacagacaacaccctaa

SEQ ID NO: 336281 - DNA, 75 bp, Artificial Sequence
  Synthetic
acccacaagtacaataccaattagaagcacaaaacaaactactacaaactgggccatttacaccaaacatacaag

SEQ ID NO: 336282 - DNA, 75 bp, Artificial Sequence
  Synthetic
ttagatacaatccactatcagacgaaggaaaagacacaaaaatatactttaaaccaacaaaccaacctaatgaag

SEQ ID NO: 336283 - DNA, 75 bp, Artificial Sequence
  Synthetic
gacaactatcagacaatatatcaatgttttataaattttactttaaatggggaggaagcccaccaaaagcaatta

SEQ ID NO: 336284 - DNA, 75 bp, Artificial Sequence
  Synthetic
gattccaaccacctctacaaacacaacaagaaacaacatcggagagttcatccgaggaagaagaagaagagatat

SEQ ID NO: 336285 - DNA, 75 bp, Artificial Sequence
  Synthetic
atgttgaaaatcctgcccaccagattcaatatcccataccccgtaacgagcatgaaacaacttcgttacagagtc

SEQ ID NO: 336286 - DNA, 75 bp, Artificial Sequence
  Synthetic
caggggaagccccagaatccatcttatactccttcgactatagacacgggaactacacaacaacagctttgtcac

SEQ ID NO: 336287 - DNA, 75 bp, Artificial Sequence
  Synthetic
gagacacactactataaaactaagtacactgacgaatggctgagtttatcacgccagacggagacggcaacacca

SEQ ID NO: 336288 - DNA, 75 bp, Artificial Sequence
  Synthetic
gaattagccaagactgggcacttaaagacactgtttctaaaattacagagccagatcgacagcaactgctcaaac

SEQ ID NO: 336289 - DNA, 75 bp, Artificial Sequence
  Synthetic
gatcagtctggcggaccgggcaagaaacttaaaaatatgttattttacaggtatgagcaaactattaacaccaac

SEQ ID NO: 336290 - DNA, 75 bp, Artificial Sequence
  Synthetic
aagccctcgaatgcctgcaaatctcggaagaaacgcaggagaaaaaagaaaaagaagtacagcagctcatcagca

SEQ ID NO: 336291 - DNA, 75 bp, Artificial Sequence
  Synthetic
tatatacagcaacaaaggattagaaaacaactgggtaaacctaatatggaacagccatgatcttatttgtggctg

SEQ ID NO: 336292 - DNA, 75 bp, Artificial Sequence
  Synthetic
acctcagacagcagcagcagctgtacagagagcgaataatatcattattaaaggaccaataacttttaactgtgt

SEQ ID NO: 336293 - DNA, 75 bp, Artificial Sequence
  Synthetic
caacaacccttggaaacatttagcagacatattagcaagacaaggaacacaactatgcctccctacaactactac

SEQ ID NO: 336294 - DNA, 75 bp, Artificial Sequence
  Synthetic
aaaaaaggtgaaattgtttgatgataaaccaaaaaaccgtagatttacacctgaggaatttgaaactgagttaca

SEQ ID NO: 336295 - DNA, 75 bp, Artificial Sequence
  Synthetic
cgacgccgctacttctaccgacccagacgttatagaagacgatggcttacaacctggagacctagacaagctttt

SEQ ID NO: 336296 - DNA, 75 bp, Artificial Sequence
  Synthetic
aatagcaaaatggttaaagagacccccaagatcctttgtaaatgatcctcccttttacccatggttaccacctga

SEQ ID NO: 336297 - DNA, 75 bp, Artificial Sequence
  Synthetic
cgaagaagatttcgaagacggcgatgggtaagaaaaagacgcttttttagatataaaaaaagaaaactaaaaaag

SEQ ID NO: 336298 - DNA, 75 bp, Artificial Sequence
  Synthetic
acctgttgtaaactttaagcttaattttactgaataaaggccagcattaattcacttaaggagtctgtttattta

SEQ ID NO: 336299 - DNA, 75 bp, Artificial Sequence
  Synthetic
attagactatcacaatggcaaccagacagtataagaaaatgtactattaaaggacaattatgcttactaacatgt

SEQ ID NO: 336300 - DNA, 75 bp, Artificial Sequence
  Synthetic
agttaaaccttaataaacggtcaccgcctccctaatacgcaggcgcagaaagggggctccgccccctttaacccc

SEQ ID NO: 336301 - DNA, 75 bp, Artificial Sequence
  Synthetic
ggaattggaagaattaacaataactttaccttaactgcagaaagctatgtacctatttctgaaccaggaggggga

SEQ ID NO: 336302 - DNA, 75 bp, Artificial Sequence
  Synthetic
ggctccgccccctttaacccccagggggctccgccccctgaaacccccaagggggctacgcccccttacaccccc

SEQ ID NO: 336303 - DNA, 75 bp, Artificial Sequence
  Synthetic
taataaatattcaacaggaaaaccacctaattagaattgccgaccacaaacggtcacttacttctcctttttact

SEQ ID NO: 336304 - DNA, 75 bp, Artificial Sequence
  Synthetic
acctatttctgaaccaggagggggaggatggagtataatgcaaataactttaagagctttgtatgacgaatacga

SEQ ID NO: 336305 - DNA, 75 bp, Artificial Sequence
  Synthetic
atacttctgcttttaatcattattattcatgacataaattagtaaacaccgtaattccggggaggagactaaacc

SEQ ID NO: 336306 - DNA, 75 bp, Artificial Sequence
  Synthetic
ttataatagtaatgacactgactacatagtgactgtacaacgaacaggaccttttgaagttgacagagactcata

SEQ ID NO: 336307 - DNA, 75 bp, Artificial Sequence
  Synthetic
ctatataactaagtacactgacgaatggctgagtttaccacgccagacggagacgggatcacttcagtgactcca

SEQ ID NO: 336308 - DNA, 75 bp, Artificial Sequence
  Synthetic
cctaaacacacaaccaagcagacacatgatgaacaaaaatagttttatagtaccaaaactcaaccctaacaaaaa

SEQ ID NO: 336309 - DNA, 75 bp, Artificial Sequence
  Synthetic
ggctgaacttgggcgggagccgaaggtgagtgaaaccaccgtagtctaggggcaattcgggctagttcagtctgg

SEQ ID NO: 336310 - DNA, 75 bp, Artificial Sequence
  Synthetic
aagaaagccatacataagaaaaaaatacagaccaccagcactgctacaaaacaaatggtactttgcacaagacat

SEQ ID NO: 336311 - DNA, 75 bp, Artificial Sequence
  Synthetic
cggaccgggcaagatacttaaaatatactttttttacagatgtcaatgcctttttctactaaaaaacaaaggcta

SEQ ID NO: 336312 - DNA, 75 bp, Artificial Sequence
  Synthetic
actaaacacccctttaatactatttaccacatcatcctgctctttagaccaaatgtatgcaccaaatgaccaaat

SEQ ID NO: 336313 - DNA, 75 bp, Artificial Sequence
  Synthetic
caactatgtaacctagtcactggaattcatgatataacctgcaactgctacaaccctctgtttcactcggcacaa

SEQ ID NO: 336314 - DNA, 75 bp, Artificial Sequence
  Synthetic
tagcacaaacataacttttttatcactaaacacaaatatttttcaaaacccatactgggaattagatgataacca

SEQ ID NO: 336315 - DNA, 75 bp, Artificial Sequence
  Synthetic
ataattttaaaacaactagcacctgaattaaaaaaagaagaaaaacaccaacttaaacaatgccttaccgaagaa

SEQ ID NO: 336316 - DNA, 75 bp, Artificial Sequence
  Synthetic
accttactttcccaaagtaacagacacaattaataacataggcctatacaccatgggaaatggaggagacataaa

SEQ ID NO: 336317 - DNA, 75 bp, Artificial Sequence
  Synthetic
actactaccaaagaagaagaagacgttggatttactaccggagacctagaggcccttttcgcagaaaatggagac

SEQ ID NO: 336318 - DNA, 75 bp, Artificial Sequence
  Synthetic
taaaatgaaggattggaaagaattaataccactataccaaacacaattatacaaaaaagaacataacacaagtgg

SEQ ID NO: 336319 - DNA, 75 bp, Artificial Sequence
  Synthetic
gatacagaagacgccgctgggtaagaaaaaaaaaactaccatttttaagacttaaagaatatcaaccaagtaaca

SEQ ID NO: 336320 - DNA, 75 bp, Artificial Sequence
  Synthetic
caatcactggacaaacaattttagtgacctacaaaatccaaaatattgggcaaacccattttcatatagtgcaca

SEQ ID NO: 336321 - DNA, 75 bp, Artificial Sequence
  Synthetic
ttagaaaatgtaaaatacaaggactaatacctttatactggggaactcctgaaagatttgtaaataattatgact

SEQ ID NO: 336322 - DNA, 75 bp, Artificial Sequence
  Synthetic
cgaagacactaatgacgtacaaatattttatggaacaccaccaacaaatcatacttataacaatcaaccacaact

SEQ ID NO: 336323 - DNA, 75 bp, Artificial Sequence
  Synthetic
catatgaaatgactacagcaccacctaaactaccaagtggaggactgtttactataaaaaacttttctttgcaat

SEQ ID NO: 336324 - DNA, 75 bp, Artificial Sequence
  Synthetic
actataaaaaacttttctttgcaatcactatattcagaaaacagatacattagaaacacatggtcacacacaaac

SEQ ID NO: 336325 - DNA, 75 bp, Artificial Sequence
  Synthetic
acaaactataacaggattataccaagagtgcaggtacaacccatttaaagacaaaggcacaggaaacatattcta

SEQ ID NO: 336326 - DNA, 75 bp, Artificial Sequence
  Synthetic
cactatattcagaaaacagatacattagaaacacatggtcacacacaaacacagacctacctttagtaagataca

SEQ ID NO: 336327 - DNA, 75 bp, Artificial Sequence
  Synthetic
cactatattcagaaaacagatacattagaaacacatggtcacacacaaacacagacctacctttagtatgataca

SEQ ID NO: 336328 - DNA, 75 bp, Artificial Sequence
  Synthetic
cactatattcagaaaacagatacattagaaacacatggtcacacacaaacacagacctacctttagtacgataca

SEQ ID NO: 336329 - DNA, 75 bp, Artificial Sequence
  Synthetic
cactatattcagaaaacagatacattagaaacacatggtcacacacaaacacagacctacctttagtaggataca

SEQ ID NO: 336330 - DNA, 75 bp, Artificial Sequence
  Synthetic
cttaaaaagcacaaaaacacaacaaggaagttttctatcactaccaacagacaatagaattgtactaaaagactt

SEQ ID NO: 336331 - DNA, 75 bp, Artificial Sequence
  Synthetic
caggatgtaaatttaaaatatacaaaagtgaacatgtagacacaattctaacatttgataacaatctaccgctag

SEQ ID NO: 336332 - DNA, 75 bp, Artificial Sequence
  Synthetic
tccaatatggttagcaacatggggatggattagctggctacaaaaatctaaaccagtacaccacatagaagaaga

SEQ ID NO: 336333 - DNA, 75 bp, Artificial Sequence
  Synthetic
cttccaatcaagatatgtaccttagcatgcaaccttctgttcactcaatgataaaacacaaaataataatcccaa

SEQ ID NO: 336334 - DNA, 75 bp, Artificial Sequence
  Synthetic
catgcaaccttctgttcactcaatgataaaacacaaaataataatcccaagactaacaaaaggatacaacaaaaa

SEQ ID NO: 336335 - DNA, 75 bp, Artificial Sequence; identical to SEQ ID NO: 336256
  Synthetic

SEQ ID NO: 336336 - DNA, 75 bp, Artificial Sequence
  Synthetic
ataaaacacaaaataataatcccaagactaacaaaaggatacaacaaaaaaccatacaaaacaatacacattaat

SEQ ID NO: 336337 - DNA, 75 bp, Artificial Sequence
  Synthetic
ataaaacacaaaataataatcccaagactaacaaaaggatacaacaaaaaaccatacaaaacaatacacattaac

SEQ ID NO: 336338 - DNA, 75 bp, Artificial Sequence
  Synthetic
ataaaacacaaaataataatcccaagactaacaaaaggatacaacaaaaaaccatacaaaacaatacacattaag

SEQ ID NO: 336339 - DNA, 75 bp, Artificial Sequence
  Synthetic
tggattagctggctacaaaaatctaaaccagtacaccacatagaagaagactatcagtttgttatacaatcacca

SEQ ID NO: 336340 - DNA, 75 bp, Artificial Sequence
  Synthetic
caaaaatagaaatgcaattagaaaccctagcaaaatttgcagaaacaggaccagcaacaccaaaaataaacaaac

SEQ ID NO: 336341 - DNA, 75 bp, Artificial Sequence
  Synthetic
ccaccaaaaccaatgattaataaatggtattttcaacaagacataacaacaataccactatgccaaataagagca

SEQ ID NO: 336342 - DNA, 75 bp, Artificial Sequence
  Synthetic
ggtattttcaacaagacataacaacaataccactatgccaaataagagcatcagcctgctccttaaatgaatggt

SEQ ID NO: 336343 - DNA, 75 bp, Artificial Sequence
  Synthetic
aataccactatgccaaataagagcatcagcctgctccttaaatgaatggtatataaactacaaatcagttagtac

SEQ ID NO: 336344 - DNA, 75 bp, Artificial Sequence
  Synthetic
aataccactatgccaaataagagcatcagcctgctccttaaatgaatggtatataaactacaattcagttagtac

SEQ ID NO: 336345 - DNA, 75 bp, Artificial Sequence
  Synthetic
aataccactatgccaaataagagcatcagcctgctccttaaatgaatggtatataaactacaactcagttagtac

SEQ ID NO: 336346 - DNA, 75 bp, Artificial Sequence; identical to SEQ ID NO: 336258
  Synthetic

SEQ ID NO: 336347 - DNA, 75 bp, Artificial Sequence
  Synthetic
ggctgcccagcaccaatggaaaacatctgcaacccagcagaacaagaaaaattccctaatcccaataacatcctc

SEQ ID NO: 336348 - DNA, 75 bp, Artificial Sequence
  Synthetic
aacatctaccataaactttctaaacccgggatgcattacaaacacatactttaacaaatactacagcacaggatg

SEQ ID NO: 336349 - DNA, 75 bp, Artificial Sequence
  Synthetic
ttaaaaaagacattgaaactacaaaatattttacagaatatggagcaaaagacatcctactacaaatacaaccac

SEQ ID NO: 336350 - DNA, 75 bp, Artificial Sequence
  Synthetic
ttaacaaatactacagcacaggatggtatgcaagaaaactagactcaggcacaaaaatatacttaatatccttta

SEQ ID NO: 336351 - DNA, 75 bp, Artificial Sequence
  Synthetic
aaaataatacacaacacacatgggaaaatgcagtatttttaggaaacacattagacaaccaaaagggcagcacac

SEQ ID NO: 336352 - DNA, 75 bp, Artificial Sequence
  Synthetic
aaaataatacacaacacacatgggaaaatgcagtatttttaggaaacacattagacaaccaatagggcagcacac

SEQ ID NO: 336353 - DNA, 75 bp, Artificial Sequence
  Synthetic
aaaataatacacaacacacatgggaaaatgcagtatttttaggaaacacattagacaaccaacagggcagcacac

SEQ ID NO: 336354 - DNA, 75 bp, Artificial Sequence
  Synthetic
aaaataatacacaacacacatgggaaaatgcagtatttttaggaaacacattagacaaccaagagggcagcacac

SEQ ID NO: 336355 - DNA, 75 bp, Artificial Sequence
  Synthetic
aaaataattcacaacacacatgggaaaatgcagtatttttaggaaacacattagacaaccaaaagggcagcacac

SEQ ID NO: 336356 - DNA, 75 bp, Artificial Sequence
  Synthetic
aaaataattcacaacacacatgggaaaatgcagtatttttaggaaacacattagacaaccaatagggcagcacac

SEQ ID NO: 336357 - DNA, 75 bp, Artificial Sequence
  Synthetic
aaaataattcacaacacacatgggaaaatgcagtatttttaggaaacacattagacaaccaacagggcagcacac

SEQ ID NO: 336358 - DNA, 75 bp, Artificial Sequence
  Synthetic
aaaataattcacaacacacatgggaaaatgcagtatttttaggaaacacattagacaaccaagagggcagcacac

SEQ ID NO: 336359 - DNA, 75 bp, Artificial Sequence
  Synthetic
aaaataatccacaacacacatgggaaaatgcagtatttttaggaaacacattagacaaccaaaagggcagcacac

SEQ ID NO: 336360 - DNA, 75 bp, Artificial Sequence
  Synthetic
aaaataatccacaacacacatgggaaaatgcagtatttttaggaaacacattagacaaccaatagggcagcacac

SEQ ID NO: 336361 - DNA, 75 bp, Artificial Sequence
  Synthetic
aaaataatccacaacacacatgggaaaatgcagtatttttaggaaacacattagacaaccaacagggcagcacac

SEQ ID NO: 336362 - DNA, 75 bp, Artificial Sequence
  Synthetic
aaaataatccacaacacacatgggaaaatgcagtatttttaggaaacacattagacaaccaagagggcagcacac

SEQ ID NO: 336363 - DNA, 75 bp, Artificial Sequence
  Synthetic
aaaataatgcacaacacacatgggaaaatgcagtatttttaggaaacacattagacaaccaaaagggcagcacac

SEQ ID NO: 336364 - DNA, 75 bp, Artificial Sequence
  Synthetic
aaaataatgcacaacacacatgggaaaatgcagtatttttaggaaacacattagacaaccaatagggcagcacac

SEQ ID NO: 336365 - DNA, 75 bp, Artificial Sequence
  Synthetic
aaaataatgcacaacacacatgggaaaatgcagtatttttaggaaacacattagacaaccaacagggcagcacac

SEQ ID NO: 336366 - DNA, 75 bp, Artificial Sequence
  Synthetic
aaaataatgcacaacacacatgggaaaatgcagtatttttaggaaacacattagacaaccaagagggcagcacac

SEQ ID NO: 336367 - DNA, 75 bp, Artificial Sequence
  Synthetic
tgcaacgagaccacctcagacacagaatcaacagactaacaaaaaaccgaaaattattccctatactatagatat

SEQ ID NO: 336368 - DNA, 75 bp, Artificial Sequence
  Synthetic
caaaagaaataaaattaatatcaaaaggttcaaccacacaagacataatgcaacattatggaaaacaacaatggg

SEQ ID NO: 336369 - DNA, 75 bp, Artificial Sequence
  Synthetic
caaaagaaataaaattaatatcataaggttcaaccacacaagacataatgcaacattatggaaaacaacaatggg

SEQ ID NO: 336370 - DNA, 75 bp, Artificial Sequence
  Synthetic
caaaagaaataaaattaatatcacaaggttcaaccacacaagacataatgcaacattatggaaaacaacaatggg

SEQ ID NO: 336371 - DNA, 75 bp, Artificial Sequence
  Synthetic
caaaagaaataaaattaatatcagaaggttcaaccacacaagacataatgcaacattatggaaaacaacaatggg

SEQ ID NO: 336372 - DNA, 75 bp, Artificial Sequence
  Synthetic
caaaagaaataaatttaatatcaaaaggttcaaccacacaagacataatgcaacattatggaaaacaacaatggg

SEQ ID NO: 336373 - DNA, 75 bp, Artificial Sequence
  Synthetic
caaaagaaataaatttaatatcataaggttcaaccacacaagacataatgcaacattatggaaaacaacaatggg

SEQ ID NO: 336374 - DNA, 75 bp, Artificial Sequence
  Synthetic
caaaagaaataaatttaatatcacaaggttcaaccacacaagacataatgcaacattatggaaaacaacaatggg

SEQ ID NO: 336375 - DNA, 75 bp, Artificial Sequence
  Synthetic
caaaagaaataaatttaatatcagaaggttcaaccacacaagacataatgcaacattatggaaaacaacaatggg

SEQ ID NO: 336376 - DNA, 75 bp, Artificial Sequence
  Synthetic
caaaagaaataaacttaatatcaaaaggttcaaccacacaagacataatgcaacattatggaaaacaacaatggg

SEQ ID NO: 336377 - DNA, 75 bp, Artificial Sequence
  Synthetic
caaaagaaataaacttaatatcataaggttcaaccacacaagacataatgcaacattatggaaaacaacaatggg

SEQ ID NO: 336378 - DNA, 75 bp, Artificial Sequence
  Synthetic
caaaagaaataaacttaatatcacaaggttcaaccacacaagacataatgcaacattatggaaaacaacaatggg

SEQ ID NO: 336379 - DNA, 75 bp, Artificial Sequence
  Synthetic
caaaagaaataaacttaatatcagaaggttcaaccacacaagacataatgcaacattatggaaaacaacaatggg

SEQ ID NO: 336380 - DNA, 75 bp, Artificial Sequence
  Synthetic
caaaagaaataaagttaatatcaaaaggttcaaccacacaagacataatgcaacattatggaaaacaacaatggg

SEQ ID NO: 336381 - DNA, 75 bp, Artificial Sequence
  Synthetic
caaaagaaataaagttaatatcataaggttcaaccacacaagacataatgcaacattatggaaaacaacaatggg

SEQ ID NO: 336382 - DNA, 75 bp, Artificial Sequence
  Synthetic
caaaagaaataaagttaatatcacaaggttcaaccacacaagacataatgcaacattatggaaaacaacaatggg

SEQ ID NO: 336383 - DNA, 75 bp, Artificial Sequence
  Synthetic
caaaagaaataaagttaatatcagaaggttcaaccacacaagacataatgcaacattatggaaaacaacaatggg

SEQ ID NO: 336384 - DNA, 75 bp, Artificial Sequence
  Synthetic
atttggtcaaagtactacaaaaaaccgtagatttaccccaaatgaatttgaagatgaattacttgtatctagaat

SEQ ID NO: 336385 - DNA, 75 bp, Artificial Sequence
  Synthetic
ggaacccattttataaaaactatctaaataacacttggaaagtatacttctttaatgaagaactctttacctttt

SEQ ID NO: 336386 - DNA, 75 bp, Artificial Sequence
  Synthetic
tacaccaataccagtaacatacataacagaaacacaactaacaaacgcaattagatacaatccactatcagacga

SEQ ID NO: 336387 - DNA, 75 bp, Artificial Sequence
  Synthetic
atggcgtagacgcccgagaacatatatatttgacccccctgactataatttgcctgtaattgaacctcttgtaaa

SEQ ID NO: 336388 - DNA, 75 bp, Artificial Sequence
  Synthetic
ttagatacaatccactatcagacgaagggaaagacacaaaaatatactttaaaccaacaaaccaacctaatgaaa

SEQ ID NO: 336389 - DNA, 75 bp, Artificial Sequence
  Synthetic
tctatttattaaagtataaacctatataaacatccaccacactccctaatacgcaggcgcacaaaggggctccgc

SEQ ID NO: 336390 - DNA, 75 bp, Artificial Sequence
  Synthetic
attgggatccaccacaaaatccaaatttaatggcggtaaacttaccactatggatactaacatttggctttgtag

SEQ ID NO: 336391 - DNA, 75 bp, Artificial Sequence
  Synthetic
actaccacaaaaaactaaaacaagtaaaaaacatagacacagaacaaatacttacaatacaagcaaaattagacg

SEQ ID NO: 336392 - DNA, 75 bp, Artificial Sequence
  Synthetic
gacctataacaaaagtttatcctcttatagattcagactttatagcaggaaaaagcccttatgaacaggtaccag

SEQ ID NO: 336393 - DNA, 75 bp, Artificial Sequence
  Synthetic
atcccctagactataacagatggcaccttagctttcaattccaacaaattactacaaacaatataggccttagcg

SEQ ID NO: 336394 - DNA, 75 bp, Artificial Sequence
  Synthetic
gtccaggatcagtaaaatcacctacattacaagcagtacaagctaaatgtcactatactttttacttcaagtggg

SEQ ID NO: 336395 - DNA, 75 bp, Artificial Sequence
  Synthetic
gaggaaatccaccaccaatgcagccaattacagacccaacaaaacaacctcactataatttaccatttaacatca

SEQ ID NO: 336396 - DNA, 75 bp, Artificial Sequence
  Synthetic
caaaaacaacttcgttacagaatccagcaacaagccctgcctactccttatacacctttgactacagaaggggca

SEQ ID NO: 336397 - DNA, 75 bp, Artificial Sequence
  Synthetic
caaaaacaacttcgttacagaatccagcaacaagccctgcctactccttatacacctttgactacagaaggggct

SEQ ID NO: 336398 - DNA, 75 bp, Artificial Sequence
  Synthetic
caaaaacaacttcgttacagaatccagcaacaagccctgcctactccttatacacctttgactacagaaggggcc

SEQ ID NO: 336399 - DNA, 75 bp, Artificial Sequence
  Synthetic
caaaaacaacttcgttacagaatccagcaacaagccctgcctactccttatacacctttgactacagaaggggcg

SEQ ID NO: 336400 - DNA, 75 bp, Artificial Sequence
  Synthetic
aacttacaacaaaagctattgaacgcttgcaaaaagacttcccacttaaaaaaacttttattacagactcagaaa

SEQ ID NO: 336401 - DNA, 75 bp, Artificial Sequence
  Synthetic
aaaacttttattacagactcagaaagattccaaccacctctacaaacacaacaagaaacaacatcggagagttca

SEQ ID NO: 336402 - DNA, 75 bp, Artificial Sequence; identical to SEQ ID NO: 336284
  Synthetic

SEQ ID NO: 336403 - DNA, 75 bp, Artificial Sequence
  Synthetic
gattccaaccacctctacaaacacaacaagaaacaacatcggagagttcatccgaggaagaagaagatgagatat

SEQ ID NO: 336404 - DNA, 75 bp, Artificial Sequence
  Synthetic
gattccaaccacctctacaaacacaacaagaaacaacatcggagagttcatccgaggaagaagaagacgagatat

SEQ ID NO: 336405 - DNA, 75 bp, Artificial Sequence
  Synthetic
gattccaaccacctctacaaacacaacaagaaacaacatcggagagttcatccgaggaagaagaagaggagatat

SEQ ID NO: 336406 - DNA, 75 bp, Artificial Sequence
  Synthetic
cgacactcctcaacaagctccagcgacagcgacacaaacagaagcagctcaagtacctcatcttaaagaatctgg

SEQ ID NO: 336407 - DNA, 75 bp, Artificial Sequence
  Synthetic
gatacctaccaaaattagaataataaacacaaaaaacacagtattactattccctaaaacaccacaaaacagaag

SEQ ID NO: 336408 - DNA, 75 bp, Artificial Sequence
  Synthetic
actaacaccctgggaagaagaacaagataaacaagaagcacaaatatgggacagagcaaaaaagcattttatata

SEQ ID NO: 336409 - DNA, 75 bp, Artificial Sequence
  Synthetic
tgatgtaccatattattacaacctaaaccctgaaccacttgtaaattttcaccttggttttaaagataaataaag

SEQ ID NO: 336410 - DNA, 75 bp, Artificial Sequence
  Synthetic
aaataaagggctaggccccattaactcatagctcggtgtctgttcctttaagtctcaactttaataaacggactc

SEQ ID NO: 336411 - DNA, 75 bp, Artificial Sequence
  Synthetic
cgcctcccaaaattggggcgccaaaagggggctccgcccccttacacccccaagggggctccgcccccttacacc

SEQ ID NO: 336412 - DNA, 75 bp, Artificial Sequence
  Synthetic
ctcccaaaattggggcgccaaaagggggctccgcccccttacacccccaagggggctccgcccccttacaccccc

SEQ ID NO: 336413 - DNA, 75 bp, Artificial Sequence
  Synthetic
atctaaataacacttggaaagtatacttctttaatgaagaactctttacctttttagaccaatacagacaacacc

SEQ ID NO: 336414 - DNA, 75 bp, Artificial Sequence
  Synthetic
atacaccaataccagtaacatacataacagaaacacaactaacaaacgcaattagatacaatccactatcagacg

SEQ ID NO: 336415 - DNA, 75 bp, Artificial Sequence
  Synthetic
ttattaatattcaacaggaaaaccacctaatttaaattgccgaccacaaaccgtcacttagttcctctttttcac

SEQ ID NO: 336416 - DNA, 75 bp, Artificial Sequence
  Synthetic
tgcgcttccccttttcctcattattattcattacattaattagtagtcaccgtaattccggggaggagactgtta

SEQ ID NO: 336417 - DNA, 75 bp, Artificial Sequence
  Synthetic
tctatataaccaactatacttccgaatggctgagtttatgccgccagacggagacgggatcacttcagtgactcc

SEQ ID NO: 336418 - DNA, 75 bp, Artificial Sequence
  Synthetic
atggctgagtttatgccgccagacggagacgggatcacttcagtgactccaggctgatcttgggcgggagccgaa

SEQ ID NO: 336419 - DNA, 75 bp, Artificial Sequence
  Synthetic
ggtgagtgaaaccaccgaagtctaggggcaattcgggctagatcagtctggcggaacgggcaagaaacttaaaat

SEQ ID NO: 336420 - DNA, 75 bp, Artificial Sequence
  Synthetic
aatatatttaattacagatgtcatctactactccaacaagaagacaattaaaccagatgatcaacctctgctgtg

SEQ ID NO: 336421 - DNA, 75 bp, Artificial Sequence
  Synthetic
gagcccacgaccttgtttgtgactgcgacgagcccaccaaacacatccttctacagatcttctctgccggagaac

SEQ ID NO: 336422 - DNA, 75 bp, Artificial Sequence
  Synthetic
cctaccacgtaacaaagaaacaaaagcttgatattgaaaaatgccttattactatagaagaaaatggaatagata

SEQ ID NO: 336423 - DNA, 75 bp, Artificial Sequence
  Synthetic
ccgtagacgatactggaattacagatggagacctagagcgcctattcgcagaagacgacgctggagaaaacgaca

SEQ ID NO: 336424 - DNA, 75 bp, Artificial Sequence
  Synthetic
accggtaagaagaaaactccaaaaactaactctaaaagaatggcagccaaaaactataagaaaaagctgcattaa

SEQ ID NO: 336425 - DNA, 75 bp, Artificial Sequence
  Synthetic
aggactacattgcttgtttattgtaacagaagatactatatctagaaactacagaatgtatgaacatagctttac

SEQ ID NO: 336426 - DNA, 75 bp, Artificial Sequence
  Synthetic
aggagaacactggccaagcgggggaggcttttctgtaacaaaatatactttagatggactatatgaacaacacca

SEQ ID NO: 336427 - DNA, 75 bp, Artificial Sequence
  Synthetic
actagacagaaactggtggactaaacctaacacaaatatgccactagtaagatacttaggatgtaaaattacctt

SEQ ID NO: 336428 - DNA, 75 bp, Artificial Sequence
  Synthetic
ttaccaaagctgggaagtagactatgtatgtaacattaacttaacatggccaatggtagcaacaaacttactata

SEQ ID NO: 336429 - DNA, 75 bp, Artificial Sequence
  Synthetic
tctaagttgtcaccctaattttatgatgatgaaccataaagctatttttgtaccatcaaaaataacaaaaagact

SEQ ID NO: 336430 - DNA, 75 bp, Artificial Sequence
  Synthetic
aaggagaggcaaaaaaaccgttagactcagaccaccacaccaaatgattaacaaatggtattttgcaaaagaact

SEQ ID NO: 336431 - DNA, 75 bp, Artificial Sequence
  Synthetic
tgcaaaaactggtttagtaatgctaactgccgcagcagcttcctttgaccattactacataggatcagataaact

SEQ ID NO: 336432 - DNA, 75 bp, Artificial Sequence
  Synthetic
aagcaataactgtacttttacatctctaaacccattattttacaaaagacatgactttataacaccaccagtaca

SEQ ID NO: 336433 - DNA, 75 bp, Artificial Sequence
  Synthetic
aggatatatattatcacaagatggtaccatagaaaagaaactcttttcaaccacacacataggagatgtagcaca

SEQ ID NO: 336434 - DNA, 75 bp, Artificial Sequence
  Synthetic
actaacaatagaacaagcaaacttaacatatttaggagacacaaaaatgtatgaacaatcaacaacaaccaaatt

SEQ ID NO: 336435 - DNA, 75 bp, Artificial Sequence
  Synthetic
aactaaatccaacgcagacacttattttacatcacacaaaaactggggaaaccctttcagtcatgaaaacttaac

SEQ ID NO: 336436 - DNA, 75 bp, Artificial Sequence
  Synthetic
aacacaagaaaaccttctaataacaaacaaatcataccaagaaattataaataaagctaaagacacaaatacatc

SEQ ID NO: 336437 - DNA, 75 bp, Artificial Sequence
  Synthetic
aaccaacaaaataggcccaggtttttttacatctccatcagaagtaacacactatgatataagatatgcaccaga

SEQ ID NO: 336438 - DNA, 75 bp, Artificial Sequence
  Synthetic
cagagacacaggagtaggaaacaaagtatacctaaaatctgtaggaagagacacatcattctgggaccccccaaa

SEQ ID NO: 336439 - DNA, 75 bp, Artificial Sequence
  Synthetic
tgatgaagaactaatatgctcaggtttcccagtatggtcactactctatggctttgtaagctggcaagtaaaact

SEQ ID NO: 336440 - DNA, 75 bp, Artificial Sequence
  Synthetic
aggccatgtaaacaatatatacagatctcacattctagtaatagaatcaaatttctttaaaccacaacttgcata

SEQ ID NO: 336441 - DNA, 75 bp, Artificial Sequence
  Synthetic
ctacataccaatagaccaacactttttagaaggaaattcagcatacatgccagaacaaggtagaacagacgatga

SEQ ID NO: 336442 - DNA, 75 bp, Artificial Sequence
  Synthetic
caataaaaattggtacccatgccttttataccaactacaagctatagaaacaattgttagaacaggaccaggaat

SEQ ID NO: 336443 - DNA, 75 bp, Artificial Sequence
  Synthetic
acctaaattaggaggtagaaaatcagcagaagcaaaaattaaatatgcattctactttaagtttggaggatgtcc

SEQ ID NO: 336444 - DNA, 75 bp, Artificial Sequence
  Synthetic
accaaagatggacacaattgacgaccctacaaaacaagagacatatccccttcccggtattcagccttcaacata

SEQ ID NO: 336445 - DNA, 75 bp, Artificial Sequence
  Synthetic
ttcgttacagaatccaacatatccacaagaatactacctctaccaattcgatgaaaaagacggaatgcttacaga

SEQ ID NO: 336446 - DNA, 75 bp, Artificial Sequence
  Synthetic
aagagctgcaaaacgaattaggctacacaaaaaaactcaaaaagctttattgtcaactacaggaacaatggaccc

SEQ ID NO: 336447 - DNA, 75 bp, Artificial Sequence
  Synthetic
gccagccctccaaacgcaagcgacaacggactcagaggaggacgaagaaacggacccgacactcctccgaatcaa

SEQ ID NO: 336448 - DNA, 75 bp, Artificial Sequence
  Synthetic
gctccgacacctccggagacagcgacagcagttggagcagcaaatcgagagactaatacaaccataacatttcct

SEQ ID NO: 336449 - DNA, 75 bp, Artificial Sequence
  Synthetic
tgtatacaatttgcaaagctatttgactctccccaaagaaacagacccatgaacaaatatgaactagaacatgaa

SEQ ID NO: 336450 - DNA, 75 bp, Artificial Sequence
  Synthetic
aaacactgtgctattgcttttaaaagaccaccctgctcaatgcttttacaaaaaccttactatccctggctatat

SEQ ID NO: 336451 - DNA, 75 bp, Artificial Sequence
  Synthetic
gacagccaatatactgtaaacttcactttaacaccccctgaataaatgttggccaacgaatttcacttgtcggag

SEQ ID NO: 336452 - DNA, 75 bp, Artificial Sequence
  Synthetic
tcagtttatataggttcaacttaaataaacatccaccgcctcccaacattgttggcgccataagggggctccgcc

SEQ ID NO: 336453 - DNA, 75 bp, Artificial Sequence
  Synthetic
cccttaaacccccaaggctccgcccccttaaacccccaaggctccgcccccttaaacccccaagggggctccgcc

SEQ ID NO: 336454 - DNA, 75 bp, Artificial Sequence
  Synthetic
gctccgcccccttaaacccccaagggggctccgcccccttaaacccccaagggggctccgcccccttacaccccc

SEQ ID NO: 336455 - DNA, 75 bp, Artificial Sequence
  Synthetic
taataaatattcaacaggaaaaccacctaatttaaattgccgaccacaaaccgtcacttagttcctctttttcca

SEQ ID NO: 336456 - DNA, 75 bp, Artificial Sequence
  Synthetic
caacttcctcttttactaatgaatattcatgtaattaattaataatcaccgtaattccggggaggagcctttaaa

SEQ ID NO: 336457 - DNA, 75 bp, Artificial Sequence
  Synthetic
ctataaaactaactacacattcgaatggctgagtttatgccgccagacggagacgggatcacttcagtgactcca

SEQ ID NO: 336458 - DNA, 75 bp, Artificial Sequence
  Synthetic
ggctgatcaagggcgggtgccgaaggtgagtgaaaccaccgtagtcaaggggcaattcgggctagatcagtctgg

SEQ ID NO: 336459 - DNA, 75 bp, Artificial Sequence
  Synthetic
cggaacgggcaagaaacttaaaatgtactttattttacagaaatgttcaaatctccaacatacttaacaactaaa

SEQ ID NO: 336460 - DNA, 75 bp, Artificial Sequence
  Synthetic
ggcaaaaacaatgccttaatcaactgcttcgttggagaccacgatcttctgtgcagctgtaacaatcctgcctac

SEQ ID NO: 336461 - DNA, 75 bp, Artificial Sequence
  Synthetic
cattgcctccaaatacttgcaactaccttagcacctcaactaaaacaagaagaaaaacaacaaataatacaatgc

SEQ ID NO: 336462 - DNA, 75 bp, Artificial Sequence
  Synthetic
cttggtggtacagacgccgtagctacaacccgtggagacgaagaaattggtttagaagacctagaaaaactattt

SEQ ID NO: 336463 - DNA, 75 bp, Artificial Sequence
  Synthetic
acagaagatacagaagaagacgccgctgggtaagaagaaaacctttttacaaacgtaaaattaagagactaaata

SEQ ID NO: 336464 - DNA, 75 bp, Artificial Sequence
  Synthetic
tagtagaatggcaacctaaatcaattagaaaatgtagaataaaaggaatgctatgcttgtttcaaacgacagaag

SEQ ID NO: 336465 - DNA, 75 bp, Artificial Sequence
  Synthetic
acagactgtcatataactttgatatgtatgaagagtctattataccagaaaaactgccgggaggggggggattta

SEQ ID NO: 336466 - DNA, 75 bp, Artificial Sequence
  Synthetic
gcattaagaatataagcttatatgccttataccaagaacacatacatgcacacaacatatttacacacacaaaca

SEQ ID NO: 336467 - DNA, 75 bp, Artificial Sequence
  Synthetic
cagacagaccactagcaagatacacaggctgttctttaaaattctaccaaagcaaagacatagactacgtagtaa

SEQ ID NO: 336468 - DNA, 75 bp, Artificial Sequence
  Synthetic
catattctacatcactcccactaagaagctcaatgggaatgtacaactccatgcaaccatccatacatctaatgc

SEQ ID NO: 336469 - DNA, 75 bp, Artificial Sequence
  Synthetic
aacaaaacaaactaattgtaccaagcaaacaaacacaaaaaagaagaaaaccatatattaaaaaacatatatcac

SEQ ID NO: 336470 - DNA, 75 bp, Artificial Sequence
  Synthetic
caccaacacaaatgaaatctcaatggtactttcaacataacattgcaaacataccgctactaatgataagaacca

SEQ ID NO: 336471 - DNA, 75 bp, Artificial Sequence
  Synthetic
cagcattaacattagataattactatataggaagcagacaattaagtacaaatgtcactatacatacacttaaca

SEQ ID NO: 336472 - DNA, 75 bp, Artificial Sequence
  Synthetic
caacatacatccaaaacagagactggggagacagaaataaaacttactactgccaaacattaggaacacaaagat

SEQ ID NO: 336473 - DNA, 75 bp, Artificial Sequence
  Synthetic
acttcctatatggaacacattcaactgcacaaaatattaatgacataaagctacaagaactaatacctttaacaa

SEQ ID NO: 336474 - DNA, 75 bp, Artificial Sequence
  Synthetic
tttgtgctacgtcactaaccacgtgacgcccacaggccaaccgaatgctatgtcgtgcacttcctgggccgggtc

SEQ ID NO: 336475 - DNA, 75 bp, Artificial Sequence
  Synthetic
ggactggccgggctatgggcaaggctctgaaaaaagcatgtttatcggcaggcattacagaaagaaaagggcgct

SEQ ID NO: 336476 - DNA, 75 bp, Artificial Sequence
  Synthetic
tctgaaaaaagcatgtttatcggcaggcattacagaaagaaaagggcgctgtcactgcttgctgtgcgaacaaca

SEQ ID NO: 336477 - DNA, 75 bp, Artificial Sequence
  Synthetic
ctacgcgcgcgcgccggggggctctgcccccccccgcgcatgcgcgcgggtcccccccccgcggggggctccgcc

SEQ ID NO: 336478 - DNA, 75 bp, Artificial Sequence
  Synthetic
tgatgtggaccccacctcgcaatgaccaacagtacctcaactggcaatggtactcaagtgtacttagctcccacg

SEQ ID NO: 336479 - DNA, 75 bp, Artificial Sequence
  Synthetic
ctgctatgtgcgggtgtcccgacgctgtcgctcattttaatcatcttgcttctgtgcttcgcgccccgcaaaatc

SEQ ID NO: 336480 - DNA, 75 bp, Artificial Sequence
  Synthetic
ctcccggctgcgccagaggcgcccggagatagagcaccatggcctatggctggtggcgccgaaggagaagaaggt

SEQ ID NO: 336481 - DNA, 75 bp, Artificial Sequence
  Synthetic
agaatactgtacgacgagtttaccaggtttatgaacttttggactgtcagtaacgaagacctagacctgtgtaga

SEQ ID NO: 336482 - DNA, 75 bp, Artificial Sequence
  Synthetic
tacaggagatggaaaagaaagggcaggcggagaaagaaagctaaaataataataagacaatggcaaccaaactac

SEQ ID NO: 336483 - DNA, 75 bp, Artificial Sequence
  Synthetic
ggcggagaaagaaagctaaaataataataagacaatggcaaccaaactacaggaggagatgtaacatagtgggct

SEQ ID NO: 336484 - DNA, 75 bp, Artificial Sequence
  Synthetic
aaatactgtcagcagaaactatgccacacactcagacgataccaactacccaggaccctttggggggggtatgac

SEQ ID NO: 336485 - DNA, 75 bp, Artificial Sequence
  Synthetic
acacactcagacgataccaactacccaggaccctttggggggggtatgactacagacaaatttactctaagaatc

SEQ ID NO: 336486 - DNA, 75 bp, Artificial Sequence
  Synthetic
acccttgcgtcaacttccagatcctggggccccagtacaaaaaaaacaccttagtattagctccactatggatga

SEQ ID NO: 336487 - DNA, 75 bp, Artificial Sequence
  Synthetic
tgaactactggacagcatctaacgaagatctagacctctgtagatatctgggagtaaacctgtactttttcagac

SEQ ID NO: 336488 - DNA, 75 bp, Artificial Sequence
  Synthetic
agatctagacctctgtagatatctgggagtaaacctgtactttttcagacacccagatgtagactttatcataaa

SEQ ID NO: 336489 - DNA, 75 bp, Artificial Sequence
  Synthetic
gacacagaactcacagcccctagcatacacccaggcatgctagccttagacaagagagcaaggtggatacccagc

SEQ ID NO: 336490 - DNA, 75 bp, Artificial Sequence
  Synthetic
gcttaaagaaacaggacaacttacaagcggcactataagttggaatagcgtacaaaactcaacagcactaaattc

SEQ ID NO: 336491 - DNA, 75 bp, Artificial Sequence
  Synthetic
actatattaagataagagtaggggcacctaaaatgttcacagataagtggtacccccaaacagacctctgtgaca

SEQ ID NO: 336492 - DNA, 75 bp, Artificial Sequence
  Synthetic
cgcagcggatatgcaatatccgttcggctcaccactaactgactctgtggttgtgaacttccaggttctgcaatc

SEQ ID NO: 336493 - DNA, 75 bp, Artificial Sequence
  Synthetic
ggctcaccactaactgactctgtggttgtgaacttccaggttctgcaatccatgtatgatgaaaaaattagcata

SEQ ID NO: 336494 - DNA, 75 bp, Artificial Sequence
  Synthetic
aaaacctattaactagtatatcaaactatattcctttctataataccacacagacaatagctcagctaaaaccat

SEQ ID NO: 336495 - DNA, 75 bp, Artificial Sequence
  Synthetic
ctatattcctttctataataccacacagacaatagctcagctaaaaccatttgtagatgcaggcaatgcaatatc

SEQ ID NO: 336496 - DNA, 75 bp, Artificial Sequence
  Synthetic
tcactactaaacacaaccaaattcacaactacaactaccaccacatacacttacccaggtacaacaaacacaaca

SEQ ID NO: 336497 - DNA, 75 bp, Artificial Sequence
  Synthetic
caactacaactaccaccacatacacttacccaggtacaacaaacacaacagtaacttttataacagctaatgaca

SEQ ID NO: 336498 - DNA, 75 bp, Artificial Sequence
  Synthetic
ccaaaacataaaagacgtagcaaaaaaagcagcagaactatactcaaaagcaacaaaagctgtactaggaaacac

SEQ ID NO: 336499 - DNA, 75 bp, Artificial Sequence
  Synthetic
aaagcagcagaactatactcaaaagcaacaaaagctgtactaggaaacacattcactacagaagattatacacta

SEQ ID NO: 336500 - DNA, 75 bp, Artificial Sequence
  Synthetic
ccatatggctatcccccggtagatcttactttgaaacaccaggagcatacacagacataaaatataatcctttta

SEQ ID NO: 336501 - DNA, 75 bp, Artificial Sequence
  Synthetic
ttactttgaaacaccaggagcatacacagacataaaatataatccttttacagacagaggagaaggaaacatgct

SEQ ID NO: 336502 - DNA, 75 bp, Artificial Sequence
  Synthetic
aatatgaactatgacaaagtacaaagtaaatgcctaatatcagacctacctctgtgggcagcagcatatggctat

SEQ ID NO: 336503 - DNA, 75 bp, Artificial Sequence
  Synthetic
gtaaatgcctaatatcagacctacctctgtgggcagcagcatatggctatgtagaattctgtgcaaaaagcacag

SEQ ID NO: 336504 - DNA, 75 bp, Artificial Sequence
  Synthetic
cagacttttaataagaagtccctttacagacccccaactcttagtacacacagaccccaccaaaggctttgttcc

SEQ ID NO: 336505 - DNA, 75 bp, Artificial Sequence
  Synthetic
cggcggagcacttccggcttgcccaaaatggcgggcaagctcttccgggtcaaaggttggcagctacgtcacaag

SEQ ID NO: 336506 - DNA, 75 bp, Artificial Sequence
  Synthetic
ttactccctaaattttggaaatggtaaaatgccaggaggtagcagcaatgtgcctattagaatgagagctaagtg

SEQ ID NO: 336507 - DNA, 75 bp, Artificial Sequence
  Synthetic
tcacctgactggggaggagttacatcccggaagctctcctcggtcacgtgactgtacacgtgactgctacgtcat

SEQ ID NO: 336508 - DNA, 75 bp, Artificial Sequence
  Synthetic
cattaaaaaagtatctctgggtatgaaataccgttttaagtggatctggggtggaaaccccgttcgccaacaggt

SEQ ID NO: 336509 - DNA, 75 bp, Artificial Sequence
  Synthetic
ggcgcgcgcgctgcgcgcgcgcgccgggggggcgccagcgccccccccccccgcgcatgcgcgggtccccccccc

SEQ ID NO: 336510 - DNA, 75 bp, Artificial Sequence
  Synthetic
gaagcttacaaatcgttgacccgaaatacaactcaccggaactcactttccatacctgggacttcaaacgtggcc

SEQ ID NO: 336511 - DNA, 75 bp, Artificial Sequence
  Synthetic
cccccgaagtacgtcactaaccacgtgactcccacaggccaaccacagtctacgtcgtgcatttcctgggcatgg

SEQ ID NO: 336512 - DNA, 75 bp, Artificial Sequence
  Synthetic
tgactcccacaggccaaccacagtctacgtcgtgcatttcctgggcatggtctacatcataatataagaaggcgc

SEQ ID NO: 336513 - DNA, 75 bp, Artificial Sequence
  Synthetic
aatgcaacaacaaccaacaactactgacattttttcagcaggccgcaagagacccaggagggacaccgaggtgta

SEQ ID NO: 336514 - DNA, 75 bp, Artificial Sequence
  Synthetic
ccactccagccaagaaggggagcaaaaagaaagcttacttttccccccagtcaagctcctcagacgagtcccccc

SEQ ID NO: 336515 - DNA, 75 bp, Artificial Sequence
  Synthetic
gggtcatcttcagagacttagcgaacgcctgggtagaccccaaccaccaagaccaccgggcgaaccgccgggccc

SEQ ID NO: 336516 - DNA, 75 bp, Artificial Sequence
  Synthetic
tcaagctcctcagacgagtccccccgtgggaagactcgcagcaggaggaaagcgggtcgcaaagctcagaggaag

SEQ ID NO: 336517 - DNA, 75 bp, Artificial Sequence
  Synthetic
cgcctgggtagaccccaaccaccaagaccaccgggcgaaccgccgggccctgctgtgagagttctgcctgccctg

SEQ ID NO: 336518 - DNA, 75 bp, Artificial Sequence
  Synthetic
agacgcagaccgtctcccagcagctcaagcagcagctgcagcaacagcgaatcctgggagtcaaactcagactcc

SEQ ID NO: 336519 - DNA, 75 bp, Artificial Sequence
  Synthetic
caagcagcagctgcagcaacagcgaatcctgggagtcaaactcagactcctgttcaaccaagtccaaaaaatcca

SEQ ID NO: 336520 - DNA, 75 bp, Artificial Sequence
  Synthetic
tgttcaaccaagtccaaaaaatccaacaaaatcaagatatcaaccctaccttgttaccaagggggggggatctag

SEQ ID NO: 336521 - DNA, 75 bp, Artificial Sequence
  Synthetic
acaaaatcaagatatcaaccctaccttgttaccaagggggggggatctagcatccttatttcaaatagcaccata

SEQ ID NO: 336522 - DNA, 75 bp, Artificial Sequence
  Synthetic
acaacccttccagtaatgactggaaggaagagtatgaggcctgtaaatactgggacagaccccctagaggcaatc

SEQ ID NO: 336523 - DNA, 75 bp, Artificial Sequence
  Synthetic
acaacccttccagtaatgactggaaggaagagtatgaggcctgtaattactgggacagaccccctagaggcaatc

SEQ ID NO: 336524 - DNA, 75 bp, Artificial Sequence
  Synthetic
acaacccttccagtaatgactggaaggaagagtatgaggcctgtaactactgggacagaccccctagaggcaatc

SEQ ID NO: 336525 - DNA, 75 bp, Artificial Sequence
  Synthetic
acaacccttccagtaatgactggaaggaagagtatgaggcctgtaagtactgggacagaccccctagaggcaatc

SEQ ID NO: 336526 - DNA, 75 bp, Artificial Sequence
  Synthetic
ggaagagtatgaggcctgtaaatactgggacagaccccctagaggcaatctaagagacaccccctactacccctg

SEQ ID NO: 336527 - DNA, 75 bp, Artificial Sequence
  Synthetic
ggaagagtatgaggcctgtaattactgggacagaccccctagaggcaatctaagagacaccccctactacccctg

SEQ ID NO: 336528 - DNA, 75 bp, Artificial Sequence
  Synthetic
ggaagagtatgaggcctgtaactactgggacagaccccctagaggcaatctaagagacaccccctactacccctg

SEQ ID NO: 336529 - DNA, 75 bp, Artificial Sequence
  Synthetic
ggaagagtatgaggcctgtaagtactgggacagaccccctagaggcaatctaagagacaccccctactacccctg

SEQ ID NO: 336530 - DNA, 75 bp, Artificial Sequence
  Synthetic
aggagtgtataacggcaaacttagcatagaacccacaaacgtagaatcacaatataattcactactttcagctat

SEQ ID NO: 336531 - DNA, 75 bp, Artificial Sequence
  Synthetic
gtaaactttaagcttggatttcaataaagctaggccgtgggactttcacttgtcggtgtctgcttataaaggtca

SEQ ID NO: 336532 - DNA, 75 bp, Artificial Sequence
  Synthetic
aatataattcactactttcagctatagagacgaacacccaaggcactctatttaatacatttaaaacaccagaaa

SEQ ID NO: 336533 - DNA, 75 bp, Artificial Sequence
  Synthetic
agccccagaaactggagacatatccacaaactgctacaaaaaactagacagcgcctggggagacactatatggaa

SEQ ID NO: 336534 - DNA, 75 bp, Artificial Sequence
  Synthetic
acaaactgctacaaaaaactagacagcgcctggggagacactatatggaaccaaaacaccatagccaactttaaa

SEQ ID NO: 336535 - DNA, 75 bp, Artificial Sequence
  Synthetic
caggacacaatcaaacaatgactggtagcaaatacctaaactacagaacaggaatatacagtgccatattccttt

SEQ ID NO: 336536 - DNA, 75 bp, Artificial Sequence
  Synthetic
tgaatcagtaacgaaagtgagtggggccagacttcgccataaggcctttatcttctcgccatttgtcagtgtcgg

SEQ ID NO: 336537 - DNA, 75 bp, Artificial Sequence
  Synthetic
gattgacgtgaaggttaaaggtcatcctcggcggaagctacacaaaatggtggacaacatcttccgggtcaaagg

SEQ ID NO: 336538 - DNA, 75 bp, Artificial Sequence
  Synthetic
ttgttttacaaaatggccgacttccttcctcttttttaaaaaaaggcgccaaaaaaccgtcggcgggggggccgc

SEQ ID NO: 336539 - DNA, 75 bp, Artificial Sequence
  Synthetic
ttcctcttttttaaaaaaaggcgccaaaaaaccgtcggcgggggggccgcgcgctgcgcgcgcggcccccggggg

SEQ ID NO: 336540 - DNA, 75 bp, Artificial Sequence
  Synthetic
aggcattgcctcccccccccgcgcgcatgcgcgcgggtccccccccctccggggggctccgccccccggcccccc

SEQ ID NO: 336541 - DNA, 75 bp, Artificial Sequence
  Synthetic
attttgctacgtcactaaccacgtgacacccacaggccaaccgaatgctatgtcatccatttcctgggccgggtc

SEQ ID NO: 336542 - DNA, 75 bp, Artificial Sequence
  Synthetic
tacgtcctcatataagtaagtgcacttccgaatggctgagttttccacgcccgtccgcagcggtgaagccacgga

SEQ ID NO: 336543 - DNA, 75 bp, Artificial Sequence
  Synthetic
aagaaggcttgcaaactactaatagtaatgtggaccccacctcgcaatgatcaacactaccttaactggcaatgg

SEQ ID NO: 336544 - DNA, 75 bp, Artificial Sequence
  Synthetic
ggggcgcaagcgctcccccccgcgcatgcgcggggcccccccccccccggggggctctgccccccggcccccccg

SEQ ID NO: 336545 - DNA, 75 bp, Artificial Sequence
  Synthetic
ctgctatgtgcgggtgtcccgacgctgtcgctcattttaatcatcttgcttctgtgcttcgtgccccgcaaaacc

SEQ ID NO: 336546 - DNA, 75 bp, Artificial Sequence
  Synthetic
tctgtgcttcgtgccccgcaaaacccaccccctcccggtccccagcgaaacctgcccctccgacggctgccggct

SEQ ID NO: 336547 - DNA, 75 bp, Artificial Sequence
  Synthetic
cctgcccctccgacggctgccggctctcccggctgcgccagaggcgcccggagatagagcaccatggcctatggc

SEQ ID NO: 336548 - DNA, 75 bp, Artificial Sequence
  Synthetic
gagatagagcaccatggcctatggctggtggcgccgaaggagaagacggtggcgcaggtggagacgcagaccatg

SEQ ID NO: 336549 - DNA, 75 bp, Artificial Sequence
  Synthetic
gaggcgccgctggaggacccgaagacgcagacctgctagacgccgtggccgccgcagaaacgtaaggagacgccg

SEQ ID NO: 336550 - DNA, 75 bp, Artificial Sequence
  Synthetic
tataggagatggaaaagaaagggcaggcgcagaaaaaaagctaaaataataataagacaatggcaaccaaactac

SEQ ID NO: 336551 - DNA, 75 bp, Artificial Sequence
  Synthetic
ggcgcagaaaaaaagctaaaataataataagacaatggcaaccaaactacagaaggagatgtaacatagtaggct

SEQ ID NO: 336552 - DNA, 75 bp, Artificial Sequence
  Synthetic
acatccctgtactaatatgtggcgaaaatactgtcagcagaaactatgccacacactcagacgataccaactacc

SEQ ID NO: 336553 - DNA, 75 bp, Artificial Sequence
  Synthetic
acacactcagacgataccaactacccaggaccctttggggggggtatgactacagacaaatttactttaagaatt

SEQ ID NO: 336554 - DNA, 75 bp, Artificial Sequence
  Synthetic
ttgcacctttagatgccctctggggagaccccatatactataatgatctaaatgaaaagaaaagtttcaagaata

SEQ ID NO: 336555 - DNA, 75 bp, Artificial Sequence
  Synthetic
tgaactactggacagcatctaacgaagacctagacctttgtagatatctaggagtaaacctgtactttttcagac

SEQ ID NO: 336556 - DNA, 75 bp, Artificial Sequence
  Synthetic
agaccccatatactataatgatctaaatgaaaagaaaagtttcaagaatatcattgagaacatactaataaaaaa

SEQ ID NO: 336557 - DNA, 75 bp, Artificial Sequence
  Synthetic
aattaataccatgcctccttttctagacacagaactcacagcccctagcatacacccaggcatgctagccctaga

SEQ ID NO: 336558 - DNA, 75 bp, Artificial Sequence
  Synthetic
gacacagaactcacagcccctagcatacacccaggcatgctagccctagacaaaagagcaagatggatacctagc

SEQ ID NO: 336559 - DNA, 75 bp, Artificial Sequence
  Synthetic
accaagaatgttcactgataaatggtacccccaaacagatctttgtgacatggtgcttctaactgtctatgcaac

SEQ ID NO: 336560 - DNA, 75 bp, Artificial Sequence
  Synthetic
ggcaattcgggctcgggactggccgggctatgggcaaggctcttaaagcgtacctaccccgctatgtttctcggc

SEQ ID NO: 336561 - DNA, 75 bp, Artificial Sequence
  Synthetic
ttgtgaacttccaggttctgcaatccatgtatgataaaacaattagcatattaccagacgaaaaatcacaaagag

SEQ ID NO: 336562 - DNA, 75 bp, Artificial Sequence
  Synthetic
aagtgcttctgctggctgtgcgagctacacagaaaacatcttccatgagtatctggcgtccccctctcgggaatg

SEQ ID NO: 336563 - DNA, 75 bp, Artificial Sequence
  Synthetic
tacacagaaaacatcttccatgagtatctggcgtccccctctcgggaatgtctcctacagggagagaaattggct

SEQ ID NO: 336564 - DNA, 75 bp, Artificial Sequence
  Synthetic
ttacattcccttttataataccacacaaactatagcccaattaaagccatttatagatgcaggcaatgtaacatc

SEQ ID NO: 336565 - DNA, 75 bp, Artificial Sequence
  Synthetic
caaactatagcccaattaaagccatttatagatgcaggcaatgtaacatcaggcgcaacagcaacaacatgggca

SEQ ID NO: 336566 - DNA, 75 bp, Artificial Sequence
  Synthetic
tccttttgtggctgtggtgattttattcttcatcttactaatttggctgcacgctttgctcttcaggggcccccg

SEQ ID NO: 336567 - DNA, 75 bp, Artificial Sequence
  Synthetic
ttcttcatcttactaatttggctgcacgctttgctcttcaggggcccccgccggagggtggtcctcctcggccga

SEQ ID NO: 336568 - DNA, 75 bp, Artificial Sequence
  Synthetic
ctacagcaaccacaacaacttatgcatatccaggcaccaacagacccccagtaactatgttaacctgtaatgact

SEQ ID NO: 336569 - DNA, 75 bp, Artificial Sequence
  Synthetic
gtaactatgttaacctgtaatgactcctggtacagaggaacagtatataacacacaaattcaacagttaccaata

SEQ ID NO: 336570 - DNA, 75 bp, Artificial Sequence
  Synthetic
ggcccccgaggtccgcagggaaacgcgcacagagaacccgggcgcctccggtgagccatggcctggcgatggtgg

SEQ ID NO: 336571 - DNA, 75 bp, Artificial Sequence
  Synthetic
cgcacagagaacccgggcgcctccggtgagccatggcctggcgatggtggtggcagagacgatggcgccgccgcc

SEQ ID NO: 336572 - DNA, 75 bp, Artificial Sequence
  Synthetic
caacaaaaaccttgctaggaaacaccttcacaaatgaggactacacactagaatatcatggaggactgtacagct

SEQ ID NO: 336573 - DNA, 75 bp, Artificial Sequence
  Synthetic
cctacgacgccggagacctcgacgacctgttcgccgccgtcgaagacgagcaacagtaaggaggcggaggtggag

SEQ ID NO: 336574 - DNA, 75 bp, Artificial Sequence
  Synthetic
cctgttcgccgccgtcgaagacgagcaacagtaaggaggcggaggtggaggggcagacgtgggcgacgcacatac

SEQ ID NO: 336575 - DNA, 75 bp, Artificial Sequence
  Synthetic
ttactttgaaacaacaggagcatatacagacataaagtacaatccattcacagacagaggagaaggcaacatgtt

SEQ ID NO: 336576 - DNA, 75 bp, Artificial Sequence
  Synthetic
cagacagaggagaaggcaacatgttatggatagactggctaagcaaaaaaaacatgaactatgacaaagtacaaa

SEQ ID NO: 336577 - DNA, 75 bp, Artificial Sequence
  Synthetic
gcagacccagaaagagatttgtactgactcagtggagcccccagacagccagaaactgttcaataaggggcatag

SEQ ID NO: 336578 - DNA, 75 bp, Artificial Sequence
  Synthetic
atggatagactggctaagcaaaaaaaacatgaactatgacaaagtacaaagtaaatgcttaatatcagacctacc

SEQ ID NO: 336579 - DNA, 75 bp, Artificial Sequence
  Synthetic
gactcagtggagcccccagacagccagaaactgttcaataaggggcatagtgcccatggtaatatgcggacacac

SEQ ID NO: 336580 - DNA, 75 bp, Artificial Sequence
  Synthetic
cacagcgaggactttaccactcagataagaccctttggaggcagcttcagcacaaccacctggtccctaaaagta

SEQ ID NO: 336581 - DNA, 75 bp, Artificial Sequence
  Synthetic
taagaccctttggaggcagcttcagcacaaccacctggtccctaaaagtactgtgggacgaacaccagaaattcc

SEQ ID NO: 336582 - DNA, 75 bp, Artificial Sequence
  Synthetic
cagaccccacaaaaggctttgttccttactctttaaactttggaaatggtaaaatgccaggaggtagtagtaatg

SEQ ID NO: 336583 - DNA, 75 bp, Artificial Sequence
  Synthetic
ttactctttaaactttggaaatggtaaaatgccaggaggtagtagtaatgtgcctattagaatgagagctaaatg

SEQ ID NO: 336584 - DNA, 75 bp, Artificial Sequence
  Synthetic
acagctggacctagccaggtacaggggggtcaccttctggttctacagagaccagaaaacagactatatagtaca

SEQ ID NO: 336585 - DNA, 75 bp, Artificial Sequence
  Synthetic
ggggtcaccttctggttctacagagaccagaaaacagactatatagtacaatggagcagaaatcctccctttaaa

SEQ ID NO: 336586 - DNA, 75 bp, Artificial Sequence
  Synthetic
gaagtactagaggccttagcacagtcaggcccctttgcataccactcagacattaaaaaagtatctctgggtatg

SEQ ID NO: 336587 - DNA, 75 bp, Artificial Sequence
  Synthetic
cactcctcgggcaatagagtccctagaagcttacaaatcgttgacccgaaatacaactcaccggaactcacattc

SEQ ID NO: 336588 - DNA, 75 bp, Artificial Sequence
  Synthetic
gaagcttacaaatcgttgacccgaaatacaactcaccggaactcacattccatacctgggacttcagacgtggcc

SEQ ID NO: 336589 - DNA, 75 bp, Artificial Sequence
  Synthetic
accaccctggaatgatgatgcaggcaaaaaagaaactggtggtccccagtttccagaccagacctaaaggcaaaa

SEQ ID NO: 336590 - DNA, 75 bp, Artificial Sequence
  Synthetic
aaaaaagaaactggtggtccccagtttccagaccagacctaaaggcaaaaagagatacagagtcagaataagacc

SEQ ID NO: 336591 - DNA, 75 bp, Artificial Sequence
  Synthetic
ttgttaccaagggggggggatctagcatccttatttcaaatagcaccataaacatgtttggtgaccccaaacctt

SEQ ID NO: 336592 - DNA, 75 bp, Artificial Sequence
  Synthetic
tacactcaagaggacctttgtccagtacctcttgtgcaaattgtggtttctgcggctacccagacaaaaaagaac

SEQ ID NO: 336593 - DNA, 75 bp, Artificial Sequence
  Synthetic
aacatgtttggtgaccccaaaccttacaacccttccagtaatgactggaaagaggagtacgaggcctgtagaata

SEQ ID NO: 336594 - DNA, 75 bp, Artificial Sequence
  Synthetic
acaacccttccagtaatgactggaaagaggagtacgaggcctgtagaatatgggacagaccccccagaggcaacc

SEQ ID NO: 336595 - DNA, 75 bp, Artificial Sequence
  Synthetic
tacctcttgtgcaaattgtggtttctgcggctacccagacaaaaaagaactgctcaccacaaacgaacaaccctt

SEQ ID NO: 336596 - DNA, 75 bp, Artificial Sequence
  Synthetic
caagtacttaaactacataggagttaactcttccgagacccgaagaaacagttataaaactctacaagagaaact

SEQ ID NO: 336597 - DNA, 75 bp, Artificial Sequence
  Synthetic
aactcttccgagacccgaagaaacagttataaaactctacaagagaaactttactcacaatgcacatactttcaa

SEQ ID NO: 336598 - DNA, 75 bp, Artificial Sequence
  Synthetic
ctaagcactccgagcgaagcgaggagtgcgacccttgggggctcaacgccttcggagccgcgcgctacgccttcg

SEQ ID NO: 336599 - DNA, 75 bp, Artificial Sequence
  Synthetic
ctccagcatttcagcccgcaaagaaacctaacagaaccaacaactcaaccagcacaacactaggcaacaaagtca

SEQ ID NO: 336600 - DNA, 75 bp, Artificial Sequence
  Synthetic
acctaacagaaccaacaactcaaccagcacaacactaggcaacaaagtcacagacctaaaatccaacaatggcaa

SEQ ID NO: 336601 - DNA, 75 bp, Artificial Sequence
  Synthetic
gctcgtgctgacacgctcgcgcgtgtcagaccacttcgggctcgcgggggtcgggaaatttactaaacagactcc

SEQ ID NO: 336602 - DNA, 75 bp, Artificial Sequence
  Synthetic
ttcggagccgcgcgctacgccttcggctgcgcgcggcacctcagacccccgctcgtgctgacacgctcgcgcgtg

SEQ ID NO: 336603 - DNA, 75 bp, Artificial Sequence
  Synthetic
tttggcatgtgttcatataaacccagcaaggacatactatataaagcaaacgaatggttgtgggacaatctcatg

SEQ ID NO: 336604 - DNA, 75 bp, Artificial Sequence
  Synthetic
gagttgccattggactcaggagctatgaatcagtaacgaaagtgagtggggccagacttcgccataaggccttta

SEQ ID NO: 336605 - DNA, 75 bp, Artificial Sequence
  Synthetic
tcgggaaatttactaaacagactccgagttgccattggactcaggagctatgaatcagtaacgaaagtgagtggg

SEQ ID NO: 336606 - DNA, 75 bp, Artificial Sequence
  Synthetic
gcaaggacatactatataaagcaaacgaatggttgtgggacaatctcatggttgaaaatgatttacattccacat

SEQ ID NO: 336607 - DNA, 75 bp, Artificial Sequence
  Synthetic
ggagtaccacacaggcatttacagctccatattcctaagtcctcaaaggtccctagaattcccagcagcatacca

SEQ ID NO: 336608 - DNA, 75 bp, Artificial Sequence
  Synthetic
tccatattcctaagtcctcaaaggtccctagaattcccagcagcataccaagatgtcacatacaacccaaactgt

SEQ ID NO: 336609 - DNA, 75 bp, Artificial Sequence
  Synthetic
gccattttaagtagctgacgtcaaggattgacgtaaaggttaaaggtcatcctcggcggaagctacacaaaatgg

SEQ ID NO: 336610 - DNA, 75 bp, Artificial Sequence
  Synthetic
ggttccaatatggcacaaaaatgaacacaaactttaatgaacaacagtgtaagtgtgtgttaacaaacattcccc

SEQ ID NO: 336611 - DNA, 75 bp, Artificial Sequence
  Synthetic
cacaaactttaatgaacaacagtgtaagtgtgtgttaacaaacattcccctgtgggcggcctttaacggctaccc

SEQ ID NO: 336612 - DNA, 75 bp, Artificial Sequence
  Synthetic
gaggggacccgctgtaacccggaagtaggccccgtcacgtgacttaccacgtgtgtacacgtcaccgccgccatt

SEQ ID NO: 336613 - DNA, 75 bp, Artificial Sequence
  Synthetic
atcagcacagaggtacacaactttggcatagtatgtttccagtgcccctacacctttcccccactctatgacaaa

SEQ ID NO: 336614 - DNA, 75 bp, Artificial Sequence
  Synthetic
gtgtgtacacgtcaccgccgccattttgttttacaaaatggctgacttccttcctcttttttgaaaaaaggcgcc

SEQ ID NO: 336615 - DNA, 75 bp, Artificial Sequence
  Synthetic
attttgtgcagcccgccaatttctcatttaaacaggccaatcagctactactacgtacacttcctggggtgtgtc

SEQ ID NO: 336616 - DNA, 75 bp, Artificial Sequence
  Synthetic
gcatagtatgtttccagtgcccctacacctttcccccactctatgacaaaaagaacccagataaaggctacgtat

SEQ ID NO: 336617 - DNA, 75 bp, Artificial Sequence
  Synthetic
aaaaatgccagacgggtcaggccacattcccatctactggcagcagagatggtggatcagactagcctttcaagt

SEQ ID NO: 336618 - DNA, 75 bp, Artificial Sequence
  Synthetic
attcccatctactggcagcagagatggtggatcagactagcctttcaagtacaagtcatgcatgactttgtactc

SEQ ID NO: 336619 - DNA, 75 bp, Artificial Sequence
  Synthetic
gcccgtccgcggcgagagcgcgagcgaagcgagcgatcgagcgtcccgtgggcgggtgccgtaggtgagtttaca

SEQ ID NO: 336620 - DNA, 75 bp, Artificial Sequence
  Synthetic
acctagcaaacactacactaacagccaggtacaagttcagattcaaatggggcggtaatatcatccccgaacaga

SEQ ID NO: 336621 - DNA, 75 bp, Artificial Sequence
  Synthetic
ctcgggactggccgggctatgggcaagactcttaaaaaattcccccgctctgttgtccggcaggatacaaaatca

SEQ ID NO: 336622 - DNA, 75 bp, Artificial Sequence
  Synthetic
caggtacaagttcagattcaaatggggcggtaatatcatccccgaacagattatcaagaacccgtgtaagagaga

SEQ ID NO: 336623 - DNA, 75 bp, Artificial Sequence
  Synthetic
cgttcaacagagagaagagctctgggtacagacagttactacttcacatgctactttttgcggctgtggtgaccc

SEQ ID NO: 336624 - DNA, 75 bp, Artificial Sequence
  Synthetic
agacaacgtcgcgacctacaagttgttgacccatcaaccatgggcccgatctacaccttccacacatgggactgg

SEQ ID NO: 336625 - DNA, 75 bp, Artificial Sequence
  Synthetic
gtacagacagttactacttcacatgctactttttgcggctgtggtgaccctagtagccatcttcaccgcattctt

SEQ ID NO: 336626 - DNA, 75 bp, Artificial Sequence
  Synthetic
ttgacccatcaaccatgggcccgatctacaccttccacacatgggactggcgacgggggctttttggtgcagatg

SEQ ID NO: 336627 - DNA, 75 bp, Artificial Sequence
  Synthetic
ggccccccgaaaccccaaaccccattcgtgccctaccggccctaccggcaccccaagaacctgaacagccgccat

SEQ ID NO: 336628 - DNA, 75 bp, Artificial Sequence
  Synthetic
ggaagatgctctccgctttacaaaccctttcaagagacccagatatcttcccccgacagacggagaagactaccg

SEQ ID NO: 336629 - DNA, 75 bp, Artificial Sequence
  Synthetic
tcgtgccctaccggccctaccggcaccccaagaacctgaacagccgccatcacggcctggtaccggtacagaaga

SEQ ID NO: 336630 - DNA, 75 bp, Artificial Sequence
  Synthetic
cctttcaagagacccagatatcttcccccgacagacggagaagactaccgacaagaagaagacttcgctttacag

SEQ ID NO: 336631 - DNA, 75 bp, Artificial Sequence
  Synthetic
cgaggtggggcctacgcagaagaagatttagaagatcttttcgcggccgcggaagaagacgatatgtgagtagat

SEQ ID NO: 336632 - DNA, 75 bp, Artificial Sequence
  Synthetic
aagaagtccaggacgaggagagccccccgcaaaacgcgccgctcctacagcagcagcagcagcagcgggagctct

SEQ ID NO: 336633 - DNA, 75 bp, Artificial Sequence
  Synthetic
atttagaagatcttttcgcggccgcggaagaagacgatatgtgagtagatggtcgcgccgccgatacaggcgcag

SEQ ID NO: 336634 - DNA, 75 bp, Artificial Sequence
  Synthetic
cccgcaaaacgcgccgctcctacagcagcagcagcagcagcgggagctctcagtccagcacgcggagcagcagcg

SEQ ID NO: 336635 - DNA, 75 bp, Artificial Sequence
  Synthetic
ggacgcagacgaagaaagagacagactcttataccgagacagtggcagccagatgttactaaaaagtgcttcatt

SEQ ID NO: 336636 - DNA, 75 bp, Artificial Sequence
  Synthetic
ctccaagaagtcctcaaaacgcaagcgggtctccacctaaaccccctattattaggcccgccacaaacaaggtgt

SEQ ID NO: 336637 - DNA, 75 bp, Artificial Sequence
  Synthetic
ctcttataccgagacagtggcagccagatgttactaaaaagtgcttcattactggctggatgcccttaataatct

SEQ ID NO: 336638 - DNA, 75 bp, Artificial Sequence
  Synthetic
cgggtctccacctaaaccccctattattaggcccgccacaaacaaggtgtatatctttgagccccccagaggcct

SEQ ID NO: 336639 - DNA, 75 bp, Artificial Sequence
  Synthetic
ctttataacccacgaagaggatatccccggtgcaggagcctcctatggaggaaaccttacaaacattaccattac

SEQ ID NO: 336640 - DNA, 75 bp, Artificial Sequence
  Synthetic
tgggaggacgagtactgcacctgcaagtactgggatcgccctcccagaaccaaccacctagacacccccacttat

SEQ ID NO: 336641 - DNA, 75 bp, Artificial Sequence
  Synthetic
cccggtgcaggagcctcctatggaggaaaccttacaaacattaccattactctgggagggctatatgaacaatat

SEQ ID NO: 336642 - DNA, 75 bp, Artificial Sequence
  Synthetic
agtactgggatcgccctcccagaaccaaccacctagacacccccacttatccctagatgcccaccaacttcaaag

SEQ ID NO: 336643 - DNA, 75 bp, Artificial Sequence
  Synthetic
gaagcaactatgacctagagctggccagatacctaggcttcaccctaaaatgctacagacatgcaacagtagact

SEQ ID NO: 336644 - DNA, 75 bp, Artificial Sequence
  Synthetic
ctaaataaaaatagcaaagctatacactgttcacttgtcagtgtctacctctataagtcactaagcactccaagc

SEQ ID NO: 336645 - DNA, 75 bp, Artificial Sequence
  Synthetic
cagatacctaggcttcaccctaaaatgctacagacatgcaacagtagactatatacttacatacagcagaacaac

SEQ ID NO: 336646 - DNA, 75 bp, Artificial Sequence
  Synthetic
actgttcacttgtcagtgtctacctctataagtcactaagcactccaagcgtagcaaagagtgcgaccctcaaaa

SEQ ID NO: 336647 - DNA, 75 bp, Artificial Sequence
  Synthetic
cacatgctaactcaccccttactaatgctactaaacaaacatcacagagtaatacccagcttaaaaacaaggcca

SEQ ID NO: 336648 - DNA, 75 bp, Artificial Sequence
  Synthetic
cgcgctacgccttcagctgcgcgcggcacctcgaacccccactcgtgctgacacgctcgcgcgtgtcaaaccact

SEQ ID NO: 336649 - DNA, 75 bp, Artificial Sequence
  Synthetic
tgctactaaacaaacatcacagagtaatacccagcttaaaaacaaggccaaaaggaaaaaggtcagttagaatcc

SEQ ID NO: 336650 - DNA, 75 bp, Artificial Sequence
  Synthetic
tactaaacagactccgagttgccattagacactgtagctgtaaatcagtaacgaaagtgagtggggccagaaagg

SEQ ID NO: 336651 - DNA, 75 bp, Artificial Sequence
  Synthetic
aaacaaatggtactttgcaaaagacctctgtaacataggaccctgtcaaatatatgccacaggcctagaactctc

SEQ ID NO: 336652 - DNA, 75 bp, Artificial Sequence
  Synthetic
aagtacgtcactaaccacgtgactcctatcgaccaatcagggtctacgtcgtgcacttcctgggcatggtctaca

SEQ ID NO: 336653 - DNA, 75 bp, Artificial Sequence
  Synthetic
ctctgtaacataggaccctgtcaaatatatgccacaggcctagaactctcaaacccctggctaagatcaggcaca

SEQ ID NO: 336654 - DNA, 75 bp, Artificial Sequence
  Synthetic
tacttaaaaatcacctatatgatggcaacctctcaaacatagcctcaggtgaacaattaacagccagacaaactc

SEQ ID NO: 336655 - DNA, 75 bp, Artificial Sequence
  Synthetic
caacctctcaaacatagcctcaggtgaacaattaacagccagacaaactctatttacaactaaattactcccaag

SEQ ID NO: 336656 - DNA, 75 bp, Artificial Sequence
  Synthetic
tacgcctataccccactaatgaaaacattctacacacaagcagccaacacagcagcacataacataacagacaaa

SEQ ID NO: 336657 - DNA, 75 bp, Artificial Sequence
  Synthetic
ttggcagggcctaccgccacaagaaaaggaaagtgctactgccctcactgcgagctccacaggcgtctcgcaggg

SEQ ID NO: 336658 - DNA, 75 bp, Artificial Sequence
  Synthetic
cattctacacacaagcagccaacacagcagcacataacataacagacaaaacatacaactggaaaaactacaaaa

SEQ ID NO: 336659 - DNA, 75 bp, Artificial Sequence
  Synthetic
atggacaacaaaagcacaatttaattatgacttagttaaagaagaatacaaaacggtatatccaaccacagctac

SEQ ID NO: 336660 - DNA, 75 bp, Artificial Sequence
  Synthetic
tatgacttagttaaagaagaatacaaaacggtatatccaaccacagctacattcccaccagagtggtcaaacaga

SEQ ID NO: 336661 - DNA, 75 bp, Artificial Sequence
  Synthetic
tattcagcccttattttctaacaccaaacagatacagcacagagtggcacatgccaattacctatgttagataca

SEQ ID NO: 336662 - DNA, 75 bp, Artificial Sequence
  Synthetic
gtcagtcgccgccaggtggtcctcctccgggcaccccgcagataaggagagccagacctagtcccgccgcgcccg

SEQ ID NO: 336663 - DNA, 75 bp, Artificial Sequence
  Synthetic
gccagacctagtcccgccgcgcccgagcaacctcaagccctaccatggcatggggatggtggagaaggtggcgca

SEQ ID NO: 336664 - DNA, 75 bp, Artificial Sequence
  Synthetic
aaacagatacagcacagagtggcacatgccaattacctatgttagatacaacccactagcagacaaaggcatagg

SEQ ID NO: 336665 - DNA, 75 bp, Artificial Sequence
  Synthetic
tcagaaagcagcagcagctttgagcccaccaaaagcaagtgcatgctacaagacatgccactatacatgctcaca

SEQ ID NO: 336666 - DNA, 75 bp, Artificial Sequence
  Synthetic
ccaccaaaagcaagtgcatgctacaagacatgccactatacatgctcacatatggatacctagactatgttgtta

SEQ ID NO: 336667 - DNA, 75 bp, Artificial Sequence
  Synthetic
gacgctatagaagacgacgaacagtaagaaccaggcggaggcggtgggggcgcagacggtacagacggggatgga

SEQ ID NO: 336668 - DNA, 75 bp, Artificial Sequence
  Synthetic
aagaaccaggcggaggcggtgggggcgcagacggtacagacggggatggagacgaaggacttatgtgagaaaggg

SEQ ID NO: 336669 - DNA, 75 bp, Artificial Sequence
  Synthetic
gacagacatgagagtggccattagaagcccctacacctttcctcaactaataggcagcacagataaagtgggctt

SEQ ID NO: 336670 - DNA, 75 bp, Artificial Sequence
  Synthetic
agcccctacacctttcctcaactaataggcagcacagataaagtgggcttcatccccctaggtgaaaaattcatg

SEQ ID NO: 336671 - DNA, 75 bp, Artificial Sequence
  Synthetic
ctgatactgagacagtggcaaccagccaccagacgcagatgcactataactgggtacctgcccatagtgttctgc

SEQ ID NO: 336672 - DNA, 75 bp, Artificial Sequence
  Synthetic
ccaccagacgcagatgcactataactgggtacctgcccatagtgttctgcggccacactaagggcaacaaaaact

SEQ ID NO: 336673 - DNA, 75 bp, Artificial Sequence
  Synthetic
actttataccgttaaagtattggtacagatggtatccgtttgcggctaaccaaaagtcagttttagaaaccatag

SEQ ID NO: 336674 - DNA, 75 bp, Artificial Sequence
  Synthetic
cagatggtatccgtttgcggctaaccaaaagtcagttttagaaaccatagtttcctgtggccccttcatgcccag

SEQ ID NO: 336675 - DNA, 75 bp, Artificial Sequence
  Synthetic
cccccaaggacagccatttggaggggctttaagcactacctcattctctttaaaagtactatatgaccaacatca

SEQ ID NO: 336676 - DNA, 75 bp, Artificial Sequence
  Synthetic
gctttaagcactacctcattctctttaaaagtactatatgaccaacatcaaagaggacttaacaagtggtctttc

SEQ ID NO: 336677 - DNA, 75 bp, Artificial Sequence
  Synthetic
ataactgtaggttacaaagcaacctttaaacgggggggctcccctctacctccacagcccatcgacgacccatgc

SEQ ID NO: 336678 - DNA, 75 bp, Artificial Sequence
  Synthetic
ttaaacgggggggctcccctctacctccacagcccatcgacgacccatgccaaaagcccacccacgaccttcccg

SEQ ID NO: 336679 - DNA, 75 bp, Artificial Sequence
  Synthetic
gatacaggggctgcaaattttatttttacagaacaaaacagacagactgggtgggccagtatgacatatcagaac

SEQ ID NO: 336680 - DNA, 75 bp, Artificial Sequence
  Synthetic
ttacagaacaaaacagacagactgggtgggccagtatgacatatcagaaccctacaagctagacaaatatagctg

SEQ ID NO: 336681 - DNA, 75 bp, Artificial Sequence
  Synthetic
acaaatctcggacccggcaagactcggaccggagacgctcttccactcatgggacatcagacgtggatacattaa

SEQ ID NO: 336682 - DNA, 75 bp, Artificial Sequence
  Synthetic
ggaccggagacgctcttccactcatgggacatcagacgtggatacattaacacaaaagctattaaaagaatctca

SEQ ID NO: 336683 - DNA, 75 bp, Artificial Sequence
  Synthetic
attaaggcaaagcacaaatttttaattccaagctatgacactaatcccaggggcagacagaaaattatagttaaa

SEQ ID NO: 336684 - DNA, 75 bp, Artificial Sequence
  Synthetic
tttcaacaggcgtcgtgtcaaaaagaccccgattggaaacccagtaccacggccaacacgaaagccaagaagaag

SEQ ID NO: 336685 - DNA, 75 bp, Artificial Sequence
  Synthetic
accccgattggaaacccagtaccacggccaacacgaaagccaagaagaagacgcctatcttttactcaaacaact

SEQ ID NO: 336686 - DNA, 75 bp, Artificial Sequence
  Synthetic
caacccttgctacaccttccaggtgttgaaagagttctactatcaggcaataggctttagtgcaacagatgaaaa

SEQ ID NO: 336687 - DNA, 75 bp, Artificial Sequence
  Synthetic
tcggagggagaacaagcaccccaagaaaaaacactccaaaaagaaaagctcctcaagcagctgcagctccacaag

SEQ ID NO: 336688 - DNA, 75 bp, Artificial Sequence
  Synthetic
aaaaaacactccaaaaagaaaagctcctcaagcagctgcagctccacaagcagcagcagcaactcctcagaaaag

SEQ ID NO: 336689 - DNA, 75 bp, Artificial Sequence
  Synthetic
tacgggcaaaacgcttactgggaatcaaacattactcccttttatgtaattaatgttaaaaaaggcagtaacacc

SEQ ID NO: 336690 - DNA, 75 bp, Artificial Sequence
  Synthetic
caaacattactcccttttatgtaattaatgttaaaaaaggcagtaacaccgcagaaatgctaacacctactataa

SEQ ID NO: 336691 - DNA, 75 bp, Artificial Sequence
  Synthetic
cctccgactcagacggggagtccactgggacccaggcctatagtactgcctccagagcctattccagacttgctt

SEQ ID NO: 336692 - DNA, 75 bp, Artificial Sequence
  Synthetic
tgggacccaggcctatagtactgcctccagagcctattccagacttgcttttcccaaatactaaaaaaaaaaaga

SEQ ID NO: 336693 - DNA, 75 bp, Artificial Sequence
  Synthetic
gaataccaactataactggtacacatataatgccaaagagaacaaagaaaacttaaaaaaattaagaaacgccta

SEQ ID NO: 336694 - DNA, 75 bp, Artificial Sequence
  Synthetic
tataatgccaaagagaacaaagaaaacttaaaaaaattaagaaacgcctactttaaagaactaacctctcacgga

SEQ ID NO: 336695 - DNA, 75 bp, Artificial Sequence
  Synthetic
cgaggctcaaatagcagggtggttagacaggcctatgaggctgtatcctggggacaaccccttctacccgtggct

SEQ ID NO: 336696 - DNA, 75 bp, Artificial Sequence
  Synthetic
gacaggcctatgaggctgtatcctggggacaaccccttctacccgtggctaccaaaaaagccacctacccaccct

SEQ ID NO: 336697 - DNA, 75 bp, Artificial Sequence
  Synthetic
gctatggtagtcagtggactacccccagcacagacgcctacgagtaccacttaggcatgttcagtactatatttt

SEQ ID NO: 336698 - DNA, 75 bp, Artificial Sequence
  Synthetic
cagcacagacgcctacgagtaccacttaggcatgttcagtactatatttttagccccagacagaccagtaccccg

SEQ ID NO: 336699 - DNA, 75 bp, Artificial Sequence
  Synthetic
acttacaaccccctaatggacaaaggggtgggcaaccacgtatggtttcagtacaacacaaaagcagatacacaa

SEQ ID NO: 336700 - DNA, 75 bp, Artificial Sequence
  Synthetic
gggtgggcaaccacgtatggtttcagtacaacacaaaagcagatacacaactaatacttacaggagggtcctgca

SEQ ID NO: 336701 - DNA, 75 bp, Artificial Sequence
  Synthetic
atgggcagccttctatggctacagtgacttcatagaatcagagctaggtccctttgtagattcacagacagtagg

SEQ ID NO: 336702 - DNA, 75 bp, Artificial Sequence
  Synthetic
gacttcatagaatcagagctaggtccctttgtagattcacagacagtaggcctcgtctgtgtaatttgcccttac

SEQ ID NO: 336703 - DNA, 75 bp, Artificial Sequence
  Synthetic
ttggactctgagggggcgtacagcaacgaaagtgagtggggccagacttcgccataaggcctttaacttccgggt

SEQ ID NO: 336704 - DNA, 75 bp, Artificial Sequence
  Synthetic
caaatcccatgatgggatacgtattctatgacagaaactttggtgatggcaaatggactgacggacgaggtaaaa

SEQ ID NO: 336705 - DNA, 75 bp, Artificial Sequence
  Synthetic
tcggccgccattttaggccctcgcgggcctccgtaggcgcgtactagtgacgtcacggcagccattttgactgtg

SEQ ID NO: 336706 - DNA, 75 bp, Artificial Sequence
  Synthetic
tagagccctactggcaagtcaggtggaggccagaaatgcttttccaagagactgtaatggcagacttagttcaga

SEQ ID NO: 336707 - DNA, 75 bp, Artificial Sequence
  Synthetic
gcgtgtaacccggaagtcatcctcgtcacgtgacctgacgtcacggccgccattttgtgctgtccgccatcttgt

SEQ ID NO: 336708 - DNA, 75 bp, Artificial Sequence
  Synthetic
acttaaaaacagcacactagtgtgcaagtacaaattctatttcacctggggaggtaacatgatgttccaacagac

SEQ ID NO: 336709 - DNA, 75 bp, Artificial Sequence
  Synthetic
cccccgcgcatgcgcggggccccccccccgggggggctccgcccccccggcccccccccgtactaaatccaccgc

SEQ ID NO: 336710 - DNA, 75 bp, Artificial Sequence
  Synthetic
ccccgggggggctccgcccccccggcccccccccgtactaaatccaccgcgcatgcgaggacacgcccccgccgc

SEQ ID NO: 336711 - DNA, 75 bp, Artificial Sequence
  Synthetic
agaagtccgtcactaaccacgtgactcccacaggccacccatatgctacgtcgtgcacttcctgggcggagttta

SEQ ID NO: 336712 - DNA, 75 bp, Artificial Sequence
  Synthetic
gtccgcagcgagtgagccacggagggactcccgcgcgtcccgtgggcgggtgccggaggtgagtttacacaccgc

SEQ ID NO: 336713 - DNA, 75 bp, Artificial Sequence
  Synthetic
gactcccgcgcgtcccgtgggcgggtgccggaggtgagtttacacaccgcagtcaaggggcaattcgggcacggg

SEQ ID NO: 336714 - DNA, 75 bp, Artificial Sequence
  Synthetic
ttaaaaatgtacttttccagaaaaagaagacccaagaaggagaggccgctgccactgcgatacgtgtgtggccta

SEQ ID NO: 336715 - DNA, 75 bp, Artificial Sequence
  Synthetic
gcgataaaccaggtgtacttgttcccagagagggccccaaaaccccctcctagcagccaagactggcagcaggag

SEQ ID NO: 336716 - DNA, 75 bp, Artificial Sequence
  Synthetic
gaagacccaagaaggagaggccgctgccactgcgatacgtgtgtggcctaccgcctagcaggcctgatccgatga

SEQ ID NO: 336717 - DNA, 75 bp, Artificial Sequence
  Synthetic
cccaggacaagagggcctgtggtaccgatcagtttttacttctcatggcgctttttgtggttgcggtgattttgt

SEQ ID NO: 336718 - DNA, 75 bp, Artificial Sequence
  Synthetic
ggccccccagatacaacctatcctctcctcccttctaccccagctgcccttctaaattctgtgtaaaattcagcc

SEQ ID NO: 336719 - DNA, 75 bp, Artificial Sequence
  Synthetic
ccgcctccggaacctgaaccaagaagacacgtccagagagagaacccgggatgtggtggtggagacgccgcagat

SEQ ID NO: 336720 - DNA, 75 bp, Artificial Sequence
  Synthetic
gacacgtccagagagagaacccgggatgtggtggtggagacgccgcagatggagggccccatggagaaggaggcg

SEQ ID NO: 336721 - DNA, 75 bp, Artificial Sequence
  Synthetic
atggagacgacgcagacctcggaccagaagatttagacgagctgctcgacgtcctagacgccccagagtaaggag

SEQ ID NO: 336722 - DNA, 75 bp, Artificial Sequence
  Synthetic
gtcctagacgccccagagtaaggagacctcggcgccgcagggggtgggctcgtagatatagacttagaaggaggc

SEQ ID NO: 336723 - DNA, 75 bp, Artificial Sequence
  Synthetic
agtgggcatatcagtaacgaaagtgagtggggccagacttcgccataaggcctttatcttcttgccattggatcg

SEQ ID NO: 336724 - DNA, 75 bp, Artificial Sequence
  Synthetic
acctcggcgccgcagggggtgggctcgtagatatagacttagaaggaggcggaggaggagaagaaggagaaagct

SEQ ID NO: 336725 - DNA, 75 bp, Artificial Sequence
  Synthetic
aaaataagaaaatgtctagtaataggttatcttgctctagtactatgtggaaacgggacattcagtaaaaactat

SEQ ID NO: 336726 - DNA, 75 bp, Artificial Sequence
  Synthetic
cctccgttttaggccttccggactacaaaaatggccgtttcagtgacttcacggccgccattttaattaaggcgg

SEQ ID NO: 336727 - DNA, 75 bp, Artificial Sequence
  Synthetic
caaaaatggccgtttcagtgacttcacggccgccattttaattaaggcggaagcagctcggcgtacataaaatgg

SEQ ID NO: 336728 - DNA, 75 bp, Artificial Sequence
  Synthetic
agaaaggaccctttggagggggactaagcagcatgagatttaacatgagaatactatatgatcaatttaaaagac

SEQ ID NO: 336729 - DNA, 75 bp, Artificial Sequence
  Synthetic
aagcagcatgagatttaacatgagaatactatatgatcaatttaaaagacaccttaacttctggacacacacaaa

SEQ ID NO: 336730 - DNA, 75 bp, Artificial Sequence
  Synthetic
aaatggcggacaagttcttccgggttaaaggtcgccgccacgtcacacgtcacgtggggaggcttggtgtataac

SEQ ID NO: 336731 - DNA, 75 bp, Artificial Sequence
  Synthetic
atactatatgatcaatttaaaagacaccttaacttctggacacacacaaaccaggacctagacctagttagatac

SEQ ID NO: 336732 - DNA, 75 bp, Artificial Sequence
  Synthetic
taaaggtcgccgccacgtcacacgtcacgtggggaggcttggtgtataacccggaagccaatcctctcacttggc

SEQ ID NO: 336733 - DNA, 75 bp, Artificial Sequence
  Synthetic
gacacccagaggtggacttcatagtaaaattcaacagaaaacctccattcctagacacaatagtatcaggtccag

SEQ ID NO: 336734 - DNA, 75 bp, Artificial Sequence
  Synthetic
ccgccattttgttttacaaaatggccggactccttcctctttttttaaaattaacggtccagcggcggcgcgcgc

SEQ ID NO: 336735 - DNA, 75 bp, Artificial Sequence
  Synthetic
gctgcgcgcgcgcgccggggggggtccccccccccccggggagggggggggcccccccccctgggggggtttgcc

SEQ ID NO: 336736 - DNA, 75 bp, Artificial Sequence
  Synthetic
aacaaaacacaaaatactagtaaaaagctttaaaacaaaacccaaaggaaaaggcacagtaaaggtgcgcattcg

SEQ ID NO: 336737 - DNA, 75 bp, Artificial Sequence
  Synthetic
agctttaaaacaaaacccaaaggaaaaggcacagtaaaggtgcgcattcgcccccccacactctttgacgaccgt

SEQ ID NO: 336738 - DNA, 75 bp, Artificial Sequence
  Synthetic
caagtcgttgaccgggctatgggcaaggctcttgtgggacgctcttaatatgcacctctctaaactctctagaaa

SEQ ID NO: 336739 - DNA, 75 bp, Artificial Sequence
  Synthetic
cccccccacactctttgacgaccgttggtactttcaacatgacatctgcaaaaccacactgttcaccattagcgc

SEQ ID NO: 336740 - DNA, 75 bp, Artificial Sequence
  Synthetic
aggctcttgtgggacgctcttaatatgcacctctctaaactctctagaaaacgaaaggagaggtcgctgctactg

SEQ ID NO: 336741 - DNA, 75 bp, Artificial Sequence
  Synthetic
aaaccacactgttcaccattagcgcaacaccatgtgacctgcggtttccgttctgctcaccacaaactgacaacc

SEQ ID NO: 336742 - DNA, 75 bp, Artificial Sequence
  Synthetic
tgtcaaggggcaattcgggctcgtacaagtcgttgaccgggctatgggcaaggctcttgtgggacgctcttaata

SEQ ID NO: 336743 - DNA, 75 bp, Artificial Sequence
  Synthetic
ctatgagcctttggagaccgcccgcacacgatgtcacggggctggagagaaactggtatgagtcctgtttccgca

SEQ ID NO: 336744 - DNA, 75 bp, Artificial Sequence
  Synthetic
ttctgctcaccacaaactgacaacccttgcgtcaacttcctagttcttgcaggagtgtataacggcaaacttagc

SEQ ID NO: 336745 - DNA, 75 bp, Artificial Sequence
  Synthetic
acacgatgtcacggggctggagagaaactggtatgagtcctgtttccgcagccacgctgctatgtgtggttgtgg

SEQ ID NO: 336746 - DNA, 75 bp, Artificial Sequence
  Synthetic
atagaagccacaaagttagaatcacaatataattcactagtttcatctatagaaatacccacccaaggcactcta

SEQ ID NO: 336747 - DNA, 75 bp, Artificial Sequence
  Synthetic
aatataattcactagtttcatctatagaaatacccacccaaggcactctatttaatacatttaaaacaccagaaa

SEQ ID NO: 336748 - DNA, 75 bp, Artificial Sequence
  Synthetic
ctggcatctcgttttggacgtcctccaaacccccgacccccgggagcgccgcaaccgcctccaataaggccgcta

SEQ ID NO: 336749 - DNA, 75 bp, Artificial Sequence
  Synthetic
caaacccccgacccccgggagcgccgcaaccgcctccaataaggccgctaccggcgctgccggcccctgagggtc

SEQ ID NO: 336750 - DNA, 75 bp, Artificial Sequence
  Synthetic
tggtggaggagacgccgaagggcgcggtggaggagacgcgccgcggcgcggagatggcgacggaggagacctcgc

SEQ ID NO: 336751 - DNA, 75 bp, Artificial Sequence
  Synthetic
ggtggaggagacgcgccgcggcgcggagatggcgacggaggagacctcgcagacgccgagctgctcgccgcgctg

SEQ ID NO: 336752 - DNA, 75 bp, Artificial Sequence
  Synthetic
gaaaacacagacaagttgtgggaagcaagaggcaaccaaacaatgactggtagcaaatacctaaactacagaaca

SEQ ID NO: 336753 - DNA, 75 bp, Artificial Sequence
  Synthetic
tagcaaatacctaaactacagaacaggaatatacagtgccatattcctttcagcaggcagactgtcaccagactt

SEQ ID NO: 336754 - DNA, 75 bp, Artificial Sequence
  Synthetic
cagggggcggtggcggagggcacacagacgatggagacgcagacgggggagacgcagacataagagaaaactaat

SEQ ID NO: 336755 - DNA, 75 bp, Artificial Sequence
  Synthetic
ggaatatacagtgccatattcctttcagcaggcagactgtcaccagactttgggggactatacaatgacatagta

SEQ ID NO: 336756 - DNA, 75 bp, Artificial Sequence
  Synthetic
agacgatggagacgcagacgggggagacgcagacataagagaaaactaattataagacagtggcagcccccgtac

SEQ ID NO: 336757 - DNA, 75 bp, Artificial Sequence
  Synthetic
tacaatcccaccacagacgaaggcataggaaacattgtgtggatagactggtgtacaaaagcagactgcaacttc

SEQ ID NO: 336758 - DNA, 75 bp, Artificial Sequence
  Synthetic
taggaaacattgtgtggatagactggtgtacaaaagcagactgcaacttcaatgagacacagtccaaaggagtaa

SEQ ID NO: 336759 - DNA, 75 bp, Artificial Sequence
  Synthetic
acctcccgctgatcatgtgcggagaaaactgtttctctaaaaacttcgccacccactcggacgacatagactgca

SEQ ID NO: 336760 - DNA, 75 bp, Artificial Sequence
  Synthetic
aaactgtttctctaaaaacttcgccacccactcggacgacatagactgcagcgtagcctacgggggaggtatgac

SEQ ID NO: 336761 - DNA, 75 bp, Artificial Sequence
  Synthetic
taaaagacattccactgtgggcagcactgtttggctatgtagactttctaaaaaagacatttaaagacgaacagc

SEQ ID NO: 336762 - DNA, 75 bp, Artificial Sequence
  Synthetic
tagacaaaattgccagactcactctcataagcccctatacaaagcctcaactaataggacctacacaacccaaca

SEQ ID NO: 336763 - DNA, 75 bp, Artificial Sequence
  Synthetic
ctgtacgacgaattccagagacacctaaactactggactgcctctaacaacgacctagacctagccagatacctg

SEQ ID NO: 336764 - DNA, 75 bp, Artificial Sequence
  Synthetic
taaactactggactgcctctaacaacgacctagacctagccagatacctgggtgccaccataacctttttcagac

SEQ ID NO: 336765 - DNA, 75 bp, Artificial Sequence
  Synthetic
aagggtttgttccgtacgactacaactttggcagagcacacatgccctccggagaatcctacatacctatgtact

SEQ ID NO: 336766 - DNA, 75 bp, Artificial Sequence
  Synthetic
aatacacaccagtcctcccttcagagacacagagatgacgggacctagcatacaccccgggatgctaatgctaaa

SEQ ID NO: 336767 - DNA, 75 bp, Artificial Sequence
  Synthetic
gacacagagatgacgggacctagcatacaccccgggatgctaatgctaaagaagcacagactgctcatacctagc

SEQ ID NO: 336768 - DNA, 75 bp, Artificial Sequence
  Synthetic
atttcaccaacaaaagtttatagacgacattgtaagcagcgggcccttcgcataccacggctcacagccctcagc

SEQ ID NO: 336769 - DNA, 75 bp, Artificial Sequence
  Synthetic
cataccacggctcacagccctcagcaactctcaccactaaatacaaattccactttctctttgggggcaaccccg

SEQ ID NO: 336770 - DNA, 75 bp, Artificial Sequence
  Synthetic
acagaatcacagtcagaataggagcccctaaaacctttgaggacaagtggtacccccaaacggacctgtgcgacg

SEQ ID NO: 336771 - DNA, 75 bp, Artificial Sequence
  Synthetic
ccctaaaacctttgaggacaagtggtacccccaaacggacctgtgcgacgttatacttgtggttatttatgcaac

SEQ ID NO: 336772 - DNA, 75 bp, Artificial Sequence
  Synthetic
ttgtaaccaaccagtctttgacattcccggagccggtggactccctcgtccgatacaagtcgttgacccgaaata

SEQ ID NO: 336773 - DNA, 75 bp, Artificial Sequence
  Synthetic
cccggagccggtggactccctcgtccgatacaagtcgttgacccgaaatacgtcaacgaaggctacacgttccac

SEQ ID NO: 336774 - DNA, 75 bp, Artificial Sequence
  Synthetic
ggctcaccactaacgaacactcattgtgtaaacttccaagttttaggaagtgactataacgacattcttagcata

SEQ ID NO: 336775 - DNA, 75 bp, Artificial Sequence
  Synthetic
gtgtaaacttccaagttttaggaagtgactataacgacattcttagcatactcccagacaaacttaagtcgaaag

SEQ ID NO: 336776 - DNA, 75 bp, Artificial Sequence
  Synthetic
ttggccaagcagctattaaaagagtgtcgggagaacaaacaaatgcttcactttattcatcaggtccaaaacggc

SEQ ID NO: 336777 - DNA, 75 bp, Artificial Sequence
  Synthetic
aaacatagcatactacaacacaaaacaaacaatagctcacttaaaaattacagacaactgtaaaaacacgcaaac

SEQ ID NO: 336778 - DNA, 75 bp, Artificial Sequence
  Synthetic
caagaacagaaattcctccacaaaatgcagaagaaggctcatattccagggaacaaaaactccagccctggctcg

SEQ ID NO: 336779 - DNA, 75 bp, Artificial Sequence
  Synthetic
caaacaatagctcacttaaaaattacagacaactgtaaaaacacgcaaacagatataactaacacaaaacacaat

SEQ ID NO: 336780 - DNA, 75 bp, Artificial Sequence
  Synthetic
gaacaaaaactccagccctggctcgactcgagcgaccaggaagagagcgagacagaagccccagaagaagaagcg

SEQ ID NO: 336781 - DNA, 75 bp, Artificial Sequence
  Synthetic
acgtcgacgaaattaaccaggtaagaaaagacacaggagataagtttataaaagctacaagtttggctctcagta

SEQ ID NO: 336782 - DNA, 75 bp, Artificial Sequence
  Synthetic
gacagaagccccagaagaagaagcgacctcgccaccgtcgctacagctccagctcaagcagcagatcagggagca

SEQ ID NO: 336783 - DNA, 75 bp, Artificial Sequence
  Synthetic
aaaagacacaggagataagtttataaaagctacaagtttggctctcagtaactcctgggtaaaaccaactactaa

SEQ ID NO: 336784 - DNA, 75 bp, Artificial Sequence
  Synthetic
tacagctccatattcctatcatcaggcagaagcaatccagaacttaaaggcccatacacagacgtgtgttacaac

SEQ ID NO: 336785 - DNA, 75 bp, Artificial Sequence
  Synthetic
gcagaagcaatccagaacttaaaggcccatacacagacgtgtgttacaacccactggtagacaaaggcattggaa

SEQ ID NO: 336786 - DNA, 75 bp, Artificial Sequence
  Synthetic
atctgttcccagaacgcttaccacccatgtggaccaagcaagattgggaaacagaatatcaagtcgcggcggcct

SEQ ID NO: 336787 - DNA, 75 bp, Artificial Sequence
  Synthetic
acagaatatcaagtcgcggcggccttcaacaggcctgcgcgaacaaacctaaatgatactcctttttacccttac

SEQ ID NO: 336788 - DNA, 75 bp, Artificial Sequence
  Synthetic
caaagaggactccaaattcgatgaaacaaaaagcaaagtacccataagagacatgccactgtgggcagctctgtt

SEQ ID NO: 336789 - DNA, 75 bp, Artificial Sequence
  Synthetic
acaaaaagcaaagtacccataagagacatgccactgtgggcagctctgtttggatacgcagaatatgcatctaag

SEQ ID NO: 336790 - DNA, 75 bp, Artificial Sequence
  Synthetic
tgtcctttaagctaggatttaaaccctaataaaattaccaggccgtgggagtttcacttgtcggtgtctacctct

SEQ ID NO: 336791 - DNA, 75 bp, Artificial Sequence
  Synthetic
ccaacgctagactgacactaatatgcccctacaccgaccccatgttattcaaaccccaggatccaaagttcggat

SEQ ID NO: 336792 - DNA, 75 bp, Artificial Sequence
  Synthetic
cccctacaccgaccccatgttattcaaaccccaggatccaaagttcggattcgtaccatacagcctgaactttgg

SEQ ID NO: 336793 - DNA, 75 bp, Artificial Sequence
  Synthetic
ggggcaactccctcgaagtccggcgctacgcgcttcgcgctgcgccggacatctcggaccccccctccacccgaa

SEQ ID NO: 336794 - DNA, 75 bp, Artificial Sequence
  Synthetic
acctacgtgcccataaggcagagggccaagtggtacgcatgtctgtaccaccagcaagaggtaatagaggccatc

SEQ ID NO: 336795 - DNA, 75 bp, Artificial Sequence
  Synthetic
ccaagtggtacgcatgtctgtaccaccagcaagaggtaatagaggccatcacacagtcaggaccgtttgcatacc

SEQ ID NO: 336796 - DNA, 75 bp, Artificial Sequence
  Synthetic
cgtcgggggggtcgggggctttattaaacagactccgagatgccattggacactgaggggacatacagcaacgaa

SEQ ID NO: 336797 - DNA, 75 bp, Artificial Sequence
  Synthetic
aggggtaaaatacaaatttaagtggatctggggcggctctcctatacctcaccaggtggtcagaaacccctgccg

SEQ ID NO: 336798 - DNA, 75 bp, Artificial Sequence
  Synthetic
atctggggcggctctcctatacctcaccaggtggtcagaaacccctgccgagagacgcactccagcacccagggc

SEQ ID NO: 336799 - DNA, 75 bp, Artificial Sequence
  Synthetic
actaccaaaatggcgcattccgtgacgtcatggccgccattttaagtaagcaccgcctaggaatgacgtataagt

SEQ ID NO: 336800 - DNA, 75 bp, Artificial Sequence
  Synthetic
tcgtgacccggaaatacaacacaccagaattcacatggcacagttgggacaccagacgtgggctgtttggcgacg

SEQ ID NO: 336801 - DNA, 75 bp, Artificial Sequence
  Synthetic
cgtcatggccgccattttaagtaagcaccgcctaggaatgacgtataagttcaaaggtcatcctcagccggaact

SEQ ID NO: 336802 - DNA, 75 bp, Artificial Sequence
  Synthetic
agaattcacatggcacagttgggacaccagacgtgggctgtttggcgacggagctttacaaagaatgctgcaaca

SEQ ID NO: 336803 - DNA, 75 bp, Artificial Sequence
  Synthetic
ccgggtcaaaggacacacctacgtcatatgtcacgtggggaggccctactgcgcaaacgcggaagtaggccccgt

SEQ ID NO: 336804 - DNA, 75 bp, Artificial Sequence
  Synthetic
acagcatcaaagaagcggccaaagagggacacactcgcggaaggacaccaagaagagccagaagacgtctcagac

SEQ ID NO: 336805 - DNA, 75 bp, Artificial Sequence
  Synthetic
gggacacactcgcggaaggacaccaagaagagccagaagacgtctcagacttcaagcgactccgactccagctac

SEQ ID NO: 336806 - DNA, 75 bp, Artificial Sequence
  Synthetic
agggggcgcaagcgcccccccccgcgcatgcgcggggccccccccccggggggctctgccccccggccccccccg

SEQ ID NO: 336807 - DNA, 75 bp, Artificial Sequence
  Synthetic
gccattttgtaaaacaaaatggccgacttccttcctcttttttaacaaaaaagcggaagtaccccgcagcggcgg

SEQ ID NO: 336808 - DNA, 75 bp, Artificial Sequence
  Synthetic
tcaagaagagaaaaaagcgagagagagcaaagcccaggaagaagaagccaaaacgctggagcagcaactcgagca

SEQ ID NO: 336809 - DNA, 75 bp, Artificial Sequence
  Synthetic
attttgtgcagcccgccaatttctgttcaaacagaccaatcaggaccttctacgtgcacttcctggggcgtgtct

SEQ ID NO: 336810 - DNA, 75 bp, Artificial Sequence
  Synthetic
agcaaagcccaggaagaagaagccaaaacgctggagcagcaactcgagcagcagcgcctcctcggattccaactc

SEQ ID NO: 336811 - DNA, 75 bp, Artificial Sequence
  Synthetic
acgaggtctatataagcaacagcggtgacgaatggtagagtttttcttcgcccgtccgcggcgagagcgcgagcg

SEQ ID NO: 336812 - DNA, 75 bp, Artificial Sequence
  Synthetic
aagtccaaaaagggcacgccatacccccccaggccctggtacagtaggtaaattaggattcagcacctataacct

SEQ ID NO: 336813 - DNA, 75 bp, Artificial Sequence
  Synthetic
cccccaggccctggtacagtaggtaaattaggattcagcacctataacctgtccactccctttgacatgtttggt

SEQ ID NO: 336814 - DNA, 75 bp, Artificial Sequence
  Synthetic
gcgggtgccgtaggtgagtttacacaccgaagtcaaggggcaattcgggcacgggactggccgggctatgggcaa

SEQ ID NO: 336815 - DNA, 75 bp, Artificial Sequence
  Synthetic
gcagcgactgggaaacagagtaccagacctgcaaggcttttgacagaccacccagaccaaacccgctagagccca

SEQ ID NO: 336816 - DNA, 75 bp, Artificial Sequence
  Synthetic
accgaagtcaaggggcaattcgggcacgggactggccgggctatgggcaaggctcttaaaaaattcccccgctct

SEQ ID NO: 336817 - DNA, 75 bp, Artificial Sequence
  Synthetic
gacctgcaaggcttttgacagaccacccagaccaaacccgctagagcccagcatccccttctatccctacatccc

SEQ ID NO: 336818 - DNA, 75 bp, Artificial Sequence
  Synthetic
gccgtggagaccgccggtccataacgtgccaggtagagagaatcaatggtttgcagcgttctttcacggtcatgc

SEQ ID NO: 336819 - DNA, 75 bp, Artificial Sequence
  Synthetic
ctaaaattcaaataaaagtctctgtacaaggccgtgggagtttcactggtcggtgtctacctctataagtcgcca

SEQ ID NO: 336820 - DNA, 75 bp, Artificial Sequence
  Synthetic
acaaggccgtgggagtttcactggtcggtgtctacctctataagtcgccaagcactccgagcgtcagcgaggagt

SEQ ID NO: 336821 - DNA, 75 bp, Artificial Sequence
  Synthetic
tgctttctgcgggtgtggtgaccctgttgggcatcttaacggcattgctcctcgctttcctaacgccggtccacc

SEQ ID NO: 336822 - DNA, 75 bp, Artificial Sequence
  Synthetic
ctcgctttcctaacgccggtccaccgagaccacctccagggctagaccagcttaatcccgagggcccggcaggtc

SEQ ID NO: 336823 - DNA, 75 bp, Artificial Sequence
  Synthetic
cttaatcccgagggcccggcaggtcccggagggccccccgccatcttgccagctctgccggccccggcagaccct

SEQ ID NO: 336824 - DNA, 75 bp, Artificial Sequence
  Synthetic
agctctgccggccccggcagaccctgaaccggcaccacggcgtggtggtggggcagatggaggcgccgccgctgg

SEQ ID NO: 336825 - DNA, 75 bp, Artificial Sequence
  Synthetic
gggaactttactaaacagactccgaggtgccattggacactgagggggcgtacagcaacgaaagtgagtggggcc

SEQ ID NO: 336826 - DNA, 75 bp, Artificial Sequence
  Synthetic
gggcagatggaggcgccgccgctggggccgccgccgacgcagaccataccgggtacgaagaaggagacctagaag

SEQ ID NO: 336827 - DNA, 75 bp, Artificial Sequence
  Synthetic
ggtgccattggacactgagggggcgtacagcaacgaaagtgagtggggccagacttctccgtagggcctttatct

SEQ ID NO: 336828 - DNA, 75 bp, Artificial Sequence
  Synthetic
cgatatgtgagtaggcggaggcgccgccgctactacaggcgcagactgagacggggcagacgcagagggcgacga

SEQ ID NO: 336829 - DNA, 75 bp, Artificial Sequence
  Synthetic
ggtatcgtagccaacgcggaccccgttttcggggcccccgcggggctctcggcgcgttttaatgacgtcacggac

SEQ ID NO: 336830 - DNA, 75 bp, Artificial Sequence
  Synthetic
tcccggcttccgtactacgtcaggcggggcgtggccgtattagaaaatggtggccattttcttccgggaaaaagg

SEQ ID NO: 336831 - DNA, 75 bp, Artificial Sequence
  Synthetic
ggcggggcgtggccgtattagaaaatggtggccattttcttccgggaaaaaggtcgcagctacgtcactaaccac

SEQ ID NO: 336832 - DNA, 75 bp, Artificial Sequence
  Synthetic
atgcctcttataatctgtggctctggaagcacacagatgaactttataactcacatggacgatactccccctatg

SEQ ID NO: 336833 - DNA, 75 bp, Artificial Sequence
  Synthetic
cttagagttttcattcttaatatgtttctcggcagagtttaccgccacaagaaaaggaaagtgctactgtcccca

SEQ ID NO: 336834 - DNA, 75 bp, Artificial Sequence
  Synthetic
tcacatggacgatactccccctatgggatacacctacgggggcaactttgtaaatgtaactttcagtctagaggc

SEQ ID NO: 336835 - DNA, 75 bp, Artificial Sequence
  Synthetic
ttctcggcagagtttaccgccacaagaaaaggaaagtgctactgtccccactgcgagcttcacaggcgtctcgga

SEQ ID NO: 336836 - DNA, 75 bp, Artificial Sequence
  Synthetic
gactggccgggctatgggcaaggctcttagagttttcattcttaatatgtttctcggcagagtttaccgccacaa

SEQ ID NO: 336837 - DNA, 75 bp, Artificial Sequence
  Synthetic
catctatgaacaattcctgtaccacagaaacaggtggtccaggtctaaccatgacttagacctggccagatacca

SEQ ID NO: 336838 - DNA, 75 bp, Artificial Sequence
  Synthetic
acacgatgcacccggcatcgagcacaattggtaccaggcctgtttcagagcccacgctggagcttgtggctgtag

SEQ ID NO: 336839 - DNA, 75 bp, Artificial Sequence
  Synthetic
gctacaacagaacaggcccctttactataagtgaaatgacttacatgagcacacacccggctctcatgctactac

SEQ ID NO: 336840 - DNA, 75 bp, Artificial Sequence
  Synthetic
tataagtgaaatgacttacatgagcacacacccggctctcatgctactacaaaaacatagaatagttgtacccag

SEQ ID NO: 336841 - DNA, 75 bp, Artificial Sequence
  Synthetic
agagccataaaaattagaataagggccccaaaactaatgctcaccaagtggtactttacaaaagacatttgctcc

SEQ ID NO: 336842 - DNA, 75 bp, Artificial Sequence
  Synthetic
ccccaaaactaatgctcaccaagtggtactttacaaaagacatttgctccatgggcctctttcaactaatggcaa

SEQ ID NO: 336843 - DNA, 75 bp, Artificial Sequence
  Synthetic
cagctgcagaacttacaaacccatggctcagagacaccacaaaaagcccagtaattggcttcagagtcttaaaaa

SEQ ID NO: 336844 - DNA, 75 bp, Artificial Sequence
  Synthetic
gctcagagacaccacaaaaagcccagtaattggcttcagagtcttaaaaaacagcttatacacatgcctttccaa

SEQ ID NO: 336845 - DNA, 75 bp, Artificial Sequence
  Synthetic
agtaagaaccaggcgaaggcggtgggggcgcagacggtacagacggggctggagacgcagaacttatgtgagaaa

SEQ ID NO: 336846 - DNA, 75 bp, Artificial Sequence
  Synthetic
gggcgcagacggtacagacggggctggagacgcagaacttatgtgagaaaggggcgacatagaaaaaagaaaaag

SEQ ID NO: 336847 - DNA, 75 bp, Artificial Sequence
  Synthetic
cttaaaagaccaagcaatacaaggtgaaagaaagactgtacaaaatagattacacccagaaaacctacatggcac

SEQ ID NO: 336848 - DNA, 75 bp, Artificial Sequence
  Synthetic
gaaagaaagactgtacaaaatagattacacccagaaaacctacatggcacaggacctaatgctaaaggctgggaa

SEQ ID NO: 336849 - DNA, 75 bp, Artificial Sequence
  Synthetic
tacacccagaaaacctacatggcacaggacctaatgctaaaggctgggaatacacatacacaaaactaatggcat

SEQ ID NO: 336850 - DNA, 75 bp, Artificial Sequence
  Synthetic
cagcacctacaactggcaaaactatcaaactaactatgcaaacacatatacaaaatttaaagaaaaaagaacagc

SEQ ID NO: 336851 - DNA, 75 bp, Artificial Sequence
  Synthetic
ggggccctcagcactacctccttctccctaaaagtgttgtatgaccagcaccagaggggactaaacaagtggtct

SEQ ID NO: 336852 - DNA, 75 bp, Artificial Sequence
  Synthetic
aaacttaaacttaattaaagcagaatacctatatcattaccctaacaatgtcacacaatctgactttatattaga

SEQ ID NO: 336853 - DNA, 75 bp, Artificial Sequence
  Synthetic
ccagaggggactaaacaagtggtcttttcccaacgaccaactagacctcgccagatacaggggctgcaaattcta

SEQ ID NO: 336854 - DNA, 75 bp, Artificial Sequence
  Synthetic
atatacagcccctactacctaacacccaccagaattagcctagactgggacacaccatggacatatgtaagatac

SEQ ID NO: 336855 - DNA, 75 bp, Artificial Sequence
  Synthetic
cacaccatggacatatgtaagatacaacccactatcagacaaaggcataggtaacagaatatatgcacagtggtg

SEQ ID NO: 336856 - DNA, 75 bp, Artificial Sequence
  Synthetic
accacaaagagcaagtgcatactaagagacttcccactgtgggccatggcctatggctactgtgactgggtggtg

SEQ ID NO: 336857 - DNA, 75 bp, Artificial Sequence
  Synthetic
caataggcttttccgcttccattgatgcccaaatgtcagtattaaatacattatacacacaaaacgcatactggg

SEQ ID NO: 336858 - DNA, 75 bp, Artificial Sequence
  Synthetic
caacggagacatgccgtttcttgcaccatacatacctattacatggtggattaagtggtaccccatgattacaca

SEQ ID NO: 336859 - DNA, 75 bp, Artificial Sequence
  Synthetic
tgcccaaatgtcagtattaaatacattatacacacaaaacgcatactgggaatctaacctaactccttactatgt

SEQ ID NO: 336860 - DNA, 75 bp, Artificial Sequence
  Synthetic
ttaagtggtaccccatgattacacaccaaaaggaagttcttgaggcaatagttaactgtggaccgtttgtacccc

SEQ ID NO: 336861 - DNA, 75 bp, Artificial Sequence
  Synthetic
acaacaacaaacttaataggtagtcagccaactaaatctacctttgtatgtaataaaagcacaaactacaactgg

SEQ ID NO: 336862 - DNA, 75 bp, Artificial Sequence
  Synthetic
agccaactaaatctacctttgtatgtaataaaagcacaaactacaactggtacacctacaaagcaagtgcagtaa

SEQ ID NO: 336863 - DNA, 75 bp, Artificial Sequence
  Synthetic
ataaccatgggttacaaaatggattggaaatggggcggctctcccctgccttcacaggcaatcgacgacccctgc

SEQ ID NO: 336864 - DNA, 75 bp, Artificial Sequence
  Synthetic
ggaaatggggcggctctcccctgccttcacaggcaatcgacgacccctgccagaagtccacccacgaacttcccg

SEQ ID NO: 336865 - DNA, 75 bp, Artificial Sequence
  Synthetic
agcatactttaatcagttaaccagtgaaggaccacaaaacacaaacagcacagacggctatgcatcacagtggac

SEQ ID NO: 336866 - DNA, 75 bp, Artificial Sequence
  Synthetic
gaaggaccacaaaacacaaacagcacagacggctatgcatcacagtggaccactcccacaacagacagttatgaa

SEQ ID NO: 336867 - DNA, 75 bp, Artificial Sequence
  Synthetic
acaagtctctgacccgacaaagctcggaccgaagacagtttttcacaaatgggactggagacgtgggatgcttag

SEQ ID NO: 336868 - DNA, 75 bp, Artificial Sequence
  Synthetic
ggaccgaagacagtttttcacaaatgggactggagacgtgggatgcttagcaaaagaagtattaaaagagtccaa

SEQ ID NO: 336869 - DNA, 75 bp, Artificial Sequence
  Synthetic
tatttctagccccagacagacctgtgccccgctttccctgcgcctaccaagatgttacttacaacccactaatgg

SEQ ID NO: 336870 - DNA, 75 bp, Artificial Sequence
  Synthetic
gccccgctttccctgcgcctaccaagatgttacttacaacccactaatggacaaaggggtgggcaaccacgtatg

SEQ ID NO: 336871 - DNA, 75 bp, Artificial Sequence
  Synthetic
aaacaagttcgatactcgagtccaaggccctccaaccccagaaaaagaaagttacactttactccaagccctcca

SEQ ID NO: 336872 - DNA, 75 bp, Artificial Sequence
  Synthetic
ggccctccaaccccagaaaaagaaagttacactttactccaagccctccaagagtcggggcaagagagcagctca

SEQ ID NO: 336873 - DNA, 75 bp, Artificial Sequence
  Synthetic
acacaactaatagttgcaggagggtcctgcaaagcacacatagaaaacatacccctgtgggcagccttctatggc

SEQ ID NO: 336874 - DNA, 75 bp, Artificial Sequence
  Synthetic
agagtcggggcaagagagcagctcagaggaccaagaacaagcaccccaagaaaaagaggaccagaaggaagcgct

SEQ ID NO: 336875 - DNA, 75 bp, Artificial Sequence
  Synthetic
cctgcaaagcacacatagaaaacatacccctgtgggcagccttctatggctacagtgacttcatagagtcagaac

SEQ ID NO: 336876 - DNA, 75 bp, Artificial Sequence
  Synthetic
caccaccagcgagtcctcaagcgaggcctcaaactcctcctcggagacgtgctccgactccggagaggagtccac

SEQ ID NO: 336877 - DNA, 75 bp, Artificial Sequence
  Synthetic
ggtaggcctaatttgtgtcatctgcccttacacaaaaccccccatgtacaacaagacaaatcccgccatggggta

SEQ ID NO: 336878 - DNA, 75 bp, Artificial Sequence
  Synthetic
gctccgactccggagaggagtccactgggaccccctcctgtcctaattcaaggtcccagtatcccagacctgctt

SEQ ID NO: 336879 - DNA, 75 bp, Artificial Sequence
  Synthetic
ccttacacaaaaccccccatgtacaacaagacaaatcccgccatggggtacgtgttttatgacagaaactttggt

SEQ ID NO: 336880 - DNA, 75 bp, Artificial Sequence
  Synthetic
gtaaaatagagccctactggcaagtcaggtggaggccagaaatgctttttcaagagactgtaatggcagacatag

SEQ ID NO: 336881 - DNA, 75 bp, Artificial Sequence
  Synthetic
gattttccaactacgactgggtgtgcgagtacgagctggccaaatggatggatcggcccttgcggcactacccat

SEQ ID NO: 336882 - DNA, 75 bp, Artificial Sequence
  Synthetic
cgagtacgagctggccaaatggatggatcggcccttgcggcactacccatcagacccccctcactacccctggct

SEQ ID NO: 336883 - DNA, 75 bp, Artificial Sequence
  Synthetic
acatgtagagtaagtttcaaattaaagctcaatgactaaaattcaaggccgtgggtgtttcacttcatcggtgtc

SEQ ID NO: 336884 - DNA, 75 bp, Artificial Sequence
  Synthetic
tacctctaaaagtcactaagcactccgagcgtaagcgaggagtgcgacccccctgcccggtagcaacttcctcgg

SEQ ID NO: 336885 - DNA, 75 bp, Artificial Sequence
  Synthetic
caacgaaagtgagtggggccaaacttcgccataaggcctttaactttgggtcgcttgtcagcagcttccgggtcc

SEQ ID NO: 336886 - DNA, 75 bp, Artificial Sequence
  Synthetic
gggacaggcctcccagatacaacctatcctctcctcctttctaccccaggtgcccttctacattctctgtaaaat

SEQ ID NO: 336887 - DNA, 75 bp, Artificial Sequence
  Synthetic
cccgcgcatgtgcgggtcccccccctcggggggggctccgcccccccggcccccccccgggctaaatacaccgcg

SEQ ID NO: 336888 - DNA, 75 bp, Artificial Sequence
  Synthetic
caccagggggcgctacgcgcccccccccgcgcatgtgcgggtcccccccctcggggggggctccgcccccccggc

SEQ ID NO: 336889 - DNA, 75 bp, Artificial Sequence
  Synthetic
tcggggggggctccgcccccccggcccccccccgggctaaatacaccgcgcatgcgcggccacgcccccgccgcc

SEQ ID NO: 336890 - DNA, 75 bp, Artificial Sequence
  Synthetic
aacttcactgtacaaagccgtgggagtttcactggtcggtgtctacctctaaaggtcactaagcactccgagcgt

SEQ ID NO: 336891 - DNA, 75 bp, Artificial Sequence
  Synthetic
attttgctacgtcactaaccacgtgacccctcccacccaaccagagtctacttcttgcacttcctgggaggagtc

SEQ ID NO: 336892 - DNA, 75 bp, Artificial Sequence
  Synthetic
gcagtcaaggggcaattcgggctcgggactggccgggctatgggcaagactctgaaaaatgcatttttatcggca

SEQ ID NO: 336893 - DNA, 75 bp, Artificial Sequence
  Synthetic
ataaggcctttatcttcttgccattggatagtgtcgggggttgccataggcttcgacctcagttttaggccttcc

SEQ ID NO: 336894 - DNA, 75 bp, Artificial Sequence
  Synthetic
gtcactgtgtgcagtgcgagcaacacagaaggcttgcaaacttctaaaagttatgtggagccctccccgcaacga

SEQ ID NO: 336895 - DNA, 75 bp, Artificial Sequence
  Synthetic
cagaaggcttgcaaacttctaaaagttatgtggagccctccccgcaacgatgaacattaccttaagggacaatgg

SEQ ID NO: 336896 - DNA, 75 bp, Artificial Sequence
  Synthetic
aggcggaagcagctcggcgtacacaaaatggcggcggagcacttccggcttgcccaaaatggcgggcaagctctt

SEQ ID NO: 336897 - DNA, 75 bp, Artificial Sequence
  Synthetic
ctgctttctgtggctgccccgatgctgtcgctcacttcaatcatcttgctactgtacttcgtgctccggaaaacc

SEQ ID NO: 336898 - DNA, 75 bp, Artificial Sequence
  Synthetic
tgtcgctcacttcaatcatcttgctactgtacttcgtgctccggaaaacccgggaccccccgggggacatcgacc

SEQ ID NO: 336899 - DNA, 75 bp, Artificial Sequence
  Synthetic
acaagtcacgtgggaggcttggcgtataacccggaagtcaatactctgacgtggcctgtcacgtgactgctacgt

SEQ ID NO: 336900 - DNA, 75 bp, Artificial Sequence
  Synthetic
ctcccggctgctcccgaggcgcccggtgatcgagcgccatggcctatgggttgtggaggagacggcgaaggaggt

SEQ ID NO: 336901 - DNA, 75 bp, Artificial Sequence
  Synthetic
cacgaccgccatattgttttacaaaatggctgacttccttcctcttttttaaaaataacggtccagcggcggcgc

SEQ ID NO: 336902 - DNA, 75 bp, Artificial Sequence
  Synthetic
gtgatcgagcgccatggcctatgggttgtggaggagacggcgaaggaggtggaagaggtggagacgcagacggtg

SEQ ID NO: 336903 - DNA, 75 bp, Artificial Sequence
  Synthetic
cgcagacctgctggacgccgtagacgccgcagaacagtaaggagacggcgcaggcgcgggaggtggaggaggaga

SEQ ID NO: 336904 - DNA, 75 bp, Artificial Sequence
  Synthetic
aagtccgtcactaaccacgtgactcctctcgcccaatcagacagtatatcgtgcatttcctgggcatggtctata

SEQ ID NO: 336905 - DNA, 75 bp, Artificial Sequence
  Synthetic
gacgcaggaaaaagaaaaaactcataataagacaatggcagccaaactataccagaaagtgcaacattgtgggtt

SEQ ID NO: 336906 - DNA, 75 bp, Artificial Sequence
  Synthetic
cccgaagtccgccactaaccacgtgactcccgcaggccaacccagtactatgtcgtccacttcctgggacgagtc

SEQ ID NO: 336907 - DNA, 75 bp, Artificial Sequence
  Synthetic
actcccgcaggccaacccagtactatgtcgtccacttcctgggacgagtctacgtcctgatataagtaagtgcac

SEQ ID NO: 336908 - DNA, 75 bp, Artificial Sequence
  Synthetic
tgtcgtccacttcctgggacgagtctacgtcctgatataagtaagtgcacttccgaatggctgagttttccacgc

SEQ ID NO: 336909 - DNA, 75 bp, Artificial Sequence
  Synthetic
actatattaaaataagagtaggggcaccaaaaatgttcactgataaatggtacccccaaacagatctttgtgaca

SEQ ID NO: 336910 - DNA, 75 bp, Artificial Sequence
  Synthetic
ggctacccactaactgactctgtggttgtgaacttccaggttctgcaatccatgtatgataaatacattagcata

SEQ ID NO: 336911 - DNA, 75 bp, Artificial Sequence
  Synthetic
agtcactacttagtaacatagcaaattacattcccttttataataccacacaaactatagcccaattaaagccat

SEQ ID NO: 336912 - DNA, 75 bp, Artificial Sequence
  Synthetic
accctcccggcccagcgccgcgaggccgcccggcgctccgccgcctcccggcactcccttcagcccccgcgaccc

SEQ ID NO: 336913 - DNA, 75 bp, Artificial Sequence
  Synthetic
tcatacataaacacaaccaaatttactacaacagccacaacaacttatacatatccaggcactacaactaacaca

SEQ ID NO: 336914 - DNA, 75 bp, Artificial Sequence
  Synthetic
cttctagagaactagcatggcctactggttcagaaggtggggctggaggccgaggcgccggtggagaaggtggcg

SEQ ID NO: 336915 - DNA, 75 bp, Artificial Sequence
  Synthetic
tggttcagaaggtggggctggaggccgaggcgccggtggagaaggtggcgccgccgtcgaaggagactaccgaga

SEQ ID NO: 336916 - DNA, 75 bp, Artificial Sequence
  Synthetic
cctggtacagaggaacagtatataacaatcaaattaaagagttaccaaaaaaagcagctgaattatactcaaaag

SEQ ID NO: 336917 - DNA, 75 bp, Artificial Sequence
  Synthetic
caatcaaattaaagagttaccaaaaaaagcagctgaattatactcaaaagcaacaaaaaccttgctaggaaacac

SEQ ID NO: 336918 - DNA, 75 bp, Artificial Sequence
  Synthetic
gccttggaagaagacgcaaaccaagggtaaggaggcgccgcagaactcgcagacgtacctacagacgggggtgga

SEQ ID NO: 336919 - DNA, 75 bp, Artificial Sequence
  Synthetic
gaataccatggaggactatacagctcaatatggctatcccctggtagatcttactttgaaacaccaggagcatac

SEQ ID NO: 336920 - DNA, 75 bp, Artificial Sequence
  Synthetic
gcgacgcaaaaagaaactcatactgactcagtggaacccggcaatagttaagaggtgcaacattaagggcggact

SEQ ID NO: 336921 - DNA, 75 bp, Artificial Sequence
  Synthetic
ttagaattctgctctaaaagcacaggagacacaaacatacacatgaatgccagactactaataagaagtcctttt

SEQ ID NO: 336922 - DNA, 75 bp, Artificial Sequence
  Synthetic
acagtgactttctctctgaaagccttgtatgaccagtacctaaaacaccaaaacaggtggactttctcaaacgac

SEQ ID NO: 336923 - DNA, 75 bp, Artificial Sequence
  Synthetic
gagacacaaacatacacatgaatgccagactactaataagaagtccttttacagacccccagctaatagcacaca

SEQ ID NO: 336924 - DNA, 75 bp, Artificial Sequence
  Synthetic
ctattccttaaactttggaaatggtaaaatgccaggaggtagcagcaatgttcccataagaatgagagctaagtg

SEQ ID NO: 336925 - DNA, 75 bp, Artificial Sequence
  Synthetic
aaaatgccaggaggtagcagcaatgttcccataagaatgagagctaagtggtaccccactttattccaccaacaa

SEQ ID NO: 336926 - DNA, 75 bp, Artificial Sequence
  Synthetic
aaacacaagataataattcccagctttcaaacaagacctgggggcagacgctttgttaaaataagacttaatccc

SEQ ID NO: 336927 - DNA, 75 bp, Artificial Sequence
  Synthetic
caggaccctttgcttatcactcagacattaaaaaagtatctctaggcataaaataccgttttaagtggatctggg

SEQ ID NO: 336928 - DNA, 75 bp, Artificial Sequence
  Synthetic
ttcaaacaagacctgggggcagacgctttgttaaaataagacttaatccccccaaactatttgaagacaagtggt

SEQ ID NO: 336929 - DNA, 75 bp, Artificial Sequence
  Synthetic
aaataccgttttaagtggatctggggtggaaaccccgttcgccaacaggttgttagaaacccctgcaaggaaccc

SEQ ID NO: 336930 - DNA, 75 bp, Artificial Sequence
  Synthetic
gaagcatacaaatcgttgacccgaaatacaactcaccggaacttaccatccatgcctgggacttcagacgtggct

SEQ ID NO: 336931 - DNA, 75 bp, Artificial Sequence
  Synthetic
atacaactcaccggaacttaccatccatgcctgggacttcagacgtggcttctttggcccgaaagctattcaaag

SEQ ID NO: 336932 - DNA, 75 bp, Artificial Sequence
  Synthetic
ccgtaaaagaccaagagtccacacaagactttgaaaattggctttataaaacagactcacactatcaaacatttg

SEQ ID NO: 336933 - DNA, 75 bp, Artificial Sequence
  Synthetic
agactttgaaaattggctttataaaacagactcacactatcaaacatttgccacagaggctcaactaggcagaat

SEQ ID NO: 336934 - DNA, 75 bp, Artificial Sequence
  Synthetic
gaatttttttcagcaggccgcaagagacccagaagggacacagaagtgtatcagtccgaccaagaaaaggagcaa

SEQ ID NO: 336935 - DNA, 75 bp, Artificial Sequence
  Synthetic
aaaaacactaaacagcagtcgtggcaagataactggagcaaaaaaaattcaccatggacaggtaactcaggtaca

SEQ ID NO: 336936 - DNA, 75 bp, Artificial Sequence
  Synthetic
aagataactggagcaaaaaaaattcaccatggacaggtaactcaggtacatacccacaaacaaccagtgaaatgt

SEQ ID NO: 336937 - DNA, 75 bp, Artificial Sequence
  Synthetic
atgggaggactcggaacaggagcaaagcgggtcgcaaagctcagaggaagagacccacaccgtctcccagcagct

SEQ ID NO: 336938 - DNA, 75 bp, Artificial Sequence
  Synthetic
cggctttcccacatacagagcccaaaaagactacattttagaaagaagacagtgcaactttaactatgaagttaa

SEQ ID NO: 336939 - DNA, 75 bp, Artificial Sequence
  Synthetic
atcctcggcgtcaagctcagagtcctgttccaccaagtccacaaaatccaacaaaatcaacatatcaaccctacc

SEQ ID NO: 336940 - DNA, 75 bp, Artificial Sequence
  Synthetic
tgttccaccaagtccacaaaatccaacaaaatcaacatatcaaccctaccttattgccaaggggtggggccctag

SEQ ID NO: 336941 - DNA, 75 bp, Artificial Sequence
  Synthetic
aaagactacattttagaaagaagacagtgcaactttaactatgaagttaataatccagttagcaaaaaagtatgg

SEQ ID NO: 336942 - DNA, 75 bp, Artificial Sequence
  Synthetic
cagtagactactatgaataccactgtggatggttcagcaacatattcataggccccaacagatacaacctacagt

SEQ ID NO: 336943 - DNA, 75 bp, Artificial Sequence
  Synthetic
aacatgtttggagaccccaagccctacaaaccttccagcaacgactggaaggaagagtacgaggctgccaaacac

SEQ ID NO: 336944 - DNA, 75 bp, Artificial Sequence
  Synthetic
acaaaccttccagcaacgactggaaggaagagtacgaggctgccaaacactgggatagacccccaaggagcaacc

SEQ ID NO: 336945 - DNA, 75 bp, Artificial Sequence
  Synthetic
tggatggttcagcaacatattcataggccccaacagatacaacctacagtttcaaacagcatatgtagacaccac

SEQ ID NO: 336946 - DNA, 75 bp, Artificial Sequence
  Synthetic
aaaggcaacaaaatatggtttcaatatctgtctaaaaagggcacagactacaatgaaaaacaatgctactgcacc

SEQ ID NO: 336947 - DNA, 75 bp, Artificial Sequence
  Synthetic
ggcccccccttcaaacccctacaaggtaaactttaagctaggcctccaataaaacaaggccgtgggcgtttcact

SEQ ID NO: 336948 - DNA, 75 bp, Artificial Sequence
  Synthetic
atctgtctaaaaagggcacagactacaatgaaaaacaatgctactgcaccctagaagacatgcccctatgggcaa

SEQ ID NO: 336949 - DNA, 75 bp, Artificial Sequence
  Synthetic
aaaacaaggccgtgggcgtttcacttgtcggtgtctgcttattaaggtaaccaagcactccgagcgaagcgagga

SEQ ID NO: 336950 - DNA, 75 bp, Artificial Sequence
  Synthetic
agagactcaactaggacccaatgtggaccatgaaacagcaggcttaataattatgatctgtccatacactcaacc

SEQ ID NO: 336951 - DNA, 75 bp, Artificial Sequence
  Synthetic
gaccatgaaacagcaggcttaataattatgatctgtccatacactcaaccacctatgtatgacaaaaacagacct

SEQ ID NO: 336952 - DNA, 75 bp, Artificial Sequence
  Synthetic
gctgcgccggacacctcagaccccccctcaacccgaaacgcttgcgcgtttcggaccacttcggcgtcgcggggg

SEQ ID NO: 336953 - DNA, 75 bp, Artificial Sequence
  Synthetic
caaactttggcaatggaaaaatgccctcaggaagtggccaagtcccagtatactggcaatgccgatggaggccca

SEQ ID NO: 336954 - DNA, 75 bp, Artificial Sequence
  Synthetic
gagttgccattggactcaggagctatgattcagtatcggaagtgagtggcgccagacttccccataagcccttta

SEQ ID NO: 336955 - DNA, 75 bp, Artificial Sequence
  Synthetic
tgctgtggttccaacaacaagtactcaatgacatctcaaagactggaccgtacgcctacagagacgaatataaaa

SEQ ID NO: 336956 - DNA, 75 bp, Artificial Sequence
  Synthetic
tgattcagtatcggaagtgagtggcgccagacttccccataagccctttatcttcttgccatttgtcagtaacag

SEQ ID NO: 336957 - DNA, 75 bp, Artificial Sequence
  Synthetic
ctttacctagtaaaaactaccaaaaaggccgttcgagtgacgtcacagccgccattttaactagctcacttcaag

SEQ ID NO: 336958 - DNA, 75 bp, Artificial Sequence
  Synthetic
gccattttaactagctcacttcaaggattgacctaaaggttatacctcatcctcgccggaagctacccaaaatgg

SEQ ID NO: 336959 - DNA, 75 bp, Artificial Sequence
  Synthetic
tcgtgcatacgtcacaagtcacgtgggggggacccgctgtaacccggaagtaggccccgtcacgtgacttaccac

SEQ ID NO: 336960 - DNA, 75 bp, Artificial Sequence
  Synthetic
gtggtgtacacgtcgccccgccgttttgttttacaaaatggctgacttccttcctcttttttaaaaaaaggcgcc

SEQ ID NO: 336961 - DNA, 75 bp, Artificial Sequence
  Synthetic
tgctacgtcactaaccacgtgcactccgcaggccagtccaagtctacgtcgtgcacttcctgggcgtggtttaca

SEQ ID NO: 336962 - DNA, 75 bp, Artificial Sequence
  Synthetic
gacttcaggggaaggaaaatcgccactacagcaagaagagaaagaagtcgaagtcctccaaacgccgacagtaca

SEQ ID NO: 336963 - DNA, 75 bp, Artificial Sequence
  Synthetic
tcctgatataagtaactgcacttccgaatggctgagttttccacgcccgtccgcagagaggagccacggcagagg

SEQ ID NO: 336964 - DNA, 75 bp, Artificial Sequence
  Synthetic
aagtcctccaaacgccgacagtacagctccagctccagcgaaacatccaggagcagctcgcaatcaagcagcagc

SEQ ID NO: 336965 - DNA, 75 bp, Artificial Sequence
  Synthetic
cggaggtgagtttacacaccgcagtcaaggggcaattcgggctcgggactggccgggctttgggcaaggctctta

SEQ ID NO: 336966 - DNA, 75 bp, Artificial Sequence
  Synthetic
caaggggcaattcgggctcgggactggccgggctttgggcaaggctcttaaaaatgcacttttctcgaataagca

SEQ ID NO: 336967 - DNA, 75 bp, Artificial Sequence
  Synthetic
cttcctcaccccccaacagccgaagagtgggaaacagagtaccagtgctgtaaggcctttaacagaccacctaga

SEQ ID NO: 336968 - DNA, 75 bp, Artificial Sequence
  Synthetic
ccaactgctatgagcttctggagacctccggtgcacaatgtcacggggatccagcgcctgtggtacgaatccttt

SEQ ID NO: 336969 - DNA, 75 bp, Artificial Sequence
  Synthetic
gcccatccgtagagccaggcctgccccggccgctccggaaccctcacaggttgactccagaccggccctgccatg

SEQ ID NO: 336970 - DNA, 75 bp, Artificial Sequence
  Synthetic
ttgactccagaccggccctgccatggcatggagatggtggaagcgacggaggcgctggtggctccgcaagcggtg

SEQ ID NO: 336971 - DNA, 75 bp, Artificial Sequence
  Synthetic
gacccgtggcagacttcgcagacgatggcctcgaccagctcgtcgccgccctagacgacgaagagtaaggagacg

SEQ ID NO: 336972 - DNA, 75 bp, Artificial Sequence
  Synthetic
tggcctcgaccagctcgtcgccgccctagacgacgaagagtaaggagacgcagacgttggaggagggggcgaccc

SEQ ID NO: 336973 - DNA, 75 bp, Artificial Sequence
  Synthetic
gacgcaaaaaacgtaggagacgaaagcccaaaataatcttaaaacaatggcaaccagacattgtaaagaggtgct

SEQ ID NO: 336974 - DNA, 75 bp, Artificial Sequence
  Synthetic
aaactaccaaaatggccgttccagtgacgtcacagccgccattttaagtagctgacgtcaaggattgacgtgaag

SEQ ID NO: 336975 - DNA, 75 bp, Artificial Sequence
  Synthetic
caaccagacattgtaaagaggtgctacatagtgggctacattcctgccataatatgtggggcgggcacctggtct

SEQ ID NO: 336976 - DNA, 75 bp, Artificial Sequence
  Synthetic
acattatccccaaaggaccctttggaggagggcacagcactatgaggttctccctaaaagtactctttgaagaac

SEQ ID NO: 336977 - DNA, 75 bp, Artificial Sequence
  Synthetic
ataagtcacgtggtggggacccgctgtaacccggaagtaggccccgtcacgtgatttgtcacgtgtgtacacgtc

SEQ ID NO: 336978 - DNA, 75 bp, Artificial Sequence
  Synthetic
gtaacccggaagtaggccccgtcacgtgatttgtcacgtgtgtacacgtcacaaccgccattttgttttacaaaa

SEQ ID NO: 336979 - DNA, 75 bp, Artificial Sequence
  Synthetic
aaaaaaacggccgtgcggcggcgcgcgcgcttcgcgcgcgcgccgggggctgccgcccccccccgcgcatgcgcg

SEQ ID NO: 336980 - DNA, 75 bp, Artificial Sequence
  Synthetic
ataagatactttagatgctcctttaaattctatagagaccaagaaacagactatatagtacactacagcagaaaa

SEQ ID NO: 336981 - DNA, 75 bp, Artificial Sequence
  Synthetic
actcccctgggaggtaacagactcacagcacctagcctacaccccggggtacaaatgcttagcaaaaacaaaata

SEQ ID NO: 336982 - DNA, 75 bp, Artificial Sequence
  Synthetic
gtgcagcccgccaatttctgttcaaacaggccaatcagcgtctactacgtacacttcctggggtgtgtcctgcca

SEQ ID NO: 336983 - DNA, 75 bp, Artificial Sequence
  Synthetic
caaagggtagcagctatgtaaaagtaaacatagcaccccccacactactaactgacaagtggtactttagcaaag

SEQ ID NO: 336984 - DNA, 75 bp, Artificial Sequence
  Synthetic
ctcaatataagcaacagcagtgacgaatggtagagttttttccgcccgtccgcagcgaggacgcgagcgtagcga

SEQ ID NO: 336985 - DNA, 75 bp, Artificial Sequence
  Synthetic
cttagacgttgtactctgcaacttgcggtttccgttctgctcaccacaaactgacaacccttgcatcacatttca

SEQ ID NO: 336986 - DNA, 75 bp, Artificial Sequence
  Synthetic
cggtttccgttctgctcaccacaaactgacaacccttgcatcacatttcaagttctgcattcttactacaacgac

SEQ ID NO: 336987 - DNA, 75 bp, Artificial Sequence
  Synthetic
gtctaggggcaattcgggcacgggtctggccgggctatgggcaagactcttaaaaaattcccccgttctgttctg

SEQ ID NO: 336988 - DNA, 75 bp, Artificial Sequence
  Synthetic
cgtacaaatcaaactttgtaaacaatttaaacacaaaactaggtacaacatggggaaacagactaaacacattta

SEQ ID NO: 336989 - DNA, 75 bp, Artificial Sequence
  Synthetic
gtctccgccgagacataatatcacaacaagagaagatctctgggtgcaatcggttgtttattcacatgacacttt

SEQ ID NO: 336990 - DNA, 75 bp, Artificial Sequence
  Synthetic
gaacagaaggctgctactcacatccaaaattgcagaaaaaacaagtacaagctgcaactgatgaaaaatatttta

SEQ ID NO: 336991 - DNA, 75 bp, Artificial Sequence
  Synthetic
ttgtggctgtgataatcttcttgagcatcttactggcctcctgggcggcgtacaaccacctccacctagagaccc

SEQ ID NO: 336992 - DNA, 75 bp, Artificial Sequence
  Synthetic
tgcagtatttgatactgcagagacagaaaaactaactaaaaacatggattcttatgctgcctctgctttacaaag

SEQ ID NO: 336993 - DNA, 75 bp, Artificial Sequence
  Synthetic
gaaaaactaactaaaaacatggattcttatgctgcctctgctttacaaagaggaatacaaggagaccctgccttt

SEQ ID NO: 336994 - DNA, 75 bp, Artificial Sequence
  Synthetic
gatggaggagacgccgctggggcctacgaaccagaagacctagaagaacttttcgccgccgccgagcaagacgat

SEQ ID NO: 336995 - DNA, 75 bp, Artificial Sequence
  Synthetic
ctccctggctaacaccaggcaggatatctcctgaaaccccaggactttacacagacgtgacttataacccatacg

SEQ ID NO: 336996 - DNA, 75 bp, Artificial Sequence
  Synthetic
atctcctgaaaccccaggactttacacagacgtgacttataacccatacgcagacaaaggagtgggcaacagaat

SEQ ID NO: 336997 - DNA, 75 bp, Artificial Sequence
  Synthetic
atacaggcgcagacggagacgggggcgacgcagacggggacgcagacgcaggcacagaaagaccctcattctcag

SEQ ID NO: 336998 - DNA, 75 bp, Artificial Sequence
  Synthetic
cgacgcagacggggacgcagacgcaggcacagaaagaccctcattctcaggcaatggcaaccagacgttattaag

SEQ ID NO: 336999 - DNA, 75 bp, Artificial Sequence
  Synthetic
atgggttgactactgcagtaaaaaaggcaacaaatatgacaatacaagtaaatgccttttagaagacatgccact

SEQ ID NO: 337000 - DNA, 75 bp, Artificial Sequence
  Synthetic
ggcaacaaatatgacaatacaagtaaatgccttttagaagacatgccactatggatggtatcctttggatacgta

SEQ ID NO: 337001 - DNA, 75 bp, Artificial Sequence
  Synthetic
aatgccttttagaagacatgccactatggatggtatcctttggatacgtagactgggtaaaaaaagagactggca

SEQ ID NO: 337002 - DNA, 75 bp, Artificial Sequence
  Synthetic
actggggtattccactatgggccagagtacttataagaagcccatatactgtcccaaaactataccatgaaaacg

SEQ ID NO: 337003 - DNA, 75 bp, Artificial Sequence
  Synthetic
tatgaagaattcatgcaccacagaaacaggtggtcagcctcaaaccatgacctagagctagtgagatacctcaga

SEQ ID NO: 337004 - DNA, 75 bp, Artificial Sequence
  Synthetic
ttcttactattttggagaaggcaaaatgccaaacggagacatgtacgtaccatttaaaataagaatgaaatggta

SEQ ID NO: 337005 - DNA, 75 bp, Artificial Sequence
  Synthetic
acaggtggtcagcctcaaaccatgacctagagctagtgagatacctcagaaccagccttaaactctacagacacg

SEQ ID NO: 337006 - DNA, 75 bp, Artificial Sequence
  Synthetic
caccaccacaggcccctttgaaacaaatgaaatgtcctacatgctcactcacccactggccatgctcctcagcaa

SEQ ID NO: 337007 - DNA, 75 bp, Artificial Sequence
  Synthetic
gtgttaaatgacttagcaaagagcggaccgtttgcatacaaaaacaccaaaacaagtgtgactgtgaccgccaaa

SEQ ID NO: 337008 - DNA, 75 bp, Artificial Sequence
  Synthetic
aatgaaatgtcctacatgctcactcacccactggccatgctcctcagcaaaagacacgtagttgtacccagccta

SEQ ID NO: 337009 - DNA, 75 bp, Artificial Sequence
  Synthetic
gcaaccccgtaccctcacagattgtacaagatccctgcacacagcccacctacgacatccccggcaccggtaacc

SEQ ID NO: 337010 - DNA, 75 bp, Artificial Sequence
  Synthetic
ataaaaagataacaatcaagcccccaaaactcatgctaaacaagtggtactttgctgcagacttctgtcacatag

SEQ ID NO: 337011 - DNA, 75 bp, Artificial Sequence
  Synthetic
aaaactcatgctaaacaagtggtactttgctgcagacttctgtcacataggcctcttccaactctgggccacagg

SEQ ID NO: 337012 - DNA, 75 bp, Artificial Sequence
  Synthetic
agatcaggcacaaacagccctgtcataggcttctatgtccttaaaaaccaagtgtaccaaaatagatacagcaac

SEQ ID NO: 337013 - DNA, 75 bp, Artificial Sequence
  Synthetic
taggcttctatgtccttaaaaaccaagtgtaccaaaatagatacagcaacctaaacacaccagaggcacacacag

SEQ ID NO: 337014 - DNA, 75 bp, Artificial Sequence
  Synthetic
acttctgagtttttattctcaggcccaaagaaacccagaatcgatcaaggtccttacatcccgccagaaaagggc

SEQ ID NO: 337015 - DNA, 75 bp, Artificial Sequence
  Synthetic
caaagaaacccagaatcgatcaaggtccttacatcccgccagaaaagggctcacgttcactccaaagagaatcga

SEQ ID NO: 337016 - DNA, 75 bp, Artificial Sequence
  Synthetic
aacccaacaatgcactaacaataaatggtacaattggcaatacacatacaataaacttatgaaaccaatttacta

SEQ ID NO: 337017 - DNA, 75 bp, Artificial Sequence
  Synthetic
tggtacaattggcaatacacatacaataaacttatgaaaccaatttactatgcagcctcaaatgaaactggtaat

SEQ ID NO: 337018 - DNA, 75 bp, Artificial Sequence
  Synthetic
ggcagagacagaagccccctcggaagaggagccggagaaccaagaagaacaagtactccagttgcagctcagaca

SEQ ID NO: 337019 - DNA, 75 bp, Artificial Sequence
  Synthetic
gcagctccgagaacagcgaaaactcagacagggaatccagtgccttttcgagcaactgataacaactcagcaggg

SEQ ID NO: 337020 - DNA, 75 bp, Artificial Sequence
  Synthetic
attggaaaaattacaaacaacactataacaaaacacaaaataaatggctagcagttattaaagatgcctatgagt

SEQ ID NO: 337021 - DNA, 75 bp, Artificial Sequence
  Synthetic
taacaaaacacaaaataaatggctagcagttattaaagatgcctatgagttagtaagagaagaataccaacaatt

SEQ ID NO: 337022 - DNA, 75 bp, Artificial Sequence
  Synthetic
taggccccgagcagtggctgtttcccgaaaggaagcctaagccaccgccctcagcccaggactgggccgaggaat

SEQ ID NO: 337023 - DNA, 75 bp, Artificial Sequence
  Synthetic
ccaccatgggaaccaaccacatctaatacaggcagacaatacctagaacatgactgtggcatatacagcccatac

SEQ ID NO: 337024 - DNA, 75 bp, Artificial Sequence
  Synthetic
atacaggcagacaatacctagaacatgactgtggcatatacagcccatacttcataactccacaaatttacagcc

SEQ ID NO: 337025 - DNA, 75 bp, Artificial Sequence
  Synthetic
acactgcatgtaaatactgggacagaccacctagaacattcctcacagacatgccattctataatcactgcaaaa

SEQ ID NO: 337026 - DNA, 75 bp, Artificial Sequence
  Synthetic
catcagatacaatcccctcacagacaaaggcataggcaacagagtgtgtgtacagtactgcagcgaggccagcag

SEQ ID NO: 337027 - DNA, 75 bp, Artificial Sequence
  Synthetic
aactataaataaacacgccagcttcactgttctaggccgtgggagtttcactggtcggtgtctacctctaaaggt

SEQ ID NO: 337028 - DNA, 75 bp, Artificial Sequence
  Synthetic
actgttctaggccgtgggagtttcactggtcggtgtctacctctaaaggtcactaagcactccgagcgcaagcga

SEQ ID NO: 337029 - DNA, 75 bp, Artificial Sequence
  Synthetic
aaaggcataggcaacagagtgtgtgtacagtactgcagcgaggccagcagtgactacaatccagtaaaaagcaag

SEQ ID NO: 337030 - DNA, 75 bp, Artificial Sequence
  Synthetic
ggatgatgctgtatggctatgcagactatgtagtaaagagcacaggcatacagtcagcctggacagacatgagag

SEQ ID NO: 337031 - DNA, 75 bp, Artificial Sequence
  Synthetic
ggagtgcgaccctccccccggtagcaacttcttcggagtccggcgctacgccttcggctgcgccggacacctcag

SEQ ID NO: 337032 - DNA, 75 bp, Artificial Sequence
  Synthetic
cagtcagcctggacagacatgagagtggccatcagatgtccatacacagaccccaaactcataggcagcacagaa

SEQ ID NO: 337033 - DNA, 75 bp, Artificial Sequence
  Synthetic
cgcgtttcggaccttcggcgtcgggggggtcgggaactttattaaacagactccgaggtgctcttggacactgag

SEQ ID NO: 337034 - DNA, 75 bp, Artificial Sequence
  Synthetic
tagaattcatgaacggagacatgccagacaagaggccctacattccgttaaagtggtggtttaagtggtacccca

SEQ ID NO: 337035 - DNA, 75 bp, Artificial Sequence
  Synthetic
agacaagaggccctacattccgttaaagtggtggtttaagtggtaccccatgattacacaccaaaaaaccgcact

SEQ ID NO: 337036 - DNA, 75 bp, Artificial Sequence
  Synthetic
ttcatgcccagagatcaggaacaagccagttgggacataaccgtaggttacaaagcaaccttcttatggggcggg

SEQ ID NO: 337037 - DNA, 75 bp, Artificial Sequence
  Synthetic
gccgccatcttaagtagctgaggcggacggtggcgtgagttcaaaggtcaccatcagccacacctactcaaaatg

SEQ ID NO: 337038 - DNA, 75 bp, Artificial Sequence
  Synthetic
gacggtggcgtgagttcaaaggtcaccatcagccacacctactcaaaatggagggcaatctcttccgggtcaaag

SEQ ID NO: 337039 - DNA, 75 bp, Artificial Sequence
  Synthetic
caaagcaaccttcttatggggcgggtcccccttacctccacagcccatcgacgacccttgccaaaaaggcagaca

SEQ ID NO: 337040 - DNA, 75 bp, Artificial Sequence
  Synthetic
tgacctgtgacgtcacgggcgccattttgcttgacaaaatggccgacttccttcctcttttttaaaaaaaagcgg

SEQ ID NO: 337041 - DNA, 75 bp, Artificial Sequence
  Synthetic
cgcaacacctcggaccggcgacgctgttccactcgtgggacctcagacgtggatacattagtacaaaaagtatta

SEQ ID NO: 337042 - DNA, 75 bp, Artificial Sequence
  Synthetic
tcctcttttttaaaaaaaagcggaagtgccgccgcggcggcggggggcgccgcccagtagggggcgccatgcgcc

SEQ ID NO: 337043 - DNA, 75 bp, Artificial Sequence
  Synthetic
taatgaatatttttcgacaggcgtcgaatccaaaagaccccgcttcgacactccccaccacgggcagctatcaaa

SEQ ID NO: 337044 - DNA, 75 bp, Artificial Sequence
  Synthetic
cttaaaaaatgcactttcgcagggttgcggagaaaaggaaagtgcttctgcaaactgtgcgagctgcaaagaagg

SEQ ID NO: 337045 - DNA, 75 bp, Artificial Sequence
  Synthetic
tgcggagaaaaggaaagtgcttctgcaaactgtgcgagctgcaaagaaggctaggcggcttctaggtatgtggca

SEQ ID NO: 337046 - DNA, 75 bp, Artificial Sequence
  Synthetic
gaatccaaaagaccccgcttcgacactccccaccacgggcagctatcaaaccaagaagaagacgccttgtctatc

SEQ ID NO: 337047 - DNA, 75 bp, Artificial Sequence
  Synthetic
aagagacctcatcagaagaagaacaagcactccaaaagcaagaagaccaaaaagaaaagctcctacagcaactcc

SEQ ID NO: 337048 - DNA, 75 bp, Artificial Sequence
  Synthetic
attgagagaaactggtacgagagctgttttcgatcccatgctgctgtttgtggctgtggcgactttgttggccat

SEQ ID NO: 337049 - DNA, 75 bp, Artificial Sequence
  Synthetic
agcactccaaaagcaagaagaccaaaaagaaaagctcctacagcaactccgagtccagcgacagcaccagcgagt

SEQ ID NO: 337050 - DNA, 75 bp, Artificial Sequence
  Synthetic
tggctgtggcgactttgttggccatattaatcatctggcaactactctgggtcgccctccacgtcctgggccccc

SEQ ID NO: 337051 - DNA, 75 bp, Artificial Sequence
  Synthetic
atgggagacgtcctccgactcagacagggagtccactggaacccgatcctatagtacttccaccagaaccaatac

SEQ ID NO: 337052 - DNA, 75 bp, Artificial Sequence
  Synthetic
taaaaaaaagttctctcccttcgactgggaatgcgagcaggatctagcaatggcattcaagcggcctatgcgctt

SEQ ID NO: 337053 - DNA, 75 bp, Artificial Sequence
  Synthetic
agcgcggcgcagacggtggagaccccggagacgtaggagacgacgccctgctcgccgctttccaactcgtcgaag

SEQ ID NO: 337054 - DNA, 75 bp, Artificial Sequence
  Synthetic
ccgtggttaccccccaagcgagatatccacaaaatatgtaaagtaaacttcaaaataaatttcactgaatgaaat

SEQ ID NO: 337055 - DNA, 75 bp, Artificial Sequence
  Synthetic
caaaataaatttcactgaatgaaatttcgaggccccgggagtttcacttagcggtgtatgcctctaaaggtcacc

SEQ ID NO: 337056 - DNA, 75 bp, Artificial Sequence
  Synthetic
tgcgacccttctgcccggtagcaacttcctcggggtccggcgctacgccttcgctgcgccggacgcctcggaccc

SEQ ID NO: 337057 - DNA, 75 bp, Artificial Sequence
  Synthetic
tgtcagtaacgaagacctagacctgtgtagatacgtgggctgcaaactaatattttttaaacaccccacggtgga

SEQ ID NO: 337058 - DNA, 75 bp, Artificial Sequence
  Synthetic
ttttatagtacagataaacactcagcctcctttcttagacacgcacctcaccgcggccagcatacacccgggcat

SEQ ID NO: 337059 - DNA, 75 bp, Artificial Sequence
  Synthetic
gccattttagcttcggccgccattttaagccctcgcgggccaccgtaggcgcgttttaatgacgtcacgggcgcc

SEQ ID NO: 337060 - DNA, 75 bp, Artificial Sequence
  Synthetic
ccgcggccagcatacacccgggcatcatgatgctcagcaagagacgcatattaataccctctctaaagacccggc

SEQ ID NO: 337061 - DNA, 75 bp, Artificial Sequence
  Synthetic
cctcctttcttagacacgcacctcaccgcggccagcatacacccgggcatcatgatgctcagcaagagacgcata

SEQ ID NO: 337062 - DNA, 75 bp, Artificial Sequence
  Synthetic
taagccctcgcgggccaccgtaggcgcgttttaatgacgtcacgggcgccatcttggctgtgacgtttcagtcac

SEQ ID NO: 337063 - DNA, 75 bp, Artificial Sequence
  Synthetic
aagcgtccctggtcacgtgattgtgacgtcacggccgccatcttgtgcgtccgccattttgtgacttccttccgc

SEQ ID NO: 337064 - DNA, 75 bp, Artificial Sequence
  Synthetic
cagggtgggcgccccaagactttttcaggacaagtggtacccccagtcagacctgtgtgacacagttctgctttc

SEQ ID NO: 337065 - DNA, 75 bp, Artificial Sequence
  Synthetic
ctttttcaaaaaaagaggaagtatgacgtagcggcgggggggcggcgcgcttcgcgcgccgcccactagggggcg

SEQ ID NO: 337066 - DNA, 75 bp, Artificial Sequence
  Synthetic
caatatccgttcggctcaccactaactgaaaacccttgcgtaaacttccagatactggggccccactacaaaaaa

SEQ ID NO: 337067 - DNA, 75 bp, Artificial Sequence
  Synthetic
ctgaaaacccttgcgtaaacttccagatactggggccccactacaaaaaacaccttagtattagctccactaatg

SEQ ID NO: 337068 - DNA, 75 bp, Artificial Sequence
  Synthetic
aagtaatttatttaataaaactgaactatacaacacctttcaaaccatagcccagcttaaagagacaggacaaac

SEQ ID NO: 337069 - DNA, 75 bp, Artificial Sequence
  Synthetic
ctatacaacacctttcaaaccatagcccagcttaaagagacaggacaaacctcaggagttaatccaaattggact

SEQ ID NO: 337070 - DNA, 75 bp, Artificial Sequence
  Synthetic
atcaagcaggtaacaatgcacaaaacagcagagacacttggtacaagggaaacacatacaacgacaacatatcaa

SEQ ID NO: 337071 - DNA, 75 bp, Artificial Sequence
  Synthetic
cagcagagacacttggtacaagggaaacacatacaacgacaacatatcaaagttagcagagataacaagacagag

SEQ ID NO: 337072 - DNA, 75 bp, Artificial Sequence
  Synthetic
atacaaccctttcacagacaaaggtacaggcaacataatctggatagactaccttacaaaagaagacacaatctt

SEQ ID NO: 337073 - DNA, 75 bp, Artificial Sequence
  Synthetic
tgcaaagtacacaggagactctgccattatttacaatgccagagtactcataagatgcccatacactgaacccat

SEQ ID NO: 337074 - DNA, 75 bp, Artificial Sequence
  Synthetic
taagatgcccatacactgaacccatgctaatagaccactcagacccaaacaaaggctttgtaccgtactcattta

SEQ ID NO: 337075 - DNA, 75 bp, Artificial Sequence
  Synthetic
gtttcgtgtaaccttcaaactgggctttcagtaaaatttcaaggcagtacactgtccacctgtcggtgtctacct

SEQ ID NO: 337076 - DNA, 75 bp, Artificial Sequence
  Synthetic
tttcagtaaaatttcaaggcagtacactgtccacctgtcggtgtctacctctataagtcactaagcactccgagc

SEQ ID NO: 337077 - DNA, 75 bp, Artificial Sequence
  Synthetic
cctgctccaactccagcacctccgcggcccatagaggacctcgcagcgtacaagcggttgacccgaaatacgtta

SEQ ID NO: 337078 - DNA, 75 bp, Artificial Sequence
  Synthetic
ggacatcagacgaggactctttggcaaagcaggtattaaaagaatgcaacaggaatcagatgctctttacattcc

SEQ ID NO: 337079 - DNA, 75 bp, Artificial Sequence
  Synthetic
aaagcaggtattaaaagaatgcaacaggaatcagatgctctttacattcctgcaggaccactcaagagacctcgc

SEQ ID NO: 337080 - DNA, 75 bp, Artificial Sequence
  Synthetic
aagagcaaaacgaaagctcagctttcagagtccagcagcgagccccgtgggtccactccagccaagaaacgcaaa

SEQ ID NO: 337081 - DNA, 75 bp, Artificial Sequence
  Synthetic
gggctgccgccccccccgcgcatgcgcgcggggccccccccccgcggggggctccgccccccggccccccccccg

SEQ ID NO: 337082 - DNA, 75 bp, Artificial Sequence
  Synthetic
cagagtccagcagcgagccccgtgggtccactccagccaagaaacgcaaagctcccaagaagagacgcaggcgca

SEQ ID NO: 337083 - DNA, 75 bp, Artificial Sequence
  Synthetic
ccgggccctgggcaaggctcttaaaaaatgcgctttcgcagagttgcggagaaaaggaaagtgcctctgcaaact

SEQ ID NO: 337084 - DNA, 75 bp, Artificial Sequence
  Synthetic
ctccagctccgagagcagcgagtactccgactccagctgcagcagctcgcaacgcaagtcctcaaagtccaagca

SEQ ID NO: 337085 - DNA, 75 bp, Artificial Sequence
  Synthetic
cttcccaagcgtaaacaaagtctatatgtttgagcccaatggtcctaaacccatacagggttacaacgattggct

SEQ ID NO: 337086 - DNA, 75 bp, Artificial Sequence
  Synthetic
atgtttgagcccaatggtcctaaacccatacagggttacaacgattggctagaagagtacactgcttgcaaattt

SEQ ID NO: 337087 - DNA, 75 bp, Artificial Sequence
  Synthetic
aataaaaattctaggccgtgggagtttcacttgtcggtgtctgcttcttaaggttgccaagcactccgagcgcca

SEQ ID NO: 337088 - DNA, 75 bp, Artificial Sequence
  Synthetic
tagcaacgccttcggagccgcgcgctacgccttcggctgcgcgcggcacctcagaccccccctccacccgaaacg

SEQ ID NO: 337089 - DNA, 75 bp, Artificial Sequence
  Synthetic
acaacccggaagccctcctccgtcacgtgactaatcacgtgactgctacgtcatcggcgccatcttgttttacaa

SEQ ID NO: 337090 - DNA, 75 bp, Artificial Sequence
  Synthetic
cgtgactaatcacgtgactgctacgtcatcggcgccatcttgttttacaaaatggcggacaacttccgctttttt

SEQ ID NO: 337091 - DNA, 75 bp, Artificial Sequence
  Synthetic
tagtattagctccactatggatgatactaacaaacagcactataacagcaacttatttaataaaactgcactata

SEQ ID NO: 337092 - DNA, 75 bp, Artificial Sequence
  Synthetic
aatggcggacaacttccgcttttttgaaaaaaggcgccaaaaaacggcggcggcggcgcgcgcgctgcgcgcgcg

SEQ ID NO: 337093 - DNA, 75 bp, Artificial Sequence
  Synthetic
cttaaagagacaggacaaactgcaaacattagcccaagttggagtgaagtacaaaacacaaaactactagatcac

SEQ ID NO: 337094 - DNA, 75 bp, Artificial Sequence
  Synthetic
agtctacgtcgtgcatttcctgggcatggtctacatcataatataagaaggcgcacttccgaatggctgagtttt

SEQ ID NO: 337095 - DNA, 75 bp, Artificial Sequence
  Synthetic
gagacacttggtacaagggaaacacatacaatgactacatacaacagttagcagagaaaacaagagaaaggttta

SEQ ID NO: 337096 - DNA, 75 bp, Artificial Sequence
  Synthetic
cacggagggagatcctcgcgtcccgagggcgggtgccggaggtgagtttacacaccgcagtcaaggggcaattcg

SEQ ID NO: 337097 - DNA, 75 bp, Artificial Sequence
  Synthetic
ggagatcctcgcgtcccgagggcgggtgccggaggtgagtttacacaccgcagtcaaggggcaattcgggctcgg

SEQ ID NO: 337098 - DNA, 75 bp, Artificial Sequence
  Synthetic
acgtcacaggagggggcgtagtcccacccgcccacccgggtccgtcactcagggggcgtgccaaggctggtcacc

SEQ ID NO: 337099 - DNA, 75 bp, Artificial Sequence
  Synthetic
acccgcccacccgggtccgtcactcagggggcgtgccaaggctggtcaccacccattttggcgggaaccaatcac

SEQ ID NO: 337100 - DNA, 75 bp, Artificial Sequence
  Synthetic
agggggcgtgccaaggctggtcaccacccattttggcgggaaccaatcacaaaatggggggggccggccaatggt

SEQ ID NO: 337101 - DNA, 75 bp, Artificial Sequence
  Synthetic
catctgataaaagtaagtgcacattcgaatggctgagtttatactgtccggccgcaggtcggtggaggagcgaca

SEQ ID NO: 337102 - DNA, 75 bp, Artificial Sequence
  Synthetic
aaaacaaaagcaaatgtgagataatggacatgcccctgtgggcggcctgcacaggatacacagagttttgtgcaa

SEQ ID NO: 337103 - DNA, 75 bp, Artificial Sequence
  Synthetic
cgaatggctgagtttatactgtccggccgcaggtcggtggaggagcgacagtaacgaccccagaccagccctggg

SEQ ID NO: 337104 - DNA, 75 bp, Artificial Sequence
  Synthetic
ccgcagtcaaggggcaattcgggcagggctggccgggcatctgggcaagtgtctgaaagcgtgcgttgtccccca

SEQ ID NO: 337105 - DNA, 75 bp, Artificial Sequence
  Synthetic
gggctggccgggcatctgggcaagtgtctgaaagcgtgcgttgtcccccagataggccaccgcgaggactacgac

SEQ ID NO: 337106 - DNA, 75 bp, Artificial Sequence
  Synthetic
cacccacgggacagtgggaaccgccgcagcaaggagtgggaccccgagaactcgactggtggcgcgggacgtggt

SEQ ID NO: 337107 - DNA, 75 bp, Artificial Sequence
  Synthetic
gcagcaaggagtgggaccccgagaactcgactggtggcgcgggacgtggtggaatcacgctgctttttgtggttg

SEQ ID NO: 337108 - DNA, 75 bp, Artificial Sequence
  Synthetic
ctacttagccatcataattttggacctcgtgggccgcctggaggccctcctgcaccaccaccaccccctcctcca

SEQ ID NO: 337109 - DNA, 75 bp, Artificial Sequence
  Synthetic
caaacaggtcgtcaggaatccctgctccaactccagcacctccgcggcccatagaggacctcgcagcgtacaagc

SEQ ID NO: 337110 - DNA, 75 bp, Artificial Sequence
  Synthetic
ctcgtgggccgcctggaggccctcctgcaccaccaccaccccctcctccagtagcgcagcggggccccccgaacg

SEQ ID NO: 337111 - DNA, 75 bp, Artificial Sequence
  Synthetic
gctgccgggactgcccccgcagccccctgaagatcctccagcacggcctggtggtggaggagatggccccgacgc

SEQ ID NO: 337112 - DNA, 75 bp, Artificial Sequence
  Synthetic
cctgaagatcctccagcacggcctggtggtggaggagatggccccgacgccgccgtcggtggaggaggtggggcc

SEQ ID NO: 337113 - DNA, 75 bp, Artificial Sequence
  Synthetic
tagaggagttgctggccgccgccgccgaggaagaagggtaaggaggagaaggaggaggcgggtgtggagacgtgg

SEQ ID NO: 337114 - DNA, 75 bp, Artificial Sequence
  Synthetic
cgaggaagaagggtaaggaggagaaggaggaggcgggtgtggagacgtggcagacggtggagactgagacgcaga

SEQ ID NO: 337115 - DNA, 75 bp, Artificial Sequence
  Synthetic
acactctgatcctgagacagtggcagcccaccaccatcaagtccctaagaatctcgggatggttcccgggggtgg

SEQ ID NO: 337116 - DNA, 75 bp, Artificial Sequence
  Synthetic
gcccaccaccatcaagtccctaagaatctcgggatggttcccgggggtggtgtgcagcaacaggcgcagtcaaaa

SEQ ID NO: 337117 - DNA, 75 bp, Artificial Sequence
  Synthetic
attccagccaggggaggtggattcggagggaatatcagtatcacgaaatggaacctgtccatgctgtggcacgag

SEQ ID NO: 337118 - DNA, 75 bp, Artificial Sequence
  Synthetic
gagggaatatcagtatcacgaaatggaacctgtccatgctgtggcacgagaacttaatgaacagaaaccggtgga

SEQ ID NO: 337119 - DNA, 75 bp, Artificial Sequence
  Synthetic
agtgagatacctgggagggagttggaagttctaccgagaccccgacagagactttattgccacttatagtttaga

SEQ ID NO: 337120 - DNA, 75 bp, Artificial Sequence
  Synthetic
aagttctaccgagaccccgacagagactttattgccacttatagtttagagagccccatgaccactaaccagtac

SEQ ID NO: 337121 - DNA, 75 bp, Artificial Sequence
  Synthetic
aaattctaggccgtgggactttcacttgtcggtgtctgcttcttaaggtcgccaagcactccgagcgtcagcgag

SEQ ID NO: 337122 - DNA, 75 bp, Artificial Sequence
  Synthetic
tcatgttgttaaggagacacagaatccttattcctagtctaaaaaccaaaccccggggtaagccatacgtaaaga

SEQ ID NO: 337123 - DNA, 75 bp, Artificial Sequence
  Synthetic
ccttattcctagtctaaaaaccaaaccccggggtaagccatacgtaaagagaaagttcaagccccccaaactcat

SEQ ID NO: 337124 - DNA, 75 bp, Artificial Sequence
  Synthetic
acgccttcggagccgcgcgctacgccttcggctgcgcgcggcacctcagaccccccccctccacccgaaacgctt

SEQ ID NO: 337125 - DNA, 75 bp, Artificial Sequence
  Synthetic
cacttttgcaatgttaacctcatcaagctaaccgttgtcggtttagacttgcaaaaggcttggttaagaagagga

SEQ ID NO: 337126 - DNA, 75 bp, Artificial Sequence
  Synthetic
agctaaccgttgtcggtttagacttgcaaaaggcttggttaagaagaggaactgaatcccctattgcagaatttg

SEQ ID NO: 337127 - DNA, 75 bp, Artificial Sequence
  Synthetic
caacatatccctaactgccactgaaacaaacagtgaggagcaaaaaaaaacatgggaaaatgtatgggcatttcc

SEQ ID NO: 337128 - DNA, 75 bp, Artificial Sequence
  Synthetic
acaaacagtgaggagcaaaaaaaaacatgggaaaatgtatgggcatttcccatgagtatgaccatgaattttagg

SEQ ID NO: 337129 - DNA, 75 bp, Artificial Sequence
  Synthetic
cagatgctgagttaaaagatggccccaagagagacagtgtccctaccttgtggaagaagtatgtcacatcaaaca

SEQ ID NO: 337130 - DNA, 75 bp, Artificial Sequence
  Synthetic
caagagagacagtgtccctaccttgtggaagaagtatgtcacatcaaacaaaatgacagaaaacgtatttaatga

SEQ ID NO: 337131 - DNA, 75 bp, Artificial Sequence
  Synthetic
gtttcaaacagtggcatcaccacaacgaacaccctttctagaaccatgtactttgatagaatctgtggcatgttc

SEQ ID NO: 337132 - DNA, 75 bp, Artificial Sequence
  Synthetic
cgaacaccctttctagaaccatgtactttgatagaatctgtggcatgttcagctcctatgtgttagacgatacag

SEQ ID NO: 337133 - DNA, 75 bp, Artificial Sequence
  Synthetic
gaagtccgtcactaaccacgtgactcccacaggccaaccacagtgtacatcgtgcatttcctgggcatggtctac

SEQ ID NO: 337134 - DNA, 75 bp, Artificial Sequence
  Synthetic
gaagtccgtcactaaccacgtgactccctcaggccaaccacagtgtacatcgtgcatttcctgggcatggtctac

SEQ ID NO: 337135 - DNA, 75 bp, Artificial Sequence
  Synthetic
gaagtccgtcactaaccacgtgactcccccaggccaaccacagtgtacatcgtgcatttcctgggcatggtctac

SEQ ID NO: 337136 - DNA, 75 bp, Artificial Sequence
  Synthetic
gaagtccgtcactaaccacgtgactcccgcaggccaaccacagtgtacatcgtgcatttcctgggcatggtctac

SEQ ID NO: 337137 - DNA, 75 bp, Artificial Sequence
  Synthetic
agcctacgtcggggttagatacaatcccctgatagacgagggcacaggaaacaaggtatggatagacccagtcac

SEQ ID NO: 337138 - DNA, 75 bp, Artificial Sequence
  Synthetic
cccctgatagacgagggcacaggaaacaaggtatggatagacccagtcactaaaaaggacactaagtttcagccc

SEQ ID NO: 337139 - DNA, 75 bp, Artificial Sequence
  Synthetic
gacagcccttgtggctcctgctctttggatacacggactggatcaaaaagttttacgcagacaggaacccgggaa

SEQ ID NO: 337140 - DNA, 75 bp, Artificial Sequence
  Synthetic
tggatacacggactggatcaaaaagttttacgcagacaggaacccgggaactacgtacagagtgaccctcctaag

SEQ ID NO: 337141 - DNA, 75 bp, Artificial Sequence
  Synthetic
tctgcagactgtgccagacccacagaaggctaggcggcttctgattatgtggcagccccccgtgcacaaagtacc

SEQ ID NO: 337142 - DNA, 75 bp, Artificial Sequence
  Synthetic
aacaaagacttgtacggctacgtgccgctgggcgacgacttctgtgcgggacgacatccttaccgacagtataag

SEQ ID NO: 337143 - DNA, 75 bp, Artificial Sequence
  Synthetic
cgctgggcgacgacttctgtgcgggacgacatccttaccgacagtataagatcacgcccgagtgggaaactctct

SEQ ID NO: 337144 - DNA, 75 bp, Artificial Sequence
  Synthetic
cgggatcgagagaaactggtacgagagttgctttcgatcccatgctgctgtgtgtggctgtggcgactttgttgg

SEQ ID NO: 337145 - DNA, 75 bp, Artificial Sequence
  Synthetic
gccagccttagaggccatcgttaactgtggcccctggatgcccagagacgaggaggccagaagctggcagttaaa

SEQ ID NO: 337146 - DNA, 75 bp, Artificial Sequence
  Synthetic
tgtggcccctggatgcccagagacgaggaggccagaagctggcagttaaacctggggtaccagttcagatttaaa

SEQ ID NO: 337147 - DNA, 75 bp, Artificial Sequence
  Synthetic
agccgccggaagacccctgtaagcaacccacccacgacctacccgagaccaatatgctccagttggcagtacaag

SEQ ID NO: 337148 - DNA, 75 bp, Artificial Sequence
  Synthetic
acccacccacgacctacccgagaccaatatgctccagttggcagtacaagctagcaacccgcggactgttgacga

SEQ ID NO: 337149 - DNA, 75 bp, Artificial Sequence
  Synthetic
cggggcatgtttagcgcgtcaagtattaaaagaatgcgagaataccaaacagatgatgaaaattttccagactct

SEQ ID NO: 337150 - DNA, 75 bp, Artificial Sequence
  Synthetic
ttaaaagaatgcgagaataccaaacagatgatgaaaattttccagactctccagcaaaacgaagccgctacgacc

SEQ ID NO: 337151 - DNA, 75 bp, Artificial Sequence
  Synthetic
gaagagtaaggaggcgcagggggcggtggcgcagacggtatagaaaatggaggagacgcaggggcagacggacgc

SEQ ID NO: 337152 - DNA, 75 bp, Artificial Sequence
  Synthetic
gtggcagccgaactttataagacgctgctacataataggctacctgcctctcatattctgtggcgagaacaccac

SEQ ID NO: 337153 - DNA, 75 bp, Artificial Sequence
  Synthetic
tttaccctctggctctctccaagccctcaaagccctgttcgagaccccgcaaacgcctggaccgctcagcccgtc

SEQ ID NO: 337154 - DNA, 75 bp, Artificial Sequence
  Synthetic
ctcaaagccctgttcgagaccccgcaaacgcctggaccgctcagcccgtcgtgggcgaaagcggacgaggcgcca

SEQ ID NO: 337155 - DNA, 75 bp, Artificial Sequence
  Synthetic
tgctacataataggctacctgcctctcatattctgtggcgagaacaccaccgccaataactttgccacccactcg

SEQ ID NO: 337156 - DNA, 75 bp, Artificial Sequence
  Synthetic
ggggggggggcatgactaccactaagttcactttgagaatcctgtacgacgagtttaccaggtttatgaacttct

SEQ ID NO: 337157 - DNA, 75 bp, Artificial Sequence
  Synthetic
gggagctccagcgacagcgaaagcaacagcagcgactccagcagggtatccaggaaatgcttctgagcatgaagc

SEQ ID NO: 337158 - DNA, 75 bp, Artificial Sequence
  Synthetic
acagcagcgactccagcagggtatccaggaaatgcttctgagcatgaagctcactcagatgggtcaccacataga

SEQ ID NO: 337159 - DNA, 75 bp, Artificial Sequence
  Synthetic
gttcactttgagaatcctgtacgacgagtttaccaggtttatgaacttctggactgtcagtaacgaagacctaga

SEQ ID NO: 337160 - DNA, 75 bp, Artificial Sequence
  Synthetic
ctgatattctttaagcaccccacggtagactttatagtcaggataaacacagagcctccgttcctagacactaac

SEQ ID NO: 337161 - DNA, 75 bp, Artificial Sequence
  Synthetic
cgccaggcagaaaacgtacgtttaaccagtttgacagagacacggagagagagctagcacacatgttccggcgtt

SEQ ID NO: 337162 - DNA, 75 bp, Artificial Sequence
  Synthetic
ccagtttgacagagacacggagagagagctagcacacatgttccggcgtttccctaggcagctgccctacccaga

SEQ ID NO: 337163 - DNA, 75 bp, Artificial Sequence
  Synthetic
gcatcatgatgctaagcaaaaaacacatactcataccctctctaaagaccaggcctagcagaaaacacagggtgg

SEQ ID NO: 337164 - DNA, 75 bp, Artificial Sequence
  Synthetic
cctcctcacggctacagcccaccctacaaggtcaacttcaacctgggcttcaaccccttcgcaataaactaggcc

SEQ ID NO: 337165 - DNA, 75 bp, Artificial Sequence
  Synthetic
acaaggtcaacttcaacctgggcttcaaccccttcgcaataaactaggcctacgaatttcacttgagtggagtct

SEQ ID NO: 337166 - DNA, 75 bp, Artificial Sequence
  Synthetic
gtttcaagacaagtggtacccccagtcagacctgtgtgacacagttctgctttccgtgtttgcaacggcctgtga

SEQ ID NO: 337167 - DNA, 75 bp, Artificial Sequence
  Synthetic
gagggggccccccaagggtcacgggtcggctcgctccgctcgcctccccgcgcacgcacacccaaggtcgctccc

SEQ ID NO: 337168 - DNA, 75 bp, Artificial Sequence
  Synthetic
tcggctcgctccgctcgcctccccgcgcacgcacacccaaggtcgctcccgttattaggagtcgcacgcgctgcg

SEQ ID NO: 337169 - DNA, 75 bp, Artificial Sequence
  Synthetic
aacgataccactaacaaacaacactatgacaacactttatttaacaaaatagtattatataacacttttcaaaca

SEQ ID NO: 337170 - DNA, 75 bp, Artificial Sequence
  Synthetic
cgccggaacgtccgcgcttgcgcgcgtccgaacctcactcgctccggctcgcttcgctcgcctccgctccctcgg

SEQ ID NO: 337171 - DNA, 75 bp, Artificial Sequence
  Synthetic
gtccgaacctcactcgctccggctcgcttcgctcgcctccgctccctcggatccggctagtcgctgaaactttat

SEQ ID NO: 337172 - DNA, 75 bp, Artificial Sequence
  Synthetic
atgacaacactttatttaacaaaatagtattatataacacttttcaaacaatagctcagctcaaagaaacaggac

SEQ ID NO: 337173 - DNA, 75 bp, Artificial Sequence
  Synthetic
acaaaacacaacagcactgtcaccaaaaggcacaaatgcaactataagcaaagacacctggtacaaaggaaacac

SEQ ID NO: 337174 - DNA, 75 bp, Artificial Sequence
  Synthetic
tctaaccaagggctcctcggtcggtggtgaatatcgtagccaacgcgacgccggatccgaggggccattttggac

SEQ ID NO: 337175 - DNA, 75 bp, Artificial Sequence
  Synthetic
ggtgaatatcgtagccaacgcgacgccggatccgaggggccattttggactgggggcgtggttttgatgacgtca

SEQ ID NO: 337176 - DNA, 75 bp, Artificial Sequence
  Synthetic
aaaggcacaaatgcaactataagcaaagacacctggtacaaaggaaacacatacaaagacaagattaaagagtta

SEQ ID NO: 337177 - DNA, 75 bp, Artificial Sequence
  Synthetic
cagctgcaacaaaagcagccctgccaaactaccctacaatcatgtccacagacctgtatgagtaccactcaggca

SEQ ID NO: 337178 - DNA, 75 bp, Artificial Sequence
  Synthetic
tcaaaggttgcacttccgcttccgggtgagcggtcgccatgatgaatcacgtggcttgtgacgtgtgattcacgt

SEQ ID NO: 337179 - DNA, 75 bp, Artificial Sequence
  Synthetic
gacctgtatgagtaccactcaggcatatactccagcatattcctagcagcaggcaggagctactttgagaccccg

SEQ ID NO: 337180 - DNA, 75 bp, Artificial Sequence
  Synthetic
gtgagcggtcgccatgatgaatcacgtggcttgtgacgtgtgattcacgtgacggccggccatcttgtggcggcc

SEQ ID NO: 337181 - DNA, 75 bp, Artificial Sequence
  Synthetic
catctgcgcgcgcaaccccccccccgcggcggggcgcgcgcttcgcgcgcgccccggggggcgcctgcggcgccc

SEQ ID NO: 337182 - DNA, 75 bp, Artificial Sequence
  Synthetic
aaacatggtctggatagactacctcacaaaaccagactccatatacacaaagaacaaaagcaaatgcgagatatt

SEQ ID NO: 337183 - DNA, 75 bp, Artificial Sequence
  Synthetic
ccccccccctgcagagcaggggccccccccctcgggggggctgcgcccccccggcccccccccccttggcgcgcc

SEQ ID NO: 337184 - DNA, 75 bp, Artificial Sequence
  Synthetic
aagtccgtcactaaccacgtgactcccgcaggccaatcagagtctatgtcgtgcacttcctgggcatggtctacg

SEQ ID NO: 337185 - DNA, 75 bp, Artificial Sequence
  Synthetic
ccgcaggccaatcagagtctatgtcgtgcacttcctgggcatggtctacgttctcatataactaactgcacttcc

SEQ ID NO: 337186 - DNA, 75 bp, Artificial Sequence
  Synthetic
acaggatactcagaattctgttcaaaagttacaggagacaccgccattcacctaactgccagagtagtagtcaga

SEQ ID NO: 337187 - DNA, 75 bp, Artificial Sequence
  Synthetic
aagttacaggagacaccgccattcacctaactgccagagtagtagtcagatgcccctacaccgagcccatgctaa

SEQ ID NO: 337188 - DNA, 75 bp, Artificial Sequence
  Synthetic
ctttgtaccatactcctttaactttggagagggcaagatgcccggaggctcctcaaaagtacccataagaatgag

SEQ ID NO: 337189 - DNA, 75 bp, Artificial Sequence
  Synthetic
agccaagtggtacgtgaacatgtttcaccagcaagaattcatggaggccatagttgagagcggaccgcttgctta

SEQ ID NO: 337190 - DNA, 75 bp, Artificial Sequence
  Synthetic
ctcggcaggccttacaggagaaagaaaagggcgctgtcactgcctggcgtgcgagctgcacaggcgaaacaacct

SEQ ID NO: 337191 - DNA, 75 bp, Artificial Sequence
  Synthetic
ggtgatatgagctggagccgtccagtacataatgccgccgggatcgaaaggcagtggttcgaatccacctttaga

SEQ ID NO: 337192 - DNA, 75 bp, Artificial Sequence
  Synthetic
tcccacgctagttgctgtggctgcggcaattttgttaatcatattaatgtactggctgctcgctacggctttact

SEQ ID NO: 337193 - DNA, 75 bp, Artificial Sequence
  Synthetic
ctgggccgcgtccacaactgaggcccgcgcttcccgcgccggaccccgacccccaggcgcccaaccgtgagccat

SEQ ID NO: 337194 - DNA, 75 bp, Artificial Sequence
  Synthetic
cgcgcttcccgcgccggaccccgacccccaggcgcccaaccgtgagccatggcgtggagctggtggtggcaacga

SEQ ID NO: 337195 - DNA, 75 bp, Artificial Sequence
  Synthetic
acgggggcgacgcagacggtacgccaccagacgaaagagacgttataggggtcgccgctttaaaaagaaactagt

SEQ ID NO: 337196 - DNA, 75 bp, Artificial Sequence
  Synthetic
gctccgagagcagcgagtactccggttccagctccaacagctcgccagccaagtcctcaaagtgcaagcagggca

SEQ ID NO: 337197 - DNA, 75 bp, Artificial Sequence
  Synthetic
atgagacgctgcttaatcaagggcatagtccccctggtaatatgcggccacaccaggtggaactacaactacgcc

SEQ ID NO: 337198 - DNA, 75 bp, Artificial Sequence
  Synthetic
caagcgtaaacaaagcctttatgtttgagccccagggtcccaaacccatacagggctacaacgattggttagaag

SEQ ID NO: 337199 - DNA, 75 bp, Artificial Sequence
  Synthetic
caggcctcccagaaagctacacacagatacacccttttacccctgggcaccaaaacccccagaccaagtgagagt

SEQ ID NO: 337200 - DNA, 75 bp, Artificial Sequence
  Synthetic
caacaaccagctagacctggccaggtacaagggggccaagttcaccttctacagacacaaaaagactgactttat

SEQ ID NO: 337201 - DNA, 75 bp, Artificial Sequence
  Synthetic
tacaagggggccaagttcaccttctacagacacaaaaagactgactttataatattctttaacagaaagcctccc

SEQ ID NO: 337202 - DNA, 75 bp, Artificial Sequence
  Synthetic
aaagccccccactctgttagaggacaagtggtacacccagcaggacctgtgcgacgttaacctgttgcaacttgt

SEQ ID NO: 337203 - DNA, 75 bp, Artificial Sequence
  Synthetic
ggagctgtgaatcagtaacgaaagtgagtggggccagacttcgccatagggcctttatcttcttgccattggata

SEQ ID NO: 337204 - DNA, 75 bp, Artificial Sequence
  Synthetic
gtgtaacgggtcgccataggcttcggcgtgcgttttaggccttccggactacaaaaatggcgtattcggtgacgt

SEQ ID NO: 337205 - DNA, 75 bp, Artificial Sequence
  Synthetic
gaaagacatctattatgacactatgagcatatctgaacccacagactcctacactagtgttaacaataaaagtac

SEQ ID NO: 337206 - DNA, 75 bp, Artificial Sequence
  Synthetic
agcatatctgaacccacagactcctacactagtgttaacaataaaagtacaacacaaacttttactaactactca

SEQ ID NO: 337207 - DNA, 75 bp, Artificial Sequence
  Synthetic
cacgagcctcctactggaactcgttccacgccactgaatacctaaaccccaacatcatatacaaaaacggtgaaa

SEQ ID NO: 337208 - DNA, 75 bp, Artificial Sequence
  Synthetic
caacccggaagtcctcctcggccacgtgactaatcacgtgattgttacgtcatcggcgccatcttatattacaaa

SEQ ID NO: 337209 - DNA, 75 bp, Artificial Sequence
  Synthetic
aactattcaaagaacatgaagacttaataacctggatgacccaaactaacaataccgggtttctaactaaaaaca

SEQ ID NO: 337210 - DNA, 75 bp, Artificial Sequence
  Synthetic
caggcccaatgcagacaaaattaaaaaagccagaaagacatactggaacgccctaataggcaccaacgacctggc

SEQ ID NO: 337211 - DNA, 75 bp, Artificial Sequence
  Synthetic
ggcggcgcgcgcgctgcgcgcgcgcgccgggggggcgccagcgcccccccccgcgcatgcgcgggtccccccccc

SEQ ID NO: 337212 - DNA, 75 bp, Artificial Sequence
  Synthetic
aaagccagaaagacatactggaacgccctaataggcaccaacgacctggccactaatataggccaggccagagca

SEQ ID NO: 337213 - DNA, 75 bp, Artificial Sequence
  Synthetic
tttttgctacgtcactaaccacgtgacccctcccacccaaccagagtctacttcgtgcacttcctgggaggggtc

SEQ ID NO: 337214 - DNA, 75 bp, Artificial Sequence
  Synthetic
gccgggggggcgccagcgcccccccccgcgcatgcgcgggtcccccccccgcggggggctccgccccccggcccc

SEQ ID NO: 337215 - DNA, 75 bp, Artificial Sequence
  Synthetic
ggtactcccccatatttctcagcagacacaggagcaacatgaactttgccagggcctaccaagacgtcacataca

SEQ ID NO: 337216 - DNA, 75 bp, Artificial Sequence
  Synthetic
caacagggtgtgggttcagcctctaactaaacccaccacagagttcgacgagaaaaggtgtaagtgcgtagtgca

SEQ ID NO: 337217 - DNA, 75 bp, Artificial Sequence
  Synthetic
tactgctaccaagactttgtagaggaggagctggggtcctcctcagagatattaaattcatgcctactggtatta

SEQ ID NO: 337218 - DNA, 75 bp, Artificial Sequence
  Synthetic
tgtatgacaaaaagctaccagacaagggattcgtgttttatgactccctttttggagacggcaaaatgtctgacg

SEQ ID NO: 337219 - DNA, 75 bp, Artificial Sequence
  Synthetic
gggattcgtgttttatgactccctttttggagacggcaaaatgtctgacggacgcggacaggtggacattttctg

SEQ ID NO: 337220 - DNA, 75 bp, Artificial Sequence
  Synthetic
gcaacagcgatggtaccctcgcttagccactcagatgcaagtcatgcacgacatcaccatgacgggccccttctc

SEQ ID NO: 337221 - DNA, 75 bp, Artificial Sequence
  Synthetic
ggctcaccactaactgactctgtggttgtgaacttccaggttctgcaatccatgtatgataaatacattagcata

SEQ ID NO: 337222 - DNA, 75 bp, Artificial Sequence
  Synthetic
caactgactgccaagtacacctttgactttatgtggggcggaaatatgatctccacacagatcatcaagaacccc

SEQ ID NO: 337223 - DNA, 75 bp, Artificial Sequence
  Synthetic
actttatgtggggcggaaatatgatctccacacagatcatcaagaacccctgcaaagacagtggactggaacccg

SEQ ID NO: 337224 - DNA, 75 bp, Artificial Sequence
  Synthetic
cttacaaattgttgacccatactccatgggcccccaattctcgttccacaactgggactacagacatggcctttt

SEQ ID NO: 337225 - DNA, 75 bp, Artificial Sequence
  Synthetic
tctaaacaaccaaaagatgatgcagactatcctaacccatacaaaaggcctagatattttccacccacagaccaa

SEQ ID NO: 337226 - DNA, 75 bp, Artificial Sequence
  Synthetic
tcagtttcctcaaaacagcaccgtcgaactcagaagagagcgatcaagaagtcctccaagaaacgcaagtactcc

SEQ ID NO: 337227 - DNA, 75 bp, Artificial Sequence
  Synthetic
caggctactaataagaagtccctttacagacccacagctactagtacacacagaccccacaaaaggctttgttcc

SEQ ID NO: 337228 - DNA, 75 bp, Artificial Sequence
  Synthetic
cagcgaatcggagagcaactccgatacctactccaacagatgttcaaaactcaggccaatctccacctaaaccca

SEQ ID NO: 337229 - DNA, 75 bp, Artificial Sequence
  Synthetic
cctgggaggacgagttcctcaccgcaaaagtgtggaaccgcccggtacgcaagtactactcagacaccccctact

SEQ ID NO: 337230 - DNA, 75 bp, Artificial Sequence
  Synthetic
acccctgggcccccaaaccccagtactctgtcagtttcaaactcggctggaaataaaaaaagcctgctccactgt

SEQ ID NO: 337231 - DNA, 75 bp, Artificial Sequence
  Synthetic
gggacggctgtcttaaatacggaagtaggccccgccacgtgatttaacacgtgtgcatgcgtcacggcggccatt

SEQ ID NO: 337232 - DNA, 75 bp, Artificial Sequence
  Synthetic
aaataaaaaaagcctgctccactgtactaggccgtgggagtttcactcgtcggtgtctacctcttaaggtcacca

SEQ ID NO: 337233 - DNA, 75 bp, Artificial Sequence
  Synthetic
gtgtgcatgcgtcacggcggccattttgttttacaaaatggcgaacaaccttcctcttttttaaaaaaaggcgcc

SEQ ID NO: 337234 - DNA, 75 bp, Artificial Sequence
  Synthetic
cggtgtctacctcttaaggtcaccaagcactccgagcgtcagcgaggagtgcgacccttgggggtgggtgcaacg

SEQ ID NO: 337235 - DNA, 75 bp, Artificial Sequence
  Synthetic
tcggctgcgcgcggcacctcggacccccgctcgtgctgacgcgcttgcgcgcgtcagaccacttcgggctcgcgg

SEQ ID NO: 337236 - DNA, 75 bp, Artificial Sequence
  Synthetic
cccagaaaaggaaagtgcttctgcaaactgtgcgagctccaaagaaggctaggcggcttctaggtatgtggcagc

SEQ ID NO: 337237 - DNA, 75 bp, Artificial Sequence
  Synthetic
ttcagatcccatgctgctgtttgtggctgtggcgactttgttggccatcttaatcatctggcaactactctgggt

SEQ ID NO: 337238 - DNA, 75 bp, Artificial Sequence
  Synthetic
caactccactttctcacaaaatggcggcggagcacttccggcttgcccaaaatggccgccaaaaacatccgggtc

SEQ ID NO: 337239 - DNA, 75 bp, Artificial Sequence
  Synthetic
gcggaccccgcacgccacaaataagaaacctgccagcgctcccggcgccccagggcgagcccggtgacagagcgc

SEQ ID NO: 337240 - DNA, 75 bp, Artificial Sequence
  Synthetic
acgtgactggggaggtacttaaacacggaagtatcctcaaccacgtaactggtcacgtggtgcgcacgtcacggc

SEQ ID NO: 337241 - DNA, 75 bp, Artificial Sequence
  Synthetic
ggtcacgtggtgcgcacgtcacggcaaccattttgttttacaaaatggcgcatttccttcctcttttttaaaaat

SEQ ID NO: 337242 - DNA, 75 bp, Artificial Sequence
  Synthetic
aaccattttgttttacaaaatggcgcatttccttcctcttttttaaaaattaaccgttggcggcggcgcgcgcgc

SEQ ID NO: 337243 - DNA, 75 bp, Artificial Sequence
  Synthetic
cgccgctttcgagctcgtcgaagagtaaggaggcgcggggggcggtggcgcagacgctacagaaaatggcgacgg

SEQ ID NO: 337244 - DNA, 75 bp, Artificial Sequence
  Synthetic
ggagctctgcccccccccgcgcatgcgcgcgggtcccccccccgcggggggctccgccccccggtcccccccccg

SEQ ID NO: 337245 - DNA, 75 bp, Artificial Sequence
  Synthetic
tacgtcactaaccacgtgttctccacagaccaaccgtatactatgtcgtccacttcctgggctgtgtctacgtcc

SEQ ID NO: 337246 - DNA, 75 bp, Artificial Sequence
  Synthetic
cagaccaaccgtatactatgtcgtccacttcctgggctgtgtctacgtcctaatataaatgagtacacttccgaa

SEQ ID NO: 337247 - DNA, 75 bp, Artificial Sequence
  Synthetic
cacttcctgggctgtgtctacgtcctaatataaatgagtacacttccgaatggctgagtttatgctgcccgtccg

SEQ ID NO: 337248 - DNA, 75 bp, Artificial Sequence
  Synthetic
tctgtggcgaaaacacaaccgcccagaactatgccactcactcagacgacatgataagcaaaggaccgtacgggg

SEQ ID NO: 337249 - DNA, 75 bp, Artificial Sequence
  Synthetic
ggggcaattcgggctcgggactggccgggccccgggcaaggctcttaaatagctatgttttttggtaggcctcac

SEQ ID NO: 337250 - DNA, 75 bp, Artificial Sequence
  Synthetic
ttagcttgccaactgcgaagaaaaaaccacctatgagtctgtggaggcctcctctgcacaatgtcccggggatcg

SEQ ID NO: 337251 - DNA, 75 bp, Artificial Sequence
  Synthetic
accacctatgagtctgtggaggcctcctctgcacaatgtcccggggatcgagcacctctggtacgagtccgtgca

SEQ ID NO: 337252 - DNA, 75 bp, Artificial Sequence
  Synthetic
tgtggggatcctgtacgccatcttactgctcttgctgaaagatatggcgtcccggggggctcgcgatcttctggg

SEQ ID NO: 337253 - DNA, 75 bp, Artificial Sequence
  Synthetic
ctgctcttgctgaaagatatggcgtcccggggggctcgcgatcttctggggcaccgggagtagggggcaaccaca

SEQ ID NO: 337254 - DNA, 75 bp, Artificial Sequence
  Synthetic
ccagcaggtaaccagcctccggccctgccatggcatggggatggtggaagcggagacggcgcggctggtggagga

SEQ ID NO: 337255 - DNA, 75 bp, Artificial Sequence
  Synthetic
gacaacccttgcgtcaacttccagatcctggggccccagtacaaaaaacaccttagtattagctccactatggat

SEQ ID NO: 337256 - DNA, 75 bp, Artificial Sequence
  Synthetic
cagacgatggcctagacgaagtcgtcgccgccctcgacgaagacgagtaaggaggcggaggaggtggaggagagg

SEQ ID NO: 337257 - DNA, 75 bp, Artificial Sequence
  Synthetic
cgccgccctcgacgaagacgagtaaggaggcggaggaggtggaggagaggacgaccgagacgcagactatacaga

SEQ ID NO: 337258 - DNA, 75 bp, Artificial Sequence
  Synthetic
gaaagagggctaaaataactataagacagtggcaaccagccaagactagaaaatgctacataagaggctacatgc

SEQ ID NO: 337259 - DNA, 75 bp, Artificial Sequence
  Synthetic
acagtggcaaccagccaagactagaaaatgctacataagaggctacatgcccgcccttatgtgcggctggggagc

SEQ ID NO: 337260 - DNA, 75 bp, Artificial Sequence
  Synthetic
ttagaggacaaaataactgcgggaccgtacggtgggggacacagcactatgagattctccctacaggtgctctac

SEQ ID NO: 337261 - DNA, 75 bp, Artificial Sequence
  Synthetic
cgtacggtgggggacacagcactatgagattctccctacaggtgctctacgaggagcacctaaaacaccacaatt

SEQ ID NO: 337262 - DNA, 75 bp, Artificial Sequence
  Synthetic
accaaactaccccacaattatgtccacagacttatacgaataccactcaggaatatactccagcacatatctatc

SEQ ID NO: 337263 - DNA, 75 bp, Artificial Sequence
  Synthetic
agaactggccctgtactatggctgcacaattaagttttacagggaccccgaaacagactttatagttacatacca

SEQ ID NO: 337264 - DNA, 75 bp, Artificial Sequence
  Synthetic
acaattaagttttacagggaccccgaaacagactttatagttacataccagagaaaatctcctctgggaggtaac

SEQ ID NO: 337265 - DNA, 75 bp, Artificial Sequence
  Synthetic
cagcagaagccatgcttacgagaaacaaaatactagtacccagtttacaaactaaaccaaaaggaaaaaaaactg

SEQ ID NO: 337266 - DNA, 75 bp, Artificial Sequence
  Synthetic
caaaatactagtacccagtttacaaactaaaccaaaaggaaaaaaaactgtaaaagttaacatagcaccccccac

SEQ ID NO: 337267 - DNA, 75 bp, Artificial Sequence
  Synthetic
caaaaagacatatgtgacttaacactgttcaacttgaacgttattgcggctgacttgcggtttccgttcggctca

SEQ ID NO: 337268 - DNA, 75 bp, Artificial Sequence
  Synthetic
tgttcaacttgaacgttattgcggctgacttgcggtttccgttcggctcaccacaaactgacaacatttgcataa

SEQ ID NO: 337269 - DNA, 75 bp, Artificial Sequence
  Synthetic
caacggcttcctctctataacccacacttcctcaacaagtgacaatatcataaatgagtttttaaaactagcaat

SEQ ID NO: 337270 - DNA, 75 bp, Artificial Sequence
  Synthetic
acttcctcaacaagtgacaatatcataaatgagtttttaaaactagcaataccagatgaacctaaacaaagacac

SEQ ID NO: 337271 - DNA, 75 bp, Artificial Sequence
  Synthetic
cagaaggctgcttctcacacccacaactgcaaaaatacaaaatacctactacaggcataggcactgaaaactact

SEQ ID NO: 337272 - DNA, 75 bp, Artificial Sequence
  Synthetic
actgcaaaaatacaaaatacctactacaggcataggcactgaaaactactttactacaccagacggactatgggg

SEQ ID NO: 337273 - DNA, 75 bp, Artificial Sequence
  Synthetic
agcggttgacccgaaatacaataccccagaagtcacatggcactcgtgggacatcagacgaggactctttggcaa

SEQ ID NO: 337274 - DNA, 75 bp, Artificial Sequence
  Synthetic
acaggcacatcccaaactgcacaaactataagacaaacaattaaaaataacatgacttcttactttaaaaaaata

SEQ ID NO: 337275 - DNA, 75 bp, Artificial Sequence
  Synthetic
ctataagacaaacaattaaaaataacatgacttcttactttaaaaaaatagaagaagagagtacaataataacaa

SEQ ID NO: 337276 - DNA, 75 bp, Artificial Sequence
  Synthetic
aacaggaatattttcacctccatggctaaacataggcagagtcagcagagagtttccaggactatacaatgacat

SEQ ID NO: 337277 - DNA, 75 bp, Artificial Sequence
  Synthetic
ctaaacataggcagagtcagcagagagtttccaggactatacaatgacattatatacaacccatggacagacaaa

SEQ ID NO: 337278 - DNA, 75 bp, Artificial Sequence
  Synthetic
acagcttaacaaaaacagacaacatttacaaaaaaggacaaagtgtacttctaatagaagacatgcctatgtaca

SEQ ID NO: 337279 - DNA, 75 bp, Artificial Sequence
  Synthetic
ttacaaaaaaggacaaagtgtacttctaatagaagacatgcctatgtacattatgctaaacggatacatagactg

SEQ ID NO: 337280 - DNA, 75 bp, Artificial Sequence
  Synthetic
caactgcaaaccatgtacagagtaatgatagtatgtccttacacatatccaagactatacctagaaaccaatcct

SEQ ID NO: 337281 - DNA, 75 bp, Artificial Sequence
  Synthetic
tgatagtatgtccttacacatatccaagactatacctagaaaccaatccttacaatggctatgtaatgtactcgc

SEQ ID NO: 337282 - DNA, 75 bp, Artificial Sequence
  Synthetic
aagaatacactgcttgcaagcactgggacagaccccccagaaagctacactcagacattcccttctacccctggg

SEQ ID NO: 337283 - DNA, 75 bp, Artificial Sequence
  Synthetic
agacaaaatatccattccacccatagcatggagaggcaagtggtacccacacatactacaccaagaagcagtaat

SEQ ID NO: 337284 - DNA, 75 bp, Artificial Sequence
  Synthetic
gcatggagaggcaagtggtacccacacatactacaccaagaagcagtaataaatgacatagtacagtcagggcct

SEQ ID NO: 337285 - DNA, 75 bp, Artificial Sequence
  Synthetic
acatgcaactaaacatgaaatactcatttagatttacatggggcggtaatcctatctctgcacagattgttaaag

SEQ ID NO: 337286 - DNA, 75 bp, Artificial Sequence
  Synthetic
atttagatttacatggggcggtaatcctatctctgcacagattgttaaagacccctgcacccagcccacctttga

SEQ ID NO: 337287 - DNA, 75 bp, Artificial Sequence
  Synthetic
cgcagaatacaagtcatcaatccgaaattcctcgggcccaactacagtttcagatcatttgacatacgacgtgac

SEQ ID NO: 337288 - DNA, 75 bp, Artificial Sequence
  Synthetic
aattcctcgggcccaactacagtttcagatcatttgacatacgacgtgacctctttagcgacaagagtcttaaaa

SEQ ID NO: 337289 - DNA, 75 bp, Artificial Sequence
  Synthetic
tgagtctttattctcaggtggcaaacgcccccggatcgatctgcccaagtacgtcccgccagaagaaagctccaa

SEQ ID NO: 337290 - DNA, 75 bp, Artificial Sequence
  Synthetic
cgcccccggatcgatctgcccaagtacgtcccgccagaagaaagctccaatacgcaacagagacaacaaagagaa

SEQ ID NO: 337291 - DNA, 75 bp, Artificial Sequence
  Synthetic
aaagcgaagcagaagcccaagaagaaacgccggaggggtcgatccgagagcagctccagcaccagctccaagagc

SEQ ID NO: 337292 - DNA, 75 bp, Artificial Sequence
  Synthetic
aacgccggaggggtcgatccgagagcagctccagcaccagctccaagagcagcttcaactccgaagagggctcca

SEQ ID NO: 337293 - DNA, 75 bp, Artificial Sequence
  Synthetic
acgcagcagggagtccacgtagacccctgccttgcgtaggccccaagcagtggctatttccagagagaaagccca

SEQ ID NO: 337294 - DNA, 75 bp, Artificial Sequence
  Synthetic
cctgccttgcgtaggccccaagcagtggctatttccagagagaaagcccaaaccccctcctagttccggggactg

SEQ ID NO: 337295 - DNA, 75 bp, Artificial Sequence
  Synthetic
ataatgaacaggcctccccgcactcacctcacagacccccctttctatccttactgcaaaaacaattacaatgta

SEQ ID NO: 337296 - DNA, 75 bp, Artificial Sequence
  Synthetic
ttgcacctttagacgccctctggggagaccccatatactataatgatctaaatgaaaagaaaagtttgaaggata

SEQ ID NO: 337297 - DNA, 75 bp, Artificial Sequence
  Synthetic
acctttcagcttaactacaaataaagctcagccttactgttcaaggccgtgggactttcacttgtcggtgtctac

SEQ ID NO: 337298 - DNA, 75 bp, Artificial Sequence
  Synthetic
agaccccatatactataatgatctaaatgaaaagaaaagtttgaaggatatcattgagaacatactaataaaaaa

SEQ ID NO: 337299 - DNA, 75 bp, Artificial Sequence
  Synthetic
gcgccagcgaggagagcgacccttccccctgactcaacttcttcggagccgcgcgctacgccttcggctgcgcgc

SEQ ID NO: 337300 - DNA, 75 bp, Artificial Sequence
  Synthetic
ttattaaacagactccaggttgccattggacactggagctgtgaatcagtaacgaaagtgagtggggccagactt

SEQ ID NO: 337301 - DNA, 75 bp, Artificial Sequence
  Synthetic
ttggacactggagctgtgaatcagtaacgaaagtgagtggggccagacttcgccataaggcctttatcttcttgc

SEQ ID NO: 337302 - DNA, 75 bp, Artificial Sequence
  Synthetic
ttccggactacaaaaaccgccatattagtgacgtcacagccgccattttaagtaagcatggcgggcggtgacgtg

SEQ ID NO: 337303 - DNA, 75 bp, Artificial Sequence
  Synthetic
tagtgacgtcacagccgccattttaagtaagcatggcgggcggtgacgtgcaatgtcaaaggtcacagcctgtca

SEQ ID NO: 337304 - DNA, 75 bp, Artificial Sequence
  Synthetic
gcttccgggttagccgccatgtttggtcacgtgactacctacgtcacggccgccactttagtttacaaaatggcc

SEQ ID NO: 337305 - DNA, 75 bp, Artificial Sequence
  Synthetic
gtcacgtgactacctacgtcacggccgccactttagtttacaaaatggccgacttccttcctcttttgtgaaaaa

SEQ ID NO: 337306 - DNA, 75 bp, Artificial Sequence
  Synthetic
gcccagtagggggcgccatgcgcccccccccgcgcatgcgcggggcccccccccgcggggggctccgccccccgg

SEQ ID NO: 337307 - DNA, 75 bp, Artificial Sequence
  Synthetic
ggggcggcgcgctgcgcgcgccgcccagtagggggtgctaaagcacccccccccgcgcatgcgcggggccccccc

SEQ ID NO: 337308 - DNA, 75 bp, Artificial Sequence
  Synthetic
cagtagggggtgctaaagcacccccccccgcgcatgcgcggggccccccccccggggggctctgccccccggccc

SEQ ID NO: 337309 - DNA, 75 bp, Artificial Sequence
  Synthetic
attttgtgcagcccgccaatttctgttcaaacaggccaatcaccgtctactacgtacacttcctggggtgtgtcc

SEQ ID NO: 337310 - DNA, 75 bp, Artificial Sequence
  Synthetic
ttcaaacaggccaatcaccgtctactacgtacacttcctggggtgtgtcctcccactgaatataagcaacagcgg

SEQ ID NO: 337311 - DNA, 75 bp, Artificial Sequence
  Synthetic
ccgtccgcagcgaggacgcgagcgcagcgagcggccgagcgacccgtgggcgggagccgaaggtgagtttacaca

SEQ ID NO: 337312 - DNA, 75 bp, Artificial Sequence
  Synthetic
agcgagcggccgagcgacccgtgggcgggagccgaaggtgagtttacacaccgcagtcaaggggcaattcgggct

SEQ ID NO: 337313 - DNA, 75 bp, Artificial Sequence
  Synthetic
aatataattcactactttcagctatagagacacacacccaaggcactctatttaatacatttaaaacaccagaaa

SEQ ID NO: 337314 - DNA, 75 bp, Artificial Sequence
  Synthetic
ccgtggtctctgccgagacataatatcagaacgagagaagatctctgggtgcaatcgattctttattcacatgac

SEQ ID NO: 337315 - DNA, 75 bp, Artificial Sequence
  Synthetic
acaaactgctacaaaaaactagacatcgcctggggagacactatatggaaccaaagcaccataggcaactttaaa

SEQ ID NO: 337316 - DNA, 75 bp, Artificial Sequence
  Synthetic
actttttgtggctgtgataatattcctgagcatcttactggcctcctgggcggcgtacgaccagctccacctaga

SEQ ID NO: 337317 - DNA, 75 bp, Artificial Sequence
  Synthetic
gcctgccggcactgccgccagctccggaaccccctgaggaaccacggcgtggtggagatacagacggagaccgtg

SEQ ID NO: 337318 - DNA, 75 bp, Artificial Sequence
  Synthetic
ggcctacgaacccgaagacctagaagaacttttcgccgccgccgagcaagacgatatgtgagtagagggcggcgc

SEQ ID NO: 337319 - DNA, 75 bp, Artificial Sequence
  Synthetic
gggggcgacgcagacggggacgcagacgcaggcacagaaagactctcattgtcaggcaatggcaaccagacgtta

SEQ ID NO: 337320 - DNA, 75 bp, Artificial Sequence
  Synthetic
gctgcccctcattatctgtggaaacggacacacccaatttaactttataactcacatggatgacattccacccaa

SEQ ID NO: 337321 - DNA, 75 bp, Artificial Sequence
  Synthetic
ggacacacccaatttaactttataactcacatggatgacattccacccaagaatgcatcctacgggggcaacttc

SEQ ID NO: 337322 - DNA, 75 bp, Artificial Sequence
  Synthetic
attttgtgcagcccgccaatttctgttcaaacagaccaatcagctactacttcgtgcacttcctggggcgtgtcc

SEQ ID NO: 337323 - DNA, 75 bp, Artificial Sequence
  Synthetic
gcttctatgacgaattcatgcaccacagaaacagatggtcagcctctaaccatgacctagagctagtgagataca

SEQ ID NO: 337324 - DNA, 75 bp, Artificial Sequence
  Synthetic
cagaaacagatggtcagcctctaaccatgacctagagctagtgagatacatcagaaccagccttaaactctacag

SEQ ID NO: 337325 - DNA, 75 bp, Artificial Sequence
  Synthetic
tgctacaccaccacaggccccttcgagacaaatgaaatgtcctacatgctcactcaccctctggccatgctcctc

SEQ ID NO: 337326 - DNA, 75 bp, Artificial Sequence
  Synthetic
agacaaatgaaatgtcctacatgctcactcaccctctggccatgctcctcagcaaaagacacgtagttgtgccta

SEQ ID NO: 337327 - DNA, 75 bp, Artificial Sequence
  Synthetic
tcgggactggccgggctatgggcaaggctcttaaaaagctccctcgctgtgttcttcgccaggacacaaaacaat

SEQ ID NO: 337328 - DNA, 75 bp, Artificial Sequence
  Synthetic
aaagtacaaaaagataacaattaagcccccaaaactgatgctaaacaagtggtactttgctacagacctctgcca

SEQ ID NO: 337329 - DNA, 75 bp, Artificial Sequence
  Synthetic
atccaaggcagagaagatcaatggtatgcaggcatctttcatacgcattttgctttttgcggttgtggtgaccct

SEQ ID NO: 337330 - DNA, 75 bp, Artificial Sequence
  Synthetic
cccccaaaactgatgctaaacaagtggtactttgctacagacctctgccacataggcctcttccagctctgggcc

SEQ ID NO: 337331 - DNA, 75 bp, Artificial Sequence
  Synthetic
atgcaggcatctttcatacgcattttgctttttgcggttgtggtgaccctgttgggcgtattaaccgcattgctc

SEQ ID NO: 337332 - DNA, 75 bp, Artificial Sequence
  Synthetic
ggctcagatcaggcacaaacagccctgttataggcttctatgtccttaaaaaccaagtttacaaaaacagataca

SEQ ID NO: 337333 - DNA, 75 bp, Artificial Sequence
  Synthetic
gagaccacctccagggctagaccagcccaacctcggagggccggaaggtccaggaggtgcccctagagccctgcc

SEQ ID NO: 337334 - DNA, 75 bp, Artificial Sequence
  Synthetic
tgttataggcttctatgtccttaaaaaccaagtttacaaaaacagatacagcaacctaaacacaacagaagcaca

SEQ ID NO: 337335 - DNA, 75 bp, Artificial Sequence
  Synthetic
gaactaacccaaacaaaaactaacgacaaatggtacaattggcaatatacatacaataaacttatgaagccaatt

SEQ ID NO: 337336 - DNA, 75 bp, Artificial Sequence
  Synthetic
gagccggcaccacggcgtggtggtggggccgatggagacagcgccgctggggccgccgccgccgcagaccatgga

SEQ ID NO: 337337 - DNA, 75 bp, Artificial Sequence
  Synthetic
acaaatggtacaattggcaatatacatacaataaacttatgaagccaatttactatgcagcttcaaatgaaagta

SEQ ID NO: 337338 - DNA, 75 bp, Artificial Sequence
  Synthetic
gggccgatggagacagcgccgctggggccgccgccgccgcagaccatggagggtacgacgaaggagacctagaag

SEQ ID NO: 337339 - DNA, 75 bp, Artificial Sequence
  Synthetic
atataattggaaacattacaaagaatattttagcaacacacaaactaagtggaaaacaattattaaagacgccta

SEQ ID NO: 337340 - DNA, 75 bp, Artificial Sequence
  Synthetic
tattttagcaacacacaaactaagtggaaaacaattattaaagacgcctatgacttagtaagagaggaataccaa

SEQ ID NO: 337341 - DNA, 75 bp, Artificial Sequence
  Synthetic
gccgctactacaggcgcagactaagacggggcagacgcagagggcgacgaaagagacacagaccgaccctaatac

SEQ ID NO: 337342 - DNA, 75 bp, Artificial Sequence
  Synthetic
atccaccaccatggcaatcaaccacttctaatacaggcagacaatacctagaacatgactgtggcatttacagcc

SEQ ID NO: 337343 - DNA, 75 bp, Artificial Sequence
  Synthetic
taaacactgtaagataacaggatggatgcccctcattatctgtggctctggcagcacacagatgaactttataac

SEQ ID NO: 337344 - DNA, 75 bp, Artificial Sequence
  Synthetic
ttctaatacaggcagacaatacctagaacatgactgtggcatttacagcccatactttctaacaccacaaatata

SEQ ID NO: 337345 - DNA, 75 bp, Artificial Sequence
  Synthetic
atgcccctcattatctgtggctctggcagcacacagatgaactttataacccacatggacgatactcctcccatg

SEQ ID NO: 337346 - DNA, 75 bp, Artificial Sequence
  Synthetic
tcctacatcagatacaatcccctcacagacaaaggcataggaaacagagtctgtgtccagtactgcagcgaggcc

SEQ ID NO: 337347 - DNA, 75 bp, Artificial Sequence
  Synthetic
taaatgtgactttcagcttagaggccatctatgaacagttcctatatcacagaaacagatggtccagatctaacc

SEQ ID NO: 337348 - DNA, 75 bp, Artificial Sequence
  Synthetic
cagacaaaggcataggaaacagagtctgtgtccagtactgcagcgaggccagcagcgactacaacccaataaaga

SEQ ID NO: 337349 - DNA, 75 bp, Artificial Sequence
  Synthetic
catctatgaacagttcctatatcacagaaacagatggtccagatctaaccatgacttagacctagccaggtacca

SEQ ID NO: 337350 - DNA, 75 bp, Artificial Sequence
  Synthetic
cacgccacagtagactacatactttcctacaacaggacaggacccttccagatcagtgagatgacatacatgagc

SEQ ID NO: 337351 - DNA, 75 bp, Artificial Sequence
  Synthetic
gcagactatgtagtaaagagcacaggcatacagtcagcctggacagacatgagagtggccatcagatgtccctac

SEQ ID NO: 337352 - DNA, 75 bp, Artificial Sequence
  Synthetic
gcatacagtcagcctggacagacatgagagtggccatcagatgtccctacacagaccctaagcttgtgggcagca

SEQ ID NO: 337353 - DNA, 75 bp, Artificial Sequence
  Synthetic
cctacaacaggacaggacccttccagatcagtgagatgacatacatgagcactcacccagcaataatgctactaa

SEQ ID NO: 337354 - DNA, 75 bp, Artificial Sequence
  Synthetic
ccttagaacaaagcctaaaggcaggcgctccataaaaattagaataaagccccccaaacttatgctaaacaagtg

SEQ ID NO: 337355 - DNA, 75 bp, Artificial Sequence
  Synthetic
aggcctagaattcatgaacggagacattccagacaaaaggccctacattccgttaacctggtggtttaagtggta

SEQ ID NO: 337356 - DNA, 75 bp, Artificial Sequence
  Synthetic
attccagacaaaaggccctacattccgttaacctggtggtttaagtggtaccccatgattacacaccagaaaacc

SEQ ID NO: 337357 - DNA, 75 bp, Artificial Sequence
  Synthetic
cgctccataaaaattagaataaagccccccaaacttatgctaaacaagtggtactttaccaaagacatatgctcc

SEQ ID NO: 337358 - DNA, 75 bp, Artificial Sequence
  Synthetic
ccggagcagaactcactaacccctggctcagagacaccacaaaaagcccagtaataggcttcagagttctaaaaa

SEQ ID NO: 337359 - DNA, 75 bp, Artificial Sequence
  Synthetic
gccccttcatgcccagagatcaggaacaagctagttgggacataactgtaggttacaaagcaaccttcttatggg

SEQ ID NO: 337360 - DNA, 75 bp, Artificial Sequence
  Synthetic
gctcagagacaccacaaaaagcccagtaataggcttcagagttctaaaaaacagtgtttacaccaacttatctaa

SEQ ID NO: 337361 - DNA, 75 bp, Artificial Sequence
  Synthetic
ggttacaaagcaaccttcttatggggcgggtccccgttacctccacagcccattgacgacccctgccaaaaagga

SEQ ID NO: 337362 - DNA, 75 bp, Artificial Sequence
  Synthetic
gaaagaaaatccatcttaaacaaaattcacccagaaactctcacaggatcaggcaatgcatctaaagggtgggaa

SEQ ID NO: 337363 - DNA, 75 bp, Artificial Sequence
  Synthetic
ttcacccagaaactctcacaggatcaggcaatgcatctaaagggtgggaatactcatacacaaaactaatggcgc

SEQ ID NO: 337364 - DNA, 75 bp, Artificial Sequence
  Synthetic
caaaccctccaagaatacaaatatcagacccgcaacacctcggaccggcgacgctgttccactcgtgggacctca

SEQ ID NO: 337365 - DNA, 75 bp, Artificial Sequence
  Synthetic
agacccgcaacacctcggaccggcgacgctgttccactcgtgggacctcagacgtggatatattaatacaaaaag

SEQ ID NO: 337366 - DNA, 75 bp, Artificial Sequence
  Synthetic
cagcacatacaactggcaaaactaccaaacacactgcgcaacaacagctatcaaatttaaagaaaaacaaaccag

SEQ ID NO: 337367 - DNA, 75 bp, Artificial Sequence
  Synthetic
caaacacactgcgcaacaacagctatcaaatttaaagaaaaacaaaccagtactctaactcttattaaagcagag

SEQ ID NO: 337368 - DNA, 75 bp, Artificial Sequence
  Synthetic
gatgctaatgaatatttttcgacaggcgtcgtgtccaaaaaaccccgattcgacactccccaccacgggcagcta

SEQ ID NO: 337369 - DNA, 75 bp, Artificial Sequence
  Synthetic
gcgtcgtgtccaaaaaaccccgattcgacactccccaccacgggcagctatcaaaccaagaagaagacgccttgt

SEQ ID NO: 337370 - DNA, 75 bp, Artificial Sequence
  Synthetic
tcacacaggtagacttcatagatgaccccacactcacacatgactttggcatatacagcccatactggataacac

SEQ ID NO: 337371 - DNA, 75 bp, Artificial Sequence
  Synthetic
ccccacactcacacatgactttggcatatacagcccatactggataacacctaccagaataagcctagactggga

SEQ ID NO: 337372 - DNA, 75 bp, Artificial Sequence
  Synthetic
gcaagaagagaccacctccgaggaagaacaagcactccaaaaagaagaggagcaaaaagaaaagctcctacagca

SEQ ID NO: 337373 - DNA, 75 bp, Artificial Sequence
  Synthetic
gaacaagcactccaaaaagaagaggagcaaaaagaaaagctcctacagcaactcagagtccagcgacagcaccag

SEQ ID NO: 337374 - DNA, 75 bp, Artificial Sequence
  Synthetic
aacccactctcagacaaaggcataggcaacagaatctatgcacagtggtgctcagaaaaaagcagcaaattagac

SEQ ID NO: 337375 - DNA, 75 bp, Artificial Sequence
  Synthetic
gcaacagaatctatgcacagtggtgctcagaaaaaagcagcaaattagacaccacaaagagcaaatgcatactaa

SEQ ID NO: 337376 - DNA, 75 bp, Artificial Sequence
  Synthetic
acctcatgggagacgtcctccgactcagacagggagtccactggaacccagtcctataatacttccaccagaacc

SEQ ID NO: 337377 - DNA, 75 bp, Artificial Sequence
  Synthetic
ctatggctactgtgactgggtagtaaaatgtacaggagtgtccagtgcatggacagacatgagagtagccatcat

SEQ ID NO: 337378 - DNA, 75 bp, Artificial Sequence
  Synthetic
actggtaaaaaaaaaaaattctctctcttcgactgggagtgcgagagggatctagcatgtgcattctgccgtccc

SEQ ID NO: 337379 - DNA, 75 bp, Artificial Sequence
  Synthetic
aaatgtacaggagtgtccagtgcatggacagacatgagagtagccatcatctgcccgtacacagaaccggcactt

SEQ ID NO: 337380 - DNA, 75 bp, Artificial Sequence
  Synthetic
ttattccagtaagtgacaccttttgcaacggagacatgccgtttcttgcaccatacatccctattacatggtgga

SEQ ID NO: 337381 - DNA, 75 bp, Artificial Sequence
  Synthetic
gcgagatatccccaaaatatgtaaagtaaacttcaaaataaatttcactgaatgaaatttcgaggccccgggagt

SEQ ID NO: 337382 - DNA, 75 bp, Artificial Sequence
  Synthetic
gtaaacttcaaaataaatttcactgaatgaaatttcgaggccccgggagtttcacttagcggtgtctacctctaa

SEQ ID NO: 337383 - DNA, 75 bp, Artificial Sequence
  Synthetic
tcaagtggtaccccatgattacacaccaaaaggaagttcttgaggcaatagtaaactgtggaccgtttgtccccc

SEQ ID NO: 337384 - DNA, 75 bp, Artificial Sequence
  Synthetic
tggaaatggggcggctctcccctgccttcacaggcaatcgacgacccctgccagaagcccacccatgagctaccc

SEQ ID NO: 337385 - DNA, 75 bp, Artificial Sequence
  Synthetic
tcggacccccgctcgtgctgacacgctcgcgcgtgtcagaccacttcgggctcgcgggggtcgagttatttacta

SEQ ID NO: 337386 - DNA, 75 bp, Artificial Sequence
  Synthetic
aacagactccgagtcgctcttggactcaggagctgtgaatcagtaacgaaagtgagtggggccagacttcgccat

SEQ ID NO: 337387 - DNA, 75 bp, Artificial Sequence
  Synthetic
tacaagtctctgacccgacaaagctcggaccgaagacagtgttccacaaatgggactggagacgtgggcaactta

SEQ ID NO: 337388 - DNA, 75 bp, Artificial Sequence
  Synthetic
tcaggagctgtgaatcagtaacgaaagtgagtggggccagacttcgccataaggcctttaacttctgggtccgta

SEQ ID NO: 337389 - DNA, 75 bp, Artificial Sequence
  Synthetic
cggaccgaagacagtgttccacaaatgggactggagacgtgggcaacttagcaaaagaagtattaaaagagtcca

SEQ ID NO: 337390 - DNA, 75 bp, Artificial Sequence
  Synthetic
gttacagggcctttatcaagaaaaagaaacaagctcgacacaaagatgccaggccccccaacccccgaaaaagaa

SEQ ID NO: 337391 - DNA, 75 bp, Artificial Sequence
  Synthetic
cgccattttaggccctcgcgggcctccgtaggcgcgctttaatgacgtcgcaggcgccatcttggctgtgacgtt

SEQ ID NO: 337392 - DNA, 75 bp, Artificial Sequence
  Synthetic
gaaacaagctcgacacaaagatgccaggccccccaacccccgaaaaagaaagctacactttactccaagccctcc

SEQ ID NO: 337393 - DNA, 75 bp, Artificial Sequence
  Synthetic
ccaggacgaagaacaagcaccccaaaaagaagagaaccagaaagaagcgctcgtggagcagctccagctccagaa

SEQ ID NO: 337394 - DNA, 75 bp, Artificial Sequence
  Synthetic
aaagaagagaaccagaaagaagcgctcgtggagcagctccagctccagaaacagcaccagcgagtcctcaagcga

SEQ ID NO: 337395 - DNA, 75 bp, Artificial Sequence
  Synthetic
tcctccgactccgccgcggagtccactgggaccccctcctatcctaattcagggtccctctatcccagacctgct

SEQ ID NO: 337396 - DNA, 75 bp, Artificial Sequence
  Synthetic
tagggggcgctgcgcgcccccccccgcgcatgcgcggggaccccccccccccgttctatatccaccgcgcatgcg

SEQ ID NO: 337397 - DNA, 75 bp, Artificial Sequence
  Synthetic
aagtacgtcactaaccacgtgactcccgcaggccaaccagagtctacgtcgtgcacttcctgggcatggtctaca

SEQ ID NO: 337398 - DNA, 75 bp, Artificial Sequence
  Synthetic
ctgggaccccctcctatcctaattcagggtccctctatcccagacctgcttttccctaacactcaaaaaaaaccc

SEQ ID NO: 337399 - DNA, 75 bp, Artificial Sequence
  Synthetic
ccgagtaccaaatagccaagtggccagaccgccctttgaggcactacccctcagacctccctcactacccgtggc

SEQ ID NO: 337400 - DNA, 75 bp, Artificial Sequence
  Synthetic
taccaaaaaagccacctacccagcctacatgtagagtaagtttcaaattaaagcttgatgcctaagattcaaggc

SEQ ID NO: 337401 - DNA, 75 bp, Artificial Sequence
  Synthetic
ccggaggtgagtttacacaccgcagtcaaggggcaattcgggctcgggactggccgggccccgggcaaggctctt

SEQ ID NO: 337402 - DNA, 75 bp, Artificial Sequence
  Synthetic
tcaaggggcaattcgggctcgggactggccgggccccgggcaaggctcttaaaaaatgcgttttcgcagggttgc

SEQ ID NO: 337403 - DNA, 75 bp, Artificial Sequence
  Synthetic
actgtgccagctgcaaagaaggctaggcggcttctaggtatgtggcagccccccacgcacaatgtcccgggcatc

SEQ ID NO: 337404 - DNA, 75 bp, Artificial Sequence
  Synthetic
ttagatcccacgctgctgtttgtggctgtggcgattttgttggccatcttaatcatctggcaactactctgggtc

SEQ ID NO: 337405 - DNA, 75 bp, Artificial Sequence
  Synthetic
gcaacgaaagtgagtggggccagacttcgccataaggcctttaactttgggtcgtctgtcagcggcttccgggtt

SEQ ID NO: 337406 - DNA, 75 bp, Artificial Sequence
  Synthetic
ttcgccataaggcctttaactttgggtcgtctgtcagcggcttccgggttcgcctgggggccgccattttagctt

SEQ ID NO: 337407 - DNA, 75 bp, Artificial Sequence
  Synthetic
gcctccgtagtcgcgtcttagtgacgtcacggcagccatcttggtcctgacgtcactgtcacgtggggagggaac

SEQ ID NO: 337408 - DNA, 75 bp, Artificial Sequence
  Synthetic
cacgtgacatgacgtcacggccgccattttgtgctgtccgccatcttgtcacttccttccgctttttaaaaaaaa

SEQ ID NO: 337409 - DNA, 75 bp, Artificial Sequence
  Synthetic
agacgtaggagacgacgccctactcgccgctttcgagctcgtcgaagagtaaggaggcgcggggggaggtggcgc

SEQ ID NO: 337410 - DNA, 75 bp, Artificial Sequence
  Synthetic
cccccggggtggctccgcccccccggcccccccccgtgcttaatccaccgcgcatgcgcaaccacgcccccgccg

SEQ ID NO: 337411 - DNA, 75 bp, Artificial Sequence
  Synthetic
ccaaactttataagacgctgctacatcatagggtacttaccacttatattctgcggcgaaaatacaaccgcccag

SEQ ID NO: 337412 - DNA, 75 bp, Artificial Sequence
  Synthetic
tgataagcaaaggaccgtacggggggggcatgactaccaccaaattcactctgagaatactgtacgacgagttta

SEQ ID NO: 337413 - DNA, 75 bp, Artificial Sequence
  Synthetic
ccggaggtgagtttacacaccgcagtcaaggggcaattcgggctcgggaggccgggccatgggcaaggctcttaa

SEQ ID NO: 337414 - DNA, 75 bp, Artificial Sequence
  Synthetic
tatccgttcggctcaccactaactgacaacccttgcgtcaacttccagatcctggggccccagtacaaaaaacac

SEQ ID NO: 337415 - DNA, 75 bp, Artificial Sequence
  Synthetic
aaacttatttaacaaaactgaactatacaacacctttcaaaccatagctcagcttaaagagacaggacacatttc

SEQ ID NO: 337416 - DNA, 75 bp, Artificial Sequence
  Synthetic
gtccagaattcaacaacacttactaaaggaggtgacaatgccactcagagtagagacacttggtataaaggaaat

SEQ ID NO: 337417 - DNA, 75 bp, Artificial Sequence
  Synthetic
aaggaggtgacaatgccactcagagtagagacacttggtataaaggaaatacatacaacgagaacatatgcaagt

SEQ ID NO: 337418 - DNA, 75 bp, Artificial Sequence
  Synthetic
taaaaatgcaaccaaaggagcactaccaaactaccccacaataatgtccacagacctatatgaataccactcagg

SEQ ID NO: 337419 - DNA, 75 bp, Artificial Sequence
  Synthetic
ccaaactaccccacaataatgtccacagacctatatgaataccactcaggcatatactccagcatatatctatca

SEQ ID NO: 337420 - DNA, 75 bp, Artificial Sequence
  Synthetic
caaccctttcacagacaaaggcacaggcaacataatctggatagactacctcacaaaagaagacaccatttttgt

SEQ ID NO: 337421 - DNA, 75 bp, Artificial Sequence
  Synthetic
atggacatgcccctgtgggcggcctgcacgggatacacagagttttgtgcaaagtatacaggcgactctgccatt

SEQ ID NO: 337422 - DNA, 75 bp, Artificial Sequence
  Synthetic
gatgcccatacactgagcccatgttaatagaccactcagacccaaacaaaggcttcgttccctactcatttaact

SEQ ID NO: 337423 - DNA, 75 bp, Artificial Sequence
  Synthetic
aatagaccactcagacccaaacaaaggcttcgttccctactcatttaactttggcaacggaaagatgcccggagg

SEQ ID NO: 337424 - DNA, 75 bp, Artificial Sequence
  Synthetic
tacaagggcgacataaaatcagctgtactagccatgaaatacagatttcactggaagtggggcggaaaccctata

SEQ ID NO: 337425 - DNA, 75 bp, Artificial Sequence
  Synthetic
ccatagaggacctcgcagcgtacaagcggttgacccgaaatacaataccccagaggtcacgtggcactcgtggga

SEQ ID NO: 337426 - DNA, 75 bp, Artificial Sequence
  Synthetic
gcaggtattaaaagaatgcaacaggaatcagatgctctttacattcctccaggaccaatcaagagacctcgcagg

SEQ ID NO: 337427 - DNA, 75 bp, Artificial Sequence
  Synthetic
cccaagaagagacggaggcgcaggggtcggtacaagaccaactactcctccagctccgagagcagcgagttctcc

SEQ ID NO: 337428 - DNA, 75 bp, Artificial Sequence
  Synthetic
ccaagtcctcaaagtccaagcagggcacagcctacaccccctattatcttcccaagcataaacaaagcctttatg

SEQ ID NO: 337429 - DNA, 75 bp, Artificial Sequence
  Synthetic
cacagcctacaccccctattatcttcccaagcataaacaaagcctttatgtttgagccccagggtcctaaaccca

SEQ ID NO: 337430 - DNA, 75 bp, Artificial Sequence
  Synthetic
agagtacactgcttgcaaattctgggacagaccccccagaaagctacacacagacatacccttctacccctgggc

SEQ ID NO: 337431 - DNA, 75 bp, Artificial Sequence
  Synthetic
gtggggccagacttcgccatagggcctttatcttctcgccattggatagtgtccggggtcgccgtaggcttcggc

SEQ ID NO: 337432 - DNA, 75 bp, Artificial Sequence
  Synthetic
cggccgccattttaagtaaggcggaagcagctccactttctcacaaaatggcggcggagcacttccggcttgccc

SEQ ID NO: 337433 - DNA, 75 bp, Artificial Sequence
  Synthetic
agcagctccactttctcacaaaatggcggcggagcacttccggcttgcccaaaatggcgggcaagctcttccggg

SEQ ID NO: 337434 - DNA, 75 bp, Artificial Sequence
  Synthetic
aaaatggcgggcaagctcttccgggtaaagggtcagcagctacgtcacaagtcacctgactggggaggggtcaca

SEQ ID NO: 337435 - DNA, 75 bp, Artificial Sequence
  Synthetic
ggctgttcacgtggttgctacgtcatcggcgccatcttgtgtcacaaaatggcggacaacttccgcttttttaaa

SEQ ID NO: 337436 - DNA, 75 bp, Artificial Sequence
  Synthetic
tcggcgccatcttgtgtcacaaaatggcggacaacttccgcttttttaaaaaaaggcgcgaaaaaacggcggcgg

SEQ ID NO: 337437 - DNA, 75 bp, Artificial Sequence
  Synthetic
gcgcgctacgccttcggctgcgcgcggcacctcggacccccgctcgtgctgacgcgctcgcgcgcgtcagaccac

SEQ ID NO: 337438 - DNA, 75 bp, Artificial Sequence
  Synthetic
gagcatagtacagtgcggaccgttcgggtacaagggcgacgtaaaatcagctgtactggccatgaaatacagatt

SEQ ID NO: 337439 - DNA, 75 bp, Artificial Sequence
  Synthetic
ctcttttttaaaaataacggcccagcggcggcgcgcgcgcttcgcgcgcgcgccggggggctccgccccccggtc

SEQ ID NO: 337440 - DNA, 75 bp, Artificial Sequence
  Synthetic
tggaacagaccccctagaaaactacacacagacatacccttttacccctgggcaccaaaaccccaagagcatgtc

SEQ ID NO: 337441 - DNA, 75 bp, Artificial Sequence
  Synthetic
gctacgtcactaacctacgtgtccgtctcccataggccggacactgtctacgtcatacacttcctgggcatggtc

SEQ ID NO: 337442 - DNA, 75 bp, Artificial Sequence
  Synthetic
tctcccataggccggacactgtctacgtcatacacttcctgggcatggtctacgtgataatataagtagcagcac

SEQ ID NO: 337443 - DNA, 75 bp, Artificial Sequence
  Synthetic
cgtcatacacttcctgggcatggtctacgtgataatataagtagcagcacttccgaatggctgagttttctacgc

SEQ ID NO: 337444 - DNA, 75 bp, Artificial Sequence
  Synthetic
aatacaagagatttatgaattactggacagcctcaaacgaggacctagacctgtgtagatacctaggatgtactc

SEQ ID NO: 337445 - DNA, 75 bp, Artificial Sequence
  Synthetic
gccgggggggcgccagcgcccccccccccgcgcatgcgcgggtcccccccccgcggggggctccgccccccggcc

SEQ ID NO: 337446 - DNA, 75 bp, Artificial Sequence
  Synthetic
ctgtgtagatacctaggatgtactctatatgtatttagacacccagaagtagactttataattataataaacaca

SEQ ID NO: 337447 - DNA, 75 bp, Artificial Sequence
  Synthetic
taacaggccctagcatacacccgggtatgatggccctcaacaaaagagccagatggatacctagcataaaaaaca

SEQ ID NO: 337448 - DNA, 75 bp, Artificial Sequence
  Synthetic
aattaaagtaggagccccccgaatgttcacagataagtagtatccccagacagacctctgtgacatgacactcct

SEQ ID NO: 337449 - DNA, 75 bp, Artificial Sequence
  Synthetic
tgctacgtcactaacccacgtgtcctctacaggccaatcgcagtctatgtcgtgcacttcctgggcatggtctac

SEQ ID NO: 337450 - DNA, 75 bp, Artificial Sequence
  Synthetic
tctacaggccaatcgcagtctatgtcgtgcacttcctgggcatggtctacataattatataaatgcttgcacttc

SEQ ID NO: 337451 - DNA, 75 bp, Artificial Sequence
  Synthetic
taactgacactatagttgtgtcattccaagttctgcaatccatgtacaacgactgcctcagtgtacttcctacta

SEQ ID NO: 337452 - DNA, 75 bp, Artificial Sequence
  Synthetic
gatccgaacgtcctgagggcgggtgccggaggtgagtttacacaccgaagtcaaggggcaattcgggctcaggac

SEQ ID NO: 337453 - DNA, 75 bp, Artificial Sequence
  Synthetic
cacacaattacatgataaaattattaatcatttaccctactacaacaccacacaaacacaagcacaattcaagag

SEQ ID NO: 337454 - DNA, 75 bp, Artificial Sequence
  Synthetic
aatcatttaccctactacaacaccacacaaacacaagcacaattcaagagatttatagaaaacaaatcagcaaca

SEQ ID NO: 337455 - DNA, 75 bp, Artificial Sequence
  Synthetic
acataaacagcacaaaatttaacacacaagaatcacctaaaaatgacagtggcataggaggcccatactgcacat

SEQ ID NO: 337456 - DNA, 75 bp, Artificial Sequence
  Synthetic
tccaacgcatgtggtatgagtcctttcaccgtggccacgcttctttttgtggttgtgggaatcctatacttcaca

SEQ ID NO: 337457 - DNA, 75 bp, Artificial Sequence
  Synthetic
agcatacaatgagaaaattaaaaacatacctaaacaagcaagccaactatactatgaagaaactaaaaaattaat

SEQ ID NO: 337458 - DNA, 75 bp, Artificial Sequence
  Synthetic
ttactgcacttgctgaaacatatggccatccaacaggcccgagaccttctgggccaccgggagtagaccccaacc

SEQ ID NO: 337459 - DNA, 75 bp, Artificial Sequence
  Synthetic
ggcatggggatggtggaagcgacggaggcgctggtggttccggaagcggtggacccgtggcagacttcgcagacg

SEQ ID NO: 337460 - DNA, 75 bp, Artificial Sequence
  Synthetic
acccattctcagacagaggcgaaggaaacatgctgtggatagactggctaactaaagatacctcagtatatgaca

SEQ ID NO: 337461 - DNA, 75 bp, Artificial Sequence
  Synthetic
atggcctcgatcagctcgtcgccgccctagacgacgaagagtaaggaggcgcagacggtggaggagggggagacg

SEQ ID NO: 337462 - DNA, 75 bp, Artificial Sequence
  Synthetic
agacatgcccttatgggcctctgtatacggattctccgagtactgcagtaaagtaacaggagacacaaacataga

SEQ ID NO: 337463 - DNA, 75 bp, Artificial Sequence
  Synthetic
agacgctttagacgcaggagacgaaaagcaaaacttataataaaactgtggcaacctgcagtaattaaaagatgc

SEQ ID NO: 337464 - DNA, 75 bp, Artificial Sequence
  Synthetic
aagcaaaacttataataaaactgtggcaacctgcagtaattaaaagatgcagaataaagggatacataccactga

SEQ ID NO: 337465 - DNA, 75 bp, Artificial Sequence
  Synthetic
agcccctacacagtaccacaactgttagatcacaacaaccccctcaggggatacgtaccctacagttttaacttt

SEQ ID NO: 337466 - DNA, 75 bp, Artificial Sequence
  Synthetic
cacaaactttaccagtcacataaatgacagaataatgaaaggccccttcgggggaggacacagcactatgaggtt

SEQ ID NO: 337467 - DNA, 75 bp, Artificial Sequence
  Synthetic
gcagccaggtacccattagaatgagagcaaagtggtaccctaccctttttcaccaaaaagaagtactagaagcct

SEQ ID NO: 337468 - DNA, 75 bp, Artificial Sequence
  Synthetic
ccagaagcaacgataacctagagctaaccagatacttgggggcttcagtaaaaatatacaggcacccagaccaag

SEQ ID NO: 337469 - DNA, 75 bp, Artificial Sequence
  Synthetic
aaccagatacttgggggcttcagtaaaaatatacaggcacccagaccaagactttatagtaatatacaacagaag

SEQ ID NO: 337470 - DNA, 75 bp, Artificial Sequence
  Synthetic
gaactcacgattcacgcgtgggacttcagacatgggttctttggcagaaaggctattaagcgaatgcaggaacaa

SEQ ID NO: 337471 - DNA, 75 bp, Artificial Sequence
  Synthetic
acagcaccctctctacacccaggcaatgccattttagcaaaacacaaaatattagtaccaagtttacagacaaga

SEQ ID NO: 337472 - DNA, 75 bp, Artificial Sequence
  Synthetic
atgccattttagcaaaacacaaaatattagtaccaagtttacagacaagaccaaagggtagaaaagcaattagac

SEQ ID NO: 337473 - DNA, 75 bp, Artificial Sequence
  Synthetic
cagggttcaagcgcagtcgccgagatacagaagcactccaatgcagcgaagaagacctccaaaaagaaaacttac

SEQ ID NO: 337474 - DNA, 75 bp, Artificial Sequence
  Synthetic
tacagacaagtggtactttcaaaaggacatagccgacctcacccttttcaacatcatggcagttgaggctgactt

SEQ ID NO: 337475 - DNA, 75 bp, Artificial Sequence
  Synthetic
gacatagccgacctcacccttttcaacatcatggcagttgaggctgacttgcggtttccgttctgctcaccacaa

SEQ ID NO: 337476 - DNA, 75 bp, Artificial Sequence
  Synthetic
aggtccttagttccgtttacaacaactacctcagtattaatacctttaataatgacaactcagactcaaagttaa

SEQ ID NO: 337477 - DNA, 75 bp, Artificial Sequence
  Synthetic
aaccctacaacccctcctccaatgactggaaggaggagtacgaggccgcaaagtactgggacagaccccccagac

SEQ ID NO: 337478 - DNA, 75 bp, Artificial Sequence
  Synthetic
ctacctcagtattaatacctttaataatgacaactcagactcaaagttaaaagaatttttaaataaagcatttcc

SEQ ID NO: 337479 - DNA, 75 bp, Artificial Sequence
  Synthetic
cccctgggcccccacccccaaaccatacaatgtcaactttgccctcaactacaaataaacggtggccgtgggagt

SEQ ID NO: 337480 - DNA, 75 bp, Artificial Sequence
  Synthetic
ttaaatgcactaaatacatttagaacagaaggatgcataagtcacccacaactaaaaaaaccaaacccacaaata

SEQ ID NO: 337481 - DNA, 75 bp, Artificial Sequence
  Synthetic
ttgcacctttagatgccctctggggagaccccatatactataatgatctaaatgaaaacaaaagtttgaacgata

SEQ ID NO: 337482 - DNA, 75 bp, Artificial Sequence
  Synthetic
agaccccatatactataatgatctaaatgaaaacaaaagtttgaacgatatcattgagaaaatactaataaaaaa

SEQ ID NO: 337483 - DNA, 75 bp, Artificial Sequence
  Synthetic
aacggactccgaggtgccattggacactgagggggtgaacagcaacgaaagtgagtggggccagacttcgccata

SEQ ID NO: 337484 - DNA, 75 bp, Artificial Sequence
  Synthetic
agagaatttccaaattcataccaaggaaacaaggccttttgccacctaacaggcatatacagcccaccataccta

SEQ ID NO: 337485 - DNA, 75 bp, Artificial Sequence
  Synthetic
cgtcacgagcgccatcttaagtggctgtcgccgaggattggcgtcacagttcaaaggtcatcctcggcggtaacc

SEQ ID NO: 337486 - DNA, 75 bp, Artificial Sequence
  Synthetic
gaaacaaggccttttgccacctaacaggcatatacagcccaccatacctaaaccaaggcagaatatctccagaaa

SEQ ID NO: 337487 - DNA, 75 bp, Artificial Sequence
  Synthetic
tgtcgccgaggattggcgtcacagttcaaaggtcatcctcggcggtaaccgcaaagatggcggtcaatctcattc

SEQ ID NO: 337488 - DNA, 75 bp, Artificial Sequence
  Synthetic
tgtcgccgaggattggcgtcacagttcaaaggtcatcctcggcggtaaccgcaaagatggcggtcaatctctttc

SEQ ID NO: 337489 - DNA, 75 bp, Artificial Sequence
  Synthetic
tgtcgccgaggattggcgtcacagttcaaaggtcatcctcggcggtaaccgcaaagatggcggtcaatctccttc

SEQ ID NO: 337490 - DNA, 75 bp, Artificial Sequence
  Synthetic
tgtcgccgaggattggcgtcacagttcaaaggtcatcctcggcggtaaccgcaaagatggcggtcaatctcgttc

SEQ ID NO: 337491 - DNA, 75 bp, Artificial Sequence
  Synthetic
ttacaacccttacacagacaaaggaactggaaacaaagtatggatggacccactaactaaagagaacaacatata

SEQ ID NO: 337492 - DNA, 75 bp, Artificial Sequence
  Synthetic
aagtcacatgacaggggtccacttaaacacggaagtaggccccgacatgtgactcgtcacgtgtgtacacgtcac

SEQ ID NO: 337493 - DNA, 75 bp, Artificial Sequence
  Synthetic
actggaaacaaagtatggatggacccactaactaaagagaacaacatatataaagaaggacagagcaaatgccta

SEQ ID NO: 337494 - DNA, 75 bp, Artificial Sequence
  Synthetic
tactttttggatatacagactggtgtaaaaaggacactaataactgggacttaccactaaactacagactagtac

SEQ ID NO: 337495 - DNA, 75 bp, Artificial Sequence
  Synthetic
taaaaaggacactaataactgggacttaccactaaactacagactagtactaatatgcccttatacctttccaaa

SEQ ID NO: 337496 - DNA, 75 bp, Artificial Sequence
  Synthetic
tatgggtacatcccgtactcctacaaattcggagcgggtcagatgccagacggcagcaactacataccctttcag

SEQ ID NO: 337497 - DNA, 75 bp, Artificial Sequence
  Synthetic
aattcggagcgggtcagatgccagacggcagcaactacataccctttcagtttagagcaaagtggtaccccacag

SEQ ID NO: 337498 - DNA, 75 bp, Artificial Sequence
  Synthetic
cttcctggggtgtgtcttcgaagagtatataagcacaggcggtgacgaatggtagagttttttctggcccgtccg

SEQ ID NO: 337499 - DNA, 75 bp, Artificial Sequence
  Synthetic
ggacataagcaggagcgggccctttgcacctaaggtagaaaaaccaagcactcagctggtaatgaagtactgttt

SEQ ID NO: 337500 - DNA, 75 bp, Artificial Sequence
  Synthetic
cggaggtgagtttacacaccgcagtctaggggcaattcgggcacgggtctggccgggctatgggcaagactctta

SEQ ID NO: 337501 - DNA, 75 bp, Artificial Sequence
  Synthetic
gcacctaaggtagaaaaaccaagcactcagctggtaatgaagtactgttttaactttaactggggcggtaaccct

SEQ ID NO: 337502 - DNA, 75 bp, Artificial Sequence
  Synthetic
ctaggggcaattcgggcacgggtctggccgggctatgggcaagactcttaaaaagtttccccgctgtgtcctacg

SEQ ID NO: 337503 - DNA, 75 bp, Artificial Sequence
  Synthetic
ccagcttccagcccacctatgaaatacccggtaccggtaacatccctagaagaatacaagtcatcgacccgcggg

SEQ ID NO: 337504 - DNA, 75 bp, Artificial Sequence
  Synthetic
gaccgccggcgcacgacgtccagggcagagagaaccagttctttgcgggatgttttcacatgcatgctgctttct

SEQ ID NO: 337505 - DNA, 75 bp, Artificial Sequence
  Synthetic
acccggtaccggtaacatccctagaagaatacaagtcatcgacccgcgggtcctgggaccgcactactcgttccg

SEQ ID NO: 337506 - DNA, 75 bp, Artificial Sequence
  Synthetic
cagagagaaccagttctttgcgggatgttttcacatgcatgctgctttctgcgggtgcggtgaccttgtcggcca

SEQ ID NO: 337507 - DNA, 75 bp, Artificial Sequence
  Synthetic
tttagcagagcaagtattaagagagtgtcagaacaacaagaaacttctgaccttgtattctcaggcccaaaaaag

SEQ ID NO: 337508 - DNA, 75 bp, Artificial Sequence
  Synthetic
cctgctgccggaccccccgctccgccgaacctcagacctccgagaccccctgccccggccggtccgggcggtccc

SEQ ID NO: 337509 - DNA, 75 bp, Artificial Sequence
  Synthetic
tgtcagaacaacaagaaacttctgaccttgtattctcaggcccaaaaaagcctcgggtcgacatcccaaaacaag

SEQ ID NO: 337510 - DNA, 75 bp, Artificial Sequence
  Synthetic
cgaacctcagacctccgagaccccctgccccggccggtccgggcggtccccccggctactttcccgctcttccgg

SEQ ID NO: 337511 - DNA, 75 bp, Artificial Sequence
  Synthetic
actccaaagagaatcgagaccgtgggagaccgaggaagaaagcgagacagaagccctctcgcaagagagccaaga

SEQ ID NO: 337512 - DNA, 75 bp, Artificial Sequence
  Synthetic
agcaccacgccgtggtggtggggaagatggcgccgccgcgggtggcgccgccgatgggggagaaggagaggccgc

SEQ ID NO: 337513 - DNA, 75 bp, Artificial Sequence
  Synthetic
gagaccgaggaagaaagcgagacagaagccctctcgcaagagagccaagaggtccccttccaacagcagttgcag

SEQ ID NO: 337514 - DNA, 75 bp, Artificial Sequence
  Synthetic
gatggcgccgccgcgggtggcgccgccgatgggggagaaggagaggccgccgcgtacggcgaggaagaactagaa

SEQ ID NO: 337515 - DNA, 75 bp, Artificial Sequence
  Synthetic
tcagacagggaatcaaagtcctcttcgagcagctcataaggacccaacaaggggtccatgtaaacccatgcctac

SEQ ID NO: 337516 - DNA, 75 bp, Artificial Sequence
  Synthetic
acgatatgtaagtaggagatggcgccggccttacaggcgcagacgcaggaaggggcgacgcagacgcagacgcag

SEQ ID NO: 337517 - DNA, 75 bp, Artificial Sequence
  Synthetic
cgagcagctcataaggacccaacaaggggtccatgtaaacccatgcctacagtaggtcccaggcagtggctgttt

SEQ ID NO: 337518 - DNA, 75 bp, Artificial Sequence
  Synthetic
cggccttacaggcgcagacgcaggaaggggcgacgcagacgcagacgcagacggactcacaaacccaccctagta

SEQ ID NO: 337519 - DNA, 75 bp, Artificial Sequence
  Synthetic
ctagcagtggagactgggccatggagtttctcgcagcaaaaatatttgataggccagttagaagcaaccttaaag

SEQ ID NO: 337520 - DNA, 75 bp, Artificial Sequence
  Synthetic
ttaggacctgctacatcacagggtggatgcccctcatcatctgtggccaaggacagacgcagtttaactttatca

SEQ ID NO: 337521 - DNA, 75 bp, Artificial Sequence
  Synthetic
gtttctcgcagcaaaaatatttgataggccagttagaagcaaccttaaagataccccttactacccatatgttaa

SEQ ID NO: 337522 - DNA, 75 bp, Artificial Sequence
  Synthetic
gatgcccctcatcatctgtggccaaggacagacgcagtttaactttatcatgcacatggacgatatcaccccccg

SEQ ID NO: 337523 - DNA, 75 bp, Artificial Sequence
  Synthetic
cttaaatttgaataaacagcagcttcaaacttgcaaggccgtgggagtttcactggtcggtgtctacctctaaag

SEQ ID NO: 337524 - DNA, 75 bp, Artificial Sequence
  Synthetic
accaacataacatggaccctagagggcctgtgggaacagttccagtaccacagaaacaggtggtcgcgcagcaac

SEQ ID NO: 337525 - DNA, 75 bp, Artificial Sequence
  Synthetic
gcctgtgggaacagttccagtaccacagaaacaggtggtcgcgcagcaaccacgacctagacctagccaggtaca

SEQ ID NO: 337526 - DNA, 75 bp, Artificial Sequence
  Synthetic
gaggagtgcgaccctcccccctggaacaacttcttcggagtccggcgctacgccttcggctgcgccggacacctc

SEQ ID NO: 337527 - DNA, 75 bp, Artificial Sequence
  Synthetic
acacgaaactgtagactacatagtcagctacaccagaacaggacctttccaaatggggcacctcactcacctcag

SEQ ID NO: 337528 - DNA, 75 bp, Artificial Sequence
  Synthetic
agctacaccagaacaggacctttccaaatggggcacctcactcacctcagcactcaccctcttctcatgctactc

SEQ ID NO: 337529 - DNA, 75 bp, Artificial Sequence
  Synthetic
gactccgaagtgctcttggacactgagggggtgaacagcaacgaaagtgagtggggccagacttcgccataaggc

SEQ ID NO: 337530 - DNA, 75 bp, Artificial Sequence
  Synthetic
agggggtgaacagcaacgaaagtgagtggggccagacttcgccataaggcctttatcttcttgccatttgtcagt

SEQ ID NO: 337531 - DNA, 75 bp, Artificial Sequence
  Synthetic
gcctaaagaccaaacctgggggcaaaaagtacaaaaaaatcagaatcaagcccccaaaactaatgttaaacaagt

SEQ ID NO: 337532 - DNA, 75 bp, Artificial Sequence
  Synthetic
aaagtacaaaaaaatcagaatcaagcccccaaaactaatgttaaacaagtggtacttcaccaaagacatctgtga

SEQ ID NO: 337533 - DNA, 75 bp, Artificial Sequence
  Synthetic
gtccggggtcgccataggcttcgggctcgtttttaggccttccggactacaaaaatcgccattttggtgacgtca

SEQ ID NO: 337534 - DNA, 75 bp, Artificial Sequence
  Synthetic
acaggagcagagctcagaaacccctggttaagatcaggcacacagagcccctgcatagggttctctgtactcaac

SEQ ID NO: 337535 - DNA, 75 bp, Artificial Sequence
  Synthetic
aaaaatcgccattttggtgacgtcacggccgccatcttaagtagttgaggcggacggtggcgtgagttcaaaggt

SEQ ID NO: 337536 - DNA, 75 bp, Artificial Sequence
  Synthetic
ggttaagatcaggcacacagagcccctgcatagggttctctgtactcaacaactcctactacaccaacctcagca

SEQ ID NO: 337537 - DNA, 75 bp, Artificial Sequence
  Synthetic
agcaagcatacaacattcatttcaccccagcacaataaacgaaactccacaaaaaaacctatggcagtacacata

SEQ ID NO: 337538 - DNA, 75 bp, Artificial Sequence
  Synthetic
aggttacagccgccatgttaaaacacgtgacgtatgacgtcacggccgccattttgtgacacaagatggccgact

SEQ ID NO: 337539 - DNA, 75 bp, Artificial Sequence
  Synthetic
cgtgacgtatgacgtcacggccgccattttgtgacacaagatggccgacttccttcctctttttcaaaaaaagcg

SEQ ID NO: 337540 - DNA, 75 bp, Artificial Sequence
  Synthetic
cccagcacaataaacgaaactccacaaaaaaacctatggcagtacacatacacaggcctcatgtcaaagtactac

SEQ ID NO: 337541 - DNA, 75 bp, Artificial Sequence
  Synthetic
attttgtgacacaagatggccgacttccttcctctttttcaaaaaaagcggaagtgccgccgcggcggcgggggg

SEQ ID NO: 337542 - DNA, 75 bp, Artificial Sequence
  Synthetic
atgacttccaaaattacagcaccgctgaaaactaccaaaaaacgtataaccaatggtcacaagaaagaaataata

SEQ ID NO: 337543 - DNA, 75 bp, Artificial Sequence
  Synthetic
tgaaaactaccaaaaaacgtataaccaatggtcacaagaaagaaataatagacttcaaaaacttcaaacacaatg

SEQ ID NO: 337544 - DNA, 75 bp, Artificial Sequence
  Synthetic
tgctacgtcactaaccacgtgcaccccgcaggccggtccaagtctacgtcgtgcacttcctgggcgtggtttaca

SEQ ID NO: 337545 - DNA, 75 bp, Artificial Sequence
  Synthetic
acacagaggcccacagactccacactcctacaagactttggcatatacagccccttctacctcacacccaccaga

SEQ ID NO: 337546 - DNA, 75 bp, Artificial Sequence
  Synthetic
tcctacaagactttggcatatacagccccttctacctcacacccaccagaatcagcctagactggcgcaccacct

SEQ ID NO: 337547 - DNA, 75 bp, Artificial Sequence
  Synthetic
cacagacaagggcataggcaacagagtgtacatacagtggtgctcagaggctagctgcaaatacagccccacaaa

SEQ ID NO: 337548 - DNA, 75 bp, Artificial Sequence
  Synthetic
gaaagaaaaggaaagtgctactgctttgcgtgccagcagctaagaaaaaaccaactgctatgagcttctggagac

SEQ ID NO: 337549 - DNA, 75 bp, Artificial Sequence
  Synthetic
ttgcgtgccagcagctaagaaaaaaccaactgctatgagcttctggagacctccggtgcacaatgtcacggggat

SEQ ID NO: 337550 - DNA, 75 bp, Artificial Sequence
  Synthetic
gtgtacatacagtggtgctcagaggctagctgcaaatacagccccacaaagagcaagtgccccatagtagacatg

SEQ ID NO: 337551 - DNA, 75 bp, Artificial Sequence
  Synthetic
acatagactggtgcatcaaatgcacaggcaactctggcatagtaaaagacgccagaatcatggtaaggtgtccct

SEQ ID NO: 337552 - DNA, 75 bp, Artificial Sequence
  Synthetic
aggcaactctggcatagtaaaagacgccagaatcatggtaaggtgtccctacaccgagccccaattagtgggggc

SEQ ID NO: 337553 - DNA, 75 bp, Artificial Sequence
  Synthetic
acctcagacacttaaacttttggacaaagagcaaccaggacctagaactcataagatactttagatgctccttta

SEQ ID NO: 337554 - DNA, 75 bp, Artificial Sequence
  Synthetic
ctcagtaataccttcatgaacggagacatgcccgtgctggccccctatatcccaatttcctggttcgttaagtgg

SEQ ID NO: 337555 - DNA, 75 bp, Artificial Sequence
  Synthetic
acatgcccgtgctggccccctatatcccaatttcctggttcgttaagtggtaccccatgattgcacaccaaaagg

SEQ ID NO: 337556 - DNA, 75 bp, Artificial Sequence
  Synthetic
cggaccgttcatgcccagagatcaggaagccaagagttgggacataaccatgggttacagatcctgtttcaaatg

SEQ ID NO: 337557 - DNA, 75 bp, Artificial Sequence
  Synthetic
gaagccaagagttgggacataaccatgggttacagatcctgtttcaaatggggcgggtcgcctctgcccacacag

SEQ ID NO: 337558 - DNA, 75 bp, Artificial Sequence
  Synthetic
ccacgcaccctcttcccgaccccgatagacaccctcgcctcctacaagtctcagacccgacaaagctcggcccca

SEQ ID NO: 337559 - DNA, 75 bp, Artificial Sequence
  Synthetic
tagacaccctcgcctcctacaagtctcagacccgacaaagctcggccccaagaccatattccacagatgggacat

SEQ ID NO: 337560 - DNA, 75 bp, Artificial Sequence
  Synthetic
agtattgagagaatgtcagaatacacagagtatgatgaatattttgaaacaggtctaccatcaaaaagaaaaaag

SEQ ID NO: 337561 - DNA, 75 bp, Artificial Sequence
  Synthetic
cagagtatgatgaatattttgaaacaggtctaccatcaaaaagaaaaaagttcgacacgccggcagaaggactcc

SEQ ID NO: 337562 - DNA, 75 bp, Artificial Sequence
  Synthetic
tttactccaagccctcgaggcgagccaagaagggtcggggtcagaagaccaagaacaagcacccccacaagagac

SEQ ID NO: 337563 - DNA, 75 bp, Artificial Sequence
  Synthetic
caagaagggtcggggtcagaagaccaagaacaagcacccccacaagagacggagacgcagcaactcctccagcag

SEQ ID NO: 337564 - DNA, 75 bp, Artificial Sequence
  Synthetic
gagtcctcagacagggcctcaaacacctcctcggggacgtcctccgactccgacggggagtccactgggaccccc

SEQ ID NO: 337565 - DNA, 75 bp, Artificial Sequence
  Synthetic
cctcctcggggacgtcctccgactccgacggggagtccactgggaccccctccttacatagatccaccaccgttc

SEQ ID NO: 337566 - DNA, 75 bp, Artificial Sequence
  Synthetic
cccttcaatgtggaaccaagagccagtgttaaatgacttagcaaagagcggaccgtttgcatacaaaaacaccaa

SEQ ID NO: 337567 - DNA, 75 bp, Artificial Sequence
  Synthetic
ctaaccaaaaaaaaaaattctccaaattcgactgggaaacggaggctcagctaggggcgatattcaagcgtccta

SEQ ID NO: 337568 - DNA, 75 bp, Artificial Sequence
  Synthetic
attcgactgggaaacggaggctcagctaggggcgatattcaagcgtcctatgcgcttctatccctcagacacccc

SEQ ID NO: 337569 - DNA, 75 bp, Artificial Sequence
  Synthetic
cgagatatccccaaaatatgtaaggtaaacttccaaataaagctcgcagagtaacacattcgaggccctcctctg

SEQ ID NO: 337570 - DNA, 75 bp, Artificial Sequence
  Synthetic
ttcacttagcggtgtctacctcttaaggttaccaagcactccgagcgcaagcgaggagtgcgaccctccgccctg

SEQ ID NO: 337571 - DNA, 75 bp, Artificial Sequence
  Synthetic
aacagactccgagttgccattggacactggagctgtgaatcagtaacgaaagtgagtggggccagacttcgccat

SEQ ID NO: 337572 - DNA, 75 bp, Artificial Sequence
  Synthetic
ggccgccattttagcttcggccgccattttaggccctcgcgggcctccgtaggcgcgtttttatgacgtcacagg

SEQ ID NO: 337573 - DNA, 75 bp, Artificial Sequence
  Synthetic
cgccatcttggctgtgacgtatcggtcacgtggcaagggcgtgccttaacccggaagcatccctggtcacgtgac

SEQ ID NO: 337574 - DNA, 75 bp, Artificial Sequence
  Synthetic
caacttcttcggagtccggcgctacgccttcggctgcgccggacacctcagaccccccctccacccgaaacgctt

SEQ ID NO: 337575 - DNA, 75 bp, Artificial Sequence
  Synthetic
tggggccagacttcgccataaggcctttatcttcttgccatttgttagtgttcggggtcgccataggcttcggcc

SEQ ID NO: 337576 - DNA, 75 bp, Artificial Sequence
  Synthetic
accatcagccacacctactcaaaatggagggcaatctcttccgggtcaaaggtcaccggcgccatcttaagtcac

SEQ ID NO: 337577 - DNA, 75 bp, Artificial Sequence
  Synthetic
ttttgcttgacaaaatggccgacttccttcctcttttttaaaaaaagcggaagtgccgccgcggcggcggggggc

SEQ ID NO: 337578 - DNA, 75 bp, Artificial Sequence
  Synthetic
cctcttttttaaaaaaagcggaagtgccgccgcggcggcggggggcggcgcgctgcgcgcgtcgcccagtaggcc

SEQ ID NO: 337579 - DNA, 75 bp, Artificial Sequence
  Synthetic
aagtccgtcactgaccacgtgactcccgcaggccaaccatagtctacgtcgtgcacttcctgggcatggtctaca

SEQ ID NO: 337580 - DNA, 75 bp, Artificial Sequence
  Synthetic
ccgcaggccaaccatagtctacgtcgtgcacttcctgggcatggtctacaacataatataagaaactgcacttcc

SEQ ID NO: 337581 - DNA, 75 bp, Artificial Sequence
  Synthetic
acataatataagaaactgcacttccgaatggctgagttttccacgcccgtccgcagcgagaacgccacggacgaa

SEQ ID NO: 337582 - DNA, 75 bp, Artificial Sequence
  Synthetic
tcaaggggcaattcgggctcgggactggccgggctatgggcaaggctcttaaaaagccatgtttctcggtaaact

SEQ ID NO: 337583 - DNA, 75 bp, Artificial Sequence
  Synthetic
ctgcaagctgtgccaactttaccgcagagcaggaggcttctgattatgtggcagcccccagtgcataatgtaccc

SEQ ID NO: 337584 - DNA, 75 bp, Artificial Sequence
  Synthetic
ctacgcgcgcgcgccggggggccctgccccccccgcgcatgcgcgcgggtcccccccccgcggggggctccgccc

SEQ ID NO: 337585 - DNA, 75 bp, Artificial Sequence
  Synthetic
ggcatcgagagaaactggtacgagagttgctatcgatcccatgctgctgtttgtggctgtggcgactttgttggc

SEQ ID NO: 337586 - DNA, 75 bp, Artificial Sequence
  Synthetic
aagtacgtcactaaccacgtgacttctttcagcgaaccaatgtgctatgtcgtgcacttcctgggccgggtctac

SEQ ID NO: 337587 - DNA, 75 bp, Artificial Sequence
  Synthetic
tgggtcgccctccgcgttctcggcaccccgggggccccggcactccgcagataagaaacctgccagcgctcccgg

SEQ ID NO: 337588 - DNA, 75 bp, Artificial Sequence
  Synthetic
ccccgggggccccggcactccgcagataagaaacctgccagcgctcccggcaccccagggtgagcccggtgacag

SEQ ID NO: 337589 - DNA, 75 bp, Artificial Sequence
  Synthetic
gccggcggcgccgctggagaagatggaggacgcggcgcagaccgtggagaaccaggagacgtagaagacgacgcg

SEQ ID NO: 337590 - DNA, 75 bp, Artificial Sequence
  Synthetic
ctcctcgccgctttcgacctcgtcgaagagtaaggaggcgcagggggcggtggcgcaggcggtatagaaaatgga

SEQ ID NO: 337591 - DNA, 75 bp, Artificial Sequence
  Synthetic
actgtcccgcttgccagcttcaaagaaaaaaccacctgctatgagtgactggatcccacctgcccaaaatgttgc

SEQ ID NO: 337592 - DNA, 75 bp, Artificial Sequence
  Synthetic
aagagtaaggaggcgcagggggcggtggcgcaggcggtatagaaaatggaggcgacgcaagggcaaacggacgca

SEQ ID NO: 337593 - DNA, 75 bp, Artificial Sequence
  Synthetic
aaaaaaccacctgctatgagtgactggatcccacctgcccaaaatgttgccgatagagagagcgattggttccga

SEQ ID NO: 337594 - DNA, 75 bp, Artificial Sequence
  Synthetic
tggcagccaaactttataagacgctgctacatcataggctatctgcctctaatattctgtggcgagaacaccacc

SEQ ID NO: 337595 - DNA, 75 bp, Artificial Sequence
  Synthetic
tttgcggttgtggcgatcctgttaggcatctcgctagtatttctgctgctgtgggctaccaacctccgccggggt

SEQ ID NO: 337596 - DNA, 75 bp, Artificial Sequence
  Synthetic
gctacatcataggctatctgcctctaatattctgtggcgagaacaccaccgcccagaactttgccacccactcgg

SEQ ID NO: 337597 - DNA, 75 bp, Artificial Sequence
  Synthetic
gcatctcgctagtatttctgctgctgtgggctaccaacctccgccggggtcccgccaggccccagggtcttcggg

SEQ ID NO: 337598 - DNA, 75 bp, Artificial Sequence
  Synthetic
ggggggggggcatgactactaccaagtttactctgagaatcctctacgacgagtttaccaggtttatgaactatt

SEQ ID NO: 337599 - DNA, 75 bp, Artificial Sequence
  Synthetic
agagcgctcccggcagcccccagcggttctagcaaccaacaatgtggtggaaccgctggaagaggtaccggtgga

SEQ ID NO: 337600 - DNA, 75 bp, Artificial Sequence
  Synthetic
gtttactctgagaatcctctacgacgagtttaccaggtttatgaactattggactgttagtaacgaagacctaga

SEQ ID NO: 337601 - DNA, 75 bp, Artificial Sequence
  Synthetic
gttctagcaaccaacaatgtggtggaaccgctggaagaggtaccggtggagaccgctcagaaggtggagaaccta

SEQ ID NO: 337602 - DNA, 75 bp, Artificial Sequence
  Synthetic
ctcatattctttaagcaccccaccgtagactttatagtcaggataaacacacagcctccatttctagacactaac

SEQ ID NO: 337603 - DNA, 75 bp, Artificial Sequence
  Synthetic
agacgcagaggagctgctcgccgccctagaagacgtagagtaaggagatggcgacgaaggaggagggcgtggggc

SEQ ID NO: 337604 - DNA, 75 bp, Artificial Sequence
  Synthetic
ctagaagacgtagagtaaggagatggcgacgaaggaggagggcgtggggcaggagacggtacataaggcgccgca

SEQ ID NO: 337605 - DNA, 75 bp, Artificial Sequence
  Synthetic
gcatcatgatgctcagcaaaaaacacatactcataccctcactcaagaccaggcccagcagaaaacacagagtgg

SEQ ID NO: 337606 - DNA, 75 bp, Artificial Sequence
  Synthetic
acctataactcagtggaacccctccgtggtcagaaaatgcgtggtaaccggatacatacccctcctaatctgtgg

SEQ ID NO: 337607 - DNA, 75 bp, Artificial Sequence
  Synthetic
gtggtcagaaaatgcgtggtaaccggatacatacccctcctaatctgtggaacgggtaccaccggcaccacatac

SEQ ID NO: 337608 - DNA, 75 bp, Artificial Sequence
  Synthetic
actacaaaaaatatgaccccttcggaggtggctacagcaccatgcaattcaccttagagactctctttgacgagt

SEQ ID NO: 337609 - DNA, 75 bp, Artificial Sequence
  Synthetic
aggtggctacagcaccatgcaattcaccttagagactctctttgacgagtgggtaaaacacagatgtacctggag

SEQ ID NO: 337610 - DNA, 75 bp, Artificial Sequence
  Synthetic
ttgcaatatccgttcggctcaccactaactgacaacccttgcgtcaacttccagattctggggcaccagtacaaa

SEQ ID NO: 337611 - DNA, 75 bp, Artificial Sequence
  Synthetic
atgacgactctaacaaaagccactatgacaacaatttatttaacaaaactgaactgtacaacacattccagacca

SEQ ID NO: 337612 - DNA, 75 bp, Artificial Sequence
  Synthetic
gtaaggtatctggggggcagctttaccctatacagacatccaaaatgtgactttatattcagatacaacagaaaa

SEQ ID NO: 337613 - DNA, 75 bp, Artificial Sequence
  Synthetic
tgacaacaatttatttaacaaaactgaactgtacaacacattccagaccatagctcaacttaaagaaacaggact

SEQ ID NO: 337614 - DNA, 75 bp, Artificial Sequence
  Synthetic
ccctatacagacatccaaaatgtgactttatattcagatacaacagaaaacccccctttaaggacactcaaataa

SEQ ID NO: 337615 - DNA, 75 bp, Artificial Sequence
  Synthetic
aacttgtggaccgaagtacaaaacacaacagcactatcaccaacaggctcaaatgcagctaacagcaaagacact

SEQ ID NO: 337616 - DNA, 75 bp, Artificial Sequence
  Synthetic
cctcatgaccagaagaaaaaagaaaataattaaaagcttcctcactagacccaggggcagagccacaaaaagagt

SEQ ID NO: 337617 - DNA, 75 bp, Artificial Sequence
  Synthetic
caacagcactatcaccaacaggctcaaatgcagctaacagcaaagacacttggtacaaaggcaacacatacaacc

SEQ ID NO: 337618 - DNA, 75 bp, Artificial Sequence
  Synthetic
ataattaaaagcttcctcactagacccaggggcagagccacaaaaagagttagattcaagccccccactctgtat

SEQ ID NO: 337619 - DNA, 75 bp, Artificial Sequence
  Synthetic
aaccagacagagattccaagctgcaacaaaggcagcactaccaaactaccccacaattatgtccacagacctgta

SEQ ID NO: 337620 - DNA, 75 bp, Artificial Sequence
  Synthetic
atatctgcaacctgccgctcgttaacattgcagcatctgcgtgcagcttgcggtttccgttctgctcaccacaaa

SEQ ID NO: 337621 - DNA, 75 bp, Artificial Sequence
  Synthetic
cattgcagcatctgcgtgcagcttgcggtttccgttctgctcaccacaaactgacaacacttgtgtaaacttcca

SEQ ID NO: 337622 - DNA, 75 bp, Artificial Sequence
  Synthetic
tgagtaccactcgggcatatactctagcatattcctagcagcaggcagaagctactttgaaaccccgggggccta

SEQ ID NO: 337623 - DNA, 75 bp, Artificial Sequence
  Synthetic
atgctaagtatctccccagactacccaaagaaaaactatgacagttttgttaaaacctaccttaaaaatgcacaa

SEQ ID NO: 337624 - DNA, 75 bp, Artificial Sequence
  Synthetic
acagacaaaggcacaggaaacatggtctggatagactacctcacaaaaccagactccatatacacaaagaacaaa

SEQ ID NO: 337625 - DNA, 75 bp, Artificial Sequence
  Synthetic
caaagaaaaactatgacagttttgttaaaacctaccttaaaaatgcacaagagcactggaatcaaaacaaaaagg

SEQ ID NO: 337626 - DNA, 75 bp, Artificial Sequence
  Synthetic
aaacagactactaacagtatttaacacatttaaaactgaagaacacttatacgacccatcagccaaagagactaa

SEQ ID NO: 337627 - DNA, 75 bp, Artificial Sequence
  Synthetic
ctcagagttctgttcaaaagttacaggagacaccgccatacacctgactgccagagtagtagttaggtgccccta

SEQ ID NO: 337628 - DNA, 75 bp, Artificial Sequence
  Synthetic
ggagacaccgccatacacctgactgccagagtagtagttaggtgcccctacaccgaacccatgctcatagaccac

SEQ ID NO: 337629 - DNA, 75 bp, Artificial Sequence
  Synthetic
acatttaaaactgaagaacacttatacgacccatcagccaaagagactaaaaacacaacaaatacagacgccgcc

SEQ ID NO: 337630 - DNA, 75 bp, Artificial Sequence
  Synthetic
gtttatggggagactacatttataaagagacagtagtagacaatttcattaataatgccaaaaactattttgagt

SEQ ID NO: 337631 - DNA, 75 bp, Artificial Sequence
  Synthetic
catactcttttaactttggagagggcaagatgcccggaggctcctccaaagtacccataagaatgagagccaagt

SEQ ID NO: 337632 - DNA, 75 bp, Artificial Sequence
  Synthetic
agagacagtagtagacaatttcattaataatgccaaaaactattttgagtctagaaaaggaaacatagtaatgag

SEQ ID NO: 337633 - DNA, 75 bp, Artificial Sequence
  Synthetic
ggtacgtgaacatatttcaccagcaagagttcatggaggccatagttgaaagcggaccgtttgcttacaagggcg

SEQ ID NO: 337634 - DNA, 75 bp, Artificial Sequence
  Synthetic
ggactctatagtcctatattcttatcaaacagtagactatccccagacttcccaggattctacatagatgtcctg

SEQ ID NO: 337635 - DNA, 75 bp, Artificial Sequence
  Synthetic
caaacagtagactatccccagacttcccaggattctacatagatgtcctgtataacccagctaatgacaaaggaa

SEQ ID NO: 337636 - DNA, 75 bp, Artificial Sequence
  Synthetic
caaatacagattccactggaaatggggcggaaaccctatatccaaacaggtcgtccggaatccctgctccacctc

SEQ ID NO: 337637 - DNA, 75 bp, Artificial Sequence
  Synthetic
gtgcacaaaaaatgacagtacctggagagacacacctcaaaaactaccagtagtagacattcccttatgggccgc

SEQ ID NO: 337638 - DNA, 75 bp, Artificial Sequence
  Synthetic
cagcacctccgcgggccatcgaggacctcgcagcgtacaagtcgttgacccgaagcacgttaccccggaagtcac

SEQ ID NO: 337639 - DNA, 75 bp, Artificial Sequence
  Synthetic
agagacacacctcaaaaactaccagtagtagacattcccttatgggccgccctgctaggctacagtgactactgc

SEQ ID NO: 337640 - DNA, 75 bp, Artificial Sequence
  Synthetic
ggactctttggcaaagcaggtattaagagaatgcaacaagaatcagatgctctttacattcctacaggaccactc

SEQ ID NO: 337641 - DNA, 75 bp, Artificial Sequence
  Synthetic
taataaaagaagccagactgactataatatgtccctacacccagccaccactcacagaccctgaaaacgtggaca

SEQ ID NO: 337642 - DNA, 75 bp, Artificial Sequence
  Synthetic
aatatgtccctacacccagccaccactcacagaccctgaaaacgtggacatgggcttcataccctatgactttaa

SEQ ID NO: 337643 - DNA, 75 bp, Artificial Sequence
  Synthetic
cccaagacccagaagagcaaaacgaaagctcaggtttcagagtccagcagcgactcccctgggtccactccagcc

SEQ ID NO: 337644 - DNA, 75 bp, Artificial Sequence
  Synthetic
ggaaccccctacatacctatagagtgcagaatgaaatggtacccctgtatgttccaccaacaaaactttatgaac

SEQ ID NO: 337645 - DNA, 75 bp, Artificial Sequence
  Synthetic
gcagaatgaaatggtacccctgtatgttccaccaacaaaactttatgaactcaatagtcagctgtggaccatttg

SEQ ID NO: 337646 - DNA, 75 bp, Artificial Sequence
  Synthetic
gaacaactcctcctccagctccgagagcagcgagtactccggttccagctccaacagctcgccagccaagtcctc

SEQ ID NO: 337647 - DNA, 75 bp, Artificial Sequence
  Synthetic
agtactaactgcaaaatataaatttaattttctatttggtggtaacccaactcctgaacagacgattaaggaccc

SEQ ID NO: 337648 - DNA, 75 bp, Artificial Sequence
  Synthetic
agcagcgagtactccggttccagctccaacagctcgccagccaagtcctcaaagtccaagccgggcaaggcctac

SEQ ID NO: 337649 - DNA, 75 bp, Artificial Sequence
  Synthetic
aattttctatttggtggtaacccaactcctgaacagacgattaaggacccctgtcaacaacccaccttcgaaatg

SEQ ID NO: 337650 - DNA, 75 bp, Artificial Sequence
  Synthetic
aacaaggcctttatgtttgagcctgagggtcctaaacccatacagggctacaacgattggctagaggagtacacc

SEQ ID NO: 337651 - DNA, 75 bp, Artificial Sequence
  Synthetic
acgtacaaatcgaggacccgcaactcctccacgagggatactacttcagagcctgggatctcagacgtggtctct

SEQ ID NO: 337652 - DNA, 75 bp, Artificial Sequence
  Synthetic
cctccacgagggatactacttcagagcctgggatctcagacgtggtctctatggcgagaaagctatcaaaagaat

SEQ ID NO: 337653 - DNA, 75 bp, Artificial Sequence
  Synthetic
ccagaaagctacacacagacacacctttctacccctgggcaccaaaacccctagaccaagtaagggtctccttta

SEQ ID NO: 337654 - DNA, 75 bp, Artificial Sequence
  Synthetic
ttttttgcaggacctccaaaaaagagcagattcgaggtacccgcaaatgtcgcagacgactacagttcaaaggag

SEQ ID NO: 337655 - DNA, 75 bp, Artificial Sequence
  Synthetic
gcagattcgaggtacccgcaaatgtcgcagacgactacagttcaaaggagcaaaaatggcatccgtggcccgact

SEQ ID NO: 337656 - DNA, 75 bp, Artificial Sequence
  Synthetic
ggccgtgggagtttcacttgtcggtgtctgcttcttaaggtcaccaagcactccgagcgccagcgaggagtgcga

SEQ ID NO: 337657 - DNA, 75 bp, Artificial Sequence
  Synthetic
ctccgagcgccagcgaggagtgcgaccctaggggtgggtgcaacgccctcggcggccgcgcgctacgccttcggc

SEQ ID NO: 337658 - DNA, 75 bp, Artificial Sequence
  Synthetic
cgacgaggaagaaaaagaggtccagacgccgatcctccagcaccagctccgagagcacctccgagagcagaaagt

SEQ ID NO: 337659 - DNA, 75 bp, Artificial Sequence
  Synthetic
acgccgatcctccagcaccagctccgagagcacctccgagagcagaaagtcctcaagtcccagatcaaattcgtc

SEQ ID NO: 337660 - DNA, 75 bp, Artificial Sequence
  Synthetic
gtcacctccacgtaccatactacccctagtgggtcctagagcctacctgttcccaaaacgcttgccacaagtgtg

SEQ ID NO: 337661 - DNA, 75 bp, Artificial Sequence
  Synthetic
ctagtgggtcctagagcctacctgttcccaaaacgcttgccacaagtgtggactaagcaagactgggaaacagaa

SEQ ID NO: 337662 - DNA, 75 bp, Artificial Sequence
  Synthetic
ttctcgccattggatagtgtcaggggtcgccataacgcggaccccgttttcaccccttccggactacaaaaatgg

SEQ ID NO: 337663 - DNA, 75 bp, Artificial Sequence
  Synthetic
gacccgcgcgcacaaacctaagcagccccccgttttatccctggttgcccagggcacctcaaagcttcaaagtca

SEQ ID NO: 337664 - DNA, 75 bp, Artificial Sequence
  Synthetic
attttaagtaaggcggaagcagccccactttcttacaaaatggcggcggagcacttccggcttgcccaaaatggc

SEQ ID NO: 337665 - DNA, 75 bp, Artificial Sequence
  Synthetic
aataaaatgcaaggccgtgggagtttcacttgtcggtgtctgcttattaaggtcactaagcactccgagcgaagc

SEQ ID NO: 337666 - DNA, 75 bp, Artificial Sequence
  Synthetic
cactttcttacaaaatggcggcggagcacttccggcttgcccaaaatggcgggcaagctcttccgggtgaaaggt

SEQ ID NO: 337667 - DNA, 75 bp, Artificial Sequence
  Synthetic
gaaagggttggcgtgacaacccggaagccaatcctctcacgtggcctgtcacgtggctaccacgtcatcggcgcc

SEQ ID NO: 337668 - DNA, 75 bp, Artificial Sequence
  Synthetic
acgtggctaccacgtcatcggcgccatcttgtatcacaaaatggcggacaacttccgcttttttaaaaaaacgcg

SEQ ID NO: 337669 - DNA, 75 bp, Artificial Sequence
  Synthetic
ggcgccagcgccccccccccgcgcatgcgcgggtcccccccccgcggggggctccgccccccggccccccccccg

SEQ ID NO: 337670 - DNA, 75 bp, Artificial Sequence
  Synthetic
tgagtggggccagacttcgccataaggcctttatcttcttgccattggtcagtgtacggggtcgccataggcttc

SEQ ID NO: 337671 - DNA, 75 bp, Artificial Sequence
  Synthetic
caggccagtagaagtctatgtcgtgcacttcctgggcgtggtttacgtcctcatataagtaactgcacttccgaa

SEQ ID NO: 337672 - DNA, 75 bp, Artificial Sequence
  Synthetic
cacttcctgggcgtggtttacgtcctcatataagtaactgcacttccgaatggctgagttttctacgcccgtccg

SEQ ID NO: 337673 - DNA, 75 bp, Artificial Sequence
  Synthetic
taccaaaatggccgttccagtgacgtcacggcggccattttgagtaaggcggggcaaggccgacactatacaaaa

SEQ ID NO: 337674 - DNA, 75 bp, Artificial Sequence
  Synthetic
tcacggcggccattttgagtaaggcggggcaaggccgacactatacaaaatggcggtgtcagtcttccgctttac

SEQ ID NO: 337675 - DNA, 75 bp, Artificial Sequence
  Synthetic
tacgtcactaaccacgtgcactccacaggccagtagaagtctatgtcgtgcacttcctgggcgtggtttacgtcc

SEQ ID NO: 337676 - DNA, 75 bp, Artificial Sequence
  Synthetic
ggtcaaaggtcatgcctacgtcataagtcacgtggggacggctgctgtaaacacggaagtagctgacccgcgtga

SEQ ID NO: 337677 - DNA, 75 bp, Artificial Sequence
  Synthetic
acacggaagtagctgacccgcgtgacttgtcacgtgagcacacgtcacggcggccattttgtatcacaaaatggc

SEQ ID NO: 337678 - DNA, 75 bp, Artificial Sequence
  Synthetic
cttcgcgcgcgcgccggggggctccgcccccccccgcgcatgcgcggggccccccccccgcggggggctccgccc

SEQ ID NO: 337679 - DNA, 75 bp, Artificial Sequence
  Synthetic
gatccgtagagccaggcctgccccggccgctccggagccctcacaggttgagccgagacctgccctgccatggca

SEQ ID NO: 337680 - DNA, 75 bp, Artificial Sequence
  Synthetic
ccgtggcagacttcgcagacgatggcctcgatcagctcgtcgccgccctagacgacgaagagtaaggagacgcag

SEQ ID NO: 337681 - DNA, 75 bp, Artificial Sequence
  Synthetic
cctcgatcagctcgtcgccgccctagacgacgaagagtaaggagacgcagacgatggaggagggggcgacctaga

SEQ ID NO: 337682 - DNA, 75 bp, Artificial Sequence
  Synthetic
agagccaaatggtacgtgaacatattccaccaaaaggaggttctagaggctatagtacaaagcggaccgttcggg

SEQ ID NO: 337683 - DNA, 75 bp, Artificial Sequence
  Synthetic
gcaaaaaacgtaggagacgaaagcccaaaacagttttaaaacaatggcagccagacattacaaagaggtgctaca

SEQ ID NO: 337684 - DNA, 75 bp, Artificial Sequence
  Synthetic
caaaacagttttaaaacaatggcagccagacattacaaagaggtgctacataataggctacattcctgccataat

SEQ ID NO: 337685 - DNA, 75 bp, Artificial Sequence
  Synthetic
aactacaccagccacctgctagatattatccccaagggaccgtttggagggggacacagcaccatgagattctcc

SEQ ID NO: 337686 - DNA, 75 bp, Artificial Sequence
  Synthetic
ttatccccaagggaccgtttggagggggacacagcaccatgagattctccctaaaagtgctcttcgaagagcacc

SEQ ID NO: 337687 - DNA, 75 bp, Artificial Sequence
  Synthetic
tagtaaccaggatttagaacttgtaagatactttagatgctcctttaggttctacagagaccaacacacagacta

SEQ ID NO: 337688 - DNA, 75 bp, Artificial Sequence
  Synthetic
agatactttagatgctcctttaggttctacagagaccaacacacagactatcttgtacactacagcagaaaaaca

SEQ ID NO: 337689 - DNA, 75 bp, Artificial Sequence
  Synthetic
cacctagccttcacccaggggtacagatgctaagcaaaaacaaaataatagtacccagctatgatactaaaccta

SEQ ID NO: 337690 - DNA, 75 bp, Artificial Sequence
  Synthetic
gatgctaagcaaaaacaaaataatagtacccagctatgatactaaacctaagggcaaaagctatgtaaaagtaac

SEQ ID NO: 337691 - DNA, 75 bp, Artificial Sequence
  Synthetic
aagatcgtcactaaccacgtgactcatttcagccaaccggtatgctatgtcgtgcacttcctgggccgggtctac

SEQ ID NO: 337692 - DNA, 75 bp, Artificial Sequence
  Synthetic
atttcagccaaccggtatgctatgtcgtgcacttcctgggccgggtctacgtcctaatataagaagctgcacttc

SEQ ID NO: 337693 - DNA, 75 bp, Artificial Sequence
  Synthetic
gtcctaatataagaagctgcacttccgaatggctgagttttccacgcccgtccgcagcggtatcgccacggaggg

SEQ ID NO: 337694 - DNA, 75 bp, Artificial Sequence
  Synthetic
tttgtgacacaaccttggttaacttagacgttgtactctgcaacttgcggtttccgttctgctcaccacaaactg

SEQ ID NO: 337695 - DNA, 75 bp, Artificial Sequence
  Synthetic
gccgaaggtgagtttacacaccgaagtcaaggggcaattcgggctcgggactggccgggctatgggcaaggctct

SEQ ID NO: 337696 - DNA, 75 bp, Artificial Sequence
  Synthetic
tcttcactccatctacaacgacttcctctctatagtagatactggaaactataaaacacaatttgtgtcaaactt

SEQ ID NO: 337697 - DNA, 75 bp, Artificial Sequence
  Synthetic
ctctctatagtagatactggaaactataaaacacaatttgtgtcaaacttatctacaaaagtaggtactgactgg

SEQ ID NO: 337698 - DNA, 75 bp, Artificial Sequence
  Synthetic
gtcaaggggcaattcgggctcgggactggccgggctatgggcaaggctcttaaaaaagctcccaaattatgtttt

SEQ ID NO: 337699 - DNA, 75 bp, Artificial Sequence
  Synthetic
cagaaggctgctactctcaccctaaattacccaaaaaggcagtaacacctggaaatgacaaaacatactttactg

SEQ ID NO: 337700 - DNA, 75 bp, Artificial Sequence
  Synthetic
aaggaaagtgctactgtcccgtgtgtgtcctgcagagaagaaacaacataccatgagcgactggattcctcctac

SEQ ID NO: 337701 - DNA, 75 bp, Artificial Sequence
  Synthetic
attacccaaaaaggcagtaacacctggaaatgacaaaacatactttactgtacccgatggcttatggggagacgc

SEQ ID NO: 337702 - DNA, 75 bp, Artificial Sequence
  Synthetic
tgtcctgcagagaagaaacaacataccatgagcgactggattcctcctacacagaatgtaccctctagagaggaa

SEQ ID NO: 337703 - DNA, 75 bp, Artificial Sequence
  Synthetic
ataattactaaaaacatggagtcatacagcgagtctgcaaaagccagaggagtgcaaggagaccctgcattttgc

SEQ ID NO: 337704 - DNA, 75 bp, Artificial Sequence
  Synthetic
tgcacagagctttttgcggctgcaacgatcctgtcaggcatcttgctagcctggctgctaattttggttttcaac

SEQ ID NO: 337705 - DNA, 75 bp, Artificial Sequence
  Synthetic
cgatcctgtcaggcatcttgctagcctggctgctaattttggttttcaacccgcgccggcgagtcgttcagatcc

SEQ ID NO: 337706 - DNA, 75 bp, Artificial Sequence
  Synthetic
cctggctaacaccaggtagaatatccccggagactccaggactttacacagacgtgacttacaacccatacgcag

SEQ ID NO: 337707 - DNA, 75 bp, Artificial Sequence
  Synthetic
gtgagaaacctccgcgcgctcccggcagcccccaccactcctagaccaccgtcatgtggtggaactggtggaaga

SEQ ID NO: 337708 - DNA, 75 bp, Artificial Sequence
  Synthetic
cagcccccaccactcctagaccaccgtcatgtggtggaactggtggaagaggcgccggtggagaccgcgccgacg

SEQ ID NO: 337709 - DNA, 75 bp, Artificial Sequence
  Synthetic
aataaatatgacaatacaagtaaatgccttttagaagacatgccactatggatggtcacctttggctatgtagac

SEQ ID NO: 337710 - DNA, 75 bp, Artificial Sequence
  Synthetic
cttccagtctggagacgtcggagaactactagatatgctagacgacgcagagtaaggagactgaggaggcgaagg

SEQ ID NO: 337711 - DNA, 75 bp, Artificial Sequence
  Synthetic
ctactagatatgctagacgacgcagagtaaggagactgaggaggcgaaggaggagagggtgggcgcgccggaggt

SEQ ID NO: 337712 - DNA, 75 bp, Artificial Sequence
  Synthetic
ggggtattccactgtgggccagagtactgataagatgcccttacacagtaccaaaactttacaatgaagcagacc

SEQ ID NO: 337713 - DNA, 75 bp, Artificial Sequence
  Synthetic
actgataagatgcccttacacagtaccaaaactttacaatgaagcagacccaaactacggatgggtcccttactc

SEQ ID NO: 337714 - DNA, 75 bp, Artificial Sequence
  Synthetic
aagaagaaagaaaataaaactaacacagtggaatcccacagtggtaaaaaaatgcgtggtaaaaggttacctgcc

SEQ ID NO: 337715 - DNA, 75 bp, Artificial Sequence
  Synthetic
cagtggaatcccacagtggtaaaaaaatgcgtggtaaaaggttacctgcccctcctaatctgtggaacgggcacc

SEQ ID NO: 337716 - DNA, 75 bp, Artificial Sequence
  Synthetic
ccaaacggagacctgtacgtaccctttaaaattagaatgaagtggtacccgtccatgtggaaccaagaaccagta

SEQ ID NO: 337717 - DNA, 75 bp, Artificial Sequence
  Synthetic
gcagccacatgcatgactatagaaaatatgacccatttggagggggcataagcactatgcaattcaatctaagca

SEQ ID NO: 337718 - DNA, 75 bp, Artificial Sequence
  Synthetic
gtccatgtggaaccaagaaccagtactaaatgacttagcaaagagcggaccgtttgcatacaaagacacaaaaac

SEQ ID NO: 337719 - DNA, 75 bp, Artificial Sequence
  Synthetic
atatgacccatttggagggggcataagcactatgcaattcaatctaagcatcctgtttgacgagtatatgaaaca

SEQ ID NO: 337720 - DNA, 75 bp, Artificial Sequence
  Synthetic
gtagacctagaactcataagatacaggggatgctctttcaaactatatagacacgagaaatgcgactttttcttc

SEQ ID NO: 337721 - DNA, 75 bp, Artificial Sequence
  Synthetic
ggggatgctctttcaaactatatagacacgagaaatgcgactttttcttcacatacagtagaaaaccacctttta

SEQ ID NO: 337722 - DNA, 75 bp, Artificial Sequence
  Synthetic
ctcgcagaatacaagtcattgacccgaaagtcctcggtccccactactcattccaccgctgggacttcaggcgtg

SEQ ID NO: 337723 - DNA, 75 bp, Artificial Sequence
  Synthetic
actacatccaggaatgctaatgaacaggagaaaaaaaataatactactcagttttaaaactagacccaaagggca

SEQ ID NO: 337724 - DNA, 75 bp, Artificial Sequence
  Synthetic
aggagaaaaaaaataatactactcagttttaaaactagacccaaagggcacagcacaaaaaccattagaatacca

SEQ ID NO: 337725 - DNA, 75 bp, Artificial Sequence
  Synthetic
tctgagtttttattctcaggtccaaagagacccagaatcgatcaagggccttacatcccgccagaaaaaggctca

SEQ ID NO: 337726 - DNA, 75 bp, Artificial Sequence
  Synthetic
ggtacttccagaaagactttgcaaaggttccgctcgttaacatcggtgccagtatagggaacttgcggtttccgt

SEQ ID NO: 337727 - DNA, 75 bp, Artificial Sequence
  Synthetic
ggttccgctcgttaacatcggtgccagtatagggaacttgcggtttccgttctgccgaccacaaactgaaaacac

SEQ ID NO: 337728 - DNA, 75 bp, Artificial Sequence
  Synthetic
agagacagaagccccctcggaagaagagccggagaaccaagaagaacaagtactccagttgcagctccgacagca

SEQ ID NO: 337729 - DNA, 75 bp, Artificial Sequence
  Synthetic
aatgcctggaacaatatgctaagtatagcacacccccacacagaaaataactggcagtatattacagaaacttta

SEQ ID NO: 337730 - DNA, 75 bp, Artificial Sequence
  Synthetic
tagcacacccccacacagaaaataactggcagtatattacagaaactttactaaaaacacactggcactcaaacc

SEQ ID NO: 337731 - DNA, 75 bp, Artificial Sequence
  Synthetic
cagggaatccagtgcctcttcgagcaactgataacaacccaacagggggttcacaaaaacccattgctagagtag

SEQ ID NO: 337732 - DNA, 75 bp, Artificial Sequence
  Synthetic
aactgataacaacccaacagggggttcacaaaaacccattgctagagtaggcccagagcagtggctgtttcccga

SEQ ID NO: 337733 - DNA, 75 bp, Artificial Sequence
  Synthetic
cgacagcagagacagagtcggagtagtgtttaacacatttaaaacacaagaacacatacagaatccaaactttca

SEQ ID NO: 337734 - DNA, 75 bp, Artificial Sequence
  Synthetic
gtgtttaacacatttaaaacacaagaacacatacagaatccaaactttcagactgacaaagaacaagtgagtact

SEQ ID NO: 337735 - DNA, 75 bp, Artificial Sequence
  Synthetic
gcccaggactgggcggaggagtacactgcctgtaaatactggggtaggccacctcgcaaattcctcacagacacg

SEQ ID NO: 337736 - DNA, 75 bp, Artificial Sequence
  Synthetic
ctgcctgtaaatactggggtaggccacctcgcaaattcctcacagacacgccattctatactcactgcaagacca

SEQ ID NO: 337737 - DNA, 75 bp, Artificial Sequence
  Synthetic
gcttatggggcgactacgtatacaaagaaagcataattgactcatttaaaacgaatgccacaaactattataata

SEQ ID NO: 337738 - DNA, 75 bp, Artificial Sequence
  Synthetic
agaaagcataattgactcatttaaaacgaatgccacaaactattataatagcagaaaaggcacacaaataacagc

SEQ ID NO: 337739 - DNA, 75 bp, Artificial Sequence
  Synthetic
ctatcaataaatataccagcttcactgttctaggccgtgggagtttcactggtcggtgtctatctctaaaggtca

SEQ ID NO: 337740 - DNA, 75 bp, Artificial Sequence
  Synthetic
ggcatattctcacccatcttcttaagcagacagagactagcccccgactttccagggttctacacagaggtcata

SEQ ID NO: 337741 - DNA, 75 bp, Artificial Sequence
  Synthetic
gcagacagagactagcccccgactttccagggttctacacagaggtcatatataacccagcaaacgataaaggcg

SEQ ID NO: 337742 - DNA, 75 bp, Artificial Sequence
  Synthetic
cccccctccacccgaaacgcttgcgcgtttcggaccttcggcgtcgggggggtcgggagctttattaaacagact

SEQ ID NO: 337743 - DNA, 75 bp, Artificial Sequence
  Synthetic
gtgcacaaaaaatgactcacaatggacagacagacaatctgtagtacccatagtagacataccgctgtgggccgc

SEQ ID NO: 337744 - DNA, 75 bp, Artificial Sequence
  Synthetic
acagacagacaatctgtagtacccatagtagacataccgctgtgggccgccgttatggggtacagtgactactgt

SEQ ID NO: 337745 - DNA, 75 bp, Artificial Sequence
  Synthetic
ggccagacttcgccataaggcctttatcttcctgccatttgtcagtgtccggggtcgctgtaggcttcgggctcg

SEQ ID NO: 337746 - DNA, 75 bp, Artificial Sequence
  Synthetic
tgctaaaagaagccagacttacagttatatgcccctacacggaaccaccactgactgacaaaaacagtaccgaca

SEQ ID NO: 337747 - DNA, 75 bp, Artificial Sequence
  Synthetic
tatatgcccctacacggaaccaccactgactgacaaaaacagtaccgacactggattcataccttttgactataa

SEQ ID NO: 337748 - DNA, 75 bp, Artificial Sequence
  Synthetic
accgccattttggtgacgtcacggccgccatcttaagtagttgaggcggacggtggcgtcggttcaaaggtcacc

SEQ ID NO: 337749 - DNA, 75 bp, Artificial Sequence
  Synthetic
ggacagaattatataccagtagagtacagatttaggtggtacccatgcatgtttcaccagcaaaactggatgaat

SEQ ID NO: 337750 - DNA, 75 bp, Artificial Sequence
  Synthetic
atcagccacacctactcaaaatggagggcaatttcttccgggtcaaaggtcacagtcgccatattacatcacgtg

SEQ ID NO: 337751 - DNA, 75 bp, Artificial Sequence
  Synthetic
acagatttaggtggtacccatgcatgtttcaccagcaaaactggatgaatgacattgcacagtgcggcccctttg

SEQ ID NO: 337752 - DNA, 75 bp, Artificial Sequence
  Synthetic
tgtgacacaagatgaccgacttccttcctctttttcaaaaaaaagcggaagtgccgccgcggcggcggggggcgg

SEQ ID NO: 337753 - DNA, 75 bp, Artificial Sequence
  Synthetic
tcctctttttcaaaaaaaagcggaagtgccgccgcggcggcggggggcggcgcgctgcgcgcgccgcccagtagg

SEQ ID NO: 337754 - DNA, 75 bp, Artificial Sequence
  Synthetic
agtgctgacagctaaatacaaatttacttttcttttcggtggcaatcccatcgcccagcaaactcttaaagaccc

SEQ ID NO: 337755 - DNA, 75 bp, Artificial Sequence
  Synthetic
acttttcttttcggtggcaatcccatcgcccagcaaactcttaaagacccgggaacccagcccaccttcgaaatt

SEQ ID NO: 337756 - DNA, 75 bp, Artificial Sequence
  Synthetic
gggcgcaatgcgcccccccccgcgcatgcgcggggccccccccgcggggggctctgccccccggccccccccgtg

SEQ ID NO: 337757 - DNA, 75 bp, Artificial Sequence
  Synthetic
gagtacaagtggagaacccgaaacatctccacgaggggatgttcttcagagcgtgggatctccgaagaggctact

SEQ ID NO: 337758 - DNA, 75 bp, Artificial Sequence
  Synthetic
tctccacgaggggatgttcttcagagcgtgggatctccgaagaggctactttggtgaaaaagctctcaaaagaat

SEQ ID NO: 337759 - DNA, 75 bp, Artificial Sequence
  Synthetic
tgtcctgatataactagctgcacttccgaatggctgagttttccacgcccgtccgcagcgagtgagccacggagg

SEQ ID NO: 337760 - DNA, 75 bp, Artificial Sequence
  Synthetic
tttattacaggccctccaaaaagatcaaaattcgaggttcccgccattgccgcagacgactgcggtttccaggga

SEQ ID NO: 337761 - DNA, 75 bp, Artificial Sequence
  Synthetic
caaaattcgaggttcccgccattgccgcagacgactgcggtttccagggaagaaagcaaaagttctggttcgaaa

SEQ ID NO: 337762 - DNA, 75 bp, Artificial Sequence
  Synthetic
ccagacagaagaagaggaggaggactcgcaaaacacgcagctccagctccgaaaacagctcaaggagcagaagct

SEQ ID NO: 337763 - DNA, 75 bp, Artificial Sequence
  Synthetic
tcgcaaaacacgcagctccagctccgaaaacagctcaaggagcagaagctcctcaagtgccaggtccaacacctc

SEQ ID NO: 337764 - DNA, 75 bp, Artificial Sequence
  Synthetic
atcacctccacgtacccatcttccccttgtaggaccaagagcccatctgttccaggaccgcttgccacaagtgtg

SEQ ID NO: 337765 - DNA, 75 bp, Artificial Sequence
  Synthetic
cttgtaggaccaagagcccatctgttccaggaccgcttgccacaagtgtggtctaagcaagactggcaaacagaa

SEQ ID NO: 337766 - DNA, 75 bp, Artificial Sequence
  Synthetic
gaccaccgcgcacagacttatccagacctcccttctatccctggatgcccagaaataacccacacttcagagttt

SEQ ID NO: 337767 - DNA, 75 bp, Artificial Sequence
  Synthetic
cctttaaactaggctttcagccataataaaatttcaaggccgtgggagtttcacttgtcggtgtctgcttataaa

SEQ ID NO: 337768 - DNA, 75 bp, Artificial Sequence
  Synthetic
cggatccaattttaggccttccggactacaaaaatggcggattcgtgacgtcacggccgccattttgtgtaaggc

SEQ ID NO: 337769 - DNA, 75 bp, Artificial Sequence
  Synthetic
ctacaaaaatggcggattcgtgacgtcacggccgccattttgtgtaaggcggaacaggctgacaccccgtgtcaa

SEQ ID NO: 337770 - DNA, 75 bp, Artificial Sequence
  Synthetic
aaggcctttatcttcttgccattggtcagtatttgaggttgccataggcttcggcctccattttaggccttccgg

SEQ ID NO: 337771 - DNA, 75 bp, Artificial Sequence
  Synthetic
caccaaatggtggacaatttcttccgggtcaaaggtcgtacctacgtcataagtcacgtgggaagagctgctgtg

SEQ ID NO: 337772 - DNA, 75 bp, Artificial Sequence
  Synthetic
gcttgtcacgtgagtgcacgtcacggcggccattttgaatcacaaaatggcggacttccttcctcttttttaaaa

SEQ ID NO: 337773 - DNA, 75 bp, Artificial Sequence
  Synthetic
gcggccattttgaatcacaaaatggcggacttccttcctcttttttaaaattaacggaccggcggcggcgcgcgc

SEQ ID NO: 337774 - DNA, 75 bp, Artificial Sequence
  Synthetic
ttcgcgcgccgcccagtagggggcgcaagcgcccccccccgcgcatgcgcggggcccccccccggggggctctgc

SEQ ID NO: 337775 - DNA, 75 bp, Artificial Sequence
  Synthetic
gtaaaacaaaatggccgacttccttcctcttttttaacaaaaaagcggaggtaccccgcagcggcgggggggcgg

SEQ ID NO: 337776 - DNA, 75 bp, Artificial Sequence
  Synthetic
ggggctccgccccccccccgcgcatgtgcggggccccccccccgcggggggctccgccccccggccccccccccg

SEQ ID NO: 337777 - DNA, 75 bp, Artificial Sequence
  Synthetic
cctcgcgtcccgagggcgggtgccggaggtgagtttacacaccgcagtcaaggggcaattcgggctcgggactgg

SEQ ID NO: 337778 - DNA, 75 bp, Artificial Sequence
  Synthetic
gctacgtcactaacctacgtgtccgtctcctataggccggacaccgtctacgtcatacacctcctgggcatggtc

SEQ ID NO: 337779 - DNA, 75 bp, Artificial Sequence
  Synthetic
ccgggccctgggcaaggctcttaaaaaatgcgctttcgcagggttgcggagaaaaggaaagtgcttctgcaaagt

SEQ ID NO: 337780 - DNA, 75 bp, Artificial Sequence
  Synthetic
ggcttctaggtatgtggcagccccccgcgcacaatgtccccggcatcgagagaaactggtacgagagctgcttca

SEQ ID NO: 337781 - DNA, 75 bp, Artificial Sequence
  Synthetic
tggcgactttgttggccatattaatcatttggcaactactctgggtcgtcctccgcgtcctgggcccccaggcgg

SEQ ID NO: 337782 - DNA, 75 bp, Artificial Sequence
  Synthetic
tatgtgtggctgtgctgattttattaatcatctcaatcatatcgctgctatgctcggccgtccggaagaccagaa

SEQ ID NO: 337783 - DNA, 75 bp, Artificial Sequence
  Synthetic
cgctacagaaaatggcgacggggcagacgcagacggactcacagaaaaaagataattataaaacagtggcaacca

SEQ ID NO: 337784 - DNA, 75 bp, Artificial Sequence
  Synthetic
gataattataaaacagtggcaaccaaactttattagacgctgctacataataggatacctacctatcattttctg

SEQ ID NO: 337785 - DNA, 75 bp, Artificial Sequence
  Synthetic
gaccaggcagaaaacactatgtaaagattaaagtgggagccccccgaatgttcacagataagtggtacccccaga

SEQ ID NO: 337786 - DNA, 75 bp, Artificial Sequence
  Synthetic
atgcaatatccgttcggctcaccactaactgacactatagttgtgtcattccaagttctgcaatccatgttcaac

SEQ ID NO: 337787 - DNA, 75 bp, Artificial Sequence
  Synthetic
atggtacagataaacactcagcctcctttcttagacacaagcctcaccgcggccagcatacacccgggcatcatg

SEQ ID NO: 337788 - DNA, 75 bp, Artificial Sequence
  Synthetic
cgcacaattacatgataaaattattaaccatttaccctactacaacaccacacaaacacaagcacaatttaagag

SEQ ID NO: 337789 - DNA, 75 bp, Artificial Sequence
  Synthetic
cagaaaacacagggtggtcgtcagggtgggcgccccaagactttttcaggacaagtggtacccccagtcagacct

SEQ ID NO: 337790 - DNA, 75 bp, Artificial Sequence
  Synthetic
gtgggcgccccaagactttttcaggacaagtggtacccccagtcagacctatgtgacacagttctgctttccata

SEQ ID NO: 337791 - DNA, 75 bp, Artificial Sequence
  Synthetic
aaccatttaccctactacaacaccacacaaacacaagcacaatttaagagatttacagaaaaccaagaagcaaca

SEQ ID NO: 337792 - DNA, 75 bp, Artificial Sequence
  Synthetic
acgtaaacagctgtaaatttaacaaacaagaatcacctaaaagtgacaatggcataggaggcccatactgctcat

SEQ ID NO: 337793 - DNA, 75 bp, Artificial Sequence
  Synthetic
agcatacaataacaaaattacaactatacctgaaaaagcaagcaaactatactatgaggagactaaaaaattaat

SEQ ID NO: 337794 - DNA, 75 bp, Artificial Sequence
  Synthetic
aacttatttaatcaagttcaactatacaacacctttcaaaccatagcccagcttaaagaaacaggacaacttaca

SEQ ID NO: 337795 - DNA, 75 bp, Artificial Sequence
  Synthetic
acaacacctttcaaaccatagcccagcttaaagaaacaggacaacttacaagcggcactacaagttggaatagcg

SEQ ID NO: 337796 - DNA, 75 bp, Artificial Sequence
  Synthetic
acccattctcagacagaggcgaaggcaacatgctgtggatagactggctaactaaagacacctcagtatatgaga

SEQ ID NO: 337797 - DNA, 75 bp, Artificial Sequence
  Synthetic
ctcaggtagtaatgcaactgacagcagagacacttggtacaagggaaacacatacaatacgaacatacaaacgtt

SEQ ID NO: 337798 - DNA, 75 bp, Artificial Sequence
  Synthetic
agacatgcccttatgggccactgtgttcggattctccgagtactgcagtaaagtaacaggagacacaaacataga

SEQ ID NO: 337799 - DNA, 75 bp, Artificial Sequence
  Synthetic
agacatgcccttatgggcctctgtgttcggattctccgagtactgcagtaaagtaacaggagacacaaacataga

SEQ ID NO: 337800 - DNA, 75 bp, Artificial Sequence
  Synthetic
agacatgcccttatgggcccctgtgttcggattctccgagtactgcagtaaagtaacaggagacacaaacataga

SEQ ID NO: 337801 - DNA, 75 bp, Artificial Sequence
  Synthetic
agacatgcccttatgggccgctgtgttcggattctccgagtactgcagtaaagtaacaggagacacaaacataga

SEQ ID NO: 337802 - DNA, 75 bp, Artificial Sequence
  Synthetic
agagacacttggtacaagggaaacacatacaatacgaacatacaaacgttagcagagaaaacaagacaaaggttt

SEQ ID NO: 337803 - DNA, 75 bp, Artificial Sequence
  Synthetic
agcccctacacagtgccacaactgttagatcacaacaaccccctcaggggatacgtgccctacagttttaacttt

SEQ ID NO: 337804 - DNA, 75 bp, Artificial Sequence
  Synthetic
agacttatatgaataccactcaggcatatactccagcatatttctatcagctggcaggagctactttgaaaccac

SEQ ID NO: 337805 - DNA, 75 bp, Artificial Sequence
  Synthetic
tcagacatgggttctttggcagaaaagctattaagagaatgcaagaacaaccaatacctcatgacactttttcag

SEQ ID NO: 337806 - DNA, 75 bp, Artificial Sequence
  Synthetic
tacagaagcactccaatccagccaagaagagcaacaaaaagaaaacttacttttcccagtccagcagctcaagcg

SEQ ID NO: 337807 - DNA, 75 bp, Artificial Sequence
  Synthetic
atagtacagtccggaccgttcgggtacaggggcgacataaaatcagctgtactgtccatgaaatacagatttcac

SEQ ID NO: 337808 - DNA, 75 bp, Artificial Sequence
  Synthetic
cgcaaaaacaggagaccctctcccagcaactcagagaccagctgcacaagcagcgggtcatgggagaccaactca

SEQ ID NO: 337809 - DNA, 75 bp, Artificial Sequence
  Synthetic
ggtccaacaaaatcaacacataaaccctatgttattgccaaagggtctggcattaacttctatttctcgcagtgt

SEQ ID NO: 337810 - DNA, 75 bp, Artificial Sequence
  Synthetic
cctatgttattgccaaagggtctggcattaacttctatttctcgcagtgtaacatagatatgttcggggacccca

SEQ ID NO: 337811 - DNA, 75 bp, Artificial Sequence
  Synthetic
ctggaaggaggagtacgaggcctgcaggtactgggacagaccccccagacacaacctgaggagcaccccccacta

SEQ ID NO: 337812 - DNA, 75 bp, Artificial Sequence
  Synthetic
atcagatgctctttacgttcctgcaggaccactcaagaggcctcgcagagacaccaacgcccaagacccggaaga

SEQ ID NO: 337813 - DNA, 75 bp, Artificial Sequence
  Synthetic
taccgtgtcaactttgccctcaactacaaataaacggtggccgtgggagcttcacttgtcggtgtctacctctta

SEQ ID NO: 337814 - DNA, 75 bp, Artificial Sequence
  Synthetic
acaaataaacggtggccgtgggagcttcacttgtcggtgtctacctcttaaggtcactaagcactccgagcgtca

SEQ ID NO: 337815 - DNA, 75 bp, Artificial Sequence
  Synthetic
agctccgagagcagcgagtactccgactccagctccaacaactcgcaacccaagtcctcaaagttcaagcaggac

SEQ ID NO: 337816 - DNA, 75 bp, Artificial Sequence
  Synthetic
cgcttgcgcgattcggacctgcggcctcgggggggtcgggggctttactaaacagactccgaggtgccattggac

SEQ ID NO: 337817 - DNA, 75 bp, Artificial Sequence
  Synthetic
ctcgggggggtcgggggctttactaaacagactccgaggtgccattggacactgagggggcaaacagcaacgaaa

SEQ ID NO: 337818 - DNA, 75 bp, Artificial Sequence
  Synthetic
ccaagcataaacaaagcctatatgtttgaaccccagggtcctaaacccatacaggggtacaacgattggctagag

SEQ ID NO: 337819 - DNA, 75 bp, Artificial Sequence
  Synthetic
aggcctttatcttcttgccatttgtccgcgaccgggggtcgctcctagacgcggaccccgtttcggggtccttcc

SEQ ID NO: 337820 - DNA, 75 bp, Artificial Sequence
  Synthetic
acagacccccaagaatgctacacacagacttacccttttacccctgggcaccaaaaccccaagaccaagtcaggg

SEQ ID NO: 337821 - DNA, 75 bp, Artificial Sequence
  Synthetic
cgtcacgggcgccatgttaagtggctgtcgccgaggattgacgtcacagttcaaaggtcatcctcgacggtaacc

SEQ ID NO: 337822 - DNA, 75 bp, Artificial Sequence
  Synthetic
tgtcgccgaggattgacgtcacagttcaaaggtcatcctcgacggtaaccgcaaacatggcggacaatctcttcc

SEQ ID NO: 337823 - DNA, 75 bp, Artificial Sequence
  Synthetic
cccccgggggaggcaacgcctcccccccccgcgcgcatgcgcgcgggtccccccccctccggggggctccgcccc

SEQ ID NO: 337824 - DNA, 75 bp, Artificial Sequence
  Synthetic
tcccggaagttctcctcggtcacgtgactgtacacgtgactgctacgtcattggcgccatcttgtgtcacaaaat

SEQ ID NO: 337825 - DNA, 75 bp, Artificial Sequence
  Synthetic
cggcgcgcgcgctgcgcgcgcgcgccgggggggcgccagcgccccccccgcgcatgcgcgggtccccccccccca

SEQ ID NO: 337826 - DNA, 75 bp, Artificial Sequence
  Synthetic
tacgtcactaaccacgtgtcctccacagaccaaccatatgctatgtcgtccacttcctggggtgtgtctacgtga

SEQ ID NO: 337827 - DNA, 75 bp, Artificial Sequence
  Synthetic
cagaccaaccatatgctatgtcgtccacttcctggggtgtgtctacgtgataatataaatgactgcacttccgaa

SEQ ID NO: 337828 - DNA, 75 bp, Artificial Sequence
  Synthetic
cacttcctggggtgtgtctacgtgataatataaatgactgcacttccgaatggctgagtttatgctgcccgtccg

SEQ ID NO: 337829 - DNA, 75 bp, Artificial Sequence
  Synthetic
gggcaattcgggctcgggactggccgggccatgggcaaggctcttaaatagctacgtttcttggtaggcctcaca

SEQ ID NO: 337830 - DNA, 75 bp, Artificial Sequence
  Synthetic
ctacgcgcgcgcgccggggggctctgcccccccccgcgcatgcgcgcgggtccccccccccgcggggggctccgc

SEQ ID NO: 337831 - DNA, 75 bp, Artificial Sequence
  Synthetic
tagcttgccagctgcaaagaaaaaaccacctatgagtatttggaggcctccactgcacaatgtcccgggactcga

SEQ ID NO: 337832 - DNA, 75 bp, Artificial Sequence
  Synthetic
gggtcatcgctcttaaatatgttttttggcaggccttacagaaaaaagaaaagggcgctgtcactgcttgacgtg

SEQ ID NO: 337833 - DNA, 75 bp, Artificial Sequence
  Synthetic
ttggcaggccttacagaaaaaagaaaagggcgctgtcactgcttgacgtgcgaactccacaggagaaacgggctc

SEQ ID NO: 337834 - DNA, 75 bp, Artificial Sequence
  Synthetic
ccacctatgagtatttggaggcctccactgcacaatgtcccgggactcgaacacctctggtacgagtcagtgcat

SEQ ID NO: 337835 - DNA, 75 bp, Artificial Sequence
  Synthetic
ggccgggccatgggcaaggctcttagggtcatcgctcttaaatatgttttttggcaggccttacagaaaaaagaa

SEQ ID NO: 337836 - DNA, 75 bp, Artificial Sequence
  Synthetic
gtggggatcctgtacgccatcttactgctcttgctgaaagatatggcattccgggagggtcgcggtcttctgggg

SEQ ID NO: 337837 - DNA, 75 bp, Artificial Sequence
  Synthetic
acacaatgccgccggcatcgacaggcagttctttgaggcttgttttcgatgccacgcaggttgctgtggctgcgg

SEQ ID NO: 337838 - DNA, 75 bp, Artificial Sequence
  Synthetic
cagttctttgaggcttgttttcgatgccacgcaggttgctgtggctgcggcaattttgttagccatcttaatgta

SEQ ID NO: 337839 - DNA, 75 bp, Artificial Sequence
  Synthetic
tgctcttgctgaaagatatggcattccgggagggtcgcggtcttctggggcaccgggagtagggggcaaccacaa

SEQ ID NO: 337840 - DNA, 75 bp, Artificial Sequence
  Synthetic
cacccggcggctgctccggaccccccagcaggtaaccagcctccggccctgccatggcatggggatggtggaaac

SEQ ID NO: 337841 - DNA, 75 bp, Artificial Sequence
  Synthetic
ggggcccggcgccgccaggtggtcctgggccggcgccccaagtgagacccgcgcttccagcgcctgagccggacc

SEQ ID NO: 337842 - DNA, 75 bp, Artificial Sequence
  Synthetic
tgggccggcgccccaagtgagacccgcgcttccagcgcctgagccggaccccgagggtcctgagcctcagccatg

SEQ ID NO: 337843 - DNA, 75 bp, Artificial Sequence
  Synthetic
cagcaggtaaccagcctccggccctgccatggcatggggatggtggaaacgaaagcggcgctggtggtggagaaa

SEQ ID NO: 337844 - DNA, 75 bp, Artificial Sequence
  Synthetic
agacgatggcctagacgatctcgtcgccgccctcgacgaagaagagtaaggaggcggaggaggtggaggagaggg

SEQ ID NO: 337845 - DNA, 75 bp, Artificial Sequence
  Synthetic
ggaggcgccgccgttggaaacccaggcgccgccgctggagacgcctacgacggagacgacctagacgccctcttc

SEQ ID NO: 337846 - DNA, 75 bp, Artificial Sequence
  Synthetic
gccgccctcgacgaagaagagtaaggaggcggaggaggtggaggagagggcgaccgagacgcagactgtacagac

SEQ ID NO: 337847 - DNA, 75 bp, Artificial Sequence
  Synthetic
aaggaggcggaggtggggcaggagacgggggcgacgcagacggtacgccaccagacgaaagagacgcaccaaggg

SEQ ID NO: 337848 - DNA, 75 bp, Artificial Sequence
  Synthetic
gaagagggctaagataactataagacaatggcagccagccatgacgagacgctgttttataaggggacacatgcc

SEQ ID NO: 337849 - DNA, 75 bp, Artificial Sequence
  Synthetic
caatggcagccagccatgacgagacgctgttttataaggggacacatgcccgctttaatatgtggctggggggcg

SEQ ID NO: 337850 - DNA, 75 bp, Artificial Sequence
  Synthetic
ctgactcagtggcacccctctagcataaggcgctgcttaattaagggcatagtccccctggtgatatgcggacac

SEQ ID NO: 337851 - DNA, 75 bp, Artificial Sequence
  Synthetic
tggaggacaaaatagttaaaggaccctacggagggggacacgccacttttagattctccctacaagtactgtgcg

SEQ ID NO: 337852 - DNA, 75 bp, Artificial Sequence
  Synthetic
taaggcgctgcttaattaagggcatagtccccctggtgatatgcggacacaccaggtggaactggaactacgccc

SEQ ID NO: 337853 - DNA, 75 bp, Artificial Sequence
  Synthetic
ctacggagggggacacgccacttttagattctccctacaagtactgtgcgaggagcatctaaaacaccacaatta

SEQ ID NO: 337854 - DNA, 75 bp, Artificial Sequence
  Synthetic
gggtcgctatgcccacggggggtccctcagcaccactacgtggtcgcttaaggtgctgtacgacgaattcttaaa

SEQ ID NO: 337855 - DNA, 75 bp, Artificial Sequence
  Synthetic
gaactagctctgtactacggagccactattaaattttacagaagcccagacacagactttatagtaacataccag

SEQ ID NO: 337856 - DNA, 75 bp, Artificial Sequence
  Synthetic
ctcagcaccactacgtggtcgcttaaggtgctgtacgacgaattcttaaagcatcacaacttctggggctatccc

SEQ ID NO: 337857 - DNA, 75 bp, Artificial Sequence
  Synthetic
ctattaaattttacagaagcccagacacagactttatagtaacataccagagaaaatccccccttggaggcaaca

SEQ ID NO: 337858 - DNA, 75 bp, Artificial Sequence
  Synthetic
acaagggggcaaaatttacattttacagacagaaaaagactgactttatagtgttctttaacagaaagcctccct

SEQ ID NO: 337859 - DNA, 75 bp, Artificial Sequence
  Synthetic
agcagaggccatgctaagcaaaaacaaaatactaataccgagcttacaaacaaaacccaaaggaaaaaagactgt

SEQ ID NO: 337860 - DNA, 75 bp, Artificial Sequence
  Synthetic
aaaatactaataccgagcttacaaacaaaacccaaaggaaaaaagactgtaaaagttaacataccaccccccacc

SEQ ID NO: 337861 - DNA, 75 bp, Artificial Sequence
  Synthetic
agaaggacatatgtgacctaacactgtttaacttgaacgttgttgcggctgacttgcggtttccgttctgctcac

SEQ ID NO: 337862 - DNA, 75 bp, Artificial Sequence
  Synthetic
ccagctacgacactaaaccaaagggcaggccaaaaataactgttagaataaagccccccactctgttagaggaca

SEQ ID NO: 337863 - DNA, 75 bp, Artificial Sequence
  Synthetic
gtttaacttgaacgttgttgcggctgacttgcggtttccgttctgctcaccacaaactgacaacgtttgcatcac

SEQ ID NO: 337864 - DNA, 75 bp, Artificial Sequence
  Synthetic
agtggtacactcagcaggacctgtgcgacgttaacctgttgcaacttgtggttactgcggctgactttcaacatc

SEQ ID NO: 337865 - DNA, 75 bp, Artificial Sequence
  Synthetic
aacaacttcctctctacaactttaggcactacaaatgaatccacttttatagaaaactttttaaaagttgcattt

SEQ ID NO: 337866 - DNA, 75 bp, Artificial Sequence
  Synthetic
gcactacaaatgaatccacttttatagaaaactttttaaaagttgcatttccagatgacaaacctaggcattcaa

SEQ ID NO: 337867 - DNA, 75 bp, Artificial Sequence
  Synthetic
tccaaccacaacgttccaagtgttgaaagacatttattacaacactatgagcatctctgagcctccagaggccta

SEQ ID NO: 337868 - DNA, 75 bp, Artificial Sequence
  Synthetic
aaagacatttattacaacactatgagcatctctgagcctccagaggcctacactaatgttaataagccttctgaa

SEQ ID NO: 337869 - DNA, 75 bp, Artificial Sequence
  Synthetic
aggatgcatgtctcacccccaactacaaaaatttaaaccaccaaacacaggaccaggcgaaaacaaatacttttt

SEQ ID NO: 337870 - DNA, 75 bp, Artificial Sequence
  Synthetic
caaaaatttaaaccaccaaacacaggaccaggcgaaaacaaatacttttttacaccagacggactatggggagac

SEQ ID NO: 337871 - DNA, 75 bp, Artificial Sequence
  Synthetic
atgaactagagcaaataatatacacaaggggctcctactggaactcttttcacgcccttgagtaccttaatccag

SEQ ID NO: 337872 - DNA, 75 bp, Artificial Sequence
  Synthetic
aaggggctcctactggaactcttttcacgcccttgagtaccttaatccaggaatatctggcagttacaactcaaa

SEQ ID NO: 337873 - DNA, 75 bp, Artificial Sequence
  Synthetic
tacaacaacaaactgcacaacaaattagagaaaaaattaaaaaaaacatggaaaattactatgccaaaatagtag

SEQ ID NO: 337874 - DNA, 75 bp, Artificial Sequence
  Synthetic
tagagaaaaaattaaaaaaaacatggaaaattactatgccaaaatagtagaagaaaacacaataataacaaaagg

SEQ ID NO: 337875 - DNA, 75 bp, Artificial Sequence
  Synthetic
ctaataaattggcttactggaaaaggcccaaacaaatttcaaactggaaacagcactcaatttggccataacagc

SEQ ID NO: 337876 - DNA, 75 bp, Artificial Sequence
  Synthetic
gcccaaacaaatttcaaactggaaacagcactcaatttggccataacagctacaaacccacagaaaacaatatta

SEQ ID NO: 337877 - DNA, 75 bp, Artificial Sequence
  Synthetic
ggcatattttcaccaccattcttaaacataggtagagtagccagagaatttccaggactatacacagacgttgtc

SEQ ID NO: 337878 - DNA, 75 bp, Artificial Sequence
  Synthetic
acataggtagagtagccagagaatttccaggactatacacagacgttgtctataatccatggacagataaaggca

SEQ ID NO: 337879 - DNA, 75 bp, Artificial Sequence
  Synthetic
tgcgttaaaccaacctaatgacctgactgttaacatagcacaggcaaaggcagagagattcgagtaccacctagg

SEQ ID NO: 337880 - DNA, 75 bp, Artificial Sequence
  Synthetic
actgttaacatagcacaggcaaaggcagagagattcgagtaccacctaggctggtactctcccatactactgagc

SEQ ID NO: 337881 - DNA, 75 bp, Artificial Sequence
  Synthetic
cctaacaaaaagcgacaatatatatgacccaagacaaagcattctactaatggcagacatgccactatacataat

SEQ ID NO: 337882 - DNA, 75 bp, Artificial Sequence
  Synthetic
gacccaagacaaagcattctactaatggcagacatgccactatacataatgttaaatggatatatagactgggca

SEQ ID NO: 337883 - DNA, 75 bp, Artificial Sequence
  Synthetic
ccagggcctaccaagatgttacttataaccctaactgtgacagaggagttaaaaacagagtgtgggttcagcctc

SEQ ID NO: 337884 - DNA, 75 bp, Artificial Sequence
  Synthetic
taaccctaactgtgacagaggagttaaaaacagagtgtgggttcagcctctcactaaacccaccacagagtttga

SEQ ID NO: 337885 - DNA, 75 bp, Artificial Sequence
  Synthetic
tagctacacaatacagactactactaacatgtccctacacattcccaagactatacgtagaaacaaacccaaact

SEQ ID NO: 337886 - DNA, 75 bp, Artificial Sequence
  Synthetic
aacatgtccctacacattcccaagactatacgtagaaacaaacccaaactatggatatgtaccatattcagaatc

SEQ ID NO: 337887 - DNA, 75 bp, Artificial Sequence
  Synthetic
gagaacctgcccctgtgggcagccttctactgctaccacaactttgtagaagaggagctaggcatctcctctgaa

SEQ ID NO: 337888 - DNA, 75 bp, Artificial Sequence
  Synthetic
tctactgctaccacaactttgtagaagaggagctaggcatctcctctgaaatctacaactcctgcatagtagtag

SEQ ID NO: 337889 - DNA, 75 bp, Artificial Sequence
  Synthetic
aaaaacccctacgtaccaattacatggagaggcaaatggtaccctcacatacttcatcaagaggcagttataaat

SEQ ID NO: 337890 - DNA, 75 bp, Artificial Sequence
  Synthetic
ggagaggcaaatggtaccctcacatacttcatcaagaggcagttataaatgacatagtaatatcaggcccattca

SEQ ID NO: 337891 - DNA, 75 bp, Artificial Sequence
  Synthetic
tctttatgacaaaaaactacccaacaaggggtacatattctatgacaccctgtttggcaacggcaaaatgcccga

SEQ ID NO: 337892 - DNA, 75 bp, Artificial Sequence
  Synthetic
gcaattaaacatgaaatactcgtttagattcacatggggcggcaatcctatttccacacagattgttaaagaccc

SEQ ID NO: 337893 - DNA, 75 bp, Artificial Sequence
  Synthetic
tggcaacagcggtggtacccccgcatggccacgcagactcaggtgatgcatgacattaccatgacaggccccttc

SEQ ID NO: 337894 - DNA, 75 bp, Artificial Sequence
  Synthetic
agattcacatggggcggcaatcctatttccacacagattgttaaagacccctgcacccagcccacctttgaaata

SEQ ID NO: 337895 - DNA, 75 bp, Artificial Sequence
  Synthetic
gaatacaagtcatcaatccgaaagtcctcggacccagctacagtttcagatcctttgacctcagacgtgacatgt

SEQ ID NO: 337896 - DNA, 75 bp, Artificial Sequence
  Synthetic
cctcggacccagctacagtttcagatcctttgacctcagacgtgacatgtttagcggctcgagtcttaaaagagt

SEQ ID NO: 337897 - DNA, 75 bp, Artificial Sequence
  Synthetic
gacttacaaattgttgacccacactccatgggcccgcaattctcgttccacaactgggactacagacggggccta

SEQ ID NO: 337898 - DNA, 75 bp, Artificial Sequence
  Synthetic
tttttattctccggcggcaaacgccccaggatcgaccttcccaagtacgtcccgccagaagaagacttcaatatc

SEQ ID NO: 337899 - DNA, 75 bp, Artificial Sequence
  Synthetic
ccatgggcccgcaattctcgttccacaactgggactacagacggggcctatttggccaagacgctatcgacagag

SEQ ID NO: 337900 - DNA, 75 bp, Artificial Sequence
  Synthetic
ccaggatcgaccttcccaagtacgtcccgccagaagaagacttcaatatccaagagagacaacaaagagaacaga

SEQ ID NO: 337901 - DNA, 75 bp, Artificial Sequence
  Synthetic
agagtatcctaacccatacaaaaggcctagatatcttccgcccacagaccgcgcagaccaagagcaagaaaaaga

SEQ ID NO: 337902 - DNA, 75 bp, Artificial Sequence
  Synthetic
cgaagcagaagcccaagaagagacgcaggcgggctcggtccgagagcagctccagcagcagctccaagagcagtt

SEQ ID NO: 337903 - DNA, 75 bp, Artificial Sequence
  Synthetic
cctagatatcttccgcccacagaccgcgcagaccaagagcaagaaaaagacttcaatttccaggaagaaagcggg

SEQ ID NO: 337904 - DNA, 75 bp, Artificial Sequence
  Synthetic
caggcgggctcggtccgagagcagctccagcagcagctccaagagcagtttcaactccgaagagggctcaagtgc

SEQ ID NO: 337905 - DNA, 75 bp, Artificial Sequence
  Synthetic
aagaagtcctccaagagacgcaagtactccagttcaagccagagcagcagcagcaactccacctgcagctcgcgc

SEQ ID NO: 337906 - DNA, 75 bp, Artificial Sequence
  Synthetic
aacagggagtccacgtagatccctgcctcgtgtaggcccggagcagtggctactccccgagagaaagcctaagcc

SEQ ID NO: 337907 - DNA, 75 bp, Artificial Sequence
  Synthetic
actccagttcaagccagagcagcagcagcaactccacctgcagctcgcgcagcagcagcgactcggagagcaact

SEQ ID NO: 337908 - DNA, 75 bp, Artificial Sequence
  Synthetic
cctcgtgtaggcccggagcagtggctactccccgagagaaagcctaagcccgctcctacttcaggagactgggct

SEQ ID NO: 337909 - DNA, 75 bp, Artificial Sequence
  Synthetic
aaaacccaagccaatctgcacctaaacccatatacatacacccagctataaacaaggtgtttatgtttgaccctg

SEQ ID NO: 337910 - DNA, 75 bp, Artificial Sequence
  Synthetic
tgaataggcctcctcgctctcagcttactgaccccccattttacccttactgcaaaaataattacaatgtaacct

SEQ ID NO: 337911 - DNA, 75 bp, Artificial Sequence
  Synthetic
acccatatacatacacccagctataaacaaggtgtttatgtttgaccctgagggtcccaggcccataaacaccag

SEQ ID NO: 337912 - DNA, 75 bp, Artificial Sequence
  Synthetic
actgcctctgtgtggggcagacccgtccgttcctactacacggacacccccttctacccagaggttcccaaggtg

SEQ ID NO: 337913 - DNA, 75 bp, Artificial Sequence
  Synthetic
ccccctcaattttctgtaagttttaaacttggctggaaataaaaatgcaaggcctttcactgttcacttgtcggt

SEQ ID NO: 337914 - DNA, 75 bp, Artificial Sequence
  Synthetic
ctccgagcgtcagcgaggagtgcgacccttccccctggtgcaacgccctcggcggccgcgcgctacgccttcggc

SEQ ID NO: 337915 - DNA, 75 bp, Artificial Sequence
  Synthetic
aatcagtaacgaaagtgagtggggccagactttgccataaggcctttatcttcttgccatttgtccgtgtacggg

SEQ ID NO: 337916 - DNA, 75 bp, Artificial Sequence
  Synthetic
tgcacaaaatggcggacttccgcttccggatcagccgccatatttggtcacgtgactgcctacgtcacggccgcc

SEQ ID NO: 337917 - DNA, 75 bp, Artificial Sequence
  Synthetic
ttaggccttccggactaccaaaatggccgatttcgtgacgtcatggcggccattttaagtaagctccacccagga

SEQ ID NO: 337918 - DNA, 75 bp, Artificial Sequence
  Synthetic
gccgatttcgtgacgtcatggcggccattttaagtaagctccacccaggactgacgtcagtgtgaaaggtcatcc

SEQ ID NO: 337919 - DNA, 75 bp, Artificial Sequence
  Synthetic
gaccaattgcttccgggtgaaaggtcacgcctacgtcattcgtcacgtggggaggcatactgcgcaaacgcggaa

SEQ ID NO: 337920 - DNA, 75 bp, Artificial Sequence
  Synthetic
tagggggtgctaaagcacccccccccccgcgcatgcgcggggcccccccccccggggggctctgccccccggccc

SEQ ID NO: 337921 - DNA, 75 bp, Artificial Sequence
  Synthetic
cacgcctacgtcattcgtcacgtggggaggcatactgcgcaaacgcggaagtaagccccgtcacgtgacggtcac

SEQ ID NO: 337922 - DNA, 75 bp, Artificial Sequence
  Synthetic
ggcttagtgcgtcaccacccacgtgacccgcctccgccaattaacaggtacttcgtacacttcctgggcgggctt

SEQ ID NO: 337923 - DNA, 75 bp, Artificial Sequence
  Synthetic
tttagttaacaaaatggccgacttccttccgcttttttaaaaattaaccgtcagcggcggcgcgcgcgctgcgcg

SEQ ID NO: 337924 - DNA, 75 bp, Artificial Sequence
  Synthetic
ttccgaatggctgagttttccacgcccgtccgcagcggtgaagccacggagggagctcagcgcgtcccgagggcg

SEQ ID NO: 337925 - DNA, 75 bp, Artificial Sequence
  Synthetic
cgcgcgccggggggctttgccccccccccgcgcatgcgcgcggggccccccccccgcggggggctccgccccccg

SEQ ID NO: 337926 - DNA, 75 bp, Artificial Sequence
  Synthetic
gcagtcaaggggcaattcgggctcgggactggccgggctttgggcaaggctcttaaaaaagctatgtttattggc

SEQ ID NO: 337927 - DNA, 75 bp, Artificial Sequence
  Synthetic
tgctactgctatctgtgcattctacaaagacaaaagggaaacttctaatagctatgtggactcccccacgcaatg

SEQ ID NO: 337928 - DNA, 75 bp, Artificial Sequence
  Synthetic
aaagacaaaagggaaacttctaatagctatgtggactcccccacgcaatgatcaacaataccttaactggcaatg

SEQ ID NO: 337929 - DNA, 75 bp, Artificial Sequence
  Synthetic
gctacgtcactaaccacgtgcacttcacaggccaaccagagcctatgtcgtgcacttcctgggccgggtctacat

SEQ ID NO: 337930 - DNA, 75 bp, Artificial Sequence
  Synthetic
cacaggccaaccagagcctatgtcgtgcacttcctgggccgggtctacatcctaatataagtaactgcacttccg

SEQ ID NO: 337931 - DNA, 75 bp, Artificial Sequence
  Synthetic
tctgctatgtgcgggtgttccgacgctatcgctcatcttaatcatcttgctaatctgcttcgtgccccgcaaaat

SEQ ID NO: 337932 - DNA, 75 bp, Artificial Sequence
  Synthetic
cctaatataagtaactgcacttccgaatggctgagttttccacgcccgtccgcggcgagaacaccacggagggga

SEQ ID NO: 337933 - DNA, 75 bp, Artificial Sequence
  Synthetic
ccctacccgtgcgagcactgcctgctcccccggctgcccacgaggcagccggtgatcgagcaccatggcctatgg

SEQ ID NO: 337934 - DNA, 75 bp, Artificial Sequence
  Synthetic
tcccccggctgcccacgaggcagccggtgatcgagcaccatggcctatgggtggtggaggagacgccggaggcgc

SEQ ID NO: 337935 - DNA, 75 bp, Artificial Sequence
  Synthetic
caaggggcaattcgggcacgggactggctgggctatgggcaaggctcttagggttatcattcttaaaacatgttt

SEQ ID NO: 337936 - DNA, 75 bp, Artificial Sequence
  Synthetic
ggaggcgccgctggaggacccgcagacgcagacctgctagacgccgtggccgccgcagaaacgtaaggagacggc

SEQ ID NO: 337937 - DNA, 75 bp, Artificial Sequence
  Synthetic
ggaaagtgccactgccgcctctgcagactgaaccgctacaaccacctatacacatgagcctgtggagacccccgg

SEQ ID NO: 337938 - DNA, 75 bp, Artificial Sequence
  Synthetic
acgcagacctgctagacgccgtggccgccgcagaaacgtaaggagacggcgcagagggaggtggagaaggaggta

SEQ ID NO: 337939 - DNA, 75 bp, Artificial Sequence
  Synthetic
gactgaaccgctacaaccacctatacacatgagcctgtggagacccccggtatacaatgtcccgggacaagaaag

SEQ ID NO: 337940 - DNA, 75 bp, Artificial Sequence
  Synthetic
cgtagaagaaaagcaaaaataataataagacagtggcagccaaactacagaagaagatgtaatatagtgggctac

SEQ ID NO: 337941 - DNA, 75 bp, Artificial Sequence
  Synthetic
gctcacgatgctttttgtggttgtggcgattttgttgctcatattaacagtgtggcggctcgtgttggacgtcct

SEQ ID NO: 337942 - DNA, 75 bp, Artificial Sequence
  Synthetic
taagacagtggcagccaaactacagaagaagatgtaatatagtgggctacctccctatacttatctgtggtggaa

SEQ ID NO: 337943 - DNA, 75 bp, Artificial Sequence
  Synthetic
gcgattttgttgctcatattaacagtgtggcggctcgtgttggacgtccttcagacaatcaacccccgagacccc

SEQ ID NO: 337944 - DNA, 75 bp, Artificial Sequence
  Synthetic
acactcagacgatactaactatccaggaccctttgggggaggcatgaccacagacaaattcagccttagaatact

SEQ ID NO: 337945 - DNA, 75 bp, Artificial Sequence
  Synthetic
gagagctctaccagctcctccaagtagcggcacatccacagacaaccagggagcacaatggcctggagatggtgg

SEQ ID NO: 337946 - DNA, 75 bp, Artificial Sequence
  Synthetic
ggaccctttgggggaggcatgaccacagacaaattcagccttagaatactatatgatgaatacaaaagatttatg

SEQ ID NO: 337947 - DNA, 75 bp, Artificial Sequence
  Synthetic
agcggcacatccacagacaaccagggagcacaatggcctggagatggtggtggagaaggcgccgaaggtggccca

SEQ ID NO: 337948 - DNA, 75 bp, Artificial Sequence
  Synthetic
acctagatctctgtagatatctaggatgcactttttacttctttagacaccctgaagtagactttattataaaaa

SEQ ID NO: 337949 - DNA, 75 bp, Artificial Sequence
  Synthetic
gagacctcgccccagaagacgtagaagaactgctagaactcgtcgaagaggcagagtaaggagatggaggcggag

SEQ ID NO: 337950 - DNA, 75 bp, Artificial Sequence
  Synthetic
atgcactttttacttctttagacaccctgaagtagactttattataaaaataaacaccatgcccccattcttaga

SEQ ID NO: 337951 - DNA, 75 bp, Artificial Sequence
  Synthetic
agaactgctagaactcgtcgaagaggcagagtaaggagatggaggcggagagggagagggtggcggagaaggacc

SEQ ID NO: 337952 - DNA, 75 bp, Artificial Sequence
  Synthetic
cacccaggcctcatggccctagacaaaagagccagatggattccttctcttaaaaatagaccaggtaaaaaacac

SEQ ID NO: 337953 - DNA, 75 bp, Artificial Sequence
  Synthetic
aaaagaaaattaacatacaacagtggaaccccgccactgtaaagaaatgcgtggtcaccggatacgtacccctcc

SEQ ID NO: 337954 - DNA, 75 bp, Artificial Sequence
  Synthetic
aaagagccagatggattccttctcttaaaaatagaccaggtaaaaaacactatataaaaattagagtaggggctc

SEQ ID NO: 337955 - DNA, 75 bp, Artificial Sequence
  Synthetic
gaaccccgccactgtaaagaaatgcgtggtcaccggatacgtacccctcctcatctgtggaacgggtaccacggg

SEQ ID NO: 337956 - DNA, 75 bp, Artificial Sequence
  Synthetic
ccctcaaacagacctctgtgacatgacactgctaactatctatgcaaccgcagcggatatgcaatatccgttcgg

SEQ ID NO: 337957 - DNA, 75 bp, Artificial Sequence
  Synthetic
cacataaatgactatacaaagtttgacccctttggaggtgggtttagtactttaatgtttaacctaagaatacta

SEQ ID NO: 337958 - DNA, 75 bp, Artificial Sequence
  Synthetic
acactgctaactatctatgcaaccgcagcggatatgcaatatccgttcggctcaccactaactgacactgtggtt

SEQ ID NO: 337959 - DNA, 75 bp, Artificial Sequence
  Synthetic
acccctttggaggtgggtttagtactttaatgtttaacctaagaatactatttgatgaatataaaaagcaaagat

SEQ ID NO: 337960 - DNA, 75 bp, Artificial Sequence
  Synthetic
tgtatgatgaaacaattagcatattacctgatgaaaaaactaaaagaaatagccttcttacttctataagaagct

SEQ ID NO: 337961 - DNA, 75 bp, Artificial Sequence
  Synthetic
actagaacttgtaaggtacctaggctgtagctttaccttgtacagagagcaaaatgttgactttttatttaaata

SEQ ID NO: 337962 - DNA, 75 bp, Artificial Sequence
  Synthetic
acctgatgaaaaaactaaaagaaatagccttcttacttctataagaagctacatacctttttataatactacaca

SEQ ID NO: 337963 - DNA, 75 bp, Artificial Sequence
  Synthetic
tgtagctttaccttgtacagagagcaaaatgttgactttttatttaaatataatagaagacagccattttcagac

SEQ ID NO: 337964 - DNA, 75 bp, Artificial Sequence
  Synthetic
gtagatgcaggaggacacacaacaggctcaacaacaactacatggggacaactattaaacacaactaaatttacc

SEQ ID NO: 337965 - DNA, 75 bp, Artificial Sequence
  Synthetic
acccaggcataataatgaaacaaaaaagaaaagtaatagtgcctagctacaaaactaaacctaaaggcagacccg

SEQ ID NO: 337966 - DNA, 75 bp, Artificial Sequence
  Synthetic
gctcaacaacaactacatggggacaactattaaacacaactaaatttaccactaccacaacaaccacatacacat

SEQ ID NO: 337967 - DNA, 75 bp, Artificial Sequence
  Synthetic
aagaaaagtaatagtgcctagctacaaaactaaacctaaaggcagacccgtaaaaagaataagaataaagccccc

SEQ ID NO: 337968 - DNA, 75 bp, Artificial Sequence
  Synthetic
aacatttataacagccaatgatacctggtacaggggaacagcatataaagataacattaaagatgtaccacaaaa

SEQ ID NO: 337969 - DNA, 75 bp, Artificial Sequence
  Synthetic
tttcaaaaggactttagtaacttccccctagtaactatcagtgcctctgcggctagcctgcggtttccgttctgc

SEQ ID NO: 337970 - DNA, 75 bp, Artificial Sequence
  Synthetic
tggtacaggggaacagcatataaagataacattaaagatgtaccacaaaaagcagcacaattatactttcaaaca

SEQ ID NO: 337971 - DNA, 75 bp, Artificial Sequence
  Synthetic
ccctagtaactatcagtgcctctgcggctagcctgcggtttccgttctgctcaccacaaactggcaacatttgca

SEQ ID NO: 337972 - DNA, 75 bp, Artificial Sequence
  Synthetic
tccatggctcagatgaaacacttgaataccatgcaggcctatacagctctatctggctatcaccaggtagatcct

SEQ ID NO: 337973 - DNA, 75 bp, Artificial Sequence
  Synthetic
ctggtataaccgccggatgtccataaccccagacttactaaagtcaaactatgaaagtttttttagtgtattaaa

SEQ ID NO: 337974 - DNA, 75 bp, Artificial Sequence
  Synthetic
ataccatgcaggcctatacagctctatctggctatcaccaggtagatcctactttgaaacaccaggtgcatacac

SEQ ID NO: 337975 - DNA, 75 bp, Artificial Sequence
  Synthetic
accccagacttactaaagtcaaactatgaaagtttttttagtgtattaaacactaaatttagtagcagccccctt

SEQ ID NO: 337976 - DNA, 75 bp, Artificial Sequence
  Synthetic
gacagaggagaaggcaacatgctgtggatagactggctaagtaaaaaaaacatgaaatatgacaaagtgcaaagt

SEQ ID NO: 337977 - DNA, 75 bp, Artificial Sequence
  Synthetic
catcaggaccaataggcactgtatttaacacatttaaaacccaagaacacgtagtagaccccagatgggatactg

SEQ ID NO: 337978 - DNA, 75 bp, Artificial Sequence
  Synthetic
taacacatttaaaacccaagaacacgtagtagaccccagatgggatactgtaaaaaaacagagcacaggcagtca

SEQ ID NO: 337979 - DNA, 75 bp, Artificial Sequence
  Synthetic
ggatagactggctaagtaaaaaaaacatgaaatatgacaaagtgcaaagtaagtgcctagtagcagacctaccac

SEQ ID NO: 337980 - DNA, 75 bp, Artificial Sequence
  Synthetic
cattggggagaccacatatatgaaaacaccagcagtaaatcaatactaactgctatgaaagacaatgcaactaaa

SEQ ID NO: 337981 - DNA, 75 bp, Artificial Sequence
  Synthetic
acaccagcagtaaatcaatactaactgctatgaaagacaatgcaactaaaatgtatgacagaagaaaaagagata

SEQ ID NO: 337982 - DNA, 75 bp, Artificial Sequence
  Synthetic
ctatagaacaggactatacagcagcatatttttagctaatgaaagaaccagccctgactttccaggcctatacca

SEQ ID NO: 337983 - DNA, 75 bp, Artificial Sequence
  Synthetic
atatttttagctaatgaaagaaccagccctgactttccaggcctataccaagaagtagtttacaaccctttagta

SEQ ID NO: 337984 - DNA, 75 bp, Artificial Sequence
  Synthetic
ggatagactggtgctctaaagacgacaccacctttcgagatctaccacagagatatgctgtaaaagacattcctt

SEQ ID NO: 337985 - DNA, 75 bp, Artificial Sequence
  Synthetic
caccacctttcgagatctaccacagagatatgctgtaaaagacattcctttatgggcagcatttatgggctacag

SEQ ID NO: 337986 - DNA, 75 bp, Artificial Sequence
  Synthetic
gaccccggactcagtaaagaggtcagagtaactattatatgcccatatacaaaacccaagctctacaacccagac

SEQ ID NO: 337987 - DNA, 75 bp, Artificial Sequence
  Synthetic
gagtaactattatatgcccatatacaaaacccaagctctacaacccagacagcacagacgaaggctacgtaccct

SEQ ID NO: 337988 - DNA, 75 bp, Artificial Sequence
  Synthetic
aatgccagacggcaacgggtacatacccatagcctacagatttcagtggtacccttgcatgttccaccaacagaa

SEQ ID NO: 337989 - DNA, 75 bp, Artificial Sequence
  Synthetic
cccatagcctacagatttcagtggtacccttgcatgttccaccaacagaactttatgaatgacattgtacagtca

SEQ ID NO: 337990 - DNA, 75 bp, Artificial Sequence
  Synthetic
aagctcctccgaagagtccccccgtgggaggactcggaacaggagcaaagcgggtcgcaaagctcagaggaagag

SEQ ID NO: 337991 - DNA, 75 bp, Artificial Sequence
  Synthetic
aaaaaagctgcactctaactgcaaagtaccgcttcagatttttatttgggggcaatcctatatctcaacaggtca

SEQ ID NO: 337992 - DNA, 75 bp, Artificial Sequence
  Synthetic
cgggtcgcaaagctcagaggaagagacggcgaccctctcccagcagctcaaacagcagctgcagcagcagcgagt

SEQ ID NO: 337993 - DNA, 75 bp, Artificial Sequence
  Synthetic
gtaccgcttcagatttttatttgggggcaatcctatatctcaacaggtcattaaagatccctctaaacaacccga

SEQ ID NO: 337994 - DNA, 75 bp, Artificial Sequence
  Synthetic
ctctttagcacagtacaagtcacgaacccgaaactcatcgacgagggatacttcttcaacgcctgggacatcaga

SEQ ID NO: 337995 - DNA, 75 bp, Artificial Sequence
  Synthetic
aaaatcaagatatcaaccctaccttgttaccaagggggggggatctagtatccttctttcaggctgtaccataaa

SEQ ID NO: 337996 - DNA, 75 bp, Artificial Sequence
  Synthetic
acccgaaactcatcgacgagggatacttcttcaacgcctgggacatcagacgtgggctatttggcttctcagcta

SEQ ID NO: 337997 - DNA, 75 bp, Artificial Sequence
  Synthetic
tgcccctccagcaatgactggaaagaagagtatgaggcctgtaaatattgggatagacctcccagacacaacctt

SEQ ID NO: 337998 - DNA, 75 bp, Artificial Sequence
  Synthetic
ccctactaaatattttacaggcccaccaaagcgcccgcgattcgaggtacccgccattgcaaacgcaggctcaga

SEQ ID NO: 337999 - DNA, 75 bp, Artificial Sequence
  Synthetic
ggatagacctcccagacacaaccttagagacccccccttttacccctgggcccctaaaaacaatccttgcaatgt

SEQ ID NO: 338000 - DNA, 75 bp, Artificial Sequence
  Synthetic
ccaaagcgcccgcgattcgaggtacccgccattgcaaacgcaggctcagatttacaccctaccaaatggcacccc

SEQ ID NO: 338001 - DNA, 75 bp, Artificial Sequence
  Synthetic
aagaccagaaagaagactccccctcgccgcaaacgaaggcaccattacagctcatcctcaaacagcagctcaggg

SEQ ID NO: 338002 - DNA, 75 bp, Artificial Sequence
  Synthetic
actaggccgtgggagtttcacttgtcggtgtctacctctataagtcactaagcactccgagcgcagcgaggagtg

SEQ ID NO: 338003 - DNA, 75 bp, Artificial Sequence
  Synthetic
gccgcaaacgaaggcaccattacagctcatcctcaaacagcagctcagggagcaaagagagctcaagcgacgaat

SEQ ID NO: 338004 - DNA, 75 bp, Artificial Sequence
  Synthetic
aagacccaatatcacctccacgcacccattatccctagtaggacctccagccttactgttcccagagatgaccaa

SEQ ID NO: 338005 - DNA, 75 bp, Artificial Sequence
  Synthetic
ccattatccctagtaggacctccagccttactgttcccagagatgaccaaaaaaatattttccagcaacgactgg

SEQ ID NO: 338006 - DNA, 75 bp, Artificial Sequence
  Synthetic
cgctcgtgctgacacgcttgcgcgtgtcagaccacttcgggctcgcgggggtcgggaaatttgctaaacagactc

SEQ ID NO: 338007 - DNA, 75 bp, Artificial Sequence
  Synthetic
agtgggacaggccagctagacaaagccttacagacaccccttactacccttggatgctacccccaaaacagccat

SEQ ID NO: 338008 - DNA, 75 bp, Artificial Sequence
  Synthetic
atgaatcagtaacgaaagtgagtggggccagacttcgccataaggcctttatcttcttgccatttgtcagtattg

SEQ ID NO: 338009 - DNA, 75 bp, Artificial Sequence
  Synthetic
caaataaacaaggccgtgggagtttcacttgtcggtgtcagcttattaaggtcactaagcactccgagcgaagcg

SEQ ID NO: 338010 - DNA, 75 bp, Artificial Sequence
  Synthetic
attttaggccttccggactacaaaaatcgccatatttgtgacgtcagagccgccattttaagtcagctctgggga

SEQ ID NO: 338011 - DNA, 75 bp, Artificial Sequence
  Synthetic
cgccattttaagtcagctctggggaggcgtgacttccagttcaaaggtcatcctcaccataactggcacaaaatg

SEQ ID NO: 338012 - DNA, 75 bp, Artificial Sequence
  Synthetic
gacccccgctcgtgctgacacgcttgcgcgtgtcagaccacttcgggctcgcgggggtcggatgctttattaaac

SEQ ID NO: 338013 - DNA, 75 bp, Artificial Sequence
  Synthetic
gtcactgctacgtcataggtgacgtggggggggacctacttaaacacggaagtaggccccgacacgtcactgtca

SEQ ID NO: 338014 - DNA, 75 bp, Artificial Sequence
  Synthetic
agtggggccagacttcgccataaggcctttatcttcttgccatttgtcagtaacttaaattgccataaacttcga

SEQ ID NO: 338015 - DNA, 75 bp, Artificial Sequence
  Synthetic
gaggcacagcctcccccccccgcgcgcatgcgcgcgggtccccccccctccggggggctccgccccccggccccc

SEQ ID NO: 338016 - DNA, 75 bp, Artificial Sequence
  Synthetic
caaaaatcgccattttagtgacgtcacagcagccattttaagtaaggcggaagagctctagctatacaaaatggc

SEQ ID NO: 338017 - DNA, 75 bp, Artificial Sequence
  Synthetic
acagcagccattttaagtaaggcggaagagctctagctatacaaaatggcggcggagcacttccgctttgcccaa

SEQ ID NO: 338018 - DNA, 75 bp, Artificial Sequence
  Synthetic
tcgcccgcaggccaacccgcgtgttctacgtgcacttcctgggctgggtcttcgaatctatataaccaagtgcac

SEQ ID NO: 338019 - DNA, 75 bp, Artificial Sequence
  Synthetic
ctacgtgcacttcctgggctgggtcttcgaatctatataaccaagtgcacttccgaatggctgagtttatgccgc

SEQ ID NO: 338020 - DNA, 75 bp, Artificial Sequence
  Synthetic
aaaggtcatgcctacgtcacaagtcacgtggggagggttgccgtgtaacccggaagtcaatcctcccacgtggcc

SEQ ID NO: 338021 - DNA, 75 bp, Artificial Sequence
  Synthetic
acgtggggagggttgccgtgtaacccggaagtcaatcctcccacgtggcctgtcacgtgacgcatacgtcacggc

SEQ ID NO: 338022 - DNA, 75 bp, Artificial Sequence
  Synthetic
gcgacgcggcgtcatcagtcacgtgtcgcccgcaggccaacccgcgtgttctacgtgcacttcctgggctgggtc

SEQ ID NO: 338023 - DNA, 75 bp, Artificial Sequence
  Synthetic
gaaccgaacggccgaccgcgtcccgaaggcgggtacccgaggtgagtttacacaccgaggttaagggccaattcg

SEQ ID NO: 338024 - DNA, 75 bp, Artificial Sequence
  Synthetic
aaggcgggtacccgaggtgagtttacacaccgaggttaagggccaattcgggcttgggactggccgggctgtggg

SEQ ID NO: 338025 - DNA, 75 bp, Artificial Sequence
  Synthetic
gacttccttccgcttttttgaaaataacggcccagcggcggcgcgcgcgctacgcgcgcgcgccggggggctacc

SEQ ID NO: 338026 - DNA, 75 bp, Artificial Sequence
  Synthetic
tgcacctctctaacttccagaaaacgaaagaagaggccactgccactgcttcgcctgcgagctaaaccgaaagca

SEQ ID NO: 338027 - DNA, 75 bp, Artificial Sequence
  Synthetic
gaaagaagaggccactgccactgcttcgcctgcgagctaaaccgaaagcacggcctggggcgatgagcttttggt

SEQ ID NO: 338028 - DNA, 75 bp, Artificial Sequence
  Synthetic
gcgcagacgatacagaaaatggcgacggggcagacgcagacggactcacagaaaaaagatagttataaaacagtg

SEQ ID NO: 338029 - DNA, 75 bp, Artificial Sequence
  Synthetic
gcaaccaaactttattagacgctgctacataataggatacctacctctcatatactgtggcgaaaatacaaccgc

SEQ ID NO: 338030 - DNA, 75 bp, Artificial Sequence
  Synthetic
acaagagaggaattggttcgagtcctgtttccgtagtcacgccgctttttgtggctgcggtaattttatcggtca

SEQ ID NO: 338031 - DNA, 75 bp, Artificial Sequence
  Synthetic
tgtttccgtagtcacgccgctttttgtggctgcggtaattttatcggtcatcttaataatcttgctgaccgctat

SEQ ID NO: 338032 - DNA, 75 bp, Artificial Sequence
  Synthetic
cgggtggtcctgggccacaggcgccggttccaacagtgagggccctgcctgcgctgcccgcggcgcctagccgtc

SEQ ID NO: 338033 - DNA, 75 bp, Artificial Sequence
  Synthetic
ggttccaacagtgagggccctgcctgcgctgcccgcggcgcctagccgtccgctacccccgccgccgccgccatg

SEQ ID NO: 338034 - DNA, 75 bp, Artificial Sequence
  Synthetic
ggcgccgaccgcgacgctggaggcgctggagacgctggggccgtcgccggacgcggtggggactacggacccgaa

SEQ ID NO: 338035 - DNA, 75 bp, Artificial Sequence
  Synthetic
ctggagacgctggggccgtcgccggacgcggtggggactacggacccgaagagctcgagcagccgttcgccgccg

SEQ ID NO: 338036 - DNA, 75 bp, Artificial Sequence
  Synthetic
gctcggggagggcgacggtaccactaccgacgcaggttcagacgccgacgcgccagacgtaggaaaaagatagta

SEQ ID NO: 338037 - DNA, 75 bp, Artificial Sequence
  Synthetic
accgacgcaggttcagacgccgacgcgccagacgtaggaaaaagatagtactgactcagtggaacccccagactg

SEQ ID NO: 338038 - DNA, 75 bp, Artificial Sequence
  Synthetic
gtttcccatcctgtggtgcggctccggagccgccgggaaaaactacgccctgcacatggacgattacacgccctc

SEQ ID NO: 338039 - DNA, 75 bp, Artificial Sequence
  Synthetic
ggagccgccgggaaaaactacgccctgcacatggacgattacacgccctcgggaggcttcggggggtccttttcc

SEQ ID NO: 338040 - DNA, 75 bp, Artificial Sequence
  Synthetic
tgtacgacgaacacatgaaaggcaggaacaggtggtcacacactaacgaggacctagagctcgccctgtactttg

SEQ ID NO: 338041 - DNA, 75 bp, Artificial Sequence
  Synthetic
gaacaggtggtcacacactaacgaggacctagagctcgccctgtactttggctgccggtttacattttacagaca

SEQ ID NO: 338042 - DNA, 75 bp, Artificial Sequence
  Synthetic
tttagcaacacaccgcccatgatgagcaaccagtacaccgcgccactagcgcaccccggcatgcttatgaggagc

SEQ ID NO: 338043 - DNA, 75 bp, Artificial Sequence
  Synthetic
gcaaccagtacaccgcgccactagcgcaccccggcatgcttatgaggagcaagtacaaactgctgctccccagct

SEQ ID NO: 338044 - DNA, 75 bp, Artificial Sequence
  Synthetic
aaccgtatcagttaggataagacccccaaaactgttcaaccacaaatggtacgcgcagtcagacctgtgcgacgt

SEQ ID NO: 338045 - DNA, 75 bp, Artificial Sequence
  Synthetic
actaccaaactaccccacaataatgtccacagacttatacgaataccactcaggcatatactccagcatatttct

SEQ ID NO: 338046 - DNA, 75 bp, Artificial Sequence
  Synthetic
ccaaaactgttcaaccacaaatggtacgcgcagtcagacctgtgcgacgttaaccttgtgcaattcactgtaacc

SEQ ID NO: 338047 - DNA, 75 bp, Artificial Sequence
  Synthetic
gctcaccactaactgaaactccttgtgtgaccttccaagtattgggagacttgtacaacaagtgtctcaacatag

SEQ ID NO: 338048 - DNA, 75 bp, Artificial Sequence
  Synthetic
tgtgaccttccaagtattgggagacttgtacaacaagtgtctcaacatagacttacccaaggttgatacggttaa

SEQ ID NO: 338049 - DNA, 75 bp, Artificial Sequence
  Synthetic
gataatggacatgcccctgtgggcggcctgcacaggatacacagagttctgtgcaaagtacacaggagactctgc

SEQ ID NO: 338050 - DNA, 75 bp, Artificial Sequence
  Synthetic
atacaggtaaagttaactgacaactcaggtaacccaactaacaaagaggcagtcaaaacattatatgaacaactg

SEQ ID NO: 338051 - DNA, 75 bp, Artificial Sequence
  Synthetic
caggtaacccaactaacaaagaggcagtcaaaacattatatgaacaactgttttcatacgggcagtactggcaaa

SEQ ID NO: 338052 - DNA, 75 bp, Artificial Sequence
  Synthetic
aaaccctccaaagtacgataacggtaacaacaaaaaattattcaatgacaatgattacaatacatttaaaacaac

SEQ ID NO: 338053 - DNA, 75 bp, Artificial Sequence
  Synthetic
aacaacaaaaaattattcaatgacaatgattacaatacatttaaaacaacttttctaacaaaaaaagactccgga

SEQ ID NO: 338054 - DNA, 75 bp, Artificial Sequence
  Synthetic
cacaggtagcagaaaacatcaaaaacattagagaccaaaactttgcattaacaacggggaagaatgacgtgtttg

SEQ ID NO: 338055 - DNA, 75 bp, Artificial Sequence
  Synthetic
cattagagaccaaaactttgcattaacaacggggaagaatgacgtgtttggagacagcaaagcacagtaccacaa

SEQ ID NO: 338056 - DNA, 75 bp, Artificial Sequence
  Synthetic
ctaggcatatacagtcccgtgttcctgcacccaggcagatcaaacattcaaatgtggacagcatacagggacata

SEQ ID NO: 338057 - DNA, 75 bp, Artificial Sequence
  Synthetic
tgcacccaggcagatcaaacattcaaatgtggacagcatacagggacatagtttacaaccccttcttagacaagg

SEQ ID NO: 338058 - DNA, 75 bp, Artificial Sequence
  Synthetic
atatcatacaaagacagacaacaaatacgaccccacaaaatgccgatacatggtagaagacctccctctgtggag

SEQ ID NO: 338059 - DNA, 75 bp, Artificial Sequence
  Synthetic
tacgaccccacaaaatgccgatacatggtagaagacctccctctgtggagcctcctgcacgggtacgcagactac

SEQ ID NO: 338060 - DNA, 75 bp, Artificial Sequence
  Synthetic
accccttagtagagggaaaagtgctaatcagatgtccgtatactcgacccgccctctacaacaaacaatccccgg

SEQ ID NO: 338061 - DNA, 75 bp, Artificial Sequence
  Synthetic
aatcagatgtccgtatactcgacccgccctctacaacaaacaatccccggatgaaggctacgtagtgtacaacac

SEQ ID NO: 338062 - DNA, 75 bp, Artificial Sequence
  Synthetic
gacggttccggatacatccccatccccgaacgcgcccggtggatggtgatgctaaagtaccagcttgacgtgttt

SEQ ID NO: 338063 - DNA, 75 bp, Artificial Sequence
  Synthetic
ccgaacgcgcccggtggatggtgatgctaaagtaccagcttgacgtgtttcacgacttggtagtgtgcggaccgt

SEQ ID NO: 338064 - DNA, 75 bp, Artificial Sequence
  Synthetic
cgtgcaaatgccctgcaaatacaagttcagatttaaatggggcggtactactctgcgttcccaggtcattcgaaa

SEQ ID NO: 338065 - DNA, 75 bp, Artificial Sequence
  Synthetic
ttcagatttaaatggggcggtactactctgcgttcccaggtcattcgaaacccctgttcgggcggagacgtggca

SEQ ID NO: 338066 - DNA, 75 bp, Artificial Sequence
  Synthetic
gagacgaacaagtcgttgacccgcgcgtggtcggcccccagtggtcttccactcctgggaccagagacgaggact

SEQ ID NO: 338067 - DNA, 75 bp, Artificial Sequence
  Synthetic
cgtggtcggcccccagtggtcttccactcctgggaccagagacgaggactgtttagcgagaaagctttccgacga

SEQ ID NO: 338068 - DNA, 75 bp, Artificial Sequence
  Synthetic
aagagccttttgcaggcccaaaaagacctttcttgcttatgtcaacagaggtccccgaaggaggagaaagagact

SEQ ID NO: 338069 - DNA, 75 bp, Artificial Sequence
  Synthetic
acctttcttgcttatgtcaacagaggtccccgaaggaggagaaagagactctccttcggcaaagaaggcgagact

SEQ ID NO: 338070 - DNA, 75 bp, Artificial Sequence
  Synthetic
agctcgtcgtcggacgcctcccagaaagtccaagaaacgacgagacacctcctccagcgaaagctcgcagaacag

SEQ ID NO: 338071 - DNA, 75 bp, Artificial Sequence
  Synthetic
aagtccaagaaacgacgagacacctcctccagcgaaagctcgcagaacagcgacagctcaggaggcagctggagt

SEQ ID NO: 338072 - DNA, 75 bp, Artificial Sequence
  Synthetic
ccagcagggcctacacctaaacccgctcctgttatcctgccagccaaaaaccgggttctgatgttcccggagcgc

SEQ ID NO: 338073 - DNA, 75 bp, Artificial Sequence
  Synthetic
attttgtgcagcccgccaatttctcttttaaacagaccaatcacgcactacttcgtacacttcctggggtgtgtc

SEQ ID NO: 338074 - DNA, 75 bp, Artificial Sequence
  Synthetic
ctcctgttatcctgccagccaaaaaccgggttctgatgttcccggagcgcggcagcaaacccgttcccacctccc

SEQ ID NO: 338075 - DNA, 75 bp, Artificial Sequence
  Synthetic
cgccaaggcgtgggatcgccccgtccgctctttcctcaacgacaaacccttctacccctggtgtcctccgggcat

SEQ ID NO: 338076 - DNA, 75 bp, Artificial Sequence
  Synthetic
aaataaacaaggccgtgggactttcactggtcggtgtctgtttattaaagtcgctaagcactccgagcgccagcg

SEQ ID NO: 338077 - DNA, 75 bp, Artificial Sequence
  Synthetic
cttgcccagagagaagagcactggtacaaagcaattcttgagtcgcactctactttttgcggctgctctgacgtt

SEQ ID NO: 338078 - DNA, 75 bp, Artificial Sequence
  Synthetic
ccacttcttcggagtcgggcgctacgccttcggctgcgcccgacacctcagcccccccctcgcccgtccgcgctt

SEQ ID NO: 338079 - DNA, 75 bp, Artificial Sequence
  Synthetic
gccttcggctgcgcccgacacctcagcccccccctcgcccgtccgcgcttcgcgcgtccgaccttcggcctcggg

SEQ ID NO: 338080 - DNA, 75 bp, Artificial Sequence
  Synthetic
acaaagcaattcttgagtcgcactctactttttgcggctgctctgacgttgttaggcatttctgtgtccttgctt

SEQ ID NO: 338081 - DNA, 75 bp, Artificial Sequence
  Synthetic
gatccctgccctaccggcaccccctgagcagcaaccacggcctggtggagatacagaaggcgcccctggcgaccc

SEQ ID NO: 338082 - DNA, 75 bp, Artificial Sequence
  Synthetic
ctccgagacgctcttggacacccgagggggcgtacagcaacgaaagtgagtggggccagacttcgccatcgggcc

SEQ ID NO: 338083 - DNA, 75 bp, Artificial Sequence
  Synthetic
gagcagcaaccacggcctggtggagatacagaaggcgcccctggcgaccctggagacgccggggctgggcggtac

SEQ ID NO: 338084 - DNA, 75 bp, Artificial Sequence
  Synthetic
tcgccgccgcggcaaaagacgatatgtgagtagaaggccgcgccgccgatacaggcgcagatacagacggggcag

SEQ ID NO: 338085 - DNA, 75 bp, Artificial Sequence
  Synthetic
gtgagtagaaggccgcgccgccgatacaggcgcagatacagacggggcagacgtagaaggggacgcagacgcagg

SEQ ID NO: 338086 - DNA, 75 bp, Artificial Sequence
  Synthetic
gaccccgttttcggggcccccgcggggctctcggcgcgttttaatgacgtcacggacgccattttgtgatacgcg

SEQ ID NO: 338087 - DNA, 75 bp, Artificial Sequence
  Synthetic
gtcaggcggggcgtggccgtatcagaaaatggcggccattttcttccgggtaaaaggtcgcagctacgtcataag

SEQ ID NO: 338088 - DNA, 75 bp, Artificial Sequence
  Synthetic
aatggcagccggacgttatgaaaaagtgctttattactgggtggctacctctaataatctgtggatctggaaaca

SEQ ID NO: 338089 - DNA, 75 bp, Artificial Sequence
  Synthetic
aaaatggcggccattttcttccgggtaaaaggtcgcagctacgtcataagtcacgtgactgggcaggtactaaac

SEQ ID NO: 338090 - DNA, 75 bp, Artificial Sequence
  Synthetic
gtgctttattactgggtggctacctctaataatctgtggatctggaaacacccagtttaactttgtgactcatga

SEQ ID NO: 338091 - DNA, 75 bp, Artificial Sequence
  Synthetic
ctgtcacgtagttgtacgtcacggccgccactttgtataacaaaatggctgacttccttcctcttttttaaaaaa

SEQ ID NO: 338092 - DNA, 75 bp, Artificial Sequence
  Synthetic
tcctttggaggaaactttactaacctcaccttcaccctagcgggactatatgaacaaaaactgctccacagaaac

SEQ ID NO: 338093 - DNA, 75 bp, Artificial Sequence
  Synthetic
tcaccttcaccctagcgggactatatgaacaaaaactgctccacagaaacaggtggtccaagtccaactttgacc

SEQ ID NO: 338094 - DNA, 75 bp, Artificial Sequence
  Synthetic
ggggcgcgcgcttcccctggggggagcactgctccccccccccgtgcgcatgcgcgcgggtccccccccctcggg

SEQ ID NO: 338095 - DNA, 75 bp, Artificial Sequence
  Synthetic
aaaaattaaactatacagacaccccactgtagactacatagtcacctacaacagaacaggcccattcgagataaa

SEQ ID NO: 338096 - DNA, 75 bp, Artificial Sequence
  Synthetic
actgtagactacatagtcacctacaacagaacaggcccattcgagataaatgaactcagctacatgctcacacac

SEQ ID NO: 338097 - DNA, 75 bp, Artificial Sequence
  Synthetic
tcccacaggccaatcacccgcctctacgtgcacttcctgggctgggtctacccggtgatataaagcggtgcactt

SEQ ID NO: 338098 - DNA, 75 bp, Artificial Sequence
  Synthetic
acgtgcacttcctgggctgggtctacccggtgatataaagcggtgcacttccgaatggctgagtttttcacgccc

SEQ ID NO: 338099 - DNA, 75 bp, Artificial Sequence
  Synthetic
agaagtccgtcactaaccacgtgactcccacaggccaatcacccgcctctacgtgcacttcctgggctgggtcta

SEQ ID NO: 338100 - DNA, 75 bp, Artificial Sequence
  Synthetic
accacatagtagttccaagctttaaaacaaggcccaaaggaaagagatccaaaacaatacttattaagcctccaa

SEQ ID NO: 338101 - DNA, 75 bp, Artificial Sequence
  Synthetic
aacaaggcccaaaggaaagagatccaaaacaatacttattaagcctccaaaactcatgataaacaagtggtactt

SEQ ID NO: 338102 - DNA, 75 bp, Artificial Sequence
  Synthetic
agcactgctccccccccccgtgcgcatgcgcgcgggtccccccccctcggggggctccgccccccggcccccccc

SEQ ID NO: 338103 - DNA, 75 bp, Artificial Sequence
  Synthetic
agtcaaggggcaattcgggctcgggactggccgggctatgggcaaggctcttaaggtaatcgctcttaaaaatgc

SEQ ID NO: 338104 - DNA, 75 bp, Artificial Sequence
  Synthetic
ctcttccaaatctatgccacaggcctagaactcaccaacccatggctcagatcaggcaccaagagccccatcata

SEQ ID NO: 338105 - DNA, 75 bp, Artificial Sequence
  Synthetic
tagaactcaccaacccatggctcagatcaggcaccaagagccccatcataggcatatatgtccttaaaaactctg

SEQ ID NO: 338106 - DNA, 75 bp, Artificial Sequence
  Synthetic
gaaaaaggaaaggcaactgctactgctttctgtgtcgcctgcaccgccgccatcttccatgagcctgtggcgtcc

SEQ ID NO: 338107 - DNA, 75 bp, Artificial Sequence
  Synthetic
ctttctgtgtcgcctgcaccgccgccatcttccatgagcctgtggcgtccccccgctcacaatgtcgccggccag

SEQ ID NO: 338108 - DNA, 75 bp, Artificial Sequence
  Synthetic
acatggagggggccacgaagaaggcagaaaacaagtttttaacactctcatgcctgaaactgcaggcaaaaactg

SEQ ID NO: 338109 - DNA, 75 bp, Artificial Sequence
  Synthetic
agaaaacaagtttttaacactctcatgcctgaaactgcaggcaaaaactggcaatacacatacactcctttaatg

SEQ ID NO: 338110 - DNA, 75 bp, Artificial Sequence
  Synthetic
accgagcccacggtgctttttgtggctgcggtaattttattcttcatctttctggtctggcttcacgttttaatt

SEQ ID NO: 338111 - DNA, 75 bp, Artificial Sequence
  Synthetic
ctgcggtaattttattcttcatctttctggtctggcttcacgttttaattttcaaggaggtccgccgggcccggg

SEQ ID NO: 338112 - DNA, 75 bp, Artificial Sequence
  Synthetic
aaacaaacaatgaaaaactacccacaccttataactggaaaaactacagtgaaaactatacacaagtaaaatcta

SEQ ID NO: 338113 - DNA, 75 bp, Artificial Sequence
  Synthetic
accttataactggaaaaactacagtgaaaactatacacaagtaaaatctaagtgggactcactagcacaatcagg

SEQ ID NO: 338114 - DNA, 75 bp, Artificial Sequence
  Synthetic
gctctaagacgtctggtgcctctgcccgcgctacccccggccgataaccagccatggcctggtggggatggcgcc

SEQ ID NO: 338115 - DNA, 75 bp, Artificial Sequence
  Synthetic
ccgcgctacccccggccgataaccagccatggcctggtggggatggcgccgccggtggggctggcgaccgcgctg

SEQ ID NO: 338116 - DNA, 75 bp, Artificial Sequence
  Synthetic
aatgcagtctatacaaccactgccacataccctccagaatacacacaaagaaactacctaagtcatgactatggc

SEQ ID NO: 338117 - DNA, 75 bp, Artificial Sequence
  Synthetic
cataccctccagaatacacacaaagaaactacctaagtcatgactatggcatttacagcccatactttttaacac

SEQ ID NO: 338118 - DNA, 75 bp, Artificial Sequence
  Synthetic
cgcagacgccgagtaccggcccgaagacctcgacgacctgttcgccgccatcgaaagagataccgagtaaggagg

SEQ ID NO: 338119 - DNA, 75 bp, Artificial Sequence
  Synthetic
gacctcgacgacctgttcgccgccatcgaaagagataccgagtaaggaggcgtcggtgggggaggcgctatactc

SEQ ID NO: 338120 - DNA, 75 bp, Artificial Sequence
  Synthetic
cacagcctgggagtatgtaagatacaacccactatcagacaaaggtctaggtaacagaatctatgcacagtggtg

SEQ ID NO: 338121 - DNA, 75 bp, Artificial Sequence
  Synthetic
aacccactatcagacaaaggtctaggtaacagaatctatgcacagtggtgcagcgaagcatcctcctcttatagc

SEQ ID NO: 338122 - DNA, 75 bp, Artificial Sequence
  Synthetic
gagacgtaggcgccgcaaaaagatagtcctcactcagtggaacccccagaccgtacgcagatgctacataagagg

SEQ ID NO: 338123 - DNA, 75 bp, Artificial Sequence
  Synthetic
gtcctcactcagtggaacccccagaccgtacgcagatgctacataagaggcctcatgcccgtcatctgggcgggc

SEQ ID NO: 338124 - DNA, 75 bp, Artificial Sequence
  Synthetic
aagacatgccactatacatgctaacatatggctacctagactatgtagtaaaatgcacaggcaataaatcagcct

SEQ ID NO: 338125 - DNA, 75 bp, Artificial Sequence
  Synthetic
atatggctacctagactatgtagtaaaatgcacaggcaataaatcagcctggacagacatgagagtctgtgtaag

SEQ ID NO: 338126 - DNA, 75 bp, Artificial Sequence
  Synthetic
ccgtccgctcggacgactacacccagtcttccttcggaggctcctttggcacagagaccttcagtctaagggtac

SEQ ID NO: 338127 - DNA, 75 bp, Artificial Sequence
  Synthetic
gtcttccttcggaggctcctttggcacagagaccttcagtctaagggtactttttgaccagtaccagagaggctt

SEQ ID NO: 338128 - DNA, 75 bp, Artificial Sequence
  Synthetic
acagggtcagacagtaactccggctttgtactattatcagaaagcttcatgaacggagacatgccctggcccagc

SEQ ID NO: 338129 - DNA, 75 bp, Artificial Sequence
  Synthetic
ttgtactattatcagaaagcttcatgaacggagacatgccctggcccagcaacttcataccgttgaagttgtggt

SEQ ID NO: 338130 - DNA, 75 bp, Artificial Sequence
  Synthetic
gacctagacctggccctgtactatggctgccgcttcaggttttacagacacgaccgcacagactttatagtctcc

SEQ ID NO: 338131 - DNA, 75 bp, Artificial Sequence
  Synthetic
gctgccgcttcaggttttacagacacgaccgcacagactttatagtctcctttaccaacaatccccccatgaaga

SEQ ID NO: 338132 - DNA, 75 bp, Artificial Sequence
  Synthetic
ccaaaaacaggcagttgagaacatagtttcctgtggccccttcatgcccagagatcaggaagccaactcttggga

SEQ ID NO: 338133 - DNA, 75 bp, Artificial Sequence
  Synthetic
gtttcctgtggccccttcatgcccagagatcaggaagccaactcttgggacataaccataggttacaagtcagtt

SEQ ID NO: 338134 - DNA, 75 bp, Artificial Sequence
  Synthetic
ccatccgggcatgctcatgagagccaaacacaagatactgatccccagcagactgaccagaccgcggggcaagaa

SEQ ID NO: 338135 - DNA, 75 bp, Artificial Sequence
  Synthetic
aaacacaagatactgatccccagcagactgaccagaccgcggggcaagaaatacatctctgtcagaataagaccc

SEQ ID NO: 338136 - DNA, 75 bp, Artificial Sequence
  Synthetic
ctccacagcccatcgacgacccttgccaaaaatccacacacgaactacccgaccccgataaataccctccaagaa

SEQ ID NO: 338137 - DNA, 75 bp, Artificial Sequence
  Synthetic
ccaaaaatccacacacgaactacccgaccccgataaataccctccaagaatacaaatcgcagatccggaacacct

SEQ ID NO: 338138 - DNA, 75 bp, Artificial Sequence
  Synthetic
acactcagtcagacctgtgttccgttagtctggtgcaacttaacctgaccgcagcagacttgaaacatccgttcg

SEQ ID NO: 338139 - DNA, 75 bp, Artificial Sequence
  Synthetic
tagtctggtgcaacttaacctgaccgcagcagacttgaaacatccgttcggctcaccactaactgacactccttg

SEQ ID NO: 338140 - DNA, 75 bp, Artificial Sequence
  Synthetic
ttcgacatcagacgtggactgtttagctcggcaagtcttaaaagagtgtcagaataccaacctcctgatgaccct

SEQ ID NO: 338141 - DNA, 75 bp, Artificial Sequence
  Synthetic
gctcggcaagtcttaaaagagtgtcagaataccaacctcctgatgaccctttttcaacaggcgtcgggttcaaaa

SEQ ID NO: 338142 - DNA, 75 bp, Artificial Sequence
  Synthetic
ctctacaacgagtgtctcaatatagatcttcctgaaacagaaaaagattcattaactaaacttaaaaactcatca

SEQ ID NO: 338143 - DNA, 75 bp, Artificial Sequence
  Synthetic
atcttcctgaaacagaaaaagattcattaactaaacttaaaaactcatcaactgatgagtatagtaaaaacttac

SEQ ID NO: 338144 - DNA, 75 bp, Artificial Sequence
  Synthetic
gggagccacagaaaaccaagaagaagacgcctactatttactcaaagcactccaaaaagagcaagagagcagcca

SEQ ID NO: 338145 - DNA, 75 bp, Artificial Sequence
  Synthetic
gacgcctactatttactcaaagcactccaaaaagagcaagagagcagccagtcagaagaagagacagcccaagaa

SEQ ID NO: 338146 - DNA, 75 bp, Artificial Sequence
  Synthetic
taatggccagtactggcagacattcatcacaggcccttttatcaaagacacaatgcaggcaaacaattatcagca

SEQ ID NO: 338147 - DNA, 75 bp, Artificial Sequence
  Synthetic
atcacaggcccttttatcaaagacacaatgcaggcaaacaattatcagcaaaagaaaaccaactataccaaaaca

SEQ ID NO: 338148 - DNA, 75 bp, Artificial Sequence
  Synthetic
tcaagcagctcaacctgcagcgacagcagcagcgagtcctcagagagggactcaaacaagtcctgggagacgtcc

SEQ ID NO: 338149 - DNA, 75 bp, Artificial Sequence
  Synthetic
gcagcagcgagtcctcagagagggactcaaacaagtcctgggagacgtcctccgactccggaaaggagtccactg

SEQ ID NO: 338150 - DNA, 75 bp, Artificial Sequence
  Synthetic
caggtgacacagcctttgtcagcaacgctgacagcaattatctatacgccacataccatccagaaaacattgaaa

SEQ ID NO: 338151 - DNA, 75 bp, Artificial Sequence
  Synthetic
cgctgacagcaattatctatacgccacataccatccagaaaacattgaaaccaaattatataaaattagagaaaa

SEQ ID NO: 338152 - DNA, 75 bp, Artificial Sequence
  Synthetic
gagatccaattccagacctgctgtttcccagtactggtaaaaaaagaaaattctccaaattcgactgggaaacgg

SEQ ID NO: 338153 - DNA, 75 bp, Artificial Sequence
  Synthetic
tcccagtactggtaaaaaaagaaaattctccaaattcgactgggaaacggaggcggagatcgggcgctggctcag

SEQ ID NO: 338154 - DNA, 75 bp, Artificial Sequence
  Synthetic
aacgacgtattcggagaccacacaagccaatacagaggagccacacaactactagaataccacctgggcatctac

SEQ ID NO: 338155 - DNA, 75 bp, Artificial Sequence
  Synthetic
gccaatacagaggagccacacaactactagaataccacctgggcatctacagccccatattcttacacccaggca

SEQ ID NO: 338156 - DNA, 75 bp, Artificial Sequence
  Synthetic
gacccccctcactacccgtggctaccccccaagcgagatatcccaaaaatatgtaaagtaaacttcaaaataaat

SEQ ID NO: 338157 - DNA, 75 bp, Artificial Sequence
  Synthetic
ctacagagacatagtatacaacccactcttagacaaaggagagggcaacagaatatggttccaataccacactaa

SEQ ID NO: 338158 - DNA, 75 bp, Artificial Sequence
  Synthetic
ttcacagagtaactactcgaggccctcctctgttcacttagcggtgtctacctctaaaagtcaccaagcactccg

SEQ ID NO: 338159 - DNA, 75 bp, Artificial Sequence
  Synthetic
ctcttagacaaaggagagggcaacagaatatggttccaataccacactaaaaaagacaacagatactcagtgcct

SEQ ID NO: 338160 - DNA, 75 bp, Artificial Sequence
  Synthetic
ttcccctctggtcactcctacacggttactcagagtacctagagagccaagtaaaatacggagacctcagaaaag

SEQ ID NO: 338161 - DNA, 75 bp, Artificial Sequence
  Synthetic
ttactcagagtacctagagagccaagtaaaatacggagacctcagaaaagaaggcaaggtcctcatcacctgtcc

SEQ ID NO: 338162 - DNA, 75 bp, Artificial Sequence
  Synthetic
ggctttactaacagactccgagtcgctcttggactctgggggggcatacagcaacgaaagtgagtggggccagac

SEQ ID NO: 338163 - DNA, 75 bp, Artificial Sequence
  Synthetic
ccaaaagacccctccaagggctgggtaccatacaatgacaccttcggtagaggcaaatggatagacggaggaggc

SEQ ID NO: 338164 - DNA, 75 bp, Artificial Sequence
  Synthetic
taccatacaatgacaccttcggtagaggcaaatggatagacggaggaggctacatacccctacccgagagggcct

SEQ ID NO: 338165 - DNA, 75 bp, Artificial Sequence
  Synthetic
ggtgcgtgtgggggccgccattttagcttcgaccgccattttaggccctagcgggcctccgtaggcgcgttttaa

SEQ ID NO: 338166 - DNA, 75 bp, Artificial Sequence
  Synthetic
agagcaggtctttaaagacatagtaacctgcggtcccttcgcctaccgagacgatgagaaaaactcccaactggt

SEQ ID NO: 338167 - DNA, 75 bp, Artificial Sequence
  Synthetic
acctgcggtcccttcgcctaccgagacgatgagaaaaactcccaactggtggcgggatacacattcagattcaag

SEQ ID NO: 338168 - DNA, 75 bp, Artificial Sequence
  Synthetic
agatcatcaggaacccctgcacggacaaccagctatctcccgacccccgtagacggcctagagacgtacaagtat

SEQ ID NO: 338169 - DNA, 75 bp, Artificial Sequence
  Synthetic
tgtgacttccttccgctttttcaaaaaaaaagaggaagtatgacgtagcggcgggggggcggcgcgcttcgcgcg

SEQ ID NO: 338170 - DNA, 75 bp, Artificial Sequence
  Synthetic
aaaaaagaggaagtatgacgtagcggcgggggggcggcgcgcttcgcgcgccgcccactagggggcgctgcgcgc

SEQ ID NO: 338171 - DNA, 75 bp, Artificial Sequence
  Synthetic
caaccagctatctcccgacccccgtagacggcctagagacgtacaagtatctgacccgagcaccattgggccgcc

SEQ ID NO: 338172 - DNA, 75 bp, Artificial Sequence
  Synthetic
cgacgtggacagtttactgaatcagctctcagacgtatgttactccaaccgatccctcgcccaacatttgctgag

SEQ ID NO: 338173 - DNA, 75 bp, Artificial Sequence
  Synthetic
cccccccggggggggtccgcccccccggcccccccccgtgcaaagtccaccgcgcatgcgcgaccacgcccccgc

SEQ ID NO: 338174 - DNA, 75 bp, Artificial Sequence
  Synthetic
ctctcagacgtatgttactccaaccgatccctcgcccaacatttgctgagccaccaaagagacctttactcttcc

SEQ ID NO: 338175 - DNA, 75 bp, Artificial Sequence
  Synthetic
gctacgtcactaaccgacgtgtccgtctcctataggccggacaccgtctacgtcatacacttcctgggcatggtc

SEQ ID NO: 338176 - DNA, 75 bp, Artificial Sequence
  Synthetic
tctcctataggccggacaccgtctacgtcatacacttcctgggcatggtctacgtgataatataagtggcagcac

SEQ ID NO: 338177 - DNA, 75 bp, Artificial Sequence
  Synthetic
agggcaagaaagcgtctcaggttcaccggccaaaaggttccgcatctggccaggagacgagaccccgacgcagac

SEQ ID NO: 338178 - DNA, 75 bp, Artificial Sequence
  Synthetic
ccggccaaaaggttccgcatctggccaggagacgagaccccgacgcagacggggtcgcagccctcggaggaggaa

SEQ ID NO: 338179 - DNA, 75 bp, Artificial Sequence
  Synthetic
tcctccagcgaaagctcagagagcagcagctcctccaaatccagctccagcgtctcacagtctccctcgccaaaa

SEQ ID NO: 338180 - DNA, 75 bp, Artificial Sequence
  Synthetic
gcagctcctccaaatccagctccagcgtctcacagtctccctcgccaaaacccaggcgggtctccacataaaccc

SEQ ID NO: 338181 - DNA, 75 bp, Artificial Sequence
  Synthetic
ctgctaccactgcaccattcacagaaagctaggccatctgtgagaggtatgtggagaccccccgtgcgaaatgac

SEQ ID NO: 338182 - DNA, 75 bp, Artificial Sequence
  Synthetic
ataaggtaaccatgtttccaaccaccagcactcctagaaaaccctccaagggcgactgggagaccgagtaccagg

SEQ ID NO: 338183 - DNA, 75 bp, Artificial Sequence
  Synthetic
gtggagaccccccgtgcgaaatgacttcactattcaacgtaactggttctacagttgcttttactcccacacttc

SEQ ID NO: 338184 - DNA, 75 bp, Artificial Sequence
  Synthetic
cagcactcctagaaaaccctccaagggcgactgggagaccgagtaccaggcctgcgccgccttcgaccggcctcc

SEQ ID NO: 338185 - DNA, 75 bp, Artificial Sequence
  Synthetic
cactacccctggctgcctcagtcttacagggtctccttcaaactaggatggcattagaccccgccaataaaaata

SEQ ID NO: 338186 - DNA, 75 bp, Artificial Sequence
  Synthetic
gcattagaccccgccaataaaaataaagctgcttttcactgcacgttggccgtgggactctcacttagcggtgtc

SEQ ID NO: 338187 - DNA, 75 bp, Artificial Sequence
  Synthetic
ccgccgaggcgcccggtgatcgagcaccatggcctatcggtggtggtggaggcgacggaggcgcccgtggaggag

SEQ ID NO: 338188 - DNA, 75 bp, Artificial Sequence
  Synthetic
caaaaaaaagattattataaaacagtggcagcccaactacactcggagatgcaacatagtgggctacctacctct

SEQ ID NO: 338189 - DNA, 75 bp, Artificial Sequence
  Synthetic
tggcagcccaactacactcggagatgcaacatagtgggctacctacctctgctaatctgtggagaaaatactgtt

SEQ ID NO: 338190 - DNA, 75 bp, Artificial Sequence
  Synthetic
gccattggacaccgtagctgtgaatcagtaacgaaagtgagtggggccagacttcgccataaggcctttatcttc

SEQ ID NO: 338191 - DNA, 75 bp, Artificial Sequence
  Synthetic
ggtccgcgaactaccaaaatggccgaattcgtgacgtcatgcccgccattttaagtaaggcggaaccaggctgtc

SEQ ID NO: 338192 - DNA, 75 bp, Artificial Sequence
  Synthetic
acgacagctactaccccggaccctttggggggggaatgactacagacaaatttactctaagaatactgtatgatg

SEQ ID NO: 338193 - DNA, 75 bp, Artificial Sequence
  Synthetic
ttaagtaaggcggaaccaggctgtcaccccgtgtcaaaggtcaggggtcagccttccgctttacacaaaatggag

SEQ ID NO: 338194 - DNA, 75 bp, Artificial Sequence
  Synthetic
tggggggggaatgactacagacaaatttactctaagaatactgtatgatgagtacaagaggtttatgaactactg

SEQ ID NO: 338195 - DNA, 75 bp, Artificial Sequence
  Synthetic
ctctgtagatacctaggacttactctatatgtgtttagacacccagaagtagactttatactaactataaatacc

SEQ ID NO: 338196 - DNA, 75 bp, Artificial Sequence
  Synthetic
ggggaacctacttaaacacggaagtaggccccgacacgtcactgtcacgtgacagtgcgtcacagccgccatttt

SEQ ID NO: 338197 - DNA, 75 bp, Artificial Sequence
  Synthetic
tcccctccatttctagacacagaaataacagggcctagcatacatccaggtatgatggccctcaacaaaagagcc

SEQ ID NO: 338198 - DNA, 75 bp, Artificial Sequence
  Synthetic
cctgtttttcaaaaaaataccggaagtaacgtaccgggggcggggcgcgcgcttcgcgcgcgcccgggacaagcc

SEQ ID NO: 338199 - DNA, 75 bp, Artificial Sequence
  Synthetic
gcttcgcgcgcgcccgggacaagcccgcccccccccccgcgcatgcgcgcggggcccccccccccgcggggggct

SEQ ID NO: 338200 - DNA, 75 bp, Artificial Sequence
  Synthetic
taactgacactatagttgtgtcattccaagttctgcaatccatgtacaacgactgcctgagcatacttcctgata

SEQ ID NO: 338201 - DNA, 75 bp, Artificial Sequence
  Synthetic
gttgtggggatcctatacttcacattactgcacttgctgaaacatatggccatccaacaggcccgagaccttctg

SEQ ID NO: 338202 - DNA, 75 bp, Artificial Sequence
  Synthetic
catccaacaggcccgagaccttctgggtcatcgggaatagaccccactccgcccatccgtagagccaggcctgcc

SEQ ID NO: 338203 - DNA, 75 bp, Artificial Sequence
  Synthetic
cacccagctacataaaaaaataatacaacatttaccctactacaacaccacacaaacacaagcacaatttaaaag

SEQ ID NO: 338204 - DNA, 75 bp, Artificial Sequence
  Synthetic
caacatttaccctactacaacaccacacaaacacaagcacaatttaaaagagttgtagaaaacatgtcagcaacc

SEQ ID NO: 338205 - DNA, 75 bp, Artificial Sequence
  Synthetic
acataaatactataaagttcacagacacacaaactcctgaaaatgattcaggcataggaggcccttacaccaatt

SEQ ID NO: 338206 - DNA, 75 bp, Artificial Sequence
  Synthetic
cacacaaactcctgaaaatgattcaggcataggaggcccttacaccaattattcagactcatggtacaaaggcac

SEQ ID NO: 338207 - DNA, 75 bp, Artificial Sequence
  Synthetic
atacctgaaaaagcaagtaaattatactacgaccaaaccaaacaactaattggcattacatttacaggatccaca

SEQ ID NO: 338208 - DNA, 75 bp, Artificial Sequence
  Synthetic
actacgaccaaaccaaacaactaattggcattacatttacaggatccacacacagactacactactgtggaggcc

SEQ ID NO: 338209 - DNA, 75 bp, Artificial Sequence
  Synthetic
aggtagatcctactttgaaacgaaaggcccatacacagacatcacttacaaccccttttcagacagaggagaggg

SEQ ID NO: 338210 - DNA, 75 bp, Artificial Sequence
  Synthetic
ggcccatacacagacatcacttacaaccccttttcagacagaggagagggtaatatgctatggatagactggcta

SEQ ID NO: 338211 - DNA, 75 bp, Artificial Sequence
  Synthetic
aaacaagtagcaagtgcctcatagaaaacttacccctgtgggcctcagtatacggatacaaagagtactgcagca

SEQ ID NO: 338212 - DNA, 75 bp, Artificial Sequence
  Synthetic
cccgaaagtcctcggtccccactattccttccaccggtgggacttccggcgtggcctctttggctcacaagctat

SEQ ID NO: 338213 - DNA, 75 bp, Artificial Sequence
  Synthetic
aaacttacccctgtgggcctcagtatacggatacaaagagtactgcagcaaagtaacaggagatacaaacataga

SEQ ID NO: 338214 - DNA, 75 bp, Artificial Sequence
  Synthetic
agcccctacacagtaccacagctgttagaccacaacaatcccctcagaggttacgtgccttatagcctcaacttt

SEQ ID NO: 338215 - DNA, 75 bp, Artificial Sequence
  Synthetic
tagaccacaacaatcccctcagaggttacgtgccttatagcctcaactttggaaatggtaaaatgccaggcggta

SEQ ID NO: 338216 - DNA, 75 bp, Artificial Sequence
  Synthetic
ttttgcttgaccaaatggccgacttccttcctcttttttaaaaaaaagcggaagtgccgccgcggcggcgggggg

SEQ ID NO: 338217 - DNA, 75 bp, Artificial Sequence
  Synthetic
ggccgggccatgggcaaggctcttaaaaagctatgtttctcggtaaaatctacaggaagaaaaggaaactgcttc

SEQ ID NO: 338218 - DNA, 75 bp, Artificial Sequence
  Synthetic
agccaagtggtaccccactctgttccaccaaaaagaagtactagaggccatagcacaggcgggtccctttgcata

SEQ ID NO: 338219 - DNA, 75 bp, Artificial Sequence
  Synthetic
caccaaaaagaagtactagaggccatagcacaggcgggtccctttgcataccactcagacattaagaaagtatcc

SEQ ID NO: 338220 - DNA, 75 bp, Artificial Sequence
  Synthetic
ggttcgaggaagccacgatgctttttgtggctgtagtgatcctattcttcatctttctcgtctggctgcacgttt

SEQ ID NO: 338221 - DNA, 75 bp, Artificial Sequence
  Synthetic
tgtggctgtagtgatcctattcttcatctttctcgtctggctgcacgttttaaccatcagggacctccgacgccc

SEQ ID NO: 338222 - DNA, 75 bp, Artificial Sequence
  Synthetic
aagaccacccaaggttcctcgggcaatagagtgcctcgatcaatacaagtcgttgacccgcggtacaacacgcca

SEQ ID NO: 338223 - DNA, 75 bp, Artificial Sequence
  Synthetic
ataccccagtgagacgcctgctgcctctccccagctaccccggcgagggtccccaggctagatggcctggtgagg

SEQ ID NO: 338224 - DNA, 75 bp, Artificial Sequence
  Synthetic
tctccccagctaccccggcgagggtccccaggctagatggcctggtgaggatggaggcgccgctggtggcgaccg

SEQ ID NO: 338225 - DNA, 75 bp, Artificial Sequence
  Synthetic
cgcgccgccgaagacgagtaccagcccgaagacctagacgagcttttcggcgctatcgaacaagaacagtaagga

SEQ ID NO: 338226 - DNA, 75 bp, Artificial Sequence
  Synthetic
ccgaagacctagacgagcttttcggcgctatcgaacaagaacagtaaggaggaggcgaagggggaggcggagggg

SEQ ID NO: 338227 - DNA, 75 bp, Artificial Sequence
  Synthetic
cgctatgccagacgcaggttccgacgcaaaaagatagtactgactcagtggaacccccagactaccagaaaatgt

SEQ ID NO: 338228 - DNA, 75 bp, Artificial Sequence
  Synthetic
gcaaaaagatagtactgactcagtggaacccccagactaccagaaaatgtataataaggggcatgatgccagtac

SEQ ID NO: 338229 - DNA, 75 bp, Artificial Sequence
  Synthetic
cagaaactatgcagtgaggtcagatgactatgtggtgaacaaagggttcgggggctccttcgccacggagacctt

SEQ ID NO: 338230 - DNA, 75 bp, Artificial Sequence
  Synthetic
gactatgtggtgaacaaagggttcgggggctccttcgccacggagaccttctccctgaaggttctctatgaccag

SEQ ID NO: 338231 - DNA, 75 bp, Artificial Sequence
  Synthetic
gggcctttatcttcttgccatttgtccgcgaccgggggtcgctcctaggcgcggaccccgtttcggggtccttcc

SEQ ID NO: 338232 - DNA, 75 bp, Artificial Sequence
  Synthetic
cccacactaacgaggacctagacctggcccgctacaggggctgcaggtggactttttacagacataaagacacag

SEQ ID NO: 338233 - DNA, 75 bp, Artificial Sequence
  Synthetic
ggcccgctacaggggctgcaggtggactttttacagacataaagacacagactttatagtgtactttacaaacaa

SEQ ID NO: 338234 - DNA, 75 bp, Artificial Sequence
  Synthetic
tgtcgctgaggattgacgtcacagttcaaaggtcatcctcggcggtaaccgcaaagatggcggtcaatctcttcc

SEQ ID NO: 338235 - DNA, 75 bp, Artificial Sequence
  Synthetic
tccgcgcccctgacgacccccggcatgctcatgcgcagtaaatacaaagtcctcattcccagcttccagaccaga

SEQ ID NO: 338236 - DNA, 75 bp, Artificial Sequence
  Synthetic
tgctcatgcgcagtaaatacaaagtcctcattcccagcttccagaccagacccaagggtcgcaaaacagtaaccg

SEQ ID NO: 338237 - DNA, 75 bp, Artificial Sequence
  Synthetic
tcaagacaagtggtacacccagcaggacctgtgttcagttcctcttgtccaactgaacgtgaccgcagctgattt

SEQ ID NO: 338238 - DNA, 75 bp, Artificial Sequence
  Synthetic
gccgacttccttcctcttttttaaaaaaaggcgcgaaaaaaccgtcggcgggggggccgcgcgctgcgcgcgcgg

SEQ ID NO: 338239 - DNA, 75 bp, Artificial Sequence
  Synthetic
gacctgtgttcagttcctcttgtccaactgaacgtgaccgcagctgatttcacacatccgttcggctcaccacta

SEQ ID NO: 338240 - DNA, 75 bp, Artificial Sequence
  Synthetic
aggtgctgggtgacttgtacaatacatgtctcaatatcgaccttccgcaatttagtgaattaggagaaataacta

SEQ ID NO: 338241 - DNA, 75 bp, Artificial Sequence
  Synthetic
aagttcgtcaccaaccacgtgactcctctcgcccaatcagggtctatgtcgtgcatttcctgggcatggtctacg

SEQ ID NO: 338242 - DNA, 75 bp, Artificial Sequence
  Synthetic
atgtctcaatatcgaccttccgcaatttagtgaattaggagaaataactagtgcctactcaaaaccaaactcaaa

SEQ ID NO: 338243 - DNA, 75 bp, Artificial Sequence
  Synthetic
ttgttcacaaaagccacatcaggacactactggcagacattcataaccaacagcatggtcagagcacacatagat

SEQ ID NO: 338244 - DNA, 75 bp, Artificial Sequence
  Synthetic
aaggaaagtgctactgccgccactgcgagctccacaggcggctaggagggctatgagctggcgtccccctgtaca

SEQ ID NO: 338245 - DNA, 75 bp, Artificial Sequence
  Synthetic
cgagctccacaggcggctaggagggctatgagctggcgtccccctgtacacgatgcgccaggcatcgagcgtaat

SEQ ID NO: 338246 - DNA, 75 bp, Artificial Sequence
  Synthetic
aaaagaaattcacagacactagagacagctcctttctttttgccacttaccatcccgaagctataaaagacacaa

SEQ ID NO: 338247 - DNA, 75 bp, Artificial Sequence
  Synthetic
cagctcctttctttttgccacttaccatcccgaagctataaaagacacaattatgaaaatgagagagaacaactt

SEQ ID NO: 338248 - DNA, 75 bp, Artificial Sequence
  Synthetic
atgctggatgttgtggttgtggcaattttgttgctcacattaatattctggctggccgttatggctttactggga

SEQ ID NO: 338249 - DNA, 75 bp, Artificial Sequence
  Synthetic
ttttgttgctcacattaatattctggctggccgttatggctttactgggaatccgccgccgccgggtggtccgcc

SEQ ID NO: 338250 - DNA, 75 bp, Artificial Sequence
  Synthetic
aagtatggagactacacagcacagtaccaaggaaacacacacatgctagactactaccttggcttttacagcccc

SEQ ID NO: 338251 - DNA, 75 bp, Artificial Sequence
  Synthetic
accaaggaaacacacacatgctagactactaccttggcttttacagccccatattcctctcagatggaaggtcta

SEQ ID NO: 338252 - DNA, 75 bp, Artificial Sequence
  Synthetic
gccagacgtagtcccgcccagcccgaacaaccccctgccctgccatggcatggggatggtggagaaggtggcgcc

SEQ ID NO: 338253 - DNA, 75 bp, Artificial Sequence
  Synthetic
agacatagtatacaatcccttcttagacaaggcccagggcaacatggtgtggtttcagtaccacacaaagacaga

SEQ ID NO: 338254 - DNA, 75 bp, Artificial Sequence
  Synthetic
gacaaggcccagggcaacatggtgtggtttcagtaccacacaaagacagacaacaagtttaaaaaaccagagtgc

SEQ ID NO: 338255 - DNA, 75 bp, Artificial Sequence
  Synthetic
tggggatggtggagaaggtggcgccggtggcccgccaggcgctggaggagacgccgccgccgacgcccagttagg

SEQ ID NO: 338256 - DNA, 75 bp, Artificial Sequence
  Synthetic
tgtgggccctcctaaacggatatgtagactacttagagactcaaatacagtatggtgacctcagtaaagaaggga

SEQ ID NO: 338257 - DNA, 75 bp, Artificial Sequence
  Synthetic
aagtcctcatcaggtgtccctacaccaagccagcactagtagaccccaaagacgacactgcaggatatgtagtct

SEQ ID NO: 338258 - DNA, 75 bp, Artificial Sequence
  Synthetic
gtggatagacggagggggctacatccccctgcacgagaggacaaagtggtacgtgatgctcagataccagacgga

SEQ ID NO: 338259 - DNA, 75 bp, Artificial Sequence
  Synthetic
ggccacactaagggcaataaaaactacgccctacactctgacgactacaccccccaaggacaggcatttggaggg

SEQ ID NO: 338260 - DNA, 75 bp, Artificial Sequence
  Synthetic
cccctgcacgagaggacaaagtggtacgtgatgctcagataccagacggacgtcttccatgacatagtgacctgt

SEQ ID NO: 338261 - DNA, 75 bp, Artificial Sequence
  Synthetic
acgccctacactctgacgactacaccccccaaggacaggcatttggaggggctctaagcactacctcattctctt

SEQ ID NO: 338262 - DNA, 75 bp, Artificial Sequence
  Synthetic
acaaaaacagccagctagtggccaaataccgcttcagctttatatggggaggtaacactgtccactctcaggtca

SEQ ID NO: 338263 - DNA, 75 bp, Artificial Sequence
  Synthetic
gagaggactgaataagtggtcttttcccaacgaccagctagacctggccagatacaggggctgcaaattctactt

SEQ ID NO: 338264 - DNA, 75 bp, Artificial Sequence
  Synthetic
cccaacgaccagctagacctggccagatacaggggctgcaaattctacttttacaggacaaaacagactgactgg

SEQ ID NO: 338265 - DNA, 75 bp, Artificial Sequence
  Synthetic
agtatccggtccccgtcgacagcctagggatgtacaagtcgttgacccgcaacgcatcacgccgccgtgggtcct

SEQ ID NO: 338266 - DNA, 75 bp, Artificial Sequence
  Synthetic
agggatgtacaagtcgttgacccgcaacgcatcacgccgccgtgggtcctccacagcttcgaccagcgaagaggc

SEQ ID NO: 338267 - DNA, 75 bp, Artificial Sequence
  Synthetic
cctacaaactagacaagtacagctgccccaactaccacccgggaaaccttattaaagcaaagcacaaatttttaa

SEQ ID NO: 338268 - DNA, 75 bp, Artificial Sequence
  Synthetic
aacgcatcacgccgccgtgggtcctccacagcttcgaccagcgaagaggcctctttactgaaacagctctcagac

SEQ ID NO: 338269 - DNA, 75 bp, Artificial Sequence
  Synthetic
ttcccagctatgacactaatcccaagggcagacagaaaattatagttaaaattccccccccagacctctttgtag

SEQ ID NO: 338270 - DNA, 75 bp, Artificial Sequence
  Synthetic
cgagtatgctgttagcaccctcaggacacccctcctctttctaccctcagaataccagcgagaagacggcgctgc

SEQ ID NO: 338271 - DNA, 75 bp, Artificial Sequence
  Synthetic
aataccagcgagaagacggcgctgcagaaagcgcctcaggttcaccggccaaaagaccccgtatctggtcagaag

SEQ ID NO: 338272 - DNA, 75 bp, Artificial Sequence
  Synthetic
taggctttagtgcaacacaagacaagattgacaatgtatttaacattttataccaaaacaactcttattgggaat

SEQ ID NO: 338273 - DNA, 75 bp, Artificial Sequence
  Synthetic
ggaggagaacccggcggagacgacgagggagctcctccagcgaaagctccgagagcagcgagcactccagttcca

SEQ ID NO: 338274 - DNA, 75 bp, Artificial Sequence
  Synthetic
agggagctcctccagcgaaagctccgagagcagcgagcactccagttccaactccagcacttcgcggtccaactc

SEQ ID NO: 338275 - DNA, 75 bp, Artificial Sequence
  Synthetic
gattgacaatgtatttaacattttataccaaaacaactcttattgggaatccaacattacccccttctatgtaat

SEQ ID NO: 338276 - DNA, 75 bp, Artificial Sequence
  Synthetic
gcagactatctttcccctcaaattacagactcaaactttagaaagaaagtaaataccaactacaactggtacacc

SEQ ID NO: 338277 - DNA, 75 bp, Artificial Sequence
  Synthetic
taaaccccctgttatctttcccgcaatgaataaggtctttctgtttcccccagagggtcccaagcccatcctggg

SEQ ID NO: 338278 - DNA, 75 bp, Artificial Sequence
  Synthetic
atgaataaggtctttctgtttcccccagagggtcccaagcccatcctgggcaaagaggcctggcaggacgagtac

SEQ ID NO: 338279 - DNA, 75 bp, Artificial Sequence
  Synthetic
cagactcaaactttagaaagaaagtaaataccaactacaactggtacacctataatgccaaatcaaacaaagaca

SEQ ID NO: 338280 - DNA, 75 bp, Artificial Sequence
  Synthetic
ctttaaacaattaaccagtgaaggtccacagcatacaagcagtgacaacggctatgccagccagtggaccacccc

SEQ ID NO: 338281 - DNA, 75 bp, Artificial Sequence
  Synthetic
ctgccagaacccaccacacagacacccccttctatccctgggccccccacaagttccatgtaagcttcaaacttg

SEQ ID NO: 338282 - DNA, 75 bp, Artificial Sequence
  Synthetic
ccacagcatacaagcagtgacaacggctatgccagccagtggaccacccccagcacagacgcctacgagtaccat

SEQ ID NO: 338283 - DNA, 75 bp, Artificial Sequence
  Synthetic
ggaactctcactggtcggtgtctacctcttaaggtcactaagcactccgagcgtcagcgaggagtgcgaccctct

SEQ ID NO: 338284 - DNA, 75 bp, Artificial Sequence
  Synthetic
tagcaccagacagacctgtccctcgctttccctgtgcctaccaagatgttacttataatcctctaatggacaaag

SEQ ID NO: 338285 - DNA, 75 bp, Artificial Sequence
  Synthetic
ctttccctgtgcctaccaagatgttacttataatcctctaatggacaaaggagtgggcaaccacatatggttcca

SEQ ID NO: 338286 - DNA, 75 bp, Artificial Sequence
  Synthetic
cttatagttagtgcaccatctccatgtaaggcacacattgaagacatacccctatgggcagccttctatggctac

SEQ ID NO: 338287 - DNA, 75 bp, Artificial Sequence
  Synthetic
gtaaggcacacattgaagacatacccctatgggcagccttctatggctacagtgactttatagagtcagagctag

SEQ ID NO: 338288 - DNA, 75 bp, Artificial Sequence
  Synthetic
gggcttagtttgtgttatctgtccatacaccaagcccccgttatggagtaaaacaaacccttccatgggctacgt

SEQ ID NO: 338289 - DNA, 75 bp, Artificial Sequence
  Synthetic
ggcaagtggactgacggacggggcaaaatagagccctactggcaagtaaggtggaggcccgaaatgcttttccaa

SEQ ID NO: 338290 - DNA, 75 bp, Artificial Sequence
  Synthetic
aaatagagccctactggcaagtaaggtggaggcccgaaatgcttttccaagagactgtaatggcagacatagtac

SEQ ID NO: 338291 - DNA, 75 bp, Artificial Sequence
  Synthetic
aaatagagccctactggcaagtaaggtggaggcccgaaatgcttttccaagagactgtattggcagacatagtac

SEQ ID NO: 338292 - DNA, 75 bp, Artificial Sequence
  Synthetic
aaatagagccctactggcaagtaaggtggaggcccgaaatgcttttccaagagactgtactggcagacatagtac

SEQ ID NO: 338293 - DNA, 75 bp, Artificial Sequence
  Synthetic
aaatagagccctactggcaagtaaggtggaggcccgaaatgcttttccaagagactgtagtggcagacatagtac

SEQ ID NO: 338294 - DNA, 75 bp, Artificial Sequence
  Synthetic
taggtgccgtccaggactgcagttccgggtcagagtgcatcctcggcggaacctgcacaaaatggcggtcaatat

SEQ ID NO: 338295 - DNA, 75 bp, Artificial Sequence
  Synthetic
cgggtcagagtgcatcctcggcggaacctgcacaaaatggcggtcaatatcttccgggtcaaaggtcacacctac

SEQ ID NO: 338296 - DNA, 75 bp, Artificial Sequence
  Synthetic
gctacgtcatatgcggaagtaggccccgccacgtgactcgtcacgtgggcgctgcgtcacggcggccattttgta

SEQ ID NO: 338297 - DNA, 75 bp, Artificial Sequence
  Synthetic
gacaatcaaaaacccgtgcaagacggacggacaagccaccgactccagtagacagcctagaggaatacaagtggc

SEQ ID NO: 338298 - DNA, 75 bp, Artificial Sequence
  Synthetic
cttttttaaaaataacggcccagcggcggcgcgcgcgcttcgcgcgcgcgccggggggctccgcccccccccgcg

SEQ ID NO: 338299 - DNA, 75 bp, Artificial Sequence
  Synthetic
gcggcgcgcgcgcttcgcgcgcgcgccggggggctccgcccccccccgcgcatgcgcggggcccccccccgcggg

SEQ ID NO: 338300 - DNA, 75 bp, Artificial Sequence
  Synthetic
cccacaggccaaccacagtctatgtcgtgcacttcctgggcatggtctacgtgataatataaagcggtgcacttc

SEQ ID NO: 338301 - DNA, 75 bp, Artificial Sequence
  Synthetic
acgacaatactcctcctcaagcgacgactcagagagcagcagaagctcgagcaccaactcagattcctcacccga

SEQ ID NO: 338302 - DNA, 75 bp, Artificial Sequence
  Synthetic
tccgcagcgagatcgcgacgtaggagcgatcgagcgtcccgagggcgggtgccggaggtgagtttacacaccgca

SEQ ID NO: 338303 - DNA, 75 bp, Artificial Sequence
  Synthetic
gactcagagagcagcagaagctcgagcaccaactcagattcctcacccgagaaatgttcaaaacgcaagcgggtc

SEQ ID NO: 338304 - DNA, 75 bp, Artificial Sequence
  Synthetic
ccagcgataaaccaggtgtacatgttccccgacagagcccctaaacccgcacccaccagccaagactggcagcac

SEQ ID NO: 338305 - DNA, 75 bp, Artificial Sequence
  Synthetic
acaggcccgtgcgccatcaccttcactctcccccattttatccccgagtcccctttacatggtctgttaaattca

SEQ ID NO: 338306 - DNA, 75 bp, Artificial Sequence
  Synthetic
tagtccccctggtaatatgcggccacaccaggtggaactacaactacgccctccatagcgaggactacacagagg

SEQ ID NO: 338307 - DNA, 75 bp, Artificial Sequence
  Synthetic
cgaggagtgcgacccttccccctgactcaacttcttcggagccgcgcgctacgccttcggctgcgcgcggcacct

SEQ ID NO: 338308 - DNA, 75 bp, Artificial Sequence
  Synthetic
cctcagcaccactacgtggtcccttaaggtgctgtatgacgagcacctcaaacaccacaacttctggggctatcc

SEQ ID NO: 338309 - DNA, 75 bp, Artificial Sequence
  Synthetic
tcgcgcgtgtcagaccacttcgggctcgcgggggtcgggaattttgctaaacagactccgagttgctcttggaca

SEQ ID NO: 338310 - DNA, 75 bp, Artificial Sequence
  Synthetic
gcgacgttaacctgttgcaacttgtggtcactgcggctgactttcgacatccattctgctcaccacaaacgaaca

SEQ ID NO: 338311 - DNA, 75 bp, Artificial Sequence
  Synthetic
ctgagtgggcgtatcagtaacgaaagtgagtggggccagacttcgccataaggcctttatcttctcgccattgga

SEQ ID NO: 338312 - DNA, 75 bp, Artificial Sequence
  Synthetic
cgaccgccattttgttttacaaaatggccgacttccttcctctttttttaaaaaataacggtcggcggcggcgcg

SEQ ID NO: 338313 - DNA, 75 bp, Artificial Sequence
  Synthetic
cgcgctgcgcgcgcgccccggggggggtccgcccccccccggggagggggggggccccccccccagggggggttt

SEQ ID NO: 338314 - DNA, 75 bp, Artificial Sequence
  Synthetic
ggaagggtcgctgcaagcgcggaccccgttttcaccccttccggactacaaaaatggcgcattagtgacgtcacg

SEQ ID NO: 338315 - DNA, 75 bp, Artificial Sequence
  Synthetic
taagctaaacaaatacagctgcgcctcttaccatcctggcatgctcatgcagcgaaaacacaaggtgctaatacc

SEQ ID NO: 338316 - DNA, 75 bp, Artificial Sequence
  Synthetic
cgccgggggggcgccagcgccccccccccgcgcatgcgcgggtccccccccccgcggggggctccgccccccggc

SEQ ID NO: 338317 - DNA, 75 bp, Artificial Sequence
  Synthetic
ccccgcgcatgcgcgggtccccccccccgcggggggctccgccccccggcccccccccccgaagtacgtcactaa

SEQ ID NO: 338318 - DNA, 75 bp, Artificial Sequence
  Synthetic
tacaggaagaaaaggaaactgcttctgcaggctgtgcgtgctccacagacgccatcttccatgagccgctgctgg

SEQ ID NO: 338319 - DNA, 75 bp, Artificial Sequence
  Synthetic
cccgcgagtctcgatggtacgaggcggttcgaggaagccacgatgctttttgtggctgtagtgatcctattcttc

SEQ ID NO: 338320 - DNA, 75 bp, Artificial Sequence
  Synthetic
attggacactgtagctgtgaatcagtaacgaaagtgagtggggccagacttcgccatagggcctttatcttcttg

SEQ ID NO: 338321 - DNA, 75 bp, Artificial Sequence
  Synthetic
ataggcttcgacctcccttttaggccttccggactacaaaaatggcggattcagtgacgtcacggccgccatttt

SEQ ID NO: 338322 - DNA, 75 bp, Artificial Sequence
  Synthetic
gcgcgcggcacctcggacccccgctcgtgctgacacgcttgcgcgtgtcagaccacttcgggctcgcgggggtcg

SEQ ID NO: 338323 - DNA, 75 bp, Artificial Sequence
  Synthetic
ccacgtggctcccacaggccaaccagagtctacatcgtgcatttcctgggcatggtctacgtaataatataagta

SEQ ID NO: 338324 - DNA, 75 bp, Artificial Sequence
  Synthetic
agaaacaggtggtccagatctaaccatgacttagacctggccagataccaaggaaccactctaaaactttacaga

SEQ ID NO: 338325 - DNA, 75 bp, Artificial Sequence
  Synthetic
ggacagacatgagaatagccattatatgtccctacacagaaccagcacttatagggtcaacagaagatgtaggct

SEQ ID NO: 338326 - DNA, 75 bp, Artificial Sequence
  Synthetic
tggccgggccccgggcaaggctcttaaaaaatgcgtttttccaggattgctcgctcgaaaaggaaagtgccactg

SEQ ID NO: 338327 - DNA, 75 bp, Artificial Sequence
  Synthetic
ctgggactatgagctggcgccctccggtccacaatgccgctggaatcgaccgtaactggttcgaatcctgtttca

SEQ ID NO: 338328 - DNA, 75 bp, Artificial Sequence
  Synthetic
actctcgctactcgctacggctttactcctgggcccgcgccgccgcctggtggtccaggcccgcggccgccagta

SEQ ID NO: 338329 - DNA, 75 bp, Artificial Sequence
  Synthetic
gagacggtaaccagcccagggccctgccatggcgtggggatggtggagacgcagacgctggcccacctacagaag

SEQ ID NO: 338330 - DNA, 75 bp, Artificial Sequence
  Synthetic
gtggcggcgctggagacgccgcaggagagtaccgcgacgaagacctcgaagagctgttcgccgctatggaaagag

SEQ ID NO: 338331 - DNA, 75 bp, Artificial Sequence
  Synthetic
tgctccgactccggagaggagtccactgggaaccccctcctgtcctaattcaaggtcccagtatcccagacctgc

SEQ ID NO: 338332 - DNA, 75 bp, Artificial Sequence
  Synthetic
ggcggcggtaccgaaggggctacagacgcagggtcgcggtcagactgagacgcagacgcagacggggacgtaaga

SEQ ID NO: 338333 - DNA, 75 bp, Artificial Sequence
  Synthetic
acgcagggtcgcggtcagactgagacgcagacgcagacggggacgtaagagacttgtacttactcagtggcagcc

SEQ ID NO: 338334 - DNA, 75 bp, Artificial Sequence
  Synthetic
accgggtacctcccggtggtatggtgcggctacctccgggccgccaaaaactatgcctaccactctgacgactcc

SEQ ID NO: 338335 - DNA, 75 bp, Artificial Sequence
  Synthetic
gcggctacctccgggccgccaaaaactatgcctaccactctgacgactccacaaagcagccggacccctttgggg

SEQ ID NO: 338336 - DNA, 75 bp, Artificial Sequence
  Synthetic
ccttaaggtgctgtacgaccagcaccagagaggactcaacaggtggtctttccctaacgaccaactggacctagc

SEQ ID NO: 338337 - DNA, 75 bp, Artificial Sequence
  Synthetic
cagagaggactcaacaggtggtctttccctaacgaccaactggacctagctcgctacagggggtgcacacttacg

SEQ ID NO: 338338 - DNA, 75 bp, Artificial Sequence
  Synthetic
ttatagctatttatgacatctccgccccatacaaactagacaagtacagctctcccagctatcaccccggcaaca

SEQ ID NO: 338339 - DNA, 75 bp, Artificial Sequence
  Synthetic
gccattggacactgagggggtgaacagcaacgaaagtgagtggggccaaacttcgccataaggcctttaactttg

SEQ ID NO: 338340 - DNA, 75 bp, Artificial Sequence
  Synthetic
cattcccagctacgacactaaccccaggggccgccaaaaaatagtagttaaaatccccccccctaaactgttcgt

SEQ ID NO: 338341 - DNA, 75 bp, Artificial Sequence
  Synthetic
ctgtgcgacgttaatcttgtgacacttgcggtcagcgcagcttcctttacacatccgttcggctcaccactaacg

SEQ ID NO: 338342 - DNA, 75 bp, Artificial Sequence
  Synthetic
ttgcggtcagcgcagcttcctttacacatccgttcggctcaccactaacgaacaacccttgtgtaaccttccagg

SEQ ID NO: 338343 - DNA, 75 bp, Artificial Sequence
  Synthetic
aataggttacggttcctcagatcagaaaaaaaaacaagtacttgaaactctctataacgaaaatgcatactgggc

SEQ ID NO: 338344 - DNA, 75 bp, Artificial Sequence
  Synthetic
cccccgcgcatgcgcgggtcccccccctcgggggggctccgcccccccggcccccccccgggctaaatacaccgc

SEQ ID NO: 338345 - DNA, 75 bp, Artificial Sequence
  Synthetic
cctcgggggggctccgcccccccggcccccccccgggctaaatacaccgcgcatgcgcggccacgcccccgccgc

SEQ ID NO: 338346 - DNA, 75 bp, Artificial Sequence
  Synthetic
aaaaaaaaacaagtacttgaaactctctataacgaaaatgcatactgggcctcacacttaactccttactttacc

SEQ ID NO: 338347 - DNA, 75 bp, Artificial Sequence
  Synthetic
atactaagaatcccagcactactgcatctgttactccaaacacgctatttacaacaggtagctacgactcaaaca

SEQ ID NO: 338348 - DNA, 75 bp, Artificial Sequence
  Synthetic
atctgttactccaaacacgctatttacaacaggtagctacgactcaaacattaaaatagcaggagacagcaacta

SEQ ID NO: 338349 - DNA, 75 bp, Artificial Sequence
  Synthetic
aacaaaatagacaaacttcataaaattagagaacaatactttaaatgggaaacagatgaaggcccccaagccaca

SEQ ID NO: 338350 - DNA, 75 bp, Artificial Sequence
  Synthetic
ttagagaacaatactttaaatgggaaacagatgaaggcccccaagccacatctgattatggcaaacaccacactt

SEQ ID NO: 338351 - DNA, 75 bp, Artificial Sequence
  Synthetic
cgaataccacctaggtttatttagtcccatattcataggacccaccagaagcaacaaactatttgcaaccgccta

SEQ ID NO: 338352 - DNA, 75 bp, Artificial Sequence
  Synthetic
cccatattcataggacccaccagaagcaacaaactatttgcaaccgcctaccaggacgttacttacaacccccta

SEQ ID NO: 338353 - DNA, 75 bp, Artificial Sequence
  Synthetic
tagagacacttggtataaaggaaatacatacaacgagaagatatgcgagttagcacaaataaccagaaacagatt

SEQ ID NO: 338354 - DNA, 75 bp, Artificial Sequence
  Synthetic
tctggtttcagtacaacacaaaagcagacacccaggtggccaaacaaggctgctactgcatgctagaagacattc

SEQ ID NO: 338355 - DNA, 75 bp, Artificial Sequence
  Synthetic
tagcacaaataaccagaaacagatttaaaaatgcaaccaaaggagcactaccaaactaccccacaataatgtcca

SEQ ID NO: 338356 - DNA, 75 bp, Artificial Sequence
  Synthetic
agacacccaggtggccaaacaaggctgctactgcatgctagaagacattcccctctgggccgccatgtatggcta

SEQ ID NO: 338357 - DNA, 75 bp, Artificial Sequence
  Synthetic
ggccccttccaagacgcagagacggtgggctatatctgtgtaatatgcccctacaccgagccccccatgtacaac

SEQ ID NO: 338358 - DNA, 75 bp, Artificial Sequence
  Synthetic
tgggctatatctgtgtaatatgcccctacaccgagccccccatgtacaacaaacacaatcccatgcagggttacg

SEQ ID NO: 338359 - DNA, 75 bp, Artificial Sequence
  Synthetic
tggcaagtggatagacggacggggacacatagagccttactggctctgccgctggaggccagaaatgcttttcca

SEQ ID NO: 338360 - DNA, 75 bp, Artificial Sequence
  Synthetic
gctggaggccagaaatgcttttccagcagcaggttatgagagacattgtgcagaccgggccctggagctataaag

SEQ ID NO: 338361 - DNA, 75 bp, Artificial Sequence
  Synthetic
catgaagtataagttcagattcacatggggcggcaatatggtctcccaacagacaatcagaaacccctgcaagac

SEQ ID NO: 338362 - DNA, 75 bp, Artificial Sequence
  Synthetic
tccaaacaggtcgtcaggaatccctgctccaactccagctcctccgcggcccatagaggacctcgcagcgtacaa

SEQ ID NO: 338363 - DNA, 75 bp, Artificial Sequence
  Synthetic
agacagcctagagaagtacaagttgttgacccactcaccatgggtccccgctgggttttccactcctgggactgg

SEQ ID NO: 338364 - DNA, 75 bp, Artificial Sequence
  Synthetic
agcaaaacgaaagctcaggtttcagagtccagcagcgactcccgtgggtccactccagccaagagacgcaaagct

SEQ ID NO: 338365 - DNA, 75 bp, Artificial Sequence
  Synthetic
ttgacccactcaccatgggtccccgctgggttttccactcctgggactggagacgtggctaccttagtgagacag

SEQ ID NO: 338366 - DNA, 75 bp, Artificial Sequence
  Synthetic
actcgactatgaggcgtatatgcaaaaaccaaaaagacctagactgttccctgttacagagggcgacgaccagtc

SEQ ID NO: 338367 - DNA, 75 bp, Artificial Sequence
  Synthetic
aaaccaaaaagacctagactgttccctgttacagagggcgacgaccagtccccgcagcaaggcgacgactggtgt

SEQ ID NO: 338368 - DNA, 75 bp, Artificial Sequence
  Synthetic
ttaccgaagagacgacgcagacgctacagctccagctccagcgccagctccggcgacagcagcgactcggagagc

SEQ ID NO: 338369 - DNA, 75 bp, Artificial Sequence
  Synthetic
acagctccagctccagcgccagctccggcgacagcagcgactcggagagcagctccaactcctacaacaccacct

SEQ ID NO: 338370 - DNA, 75 bp, Artificial Sequence
  Synthetic
cgggggggcgccagcgcccccccccccgcgcatgcgcgggtccccccccccgcggggggctccgccccccggccc

SEQ ID NO: 338371 - DNA, 75 bp, Artificial Sequence
  Synthetic
ataaacccattattattggtccggcagtaaacagagtgtaccttttcccccccgacggtccccgtcccataacca

SEQ ID NO: 338372 - DNA, 75 bp, Artificial Sequence
  Synthetic
agtaaacagagtgtaccttttcccccccgacggtccccgtcccataaccacctctcagggctgggcagatgagta

SEQ ID NO: 338373 - DNA, 75 bp, Artificial Sequence
  Synthetic
cccactcgcacccactactcagacacccctacctatccctggatgcccactcagttcaaagtgtcattcaaactt

SEQ ID NO: 338374 - DNA, 75 bp, Artificial Sequence
  Synthetic
ggctttcaataaaatgtgctcaacttcaacttgctacgccgtgggagtttcactggtcggtgtctacctcttaag

SEQ ID NO: 338375 - DNA, 75 bp, Artificial Sequence
  Synthetic
aggagtgcgacccttctctctgtacaccccccctgcccggtagcaacgccctcggagtccggcgctacgcgctgc

SEQ ID NO: 338376 - DNA, 75 bp, Artificial Sequence
  Synthetic
gcgctgcgccggacacctcggaccccccctccacccgaaacgcttgcgcgtttcggaccttcggcgtcggggggg

SEQ ID NO: 338377 - DNA, 75 bp, Artificial Sequence
  Synthetic
cccctccacccgaaacgcttgcgcgtttcggaccttcggcgtcgggggggtcgggggctttattaaacagactcc

SEQ ID NO: 338378 - DNA, 75 bp, Artificial Sequence
  Synthetic
tgaatcagtaacgaaagtgagtggggccagacttcgccataaggcctttatcttcttgccattggatagtgtagg

SEQ ID NO: 338379 - DNA, 75 bp, Artificial Sequence
  Synthetic
tcttcttgccattggatagtgtagggggtcgctccaagcgcggaccccatttttaggccttccggactacaaaaa

SEQ ID NO: 338380 - DNA, 75 bp, Artificial Sequence
  Synthetic
gccattttaagtaaggcggaagtttctccactatacaaaatggcggcggagcacttccggcttgcccaaaatgga

SEQ ID NO: 338381 - DNA, 75 bp, Artificial Sequence
  Synthetic
ctccactatacaaaatggcggcggagcacttccggcttgcccaaaatggaggccaacaacatccgggtcaaaagt

SEQ ID NO: 338382 - DNA, 75 bp, Artificial Sequence
  Synthetic
ggagggttgccgtataacccggaagtcaatcctctcacgtggcctgtcacgtgactgctacgtaacgacggccat

SEQ ID NO: 338383 - DNA, 75 bp, Artificial Sequence
  Synthetic
tacgtaacgacggccattttgttttacaaaatggcgtacttccttccgcttttttaaaaataacggcccggcgcg

SEQ ID NO: 338384 - DNA, 75 bp, Artificial Sequence
  Synthetic
cgaatggctgagttttccacgcccgtccgcagcgagaacgccacggagggagatcctcgcgtcccgagggcgggt

SEQ ID NO: 338385 - DNA, 75 bp, Artificial Sequence
  Synthetic
taatcatttggcaactactctgggtcgtcctccgcgtcctgggcccccaggcggaccccgcacgccgcaaataag

SEQ ID NO: 338386 - DNA, 75 bp, Artificial Sequence
  Synthetic
ccgccattttaggccctcgcgggcctccatagtcgcacatcagtgacgtcacggcagccatcttggctgtgacgt

SEQ ID NO: 338387 - DNA, 75 bp, Artificial Sequence
  Synthetic
ccagggggcgctacgcgccccccccccgcgcatgcgcgggtcccccccctcgggggggctccgcccccccggccc

SEQ ID NO: 338388 - DNA, 75 bp, Artificial Sequence
  Synthetic
ccgcgcatgcgcgggtcccccccctcgggggggctccgcccccccggccccccccgggctaaatacaccgcgcat

SEQ ID NO: 338389 - DNA, 75 bp, Artificial Sequence
  Synthetic
cctcgggggggctccgcccccccggccccccccgggctaaatacaccgcgcatgcgcggccacgcccccgccgcc

SEQ ID NO: 338390 - DNA, 75 bp, Artificial Sequence
  Synthetic
tctgtggcgaaaatacaaccgcccagaactatgccactcactcagacgatatgataagcaaaggaccgtacgggg

SEQ ID NO: 338391 - DNA, 75 bp, Artificial Sequence
  Synthetic
cgaatggctgagttttccacgcccgtccgcagcggcagcaccacggagggtgatccccgcgtcccgagggcgggt

SEQ ID NO: 338392 - DNA, 75 bp, Artificial Sequence
  Synthetic
gccgaaggtgagtttacacaccgaagtcaaggggcaattcgggcacgggactggccgggctatgggcaaggctct

SEQ ID NO: 338393 - DNA, 75 bp, Artificial Sequence
  Synthetic
aggaggcgccgctggagacgtctacgatggagaagacctagacgcgctgttcgccgccgtcgccgaggacgtaga

SEQ ID NO: 338394 - DNA, 75 bp, Artificial Sequence
  Synthetic
gcagagacacttggtacaagggaaacacatacaatacgaacatacaaaacttagcagagaaaacaagacaaaggt

SEQ ID NO: 338395 - DNA, 75 bp, Artificial Sequence
  Synthetic
accaaactaccccacaataatgtccacagacttatatgaataccactcaggcatatactccagcatatttctatc

SEQ ID NO: 338396 - DNA, 75 bp, Artificial Sequence
  Synthetic
gcctcctatcacccaggcatgctgatgcagcagagacacaagatcctgctacccagctacgaaactaaacccaag

SEQ ID NO: 338397 - DNA, 75 bp, Artificial Sequence
  Synthetic
gagtccagcagcgactcccgtgggtccactccagccaagagacgcaaagctccgaagaagagacgcaggcgcagg

SEQ ID NO: 338398 - DNA, 75 bp, Artificial Sequence
  Synthetic
gggggggtcgggagctttattaaacagactccgagttgccattggacactggagctgtgaatcagtaacgaaagt

SEQ ID NO: 338399 - DNA, 75 bp, Artificial Sequence
  Synthetic
gattccagccagagcagcacaagcaactccacctgcagctcgcagagcagcagcgaatcggagagcaactccgat

SEQ ID NO: 338400 - DNA, 75 bp, Artificial Sequence
  Synthetic
attttgtgcagcccgccaatttctgttcaaacagaccaatcaggaccttctatgtgcacttcctggggcgcgtct

SEQ ID NO: 338401 - DNA, 75 bp, Artificial Sequence
  Synthetic
gccgggggggcgccagcgccccccccccgcgcatgcgcgggtccccccccccacgggggctccgccccccggccc

SEQ ID NO: 338402 - DNA, 75 bp, Artificial Sequence
  Synthetic
ggcaacagcgatggtaccctcgcttagccactcagacgcgagtcatgcacgacatcaccatgacgggccccttct

SEQ ID NO: 338403 - DNA, 75 bp, Artificial Sequence
  Synthetic
actcaggccaatctccacctaaacccatatatatttacccagctgtaaagcaggcgtttatgtttgaccccccgg

SEQ ID NO: 338404 - DNA, 75 bp, Artificial Sequence
  Synthetic
tgctgtccgccatcttgtgacttccttccgctttttgtaaaaaaaagaggaagtgtgacgtagcggcgggggggc

SEQ ID NO: 338405 - DNA, 75 bp, Artificial Sequence
  Synthetic
cccccccccgcgcatgcgcgggtcccccccctcgggggggctccgcccccccggccccccccccgggctaaatac

SEQ ID NO: 338406 - DNA, 75 bp, Artificial Sequence
  Synthetic
ttcaaacaggccaatcagcgtctactacgtacacttcctggggtgtgtcctgccactgtatataaaccagagggg

SEQ ID NO: 338407 - DNA, 75 bp, Artificial Sequence
  Synthetic
cccgtccgcggcgagagcgcgagcgaagcgagcgatcgggcgtcccgagggcgggtgccggaggtgagtttacac

SEQ ID NO: 338408 - DNA, 75 bp, Artificial Sequence
  Synthetic
aagcgagcgatcgggcgtcccgagggcgggtgccggaggtgagtttacacaccgcagtcaaggggcaattcgggc

SEQ ID NO: 338409 - DNA, 75 bp, Artificial Sequence
  Synthetic
ccccccccctcgggggggctccgcccccccggccccccccccgggctaaatacaccgcgcatgcgcggccacgcc

SEQ ID NO: 338410 - DNA, 75 bp, Artificial Sequence
  Synthetic
ggctcttaaaaaattccccgttactgtgctccgccaggataccaagtcatgccgtggagaccgccggcgcactcg

SEQ ID NO: 338411 - DNA, 75 bp, Artificial Sequence
  Synthetic
gtgctccgccaggataccaagtcatgccgtggagaccgccggcgcactcggtgcctggtagagaaggccagttct

SEQ ID NO: 338412 - DNA, 75 bp, Artificial Sequence
  Synthetic
gagcatccaccacaccctcatacaacaatgaccccttccccacaatacctgttaaatcagagtttgcacagtgga

SEQ ID NO: 338413 - DNA, 75 bp, Artificial Sequence
  Synthetic
tgctttctgcggttgtgggggttttattgagcatcttaatagcattcatcctcgctttctcggggctggggggcc

SEQ ID NO: 338414 - DNA, 75 bp, Artificial Sequence
  Synthetic
attgagcatcttaatagcattcatcctcgctttctcggggctggggggccaccgccacctccgcctgccctaagg

SEQ ID NO: 338415 - DNA, 75 bp, Artificial Sequence
  Synthetic
ccggaggccctccgcagcacgccccgcccaaccctcctccggagggtgaccaccagccgccacggcgtggtggtg

SEQ ID NO: 338416 - DNA, 75 bp, Artificial Sequence
  Synthetic
gcccaaccctcctccggagggtgaccaccagccgccacggcgtggtggtggggccggtggcgccggagatggcca

SEQ ID NO: 338417 - DNA, 75 bp, Artificial Sequence
  Synthetic
gagtatggcccagaagatctagatttgctgttcgccgccgccgccgaggacgatatgtgagtaagaggcgccgct

SEQ ID NO: 338418 - DNA, 75 bp, Artificial Sequence
  Synthetic
tgctgttcgccgccgccgccgaggacgatatgtgagtaagaggcgccgcttcaggcgcagacgcagacgaagggg

SEQ ID NO: 338419 - DNA, 75 bp, Artificial Sequence
  Synthetic
aaaaagagacagactcttgttatcagacagtggcaaccggacgtggtccggttctgcaagataaatggatggcta

SEQ ID NO: 338420 - DNA, 75 bp, Artificial Sequence
  Synthetic
gacagtggcaaccggacgtggtccggttctgcaagataaatggatggctacctctaattgtctgtggctcaggga

SEQ ID NO: 338421 - DNA, 75 bp, Artificial Sequence
  Synthetic
ctcagaggacataactccaagaggagccccctatggaggcaacctcacacacataacatggtgcctagaggccat

SEQ ID NO: 338422 - DNA, 75 bp, Artificial Sequence
  Synthetic
gccccctatggaggcaacctcacacacataacatggtgcctagaggccatctaccaagagtttttaatgcacaga

SEQ ID NO: 338423 - DNA, 75 bp, Artificial Sequence
  Synthetic
acctagacctcatgagatacgtaggagtgagattcaaggcctacagacaccccacaacagactatataatctcct

SEQ ID NO: 338424 - DNA, 75 bp, Artificial Sequence
  Synthetic
agtgagattcaaggcctacagacaccccacaacagactatataatctcctacagcaaaacctcaccctttcaggt

SEQ ID NO: 338425 - DNA, 75 bp, Artificial Sequence
  Synthetic
acacaccggagtcaaggggcaattcgggctcgggactggccgggctatgggcaaggctcttaaaaatgcactttt

SEQ ID NO: 338426 - DNA, 75 bp, Artificial Sequence
  Synthetic
gggctcgggactggccgggctatgggcaaggctcttaaaaatgcacttttctaggatatccaggaagaaaaggct

SEQ ID NO: 338427 - DNA, 75 bp, Artificial Sequence
  Synthetic
cacccgctcttaatgcttctcagcaaacaccacatagtggtaaaaagcctacagactaagcccagaggcaaaccc

SEQ ID NO: 338428 - DNA, 75 bp, Artificial Sequence
  Synthetic
aacaccacatagtggtaaaaagcctacagactaagcccagaggcaaaccctatgttaaattcttctgcaagcctc

SEQ ID NO: 338429 - DNA, 75 bp, Artificial Sequence
  Synthetic
ccacagaaaactctcaaacttttaagaggtatgtggagtcctcccactgacgatgaacgtgtccgcgagcgaaaa

SEQ ID NO: 338430 - DNA, 75 bp, Artificial Sequence
  Synthetic
gaggtatgtggagtcctcccactgacgatgaacgtgtccgcgagcgaaaatggtttctcgcaactgtctattctc

SEQ ID NO: 338431 - DNA, 75 bp, Artificial Sequence
  Synthetic
ctttacaaaagactttgcaaaagtaccaatactcatgatgtgggccacagcctgtgaacccagaaacccatggct

SEQ ID NO: 338432 - DNA, 75 bp, Artificial Sequence
  Synthetic
ccaatactcatgatgtgggccacagcctgtgaacccagaaacccatggctcggagaaggcaccctctcgccctgc

SEQ ID NO: 338433 - DNA, 75 bp, Artificial Sequence
  Synthetic
tcctgtcggtcacctctgtcgcctggctactctctctaaccgtccggagaacccgggaccctccgggggacgtcg

SEQ ID NO: 338434 - DNA, 75 bp, Artificial Sequence
  Synthetic
gctactctctctaaccgtccggagaacccgggaccctccgggggacgtcgtgctccttcgatcggggtcctaccc

SEQ ID NO: 338435 - DNA, 75 bp, Artificial Sequence
  Synthetic
ccatatatacctcacttagcaacttaccagcaaaagtacaaatgtttgctacaggtacacaatcagactctctaa

SEQ ID NO: 338436 - DNA, 75 bp, Artificial Sequence
  Synthetic
accagcaaaagtacaaatgtttgctacaggtacacaatcagactctctaacaacatcctcaacaggattttataa

SEQ ID NO: 338437 - DNA, 75 bp, Artificial Sequence
  Synthetic
caggtgatcgagcaccatggcctatgggtggtggaggagacgccgcagaaggtggaagagatggaggagaaggcc

SEQ ID NO: 338438 - DNA, 75 bp, Artificial Sequence
  Synthetic
gggtggtggaggagacgccgcagaaggtggaagagatggaggagaaggcccaggtggagacgcccatggaggacc

SEQ ID NO: 338439 - DNA, 75 bp, Artificial Sequence
  Synthetic
acaacatcaaaagaatgggaatacacatacacaggcctaatggaaaaattctttaaacaagccacaaacaaacct

SEQ ID NO: 338440 - DNA, 75 bp, Artificial Sequence
  Synthetic
catacacaggcctaatggaaaaattctttaaacaagccacaaacaaaccttataactgggaaaactacggcacac

SEQ ID NO: 338441 - DNA, 75 bp, Artificial Sequence
  Synthetic
gtggacgccgcggaacagtaaggagacggaggcgcgggaggtggaggaggcgctataggaggtggaggagaaagg

SEQ ID NO: 338442 - DNA, 75 bp, Artificial Sequence
  Synthetic
acggaggcgcgggaggtggaggaggcgctataggaggtggaggagaaagggcagacgcaggagaaaaaagaaact

SEQ ID NO: 338443 - DNA, 75 bp, Artificial Sequence
  Synthetic
aacattttcaacacacagaagtacaagatatgaaacaattaaaaaagaataccaaaaagtataccccacactaac

SEQ ID NO: 338444 - DNA, 75 bp, Artificial Sequence
  Synthetic
agatatgaaacaattaaaaaagaataccaaaaagtataccccacactaacaacacaaacaccaacaaacttcttt

SEQ ID NO: 338445 - DNA, 75 bp, Artificial Sequence
  Synthetic
tataccagaaagtgcaacatagtaggctacatgccagtaatcatgtgtggagaaaacactctaataagaaactat

SEQ ID NO: 338446 - DNA, 75 bp, Artificial Sequence
  Synthetic
gctacatgccagtaatcatgtgtggagaaaacactctaataagaaactatgccacacacgcagacgactgctact

SEQ ID NO: 338447 - DNA, 75 bp, Artificial Sequence
  Synthetic
gcccatactacttaacaccatccaaaagagacatagactggcacacaccatacacatacacaagatacaacccac

SEQ ID NO: 338448 - DNA, 75 bp, Artificial Sequence
  Synthetic
aagagacatagactggcacacaccatacacatacacaagatacaacccactagcagacaaaggcctaggcaacat

SEQ ID NO: 338449 - DNA, 75 bp, Artificial Sequence
  Synthetic
ggccacccagaaattcacacccagaatcctgtacgatgactacaagaggtttatgaactactggacctcctcaaa

SEQ ID NO: 338450 - DNA, 75 bp, Artificial Sequence
  Synthetic
atcctgtacgatgactacaagaggtttatgaactactggacctcctcaaacgaggacctagacctctgtagatac

SEQ ID NO: 338451 - DNA, 75 bp, Artificial Sequence
  Synthetic
gatgaggccgcctacagcccaacacaaagcaaatgcatgcttaaagacctgccactattcatactattctatggc

SEQ ID NO: 338452 - DNA, 75 bp, Artificial Sequence
  Synthetic
aaagcaaatgcatgcttaaagacctgccactattcatactattctatggctacatagactgggtacaaaagagta

SEQ ID NO: 338453 - DNA, 75 bp, Artificial Sequence
  Synthetic
gacacccagatgtagactttatcatcttaataaacaccacacctccattcgtagatacagagatcacaggaccca

SEQ ID NO: 338454 - DNA, 75 bp, Artificial Sequence
  Synthetic
cttaataaacaccacacctccattcgtagatacagagatcacaggacccagcatacatccgggcatgatggccct

SEQ ID NO: 338455 - DNA, 75 bp, Artificial Sequence
  Synthetic
catgagactcatggttatatgtccatacacagagccacaactagtagacccccaagataaaactaagggctttgt

SEQ ID NO: 338456 - DNA, 75 bp, Artificial Sequence
  Synthetic
tacacagagccacaactagtagacccccaagataaaactaagggctttgtactatatggagacacatttgccaac

SEQ ID NO: 338457 - DNA, 75 bp, Artificial Sequence
  Synthetic
agcctaaagactagacctggcagaagacacatagtaaagattagagtgggggcccccaaactgtacgaggacaag

SEQ ID NO: 338458 - DNA, 75 bp, Artificial Sequence
  Synthetic
gacacatagtaaagattagagtgggggcccccaaactgtacgaggacaagtggtacccccagtcagaactctgtg

SEQ ID NO: 338459 - DNA, 75 bp, Artificial Sequence
  Synthetic
agatacccatctcgtggtttgtccgttggtaccccaactttgcacaccaaagggaagttttagaaagagtggttt

SEQ ID NO: 338460 - DNA, 75 bp, Artificial Sequence
  Synthetic
ttggtaccccaactttgcacaccaaagggaagttttagaaagagtggtttcctgtggaccgttcatggtcagaga

SEQ ID NO: 338461 - DNA, 75 bp, Artificial Sequence
  Synthetic
gaccgcagcggatatgcaatatccgttcggctcaccactaactgacactcctgttgtaaccttccaagtgttgcg

SEQ ID NO: 338462 - DNA, 75 bp, Artificial Sequence
  Synthetic
ttcggctcaccactaactgacactcctgttgtaaccttccaagtgttgcgcagcatgtacaacgacgccctcagc

SEQ ID NO: 338463 - DNA, 75 bp, Artificial Sequence
  Synthetic
acactaggctaccacttcctattcaaatggggcggatcccctctcccctctcaggctatcgacgacccgagccag

SEQ ID NO: 338464 - DNA, 75 bp, Artificial Sequence
  Synthetic
aatggggcggatcccctctcccctctcaggctatcgacgacccgagccagaagcccacccacgcgctacccgagc

SEQ ID NO: 338465 - DNA, 75 bp, Artificial Sequence
  Synthetic
caagcagtccaggccaaaaactttacaaagaaatatctacatatttaccatactacaacaccacagaaacaatag

SEQ ID NO: 338466 - DNA, 75 bp, Artificial Sequence
  Synthetic
caaagaaatatctacatatttaccatactacaacaccacagaaacaatagcacaactaaagagatatgtagaaaa

SEQ ID NO: 338467 - DNA, 75 bp, Artificial Sequence
  Synthetic
agtcagtgacccggcaaggctcggaccgaaaacaatttttcaccagtgggaccaaagacgtggactgtttacaaa

SEQ ID NO: 338468 - DNA, 75 bp, Artificial Sequence
  Synthetic
ccgaaaacaatttttcaccagtgggaccaaagacgtggactgtttacaaaaagaagtattaaaagaatgtcggaa

SEQ ID NO: 338469 - DNA, 75 bp, Artificial Sequence
  Synthetic
aacccgtggcaatcaaaatatgtaaacactactgccttcaccactgcactaaatgttacaactgaaaaaccatac

SEQ ID NO: 338470 - DNA, 75 bp, Artificial Sequence
  Synthetic
acactactgccttcaccactgcactaaatgttacaactgaaaaaccatacaccaccttctcagacagctggtaca

SEQ ID NO: 338471 - DNA, 75 bp, Artificial Sequence
  Synthetic
cgccaggtccttcaaagcgcccagctctcgacaccagacccgagggcctggccggagagcaaagaagcgcctacg

SEQ ID NO: 338472 - DNA, 75 bp, Artificial Sequence
  Synthetic
tctcgacaccagacccgagggcctggccggagagcaaagaagcgcctacgcttttctccgggctctccaagacag

SEQ ID NO: 338473 - DNA, 75 bp, Artificial Sequence
  Synthetic
cactgaagtgccacttgccgcagcaaaactctatcaaaaccaaacaaaaaagctgctgtctacaacatttacagg

SEQ ID NO: 338474 - DNA, 75 bp, Artificial Sequence
  Synthetic
aaactctatcaaaaccaaacaaaaaagctgctgtctacaacatttacaggagggtccgagtacctagaataccat

SEQ ID NO: 338475 - DNA, 75 bp, Artificial Sequence
  Synthetic
gaagcccctctcctcgaagaacaagcacaccaaaaagaaaaagaggagctactcctcaagcagccccagcagcaa

SEQ ID NO: 338476 - DNA, 75 bp, Artificial Sequence
  Synthetic
cacaccaaaaagaaaaagaggagctactcctcaagcagccccagcagcaaagacaacaccagcgagtcctcaaac

SEQ ID NO: 338477 - DNA, 75 bp, Artificial Sequence
  Synthetic
tatcagcaggccgatcctactttgaaacaaagggagcatacacagacatctgctacaacccctacacagacagag

SEQ ID NO: 338478 - DNA, 75 bp, Artificial Sequence
  Synthetic
aacaaagggagcatacacagacatctgctacaacccctacacagacagaggagagggcaacatggtgtggataga

SEQ ID NO: 338479 - DNA, 75 bp, Artificial Sequence
  Synthetic
cgtactcaaactgaggaggggtctccacatagaccccctccttacatagcccctccacctatagtggaggacctg

SEQ ID NO: 338480 - DNA, 75 bp, Artificial Sequence
  Synthetic
cacatagaccccctccttacatagcccctccacctatagtggaggacctgctttttcctaacacccaaaaaaaaa

SEQ ID NO: 338481 - DNA, 75 bp, Artificial Sequence
  Synthetic
tatgacaaaacccgcagcaaatgccttatagaaaagctacccctatgggcagcagtatacgggtacccagaatac

SEQ ID NO: 338482 - DNA, 75 bp, Artificial Sequence
  Synthetic
ttatagaaaagctacccctatgggcagcagtatacgggtacccagaatactgtgccaagagcaccggagactcaa

SEQ ID NO: 338483 - DNA, 75 bp, Artificial Sequence
  Synthetic
gacagaggcgcagctagctgcctgcttcgacaggcctatgcgtttcttcccctcagacctcccaacatacccgtg

SEQ ID NO: 338484 - DNA, 75 bp, Artificial Sequence
  Synthetic
ttcgacaggcctatgcgtttcttcccctcagacctcccaacatacccgtggctaccaaaaaagcccactacccaa

SEQ ID NO: 338485 - DNA, 75 bp, Artificial Sequence
  Synthetic
aataaggtgcccctacaccgtcccccagatgatagacaccagcgacgaactaaggggcttcatagtatacagctt

SEQ ID NO: 338486 - DNA, 75 bp, Artificial Sequence
  Synthetic
cagatgatagacaccagcgacgaactaaggggcttcatagtatacagctttaactttggcaggggcaaaatgccc

SEQ ID NO: 338487 - DNA, 75 bp, Artificial Sequence
  Synthetic
taaaagccccccaataaaatttcaaggccgtgggactttcacttgtcggtgtctgcttcttaaggttaccaagca

SEQ ID NO: 338488 - DNA, 75 bp, Artificial Sequence
  Synthetic
gaatgagagccaagtggtacccctgcctgtttcaccaaaaagaagttctagaagccttgggacagtcgggcccct

SEQ ID NO: 338489 - DNA, 75 bp, Artificial Sequence
  Synthetic
gtctgcttcttaaggttaccaagcactccgagcgtaagcgaggagtgcgacccccccccctgtggcaacttcctc

SEQ ID NO: 338490 - DNA, 75 bp, Artificial Sequence
  Synthetic
ctcgacccgaatcgcttgcgcgattcggacctgcggcctcgggggggtcgggggctttactaaacagactccgag

SEQ ID NO: 338491 - DNA, 75 bp, Artificial Sequence
  Synthetic
cccctgcaaagacacacacggttcctcgggccctagaaagcctcgctcaatacaaatcattgacccgaagtacaa

SEQ ID NO: 338492 - DNA, 75 bp, Artificial Sequence
  Synthetic
acttcgccatagggcctttaacttccgggtgcgtctgggggccgccattttagcttcggccgccattttaggccc

SEQ ID NO: 338493 - DNA, 75 bp, Artificial Sequence
  Synthetic
tgggatttcagacgtggcttctttggctcaaaagctattaaaagaatgcaacaacaaccaacagatgctgaactt

SEQ ID NO: 338494 - DNA, 75 bp, Artificial Sequence
  Synthetic
gctcaaaagctattaaaagaatgcaacaacaaccaacagatgctgaacttcttccaccaggccgcaagaggagca

SEQ ID NO: 338495 - DNA, 75 bp, Artificial Sequence
  Synthetic
cgggtgcgtctgggggccgccattttagcttcggccgccattttaggccctcgcgggcctacgtaggcgcgtttt

SEQ ID NO: 338496 - DNA, 75 bp, Artificial Sequence
  Synthetic
ttgtgacgttactctcacgtgatgggggcgtgctctaacccggaagcatcctcgaccacgtgactgtgacgtcac

SEQ ID NO: 338497 - DNA, 75 bp, Artificial Sequence
  Synthetic
cagccaagaaaagcaaaaagaaagcttacttttcaaacacctccagctccagcgacgaatacccccatgggaaag

SEQ ID NO: 338498 - DNA, 75 bp, Artificial Sequence
  Synthetic
ctcgcaggcctcgcagacagaggcagagagcgaaaaagagcaagagggcagtctctcccagcagctccgagagca

SEQ ID NO: 338499 - DNA, 75 bp, Artificial Sequence
  Synthetic
aagcagctcagggaaatgttcctacaactccacaaaatccaacaaaatcaacacgtcaaccctaccttattgcca

SEQ ID NO: 338500 - DNA, 75 bp, Artificial Sequence
  Synthetic
ccccccccgggggggctccgcccccccggccccccccgtgcttaatccaccgcgcatgcgcagccacgcccccgc

SEQ ID NO: 338501 - DNA, 75 bp, Artificial Sequence
  Synthetic
aactccacaaaatccaacaaaatcaacacgtcaaccctaccttattgccaagggatcaggctttaatctgctggt

SEQ ID NO: 338502 - DNA, 75 bp, Artificial Sequence
  Synthetic
ggagaccctaaaccatacaaaccctccagcaacgactggaaagaggagtacgaggccgctaagtattgggacagg

SEQ ID NO: 338503 - DNA, 75 bp, Artificial Sequence
  Synthetic
ccagcaacgactggaaagaggagtacgaggccgctaagtattgggacaggccccccagatctaaccttagagata

SEQ ID NO: 338504 - DNA, 75 bp, Artificial Sequence
  Synthetic
aagcaatccctacaaagtaaactttaaactaggcttccaataaagctaggccgtgggagtttcacttgtcggtgt

SEQ ID NO: 338505 - DNA, 75 bp, Artificial Sequence
  Synthetic
ccgagcgtaagcgaggagtgcgaccctcccccccggtagcaacttcttcggagtccggcgctacgccttcggctg

SEQ ID NO: 338506 - DNA, 75 bp, Artificial Sequence
  Synthetic
gagtccggcgctacgccttcggctgcgccggacacctcagaccccccctccacccgaaacgcttgcgcgtttcgg

SEQ ID NO: 338507 - DNA, 75 bp, Artificial Sequence
  Synthetic
ccattggacactggagctgtgaatcagtaacgaaagtgagtggggccagacttcgccataaggcctttatcttct

SEQ ID NO: 338508 - DNA, 75 bp, Artificial Sequence
  Synthetic
agtaacgaaagtgagtggggccagacttcgccataaggcctttatcttcttgccattggatggtggggagggtcg

SEQ ID NO: 338509 - DNA, 75 bp, Artificial Sequence
  Synthetic
gccttccggactacaaaaatggcggatttcgtgacgtcacggccgccattttaagtcagcgctggggaggcatga

SEQ ID NO: 338510 - DNA, 75 bp, Artificial Sequence
  Synthetic
atttcgtgacgtcacggccgccattttaagtcagcgctggggaggcatgactgtaagttcaaaggtcatcctcac

SEQ ID NO: 338511 - DNA, 75 bp, Artificial Sequence
  Synthetic
atttcttccgggtcaaaggtcacgcctacgtcatagatgacgtaggagggcgtactctgtaaacacggaagtagg

SEQ ID NO: 338512 - DNA, 75 bp, Artificial Sequence
  Synthetic
ctcaggccaatctccacctaaacccatatacatttacccagctgtaaagcaggtgtttatgtttgaccccccggg

SEQ ID NO: 338513 - DNA, 75 bp, Artificial Sequence
  Synthetic
aagccttagaacattcagacgtaaacagaaactgctacaaaaaactagacagcgcctggggagacactatatgga

SEQ ID NO: 338514 - DNA, 75 bp, Artificial Sequence
  Synthetic
aaggaggcgcggggggaggtggcgcagacgctacagaaaatggcgacggggcagacgcagacggactcacagaaa

SEQ ID NO: 338515 - DNA, 75 bp, Artificial Sequence
  Synthetic
aaacttatttaagaaaactgaactatacaacacctttcaaaccatagctcagcttaaagagacaggaaacatttc

SEQ ID NO: 338516 - DNA, 75 bp, Artificial Sequence
  Synthetic
tacaacacctttcaaaccatagctcagcttaaagagacaggaaacatttcaggcattagtcctaattggactgaa

SEQ ID NO: 338517 - DNA, 75 bp, Artificial Sequence
  Synthetic
aaacaggtgacaatgccactaacagtagagacacttggtataaaggaaatacatacaaccacaagatatgcgact

SEQ ID NO: 338518 - DNA, 75 bp, Artificial Sequence
  Synthetic
agcgacaactcagatgtggaatccaacacctcttccagcaactagtgaaaacccagcaaaacttgcatatcaacc

SEQ ID NO: 338519 - DNA, 75 bp, Artificial Sequence
  Synthetic
aaaaaacaaaagcaaatgcgagataatggacatgcccctgtgggcggcctgcacaggatacacagagttttgtgc

SEQ ID NO: 338520 - DNA, 75 bp, Artificial Sequence
  Synthetic
taaagggtcagcagctacgtcacaagtcacctgactggggaggggtcacaacccggaagccctcctcggtcacgt

SEQ ID NO: 338521 - DNA, 75 bp, Artificial Sequence
  Synthetic
tacgtcactaaccacgtgcgttccacagaccaaccctatactatgtcgtgcacttcctgggccgagtctacgtcc

SEQ ID NO: 338522 - DNA, 75 bp, Artificial Sequence
  Synthetic
cagaccaaccctatactatgtcgtgcacttcctgggccgagtctacgtcctcatataaatgactgcacttccgaa

SEQ ID NO: 338523 - DNA, 75 bp, Artificial Sequence
  Synthetic
cacttcctgggccgagtctacgtcctcatataaatgactgcacttccgaatggctgagtttatgctgcccgtccg

SEQ ID NO: 338524 - DNA, 75 bp, Artificial Sequence
  Synthetic
gggggggcgccagcgcccccccccgcgcatgcgcgggtccccccccccgcggggggctccgccccccggcccccc

SEQ ID NO: 338525 - DNA, 75 bp, Artificial Sequence
  Synthetic
aggtgagtttacacaccgcagtcaaggggcaattcgggctcgggactggccgggctatgggcaaggctcttaaaa

SEQ ID NO: 338526 - DNA, 75 bp, Artificial Sequence
  Synthetic
cagaaagaagagggcactgtcactgcacggcctgccagctacaaagaaaaaaccacctcctgatatgaactactg

SEQ ID NO: 338527 - DNA, 75 bp, Artificial Sequence
  Synthetic
cacggcctgccagctacaaagaaaaaaccacctcctgatatgaactactggaggccgcctgtgcacaatgtcccg

SEQ ID NO: 338528 - DNA, 75 bp, Artificial Sequence
  Synthetic
catattactgctctggctgagagatacggccaccctgggggaccgcgcgcgcctggggcaccgggaatagggggc

SEQ ID NO: 338529 - DNA, 75 bp, Artificial Sequence
  Synthetic
gagcccgccacccggcggccgctccggagcccccagcaggtaaccagcctccggccctgccatggcatggggatg

SEQ ID NO: 338530 - DNA, 75 bp, Artificial Sequence
  Synthetic
ggagcccccagcaggtaaccagcctccggccctgccatggcatggggatggtggaaacgaaggcgcaagtggtgg

SEQ ID NO: 338531 - DNA, 75 bp, Artificial Sequence
  Synthetic
gacttcgcaaacgacgggctagacgagctggtcgccgccctcgacgaagaagagtaaggagacggagggcttgga

SEQ ID NO: 338532 - DNA, 75 bp, Artificial Sequence
  Synthetic
agctggtcgccgccctcgacgaagaagagtaaggagacggagggcttggaggcgtgggcgacgaaagagacggac

SEQ ID NO: 338533 - DNA, 75 bp, Artificial Sequence
  Synthetic
ggtaggagacacagaaccagacttataataagacaatggcagccagaaatagtgagaaagtgcctcataataggc

SEQ ID NO: 338534 - DNA, 75 bp, Artificial Sequence
  Synthetic
taataagacaatggcagccagaaatagtgagaaagtgcctcataataggctactttcccatgattatatgtggcc

SEQ ID NO: 338535 - DNA, 75 bp, Artificial Sequence
  Synthetic
cagccacctagaggaccgtgtagtaaaacaggccttcggtgggggacacgcgactaccaggtggtctctaaaagt

SEQ ID NO: 338536 - DNA, 75 bp, Artificial Sequence
  Synthetic
aaacaggccttcggtgggggacacgcgactaccaggtggtctctaaaagtactgtacgaggagaacctcagacac

SEQ ID NO: 338537 - DNA, 75 bp, Artificial Sequence
  Synthetic
gagacttagaactggccaggtacctcaaagtgacgtggaccttttacagacaccaagatgtagactttataatat

SEQ ID NO: 338538 - DNA, 75 bp, Artificial Sequence
  Synthetic
ctacgcgcgcgcgccgggggggctctgcccccccgcgcatgcgcgcgggtcccccccccgcggggggctccgccc

SEQ ID NO: 338539 - DNA, 75 bp, Artificial Sequence
  Synthetic
attttatgcagcccgccaatttctctttcaaacagaccaatcacctactacttcgtacacttcctggggcgtgtc

SEQ ID NO: 338540 - DNA, 75 bp, Artificial Sequence
  Synthetic
caaagtgacgtggaccttttacagacaccaagatgtagactttataatatactttaacagaaagagccccatggg

SEQ ID NO: 338541 - DNA, 75 bp, Artificial Sequence
  Synthetic
atgcatccgggagccctaatgctcagcaaacacaagatactagtaaaaagctttaaaacaaaacccaagggcaaa

SEQ ID NO: 338542 - DNA, 75 bp, Artificial Sequence
  Synthetic
gtgacgaatggtagagttttttctgcccgtccgcggcgaggacgcgagcgcagcgagcggccgagcgtcccgagg

SEQ ID NO: 338543 - DNA, 75 bp, Artificial Sequence
  Synthetic
gcaaacacaagatactagtaaaaagctttaaaacaaaacccaagggcaaagcaacagttaaagtgactattaagc

SEQ ID NO: 338544 - DNA, 75 bp, Artificial Sequence
  Synthetic
gcgggtgccggaggtgagtttacacaccgcagtcaaggggcaattcgggctcgggactggccgggctatgggcaa

SEQ ID NO: 338545 - DNA, 75 bp, Artificial Sequence
  Synthetic
gtactttcaaaaggacatttgcgacatgacactgttaaacctcaatgccgttgcggctgacttgcggtttccgtt

SEQ ID NO: 338546 - DNA, 75 bp, Artificial Sequence
  Synthetic
tcgggactggccgggctatgggcaaggctcttaaaaaattcccccgctctgttctccgccaggacattaaaacat

SEQ ID NO: 338547 - DNA, 75 bp, Artificial Sequence
  Synthetic
atgacactgttaaacctcaatgccgttgcggctgacttgcggtttccgttctgctcaccacaaactgacaaccct

SEQ ID NO: 338548 - DNA, 75 bp, Artificial Sequence
  Synthetic
ttactgcaaagagaagaggcctggtactcagcttttcttagctcgcattctacattttgcggttgtactgaccct

SEQ ID NO: 338549 - DNA, 75 bp, Artificial Sequence
  Synthetic
cagtgtataacaacttcctctctataactgacaatagactaacaccagtcacagatgatggccaggcttattata

SEQ ID NO: 338550 - DNA, 75 bp, Artificial Sequence
  Synthetic
actcagcttttcttagctcgcattctacattttgcggttgtactgaccctctgctgcatattactctcattgctg

SEQ ID NO: 338551 - DNA, 75 bp, Artificial Sequence
  Synthetic
aactgacaatagactaacaccagtcacagatgatggccaggcttattataaagcttttctagacgctgcatttac

SEQ ID NO: 338552 - DNA, 75 bp, Artificial Sequence
  Synthetic
cacccgccaaccggagacccctcctaacggcctcagggggctgccggcactgccagcaccccctgaaccaccagc

SEQ ID NO: 338553 - DNA, 75 bp, Artificial Sequence
  Synthetic
aatacgtttagaacaatatctaacttttcccacccacaactagaacttccaactaaaaccaccaacacatcccaa

SEQ ID NO: 338554 - DNA, 75 bp, Artificial Sequence
  Synthetic
aacggcctcagggggctgccggcactgccagcaccccctgaaccaccagcaccgccaccacggcctggggatggt

SEQ ID NO: 338555 - DNA, 75 bp, Artificial Sequence
  Synthetic
tttcccacccacaactagaacttccaactaaaaccaccaacacatcccaagatcaatactttaacactctagatg

SEQ ID NO: 338556 - DNA, 75 bp, Artificial Sequence
  Synthetic
gagaaggagaaggtgggcgatacgcagaagaagacctagaagaactgttcgccgccgcggcagaagacgatatgt

SEQ ID NO: 338557 - DNA, 75 bp, Artificial Sequence
  Synthetic
acacacacaaaatataaaacctgaccaaaaccttgataaatgcaaagaaatacttacaaacaacatgaaaaactg

SEQ ID NO: 338558 - DNA, 75 bp, Artificial Sequence
  Synthetic
agaagaagacctagaagaactgttcgccgccgcggcagaagacgatatgtgagtagatggccgcgccgccgatac

SEQ ID NO: 338559 - DNA, 75 bp, Artificial Sequence
  Synthetic
caaaaccttgataaatgcaaagaaatacttacaaacaacatgaaaaactggcataaaaaagtaaagtcagaaaac

SEQ ID NO: 338560 - DNA, 75 bp, Artificial Sequence
  Synthetic
gtagggggggacgcaaaaggagacacagacagactcttatactcagacagtggcaaccagatgttatgaaaaaat

SEQ ID NO: 338561 - DNA, 75 bp, Artificial Sequence
  Synthetic
ttgcccacaatgtaggcatattcagcagctcattcctatccgcaggcagactagcaccagaagttccaggcctgt

SEQ ID NO: 338562 - DNA, 75 bp, Artificial Sequence
  Synthetic
cagacagactcttatactcagacagtggcaaccagatgttatgaaaaaatgttttattactggctggatgcccct

SEQ ID NO: 338563 - DNA, 75 bp, Artificial Sequence
  Synthetic
cagctcattcctatccgcaggcagactagcaccagaagttccaggcctgtacacagatgttatttacaacccata

SEQ ID NO: 338564 - DNA, 75 bp, Artificial Sequence
  Synthetic
caatttaactttataacccatgaagacgatgtgccaccaaaaggagcctcctatggaggcaacctcactaacctc

SEQ ID NO: 338565 - DNA, 75 bp, Artificial Sequence
  Synthetic
ctatgggtggattactgtagcaaaggagacaacctatacaaagaaggccaaagcaagtgtctacttgccaaccta

SEQ ID NO: 338566 - DNA, 75 bp, Artificial Sequence
  Synthetic
acgatgtgccaccaaaaggagcctcctatggaggcaacctcactaacctcaccttcactctagaaggactgtatg

SEQ ID NO: 338567 - DNA, 75 bp, Artificial Sequence
  Synthetic
gagacaacctatacaaagaaggccaaagcaagtgtctacttgccaacctacccctctggatggccacaaacggtt

SEQ ID NO: 338568 - DNA, 75 bp, Artificial Sequence
  Synthetic
gtggtccagatcaaactttgatctagacctcagcagatacctctacactataataaagctatacagacacgagtc

SEQ ID NO: 338569 - DNA, 75 bp, Artificial Sequence
  Synthetic
agataactgggttataaacactcaagccagagtactcatggtatgtccctacacttacccaaaactataccatga

SEQ ID NO: 338570 - DNA, 75 bp, Artificial Sequence
  Synthetic
gacctcagcagatacctctacactataataaagctatacagacacgagtctgtagactacatagtcacctacaac

SEQ ID NO: 338571 - DNA, 75 bp, Artificial Sequence
  Synthetic
gccagagtactcatggtatgtccctacacttacccaaaactataccatgaaatacagccattatatggctttgta

SEQ ID NO: 338572 - DNA, 75 bp, Artificial Sequence
  Synthetic
cactcagctacatgaacacacaccctatgctaatgctcctaaacaagcaccacgtagtggtgccaagcccaaaaa

SEQ ID NO: 338573 - DNA, 75 bp, Artificial Sequence
  Synthetic
gaaaaatgccaaacggggccacatacataccctttaagtttagaaacaagtggtatccaaccatatacatgcagc

SEQ ID NO: 338574 - DNA, 75 bp, Artificial Sequence
  Synthetic
tatgctaatgctcctaaacaagcaccacgtagtggtgccaagcccaaaaacaaagcccaaaggcaagagggccat

SEQ ID NO: 338575 - DNA, 75 bp, Artificial Sequence
  Synthetic
ctaatgctaaacaaatggtactttgcaagagacacgtgtagaataggcctctttcagctctatgccacaggggct

SEQ ID NO: 338576 - DNA, 75 bp, Artificial Sequence
  Synthetic
atcgggcccctttgcacttaaacaacagatacccagcgccacacttactgccaaatacaaattcaaattcttatt

SEQ ID NO: 338577 - DNA, 75 bp, Artificial Sequence
  Synthetic
caagagacacgtgtagaataggcctctttcagctctatgccacaggggctaacctaacaaacccctggctcaggt

SEQ ID NO: 338578 - DNA, 75 bp, Artificial Sequence
  Synthetic
attctatgtaattaaaaactccatatatcaagacgcctttgataacctggcagacacagaacatacaaaccaaag

SEQ ID NO: 338579 - DNA, 75 bp, Artificial Sequence
  Synthetic
tatcaagacgcctttgataacctggcagacacagaacatacaaaccaaagaaaaaatgtatttgaaaacaaacta

SEQ ID NO: 338580 - DNA, 75 bp, Artificial Sequence
  Synthetic
cagacgtggctactatagcacaaagagtattaaacgaatgtcagaacacgaagaaccttctgagtttattttccc

SEQ ID NO: 338581 - DNA, 75 bp, Artificial Sequence
  Synthetic
acaactggcaatacacatacacatccctcatgaaaaacatatactttaaaacaaaacaagaagcagaaaaccaaa

SEQ ID NO: 338582 - DNA, 75 bp, Artificial Sequence
  Synthetic
cctcatgaaaaacatatactttaaaacaaaacaagaagcagaaaaccaaacaatgagtagcacatacaactttga

SEQ ID NO: 338583 - DNA, 75 bp, Artificial Sequence
  Synthetic
agtattaaacgaatgtcagaacacgaagaaccttctgagtttattttcccaggtcccaaaaaacccagggtcgac

SEQ ID NO: 338584 - DNA, 75 bp, Artificial Sequence
  Synthetic
ggccctccgattcactccaaagagaatcgaggccgtgggagaccagcgaagaagagagcgaagcagaagtccagc

SEQ ID NO: 338585 - DNA, 75 bp, Artificial Sequence
  Synthetic
gtaagaactaaatggataaaaatagctgaagatggctataaactagtatcaaaagaatacaaagaaatatacatc

SEQ ID NO: 338586 - DNA, 75 bp, Artificial Sequence
  Synthetic
ctgaagatggctataaactagtatcaaaagaatacaaagaaatatacatcagtacagccacataccctccacaat

SEQ ID NO: 338587 - DNA, 75 bp, Artificial Sequence
  Synthetic
atcgaggccgtgggagaccagcgaagaagagagcgaagcagaagtccagcaagaagagacggaggaggtgcccct

SEQ ID NO: 338588 - DNA, 75 bp, Artificial Sequence
  Synthetic
agagagcagcagcaactccgaaagggcctccagtgcgtcttccagcagctaataaagacgcagcagggggttcac

SEQ ID NO: 338589 - DNA, 75 bp, Artificial Sequence
  Synthetic
tgactatggcatttatagtccttactttttaacaccccaaagatacagcccccaatggcacacagcatggacata

SEQ ID NO: 338590 - DNA, 75 bp, Artificial Sequence
  Synthetic
tttttaacaccccaaagatacagcccccaatggcacacagcatggacatatgtcagatacaacccactaacagac

SEQ ID NO: 338591 - DNA, 75 bp, Artificial Sequence
  Synthetic
gcctccagtgcgtcttccagcagctaataaagacgcagcagggggttcacatagacccatccctactgtaggccc

SEQ ID NO: 338592 - DNA, 75 bp, Artificial Sequence
  Synthetic
aagcctaaaccccctccatcggccggagactgggccatggagtacctagcttgcaagatattcaacaggccgccc

SEQ ID NO: 338593 - DNA, 75 bp, Artificial Sequence
  Synthetic
ttcagtggtgctcagaaaaaaacagctcatacaacagcacaaaaagcaagtgcatgctacaagacatgccccttt

SEQ ID NO: 338594 - DNA, 75 bp, Artificial Sequence
  Synthetic
ctcatacaacagcacaaaaagcaagtgcatgctacaagacatgcccctttttatgctaacctatgggtacctaga

SEQ ID NO: 338595 - DNA, 75 bp, Artificial Sequence
  Synthetic
cgcactcaccttacagaccctcctttctacccctactgcaaaaacaattacaatgtaacctttcagctcaactac

SEQ ID NO: 338596 - DNA, 75 bp, Artificial Sequence
  Synthetic
aaatcagcctggacagacatgagagtctgtatcagaagcccatacacagaaccacagcttacaggcaacacagat

SEQ ID NO: 338597 - DNA, 75 bp, Artificial Sequence
  Synthetic
aggccgtgggagtttcacttgtcggtgtctacctctaaaggtcactaagcactccgagcgccagcgaggagtgcg

SEQ ID NO: 338598 - DNA, 75 bp, Artificial Sequence
  Synthetic
tctgtatcagaagcccatacacagaaccacagcttacaggcaacacagatgatattagttttgttataatatcag

SEQ ID NO: 338599 - DNA, 75 bp, Artificial Sequence
  Synthetic
ctacctagctccacacatacccgttagtctgtggtttaagtggtaccccatgatattacaccagaaggcagcttt

SEQ ID NO: 338600 - DNA, 75 bp, Artificial Sequence
  Synthetic
agtctgtggtttaagtggtaccccatgatattacaccagaaggcagctttagaaaccatagtttcctgtggaccg

SEQ ID NO: 338601 - DNA, 75 bp, Artificial Sequence
  Synthetic
actcttgggacataaccgcaggttacaaagcagtttttaagtggggtgggtcccctctgcctccacagcctatcg

SEQ ID NO: 338602 - DNA, 75 bp, Artificial Sequence
  Synthetic
caaagcagtttttaagtggggtgggtcccctctgcctccacagcctatcgacgacccctaccaaaaacccaccca

SEQ ID NO: 338603 - DNA, 75 bp, Artificial Sequence
  Synthetic
aatcagtaacgaaagtgagtggggccagactttgccataaggcctttatcttcttgccatttgtccgtgtggggg

SEQ ID NO: 338604 - DNA, 75 bp, Artificial Sequence
  Synthetic
taggccttccgaactacaaaaaccgccatatttgtgacgtcacagccgccattttaagtaagcatggcgggcggt

SEQ ID NO: 338605 - DNA, 75 bp, Artificial Sequence
  Synthetic
cctccaagactacaaattgcagacccgaaaatcctcggaccgtcgacagtcttccacacatgggacatcagacgt

SEQ ID NO: 338606 - DNA, 75 bp, Artificial Sequence
  Synthetic
cgaaaatcctcggaccgtcgacagtcttccacacatgggacatcagacgtggcctctttagcacagcaagtctta

SEQ ID NO: 338607 - DNA, 75 bp, Artificial Sequence
  Synthetic
ccatatttgtgacgtcacagccgccattttaagtaagcatggcgggcggtgatgtcaaatgttaaaggtcacagc

SEQ ID NO: 338608 - DNA, 75 bp, Artificial Sequence
  Synthetic
acttccgcttccgggtcgccgccatatttgatcacgtgactgcctacgtcacggccgccattttagtccacaaaa

SEQ ID NO: 338609 - DNA, 75 bp, Artificial Sequence
  Synthetic
tgatgaccttttttcaacaggcgtcgcatccaaaagaccccgattcgacactccagtccaagggcagctcgaaag

SEQ ID NO: 338610 - DNA, 75 bp, Artificial Sequence
  Synthetic
gcatccaaaagaccccgattcgacactccagtccaagggcagctcgaaagccaagaagaagaaagctatcgttta

SEQ ID NO: 338611 - DNA, 75 bp, Artificial Sequence
  Synthetic
tagtccacaaaatggccgacttccttcctctttttgcacaaaaaagcggaagtgccgccgcgccggcggggggcg

SEQ ID NO: 338612 - DNA, 75 bp, Artificial Sequence
  Synthetic
agacaagcagctcggaagaggagcagccacaaaaccaagagatccaagaaaaactactcctccagctccagcagc

SEQ ID NO: 338613 - DNA, 75 bp, Artificial Sequence
  Synthetic
gccacaaaaccaagagatccaagaaaaactactcctccagctccagcagcagcgacaacagcagcgactcctcgc

SEQ ID NO: 338614 - DNA, 75 bp, Artificial Sequence
  Synthetic
gatgtcctccgactccgaaaaggagtccactgggacccggtccttacatagcacctccagaacctatcccagacc

SEQ ID NO: 338615 - DNA, 75 bp, Artificial Sequence
  Synthetic
tccactgggacccggtccttacatagcacctccagaacctatcccagaccttttgttccccagtactaaaaaaaa

SEQ ID NO: 338616 - DNA, 75 bp, Artificial Sequence
  Synthetic
gagaacgaggctcaaatagcagggtggttagacaggcctatgaggctgtatcctggggacccccccttctaccct

SEQ ID NO: 338617 - DNA, 75 bp, Artificial Sequence
  Synthetic
ggttagacaggcctatgaggctgtatcctggggacccccccttctacccttggctaccccgaaagccacctaccc

SEQ ID NO: 338618 - DNA, 75 bp, Artificial Sequence
  Synthetic
aataaagctagatgattaacttgcaaggccgtgggagtttcacttgtcggtgtctacctctaaaggtcactaagc

SEQ ID NO: 338619 - DNA, 75 bp, Artificial Sequence
  Synthetic
accctcctgcccggtagcaacttcctcggggtccggcgctacgcgcttcgcgctgcgccggacgcctcggacccc

SEQ ID NO: 338620 - DNA, 75 bp, Artificial Sequence
  Synthetic
gtcagaccacttcgggctcgcgggggtcggggggctttactaacagactccgagtcgctcttggactctgagggg

SEQ ID NO: 338621 - DNA, 75 bp, Artificial Sequence
  Synthetic
cgagtcgctcttggactctgagggggcatacagcaacgaaagtgagtggggccagacttcgccatagggccttta

SEQ ID NO: 338622 - DNA, 75 bp, Artificial Sequence
  Synthetic
cattttagcttcggccgccattttaggccctcgcgggcctccgtaggcgcgttttaatgacgtcacggcagccat

SEQ ID NO: 338623 - DNA, 75 bp, Artificial Sequence
  Synthetic
gttttaatgacgtcacggcagccattttgactgtgacgtcaaagtcacgtggggagggcggcgtgtaacccggaa

SEQ ID NO: 338624 - DNA, 75 bp, Artificial Sequence
  Synthetic
tttcaaaaaaaaagaggaagtatgacgtggcggcgggggggcggcgcgcttcgcgcgccgcccactagggggcgt

SEQ ID NO: 338625 - DNA, 75 bp, Artificial Sequence
  Synthetic
cggggccccccccccgggggggctccgcccccccggccccccccccgtccttaatccaccgcgcatgcgcggcca

SEQ ID NO: 338626 - DNA, 75 bp, Artificial Sequence
  Synthetic
cccgaagatcgtcactaaccacgtgactcccgcaggccaaccacagtgtacgtgattcacttcctgggcatggtc

SEQ ID NO: 338627 - DNA, 75 bp, Artificial Sequence
  Synthetic
actcccgcaggccaaccacagtgtacgtgattcacttcctgggcatggtctatgtggtgatataaagaacagcac

SEQ ID NO: 338628 - DNA, 75 bp, Artificial Sequence
  Synthetic
cgtgattcacttcctgggcatggtctatgtggtgatataaagaacagcacttccgaatggctgagttttccacgc

SEQ ID NO: 338629 - DNA, 75 bp, Artificial Sequence
  Synthetic
gcagtcaaggggcaattcgggctcgggactggccgggccctgggcaaggctcttaaaaatgcacttttctaaaat

SEQ ID NO: 338630 - DNA, 75 bp, Artificial Sequence
  Synthetic
ctgcaaactgtgccgcttgcaaagaaccaacggactaccatgagctggtccagaccctcacaaaatgttcctatt

SEQ ID NO: 338631 - DNA, 75 bp, Artificial Sequence
  Synthetic
accaacggactaccatgagctggtccagaccctcacaaaatgttcctatttgtgaacaaaactggtttgagtcct

SEQ ID NO: 338632 - DNA, 75 bp, Artificial Sequence
  Synthetic
tggctgtaataatcctgttattcattttaataacattgctactcgctttaactatctgcctactgccaatccgcc

SEQ ID NO: 338633 - DNA, 75 bp, Artificial Sequence
  Synthetic
gccgggggggcgccagcgcccccccccccgcgcatgcacgggtccccccccccacggggggctccgccccccggc

SEQ ID NO: 338634 - DNA, 75 bp, Artificial Sequence
  Synthetic
tttaataacattgctactcgctttaactatctgcctactgccaatccgcctgtgggacccccccaaccgcccaca

SEQ ID NO: 338635 - DNA, 75 bp, Artificial Sequence
  Synthetic
ttcccgctctccccgcgcctcccgctgatccacaagcaccatggcctggggctggtggctcaagcggtggaggag

SEQ ID NO: 338636 - DNA, 75 bp, Artificial Sequence
  Synthetic
tgatccacaagcaccatggcctggggctggtggctcaagcggtggaggagaagaaagaaaccagcgtggaagaag

SEQ ID NO: 338637 - DNA, 75 bp, Artificial Sequence
  Synthetic
tacaacacctttcaaaccatagctcagcttaaagagacaggaacaatttcaggcatgcaaccttcttggactgaa

SEQ ID NO: 338638 - DNA, 75 bp, Artificial Sequence
  Synthetic
agcttaaagagacaggaacaatttcaggcatgcaaccttcttggactgaagtccagaattcaaaaacacttaatg

SEQ ID NO: 338639 - DNA, 75 bp, Artificial Sequence
  Synthetic
ttcgacgcagaagacctaaacgcacttatggccgccgtcgaagaagacgaacagtaaggaggcgccgcgttagac

SEQ ID NO: 338640 - DNA, 75 bp, Artificial Sequence
  Synthetic
ttatggccgccgtcgaagaagacgaacagtaaggaggcgccgcgttagacgactaaggaggagggggtgggctag

SEQ ID NO: 338641 - DNA, 75 bp, Artificial Sequence
  Synthetic
tagagacacttggtataaaggaaatacatacaacgacaagatacaccagttagcagaaaaaaccagaaagagatt

SEQ ID NO: 338642 - DNA, 75 bp, Artificial Sequence
  Synthetic
acatacaacgacaagatacaccagttagcagaaaaaaccagaaagagatttaaaaatgcaacaaaagcagcacta

SEQ ID NO: 338643 - DNA, 75 bp, Artificial Sequence
  Synthetic
agaaagaaaaagctagtactgactcagtggaacccccaagacgtcaggagatgcacaataaggggcataataccc

SEQ ID NO: 338644 - DNA, 75 bp, Artificial Sequence
  Synthetic
agtggaacccccaagacgtcaggagatgcacaataaggggcataataccccttatcatgtgcggtgcaaacactg

SEQ ID NO: 338645 - DNA, 75 bp, Artificial Sequence
  Synthetic
cgatgacagcactccccagccagaaaagttcggagggggcatgagcacagttacattcagcctgtttgtcttata

SEQ ID NO: 338646 - DNA, 75 bp, Artificial Sequence
  Synthetic
aagttcggagggggcatgagcacagttacattcagcctgtttgtcttatatgaccagtacaccagacacctaaac

SEQ ID NO: 338647 - DNA, 75 bp, Artificial Sequence
  Synthetic
tagacctagccagatacaaaggctgtaaatttaaattctacagagacacaaacacagacttcatagtcacctatg

SEQ ID NO: 338648 - DNA, 75 bp, Artificial Sequence
  Synthetic
taaatttaaattctacagagacacaaacacagacttcatagtcacctatgacataaatccacccatgaaaaacac

SEQ ID NO: 338649 - DNA, 75 bp, Artificial Sequence
  Synthetic
cagctccaacgtgcccataagaatgagagccaagtggtacgtgaacatattccaccaaaaagaagtattggagag

SEQ ID NO: 338650 - DNA, 75 bp, Artificial Sequence
  Synthetic
ccaggcatgctcatgcaacaaaaaagaaagatactggtgcccagctgggacacctatcccagaggcagaaaattt

SEQ ID NO: 338651 - DNA, 75 bp, Artificial Sequence
  Synthetic
gaaagatactggtgcccagctgggacacctatcccagaggcagaaaatttgttttagctaaaataccacccccca

SEQ ID NO: 338652 - DNA, 75 bp, Artificial Sequence
  Synthetic
tcagccagacttatgcaaagttcctcttgtaactttgcggtcaactgccgctgacctcaaacatccgttctgctc

SEQ ID NO: 338653 - DNA, 75 bp, Artificial Sequence
  Synthetic
cttgtaactttgcggtcaactgccgctgacctcaaacatccgttctgctcaccacaaacgaacaacccttgcacc

SEQ ID NO: 338654 - DNA, 75 bp, Artificial Sequence
  Synthetic
ataaccacatgataggcttcccctttaactataatccacaagattccagtcaaacagaaaaactaacaacatttg

SEQ ID NO: 338655 - DNA, 75 bp, Artificial Sequence
  Synthetic
taactataatccacaagattccagtcaaacagaaaaactaacaacatttgaaaaatggctatactcaaccagcac

SEQ ID NO: 338656 - DNA, 75 bp, Artificial Sequence
  Synthetic
gtcacaaaatggcggacaacttccgcttttttaaaaaaaggcgcgaaaaaacggcggcggcggcgcgcgcgctgc

SEQ ID NO: 338657 - DNA, 75 bp, Artificial Sequence
  Synthetic
gccaacctgagacccagacagtacaatgcagatggcagttctaacagccaatatgcacagctacaacccacgtgg

SEQ ID NO: 338658 - DNA, 75 bp, Artificial Sequence
  Synthetic
atgcagatggcagttctaacagccaatatgcacagctacaacccacgtggaccagcacaatatatgccaaaaaga

SEQ ID NO: 338659 - DNA, 75 bp, Artificial Sequence
  Synthetic
ctacaacttttcaggtgacaaaggctatacatatgttacacaaattagacagtggtactggactcaactaacatc

SEQ ID NO: 338660 - DNA, 75 bp, Artificial Sequence
  Synthetic
tatacatatgttacacaaattagacagtggtactggactcaactaacatcctggacacaaacagtaccccacata

SEQ ID NO: 338661 - DNA, 75 bp, Artificial Sequence
  Synthetic
acccagagttcgaataccacgcaggctggtactcaaacatatttataggccctaacagatttaacatacagttta

SEQ ID NO: 338662 - DNA, 75 bp, Artificial Sequence
  Synthetic
ctggtactcaaacatatttataggccctaacagatttaacatacagtttagagcagcttacatggatgttaccta

SEQ ID NO: 338663 - DNA, 75 bp, Artificial Sequence
  Synthetic
ctaaacagagtatggttccagtacagcacaaaacccactacacagtttgtagaaaagcaggccaaatgcctgctc

SEQ ID NO: 338664 - DNA, 75 bp, Artificial Sequence
  Synthetic
gcacaaaacccactacacagtttgtagaaaagcaggccaaatgcctgctccaaaacctacctttgtggagcatgc

SEQ ID NO: 338665 - DNA, 75 bp, Artificial Sequence
  Synthetic
gagtcagctaggcccctttcaagaccacgaaacagtaggcctagtaatagtacagtgtccatacacagtaccccc

SEQ ID NO: 338666 - DNA, 75 bp, Artificial Sequence
  Synthetic
cacgaaacagtaggcctagtaatagtacagtgtccatacacagtaccccccatgtatgacaaagacaatccagac

SEQ ID NO: 338667 - DNA, 75 bp, Artificial Sequence
  Synthetic
actttggcaacggaaagctaggcaacggactaggccagatacccagatactggcatcagagatggtaccccatct

SEQ ID NO: 338668 - DNA, 75 bp, Artificial Sequence
  Synthetic
cggactaggccagatacccagatactggcatcagagatggtaccccatcttaaagagacagaaacaagtaatgaa

SEQ ID NO: 338669 - DNA, 75 bp, Artificial Sequence
  Synthetic
gcatacagagacgagagactgcaagctgacttgactgcaggatactcctttagatttaactggggtggtgactta

SEQ ID NO: 338670 - DNA, 75 bp, Artificial Sequence
  Synthetic
ctcccacccaaccagagtctacttcgtgcacttcctgggaggagtcatccgcctaatataagtagctgcacttcc

SEQ ID NO: 338671 - DNA, 75 bp, Artificial Sequence
  Synthetic
ctgacttgactgcaggatactcctttagatttaactggggtggtgacttaatctaccaccaggttgtcaaaaacc

SEQ ID NO: 338672 - DNA, 75 bp, Artificial Sequence
  Synthetic
tgctacgtcactaaccacgtggcccctcccacccaaccagagtctacttcgtgcacttcctgggaggagtcatcc

SEQ ID NO: 338673 - DNA, 75 bp, Artificial Sequence
  Synthetic
ttccgactccagtagattcaagcgggacgtacaagttgttagcccgctcaccatgggacccagactcatcttcca

SEQ ID NO: 338674 - DNA, 75 bp, Artificial Sequence
  Synthetic
gacgtacaagttgttagcccgctcaccatgggacccagactcatcttccactcgttcgaccaaagacgggggctc

SEQ ID NO: 338675 - DNA, 75 bp, Artificial Sequence
  Synthetic
tcaaggggcaattcgggctcgggactggccgggctatgggcaagactcttaaaaatgcacttttctaggatacac

SEQ ID NO: 338676 - DNA, 75 bp, Artificial Sequence
  Synthetic
tgtacgatgaacagattgatgttccagactttacagaacagcctaaaatcccccgacttttccccccagtcgaac

SEQ ID NO: 338677 - DNA, 75 bp, Artificial Sequence
  Synthetic
agactttacagaacagcctaaaatcccccgacttttccccccagtcgaactcaaagaaagggaagaaaaagactc

SEQ ID NO: 338678 - DNA, 75 bp, Artificial Sequence
  Synthetic
aaacagtgcgaactccacagaaaactctcaaacttttaaaaggtatgtggagtcctcccaccaacgatgaacgtg

SEQ ID NO: 338679 - DNA, 75 bp, Artificial Sequence
  Synthetic
tctcaaacttttaaaaggtatgtggagtcctcccaccaacgatgaacgtgtccgcgagcgaaaatggttcctcgc

SEQ ID NO: 338680 - DNA, 75 bp, Artificial Sequence
  Synthetic
agctcccaagaaaaagaagcacaaaagcaagcggcactaccagtccagcagcagctccgactccaactgcgagaa

SEQ ID NO: 338681 - DNA, 75 bp, Artificial Sequence
  Synthetic
agcaagcggcactaccagtccagcagcagctccgactccaactgcgagaacaacagcgactccgagtccacttgc

SEQ ID NO: 338682 - DNA, 75 bp, Artificial Sequence
  Synthetic
tgtgggtgcaatgatcctgtcggccacttctgttgcttggctactctgtctaaccgcccggagaacccgggaccc

SEQ ID NO: 338683 - DNA, 75 bp, Artificial Sequence
  Synthetic
acttctgttgcttggctactctgtctaaccgcccggagaacccgggaccctccggaggacgtagtgctcctcaga

SEQ ID NO: 338684 - DNA, 75 bp, Artificial Sequence
  Synthetic
aaccaaagcaaatttacatttaaacccactatcttttcagcaagagataaactagacatgtttggtaacattata

SEQ ID NO: 338685 - DNA, 75 bp, Artificial Sequence
  Synthetic
ccactatcttttcagcaagagataaactagacatgtttggtaacattatagatagaaagcctacctcccaagatt

SEQ ID NO: 338686 - DNA, 75 bp, Artificial Sequence
  Synthetic
tgctcccgagcaacccggtgatcgagccccatggcttatgggtggtggaggagacgccgcaggaggtggaagaga

SEQ ID NO: 338687 - DNA, 75 bp, Artificial Sequence
  Synthetic
gccccatggcttatgggtggtggaggagacgccgcaggaggtggaagagatggaggagaaggcccaggtggagac

SEQ ID NO: 338688 - DNA, 75 bp, Artificial Sequence
  Synthetic
gatatttgacaggccccccagacaaaacctaacagaccctcctttctatccctggatgcctaagcctaaacctgc

SEQ ID NO: 338689 - DNA, 75 bp, Artificial Sequence
  Synthetic
acctgctggacgccgtagacgccgcagaacagtaaggagacgaaggcgtgggaggtggaggagcagatataggag

SEQ ID NO: 338690 - DNA, 75 bp, Artificial Sequence
  Synthetic
agaacagtaaggagacgaaggcgtgggaggtggaggagcagatataggagatggaggcgaaagggcagacgcagg

SEQ ID NO: 338691 - DNA, 75 bp, Artificial Sequence
  Synthetic
tttcaataaacaagaccgtgggagtttcacttgtcggtgtctacctctataagtcactaagctctccgagcgaag

SEQ ID NO: 338692 - DNA, 75 bp, Artificial Sequence
  Synthetic
aatggcagccaaactataccagaaagtgcaacattgtcggttacatgccagtaataatgtgtggagaaaatactg

SEQ ID NO: 338693 - DNA, 75 bp, Artificial Sequence
  Synthetic
gtgcaacattgtcggttacatgccagtaataatgtgtggagaaaatactgttatcagaaactatgccacacacgc

SEQ ID NO: 338694 - DNA, 75 bp, Artificial Sequence
  Synthetic
acgcgcttcgcgctgcgccggacatctcggaccccccctcgacccgaatcgctcgcgcgattcggacctgcggcc

SEQ ID NO: 338695 - DNA, 75 bp, Artificial Sequence
  Synthetic
tttgggggcggcatggccacccaaaaatttactctcagaatactgtacgatgactataagagatttatgaactac

SEQ ID NO: 338696 - DNA, 75 bp, Artificial Sequence
  Synthetic
aatttactctcagaatactgtacgatgactataagagatttatgaactactggacctcctcaaacgaggacctag

SEQ ID NO: 338697 - DNA, 75 bp, Artificial Sequence
  Synthetic
tgagtggggccagacttcgccatagggcctttctcttcttgccatttgtcagtattcggggtcgccgtaggcttc

SEQ ID NO: 338698 - DNA, 75 bp, Artificial Sequence
  Synthetic
cctgtactttttcagagacccagatgtagactttattatacttataaacaccactcctccatttgtagacacaga

SEQ ID NO: 338699 - DNA, 75 bp, Artificial Sequence
  Synthetic
gtagactttattatacttataaacaccactcctccatttgtagacacagagatcacaggacccagcatacaccca

SEQ ID NO: 338700 - DNA, 75 bp, Artificial Sequence
  Synthetic
taccaaaatggccgatttagtgacgtcacggcggccattttagattggcgcagaggatctgacgtcaaagttcaa

SEQ ID NO: 338701 - DNA, 75 bp, Artificial Sequence
  Synthetic
tcacggcggccattttagattggcgcagaggatctgacgtcaaagttcaaaggtcaggccctcggcgtcatcaca

SEQ ID NO: 338702 - DNA, 75 bp, Artificial Sequence
  Synthetic
ctagatttattcccagcctaaaaaccagaccaggcaggagacacatagtaaagataagagtaggggcccccagaa

SEQ ID NO: 338703 - DNA, 75 bp, Artificial Sequence
  Synthetic
cagaccaggcaggagacacatagtaaagataagagtaggggcccccagaatgtatgaagacaaatggtaccccca

SEQ ID NO: 338704 - DNA, 75 bp, Artificial Sequence
  Synthetic
taaaggtcacctatacgtcatcagtcacgtgggggaaggcgtgcctaaacccggaagcatcctcgtccacgtgac

SEQ ID NO: 338705 - DNA, 75 bp, Artificial Sequence
  Synthetic
cacgtgggggaaggcgtgcctaaacccggaagcatcctcgtccacgtgactgtgacgtgtgtggcacgtcaccgc

SEQ ID NO: 338706 - DNA, 75 bp, Artificial Sequence
  Synthetic
ctaacgatctatgcaaccgcaacggatatgcaacatccgttcggctcaccactaactgacactcctgttgtaacc

SEQ ID NO: 338707 - DNA, 75 bp, Artificial Sequence
  Synthetic
atatgcaacatccgttcggctcaccactaactgacactcctgttgtaaccttccaagtattgcgcagcatgtaca

SEQ ID NO: 338708 - DNA, 75 bp, Artificial Sequence
  Synthetic
gacttccttccgcttttttaaaaaaaaacggcctgcggcggcgcgcgcgcttcgcgcgcgcgccggggggctgtc

SEQ ID NO: 338709 - DNA, 75 bp, Artificial Sequence
  Synthetic
ttcgcgcgcgcgccggggggctgtcgcccccccccgcgcatgcgcggggccccccccccgcggggggctccgccc

SEQ ID NO: 338710 - DNA, 75 bp, Artificial Sequence
  Synthetic
taactttgaaaaagattccccaggggaaaaactttacaaacaaatatctacatatcttccatactacaacacaac

SEQ ID NO: 338711 - DNA, 75 bp, Artificial Sequence
  Synthetic
gaaaaactttacaaacaaatatctacatatcttccatactacaacacaacagaaacaatagcacagttaaaaaga

SEQ ID NO: 338712 - DNA, 75 bp, Artificial Sequence
  Synthetic
ccgcaggccagtccaagtgtacgtcgtgcacttcctgggcgtggtttacatcctcatataactaactgcacttcc

SEQ ID NO: 338713 - DNA, 75 bp, Artificial Sequence
  Synthetic
ccaatatgccaaatccttggcaatcaatatatgtaaatacaactccattcactgaagcagtaacagtaaccgcag

SEQ ID NO: 338714 - DNA, 75 bp, Artificial Sequence
  Synthetic
ccgcggagaggagccacggcagcggatccgaacgtcctgagggcgggtgccggaggtgagtttacacaccgaagt

SEQ ID NO: 338715 - DNA, 75 bp, Artificial Sequence
  Synthetic
aatatatgtaaatacaactccattcactgaagcagtaacagtaaccgcagatacgccatacaccaatttctcaga

SEQ ID NO: 338716 - DNA, 75 bp, Artificial Sequence
  Synthetic
acaaaagcaataactaatgtaccattttcagcagctaccttatatgaaagtcaaactaaaaaattactgtccaca

SEQ ID NO: 338717 - DNA, 75 bp, Artificial Sequence
  Synthetic
tttcagcagctaccttatatgaaagtcaaactaaaaaattactgtccacaacatttacaggaagcaccccatact

SEQ ID NO: 338718 - DNA, 75 bp, Artificial Sequence
  Synthetic
ttgcgtgccagcagttaagaaaaaaccaactgctatgagcttctggagacctccgatgcacaatgtcacggggat

SEQ ID NO: 338719 - DNA, 75 bp, Artificial Sequence
  Synthetic
ctccatatggttatcagcaggccgctcctactttgaaacaaaaggagcatacacagacatctgctacaaccctta

SEQ ID NO: 338720 - DNA, 75 bp, Artificial Sequence
  Synthetic
tcctactttgaaacaaaaggagcatacacagacatctgctacaacccttacacagacagaggagaaggcaacatg

SEQ ID NO: 338721 - DNA, 75 bp, Artificial Sequence
  Synthetic
caccgtggccatgctgctttttgtggttgtggggatcctgtacttcacattactgcacttgctgagacatatggc

SEQ ID NO: 338722 - DNA, 75 bp, Artificial Sequence
  Synthetic
cagactctagatatgacaaaacacgcagcaaatgccttatagaaaaactacctctctgggcggcagtatacgggt

SEQ ID NO: 338723 - DNA, 75 bp, Artificial Sequence
  Synthetic
cagcaaatgccttatagaaaaactacctctctgggcggcagtatacgggtacgcagaatactgtgccaaggccac

SEQ ID NO: 338724 - DNA, 75 bp, Artificial Sequence
  Synthetic
gccagagtagttatcagaagcccctacactacacctcaaatgatagacaccaacgaccctctaagaggcttcata

SEQ ID NO: 338725 - DNA, 75 bp, Artificial Sequence
  Synthetic
tggcctagaccagctcgtcgccgccctagacgacgaagagtaaggagacgcagacggtggaggagggggcgaccc

SEQ ID NO: 338726 - DNA, 75 bp, Artificial Sequence
  Synthetic
acactacacctcaaatgatagacaccaacgaccctctaagaggcttcatagtatacagcttcaactttggaaaag

SEQ ID NO: 338727 - DNA, 75 bp, Artificial Sequence
  Synthetic
agtacccataagaatgagagccaagtggtacccctgtcttttccaccaaaaagaagtactagaggccttaggcca

SEQ ID NO: 338728 - DNA, 75 bp, Artificial Sequence
  Synthetic
tggtacccctgtcttttccaccaaaaagaagtactagaggccttaggccagtcaggccccttcgcttatcacagc

SEQ ID NO: 338729 - DNA, 75 bp, Artificial Sequence
  Synthetic
taaaatacagatttcactggatatggggcggaaaccccgtgtttccacaggttgttagaaacccctgcaaagaca

SEQ ID NO: 338730 - DNA, 75 bp, Artificial Sequence
  Synthetic
gttgttagaaacccctgcaaagacacccaaggttccacaggccctagaaagcctcgctcaatacaaatcattgac

SEQ ID NO: 338731 - DNA, 75 bp, Artificial Sequence
  Synthetic
aaaaagcaaccaggacctagaactcataagatactttagatgctcctttaaattctatagagaccaagacacaga

SEQ ID NO: 338732 - DNA, 75 bp, Artificial Sequence
  Synthetic
actcccctgggaggaaacagactaacagcgcctagcctacaccccggtgtacagatgcttagcaaaaacaaaata

SEQ ID NO: 338733 - DNA, 75 bp, Artificial Sequence
  Synthetic
acagatgcttagcaaaaacaaaatattagtacctagctatgctacaaaacccaagggtgggagctatgtaaaagt

SEQ ID NO: 338734 - DNA, 75 bp, Artificial Sequence
  Synthetic
aaaaagaaagcttacttttccaacagctccagctccagcgacgagtacccccgtgggaaagctcgcaagggtcgc

SEQ ID NO: 338735 - DNA, 75 bp, Artificial Sequence
  Synthetic
actgacaagtggtactttagcaaagacatttgtgacacaaccttggttaacttagacgttgtactctgcaacttg

SEQ ID NO: 338736 - DNA, 75 bp, Artificial Sequence
  Synthetic
ccgtgggaaagctcgcaagggtcgcaaacagaaacagaaagccaaaaggagcaggagggcaccctctcccagcag

SEQ ID NO: 338737 - DNA, 75 bp, Artificial Sequence
  Synthetic
cggtttccgttctgctcaccacaaactgacaacccttgcatcacattccaagttctgcattccttgtacaacgac

SEQ ID NO: 338738 - DNA, 75 bp, Artificial Sequence
  Synthetic
attacaaaaccacttttgttactacactgacaacaaaattaggtacaacatggggttcaagactaaatacattta

SEQ ID NO: 338739 - DNA, 75 bp, Artificial Sequence
  Synthetic
actgacaacaaaattaggtacaacatggggttcaagactaaatacatttagaacagaaggctgctactcacaccc

SEQ ID NO: 338740 - DNA, 75 bp, Artificial Sequence
  Synthetic
ctacaaaccttccagcaacgactggaaggaagagtacgaggctgccaaatactgggatagaccccccaggagcaa

SEQ ID NO: 338741 - DNA, 75 bp, Artificial Sequence
  Synthetic
gctgcaaatgacacaacatactttacatcacctgatgggctctggggagacgcagttttcgacatctcaaaacct

SEQ ID NO: 338742 - DNA, 75 bp, Artificial Sequence
  Synthetic
catcacctgatgggctctggggagacgcagttttcgacatctcaaaacctcaagtaattaccgaaaatatggagt

SEQ ID NO: 338743 - DNA, 75 bp, Artificial Sequence
  Synthetic
aaggaagagtacgaggctgccaaatactgggatagaccccccaggagcaaccttagggataaacccttctatcct

SEQ ID NO: 338744 - DNA, 75 bp, Artificial Sequence
  Synthetic
aagtaaactttaagctaggcttccaataaaacaaggccgtgggagtttcacttgtcggtgtctgcttattaaggt

SEQ ID NO: 338745 - DNA, 75 bp, Artificial Sequence
  Synthetic
aggggtgaacggagaccccgctttttgccacctaacaggaatatactcacctccctggctaacaccaggcagaat

SEQ ID NO: 338746 - DNA, 75 bp, Artificial Sequence
  Synthetic
ctccctggctaacaccaggcagaatatcccctgaaaccccaggactttacacagacgtgacttacaacccatacg

SEQ ID NO: 338747 - DNA, 75 bp, Artificial Sequence
  Synthetic
agctgtaaatcagtaacgaaagtgagtggggccagacttcgccataaggcctttatcttcttgccatttgtccgt

SEQ ID NO: 338748 - DNA, 75 bp, Artificial Sequence
  Synthetic
gtccgtcatcaggccttccggactacaaaaatggcggattcgtgacgtcacggccgccattttaagtaggtgacg

SEQ ID NO: 338749 - DNA, 75 bp, Artificial Sequence
  Synthetic
agtacttatcagaagcccatacgctgttccaaaactgtataatgaagcagacccaaactatggatgggtacctat

SEQ ID NO: 338750 - DNA, 75 bp, Artificial Sequence
  Synthetic
caaaaatggcggattcgtgacgtcacggccgccattttaagtaggtgacgtccaggactgacgtaaagttcaaag

SEQ ID NO: 338751 - DNA, 75 bp, Artificial Sequence
  Synthetic
acccaaactatggatgggtacctatttcttactactttggagaaggcaaaatgccaaacggagacatgtacgtac

SEQ ID NO: 338752 - DNA, 75 bp, Artificial Sequence
  Synthetic
aatggcggacaacatcttccgagtcaaaggtcatcactacgtcataagtcacgtggggacggctgtacttaaaca

SEQ ID NO: 338753 - DNA, 75 bp, Artificial Sequence
  Synthetic
acgtggggacggctgtacttaaacacggaagtaggccccgtcacgtgatttaccacgtggtgcatgcgtcacggc

SEQ ID NO: 338754 - DNA, 75 bp, Artificial Sequence
  Synthetic
tataaatttacatttaacttcgggggcaaccccgtaccctcacagattgtacaagatccctgcacacagtccacc

SEQ ID NO: 338755 - DNA, 75 bp, Artificial Sequence
  Synthetic
cggggggaggctcaacctcccccccccgcgcgcatgggggggggggttcccccttcctccgggggggtttgcccc

SEQ ID NO: 338756 - DNA, 75 bp, Artificial Sequence
  Synthetic
cggggggaggctcatcctcccccccccgcgcgcatgggggggggggttcccccttcctccgggggggtttgcccc

SEQ ID NO: 338757 - DNA, 75 bp, Artificial Sequence
  Synthetic
cggggggaggctcaccctcccccccccgcgcgcatgggggggggggttcccccttcctccgggggggtttgcccc

SEQ ID NO: 338758 - DNA, 75 bp, Artificial Sequence
  Synthetic
cggggggaggctcagcctcccccccccgcgcgcatgggggggggggttcccccttcctccgggggggtttgcccc

SEQ ID NO: 338759 - DNA, 75 bp, Artificial Sequence
  Synthetic
taagagagtgtcagaacaaccaacaacttctgagtttttattctcaggcccaaagagacccagaatcgatcaagg

SEQ ID NO: 338760 - DNA, 75 bp, Artificial Sequence
  Synthetic
acttctgagtttttattctcaggcccaaagagacccagaatcgatcaaggtccttacatcccgccagaaaaagac

SEQ ID NO: 338761 - DNA, 75 bp, Artificial Sequence
  Synthetic
gaccgtggagcagctcggagaccgaggcagagacagaagccccctcggaagaagagccggagaaccaagaagaac

SEQ ID NO: 338762 - DNA, 75 bp, Artificial Sequence
  Synthetic
gaagagccggagaaccaagaagaacaagtactccagttgcagctcagacagcagcttcgagaacagcgaaaactc

SEQ ID NO: 338763 - DNA, 75 bp, Artificial Sequence
  Synthetic
agcaactgataacaacccaacagggggtccacaaaaacccattgttagagtaggccccgagcagtggctgtttcc

SEQ ID NO: 338764 - DNA, 75 bp, Artificial Sequence
  Synthetic
ggtccacaaaaacccattgttagagtaggccccgagcagtggctgtttcccgagaggaagccaaagccaccgccc

SEQ ID NO: 338765 - DNA, 75 bp, Artificial Sequence
  Synthetic
acactgcctgtaaatactggggcagaccacctagaaaatttctcacagacatgccattttatactcactgcaaaa

SEQ ID NO: 338766 - DNA, 75 bp, Artificial Sequence
  Synthetic
accacctagaaaatttctcacagacatgccattttatactcactgcaaaactaattacaatgtaacctttatgct

SEQ ID NO: 338767 - DNA, 75 bp, Artificial Sequence
  Synthetic
ccatcagccacacctactcaaaatggagggcaatttcttccgggtcaaaggtcaccggcgccatattacatcacg

SEQ ID NO: 338768 - DNA, 75 bp, Artificial Sequence
  Synthetic
tttgtattacaagatggccgacttccttcctctttttcaaaaaaaagcggaagtgacgccgcggcggcggggggc

SEQ ID NO: 338769 - DNA, 75 bp, Artificial Sequence
  Synthetic
tgtattacaagatggccgacttccttcctctttttcaaaaaaaagcggaagtgacgccgcggcggcggggggcgg

SEQ ID NO: 338770 - DNA, 75 bp, Artificial Sequence
  Synthetic
aaaaggcgcgaaaaaacggcggcggcggcgcgcgcgctgcgcgcgcgcgccgggggggcgccagcgccccccccc

SEQ ID NO: 338771 - DNA, 75 bp, Artificial Sequence
  Synthetic
actggccgggctatgggcaaggctcttaaaaaatgcactttcgcagggttgcggagaaaaggaaagtgcttctgc

SEQ ID NO: 338772 - DNA, 75 bp, Artificial Sequence
  Synthetic
tcgtttttaggccttccggactacaaaaatggcggattttgtgacgtcacggccgccattttaagtaaggcggaa

SEQ ID NO: 338773 - DNA, 75 bp, Artificial Sequence
  Synthetic
gggcagacgcagacggactcacagaaaaaagatagttataaaacagtggcaaccaaactttattagacgctgcta

SEQ ID NO: 338774 - DNA, 75 bp, Artificial Sequence
  Synthetic
aacctgccagcgctcccggcgccccagggcgagcccggtgacagagcgccatggcgtggggcttctggggccgac

SEQ ID NO: 338775 - DNA, 75 bp, Artificial Sequence
  Synthetic
agggcgagcccggtgacagagcgccatggcgtggggcttctggggccgacgccgccggtggagacgatggagagc

SEQ ID NO: 338776 - DNA, 75 bp, Artificial Sequence
  Synthetic
agcttaaagagacaggaaacatttcaggcattactcctacttggactgaagtccagaattcaacaacacttaatc

SEQ ID NO: 338777 - DNA, 75 bp, Artificial Sequence
  Synthetic
cggcgcgcgcgctgcgcgcgcgcgccgggggggcgccagcgccccccccccgcgcatgcgcgggtcccccccccc

SEQ ID NO: 338778 - DNA, 75 bp, Artificial Sequence
  Synthetic
ttatctacaatgccagagtactaataagatgcccatacactgaacccatgctaatagaccactcagacccaaaca

SEQ ID NO: 338779 - DNA, 75 bp, Artificial Sequence
  Synthetic
ctttggcaacggaaagatgccgggaggcagctccaacgtgcccataagaatgagagccaagtggtacgtaaacat

SEQ ID NO: 338780 - DNA, 75 bp, Artificial Sequence
  Synthetic
aagcaggtattaaaagaatgcagcaggaatcagatgctctttacattcctccaggaccattcaagagacctcgga

SEQ ID NO: 338781 - DNA, 75 bp, Artificial Sequence
  Synthetic
cgaggagtgcgacccccccttcggtagcaacgccttcggagccgcgcgctacgccttcggctgcgcgcggcacct

SEQ ID NO: 338782 - DNA, 75 bp, Artificial Sequence
  Synthetic
aagatcgtcactaaccacgtgacttccgcaggccaatacaagtctatgtcgttcacttcctgggcatggtctacg

SEQ ID NO: 338783 - DNA, 75 bp, Artificial Sequence
  Synthetic
gggtgtcctttaaactcaactttcaataaaaattctaggccgtgggagtttcacttgtcggtgtctgcttcttaa

SEQ ID NO: 338784 - DNA, 75 bp, Artificial Sequence
  Synthetic
ccgcaggccaatacaagtctatgtcgttcacttcctgggcatggtctacgtgctgatataaagcggtgcacttcc

SEQ ID NO: 338785 - DNA, 75 bp, Artificial Sequence
  Synthetic
tggccgggctatgggcaaggctcttagggtattcattcttaatatgcgcttttccagaatttacagacagaagaa

SEQ ID NO: 338786 - DNA, 75 bp, Artificial Sequence
  Synthetic
cgagctgaaccgaaggcactcgctactgatatgagctggcgccctcccgttcaccatgcggcaggaatcgagcga

SEQ ID NO: 338787 - DNA, 75 bp, Artificial Sequence
  Synthetic
ctgatatgagctggcgccctcccgttcaccatgcggcaggaatcgagcgacagttctttgagggctgctttcgat

SEQ ID NO: 338788 - DNA, 75 bp, Artificial Sequence
  Synthetic
caacccggaagttctgctctgtcacgtgacttatcacgtgactgctacgtcatcggcgccatcttgtatcacaaa

SEQ ID NO: 338789 - DNA, 75 bp, Artificial Sequence
  Synthetic
caattttatcactcatcttactatactggctgctcgctatggttttactggggggccgacgccgccaggtggtcc

SEQ ID NO: 338790 - DNA, 75 bp, Artificial Sequence
  Synthetic
ctggctgctcgctatggttttactggggggccgacgccgccaggtggtcctggggcactgccggcgttgaggcgc

SEQ ID NO: 338791 - DNA, 75 bp, Artificial Sequence
  Synthetic
gagatcagcccgagcctgagctatggcgtggtcgtggtggtggaggcgaaggaaacgatggtggccgcgcagaag

SEQ ID NO: 338792 - DNA, 75 bp, Artificial Sequence
  Synthetic
gccgtcgccgccgacgaagagtaaggaggcgccggtgggggaggcgaagacgtaggagacgggttttttataaga

SEQ ID NO: 338793 - DNA, 75 bp, Artificial Sequence
  Synthetic
gaggcgccggtgggggaggcgaagacgtaggagacgggttttttataagagacgcagacgaaagactggcagact

SEQ ID NO: 338794 - DNA, 75 bp, Artificial Sequence
  Synthetic
atactaactcagtggcaccccactaccgtccgcaactgctccatccgaggccttgtgcctctggtgctgtgcgga

SEQ ID NO: 338795 - DNA, 75 bp, Artificial Sequence
  Synthetic
ccgtccgcaactgctccatccgaggccttgtgcctctggtgctgtgcggacacacccagggaggcagaaactttg

SEQ ID NO: 338796 - DNA, 75 bp, Artificial Sequence
  Synthetic
acaggggtctccctacggaggcagcttcagcactacaacctggaacctcagggtgctgtttgacgagcaccagaa

SEQ ID NO: 338797 - DNA, 75 bp, Artificial Sequence
  Synthetic
ttcagcactacaacctggaacctcagggtgctgtttgacgagcaccagaagcaccacaacacgtggagctatccc

SEQ ID NO: 338798 - DNA, 75 bp, Artificial Sequence
  Synthetic
acaagggctgcaccttctacttttacagagacaaaaagatagactacatagttaagtttcagaggagagggccct

SEQ ID NO: 338799 - DNA, 75 bp, Artificial Sequence
  Synthetic
catggcccatccgggcatgatgatgctagacaagatgaaaatactggttcccagcttcgacactaggcccggggg

SEQ ID NO: 338800 - DNA, 75 bp, Artificial Sequence
  Synthetic
gcggcggcgcgcgcgcttcgcgcgcgcgccggggggctccgcccccccccgcgcatgcgcggggccccccccccg

SEQ ID NO: 338801 - DNA, 75 bp, Artificial Sequence
  Synthetic
ctagacaagatgaaaatactggttcccagcttcgacactaggcccgggggtcgcagaagagtaaaagtgactatc

SEQ ID NO: 338802 - DNA, 75 bp, Artificial Sequence
  Synthetic
agtggtacacccagcaagacctagcgcccgttaatcttgtgtcacttgtggtttctgcggctagcttcatacatc

SEQ ID NO: 338803 - DNA, 75 bp, Artificial Sequence
  Synthetic
ccccccgaaatacgtcactaaccacgtgactcccacaggccaaccacagtctatgtcgtgcacttcctgggcatg

SEQ ID NO: 338804 - DNA, 75 bp, Artificial Sequence
  Synthetic
gcccgttaatcttgtgtcacttgtggtttctgcggctagcttcatacatccgtttagccaaccacaaacgaacaa

SEQ ID NO: 338805 - DNA, 75 bp, Artificial Sequence
  Synthetic
aaagacatgtactatgactgcataggagttaattcctctttagatgataaatatcaaaaactatttgacaaacta

SEQ ID NO: 338806 - DNA, 75 bp, Artificial Sequence
  Synthetic
gtaggagcgatcgagcgtcccgagggcgggtgccggaggtgagtttacacaccgcagtcaaggggcaattcgggc

SEQ ID NO: 338807 - DNA, 75 bp, Artificial Sequence
  Synthetic
gagttaattcctctttagatgataaatatcaaaaactatttgacaaactatattctcaatgctgctactttgaaa

SEQ ID NO: 338808 - DNA, 75 bp, Artificial Sequence
  Synthetic
cgctccgccaatcaggtactggtacgtgcatttcctgggctgggcttaccgctgcatataactagctgcacttcc

SEQ ID NO: 338809 - DNA, 75 bp, Artificial Sequence
  Synthetic
gtgcatttcctgggctgggcttaccgctgcatataactagctgcacttccgaatggctgagttttccacgcccgt

SEQ ID NO: 338810 - DNA, 75 bp, Artificial Sequence
  Synthetic
ccccggctttaaagctgctaaaaaaacaagtaatggcactggtgactcagctgctacactaggagacgcagttac

SEQ ID NO: 338811 - DNA, 75 bp, Artificial Sequence
  Synthetic
acaagtaatggcactggtgactcagctgctacactaggagacgcagttacagaactcaaaagtacaagcggtagt

SEQ ID NO: 338812 - DNA, 75 bp, Artificial Sequence
  Synthetic
aataacgtcactaaccacgtgattccgctccgccaatcaggtactggtacgtgcatttcctgggctgggcttacc

SEQ ID NO: 338813 - DNA, 75 bp, Artificial Sequence
  Synthetic
attcagcgcgtcccgagggcgggagccgaaggtgagtttacacaccgaagtctaggggcaattcgggctcgggac

SEQ ID NO: 338814 - DNA, 75 bp, Artificial Sequence
  Synthetic
ccgaaggtgagtttacacaccgaagtctaggggcaattcgggctcgggactggccgggctatgggcaagtgtctt

SEQ ID NO: 338815 - DNA, 75 bp, Artificial Sequence
  Synthetic
ttggctgctgcacatataaacctactaaagacataggtaagaaagctaattgctggttctggcaccaattaacaa

SEQ ID NO: 338816 - DNA, 75 bp, Artificial Sequence
  Synthetic
taaagacataggtaagaaagctaattgctggttctggcaccaattaacaaagacaaactcagacacactaggaca

SEQ ID NO: 338817 - DNA, 75 bp, Artificial Sequence
  Synthetic
gcactaccgaaagaagaggctactgccactgcgatacgtgccgggttgcaccgaaaaaacctcctgctatgagct

SEQ ID NO: 338818 - DNA, 75 bp, Artificial Sequence
  Synthetic
ccactgcgatacgtgccgggttgcaccgaaaaaacctcctgctatgagctggcgtcctccggcacacaatgccga

SEQ ID NO: 338819 - DNA, 75 bp, Artificial Sequence
  Synthetic
atggagtaccacacaggcatctacagctccatattcctgagcccactaaggagcaacttagaattccccacagca

SEQ ID NO: 338820 - DNA, 75 bp, Artificial Sequence
  Synthetic
gctccatattcctgagcccactaaggagcaacttagaattccccacagcataccaagatgtaacctacaacccac

SEQ ID NO: 338821 - DNA, 75 bp, Artificial Sequence
  Synthetic
tctgtgtgtcagagtcatggtgctttttgtggttgcggtgattttgtgggccatcttaaccgccttgctgagcgt

SEQ ID NO: 338822 - DNA, 75 bp, Artificial Sequence
  Synthetic
tttgtggttgcggtgattttgtgggccatcttaaccgccttgctgagcgtcttggaaggcctcaacctcctagac

SEQ ID NO: 338823 - DNA, 75 bp, Artificial Sequence
  Synthetic
aatctggtaccagtacagtaccaaacccgacactaactttaacaacacaaattgcaaatgtgtgctcacagacct

SEQ ID NO: 338824 - DNA, 75 bp, Artificial Sequence
  Synthetic
cccgacactaactttaacaacacaaattgcaaatgtgtgctcacagacctgccgctgtggagcatgttttatggc

SEQ ID NO: 338825 - DNA, 75 bp, Artificial Sequence
  Synthetic
aataagggtgcttcctgcactaccaccggccgaaggcagtcctagaagacacaacagaaccgagaatcagccatg

SEQ ID NO: 338826 - DNA, 75 bp, Artificial Sequence
  Synthetic
ccggccgaaggcagtcctagaagacacaacagaaccgagaatcagccatgtggtggtggagacgcagattttgga

SEQ ID NO: 338827 - DNA, 75 bp, Artificial Sequence
  Synthetic
tgggcatctcagcagaaattcacaactttggcatagtgtgtgttcagtgtccctacaccttcccccccatgtatg

SEQ ID NO: 338828 - DNA, 75 bp, Artificial Sequence
  Synthetic
ctttggcatagtgtgtgttcagtgtccctacaccttcccccccatgtatgacaagactaaaccagacaaagggta

SEQ ID NO: 338829 - DNA, 75 bp, Artificial Sequence
  Synthetic
gcgccgccgcagacgacctctcgcccgcagacgtcgaagacctgctcgactggctagacgccccagagtaaggag

SEQ ID NO: 338830 - DNA, 75 bp, Artificial Sequence
  Synthetic
cgcagacgtcgaagacctgctcgactggctagacgccccagagtaaggagacgccgctttcagtgggggaggccg

SEQ ID NO: 338831 - DNA, 75 bp, Artificial Sequence
  Synthetic
aacggcaaaatgccagacggctccggacacgtacccacgtattggcaacagagatggtggcccagattcagcttt

SEQ ID NO: 338832 - DNA, 75 bp, Artificial Sequence
  Synthetic
gacacgtacccacgtattggcaacagagatggtggcccagattcagctttcagagacaagtcatgcacgacatta

SEQ ID NO: 338833 - DNA, 75 bp, Artificial Sequence
  Synthetic
gcaggagacgaaagagacaaaaaattaagcttaaacagtggaatcccgcagtaactaaattctgcagaattattg

SEQ ID NO: 338834 - DNA, 75 bp, Artificial Sequence
  Synthetic
taagcttaaacagtggaatcccgcagtaactaaattctgcagaattattggatattaccctttaataatatgcgg

SEQ ID NO: 338835 - DNA, 75 bp, Artificial Sequence
  Synthetic
agatgactctgtaatgacaggcattaccgcgggctacaagtttagattctcatggggcggtgatatggtttccga

SEQ ID NO: 338836 - DNA, 75 bp, Artificial Sequence
  Synthetic
aacgtacatagccaggactatgtccaatatgaaagctatggaggaggcatgaccaccactatgtttaacctaaaa

SEQ ID NO: 338837 - DNA, 75 bp, Artificial Sequence
  Synthetic
ggggacggacgagactccacctatcccgatagacagcgccgcgacctacaagttgttgacccacgcaccatgggc

SEQ ID NO: 338838 - DNA, 75 bp, Artificial Sequence
  Synthetic
aatatgaaagctatggaggaggcatgaccaccactatgtttaacctaaaagttccgtacgaacagtttcaactgc

SEQ ID NO: 338839 - DNA, 75 bp, Artificial Sequence
  Synthetic
actacagacgggggctatttggaaaggacgctattaagcgagtgtcagaaaaaccgacagatcctgactacttta

SEQ ID NO: 338840 - DNA, 75 bp, Artificial Sequence
  Synthetic
catagacctagacttagtaagataccacagtgttaaatttaccttctttagacaccctaaagtagactttatagt

SEQ ID NO: 338841 - DNA, 75 bp, Artificial Sequence
  Synthetic
ggacgctattaagcgagtgtcagaaaaaccgacagatcctgactactttacaacaccttacaaaaaaccaagatt

SEQ ID NO: 338842 - DNA, 75 bp, Artificial Sequence
  Synthetic
cacagtgttaaatttaccttctttagacaccctaaagtagactttatagtaaagtttaacaggaaccctccattc

SEQ ID NO: 338843 - DNA, 75 bp, Artificial Sequence
  Synthetic
aaactgcaagacgaagactacgctttacaggagaaaagaggcccgctctcgccagaagaggggcagacgaggacg

SEQ ID NO: 338844 - DNA, 75 bp, Artificial Sequence
  Synthetic
tgttacatcccggggtgctaatgaacagcaaaagaaaaatactaattccaagctgggaaactagaccccgaggta

SEQ ID NO: 338845 - DNA, 75 bp, Artificial Sequence
  Synthetic
tacaggagaaaagaggcccgctctcgccagaagaggggcagacgaggacgcaagtcctccagcagcaggtcctcc

SEQ ID NO: 338846 - DNA, 75 bp, Artificial Sequence
  Synthetic
cagcaaaagaaaaatactaattccaagctgggaaactagaccccgaggtaaaaagagaatacctgtaagaatagg

SEQ ID NO: 338847 - DNA, 75 bp, Artificial Sequence
  Synthetic
gctcggggagcagctcaggttcctcctcagggaaatgttcaaaacccaagcgggcatacacatgaacccccgcgc

SEQ ID NO: 338848 - DNA, 75 bp, Artificial Sequence
  Synthetic
tggtactttcaaagagacttctgtggtgtgccccttctaactgtcaacgcaaccgcatgcaacttgcggtatccg

SEQ ID NO: 338849 - DNA, 75 bp, Artificial Sequence
  Synthetic
ctcagggaaatgttcaaaacccaagcgggcatacacatgaacccccgcgcatttcaagagctgtaaacaaggttt

SEQ ID NO: 338850 - DNA, 75 bp, Artificial Sequence
  Synthetic
gtgtgccccttctaactgtcaacgcaaccgcatgcaacttgcggtatccgttcggctcaccacaaacgaaaaaca

SEQ ID NO: 338851 - DNA, 75 bp, Artificial Sequence
  Synthetic
gaggttcaagacctctcaggactggcagcaagagtacgaggcctgctcagtgtgggacaggcccgctcgtacctg

SEQ ID NO: 338852 - DNA, 75 bp, Artificial Sequence
  Synthetic
atcaatctataacgacaaagtgagcattgccaaagatgaagttacaaaaaattacgatacacttgttgacgccat

SEQ ID NO: 338853 - DNA, 75 bp, Artificial Sequence
  Synthetic
cagcaagagtacgaggcctgctcagtgtgggacaggcccgctcgtacctgccacacagacacccctacctaccca

SEQ ID NO: 338854 - DNA, 75 bp, Artificial Sequence
  Synthetic
attgccaaagatgaagttacaaaaaattacgatacacttgttgacgccattaaaaagtccccacaaggtttaaca

SEQ ID NO: 338855 - DNA, 75 bp, Artificial Sequence
  Synthetic
aagtaacctttaaacttggctggaagtaaataaaatgctgtgttttactgtgctacgccgtgggagtttcacttg

SEQ ID NO: 338856 - DNA, 75 bp, Artificial Sequence
  Synthetic
aacacatgcaagaaccgtcttcagaaacctgtaaagaaactcaaaaaactaatccaccgtttaaatatgaaaact

SEQ ID NO: 338857 - DNA, 75 bp, Artificial Sequence
  Synthetic
tgctacgccgtgggagtttcacttgtcggtgtctacctcttaaggtcactaagcactccgagcgtcagcgaggag

SEQ ID NO: 338858 - DNA, 75 bp, Artificial Sequence
  Synthetic
aacctgtaaagaaactcaaaaaactaatccaccgtttaaatatgaaaacttatcttccttatggggagataaaat

SEQ ID NO: 338859 - DNA, 75 bp, Artificial Sequence
  Synthetic
tttaaaacaaatgcagagaacttatggaaggcaagaagtaaacacacactgctaggttcaaaggaactaaacttt

SEQ ID NO: 338860 - DNA, 75 bp, Artificial Sequence
  Synthetic
ggaaggcaagaagtaaacacacactgctaggttcaaaggaactaaactttaaaacaggtatgtactctgccatat

SEQ ID NO: 338861 - DNA, 75 bp, Artificial Sequence
  Synthetic
tgactatcctggaatatatatagaagtagtgtacaacccactactaggacaaggagaaggtaacatgatatggct

SEQ ID NO: 338862 - DNA, 75 bp, Artificial Sequence
  Synthetic
gtagtgtacaacccactactaggacaaggagaaggtaacatgatatggctagagtggtgcccaaaaaaaaccaaa

SEQ ID NO: 338863 - DNA, 75 bp, Artificial Sequence
  Synthetic
ccgaggtgccattggacactgagggggcgtacagcaacgaaagtgagtggggccagacttcgccatagggccttt

SEQ ID NO: 338864 - DNA, 75 bp, Artificial Sequence
  Synthetic
ggggtcgctccagacgcggaccccgtttacacccccccgcgagtctcaaaatggcgcattccgtgacgtcatggc

SEQ ID NO: 338865 - DNA, 75 bp, Artificial Sequence
  Synthetic
acctaatacaacacgttccactatgggcagccatacatggctacatggacttttgcaaaaagacatttaaagaca

SEQ ID NO: 338866 - DNA, 75 bp, Artificial Sequence
  Synthetic
tttacacccccccgcgagtctcaaaatggcgcattccgtgacgtcatggccgccattttaagtaaggcggaagag

SEQ ID NO: 338867 - DNA, 75 bp, Artificial Sequence
  Synthetic
ggcagccatacatggctacatggacttttgcaaaaagacatttaaagacaataatttagataaaaacaccagagt

SEQ ID NO: 338868 - DNA, 75 bp, Artificial Sequence
  Synthetic
gagcacttccggcttgcccaaaatggcgggcaagctcctccgggttaaagttcatgcctacgtaacaagtcacgt

SEQ ID NO: 338869 - DNA, 75 bp, Artificial Sequence
  Synthetic
ccacaactatataacccacagaaaccagactggggatacgtaccttacgactataactttgctcaaaccaaaatg

SEQ ID NO: 338870 - DNA, 75 bp, Artificial Sequence
  Synthetic
gcgggcaagctcctccgggttaaagttcatgcctacgtaacaagtcacgtggggagggttggcgtataacccgga

SEQ ID NO: 338871 - DNA, 75 bp, Artificial Sequence
  Synthetic
cagactggggatacgtaccttacgactataactttgctcaaaccaaaatgccagacggaaacgggtacattcctg

SEQ ID NO: 338872 - DNA, 75 bp, Artificial Sequence
  Synthetic
acgtgacgcatacgtcacggcagccattttgtttaacaaaatggcggacatccttcctcttttttaaaaataacg

SEQ ID NO: 338873 - DNA, 75 bp, Artificial Sequence
  Synthetic
acgtgacgcatacgtcacggcagccattttgtttaacaaaatggcggacttccttcctcttttttaaaaataacg

SEQ ID NO: 338874 - DNA, 75 bp, Artificial Sequence
  Synthetic
acgtgacgcatacgtcacggcagccattttgtttaacaaaatggcggacctccttcctcttttttaaaaataacg

SEQ ID NO: 338875 - DNA, 75 bp, Artificial Sequence
  Synthetic
acgtgacgcatacgtcacggcagccattttgtttaacaaaatggcggacgtccttcctcttttttaaaaataacg

SEQ ID NO: 338876 - DNA, 75 bp, Artificial Sequence
  Synthetic
tagcggattccaccaacaaaactggatgaatgacttggaccagtgcgggcctttttcacacagaggggaagaaaa

SEQ ID NO: 338877 - DNA, 75 bp, Artificial Sequence
  Synthetic
cgcgcgcgccggggggctgctgcccccccccccgcgcatgcgcgcgggtccccccccccgcggggggctccgccc

SEQ ID NO: 338878 - DNA, 75 bp, Artificial Sequence
  Synthetic
atgaatgacttggaccagtgcgggcctttttcacacagaggggaagaaaaaatggcaacactaacttctaaatac

SEQ ID NO: 338879 - DNA, 75 bp, Artificial Sequence
  Synthetic
atcctatatttcaacagactgtcaaagacccctgtaaacaatccacctttgacatccccggtgccggtggaatcc

SEQ ID NO: 338880 - DNA, 75 bp, Artificial Sequence
  Synthetic
ggtgagtttacacaccggagtcaaggggcaattcgggctcgggactggccgggctatgggcaaggctcttagagt

SEQ ID NO: 338881 - DNA, 75 bp, Artificial Sequence
  Synthetic
gggctatgggcaaggctcttagagtatttattcttaatatgcgcttttccagaatttacaaacagaagaagaggc

SEQ ID NO: 338882 - DNA, 75 bp, Artificial Sequence
  Synthetic
agacccctgtaaacaatccacctttgacatccccggtgccggtggaatccctcgtccaatacaaattgtcaaccc

SEQ ID NO: 338883 - DNA, 75 bp, Artificial Sequence
  Synthetic
ttccaccgatgggacctcagacgtggcttctttgggccggcagctgttaaaagaatgcaagcagaatcaacagat

SEQ ID NO: 338884 - DNA, 75 bp, Artificial Sequence
  Synthetic
tgaaccgaaagcattcgctagtgatatgagttggcgccctcccgttcacaatgcggcaggaattgagcgacagct

SEQ ID NO: 338885 - DNA, 75 bp, Artificial Sequence
  Synthetic
atgagttggcgccctcccgttcacaatgcggcaggaattgagcgacagctccttgagggctgctttcgatttcac

SEQ ID NO: 338886 - DNA, 75 bp, Artificial Sequence
  Synthetic
gcttctttgggccggcagctgttaaaagaatgcaagcagaatcaacagatgctctctttcctacaacaggtccaa

SEQ ID NO: 338887 - DNA, 75 bp, Artificial Sequence
  Synthetic
ggccgttgcaggagacgccttaccttccagggagagaaaacgccaagcctggcaagactcgacctcggaagaaac

SEQ ID NO: 338888 - DNA, 75 bp, Artificial Sequence
  Synthetic
ttattactcatcttactatactggctgctcgctatggttttactggggggccggcgccgccaggtggtcctgggg

SEQ ID NO: 338889 - DNA, 75 bp, Artificial Sequence
  Synthetic
tccagggagagaaaacgccaagcctggcaagactcgacctcggaagaaaccgagagcgaagcagaagcccaagaa

SEQ ID NO: 338890 - DNA, 75 bp, Artificial Sequence
  Synthetic
ccggcgccgccaggtggtcctggggcgctgccatcgctgagacgggctcagcccgcgccggcggcccccgagaac

SEQ ID NO: 338891 - DNA, 75 bp, Artificial Sequence
  Synthetic
aacagcagctcaaagagcaacgacagctcagatgcggaatccagtacatgttccagcaattaacaaaaacgcagc

SEQ ID NO: 338892 - DNA, 75 bp, Artificial Sequence
  Synthetic
cagcctgaaccagagctatggcgtggtcgtggtggtggaggcgacggaaacgctggtggccgcgcagaaggaggc

SEQ ID NO: 338893 - DNA, 75 bp, Artificial Sequence
  Synthetic
gctcagatgcggaatccagtacatgttccagcaattaacaaaaacgcagcttcacctccacgtccctcctatccc

SEQ ID NO: 338894 - DNA, 75 bp, Artificial Sequence
  Synthetic
tcccagaacgcttaccacaaatgtggacaaagcaagactgggaaacagaacagcaagccgcggcggtctgggaca

SEQ ID NO: 338895 - DNA, 75 bp, Artificial Sequence
  Synthetic
gaccaatgcgcaacaatctcaccgaccctcctttctatccctggatgccccgctaccgcgtaagcttacgtcttg

SEQ ID NO: 338896 - DNA, 75 bp, Artificial Sequence
  Synthetic
gactcagtggcaccccactaccgtccgcaactgctccatccgaggccttgtgcctctagtactctgcggacacac

SEQ ID NO: 338897 - DNA, 75 bp, Artificial Sequence
  Synthetic
cgcaactgctccatccgaggccttgtgcctctagtactctgcggacacactcagggcggcagaaactttgctctc

SEQ ID NO: 338898 - DNA, 75 bp, Artificial Sequence
  Synthetic
ggtctccttacggaggcagttttagcactacaacctggaacttgagggtcctttttgacgaacaccaaaaacacc

SEQ ID NO: 338899 - DNA, 75 bp, Artificial Sequence
  Synthetic
acaacacgtggagctaccccaataaccagctagacctgggcagatacaagggctgcaccttctgcttttacagag

SEQ ID NO: 338900 - DNA, 75 bp, Artificial Sequence
  Synthetic
atcagtaacgaaagtgagtggggccagacttcgccataaggcctttatcttcttgccatttgtcagtgtaggggg

SEQ ID NO: 338901 - DNA, 75 bp, Artificial Sequence
  Synthetic
gtttcagaggaggggaccctttaaaataaacaagtacagcagtcccatggcccatccgggcatgatgatgctaga

SEQ ID NO: 338902 - DNA, 75 bp, Artificial Sequence
  Synthetic
taagatgaaaatcctggtgcccagctttgataccaggcccgggggtcgctgaagagtaaaagtaactatccgccc

SEQ ID NO: 338903 - DNA, 75 bp, Artificial Sequence
  Synthetic
ccgtctcagtgacgtcacaggcgccattttaagtaagcatggcgggcggcgacgtcacatgtcaaaggtcaccgc

SEQ ID NO: 338904 - DNA, 75 bp, Artificial Sequence
  Synthetic
attttaagtaagcatggcgggcggcgacgtcacatgtcaaaggtcaccgcacttccgtgcttgcacaaaatggcc

SEQ ID NO: 338905 - DNA, 75 bp, Artificial Sequence
  Synthetic
tgctgctacgtcatcgagacacgtggtgccagcagctgtaaacccggaagtcgctgacacacgtgtcttgtcacg

SEQ ID NO: 338906 - DNA, 75 bp, Artificial Sequence
  Synthetic
gtgccagcagctgtaaacccggaagtcgctgacacacgtgtcttgtcacgtgggtgctgcgtcacagccgccatt

SEQ ID NO: 338907 - DNA, 75 bp, Artificial Sequence
  Synthetic
catgtactatggctgcataggaattaattccactttaacaaccaagtatgaaaacttatttaataaactatattc

SEQ ID NO: 338908 - DNA, 75 bp, Artificial Sequence
  Synthetic
aattccactttaacaaccaagtatgaaaacttatttaataaactatattccaaatgctgctactttgaaaccttt

SEQ ID NO: 338909 - DNA, 75 bp, Artificial Sequence
  Synthetic
ttcctcttttttaaaaattaaccgtcggcggcggcgcgcgcgctgcgcgcgcgcgccgggggggtccgccccccc

SEQ ID NO: 338910 - DNA, 75 bp, Artificial Sequence
  Synthetic
gcgcgccgggggggtccgcccccccccgcgcatgcgcggggcccccccccgcggggggctccgccccccggcccc

SEQ ID NO: 338911 - DNA, 75 bp, Artificial Sequence
  Synthetic
gctttaaagctgctaaaaagactactaatggttctggttctacagctgcaacactaggagacgcagtaactgaac

SEQ ID NO: 338912 - DNA, 75 bp, Artificial Sequence
  Synthetic
taatggttctggttctacagctgcaacactaggagacgcagtaactgaacttaaaaacccaaatggtacttttta

SEQ ID NO: 338913 - DNA, 75 bp, Artificial Sequence
  Synthetic
tgctgcacatataaacccactaaacaaataggtagtaatgccaataagtggttctggcatcagttaacagccaca

SEQ ID NO: 338914 - DNA, 75 bp, Artificial Sequence
  Synthetic
aaataggtagtaatgccaataagtggttctggcatcagttaacagccacagattcagacacactaggccaatacg

SEQ ID NO: 338915 - DNA, 75 bp, Artificial Sequence
  Synthetic
gtaccacacaggcatttacagctcaatttttcttagcccactaagaagcaatctagaactccctacagcatacca

SEQ ID NO: 338916 - DNA, 75 bp, Artificial Sequence
  Synthetic
atttttcttagcccactaagaagcaatctagaactccctacagcataccaagatgtaacatataatccactaact

SEQ ID NO: 338917 - DNA, 75 bp, Artificial Sequence
  Synthetic
ggtaccagtacagtaccaaagaaaacactacatttaatgaaacacagtgcaaatgtgtactatcagacttgccac

SEQ ID NO: 338918 - DNA, 75 bp, Artificial Sequence
  Synthetic
cactacatttaatgaaacacagtgcaaatgtgtactatcagacttgccactgtggagcatgttttatggctatgt

SEQ ID NO: 338919 - DNA, 75 bp, Artificial Sequence
  Synthetic
atctcagcagagatacacaactttggcatagtatgtgtccagtgcccctacacgtttcccccaatgtttgacaaa

SEQ ID NO: 338920 - DNA, 75 bp, Artificial Sequence
  Synthetic
gcatagtatgtgtccagtgcccctacacgtttcccccaatgtttgacaaatccaaaccagataaaggctacgtgt

SEQ ID NO: 338921 - DNA, 75 bp, Artificial Sequence
  Synthetic
aaagatgccagacgggagcggacacgtacccacctactggcagcagaggtggtggcccagattcagcttccagag

SEQ ID NO: 338922 - DNA, 75 bp, Artificial Sequence
  Synthetic
gtacccacctactggcagcagaggtggtggcccagattcagcttccagagacaagtgatgcacgacattatcctc

SEQ ID NO: 338923 - DNA, 75 bp, Artificial Sequence
  Synthetic
cgtcacagccgccattttagttcacaaaatggccgacttccttcctcttttttaaaaataacggcccagcggcgg

SEQ ID NO: 338924 - DNA, 75 bp, Artificial Sequence
  Synthetic
actctgtaatgactggcataaccgcaggctacaagtttaaattctcatggggcggtgatatggtctccgaacagg

SEQ ID NO: 338925 - DNA, 75 bp, Artificial Sequence
  Synthetic
cgcgcgcgctgcgcgcgcgcgccgggggctgccgcccccccccgcgcatgcgcgcggggcccccccccgcggggg

SEQ ID NO: 338926 - DNA, 75 bp, Artificial Sequence
  Synthetic
ggggctgccgcccccccccgcgcatgcgcgcggggcccccccccgcggggggtccgccccccggccccccccccg

SEQ ID NO: 338927 - DNA, 75 bp, Artificial Sequence
  Synthetic
cggacgagactccacctatcccgatagacagcgccgcgactcacaagttgttgacccacgctccatgggccccca

SEQ ID NO: 338928 - DNA, 75 bp, Artificial Sequence
  Synthetic
ccacaggccaatcgcagtgtatgtcgtgcacttcctgggcatggtctatgtgctaatataaagcggcgcacttcc

SEQ ID NO: 338929 - DNA, 75 bp, Artificial Sequence
  Synthetic
aagttcgtcactaaccacgtgactcccacaggccaatcgcagtgtatgtcgtgcacttcctgggcatggtctatg

SEQ ID NO: 338930 - DNA, 75 bp, Artificial Sequence
  Synthetic
gcaagaagaagactccgctttacaggagaaaagaagcccgctctcgtcagaagaggggcagacgagggcgcaagt

SEQ ID NO: 338931 - DNA, 75 bp, Artificial Sequence
  Synthetic
gccgggctccgggcaaggctcttaaaaaatgcgcttttcccggattgctcgctcgaaaaggaaagtgccactgcc

SEQ ID NO: 338932 - DNA, 75 bp, Artificial Sequence
  Synthetic
gagaaaagaagcccgctctcgtcagaagaggggcagacgagggcgcaagtcctccagcagcaggtcctccagtcg

SEQ ID NO: 338933 - DNA, 75 bp, Artificial Sequence
  Synthetic
ggaaatgttcaaaacccaagcgggcatacacatgaacccccgcgcatttcaggagctgtaaaccgtgttttcatg

SEQ ID NO: 338934 - DNA, 75 bp, Artificial Sequence
  Synthetic
gaaattttattggccatcttaatactctggctactcgctacggctttactcctgggcccgcgccgccgcctggtg

SEQ ID NO: 338935 - DNA, 75 bp, Artificial Sequence
  Synthetic
tctggctactcgctacggctttactcctgggcccgcgccgccgcctggtggtccaggcccgcggccgctactacc

SEQ ID NO: 338936 - DNA, 75 bp, Artificial Sequence
  Synthetic
ttaagacctctcaggactggcagcaagagtacgaggcctgctcagtgtgggacaggcctgctcgcacctgccata

SEQ ID NO: 338937 - DNA, 75 bp, Artificial Sequence
  Synthetic
gacggtgagcagcccagggccctgccatggcgtggggatggtggagacgcagacgctggcccacctaccgaaggt

SEQ ID NO: 338938 - DNA, 75 bp, Artificial Sequence
  Synthetic
gctaaaaaacccagaattcaaagtaacctttaagcttggctggaaataaataaattgctgtgtttcactgtacta

SEQ ID NO: 338939 - DNA, 75 bp, Artificial Sequence
  Synthetic
gtaacctttaagcttggctggaaataaataaattgctgtgtttcactgtactaggccgtgggactttcacttgtc

SEQ ID NO: 338940 - DNA, 75 bp, Artificial Sequence
  Synthetic
ggcgccgctggagacgccgcaggaggataccgcgaagaagacctcgacgagctgttcgccgctatggaaagagac

SEQ ID NO: 338941 - DNA, 75 bp, Artificial Sequence
  Synthetic
cgcaggggcgcggtcagactgagacgcagacgcagacggggacgtaagagacttatactaactcagtggcagccc

SEQ ID NO: 338942 - DNA, 75 bp, Artificial Sequence
  Synthetic
ccgggtacctcccggtggtctggtgcgggtacctgcgggccgccagaaactatgcctaccactctgacgactcca

SEQ ID NO: 338943 - DNA, 75 bp, Artificial Sequence
  Synthetic
cgggtacctgcgggccgccagaaactatgcctaccactctgacgactccacaaagcagccggacccctttggggg

SEQ ID NO: 338944 - DNA, 75 bp, Artificial Sequence
  Synthetic
ctaaaggtgctgtacgaccagcaccagagaggactcaacaggtggtccttttcgaacgaccaacttgaccttgct

SEQ ID NO: 338945 - DNA, 75 bp, Artificial Sequence
  Synthetic
agagaggactcaacaggtggtccttttcgaacgaccaacttgaccttgctcgctacaaggggtgccaactgacat

SEQ ID NO: 338946 - DNA, 75 bp, Artificial Sequence
  Synthetic
tatagctgtctatgacatctctgccccgtacaaactagacaaatacagctctccaagctaccaccccggcaacat

SEQ ID NO: 338947 - DNA, 75 bp, Artificial Sequence
  Synthetic
attcccagctacgacactaaccccaggggtcgccaaaaagtagtagttaagattcccccccccaaactgttcgtt

SEQ ID NO: 338948 - DNA, 75 bp, Artificial Sequence
  Synthetic
ataggttacggttcctcagatgaaaaaaaaaaagaagtacttgaaactctgtacaagcaaaatgcatactgggcc

SEQ ID NO: 338949 - DNA, 75 bp, Artificial Sequence
  Synthetic
aaaaaaaagaagtacttgaaactctgtacaagcaaaatgcatactgggcctcacacttaactccttactttacaa

SEQ ID NO: 338950 - DNA, 75 bp, Artificial Sequence
  Synthetic
taacactaacgctgaaattgctgcatctgatcaagtacacacacttctcacaacaggtgaaaacaccaaaaacat

SEQ ID NO: 338951 - DNA, 75 bp, Artificial Sequence
  Synthetic
tctgatcaagtacacacacttctcacaacaggtgaaaacaccaaaaacattaaaatagcaggagacagtaactac

SEQ ID NO: 338952 - DNA, 75 bp, Artificial Sequence
  Synthetic
acaaaactgaacacctaaattccataagaaaacagtactttgagtgggaaacagataaaggcccacaggccacat

SEQ ID NO: 338953 - DNA, 75 bp, Artificial Sequence
  Synthetic
aagaaaacagtactttgagtgggaaacagataaaggcccacaggccacatctaagtatggcaaacgccacacttg

SEQ ID NO: 338954 - DNA, 75 bp, Artificial Sequence
  Synthetic
ttaaccgttggcggcggcgcgcgcgctacgcgcgcgcgccgggggggctctgcccccccccgcgcatgcgcgcgg

SEQ ID NO: 338955 - DNA, 75 bp, Artificial Sequence
  Synthetic
gaataccacctaggcctgtttagccctatattcataggacccaccagaagcaacaaactgtttgctacagcctac

SEQ ID NO: 338956 - DNA, 75 bp, Artificial Sequence
  Synthetic
ctacgcgcgcgcgccgggggggctctgcccccccccgcgcatgcgcgcgggtccccccccgcggggggctccgcc

SEQ ID NO: 338957 - DNA, 75 bp, Artificial Sequence
  Synthetic
attttgtacagcccgccaaattctcttcaaacaggccaatcagcgtttactacgtacacttcctggggtgtgtcc

SEQ ID NO: 338958 - DNA, 75 bp, Artificial Sequence
  Synthetic
ctatattcataggacccaccagaagcaacaaactgtttgctacagcctaccaagacgttacttacaaccccctaa

SEQ ID NO: 338959 - DNA, 75 bp, Artificial Sequence
  Synthetic
ctggtttcaatacaacacaaaggcagacacccaggtagccaaacaaggctgctactgtatgctagaggacattcc

SEQ ID NO: 338960 - DNA, 75 bp, Artificial Sequence
  Synthetic
tgacgaatggtagagttttttctggcccgtccgcggcgagagcgcgagcgaagcgagcgatcgagcgacccgtgg

SEQ ID NO: 338961 - DNA, 75 bp, Artificial Sequence
  Synthetic
gacacccaggtagccaaacaaggctgctactgtatgctagaggacattcccttctgggccgccatgtatggctac

SEQ ID NO: 338962 - DNA, 75 bp, Artificial Sequence
  Synthetic
gccccttccaggacgcagagaccgtgggctacatctgtgcaatctgtccctacacagatccccccatgcacaaca

SEQ ID NO: 338963 - DNA, 75 bp, Artificial Sequence
  Synthetic
tcgggactggccgggctatgggcaaggctcttaaaaaatttccccgttctgttcttaaacaggatataaaatcat

SEQ ID NO: 338964 - DNA, 75 bp, Artificial Sequence
  Synthetic
gggctacatctgtgcaatctgtccctacacagatccccccatgcacaacaaacaaaatcccttgcaaggctacgt

SEQ ID NO: 338965 - DNA, 75 bp, Artificial Sequence
  Synthetic
gtccaggggcgagagagccagtggttcgcggcttgttttcacggccacgcttcgttttgcggctgcggtgacttt

SEQ ID NO: 338966 - DNA, 75 bp, Artificial Sequence
  Synthetic
ggcaagtggatagacggacggggacacgtagagccttactggctgtgccgctggaggccagagatgctttttcag

SEQ ID NO: 338967 - DNA, 75 bp, Artificial Sequence
  Synthetic
ctggaggccagagatgctttttcagcagcaggtcatgagagacattgtacagactgggccctggagctataagga

SEQ ID NO: 338968 - DNA, 75 bp, Artificial Sequence
  Synthetic
tcgcggcttgttttcacggccacgcttcgttttgcggctgcggtgactttattgggcatattaacagccttgctc

SEQ ID NO: 338969 - DNA, 75 bp, Artificial Sequence
  Synthetic
cccgcatccacctgccttaaacaggccacctgcacagggcccagaaagccccgggggttccatactacccctgcc

SEQ ID NO: 338970 - DNA, 75 bp, Artificial Sequence
  Synthetic
ccacctgcacagggcccagaaagccccgggggttccatactacccctgccagccctaccggcaccacctgatccg

SEQ ID NO: 338971 - DNA, 75 bp, Artificial Sequence
  Synthetic
acggtggcgacgccgcccgtggggccgctggcgccgccgaaggcgcgtatggagaagaagacctagaactgctgt

SEQ ID NO: 338972 - DNA, 75 bp, Artificial Sequence
  Synthetic
gacagcctagagaagtacaaattgttgacccagtcaccatgggtccccgctgggttttccactcctgggactggc

SEQ ID NO: 338973 - DNA, 75 bp, Artificial Sequence
  Synthetic
cgctggcgccgccgaaggcgcgtatggagaagaagacctagaactgctgttcgccgccgccgaggaagacgatat

SEQ ID NO: 338974 - DNA, 75 bp, Artificial Sequence
  Synthetic
tgacccagtcaccatgggtccccgctgggttttccactcctgggactggcgacgtggctaccttagtgagacagc

SEQ ID NO: 338975 - DNA, 75 bp, Artificial Sequence
  Synthetic
gcagactcagacgaaggggcagacggagatacagggggcgacgaaagaagagacagaccctagtactcaaacaat

SEQ ID NO: 338976 - DNA, 75 bp, Artificial Sequence
  Synthetic
aaccaaaaagacctagactgttccctgttacagagggcgacgaccagtccccccccgcaaggcgacgactcgtat

SEQ ID NO: 338977 - DNA, 75 bp, Artificial Sequence
  Synthetic
gagatacagggggcgacgaaagaagagacagaccctagtactcaaacaatggcaacccgacgttaacagactgtg

SEQ ID NO: 338978 - DNA, 75 bp, Artificial Sequence
  Synthetic
atagtttgtggcaccggcagggcccaggacaactttatagtacactcagaggacataaccccccgaggagccgcc

SEQ ID NO: 338979 - DNA, 75 bp, Artificial Sequence
  Synthetic
tcaccgaagaaacgacggaagcgctacagctccagctccagcgccagctccggcgacagcagcgactcggagagc

SEQ ID NO: 338980 - DNA, 75 bp, Artificial Sequence
  Synthetic
aggacaactttatagtacactcagaggacataaccccccgaggagccgcctacgggggcaacctcacacacataa

SEQ ID NO: 338981 - DNA, 75 bp, Artificial Sequence
  Synthetic
acagctccagctccagcgccagctccggcgacagcagcgactcggagagcagctccagctcctccaacaccacct

SEQ ID NO: 338982 - DNA, 75 bp, Artificial Sequence
  Synthetic
agaattcctcatgcacagaaacagatggtccagaagtaaccatgacctggacctctgcagataccaaggagtagt

SEQ ID NO: 338983 - DNA, 75 bp, Artificial Sequence
  Synthetic
ataaacccattattgttggtccgccagtaaacagggcgtaccttttccccccgaagggtccccgtcccataacca

SEQ ID NO: 338984 - DNA, 75 bp, Artificial Sequence
  Synthetic
tggtccagaagtaaccatgacctggacctctgcagataccaaggagtagtttttaaggcctatagacaccccaaa

SEQ ID NO: 338985 - DNA, 75 bp, Artificial Sequence
  Synthetic
agtaaacagggcgtaccttttccccccgaagggtccccgtcccataaccacttctcagggctgggcagatgaata

SEQ ID NO: 338986 - DNA, 75 bp, Artificial Sequence
  Synthetic
gaacacctccatttcaagcaacagaacttagctacatgtcctgccatccactactcatgctgacagcaaaacaca

SEQ ID NO: 338987 - DNA, 75 bp, Artificial Sequence
  Synthetic
cccactcgcattaactacacagaccagcctacctatccctggatgcccactaactttaaagtgtctttcagactt

SEQ ID NO: 338988 - DNA, 75 bp, Artificial Sequence
  Synthetic
acttagctacatgtcctgccatccactactcatgctgacagcaaaacacaggatagtagtaaagagccaagagac

SEQ ID NO: 338989 - DNA, 75 bp, Artificial Sequence
  Synthetic
ggcttccaataaaatttactgaacttcgacttgctaggccgtgggagtttcactagtcggtgtctacctcttaag

SEQ ID NO: 338990 - DNA, 75 bp, Artificial Sequence
  Synthetic
aaatttagaataaagccccccagactaatgttaaacaagtggtacttcactcatgacttttgtaaagtcccacta

SEQ ID NO: 338991 - DNA, 75 bp, Artificial Sequence
  Synthetic
taatgttaaacaagtggtacttcactcatgacttttgtaaagtcccactattcagcatgtgggcctcagcctgtg

SEQ ID NO: 338992 - DNA, 75 bp, Artificial Sequence
  Synthetic
gggagccctaagccccacagtaggcttttttgccttaaagcctgacttctaccctaatttaagcattttaccaaa

SEQ ID NO: 338993 - DNA, 75 bp, Artificial Sequence
  Synthetic
gagttgccattggacactgtagctgtgaatcagtaacgaaagtgagtggggccagacttcgccataaggccttta

SEQ ID NO: 338994 - DNA, 75 bp, Artificial Sequence
  Synthetic
ttttttgccttaaagcctgacttctaccctaatttaagcattttaccaaatgaagtcagtcaacaattcgacttc

SEQ ID NO: 338995 - DNA, 75 bp, Artificial Sequence
  Synthetic
tcttcttgccattggatagtgtagggggtcgctccaaacgcgaaccccgtttttagcccttccggactacaaaaa

SEQ ID NO: 338996 - DNA, 75 bp, Artificial Sequence
  Synthetic
gcatacaatcagaaaaagatgttagatgggaatatacatacacaaacttaatgaggcctatatacaaccagaccc

SEQ ID NO: 338997 - DNA, 75 bp, Artificial Sequence
  Synthetic
atgggaatatacatacacaaacttaatgaggcctatatacaaccagaccccatcactaaaggcctccacatatga

SEQ ID NO: 338998 - DNA, 75 bp, Artificial Sequence
  Synthetic
ctccactatacaaaatggcggcggagcacttccggcttgcccaaaatggcggtcaacaacatccgggttaaaggt

SEQ ID NO: 338999 - DNA, 75 bp, Artificial Sequence
  Synthetic
aactatcaagcatgccaccaacaattcatagcatttaaagcacaaagatttgccaaaattaaagcagaatatcaa

SEQ ID NO: 339000 - DNA, 75 bp, Artificial Sequence
  Synthetic
tcatagcatttaaagcacaaagatttgccaaaattaaagcagaatatcaaacagtatatcctacactaacaacac

SEQ ID NO: 339001 - DNA, 75 bp, Artificial Sequence
  Synthetic
ggaggcttggcgtgtaacccggaagtcaatcctctcacgtggcctgtcacgtgactgctgcgtcacggcggccat

SEQ ID NO: 339002 - DNA, 75 bp, Artificial Sequence
  Synthetic
gtgactgctgcgtcacggcggccattttgttttacaaaatggcggacttccttcctcttttttaaaaataacggc

SEQ ID NO: 339003 - DNA, 75 bp, Artificial Sequence
  Synthetic
acaagaatttggactatactctccatactatttaacaccaacaagaatcagcctagactggcacacagtattcca

SEQ ID NO: 339004 - DNA, 75 bp, Artificial Sequence
  Synthetic
tactatttaacaccaacaagaatcagcctagactggcacacagtattccaccacatcagatacaacccgatggca

SEQ ID NO: 339005 - DNA, 75 bp, Artificial Sequence
  Synthetic
gcgcgcgcgccggggggctgcgcccccctcccccgcgcatgcgcgcggggccctccccccccggggggctccgcc

SEQ ID NO: 339006 - DNA, 75 bp, Artificial Sequence
  Synthetic
gggtcgactggtgttccagaaaagaagccacctacgaccccacaagatccaagtgcatgctaaaagacctaccac

SEQ ID NO: 339007 - DNA, 75 bp, Artificial Sequence
  Synthetic
agccacctacgaccccacaagatccaagtgcatgctaaaagacctaccactatacatgcgcttctatggctactg

SEQ ID NO: 339008 - DNA, 75 bp, Artificial Sequence
  Synthetic
tcagaaacagcctggagagacatgagattaatggtggtctgcccttatacagaaccccaactaatgaaaaaaaat

SEQ ID NO: 339009 - DNA, 75 bp, Artificial Sequence
  Synthetic
gattaatggtggtctgcccttatacagaaccccaactaatgaaaaaaaatgacaaaacctggggctatgtaatct

SEQ ID NO: 339010 - DNA, 75 bp, Artificial Sequence
  Synthetic
catgccgtggttacagccatatatcccaatctcgtggttttgccgttggttcccttgcatcactcaccaacgtga

SEQ ID NO: 339011 - DNA, 75 bp, Artificial Sequence
  Synthetic
ccaatctcgtggttttgccgttggttcccttgcatcactcaccaacgtgaagcaatggagtcagttgtggccaca

SEQ ID NO: 339012 - DNA, 75 bp, Artificial Sequence
  Synthetic
accgcaacagttgggacataactataggctacaaattcttatggagatgggggggctctcctctgcccactcagg

SEQ ID NO: 339013 - DNA, 75 bp, Artificial Sequence
  Synthetic
aggctacaaattcttatggagatgggggggctctcctctgcccactcaggcaatcgacgacccctgccagcaggg

SEQ ID NO: 339014 - DNA, 75 bp, Artificial Sequence
  Synthetic
acgttgcctagaatcttacaagtcagcgacccgacgcaactcggaccgaaaaccatattccacctctgggaccag

SEQ ID NO: 339015 - DNA, 75 bp, Artificial Sequence
  Synthetic
gcgacccgacgcaactcggaccgaaaaccatattccacctctgggaccagaggcgtggactttttagcaaaagaa

SEQ ID NO: 339016 - DNA, 75 bp, Artificial Sequence
  Synthetic
aggaactgatgacttattttcaccaggtcgcccaaagcgcccaaagctcgacacacgtcccgaaggactaccaga

SEQ ID NO: 339017 - DNA, 75 bp, Artificial Sequence
  Synthetic
ggtcgcccaaagcgcccaaagctcgacacacgtcccgaaggactaccagaggagcaaagaggagcttacaattta

SEQ ID NO: 339018 - DNA, 75 bp, Artificial Sequence
  Synthetic
agtcggaagaaagcgaccaagaagaaatgcctcccctcgaagaagaacaagtactccacgagcaaaagaaagagg

SEQ ID NO: 339019 - DNA, 75 bp, Artificial Sequence
  Synthetic
aatgcctcccctcgaagaagaacaagtactccacgagcaaaagaaagaggcgctcctccagcagctccagcagca

SEQ ID NO: 339020 - DNA, 75 bp, Artificial Sequence
  Synthetic
cgggggggcgccagcgcccccccccccgcgcatgcgcgggtccccctccccctcggggggctccgccccccggcc

SEQ ID NO: 339021 - DNA, 75 bp, Artificial Sequence
  Synthetic
tacgtcacaaaagggggcggagttcccgcccaaaagatttgaattcattggtccacgtcacttccttgacgcttt

SEQ ID NO: 339022 - DNA, 75 bp, Artificial Sequence
  Synthetic
cgaggcctcagactcctcctcggagacgtcctgaaactccgccggggtctacacatagacccggtccttacatag

SEQ ID NO: 339023 - DNA, 75 bp, Artificial Sequence
  Synthetic
ccgcccaaaagatttgaattcattggtccacgtcacttccttgacgctttcctgggcggggaaaagggccaatat

SEQ ID NO: 339024 - DNA, 75 bp, Artificial Sequence
  Synthetic
acgtcctgaaactccgccggggtctacacatagacccggtccttacatagcaccccctccatacatccctgacct

SEQ ID NO: 339025 - DNA, 75 bp, Artificial Sequence
  Synthetic
gtccacgtcacttccttgacgctttcctgggcggggaaaagggccaatataagccggagcacttccgaatggctg

SEQ ID NO: 339026 - DNA, 75 bp, Artificial Sequence
  Synthetic
aaaaaattttccaacttcgattgggctacagaataccagcttgctaccgctttcgaccgccctctccgccactac

SEQ ID NO: 339027 - DNA, 75 bp, Artificial Sequence
  Synthetic
ggacgaaccgcgcagcctggtgagtgacctcggccgcccgtgggcgggtgccgaagcgggaggtttacccccgcg

SEQ ID NO: 339028 - DNA, 75 bp, Artificial Sequence
  Synthetic
ctacagaataccagcttgctaccgctttcgaccgccctctccgccactaccccttagacctcccgcactacccgt

SEQ ID NO: 339029 - DNA, 75 bp, Artificial Sequence
  Synthetic
gacctcggccgcccgtgggcgggtgccgaagcgggaggtttacccccgcgagtcaaggggcaattcgggcaaggg

SEQ ID NO: 339030 - DNA, 75 bp, Artificial Sequence
  Synthetic
ctctacctatagagtgtcctttcaactaaaagccccccaataaaatgtcaaggccgtgggagtttcactgctcgg

SEQ ID NO: 339031 - DNA, 75 bp, Artificial Sequence
  Synthetic
tgaaagccggaccccctctcacttttacagggcttcattctctatcgctatcgcctggttccaacgggggctatc

SEQ ID NO: 339032 - DNA, 75 bp, Artificial Sequence
  Synthetic
tacagggcttcattctctatcgctatcgcctggttccaacgggggctatcggagactacctactcgtcagaactc

SEQ ID NO: 339033 - DNA, 75 bp, Artificial Sequence
  Synthetic
tgtctgcttcttaaggtcactaagcactccgagcgtcagcgaggggtgcgaccctcctgccctgtagcaacttcc

SEQ ID NO: 339034 - DNA, 75 bp, Artificial Sequence
  Synthetic
ccagtgggagcccactactctcaatgcctggggtcgcgaggaggcgtggctcagatccgtcgttgattcccatca

SEQ ID NO: 339035 - DNA, 75 bp, Artificial Sequence
  Synthetic
gcctggggtcgcgaggaggcgtggctcagatccgtcgttgattcccatcagtctttttgtggctgtaatgatcct

SEQ ID NO: 339036 - DNA, 75 bp, Artificial Sequence
  Synthetic
ctgcgccggacgcctcggaccccccctcgacccgaatcgctcgcgcgattcggacctgcggcctcgggggggtcg

SEQ ID NO: 339037 - DNA, 75 bp, Artificial Sequence
  Synthetic
ctcgacccgaatcgctcgcgcgattcggacctgcggcctcgggggggtcgggagctttattaaacagactccgag

SEQ ID NO: 339038 - DNA, 75 bp, Artificial Sequence
  Synthetic
atagtgcgggccgccatcttgggggtcctggagggccccagcccccgcctgctccggggggaccgggagtaggcg

SEQ ID NO: 339039 - DNA, 75 bp, Artificial Sequence
  Synthetic
tcctggagggccccagcccccgcctgctccggggggaccgggagtaggcggcgagggtccccgtcgctttcttcc

SEQ ID NO: 339040 - DNA, 75 bp, Artificial Sequence
  Synthetic
acagcaacgaaagtgagtggggccagacttcgccataaggcctttatcttctcgccgtttgtcagtggcttccgg

SEQ ID NO: 339041 - DNA, 75 bp, Artificial Sequence
  Synthetic
gacttcgccataaggcctttatcttctcgccgtttgtcagtggcttccgggttcgtatggaggtcgccattttgg

SEQ ID NO: 339042 - DNA, 75 bp, Artificial Sequence
  Synthetic
gaggagcctggtcatcaaaggccgccatgccctggtggccctggcgacgctggaggcgctggaggcgtcgacgcg

SEQ ID NO: 339043 - DNA, 75 bp, Artificial Sequence
  Synthetic
catgccctggtggccctggcgacgctggaggcgctggaggcgtcgacgcggaaactggagaaggcgagtggcgcc

SEQ ID NO: 339044 - DNA, 75 bp, Artificial Sequence
  Synthetic
cgggcacccgtaggcgcattatagtgacgtcacggcagccatcttgactgtgacgtcaaagtcacgtggtgacgg

SEQ ID NO: 339045 - DNA, 75 bp, Artificial Sequence
  Synthetic
cgggctcgaagacgccgaaaagcggtaaggagacgccggcgccgcagggtccgcagacggggctactacagacgc

SEQ ID NO: 339046 - DNA, 75 bp, Artificial Sequence
  Synthetic
ccattttaacccggaagtggctgttgtcacgtgacttgacgtcacggccgccattttgtgctgtccgccattttg

SEQ ID NO: 339047 - DNA, 75 bp, Artificial Sequence
  Synthetic
taaggagacgccggcgccgcagggtccgcagacggggctactacagacgctaccgacgcaggagacgctacaaga

SEQ ID NO: 339048 - DNA, 75 bp, Artificial Sequence
  Synthetic
tgacttccttccgctttttcaaaaaaaagaggaagtatgacgtagcggcgggggggcggcgcgcttcgcgcgccg

SEQ ID NO: 339049 - DNA, 75 bp, Artificial Sequence
  Synthetic
ggggggcggcgcgcttcgcgcgccgcccaccagggggcgctgcgcgccccccccccgcgcatgcgcggggccccc

SEQ ID NO: 339050 - DNA, 75 bp, Artificial Sequence
  Synthetic
gcagcccaccactaacctcagactgacggtgaaaggactgataccagtggtagtgatgggcaagggaaagactca

SEQ ID NO: 339051 - DNA, 75 bp, Artificial Sequence
  Synthetic
acggtgaaaggactgataccagtggtagtgatgggcaagggaaagactcagaataattttggacagtgggaacag

SEQ ID NO: 339052 - DNA, 75 bp, Artificial Sequence
  Synthetic
ccccgggggggctccgcccccccggcccccccccgtgttatgtccaccgcgcatgcgcggccacgcccccgccgc

SEQ ID NO: 339053 - DNA, 75 bp, Artificial Sequence
  Synthetic
aagtacgtcactaaccacgtgactcccgcaggccaaccacagtctacgtcgtccacttcctgggcatggtctaca

SEQ ID NO: 339054 - DNA, 75 bp, Artificial Sequence
  Synthetic
acgggggcagctttaccatcagaaagttcacgctgcagaccctgtatgaggactatctcaaacttagaaacagat

SEQ ID NO: 339055 - DNA, 75 bp, Artificial Sequence
  Synthetic
gttcacgctgcagaccctgtatgaggactatctcaaacttagaaacagatggtctcgcagcaacacagacttaga

SEQ ID NO: 339056 - DNA, 75 bp, Artificial Sequence
  Synthetic
tcaaggggcaattcgggctcgggactggccgggccccgggcaaggctcttaaaaaatgcgctttcgcagggttgc

SEQ ID NO: 339057 - DNA, 75 bp, Artificial Sequence
  Synthetic
ctgagactgtacagacacgagttcagcgactacattgttcactacagtctagaaacacccatggaggttgggcta

SEQ ID NO: 339058 - DNA, 75 bp, Artificial Sequence
  Synthetic
gcgactacattgttcactacagtctagaaacacccatggaggttgggctagaatcccacatgctagcacacccgc

SEQ ID NO: 339059 - DNA, 75 bp, Artificial Sequence
  Synthetic
cgtcacggtacccagcctactcaccaaaaaaggaggcaggagatacctaagactaaaaataccacccccaaaact

SEQ ID NO: 339060 - DNA, 75 bp, Artificial Sequence
  Synthetic
gagagaaactggtacgagagctgtttcagatcccatgctgctgtctgtggctgtggcgactttgttggccatctt

SEQ ID NO: 339061 - DNA, 75 bp, Artificial Sequence
  Synthetic
aaaaaaggaggcaggagatacctaagactaaaaataccacccccaaaactcatgatgactcagtggtacttccaa

SEQ ID NO: 339062 - DNA, 75 bp, Artificial Sequence
  Synthetic
gccctccacgttctgggcccccgggcggaccccgcacgccacagataagaaacctgccagcgctcccggcgcccg

SEQ ID NO: 339063 - DNA, 75 bp, Artificial Sequence
  Synthetic
tactattatctattagcacagccacacttatgcacccatggatggcaccgtttgtaaactccccagcactcacca

SEQ ID NO: 339064 - DNA, 75 bp, Artificial Sequence
  Synthetic
cggaccccgcacgccacagataagaaacctgccagcgctcccggcgcccgggggcgagcccggtgacagagcgcc

SEQ ID NO: 339065 - DNA, 75 bp, Artificial Sequence
  Synthetic
acttatgcacccatggatggcaccgtttgtaaactccccagcactcaccatctatgccgtaaatcacaaaacata

SEQ ID NO: 339066 - DNA, 75 bp, Artificial Sequence
  Synthetic
gccgccggtggagacggtggagagcgcggcgcagacggtggagaccccgcagacgtaggagacgacgccctgctc

SEQ ID NO: 339067 - DNA, 75 bp, Artificial Sequence
  Synthetic
gcggcgcagacggtggagaccccgcagacgtaggagacgacgccctgctcgccgctttcgagctcgtcgaagagt

SEQ ID NO: 339068 - DNA, 75 bp, Artificial Sequence
  Synthetic
aataatcaaggatctacaaaaaatgaactaattgaaacactatatacagctgaacacacatacaacccaatggca

SEQ ID NO: 339069 - DNA, 75 bp, Artificial Sequence
  Synthetic
aactaattgaaacactatatacagctgaacacacatacaacccaatggcacaaagaatatggggaaatatcaaac

SEQ ID NO: 339070 - DNA, 75 bp, Artificial Sequence
  Synthetic
aaattattggaacaaatggaacgaaatacacacaaaaattaaaaccaataggcaaagtgagctaacccagttaaa

SEQ ID NO: 339071 - DNA, 75 bp, Artificial Sequence
  Synthetic
gcagacgcagacggactcacagaaaaaagatagtcataaaacagtggcaaccaaactttattagacgctgctaca

SEQ ID NO: 339072 - DNA, 75 bp, Artificial Sequence
  Synthetic
atacacacaaaaattaaaaccaataggcaaagtgagctaacccagttaaagcaaatgagaaagagattagaacta

SEQ ID NO: 339073 - DNA, 75 bp, Artificial Sequence
  Synthetic
ccaacttcggcctaagctatggtctctacagccctttactattatatccagaaatgtactttccagaacaatcaa

SEQ ID NO: 339074 - DNA, 75 bp, Artificial Sequence
  Synthetic
tgataagcaaaggaccgtacgggggaggcatgactaccacaaaatttactctgagaatactgtacgacgagttta

SEQ ID NO: 339075 - DNA, 75 bp, Artificial Sequence
  Synthetic
ctacagccctttactattatatccagaaatgtactttccagaacaatcaaaagtgtaccaaaaagctagatacaa

SEQ ID NO: 339076 - DNA, 75 bp, Artificial Sequence
  Synthetic
ccaggtttatgaacttttggactgtcagtaacgaagacctagacctgtgtagatacgtgggctgcaaactcatat

SEQ ID NO: 339077 - DNA, 75 bp, Artificial Sequence
  Synthetic
aacgtagtatggacagaaccccttacaaaaaaaacatgtgattatgcttcacaagcctataatgtcatcaaagat

SEQ ID NO: 339078 - DNA, 75 bp, Artificial Sequence
  Synthetic
caaaaaaaacatgtgattatgcttcacaagcctataatgtcatcaaagatgcaccactatatctagctctatttg

SEQ ID NO: 339079 - DNA, 75 bp, Artificial Sequence
  Synthetic
tatagtacaaataaacactcagcctcctttcttagacacaaacctcaccgcggccagcatacacccgggcattat

SEQ ID NO: 339080 - DNA, 75 bp, Artificial Sequence
  Synthetic
cctttcttagacacaaacctcaccgcggccagcatacacccgggcattatgatgctgagcaagagacacatacta

SEQ ID NO: 339081 - DNA, 75 bp, Artificial Sequence
  Synthetic
cgcaaaagataagagcttctacctatctaacagagtatgtgtaaaatgcccatacactgtaccacaattattaag

SEQ ID NO: 339082 - DNA, 75 bp, Artificial Sequence
  Synthetic
ataccctctctaaagacccggcccagcagaaaacacagggtggtcgtcagggtaggcgccccaagactttttcag

SEQ ID NO: 339083 - DNA, 75 bp, Artificial Sequence
  Synthetic
gcagaaaacacagggtggtcgtcagggtaggcgccccaagactttttcaggacaagtggtacccccagtcagacc

SEQ ID NO: 339084 - DNA, 75 bp, Artificial Sequence
  Synthetic
tctaacagagtatgtgtaaaatgcccatacactgtaccacaattattaagcaaaacaaacgcaactctaggacat

SEQ ID NO: 339085 - DNA, 75 bp, Artificial Sequence
  Synthetic
gacaagtggtacccccagtcagacctgtgcgacacagttctgctttccatattcgcaaccgcctgtgacttgcaa

SEQ ID NO: 339086 - DNA, 75 bp, Artificial Sequence
  Synthetic
gaggactagtgccatccaaagatagctatgttccactatacatgagaggtaagtggtatccctctatctatcacc

SEQ ID NO: 339087 - DNA, 75 bp, Artificial Sequence
  Synthetic
attcgcaaccgcctgtgacttgcaatatccgttcggctcaccactaactgacaacccttgcgtcaacttccagat

SEQ ID NO: 339088 - DNA, 75 bp, Artificial Sequence
  Synthetic
tatccgttcggctcaccactaactgacaacccttgcgtcaacttccagattttggggccccagtacaaaaaacac

SEQ ID NO: 339089 - DNA, 75 bp, Artificial Sequence
  Synthetic
ctatgttccactatacatgagaggtaagtggtatccctctatctatcaccaagaggaggtaatagaagccatagt

SEQ ID NO: 339090 - DNA, 75 bp, Artificial Sequence
  Synthetic
gaccagatcaccaaatccctagatatcactatagggtgcagattcgggtttagaatcggaggtaacctactgaat

SEQ ID NO: 339091 - DNA, 75 bp, Artificial Sequence
  Synthetic
ctactaacaaaactcattataataacaacctatttaacaaaactgaactatacaacacctttcaaaccatagctc

SEQ ID NO: 339092 - DNA, 75 bp, Artificial Sequence
  Synthetic
caacctatttaacaaaactgaactatacaacacctttcaaaccatagctcagcttaaagagacaggacaaactat

SEQ ID NO: 339093 - DNA, 75 bp, Artificial Sequence
  Synthetic
tcactatagggtgcagattcgggtttagaatcggaggtaacctactgaatcccaaacaggtgggcgacccctgca

SEQ ID NO: 339094 - DNA, 75 bp, Artificial Sequence
  Synthetic
tcccggaggcggtgacctccttagggcagtacaagtgtcggacccgcggaaagtgggcatccaattccacccctg

SEQ ID NO: 339095 - DNA, 75 bp, Artificial Sequence
  Synthetic
gtacaaaactcaacacaacttaattcatcaggtacaaatgcaactgaaagcagagacacttggtacaaaggcaat

SEQ ID NO: 339096 - DNA, 75 bp, Artificial Sequence
  Synthetic
catcaggtacaaatgcaactgaaagcagagacacttggtacaaaggcaatacatacaaggataacattgcacagt

SEQ ID NO: 339097 - DNA, 75 bp, Artificial Sequence
  Synthetic
gcagtacaagtgtcggacccgcggaaagtgggcatccaattccacccctgggacctcagacgaggcatgcttagc

SEQ ID NO: 339098 - DNA, 75 bp, Artificial Sequence
  Synthetic
aagactcagatgatgatgaatcaattgaattccctccaaaagcttggccaggagacccggtacccgttggccgaa

SEQ ID NO: 339099 - DNA, 75 bp, Artificial Sequence
  Synthetic
taaaggtgcaacaatagcagcactaccaaactaccccacaataatgtccacagacttatatgaataccactcagg

SEQ ID NO: 339100 - DNA, 75 bp, Artificial Sequence
  Synthetic
tgaattccctccaaaagcttggccaggagacccggtacccgttggccgaaccctcgaagagcgttgcagttcctc

SEQ ID NO: 339101 - DNA, 75 bp, Artificial Sequence
  Synthetic
gcgacgccgccgccattcaagaagccgcgaacggaagaccaggaagaaaacccggaggaaacaactcagctccag

SEQ ID NO: 339102 - DNA, 75 bp, Artificial Sequence
  Synthetic
gctggcaggagctactttgaaaccacaggggcctactctgacattatatacaaccctttcacagacaaaggcaca

SEQ ID NO: 339103 - DNA, 75 bp, Artificial Sequence
  Synthetic
cgcgaacggaagaccaggaagaaaacccggaggaaacaactcagctccagctcttccaagagctccagcgacaaa

SEQ ID NO: 339104 - DNA, 75 bp, Artificial Sequence
  Synthetic
ggggttccggggactggtagaggagatgatcaagtcccaccgtcatctagccctagacccctacctaaaataggc

SEQ ID NO: 339105 - DNA, 75 bp, Artificial Sequence
  Synthetic
atgatcaagtcccaccgtcatctagccctagacccctacctaaaataggcaaagccgctctcctcttcccggaca

SEQ ID NO: 339106 - DNA, 75 bp, Artificial Sequence
  Synthetic
aagaaagctttttacccccacgctcttcgatctagaaactgaagagcaactggctcaggccttcaaacgccccaa

SEQ ID NO: 339107 - DNA, 75 bp, Artificial Sequence
  Synthetic
ttcgatctagaaactgaagagcaactggctcaggccttcaaacgccccaaaagagaataccggctccccggggac

SEQ ID NO: 339108 - DNA, 75 bp, Artificial Sequence
  Synthetic
gaccccccactcaattcagagtctcctttaagctcaactttcaataaagcgatgcctacaatgcacactggtcgg

SEQ ID NO: 339109 - DNA, 75 bp, Artificial Sequence
  Synthetic
ctttaagctcaactttcaataaagcgatgcctacaatgcacactggtcggtgtccatttatataagtcacgtccc

SEQ ID NO: 339110 - DNA, 75 bp, Artificial Sequence
  Synthetic
tcacgggtccgggcgctgcgcgcccgtccccgcgtggggggcgtacagaggtcgctcccggtgttaggcgtcgcc

SEQ ID NO: 339111 - DNA, 75 bp, Artificial Sequence
  Synthetic
catcagacgaggactctttggcaaagcaggtattaaaagaatgcaacaagaatcagatgctctttacattcctgc

SEQ ID NO: 339112 - DNA, 75 bp, Artificial Sequence
  Synthetic
gcaggtattaaaagaatgcaacaagaatcagatgctctttacattcctgcaggaccattcaaaaggcctcgcagg

SEQ ID NO: 339113 - DNA, 75 bp, Artificial Sequence
  Synthetic
agcaaaacgaaagctcagctttcagagtccagcagcgactcccgtggatacactccagccaggaaacgcaaagct

SEQ ID NO: 339114 - DNA, 75 bp, Artificial Sequence
  Synthetic
agtccagcagcgactcccgtggatacactccagccaggaaacgcaaagctcccaagaagagacggaagcgcaagg

SEQ ID NO: 339115 - DNA, 75 bp, Artificial Sequence
  Synthetic
ggggcgcaccgccccaagtgcaccgccctgtgacgtatttccgggagtgacgtatttccggttccggtgacgtat

SEQ ID NO: 339116 - DNA, 75 bp, Artificial Sequence
  Synthetic
ccctgtgacgtatttccgggagtgacgtatttccggttccggtgacgtatatccggctgtgacgtgtttccgcat

SEQ ID NO: 339117 - DNA, 75 bp, Artificial Sequence
  Synthetic
cagctccgagagcagcgagtactccgactccagctccagcagctcgcaacccaagtcctcaaagtccaagcaggg

SEQ ID NO: 339118 - DNA, 75 bp, Artificial Sequence
  Synthetic
gactccagctccagcagctcgcaacccaagtcctcaaagtccaagcagggcacggcctacaccccctattatctt

SEQ ID NO: 339119 - DNA, 75 bp, Artificial Sequence
  Synthetic
tttaaagtggcggaccttccggtgacgtgtttccgtttccgcgactagccggcggccatatttgtagtcccttcc

SEQ ID NO: 339120 - DNA, 75 bp, Artificial Sequence
  Synthetic
cgtgtttccgtttccgcgactagccggcggccatatttgtagtcccttcctctttcgctttcgccaaaaagagga

SEQ ID NO: 339121 - DNA, 75 bp, Artificial Sequence
  Synthetic
tttgagcccgagggtcctaaacccatacagggctacaacgattggctagaggagtacactgcttgcaagttctgg

SEQ ID NO: 339122 - DNA, 75 bp, Artificial Sequence
  Synthetic
gacagaccccccagaaagctacactcagaccttcccttctacccctgggtaccaaaaccccaagaccaagttaag

SEQ ID NO: 339123 - DNA, 75 bp, Artificial Sequence
  Synthetic
gttcctctttttcgccgctaaaagaggaacttcgcactatgcgggatggccacaggggggcgctcccgcgccccc

SEQ ID NO: 339124 - DNA, 75 bp, Artificial Sequence
  Synthetic
cacaggggggcgctcccgcgccccccccccgcccagggggcggggccccccccccgcggggggctccgccccccg

SEQ ID NO: 339125 - DNA, 75 bp, Artificial Sequence
  Synthetic
ctttatcttctcgccattggatagtgtccggggtcgccgtaggcttcggcctcgttttcaggccttccggactac

SEQ ID NO: 339126 - DNA, 75 bp, Artificial Sequence
  Synthetic
gcggcggagcacttccggcttgcccaaaatggcgggcaagctcttccgggttaaaggtcagcaactacgtcacaa

SEQ ID NO: 339127 - DNA, 75 bp, Artificial Sequence
  Synthetic
gccgggccatgggcaaggctcttaaaaaatgcgctttcgcagggttgctcagaaaaggaaagtgcttctgcaaac

SEQ ID NO: 339128 - DNA, 75 bp, Artificial Sequence
  Synthetic
aaaatgcgctttcgcagggttgctcagaaaaggaaagtgcttctgcaaactgtgcgaacttcaaagaaggctagg

SEQ ID NO: 339129 - DNA, 75 bp, Artificial Sequence
  Synthetic
acccggaagtcctcttcggtcacgtgactagtcacgtgcctgctacgtcatcggcgccatcttgtgtcacaaaat

SEQ ID NO: 339130 - DNA, 75 bp, Artificial Sequence
  Synthetic
cactgtacaatgtccccggcatcgagagaaattggtacgagagttgtttcagatcccatgctgccatttgtggct

SEQ ID NO: 339131 - DNA, 75 bp, Artificial Sequence
  Synthetic
cggcgcgcgcgctgcgcgcgcgcgccgggggggcgccagcgcccccccccccgcgcatgcgcgggtccccccccc

SEQ ID NO: 339132 - DNA, 75 bp, Artificial Sequence
  Synthetic
gagaaattggtacgagagttgtttcagatcccatgctgccatttgtggctgtagcgactttgttggccatcttaa

SEQ ID NO: 339133 - DNA, 75 bp, Artificial Sequence
  Synthetic
cgccagcgcccccccccccgcgcatgcgcgggtcccccccccctcggggggctccgccccccggccccccccccg

SEQ ID NO: 339134 - DNA, 75 bp, Artificial Sequence
  Synthetic
cctgcacgtcctgggcccccaggcggaccccgcacgccgcagataagaaacctgccagcgctcccggcgcccgag

SEQ ID NO: 339135 - DNA, 75 bp, Artificial Sequence
  Synthetic
cccggccgctccggagccctcacaggttgattcgagaccagccctgacatggcatggggatggtggaagcgacgg

SEQ ID NO: 339136 - DNA, 75 bp, Artificial Sequence
  Synthetic
ggcgtggggcttctgaggccgacgccgccggtggagacggtggagaccgcggcgcagacggtggagaccccgcag

SEQ ID NO: 339137 - DNA, 75 bp, Artificial Sequence
  Synthetic
ggggaggacacagcactatgaggttcagcctctacattttgtttgaggagcacctcagacacatgaacttctgga

SEQ ID NO: 339138 - DNA, 75 bp, Artificial Sequence
  Synthetic
ggaggcgcggggggcggtggcgcagacgctacagaaaatggcgacgggggagacgcagacgaactcacagaaaaa

SEQ ID NO: 339139 - DNA, 75 bp, Artificial Sequence
  Synthetic
aaactttattagacgctgctacattatagggtacctacctttaatattctgtggcgaaaacacaaccgcccagaa

SEQ ID NO: 339140 - DNA, 75 bp, Artificial Sequence
  Synthetic
tagtacagataaatactcaacctccttttttagacacgcacctcaccgcggccagcatacacccaggcatcatga

SEQ ID NO: 339141 - DNA, 75 bp, Artificial Sequence
  Synthetic
ttttttagacacgcacctcaccgcggccagcatacacccaggcatcatgatgctaagcaaaagacacatactaat

SEQ ID NO: 339142 - DNA, 75 bp, Artificial Sequence
  Synthetic
ttgcaaccgcctgtgacttgcaatatccgttcggctcaccactaactgacaacccttgcgtcaacttccagattc

SEQ ID NO: 339143 - DNA, 75 bp, Artificial Sequence
  Synthetic
tccgttcggctcaccactaactgacaacccttgcgtcaacttccagattctggggcctcagtacaaaaaacacct

SEQ ID NO: 339144 - DNA, 75 bp, Artificial Sequence
  Synthetic
actaacaaaacacattataaggtacacttgtttaacgaagtatcactatacaacgccttccaaaccatagctcag

SEQ ID NO: 339145 - DNA, 75 bp, Artificial Sequence
  Synthetic
acttgtttaacgaagtatcactatacaacgccttccaaaccatagctcagcttaaagaaacaggacaaatttcag

SEQ ID NO: 339146 - DNA, 75 bp, Artificial Sequence
  Synthetic
tcaaaacactaacaccctcaatgaatcaggtactaatgcaactcaaagcagagacacttggtacaaaggcaacac

SEQ ID NO: 339147 - DNA, 75 bp, Artificial Sequence
  Synthetic
gagacacttggtacaaaggcaacacatacaacaaaaacatttcagacttagcagaaaaaaccagaatgagattta

SEQ ID NO: 339148 - DNA, 75 bp, Artificial Sequence
  Synthetic
ggggcctactctgacattatatacaaccctttcacagacaaaggcacaggcaacataatctggatagactacctt

SEQ ID NO: 339149 - DNA, 75 bp, Artificial Sequence
  Synthetic
caacataatctggatagactaccttacaaaagaagacaccatttttgtaaaaaacaaaagcaaatgcgaaataat

SEQ ID NO: 339150 - DNA, 75 bp, Artificial Sequence
  Synthetic
acaggatatacagagttctgtgcaaagtacactggagactctgccatcatttacaatgccagaatactgataaga

SEQ ID NO: 339151 - DNA, 75 bp, Artificial Sequence
  Synthetic
agtacactggagactctgccatcatttacaatgccagaatactgataagatgcccatacaccgaacccatgctaa

SEQ ID NO: 339152 - DNA, 75 bp, Artificial Sequence
  Synthetic
cttcgtaccctactcattcaactttggtaacggaaaaatgcccggaggcagctccaacgtacccataagaatgag

SEQ ID NO: 339153 - DNA, 75 bp, Artificial Sequence
  Synthetic
caccaaaaagaagttctggaggctatagtacaaagcggaccgtttgggtacaagggcgacataaaatcagctgta

SEQ ID NO: 339154 - DNA, 75 bp, Artificial Sequence
  Synthetic
tagtacaaagcggaccgtttgggtacaagggcgacataaaatcagctgtactatccatgaaatacagatttcact

SEQ ID NO: 339155 - DNA, 75 bp, Artificial Sequence
  Synthetic
tccaactccagctcctccgcggcccatagaggacctcgcagcgtacaagcggttgacccgaaatacaatacccca

SEQ ID NO: 339156 - DNA, 75 bp, Artificial Sequence
  Synthetic
cccccccctcgggggggctccgcccccccggccccccccccgggctaaatacaccgcgcatgcgcggccacgccc

SEQ ID NO: 339157 - DNA, 75 bp, Artificial Sequence
  Synthetic
tcagacgaggactgtttggcaaagcaggtattaaaagaatgcaacaagaatcagatgctctttacattcctccag

SEQ ID NO: 339158 - DNA, 75 bp, Artificial Sequence
  Synthetic
taagtcacatgacccccgcaggccaatcgccaggtactacgtccacttcctgggctggatcttcccggccatata

SEQ ID NO: 339159 - DNA, 75 bp, Artificial Sequence
  Synthetic
caaaacgaaagctcaggtttcagagtccagcagcgactcccgtgggtccactccagccaagaaacgcaaagctcc

SEQ ID NO: 339160 - DNA, 75 bp, Artificial Sequence
  Synthetic
atcgccaggtactacgtccacttcctgggctggatcttcccggccatataactagctgcacttccgaatggctga

SEQ ID NO: 339161 - DNA, 75 bp, Artificial Sequence
  Synthetic
tgggctggatcttcccggccatataactagctgcacttccgaatggctgagtttatgccgcccgtccgcagacgg

SEQ ID NO: 339162 - DNA, 75 bp, Artificial Sequence
  Synthetic
tccagcagcgactcccgtgggtccactccagccaagaaacgcaaagctcccaagaggagacggaagcgcaagggt

SEQ ID NO: 339163 - DNA, 75 bp, Artificial Sequence
  Synthetic
tcgtcccgagggcgggtacccgaggtgagtttacacaccgaggttaaggggcaattcgggctcgggactggccgg

SEQ ID NO: 339164 - DNA, 75 bp, Artificial Sequence
  Synthetic
gctccgagagcagcgagtcctccgactccagctccagcacctcgcaacccaagtcctcaaagtccaagcaggcca

SEQ ID NO: 339165 - DNA, 75 bp, Artificial Sequence
  Synthetic
tgagtttacacaccgaggttaaggggcaattcgggctcgggactggccgggctatgggcaaggctcttgtgggac

SEQ ID NO: 339166 - DNA, 75 bp, Artificial Sequence
  Synthetic
ctccagctccagcacctcgcaacccaagtcctcaaagtccaagcaggccacggcctacaccccctattatcttcc

SEQ ID NO: 339167 - DNA, 75 bp, Artificial Sequence
  Synthetic
tgtcccgcaggaagaaagggaaagtgccactgcccccactgccgactgcaccgctacctccgcaccggcctagaa

SEQ ID NO: 339168 - DNA, 75 bp, Artificial Sequence
  Synthetic
tgagccccagggtcctaaacccatacagggctacaacgattggctagaggagtacacttgttgcaagttctggga

SEQ ID NO: 339169 - DNA, 75 bp, Artificial Sequence
  Synthetic
gccactgcccccactgccgactgcaccgctacctccgcaccggcctagaatgagcggtacctggtgtccacccgt

SEQ ID NO: 339170 - DNA, 75 bp, Artificial Sequence
  Synthetic
cagacctcccagaaggctgcactcagacttacccttctacccctgggcaccaaaaccccaagaccaagttagggt

SEQ ID NO: 339171 - DNA, 75 bp, Artificial Sequence
  Synthetic
aactggtacgagtcctgtcttcgttcgcatgctgctttttgtggttgtggtgattttgttagtcatcttaacaat

SEQ ID NO: 339172 - DNA, 75 bp, Artificial Sequence
  Synthetic
cgcatgctgctttttgtggttgtggtgattttgttagtcatcttaacaatctggcgaatcgtctcggacgtcctc

SEQ ID NO: 339173 - DNA, 75 bp, Artificial Sequence
  Synthetic
gcagccgcctgcagtaagagccctgccggcgctccccgctcccgaggaccgtttccctaatcctccgggatggcc

SEQ ID NO: 339174 - DNA, 75 bp, Artificial Sequence
  Synthetic
ccggcgctccccgctcccgaggaccgtttccctaatcctccgggatggcctggccctggaggcggcgccgctggc

SEQ ID NO: 339175 - DNA, 75 bp, Artificial Sequence
  Synthetic
gaggcgatggaggagacgccgaacctggagacgaagacctcgacgcgctgttcgccgcagacgagtaaggagaag

SEQ ID NO: 339176 - DNA, 75 bp, Artificial Sequence
  Synthetic
tggagacgaagacctcgacgcgctgttcgccgcagacgagtaaggagaaggggtcgcgggtggaggaggctatac

SEQ ID NO: 339177 - DNA, 75 bp, Artificial Sequence
  Synthetic
ttatcttgttgccattggatagtgtccggggtcgccgtaggcttcggcctagtttttaggccttccggactacaa

SEQ ID NO: 339178 - DNA, 75 bp, Artificial Sequence
  Synthetic
gacgcacatataaaaaaaaaccggtactaactcagtggcagcccacagtgagaagacgctgttttatcatagggt

SEQ ID NO: 339179 - DNA, 75 bp, Artificial Sequence
  Synthetic
actaactcagtggcagcccacagtgagaagacgctgttttatcatagggtacatgcctctcataatctgtggtga

SEQ ID NO: 339180 - DNA, 75 bp, Artificial Sequence
  Synthetic
agccacgccgatgactttgttaaagacggacctttcgggggggggatgactaccatgcaatttagcctcagaata

SEQ ID NO: 339181 - DNA, 75 bp, Artificial Sequence
  Synthetic
cacctgactggggaggaggcacaacccggaagtcctcctcggtcacgtgactggccacgtggctgctgcgtcatc

SEQ ID NO: 339182 - DNA, 75 bp, Artificial Sequence
  Synthetic
acggacctttcgggggggggatgactaccatgcaatttagcctcagaatactgtacgacgagtttctcaggttct

SEQ ID NO: 339183 - DNA, 75 bp, Artificial Sequence
  Synthetic
ggatctagacctagccaggtaccacggctttaagctaactctttacagacacccaacagtagactttattgtaat

SEQ ID NO: 339184 - DNA, 75 bp, Artificial Sequence
  Synthetic
ggctttaagctaactctttacagacacccaacagtagactttattgtaataattagaaactctccaccatttgag

SEQ ID NO: 339185 - DNA, 75 bp, Artificial Sequence
  Synthetic
cacaccccggcatgcttatgctcagacacaaaaaaatactagtgcctagccttcgcaccagaccctccagaagac

SEQ ID NO: 339186 - DNA, 75 bp, Artificial Sequence
  Synthetic
acacaaaaaaatactagtgcctagccttcgcaccagaccctccagaagacataaaataacagtaagaatagggcc

SEQ ID NO: 339187 - DNA, 75 bp, Artificial Sequence
  Synthetic
tacagccaaacagatatctgcgacgttattcttgcaacagtgtatgcaaccgcatgtgacctgcaatatccgttc

SEQ ID NO: 339188 - DNA, 75 bp, Artificial Sequence
  Synthetic
ttattcttgcaacagtgtatgcaaccgcatgtgacctgcaatatccgttcggctcaccactaactgaaaactatt

SEQ ID NO: 339189 - DNA, 75 bp, Artificial Sequence
  Synthetic
tgcttacaacaatctaattagcaacactctaaacccaaatgaggaacaacaagacattaaatcagcaatttacaa

SEQ ID NO: 339190 - DNA, 75 bp, Artificial Sequence
  Synthetic
actctaaacccaaatgaggaacaacaagacattaaatcagcaatttacaataatgttaatgcatacctaacaaga

SEQ ID NO: 339191 - DNA, 75 bp, Artificial Sequence
  Synthetic
taatatcaaaagcaccaccaaaacaagtccttaaaagtagtgatggaagtttacaaacagaccacaatgacaccc

SEQ ID NO: 339192 - DNA, 75 bp, Artificial Sequence
  Synthetic
agtccttaaaagtagtgatggaagtttacaaacagaccacaatgacacccagtttggaggcaatccatataacac

SEQ ID NO: 339193 - DNA, 75 bp, Artificial Sequence
  Synthetic
aacaaaataatacaaggagcccaaaactatttaactacaattaaaacacatctacaacctaacaactcagcaata

SEQ ID NO: 339194 - DNA, 75 bp, Artificial Sequence
  Synthetic
tgcctcgcagaatacaagtcattgacccgaaattcctcggtccccactattccttccaccggtgggacttcaggc

SEQ ID NO: 339195 - DNA, 75 bp, Artificial Sequence
  Synthetic
actatttaactacaattaaaacacatctacaacctaacaactcagcaataaacccaaacactcaatggcacttag

SEQ ID NO: 339196 - DNA, 75 bp, Artificial Sequence
  Synthetic
tccgtttttatcagcaggcagactgaacccagaaataaaaggcctatacacagacataacatataaccccatgat

SEQ ID NO: 339197 - DNA, 75 bp, Artificial Sequence
  Synthetic
aacccagaaataaaaggcctatacacagacataacatataaccccatgatggacaaaggcacaggcaacaaaatc

SEQ ID NO: 339198 - DNA, 75 bp, Artificial Sequence
  Synthetic
acatgaaatacacagaaggcagatccaagtacctcatagaaaacctgcctctctgggccgccgtctggggctacc

SEQ ID NO: 339199 - DNA, 75 bp, Artificial Sequence
  Synthetic
acggggcagacgcagagggcgacgaaagagatacagacaggctctagtagtgaggcaatggcaacctgacgttgt

SEQ ID NO: 339200 - DNA, 75 bp, Artificial Sequence
  Synthetic
caagtacctcatagaaaacctgcctctctgggccgccgtctggggctacctagactactgcacaaaaacctcagg

SEQ ID NO: 339201 - DNA, 75 bp, Artificial Sequence
  Synthetic
agagtaacactcatctctccatacaccagccccatgctattcaatccccaagaccccacaaaaggcttcgtacct

SEQ ID NO: 339202 - DNA, 75 bp, Artificial Sequence
  Synthetic
ccagccccatgctattcaatccccaagaccccacaaaaggcttcgtaccttacagcctgaactttggcctaggta

SEQ ID NO: 339203 - DNA, 75 bp, Artificial Sequence
  Synthetic
ccccctaagaatgagagcaaactggtacccgtacttctttcaccaacaaaaagtactggaggccataggcatgtc

SEQ ID NO: 339204 - DNA, 75 bp, Artificial Sequence
  Synthetic
tacccgtacttctttcaccaacaaaaagtactggaggccataggcatgtcaggacccttcacatacagaagcgac

SEQ ID NO: 339205 - DNA, 75 bp, Artificial Sequence
  Synthetic
gctacaaatttaaattcacatggggcggcaatcctgtctcacaccaggtggtccgaaacccctgtaaaggcaccg

SEQ ID NO: 339206 - DNA, 75 bp, Artificial Sequence
  Synthetic
cggcaatcctgtctcacaccaggtggtccgaaacccctgtaaaggcaccggcggcgcctcagccagtcgaaaacc

SEQ ID NO: 339207 - DNA, 75 bp, Artificial Sequence
  Synthetic
aaatacaacacgcccgagatcacaacacacacctgggacatcagacgtggatggtttggtaaaagatttattgac

SEQ ID NO: 339208 - DNA, 75 bp, Artificial Sequence
  Synthetic
cacacacctgggacatcagacgtggatggtttggtaaaagatttattgaccgagtgcaacaacaacaagcatctc

SEQ ID NO: 339209 - DNA, 75 bp, Artificial Sequence
  Synthetic
gagaccccgaaaagagatcaaggggctcacggaggccgaccaagaagcagaaaaagactctggactccgactcag

SEQ ID NO: 339210 - DNA, 75 bp, Artificial Sequence
  Synthetic
ctcacggaggccgaccaagaagcagaaaaagactctggactccgactcagacaagtccagccgtggatgtcatcg

SEQ ID NO: 339211 - DNA, 75 bp, Artificial Sequence
  Synthetic
gcgcgccagaggagcagacggtggagcagcagctcagaaaccaactccacacgcagcagctcctcggattccagc

SEQ ID NO: 339212 - DNA, 75 bp, Artificial Sequence
  Synthetic
gcagcagctcagaaaccaactccacacgcagcagctcctcggattccagctccgaagcctcatgtaccaagtcca

SEQ ID NO: 339213 - DNA, 75 bp, Artificial Sequence
  Synthetic
caccccctattgttaccccgggcttaggtaaaaagtggctgctcccagagagggtacctatagtgttcacccccc

SEQ ID NO: 339214 - DNA, 75 bp, Artificial Sequence
  Synthetic
aggtaaaaagtggctgctcccagagagggtacctatagtgttcaccccccaacagtgggaggacgagtatgttac

SEQ ID NO: 339215 - DNA, 75 bp, Artificial Sequence
  Synthetic
aaacacaaccccctagacactcccttctacccctgggcacccaaagcccctcctcaatgccgtgtaacttttaag

SEQ ID NO: 339216 - DNA, 75 bp, Artificial Sequence
  Synthetic
tctacccctgggcacccaaagcccctcctcaatgccgtgtaacttttaagcttggatttcaataaagcgaggccg

SEQ ID NO: 339217 - DNA, 75 bp, Artificial Sequence
  Synthetic
tttataaaagtcactaaggcctccgagcgtagcgaggaggccgaccctccgccaaggagcagcttcctcggggtc

SEQ ID NO: 339218 - DNA, 75 bp, Artificial Sequence
  Synthetic
agcgtagcgaggaggccgaccctccgccaaggagcagcttcctcggggtcgcgcgctacgccttcggctgcgcgc

SEQ ID NO: 339219 - DNA, 75 bp, Artificial Sequence
  Synthetic
tccgcgcttgcgcgcgtccgaccttcggcctcggggggggcgggggctttactaaacagactccgagacgccatt

SEQ ID NO: 339220 - DNA, 75 bp, Artificial Sequence
  Synthetic
cggcctcggggggggcgggggctttactaaacagactccgagacgccattggatctcggagctgccattcagcaa

SEQ ID NO: 339221 - DNA, 75 bp, Artificial Sequence
  Synthetic
gacgtattgcctttatcttctcgccattggtccgtttaaaacacgccataggccgcggaccccattttcgcccgc

SEQ ID NO: 339222 - DNA, 75 bp, Artificial Sequence
  Synthetic
attggtccgtttaaaacacgccataggccgcggaccccattttcgcccgccaaaatcgcttcccggcgcgtttta

SEQ ID NO: 339223 - DNA, 75 bp, Artificial Sequence
  Synthetic
aggggtcgaaggtcagaccacgtggtaagtcacgtgggggcagctgctgtaaacccggaagtagctgacccgcgt

SEQ ID NO: 339224 - DNA, 75 bp, Artificial Sequence
  Synthetic
taagtcacgtgggggcagctgctgtaaacccggaagtagctgacccgcgtgactggtcacgtgacctgacgtcac

SEQ ID NO: 339225 - DNA, 75 bp, Artificial Sequence
  Synthetic
ggcgtgtaacccggaagtcatcctcatcacgtgacctgacgtcacggccgccattttgtgctgtccgccatcttg

SEQ ID NO: 339226 - DNA, 75 bp, Artificial Sequence
  Synthetic
gccgacttccttcctcttttttaaacaaaaagcggaaataaccgtccgggggcggggcgcgcgcttcgcgcgcgc

SEQ ID NO: 339227 - DNA, 75 bp, Artificial Sequence
  Synthetic
cccgggggggagcacagctcccccccccccgcgcgcatgcgcgcgggtcccccccccctcggggggctccgcccc

SEQ ID NO: 339228 - DNA, 75 bp, Artificial Sequence
  Synthetic
tccacagcgaaccactggtgtacgtgattcacttcctgggcgtaacttatgtactcatataagtaactgcacttc

SEQ ID NO: 339229 - DNA, 75 bp, Artificial Sequence
  Synthetic
gattcacttcctgggcgtaacttatgtactcatataagtaactgcacttccgaatggctgagttttccacgcccg

SEQ ID NO: 339230 - DNA, 75 bp, Artificial Sequence
  Synthetic
aagatcgtcactaaccacgtgactctccacagcgaaccactggtgtacgtgattcacttcctgggcgtaacttat

SEQ ID NO: 339231 - DNA, 75 bp, Artificial Sequence
  Synthetic
gtcaaggggcaattcgggctcgggactggccgggctatgggcaaggctcttagggtattcactcttaaaatgcac

SEQ ID NO: 339232 - DNA, 75 bp, Artificial Sequence
  Synthetic
ggaaagtgtttctgccggcactgccagctccaccgccgcctaggcaacttctaatgtggcagccacctacccaga

SEQ ID NO: 339233 - DNA, 75 bp, Artificial Sequence
  Synthetic
agctccaccgccgcctaggcaacttctaatgtggcagccacctacccagaatggaacccaactcgaacggcactg

SEQ ID NO: 339234 - DNA, 75 bp, Artificial Sequence
  Synthetic
gctgccttttgtagctgtggcgactgtattggccatcttcagcatctggctactaacctgggtcgaccacctgct

SEQ ID NO: 339235 - DNA, 75 bp, Artificial Sequence
  Synthetic
gtattggccatcttcagcatctggctactaacctgggtcgaccacctgctccacaaccgccgcgagaccaacacc

SEQ ID NO: 339236 - DNA, 75 bp, Artificial Sequence
  Synthetic
actcccggcacctcccagtaacagaaactcatggcctggtactggtggagacgccgccggaggagaggctggtgg

SEQ ID NO: 339237 - DNA, 75 bp, Artificial Sequence
  Synthetic
aactcatggcctggtactggtggagacgccgccggaggagaggctggtggaagccgaggcgcaggagatggagga

SEQ ID NO: 339238 - DNA, 75 bp, Artificial Sequence
  Synthetic
tgctagacgccatcgcgctcgccgcagagtaaggaggcgaagggggaggtggaggagacgatacagacgctggcg

SEQ ID NO: 339239 - DNA, 75 bp, Artificial Sequence
  Synthetic
agagtaaggaggcgaagggggaggtggaggagacgatacagacgctggcgcagacgcggggggcgacgcagacac

SEQ ID NO: 339240 - DNA, 75 bp, Artificial Sequence
  Synthetic
ggcaacctaactttattagacactgctacataataggatacatgccactgataatatgtggagagaacactttct

SEQ ID NO: 339241 - DNA, 75 bp, Artificial Sequence
  Synthetic
aagtccgtcactaaccacgtgactcccgcaggccaaccgagtgctatgtcgtgcacttcctgggcggagtctacg

SEQ ID NO: 339242 - DNA, 75 bp, Artificial Sequence
  Synthetic
ctacataataggatacatgccactgataatatgtggagagaacactttctcccacaactatgccacccactcgga

SEQ ID NO: 339243 - DNA, 75 bp, Artificial Sequence
  Synthetic
ggagggggcatgactaccacaaaattcaccctaagaatactctttgacgagtaccaaagacacttaaatttctgg

SEQ ID NO: 339244 - DNA, 75 bp, Artificial Sequence
  Synthetic
tcaccctaagaatactctttgacgagtaccaaagacacttaaatttctggaccgttagcaaccaagacctagacc

SEQ ID NO: 339245 - DNA, 75 bp, Artificial Sequence
  Synthetic
tggccgggccccgggcaaggctcttaaaaaatgcactttcgcagagtgcgagcgaaaaggaaactgctactgcaa

SEQ ID NO: 339246 - DNA, 75 bp, Artificial Sequence
  Synthetic
catcttctttagacaccccacggtagactttgtggtacaaatacacacacagcctcccttccaagacacagagat

SEQ ID NO: 339247 - DNA, 75 bp, Artificial Sequence
  Synthetic
gactttgtggtacaaatacacacacagcctcccttccaagacacagagataacagcacccagcatacacccagga

SEQ ID NO: 339248 - DNA, 75 bp, Artificial Sequence
  Synthetic
ctgccatgagcttcaccacacctactattaatgccgggatccgagagcagcaatggttcgagtccatccttagat

SEQ ID NO: 339249 - DNA, 75 bp, Artificial Sequence
  Synthetic
tattaatgccgggatccgagagcagcaatggttcgagtccatccttagatcccaccactcgttctgtggctgtgg

SEQ ID NO: 339250 - DNA, 75 bp, Artificial Sequence
  Synthetic
tactaatacccagcctaaaaaccaggccctctaaaaaacactatgtaaaagttagagtaggggccccaagactct

SEQ ID NO: 339251 - DNA, 75 bp, Artificial Sequence
  Synthetic
gccctctaaaaaacactatgtaaaagttagagtaggggccccaagactctttcaggacaagtggtacccccagag

SEQ ID NO: 339252 - DNA, 75 bp, Artificial Sequence
  Synthetic
cttgctactcgctttaactatctgcctactacctcttcgcctctggaccctcccggcccagcgccgcgaggccgc

SEQ ID NO: 339253 - DNA, 75 bp, Artificial Sequence
  Synthetic
gttatctatgcaaccgcatgtgacttgcaatatccgttcggctcaccacaaactgacaacgtatgtgtcaacttc

SEQ ID NO: 339254 - DNA, 75 bp, Artificial Sequence
  Synthetic
tgcaatatccgttcggctcaccacaaactgacaacgtatgtgtcaacttccagatattggggcaaccctattacc

SEQ ID NO: 339255 - DNA, 75 bp, Artificial Sequence
  Synthetic
tagagatccagtatggcctactggttccgagggtggggctggaggccgaggcgccggtggagaaggtggcgccgc

SEQ ID NO: 339256 - DNA, 75 bp, Artificial Sequence
  Synthetic
tccgagggtggggctggaggccgaggcgccggtggagaaggtggcgccgccgtcgaaggagactaccgagaagaa

SEQ ID NO: 339257 - DNA, 75 bp, Artificial Sequence
  Synthetic
aactgaaaaaaccacatacgaaaaccactataaaaataacttatataagaaaattaaattttataacactacaga

SEQ ID NO: 339258 - DNA, 75 bp, Artificial Sequence
  Synthetic
cactataaaaataacttatataagaaaattaaattttataacactacagaaacaatagcacaactaaaacctcta

SEQ ID NO: 339259 - DNA, 75 bp, Artificial Sequence
  Synthetic
tggaagaagacgcaaaccaagggtaaggaggcgccgcacacgccgcagacgtgtctacaaacgggggtggagacg

SEQ ID NO: 339260 - DNA, 75 bp, Artificial Sequence
  Synthetic
ggtcacattacgtaaaccctaataaacttacaacaacacctacatcagaaataacccataataacacatggtaca

SEQ ID NO: 339261 - DNA, 75 bp, Artificial Sequence
  Synthetic
cgcaaaaagaaactcgtactgactcagtggaacccggcagtagttaagaggtgcaacattaagggcggacttcca

SEQ ID NO: 339262 - DNA, 75 bp, Artificial Sequence
  Synthetic
acttacaacaacacctacatcagaaataacccataataacacatggtacagaggcaatgcatacaatgacaaaat

SEQ ID NO: 339263 - DNA, 75 bp, Artificial Sequence
  Synthetic
cagcctttaactatggctaccacatggaggactacactccccaacctttccccttcggagggggaatgagcacag

SEQ ID NO: 339264 - DNA, 75 bp, Artificial Sequence
  Synthetic
aaaagctattataaagccacagaacttgctataccagaagcagtaaaacccaccacagacttatttgagtaccac

SEQ ID NO: 339265 - DNA, 75 bp, Artificial Sequence
  Synthetic
ttgctataccagaagcagtaaaacccaccacagacttatttgagtaccacgcaggcatatacagctccatattcc

SEQ ID NO: 339266 - DNA, 75 bp, Artificial Sequence
  Synthetic
tgactttctctctgaaagccttatatgatcagtacctcaaacaccaaaacaggtggactttctcaaacgaccagc

SEQ ID NO: 339267 - DNA, 75 bp, Artificial Sequence
  Synthetic
gacccctggagcataccaagacataatttacaatccctttacagacaaaggaataggaaacatagtgtggataga

SEQ ID NO: 339268 - DNA, 75 bp, Artificial Sequence
  Synthetic
atttacaatccctttacagacaaaggaataggaaacatagtgtggatagactggctcagtaaatcagacgcagta

SEQ ID NO: 339269 - DNA, 75 bp, Artificial Sequence
  Synthetic
taaactaaggttttacagaagccccgtctgtgactttatagtacactacaacctaatacctccactaaaaatgaa

SEQ ID NO: 339270 - DNA, 75 bp, Artificial Sequence
  Synthetic
gtctgtgactttatagtacactacaacctaatacctccactaaaaatgaaccagtttacaagtcccaacacgcac

SEQ ID NO: 339271 - DNA, 75 bp, Artificial Sequence
  Synthetic
gtatatttgacctacctctatgggcagccttctttggatatgcagagttctgctccaaaagcacaggagacacag

SEQ ID NO: 339272 - DNA, 75 bp, Artificial Sequence
  Synthetic
agccttctttggatatgcagagttctgctccaaaagcacaggagacacagccatagcatacaacagcagagtatg

SEQ ID NO: 339273 - DNA, 75 bp, Artificial Sequence
  Synthetic
acaaaataataattcccagcttccaaacaagaccggggggcaaacgctttgttaaaataagacttaatcccccca

SEQ ID NO: 339274 - DNA, 75 bp, Artificial Sequence
  Synthetic
aacaagaccggggggcaaacgctttgttaaaataagacttaatccccccaaactatttgaagacaagtggtacac

SEQ ID NO: 339275 - DNA, 75 bp, Artificial Sequence
  Synthetic
cagctgttaaaccacaacaacccctcacagggatatgtgttttactcttacaactttggcaaaggcaagatgccc

SEQ ID NO: 339276 - DNA, 75 bp, Artificial Sequence
  Synthetic
cacagggatatgtgttttactcttacaactttggcaaaggcaagatgcccggaggcagttcccaggtacctataa

SEQ ID NO: 339277 - DNA, 75 bp, Artificial Sequence
  Synthetic
ctcgttagtattacagcaactgcggctgacttgcggtatccgttctgctcaccacaaacgaacaacccttgcacc

SEQ ID NO: 339278 - DNA, 75 bp, Artificial Sequence
  Synthetic
ctgacttgcggtatccgttctgctcaccacaaacgaacaacccttgcaccaccttccaggtgctgcgcaagaact

SEQ ID NO: 339279 - DNA, 75 bp, Artificial Sequence
  Synthetic
catgttccaccagctagaggtcatggaagctatatgccaaagcggaccgtttgcatatcacagcgacgaaaaaaa

SEQ ID NO: 339280 - DNA, 75 bp, Artificial Sequence
  Synthetic
gaagctatatgccaaagcggaccgtttgcatatcacagcgacgaaaaaaaagcagtactaggcataaaatataag

SEQ ID NO: 339281 - DNA, 75 bp, Artificial Sequence
  Synthetic
aaaagaccaagagtccacacaagactttgaaaaatggctatatggcacagactcacactatcaaacatttgccac

SEQ ID NO: 339282 - DNA, 75 bp, Artificial Sequence
  Synthetic
tttgaaaaatggctatatggcacagactcacactatcaaacatttgccacagaagctcaactaggtagaatacct

SEQ ID NO: 339283 - DNA, 75 bp, Artificial Sequence
  Synthetic
ctatctcccaacagatcgtccgacacccctgcaacggacagacctcctcaggcaatagagtgcctcgctcagtac

SEQ ID NO: 339284 - DNA, 75 bp, Artificial Sequence
  Synthetic
cccctgcaacggacagacctcctcaggcaatagagtgcctcgctcagtacaagcagttgacccgaaatacgtctc

SEQ ID NO: 339285 - DNA, 75 bp, Artificial Sequence
  Synthetic
actcacaaaaagagatctggcaacaaagctggagcaaaaaaaatgaccaatggtcaggatcaggcacatacccac

SEQ ID NO: 339286 - DNA, 75 bp, Artificial Sequence
  Synthetic
aagctggagcaaaaaaaatgaccaatggtcaggatcaggcacatacccacaggatactacagaaatgtacaaaat

SEQ ID NO: 339287 - DNA, 75 bp, Artificial Sequence
  Synthetic
gacttcagaagaggcctctttggccaggcaggtattaagagaatgcaacaagaatcagatgctcttacactttct

SEQ ID NO: 339288 - DNA, 75 bp, Artificial Sequence
  Synthetic
aggcaggtattaagagaatgcaacaagaatcagatgctcttacactttctccagtccacagacccaaacgcccca

SEQ ID NO: 339289 - DNA, 75 bp, Artificial Sequence
  Synthetic
cctacatacaaagcacaacctcaatatattaaaaacagaagagccttaaactttaaatatgaaatagaaaaccct

SEQ ID NO: 339290 - DNA, 75 bp, Artificial Sequence
  Synthetic
atattaaaaacagaagagccttaaactttaaatatgaaatagaaaaccctgttagtaaaaaagtatggccacaac

SEQ ID NO: 339291 - DNA, 75 bp, Artificial Sequence
  Synthetic
aacgcccgaaaaagactcagattcagcagtccaactcagaagactccagccctggatccactccagtcaagaaac

SEQ ID NO: 339292 - DNA, 75 bp, Artificial Sequence
  Synthetic
gcagtccaactcagaagactccagccctggatccactccagtcaagaaacaaaagacgaagaggaggagataccg

SEQ ID NO: 339293 - DNA, 75 bp, Artificial Sequence
  Synthetic
ctactatgaataccactgtggatggttcagtaacatatttataggcccaaacagatacaatttacaatttcaaac

SEQ ID NO: 339294 - DNA, 75 bp, Artificial Sequence
  Synthetic
ttcagtaacatatttataggcccaaacagatacaatttacaatttcaaacagcatacgtagacaccacatataac

SEQ ID NO: 339295 - DNA, 75 bp, Artificial Sequence
  Synthetic
tccagcagctccagcagcagcgactcctcagagtccagctcgagtccattgcccaagaagtcctcaaaatcagga

SEQ ID NO: 339296 - DNA, 75 bp, Artificial Sequence
  Synthetic
cctcagagtccagctcgagtccattgcccaagaagtcctcaaaatcaggagggggcacagcctccaccccctact

SEQ ID NO: 339297 - DNA, 75 bp, Artificial Sequence
  Synthetic
acaaaatatggttccagtacctttctaaaaaaggcacagactataatgaaaaacaatgctactgccttctagaag

SEQ ID NO: 339298 - DNA, 75 bp, Artificial Sequence
  Synthetic
taaaaaaggcacagactataatgaaaaacaatgctactgccttctagaagacatgcccctgtgggcaatgtgctt

SEQ ID NO: 339299 - DNA, 75 bp, Artificial Sequence
  Synthetic
ttatgtttaaccctccaggtccaaaacgcatcactgggtacgaggcctggagggatgaatatgaaacatgcaagg

SEQ ID NO: 339300 - DNA, 75 bp, Artificial Sequence
  Synthetic
acgcatcactgggtacgaggcctggagggatgaatatgaaacatgcaaggcctggaacaggccccctagatcctt

SEQ ID NO: 339301 - DNA, 75 bp, Artificial Sequence
  Synthetic
caattaggcccaaatgtagaccatgaaacagcgggccttctaataataatatgtccttacactcaaccacctatg

SEQ ID NO: 339302 - DNA, 75 bp, Artificial Sequence
  Synthetic
aaacagcgggccttctaataataatatgtccttacactcaaccacctatgtatgacaaaactaaacccaactggg

SEQ ID NO: 339303 - DNA, 75 bp, Artificial Sequence
  Synthetic
tggatgcccaaagcccaagaccaatttcgtgtaagcttcaaacttggctttcattaaaatttcaaggccgtgcaa

SEQ ID NO: 339304 - DNA, 75 bp, Artificial Sequence
  Synthetic
tggcaatggaaaaatgccctccggaacaggccaagttccagtatactggcaatgcagatggagacccatgctgtg

SEQ ID NO: 339305 - DNA, 75 bp, Artificial Sequence
  Synthetic
tcattaaaatttcaaggccgtgcaacattcacttgtcggtgtctacctctaaaggtcactaagcactccgagcgc

SEQ ID NO: 339306 - DNA, 75 bp, Artificial Sequence
  Synthetic
gttccaagaacaagtactaaatgacatctcaaagactggaccgtacgcctacagagacgaatataaaaatgtaca

SEQ ID NO: 339307 - DNA, 75 bp, Artificial Sequence
  Synthetic
gacactgagggggcatacagcaacgaaagtgagtggggccagacttcgccataaggcctttatcttcttgccatt

SEQ ID NO: 339308 - DNA, 75 bp, Artificial Sequence
  Synthetic
tttaactgggggggcgacatgtattacccacaggtcgttaaaaacccctgtggagactccggaatcgttcccggt

SEQ ID NO: 339309 - DNA, 75 bp, Artificial Sequence
  Synthetic
aaagtgagtggggccagacttcgccataaggcctttatcttcttgccatttgtcagtatagggggtcgccatagg

SEQ ID NO: 339310 - DNA, 75 bp, Artificial Sequence
  Synthetic
tccggtagattcactcgagaagtacaagtcgttagcccgctttccatgggaccggcgtacatcttccactacttc

SEQ ID NO: 339311 - DNA, 75 bp, Artificial Sequence
  Synthetic
ataaggcctttatcttcttgccatttgtcagtatagggggtcgccataggcttcggcctccattttaggccttcc

SEQ ID NO: 339312 - DNA, 75 bp, Artificial Sequence
  Synthetic
aacgtcacggccgccattttaagtaggtgccgtccagcactgctgttccgggttaaagggcatcctcggcggaac

SEQ ID NO: 339313 - DNA, 75 bp, Artificial Sequence
  Synthetic
aaaaagctcttaaaagaatgcaacaacaacaagaatttgatgaatcttttacattcaaacctaagagacccaaac

SEQ ID NO: 339314 - DNA, 75 bp, Artificial Sequence
  Synthetic
acaacaagaatttgatgaatcttttacattcaaacctaagagacccaaactttctacagcagccacagaaatcct

SEQ ID NO: 339315 - DNA, 75 bp, Artificial Sequence
  Synthetic
ggtgccgtccagcactgctgttccgggttaaagggcatcctcggcggaacctatacaaaatggccgccaatttct

SEQ ID NO: 339316 - DNA, 75 bp, Artificial Sequence
  Synthetic
catcgatgacgtggggaggcgtactatgaaacgcggaagtaggccccgctacgtcatcatcacgtgggtgctgcg

SEQ ID NO: 339317 - DNA, 75 bp, Artificial Sequence
  Synthetic
ggggaaggaaaatcgccactacagcaaaaaaagaaagaagcagaagtcctcgaaacgtcacaaatacagctccag

SEQ ID NO: 339318 - DNA, 75 bp, Artificial Sequence
  Synthetic
tcacggccgccattttgttttacaaaatggccgacttccttcctgttttttaaaaattaaccgttagcggcggcg

SEQ ID NO: 339319 - DNA, 75 bp, Artificial Sequence
  Synthetic
cgaaacgtcacaaatacagctccagctccagcggaacatccaggagcagctcgcaatcaagcaccagctccaatt

SEQ ID NO: 339320 - DNA, 75 bp, Artificial Sequence
  Synthetic
caatccaatttgcatttaaacccacaatttttaagccgttcataaaatatgacatgtttggggacccccttcctc

SEQ ID NO: 339321 - DNA, 75 bp, Artificial Sequence
  Synthetic
gccccccaacagcccaagactgggccacagaatatgagtgctgtaaggcctttaacaggccacctagaaccaacc

SEQ ID NO: 339322 - DNA, 75 bp, Artificial Sequence
  Synthetic
ggtccctaaacctaaacctcaattccgtgtatcttttaaacttggttttcaataaacaaggccgtgggagtttca

SEQ ID NO: 339323 - DNA, 75 bp, Artificial Sequence
  Synthetic
aataaacaaggccgtgggagtttcacttgtcggtgtcaacctcttaaggtcactaagcactccgagcgtaagcga

SEQ ID NO: 339324 - DNA, 75 bp, Artificial Sequence
  Synthetic
ctttatcttcttgccatttgtcagtgtctggggtcgccataggcttcggcctccattttaggccttccggactac

SEQ ID NO: 339325 - DNA, 75 bp, Artificial Sequence
  Synthetic
tggccgccattttaggctgttgccgggcgtttgacttccgtgttaaaggtcaaacacccagcgacaccaaaaaat

SEQ ID NO: 339326 - DNA, 75 bp, Artificial Sequence
  Synthetic
ggcgtttgacttccgtgttaaaggtcaaacacccagcgacaccaaaaaatggccgtcaattgcttccggggtcaa

SEQ ID NO: 339327 - DNA, 75 bp, Artificial Sequence
  Synthetic
gtgacagggaggggcgacaaacccggaagtcatcctcgcccacgtgacttaccacgtggtgtgtacgtcacacgc

SEQ ID NO: 339328 - DNA, 75 bp, Artificial Sequence
  Synthetic
gaagtcatcctcgcccacgtgacttaccacgtggtgtgtacgtcacacgccgccattttcaatcacaaaatggcg

SEQ ID NO: 339329 - DNA, 75 bp, Artificial Sequence
  Synthetic
gcttcgcgcgcgcgccgggggctgccgcccccccccgcgcatgcgcgcggggcccccccccgcggggggctccgc

SEQ ID NO: 339330 - DNA, 75 bp, Artificial Sequence
  Synthetic
tgactcccacaggccaaccacagtctatgtcgtgcacttcctgggcatggtctacgtgataatataaagcggtgc

SEQ ID NO: 339331 - DNA, 75 bp, Artificial Sequence
  Synthetic
actgtgcgagctacacagaagactaggcggcttctaggtatgtggcagccccccgtgcacaatgtccccggcatc

SEQ ID NO: 339332 - DNA, 75 bp, Artificial Sequence
  Synthetic
cgggggggcgccagcgcccccccccccgcgcatgcgcgggtcctcccccccctcggggggctccgccccccggcc

SEQ ID NO: 339333 - DNA, 75 bp, Artificial Sequence
  Synthetic
tatagtacagagcggaccgttcgggtacaagggcgacataaaatcagctgtactgtccgtgaaatacagatttta

SEQ ID NO: 339334 - DNA, 75 bp, Artificial Sequence
  Synthetic
gctacgtcactaacctacgtgtccgtctcctataggccagacaccgtctacgtcatacacttcctgggcatggtc

SEQ ID NO: 339335 - DNA, 75 bp, Artificial Sequence
  Synthetic
cgtcatacacttcctgggcatggtctacgtgataatataagtggcagcacttccgaatggctgagttttccacgc

SEQ ID NO: 339336 - DNA, 75 bp, Artificial Sequence
  Synthetic
ggactggccgggctatgggcaaggctctgaaaaatgcacttttctaggtgtagcagaaagaaaaggacactgtca

SEQ ID NO: 339337 - DNA, 75 bp, Artificial Sequence
  Synthetic
aagctaggccatctgtgagaggtatgtggagaccccccaggcgaaatgaattcactattcaacgtaactggttct

SEQ ID NO: 339338 - DNA, 75 bp, Artificial Sequence
  Synthetic
gtggagaccccccaggcgaaatgaattcactattcaacgtaactggttctacagttgctttcactcccactcttc

SEQ ID NO: 339339 - DNA, 75 bp, Artificial Sequence
  Synthetic
ggtcatttcaatcacatcgctgctatgctcggccgtccggaagaccagaaccctcctccgccacccggggctgtg

SEQ ID NO: 339340 - DNA, 75 bp, Artificial Sequence
  Synthetic
agacccctacctgctctcccggccgcccccgaggcgcccggtgatcgagcaccatggcctatgggtggtggcgca

SEQ ID NO: 339341 - DNA, 75 bp, Artificial Sequence
  Synthetic
gaggagatggcgccgctggagacgccgtcggagaccccgcagacgccgacctcgtcgccgctatcgacgccgcag

SEQ ID NO: 339342 - DNA, 75 bp, Artificial Sequence
  Synthetic
cgtcggagaccccgcagacgccgacctcgtcgccgctatcgacgccgcagaacagtaaggagacgcggcaggggg

SEQ ID NO: 339343 - DNA, 75 bp, Artificial Sequence
  Synthetic
ctcgtcgccgctatcgacgccgcagaacagtaaggagacgcggcagggggaggtggactaagagatatagacgat

SEQ ID NO: 339344 - DNA, 75 bp, Artificial Sequence
  Synthetic
caaaaaaaaaattattataaaacaatggcagcccaactacagacgcagatgcaacatagtgggctacatgcctct

SEQ ID NO: 339345 - DNA, 75 bp, Artificial Sequence
  Synthetic
gccagaaactatgccacccactcagacgacagctactaccctggaccctttggggggggaatgaccgcagacaaa

SEQ ID NO: 339346 - DNA, 75 bp, Artificial Sequence
  Synthetic
agactttataattataattaacacatcacctccatttctagacaccgagataacaggccctagcatacacccggg

SEQ ID NO: 339347 - DNA, 75 bp, Artificial Sequence
  Synthetic
tcacctccatttctagacaccgagataacaggccctagcatacacccgggtatgatggccctcaacaaacgagtc

SEQ ID NO: 339348 - DNA, 75 bp, Artificial Sequence
  Synthetic
gattaaagtgggagccccccgaatgttcacagataagtggtacccccagacagacctctgtgacatgacactcct

SEQ ID NO: 339349 - DNA, 75 bp, Artificial Sequence
  Synthetic
taactgacactatagttgtgtcactccaagttctgcaatccatgttcaacgactgcctgagtgtacttcctacta

SEQ ID NO: 339350 - DNA, 75 bp, Artificial Sequence
  Synthetic
cacacaattacataagaaaattataaatcatttaccgtactacaacaccacacaaacacaagcacaatttaagag

SEQ ID NO: 339351 - DNA, 75 bp, Artificial Sequence
  Synthetic
aatcatttaccgtactacaacaccacacaaacacaagcacaatttaagagatttatagaaaacaaaactgcaaca

SEQ ID NO: 339352 - DNA, 75 bp, Artificial Sequence
  Synthetic
acatcaacaccgaaaaatttaacaaagaacagtcacctaaaaatgacaatggcataggaggtccatactgcacct

SEQ ID NO: 339353 - DNA, 75 bp, Artificial Sequence
  Synthetic
agcatacaacgagaaaattaaaaagatacctgaggaggcaagcaagctatactatgaagagactaaacaattaat

SEQ ID NO: 339354 - DNA, 75 bp, Artificial Sequence
  Synthetic
cacaggttgcactactgcggaggcctgtactcctcagtatggctatctgcaggcagatcgtactttgaaaccaag

SEQ ID NO: 339355 - DNA, 75 bp, Artificial Sequence
  Synthetic
ggtccctacacagacataacatacaacccattctcagacagaggcgaaggcaacatgctgtggatagactggcta

SEQ ID NO: 339356 - DNA, 75 bp, Artificial Sequence
  Synthetic
acccattctcagacagaggcgaaggcaacatgctgtggatagactggctaactaaagatacctcagtatatgaca

SEQ ID NO: 339357 - DNA, 75 bp, Artificial Sequence
  Synthetic
acccattctcagacagaggcgaaggcaacatgctgtggatagactggctaactaaagttacctcagtatatgaca

SEQ ID NO: 339358 - DNA, 75 bp, Artificial Sequence
  Synthetic
acccattctcagacagaggcgaaggcaacatgctgtggatagactggctaactaaagctacctcagtatatgaca

SEQ ID NO: 339359 - DNA, 75 bp, Artificial Sequence
  Synthetic
acccattctcagacagaggcgaaggcaacatgctgtggatagactggctaactaaaggtacctcagtatatgaca

SEQ ID NO: 339360 - DNA, 75 bp, Artificial Sequence
  Synthetic
aaacatgcccttgtgggcgtctgtgtacggattctccgagtactgcagtaaagtaacaggagacacaaacataga

SEQ ID NO: 339361 - DNA, 75 bp, Artificial Sequence
  Synthetic
agcccctacacagtgccacaactgttagatcacaacaaccccctaaggggatacgtaccgtacagttttaacttt

SEQ ID NO: 339362 - DNA, 75 bp, Artificial Sequence
  Synthetic
agcccctacacagtgccacaactgttagatcacaacaacccccttaggggatacgtaccgtacagttttaacttt

SEQ ID NO: 339363 - DNA, 75 bp, Artificial Sequence
  Synthetic
agcccctacacagtgccacaactgttagatcacaacaaccccctcaggggatacgtaccgtacagttttaacttt

SEQ ID NO: 339364 - DNA, 75 bp, Artificial Sequence
  Synthetic
agcccctacacagtgccacaactgttagatcacaacaaccccctgaggggatacgtaccgtacagttttaacttt

SEQ ID NO: 339365 - DNA, 75 bp, Artificial Sequence
  Synthetic
tcactcagatattaaaaaagtgtcactgggcttaaaatacagatttaagtgggtgtggggtggcaaccccgtgtc

SEQ ID NO: 339366 - DNA, 75 bp, Artificial Sequence
  Synthetic
gggtgtggggtggcaaccccgtgtcccaacaggttgttaggaacccctgcaagaccacccaaggttcctcgggca

SEQ ID NO: 339367 - DNA, 75 bp, Artificial Sequence
  Synthetic
ccaacaggttgttaggaacccctgcaagaccacccaaggttcctcgggcagtagagtgcctcgatcaatacaagt

SEQ ID NO: 339368 - DNA, 75 bp, Artificial Sequence
  Synthetic
cgttgacccgcggtacaacacaccagaactcaccattcacgcgtgggacttcagacatgggttctttggcaaaaa

SEQ ID NO: 339369 - DNA, 75 bp, Artificial Sequence
  Synthetic
gaactcaccattcacgcgtgggacttcagacatgggttctttggcaaaaaagctattaagcgaatgcaggagcaa

SEQ ID NO: 339370 - DNA, 75 bp, Artificial Sequence
  Synthetic
cagggttcaagcgcagtcgccgagatacagaagcactccaatccagccaagaagagcacgaaaaagaaaacttac

SEQ ID NO: 339371 - DNA, 75 bp, Artificial Sequence
  Synthetic
ttttcccagtccagcagctcaagcgagtccccccgtgggagacctcgcaagagagccaaagcgaggaagaaaact

SEQ ID NO: 339372 - DNA, 75 bp, Artificial Sequence
  Synthetic
gagagccaaagcgaggaagaaaactcgcaaaaacaggagaccctctcccagcaactcagagaccagctgcacaag

SEQ ID NO: 339373 - DNA, 75 bp, Artificial Sequence
  Synthetic
gcaactcagagaccagctgcacaagcagcggctcatgggagagcaactccgatcgctcctctaccaaatgcagag

SEQ ID NO: 339374 - DNA, 75 bp, Artificial Sequence
  Synthetic
cctatgttattgccaaagggtctggcattaacgtctatttctcacaatgtaatatagatatgtttggtgacccca

SEQ ID NO: 339375 - DNA, 75 bp, Artificial Sequence
  Synthetic
ctgggaggaggagtacgaggccgcaaagcactgggacagaccccccagacacgacctcagaagcacccccttcta

SEQ ID NO: 339376 - DNA, 75 bp, Artificial Sequence
  Synthetic
tacaatgtcaactttgcccttaactacaaataaacggtggccgtgggagtttcacttgtcggtgtctacctctta

SEQ ID NO: 339377 - DNA, 75 bp, Artificial Sequence
  Synthetic
acaaataaacggtggccgtgggagtttcacttgtcggtgtctacctcttaaggtcactaagcactccgagcgtaa

SEQ ID NO: 339378 - DNA, 75 bp, Artificial Sequence
  Synthetic
actgagggggtgaacagcaacgaaagtgagtggggccagacttcgccatagggcctttatcttcttgccatttgt

SEQ ID NO: 339379 - DNA, 75 bp, Artificial Sequence
  Synthetic
cgtcacgggcgccatcttaagtggctgtcgccgaggattgacgtcacagttcaaaggtcatcctcggcggtaacc

SEQ ID NO: 339380 - DNA, 75 bp, Artificial Sequence
  Synthetic
tgtcgccgaggattgacgtcacagttcaaaggtcatcctcggcggtaaccgcaaagatggcggtcaatctctttc

SEQ ID NO: 339381 - DNA, 75 bp, Artificial Sequence
  Synthetic
aagtcacatgtctaggggtccacttaaacacggaagtaggccccgacatgtgactcgtcacgtgtgtgcacgtca

SEQ ID NO: 339382 - DNA, 75 bp, Artificial Sequence
  Synthetic
ctggccgggccatgggcaaggctcttaaaaaatgcactttcgcagagtctcagcgaaaaggaaactgctactgct

SEQ ID NO: 339383 - DNA, 75 bp, Artificial Sequence
  Synthetic
taaaaaatgcactttcgcagagtctcagcgaaaaggaaactgctactgctatctctgcaccctgcatcgcagaca

SEQ ID NO: 339384 - DNA, 75 bp, Artificial Sequence
  Synthetic
cagcgaaaaggaaactgctactgctatctctgcaccctgcatcgcagacacctgccatgagcttcagggcaccca

SEQ ID NO: 339385 - DNA, 75 bp, Artificial Sequence
  Synthetic
gctatggttcgagtccaccgtccgatcccatgatagttactgcgggtgtggtaacactgtcactcattttaataa

SEQ ID NO: 339386 - DNA, 75 bp, Artificial Sequence
  Synthetic
tcccatgatagttactgcgggtgtggtaacactgtcactcattttaataatattgctactcgctttaactacctg

SEQ ID NO: 339387 - DNA, 75 bp, Artificial Sequence
  Synthetic
cttcctcgggaccgccgcgaggccgcccggcgatccgcgcactcccggctctgccagcggcaccctccaccccca

SEQ ID NO: 339388 - DNA, 75 bp, Artificial Sequence
  Synthetic
cccggcgatccgcgcactcccggctctgccagcggcaccctccacccccactactagccaaccatggcgtggtgg

SEQ ID NO: 339389 - DNA, 75 bp, Artificial Sequence
  Synthetic
gccggtggaggagatggcggcgccgccgtagaaggagactaccagcaagaagaactcgacgagctgttcgcggcc

SEQ ID NO: 339390 - DNA, 75 bp, Artificial Sequence
  Synthetic
ccgtagaaggagactaccagcaagaagaactcgacgagctgttcgcggccttggaagacgaccaagaaagacggt

SEQ ID NO: 339391 - DNA, 75 bp, Artificial Sequence
  Synthetic
cgcacctaccgacgggggtggcgacgcagacggtacataagacgcaggaggggacgcaaaaagaaactgactctg

SEQ ID NO: 339392 - DNA, 75 bp, Artificial Sequence
  Synthetic
gcagacggtacataagacgcaggaggggacgcaaaaagaaactgactctgactatgtggaatcccaacatagtaa

SEQ ID NO: 339393 - DNA, 75 bp, Artificial Sequence
  Synthetic
acctctgctgctgtgtggagaaaacaggtccgcatttaactatgcataccactcagaggactacacagagcagcc

SEQ ID NO: 339394 - DNA, 75 bp, Artificial Sequence
  Synthetic
aggtccgcatttaactatgcataccactcagaggactacacagagcagccattccccttcggtggaggaatgagc

SEQ ID NO: 339395 - DNA, 75 bp, Artificial Sequence
  Synthetic
tgtacgacctgtacacaaagcacatgaacagatggacgttctcaaacgaccagctagacctggccagatacaggg

SEQ ID NO: 339396 - DNA, 75 bp, Artificial Sequence
  Synthetic
gaacagatggacgttctcaaacgaccagctagacctggccagatacaggggctgcaaattcagattctacagaca

SEQ ID NO: 339397 - DNA, 75 bp, Artificial Sequence
  Synthetic
tacaacctggttcctcctctaaagatgaaccagtttacaagtcccaacacacacccaggactactcatgctcact

SEQ ID NO: 339398 - DNA, 75 bp, Artificial Sequence
  Synthetic
acacccaggactactcatgctcactaaacacaagataataatacccagcttcttaacaagaccaggaggtcgcag

SEQ ID NO: 339399 - DNA, 75 bp, Artificial Sequence
  Synthetic
cctaagctctttgaagacaagtggtacactcagcaggacttgtgcaaacaaccgttagtgactctaaccgcaacc

SEQ ID NO: 339400 - DNA, 75 bp, Artificial Sequence
  Synthetic
acactcagcaggacttgtgcaaacaaccgttagtgactctaaccgcaaccgcagcttccttgcggtatccgttct

SEQ ID NO: 339401 - DNA, 75 bp, Artificial Sequence
  Synthetic
ctgtaccttccaggtactgcgcaagaattaccacccagtcataggcacttcctcaaaagacttagaaaatgtcac

SEQ ID NO: 339402 - DNA, 75 bp, Artificial Sequence
  Synthetic
aattaccacccagtcataggcacttcctcaaaagacttagaaaatgtcactccatttgaaaactggctatataca

SEQ ID NO: 339403 - DNA, 75 bp, Artificial Sequence
  Synthetic
ccactgaggcacaagtaggcagaatacctagctttaatccagatggctccaaaaatacagaagaactacagtggc

SEQ ID NO: 339404 - DNA, 75 bp, Artificial Sequence
  Synthetic
acctagctttaatccagatggctccaaaaatacagaagaactacagtggcaaaattggtggtccaagaaacaaga

SEQ ID NO: 339405 - DNA, 75 bp, Artificial Sequence
  Synthetic
caaacagacacaacacaaatgtacaaaataccttatgacagcaactatggctttcctacatacaaacccataaaa

SEQ ID NO: 339406 - DNA, 75 bp, Artificial Sequence
  Synthetic
aaataccttatgacagcaactatggctttcctacatacaaacccataaaagagtatatgctggccagaagagcct

SEQ ID NO: 339407 - DNA, 75 bp, Artificial Sequence
  Synthetic
tccagtcagtaacaaaatatggccacaatccactaccacaaaaccaacagtagactactatgaatatcacgcagg

SEQ ID NO: 339408 - DNA, 75 bp, Artificial Sequence
  Synthetic
tagactactatgaatatcacgcaggctggttcagtaacatatttataggccccaacagatacaatttacaattcc

SEQ ID NO: 339409 - DNA, 75 bp, Artificial Sequence
  Synthetic
caatccactaaatgacaaaggaaagggcaacaaaatatggttccagtaccacagcaaagtaaacacagaccttag

SEQ ID NO: 339410 - DNA, 75 bp, Artificial Sequence
  Synthetic
ggcaacaaaatatggttccagtaccacagcaaagtaaacacagaccttagagacagaggcatctactgcctacta

SEQ ID NO: 339411 - DNA, 75 bp, Artificial Sequence
  Synthetic
cctttggatacagtgactacgtaagcacacaactaggcccaaacgtggaccacgagactcaaggcctggtgtgca

SEQ ID NO: 339412 - DNA, 75 bp, Artificial Sequence
  Synthetic
cacacaactaggcccaaacgtggaccacgagactcaaggcctggtgtgcataatatgcccatacactgagccccc

SEQ ID NO: 339413 - DNA, 75 bp, Artificial Sequence
  Synthetic
agtggctacgtagcatatgacacaaactttggaaatggaaaaatgccctcaggaaggggccaagttccagtatac

SEQ ID NO: 339414 - DNA, 75 bp, Artificial Sequence
  Synthetic
tggcagtgcagatggaggcccatgctgtggttccagcaacaagtactaaatgacatctcaaagaccggaccgtac

SEQ ID NO: 339415 - DNA, 75 bp, Artificial Sequence
  Synthetic
gttgcctgactgtatactacaactttatttttaactgggggggcgacatgtattacccgcaggtcattaaaaacc

SEQ ID NO: 339416 - DNA, 75 bp, Artificial Sequence
  Synthetic
tatttttaactgggggggcgacatgtattacccgcaggtcattaaaaacccctgcgcagacagcggactcgttcc

SEQ ID NO: 339417 - DNA, 75 bp, Artificial Sequence
  Synthetic
gtacaagtcgttagcccgttgtccatggggcctcagtacatcctccacctcttcggccaaagacgcgggttcttt

SEQ ID NO: 339418 - DNA, 75 bp, Artificial Sequence
  Synthetic
tggggcctcagtacatcctccacctcttcggccaaagacgcgggttctttagttcgaacgctattaaaagaatgc

SEQ ID NO: 339419 - DNA, 75 bp, Artificial Sequence
  Synthetic
ttttacagtcaaacctaagcgacccaaactttctacagccgccctcatcgagcagcaagaaggagactgcatttc

SEQ ID NO: 339420 - DNA, 75 bp, Artificial Sequence
  Synthetic
aaactttctacagccgccctcatcgagcagcaagaaggagactgcatttcaggggaaggaaaatcgccgtcctca

SEQ ID NO: 339421 - DNA, 75 bp, Artificial Sequence
  Synthetic
agcagacgccggagatccagctccacctccagcgaaacatcagagaacagctgctcatcaagcagcagctccaac

SEQ ID NO: 339422 - DNA, 75 bp, Artificial Sequence
  Synthetic
cctccagcgaaacatcagagaacagctgctcatcaagcagcagctccaactcctgctcctccaaatattcaaaac

SEQ ID NO: 339423 - DNA, 75 bp, Artificial Sequence
  Synthetic
cgttttataagcccgtaataacctacaacatgtttggggaacccaatcctcaccctccaactagccaagactggc

SEQ ID NO: 339424 - DNA, 75 bp, Artificial Sequence
  Synthetic
caacatgtttggggaacccaatcctcaccctccaactagccaagactggcaaacggagtacgaggcctgcaaaat

SEQ ID NO: 339425 - DNA, 75 bp, Artificial Sequence
  Synthetic
ctacaagacacccctttctatccctggatgcctaaggctcccccccagtgctgtgtaacatttaagctcgggttc

SEQ ID NO: 339426 - DNA, 75 bp, Artificial Sequence
  Synthetic
aaataaacaaggccgtgcactgttcacttgtcggtgtctacctcttaaggtcaccaagcactccgagcgccagcg

SEQ ID NO: 339427 - DNA, 75 bp, Artificial Sequence
  Synthetic
gagtggggccagacttcgccataaggcctttatcttcttgccatttgtcagtgtccggggtcgccataggcttcg

SEQ ID NO: 339428 - DNA, 75 bp, Artificial Sequence
  Synthetic
ggctcggttttaggccttccggactaccaaaatggcggattccgtgacgtcatgcccgccattttaagtagttga

SEQ ID NO: 339429 - DNA, 75 bp, Artificial Sequence
  Synthetic
accaaaatggcggattccgtgacgtcatgcccgccattttaagtagttgaggcggacggtgacgtcaggtcaaag

SEQ ID NO: 339430 - DNA, 75 bp, Artificial Sequence
  Synthetic
catgcccgccattttaagtagttgaggcggacggtgacgtcaggtcaaaggtcattgtctgcgtcagctactcga

SEQ ID NO: 339431 - DNA, 75 bp, Artificial Sequence
  Synthetic
aaaggtcgccgctacgtcataagtcacgtggggggggtcccactgtaacccggaagtaggccccgccacgtgact

SEQ ID NO: 339432 - DNA, 75 bp, Artificial Sequence
  Synthetic
acgtggggggggtcccactgtaacccggaagtaggccccgccacgtgactactcacgtggtgcgcacgtcacagc

SEQ ID NO: 339433 - DNA, 75 bp, Artificial Sequence
  Synthetic
gacttccttccgcttttttaaaaataacggcccagcggcggcgcgcgcgcttcgcgcgcgcgccggggggctgcg

SEQ ID NO: 339434 - DNA, 75 bp, Artificial Sequence
  Synthetic
cccccccccgcggggggctccgccccccggccccccccccgaagtccgtcactaaaccacgtgactcctctcgtc

SEQ ID NO: 339435 - DNA, 75 bp, Artificial Sequence
  Synthetic
actaaaccacgtgactcctctcgtccaatcaggtgctatatcgtccacttcctgggccaagtctacgtcctgata

SEQ ID NO: 339436 - DNA, 75 bp, Artificial Sequence
  Synthetic
taaagcggtgcacttccgagtggctgagttttccacgcccgtccgcagcgacatcgccacggaggagcgatcgag

SEQ ID NO: 339437 - DNA, 75 bp, Artificial Sequence
  Synthetic
tctcttcgccgccgcggccgaggacgatatgtgagtaggcgggggcgccgccgctactacaggcgcagactgaga

SEQ ID NO: 339438 - DNA, 75 bp, Artificial Sequence
  Synthetic
gggactggagacgtgggatgcttagcaaaagaagtattaaaagagtccaagaagactcaacagatgatgaatatg

SEQ ID NO: 339439 - DNA, 75 bp, Artificial Sequence
  Synthetic
gctgtccgccatcttgtgacttccttccgctttttgtaaaaaaaagaggaagtgtgacgtagcggcgggggggcg

SEQ ID NO: 339440 - DNA, 75 bp, Artificial Sequence
  Synthetic
cccgaagtccgtcactaaccacgtgactcctgtcgcccaatcagagtgtatgtcgtgcatttcctgggcatggtc

SEQ ID NO: 339441 - DNA, 75 bp, Artificial Sequence
  Synthetic
ttccgaatggctgagttttccacgcccgtccgcagcgagggagcgacggaggagctcccgagcgtcccgagggcg

SEQ ID NO: 339442 - DNA, 75 bp, Artificial Sequence
  Synthetic
ggagctcccgagcgtcccgagggcgggtgccggaggtgagtttacacaccgcagtcaaggggcaattcgggctcg

SEQ ID NO: 339443 - DNA, 75 bp, Artificial Sequence
  Synthetic
gcagtcaaggggcaattcgggctcgggactggccgggctatgggcaaggctcttagggtcttcattcttaatatg

SEQ ID NO: 339444 - DNA, 75 bp, Artificial Sequence
  Synthetic
tttcttggcagagtttaccgccacaagaaaaggaaagtgctactgtccacactgcgagctccacaggcgtctcgc

SEQ ID NO: 339445 - DNA, 75 bp, Artificial Sequence
  Synthetic
tacacgatgcacccggcatcgagcgcaattggtacgaggcctgtttcagagcccacgctggagcttgtggctgtg

SEQ ID NO: 339446 - DNA, 75 bp, Artificial Sequence
  Synthetic
caattggtacgaggcctgtttcagagcccacgctggagcttgtggctgtggcaattttattatgcaccttaatct

SEQ ID NO: 339447 - DNA, 75 bp, Artificial Sequence
  Synthetic
tttggctgggcgttatggttttactccggggtcagcgccgccaggtggtcctcctccgggcaccccgcagataag

SEQ ID NO: 339448 - DNA, 75 bp, Artificial Sequence
  Synthetic
ccggggtcagcgccgccaggtggtcctcctccgggcaccccgcagataaggagagccaggcctagtcccgccgca

SEQ ID NO: 339449 - DNA, 75 bp, Artificial Sequence
  Synthetic
gagagccaggcctagtcccgccgcaccagagcagcccgctgccctaccatggcatggggatggtggagatggcgg

SEQ ID NO: 339450 - DNA, 75 bp, Artificial Sequence
  Synthetic
ggagacgccgtcgccggcgccccgtacggagaacaagagctcgccgacctgctcgacgctatagaagacgacgaa

SEQ ID NO: 339451 - DNA, 75 bp, Artificial Sequence
  Synthetic
ggggcgcagacggtacagacggggctggagacgcaggacttatgtgagaaaggggcgacacagaaaaaagaaaaa

SEQ ID NO: 339452 - DNA, 75 bp, Artificial Sequence
  Synthetic
ccagccacaagacgcagatgtaccataactgggtacctgcccatagtgttctgcggccacactaggggcaataaa

SEQ ID NO: 339453 - DNA, 75 bp, Artificial Sequence
  Synthetic
taactgggtacctgcccatagtgttctgcggccacactaggggcaataaaaactatgcactacactctgacgact

SEQ ID NO: 339454 - DNA, 75 bp, Artificial Sequence
  Synthetic
aggggctctaagcactacctcattctctttaaaagtactatttgaccagcatcagagaggactaaacaagtggtc

SEQ ID NO: 339455 - DNA, 75 bp, Artificial Sequence
  Synthetic
atcagagaggactaaacaagtggtcttttccaaacgaccaactagacctcgccagatatagaggctgcaaattta

SEQ ID NO: 339456 - DNA, 75 bp, Artificial Sequence
  Synthetic
ctgggtgggccagtatgacatatcagaaccctacaagctagacaaatacagctgccccaactatcaccctggaaa

SEQ ID NO: 339457 - DNA, 75 bp, Artificial Sequence
  Synthetic
gaaccctacaagctagacaaatacagctgccccaactatcaccctggaaacatgattaaggcaaagcacaaattt

SEQ ID NO: 339458 - DNA, 75 bp, Artificial Sequence
  Synthetic
ctagaggcagacaaaaaattatagttaaaattccccccccagacctctttgtagacaagtggtacactcaagagg

SEQ ID NO: 339459 - DNA, 75 bp, Artificial Sequence
  Synthetic
taaaattccccccccagacctctttgtagacaagtggtacactcaagaggatctgtgttccgttaatcttgtgtc

SEQ ID NO: 339460 - DNA, 75 bp, Artificial Sequence
  Synthetic
atctgtgttccgttaatcttgtgtcacttgcggtttctgcggcttcctttctccacccattcggctcaccacaaa

SEQ ID NO: 339461 - DNA, 75 bp, Artificial Sequence
  Synthetic
acttgcggtttctgcggcttcctttctccacccattcggctcaccacaaactgacaacccttgctacaccttcca

SEQ ID NO: 339462 - DNA, 75 bp, Artificial Sequence
  Synthetic
ctgacaacccttgctacaccttccaggtgttgaaagagttctactatcaggcaataggcttctctgcaagcacac

SEQ ID NO: 339463 - DNA, 75 bp, Artificial Sequence
  Synthetic
gctatacacacaaaacagttattgggaatctaatctaactcagttttatgtacttaatgcaaaaaaaggcagtga

SEQ ID NO: 339464 - DNA, 75 bp, Artificial Sequence
  Synthetic
gaatctaatctaactcagttttatgtacttaatgcaaaaaaaggcagtgatacaacacagcctttaactagcaat

SEQ ID NO: 339465 - DNA, 75 bp, Artificial Sequence
  Synthetic
caaaaaaaaataccaattacaactggtatacatacaaggccgcgtcagtaaaaaataaactacatcaaatgagac

SEQ ID NO: 339466 - DNA, 75 bp, Artificial Sequence
  Synthetic
gtatacatacaaggccgcgtcagtaaaaaataaactacatcaaatgagacaaacctattttgaggagttaacctc

SEQ ID NO: 339467 - DNA, 75 bp, Artificial Sequence
  Synthetic
gaggaaggctacagtcagcactggaccaccccctccacaaacgcctacgaatatcacttaggaatgtttagtgca

SEQ ID NO: 339468 - DNA, 75 bp, Artificial Sequence
  Synthetic
ccaccccctccacaaacgcctacgaatatcacttaggaatgtttagtgcaatatttctagccccagacaggccag

SEQ ID NO: 339469 - DNA, 75 bp, Artificial Sequence
  Synthetic
agatgtaacttacaaccccttaatggacaaaggggtgggaaaccacatttggtttcagtacaacacaaaggcaga

SEQ ID NO: 339470 - DNA, 75 bp, Artificial Sequence
  Synthetic
gacaaaggggtgggaaaccacatttggtttcagtacaacacaaaggcagacactcagctaatagtcacaggaggg

SEQ ID NO: 339471 - DNA, 75 bp, Artificial Sequence
  Synthetic
taccactgtgggcggccttctatggatacagtgactttatagagtcagaactaggcccctttgtagatgcagaga

SEQ ID NO: 339472 - DNA, 75 bp, Artificial Sequence
  Synthetic
atacagtgactttatagagtcagaactaggcccctttgtagatgcagagacggtaggcttagtgtgtgtaatatg

SEQ ID NO: 339473 - DNA, 75 bp, Artificial Sequence
  Synthetic
aacaagacaaaccccgccatgggctacgtgttctatgacagaaactttggtgacggaaaatggactgacggacgg

SEQ ID NO: 339474 - DNA, 75 bp, Artificial Sequence
  Synthetic
ggcaaaatagagccctactggcaagttaggtggaggcccgaaatgcttttccaagaaactgtaatggcagaccta

SEQ ID NO: 339475 - DNA, 75 bp, Artificial Sequence
  Synthetic
aagacgaacttaaaaacagcaccctagtgtgcaagtacaaattctatttcacctggggaggtaacatgatgttcc

SEQ ID NO: 339476 - DNA, 75 bp, Artificial Sequence
  Synthetic
acctggggaggtaacatgatgttccaacagacgatcaaaaacccgtgcaagacggacggacaacccaccgactcc

SEQ ID NO: 339477 - DNA, 75 bp, Artificial Sequence
  Synthetic
tggcggacccggaacaaatgggaccccgctgggtgttccactcctttgactggcgaaggggctatcttagcgaga

SEQ ID NO: 339478 - DNA, 75 bp, Artificial Sequence
  Synthetic
ccgctgggtgttccactcctttgactggcgaaggggctatcttagcgagaaagctctcaaacgcctgcaagaaaa

SEQ ID NO: 339479 - DNA, 75 bp, Artificial Sequence
  Synthetic
acacaaccaaaaagacctagaatctttcctccaacagaatcagcagagggagagttccgagagcccgaaaaaggc

SEQ ID NO: 339480 - DNA, 75 bp, Artificial Sequence
  Synthetic
ttcctccaacagaatcagcagagggagagttccgagagcccgaaaaaggctcgtattcagaggaagaaaggtcgc

SEQ ID NO: 339481 - DNA, 75 bp, Artificial Sequence
  Synthetic
ggaggcgacagtactcctcctcaagcgacgactcagagagcaacagcagctccagcagcagctccaattcctcac

SEQ ID NO: 339482 - DNA, 75 bp, Artificial Sequence
  Synthetic
cgacgactcagagagcaacagcagctccagcagcagctccaattcctcacccgagaaatgttcaaaacgcaagcg

SEQ ID NO: 339483 - DNA, 75 bp, Artificial Sequence
  Synthetic
taaaccagcgataaaccaagtgtacctgtttccagagagggccccaaaaccccctcctagcagccaagactggca

SEQ ID NO: 339484 - DNA, 75 bp, Artificial Sequence
  Synthetic
ctgtttccagagagggccccaaaaccccctcctagcagccaagactggcagcaggagtacgaggcctgcgcagcc

SEQ ID NO: 339485 - DNA, 75 bp, Artificial Sequence
  Synthetic
tgtcctctcctcctttctaccccagctgcccttcaaaattctgtgtaaaattcagccttggctttaaataaatgg

SEQ ID NO: 339486 - DNA, 75 bp, Artificial Sequence
  Synthetic
ttcagccttggctttaaataaatggcaactttactgtgcaaggccgtgggagtttcactggtcggtgtctacctc

SEQ ID NO: 339487 - DNA, 75 bp, Artificial Sequence
  Synthetic
gacactgagggggcatatcagtaacgaaagtgagtggggccagacttcgccataaggcctttatcttcttgccat

SEQ ID NO: 339488 - DNA, 75 bp, Artificial Sequence
  Synthetic
cataaggcctttatcttcttgccattggatagtatcgagggttgccataggcttcgacctccattttaggccttc

SEQ ID NO: 339489 - DNA, 75 bp, Artificial Sequence
  Synthetic
tgacgtcacggccgccattttaagtaaggcggaagcagctcggcgtacacaaaatggcggcggagcacttccggc

SEQ ID NO: 339490 - DNA, 75 bp, Artificial Sequence
  Synthetic
aaggcggaagcagctcggcgtacacaaaatggcggcggagcacttccggcttgcccaaaatggtgggcaacttct

SEQ ID NO: 339491 - DNA, 75 bp, Artificial Sequence
  Synthetic
cacaagtcacgtggggagggttggcgtttaacccggaagccaatcctcttacgtggcctgtcacgtgacttgtac

SEQ ID NO: 339492 - DNA, 75 bp, Artificial Sequence
  Synthetic
gtttaacccggaagccaatcctcttacgtggcctgtcacgtgacttgtacgtcacgaccaccattttgttttaca

SEQ ID NO: 339493 - DNA, 75 bp, Artificial Sequence
  Synthetic
ttaaaaataacggttcggcggcggcgcgcgcgctacgcgcgcgcgccggggggctgccgccccccccccgcgcat

SEQ ID NO: 339494 - DNA, 75 bp, Artificial Sequence
  Synthetic
gcgcgcgctacgcgcgcgcgccggggggctgccgccccccccccgcgcatgcgcggggcccccccccgcgggggg

SEQ ID NO: 339495 - DNA, 75 bp, Artificial Sequence
  Synthetic
attttgctacgtcactaaccgcgtgacacccacaggccaaccgaatgctatgtcatccatttcctgggccgggtt

SEQ ID NO: 339496 - DNA, 75 bp, Artificial Sequence
  Synthetic
tcaacagtaccttaactggcaatggtactcaagtgtacttagctcccacgctgctatgtgcgggtgtcccgacgc

SEQ ID NO: 339497 - DNA, 75 bp, Artificial Sequence
  Synthetic
cgcagacctgctagacgccgtggccaccgcagaaacgtaaggagacgccgcagaggagggaggtggaggaggaga

SEQ ID NO: 339498 - DNA, 75 bp, Artificial Sequence
  Synthetic
aaatactgtcagcagaaactatgccacacactcagacggtaccaactacccaggacccttcggggggggtatgac

SEQ ID NO: 339499 - DNA, 75 bp, Artificial Sequence
  Synthetic
ttgtatgatgagtacaaaaggtttatgaactactggacagcatctaacgaagacctagacctttgtagatatcta

SEQ ID NO: 339500 - DNA, 75 bp, Artificial Sequence
  Synthetic
ggctcaccactaactgactctgtggttgtgaacttccaggttctgcaatccatgtatgatgaacatattagcata

SEQ ID NO: 339501 - DNA, 75 bp, Artificial Sequence
  Synthetic
aaaatttacttagtaacataacaaaatacattcccttttataataccacacaaactatagcccaattaaagccat

SEQ ID NO: 339502 - DNA, 75 bp, Artificial Sequence
  Synthetic
ttatagatgcaggcaatgtaacaacaagcacaacaccactaacatggggatcatgcataaacacaaccaagttta

SEQ ID NO: 339503 - DNA, 75 bp, Artificial Sequence
  Synthetic
atatccaggcaccaccacaaccacagtaactatgttaagctgtaatgactcctggtacagaggaacagtatataa

SEQ ID NO: 339504 - DNA, 75 bp, Artificial Sequence
  Synthetic
gtaactatgttaagctgtaatgactcctggtacagaggaacagtatataacaataaaattacagaagtaccaata

SEQ ID NO: 339505 - DNA, 75 bp, Artificial Sequence
  Synthetic
gtgggaagactcgcagcaggaggaaagcgggtcacaaagctcagaggaagagacgcagacactctcccagcagct

SEQ ID NO: 339506 - DNA, 75 bp, Artificial Sequence
  Synthetic
atcctgggactcaaactcagactcctatccaaccaaatccaaaaaatccaacaaaatcaagatatcaaccctacc

SEQ ID NO: 339507 - DNA, 75 bp, Artificial Sequence
  Synthetic
ggcccccaaggaaaaccagtaccgtgtaaactttaaacttggatttcaataaagctaggccgtgggactttcact

SEQ ID NO: 339508 - DNA, 75 bp, Artificial Sequence
  Synthetic
gggtcgccatagacttcggcctccattttaccttgtaaaaactaccaaaatggccgttccagtgacgtcacagcc

SEQ ID NO: 339509 - DNA, 75 bp, Artificial Sequence
  Synthetic
ataccctctctaaagacccggccaagcagaaaacacagggtggtcgtcagggtgggcgccccaagactctttcag

SEQ ID NO: 339510 - DNA, 75 bp, Artificial Sequence
  Synthetic
aaacttgtttaacaaaattgagctatacaacacctttcaaaccatagctcagcttaaagaaacaggacaaagtac

SEQ ID NO: 339511 - DNA, 75 bp, Artificial Sequence
  Synthetic
tacaacacctttcaaaccatagctcagcttaaagaaacaggacaaagtacaaacattaatccaaattggaatgag

SEQ ID NO: 339512 - DNA, 75 bp, Artificial Sequence
  Synthetic
caacgggtgaaaatgcaactaaaagcagagacacttggtacaaaggcaatacatacaaccaaaacatttcagact

SEQ ID NO: 339513 - DNA, 75 bp, Artificial Sequence
  Synthetic
cagagacacttggtacaaaggcaatacatacaaccaaaacatttcagacttagcagaaaaaaccagacaaagatt

SEQ ID NO: 339514 - DNA, 75 bp, Artificial Sequence
  Synthetic
aaaaaacaaaagcaaatgcgagataatggacaagcccctgtgggcggcctgcacaggatgcacagagttctgtgc

SEQ ID NO: 339515 - DNA, 75 bp, Artificial Sequence
  Synthetic
tatagtacaaagcggaccgttcgggtacaagggcgacataaaatcagctgtactgtccatgaaatacagatttca

SEQ ID NO: 339516 - DNA, 75 bp, Artificial Sequence
  Synthetic
agtccagcagcgactcccgtgggtccactccagccaagaaacggaaagctcccaagaagagacgcaggcgcaggg

SEQ ID NO: 339517 - DNA, 75 bp, Artificial Sequence
  Synthetic
cagctccgagagcagcgagtactccgactccagctccagcacctcgcaacgcaagtcctcaaagtccaagcagga

SEQ ID NO: 339518 - DNA, 75 bp, Artificial Sequence
  Synthetic
gactccagctccagcacctcgcaacgcaagtcctcaaagtccaagcaggacacggcctacaccccctatcatctt

SEQ ID NO: 339519 - DNA, 75 bp, Artificial Sequence
  Synthetic
tttgagccccagggtcctaaacccatacagggctacaacgattggctagaagaatacactgcttgcaagcactgg

SEQ ID NO: 339520 - DNA, 75 bp, Artificial Sequence
  Synthetic
cctttatcttctcgccattagatagtgtccggggtcgccgtaggcttcggcctcgtttttaggccttccgggcta

SEQ ID NO: 339521 - DNA, 75 bp, Artificial Sequence
  Synthetic
ccgggggggcgccagcgccccccccccgcgcatgcgcgggtcccccccgccgcgggggggctccgccccccggcc

SEQ ID NO: 339522 - DNA, 75 bp, Artificial Sequence
  Synthetic
tacgtcactaaccacgtgcgtttcacagaccaaccgtgtgctatgtcgtccacttcctgggctgtgtctacgtac

SEQ ID NO: 339523 - DNA, 75 bp, Artificial Sequence
  Synthetic
cagaccaaccgtgtgctatgtcgtccacttcctgggctgtgtctacgtactaatataaatgactgcacttccgaa

SEQ ID NO: 339524 - DNA, 75 bp, Artificial Sequence
  Synthetic
cacttcctgggctgtgtctacgtactaatataaatgactgcacttccgaatggctgagtttatgctgcccgtccg

SEQ ID NO: 339525 - DNA, 75 bp, Artificial Sequence
  Synthetic
cgaacgtcccgagggcgggtgccggaggtgagtttacacaccgcagtcaaggggcaattcgggctcgggactggc

SEQ ID NO: 339526 - DNA, 75 bp, Artificial Sequence
  Synthetic
cagaaggaagagggcactgtcactgcgcggcctgccaactccaaagaaaaaaccacctcctgatatgagctactg

SEQ ID NO: 339527 - DNA, 75 bp, Artificial Sequence
  Synthetic
cgcggcctgccaactccaaagaaaaaaccacctcctgatatgagctactggaggccgcctgtacacaatgtcccg

SEQ ID NO: 339528 - DNA, 75 bp, Artificial Sequence
  Synthetic
cagtgcatcgtagccatgctgctgtttgtggttgtggggattttgtacgccatattactgctctggctgagagat

SEQ ID NO: 339529 - DNA, 75 bp, Artificial Sequence
  Synthetic
ttgtggttgtggggattttgtacgccatattactgctctggctgagagatacggccaccccgggggcccgcgcgc

SEQ ID NO: 339530 - DNA, 75 bp, Artificial Sequence
  Synthetic
aaccctaattctcctcagatccgtcgagcccgccacccggcggcagctccggaccccccagcaggtaaccaacct

SEQ ID NO: 339531 - DNA, 75 bp, Artificial Sequence
  Synthetic
gagcccgccacccggcggcagctccggaccccccagcaggtaaccaacctccggccctgccatggcatggagatg

SEQ ID NO: 339532 - DNA, 75 bp, Artificial Sequence
  Synthetic
tggaaacgacgctggacccgtggccgacttcgcggacgacgggctagaccagctggtcgccgccctcgacgaaga

SEQ ID NO: 339533 - DNA, 75 bp, Artificial Sequence
  Synthetic
gacttcgcggacgacgggctagaccagctggtcgccgccctcgacgaagacgagtaaggagacggagggcttgga

SEQ ID NO: 339534 - DNA, 75 bp, Artificial Sequence
  Synthetic
tttcagacgcagacgcagacgaaagggtaggagacacagacccaaactcataataagacagtggcagccagagat

SEQ ID NO: 339535 - DNA, 75 bp, Artificial Sequence
  Synthetic
ggtaggagacacagacccaaactcataataagacagtggcagccagagattgtcagaaaatgccttataataggc

SEQ ID NO: 339536 - DNA, 75 bp, Artificial Sequence
  Synthetic
aaggacggtggtcagaaaactacagcagtcacttagaggaccgcgtagttaaacaagcctttgggggcggacacg

SEQ ID NO: 339537 - DNA, 75 bp, Artificial Sequence
  Synthetic
cagtcacttagaggaccgcgtagttaaacaagcctttgggggcggacacgcgaccaccaggtggtcacttaaagt

SEQ ID NO: 339538 - DNA, 75 bp, Artificial Sequence
  Synthetic
ttaaacttctggacctggagtaacagagacttagaactggccaggtacctacgagtgacgtggactttttacaga

SEQ ID NO: 339539 - DNA, 75 bp, Artificial Sequence
  Synthetic
gagacttagaactggccaggtacctacgagtgacgtggactttttacagacaccaagatgttgactttattgtat

SEQ ID NO: 339540 - DNA, 75 bp, Artificial Sequence
  Synthetic
aggcagcatatacacagcacccatgatgcacccaggagcccttatgcttagcaaacagaagatactagtaaagag

SEQ ID NO: 339541 - DNA, 75 bp, Artificial Sequence
  Synthetic
atgcacccaggagcccttatgcttagcaaacagaagatactagtaaagagctttaaaacaaaacccagaggcaag

SEQ ID NO: 339542 - DNA, 75 bp, Artificial Sequence
  Synthetic
cccccactctactagtagataagtggtactttcagcacgacatttgcgacatgaccttacttaacataaatgccg

SEQ ID NO: 339543 - DNA, 75 bp, Artificial Sequence
  Synthetic
gtactttcagcacgacatttgcgacatgaccttacttaacataaatgccgttgcggctgacttgcggtatccgtt

SEQ ID NO: 339544 - DNA, 75 bp, Artificial Sequence
  Synthetic
tgcgtcagcttcctcgttttgtcaaccgtctacaacaacttcctctctattgccccagacgaactgtccccagta

SEQ ID NO: 339545 - DNA, 75 bp, Artificial Sequence
  Synthetic
ccgtctacaacaacttcctctctattgccccagacgaactgtccccagtaacatcaaatggaaaagagtattata

SEQ ID NO: 339546 - DNA, 75 bp, Artificial Sequence
  Synthetic
aacaccaagagactttaatgctgtaaatacatttagaacccaagctaatttctcacacccacaacttacactccc

SEQ ID NO: 339547 - DNA, 75 bp, Artificial Sequence
  Synthetic
aatacatttagaacccaagctaatttctcacacccacaacttacactccccaacagtgcatcaaatacatcagca

SEQ ID NO: 339548 - DNA, 75 bp, Artificial Sequence
  Synthetic
gctactggggtgatgccatatatgctcgagacatccctgcggtagaaccaccacaaacactacaacaagcaaaag

SEQ ID NO: 339549 - DNA, 75 bp, Artificial Sequence
  Synthetic
tcgagacatccctgcggtagaaccaccacaaacactacaacaagcaaaagaagtattaataaataacatggaaaa

SEQ ID NO: 339550 - DNA, 75 bp, Artificial Sequence
  Synthetic
ggagttagcaaactacatcattctgtatttgcccacaatgtaggcctatttagcagcagctttttatctgcagga

SEQ ID NO: 339551 - DNA, 75 bp, Artificial Sequence
  Synthetic
tatttgcccacaatgtaggcctatttagcagcagctttttatctgcaggaagactagccacagaaattccaggcc

SEQ ID NO: 339552 - DNA, 75 bp, Artificial Sequence
  Synthetic
ctacacagacaaaggcaaaggaaacatgatatgggtagactactgtcaaaaaaaagacaacttatataaagaagg

SEQ ID NO: 339553 - DNA, 75 bp, Artificial Sequence
  Synthetic
atgatatgggtagactactgtcaaaaaaaagacaacttatataaagaaggccaaagtaaatgtctaatagctaat

SEQ ID NO: 339554 - DNA, 75 bp, Artificial Sequence
  Synthetic
gatatatagactgggtaaaaaaagaaacagataactgggtaataagtacacaagccagagtactaatggtaactc

SEQ ID NO: 339555 - DNA, 75 bp, Artificial Sequence
  Synthetic
aacagataactgggtaataagtacacaagccagagtactaatggtaactccgtacacttacccaaaaatgtaccg

SEQ ID NO: 339556 - DNA, 75 bp, Artificial Sequence
  Synthetic
gttccatactcctatgcctttggagatggaaaaatgcccaacggtagcacatacataccgtttctatacagaaac

SEQ ID NO: 339557 - DNA, 75 bp, Artificial Sequence
  Synthetic
aacaaccagtactagaagatatagctagatcaggccccttctcactaaaacaaaacatgcctagcgctacactaa

SEQ ID NO: 339558 - DNA, 75 bp, Artificial Sequence
  Synthetic
tagatcaggccccttctcactaaaacaaaacatgcctagcgctacactaacagcaaaatacaagtttaaattctt

SEQ ID NO: 339559 - DNA, 75 bp, Artificial Sequence
  Synthetic
caggttgttagagacccctgcactcagcccaccttcgaactgcccggagccagtacgcagcctccacgaatacaa

SEQ ID NO: 339560 - DNA, 75 bp, Artificial Sequence
  Synthetic
agcccaccttcgaactgcccggagccagtacgcagcctccacgaatacaagtcacggacccgaaactcctcggtc

SEQ ID NO: 339561 - DNA, 75 bp, Artificial Sequence
  Synthetic
cctcagacgtggctactatagctcaaaaagtattaagcgaatgtcagaatacgaagaaccttctgagtttatttt

SEQ ID NO: 339562 - DNA, 75 bp, Artificial Sequence
  Synthetic
aaaagtattaagcgaatgtcagaatacgaagaaccttctgagtttattttcccaggtcccaaaaaacccagggtc

SEQ ID NO: 339563 - DNA, 75 bp, Artificial Sequence
  Synthetic
aaaggccctcagattcactccaaagagaatcgaagccgtggcagaccagcgaggaagaaagcgaagcagaagtcc

SEQ ID NO: 339564 - DNA, 75 bp, Artificial Sequence
  Synthetic
agaatcgaagccgtggcagaccagcgaggaagaaagcgaagcagaagtccaagagcaagagacgcaggagatgcc

SEQ ID NO: 339565 - DNA, 75 bp, Artificial Sequence
  Synthetic
ctcagagagcagcagcaactcagaaagggcctccagtgtgtcttccagcaactaataaagacacaacagggggta

SEQ ID NO: 339566 - DNA, 75 bp, Artificial Sequence
  Synthetic
agggcctccagtgtgtcttccagcaactaataaagacacaacagggggtacacatagatccatgcctactatagg

SEQ ID NO: 339567 - DNA, 75 bp, Artificial Sequence
  Synthetic
agaaagcctagaccccctccatcggccggagactgggccatggagtacctagcttgcaaagtatttgacaggccc

SEQ ID NO: 339568 - DNA, 75 bp, Artificial Sequence
  Synthetic
ccggagactgggccatggagtacctagcttgcaaagtatttgacaggccccctcgtaccaaactcacagaccctc

SEQ ID NO: 339569 - DNA, 75 bp, Artificial Sequence
  Synthetic
ttacaatgtaacctttcagctcaactacaaataaggctcagccttactgttctaggccgtgggagtttcacttgt

SEQ ID NO: 339570 - DNA, 75 bp, Artificial Sequence
  Synthetic
gttttaggccttccggactacaaaaaccgccatatttgtgacgtcacggccgccattttaagtaagcatggcggg

SEQ ID NO: 339571 - DNA, 75 bp, Artificial Sequence
  Synthetic
accgccatatttgtgacgtcacggccgccattttaagtaagcatggcgggcggtggtgtcaaatgtcaaaggtca

SEQ ID NO: 339572 - DNA, 75 bp, Artificial Sequence
  Synthetic
gcggacttccgcttccgggtcgccgccatatttggtcacgtgacttcccacgtcacggccgccattttagttcac

SEQ ID NO: 339573 - DNA, 75 bp, Artificial Sequence
  Synthetic
ccatatttggtcacgtgacttcccacgtcacggccgccattttagttcacaaaatggccgacttccttcctgttt

SEQ ID NO: 339574 - DNA, 75 bp, Artificial Sequence
  Synthetic
agcggcggcggggggcggcgcgctgcgcgcgccgcccagtagggggcgcctagcgcccccccccgcgcatgcgcg

SEQ ID NO: 339575 - DNA, 75 bp, Artificial Sequence
  Synthetic
cgcgcgccgcccagtagggggcgcctagcgcccccccccgcgcatgcgcggggcccccccccgcggggggctctg

SEQ ID NO: 339576 - DNA, 75 bp, Artificial Sequence
  Synthetic
aagtccgtcactaaccacgtgactcccgcaggccaaccgaattctacatcgtgcacttcctgggcggggtttacg

SEQ ID NO: 339577 - DNA, 75 bp, Artificial Sequence
  Synthetic
tcaaggggcaattcgggctcgggactggccgggctatgggcaaggctcttaaaaaagctatgtttctcggtcgca

SEQ ID NO: 339578 - DNA, 75 bp, Artificial Sequence
  Synthetic
actgtccccactgcactctccacagaaagctcgcaaactactaagaggtatgtggagaccccccactcaaaatgt

SEQ ID NO: 339579 - DNA, 75 bp, Artificial Sequence
  Synthetic
aaagctcgcaaactactaagaggtatgtggagaccccccactcaaaatgtttcaggacaggagagaaagtggttc

SEQ ID NO: 339580 - DNA, 75 bp, Artificial Sequence
  Synthetic
ccttttgtggctgtgggggctgtattggtcatcttagccgtctggctgctgacctgggccgaccatctggcgcac

SEQ ID NO: 339581 - DNA, 75 bp, Artificial Sequence
  Synthetic
tggtcatcttagccgtctggctgctgacctgggccgaccatctggcgcacatcccccgtcgcaacaccagccgcc

SEQ ID NO: 339582 - DNA, 75 bp, Artificial Sequence
  Synthetic
ccggcacccccaaacccctccggtgatcgagcggcatggcctactggtggtggagacgccgtagacgacggccct

SEQ ID NO: 339583 - DNA, 75 bp, Artificial Sequence
  Synthetic
atcgagcggcatggcctactggtggtggagacgccgtagacgacggccctggagaaggaggcgccgctggaggct

SEQ ID NO: 339584 - DNA, 75 bp, Artificial Sequence
  Synthetic
acttaccgccgccgtcgaggccgccgaagagtaagaaagaggagggggaggtggagacggacttacagacgatgg

SEQ ID NO: 339585 - DNA, 75 bp, Artificial Sequence
  Synthetic
gaagagtaagaaagaggagggggaggtggagacggacttacagacgatggcgcaggcgaaaggggcgacgcagac

SEQ ID NO: 339586 - DNA, 75 bp, Artificial Sequence
  Synthetic
gtggcaaccaaactttataagacactgctttatagtgggctttatgccacttatattctgtggagagaacacaac

SEQ ID NO: 339587 - DNA, 75 bp, Artificial Sequence
  Synthetic
tgctttatagtgggctttatgccacttatattctgtggagagaacacaacctcccaaaactatgccactcactca

SEQ ID NO: 339588 - DNA, 75 bp, Artificial Sequence
  Synthetic
atgggggaggcatgaccaccacaaaattcactctcagaatcctgtatgacgaacacctcaggtttatgaactact

SEQ ID NO: 339589 - DNA, 75 bp, Artificial Sequence
  Synthetic
attcactctcagaatcctgtatgacgaacacctcaggtttatgaactactggactgtcagtaacgaagacttaga

SEQ ID NO: 339590 - DNA, 75 bp, Artificial Sequence
  Synthetic
ctaatcttctacagacaccccactgtagactttatggtgcagatacacacacaacctcctttcctagacacagaa

SEQ ID NO: 339591 - DNA, 75 bp, Artificial Sequence
  Synthetic
tagactttatggtgcagatacacacacaacctcctttcctagacacagaactaacagggcccagcatacacccag

SEQ ID NO: 339592 - DNA, 75 bp, Artificial Sequence
  Synthetic
aatattcgtgcccagtcttaaagccaggcctaacagaaaacacaaagtaagagttaaaatagggccccctcgcct

SEQ ID NO: 339593 - DNA, 75 bp, Artificial Sequence
  Synthetic
aggcctaacagaaaacacaaagtaagagttaaaatagggccccctcgcctctatgaggacaagtggtacccccag

SEQ ID NO: 339594 - DNA, 75 bp, Artificial Sequence
  Synthetic
taaccgtctatgcaaccgcatgtgacctgcaatttccgttcggctcaccactaactgacaacccttgcgtcaact

SEQ ID NO: 339595 - DNA, 75 bp, Artificial Sequence
  Synthetic
cctgcaatttccgttcggctcaccactaactgacaacccttgcgtcaacttccaggtgctaggttccgcttacaa

SEQ ID NO: 339596 - DNA, 75 bp, Artificial Sequence
  Synthetic
aacgactctaaaaatttagaacattataaaactgctctgtttcaaaaaacagcctactacaacacatttgaaacc

SEQ ID NO: 339597 - DNA, 75 bp, Artificial Sequence
  Synthetic
ataaaactgctctgtttcaaaaaacagcctactacaacacatttgaaaccatagcacagctaaaacccacaggcc

SEQ ID NO: 339598 - DNA, 75 bp, Artificial Sequence
  Synthetic
gcaagatgtacaaaacacaacagcactaaacgctgaaggctcaaaccaaggccaaagcaatgacacttggtacta

SEQ ID NO: 339599 - DNA, 75 bp, Artificial Sequence
  Synthetic
ctaaacgctgaaggctcaaaccaaggccaaagcaatgacacttggtactatggtaacacatacaaagacaacata

SEQ ID NO: 339600 - DNA, 75 bp, Artificial Sequence
  Synthetic
agcgatatctaaaagcaacacaacaagcatttccagcttatgccactttacagtcacccctctatgaataccacg

SEQ ID NO: 339601 - DNA, 75 bp, Artificial Sequence
  Synthetic
agcatttccagcttatgccactttacagtcacccctctatgaataccacgggggctgctattcctctatccttct

SEQ ID NO: 339602 - DNA, 75 bp, Artificial Sequence
  Synthetic
actctaggtgcttactcagacatcatatacaatccctttgtggacaaaggcataggcaacatggtctggatagac

SEQ ID NO: 339603 - DNA, 75 bp, Artificial Sequence
  Synthetic
tatacaatccctttgtggacaaaggcataggcaacatggtctggatagactacctcagcaaagaagatgcagttt

SEQ ID NO: 339604 - DNA, 75 bp, Artificial Sequence
  Synthetic
cataaaagaccagcccttgtgggcctccttcaatgggtacagcgaattctgtgccaaaagcacaggagacggggc

SEQ ID NO: 339605 - DNA, 75 bp, Artificial Sequence
  Synthetic
tccttcaatgggtacagcgaattctgtgccaaaagcacaggagacggggcagttaacataaacactagagtagtt

SEQ ID NO: 339606 - DNA, 75 bp, Artificial Sequence
  Synthetic
tgctagcagacaactctaatgaaaaccagggctatgtaccttactccctgaactttggcaaaggcaaaatgaaag

SEQ ID NO: 339607 - DNA, 75 bp, Artificial Sequence
  Synthetic
ccagggctatgtaccttactccctgaactttggcaaaggcaaaatgaaaggaggcagctcccaggtaccactcag

SEQ ID NO: 339608 - DNA, 75 bp, Artificial Sequence
  Synthetic
atgtaccaccaacaagagttcatggaagccatagtgcagagcggaccgtgggcttacaagggcgacgaaaagagc

SEQ ID NO: 339609 - DNA, 75 bp, Artificial Sequence
  Synthetic
aagccatagtgcagagcggaccgtgggcttacaagggcgacgaaaagagcgcggtactggccatgaaatacgtgt

SEQ ID NO: 339610 - DNA, 75 bp, Artificial Sequence
  Synthetic
catatctgaacaggttgtcagaaacccctgcaagacctccggttccagtcgagagcctcgttcaatacaagcagt

SEQ ID NO: 339611 - DNA, 75 bp, Artificial Sequence
  Synthetic
ccctgcaagacctccggttccagtcgagagcctcgttcaatacaagcagttgacccgaaaagagtcgcgccaccg

SEQ ID NO: 339612 - DNA, 75 bp, Artificial Sequence
  Synthetic
gacgagggctctttggccacgcaagtattaagagaatgtcagaggaatcagcaactcctacactttttacaggac

SEQ ID NO: 339613 - DNA, 75 bp, Artificial Sequence
  Synthetic
tattaagagaatgtcagaggaatcagcaactcctacactttttacaggaccagcgggcaagcggccccgcagaga

SEQ ID NO: 339614 - DNA, 75 bp, Artificial Sequence
  Synthetic
gaccagcaaaaagaaagctcatctttcagagtccagcgacagctccagccctggatccagtccagtcaagaaacg

SEQ ID NO: 339615 - DNA, 75 bp, Artificial Sequence
  Synthetic
ctggatccagtccagtcaagaaacgcaaagcagccaagaagaaatgcaagcgcaggggacgatacaggagcaact

SEQ ID NO: 339616 - DNA, 75 bp, Artificial Sequence
  Synthetic
agcactccgaaagcagctcgagttcctcgccagccaagtcctcaaagtccaagcagggcaacacatacaccccct

SEQ ID NO: 339617 - DNA, 75 bp, Artificial Sequence
  Synthetic
ttatcttcccaagcacaaacaaggtttatatgtttgagcctaagggcccaaaacccatacagggctaccaggcct

SEQ ID NO: 339618 - DNA, 75 bp, Artificial Sequence
  Synthetic
aaacccatacagggctaccaggcctggctggatgagtatcagacagccggggcctgggacagacccgtcagaaaa

SEQ ID NO: 339619 - DNA, 75 bp, Artificial Sequence
  Synthetic
ggctggatgagtatcagacagccggggcctgggacagacccgtcagaaaataccacacagataccccctactacc

SEQ ID NO: 339620 - DNA, 75 bp, Artificial Sequence
  Synthetic
agtttcgtgtaaccttcaaactgggctttcaataaaatttcaaggcagtaccctgttcacctgtcggtgtctacc

SEQ ID NO: 339621 - DNA, 75 bp, Artificial Sequence
  Synthetic
ctttcaataaaatttcaaggcagtaccctgttcacctgtcggtgtctacctctataagtcactaagcactccgag

SEQ ID NO: 339622 - DNA, 75 bp, Artificial Sequence
  Synthetic
ggggactcaacgccttcggagccgcgcgctacgccttcggctgcgcgcggcacctcagacccccgctcgtgctga

SEQ ID NO: 339623 - DNA, 75 bp, Artificial Sequence
  Synthetic
gcgctacgccttcggctgcgcgcggcacctcagacccccgctcgtgctgacacgcttgcgcgtgtcagaccactt

SEQ ID NO: 339624 - DNA, 75 bp, Artificial Sequence
  Synthetic
ggactcaggagctgtgaatcagtaacgaaagtgagtggggccagacttcgccataaggcctttatcttcttgcca

SEQ ID NO: 339625 - DNA, 75 bp, Artificial Sequence
  Synthetic
cgaaagtgagtggggccagacttcgccataaggcctttatcttcttgccatttgtctgtctagggggtcgccata

SEQ ID NO: 339626 - DNA, 75 bp, Artificial Sequence
  Synthetic
ccggactacaaatatggccgttccagtgacgtcacggccgccattttgagtaggtgccgtccaggactgccgttc

SEQ ID NO: 339627 - DNA, 75 bp, Artificial Sequence
  Synthetic
taggtgccgtccaggactgccgttccgggtcaaagggcatcctcggcgggacctacataaaatggtggacaatct

SEQ ID NO: 339628 - DNA, 75 bp, Artificial Sequence
  Synthetic
gtcatgtgtgacgtaggaggtctgctgcgtcatatgcggaggtaggccccgctacgtcacagtcacgtgggtgct

SEQ ID NO: 339629 - DNA, 75 bp, Artificial Sequence
  Synthetic
ggggctgccgcccccccccgcgcatgcgcgcggggccccccccccgcggggggctccgccccccggccccccccc

SEQ ID NO: 339630 - DNA, 75 bp, Artificial Sequence
  Synthetic
ggagtaaacatgtactttttcagacacccagatgtagattttatcataaaaattaataccatgcctccttttcta

SEQ ID NO: 339631 - DNA, 75 bp, Artificial Sequence
  Synthetic
ggctcaccactaactgactctgtggttgtgaacttccaggttctgcaatccatgtatgatcaaaacattagcata

SEQ ID NO: 339632 - DNA, 75 bp, Artificial Sequence
  Synthetic
aaaaactacttactcagataacagattacattcccttttataataccacacaaactatagcccaattaaagccat

SEQ ID NO: 339633 - DNA, 75 bp, Artificial Sequence
  Synthetic
ttatagacgcaggcaatataacaccaaacacaccagcaacaacatggggatcatacataaacacaaccaagttta

SEQ ID NO: 339634 - DNA, 75 bp, Artificial Sequence
  Synthetic
caagcagctacattatactcaaaagcaacaaaaaccttgctaggaaacaccttcacaactgacgaccacacacta

SEQ ID NO: 339635 - DNA, 75 bp, Artificial Sequence
  Synthetic
gaggcattgcctcccccccccgcgcacatgcgcgcgggtcccccccctccggggggctccgccccccggcccccc

SEQ ID NO: 339636 - DNA, 75 bp, Artificial Sequence
  Synthetic
attttgtgcagcccgccaatttctctttaaacagaccaatcagctactactacgtacacttcctggggtgtgtcc

SEQ ID NO: 339637 - DNA, 75 bp, Artificial Sequence
  Synthetic
tttaaacagaccaatcagctactactacgtacacttcctggggtgtgtcctgccactaaatataagcagacccgg

SEQ ID NO: 339638 - DNA, 75 bp, Artificial Sequence
  Synthetic
aaacttaaaataataccccgctgtgtactgtcacaggacaacagaaaatgtcgtgggctccgccgctattcaact

SEQ ID NO: 339639 - DNA, 75 bp, Artificial Sequence
  Synthetic
tactgtcacaggacaacagaaaatgtcgtgggctccgccgctattcaactcgaaacagagagaggaccagtggta

SEQ ID NO: 339640 - DNA, 75 bp, Artificial Sequence
  Synthetic
actttttgcggctgcggtgaccttgttaggcatttttgcgtcgttgcttctcgctttactgagcctcctgtagtg

SEQ ID NO: 339641 - DNA, 75 bp, Artificial Sequence
  Synthetic
ttaggcatttttgcgtcgttgcttctcgctttactgagcctcctgtagtgccggccctaccggcaccggtaccgg

SEQ ID NO: 339642 - DNA, 75 bp, Artificial Sequence
  Synthetic
agaaggtggagaccgtggagaagacgccgcagaccgtggaccctacgcagaagaagagctagaagatttgttcgc

SEQ ID NO: 339643 - DNA, 75 bp, Artificial Sequence
  Synthetic
gccgcagaccgtggaccctacgcagaagaagagctagaagatttgttcgccgccgcccgagaagacgatatgtga

SEQ ID NO: 339644 - DNA, 75 bp, Artificial Sequence
  Synthetic
gcgcagactaagacgggggagacgacgaaggggacgcagacgcagaaaagaaactataatagtgagacagtggca

SEQ ID NO: 339645 - DNA, 75 bp, Artificial Sequence
  Synthetic
cgaaggggacgcagacgcagaaaagaaactataatagtgagacagtggcagccagatgtaatgagaaactgttat

SEQ ID NO: 339646 - DNA, 75 bp, Artificial Sequence
  Synthetic
tctgtggctcaggcaacactcaatttaactttatcacacatgagaatgacatacccccaaggggagcctcctatg

SEQ ID NO: 339647 - DNA, 75 bp, Artificial Sequence
  Synthetic
taactttatcacacatgagaatgacatacccccaaggggagcctcctatgggggcaacctcaccaacataacctt

SEQ ID NO: 339648 - DNA, 75 bp, Artificial Sequence
  Synthetic
tacttgctacacagaaacaggtggtccaggtcaaactttgacctagacctagccagatacattaacacaaaacta

SEQ ID NO: 339649 - DNA, 75 bp, Artificial Sequence
  Synthetic
ccaggtcaaactttgacctagacctagccagatacattaacacaaaactaaaactatacagacatgactcagtag

SEQ ID NO: 339650 - DNA, 75 bp, Artificial Sequence
  Synthetic
aggtccctttgaggtgaatccactaacatacatgcacactcaccccctactcatgctcgtgaacaggcaccacat

SEQ ID NO: 339651 - DNA, 75 bp, Artificial Sequence
  Synthetic
acatacatgcacactcaccccctactcatgctcgtgaacaggcaccacatagtggtgcccagtttaaaaacaaaa

SEQ ID NO: 339652 - DNA, 75 bp, Artificial Sequence
  Synthetic
taaaaataaagcctccaaaactaatgctaaacaagtggtactttgcgaaagacatctgcccactaggcctcttcc

SEQ ID NO: 339653 - DNA, 75 bp, Artificial Sequence
  Synthetic
gctaaacaagtggtactttgcgaaagacatctgcccactaggcctcttccagctatatgctaccggcctagaact

SEQ ID NO: 339654 - DNA, 75 bp, Artificial Sequence
  Synthetic
acaaacagccccatagtagggttttatgttttaaaaccctcactatataatggagccatgtcaaacttagcagac

SEQ ID NO: 339655 - DNA, 75 bp, Artificial Sequence
  Synthetic
atgttttaaaaccctcactatataatggagccatgtcaaacttagcagacacagaacatttaaaccaaagacaaa

SEQ ID NO: 339656 - DNA, 75 bp, Artificial Sequence
  Synthetic
acaaaaccaaaaagacgaatggcaatacacatacaacaaaccaatgcaaaaaatatattatgaagcagcaaacaa

SEQ ID NO: 339657 - DNA, 75 bp, Artificial Sequence
  Synthetic
tacacatacaacaaaccaatgcaaaaaatatattatgaagcagcaaacaagcaagatagtggctttaaaaataca

SEQ ID NO: 339658 - DNA, 75 bp, Artificial Sequence
  Synthetic
ctaactaccaaaaagtacaatcacaatggcaaactgtagcacaacaaaactacaaccaagtatacaatgaattta

SEQ ID NO: 339659 - DNA, 75 bp, Artificial Sequence
  Synthetic
atggcaaactgtagcacaacaaaactacaaccaagtatacaatgaatttaaagaggtatacccactaacagctac

SEQ ID NO: 339660 - DNA, 75 bp, Artificial Sequence
  Synthetic
caatacatgtcacacgactttggcatatacagcccatactttttgtcacctgcaagatttacagactactggcac

SEQ ID NO: 339661 - DNA, 75 bp, Artificial Sequence
  Synthetic
tatacagcccatactttttgtcacctgcaagatttacagactactggcacagtgcatacacctatgtcagataca

SEQ ID NO: 339662 - DNA, 75 bp, Artificial Sequence
  Synthetic
taacataatctgcatacaatggtgcagtgaaaaaaacagtgaatttaatgagactaaaaacaagtgcatactaag

SEQ ID NO: 339663 - DNA, 75 bp, Artificial Sequence
  Synthetic
agtgaaaaaaacagtgaatttaatgagactaaaaacaagtgcatactaagagacatgccactttacatgctaaca

SEQ ID NO: 339664 - DNA, 75 bp, Artificial Sequence
  Synthetic
aatgcacaggctccaactccatctggacagacgccagagtagccatcagatgtccatacacagatcccccactat

SEQ ID NO: 339665 - DNA, 75 bp, Artificial Sequence
  Synthetic
gacagacgccagagtagccatcagatgtccatacacagatcccccactatcaaatccaactaacaaaaacacact

SEQ ID NO: 339666 - DNA, 75 bp, Artificial Sequence
  Synthetic
atgcaaggagacatgccctggccaaccacaaacattccgttaaagatgtggtttaagtggtatcccatgatcatg

SEQ ID NO: 339667 - DNA, 75 bp, Artificial Sequence
  Synthetic
ccacaaacattccgttaaagatgtggtttaagtggtatcccatgatcatgcaccagagggcctgtttagaaacca

SEQ ID NO: 339668 - DNA, 75 bp, Artificial Sequence
  Synthetic
cagagaccaaaccgcaagcagttgggacataactattgcatacagagccttttttaaatggggtggcaatcctct

SEQ ID NO: 339669 - DNA, 75 bp, Artificial Sequence
  Synthetic
gacataactattgcatacagagccttttttaaatggggtggcaatcctctgcctccacagcccatcgacgacccc

SEQ ID NO: 339670 - DNA, 75 bp, Artificial Sequence
  Synthetic
ccgaccccgataaacaccctagaggaatacaaatatcagacccgaaggtactcggaccacccacagtcttccaca

SEQ ID NO: 339671 - DNA, 75 bp, Artificial Sequence
  Synthetic
aatacaaatatcagacccgaaggtactcggaccacccacagtcttccacacatgggacatcagacgtggactgtt

SEQ ID NO: 339672 - DNA, 75 bp, Artificial Sequence
  Synthetic
tcagaataccaaccgcctgatgaccctttttcaacaggcgtcgtcttcaaaagaccccgactggaaacccagtac

SEQ ID NO: 339673 - DNA, 75 bp, Artificial Sequence
  Synthetic
ctttttcaacaggcgtcgtcttcaaaagaccccgactggaaacccagtacaaaggaacccaagaaaccccagaag

SEQ ID NO: 339674 - DNA, 75 bp, Artificial Sequence
  Synthetic
actccaaaaagagcaagagagcagcagctcggaagaagaactcccacaagaagagcaagagatccaaaaaacaca

SEQ ID NO: 339675 - DNA, 75 bp, Artificial Sequence
  Synthetic
agctcggaagaagaactcccacaagaagagcaagagatccaaaaaacacaactcctcaagcagctccaactccag

SEQ ID NO: 339676 - DNA, 75 bp, Artificial Sequence
  Synthetic
ggggaatcagacacctcttcggagacgtcctccgactcagaaaaggagtccactccaacccagacctattataat

SEQ ID NO: 339677 - DNA, 75 bp, Artificial Sequence
  Synthetic
cgtcctccgactcagaaaaggagtccactccaacccagacctattataataccagcagaggaaatcccagacctg

SEQ ID NO: 339678 - DNA, 75 bp, Artificial Sequence
  Synthetic
aaaaattctctccattcgattgggagacagagcagcagctcgcatgctggatgcggcgccccatgcgcttctatc

SEQ ID NO: 339679 - DNA, 75 bp, Artificial Sequence
  Synthetic
gacagagcagcagctcgcatgctggatgcggcgccccatgcgcttctatccaacagaccccccgttctacccctg

SEQ ID NO: 339680 - DNA, 75 bp, Artificial Sequence
  Synthetic
aatatatgtaaagtcaacttcaaaataaattactcagagtaactgttcgaggccccgggtgtttcacttagcggt

SEQ ID NO: 339681 - DNA, 75 bp, Artificial Sequence
  Synthetic
ctccgagcgaagcgaggagtgcgaccctggggcaacttcctcggggtccggcgctacgcgcttcgcgctgcgccg

SEQ ID NO: 339682 - DNA, 75 bp, Artificial Sequence
  Synthetic
ccccccgcgcatgcgcggggcccccccccgggggggctccgcccccccggcccccccccgtgctaagtccaccgc

SEQ ID NO: 339683 - DNA, 75 bp, Artificial Sequence
  Synthetic
ccccgggggggctccgcccccccggcccccccccgtgctaagtccaccgcgcatgcgcggccacgcccccgccgc

SEQ ID NO: 339684 - DNA, 75 bp, Artificial Sequence
  Synthetic
aagtccgtcactaaccacgtgacccgtctcgcccaaccagagtctatgtcgttcatttcctgggcgtggtgtaca

SEQ ID NO: 339685 - DNA, 75 bp, Artificial Sequence
  Synthetic
aaggaaagtgctactgcgatcactgcgagctccacaggcgcctcgcagggctatgagctggcgtcccccggtaca

SEQ ID NO: 339686 - DNA, 75 bp, Artificial Sequence
  Synthetic
cgagctccacaggcgcctcgcagggctatgagctggcgtcccccggtacacgatgcgcccggcatcgagcgcaat

SEQ ID NO: 339687 - DNA, 75 bp, Artificial Sequence
  Synthetic
atgctggatcttgtggttgtggcaattttattgctcacattaatcttctggctgggcgttatggttttactgggg

SEQ ID NO: 339688 - DNA, 75 bp, Artificial Sequence
  Synthetic
ttttattgctcacattaatcttctggctgggcgttatggttttactgggggcccgccgccgccgggtggtcctcc

SEQ ID NO: 339689 - DNA, 75 bp, Artificial Sequence
  Synthetic
tcccgtaactctcccgcggcacctcagcaaccccctgccctgccatggcatggggatggtggagaaggtggcgcc

SEQ ID NO: 339690 - DNA, 75 bp, Artificial Sequence
  Synthetic
acgccgccgccgacgcccacttaggagacgaagagctggccgacctgctcgacgctatcgaagacgacgcacagt

SEQ ID NO: 339691 - DNA, 75 bp, Artificial Sequence
  Synthetic
agacgaagagctggccgacctgctcgacgctatcgaagacgacgcacagtaagaaccaggcgaaggcggtggggt

SEQ ID NO: 339692 - DNA, 75 bp, Artificial Sequence
  Synthetic
gacgcaggacttatgtgaggaaggggcgacacagaaaaaagaaaaagagactcatactgagacagtggcagcccg

SEQ ID NO: 339693 - DNA, 75 bp, Artificial Sequence
  Synthetic
gcgacacagaaaaaagaaaaagagactcatactgagacagtggcagcccgccaccagacgcagatgcaccataac

SEQ ID NO: 339694 - DNA, 75 bp, Artificial Sequence
  Synthetic
ggccacaccaagggcaataaaaactacgcccttcactctgacgactacaccccccaaggacagccctttggaggg

SEQ ID NO: 339695 - DNA, 75 bp, Artificial Sequence
  Synthetic
acgcccttcactctgacgactacaccccccaaggacagccctttggaggggcccttagcactacctccttctctt

SEQ ID NO: 339696 - DNA, 75 bp, Artificial Sequence
  Synthetic
gagaggactgaacaagtggtctttccccaacgaccagctagacctggccagatacaggggctgtaaatttatatt

SEQ ID NO: 339697 - DNA, 75 bp, Artificial Sequence
  Synthetic
cccaacgaccagctagacctggccagatacaggggctgtaaatttatattctacaggactaaacaaactgactgg

SEQ ID NO: 339698 - DNA, 75 bp, Artificial Sequence
  Synthetic
cttacaagctagacaagtacagctgtcccaactaccacccgggtaacctcatcaaggcaaaacacaaatttttaa

SEQ ID NO: 339699 - DNA, 75 bp, Artificial Sequence
  Synthetic
tccccagctatgacactaatcccaggggcagacaaaagataatagtaaaaattccccccccagacctcttcgtag

SEQ ID NO: 339700 - DNA, 75 bp, Artificial Sequence
  Synthetic
acccattcggctcaccacaaactgacaacccttgctacaccttccaggtgttgaaagagttctactatcaggcaa

SEQ ID NO: 339701 - DNA, 75 bp, Artificial Sequence
  Synthetic
caacccttgctacaccttccaggtgttgaaagagttctactatcaggcaataggcttaagtgcaactgaagaatc

SEQ ID NO: 339702 - DNA, 75 bp, Artificial Sequence
  Synthetic
caacccttgctacaccttccaggtgttgaaagagttctactatcaggcaataggcttaagtgcaactgatgaatc

SEQ ID NO: 339703 - DNA, 75 bp, Artificial Sequence
  Synthetic
caacccttgctacaccttccaggtgttgaaagagttctactatcaggcaataggcttaagtgcaactgacgaatc

SEQ ID NO: 339704 - DNA, 75 bp, Artificial Sequence
  Synthetic
caacccttgctacaccttccaggtgttgaaagagttctactatcaggcaataggcttaagtgcaactgaggaatc

SEQ ID NO: 339705 - DNA, 75 bp, Artificial Sequence
  Synthetic
caacccttgctacaccttccaggtgttgaaagagttctactatcaggcaataggctttagtgcaactgaagaatc

SEQ ID NO: 339706 - DNA, 75 bp, Artificial Sequence
  Synthetic
caacccttgctacaccttccaggtgttgaaagagttctactatcaggcaataggctttagtgcaactgatgaatc

SEQ ID NO: 339707 - DNA, 75 bp, Artificial Sequence
  Synthetic
caacccttgctacaccttccaggtgttgaaagagttctactatcaggcaataggctttagtgcaactgacgaatc

SEQ ID NO: 339708 - DNA, 75 bp, Artificial Sequence
  Synthetic
caacccttgctacaccttccaggtgttgaaagagttctactatcaggcaataggctttagtgcaactgaggaatc

SEQ ID NO: 339709 - DNA, 75 bp, Artificial Sequence
  Synthetic
caacccttgctacaccttccaggtgttgaaagagttctactatcaggcaataggcttcagtgcaactgaagaatc

SEQ ID NO: 339710 - DNA, 75 bp, Artificial Sequence
  Synthetic
caacccttgctacaccttccaggtgttgaaagagttctactatcaggcaataggcttcagtgcaactgatgaatc

SEQ ID NO: 339711 - DNA, 75 bp, Artificial Sequence
  Synthetic
caacccttgctacaccttccaggtgttgaaagagttctactatcaggcaataggcttcagtgcaactgacgaatc

SEQ ID NO: 339712 - DNA, 75 bp, Artificial Sequence
  Synthetic
caacccttgctacaccttccaggtgttgaaagagttctactatcaggcaataggcttcagtgcaactgaggaatc

SEQ ID NO: 339713 - DNA, 75 bp, Artificial Sequence
  Synthetic
caacccttgctacaccttccaggtgttgaaagagttctactatcaggcaataggcttgagtgcaactgaagaatc

SEQ ID NO: 339714 - DNA, 75 bp, Artificial Sequence
  Synthetic
caacccttgctacaccttccaggtgttgaaagagttctactatcaggcaataggcttgagtgcaactgatgaatc

SEQ ID NO: 339715 - DNA, 75 bp, Artificial Sequence
  Synthetic
caacccttgctacaccttccaggtgttgaaagagttctactatcaggcaataggcttgagtgcaactgacgaatc

SEQ ID NO: 339716 - DNA, 75 bp, Artificial Sequence
  Synthetic
caacccttgctacaccttccaggtgttgaaagagttctactatcaggcaataggcttgagtgcaactgaggaatc

SEQ ID NO: 339717 - DNA, 75 bp, Artificial Sequence
  Synthetic
tacgaggaaaactcttactgggaatcaaacattactcccttttatgtaattaatgttaaaaaaggcagtaacaca

SEQ ID NO: 339718 - DNA, 75 bp, Artificial Sequence
  Synthetic
caaacattactcccttttatgtaattaatgttaaaaaaggcagtaacacaagagactacatgtcacctaaaattt

SEQ ID NO: 339719 - DNA, 75 bp, Artificial Sequence
  Synthetic
caaacattactcccttttatgtaattaatgttaaaaaaggcagtaacacaagagactacatgtcaccttaaattt

SEQ ID NO: 339720 - DNA, 75 bp, Artificial Sequence
  Synthetic
caaacattactcccttttatgtaattaatgttaaaaaaggcagtaacacaagagactacatgtcacctcaaattt

SEQ ID NO: 339721 - DNA, 75 bp, Artificial Sequence
  Synthetic
caaacattactcccttttatgtaattaatgttaaaaaaggcagtaacacaagagactacatgtcacctgaaattt

SEQ ID NO: 339722 - DNA, 75 bp, Artificial Sequence
  Synthetic
caaacattactcccttttatgtaattaatgttaaaaaaggcagtaacacatgagactacatgtcacctaaaattt

SEQ ID NO: 339723 - DNA, 75 bp, Artificial Sequence
  Synthetic
caaacattactcccttttatgtaattaatgttaaaaaaggcagtaacacatgagactacatgtcaccttaaattt

SEQ ID NO: 339724 - DNA, 75 bp, Artificial Sequence
  Synthetic
caaacattactcccttttatgtaattaatgttaaaaaaggcagtaacacatgagactacatgtcacctcaaattt

SEQ ID NO: 339725 - DNA, 75 bp, Artificial Sequence
  Synthetic
caaacattactcccttttatgtaattaatgttaaaaaaggcagtaacacatgagactacatgtcacctgaaattt

SEQ ID NO: 339726 - DNA, 75 bp, Artificial Sequence
  Synthetic
caaacattactcccttttatgtaattaatgttaaaaaaggcagtaacacacgagactacatgtcacctaaaattt

SEQ ID NO: 339727 - DNA, 75 bp, Artificial Sequence
  Synthetic
caaacattactcccttttatgtaattaatgttaaaaaaggcagtaacacacgagactacatgtcaccttaaattt

SEQ ID NO: 339728 - DNA, 75 bp, Artificial Sequence
  Synthetic
caaacattactcccttttatgtaattaatgttaaaaaaggcagtaacacacgagactacatgtcacctcaaattt

SEQ ID NO: 339729 - DNA, 75 bp, Artificial Sequence
  Synthetic
caaacattactcccttttatgtaattaatgttaaaaaaggcagtaacacacgagactacatgtcacctgaaattt

SEQ ID NO: 339730 - DNA, 75 bp, Artificial Sequence
  Synthetic
caaacattactcccttttatgtaattaatgttaaaaaaggcagtaacacaggagactacatgtcacctaaaattt

SEQ ID NO: 339731 - DNA, 75 bp, Artificial Sequence
  Synthetic
caaacattactcccttttatgtaattaatgttaaaaaaggcagtaacacaggagactacatgtcaccttaaattt

SEQ ID NO: 339732 - DNA, 75 bp, Artificial Sequence
  Synthetic
caaacattactcccttttatgtaattaatgttaaaaaaggcagtaacacaggagactacatgtcacctcaaattt

SEQ ID NO: 339733 - DNA, 75 bp, Artificial Sequence
  Synthetic
caaacattactcccttttatgtaattaatgttaaaaaaggcagtaacacaggagactacatgtcacctgaaattt

SEQ ID NO: 339734 - DNA, 75 bp, Artificial Sequence
  Synthetic
aaataccaactacaactggtatacctacaatgccaaaagccacaaaaatgacttacatgaactaagaagagccta

SEQ ID NO: 339735 - DNA, 75 bp, Artificial Sequence
  Synthetic
aaataccaactacaactggtatacctacaatgccaaaagccacaaaaatgacttacatgatctaagaagagccta

SEQ ID NO: 339736 - DNA, 75 bp, Artificial Sequence
  Synthetic
aaataccaactacaactggtatacctacaatgccaaaagccacaaaaatgacttacatgacctaagaagagccta

SEQ ID NO: 339737 - DNA, 75 bp, Artificial Sequence
  Synthetic
aaataccaactacaactggtatacctacaatgccaaaagccacaaaaatgacttacatgagctaagaagagccta

SEQ ID NO: 339738 - DNA, 75 bp, Artificial Sequence
  Synthetic
tacaatgccaaaagccacaaaaatgacttacatgaactaagaagagcctactttaaacaactaaccactgagggg

SEQ ID NO: 339739 - DNA, 75 bp, Artificial Sequence
  Synthetic
tacaatgccaaaagccacaaaaatgacttacatgatctaagaagagcctactttaaacaactaaccactgagggg

SEQ ID NO: 339740 - DNA, 75 bp, Artificial Sequence
  Synthetic
tacaatgccaaaagccacaaaaatgacttacatgacctaagaagagcctactttaaacaactaaccactgagggg

SEQ ID NO: 339741 - DNA, 75 bp, Artificial Sequence
  Synthetic
tacaatgccaaaagccacaaaaatgacttacatgagctaagaagagcctactttaaacaactaaccactgagggg

SEQ ID NO: 339742 - DNA, 75 bp, Artificial Sequence
  Synthetic
gctacgccagtcagtggaccacccctaccacagacgcctacgagtaccacctaggtatgttcagtacaatattcc

SEQ ID NO: 339743 - DNA, 75 bp, Artificial Sequence
  Synthetic
taccacagacgcctacgagtaccacctaggtatgttcagtacaatattcctagcaccagacagaccagtacctag

SEQ ID NO: 339744 - DNA, 75 bp, Artificial Sequence
  Synthetic
acatacaaccccctcatggacaaaggggtaggcaaccacgtatggtttcagtacaacacaaaggcagacactcaa

SEQ ID NO: 339745 - DNA, 75 bp, Artificial Sequence
  Synthetic
gggtaggcaaccacgtatggtttcagtacaacacaaaggcagacactcaactcatagtaacagggggctcctgca

SEQ ID NO: 339746 - DNA, 75 bp, Artificial Sequence
  Synthetic
gtgggcagccttctatggctacagtgacttcatagagtcagagctaggccccttcgtggacgcagagaccgtggg

SEQ ID NO: 339747 - DNA, 75 bp, Artificial Sequence
  Synthetic
gacttcatagagtcagagctaggccccttcgtggacgcagagaccgtgggcctaatctgtgtcatatgtccttac

SEQ ID NO: 339748 - DNA, 75 bp, Artificial Sequence
  Synthetic
ccaatcccatgatggggtacgtattctatgacagaaactttggtgacggaaaatggattgacggacggggcaaaa

SEQ ID NO: 339749 - DNA, 75 bp, Artificial Sequence
  Synthetic
gaggcccgaaatgttatttcaagagacagtaatggcagacatagtgcagaccgggccctttagttacaaagacga

SEQ ID NO: 339750 - DNA, 75 bp, Artificial Sequence
  Synthetic
aagtacaaattctatttcacctggggaggtaacatgatgttccaacagacgatcaaaaacccgtgcaagacggac

SEQ ID NO: 339751 - DNA, 75 bp, Artificial Sequence
  Synthetic
gaggtaacatgatgttccaacagacgatcaaaaacccgtgcaagacggacggacggcccaccgactccgatagac

SEQ ID NO: 339752 - DNA, 75 bp, Artificial Sequence
  Synthetic
gtgttccactcctttgactggcgaaggggctatcttagcgagggagctatcaaacgcctgcacgagaaacctctc

SEQ ID NO: 339753 - DNA, 75 bp, Artificial Sequence
  Synthetic
caaaaagacctagaatctttcctccaacagaggcagcagagggagagttccgagagcccgaaaaaggctcatatt

SEQ ID NO: 339754 - DNA, 75 bp, Artificial Sequence
  Synthetic
aacagaggcagcagagggagagttccgagagcccgaaaaaggctcatattcagaggaagaaaggtcgcaagcctc

SEQ ID NO: 339755 - DNA, 75 bp, Artificial Sequence
  Synthetic
acagtactcctcctcaagcgacgactcagagagcagcggaagctcgagcagcagctccaattcctcacccgagaa

SEQ ID NO: 339756 - DNA, 75 bp, Artificial Sequence
  Synthetic
tcagagagcagcggaagctcgagcagcagctccaattcctcacccgagaaatgttcaaaacgcaagcgggtctcc

SEQ ID NO: 339757 - DNA, 75 bp, Artificial Sequence
  Synthetic
gcgataaatcaggtgtacatgtttccagacagggccccaaaacccgtacccagcagccaagactggcagcaggag

SEQ ID NO: 339758 - DNA, 75 bp, Artificial Sequence
  Synthetic
cagacagggccccaaaacccgtacccagcagccaagactggcagcaggagtacgaggccgccgccttctgggaca

SEQ ID NO: 339759 - DNA, 75 bp, Artificial Sequence
  Synthetic
accccccttctacccccaatgcccctctcgcttctctgtaaaattcagcctgggctttaaataaagtgcaacttc

SEQ ID NO: 339760 - DNA, 75 bp, Artificial Sequence
  Synthetic
cttgtcggtgtctacctctaaaggtcactaagcactccgagcgtaagcgaggagtgcgaccctctctttctgagc

SEQ ID NO: 339761 - DNA, 75 bp, Artificial Sequence
  Synthetic
cttgtcggtgtctacctctaaaggtcactaagcactccgagcgttagcgaggagtgcgaccctctctttctgagc

SEQ ID NO: 339762 - DNA, 75 bp, Artificial Sequence
  Synthetic
cttgtcggtgtctacctctaaaggtcactaagcactccgagcgtcagcgaggagtgcgaccctctctttctgagc

SEQ ID NO: 339763 - DNA, 75 bp, Artificial Sequence
  Synthetic
cttgtcggtgtctacctctaaaggtcactaagcactccgagcgtgagcgaggagtgcgaccctctctttctgagc

SEQ ID NO: 339764 - DNA, 75 bp, Artificial Sequence
  Synthetic
ccagacttcgccataaggcctttatcttcttgccattggatagtggagaggggttgccataacgcggaccccgtt

SEQ ID NO: 339765 - DNA, 75 bp, Artificial Sequence
  Synthetic
ggccgtttccgtgacgtcacggccgccattttaagtaaggcggaagcagctcggcatatacaaaatgtcggcgga

SEQ ID NO: 339766 - DNA, 75 bp, Artificial Sequence
  Synthetic
ccattttaagtaaggcggaagcagctcggcatatacaaaatgtcggcggagcacttccggcttacccaaaatgaa

SEQ ID NO: 339767 - DNA, 75 bp, Artificial Sequence
  Synthetic
cacacctacgtcacaagtcacgtggggagggttggcgtatagcccggaagtcaatcctcccacgtggcctgtcac

SEQ ID NO: 339768 - DNA, 75 bp, Artificial Sequence
  Synthetic
ggagggttggcgtatagcccggaagtcaatcctcccacgtggcctgtcacgtgacgtgtacgtcacagtcgccat

SEQ ID NO: 339769 - DNA, 75 bp, Artificial Sequence
  Synthetic
cttcctcttttttaaaaataacggctcggcggcggcgcgcgcgctgcgcgcgcgcgccggggggctgccgccccc

SEQ ID NO: 339770 - DNA, 75 bp, Artificial Sequence
  Synthetic
cgcgcgccggggggctgccgccccccccggggaaaggggggggccccccccgggggggggtttgccccccggccc

SEQ ID NO: 339771 - DNA, 75 bp, Artificial Sequence
  Synthetic
ggggacgccatgcgcccccccccgcgcatgcgggggcccccccccgcggggggctccgccccccggccccccccg

SEQ ID NO: 339772 - DNA, 75 bp, Artificial Sequence
  Synthetic
attttgtgcagcccgccaattctcgttcaaacaggccaatcaggaggctctacgtacacttcctggggtgtgtct

SEQ ID NO: 339773 - DNA, 75 bp, Artificial Sequence
  Synthetic
ttcaaacaggccaatcaggaggctctacgtacacttcctggggtgtgtcttcgaagagtatataagcagaggcgg

SEQ ID NO: 339774 - DNA, 75 bp, Artificial Sequence
  Synthetic
accgcagtcaaggggcaattcgggctcgggactggccgggctatgggcaagattcttaaaaaattcccccgatcc

SEQ ID NO: 339775 - DNA, 75 bp, Artificial Sequence
  Synthetic
gccgtggagaccgccggtgcatagtgtccaggggcgagaggatcagtggttcgcgagcttttttcacggccacgc

SEQ ID NO: 339776 - DNA, 75 bp, Artificial Sequence
  Synthetic
gtccaggggcgagaggatcagtggttcgcgagcttttttcacggccacgcttcattttgcggttgcggtgacgct

SEQ ID NO: 339777 - DNA, 75 bp, Artificial Sequence
  Synthetic
ctcgctttcctcgcgccggtccaccaaggccccctccggggctagagcagcctaaccccccgcagcagggcccgg

SEQ ID NO: 339778 - DNA, 75 bp, Artificial Sequence
  Synthetic
aaggccccctccggggctagagcagcctaaccccccgcagcagggcccggccgggcccggagggccgcccgccat

SEQ ID NO: 339779 - DNA, 75 bp, Artificial Sequence
  Synthetic
gagcctgacgacccgcagccacggcgtggtggtggggacggtggcgccgccgctggcgccgcaggcgaccgtgga

SEQ ID NO: 339780 - DNA, 75 bp, Artificial Sequence
  Synthetic
gtggtggtggggacggtggcgccgccgctggcgccgcaggcgaccgtggagaccgagactacgacgaagaagagc

SEQ ID NO: 339781 - DNA, 75 bp, Artificial Sequence
  Synthetic
cgaagacgatttgtaagtaggagatggcgccggccttacaggcgcaggaggagacgcgggcgacgcagacgcaga

SEQ ID NO: 339782 - DNA, 75 bp, Artificial Sequence
  Synthetic
ggcgccggccttacaggcgcaggaggagacgcgggcgacgcagacgcagacgcagacgcagacataagcccaccc

SEQ ID NO: 339783 - DNA, 75 bp, Artificial Sequence
  Synthetic
cgttatcagacactgtaagataacaggacggatgcccctcattatctgtggaaaggggtccacccagttcaacta

SEQ ID NO: 339784 - DNA, 75 bp, Artificial Sequence
  Synthetic
ggacggatgcccctcattatctgtggaaaggggtccacccagttcaactacatcacccacgcggacgacatcacc

SEQ ID NO: 339785 - DNA, 75 bp, Artificial Sequence
  Synthetic
acttcacaaacatgactttctccctggaggcaatatacgaacagtttctgtaccacagaaacaggtggtcagcct

SEQ ID NO: 339786 - DNA, 75 bp, Artificial Sequence
  Synthetic
ggaggcaatatacgaacagtttctgtaccacagaaacaggtggtcagcctccaaccacgacctcgaactctgcag

SEQ ID NO: 339787 - DNA, 75 bp, Artificial Sequence
  Synthetic
tacaggcacccagatgtagactacatagtcacctacagcagaacgggaccctttgagatcagccacatgacctac

SEQ ID NO: 339788 - DNA, 75 bp, Artificial Sequence
  Synthetic
tagtcacctacagcagaacgggaccctttgagatcagccacatgacctacctcagcactcacccccttctcatgc

SEQ ID NO: 339789 - DNA, 75 bp, Artificial Sequence
  Synthetic
gcccagcctaaagactaagcccaggggcagaaaggccataaaagtcagaataagaccccccaaactcatgaacaa

SEQ ID NO: 339790 - DNA, 75 bp, Artificial Sequence
  Synthetic
ggcagaaaggccataaaagtcagaataagaccccccaaactcatgaacaacaagtggtacttcaccagagacttc

SEQ ID NO: 339791 - DNA, 75 bp, Artificial Sequence
  Synthetic
gggccacaggcttagaactcagaaacccctggctcagaatgagcaccctgagcccctgcataggcttcaatgtcc

SEQ ID NO: 339792 - DNA, 75 bp, Artificial Sequence
  Synthetic
cccctggctcagaatgagcaccctgagcccctgcataggcttcaatgtccttaaaaacagcatttacacaaacct

SEQ ID NO: 339793 - DNA, 75 bp, Artificial Sequence
  Synthetic
gacagacttaacattattaacaacacattacacccacatgacataacaggaccaaacaataaaaaatggcagtac

SEQ ID NO: 339794 - DNA, 75 bp, Artificial Sequence
  Synthetic
cattacacccacatgacataacaggaccaaacaataaaaaatggcagtacacatataccaaactcatggccccca

SEQ ID NO: 339795 - DNA, 75 bp, Artificial Sequence
  Synthetic
cacctatgacttactacgagagtatggcctctacagtccatactacctaaaccccacaaggataaaccttgactg

SEQ ID NO: 339796 - DNA, 75 bp, Artificial Sequence
  Synthetic
ggcctctacagtccatactacctaaaccccacaaggataaaccttgactggatgaccccctacacacacgtcagg

SEQ ID NO: 339797 - DNA, 75 bp, Artificial Sequence
  Synthetic
tcggaaacagaatatacatacagtggtgctcagaggcagatgtaagctacaacaggactaaatccaagtgtctct

SEQ ID NO: 339798 - DNA, 75 bp, Artificial Sequence
  Synthetic
gtgctcagaggcagatgtaagctacaacaggactaaatccaagtgtctcttacaagacatgcccctgtttttcat

SEQ ID NO: 339799 - DNA, 75 bp, Artificial Sequence
  Synthetic
attaaaaacacaggggtctcctcactagcgagagacgccagaatctgcatcaggtgtccctacacagagccacag

SEQ ID NO: 339800 - DNA, 75 bp, Artificial Sequence
  Synthetic
tagcgagagacgccagaatctgcatcaggtgtccctacacagagccacagctggtgggctccacagaagacatag

SEQ ID NO: 339801 - DNA, 75 bp, Artificial Sequence
  Synthetic
catgaggggcgacatgccggtacttgcaccatacataccgttgagctggttttgcaagtggtatcccaacatagc

SEQ ID NO: 339802 - DNA, 75 bp, Artificial Sequence
  Synthetic
gcaccatacataccgttgagctggttttgcaagtggtatcccaacatagctcaccagaaggaagtacttgaggca

SEQ ID NO: 339803 - DNA, 75 bp, Artificial Sequence
  Synthetic
cccgtgaccagggcatgaacggttgggatattacaataggttacaaaatggacttcttatggggcggttcccctc

SEQ ID NO: 339804 - DNA, 75 bp, Artificial Sequence
  Synthetic
ggatattacaataggttacaaaatggacttcttatggggcggttcccctctcccctcacagccaatcgacgaccc

SEQ ID NO: 339805 - DNA, 75 bp, Artificial Sequence
  Synthetic
cccgaccccgataagcaccctcgcctcctacaagtgtcgaacccgaaactgctcggaccgaggacagtgttccac

SEQ ID NO: 339806 - DNA, 75 bp, Artificial Sequence
  Synthetic
tcctacaagtgtcgaacccgaaactgctcggaccgaggacagtgttccacaagtgggacatcagacgtgggcagt

SEQ ID NO: 339807 - DNA, 75 bp, Artificial Sequence
  Synthetic
gtcagaatactcatcggatgatgaatctcttgcgccaggtctcccatcaaagcgaaacaagctcgactcggcctt

SEQ ID NO: 339808 - DNA, 75 bp, Artificial Sequence
  Synthetic
tctcttgcgccaggtctcccatcaaagcgaaacaagctcgactcggccttcagaggagaaaacccagagcaaaaa

SEQ ID NO: 339809 - DNA, 75 bp, Artificial Sequence
  Synthetic
tcgaggaagaagagaccccagaagaagaagaaccagcaccccaagaaaaagcccagaaagaggagctactccacc

SEQ ID NO: 339810 - DNA, 75 bp, Artificial Sequence
  Synthetic
agaagaaccagcaccccaagaaaaagcccagaaagaggagctactccaccagctccagctccagagacgccacca

SEQ ID NO: 339811 - DNA, 75 bp, Artificial Sequence
  Synthetic
ctcgtctttacagacatcctccgactccgccagggagtccactggaaccccgagctcacatagagcccccacctt

SEQ ID NO: 339812 - DNA, 75 bp, Artificial Sequence
  Synthetic
tccgccagggagtccactggaaccccgagctcacatagagcccccaccttacataccagacctactttttcccaa

SEQ ID NO: 339813 - DNA, 75 bp, Artificial Sequence
  Synthetic
cccttcgactgggaaacggaggcccagctagcagggatattcaagcgtcctatgcgcttctatccctcagacacc

SEQ ID NO: 339814 - DNA, 75 bp, Artificial Sequence
  Synthetic
agctagcagggatattcaagcgtcctatgcgcttctatccctcagacacccctcactacccgtggttacccccca

SEQ ID NO: 339815 - DNA, 75 bp, Artificial Sequence
  Synthetic
cataaacttcaaaataaagctgcaagagtgagtgattcgaggccctcctctgttcacttagcggtgtctacctct

SEQ ID NO: 339816 - DNA, 75 bp, Artificial Sequence
  Synthetic
gagtgagtgattcgaggccctcctctgttcacttagcggtgtctacctcttaaagtcaccaagcactccgagcgt

SEQ ID NO: 339817 - DNA, 75 bp, Artificial Sequence
  Synthetic
aggggcaacttcctcggggtccggcgctacgcgcttcgcgctgcgccggacgcctcggacccccccccgacccga

SEQ ID NO: 339818 - DNA, 75 bp, Artificial Sequence
  Synthetic
gctacgcgcttcgcgctgcgccggacgcctcggacccccccccgacccgaatcgctcgcgcgattcggacctgcg

SEQ ID NO: 339819 - DNA, 75 bp, Artificial Sequence
  Synthetic
ctaaacagactccgagttgccactggactcaggagctgtgaatcagtaacgaaagtgagtggggccagacttcgc

SEQ ID NO: 339820 - DNA, 75 bp, Artificial Sequence
  Synthetic
gactcaggagctgtgaatcagtaacgaaagtgagtggggccagacttcgccatagggcctttaacttggggtcgt

SEQ ID NO: 339821 - DNA, 75 bp, Artificial Sequence
  Synthetic
gggcgccgccattttagctttagacgccattttaggccctcgcgggcacccgtaggcgcgttttaatgacgtcac

SEQ ID NO: 339822 - DNA, 75 bp, Artificial Sequence
  Synthetic
gccattttaggccctcgcgggcacccgtaggcgcgttttaatgacgtcacggcagccattttgtcgtgacgtttg

SEQ ID NO: 339823 - DNA, 75 bp, Artificial Sequence
  Synthetic
acccggaagcatccctggtcacgtgactctgacgtcacggcggccattttgtgctgtccgccatcttgtgacttc

SEQ ID NO: 339824 - DNA, 75 bp, Artificial Sequence
  Synthetic
actctgacgtcacggcggccattttgtgctgtccgccatcttgtgacttccttccgctttttcaaaaaaaaagag

SEQ ID NO: 339825 - DNA, 75 bp, Artificial Sequence
  Synthetic
gcggccgcgttcgcgcgccgcccaccagggggtgctgcgcgcccccccccgcgcatgcgcggggcccccccccgg

SEQ ID NO: 339826 - DNA, 75 bp, Artificial Sequence
  Synthetic
gcgcatgcgcggggcccccccccgggggggctccgcccccccggcccccccccgtgctaaacccaccgcgcatgc

SEQ ID NO: 339827 - DNA, 75 bp, Artificial Sequence
  Synthetic
aaagagacacagacagactctagtagtgaggcagtggcaacctgacgttgttaaaaagtgtaaaataacaggatg

SEQ ID NO: 339828 - DNA, 75 bp, Artificial Sequence
  Synthetic
tgttgcaggacctttaccaagaaaaagaaacaagttcgatactcgagtccaaggccctccaaccccagaaaaaga

SEQ ID NO: 339829 - DNA, 75 bp, Artificial Sequence
  Synthetic
ccccctgcccggtagcaacttcctcggggtccggcgctacgccttcggctgcgccggacgcctcggaccccccct

SEQ ID NO: 339830 - DNA, 75 bp, Artificial Sequence
  Synthetic
cccccgcgcatgcgcgggtcccccccctcgggggggctccgccccccggcccccccccgggctaaatacaccgcg

SEQ ID NO: 339831 - DNA, 75 bp, Artificial Sequence
  Synthetic
cctcgggggggctccgccccccggcccccccccgggctaaatacaccgcgcatgcgcggccacgcccccgccgcc

SEQ ID NO: 339832 - DNA, 75 bp, Artificial Sequence
  Synthetic
gcccaccagggggcgctacgcgcccccccccgcgcatgcgcgggtcccccccctcgggggggctccgccccccgg

SEQ ID NO: 339833 - DNA, 75 bp, Artificial Sequence
  Synthetic
tcggcgccatcttgtgtcacaaaatggcggctaacttccgcttttttgaaaaaaggcgcgaaaaaacggccggcc

SEQ ID NO: 339834 - DNA, 75 bp, Artificial Sequence
  Synthetic
cctggggccccagtacaaaaaacaccttagtattagctccactatggatgacactaacaaagcacattatgaaga

SEQ ID NO: 339835 - DNA, 75 bp, Artificial Sequence
  Synthetic
aaacttatttaataaaactgaactatacaacacctttcaaaccatagctcagcttagagacacaggacaaactac

SEQ ID NO: 339836 - DNA, 75 bp, Artificial Sequence
  Synthetic
gtccagaatacagcagcacttgagttatcaggtgcaaatgccactagcagcaaagacacttggtataaaggtaat

SEQ ID NO: 339837 - DNA, 75 bp, Artificial Sequence
  Synthetic
caaagacacttggtataaaggtaatacatacacgaaagacatatcaaagttagcagaaaaaaccagacaaagatt

SEQ ID NO: 339838 - DNA, 75 bp, Artificial Sequence
  Synthetic
gatgcccacacactgagcccatgttaatagaccactcagacccaaacaaaggcttcgttccctactcattcgact

SEQ ID NO: 339839 - DNA, 75 bp, Artificial Sequence
  Synthetic
aatagaccactcagacccaaacaaaggcttcgttccctactcattcgactttggcaatggaaagatgcccggagg

SEQ ID NO: 339840 - DNA, 75 bp, Artificial Sequence
  Synthetic
gggcaattcgggctcgggactggccgggctatgggcaaggctcttagagtattcattcttaatatgcgcttttcc

SEQ ID NO: 339841 - DNA, 75 bp, Artificial Sequence
  Synthetic
agctagacgagctgttccgcgccgtcgccgccgacgaagagtaaggaggcgccggtgggggaggcgaagacgtag

SEQ ID NO: 339842 - DNA, 75 bp, Artificial Sequence
  Synthetic
ctcccggctgcgccagaggcgcccggagatagagcaccatggcctatggcttgtggcaccgaaggagaagacggt

SEQ ID NO: 339843 - DNA, 75 bp, Artificial Sequence
  Synthetic
tacacccaggcatgctagccctagacaaaagagcaagatggatacctagcttaaaatctagaccaggaaaaaaac

SEQ ID NO: 339844 - DNA, 75 bp, Artificial Sequence
  Synthetic
caatatggctatcccctggtagatcttactttgaaacaacaggagcatacacagacataaagtacaatccattca

SEQ ID NO: 339845 - DNA, 75 bp, Artificial Sequence
  Synthetic
gtaaatgcttagtacgagacctacctctatgggcagcagcatatggatatgtagaattctgtgcaaaaagtacag

SEQ ID NO: 339846 - DNA, 75 bp, Artificial Sequence
  Synthetic
tctttggcccaagagctattcaaagaatgcaacaacaaccaacaactactgacattctttcagcaggccgcaaga

SEQ ID NO: 339847 - DNA, 75 bp, Artificial Sequence
  Synthetic
attttgtggcacaagatggccgacttccttcctctttttcaaaaaaagcggaagtgccgccgcggcggcgggggc

SEQ ID NO: 339848 - DNA, 75 bp, Artificial Sequence
  Synthetic
ttgtgaacttccaggttctgcaatccatgtatgatgaaaaaattagcatattaccagaccaaaaacaacaaagac

SEQ ID NO: 339849 - DNA, 75 bp, Artificial Sequence
  Synthetic
caaactatagcccaattaaagccatttatagacgcaggcaatgtaacatcaggcacaacagcaacaacatgggga

SEQ ID NO: 339850 - DNA, 75 bp, Artificial Sequence
  Synthetic
ctacaacagccacaacaacttatacatatccagacactaacactaccacagtaactatgttaacctgtaatgact

SEQ ID NO: 339851 - DNA, 75 bp, Artificial Sequence
  Synthetic
caaacaaattaaagacttaccaataaaagcagctacattatactcagaagcaacaaaaaccttgctaggaaacac

SEQ ID NO: 339852 - DNA, 75 bp, Artificial Sequence
  Synthetic
tctatgggcagcagcatatggatatgtagaattttgtgcaaaaagtacaggagaccagaacatacacatgaatgc

SEQ ID NO: 339853 - DNA, 75 bp, Artificial Sequence
  Synthetic
tgatccccgcgtcccgagggcgggtgccgaaggtgagtttacacaccgcagtcaaggggcaattcgggctcggga

SEQ ID NO: 339854 - DNA, 75 bp, Artificial Sequence
  Synthetic
atcccacgctagttgctgtggctgcggcagttttgttaatcatattaatgtacaggctgctcgctacggctttac

SEQ ID NO: 339855 - DNA, 75 bp, Artificial Sequence
  Synthetic
acacatagccaaaaccaaaaaaaacaaaaggttaaagggcagggggcgtggcttgggctaggggacgccatcttg

SEQ ID NO: 339856 - DNA, 75 bp, Artificial Sequence
  Synthetic
gctgtgacgtatgtggggggcaagccccccacgcccccccgggaccgcctcccggcggtcagcgcctcccccacc

SEQ ID NO: 339857 - DNA, 75 bp, Artificial Sequence
  Synthetic
cccccacgcccccccgggaccgcctcccggcggtcagcgcctcccccaccctacagccccccggaggccgccatc

SEQ ID NO: 339858 - DNA, 75 bp, Artificial Sequence
  Synthetic
ttggattggaaatcgaactatcggaaatcgattaccaatatcggaaatcgtattacaaatcgatcggaaatcgat

SEQ ID NO: 339859 - DNA, 75 bp, Artificial Sequence
  Synthetic
tatgcaaatcggacatcggaatgcagaaatcgaacatcgattatgcaaatgagcccgccatttcactccaagaaa

SEQ ID NO: 339860 - DNA, 75 bp, Artificial Sequence
  Synthetic
gaagaagtactttgaaaaagaggaagtcgctctgattggcgcatacagcatccctcatttgcatacagtatgagc

SEQ ID NO: 339861 - DNA, 75 bp, Artificial Sequence
  Synthetic
tccctcatttgcatacagtatgagccaattagaacaacttccgcttttccactctatatcttgcgctgcagttcc

SEQ ID NO: 339862 - DNA, 75 bp, Artificial Sequence
  Synthetic
gaatggccgagtttatgctgccggggtcggacagcgccgaaggcgcgcgtgcgaggcccggggcgggtgccgaga

SEQ ID NO: 339863 - DNA, 75 bp, Artificial Sequence
  Synthetic
tcgaggggcaattcgggcaagggccaccgagcagcgggcaagattcttaaaggtattctgtctttgtctctcgtt

SEQ ID NO: 339864 - DNA, 75 bp, Artificial Sequence
  Synthetic
cctccaggccattcagcattattattgcgcaatccgatgtccgacgagggctaccgagagctcgtggagagtaag

SEQ ID NO: 339865 - DNA, 75 bp, Artificial Sequence
  Synthetic
tgcgcaatccgatgtccgacgagggctaccgagagctcgtggagagtaagagtgctcccacgaccccgggaccct

SEQ ID NO: 339866 - DNA, 75 bp, Artificial Sequence
  Synthetic
ctaccgagagctcgtggagagtaagagtgctcccacgaccccgggaccctggagcccagaccgggagagatggaa

SEQ ID NO: 339867 - DNA, 75 bp, Artificial Sequence
  Synthetic
gcgtcacgaggcagcgtggaagcagcactgtagctggagtcacgggctctggtgccactgccacgactggacgcg

SEQ ID NO: 339868 - DNA, 75 bp, Artificial Sequence
  Synthetic
cactgtagctggagtcacgggctctggtgccactgccacgactggacgcgacacctcaaaaaggagacgcgagaa

SEQ ID NO: 339869 - DNA, 75 bp, Artificial Sequence
  Synthetic
tgcggttccggtaccgaaagtggcgaagaccccgccgtctctttcgatctcgtagacgacgcggctatgctcgcc

SEQ ID NO: 339870 - DNA, 75 bp, Artificial Sequence
  Synthetic
gccgctggagacgccgagcctggggccgccggaggcgggtaaggagataccgaaggcgacgcgggggcaccaaaa

SEQ ID NO: 339871 - DNA, 75 bp, Artificial Sequence
  Synthetic
gacaatacatttctagtattatgcaatggaacccacaacaccgccatctttgctatatcaaaggcatcacgtggc

SEQ ID NO: 339872 - DNA, 75 bp, Artificial Sequence
  Synthetic
tctgcgccgccagatcagaccgaatgtcctggccgggcattaaacagatagcggctacggactccacaagatttt

SEQ ID NO: 339873 - DNA, 75 bp, Artificial Sequence
  Synthetic
gtcctggccgggcattaaacagatagcggctacggactccacaagattttggagcactattttagtcggaggatg

SEQ ID NO: 339874 - DNA, 75 bp, Artificial Sequence
  Synthetic
tggttcttctttgagaacctaagatggcggaaccgctggtcgcatagcaacgtgggttacgatttagcaagatac

SEQ ID NO: 339875 - DNA, 75 bp, Artificial Sequence
  Synthetic
cgtgggttacgatttagcaagatacatggggacacacctctacttcccccccctagcagacatctggtacattgt

SEQ ID NO: 339876 - DNA, 75 bp, Artificial Sequence
  Synthetic
atggggacacacctctacttcccccccctagcagacatctggtacattgtgtggacagatacagaatttgttgac

SEQ ID NO: 339877 - DNA, 75 bp, Artificial Sequence
  Synthetic
caacccaaaaaagtcatgagttacacgcatccgtggatactcctcatgaccaaaaaacacaaggtcataaaaccc

SEQ ID NO: 339878 - DNA, 75 bp, Artificial Sequence
  Synthetic
cgcatccgtggatactcctcatgaccaaaaaacacaaggtcataaaaccccggaaatggaatggcaaaggcaaaa

SEQ ID NO: 339879 - DNA, 75 bp, Artificial Sequence
  Synthetic
aatatttctcaaacctcctgcggttttcaattccgcttggtacacttcagacaagtggtgcggggcggggctagg

SEQ ID NO: 339880 - DNA, 75 bp, Artificial Sequence
  Synthetic
acgcatctacttctcctttttaaacccattcaaacagatcatgcacaccaatcagacagaacagagcttcccctt

SEQ ID NO: 339881 - DNA, 75 bp, Artificial Sequence
  Synthetic
ccattcaaacagatcatgcacaccaatcagacagaacagagcttcccctttgcgatagaattgggcaatactgat

SEQ ID NO: 339882 - DNA, 75 bp, Artificial Sequence
  Synthetic
tgcgatagaattgggcaatactgattatgacaaacctcccaataatagttacgattttaaggacacaaagtttgt

SEQ ID NO: 339883 - DNA, 75 bp, Artificial Sequence
  Synthetic
aacacaaacatggaatacaaaaggaaaaaaatactattaccgtgccgattgggacaccggagacggaaatgcaat

SEQ ID NO: 339884 - DNA, 75 bp, Artificial Sequence
  Synthetic
catgttgcccaatactctatcgccaaccaccccagctagctggcttctcctagaatgggacgccccctactggct

SEQ ID NO: 339885 - DNA, 75 bp, Artificial Sequence
  Synthetic
gtggttctggggaaaaacatatcaggattttgtttcatcacacacaccggaaggaaatccatattatggccagat

SEQ ID NO: 339886 - DNA, 75 bp, Artificial Sequence
  Synthetic
ttatgtcaaatggtggcccattaccaacccctatgatcagggaccccacacctaccccgaggacaaagaatggtg

SEQ ID NO: 339887 - DNA, 75 bp, Artificial Sequence
  Synthetic
cctaccccgaggacaaagaatggtgcctcatgatgctagatccacaacagaattttatggcatgcaacagcatcg

SEQ ID NO: 339888 - DNA, 75 bp, Artificial Sequence
  Synthetic
cagcggccctaaaaatagcagctttcgggccctgtgtttacgcaccccaagacacacaaacatcacaaataccca

SEQ ID NO: 339889 - DNA, 75 bp, Artificial Sequence
  Synthetic
ttaacattcccatgtattatctctccaaatggcagtggggtggaagtacccaagggaccagcacccacattgaca

SEQ ID NO: 339890 - DNA, 75 bp, Artificial Sequence
  Synthetic
caaatggcagtggggtggaagtacccaagggaccagcacccacattgacaacccttgctatccgagacctaaatc

SEQ ID NO: 339891 - DNA, 75 bp, Artificial Sequence
  Synthetic
aatacaaatcgcagacccagccaccgcccctagagacgtcatacacccctgggatgtggatgcttccggaactat

SEQ ID NO: 339892 - DNA, 75 bp, Artificial Sequence
  Synthetic
gcccctagagacgtcatacacccctgggatgtggatgcttccggaactatatcaaccgcaaagctcaaacgactc

SEQ ID NO: 339893 - DNA, 75 bp, Artificial Sequence
  Synthetic
atggaaggacttggttacagggaaccgaaaccgaaaccgggaccccccgagaccctcataccgccgggagcgccg

SEQ ID NO: 339894 - DNA, 75 bp, Artificial Sequence
  Synthetic
acgccagagctcgactactacagctcggagaccgagagcgatgacttcgacaccggagactccgaggaagaggag

SEQ ID NO: 339895 - DNA, 75 bp, Artificial Sequence
  Synthetic
cggagaccgagagcgatgacttcgacaccggagactccgaggaagaggaggaggaccaccaggacccgcgctggg

SEQ ID NO: 339896 - DNA, 75 bp, Artificial Sequence
  Synthetic
ttcgagagagccttgacaagcttactcgaaggcttaggggtgagcgaagacagcgacagcagctcggaaagggac

SEQ ID NO: 339897 - DNA, 75 bp, Artificial Sequence
  Synthetic
tcgaaggcttaggggtgagcgaagacagcgacagcagctcggaaagggactgctggcccttctaaaagagaaaaa

SEQ ID NO: 339898 - DNA, 75 bp, Artificial Sequence
  Synthetic
ataaaaattggcgaaacgaaactaaaccggtgtccgccatcttgttttgtgacgtaagtggggggctccgccccc

SEQ ID NO: 339899 - DNA, 75 bp, Artificial Sequence
  Synthetic
accggtgtccgccatcttgttttgtgacgtaagtggggggctccgccccccacacccccccgcggggggctccgc

SEQ ID NO: 339900 - DNA, 75 bp, Artificial Sequence
  Synthetic
gacgtaagtggggggctccgccccccacacccccccgcggggggctccgccccccacaccccccgcgcggggggc

SEQ ID NO: 339901 - DNA, 75 bp, Artificial Sequence
  Synthetic
tcccgccccccgggccccccggcacgcctcccacgaacacgcccatggggggggctccgccccccccaaaccccc

SEQ ID NO: 339902 - DNA, 75 bp, Artificial Sequence
  Synthetic
ccggcacgcctcccacgaacacgcccatggggggggctccgccccccccaaaccccccctggcgcctcccccccc

SEQ ID NO: 339903 - DNA, 75 bp, Artificial Sequence
  Synthetic
acacatagccaaaaccaaaaaaaacaaaaggttaaagggcagggggcgtggcctgtgctgggggccgccatcttg

SEQ ID NO: 339904 - DNA, 75 bp, Artificial Sequence
  Synthetic
tattacaaatcgatcgaaaatcgattatgcaaatcggacatcggaatagagaaatcgaacatcgattatgcaaat

SEQ ID NO: 339905 - DNA, 75 bp, Artificial Sequence
  Synthetic
gagcccgccatttctctccaagaaagaggaagttctctgaaaaagaggaagtcgctctgattggcgcatacagca

SEQ ID NO: 339906 - DNA, 75 bp, Artificial Sequence
  Synthetic
tccctcatttacatacagtatgagccaattagaacaacttccgcctttccactctatatcttgcgctgcagttcc

SEQ ID NO: 339907 - DNA, 75 bp, Artificial Sequence
  Synthetic
gcgaggcccggggcgggtgccgagactcctgcggagcagcgagaggcgagtcaaggggcaattcgggcaagggcc

SEQ ID NO: 339908 - DNA, 75 bp, Artificial Sequence
  Synthetic
tcaaggggcaattcgggcaagggccaccgtgcagcgggcaagattcttaaggtattctgtctttgttctctcgtt

SEQ ID NO: 339909 - DNA, 75 bp, Artificial Sequence
  Synthetic
ctaccgagagctcgtggagagtaagagtgctcccacgaccccgggaccctggagcccggacagggagagatggaa

SEQ ID NO: 339910 - DNA, 75 bp, Artificial Sequence
  Synthetic
cgaaggcggcgcgggggcaccaaaagacaatacatttctagtattatgcaatggaacccgcagcaccgccatctt

SEQ ID NO: 339911 - DNA, 75 bp, Artificial Sequence
  Synthetic
tgctatatcaagggcatcacgtggctctgcgccgccagagcggaccgcatgtcctggccgggcattaaacagata

SEQ ID NO: 339912 - DNA, 75 bp, Artificial Sequence
  Synthetic
gtcctggccgggcattaaacagatagcggctacagactccacaagatattggagcactattttagtcggaggatg

SEQ ID NO: 339913 - DNA, 75 bp, Artificial Sequence
  Synthetic
atggggacacacctctacttcccccccctagcggacatctggtacattgtctggacagatacagaatttgttgac

SEQ ID NO: 339914 - DNA, 75 bp, Artificial Sequence
  Synthetic
caaaaaacacaaggtcataaaaccccggaaatggaatggcaaaggcaaaaaaatatttctcaaacctcctgcggt

SEQ ID NO: 339915 - DNA, 75 bp, Artificial Sequence
  Synthetic
ttatgacaaaccgcccaataattcttacgactttaaagacacaaacgaagtaaaaaaggtatggaatacagcagg

SEQ ID NO: 339916 - DNA, 75 bp, Artificial Sequence
  Synthetic
taaaaaaggtatggaatacagcaggaaaaaaatactattaccgtgccgattgggacactggtgacggaaatgcaa

SEQ ID NO: 339917 - DNA, 75 bp, Artificial Sequence
  Synthetic
tcatgttgcccaatactctgagtccaaccaccccagccagctggcttctccttgaatgggacgccccctactggc

SEQ ID NO: 339918 - DNA, 75 bp, Artificial Sequence
  Synthetic
aaccaccccagccagctggcttctccttgaatgggacgccccctactggctgtggttctggggaaaaacatatca

SEQ ID NO: 339919 - DNA, 75 bp, Artificial Sequence
  Synthetic
gcctcatgatgctagatccacaaccaaatttcatgacatgcaatagcatcgcagcggccctaaaaatagcagctt

SEQ ID NO: 339920 - DNA, 75 bp, Artificial Sequence
  Synthetic
ccaagggaccagcacccacattgacaacccatgcaatccgagacctaaatcaatacaaatcgcagacccagccac

SEQ ID NO: 339921 - DNA, 75 bp, Artificial Sequence
  Synthetic
tgggatgtggatgcttccggaactatatcaaccgcaaaactcaaacaactcatggaaggacttggttacagggaa

SEQ ID NO: 339922 - DNA, 75 bp, Artificial Sequence
  Synthetic
ccacacccccccgcggggggctccgccccccacaccccccgcgcggggggctccccgccccccgggacccccctg

SEQ ID NO: 339923 - DNA, 75 bp, Artificial Sequence
  Synthetic
ctgccacgcctcccacgaacacgcccatggggggggctccgccccccccaaaccccccctggcgcctcccccccc

SEQ ID NO: 339924 - DNA, 75 bp, Artificial Sequence
  Synthetic
aaaaggttaaagggcagggggcgtggcttgggctagtggacgccatcttggttgtgacgtaagtggggggcaagc

SEQ ID NO: 339925 - DNA, 75 bp, Artificial Sequence
  Synthetic
ttggattggaaatcgaactatcgggaaatcgattaccaatatcgggaaatcgtattacaaatcgatcggaaatcg

SEQ ID NO: 339926 - DNA, 75 bp, Artificial Sequence
  Synthetic
attatgcaaatcggacatcggaatagagaaatcgaacatcgattatgcaaatgagcccgccatttcactccaaaa

SEQ ID NO: 339927 - DNA, 75 bp, Artificial Sequence
  Synthetic
aagaggaagttctctggaaaggaggaagtagctctgattggcgcatacagcatccctcatttgcatacagtatga

SEQ ID NO: 339928 - DNA, 75 bp, Artificial Sequence
  Synthetic
accaattagaacaacttccgcttttccactctatatctcgcgctgcagttccgaatggctgagtttatgctgccg

SEQ ID NO: 339929 - DNA, 75 bp, Artificial Sequence
  Synthetic
agagtgctcccacgaccccgggaccctggagtccggaccgggagagatggaagcgtcacgaggcagcgtggaagc

SEQ ID NO: 339930 - DNA, 75 bp, Artificial Sequence
  Synthetic
ctggtgccactgccacgactggacgcaacacctcaaaaaagcaacgcgagaatgcggttccggtaccgaaagtgg

SEQ ID NO: 339931 - DNA, 75 bp, Artificial Sequence
  Synthetic
aagacaatacatttctagtattatgcaatggaacccgcaacaccgccatctttgctatatcaagggcataacgtg

SEQ ID NO: 339932 - DNA, 75 bp, Artificial Sequence
  Synthetic
gctctgcgctgccagagcggaccgcatatcctggccgggcattagacagatagcggctactgactccacaagata

SEQ ID NO: 339933 - DNA, 75 bp, Artificial Sequence
  Synthetic
atatcctggccgggcattagacagatagcggctactgactccacaagatattggagcacaattttagtcggaggg

SEQ ID NO: 339934 - DNA, 75 bp, Artificial Sequence
  Synthetic
tgcggagttttaacgttatccatggactggttcttctttgagaacctaagatggcggaaccgctggtcgcatagc

SEQ ID NO: 339935 - DNA, 75 bp, Artificial Sequence
  Synthetic
cccggaaatggaatggcaaaggcaaaaaaatatttctcaaaccgcctgcggttttcaattccgcatggtacgctc

SEQ ID NO: 339936 - DNA, 75 bp, Artificial Sequence
  Synthetic
caggcaaatggtgcggagcggggctaggacgaatctacttctcctttataaaccccttcaaacaaattatgcaca

SEQ ID NO: 339937 - DNA, 75 bp, Artificial Sequence
  Synthetic
caggacagacagaacagagcttcccctttgcgatagaattgggcaatacagattatgataagccacccaataata

SEQ ID NO: 339938 - DNA, 75 bp, Artificial Sequence
  Synthetic
agtacgatttcaaaaacacagatattgtaaaacaagtatggacggcaaaagacaaaaaatatcattaccgtgccg

SEQ ID NO: 339939 - DNA, 75 bp, Artificial Sequence
  Synthetic
gacaaaaaatatcattaccgtgccgattggggcacaggcgacggaaatgcaatcatgttgcccaatactctaagt

SEQ ID NO: 339940 - DNA, 75 bp, Artificial Sequence
  Synthetic
caggattttgtttcatcacacacaccggaaggaaatcaatattatggccaaatttatgtgaaatggtggcccatt

SEQ ID NO: 339941 - DNA, 75 bp, Artificial Sequence
  Synthetic
accaacccctacgatcagggaccccacacctacccggaagacaaagaatggtgcctcgtgatgctagatccacaa

SEQ ID NO: 339942 - DNA, 75 bp, Artificial Sequence
  Synthetic
ccaaatttcatgacatgcaacagcattgcagcggccctgaaaatagcacagttcgggccctgcgtctactcatcc

SEQ ID NO: 339943 - DNA, 75 bp, Artificial Sequence
  Synthetic
gttcgggccctgcgtctactcatccacagacctacaacaatcacaaatacccattaacatacccatgtattatct

SEQ ID NO: 339944 - DNA, 75 bp, Artificial Sequence
  Synthetic
acccaagggaccagcacccacattgacaacccttgcaatccgagacctagatcaatacaaatcgcagacccagcc

SEQ ID NO: 339945 - DNA, 75 bp, Artificial Sequence
  Synthetic
cgacaccggagactccgaggaagaggaggaggaccaccaagacccgcggtgggttcgagagagccttgacaagct

SEQ ID NO: 339946 - DNA, 75 bp, Artificial Sequence
  Synthetic
cgccccccacacccccccgcgcggggggctcccgccccccggaccccccggcacgcctcccacgaacacgcccat

SEQ ID NO: 339947 - DNA, 75 bp, Artificial Sequence
  Synthetic
ggcacgcctcccacgaacacgcccatgggggggagctccgccccccccaaaccccccctggcgcctccccccccc

SEQ ID NO: 339948 - DNA, 75 bp, Artificial Sequence
  Synthetic
taattatgcaaagtaggcggagacagcaaccacgcccaaccacgcctactttgaataatgcatgttaatgagcaa

SEQ ID NO: 339949 - DNA, 75 bp, Artificial Sequence
  Synthetic
ggcgctgcgcgcctgccgctcgccggagcaattcgcggctcgcaggctcgccgcgcttttcacgtggcccgcgca

SEQ ID NO: 339950 - DNA, 75 bp, Artificial Sequence
  Synthetic
aaggggaagtctctctcattggttcgtttaaaaaacgtcaccgagcgggaaactccgggggcgtggtccactaaa

SEQ ID NO: 339951 - DNA, 75 bp, Artificial Sequence
  Synthetic
gcctctcacctcacccgtgggcgcgcaaggcgcgcccccgggatcgcagtctcgacagcacctagaatcgagcac

SEQ ID NO: 339952 - DNA, 75 bp, Artificial Sequence
  Synthetic
aggggaagttctcctcattggtccgctaaacagccaataggaaagcgacccccagaatcacctaatctgcattga

SEQ ID NO: 339953 - DNA, 75 bp, Artificial Sequence
  Synthetic
ggcgcgcgcaacgcgcgcgccgtacgtcgcgcgctgcgctaggcttcccgccaccgatcggctcgcttcgctcgc

SEQ ID NO: 339954 - DNA, 75 bp, Artificial Sequence
  Synthetic
cgtgtttccttccgcttttcgggagaggatataagcaagtgcactgacgaatggctgagtttaccgtgccgggga

SEQ ID NO: 339955 - DNA, 75 bp, Artificial Sequence
  Synthetic
cgctcggctggccttaatttgctaaaggaactccgagacgccattggacactggggcaggtgaaccgcctgaggg

SEQ ID NO: 339956 - DNA, 75 bp, Artificial Sequence
  Synthetic
gcagcgtctgccgagcggagcgaggcgcgaccgagcgactgggcgggagccgggaacatccgaaggtatgtggac

SEQ ID NO: 339957 - DNA, 75 bp, Artificial Sequence
  Synthetic
tcgcaccaagacgctcgctgacagcggcccccttcgggggccctgtcccacgctcgctcctaacgtatcagtgga

SEQ ID NO: 339958 - DNA, 75 bp, Artificial Sequence
  Synthetic
gtctaggggcaattcgggcaggagcacccggcgcaacgggcaaggctcttaaaaacgcttgtccctcttcatccc

SEQ ID NO: 339959 - DNA, 75 bp, Artificial Sequence
  Synthetic
gcgagcgcgatccgaaaccgaaagtgcaaaaagaggaaggaaagggggggcgttgcccccccttcaaccccccgg

SEQ ID NO: 339960 - DNA, 75 bp, Artificial Sequence
  Synthetic
catacagtgcgatgggagactggttcatgcagggcagccccccggacttcgcggtccaggaggacagatggctca

SEQ ID NO: 339961 - DNA, 75 bp, Artificial Sequence
  Synthetic
gggggggcgttgcccccccttcaaccccccggcgggggggccgagccccccctgcacccccccggactccgcccc

SEQ ID NO: 339962 - DNA, 75 bp, Artificial Sequence
  Synthetic
aggccgttgagagctgccaccagctgttctgcagctgctccagcgcctgggaccacctgaggaacatcctgcaga

SEQ ID NO: 339963 - DNA, 75 bp, Artificial Sequence
  Synthetic
cccgcggatactggccccagggaccaccaccgtaccgatcggaaccccacacggagcactcccgtccgccccctc

SEQ ID NO: 339964 - DNA, 75 bp, Artificial Sequence
  Synthetic
ctaaaaagcggaggccatggtgtggaggcgacggtggtggagacgccggcgccggcccgtctggcgtcgccggta

SEQ ID NO: 339965 - DNA, 75 bp, Artificial Sequence
  Synthetic
ccgccgctggaggcgccggaggcgatggcgccgtcggccccgtagaagaagacgaccctaccgtcgccgacctta

SEQ ID NO: 339966 - DNA, 75 bp, Artificial Sequence
  Synthetic
tcgccgctatggaagaagacgaaaggtgaggaggagacgcagacggactctagtcgtcagacaatttcagccccc

SEQ ID NO: 339967 - DNA, 75 bp, Artificial Sequence
  Synthetic
ttaccagagacgctgtagggtgtccggactcgaacccctcctttactttggcaaaaaggaggaggagagacactt

SEQ ID NO: 339968 - DNA, 75 bp, Artificial Sequence
  Synthetic
ctacggtaacagacagataatgaaggacgttgatcagacggaggggggcggggtgacggacggagtgttctccct

SEQ ID NO: 339969 - DNA, 75 bp, Artificial Sequence
  Synthetic
ggaggagctctacgagagctaccaggagggctggaaccactggtcggccagcaaccagatgcttcccctggttcg

SEQ ID NO: 339970 - DNA, 75 bp, Artificial Sequence
  Synthetic
gtacttcgggtgtaaaatcaccctgtatcgctcggcgacagacagctacatcttctggtggactaacaggccgcc

SEQ ID NO: 339971 - DNA, 75 bp, Artificial Sequence
  Synthetic
gttccaagtagacagacagttctgggtgggcatgcatccttactggatgctccgcagaggtcgcaaggtggtcat

SEQ ID NO: 339972 - DNA, 75 bp, Artificial Sequence
  Synthetic
gctaagtaaacaactaaaaccctttgcaaaagaccacgtcaccatcaagataggaccgcccgccctcatgaaaac

SEQ ID NO: 339973 - DNA, 75 bp, Artificial Sequence
  Synthetic
taagtggtactttgccagggacttctgcaaaacctggctgctccagtggagagcctgtttctttaaccccataga

SEQ ID NO: 339974 - DNA, 75 bp, Artificial Sequence
  Synthetic
tccttatatccccagaggcgccaataacaccaccgttaccttctatggctttcccggacactcgtacccctcgca

SEQ ID NO: 339975 - DNA, 75 bp, Artificial Sequence
  Synthetic
gagcctatactatacgtggcaagaacatcttgcagaaacaaacgtttggggaatcaccaacgaatctgaaaagac

SEQ ID NO: 339976 - DNA, 75 bp, Artificial Sequence
  Synthetic
aaaatttgaggccctccgaaaagcttggaacgagcaggccaccaaaggtcccgtagcgggttacaaagcggtcct

SEQ ID NO: 339977 - DNA, 75 bp, Artificial Sequence
  Synthetic
acaggccatgaacgcctgggctagcgttgccgccccaggtccagagggttccaactttgccaaagggaccaacgt

SEQ ID NO: 339978 - DNA, 75 bp, Artificial Sequence
  Synthetic
ggctctaggcctcgccaacctgctgtggctaatatactcccagtactactggcaaaatagatcccccagcccctg

SEQ ID NO: 339979 - DNA, 75 bp, Artificial Sequence
  Synthetic
gggcctgccaggtgccaccctggaggccatgaaacacccggaggcctggaagccgtacgcctacaaatacagctg

SEQ ID NO: 339980 - DNA, 75 bp, Artificial Sequence
  Synthetic
gtctcacgataaaggcaagggcaacagattcgccatatgcgactggccctacaaagaccagcacggagagcagac

SEQ ID NO: 339981 - DNA, 75 bp, Artificial Sequence
  Synthetic
cactccgttaaactttgacctggaaataaaggacgcccctctatggtggtgcgtaaccgcggcgtacgactgggc

SEQ ID NO: 339982 - DNA, 75 bp, Artificial Sequence
  Synthetic
catcaggcagggcaaaaacccggccaactggagctttttcgtccgctccgattatacctggccgcgggccgacaa

SEQ ID NO: 339983 - DNA, 75 bp, Artificial Sequence
  Synthetic
catcatcttggcctactcaagctactttgcagacaacgtagttaaaaataagtatgccgacccacaacatgccac

SEQ ID NO: 339984 - DNA, 75 bp, Artificial Sequence
  Synthetic
gggcggctactttaccctatacagagcccctaacctcattgacggcagggaggccatagatatcatttaccgtaa

SEQ ID NO: 339985 - DNA, 75 bp, Artificial Sequence
  Synthetic
cggtcctttcgctcctaaacaggaggagagcaccggtaacgccactatcaagtaccgcttctactttaaatgggg

SEQ ID NO: 339986 - DNA, 75 bp, Artificial Sequence
  Synthetic
cggcactcagagaccgcccaggccccagcccacagatccttgccagcaaccaaggtgggagggacctaacttccc

SEQ ID NO: 339987 - DNA, 75 bp, Artificial Sequence
  Synthetic
tccgttcgatggccgagctcgcatcgataatccgtccgaccaagacccccggtcgtacttctggccgttcgacac

SEQ ID NO: 339988 - DNA, 75 bp, Artificial Sequence
  Synthetic
ccggcgcggctcacttaccgcctccgctgtcgaccgggttaagcgatctcttgatgctgttacagagccctcaga

SEQ ID NO: 339989 - DNA, 75 bp, Artificial Sequence
  Synthetic
aacccggctccgggagggcgaggagacgtacggtctgccgcccccggagaagcgggcccgatggggatttccgtc

SEQ ID NO: 339990 - DNA, 75 bp, Artificial Sequence
  Synthetic
catcctcccgacggagaaccccacggacgaggacgagcgatacctcgaggcggaggcggacaccagcagctccga

SEQ ID NO: 339991 - DNA, 75 bp, Artificial Sequence
  Synthetic
cgcgacggacggtgtgccggagacgcccttcgagctcctccaacacatccagcgggaccgcgacaagcggcgaga

SEQ ID NO: 339992 - DNA, 75 bp, Artificial Sequence
  Synthetic
gctccgaggcagactggcgagactcatcctccgcctccgacgacgacaggatcccgagctccaaaactactaccc

SEQ ID NO: 339993 - DNA, 75 bp, Artificial Sequence
  Synthetic
ttaaagcccgctaaacttacgttctggccggaggactgggacactaaaccggtcacccccggccgcatcacgggc

SEQ ID NO: 339994 - DNA, 75 bp, Artificial Sequence
  Synthetic
cccgagctcctcctagagctggaggtggcccgggcttttaaacggttccctcgcacccaccgccaagacgccccc

SEQ ID NO: 339995 - DNA, 75 bp, Artificial Sequence
  Synthetic
acctataagtggctcaacaagagccgtccctctcagcccatctcctacaaagtgtgcttcgatctgtatccaaat

SEQ ID NO: 339996 - DNA, 75 bp, Artificial Sequence
  Synthetic
aaaatctaactgtggccatcagtacgactctccgttggcctgggacgtttagtaaagtctgaccccccccttggg

SEQ ID NO: 339997 - DNA, 75 bp, Artificial Sequence
  Synthetic
gcgccccctagaggtcgcaccaccggcgagttctccctagggcgcccggcctgcggccggggggccggctcggca

SEQ ID NO: 339998 - DNA, 75 bp, Artificial Sequence
  Synthetic
tatataagtaagtacactgacgaatggctgagtttactgcgtcagccggactggtgacaggacgtgcgaacgaag

SEQ ID NO: 339999 - DNA, 75 bp, Artificial Sequence
  Synthetic
atgcgaccggctgacgggtgggcctgtctcgttccaggtctccatgccagactctgatactgtctccttaactga

SEQ ID NO: 340000 - DNA, 75 bp, Artificial Sequence
  Synthetic
ttctcattctctctctcagtctccaaatctacatcctgattttacttataagcgacaagaagctctctggaagca

SEQ ID NO: 340001 - DNA, 75 bp, Artificial Sequence
  Synthetic
agaggaagacaaatgtatcagagtcgtaggcgaagacggcggagatggggtcgccgtgtcctatcacattacaaa

SEQ ID NO: 340002 - DNA, 75 bp, Artificial Sequence
  Synthetic
agaaagtggagacgaggatctagaagaggttatggcctccatcgacgttggagacgatggaaacgacgacctaga

SEQ ID NO: 340003 - DNA, 75 bp, Artificial Sequence
  Synthetic
actgtggtaagtgaacagcgcagcaggcgggttaaaaccatcgttgtcagggggtgggaacccctgggtaatgta

SEQ ID NO: 340004 - DNA, 75 bp, Artificial Sequence
  Synthetic
tgtcccacggacagtgccagggccaaggcaacaccatatgaatcctatgactctgactctggacagggccaatgg

SEQ ID NO: 340005 - DNA, 75 bp, Artificial Sequence
  Synthetic
cacgggacctggggtcaccactggttcaccttccaatccctggtggacagggccgaagcacgtctcaactctttc

SEQ ID NO: 340006 - DNA, 75 bp, Artificial Sequence
  Synthetic
tcgggcaattgggagagctatgactacctgcgcttcctgggggggactatgtacctcatgcagcccagagaaatg

SEQ ID NO: 340007 - DNA, 75 bp, Artificial Sequence
  Synthetic
tgcttcatgttcggtaatgacccatacctcatgacctctgatctagacaaaacggcctcacaaaaaaacagagcg

SEQ ID NO: 340008 - DNA, 75 bp, Artificial Sequence
  Synthetic
gaagagacctggatcaccccagggtatctactccacaggccgggaacccacctgatcctcagcaggcagaaggtg

SEQ ID NO: 340009 - DNA, 75 bp, Artificial Sequence
  Synthetic
gagagaaggtccatgtataaaatccgggtcccagtaccaaccagttggagggggtggttcccgatacccgagtgt

SEQ ID NO: 340010 - DNA, 75 bp, Artificial Sequence
  Synthetic
ttcagctatgtactctgtcactggtactggacctggtgggaccctgacgcctgtttcttcgatccctgcgccaca

SEQ ID NO: 340011 - DNA, 75 bp, Artificial Sequence
  Synthetic
ggcagctcgtgtgaagcagaaccatggtggagcggagccaccttcaaacaggcctgggttgacagaaccaagctc

SEQ ID NO: 340012 - DNA, 75 bp, Artificial Sequence
  Synthetic
ggcctgggttgacagaaccaagctcgaggatccccccaccggggggatccccgcggggaacaaatgctgggcccc

SEQ ID NO: 340013 - DNA, 75 bp, Artificial Sequence
  Synthetic
attcctaccttccagaccctgcaccaactactatacccactccgcctctttttggttcaaatataaattgaaatt

SEQ ID NO: 340014 - DNA, 75 bp, Artificial Sequence
  Synthetic
tcaggtcaccggagaaaacatttgggcgccggtgccaagagactactcgcaacaaggaactgttcccaccgcccc

SEQ ID NO: 340015 - DNA, 75 bp, Artificial Sequence
  Synthetic
gggatcctcaaagacgaggcttatgaacgaattactagagataatccatgccctaagcggcccagacccctggga

SEQ ID NO: 340016 - DNA, 75 bp, Artificial Sequence
  Synthetic
ccctaacatggagggggggaggaccccccctagatacccccccccgaacatgggcatttacttttaaataaaccg

SEQ ID NO: 340017 - DNA, 75 bp, Artificial Sequence
  Synthetic
tctgtggtctgtggttttccgtagctcaccacaaacggacgtcgcctaggcgacaaccgcaacttctgctttgcg

SEQ ID NO: 340018 - DNA, 75 bp, Artificial Sequence
  Synthetic
tcaccacaaacggacgtcgcctaggcgacaaccgcaacttctgctttgcggttagtttcgcttttagggttagtg

SEQ ID NO: 340019 - DNA, 75 bp, Artificial Sequence
  Synthetic
ttggtttacggcaggggcgtggttacacgacactgctgtacacggcacgcctccggcgtgacgtgtcttcctggg

SEQ ID NO: 340020 - DNA, 75 bp, Artificial Sequence
  Synthetic
ggggcgtggttacacgacactgctgtacacggcacgcctccggcgtgacgtgtcttcctgggaggagacaggggg

SEQ ID NO: 340021 - DNA, 75 bp, Artificial Sequence
  Synthetic
tatataagtaagtacactgacgaatggctgagtttactgcgtcagccggactggtgacaaaacgtgcgaacggag

SEQ ID NO: 340022 - DNA, 75 bp, Artificial Sequence
  Synthetic
gtgagtagtcatggaactaggagcgcgggcgggtgccggaggcctagaggccggagtcaaggggcttatcgggcg

SEQ ID NO: 340023 - DNA, 75 bp, Artificial Sequence
  Synthetic
ccggagtcaaggggcttatcgggcgatgcgaccggctgacgggtgggcctgtctcgttctaggtctccatgcccg

SEQ ID NO: 340024 - DNA, 75 bp, Artificial Sequence
  Synthetic
atgcgaccggctgacgggtgggcctgtctcgttctaggtctccatgcccgactctgatacagtctctttaacgga

SEQ ID NO: 340025 - DNA, 75 bp, Artificial Sequence
  Synthetic
acttgtctccgcagaacaccgaaaattctgctcttgtggagactacacccaacatttcagatttcctagtcctgt

SEQ ID NO: 340026 - DNA, 75 bp, Artificial Sequence
  Synthetic
aacatttcagatttcctagtcctgtaaaagaggacgaatgtatcagagtcgtaggcgaagacggcggagatgggg

SEQ ID NO: 340027 - DNA, 75 bp, Artificial Sequence
  Synthetic
tcgccgtgtcctatcacgttacaaaagaaagtggggacgaagacatagacgaaattatggcttccctcggagatg

SEQ ID NO: 340028 - DNA, 75 bp, Artificial Sequence
  Synthetic
gagacgatggagacgacctcgaactgtggtaactgaacaacacagcaggcgggtcaaaaccatagtggtcagagg

SEQ ID NO: 340029 - DNA, 75 bp, Artificial Sequence
  Synthetic
gtgggagcccatgggcaatgtctgtcccacggactatgctaagaccaaggcgaccccatatgcgtcctatgactc

SEQ ID NO: 340030 - DNA, 75 bp, Artificial Sequence
  Synthetic
tgaccaggggaacggacaatggcatggcacctggggacaccactggttcacgttccagtccttggtcgacagagc

SEQ ID NO: 340031 - DNA, 75 bp, Artificial Sequence
  Synthetic
agaagccagactcaactccttctctggcaactgggaaagctttgattacctgcgatttctggggggcactatgta

SEQ ID NO: 340032 - DNA, 75 bp, Artificial Sequence
  Synthetic
catcatgcagcctcgtgagatgtgctttatgttcggtaatgatccatatctaatgaccgctgatctcgataagac

SEQ ID NO: 340033 - DNA, 75 bp, Artificial Sequence
  Synthetic
accatcccagaagaatcgggcggaggaaacatggatcacccctgggtacttgatgcataggcctggaacacatct

SEQ ID NO: 340034 - DNA, 75 bp, Artificial Sequence
  Synthetic
catactcagtgcacaaaaagtccacaggagaagcatgtacaaaataagggtgccagtacctaccagctggagggg

SEQ ID NO: 340035 - DNA, 75 bp, Artificial Sequence
  Synthetic
atggctccctatacctgaatgcttctcctatgtactctgtcactggtattggacgtggtgggatccggatgcctg

SEQ ID NO: 340036 - DNA, 75 bp, Artificial Sequence
  Synthetic
tttctttgatccctgtgccacaggcagctcgtgtgaggcggagccatggtggtctgcagcaaatatgaagcagag

SEQ ID NO: 340037 - DNA, 75 bp, Artificial Sequence
  Synthetic
ctgggtggatagatctcaactggagtcatcgggagtaatcaccacgggactcaaatcctgggcccccttcctgcc

SEQ ID NO: 340038 - DNA, 75 bp, Artificial Sequence
  Synthetic
caccagaccctgtgtcaactactatacccatagcgcgtccttctggttcaaatataaattgaaattccaggtcac

SEQ ID NO: 340039 - DNA, 75 bp, Artificial Sequence
  Synthetic
cggagaaaacatatgggcgccggtgcctagagactacagccaacaaggaactgttcccaccgccccggcccgtca

SEQ ID NO: 340040 - DNA, 75 bp, Artificial Sequence
  Synthetic
gcaagtggaacctaaaaccagaacccctcataagaagggactcagacccccaaccactgctgacatcctccccgg

SEQ ID NO: 340041 - DNA, 75 bp, Artificial Sequence
  Synthetic
ggatctcgacaaagatggcatcctccaagacgaggcttatgaacgaattactagagataatccatgccctaagcg

SEQ ID NO: 340042 - DNA, 75 bp, Artificial Sequence
  Synthetic
gcccaaacccgtgggagtccgatggtgggatggggtcccggggagaaccctccaagtgcagcagtcgtctgctct

SEQ ID NO: 340043 - DNA, 75 bp, Artificial Sequence
  Synthetic
tccaagtgcagcagtcgtctgctctacagcgaccccctcccagacgaaagctcctcagacgactccgagatgtcc

SEQ ID NO: 340044 - DNA, 75 bp, Artificial Sequence
  Synthetic
tacttcagctctagcgacagcacagacgcagacataactaaccctaacatggagggggggagtaccccccctaga

SEQ ID NO: 340045 - DNA, 75 bp, Artificial Sequence
  Synthetic
tacccccccccgaacatgggcatttacttttaaataaaccgtgcattcgaaaagaggaacttgtggcctgtggtc

SEQ ID NO: 340046 - DNA, 75 bp, Artificial Sequence
  Synthetic
ggggcgtggttacacgacactgctgtacacgacacgccttcgcgtgacgtgtcttcctgggaggagcacacgggg

SEQ ID NO: 340047 - DNA, 75 bp, Artificial Sequence
  Synthetic
ctggtgacaggacgtgcgaacgaaggtgagtagtcatggaactaggagcgcgggcgggtgtcggaggccttgagg

SEQ ID NO: 340048 - DNA, 75 bp, Artificial Sequence
  Synthetic
actctgatacagtctccttaacagactacaggagatctgaaagggtgtacgtatgcaagccagcaatatgtctgc

SEQ ID NO: 340049 - DNA, 75 bp, Artificial Sequence
  Synthetic
agcgacaagaagctctctggaagcaacttgtctccgcagaacacagaaaatcctgctcttggggagactacaccc

SEQ ID NO: 340050 - DNA, 75 bp, Artificial Sequence
  Synthetic
tcgccgtgtcctatcacatttcaaaagaaagtggggacgaagatctcgaagaagtcatggcttccatcgccgttg

SEQ ID NO: 340051 - DNA, 75 bp, Artificial Sequence
  Synthetic
gagacgatggagacgacgacctcgaactgtggtaactgaacaacacagtagaagggtcaaaaccataattgtcag

SEQ ID NO: 340052 - DNA, 75 bp, Artificial Sequence
  Synthetic
aggctacaccctatgcttcctatgactctgactctggacagggccaatggcacgggacctggggacaccactggt

SEQ ID NO: 340053 - DNA, 75 bp, Artificial Sequence
  Synthetic
cacgggacctggggacaccactggttcaccttccagtcattggtggacagagctgaagcacgcctcaactctttc

SEQ ID NO: 340054 - DNA, 75 bp, Artificial Sequence
  Synthetic
tcgggcaattgggagagctatgactacctgcgctttctggggggcactatgtacctcatgcagcccagagagatg

SEQ ID NO: 340055 - DNA, 75 bp, Artificial Sequence
  Synthetic
acctgcgctttctggggggcactatgtacctcatgcagcccagagagatgtgcttcatgttcggtaatgacccct

SEQ ID NO: 340056 - DNA, 75 bp, Artificial Sequence
  Synthetic
gtacctcatgcagcccagagagatgtgcttcatgttcggtaatgacccctatttaatgacctcagatctagacaa

SEQ ID NO: 340057 - DNA, 75 bp, Artificial Sequence
  Synthetic
aacagcctcgcaaaaaaacagagcagaagagacctggatcaccccaggatatctcatacacaggcctgggaccca

SEQ ID NO: 340058 - DNA, 75 bp, Artificial Sequence
  Synthetic
ccttatcctcagcagacagaaggtggagagacgatccatgtacaagatccgggtccctgtacccaccagctggcg

SEQ ID NO: 340059 - DNA, 75 bp, Artificial Sequence
  Synthetic
gggtccctgtacccaccagctggcgggggtggttccctataccggaatgcttcagctatgtcctctgtcattggt

SEQ ID NO: 340060 - DNA, 75 bp, Artificial Sequence
  Synthetic
attggacttggtgggaccctgacgcctgtttcttcgatccctgtgctacaggcagctcgtgtgaaacagagccat

SEQ ID NO: 340061 - DNA, 75 bp, Artificial Sequence
  Synthetic
ggtggagtactgcccagaccaaacaggcctgggtagaccgaaccaagctcgatgacccccccgtcggaggaatcg

SEQ ID NO: 340062 - DNA, 75 bp, Artificial Sequence
  Synthetic
ggcctgggtagaccgaaccaagctcgatgacccccccgtcggaggaatcggacccaaccaaaaaacctgggcccc

SEQ ID NO: 340063 - DNA, 75 bp, Artificial Sequence
  Synthetic
gatgacccccccgtcggaggaatcggacccaaccaaaaaacctgggccccattcctgccttccagaccctgcacc

SEQ ID NO: 340064 - DNA, 75 bp, Artificial Sequence
  Synthetic
ctcccgccagcaagtggaatctgaagccagaaccccttatcctaaaacaaacagacccccaaccactgctgacat

SEQ ID NO: 340065 - DNA, 75 bp, Artificial Sequence
  Synthetic
cgaagacagctcctcagacgactcagagatgtcctacttcagctctagcgacagcacagacgcagacataacata

SEQ ID NO: 340066 - DNA, 75 bp, Artificial Sequence
  Synthetic
cgacaaccgcaacttctgctttgcggttggtttcgcttttagggttagtgttgctttacggcaggggcgtggtta

SEQ ID NO: 340067 - DNA, 75 bp, Artificial Sequence
  Synthetic
ggggcgtggttacacgacactgctgtacacggcacgcctctcgcgtgacgtgtcttcctgggaggggacaggggg

SEQ ID NO: 340068 - DNA, 75 bp, Artificial Sequence
  Synthetic
ctataggagatctgaaagggtgtacgtatgcaaaccagcaatatgtctgcttctcattctctctctcagtctcca

SEQ ID NO: 340069 - DNA, 75 bp, Artificial Sequence
  Synthetic
gagacgatggagacgacctcgaactgtggtaactgaacaacacagtaggagggtcaaaaccatcattgtcagagg

SEQ ID NO: 340070 - DNA, 75 bp, Artificial Sequence
  Synthetic
gggtcaaaaccatcattgtcagagggtgggaacccctgggcaacatatgtcccacagacagtgccaaggccaagg

SEQ ID NO: 340071 - DNA, 75 bp, Artificial Sequence
  Synthetic
gggacctggggacaccactggttcaccttccagtcattggtggacagagcagaagcacggctcaactctttctcg

SEQ ID NO: 340072 - DNA, 75 bp, Artificial Sequence
  Synthetic
ttcatgttcggtaatgacccctacctagtgacctctgacctagacaaaacggcctcacaaaaaaacagagcagaa

SEQ ID NO: 340073 - DNA, 75 bp, Artificial Sequence
  Synthetic
gagacctggatcaccccaggatatctactgcacaggcctggaacccaccttatcctcagcagacagaaggtggag

SEQ ID NO: 340074 - DNA, 75 bp, Artificial Sequence
  Synthetic
agacggtccatgtacaagatccgggtcccagtacccaccagctggcgggggtggttccctatacccgagtgcttc

SEQ ID NO: 340075 - DNA, 75 bp, Artificial Sequence
  Synthetic
agctatgtcctctgtcattggtactgggcgtggtgggaccctgacgcctgtttcttcgatccctgtgctacaggc

SEQ ID NO: 340076 - DNA, 75 bp, Artificial Sequence
  Synthetic
gggcgtggtgggaccctgacgcctgtttcttcgatccctgtgctacaggcagctcgtgtgaagctgagccatggt

SEQ ID NO: 340077 - DNA, 75 bp, Artificial Sequence
  Synthetic
cctgccctccagaccctgcaccaactactatacccactctgcctccttctggttcaaatataaattaaaatttca

SEQ ID NO: 340078 - DNA, 75 bp, Artificial Sequence
  Synthetic
aaggaactgttcccaccgccccctcccgccagtccatggaatctaaagccagagcctctaatcctaaagcaaaca

SEQ ID NO: 340079 - DNA, 75 bp, Artificial Sequence
  Synthetic
atcctcaaagacgaggcttatgaacgaattactagagataatccaagccctaagcggccccgacccctgggaatc

SEQ ID NO: 340080 - DNA, 75 bp, Artificial Sequence
  Synthetic
agacagctcctcagacgactcagagatgtcctacttcagctctagcgatagcacagacgcagacataactaaccc

SEQ ID NO: 340081 - DNA, 75 bp, Artificial Sequence
  Synthetic
gcatttacttttaaataaaccgtggattcgaaaagaggaacttgtggtctgtggtctgtggttttccgtagctca

SEQ ID NO: 340082 - DNA, 75 bp, Artificial Sequence
  Synthetic
ccacaaacggacgtctcctaggcgacgaccgcaacttctcttttgcggttggtttcactttcagggttagtgttg

SEQ ID NO: 340083 - DNA, 75 bp, Artificial Sequence
  Synthetic
atgcgaccggctgacgggtgggcctgtctcgttgtaggtctccatgccagactctgataccgtctccttaacaga

SEQ ID NO: 340084 - DNA, 75 bp, Artificial Sequence
  Synthetic
actctgataccgtctccttaacagattataggagatctgaaagggtgttcgtatgcaagccagcaatatgtctgc

SEQ ID NO: 340085 - DNA, 75 bp, Artificial Sequence
  Synthetic
tcgccgtatcctatcacgttacaaaagaaagtggggacgaagatcccgaagaggtcatggcatctatcgccgttg

SEQ ID NO: 340086 - DNA, 75 bp, Artificial Sequence
  Synthetic
gagacgatggagacgacgacctcgaactgtggtaactgaacaacacagtaggagggtcaaaaccatcattgtcag

SEQ ID NO: 340087 - DNA, 75 bp, Artificial Sequence
  Synthetic
gtacttcatgcagcccagagagatgtgcttcatgttcggtaatgacccctacttaatgacctcagacctagacaa

SEQ ID NO: 340088 - DNA, 75 bp, Artificial Sequence
  Synthetic
atccgatggtgggatgggaccccagggagaaccctccaagagcaacagcaggctgctgtactcagacccaaaccc

SEQ ID NO: 340089 - DNA, 75 bp, Artificial Sequence
  Synthetic
ggagaaccctccaagagcaacagcaggctgctgtactcagacccaaaccccgaagacagctcctcagacgactca

SEQ ID NO: 340090 - DNA, 75 bp, Artificial Sequence
  Synthetic
tgaattcgaaaagaggaacttgtggtctgtggtctgtggttttccgtagctcaccacaaacggacgtcgccttgg

SEQ ID NO: 340091 - DNA, 75 bp, Artificial Sequence
  Synthetic
caacgaccgcaacttctgctttgcggtcggtttcacttttagggttagtgttggtttacggcaggggcgtggttt

SEQ ID NO: 340092 - DNA, 75 bp, Artificial Sequence
  Synthetic
gggcgtggtttcacgacactggcgtacacggcacgcctctcgcgtgacgtgttttcctgggagggacacaggggg

SEQ ID NO: 340093 - DNA, 75 bp, Artificial Sequence
  Synthetic
actctgataccgtctccttaacagactataggcgatctgaaagggtgtacgtttgtaaaccagcaatatgtctgc

SEQ ID NO: 340094 - DNA, 75 bp, Artificial Sequence
  Synthetic
aacatttcagatttcctagtcctgtaaaggaggacgaatgtatcagggtcgtaggcgaagaaggcggagatgggg

SEQ ID NO: 340095 - DNA, 75 bp, Artificial Sequence
  Synthetic
tcgccgtgtcctatcacattacaaaagaaagtggagacgaggatctcgaagaggtcatggcatctatcggcgttg

SEQ ID NO: 340096 - DNA, 75 bp, Artificial Sequence
  Synthetic
gagacgatggagacgacgacctcgaactgtggtaactgagcaacacagtaaaagggtcaagacaattatagtcag

SEQ ID NO: 340097 - DNA, 75 bp, Artificial Sequence
  Synthetic
ggggtgggaacccctgggcaatatatgtcccacagacagtgccaaggccaaggctacaccctatgcctcctatga

SEQ ID NO: 340098 - DNA, 75 bp, Artificial Sequence
  Synthetic
acctaatgacctctgacctagacaaaacggcctcacaaaaaaacagagcagaagaaacctggatcaccccaggat

SEQ ID NO: 340099 - DNA, 75 bp, Artificial Sequence
  Synthetic
atctcatacataggcctggaacccaccttatcctcagcagacaaaaggtggaaagacggtccatgtacaagatcc

SEQ ID NO: 340100 - DNA, 75 bp, Artificial Sequence
  Synthetic
accggacatggtgggaccctgacgcctgtttcttcgatccctgtgctacaggcagctcgtgtgaagcagagccat

SEQ ID NO: 340101 - DNA, 75 bp, Artificial Sequence
  Synthetic
ctgtttcttcgatccctgtgctacaggcagctcgtgtgaagcagagccatggtggagtactgctcacaccaaaca

SEQ ID NO: 340102 - DNA, 75 bp, Artificial Sequence
  Synthetic
attcctgccatccagaccctgcaccaactactatacccactccgcctctttctggttcaaatataaattgaaatt

SEQ ID NO: 340103 - DNA, 75 bp, Artificial Sequence
  Synthetic
aacaaggaactgttcccacagccccctcccgccagcaagtggaatctcaagccagagccgcttattctaaagcaa

SEQ ID NO: 340104 - DNA, 75 bp, Artificial Sequence
  Synthetic
acagacccccaaccactgctgacatcctccccggggatctcgacagtgatgggatcctcaaagacgaggcttatg

SEQ ID NO: 340105 - DNA, 75 bp, Artificial Sequence
  Synthetic
aacgaattactagaaataatccaagccctaagcggccccgacccgtgggaatccgatggagggatgggaccccag

SEQ ID NO: 340106 - DNA, 75 bp, Artificial Sequence
  Synthetic
ggctgctgtactcagacccagaccccgaagacagctcctcagacgactcagaaatgtcctacttcagctctagcg

SEQ ID NO: 340107 - DNA, 75 bp, Artificial Sequence
  Synthetic
acagcacagacgcagacataactaaccctaacatggagggggggaggaccccccctagataccccccccgaacat

SEQ ID NO: 340108 - DNA, 75 bp, Artificial Sequence
  Synthetic
gggcatttacttttaaataaaccgtgaattcgaaaagaggaacttgtggtctgtggtctgtggttttccgtagct

SEQ ID NO: 340109 - DNA, 75 bp, Artificial Sequence
  Synthetic
gggcgtggtttcacgacactgctgtacacggcacgcctccggcatgacgtgtcttcctgggaggagcagcggggg

SEQ ID NO: 340110 - DNA, 75 bp, Artificial Sequence
  Synthetic
aggtggagactcttaagctatataaccaagtggggtggcgaatggctgagtttaccccgctagacggtgcaggga

SEQ ID NO: 340111 - DNA, 75 bp, Artificial Sequence
  Synthetic
tttaccccgctagacggtgcagggaccggatcgagcgcagcgaggaggtccccggctgcccgtgggcgggagccc

SEQ ID NO: 340112 - DNA, 75 bp, Artificial Sequence
  Synthetic
gaggtgagtgaaaccaccgaggtctaggggcaattcgggctagggcagtctagcggaacgggcaagaaacttaaa

SEQ ID NO: 340113 - DNA, 75 bp, Artificial Sequence
  Synthetic
aatatttcttttacagatgcaaaacctatcagccaaagacttctacaaaccatgcagatacaactgtgaaactaa

SEQ ID NO: 340114 - DNA, 75 bp, Artificial Sequence
  Synthetic
aaaccaaatgtggatgtctggcattgctgactcccatgacagttggtgtgactgtgatactccttttgctcacct

SEQ ID NO: 340115 - DNA, 75 bp, Artificial Sequence
  Synthetic
cctggctagtatttttcctcctggtcacacagatcgcacacgaaccatccaagaaatacttaccagagattttag

SEQ ID NO: 340116 - DNA, 75 bp, Artificial Sequence
  Synthetic
gaaaacatgcctttctggtggggccgacgcaacaaattctggtatggccgaaactatagaagaaaaaagagaaga

SEQ ID NO: 340117 - DNA, 75 bp, Artificial Sequence
  Synthetic
tttccaaaaagaagaaaaagaagattttacagaagaacaaaatatagaagacctgctcgccgccgtcgcagacgc

SEQ ID NO: 340118 - DNA, 75 bp, Artificial Sequence
  Synthetic
agaaggaaggtaagaagaaaaaaaaaaactcttatagtaagacaatggcagccagactctattgtactctgtaaa

SEQ ID NO: 340119 - DNA, 75 bp, Artificial Sequence
  Synthetic
attaaagggtatgactctataatatggggagctgaaggcacacagtttcaatgttctacacatgaaatgtatgaa

SEQ ID NO: 340120 - DNA, 75 bp, Artificial Sequence
  Synthetic
tatacaagacaaaagtaccctgggggaggaggatttggtgtacaactttacagcttagagtatttgtatgaccaa

SEQ ID NO: 340121 - DNA, 75 bp, Artificial Sequence
  Synthetic
tggaaacttagaaataatatatggactaaaacaaatcaactcaaagatttgtgtagatacttaaaatgtgttatg

SEQ ID NO: 340122 - DNA, 75 bp, Artificial Sequence
  Synthetic
accttttacagacaccaacacatagattttgtaattgtatatgaaagacaacccccatttgaaatagataaacta

SEQ ID NO: 340123 - DNA, 75 bp, Artificial Sequence
  Synthetic
acatacatgaaatatcatccatatatgttattacaaagaaagcataaaataattttacctagtcaaacaactaat

SEQ ID NO: 340124 - DNA, 75 bp, Artificial Sequence
  Synthetic
cctagaggtaaattaaaaaaaaagaaaactattaaacctcccaaacaaatgctcagcaaatggttttttcaacaa

SEQ ID NO: 340125 - DNA, 75 bp, Artificial Sequence
  Synthetic
caatttgctaaatatgatctactacttattgctgcagcagcatgtagtttaagataccctagaataggctgctgc

SEQ ID NO: 340126 - DNA, 75 bp, Artificial Sequence
  Synthetic
aatgaaaatagaatgataaccttatactgtttaaatactaaattttatcaagatacagaatggggaactacaaaa

SEQ ID NO: 340127 - DNA, 75 bp, Artificial Sequence
  Synthetic
caggccccccactactttaaaccatatgcaacaattaataaatccatgatatttgtctctaactatggaggtaaa

SEQ ID NO: 340128 - DNA, 75 bp, Artificial Sequence
  Synthetic
aaaacagaatataacataggccaatggatagaaacagatatacctggagaaggtaatctagcaagatactacaga

SEQ ID NO: 340129 - DNA, 75 bp, Artificial Sequence
  Synthetic
tcaataagtaaagaaggaggttacttttcacctaaaatactgcaagcatatcaaacaaaagtaaagtctgtagac

SEQ ID NO: 340130 - DNA, 75 bp, Artificial Sequence
  Synthetic
tacaaacctttaccaattgttttaggtagatataacccagcaatagatgatggaaaaggcaacaaaatttactta

SEQ ID NO: 340131 - DNA, 75 bp, Artificial Sequence
  Synthetic
caaactataatgaatggccattggggcctacctcaaaaaacaccagattatataatagaagaggtccctctttgg

SEQ ID NO: 340132 - DNA, 75 bp, Artificial Sequence
  Synthetic
ctaggcttctggggatactataactacttaaaacaaacaagaactgaagctatatttccactacacatgtttgta

SEQ ID NO: 340133 - DNA, 75 bp, Artificial Sequence
  Synthetic
gtgcaaagcaaatacattcaaacacaacaaacagaaacacctaacaatttttgggcatttatagacaacagcttt

SEQ ID NO: 340134 - DNA, 75 bp, Artificial Sequence
  Synthetic
atacagggcaaaaacccatgggactcagttattacttactcagaacaaaagctatggtttcctacagttgcatgg

SEQ ID NO: 340135 - DNA, 75 bp, Artificial Sequence
  Synthetic
caactaaaaaccataaatgctatttgtgaaagtggaccatatgtacctaaactagacaatcaaacatatagtacc

SEQ ID NO: 340136 - DNA, 75 bp, Artificial Sequence
  Synthetic
tgggaactagcaactcattactcatttcactttaaatggggtggtccacagatatcagaccaaccagttgaagac

SEQ ID NO: 340137 - DNA, 75 bp, Artificial Sequence
  Synthetic
ccaggaaacaaaaacaaatatgatgtgcccgatacaatcaaagaagcattacaaattgttaacccagcaaaaaac

SEQ ID NO: 340138 - DNA, 75 bp, Artificial Sequence
  Synthetic
acaaattgttaacccagcaaaaaacattgctgccacgatgttccatgactgggactacagacggggttgcattac

SEQ ID NO: 340139 - DNA, 75 bp, Artificial Sequence
  Synthetic
atcaacagctattaaaagaatgcaacaaaacctcccaactgattcatctctcgaatctgattcagactcagaacc

SEQ ID NO: 340140 - DNA, 75 bp, Artificial Sequence
  Synthetic
agcacccaagaaaaaaagactactaccagtcctccacgacccacaaaagaaaacggaaaagatcaaccaatgtct

SEQ ID NO: 340141 - DNA, 75 bp, Artificial Sequence
  Synthetic
cctctctctctgcgaagaaagtacatgccaggagcaggaaacggaggaaaacatcctcaagctcatccagcagca

SEQ ID NO: 340142 - DNA, 75 bp, Artificial Sequence
  Synthetic
gcagcagcagcagcagaaactcaagcacaacctcttagtactaatcaaggacttaaaagtgaaacaaagattatt

SEQ ID NO: 340143 - DNA, 75 bp, Artificial Sequence
  Synthetic
acaactacaaacgggggtactagaataacccttaccagatttaaaccaggatttgagcaagaaactgaaaaagag

SEQ ID NO: 340144 - DNA, 75 bp, Artificial Sequence
  Synthetic
ttagcacaagcatttaacagaccccctagactgttcaaagaagataaacccttttacccctggctacccagattt

SEQ ID NO: 340145 - DNA, 75 bp, Artificial Sequence
  Synthetic
acaccccttgtaaactttcaccttaattttaaaggctaggcctacactgctcacttagtggtgtatgtttattaa

SEQ ID NO: 340146 - DNA, 75 bp, Artificial Sequence
  Synthetic
agtttgcaccccagaaaaattgtaaaataaaaaaaaaaaaaaaaaataaaaaattgcaaaaattcggcgctcgcg

SEQ ID NO: 340147 - DNA, 75 bp, Artificial Sequence
  Synthetic
aataaaaaaaaaaaaaaaaaataaaaaattgcaaaaattcggcgctcgcgcgcgctgcgcgcgcgagcgccgtca

SEQ ID NO: 340148 - DNA, 75 bp, Artificial Sequence
  Synthetic
gattggggtgcgcgcgtagcgcgcgcaccccaatgcgccccgccctcgttccgacccgcttgcgcgggtcggacc

SEQ ID NO: 340149 - DNA, 75 bp, Artificial Sequence
  Synthetic
caccccaatgcgccccgccctcgttccgacccgcttgcgcgggtcggaccacttcgggctcgggggggcgcgcct

SEQ ID NO: 340150 - DNA, 75 bp, Artificial Sequence
  Synthetic
ccgacccgcttgcgcgggtcggaccacttcgggctcgggggggcgcgcctgcggcgcttatttactaaacagact

SEQ ID NO: 340151 - DNA, 75 bp, Artificial Sequence
  Synthetic
ccgagtcgccattgggccccccctaagctccgcccccctcatgaatattcataaaggaaaccacaaaattagaat

SEQ ID NO: 340152 - DNA, 75 bp, Artificial Sequence
  Synthetic
agctccgcccccctcatgaatattcataaaggaaaccacaaaattagaattgccgaccacaaactgccatatgct

SEQ ID NO: 340153 - DNA, 75 bp, Artificial Sequence
  Synthetic
aattagttccccttttacacagtaaaaaggggaagtgggggggcagagcccccccacaccccccgcggggggggc

SEQ ID NO: 340154 - DNA, 75 bp, Artificial Sequence
  Synthetic
agagccccccccgcaccccccctacgtcacaggccacgcccccgccgccatcttgggtgcggcagggcggggact

SEQ ID NO: 340155 - DNA, 75 bp, Artificial Sequence
  Synthetic
cggggactaaaatggcgggacccaatcattttatactttcactttccaattaaaacccgccacgtcacacaaaag

SEQ ID NO: 340156 - DNA, 75 bp, Artificial Sequence
  Synthetic
gggctgtccttaaaaacctatataaccaactacagtgacgaatggctgagtttaccccgctagacggtgcaggga

SEQ ID NO: 340157 - DNA, 75 bp, Artificial Sequence
  Synthetic
ccggatcgagcgcagcgaggaggtccccggctgcccaagggcgggagcccgaggtgagtgaaaccaccgaggtct

SEQ ID NO: 340158 - DNA, 75 bp, Artificial Sequence
  Synthetic
aggggcaactcgggctagggcagtctagcggaatgggcaagaaacttaaaacaatttttcttttacagatgcaaa

SEQ ID NO: 340159 - DNA, 75 bp, Artificial Sequence
  Synthetic
acatctcctatacagacttctacaaaccaacaccatacaacacagacaccaaaaatcaaatatggctatctcagc

SEQ ID NO: 340160 - DNA, 75 bp, Artificial Sequence
  Synthetic
ttgctgacagtcatgacaattggtgtaattgtgatttcccttttgctcacctcctggctagtatttttcctcctg

SEQ ID NO: 340161 - DNA, 75 bp, Artificial Sequence
  Synthetic
gtcacaaagatcgcacacgaaccattaatcaaattctccaaagagattttcggcaaaaatgcctttctggtgggg

SEQ ID NO: 340162 - DNA, 75 bp, Artificial Sequence
  Synthetic
ccgacgcaaaagattctggcttggccggagaagatttagaaaaagatggccaaaaagacggaggaaaatacacag

SEQ ID NO: 340163 - DNA, 75 bp, Artificial Sequence
  Synthetic
aagaagatttaccaagagacgaggtagaagaactactcgccgccgtcgaaagcgccgcttcaaggtaagaagaaa

SEQ ID NO: 340164 - DNA, 75 bp, Artificial Sequence
  Synthetic
aaaacctaaaataccaatatatcaatggcaacctgactctattagaaaatgcaaaattaaaggagtggggactct

SEQ ID NO: 340165 - DNA, 75 bp, Artificial Sequence
  Synthetic
agttttaggagctcatggaaaacaatttgtatgctatacagatgtagagacaagagcaccaccacctaaagcacc

SEQ ID NO: 340166 - DNA, 75 bp, Artificial Sequence
  Synthetic
aggagggggaggttttggctgcaaacaatttagcctacaatacttatatgaagaatacagatttagaaacaatat

SEQ ID NO: 340167 - DNA, 75 bp, Artificial Sequence
  Synthetic
atggacacatacaaacataaatctagacctagttagataccttagagctgcctttactttctacagacacccaga

SEQ ID NO: 340168 - DNA, 75 bp, Artificial Sequence
  Synthetic
cattgactttattattaactatgatagacaaccacctttttatttagataaattcacatatccactatgtcaccc

SEQ ID NO: 340169 - DNA, 75 bp, Artificial Sequence
  Synthetic
acaaaacctactactaggaaaacataaaataattctactcagcaaagcttctaaaccaaatggtaaggttaaaaa

SEQ ID NO: 340170 - DNA, 75 bp, Artificial Sequence
  Synthetic
aagaataataattaaacctcctaaacaaatgataaccaaatggttttttcaagaacaatttacaacacaaccact

SEQ ID NO: 340171 - DNA, 75 bp, Artificial Sequence
  Synthetic
tctaagtcttagagcagctgcagcatcatttcaatacccacatataggttgttgtatgcctaacagagttgtaac

SEQ ID NO: 340172 - DNA, 75 bp, Artificial Sequence
  Synthetic
cttttcagcacttaatccaggattttaccaacaaggtaactggtcattagcccaacaagaaacacacccatactc

SEQ ID NO: 340173 - DNA, 75 bp, Artificial Sequence
  Synthetic
accttggccacaaatacccagaaggttaatattctgggatgttccagcatctgaaataccaacagacggacaaca

SEQ ID NO: 340174 - DNA, 75 bp, Artificial Sequence
  Synthetic
aagactagacttttctaaaaaacatgcctttattacagacatacacagctatagtgactcagtaagctataacaa

SEQ ID NO: 340175 - DNA, 75 bp, Artificial Sequence
  Synthetic
agggtactttacctccaaaattctaaaagctaaatttgtttccaaggacattagtgatacagcaggcataggtaa

SEQ ID NO: 340176 - DNA, 75 bp, Artificial Sequence
  Synthetic
cttacctctaaacttatgtagatacaatccagcaatagacacaggtaaaggtaatactatatggctacattcaaa

SEQ ID NO: 340177 - DNA, 75 bp, Artificial Sequence
  Synthetic
cctagtaaattcatactcaaaaccccaacatgatgaagacattattataactggaatgcctatttggatgctatt

SEQ ID NO: 340178 - DNA, 75 bp, Artificial Sequence
  Synthetic
atttggatggctaagctatgtccaacatgtaaaaaaaccacctgacttttatctgtctttcactgtgctaattga

SEQ ID NO: 340179 - DNA, 75 bp, Artificial Sequence
  Synthetic
aagccctgccatagaagtagctagtgcaagtgctacaccaacacctgtaatacctattgacacctcttttataaa

SEQ ID NO: 340180 - DNA, 75 bp, Artificial Sequence
  Synthetic
tggaaacccaccatacaaccaaacaataactattagagataaagctcactggtggccagatgtatacaaccaaac

SEQ ID NO: 340181 - DNA, 75 bp, Artificial Sequence
  Synthetic
agaagttttaaattcattagttactgcaggaccatatgtgccaaagctagacaatataagaaacagcacttggga

SEQ ID NO: 340182 - DNA, 75 bp, Artificial Sequence
  Synthetic
acttcattacttttataattttctctttaagtggggtggacccgaaagcacagatcaaccagttgcagacccctc

SEQ ID NO: 340183 - DNA, 75 bp, Artificial Sequence
  Synthetic
aaaacaacccatatatgatgccctcgataaacagcaacagacagtacaaattaggaacccagcaaaacaaaaata

SEQ ID NO: 340184 - DNA, 75 bp, Artificial Sequence
  Synthetic
tgcaactatcatgcatccctgggatgtcagacggggaattattacaaacaaagctcttaaaagaatgtatgaaaa

SEQ ID NO: 340185 - DNA, 75 bp, Artificial Sequence
  Synthetic
cctctcgattgattcaactttcgaagcagatagcattgcctcaaaaagaaaaagagttacaggcccttgctttac

SEQ ID NO: 340186 - DNA, 75 bp, Artificial Sequence
  Synthetic
agccctccaagaaatcaatcaagaggagagaacatgtctccaaacactctgcgaagaaaatatcttccaagaaac

SEQ ID NO: 340187 - DNA, 75 bp, Artificial Sequence
  Synthetic
gccacaggaagaaaacctacagcagctcatcctccagcaacagcagcaccagcaggacatcaagtacaacatcct

SEQ ID NO: 340188 - DNA, 75 bp, Artificial Sequence
  Synthetic
aaaattaatatcacaaatgaaagaacaacaaaacatgttgaaactacacacaggactattaaactaacaagattc

SEQ ID NO: 340189 - DNA, 75 bp, Artificial Sequence
  Synthetic
aaagatggatttgaaagagaaacagaaaaccaactagcaaatgcatttagtagacccccacgaatgtttaaagaa

SEQ ID NO: 340190 - DNA, 75 bp, Artificial Sequence
  Synthetic
gaccccccattttacccctggctacccaaacctgaaccccttgtaaactttcacctaaactttaaattctaggcc

SEQ ID NO: 340191 - DNA, 75 bp, Artificial Sequence
  Synthetic
tacaacactcacttagtggtgtatgtttatataagtttacaccccaaaaaaattgtaaaataaaaaaaaaaaaaa

SEQ ID NO: 340192 - DNA, 75 bp, Artificial Sequence
  Synthetic
aattgtaaaataaaaaaaaaaaaaaaaaaaataaaaaattgcaaaaattcggcgctcgcgcgcgctgcgcgcgcg

SEQ ID NO: 340193 - DNA, 75 bp, Artificial Sequence
  Synthetic
cgagcgccgtcacgcgccggcgctcgcgcgccgcgcgtatgtgctaacacaccacgcacctagattggggtgcgc

SEQ ID NO: 340194 - DNA, 75 bp, Artificial Sequence
  Synthetic
gggggcgcgcctgcggcgctactttactaaacagactccgagtcgccatttggcccccctaagctccgcccccct

SEQ ID NO: 340195 - DNA, 75 bp, Artificial Sequence
  Synthetic
catgaatattcataaaggaaaccacaaaatttgaattgccgaccacaaactgccatatgcaaattagttcccctt

SEQ ID NO: 340196 - DNA, 75 bp, Artificial Sequence
  Synthetic
ttacacagtaaaaaggggaagtgggggggcagagcccccccacaccccccgcggggggggcaaagccccccccgc

SEQ ID NO: 340197 - DNA, 75 bp, Artificial Sequence
  Synthetic
accccccctacgtcacagatcccgcccccgccgccatcttgggtgcggctgggcggggactaaaatggcgggacc

SEQ ID NO: 340198 - DNA, 75 bp, Artificial Sequence
  Synthetic
cggggactaaaatggcgggacccaataaatttatactttcactttccaattaacacccgccacgtcactaaaaag

SEQ ID NO: 340199 - DNA, 75 bp, Artificial Sequence
  Synthetic
gggtggagacttttaaactatataagtaagtagggtggtgaatggctgagtttaccccgctagacggtgcaggga

SEQ ID NO: 340200 - DNA, 75 bp, Artificial Sequence
  Synthetic
tttaccccgctagacggtgcagggaccggatcgagcgcagcgaggaggtccccggctgcccatgggcgggagccc

SEQ ID NO: 340201 - DNA, 75 bp, Artificial Sequence
  Synthetic
tatatttcttttacagatgaacaacctatcagctcaagacttctacaaaaaatgtacctacaactcagaaaccag

SEQ ID NO: 340202 - DNA, 75 bp, Artificial Sequence
  Synthetic
aaaccaaatgtggatgtcctgcattgctgactcccatgacagttggtgtaactgcgatactccttttgctcacct

SEQ ID NO: 340203 - DNA, 75 bp, Artificial Sequence
  Synthetic
cttggctagtatttttcctcctggtcacacagatcgcacacgaaccatccaagaaatacttaccagagactttag

SEQ ID NO: 340204 - DNA, 75 bp, Artificial Sequence
  Synthetic
gaaacaatgcctttctggtgggggcgacgcagaaaattctggtatggccgccaatatagaagaaaaagaaaacca

SEQ ID NO: 340205 - DNA, 75 bp, Artificial Sequence
  Synthetic
tatcaaagaagaaagaaaagaagaatttttagaagaccaaaatatagaagatctactcgccgccgtcgcagacgc

SEQ ID NO: 340206 - DNA, 75 bp, Artificial Sequence
  Synthetic
agaaggaaggtaagaagaaaaaaaaaaactcttattgttagacagtggcagcctgactctattgtactttgtaaa

SEQ ID NO: 340207 - DNA, 75 bp, Artificial Sequence
  Synthetic
attaaaggctatgactctatcatatggggagcagaaggtacacaatttcaatgttcaactcatgaaatgtatgaa

SEQ ID NO: 340208 - DNA, 75 bp, Artificial Sequence
  Synthetic
tataccagacagaaatacccaggaggagggggatttggagtacaattatatagcttagaatatttatatgatcaa

SEQ ID NO: 340209 - DNA, 75 bp, Artificial Sequence
  Synthetic
tggaaacttagaaataacatatggacaaaaacaaatgaatataaagacttatgtagataccttaaatgtgtaatg

SEQ ID NO: 340210 - DNA, 75 bp, Artificial Sequence
  Synthetic
acattttacagacaccaatacatagactttgtcattgtatatgaaagacaaccaccatttgagatagacaagtta

SEQ ID NO: 340211 - DNA, 75 bp, Artificial Sequence
  Synthetic
acatacatgaaataccacccatacatgctcctacaaagaaaacacaaaataatactacctagccaaactactaat

SEQ ID NO: 340212 - DNA, 75 bp, Artificial Sequence
  Synthetic
cctagaggtaaactaaaaaaaagaaaagtagttaagcctcctaaacaaatgttatctaaatggttttttcaacaa

SEQ ID NO: 340213 - DNA, 75 bp, Artificial Sequence
  Synthetic
cagtttgctaaatatgacttagtattaattgctgcagcagcatgcagccttagatatcctagaattggttgctgt

SEQ ID NO: 340214 - DNA, 75 bp, Artificial Sequence
  Synthetic
aatgaaaacagaatgataaccttgtactgccttaacaccaaattttatcaagatacagaatggggtgcaactaag

SEQ ID NO: 340215 - DNA, 75 bp, Artificial Sequence
  Synthetic
caataccctcattactttaaaccatatgcaaccattaataaaaatctagtatttgtatctaactatggaggtaaa

SEQ ID NO: 340216 - DNA, 75 bp, Artificial Sequence
  Synthetic
aaaacagaatataacataggtacctggattgaaacagaccaatctccagaaggtaacttagctagatattacaga

SEQ ID NO: 340217 - DNA, 75 bp, Artificial Sequence
  Synthetic
tcaatcagtaaagatggaggttatttctcacccaaaatactacaagcataccaaactaaagtcaacagtgttgac

SEQ ID NO: 340218 - DNA, 75 bp, Artificial Sequence
  Synthetic
tacaaaccactgccaattatattaggcagatataaccctgcaatagatgatggaaaaggaaacaaaatttattta

SEQ ID NO: 340219 - DNA, 75 bp, Artificial Sequence
  Synthetic
caaactataatgaatggccactggggcttacctcaaaaaacaccagactatattatagaagaggtacccctctgg

SEQ ID NO: 340220 - DNA, 75 bp, Artificial Sequence
  Synthetic
ttaggcttctggggatactataattaccttaaacaaacaagaacggaagccatttttcctttacatatgtttgtt

SEQ ID NO: 340221 - DNA, 75 bp, Artificial Sequence
  Synthetic
gtacaaagcaaatatatacagacacaacaaacagagacaccaaacaatttttgggcattcatagacaattcattt

SEQ ID NO: 340222 - DNA, 75 bp, Artificial Sequence
  Synthetic
atacaaggaaaaaacccatgggactctattattacctactctgaacaaaaactgtggttcccaacagttgcatgg

SEQ ID NO: 340223 - DNA, 75 bp, Artificial Sequence
  Synthetic
cagctaaaaactataaatgctatatgtgaaagtggaccctatgtaccaaagctagataaccaaacctacagcacc

SEQ ID NO: 340224 - DNA, 75 bp, Artificial Sequence
  Synthetic
tgggaattagccacacagtactcatttcattttaaatggggtggtccacagatatcagaccaaccagttgaagac

SEQ ID NO: 340225 - DNA, 75 bp, Artificial Sequence
  Synthetic
ccaggaaacaaaaacaaatatgatgtgcccgatacagtcaaagaagcattacaggttattaacccagcaaaaaac

SEQ ID NO: 340226 - DNA, 75 bp, Artificial Sequence
  Synthetic
acaggttattaacccagcaaaaaacattgctgccacaatgttccatgactgggactacagaaggggctgcattac

SEQ ID NO: 340227 - DNA, 75 bp, Artificial Sequence
  Synthetic
agctcccaaaaagaaaagactactgccagtcctccacgacccgcaaaagaaaacggagaaaatcaacaaatgtct

SEQ ID NO: 340228 - DNA, 75 bp, Artificial Sequence
  Synthetic
cctctctctctgcgaagaaagtacatgccaagagcaggaaacgccggaaaacatccagcagctcatcaagcagca

SEQ ID NO: 340229 - DNA, 75 bp, Artificial Sequence
  Synthetic
gcagcagcagcagcagaagctcaagcacaacctcttagtactaatcaaagacttaaaagtaaaacagagactact

SEQ ID NO: 340230 - DNA, 75 bp, Artificial Sequence
  Synthetic
acagctacaaacaggtgtactagaataactttaaccagatttaaacctggttttgaacaagacacagaaaaagag

SEQ ID NO: 340231 - DNA, 75 bp, Artificial Sequence
  Synthetic
ttagcacaagcatttaatagaccccctagactctttaaagaagacaaacccttttacccatggctacccagattc

SEQ ID NO: 340232 - DNA, 75 bp, Artificial Sequence
  Synthetic
accccccttgtaaactttcaccttaattttaaaggctaggcctacactgttcacttagcggtgtatgtttatata

SEQ ID NO: 340233 - DNA, 75 bp, Artificial Sequence
  Synthetic
agtttgcaccccaaaaaaattgtaaaaataaaaaaataaaaaaaaaataaaaaatcgcaaaaattcggcgctcgc

SEQ ID NO: 340234 - DNA, 75 bp, Artificial Sequence
  Synthetic
gcgcgctgcgcgcgcgcgagcgccgtcacgcgccggcgctcgcgcgccgcgcgtatgtgcttacactccacgcac

SEQ ID NO: 340235 - DNA, 75 bp, Artificial Sequence
  Synthetic
tcacgcgccggcgctcgcgcgccgcgcgtatgtgcttacactccacgcacctagattggggtgcgcgcgtagcgc

SEQ ID NO: 340236 - DNA, 75 bp, Artificial Sequence
  Synthetic
accacttcgggctcgggggggcgcgcctgcggcgcttatttactaaacagactccgagtcgccatttggcccccc

SEQ ID NO: 340237 - DNA, 75 bp, Artificial Sequence
  Synthetic
ctaagctccgcccccctcatgaatattcataaaggaaaccacaaaatttgaattgccaaccacaaactgccatat

SEQ ID NO: 340238 - DNA, 75 bp, Artificial Sequence
  Synthetic
ttcataaaggaaaccacaaaatttgaattgccaaccacaaactgccatatgctaattagttccccttttacacag

SEQ ID NO: 340239 - DNA, 75 bp, Artificial Sequence
  Synthetic
taaaaaggggaagtgggggggcagagcccccccacaccccccgcggggggggcaaagccccccccacaccccccc

SEQ ID NO: 340240 - DNA, 75 bp, Artificial Sequence
  Synthetic
tacgtcactaaccacgcccccgccgccatcttgggcgcggcagggcgggggctaaaatggcgggacccaatcaaa

SEQ ID NO: 340241 - DNA, 75 bp, Artificial Sequence
  Synthetic
cgggggctaaaatggcgggacccaatcaaatcatactttcactttccaattaaaacccgccacgtcacactaaag

SEQ ID NO: 340242 - DNA, 75 bp, Artificial Sequence
  Synthetic
taataaatattcataaaggaaaccgctaatttgaattgccgaccacaaactgacatatgcaaattaacttctgca

SEQ ID NO: 340243 - DNA, 75 bp, Artificial Sequence
  Synthetic
tgacatatgcaaattaacttctgcaatttaccttaacttcctcaaaaattaattaataatcatcgtcacagtggg

SEQ ID NO: 340244 - DNA, 75 bp, Artificial Sequence
  Synthetic
atttaccttaacttcctcaaaaattaattaataatcatcgtcacagtgggaggagactctacactatataatcaa

SEQ ID NO: 340245 - DNA, 75 bp, Artificial Sequence
  Synthetic
ctacacttccgaatggctgagtttatgccgccagacggagactggagcagttcactgattacaggctgaccaagg

SEQ ID NO: 340246 - DNA, 75 bp, Artificial Sequence
  Synthetic
gcgggtgccgaaggtgagtgaaaccaccgaagtcaaggggcaattcgggctaggtcagtctggcggaacgggcaa

SEQ ID NO: 340247 - DNA, 75 bp, Artificial Sequence
  Synthetic
gaaacttaaaataattttattttacagaatgtcaagatatattccaacaaaatcaacacttagacaaaaaaaact

SEQ ID NO: 340248 - DNA, 75 bp, Artificial Sequence
  Synthetic
agaatgtcaagatatattccaacaaaatcaacacttagacaaaaaaaactacaatggatgaatctaattgtgcac

SEQ ID NO: 340249 - DNA, 75 bp, Artificial Sequence
  Synthetic
ggccacgacatcttttgtgactgctgcaaaccacttgaatgcaccattggaaccataattaaccaagaaccaaac

SEQ ID NO: 340250 - DNA, 75 bp, Artificial Sequence
  Synthetic
ctaaaatttaacacagaagaaaaaaatctacttaaaaaatgcctttctacaaaagatggagacgctggcgctggc

SEQ ID NO: 340251 - DNA, 75 bp, Artificial Sequence
  Synthetic
gccgcagaccccgacggctttggagaaggagatttagacgccctctttacagaagattttggagaagaaaataca

SEQ ID NO: 340252 - DNA, 75 bp, Artificial Sequence
  Synthetic
gggtaagaaaaagaaaacttaaatacttacccttaagacaatggcaacctcattatattaacaaactaaaagtac

SEQ ID NO: 340253 - DNA, 75 bp, Artificial Sequence
  Synthetic
aaggatggtacccactagcaatatcaactaaagacagactatcaaataacttaaacttatatttagaaagcattg

SEQ ID NO: 340254 - DNA, 75 bp, Artificial Sequence
  Synthetic
aactaaagacagactatcaaataacttaaacttatatttagaaagcattgcgccgcattatttacatggtggggg

SEQ ID NO: 340255 - DNA, 75 bp, Artificial Sequence
  Synthetic
aggatttacaatatgtaacttttctttaatgactttatatcaagaaaaccttgtatgtagaaactggtggacaaa

SEQ ID NO: 340256 - DNA, 75 bp, Artificial Sequence
  Synthetic
aggaaatgaaaatatgcctttaattagatacctaggatgtgaaattaccttatatagacaagctgaagtagacta

SEQ ID NO: 340257 - DNA, 75 bp, Artificial Sequence
  Synthetic
catggtatatgtacataattcttatcctatgtcagctaatttattaacatatcaaagtacatgcccacaagttat

SEQ ID NO: 340258 - DNA, 75 bp, Artificial Sequence
  Synthetic
gcttatgaacaatagaacaaaaataatgccttgtaaaagatataatagaaacaaaaaaccttacaaaaaattctt

SEQ ID NO: 340259 - DNA, 75 bp, Artificial Sequence
  Synthetic
tgtaaaaccaccttctcaattacaaaacaaatggtactttcaaaaggaactatctaacgttccacttatgcaagt

SEQ ID NO: 340260 - DNA, 75 bp, Artificial Sequence
  Synthetic
tatggctacaacttgctcgttagaccgcatgtacctttcctcatcatcagtttcaaccacaatgggttttgtaag

SEQ ID NO: 340261 - DNA, 75 bp, Artificial Sequence
  Synthetic
cgcatgtacctttcctcatcatcagtttcaaccacaatgggttttgtaagcttagatactaacggtttcatggaa

SEQ ID NO: 340262 - DNA, 75 bp, Artificial Sequence
  Synthetic
agatatatgaaagacaatggaacagcaccatactccccattaacaggacaaataatttttgctgcaccaaacggt

SEQ ID NO: 340263 - DNA, 75 bp, Artificial Sequence
  Synthetic
gacaatgtaataacaaatatacccctaggacaatgcatattattaggaacagtaacagactatacaccaggaacc

SEQ ID NO: 340264 - DNA, 75 bp, Artificial Sequence
  Synthetic
caactttcatccataaccttaaatacgggtgcactcagtcccccttcagattggggaacctttaagtcagcatct

SEQ ID NO: 340265 - DNA, 75 bp, Artificial Sequence
  Synthetic
aaagcaatttataatgcatactatcaacacaaatattggggaaatccattttttacaaactggttccatggtgac

SEQ ID NO: 340266 - DNA, 75 bp, Artificial Sequence
  Synthetic
caaagaatgatagctacaggcaaaaccttaaaagaactttgtcaaatatacaaagatgacgatataaccacagct

SEQ ID NO: 340267 - DNA, 75 bp, Artificial Sequence
  Synthetic
ccttaaaagaactttgtcaaatatacaaagatgacgatataaccacagctaaactaaaagaaggctttatattta

SEQ ID NO: 340268 - DNA, 75 bp, Artificial Sequence
  Synthetic
aagaacaaaagtgggtagaactcagatacaacccatgggcagataaaggaaaaggtaatatggtatatttattac

SEQ ID NO: 340269 - DNA, 75 bp, Artificial Sequence
  Synthetic
aaaggtaatatggtatatttattacccattaatgaacatcaacactcttatggctgggcaccaccaacaaacaaa

SEQ ID NO: 340270 - DNA, 75 bp, Artificial Sequence
  Synthetic
gatataataacacaagatctacccctcaacatattactgtggggatacctagattttcacagaaaagcaaaaaca

SEQ ID NO: 340271 - DNA, 75 bp, Artificial Sequence
  Synthetic
tacaatgacatagacacaacatgtctactagtcataaaatctccttacctatatccaaaaggacaaattactttt

SEQ ID NO: 340272 - DNA, 75 bp, Artificial Sequence
  Synthetic
gctgttcctttagatcaagaatttctagatggtaactcaccatactttactgaaggtcacaaaacacaatcagac

SEQ ID NO: 340273 - DNA, 75 bp, Artificial Sequence
  Synthetic
caacaatattggcatccaaaagtaagatttcaaactagaaccgttaatgccatagcatgtacaggcccaggaaca

SEQ ID NO: 340274 - DNA, 75 bp, Artificial Sequence
  Synthetic
gatttcaaactagaaccgttaatgccatagcatgtacaggcccaggaacaacaaaattaccaccagatgttagta

SEQ ID NO: 340275 - DNA, 75 bp, Artificial Sequence
  Synthetic
ctgaatttcatatgaaatataaatttcgttttaagattggaggagaaccagcacccatgtctgtactcaaaaacc

SEQ ID NO: 340276 - DNA, 75 bp, Artificial Sequence
  Synthetic
cagatgaacaaccaacctataccatccccaataacctcctacaaacaacttcgttgcagagtccaacaacaccat

SEQ ID NO: 340277 - DNA, 75 bp, Artificial Sequence
  Synthetic
ttgaatacctcctctggaactttgacgaacgcagaggagagcttacaaaaagagctgcaaaaagaattactcaaa

SEQ ID NO: 340278 - DNA, 75 bp, Artificial Sequence
  Synthetic
agagctgcaaaaagaattactcaaaacatccaaactgaaacaaatgttttgccaattacagagtcagcagcctgg

SEQ ID NO: 340279 - DNA, 75 bp, Artificial Sequence
  Synthetic
acatccaaactgaaacaaatgttttgccaattacagagtcagcagcctggtgtccagcaacacaccgaaaaacac

SEQ ID NO: 340280 - DNA, 75 bp, Artificial Sequence
  Synthetic
aagacccatcggagacatcgacctcggaagaagacgaaacactcacgacggaggagaaactactccagcagcgaa

SEQ ID NO: 340281 - DNA, 75 bp, Artificial Sequence
  Synthetic
gagagcaaaaactcctccacaaactcatcagacgacagttactcagactaaccacatcagaataaagacattaaa

SEQ ID NO: 340282 - DNA, 75 bp, Artificial Sequence
  Synthetic
tgtttctatgtttgcagatactcccactccaaataggagaatgactacctgggaatatgagcaagagttagagga

SEQ ID NO: 340283 - DNA, 75 bp, Artificial Sequence
  Synthetic
actccaaataggagaatgactacctgggaatatgagcaagagttagaggatgctaaaatatggtgtagagtacct

SEQ ID NO: 340284 - DNA, 75 bp, Artificial Sequence
  Synthetic
gggaatatgagcaagagttagaggatgctaaaatatggtgtagagtacctagaacatatatacatgatcacccaa

SEQ ID NO: 340285 - DNA, 75 bp, Artificial Sequence
  Synthetic
cctatccctgggtcccagaagtacctaaatatactgtaaactttgacttaaacgcgccgcaataaactcaaggcc

SEQ ID NO: 340286 - DNA, 75 bp, Artificial Sequence
  Synthetic
tgcaaaatttcactctcggtgtccatttatataagtttaaaccttaataaacatccaccacactcccaaatacgc

SEQ ID NO: 340287 - DNA, 75 bp, Artificial Sequence
  Synthetic
ctcggtgtccatttatataagtttaaaccttaataaacatccaccacactcccaaatacgcaggcgcagaggggg

SEQ ID NO: 340288 - DNA, 75 bp, Artificial Sequence
  Synthetic
gggaaccaaataggtaaccacaaacggacagggaaaccgcaaaatttgcattgccgaccacaaacggatatttaa

SEQ ID NO: 340289 - DNA, 75 bp, Artificial Sequence
  Synthetic
attaagtttccttaaaaaccattaaattcacccctacttaattattaatcactgtcattttacacacatcctggg

SEQ ID NO: 340290 - DNA, 75 bp, Artificial Sequence
  Synthetic
tggttctacacaagtatatagctaagtacacttccgaatggctgagtttatgccgccagacgaaggaagcatcac

SEQ ID NO: 340291 - DNA, 75 bp, Artificial Sequence
  Synthetic
gtacacttccgaatggctgagtttatgccgccagacgaaggaagcatcactttagtgactgcagactgatcttgg

SEQ ID NO: 340292 - DNA, 75 bp, Artificial Sequence
  Synthetic
gcgggagccgaaggtgagtgaaaccaccgtagtctaggggcaattcgggctagatcagtctggcggaacgggcaa

SEQ ID NO: 340293 - DNA, 75 bp, Artificial Sequence
  Synthetic
gaaacttaaattaaacatatttttacagaatgtccctttggaaaccaacaaaatatggaccaaaacgcctagaac

SEQ ID NO: 340294 - DNA, 75 bp, Artificial Sequence
  Synthetic
ttcaatggctaaatggttgtattacctctcacgattatatttgcggctgtgacgaccccgccaaacattttctaa

SEQ ID NO: 340295 - DNA, 75 bp, Artificial Sequence
  Synthetic
aagttttagttgaaaaatcaggttttgatcagaaatgcctcacttttggagacgaccctggtaccggcgccgcta

SEQ ID NO: 340296 - DNA, 75 bp, Artificial Sequence
  Synthetic
caactacagacgacattggtatcgaccaaggagacttagaactgcttttcgcagaagaagacgccgatgggtaag

SEQ ID NO: 340297 - DNA, 75 bp, Artificial Sequence
  Synthetic
aaaaaaatcttattatactatacctaagactataagactaagacaatggaacccacggactacaagactgtgtaa

SEQ ID NO: 340298 - DNA, 75 bp, Artificial Sequence
  Synthetic
aattaaaggacatatacctttaataatatgcggacgagacagacaaatatttaactggatgcaatactatgactc

SEQ ID NO: 340299 - DNA, 75 bp, Artificial Sequence
  Synthetic
tataggacctgtagaacaatctggaggagggggatggagcagtattgtatttagcttaggggcactatatcaaca

SEQ ID NO: 340300 - DNA, 75 bp, Artificial Sequence
  Synthetic
atttaaaagactaatgaactggtggacgaaagacaatgacggactgccattagtacaatatagaggatgcaaatt

SEQ ID NO: 340301 - DNA, 75 bp, Artificial Sequence
  Synthetic
taaattctacaaaagctgggactgtgactatatagtgacagcacaaacttgcccaccaatgacagacacagaata

SEQ ID NO: 340302 - DNA, 75 bp, Artificial Sequence
  Synthetic
taaacacttagattcacacccctacagacaattaatgaacaaaagacctataatagtaccaaatctagtaagaaa

SEQ ID NO: 340303 - DNA, 75 bp, Artificial Sequence
  Synthetic
accatctaaaaaaacctacaaaataaagagattcccaccaccaagcttactacaaaacaaatggtactttcaaca

SEQ ID NO: 340304 - DNA, 75 bp, Artificial Sequence
  Synthetic
agacttttgtgctacaaacttactaatgttaacaacatcagcagctagctttgatcaattctggctacctaacga

SEQ ID NO: 340305 - DNA, 75 bp, Artificial Sequence
  Synthetic
tgaaattagccaagttattacatttcacagcttaaatactaaaatatttgcaaatgcaaactttcatgatccaga

SEQ ID NO: 340306 - DNA, 75 bp, Artificial Sequence
  Synthetic
acatacacatggctacagaccaaaatccacttactatttatggggtaccggtaacggtacaaccccaaaaccacc

SEQ ID NO: 340307 - DNA, 75 bp, Artificial Sequence
  Synthetic
gaaatatggggaactacattacttagggaacacaaacagatatcaaataggttcaacatggtcgggaaatttccc

SEQ ID NO: 340308 - DNA, 75 bp, Artificial Sequence
  Synthetic
accagatttaccacagcaaggaaaccccttttaccatgatcattcctccatagacacaaaaatatactacagcac

SEQ ID NO: 340309 - DNA, 75 bp, Artificial Sequence
  Synthetic
cacatcaccactaaatgcagacacacaaacaaatataacagaaagtgacccattgtttataacatgtagatacaa

SEQ ID NO: 340310 - DNA, 75 bp, Artificial Sequence
  Synthetic
cccattaaaagacacaggagaaggtaatcaagtcttttttaaatcaacatccataagtaaaaaccctatttatga

SEQ ID NO: 340311 - DNA, 75 bp, Artificial Sequence
  Synthetic
acctgaaaacaacccagatatacacatttcaggttttcccctctggcttatattttgggggtggacagaatggtt

SEQ ID NO: 340312 - DNA, 75 bp, Artificial Sequence
  Synthetic
agaaaaaaaaaaacctataaaccaaatatattttaactactacattgtagttgttacagactttattgaacctaa

SEQ ID NO: 340313 - DNA, 75 bp, Artificial Sequence
  Synthetic
attaccaggatatgtaatattagaccaagattttatatttccagatccaacaaaattaacagaaacagatttaaa

SEQ ID NO: 340314 - DNA, 75 bp, Artificial Sequence
  Synthetic
ctactggcacccccgatgggcatatcaaaaaaaaacagctaatttaataggaacatcaggaccagcaacacctaa

SEQ ID NO: 340315 - DNA, 75 bp, Artificial Sequence
  Synthetic
attaaacaaagctcatagcatacaagtaaatgcaatgtacactttttatttcaagttcggaggatgccctgctcc

SEQ ID NO: 340316 - DNA, 75 bp, Artificial Sequence
  Synthetic
aatgcaaaacattaaagacccctgcgaacaacccaaattccccgtgcccagtgaccagttacaaacaatacaagt

SEQ ID NO: 340317 - DNA, 75 bp, Artificial Sequence
  Synthetic
cattgatccagcaacagacaaacaatcaatgctccacgactttgacgaacgaagacatacacttacagaaacagc

SEQ ID NO: 340318 - DNA, 75 bp, Artificial Sequence
  Synthetic
tacgaaaagaattaaaaaggctaaagacagtaaaacacctatattcacagatctcctcaacccacgaatccaaga

SEQ ID NO: 340319 - DNA, 75 bp, Artificial Sequence
  Synthetic
ggaaacgacatcggaggactcgagcgaggaagaagcccacccatcacaaaacatcacccagcagctcctcaacat

SEQ ID NO: 340320 - DNA, 75 bp, Artificial Sequence
  Synthetic
cagacgaaggagactcaagctcctccgaaagctccaattaaaataacaccaataataacccaaaaccttcttttt

SEQ ID NO: 340321 - DNA, 75 bp, Artificial Sequence
  Synthetic
ccaaaaaaagaaaaactaacccgaattcacccatacaaaaatatgtttgagtacaatacagaaaaagaaataagc

SEQ ID NO: 340322 - DNA, 75 bp, Artificial Sequence
  Synthetic
aaatggctaatgagacctatgagacatttcttagaagacccccccatttatccctgggtacccccaacacccatt

SEQ ID NO: 340323 - DNA, 75 bp, Artificial Sequence
  Synthetic
gtacaatttaaccttaattacaaagaataaaggccaacaattttcactcaacaaggcagtttgtattattttaac

SEQ ID NO: 340324 - DNA, 75 bp, Artificial Sequence
  Synthetic
cttaataaaccgactccgcctcccaaaaacatcggcgtaggggggttcgacccctataaacccttgggggggaaa

SEQ ID NO: 340325 - DNA, 75 bp, Artificial Sequence
  Synthetic
cttaataaaccgactccgcctcccaaaaacatcggcgtaggggggttcgacccctataaacccttgggggggtaa

SEQ ID NO: 340326 - DNA, 75 bp, Artificial Sequence
  Synthetic
cttaataaaccgactccgcctcccaaaaacatcggcgtaggggggttcgacccctataaacccttgggggggcaa

SEQ ID NO: 340327 - DNA, 75 bp, Artificial Sequence
  Synthetic
cttaataaaccgactccgcctcccaaaaacatcggcgtaggggggttcgacccctataaacccttggggggggaa

SEQ ID NO: 340328 - DNA, 75 bp, Artificial Sequence
  Synthetic
cttaataaaccgactccgcctcccaaaaacatcggcgtaggggggttcgacccctataatcccttgggggggaaa

SEQ ID NO: 340329 - DNA, 75 bp, Artificial Sequence
  Synthetic
cttaataaaccgactccgcctcccaaaaacatcggcgtaggggggttcgacccctataatcccttgggggggtaa

SEQ ID NO: 340330 - DNA, 75 bp, Artificial Sequence
  Synthetic
cttaataaaccgactccgcctcccaaaaacatcggcgtaggggggttcgacccctataatcccttgggggggcaa

SEQ ID NO: 340331 - DNA, 75 bp, Artificial Sequence
  Synthetic
cttaataaaccgactccgcctcccaaaaacatcggcgtaggggggttcgacccctataatcccttggggggggaa

SEQ ID NO: 340332 - DNA, 75 bp, Artificial Sequence
  Synthetic
cttaataaaccgactccgcctcccaaaaacatcggcgtaggggggttcgacccctataaccccttgggggggaaa

SEQ ID NO: 340333 - DNA, 75 bp, Artificial Sequence
  Synthetic
cttaataaaccgactccgcctcccaaaaacatcggcgtaggggggttcgacccctataaccccttgggggggtaa

SEQ ID NO: 340334 - DNA, 75 bp, Artificial Sequence
  Synthetic
cttaataaaccgactccgcctcccaaaaacatcggcgtaggggggttcgacccctataaccccttgggggggcaa

SEQ ID NO: 340335 - DNA, 75 bp, Artificial Sequence
  Synthetic
cttaataaaccgactccgcctcccaaaaacatcggcgtaggggggttcgacccctataaccccttggggggggaa

SEQ ID NO: 340336 - DNA, 75 bp, Artificial Sequence
  Synthetic
cttaataaaccgactccgcctcccaaaaacatcggcgtaggggggttcgacccctataagcccttgggggggaaa

SEQ ID NO: 340337 - DNA, 75 bp, Artificial Sequence
  Synthetic
cttaataaaccgactccgcctcccaaaaacatcggcgtaggggggttcgacccctataagcccttgggggggtaa

SEQ ID NO: 340338 - DNA, 75 bp, Artificial Sequence
  Synthetic
cttaataaaccgactccgcctcccaaaaacatcggcgtaggggggttcgacccctataagcccttgggggggcaa

SEQ ID NO: 340339 - DNA, 75 bp, Artificial Sequence
  Synthetic
cttaataaaccgactccgcctcccaaaaacatcggcgtaggggggttcgacccctataagcccttggggggggaa

SEQ ID NO: 340340 - DNA, 75 bp, Artificial Sequence
  Synthetic
cttaataaaccgactccgcctcccaaaaacatcggcgtaggggggttcgtcccctataaacccttgggggggaaa

SEQ ID NO: 340341 - DNA, 75 bp, Artificial Sequence
  Synthetic
cttaataaaccgactccgcctcccaaaaacatcggcgtaggggggttcgtcccctataaacccttgggggggtaa

SEQ ID NO: 340342 - DNA, 75 bp, Artificial Sequence
  Synthetic
cttaataaaccgactccgcctcccaaaaacatcggcgtaggggggttcgtcccctataaacccttgggggggcaa

SEQ ID NO: 340343 - DNA, 75 bp, Artificial Sequence
  Synthetic
cttaataaaccgactccgcctcccaaaaacatcggcgtaggggggttcgtcccctataaacccttggggggggaa

SEQ ID NO: 340344 - DNA, 75 bp, Artificial Sequence
  Synthetic
cttaataaaccgactccgcctcccaaaaacatcggcgtaggggggttcgtcccctataatcccttgggggggaaa

SEQ ID NO: 340345 - DNA, 75 bp, Artificial Sequence
  Synthetic
cttaataaaccgactccgcctcccaaaaacatcggcgtaggggggttcgtcccctataatcccttgggggggtaa

SEQ ID NO: 340346 - DNA, 75 bp, Artificial Sequence
  Synthetic
cttaataaaccgactccgcctcccaaaaacatcggcgtaggggggttcgtcccctataatcccttgggggggcaa

SEQ ID NO: 340347 - DNA, 75 bp, Artificial Sequence
  Synthetic
cttaataaaccgactccgcctcccaaaaacatcggcgtaggggggttcgtcccctataatcccttggggggggaa

SEQ ID NO: 340348 - DNA, 75 bp, Artificial Sequence
  Synthetic
cttaataaaccgactccgcctcccaaaaacatcggcgtaggggggttcgtcccctataaccccttgggggggaaa

SEQ ID NO: 340349 - DNA, 75 bp, Artificial Sequence
  Synthetic
cttaataaaccgactccgcctcccaaaaacatcggcgtaggggggttcgtcccctataaccccttgggggggtaa

SEQ ID NO: 340350 - DNA, 75 bp, Artificial Sequence
  Synthetic
cttaataaaccgactccgcctcccaaaaacatcggcgtaggggggttcgtcccctataaccccttgggggggcaa

SEQ ID NO: 340351 - DNA, 75 bp, Artificial Sequence
  Synthetic
cttaataaaccgactccgcctcccaaaaacatcggcgtaggggggttcgtcccctataaccccttggggggggaa

SEQ ID NO: 340352 - DNA, 75 bp, Artificial Sequence
  Synthetic
cttaataaaccgactccgcctcccaaaaacatcggcgtaggggggttcgtcccctataagcccttgggggggaaa

SEQ ID NO: 340353 - DNA, 75 bp, Artificial Sequence
  Synthetic
cttaataaaccgactccgcctcccaaaaacatcggcgtaggggggttcgtcccctataagcccttgggggggtaa

SEQ ID NO: 340354 - DNA, 75 bp, Artificial Sequence
  Synthetic
cttaataaaccgactccgcctcccaaaaacatcggcgtaggggggttcgtcccctataagcccttgggggggcaa

SEQ ID NO: 340355 - DNA, 75 bp, Artificial Sequence
  Synthetic
cttaataaaccgactccgcctcccaaaaacatcggcgtaggggggttcgtcccctataagcccttggggggggaa

SEQ ID NO: 340356 - DNA, 75 bp, Artificial Sequence
  Synthetic
cttaataaaccgactccgcctcccaaaaacatcggcgtaggggggttcgccccctataaacccttgggggggaaa

SEQ ID NO: 340357 - DNA, 75 bp, Artificial Sequence
  Synthetic
cttaataaaccgactccgcctcccaaaaacatcggcgtaggggggttcgccccctataaacccttgggggggtaa

SEQ ID NO: 340358 - DNA, 75 bp, Artificial Sequence
  Synthetic
cttaataaaccgactccgcctcccaaaaacatcggcgtaggggggttcgccccctataaacccttgggggggcaa

SEQ ID NO: 340359 - DNA, 75 bp, Artificial Sequence
  Synthetic
cttaataaaccgactccgcctcccaaaaacatcggcgtaggggggttcgccccctataaacccttggggggggaa

SEQ ID NO: 340360 - DNA, 75 bp, Artificial Sequence
  Synthetic
cttaataaaccgactccgcctcccaaaaacatcggcgtaggggggttcgccccctataatcccttgggggggaaa

SEQ ID NO: 340361 - DNA, 75 bp, Artificial Sequence
  Synthetic
cttaataaaccgactccgcctcccaaaaacatcggcgtaggggggttcgccccctataatcccttgggggggtaa

SEQ ID NO: 340362 - DNA, 75 bp, Artificial Sequence
  Synthetic
cttaataaaccgactccgcctcccaaaaacatcggcgtaggggggttcgccccctataatcccttgggggggcaa

SEQ ID NO: 340363 - DNA, 75 bp, Artificial Sequence
  Synthetic
cttaataaaccgactccgcctcccaaaaacatcggcgtaggggggttcgccccctataatcccttggggggggaa

SEQ ID NO: 340364 - DNA, 75 bp, Artificial Sequence
  Synthetic
cttaataaaccgactccgcctcccaaaaacatcggcgtaggggggttcgccccctataaccccttgggggggaaa

SEQ ID NO: 340365 - DNA, 75 bp, Artificial Sequence
  Synthetic
cttaataaaccgactccgcctcccaaaaacatcggcgtaggggggttcgccccctataaccccttgggggggtaa

SEQ ID NO: 340366 - DNA, 75 bp, Artificial Sequence
  Synthetic
cttaataaaccgactccgcctcccaaaaacatcggcgtaggggggttcgccccctataaccccttgggggggcaa

SEQ ID NO: 340367 - DNA, 75 bp, Artificial Sequence
  Synthetic
cttaataaaccgactccgcctcccaaaaacatcggcgtaggggggttcgccccctataaccccttggggggggaa

SEQ ID NO: 340368 - DNA, 75 bp, Artificial Sequence
  Synthetic
cttaataaaccgactccgcctcccaaaaacatcggcgtaggggggttcgccccctataagcccttgggggggaaa

SEQ ID NO: 340369 - DNA, 75 bp, Artificial Sequence
  Synthetic
cttaataaaccgactccgcctcccaaaaacatcggcgtaggggggttcgccccctataagcccttgggggggtaa

SEQ ID NO: 340370 - DNA, 75 bp, Artificial Sequence
  Synthetic
cttaataaaccgactccgcctcccaaaaacatcggcgtaggggggttcgccccctataagcccttgggggggcaa

SEQ ID NO: 340371 - DNA, 75 bp, Artificial Sequence
  Synthetic
cttaataaaccgactccgcctcccaaaaacatcggcgtaggggggttcgccccctataagcccttggggggggaa

SEQ ID NO: 340372 - DNA, 75 bp, Artificial Sequence
  Synthetic
cttaataaaccgactccgcctcccaaaaacatcggcgtaggggggttcggcccctataaacccttgggggggaaa

SEQ ID NO: 340373 - DNA, 75 bp, Artificial Sequence
  Synthetic
cttaataaaccgactccgcctcccaaaaacatcggcgtaggggggttcggcccctataaacccttgggggggtaa

SEQ ID NO: 340374 - DNA, 75 bp, Artificial Sequence
  Synthetic
cttaataaaccgactccgcctcccaaaaacatcggcgtaggggggttcggcccctataaacccttgggggggcaa

SEQ ID NO: 340375 - DNA, 75 bp, Artificial Sequence
  Synthetic
cttaataaaccgactccgcctcccaaaaacatcggcgtaggggggttcggcccctataaacccttggggggggaa

SEQ ID NO: 340376 - DNA, 75 bp, Artificial Sequence
  Synthetic
cttaataaaccgactccgcctcccaaaaacatcggcgtaggggggttcggcccctataatcccttgggggggaaa

SEQ ID NO: 340377 - DNA, 75 bp, Artificial Sequence
  Synthetic
cttaataaaccgactccgcctcccaaaaacatcggcgtaggggggttcggcccctataatcccttgggggggtaa

SEQ ID NO: 340378 - DNA, 75 bp, Artificial Sequence
  Synthetic
cttaataaaccgactccgcctcccaaaaacatcggcgtaggggggttcggcccctataatcccttgggggggcaa

SEQ ID NO: 340379 - DNA, 75 bp, Artificial Sequence
  Synthetic
cttaataaaccgactccgcctcccaaaaacatcggcgtaggggggttcggcccctataatcccttggggggggaa

SEQ ID NO: 340380 - DNA, 75 bp, Artificial Sequence
  Synthetic
cttaataaaccgactccgcctcccaaaaacatcggcgtaggggggttcggcccctataaccccttgggggggaaa

SEQ ID NO: 340381 - DNA, 75 bp, Artificial Sequence
  Synthetic
cttaataaaccgactccgcctcccaaaaacatcggcgtaggggggttcggcccctataaccccttgggggggtaa

SEQ ID NO: 340382 - DNA, 75 bp, Artificial Sequence
  Synthetic
cttaataaaccgactccgcctcccaaaaacatcggcgtaggggggttcggcccctataaccccttgggggggcaa

SEQ ID NO: 340383 - DNA, 75 bp, Artificial Sequence
  Synthetic
cttaataaaccgactccgcctcccaaaaacatcggcgtaggggggttcggcccctataaccccttggggggggaa

SEQ ID NO: 340384 - DNA, 75 bp, Artificial Sequence
  Synthetic
cttaataaaccgactccgcctcccaaaaacatcggcgtaggggggttcggcccctataagcccttgggggggaaa

SEQ ID NO: 340385 - DNA, 75 bp, Artificial Sequence
  Synthetic
cttaataaaccgactccgcctcccaaaaacatcggcgtaggggggttcggcccctataagcccttgggggggtaa

SEQ ID NO: 340386 - DNA, 75 bp, Artificial Sequence
  Synthetic
cttaataaaccgactccgcctcccaaaaacatcggcgtaggggggttcggcccctataagcccttgggggggcaa

SEQ ID NO: 340387 - DNA, 75 bp, Artificial Sequence
  Synthetic
cttaataaaccgactccgcctcccaaaaacatcggcgtaggggggttcggcccctataagcccttggggggggaa

SEQ ID NO: 340388 - DNA, 75 bp, Artificial Sequence
  Synthetic
gggggttcgacccctaaaaacccttgggggggtaagcccccccaaaccccccggggggtttgccccctaaccccc

SEQ ID NO: 340389 - DNA, 75 bp, Artificial Sequence
  Synthetic
gggggttcgacccctaaaatcccttgggggggtaagcccccccaaaccccccggggggtttgccccctaaccccc

SEQ ID NO: 340390 - DNA, 75 bp, Artificial Sequence
  Synthetic
gggggttcgacccctaaaaccccttgggggggtaagcccccccaaaccccccggggggtttgccccctaaccccc

SEQ ID NO: 340391 - DNA, 75 bp, Artificial Sequence
  Synthetic
gggggttcgacccctaaaagcccttgggggggtaagcccccccaaaccccccggggggtttgccccctaaccccc

SEQ ID NO: 340392 - DNA, 75 bp, Artificial Sequence
  Synthetic
gggggttcgacccctataaacccttgggggggtaagcccccccaaaccccccggggggtttgccccctaaccccc

SEQ ID NO: 340393 - DNA, 75 bp, Artificial Sequence
  Synthetic
gggggttcgacccctataatcccttgggggggtaagcccccccaaaccccccggggggtttgccccctaaccccc

SEQ ID NO: 340394 - DNA, 75 bp, Artificial Sequence
  Synthetic
gggggttcgacccctataaccccttgggggggtaagcccccccaaaccccccggggggtttgccccctaaccccc

SEQ ID NO: 340395 - DNA, 75 bp, Artificial Sequence
  Synthetic
gggggttcgacccctataagcccttgggggggtaagcccccccaaaccccccggggggtttgccccctaaccccc

SEQ ID NO: 340396 - DNA, 75 bp, Artificial Sequence
  Synthetic
gggggttcgacccctacaaacccttgggggggtaagcccccccaaaccccccggggggtttgccccctaaccccc

SEQ ID NO: 340397 - DNA, 75 bp, Artificial Sequence
  Synthetic
gggggttcgacccctacaatcccttgggggggtaagcccccccaaaccccccggggggtttgccccctaaccccc

SEQ ID NO: 340398 - DNA, 75 bp, Artificial Sequence
  Synthetic
gggggttcgacccctacaaccccttgggggggtaagcccccccaaaccccccggggggtttgccccctaaccccc

SEQ ID NO: 340399 - DNA, 75 bp, Artificial Sequence
  Synthetic
gggggttcgacccctacaagcccttgggggggtaagcccccccaaaccccccggggggtttgccccctaaccccc

SEQ ID NO: 340400 - DNA, 75 bp, Artificial Sequence
  Synthetic
gggggttcgacccctagaaacccttgggggggtaagcccccccaaaccccccggggggtttgccccctaaccccc

SEQ ID NO: 340401 - DNA, 75 bp, Artificial Sequence
  Synthetic
gggggttcgacccctagaatcccttgggggggtaagcccccccaaaccccccggggggtttgccccctaaccccc

SEQ ID NO: 340402 - DNA, 75 bp, Artificial Sequence
  Synthetic
gggggttcgacccctagaaccccttgggggggtaagcccccccaaaccccccggggggtttgccccctaaccccc

SEQ ID NO: 340403 - DNA, 75 bp, Artificial Sequence
  Synthetic
gggggttcgacccctagaagcccttgggggggtaagcccccccaaaccccccggggggtttgccccctaaccccc

SEQ ID NO: 340404 - DNA, 75 bp, Artificial Sequence
  Synthetic
gggggttcgtcccctaaaaacccttgggggggtaagcccccccaaaccccccggggggtttgccccctaaccccc

SEQ ID NO: 340405 - DNA, 75 bp, Artificial Sequence
  Synthetic
gggggttcgtcccctaaaatcccttgggggggtaagcccccccaaaccccccggggggtttgccccctaaccccc

SEQ ID NO: 340406 - DNA, 75 bp, Artificial Sequence
  Synthetic
gggggttcgtcccctaaaaccccttgggggggtaagcccccccaaaccccccggggggtttgccccctaaccccc

SEQ ID NO: 340407 - DNA, 75 bp, Artificial Sequence
  Synthetic
gggggttcgtcccctaaaagcccttgggggggtaagcccccccaaaccccccggggggtttgccccctaaccccc

SEQ ID NO: 340408 - DNA, 75 bp, Artificial Sequence
  Synthetic
gggggttcgtcccctataaacccttgggggggtaagcccccccaaaccccccggggggtttgccccctaaccccc

SEQ ID NO: 340409 - DNA, 75 bp, Artificial Sequence
  Synthetic
gggggttcgtcccctataatcccttgggggggtaagcccccccaaaccccccggggggtttgccccctaaccccc

SEQ ID NO: 340410 - DNA, 75 bp, Artificial Sequence
  Synthetic
gggggttcgtcccctataaccccttgggggggtaagcccccccaaaccccccggggggtttgccccctaaccccc

SEQ ID NO: 340411 - DNA, 75 bp, Artificial Sequence
  Synthetic
gggggttcgtcccctataagcccttgggggggtaagcccccccaaaccccccggggggtttgccccctaaccccc

SEQ ID NO: 340412 - DNA, 75 bp, Artificial Sequence
  Synthetic
gggggttcgtcccctacaaacccttgggggggtaagcccccccaaaccccccggggggtttgccccctaaccccc

SEQ ID NO: 340413 - DNA, 75 bp, Artificial Sequence
  Synthetic
gggggttcgtcccctacaatcccttgggggggtaagcccccccaaaccccccggggggtttgccccctaaccccc

SEQ ID NO: 340414 - DNA, 75 bp, Artificial Sequence
  Synthetic
gggggttcgtcccctacaaccccttgggggggtaagcccccccaaaccccccggggggtttgccccctaaccccc

SEQ ID NO: 340415 - DNA, 75 bp, Artificial Sequence
  Synthetic
gggggttcgtcccctacaagcccttgggggggtaagcccccccaaaccccccggggggtttgccccctaaccccc

SEQ ID NO: 340416 - DNA, 75 bp, Artificial Sequence
  Synthetic
gggggttcgtcccctagaaacccttgggggggtaagcccccccaaaccccccggggggtttgccccctaaccccc

SEQ ID NO: 340417 - DNA, 75 bp, Artificial Sequence
  Synthetic
gggggttcgtcccctagaatcccttgggggggtaagcccccccaaaccccccggggggtttgccccctaaccccc

SEQ ID NO: 340418 - DNA, 75 bp, Artificial Sequence
  Synthetic
gggggttcgtcccctagaaccccttgggggggtaagcccccccaaaccccccggggggtttgccccctaaccccc

SEQ ID NO: 340419 - DNA, 75 bp, Artificial Sequence
  Synthetic
gggggttcgtcccctagaagcccttgggggggtaagcccccccaaaccccccggggggtttgccccctaaccccc

SEQ ID NO: 340420 - DNA, 75 bp, Artificial Sequence
  Synthetic
gggggttcgccccctaaaaacccttgggggggtaagcccccccaaaccccccggggggtttgccccctaaccccc

SEQ ID NO: 340421 - DNA, 75 bp, Artificial Sequence
  Synthetic
gggggttcgccccctaaaatcccttgggggggtaagcccccccaaaccccccggggggtttgccccctaaccccc

SEQ ID NO: 340422 - DNA, 75 bp, Artificial Sequence
  Synthetic
gggggttcgccccctaaaaccccttgggggggtaagcccccccaaaccccccggggggtttgccccctaaccccc

SEQ ID NO: 340423 - DNA, 75 bp, Artificial Sequence
  Synthetic
gggggttcgccccctaaaagcccttgggggggtaagcccccccaaaccccccggggggtttgccccctaaccccc

SEQ ID NO: 340424 - DNA, 75 bp, Artificial Sequence
  Synthetic
gggggttcgccccctataaacccttgggggggtaagcccccccaaaccccccggggggtttgccccctaaccccc

SEQ ID NO: 340425 - DNA, 75 bp, Artificial Sequence
  Synthetic
gggggttcgccccctataatcccttgggggggtaagcccccccaaaccccccggggggtttgccccctaaccccc

SEQ ID NO: 340426 - DNA, 75 bp, Artificial Sequence
  Synthetic
gggggttcgccccctataaccccttgggggggtaagcccccccaaaccccccggggggtttgccccctaaccccc

SEQ ID NO: 340427 - DNA, 75 bp, Artificial Sequence
  Synthetic
gggggttcgccccctataagcccttgggggggtaagcccccccaaaccccccggggggtttgccccctaaccccc

SEQ ID NO: 340428 - DNA, 75 bp, Artificial Sequence
  Synthetic
gggggttcgccccctacaaacccttgggggggtaagcccccccaaaccccccggggggtttgccccctaaccccc

SEQ ID NO: 340429 - DNA, 75 bp, Artificial Sequence
  Synthetic
gggggttcgccccctacaatcccttgggggggtaagcccccccaaaccccccggggggtttgccccctaaccccc

SEQ ID NO: 340430 - DNA, 75 bp, Artificial Sequence
  Synthetic
gggggttcgccccctacaaccccttgggggggtaagcccccccaaaccccccggggggtttgccccctaaccccc

SEQ ID NO: 340431 - DNA, 75 bp, Artificial Sequence
  Synthetic
gggggttcgccccctacaagcccttgggggggtaagcccccccaaaccccccggggggtttgccccctaaccccc

SEQ ID NO: 340432 - DNA, 75 bp, Artificial Sequence
  Synthetic
gggggttcgccccctagaaacccttgggggggtaagcccccccaaaccccccggggggtttgccccctaaccccc

SEQ ID NO: 340433 - DNA, 75 bp, Artificial Sequence
  Synthetic
gggggttcgccccctagaatcccttgggggggtaagcccccccaaaccccccggggggtttgccccctaaccccc

SEQ ID NO: 340434 - DNA, 75 bp, Artificial Sequence
  Synthetic
gggggttcgccccctagaaccccttgggggggtaagcccccccaaaccccccggggggtttgccccctaaccccc

SEQ ID NO: 340435 - DNA, 75 bp, Artificial Sequence
  Synthetic
gggggttcgccccctagaagcccttgggggggtaagcccccccaaaccccccggggggtttgccccctaaccccc

SEQ ID NO: 340436 - DNA, 75 bp, Artificial Sequence
  Synthetic
gggggttcggcccctaaaaacccttgggggggtaagcccccccaaaccccccggggggtttgccccctaaccccc

SEQ ID NO: 340437 - DNA, 75 bp, Artificial Sequence
  Synthetic
gggggttcggcccctaaaatcccttgggggggtaagcccccccaaaccccccggggggtttgccccctaaccccc

SEQ ID NO: 340438 - DNA, 75 bp, Artificial Sequence
  Synthetic
gggggttcggcccctaaaaccccttgggggggtaagcccccccaaaccccccggggggtttgccccctaaccccc

SEQ ID NO: 340439 - DNA, 75 bp, Artificial Sequence
  Synthetic
gggggttcggcccctaaaagcccttgggggggtaagcccccccaaaccccccggggggtttgccccctaaccccc

SEQ ID NO: 340440 - DNA, 75 bp, Artificial Sequence
  Synthetic
gggggttcggcccctataaacccttgggggggtaagcccccccaaaccccccggggggtttgccccctaaccccc

SEQ ID NO: 340441 - DNA, 75 bp, Artificial Sequence
  Synthetic
gggggttcggcccctataatcccttgggggggtaagcccccccaaaccccccggggggtttgccccctaaccccc

SEQ ID NO: 340442 - DNA, 75 bp, Artificial Sequence
  Synthetic
gggggttcggcccctataaccccttgggggggtaagcccccccaaaccccccggggggtttgccccctaaccccc

SEQ ID NO: 340443 - DNA, 75 bp, Artificial Sequence
  Synthetic
gggggttcggcccctataagcccttgggggggtaagcccccccaaaccccccggggggtttgccccctaaccccc

SEQ ID NO: 340444 - DNA, 75 bp, Artificial Sequence
  Synthetic
gggggttcggcccctacaaacccttgggggggtaagcccccccaaaccccccggggggtttgccccctaaccccc

SEQ ID NO: 340445 - DNA, 75 bp, Artificial Sequence
  Synthetic
gggggttcggcccctacaatcccttgggggggtaagcccccccaaaccccccggggggtttgccccctaaccccc

SEQ ID NO: 340446 - DNA, 75 bp, Artificial Sequence
  Synthetic
gggggttcggcccctacaaccccttgggggggtaagcccccccaaaccccccggggggtttgccccctaaccccc

SEQ ID NO: 340447 - DNA, 75 bp, Artificial Sequence
  Synthetic
gggggttcggcccctacaagcccttgggggggtaagcccccccaaaccccccggggggtttgccccctaaccccc

SEQ ID NO: 340448 - DNA, 75 bp, Artificial Sequence
  Synthetic
gggggttcggcccctagaaacccttgggggggtaagcccccccaaaccccccggggggtttgccccctaaccccc

SEQ ID NO: 340449 - DNA, 75 bp, Artificial Sequence
  Synthetic
gggggttcggcccctagaatcccttgggggggtaagcccccccaaaccccccggggggtttgccccctaaccccc

SEQ ID NO: 340450 - DNA, 75 bp, Artificial Sequence
  Synthetic
gggggttcggcccctagaaccccttgggggggtaagcccccccaaaccccccggggggtttgccccctaaccccc

SEQ ID NO: 340451 - DNA, 75 bp, Artificial Sequence
  Synthetic
gggggttcggcccctagaagcccttgggggggtaagcccccccaaaccccccggggggtttgccccctaaccccc

SEQ ID NO: 340452 - DNA, 75 bp, Artificial Sequence
  Synthetic
gaaatttaacaaaaaaaccacaaaatttgcattgccgaccacaaactgacaggaaaaccacaaaatttacattgc

SEQ ID NO: 340453 - DNA, 75 bp, Artificial Sequence
  Synthetic
gaaattttacaaaaaaaccacaaaatttgcattgccgaccacaaactgacaggaaaaccacaaaatttacattgc

SEQ ID NO: 340454 - DNA, 75 bp, Artificial Sequence
  Synthetic
gaaatttcacaaaaaaaccacaaaatttgcattgccgaccacaaactgacaggaaaaccacaaaatttacattgc

SEQ ID NO: 340455 - DNA, 75 bp, Artificial Sequence
  Synthetic
gaaatttgacaaaaaaaccacaaaatttgcattgccgaccacaaactgacaggaaaaccacaaaatttacattgc

SEQ ID NO: 340456 - DNA, 75 bp, Artificial Sequence
  Synthetic
caaccacaaactgacaggaaaaccacaatatttgcattgccgaccacaaactgtcacctacttctcctttttagc

SEQ ID NO: 340457 - DNA, 75 bp, Artificial Sequence
  Synthetic
tttacttccacttttactaataaatattcattacattaattattaatcaccgtaattccggggaggagttaacaa

SEQ ID NO: 340458 - DNA, 75 bp, Artificial Sequence
  Synthetic
actatataactaactacacttccgaatggctgagtttatgccgccagacgaagacaggatcacttcagtgactcc

SEQ ID NO: 340459 - DNA, 75 bp, Artificial Sequence
  Synthetic
atggctgagtttatgccgccagacgaagacaggatcacttcagtgactccaggctgaccaagggcgggtgccgaa

SEQ ID NO: 340460 - DNA, 75 bp, Artificial Sequence
  Synthetic
ggtgagtgaaaccaccgaagtcaaggggcaattcgggctaggtcagtctggcggaacgggcaagaaacttaaatt

SEQ ID NO: 340461 - DNA, 75 bp, Artificial Sequence
  Synthetic
attttatttttacagatgagcagacaatgtcctccaaaatacaacaacaaacaactccaacttcaacatgttaac

SEQ ID NO: 340462 - DNA, 75 bp, Artificial Sequence
  Synthetic
accctagtaagcattcatgatcttacctgcggctgtgaatctccactagaatgcaccattataaccatctataat

SEQ ID NO: 340463 - DNA, 75 bp, Artificial Sequence
  Synthetic
caagaaaaagaccttaaatttaccgaagaagaaaagaaaaaactacaaaaatggcttacttctacagaaaaagat

SEQ ID NO: 340464 - DNA, 75 bp, Artificial Sequence
  Synthetic
actaccccagaagaagaaggttttggagacggagacctagagcgccttttcgacgaagattttggagacgacgcc

SEQ ID NO: 340465 - DNA, 75 bp, Artificial Sequence
  Synthetic
gataccgctacaaggtaaagagaaaactttctactattaaactaaaacaatggcaaccaatatatttaagacatt

SEQ ID NO: 340466 - DNA, 75 bp, Artificial Sequence
  Synthetic
taaagataaaaggaatactgccactttttataactacagataaaagaatatctaatgactatactatgtacacca

SEQ ID NO: 340467 - DNA, 75 bp, Artificial Sequence
  Synthetic
acagcctagcacaacactacgtgcctggtggaggaggatttacaatttatagatttactttgaaagcattatatg

SEQ ID NO: 340468 - DNA, 75 bp, Artificial Sequence
  Synthetic
aactatttactaaaatacaaaacaaatggacacaatctaatgaagattggccttttataagatatacaggatgtg

SEQ ID NO: 340469 - DNA, 75 bp, Artificial Sequence
  Synthetic
aatttaaattttacaaatcagaaaaggcagactacataattaactaccatagatgtccacctatgctagcaacca

SEQ ID NO: 340470 - DNA, 75 bp, Artificial Sequence
  Synthetic
tagacacattccatagcacacaaccacacatgatgacattaaataaaaaacacaaaataataagatgcaaacaaa

SEQ ID NO: 340471 - DNA, 75 bp, Artificial Sequence
  Synthetic
acaatccatataaaagaccatacaaaagagtaaaaataaaaccaccagcattacttcaaaacaactggtattttc

SEQ ID NO: 340472 - DNA, 75 bp, Artificial Sequence
  Synthetic
aaaaagactttgcagcagaaccattacttctcttaatgacatcttcaatgagtttagacagatactatttaaatt

SEQ ID NO: 340473 - DNA, 75 bp, Artificial Sequence
  Synthetic
ccaaatctataagcacaacaatgggctttatttcattaaatgacaatatttttgactattacgattacaaactac

SEQ ID NO: 340474 - DNA, 75 bp, Artificial Sequence
  Synthetic
caccaacaacaggatacataccaaaacccaaaaaatacatgtggtccttatatcaaccattagcagatattcata

SEQ ID NO: 340475 - DNA, 75 bp, Artificial Sequence
  Synthetic
aaacacaaattaaagaattaatttacttaggaaaaagtaaagaaatggacaaaggaaaacctttaaaaaactttc

SEQ ID NO: 340476 - DNA, 75 bp, Artificial Sequence
  Synthetic
tacatggtgacccagatgaaacttggacaaattacttttctagcacacaaaactggggtaatatatttgacccat

SEQ ID NO: 340477 - DNA, 75 bp, Artificial Sequence
  Synthetic
actatttaactcaagaacatgtagtcctatattctgagaaatcaccaaatgaactaaaaacagaataccaaaaag

SEQ ID NO: 340478 - DNA, 75 bp, Artificial Sequence
  Synthetic
acaaacaaaaatggaaaacatttagtaacgaaattggtgaatacatacaagaaacaacccacacattactagtaa

SEQ ID NO: 340479 - DNA, 75 bp, Artificial Sequence
  Synthetic
actgtagatacaatccctatgctgatacaggaggaaacactgtatttatagtacctataacacaaccagaacaaa

SEQ ID NO: 340480 - DNA, 75 bp, Artificial Sequence
  Synthetic
caccacttcatataccacaagacgacaaatacaaaacagaaccatatcccctatggctaggaacatggggatttt

SEQ ID NO: 340481 - DNA, 75 bp, Artificial Sequence
  Synthetic
tagactatgagagaaaaagaataggccaaacaatagacacagactaccaaatagtaataaaatcaccacatatta

SEQ ID NO: 340482 - DNA, 75 bp, Artificial Sequence
  Synthetic
caccatcacaatatttttacattccaatagacgaaacatttacaacaggaagatcaccatacagaccaccagaca

SEQ ID NO: 340483 - DNA, 75 bp, Artificial Sequence
  Synthetic
cacaaccaacagtatatgatcaattacattggcatccaaaaataacaatgcaaatggacactataaactcaatag

SEQ ID NO: 340484 - DNA, 75 bp, Artificial Sequence
  Synthetic
cggcctgtggacctggaactattaaacttccaccacaagtatcagcagaagctcactgtacatatacttttcatt

SEQ ID NO: 340485 - DNA, 75 bp, Artificial Sequence
  Synthetic
ttaagcttggaagctgtgctccaccaatgcaaaacattgacaacccagaaaaacaagaaacttttgccaataaca

SEQ ID NO: 340486 - DNA, 75 bp, Artificial Sequence
  Synthetic
tcttccaaacaaattcgttgcagaatccagaatatcccctacaatactacttgtacaactttgacgaaagacgaa

SEQ ID NO: 340487 - DNA, 75 bp, Artificial Sequence
  Synthetic
aaatgcttacaaaaagagctgcaaaacgaatcaaaaaaattattgactctgaaaaatctttatcatcaactacag

SEQ ID NO: 340488 - DNA, 75 bp, Artificial Sequence
  Synthetic
gacaaagccaactggaaatcccactccagcaagaagccgaaacggacatctcatcggaggaggaagccgaaaaag

SEQ ID NO: 340489 - DNA, 75 bp, Artificial Sequence
  Synthetic
agacattactcctcctcctcagacagcaacgactcaagcaagccaagtacaagcagcgactcctccagctaatag

SEQ ID NO: 340490 - DNA, 75 bp, Artificial Sequence
  Synthetic
aacaattacaaactttagaataaaacaaactaaatttaccgtaaatttatttcctccagagactcctaaaaacag

SEQ ID NO: 340491 - DNA, 75 bp, Artificial Sequence
  Synthetic
gagaatgactgcaaaagaatttgcagaagaattagaggaatcaaaaatatggggtcatagaccacgtacttttat

SEQ ID NO: 340492 - DNA, 75 bp, Artificial Sequence
  Synthetic
tctagatactccttactatgactttttacctattaccccaaaaatacccaaaattaactttgacttgtgttacaa

SEQ ID NO: 340493 - DNA, 75 bp, Artificial Sequence
  Synthetic
agaataaaggcctgcaaatttcatatctcggtgtccatttatattagtttaaacttaaataaacatccaccacac

SEQ ID NO: 340494 - DNA, 75 bp, Artificial Sequence
  Synthetic
tccctaatacgcaggcgcacagggggatccgccccctgtaacccccagggggggcacagcccccccttaaacccc

SEQ ID NO: 340495 - DNA, 75 bp, Artificial Sequence
  Synthetic
tccctaatacgcaggcgcacagggggttccgccccctgtaacccccagggggggcacagcccccccttaaacccc

SEQ ID NO: 340496 - DNA, 75 bp, Artificial Sequence
  Synthetic
tccctaatacgcaggcgcacagggggctccgccccctgtaacccccagggggggcacagcccccccttaaacccc

SEQ ID NO: 340497 - DNA, 75 bp, Artificial Sequence
  Synthetic
tccctaatacgcaggcgcacaggggggtccgccccctgtaacccccagggggggcacagcccccccttaaacccc

SEQ ID NO: 340498 - DNA, 75 bp, Artificial Sequence
  Synthetic
cctaatacgcaggcgcacagggggatccgccccctgtaacccccagggggggcacagcccccccttaaacccccc

SEQ ID NO: 340499 - DNA, 75 bp, Artificial Sequence
  Synthetic
cctaatacgcaggcgcacagggggttccgccccctgtaacccccagggggggcacagcccccccttaaacccccc

SEQ ID NO: 340500 - DNA, 75 bp, Artificial Sequence
  Synthetic
cctaatacgcaggcgcacagggggctccgccccctgtaacccccagggggggcacagcccccccttaaacccccc

SEQ ID NO: 340501 - DNA, 75 bp, Artificial Sequence
  Synthetic
cctaatacgcaggcgcacaggggggtccgccccctgtaacccccagggggggcacagcccccccttaaacccccc

SEQ ID NO: 340502 - DNA, 75 bp, Artificial Sequence
  Synthetic
atttaccttaacttcctcaaaaattaattaataatcatcgtcacagtgggaggagactccacactatataataaa

SEQ ID NO: 340503 - DNA, 75 bp, Artificial Sequence
  Synthetic
gaaacttaaaataatgttattttacagaatgtcaagatatattccatcaaaatcaacacttagacaaaaaaaact

SEQ ID NO: 340504 - DNA, 75 bp, Artificial Sequence
  Synthetic
agaatgtcaagatatattccatcaaaatcaacacttagacaaaaaaaactacaatggatgaatttaattgttcac

SEQ ID NO: 340505 - DNA, 75 bp, Artificial Sequence
  Synthetic
gaagaactaataacaaatatacccctaggacaatgcatattattaggaacagtaacagactatacaacaggaacc

SEQ ID NO: 340506 - DNA, 75 bp, Artificial Sequence
  Synthetic
caactttcatccataaacttacatacaggtgcactcactcccccttcaacttggggaacctataaaacagcatct

SEQ ID NO: 340507 - DNA, 75 bp, Artificial Sequence
  Synthetic
acagcaatttataatgcatactatcaacacaaatattggggaaatcccttttttacaaattggttccatggtgac

SEQ ID NO: 340508 - DNA, 75 bp, Artificial Sequence
  Synthetic
caaagaatggtagctacaggcaaaaccttaaaagaactttgtgacctatacaaaaatgacgacttaaacacagct

SEQ ID NO: 340509 - DNA, 75 bp, Artificial Sequence
  Synthetic
ccttaaaagaactttgtgacctatacaaaaatgacgacttaaacacagctaaactaaacaaaggctttatattta

SEQ ID NO: 340510 - DNA, 75 bp, Artificial Sequence
  Synthetic
gatgttataacacaagacctacccctcaacatattactatggggatacctagattttcacagaaaagcaaaaaca

SEQ ID NO: 340511 - DNA, 75 bp, Artificial Sequence
  Synthetic
tacaatgacatagacacaacatgtatactagtcatcaaatctccttacctacatccaaaaggacaaattactttt

SEQ ID NO: 340512 - DNA, 75 bp, Artificial Sequence
  Synthetic
acatccaaactgaaacaaatgttttgccaattacagaatcagcagcctggtgtccaacaacatacagaaaaacac

SEQ ID NO: 340513 - DNA, 75 bp, Artificial Sequence
  Synthetic
gggaatatgagcaagagttagaagatgctaaaatatggtgtagagtacctagatcatatatacatgatcgcccaa

SEQ ID NO: 340514 - DNA, 75 bp, Artificial Sequence
  Synthetic
taattaatattcaacaggaaaaccacctaattagaattgccgaccacaaaccgtcaaacacttccccttttttac

SEQ ID NO: 340515 - DNA, 75 bp, Artificial Sequence
  Synthetic
actacttcctcaaatactcattagttattaaacaattcattagtaatcaccgtagttcctgggaggagtttagaa

SEQ ID NO: 340516 - DNA, 75 bp, Artificial Sequence
  Synthetic
actatataactaacagcacagacgaatggctgagtttatgccgccagacggagacgggaacacgacagtgaccac

SEQ ID NO: 340517 - DNA, 75 bp, Artificial Sequence
  Synthetic
cggctgatcttgggcgggagccgaaggtgagtgaaaccaccggagtctaggggcaattcgggctagatcagtctg

SEQ ID NO: 340518 - DNA, 75 bp, Artificial Sequence
  Synthetic
gaggaacgggcaagaaacttaaaataaccttattttacagatgcacaaattaacaagagcacagcaaattaaatt

SEQ ID NO: 340519 - DNA, 75 bp, Artificial Sequence
  Synthetic
tacaaactgcactgttggaatacacgactgcctatgtgactgcgacaaaccagcactccacgccgctacaattct

SEQ ID NO: 340520 - DNA, 75 bp, Artificial Sequence
  Synthetic
tctaaaacaactgggacccgaactacttcaagaagaaaaagaccaccttaaaagatgccttggtacaactactgg

SEQ ID NO: 340521 - DNA, 75 bp, Artificial Sequence
  Synthetic
ccccgtagaagaagactgcggcgttactggagaagacctagaaaaactcttcgcagaagatactggagaagacca

SEQ ID NO: 340522 - DNA, 75 bp, Artificial Sequence
  Synthetic
agatgggtaagaagaccatataaaagaaaacttagaaaaatagtactaactcaatttcaaccaaaaactataaga

SEQ ID NO: 340523 - DNA, 75 bp, Artificial Sequence
  Synthetic
aagagtaaaattaaaggacctatatgcttatttcagactactaacaaaagacttgtaaacaattttgatatgtat

SEQ ID NO: 340524 - DNA, 75 bp, Artificial Sequence
  Synthetic
gaaactagcgaagtaccggagcatcaaccagggggaggaggatggggaattaaagtttttaccttagaaggactt

SEQ ID NO: 340525 - DNA, 75 bp, Artificial Sequence
  Synthetic
tattcagaacatatctatggtagaaatatctggactgtaacaaaccaggacttaccattagttagatacttagga

SEQ ID NO: 340526 - DNA, 75 bp, Artificial Sequence
  Synthetic
tgctcaataagattttatcagagtgaatacacagactacgtagcaacatactcaaaccaactaccattacagagc

SEQ ID NO: 340527 - DNA, 75 bp, Artificial Sequence
  Synthetic
tcactaggcatgtataatgctatgcaaccaaacatacacttactattaaaaaacaaaataacaatgccaggactt

SEQ ID NO: 340528 - DNA, 75 bp, Artificial Sequence
  Synthetic
aaaacatacaaaagaaaagtaccatataaaaaagtattcgtgccaccaccaacacaactagaaaacaaatggtac

SEQ ID NO: 340529 - DNA, 75 bp, Artificial Sequence
  Synthetic
ttccaacaaaacatggcaaaaacaccactattaatgacaagagtaacagcctgcagcttaaacaaattttacata

SEQ ID NO: 340530 - DNA, 75 bp, Artificial Sequence
  Synthetic
gatccagaccacataaatacaaatttaacaatcacaagcttaaatgtatccttattttcaaacagacaatttcaa

SEQ ID NO: 340531 - DNA, 75 bp, Artificial Sequence
  Synthetic
gacgcaacagactatcacccaaaaacagtaggaacaattaactactacttatactcaacaacacaaaacccacca

SEQ ID NO: 340532 - DNA, 75 bp, Artificial Sequence
  Synthetic
tacaatgggcctttaaaattaaaaatgctaatcccactaacagacaccatgatatacaaaccaggaataaactat

SEQ ID NO: 340533 - DNA, 75 bp, Artificial Sequence
  Synthetic
gaggaatataaaagaaacaacacaacaaaatcatggactgactggaaaacagaatacactatatatgcaggaaac

SEQ ID NO: 340534 - DNA, 75 bp, Artificial Sequence
  Synthetic
ccattccatacaaattacttatcagtaggagaaccagtatttttaataggaaaaaaaccttctgacttattttcc

SEQ ID NO: 340535 - DNA, 75 bp, Artificial Sequence
  Synthetic
tcagaagaaggagaaactagtgactatactacagcagaactaacaaaaactataagatacaatccatataatgac

SEQ ID NO: 340536 - DNA, 75 bp, Artificial Sequence
  Synthetic
caaggacaaacaaatatatgctactttaaagcaaattttaaatcagaaacctcctggcaaccaccagataaccca

SEQ ID NO: 340537 - DNA, 75 bp, Artificial Sequence
  Synthetic
gacctaacaaatgaaaatcttccgttttggctactactttggggattttcagactggcataaaaaaattaaaaaa

SEQ ID NO: 340538 - DNA, 75 bp, Artificial Sequence
  Synthetic
cacctacatatagacagcagctacattttagtaatgagacacattccactagcattaaacacagaatacatagta

SEQ ID NO: 340539 - DNA, 75 bp, Artificial Sequence
  Synthetic
ccactaagtgacagctttttacaaggaaaaagcccattttcaccagaagaacaaccaataggggcagatagaact

SEQ ID NO: 340540 - DNA, 75 bp, Artificial Sequence
  Synthetic
acatggcatccacaattccaacaccaagcagaggccataaacacaatatgttcagcaggcccaggaacaacaaaa

SEQ ID NO: 340541 - DNA, 75 bp, Artificial Sequence
  Synthetic
attccagacaactactcagtacaagggctaatgaagtactctttttactttaagtggggtggaagccctcctcca

SEQ ID NO: 340542 - DNA, 75 bp, Artificial Sequence
  Synthetic
atgtctaccattgaagaccccatacaacaaccaacatatcctgtaccccataatttcaacctcacaacttcgtta

SEQ ID NO: 340543 - DNA, 75 bp, Artificial Sequence
  Synthetic
cagaatccagaaacagatccagccagcatactgtggagctttgaccaaagacgacactctcttacaaaaaaagct

SEQ ID NO: 340544 - DNA, 75 bp, Artificial Sequence
  Synthetic
attgagcgcctccaaaaagacacaggaattaaaacaattactgttacaggtggaagccacttcgacccagcaccg

SEQ ID NO: 340545 - DNA, 75 bp, Artificial Sequence
  Synthetic
acaatctcacaagaagagacatcggaggagagttccgaggaagaaaaagaaacatcactactcgagaagctccag

SEQ ID NO: 340546 - DNA, 75 bp, Artificial Sequence
  Synthetic
cagcagcagcgtcagcagcgcagactcaagctccgaataatgaaaaccctactcaaaatacaacaattagaataa

SEQ ID NO: 340547 - DNA, 75 bp, Artificial Sequence
  Synthetic
aaaaatgcacctttaaagttaaactatttgaagatcctcaacctaaaaataggaggttaaatgcatgggaattac

SEQ ID NO: 340548 - DNA, 75 bp, Artificial Sequence
  Synthetic
aagaagaaaaagaaatagcaggtatttttaaaagaccaatgagatactttttacatgacaaaccattttaccctt

SEQ ID NO: 340549 - DNA, 75 bp, Artificial Sequence
  Synthetic
actgtgtaccagaacctgttgtaaattttgacttaaactataaacaataaagaaataaagggctaggccccatta

SEQ ID NO: 340550 - DNA, 75 bp, Artificial Sequence
  Synthetic
attcaaactcggtgtctgttcctttaagtctcaacttatttaaacatccaccacctcccaaaaatttgggcgcca

SEQ ID NO: 340551 - DNA, 75 bp, Artificial Sequence
  Synthetic
aaagggggctccgcccccttaaacccccagggggctccgccccctaaaacccccagggggctccgccccctacaa

SEQ ID NO: 340552 - DNA, 75 bp, Artificial Sequence
  Synthetic
gggctccgcccccttaaacccccagggggctccgccccctaaaacccccagggggctccgccccctacaaccccc

SEQ ID NO: 340553 - DNA, 75 bp, Artificial Sequence
  Synthetic
taattaacatattcaacaggaaaaccacctaattagaattgccgaccacaaactgccaaatacttcccctttttt

SEQ ID NO: 340554 - DNA, 75 bp, Artificial Sequence
  Synthetic
ccatacttcctgttttactcataaatattcattaaattaattaataatcaccatcatttccagggagtgtcctct

SEQ ID NO: 340555 - DNA, 75 bp, Artificial Sequence
  Synthetic
tattcattaaattaattaataatcaccatcatttccagggagtgtcctctctgctatatattcaatgacaggtcc

SEQ ID NO: 340556 - DNA, 75 bp, Artificial Sequence
  Synthetic
gaatggctgagtttatgccgccagacggagacgggatcacttcagtgactccaggctgatcttgggcgggagccg

SEQ ID NO: 340557 - DNA, 75 bp, Artificial Sequence
  Synthetic
aaggtgagtgaaaccaccgtagtctaggggcaattcgggctagatcagtctggcggaacgggcaagaaacttaaa

SEQ ID NO: 340558 - DNA, 75 bp, Artificial Sequence
  Synthetic
ttattttattttacagaatgacaacaagaattgtacctacaaaagacagcattcgccaaaaaaatctaaaatgga

SEQ ID NO: 340559 - DNA, 75 bp, Artificial Sequence
  Synthetic
tgaacctcctagtacacagccatgacattttctgcgactgcgactcaccgctacaacacacccttattttaatct

SEQ ID NO: 340560 - DNA, 75 bp, Artificial Sequence
  Synthetic
gccaacaagaaccaaaaattgaattaaaaccaattgagaaggatatcatcaaaaaatgccttattggagatacta

SEQ ID NO: 340561 - DNA, 75 bp, Artificial Sequence
  Synthetic
cagaagccgctggagaccccgcagaagatggcgtcgaagaaggtttactagacgcccttttcaaagaagactttg

SEQ ID NO: 340562 - DNA, 75 bp, Artificial Sequence
  Synthetic
gagaagaagacaccgccgggtaagaaaaagaaaacttaaaaaaattaagataaatcaatggcaaccacaatttat

SEQ ID NO: 340563 - DNA, 75 bp, Artificial Sequence
  Synthetic
aaagaaaatgaaaatagttggaactgaaccactatttttaactacttcagaaagactaacaaataactttgtatg

SEQ ID NO: 340564 - DNA, 75 bp, Artificial Sequence
  Synthetic
ctataaagacagtacagcaccacacttggtgccgggaggggggggattttccataatgaactttactttaaatgc

SEQ ID NO: 340565 - DNA, 75 bp, Artificial Sequence
  Synthetic
attgtatgaaaaacatttgtacttagaaaactggtggacaactagtaatgataatatgcctttaattagatttac

SEQ ID NO: 340566 - DNA, 75 bp, Artificial Sequence
  Synthetic
aggagttactttgtattactatagacaagcagaatttgactacttagctcaatatgtaagacagtacccaatgaa

SEQ ID NO: 340567 - DNA, 75 bp, Artificial Sequence
  Synthetic
tgcttctttgctaaaatatactagcacacatccacaagcaatgcttttacacaaaaatacacttaagataacatg

SEQ ID NO: 340568 - DNA, 75 bp, Artificial Sequence
  Synthetic
caaaagaaacaatagaaacaaaaaaccatacaaaaaaattaaaatacaaccaccttcacaaatgtataatcactg

SEQ ID NO: 340569 - DNA, 75 bp, Artificial Sequence
  Synthetic
gtactttcagaaagacatagctcacgtaccactattgcaactaataaccacatcagcatcgttagaccgcatgtt

SEQ ID NO: 340570 - DNA, 75 bp, Artificial Sequence
  Synthetic
cctcaattctaactcacttagttccacaataggtttcacaagtctagatcagttaggctttctaaaccacaatta

SEQ ID NO: 340571 - DNA, 75 bp, Artificial Sequence
  Synthetic
cacaaaagaaggcacacaaggatatgtagcaaaaccaggccaactgctatttggaatacatcaaggaaaatacaa

SEQ ID NO: 340572 - DNA, 75 bp, Artificial Sequence
  Synthetic
tattaaaacagtaagattttcagaattaatatatatgggtaatgcagtagatttaatagaaggcacagaagcagg

SEQ ID NO: 340573 - DNA, 75 bp, Artificial Sequence
  Synthetic
tgccataacagcaacccaatacaatacaataacaggaactacatacaacaacactataaaaaaacaattaaaata

SEQ ID NO: 340574 - DNA, 75 bp, Artificial Sequence
  Synthetic
catacaacaaactccaaacacctggggaaatccatttaatgatacttttcatagaacaggaggcctaataacaac

SEQ ID NO: 340575 - DNA, 75 bp, Artificial Sequence
  Synthetic
aagcctagcctgggaacaaatcattggattagcaactagcgacacagcaacattaacagaccaatttacatggaa

SEQ ID NO: 340576 - DNA, 75 bp, Artificial Sequence
  Synthetic
aactacatttacatttccagtaagatacaatccctttgctgacaaaggtgtaggaaacaaactatacttaattaa

SEQ ID NO: 340577 - DNA, 75 bp, Artificial Sequence
  Synthetic
atggaaagacccagctcatgacacagactgggatacaccaataccagaaactctttatgaaaacttaccactatg

SEQ ID NO: 340578 - DNA, 75 bp, Artificial Sequence
  Synthetic
gctaatgttttggggatacctagactactttagaaaatcaggagacacatctactctagataccacagcactaat

SEQ ID NO: 340579 - DNA, 75 bp, Artificial Sequence
  Synthetic
agtaattaaaacaaattacacatttccaaaagacaaaaaactactaattcctttagatcaagactttttagaagg

SEQ ID NO: 340580 - DNA, 75 bp, Artificial Sequence
  Synthetic
tagaagtccatacatggaacaacaagaaacaactgccagtgatagacaaaactggcacccaaaagttagatttca

SEQ ID NO: 340581 - DNA, 75 bp, Artificial Sequence
  Synthetic
aatacgaactgcaaacttaataggttcctgtggaccaggtacaataaaactaccaccacaacaatcagcagaagc

SEQ ID NO: 340582 - DNA, 75 bp, Artificial Sequence
  Synthetic
tcatgtaaaatatgtttttcactttaagcttgggggaacaccacctcctatggccactctcacagaaccagacaa

SEQ ID NO: 340583 - DNA, 75 bp, Artificial Sequence
  Synthetic
acaaccaaaatataccactcccgataacgtcatccaaacaccttcgttgcagagtccaacatctccctttgaata

SEQ ID NO: 340584 - DNA, 75 bp, Artificial Sequence
  Synthetic
catcctctacaacttcgacgaaagacgaggtacacttacaaaaaaagctgctgaaagaatcacaaaatacaaaga

SEQ ID NO: 340585 - DNA, 75 bp, Artificial Sequence
  Synthetic
gactgaacaaactgttctcccgtttacagaatcagctctatcctgctacacaacaccccaagaaaaaacacagac

SEQ ID NO: 340586 - DNA, 75 bp, Artificial Sequence
  Synthetic
accagaaacatcggacgaggaaaaagaagaaatgtcactccaggaacagctccagctccagcgaaagcagcaaag

SEQ ID NO: 340587 - DNA, 75 bp, Artificial Sequence
  Synthetic
actcctccgaaagcgaatcaacgaactcctcaaccgactaacactattagaatagataaatgtaaagtgaatata

SEQ ID NO: 340588 - DNA, 75 bp, Artificial Sequence
  Synthetic
tcactgtttccaccagatataaaacctaatcgtagactcacaacatgggaattagaacaagaaatagaggatgca

SEQ ID NO: 340589 - DNA, 75 bp, Artificial Sequence
  Synthetic
aaaatatggcacagagtgccaagatcttacttgtatgataaacctacatatccctgggtaccccaagactcccca

SEQ ID NO: 340590 - DNA, 75 bp, Artificial Sequence
  Synthetic
tttactgtaaactttgacttaaatgcgccgcaataaaaattcaaggcctgcaataattcactctcggtgtccatt

SEQ ID NO: 340591 - DNA, 75 bp, Artificial Sequence
  Synthetic
tattaaagtataaacttatataaacatccaccacactccctaatacgcaggcgcagtagggggctccgcccccta

SEQ ID NO: 340592 - DNA, 75 bp, Artificial Sequence
  Synthetic
ctaatacgcaggcgcagtagggggctccgccccctacaacccccagggggggcaaagccccccctacaacccccc

SEQ ID NO: 340593 - DNA, 75 bp, Artificial Sequence
  Synthetic
aacaactttaaaaaagagcgggaaccaatcaaattcaaacaccaacaaccaataaaatacacccacgtcactaat

SEQ ID NO: 340594 - DNA, 75 bp, Artificial Sequence
  Synthetic
taattagtaaacaccatcataaccggggaggagccaatcatctatatattcaactgcacttccgaatggctgagt

SEQ ID NO: 340595 - DNA, 75 bp, Artificial Sequence
  Synthetic
ttatgccgctagacggagagaagatagtcgcagactaacttcgctgtccctgggcgggtgccgaaggtgagtgaa

SEQ ID NO: 340596 - DNA, 75 bp, Artificial Sequence
  Synthetic
accaccgaagtcaaggggcaattcgggctgggacagtctagcggaacgggcaagaaacttaaattaatttacttt

SEQ ID NO: 340597 - DNA, 75 bp, Artificial Sequence
  Synthetic
tacagatgagcggcaactttaaaccaacattttatacaccaaaatcgaaaggaaaagctctcctcaacagcgtag

SEQ ID NO: 340598 - DNA, 75 bp, Artificial Sequence
  Synthetic
ctcacagccacgacttgctgtgccactgcgaccacccactaaaacatctttgtgaaattatctttgaaaacgaac

SEQ ID NO: 340599 - DNA, 75 bp, Artificial Sequence
  Synthetic
ctgaattaaagttacaactatgccatactactaccgccgaaactggagactcccataccgccggcgacgatggtt

SEQ ID NO: 340600 - DNA, 75 bp, Artificial Sequence
  Synthetic
ttggagaaggcgacctcgaccgtttattcgccgaagatttcaccgaagaagggtaagaagacaaccatactttca

SEQ ID NO: 340601 - DNA, 75 bp, Artificial Sequence
  Synthetic
taaaaaacttaaaaaacttaaactgcaacaatatcaacctcgaactgtaagatactgtaaaattaaaggatttca

SEQ ID NO: 340602 - DNA, 75 bp, Artificial Sequence
  Synthetic
atgcttattcgaagctagcaaatatagaataggcaataactatactatgtactttaatacttttgcaccagaaca

SEQ ID NO: 340603 - DNA, 75 bp, Artificial Sequence
  Synthetic
cttaccaggaggaggaggatttagtattgttaaatactccctagaaagtttatactctgaacatgaatacgtaag

SEQ ID NO: 340604 - DNA, 75 bp, Artificial Sequence
  Synthetic
aaactggtggacaaaatccaatttaaacttaccactttttagatacttaggatgtaccttaaaactttatcaatc

SEQ ID NO: 340605 - DNA, 75 bp, Artificial Sequence
  Synthetic
agaagatgtagactatgcatttcaatatcaaaactgttatcccatggtagctacagcacacttatacataagcag

SEQ ID NO: 340606 - DNA, 75 bp, Artificial Sequence
  Synthetic
acaaccttcaatcatgatgatgaacaaccactcaatattagttcccagcaaacgcacacaaaaaagaaaaaaacc

SEQ ID NO: 340607 - DNA, 75 bp, Artificial Sequence
  Synthetic
atgcataaaaataaaagttagccccccatcacaaatggaaaacaaatggtattttcaaaaagacaactgcaaaac

SEQ ID NO: 340608 - DNA, 75 bp, Artificial Sequence
  Synthetic
acccctactcattacaacagctacagcttgcagctttgatcattactacctaaatacatcagcaaaaaacaactg

SEQ ID NO: 340609 - DNA, 75 bp, Artificial Sequence
  Synthetic
cataactatatattctttaaacacatacctataccaaagcagacactttaacaaccgcggaacaacaggttacca

SEQ ID NO: 340610 - DNA, 75 bp, Artificial Sequence
  Synthetic
ccctaaaaacaatacatacttatatggcactcttgaaaacggtccaaaatacaaagtaggagacttaatatactt

SEQ ID NO: 340611 - DNA, 75 bp, Artificial Sequence
  Synthetic
ggggaacacaatgacatatcaacaaggccaaagcccgagagagttacacccaacagacaccacaaagggcttcca

SEQ ID NO: 340612 - DNA, 75 bp, Artificial Sequence
  Synthetic
ggaagcaaaacaatttgaaaactggggaaacccattctacacacacaacctacacggcactatacacatactaca

SEQ ID NO: 340613 - DNA, 75 bp, Artificial Sequence
  Synthetic
aacaacagaatcaccaacacaaatgtacaccggtactagttatgaagcagaaaaaacaaatctaacagaaatatc

SEQ ID NO: 340614 - DNA, 75 bp, Artificial Sequence
  Synthetic
aaacaacttttatacacttagatataacccatacagagacagcggtgaaggcaacaaaatatacttacttaaaaa

SEQ ID NO: 340615 - DNA, 75 bp, Artificial Sequence
  Synthetic
ctggacagaggaaacaggctgggacccaccaacagacacagacttaatcatggaaggctaccccctatggctaat

SEQ ID NO: 340616 - DNA, 75 bp, Artificial Sequence
  Synthetic
gctatggggatggatagactggcaaaaaaagctagcaaaaataaacacaatagataccaaatacatactagtaat

SEQ ID NO: 340617 - DNA, 75 bp, Artificial Sequence
  Synthetic
acaaacaaaattcacaaaaggagaaatgccaataatagtaccaatagactacgactttattgacggtcaatcacc

SEQ ID NO: 340618 - DNA, 75 bp, Artificial Sequence
  Synthetic
atacacagaagaactagaccccacagacaaacaaaactggcatcccatggtacaataccaacaacagacaataaa

SEQ ID NO: 340619 - DNA, 75 bp, Artificial Sequence
  Synthetic
caacatacttacatgtgggccaggcacaccaaaatacaatggcaaaaacacagtagaagccaaactagaatactc

SEQ ID NO: 340620 - DNA, 75 bp, Artificial Sequence
  Synthetic
ttttaaatttaaatttggaggctgtccgccaccaatggcagccctagaagacccttgtaaacaacccacatacca

SEQ ID NO: 340621 - DNA, 75 bp, Artificial Sequence
  Synthetic
aattccccaaacaacaactatgttacaggatcctaccacgcccctccagtattacctctggaactttgacgagag

SEQ ID NO: 340622 - DNA, 75 bp, Artificial Sequence
  Synthetic
aaggggacaacttacaaaaacagctgcagatagaatacaaaaagactggcaacttacagactctgttatctcaac

SEQ ID NO: 340623 - DNA, 75 bp, Artificial Sequence
  Synthetic
tacagggctacatgccaaagacctggaacccctccaaacacaccaagaaatccaagaccaaacatcgtcggagga

SEQ ID NO: 340624 - DNA, 75 bp, Artificial Sequence
  Synthetic
agaaagcgaagaggacatattctcccagctccagcgacagcgagccaaacaacacagaatcaggcagcgaatcct

SEQ ID NO: 340625 - DNA, 75 bp, Artificial Sequence
  Synthetic
ccaattagtaaccaaaatacaaaaattagaataataaaaagctctgtaacagttagcttattcccaccagaagaa

SEQ ID NO: 340626 - DNA, 75 bp, Artificial Sequence
  Synthetic
aaaccaaataggagaatgacccctaaagaactagaagatgaactcttttgggcaaaaatgtttaaaagacctatg

SEQ ID NO: 340627 - DNA, 75 bp, Artificial Sequence
  Synthetic
agatcttacatattcgataaaccttgctacccatatgtacctgtaaatgaaaagcaatgtgtaaactttgaccct

SEQ ID NO: 340628 - DNA, 75 bp, Artificial Sequence
  Synthetic
aactatactgaataaagacctgcatactacacttaatggactctgttcctttaagaaaaaactttaataaaccac

SEQ ID NO: 340629 - DNA, 75 bp, Artificial Sequence
  Synthetic
acctacctatgacgtatgcaggcgccaaaatggcgcctgaaaaacaaaatggcggaggggctacgcccccccgca

SEQ ID NO: 340630 - DNA, 75 bp, Artificial Sequence
  Synthetic
gacgtatgcaggcgccaaaatggcgcctgaaaaacaaaatggcggaggggctacgcccccccgcaccccccccgc

SEQ ID NO: 340631 - DNA, 75 bp, Artificial Sequence
  Synthetic
ttattaatattcaacaggaaaaccacctaatttaaattgccgaccacaaaccgtcacatacttcccttttttaca

SEQ ID NO: 340632 - DNA, 75 bp, Artificial Sequence
  Synthetic
atacttccctttttactcataaatattcattacattatttaataatcaccgtcattccggggaggagccaattac

SEQ ID NO: 340633 - DNA, 75 bp, Artificial Sequence
  Synthetic
ctatataacaaactacacttccgaatggctgagtttatgccgccagacggagactggaacaccacagtgactcca

SEQ ID NO: 340634 - DNA, 75 bp, Artificial Sequence
  Synthetic
ggctgacttagggcgggtgccgaaggtgagtgaaaccaccgtagtcaaggggcaattcgggcaaagtcggtctgg

SEQ ID NO: 340635 - DNA, 75 bp, Artificial Sequence
  Synthetic
cggactgggcaagaaacttaaaactatttattttacagatatgtcctttaccttttggaaaccaactccttacgg

SEQ ID NO: 340636 - DNA, 75 bp, Artificial Sequence
  Synthetic
acaccgccaaaaagaaaacaactggataaatgaaatcatccattttcatgacaacttctgtggctgcgacgaacc

SEQ ID NO: 340637 - DNA, 75 bp, Artificial Sequence
  Synthetic
catcaaacatcttatttggaaactagcacataatgccccacaactaaacattgaaaaagaagatttacaaaaact

SEQ ID NO: 340638 - DNA, 75 bp, Artificial Sequence
  Synthetic
acaaaaatgcctccctacaactactacagatggaacaactggagaagaccaacatacagacgccgccgatggaga

SEQ ID NO: 340639 - DNA, 75 bp, Artificial Sequence
  Synthetic
cgcagacaatatagacgaaggagacctcgaccgtttattcgaagaagattttggagacgacacacggtaagaaga

SEQ ID NO: 340640 - DNA, 75 bp, Artificial Sequence
  Synthetic
cgacgtattaaaaagaaacttaaaaaaattaaaatatatgagtggcaaccaactgtaattaaaaaatgccacata

SEQ ID NO: 340641 - DNA, 75 bp, Artificial Sequence
  Synthetic
aaaggaacaattcctcttatacaaggaggaaaagatagacaaggttttaactatgctcaataccaagactcatat

SEQ ID NO: 340642 - DNA, 75 bp, Artificial Sequence
  Synthetic
ataccttcacacaaaggtggaggtggaacttggagcataatggtattttctttaggagcattatatgaagaatgg

SEQ ID NO: 340643 - DNA, 75 bp, Artificial Sequence
  Synthetic
gaaagactaaacaatgtatggacaaaaactaacaatgggttaccatttgctagatactgtggatgtagatttaaa

SEQ ID NO: 340644 - DNA, 75 bp, Artificial Sequence
  Synthetic
ttttatagacaagaatactatgactatatagtacattactcaatatgctaccctatgacagacacagaagaccaa

SEQ ID NO: 340645 - DNA, 75 bp, Artificial Sequence
  Synthetic
cacctaaactcacaaccacacagactaatacaaggcagaaaaaaaattgtagtacacagatataataaacaaatt

SEQ ID NO: 340646 - DNA, 75 bp, Artificial Sequence
  Synthetic
cacaaaaaaccatacgtaaaaaaaagaataagaccaccagcaatgctacaatcacactggtactttcaacaagaa

SEQ ID NO: 340647 - DNA, 75 bp, Artificial Sequence
  Synthetic
atatgtaacacaggcctactactaataacaacttcaatatgcaaccttaacaattactggctatcaaacaaccac

SEQ ID NO: 340648 - DNA, 75 bp, Artificial Sequence
  Synthetic
ctaagtaacaatataagcttttggtccgttaacacaagactattttcaaaccccaactttcaaaacacagactcc

SEQ ID NO: 340649 - DNA, 75 bp, Artificial Sequence
  Synthetic
acagtaggatacacaccaaaagacggagtctacctttatggaacatataatggaacaccaacacaaaacttaaca

SEQ ID NO: 340650 - DNA, 75 bp, Artificial Sequence
  Synthetic
tggatgcacatgatatatttaggaaacactcacaaataccaacaaggactagcaccaatagatatgtcaggacct

SEQ ID NO: 340651 - DNA, 75 bp, Artificial Sequence
  Synthetic
acaagtaaccaaataaaagcattacacgaaaaacaaaactggggaaacccattccattataactttgcaaataaa

SEQ ID NO: 340652 - DNA, 75 bp, Artificial Sequence
  Synthetic
caagtaagatttttcatatcaagcaaaaacccaacaaccatacaagacacagacttaaacaaccctataagtaat

SEQ ID NO: 340653 - DNA, 75 bp, Artificial Sequence
  Synthetic
acaaccatattagatgaaccagtttttcaagaatgtagatacaatccctacaaagataaaggatacggaaatgaa

SEQ ID NO: 340654 - DNA, 75 bp, Artificial Sequence
  Synthetic
gcatactttttatcaaatgtcattgctaaaaaaaaagcctgggatcccccagacaacaaactactatataactca

SEQ ID NO: 340655 - DNA, 75 bp, Artificial Sequence
  Synthetic
ggctatccctgctggctactaccttggggatggctagattggcaactaaaacttaaacaaataaatcaaataggc

SEQ ID NO: 340656 - DNA, 75 bp, Artificial Sequence
  Synthetic
ataaactacaattatatatttaaaacagatcaaatactaccaaaactcccagcatacataccaattaacccctcc

SEQ ID NO: 340657 - DNA, 75 bp, Artificial Sequence
  Synthetic
tttgtcttccctgaagaagaccaactaacagaaacagacaaactacactggtatccaaaaaatgattatcaatta

SEQ ID NO: 340658 - DNA, 75 bp, Artificial Sequence
  Synthetic
aactctatatcaacactatgtagctccggcccaggaacatatcaatttgataaaacagaaagtgttcaagtcaat

SEQ ID NO: 340659 - DNA, 75 bp, Artificial Sequence
  Synthetic
gctttttatgactttttttttaagtggggaggatgcccagcaccaatggaagaagtcaaagacccctgtaaccag

SEQ ID NO: 340660 - DNA, 75 bp, Artificial Sequence
  Synthetic
ccacactttcccatccccactgaaatcattgaaggacgtaaaatccagaatccaaacacaaacaaatcagaatac

SEQ ID NO: 340661 - DNA, 75 bp, Artificial Sequence
  Synthetic
ttatactgcttcgacgaaagacgacaaattcttacaaaaactgctcaaaaaagaatatgtgaagacattaaacct

SEQ ID NO: 340662 - DNA, 75 bp, Artificial Sequence
  Synthetic
gaaacatttatgttcacagatggatcaaaactcaacgtcccaatactccaacaaaaagaaaaaacacagacgaca

SEQ ID NO: 340663 - DNA, 75 bp, Artificial Sequence
  Synthetic
tcgagcgaggaagaagcagaaacaccactactcaagaagctcaagctcctcaagcgacaccagagaaagctccag

SEQ ID NO: 340664 - DNA, 75 bp, Artificial Sequence
  Synthetic
cgaaagctccagcgattaacaacatcacatctatcagaataacaaaatgtgttcaaaaagcatatctttttgaac

SEQ ID NO: 340665 - DNA, 75 bp, Artificial Sequence
  Synthetic
caccacaaaaaaacagaagaatgacaccaaaagaacaagaacaagaaaaactagacgcacaaatctggaaaagac

SEQ ID NO: 340666 - DNA, 75 bp, Artificial Sequence
  Synthetic
cacaaagactttttatactagatccaccattttatccatggtgcccccctgaacctacagtaaactttgacctta

SEQ ID NO: 340667 - DNA, 75 bp, Artificial Sequence
  Synthetic
aatacaaatatgaataaagaaataaagggcaaggccccattaattcaaactcggtgtctgttcctttaagtctca

SEQ ID NO: 340668 - DNA, 75 bp, Artificial Sequence
  Synthetic
acttatttaaacagtctccgcctccctaaattagggcgccaaaagggggctccgcccccttaaacccataggggg

SEQ ID NO: 340669 - DNA, 75 bp, Artificial Sequence
  Synthetic
acttatttaaacagtctccgcctccctaaattagggcgccaaaagggggctccgcccccttaaacccttaggggg

SEQ ID NO: 340670 - DNA, 75 bp, Artificial Sequence
  Synthetic
acttatttaaacagtctccgcctccctaaattagggcgccaaaagggggctccgcccccttaaacccctaggggg

SEQ ID NO: 340671 - DNA, 75 bp, Artificial Sequence
  Synthetic
acttatttaaacagtctccgcctccctaaattagggcgccaaaagggggctccgcccccttaaacccgtaggggg

SEQ ID NO: 340672 - DNA, 75 bp, Artificial Sequence
  Synthetic
ggctccgcccccttaaacccatagggggctccgccccctaaaacccccaagggggttacgcccccttacaccccc

SEQ ID NO: 340673 - DNA, 75 bp, Artificial Sequence
  Synthetic
ggctccgcccccttaaacccttagggggctccgccccctaaaacccccaagggggttacgcccccttacaccccc

SEQ ID NO: 340674 - DNA, 75 bp, Artificial Sequence
  Synthetic
ggctccgcccccttaaacccctagggggctccgccccctaaaacccccaagggggttacgcccccttacaccccc

SEQ ID NO: 340675 - DNA, 75 bp, Artificial Sequence
  Synthetic
ggctccgcccccttaaacccgtagggggctccgccccctaaaacccccaagggggttacgcccccttacaccccc

SEQ ID NO: 340676 - DNA, 75 bp, Artificial Sequence
  Synthetic
taataaatattcaacaggaaaaccacctcatttgaattgccgaccacaaactgccacttattccctttttgccac

SEQ ID NO: 340677 - DNA, 75 bp, Artificial Sequence
  Synthetic
tacttcctcttttgctcattattattcatgcaaattaattaatacacaccgtcataactaggcggggactaaaac

SEQ ID NO: 340678 - DNA, 75 bp, Artificial Sequence
  Synthetic
ctatataactaacagtacttccgaatggctgagtttatgccgctagacggagacgaagacggacaacgacttcgg

SEQ ID NO: 340679 - DNA, 75 bp, Artificial Sequence
  Synthetic
ctgatcttgggcgggtgctgaaggtgagtgtaaaccaccgaaatcaaggggcaattcgggctaggatcagtctag

SEQ ID NO: 340680 - DNA, 75 bp, Artificial Sequence
  Synthetic
cggaacgggcaagaaacttaaaataatatttattttacagatgagcacaagatatatacctacaaaagacagcca

SEQ ID NO: 340681 - DNA, 75 bp, Artificial Sequence
  Synthetic
cagacaaaagaacctaaaatggcttaactttgtaactcacgcccatgatatcttctgtgactgcgactcaccact

SEQ ID NO: 340682 - DNA, 75 bp, Artificial Sequence
  Synthetic
tcaacatacagtagcaaatattttaatacaagaaccgaacatcaaattcaacacacaagaaaaggatttacttaa

SEQ ID NO: 340683 - DNA, 75 bp, Artificial Sequence
  Synthetic
aaaatgccttggagaaactactactacagaaggcgccggagacccagaaggttttggagacggagatttagaacg

SEQ ID NO: 340684 - DNA, 75 bp, Artificial Sequence
  Synthetic
cctatttacagaagattttggagaagaagataccgggtaagaaaaagacattttaaaagaaaactttctaaacta

SEQ ID NO: 340685 - DNA, 75 bp, Artificial Sequence
  Synthetic
actatacaagaatggcaaccgccatcaataagaaaactaactattaaaggatactatcctttatttcaatcaaca

SEQ ID NO: 340686 - DNA, 75 bp, Artificial Sequence
  Synthetic
agagacagactttctaacaatatgataacttacttagaatctatcgctccgcattatgtaccggggggagggggc

SEQ ID NO: 340687 - DNA, 75 bp, Artificial Sequence
  Synthetic
tttagcataagttgcttttctttaaatactctgtataaagaacacttaaaactacataactggtggacaaaaaca

SEQ ID NO: 340688 - DNA, 75 bp, Artificial Sequence
  Synthetic
aatgacaattatccactaattagatataatggatgcacacttaaactatttaaatcagaaaaagtagactacata

SEQ ID NO: 340689 - DNA, 75 bp, Artificial Sequence
  Synthetic
ttttactaccaaagacattaccctatgaaagctagtgccctcatgtacacatctacacaaccacaaatactatta

SEQ ID NO: 340690 - DNA, 75 bp, Artificial Sequence
  Synthetic
ctaaacaacagaaaaaggattgtaaaatgcaaggcaaacaacaaaaaaacaaaaccatacataagactaagaata

SEQ ID NO: 340691 - DNA, 75 bp, Artificial Sequence
  Synthetic
ccaccaccatcacaactcaaaacaaaatggtattttcaaagagacatagctaatttaccgttattactaacaatt

SEQ ID NO: 340692 - DNA, 75 bp, Artificial Sequence
  Synthetic
gcaacagcttgcagtttagacagaccatacctgaattcacaatctatttcaaacacagtgggtttcaaaacctta

SEQ ID NO: 340693 - DNA, 75 bp, Artificial Sequence
  Synthetic
aactacgaagcctttctcaacagaggtttcaaaaacatacccacaacaggatactttcctaaacccaacacccgt

SEQ ID NO: 340694 - DNA, 75 bp, Artificial Sequence
  Synthetic
tactttattacacaaacacattcaacagaccctaaaaatgtacccataggatctctaatattcctaggaaacaca

SEQ ID NO: 340695 - DNA, 75 bp, Artificial Sequence
  Synthetic
aacttattaacattaggaacaaaaatacaagatgcttgtccatcaagcacagaaaatgaatggaaaaaccaattt

SEQ ID NO: 340696 - DNA, 75 bp, Artificial Sequence
  Synthetic
gaaaaatatttacaaacagaaaaaaactggggaaacccatttacaccagaatatctagatgaagacaattacaat

SEQ ID NO: 340697 - DNA, 75 bp, Artificial Sequence
  Synthetic
atatggataaccaataaaacaccacaagaacttaaagcaaaatacaaatcaaacacagacaaactacattcatca

SEQ ID NO: 340698 - DNA, 75 bp, Artificial Sequence
  Synthetic
gacacagatactttctggacacttaaaagagtaccctcagtattagactgcagatacaatccttttagagacgat

SEQ ID NO: 340699 - DNA, 75 bp, Artificial Sequence
  Synthetic
aacagaaatgaagtatatctactaaaaataacagaacaaaatagttatgattaccatgaaccaccaaaaccagaa

SEQ ID NO: 340700 - DNA, 75 bp, Artificial Sequence
  Synthetic
cttatagctaaagatttaccactttgggcctgtctttggggatacattgactaccaaaaaaaagcagcaacatac

SEQ ID NO: 340701 - DNA, 75 bp, Artificial Sequence
  Synthetic
acagaaatagacaccacatgcatatgtgttatactgtcacatagcttagaccctacaactcatactacattcata

SEQ ID NO: 340702 - DNA, 75 bp, Artificial Sequence
  Synthetic
ccattagatgaagactttttaaagggacaaagttcatttagaccagaacaccaaaccactagacctgatgaactt

SEQ ID NO: 340703 - DNA, 75 bp, Artificial Sequence
  Synthetic
aactggcacccaaaagtatcatttcaaatacaatcacttaataatatagcatgcacaggaccatacacagctaaa

SEQ ID NO: 340704 - DNA, 75 bp, Artificial Sequence
  Synthetic
ttaccagctggtacctcaatagaaggtcacatgcaatataaatttcattttaagcttggaggaagcccaccacca

SEQ ID NO: 340705 - DNA, 75 bp, Artificial Sequence
  Synthetic
atggccacacttacgaacccagaaaatcaaccaaaatatcccaatcccgataacttcctgcaaacaacttcgtta

SEQ ID NO: 340706 - DNA, 75 bp, Artificial Sequence
  Synthetic
cagagtccaacaatgcccatcgaacattatctctacaactttgacgaacgacgacacatccttacaaaaaaagct

SEQ ID NO: 340707 - DNA, 75 bp, Artificial Sequence
  Synthetic
atcaaaagaatgcaaacagacaaagaaactcaaagctctcttttgcaaattacagactcagcttcaacagacgtc

SEQ ID NO: 340708 - DNA, 75 bp, Artificial Sequence
  Synthetic
ccaacaccctacacagaaacaccgacatcggaatcggaggactcggaaaaagaggaggagacactgcagcagcga

SEQ ID NO: 340709 - DNA, 75 bp, Artificial Sequence
  Synthetic
ctcctcaagcagcgaaagtaccaaaagcaactccagcggggaatcaacaagctcctcaacagattagcaaatata

SEQ ID NO: 340710 - DNA, 75 bp, Artificial Sequence
  Synthetic
caataaaacaatgtactcttactgtaaacttatttgatgactatgtaccaaaaaatagacgtatgaacccatggg

SEQ ID NO: 340711 - DNA, 75 bp, Artificial Sequence
  Synthetic
aatatgaacaagagctagaggactctaaaatatggtgtagaaaccctagaactcatatattggtaagcctttcta

SEQ ID NO: 340712 - DNA, 75 bp, Artificial Sequence
  Synthetic
tccttttgtacccccaagtgacaaatacgctgtaaactttgaccttaatttcccttaataaaggcctgcaaactt

SEQ ID NO: 340713 - DNA, 75 bp, Artificial Sequence
  Synthetic
ccacttgaggtgtccatttattaaagtttaaacctatataaacatccaccacactcccaaatacgcaggcgcagt

SEQ ID NO: 340714 - DNA, 75 bp, Artificial Sequence
  Synthetic
atacgcaggcgcagtagggggctccgccccctaaaacccccgagggggggctccgccccccctaatacccccccc

SEQ ID NO: 340715 - DNA, 75 bp, Artificial Sequence
  Synthetic
taataaatattcaacaggaaaaccacctaatttaaattgccgaccacaaaccgtctcttacttcctctttttact

SEQ ID NO: 340716 - DNA, 75 bp, Artificial Sequence
  Synthetic
aatacttccctttttgctcattattattcattacattaattagtaatctccgtaattccggggaggggccaacaa

SEQ ID NO: 340717 - DNA, 75 bp, Artificial Sequence
  Synthetic
attcattacattaattagtaatctccgtaattccggggaggggccaacaaactatataaccaagtacacttccga

SEQ ID NO: 340718 - DNA, 75 bp, Artificial Sequence
  Synthetic
ggtgagtgaaaccaccgtagtctaggggcaattcgggctagttcagtctggcggaacgggcaagaaacttaaaat

SEQ ID NO: 340719 - DNA, 75 bp, Artificial Sequence
  Synthetic
attatattttacagatgtcaagctgttataaaccaacatactataacacaaaaggcaaacaaactcaatggatta

SEQ ID NO: 340720 - DNA, 75 bp, Artificial Sequence
  Synthetic
acgatattcactgcacccacgatttatggtgttcctgtgaccacgtactcaaacatctcctactaagcattgctg

SEQ ID NO: 340721 - DNA, 75 bp, Artificial Sequence
  Synthetic
aaagaaacgaaaaaattgaattaaccaaagaagaaaagaaacaagtactacaatgccttactactacagaagaaa

SEQ ID NO: 340722 - DNA, 75 bp, Artificial Sequence
  Synthetic
ttactacccaaaatggagacgatggagatctagacgaaataggtttagacgccattttcgcagaagaacttaccg

SEQ ID NO: 340723 - DNA, 75 bp, Artificial Sequence
  Synthetic
aagacgctgggtaagcaacccttttaacaaaataactttaaaacaatggcaaccgccatataaaaagacttgcta

SEQ ID NO: 340724 - DNA, 75 bp, Artificial Sequence
  Synthetic
cataaaaggacaaacttgtttaatatattataacaatgacagacttggatataacagtacaatgtatgaaaaaag

SEQ ID NO: 340725 - DNA, 75 bp, Artificial Sequence
  Synthetic
tattgtaccttttcattggccgggagggggaagcttttctgtaagcaaatatactttagatggattatttgatat

SEQ ID NO: 340726 - DNA, 75 bp, Artificial Sequence
  Synthetic
gcataaagaatgtagaaactggtggacaggcagtaatatagatttaccattatgtaaatataaaggatgtacatt

SEQ ID NO: 340727 - DNA, 75 bp, Artificial Sequence
  Synthetic
aactttttaccaagcacaaaatacagactttatatttaaagtaacaaatgaacagccagcagtaagcaacaaatt

SEQ ID NO: 340728 - DNA, 75 bp, Artificial Sequence
  Synthetic
aacatatcctagcacacatccacaaataatgctaatgagcaaccaacaccatgtactatcatccacacaaaacag

SEQ ID NO: 340729 - DNA, 75 bp, Artificial Sequence
  Synthetic
aaagaaaagaaaaccatacacaaaaatacacataccaccaccagaaatgtttgaaaacaaatggtattttacaca

SEQ ID NO: 340730 - DNA, 75 bp, Artificial Sequence
  Synthetic
agacttatttagaataccactactacaaatatttgcaactgcagcaaacatgccaaacccatacttaaaacctaa

SEQ ID NO: 340731 - DNA, 75 bp, Artificial Sequence
  Synthetic
cagaaaatcaaacaacacagtgttttggggaataaacacacaaagtacacaaaacagagaaatgtcaatagaaac

SEQ ID NO: 340732 - DNA, 75 bp, Artificial Sequence
  Synthetic
agaccaatcatggccttttaaaaagcaaggcacacaatccttttacttttactactacactggcacaaacccacc

SEQ ID NO: 340733 - DNA, 75 bp, Artificial Sequence
  Synthetic
atcagacacaagtcaaattaaagtagcagacataatagcagtaacagacaaaaaaaacaacaaaccaggagaaag

SEQ ID NO: 340734 - DNA, 75 bp, Artificial Sequence
  Synthetic
ctaccatgaccaacaaacaacatcaaacaaaaattggcaacaatactttgaaaattaccaacaattttggggaaa

SEQ ID NO: 340735 - DNA, 75 bp, Artificial Sequence
  Synthetic
tccatttaacaatcacttaaatgaacatccagaatacttttattactcttttatatcaccagaaactctaaaagc

SEQ ID NO: 340736 - DNA, 75 bp, Artificial Sequence
  Synthetic
aactgcaaaaacaaaaacagaccaaatgacttggaaagacttaacagacacaaaccaatcatatgccttaactaa

SEQ ID NO: 340737 - DNA, 75 bp, Artificial Sequence
  Synthetic
atttgatgaaccaatattcatcccataccaatataacccagaaagggacacaggagaagacacacaatgctactt

SEQ ID NO: 340738 - DNA, 75 bp, Artificial Sequence
  Synthetic
tttaagtaacagagaaggccacggatgggacccacccggtgttccagaaattatattagaaggctttcctttgtg

SEQ ID NO: 340739 - DNA, 75 bp, Artificial Sequence
  Synthetic
gctaatattatggggatacgcagactttcaaaaaaacttaaaaaagatacttaacatagacacaacatatatact

SEQ ID NO: 340740 - DNA, 75 bp, Artificial Sequence
  Synthetic
caccattaaatcaaaatttgcacaaaggcctagaacatatcctatagtaattatagatgaatcatttaaacaagg

SEQ ID NO: 340741 - DNA, 75 bp, Artificial Sequence
  Synthetic
atttagtccatacgaacaaacatgcttaccagaagacataactagatggtatccaatgtaccaataccaaacaag

SEQ ID NO: 340742 - DNA, 75 bp, Artificial Sequence
  Synthetic
agaacaaaacaaaatactacaaacaggaccattcacaccatacatacaaaacctacaatctgaaaatttatgtat

SEQ ID NO: 340743 - DNA, 75 bp, Artificial Sequence
  Synthetic
gtactataaatttagattccaatggggaggaagcccacctaaaacagtaaatgttgaaaatccttcccaccagaa

SEQ ID NO: 340744 - DNA, 75 bp, Artificial Sequence
  Synthetic
tatctttcctataccccgtaacgagcatgaaacaacttcgttacagagtccagggacagcccccgaaagcatcct

SEQ ID NO: 340745 - DNA, 75 bp, Artificial Sequence
  Synthetic
atactcatttgacttcagacatggagactacacaacaaaagctcttgcaagaattacaaaggactggccaattaa

SEQ ID NO: 340746 - DNA, 75 bp, Artificial Sequence
  Synthetic
agaaactgtttctcaaattacagaaccagagtcagcaaaactactccaacaaatgttccagtttctccaaacatc

SEQ ID NO: 340747 - DNA, 75 bp, Artificial Sequence
  Synthetic
agaagaaacgcaggagaaaaaagaaaaagagatgcaccagtacatccaactcctcagacaacagcagcagcagta

SEQ ID NO: 340748 - DNA, 75 bp, Artificial Sequence
  Synthetic
cagagagcgaatagcatcaatattaaaccaccaacaattataggatgtattaaaagggttaaactgtttgatgat

SEQ ID NO: 340749 - DNA, 75 bp, Artificial Sequence
  Synthetic
aacaaatgtaaaaatcgccgctttacccctgaagaatttcaaactgaattagaaatatgtaaatggatgaaaaga

SEQ ID NO: 340750 - DNA, 75 bp, Artificial Sequence
  Synthetic
ccccctagatattatgtacatgatccacccttttacccctggactgtaccagaacctaaagtaaactttgctctt

SEQ ID NO: 340751 - DNA, 75 bp, Artificial Sequence
  Synthetic
aatttcaaagaataaaggccagcattaattcacttagtggtgtcagtttatattatttaaacttaaataaacagt

SEQ ID NO: 340752 - DNA, 75 bp, Artificial Sequence
  Synthetic
caccgcctccctaatacgcaggcgcacaagggggctccgcccccttaaacccccaagggggctccgcccccttaa

SEQ ID NO: 340753 - DNA, 75 bp, Artificial Sequence
  Synthetic
gctccgcccccttaaacccccaagggggctccgcccccttaaacccccaagggggctccgcccccttaaaccccc

SEQ ID NO: 340754 - DNA, 75 bp, Artificial Sequence
  Synthetic
taattaatattcaacaggaaaaccacataatttgaattgccgaccacaaactgacaactgttgctgcaacttctg

SEQ ID NO: 340755 - DNA, 75 bp, Artificial Sequence
  Synthetic
cttttacaactacacttctccttttttagagccacacctactaattcattaatagtcagacgctattcctgggag

SEQ ID NO: 340756 - DNA, 75 bp, Artificial Sequence
  Synthetic
gagcaacacatctatataaccaagtacacagacgaatggctgagtttatcacgccagacggagacggcatcagaa

SEQ ID NO: 340757 - DNA, 75 bp, Artificial Sequence
  Synthetic
acacagacgaatggctgagtttatcacgccagacggagacggcatcagaagactgactgccggctgatcttgggc

SEQ ID NO: 340758 - DNA, 75 bp, Artificial Sequence
  Synthetic
aacttaaaatataacatttattttacagatatgagctcttttctaacaccagctgtatactccaaaaatggctta

SEQ ID NO: 340759 - DNA, 75 bp, Artificial Sequence
  Synthetic
gaaaaccaatggattaacacaatttggaacacccacgacttaatgtgcggatgcaacaacgccattaaacatctt

SEQ ID NO: 340760 - DNA, 75 bp, Artificial Sequence
  Synthetic
tttgacatcctgaaaaaaaaaggtgaacaactatgcctcccttctactacagaagacgctggtactcaaacccat

SEQ ID NO: 340761 - DNA, 75 bp, Artificial Sequence
  Synthetic
ggagaagaaaaagactacgatttagaagaaggagacttagacgccctattcgcaaacgatttcgaagaagacgat

SEQ ID NO: 340762 - DNA, 75 bp, Artificial Sequence
  Synthetic
gggtaagaagacgtcgcttttttagatttaaaagaaaacttagaaaaataagaatagaccaatggcaaccagaaa

SEQ ID NO: 340763 - DNA, 75 bp, Artificial Sequence
  Synthetic
ctattagaaaatgccatgtaaaaggaaacttatgcttactaacttgcggtagaggaaatattaaccataactaca

SEQ ID NO: 340764 - DNA, 75 bp, Artificial Sequence
  Synthetic
tactaacatcagaaagttatgtacctacatcagaaccgggagggggatcatggtcaattttacaaatgacaacaa

SEQ ID NO: 340765 - DNA, 75 bp, Artificial Sequence
  Synthetic
gagtactgtatgacgaatacaaagcagccagaaactggtggacaaaatctaactccttactaccactaacaaaat

SEQ ID NO: 340766 - DNA, 75 bp, Artificial Sequence
  Synthetic
atattagatgtaaactaaaattttatagaagtgaccaaacagactacatagtaactatacaaagaacaggcccat

SEQ ID NO: 340767 - DNA, 75 bp, Artificial Sequence
  Synthetic
ttgaagttacactagaatcatacttaagcacacaacctagtagacacctaatgaaccacaaagcatttatagtac

SEQ ID NO: 340768 - DNA, 75 bp, Artificial Sequence
  Synthetic
caaaactaggaagaggaccaaacaaagaaacatatgtaaaaaaaattgttagaccaccagcactatttcaaagta

SEQ ID NO: 340769 - DNA, 75 bp, Artificial Sequence
  Synthetic
aatggtacttttcacaagacatatacaatacaccactatttatattaacagtatcatcctgctcactagaccaaa

SEQ ID NO: 340770 - DNA, 75 bp, Artificial Sequence
  Synthetic
tgtatgccccacaagaccaaataagtactaatatatcattattttcattaaacacaaatgttttccaaataaata

SEQ ID NO: 340771 - DNA, 75 bp, Artificial Sequence
  Synthetic
actggcacaaacaaccatacaccacaaaagcagcaagcaccttagaaacatacctatactgctaccacaatggac

SEQ ID NO: 340772 - DNA, 75 bp, Artificial Sequence
  Synthetic
atgaaccaacacaagaattaaaatggaaagacataatattactaggaaacatgacaaactacacagacggtaaaa

SEQ ID NO: 340773 - DNA, 75 bp, Artificial Sequence
  Synthetic
agtacaatacatcaggaacaaccccattagacctttttaaaacagaaaacaaaccatattggggtaacgtattta

SEQ ID NO: 340774 - DNA, 75 bp, Artificial Sequence
  Synthetic
caaacttaaaccaagatcaagatgtaataatatactacggtactaaaccaaaacaagacgacaattggacctcaa

SEQ ID NO: 340775 - DNA, 75 bp, Artificial Sequence
  Synthetic
cagcacctattttacctataacaagtttatatgtagaatgcagatacaacccatttaaagacaaaggcacaggaa

SEQ ID NO: 340776 - DNA, 75 bp, Artificial Sequence
  Synthetic
acaaagtatatttagttccaacagactcaggattaggatccttcttaacattaccaacaaaaagtgaactaataa

SEQ ID NO: 340777 - DNA, 75 bp, Artificial Sequence
  Synthetic
taacagacctaccattatggttaataacatggggatggatagaatggttaaaaaaaagcagaccagtagcacata

SEQ ID NO: 340778 - DNA, 75 bp, Artificial Sequence
  Synthetic
ttgaagaagaataccaagttgttatacaaagcaaatacatacacccacaattaccatgttatgtacttatagaca

SEQ ID NO: 340779 - DNA, 75 bp, Artificial Sequence
  Synthetic
aatactttagacacccaccagaaggacaacattatataacagaactatcagaaacagacaaactacactggcacc

SEQ ID NO: 340780 - DNA, 75 bp, Artificial Sequence
  Synthetic
caaaatactcaatgcaaacagaacaactagaactaatagcagaaacaggaccagcggcaccaaaaattaacaaca

SEQ ID NO: 340781 - DNA, 75 bp, Artificial Sequence
  Synthetic
caaaacaaatagaagcacaccttaattatgactttttattcaagtggggaggaagcccagcaccaatggaaacaa

SEQ ID NO: 340782 - DNA, 75 bp, Artificial Sequence
  Synthetic
ttacagacccagcagaacaagaaaaattcccctcgcccagtaaccagctccagggacttcagatcgagagtccag

SEQ ID NO: 340783 - DNA, 75 bp, Artificial Sequence
  Synthetic
ggaaaccaaagcaatactatctttacacatttgacgaaaagcgcagcgaactcacaatgccagctgcaaaaagac

SEQ ID NO: 340784 - DNA, 75 bp, Artificial Sequence
  Synthetic
ttaaaaaagactttacaactccaacattttttacagactttggaacaaaagacatccccctcaaaacacaagagg

SEQ ID NO: 340785 - DNA, 75 bp, Artificial Sequence
  Synthetic
aaacggaccaaatatcggaggacgaagaaatcgaaacatcactcccgaaagaagaccacctcaagcagcagctcc

SEQ ID NO: 340786 - DNA, 75 bp, Artificial Sequence
  Synthetic
agcgaacgagacagtactacagggagggaatcagaaagctcctaaaaacaaaaaaattattccccctgtaagaga

SEQ ID NO: 340787 - DNA, 75 bp, Artificial Sequence
  Synthetic
catgtttggtaaaccatacaaattaaatcgtagatttactagtaaagaatttgaacaagagttagaggacgctag

SEQ ID NO: 340788 - DNA, 75 bp, Artificial Sequence
  Synthetic
aatttggaaaagacgccctagatattatataaatgatatgcctgactataaacttgatgtactagaacctcttgt

SEQ ID NO: 340789 - DNA, 75 bp, Artificial Sequence
  Synthetic
aaacttcaatgtaaacttttcattaaactacaaattctaagccagcaaatattcacttgtcggtgtcagtttata

SEQ ID NO: 340790 - DNA, 75 bp, Artificial Sequence
  Synthetic
taagtaaaaactttaataaacatccactacctcccaaatacgcaggcgcaaagggggctccgcccccttacaccc

SEQ ID NO: 340791 - DNA, 75 bp, Artificial Sequence; identical to SEQ ID NO: 336248
  Synthetic

SEQ ID NO: 340792 - DNA, 75 bp, Artificial Sequence
  Synthetic
atataaatattcataaaggaaaccactaattagaattgccgaccacaaacagacatatgcaaattaacttccgta

SEQ ID NO: 340793 - DNA, 75 bp, Artificial Sequence
  Synthetic
aaacacacacttacttccccaaaaattaattagtaatcaccatcatttccgtgagtcacaacaactataaaacta

SEQ ID NO: 340794 - DNA, 75 bp, Artificial Sequence
  Synthetic
actacaatgacgaatggctgagtttatgccgctagacggagagaagacaggttactgatcttcgctaactcaggg

SEQ ID NO: 340795 - DNA, 75 bp, Artificial Sequence
  Synthetic
cgggagccgaaggtgagtgaaaccaccgaagtctaggggcaattcgggctgagttagtctagcggaccgggcaag

SEQ ID NO: 340796 - DNA, 75 bp, Artificial Sequence
  Synthetic
aaacttaaaataacaataattattttattacagatgaactttgagtatccggactactcaccaaaagaactacaa

SEQ ID NO: 340797 - DNA, 75 bp, Artificial Sequence
  Synthetic
ctacaatggattaacaacattgttcatactcacgacctgctctgcaaatgcaccaaaccacttgaacatacaatt

SEQ ID NO: 340798 - DNA, 75 bp, Artificial Sequence
  Synthetic
catggaattataaaacaagaaccaaaccttcgcctggaaaaagaaacaaaaaaattacttgaaaaatgccttact

SEQ ID NO: 340799 - DNA, 75 bp, Artificial Sequence
  Synthetic
tctacagaagatggttccctcgtagaagacgctttagacggtcttggagacggagaattagaggcccttttcgca

SEQ ID NO: 340800 - DNA, 75 bp, Artificial Sequence
  Synthetic
gaaaatactggagaagacactgggtaagacgctattctcgaaagagaaaactttctaaattaaacatcaaagaat

SEQ ID NO: 340801 - DNA, 75 bp, Artificial Sequence
  Synthetic
ggcaacccataacaattagaaaaacaaaagtaaaaggactttacccagcatttctatgtaatgatcaaagaatag

SEQ ID NO: 340802 - DNA, 75 bp, Artificial Sequence
  Synthetic
gcaataatgccattcaatacttagactctatagcacctcaccattttcctggaggaggaggatttggaataatac

SEQ ID NO: 340803 - DNA, 75 bp, Artificial Sequence
  Synthetic
aatttactttgcaaggcctttatgaacaatttataaaagcaacaaactggtggactcaaacaaactgttctttac

SEQ ID NO: 340804 - DNA, 75 bp, Artificial Sequence
  Synthetic
ctttaataagatataacttttgtaaactaaaattttatagaactgcaaatgttgactatgttgttaaaataataa

SEQ ID NO: 340805 - DNA, 75 bp, Artificial Sequence
  Synthetic
gatgttatcctttaaaagctacacatgatctttatatgcaaactcaaccaagtatattaatgagagataagcaca

SEQ ID NO: 340806 - DNA, 75 bp, Artificial Sequence
  Synthetic
gcatattaattccttgcatgaaaaacggtagaaaccgcaaaacttacaaaacaataaaagttaggccacccacac

SEQ ID NO: 340807 - DNA, 75 bp, Artificial Sequence
  Synthetic
aaatgacaaacggttggttctttcaaaaggacctttgcaactttccgcttttagtaatactagctactgcagcaa

SEQ ID NO: 340808 - DNA, 75 bp, Artificial Sequence
  Synthetic
gctttgaccgttactacacaaactctaaagctaaatcaacaactataggctttatttcactaaacactttaacat

SEQ ID NO: 340809 - DNA, 75 bp, Artificial Sequence
  Synthetic
ttcaataccataattggcaagaccccccaaccacaggctataaaccacaagacaacatgtggttttggggaacac

SEQ ID NO: 340810 - DNA, 75 bp, Artificial Sequence
  Synthetic
taaatggatcagacgatccaaatgaagaacctttaacaaacctaatttacttaggaggcactaataaccacacca

SEQ ID NO: 340811 - DNA, 75 bp, Artificial Sequence
  Synthetic
aaggaattccagttaaaaatcaatccaactatgcatcacaaccaaatatgtggggcaatatatttcatgaagact

SEQ ID NO: 340812 - DNA, 75 bp, Artificial Sequence
  Synthetic
atttatttggaacatcacaaatatatgttagtaacaaaacacctcaagaagtagtaaattacatagtgagtcacc

SEQ ID NO: 340813 - DNA, 75 bp, Artificial Sequence
  Synthetic
aaactcaaaaagtaaaagagtacactggaataactccaagaacactgcctctaacagtagaatgcagatacaatc

SEQ ID NO: 340814 - DNA, 75 bp, Artificial Sequence
  Synthetic
catttaatgacaaatccacaggtaacaacacattttttgtaagcaaccacgcagatcaaactaaatggcaaccaa

SEQ ID NO: 340815 - DNA, 75 bp, Artificial Sequence
  Synthetic
tagacaacccagatacacaaacacctaatttaccaatatggttaacaacatggggcttaatggactggtataaaa

SEQ ID NO: 340816 - DNA, 75 bp, Artificial Sequence
  Synthetic
aagcaggaataataagccagcctgaactaaactatatggtagtttttgaatgtccatatataagtagtaacccaa

SEQ ID NO: 340817 - DNA, 75 bp, Artificial Sequence
  Synthetic
aactaaaatattatgtacctatagatgacacaatgcaaactggacaaagtccatacatagaagtactatcacaat

SEQ ID NO: 340818 - DNA, 75 bp, Artificial Sequence
  Synthetic
cagatgaaaaacattggtacccaaaaggctcttttcaaattaaaactttaaatactataacatcatgtggcccag

SEQ ID NO: 340819 - DNA, 75 bp, Artificial Sequence
  Synthetic
gtactgtaaaattagataatgataaatcttgtgaagcacattttgaatatgactttcgttttaagattggaggat

SEQ ID NO: 340820 - DNA, 75 bp, Artificial Sequence
  Synthetic
gtccccctgcaatggaaaaactctgtgacccttcaaaacaaaacaaatatcccatacccaatactaagctccaaa

SEQ ID NO: 340821 - DNA, 75 bp, Artificial Sequence
  Synthetic
caacttcgttacagattccagcatcagccattgaaacctatctctacaactttgacgaaagaaaaggactcctta

SEQ ID NO: 340822 - DNA, 75 bp, Artificial Sequence
  Synthetic
cagaaaaagctactaaacgaatcaaaaaagactatggaactgaacaaactattttgccgtttacaggaacagcaa

SEQ ID NO: 340823 - DNA, 75 bp, Artificial Sequence
  Synthetic
tggacctcccgacaccaatccaaagcccaccacaggaccaaacatcgtcagaggaagaagaagagacgacacaag

SEQ ID NO: 340824 - DNA, 75 bp, Artificial Sequence
  Synthetic
agctccagctcatcagactccgaaggaaacaacgactcctcaagcagcgaatcctccagctattagacatacaaa

SEQ ID NO: 340825 - DNA, 75 bp, Artificial Sequence
  Synthetic
gtatagaataattcacagtaaagtaaaaatagatatgtttggagaaagacctcctaaaaacaggagaatgactcc

SEQ ID NO: 340826 - DNA, 75 bp, Artificial Sequence
  Synthetic
tcaagaaagagaagaagagctactactagctaaaatatttcaaagacctccaagagactatatactagaccgccc

SEQ ID NO: 340827 - DNA, 75 bp, Artificial Sequence
  Synthetic
attttacccctacgtaccaactcctccacaaaaatacatggtaaactttgaccttaatcctcccctataaacacc

SEQ ID NO: 340828 - DNA, 75 bp, Artificial Sequence
  Synthetic
tatgtaaatattcaactcttcaataaacaaggccagcaaatattcacttgtcggtgtccatttattaaagtttca

SEQ ID NO: 340829 - DNA, 75 bp, Artificial Sequence
  Synthetic
acttaaataaacatccaccactctcccaagtatgcaggcctaaaaaggggctccgccccttaaacccctaggggg

SEQ ID NO: 340830 - DNA, 75 bp, Artificial Sequence
  Synthetic
gggctccgccccttaaacccctagggggctccgccccctaaaacccccaagggggctccgcccccttacaccccc

SEQ ID NO: 340831 - DNA, 75 bp, Artificial Sequence
  Synthetic
gacacttccgggttcagcaggctcaatttggctcgcttcgctcgcaccacgtttgctgccaggcggacctgattg

SEQ ID NO: 340832 - DNA, 75 bp, Artificial Sequence
  Synthetic
atttggctcgcttcgctcgcaccacgtttgctgccaggcggacctgattgaagactgaaaaccgttaaattcaaa

SEQ ID NO: 340833 - DNA, 75 bp, Artificial Sequence
  Synthetic
acctttaaaacaagtatcggagaccccagcacaatcccatgcccctacggaccaggggaagcccctcaacacctc

SEQ ID NO: 340834 - DNA, 75 bp, Artificial Sequence
  Synthetic
aagactgaaaaccgttaaattcaaatttgaaaatggcgggcaaaatggctgccagggggcggagattatgcaaat

SEQ ID NO: 340835 - DNA, 75 bp, Artificial Sequence
  Synthetic
gacactctcaaaaaattacttgaaatccccacagactcggaggaagagaaagcataccccctccttgggccaaaa

SEQ ID NO: 340836 - DNA, 75 bp, Artificial Sequence
  Synthetic
actcctccagcatgtccagcgactggtaaagagattcaggaccctatagataaatatagaaacttagcagacccc

SEQ ID NO: 340837 - DNA, 75 bp, Artificial Sequence
  Synthetic
cacgagactcactgcaagtgcggtaactggagaaaccacctgtggacgctatgcgctttagacgacgcagatttg

SEQ ID NO: 340838 - DNA, 75 bp, Artificial Sequence
  Synthetic
tatgggaggcgttggagacggactgcctggagacgtcggcgggtaaggagatggcggcgttccgtcttccgtaga

SEQ ID NO: 340839 - DNA, 75 bp, Artificial Sequence
  Synthetic
cctggagacgtcggcgggtaaggagatggcggcgttccgtcttccgtagagggggacgtagagcgcgcccctacc

SEQ ID NO: 340840 - DNA, 75 bp, Artificial Sequence
  Synthetic
agtgaggagagtagtaattaaggggtggtggccactgatccaatgcatggagggtatggagtacctgagatacag

SEQ ID NO: 340841 - DNA, 75 bp, Artificial Sequence
  Synthetic
tggtggccactgatccaatgcatggagggtatggagtacctgagatacagaccgatgtacaatattgagaaaaga

SEQ ID NO: 340842 - DNA, 75 bp, Artificial Sequence
  Synthetic
gagtgttcagtgaggacatgggctacctgatgcagtacggtggaggatgggcctcaggaacaatttcccttaagg

SEQ ID NO: 340843 - DNA, 75 bp, Artificial Sequence
  Synthetic
cctgatgcagtacggtggaggatgggcctcaggaacaatttcccttaagggtttattcaatgagcacgaactgtg

SEQ ID NO: 340844 - DNA, 75 bp, Artificial Sequence
  Synthetic
gacggaatggacctagccagatacttcgggtgctcgattacactgtacccagaggaaaatcaggattatttgttc

SEQ ID NO: 340845 - DNA, 75 bp, Artificial Sequence
  Synthetic
agaggaaaatcaggattatttgttctggtttgacacagaattcgaccagcaacaactgattaacttgcaggaata

SEQ ID NO: 340846 - DNA, 75 bp, Artificial Sequence
  Synthetic
gcgaaaaactccagattaatagcggctaaaagtagaatgccaattaggaggagagtgaagagaattttcataccc

SEQ ID NO: 340847 - DNA, 75 bp, Artificial Sequence
  Synthetic
ggcagtttcaaaaagacctagcagactaccccctctttaactgggcctgtatctgcattgacatggaaaagccct

SEQ ID NO: 340848 - DNA, 75 bp, Artificial Sequence
  Synthetic
ctaccccctctttaactgggcctgtatctgcattgacatggaaaagcccttcgattacacaggggcatggagaaa

SEQ ID NO: 340849 - DNA, 75 bp, Artificial Sequence
  Synthetic
gtttgctgccaggcggacctgattgaagactgaaaaccgttaaattcaaacttcaaaatggcgccaaaagatgat

SEQ ID NO: 340850 - DNA, 75 bp, Artificial Sequence
  Synthetic
gcatcaggggacatggaatacatagaaaaatgggggagaatcccaccaacaggagactggcaactaccgtcatcc

SEQ ID NO: 340851 - DNA, 75 bp, Artificial Sequence
  Synthetic
aggagactggcaactaccgtcatccagtgtgatgacacaaaacggaaacaacccgaactggaagcctagagacgc

SEQ ID NO: 340852 - DNA, 75 bp, Artificial Sequence
  Synthetic
tactggacatcagatggcagtacaaaaacatgcaattggtgcacaatccacaacacaccgataaacagatggaga

SEQ ID NO: 340853 - DNA, 75 bp, Artificial Sequence
  Synthetic
aaacatgcaattggtgcacaatccacaacacaccgataaacagatggagaaaaaaggaagcggcagcagttcagg

SEQ ID NO: 340854 - DNA, 75 bp, Artificial Sequence
  Synthetic
aagagtatgctcagagcaggagacatactacagatggcaacagggagagtttacgggacagttcaaacagcagtg

SEQ ID NO: 340855 - DNA, 75 bp, Artificial Sequence
  Synthetic
gtggccaggaggggggacagaccacgcactatgtgtgatagacgcaacaggaacaaaggcattagacaatccaga

SEQ ID NO: 340856 - DNA, 75 bp, Artificial Sequence
  Synthetic
gcactatgtgtgatagacgcaacaggaacaaaggcattagacaatccagacgtatatgtactgacatggaatggt

SEQ ID NO: 340857 - DNA, 75 bp, Artificial Sequence
  Synthetic
ttcaggtaggagagcatggcaggacacagacttcggaaaaattagactaccaaaaacaggccacgacatagactt

SEQ ID NO: 340858 - DNA, 75 bp, Artificial Sequence
  Synthetic
acagacttcggaaaaattagactaccaaaaacaggccacgacatagactttggacataaaactagattcggacca

SEQ ID NO: 340859 - DNA, 75 bp, Artificial Sequence
  Synthetic
aagagtgccaccacagggagatagtgagctgccgccacaaagtgaatttaaaagtggcaccgacaataaaaacta

SEQ ID NO: 340860 - DNA, 75 bp, Artificial Sequence
  Synthetic
aattccgtaatgacccaccaaaacctatcaatatttgggtgaaatacaagttcttttttcagttcggcggcatgt

SEQ ID NO: 340861 - DNA, 75 bp, Artificial Sequence
  Synthetic
tccaggaacttctaacccgacctatcctgtccggatgggaggagcagttacacaccccaaatacgccggtcaagg

SEQ ID NO: 340862 - DNA, 75 bp, Artificial Sequence
  Synthetic
gctcaaggtatcaccgctgcctctctcagagccatcagtgcagttccacccagatcctacagccagagtgcgttt

SEQ ID NO: 340863 - DNA, 75 bp, Artificial Sequence
  Synthetic
caagaaaggcagataatgacaatcctacagtgtccgcgtgggcatttgagggaaaatggacaactactgggacag

SEQ ID NO: 340864 - DNA, 75 bp, Artificial Sequence
  Synthetic
tacagtgtccgcgtgggcatttgagggaaaatggacaactactgggacagtactagcggatgtttttaagataaa

SEQ ID NO: 340865 - DNA, 75 bp, Artificial Sequence
  Synthetic
aggaaggagaggaaaccgaggaaacctcgtgtgagagctccattacgagtgccgaaagctctactgaaggagatg

SEQ ID NO: 340866 - DNA, 75 bp, Artificial Sequence
  Synthetic
ctcgtgtgagagctccattacgagtgccgaaagctctactgaaggagatggatcgtctgaggatgaggaacgaag

SEQ ID NO: 340867 - DNA, 75 bp, Artificial Sequence
  Synthetic
aaacgcttgcaattctaacactgcctccgcgtattcattgggggggtccgggggggcttgcccccccgttagctg

SEQ ID NO: 340868 - DNA, 75 bp, Artificial Sequence
  Synthetic
ggttaccgcactaactccctgccaagtgaaactcggggacgagtgagtacgggacatcccgtgtaatggctacat

SEQ ID NO: 340869 - DNA, 75 bp, Artificial Sequence
  Synthetic
gggacatcccgtgtaatggctacataactacccggctttgcttcgacagtggccgtggctcgaccctcacacaac

SEQ ID NO: 340870 - DNA, 75 bp, Artificial Sequence
  Synthetic
acagtggccgtggctcgaccctcacacaacactgcaggtagggggcgcaattgggatcgtttcaaaactatggcc

SEQ ID NO: 340871 - DNA, 75 bp, Artificial Sequence
  Synthetic
cctacacctctccatgggaggatgccgccccccaaaccccccgcgtcggatggggggggctgcgccccccccaaa

SEQ ID NO: 340872 - DNA, 75 bp, Artificial Sequence
  Synthetic
taatgacagggctcaccggaaaggctgcaaaattacagctaaaaccacatcgctaacacaataaaccacaagata

SEQ ID NO: 340873 - DNA, 75 bp, Artificial Sequence
  Synthetic
ttacaggaaactgcaataaattaagaaataaatttcacataaccacaaaatttcaataaaaccacaggaaactct

SEQ ID NO: 340874 - DNA, 75 bp, Artificial Sequence
  Synthetic
gcaaaaaaaaggaagtaaataccattggctgaatcagaagtcctcattagcatactaaatcaaccaatcagaaac

SEQ ID NO: 340875 - DNA, 75 bp, Artificial Sequence
  Synthetic
aagtgcgcagacgaatggctgagtttatgccgcaggtggtagacacgaacacccgctgagtgtctaaccgcctgg

SEQ ID NO: 340876 - DNA, 75 bp, Artificial Sequence
  Synthetic
tatgccgcaggtggtagacacgaacacccgctgagtgtctaaccgcctgggcgggtgccggagctccagagagcg

SEQ ID NO: 340877 - DNA, 75 bp, Artificial Sequence
  Synthetic
ggtaacctgcggaaccgggcccccctcgatggaggagagatggctgacggtagcgtactgcgcgcacggattatt

SEQ ID NO: 340878 - DNA, 75 bp, Artificial Sequence
  Synthetic
tcgatggaggagagatggctgacggtagcgtactgcgcgcacggattattctgcgactgtaaagaaccaaaaaaa

SEQ ID NO: 340879 - DNA, 75 bp, Artificial Sequence
  Synthetic
catcttgaaaaatgccttacagacgctatagaagacgccggaggagacccacacggagatggaggcaccgaagat

SEQ ID NO: 340880 - DNA, 75 bp, Artificial Sequence
  Synthetic
tggatatacaaaaaacaagggagcagaatattctcggaggacatgggttaccttatgcagtacggtggaggatgg

SEQ ID NO: 340881 - DNA, 75 bp, Artificial Sequence
  Synthetic
gaatattctcggaggacatgggttaccttatgcagtacggtggaggatgggcatcaggaacaatatccttaaagg

SEQ ID NO: 340882 - DNA, 75 bp, Artificial Sequence
  Synthetic
ggacccgctactttcgatatcggcatcgacgcccttatcgccgccgcagacgctataaggtaaggagacggagga

SEQ ID NO: 340883 - DNA, 75 bp, Artificial Sequence
  Synthetic
gttcccaccaactataagaaactgttttattaagggaatctggccgttgagctacggacactggctccgtacctg

SEQ ID NO: 340884 - DNA, 75 bp, Artificial Sequence
  Synthetic
tttattaagggaatctggccgttgagctacggacactggctccgtacctgtctccctatgagaaaagaaaacgga

SEQ ID NO: 340885 - DNA, 75 bp, Artificial Sequence
  Synthetic
tctccctatgagaaaagaaaacggactcatatttctgggcggtggaatagactggactgtgtggactttacaaaa

SEQ ID NO: 340886 - DNA, 75 bp, Artificial Sequence
  Synthetic
cttatataatgaaaaacttaattggaggaatgtttggactgcttcaaatgatggaatggaatttgctcgatttag

SEQ ID NO: 340887 - DNA, 75 bp, Artificial Sequence
  Synthetic
aggaatgtttggactgcttcaaatgatggaatggaatttgctcgatttagatatacaaaatttaaattttttaga

SEQ ID NO: 340888 - DNA, 75 bp, Artificial Sequence
  Synthetic
catgggaccaagacataccctgtaaacctctaccatatactaatctacatcctttagtcatgttactaaaaaaac

SEQ ID NO: 340889 - DNA, 75 bp, Artificial Sequence
  Synthetic
cctttagtcatgttactaaaaaaacaacataaagttgtactaagtaaacaggaatgtaatcctagaaaaaaagac

SEQ ID NO: 340890 - DNA, 75 bp, Artificial Sequence
  Synthetic
gcatcaggtgacatggaatacatagaaaagtggggaagaattccaccaacaggagactggaaactcccagcctcc

SEQ ID NO: 340891 - DNA, 75 bp, Artificial Sequence
  Synthetic
cacctccaaaactaacatcacaatggaggctatctagagaactatcaaaaatgccacttgttagactaggattta

SEQ ID NO: 340892 - DNA, 75 bp, Artificial Sequence
  Synthetic
gcttaatagactttaaagagccatggctagagggttatggaaatgccttttacagcactttaggatatgaagcta

SEQ ID NO: 340893 - DNA, 75 bp, Artificial Sequence
  Synthetic
ttggtgtcaatgtaaatactactggatatatgacagtggaataggtaaccacgtatacgttgtcatgctacaaaa

SEQ ID NO: 340894 - DNA, 75 bp, Artificial Sequence
  Synthetic
ggactgtgcattatagacgcaacaggaacaaaagcattagataacccagacgtgtatgtgcttaaatggggatca

SEQ ID NO: 340895 - DNA, 75 bp, Artificial Sequence
  Synthetic
agaggcaggagatgaaccaggagatttaataacaaaacaaaatacaataacagatatagaacaaataggagaagg

SEQ ID NO: 340896 - DNA, 75 bp, Artificial Sequence
  Synthetic
cattgacatactggggaataagcacatctggaaacagaagctggcaggacgcagacttcggaaaaatacagttac

SEQ ID NO: 340897 - DNA, 75 bp, Artificial Sequence
  Synthetic
atctggaaacagaagctggcaggacgcagacttcggaaaaatacagttaccgaaggccccgcacgacgtcgactt

SEQ ID NO: 340898 - DNA, 75 bp, Artificial Sequence
  Synthetic
ggaagatcagagagagatctaaaagcactagcaactacaaatactaacattaaaaacgaatacaacgccaatcca

SEQ ID NO: 340899 - DNA, 75 bp, Artificial Sequence
  Synthetic
ttctgcgtgaaaaacccaccgtgtgagttcagacaggacccaccaaaccccattaatatctgggttaaatataaa

SEQ ID NO: 340900 - DNA, 75 bp, Artificial Sequence
  Synthetic
aacagcaaaaaacttaaaataggcataataggatgggcatcaagtaattacacagccctaacctcatcacaaaca

SEQ ID NO: 340901 - DNA, 75 bp, Artificial Sequence
  Synthetic
aaagctcatacagaatatcacatgtactacaaaactcaggacacacaggaggagcagcacaaatagataacctct

SEQ ID NO: 340902 - DNA, 75 bp, Artificial Sequence
  Synthetic
actacaaaactcaggacacacaggaggagcagcacaaatagataacctctgggaaaacggttggaaaaactcaaa

SEQ ID NO: 340903 - DNA, 75 bp, Artificial Sequence
  Synthetic
aaaaacaacctagattttagcaaaagagctctctgcatcctaagaaataacatgtttttaggaaaacaaccagtg

SEQ ID NO: 340904 - DNA, 75 bp, Artificial Sequence
  Synthetic
tctttggacccctagtagaaaaagctaattgggaagccgcagaagctacagtacaactaaaaccagaactaaaag

SEQ ID NO: 340905 - DNA, 75 bp, Artificial Sequence
  Synthetic
taattgggaagccgcagaagctacagtacaactaaaaccagaactaaaagactataatattttaatgagatataa

SEQ ID NO: 340906 - DNA, 75 bp, Artificial Sequence
  Synthetic
actataatattttaatgagatataactttcgatttcagtggggaggacacggaacagaaacctttaaaacaagca

SEQ ID NO: 340907 - DNA, 75 bp, Artificial Sequence
  Synthetic
cgctcgctcgcaccagttgctgcaggcgactgatggagactgaaaccgttaattcaaatctgaaatggcgcgcaa

SEQ ID NO: 340908 - DNA, 75 bp, Artificial Sequence
  Synthetic
tacacttcggtcggagctcattgctcgctcgctcgcaccagttgctgcaggcgactgatggagactgaaaccgtt

SEQ ID NO: 340909 - DNA, 75 bp, Artificial Sequence
  Synthetic
cccctacggccccggagaccctccccaacttgccgtgcgtgaccccaccaaggtacacgagggggtcctcaacgc

SEQ ID NO: 340910 - DNA, 75 bp, Artificial Sequence
  Synthetic
aggtacacgagggggtcctcaacgcgtgggattatgactatgatggcattgttagaaaagacactctcaaaaaat

SEQ ID NO: 340911 - DNA, 75 bp, Artificial Sequence
  Synthetic
ggaggagtcaaatctgattggtcgggagctcaagtcctcatttgcatagggtgtaaccaatcagaattaaggcgt

SEQ ID NO: 340912 - DNA, 75 bp, Artificial Sequence
  Synthetic
gttagaaaagacactctcaaaaaattgcttgaaatccccacagactcggaggaagagaaagcgtacccccccctt

SEQ ID NO: 340913 - DNA, 75 bp, Artificial Sequence
  Synthetic
cagcgactggtaaagagattcaggaccctatagataaatatagaaacttagcagacccctcactaaatgtcacag

SEQ ID NO: 340914 - DNA, 75 bp, Artificial Sequence
  Synthetic
gcagacccctcactaaatgtcacaggacacatggaaaactttatgcgcttacacgtacaaaacatacacgagata

SEQ ID NO: 340915 - DNA, 75 bp, Artificial Sequence
  Synthetic
acacgtacaaaacatacacgagataagagctaaaaatgctaaaagaaacctcaataaacaatacttttctgatta

SEQ ID NO: 340916 - DNA, 75 bp, Artificial Sequence
  Synthetic
atagcggcctgctgtgtccaatctatcattcctacaccccttcaaaatggcggcgggtcacaaaatggcggaggg

SEQ ID NO: 340917 - DNA, 75 bp, Artificial Sequence
  Synthetic
caccccccatgcgggggctgcgccccctgcacccccccggccaagtcacaaaatggcgggcgcggctgggacaca

SEQ ID NO: 340918 - DNA, 75 bp, Artificial Sequence
  Synthetic
tcacaggatggtggccagtaatacagtgtatggacgggatggagtggataaaatacaagccgatggacttaagag

SEQ ID NO: 340919 - DNA, 75 bp, Artificial Sequence
  Synthetic
ggggacccccctgcacccccccatgcgggggctccgccccctgcacccccgggagggggggaaaccccccctcaa

SEQ ID NO: 340920 - DNA, 75 bp, Artificial Sequence
  Synthetic
cgccccctgcacccccgggagggggggaaaccccccctcaaccccccgcggggggcaagcccccctgcacccccc

SEQ ID NO: 340921 - DNA, 75 bp, Artificial Sequence
  Synthetic
attacaggaaactgcaataaatttagaaataaattacacataaccacctaaccacaggaaactctgcaaaaaagg

SEQ ID NO: 340922 - DNA, 75 bp, Artificial Sequence
  Synthetic
gaaccaatcagaagaacttcctcttttagactatataagtaagtgcgcagacgaatggctgagtttatgccgctg

SEQ ID NO: 340923 - DNA, 75 bp, Artificial Sequence
  Synthetic
tttaatagtgtgtaaacaaaagatgccaattagacggagagtaaagagtattttcataccgccaccggcacagtt

SEQ ID NO: 340924 - DNA, 75 bp, Artificial Sequence
  Synthetic
gtggtagacacgaacagagctgagtgtctaaccgcctgggcgggtgccggagctcctgagagcggagtcaagggg

SEQ ID NO: 340925 - DNA, 75 bp, Artificial Sequence
  Synthetic
gtctaaccgcctgggcgggtgccggagctcctgagagcggagtcaaggggcctatcgggcaggcggtaatccagc

SEQ ID NO: 340926 - DNA, 75 bp, Artificial Sequence
  Synthetic
aaagatggctgacggtagcgtactgcgcccacggattattttgcggctgtaaagacccgaaaaaacatcttgaaa

SEQ ID NO: 340927 - DNA, 75 bp, Artificial Sequence
  Synthetic
tgccaccagcagacgacttcaaggcaggaggggtgaacaaaaacttcagaccgacaggtattcagagaatatacc

SEQ ID NO: 340928 - DNA, 75 bp, Artificial Sequence
  Synthetic
ggagacggaggaaaaaagctccggtcatacaatggttccctcctagccggagaacctgcctcatagagggattct

SEQ ID NO: 340929 - DNA, 75 bp, Artificial Sequence
  Synthetic
ccgtacctgtctcccctttaggcggttaaatggactagtattcccgggtggaggttgtgactggagccagtggag

SEQ ID NO: 340930 - DNA, 75 bp, Artificial Sequence
  Synthetic
agcatcagaatttacaggagcatttcagcaagactggtggccagttagcggaacagagtaccctctatgtacaat

SEQ ID NO: 340931 - DNA, 75 bp, Artificial Sequence
  Synthetic
ctaaactggagaaatatatggacagctagtaatgttggaatggaattcgctagatttttaaaaggaaagttttac

SEQ ID NO: 340932 - DNA, 75 bp, Artificial Sequence
  Synthetic
ctagtaatgttggaatggaattcgctagatttttaaaaggaaagttttactttttcagacatccatggagaaatt

SEQ ID NO: 340933 - DNA, 75 bp, Artificial Sequence
  Synthetic
ccgacagtagaggtgtggtcatggaaagcaactataccgacatcagggacactgaaagactatttcggactcagt

SEQ ID NO: 340934 - DNA, 75 bp, Artificial Sequence
  Synthetic
accatgcaggccactaccttatcaaaacctgcatccactcctaatgctactaaaaaaacagcacaaaattgtact

SEQ ID NO: 340935 - DNA, 75 bp, Artificial Sequence
  Synthetic
agaaagcaaaaacctgtcacgttaaaattcaaacctccaccaaaactaacatcacaatggagactaagtagagaa

SEQ ID NO: 340936 - DNA, 75 bp, Artificial Sequence
  Synthetic
agaaccatgggtagaaggatggggaaatgcattttattccgtgctaggatatgaagcagtaaaagaccaaggaca

SEQ ID NO: 340937 - DNA, 75 bp, Artificial Sequence
  Synthetic
tactattggatctatgattcgggagtaggaaatgcagtatatgttataatgttaaaacgagaaacacaatcaaat

SEQ ID NO: 340938 - DNA, 75 bp, Artificial Sequence
  Synthetic
taggaaatgcagtatatgttataatgttaaaacgagaaacacaatcaaatccaggacagatggtacaaaacttcc

SEQ ID NO: 340939 - DNA, 75 bp, Artificial Sequence
  Synthetic
tgctatagatcacatagaactaataaacgaaggatggccatactggctatacttctacggaaaaagcgaacaaga

SEQ ID NO: 340940 - DNA, 75 bp, Artificial Sequence
  Synthetic
acccaaactctttaaaattaaaaataggaattgtaggatgggcctcttctaactatacaacaccaggcagtgtac

SEQ ID NO: 340941 - DNA, 75 bp, Artificial Sequence
  Synthetic
cgcttgcaattctaaatcagtgtccgtgtattcattggggggtccgggggggcttgcccgtgtagttgggttctc

SEQ ID NO: 340942 - DNA, 75 bp, Artificial Sequence
  Synthetic
catacaaggaggatacgtagcatgggcaggagggcaaggaaaatataacttaggagcaggatccatagacaatct

SEQ ID NO: 340943 - DNA, 75 bp, Artificial Sequence
  Synthetic
gggacgagtgagtgcgggacatcccgtgtaatggctacataactacccggctttgttcgacagtgccgtggctcg

SEQ ID NO: 340944 - DNA, 75 bp, Artificial Sequence
  Synthetic
acaccaaaaaggatggccaaataatcaaaactggcccaacacaaatgcagatgaaacaaactttaattggggact

SEQ ID NO: 340945 - DNA, 75 bp, Artificial Sequence
  Synthetic
gtgtaatggctacataactacccggctttgttcgacagtgccgtggctcgaccctcacacaacactgcagatagg

SEQ ID NO: 340946 - DNA, 75 bp, Artificial Sequence
  Synthetic
accctaaatactttagaccagaattaaaagactataacttaatcatgaaatatacctttaaatttcagtggggag

SEQ ID NO: 340947 - DNA, 75 bp, Artificial Sequence
  Synthetic
cccccgcgtcggatggggggggctgcgccccccccaaaccccccttgcccggggctgctgctgtcgcgagccccc

SEQ ID NO: 340948 - DNA, 75 bp, Artificial Sequence
  Synthetic
ctccaaggtacaaaacaccgtcctcaacccctgggactatgactgtgatgggattgttagaaaagatactctcaa

SEQ ID NO: 340949 - DNA, 75 bp, Artificial Sequence
  Synthetic
aacactgtaatagataaatatagaaacctagcagacccctcactcaatgtcacaggacacatggaaaaattcatg

SEQ ID NO: 340950 - DNA, 75 bp, Artificial Sequence
  Synthetic
aaataagagctaaaaatgctaaaaaatccctcaataaactttacttttctgattaatagcggcctcctgtgtcca

SEQ ID NO: 340951 - DNA, 75 bp, Artificial Sequence
  Synthetic
atccctcaataaactttacttttctgattaatagcggcctcctgtgtccaatctatttttcctacaccccttcaa

SEQ ID NO: 340952 - DNA, 75 bp, Artificial Sequence
  Synthetic
atctatttttcctacaccccttcaaaatggcgggagggacacaaaatggcggagggactaaggggggggcaagcc

SEQ ID NO: 340953 - DNA, 75 bp, Artificial Sequence
  Synthetic
ccccaccccccatgcggggctccgccctgcacccccctgctaagtcacaagatggcggcgcggctgggacacaaa

SEQ ID NO: 340954 - DNA, 75 bp, Artificial Sequence
  Synthetic
gaagtcctcattagaataagaaaaggaccaatcagaaacacttccccttttagagtatataagtaagtgcgcaga

SEQ ID NO: 340955 - DNA, 75 bp, Artificial Sequence
  Synthetic
ctttcgatatcggtatcgacgcgctcctcgccgccgccgcacaaaggtaaggagacggaggaggaaagctccggt

SEQ ID NO: 340956 - DNA, 75 bp, Artificial Sequence
  Synthetic
ctggtcaaactggacacaaataaaatactattggatctatgacacgggagtaggaaatgcagtatatgttatact

SEQ ID NO: 340957 - DNA, 75 bp, Artificial Sequence
  Synthetic
ccaggaaacatggcaacaacctttaaagcatcaggaggacagcatccagatgcaatagatcacattgaattaata

SEQ ID NO: 340958 - DNA, 75 bp, Artificial Sequence
  Synthetic
aaccaaggatggccttactggttatacttttatggtaaaagtgaacaagacattaaaaaagaggcacacagcgca

SEQ ID NO: 340959 - DNA, 75 bp, Artificial Sequence
  Synthetic
acccaaaatctaaaaaactaaaaataggaatagtaggatgggcatcttcaaactacacaacaacaggcagtgatc

SEQ ID NO: 340960 - DNA, 75 bp, Artificial Sequence
  Synthetic
aaaacagtggtggatcaacatcagctatacaaggtggatatgtagcatatgcagggtccggggtcataggagcag

SEQ ID NO: 340961 - DNA, 75 bp, Artificial Sequence
  Synthetic
atgtatactcagagataacatgcacttaggaagccaggaattagacgacgaaacaacaatgctaacactatttgg

SEQ ID NO: 340962 - DNA, 75 bp, Artificial Sequence
  Synthetic
aaacaacaatgctaacactatttggaccatttgtagaaaaagctaatccaatatttgcaacaacagaccctaaat

SEQ ID NO: 340963 - DNA, 75 bp, Artificial Sequence
  Synthetic
taatataatcatgaaatatgcctttaaatttcagtggggaggacatggcacagaaagatttaaaaccaacatcgg

SEQ ID NO: 340964 - DNA, 75 bp, Artificial Sequence
  Synthetic
gcgggatacaagacccctccaaggtacaaaacaccgtcctcaacccctgggactatgactgtgatgggattgtta

SEQ ID NO: 340965 - DNA, 75 bp, Artificial Sequence
  Synthetic
cgactcctcaagcacctccagcgggtgggaaagaggatgaaaacactgtaatagataaatacagaaacctagcag

SEQ ID NO: 340966 - DNA, 75 bp, Artificial Sequence
  Synthetic
tgtgtccaatctatttttcctacacacccttcacaatggcgggagggacacaaatggcggagggactaagggggg

SEQ ID NO: 340967 - DNA, 75 bp, Artificial Sequence
  Synthetic
ccccgcaccccccatgcgggggctccgcctcctgcacccccgggagggggggaaaccccccctcaaccccccgcg

SEQ ID NO: 340968 - DNA, 75 bp, Artificial Sequence
  Synthetic
tcatgacagggttcaccggaagggctgcaaaattacagctaaaaccacaagtctaacacaacaaaccacaaaata

SEQ ID NO: 340969 - DNA, 75 bp, Artificial Sequence
  Synthetic
tgcaaaattacagctaaaaccacaagtctaacacaacaaaccacaaaatattacaggaaactgcaataaatttag

SEQ ID NO: 340970 - DNA, 75 bp, Artificial Sequence
  Synthetic
ttacaggaaactgcaataaatttagaaataagttacacataaccaccaaaccacaggaaactctgcaaaaaggag

SEQ ID NO: 340971 - DNA, 75 bp, Artificial Sequence
  Synthetic
tggccgttgagctacggacactggttccgtacctgtctccctatgagaaggctaaacggactgattttcacgggt

SEQ ID NO: 340972 - DNA, 75 bp, Artificial Sequence
  Synthetic
gtttacaaaatttataccatgaaaaattaaactggagaaatatatggacagcatctaatgttggaatggaatttg

SEQ ID NO: 340973 - DNA, 75 bp, Artificial Sequence
  Synthetic
cttcttcagacacccctggagaagctatataattacttgggaccaagatataccatgcaaacctttaccatatca

SEQ ID NO: 340974 - DNA, 75 bp, Artificial Sequence
  Synthetic
tatataattacttgggaccaagatataccatgcaaacctttaccatatcaaaatttacacccgctactaatgctc

SEQ ID NO: 340975 - DNA, 75 bp, Artificial Sequence
  Synthetic
tatctcaaaaagactgtaatcctaacagaagacagaaacctgtaacattgaaaataagacctccaccaaaactaa

SEQ ID NO: 340976 - DNA, 75 bp, Artificial Sequence
  Synthetic
cagaagacagaaacctgtaacattgaaaataagacctccaccaaaactaacatcacagtggagactaagcagaga

SEQ ID NO: 340977 - DNA, 75 bp, Artificial Sequence
  Synthetic
ctaggagtcagtctcatagacctctcagaaccatggttagaaggctggggaaatgctttttacagcgtactagga

SEQ ID NO: 340978 - DNA, 75 bp, Artificial Sequence
  Synthetic
cagaaccatggttagaaggctggggaaatgctttttacagcgtactaggatatgaagctagcaagcattcaggaa

SEQ ID NO: 340979 - DNA, 75 bp, Artificial Sequence
  Synthetic
atatttctggatatatgacacaggagtaggaaatgcagtctatgtaattaaactaaaacaagatgtagatgataa

SEQ ID NO: 340980 - DNA, 75 bp, Artificial Sequence
  Synthetic
tcccggaacaatggcacaaaaatttgtaacaggaacaggacaacatccagatgctatagacagaatagaactaat

SEQ ID NO: 340981 - DNA, 75 bp, Artificial Sequence
  Synthetic
aaatgagggatggccttactggcttttcttttacggacaatcagaacaagacataaaaaaattagcacacgacca

SEQ ID NO: 340982 - DNA, 75 bp, Artificial Sequence
  Synthetic
ttcttttacggacaatcagaacaagacataaaaaaattagcacacgaccaagaaatagcaagagaatacgccaac

SEQ ID NO: 340983 - DNA, 75 bp, Artificial Sequence
  Synthetic
taggagtgataggatgggcgagcagtaattttacaacagcaggtagcgtacaaaatcaaacacttcaaacaccag

SEQ ID NO: 340984 - DNA, 75 bp, Artificial Sequence
  Synthetic
taattttacaacagcaggtagcgtacaaaatcaaacacttcaaacaccagaagccatacaaggtggatacgtagc

SEQ ID NO: 340985 - DNA, 75 bp, Artificial Sequence
  Synthetic
gctggatcaataacaaacttatacacagatgcatggccaggagaccaaaactggccacctctaaatagagaccaa

SEQ ID NO: 340986 - DNA, 75 bp, Artificial Sequence
  Synthetic
ctggccacctctaaatagagaccaaacaaactttaactggggcttaagaggactgtgtataatgagagataatat

SEQ ID NO: 340987 - DNA, 75 bp, Artificial Sequence
  Synthetic
gatgaatgtaccatgctcacactttttggaccttttgtggaaaaagcaaacacagcttttgctacaaatgaccct

SEQ ID NO: 340988 - DNA, 75 bp, Artificial Sequence
  Synthetic
aaatacttcagaccagaactcaaagactataatatagtaatgaaatatgcctttaaatttcagtggggaggccac

SEQ ID NO: 340989 - DNA, 75 bp, Artificial Sequence
  Synthetic
tcggagatcccagcaccataccatgtcccttcgaacccggggaacggtaccaccacggggtacaagaccccgcca

SEQ ID NO: 340990 - DNA, 75 bp, Artificial Sequence
  Synthetic
gcgacgactcctcaagcacctccagcgggtggtaaagagaatgaagacactgtgatagataaatatagaaaccta

SEQ ID NO: 340991 - DNA, 75 bp, Artificial Sequence
  Synthetic
cccccccgcaccccccctgcgggggctccgccccctgcacccccgggagggggggaaaccccccctcaacccccc

SEQ ID NO: 340992 - DNA, 75 bp, Artificial Sequence
  Synthetic
gacagggggcggagtttatgcaaattaatttatgcaaagtaggaggagctcgattttaatttatgcaaagtagga

SEQ ID NO: 340993 - DNA, 75 bp, Artificial Sequence
  Synthetic
cgattttaatttatgcaaagtaggaggagtcaaatctgattggacgggagctcaagtcttcatttgcatagggtg

SEQ ID NO: 340994 - DNA, 75 bp, Artificial Sequence
  Synthetic
cactaaactgaatataagtaagtgcagttccgaatggctgagtttatgccgccagcggtagacagaactgtctag

SEQ ID NO: 340995 - DNA, 75 bp, Artificial Sequence
  Synthetic
ctatgccggaacactgggaggaggcctggttggaagctaccaagggctggcacgaccttgactgccgctgcggta

SEQ ID NO: 340996 - DNA, 75 bp, Artificial Sequence
  Synthetic
gctcgccgatggagacgccgctttggccgccgccgtagacgctatagaaagagacgctatggatggaggagacgc

SEQ ID NO: 340997 - DNA, 75 bp, Artificial Sequence
  Synthetic
gccgccgccgtagacgctatagaaagagacgctatggatggaggagacgctactaccgctacagaccgcgttact

SEQ ID NO: 340998 - DNA, 75 bp, Artificial Sequence
  Synthetic
aaggcggcgttccgtctaccaacgaggtggacgtagagcgcgcccctaccgcatttctgcctttaatccaaaagt

SEQ ID NO: 340999 - DNA, 75 bp, Artificial Sequence
  Synthetic
ggtggacgtagagcgcgcccctaccgcatttctgcctttaatccaaaagtaatgcgtagagtggtaattagaggg

SEQ ID NO: 341000 - DNA, 75 bp, Artificial Sequence
  Synthetic
aaggtcaggaatcactaagatacagaccacttcagtgggacgtagagaaaagctggagaataaacacaactcttg

SEQ ID NO: 341001 - DNA, 75 bp, Artificial Sequence
  Synthetic
accacttcagtgggacgtagagaaaagctggagaataaacacaactcttgaggacaactatggatacttagtaca

SEQ ID NO: 341002 - DNA, 75 bp, Artificial Sequence
  Synthetic
gaggtaacactggaggggctgtatcaggagcacctactatggagaaactcgtggtcaaaaggaaacgatggaatg

SEQ ID NO: 341003 - DNA, 75 bp, Artificial Sequence
  Synthetic
aggagcacctactatggagaaactcgtggtcaaaaggaaacgatggaatggacttagtgagatacttcggctgca

SEQ ID NO: 341004 - DNA, 75 bp, Artificial Sequence
  Synthetic
tcaggactactggttttggtgggacacagactttaaggaattatatgcagagagtatcaaagaatactcacagcc

SEQ ID NO: 341005 - DNA, 75 bp, Artificial Sequence
  Synthetic
agagtatcaaagaatactcacagccatctgtaatgatgatggcaaaaagaacaaaaatagtgatcgcaagaagta

SEQ ID NO: 341006 - DNA, 75 bp, Artificial Sequence
  Synthetic
acaaaaatagtgatcgcaagaagtagagccccacatagaaggaaggtacgcaaaattttcataccgcctccaagt

SEQ ID NO: 341007 - DNA, 75 bp, Artificial Sequence
  Synthetic
aaactgacttttgcaatagaccactattcacatgggctgcaggactcatagacctccaaaaaccatttgacgcaa

SEQ ID NO: 341008 - DNA, 75 bp, Artificial Sequence
  Synthetic
gttagaacagagaaacgaggcaggagaaatgaaatacatagagctatggggacgagtgccaccccagggggacac

SEQ ID NO: 341009 - DNA, 75 bp, Artificial Sequence
  Synthetic
caaaaaccctcgggatataacccaaaatactacgtaaacccgggcgaggaaaaaccaatctacccagtaataata

SEQ ID NO: 341010 - DNA, 75 bp, Artificial Sequence
  Synthetic
aatactacgtaaacccgggcgaggaaaaaccaatctacccagtaataatatacgtagacatgaaagaccaaaaac

SEQ ID NO: 341011 - DNA, 75 bp, Artificial Sequence
  Synthetic
caacaagacgcttaacaggtggcgcagcgctcaggcaagcacattaaaaattggtgacttgcaggggctagtatt

SEQ ID NO: 341012 - DNA, 75 bp, Artificial Sequence
  Synthetic
agcgctcaggcaagcacattaaaaattggtgacttgcaggggctagtattaagacagctgatgaaccaagaaatg

SEQ ID NO: 341013 - DNA, 75 bp, Artificial Sequence
  Synthetic
ttacaaatgtattcctgcaaaggtggagaggtttcagattagcagtaatagacgcaagaaaggcagacacagaaa

SEQ ID NO: 341014 - DNA, 75 bp, Artificial Sequence
  Synthetic
gagaggtttcagattagcagtaatagacgcaagaaaggcagacacagaaaacccgacagtgcaaacttggaaggt

SEQ ID NO: 341015 - DNA, 75 bp, Artificial Sequence
  Synthetic
acagtgcttaaagaggttttcaatataaacctgaataatgagcagatgagacaggcagactttggaaaactaaac

SEQ ID NO: 341016 - DNA, 75 bp, Artificial Sequence
  Synthetic
ttaccaaaatccccacacgacattgactttggacaccacagtagatttggacctttctgtgtaaaaaacgaacca

SEQ ID NO: 341017 - DNA, 75 bp, Artificial Sequence
  Synthetic
agccaactaacctgtggtttcagtacaaatttctgtttcagtttggaggtgaataccaaccaccaacaggcatcc

SEQ ID NO: 341018 - DNA, 75 bp, Artificial Sequence
  Synthetic
ccgttggggtatcactgctgcctcttcccgagccctcagtgcagatacacccacggaagcaacgcaaagtgcact

SEQ ID NO: 341019 - DNA, 75 bp, Artificial Sequence
  Synthetic
tctccgaggggactcggaaaagaaaggagaggaaaccgaggaaacctcgtcatcgtccagtatcacgagtgccga

SEQ ID NO: 341020 - DNA, 75 bp, Artificial Sequence
  Synthetic
catcgtccagtatcacgagtgccgaaagctctactgaaggagatggatcgtctgatgatgaagagacaatcagac

SEQ ID NO: 341021 - DNA, 75 bp, Artificial Sequence
  Synthetic
tctgatgatgaagagacaatcagacgccgaaggaggacctggaagcgactcagacggatggtccgagagcagctt

SEQ ID NO: 341022 - DNA, 75 bp, Artificial Sequence
  Synthetic
cagacggatggtccgagagcagcttgaccgacgaatggaccacaagcgacagcgacttcattgacacccccatta

SEQ ID NO: 341023 - DNA, 75 bp, Artificial Sequence
  Synthetic
gaccgacgaatggaccacaagcgacagcgacttcattgacacccccattagacagggatgcctcaataaaaaaca

SEQ ID NO: 341024 - DNA, 75 bp, Artificial Sequence
  Synthetic
ttgcccccccgtaagctgggttaccgcactaactccctgccaagtgaaactcggggacgagtgagtgcgggacat

SEQ ID NO: 341025 - DNA, 75 bp, Artificial Sequence
  Synthetic
gtgggggggccaaggccccccctacacccccccatggggggctgccgccccccaaaccccccgcgtcggatgggg

SEQ ID NO: 341026 - DNA, 75 bp, Artificial Sequence
  Synthetic
tacacttccgggttcaggaggctcaatttggctcgcttcgctcgcaccacgtttgctgccaggcggacctgattg

SEQ ID NO: 341027 - DNA, 75 bp, Artificial Sequence
  Synthetic
gtttgctgccaggcggacctgattgaagactgaaaaccgttaaattcaaatttgaaaatggcgggcaaaatggcg

SEQ ID NO: 341028 - DNA, 75 bp, Artificial Sequence
  Synthetic
taatttatgcaaagtaggaggagctcgattttaatttatgcaaagtaggaggagtcaaatctgattggtcgggag

SEQ ID NO: 341029 - DNA, 75 bp, Artificial Sequence
  Synthetic
acttccgaatggctgagtttatgccgccagcggtagacagaactgtctagcgactgggcgggtgccggaggatcc

SEQ ID NO: 341030 - DNA, 75 bp, Artificial Sequence
  Synthetic
cagatccggagtcaaggggcctatcgggcaggagcagctgagcggagggcctatgcgggagaaagactactggga

SEQ ID NO: 341031 - DNA, 75 bp, Artificial Sequence
  Synthetic
tcgatccacgaccaccactgcacctgcggagactggcgtaaccacctctggacactatgcgctttagacgacgca

SEQ ID NO: 341032 - DNA, 75 bp, Artificial Sequence
  Synthetic
gacactatgcgctttagacgacgcagatttggccgccgccgccgctattaccgaaagagacgaggcggatggagg

SEQ ID NO: 341033 - DNA, 75 bp, Artificial Sequence
  Synthetic
gaccctggagacgctggcgggtaaggagatggcggcgttccgtcttccgtagagggggacgtagagcgcgcccct

SEQ ID NO: 341034 - DNA, 75 bp, Artificial Sequence
  Synthetic
gagatggcggcgttccgtcttccgtagagggggacgtagagcgcgcccctaccgcattagcgcttggaatcctaa

SEQ ID NO: 341035 - DNA, 75 bp, Artificial Sequence
  Synthetic
agagggggacgtagagcgcgcccctaccgcattagcgcttggaatcctaaagtagtgaggaactgtaaaataaca

SEQ ID NO: 341036 - DNA, 75 bp, Artificial Sequence
  Synthetic
tggaggggatggagtggatcaagtataagccgatggacttaagagtagaggcaaactggatattcaaaaaagaaa

SEQ ID NO: 341037 - DNA, 75 bp, Artificial Sequence
  Synthetic
taagccgatggacttaagagtagaggcaaactggatattcaaaaaagaaagcggcagcggtcgggttgagacgga

SEQ ID NO: 341038 - DNA, 75 bp, Artificial Sequence
  Synthetic
ggaggaggatggtctagtggagtgatcagcttagagggactcttcaatgaaaacagactgtggcgcaatatatgg

SEQ ID NO: 341039 - DNA, 75 bp, Artificial Sequence
  Synthetic
tcagcttagagggactcttcaatgaaaacagactgtggcgcaatatatggtccaagagcaacgatggtatggact

SEQ ID NO: 341040 - DNA, 75 bp, Artificial Sequence
  Synthetic
tagactataccccacagaccaccaggattacctattctggtatgacacagaatttgatgaacagcagagaaggca

SEQ ID NO: 341041 - DNA, 75 bp, Artificial Sequence
  Synthetic
gattacctattctggtatgacacagaatttgatgaacagcagagaaggcagctagatgaatacacacaacctagt

SEQ ID NO: 341042 - DNA, 75 bp, Artificial Sequence
  Synthetic
gactaatagtctgcaagaaaaaaatgcccataagaaggagggttaaatctatcttcatacctccaccatcacagt

SEQ ID NO: 341043 - DNA, 75 bp, Artificial Sequence
  Synthetic
gcccataagaaggagggttaaatctatcttcatacctccaccatcacagttaactacacagtggaaattccaaca

SEQ ID NO: 341044 - DNA, 75 bp, Artificial Sequence
  Synthetic
aactgggcatgcatatgcatagatatggacacaccatttgactacaatggagcttggagaaatgcctggtggcta

SEQ ID NO: 341045 - DNA, 75 bp, Artificial Sequence
  Synthetic
tggacacaccatttgactacaatggagcttggagaaatgcctggtggctaatgcgcagactgcaaaatggaaaca

SEQ ID NO: 341046 - DNA, 75 bp, Artificial Sequence
  Synthetic
aatacccctgacaggtgacactgaactaccagactatgatgaattcagagcagggggagtgaatcccaactacaa

SEQ ID NO: 341047 - DNA, 75 bp, Artificial Sequence
  Synthetic
ctaccagactatgatgaattcagagcagggggagtgaatcccaactacaacccgagaggtagacagaagatatac

SEQ ID NO: 341048 - DNA, 75 bp, Artificial Sequence
  Synthetic
agggcaacaagagagtggttaaatgggccacaatccacaaccaagcaatagagagatggcgaacaaaccaggcag

SEQ ID NO: 341049 - DNA, 75 bp, Artificial Sequence
  Synthetic
ggccacaatccacaaccaagcaatagagagatggcgaacaaaccaggcagaaataatgaaactcagcaccttgag

SEQ ID NO: 341050 - DNA, 75 bp, Artificial Sequence
  Synthetic
gaaagtgagacatattacaaatggacagcatcagagttcacggcagcattcagagcagactggtggcctccagga

SEQ ID NO: 341051 - DNA, 75 bp, Artificial Sequence
  Synthetic
cagcatcagagttcacggcagcattcagagcagactggtggcctccaggaggcacagaataccaattatgcacca

SEQ ID NO: 341052 - DNA, 75 bp, Artificial Sequence
  Synthetic
tccaaaggtagaggcatggtcatggaatggaaacattccaggcagtgggacactgaaggactactttggactcag

SEQ ID NO: 341053 - DNA, 75 bp, Artificial Sequence
  Synthetic
aatggaaacattccaggcagtgggacactgaaggactactttggactcagttcagggacgacctggcgggacaca

SEQ ID NO: 341054 - DNA, 75 bp, Artificial Sequence
  Synthetic
gaagtagtcataatgttgacttcggacacaaagctagatttggaccattttgtgtgaaaaacccgccaatagact

SEQ ID NO: 341055 - DNA, 75 bp, Artificial Sequence
  Synthetic
ttcaaaaaacaccccctaaccccttaaatatatgggttaaatacaccttctacttccagttcggtggcatgtacc

SEQ ID NO: 341056 - DNA, 75 bp, Artificial Sequence
  Synthetic
accccaaatacgccgggcaaggaggaatcacgacgcaaattggagatcaaggtatcaccgctgcctctatccgtg

SEQ ID NO: 341057 - DNA, 75 bp, Artificial Sequence
  Synthetic
ctacacgcagtcggcgttcctcaaagccccggaagccgagaaagaagaggaaagagagagtgagaccagtttcac

SEQ ID NO: 341058 - DNA, 75 bp, Artificial Sequence
  Synthetic
gctgacagacccgtggacaacaagcgacgacgattttcagagtgaccctgacccccttacaaataaacgcaaaaa

SEQ ID NO: 341059 - DNA, 75 bp, Artificial Sequence
  Synthetic
gccccccaaaccccccgcgtcggatggggggggctgcgccccccccaaaccccccttgcccggggctgtgccccg

SEQ ID NO: 341060 - DNA, 75 bp, Artificial Sequence
  Synthetic
taatgacagggttcaccggaaaggctgcaaaattacagctaaaaccacaatactaacacaataaaccacaaacta

SEQ ID NO: 341061 - DNA, 75 bp, Artificial Sequence
  Synthetic
tgcaaaattacagctaaaaccacaatactaacacaataaaccacaaactattacaggaaactgcaataaatttag

SEQ ID NO: 341062 - DNA, 75 bp, Artificial Sequence
  Synthetic
ttacaggaaactgcaataaatttagaaataaattacaaataaccaccaaaccacaggaaactctacaaaaaagag

SEQ ID NO: 341063 - DNA, 75 bp, Artificial Sequence
  Synthetic
gaccaatcagaaacacttccccttttagagtatataagtaagtgcgcagacgaatggctgagtttatgccgactg

SEQ ID NO: 341064 - DNA, 75 bp, Artificial Sequence
  Synthetic
gaaccgggccccccctccatggaagaaagatggctgacggtagcgtactgcgcccacggattattctgcggctgt

SEQ ID NO: 341065 - DNA, 75 bp, Artificial Sequence
  Synthetic
ccgtacctgtctcccctttagaagaaaaaatggactagtgtttacgggaggaggctgtgactggactcagtggag

SEQ ID NO: 341066 - DNA, 75 bp, Artificial Sequence
  Synthetic
taaaaaaacagcacaaattagtactctcacaacaaagctgtaaccctagcagaaaacagaaaccagtaactttaa

SEQ ID NO: 341067 - DNA, 75 bp, Artificial Sequence
  Synthetic
atcacaatggagactaagcagagaattagcaaaaatgcctttaattagattaggagtcagcttcatagacttaac

SEQ ID NO: 341068 - DNA, 75 bp, Artificial Sequence
  Synthetic
ttagcaaaaatgcctttaattagattaggagtcagcttcatagacttaacagaaccttgggtagaaggctgggga

SEQ ID NO: 341069 - DNA, 75 bp, Artificial Sequence
  Synthetic
acgaagcaacaaaacaacaaggacatatatcaaactgggcacaaatgaaatactactggatatatgatacaggag

SEQ ID NO: 341070 - DNA, 75 bp, Artificial Sequence
  Synthetic
tatatcaaactgggcacaaatgaaatactactggatatatgatacaggagtaggtaacgctgtctatgtaatatt

SEQ ID NO: 341071 - DNA, 75 bp, Artificial Sequence
  Synthetic
ccaggacaaatggtacaaaatttcccttcatccgggggacaacatccagatgctatagatcacatagaattaatt

SEQ ID NO: 341072 - DNA, 75 bp, Artificial Sequence
  Synthetic
cttcatccgggggacaacatccagatgctatagatcacatagaattaattaatgaaggatggccatactggctat

SEQ ID NO: 341073 - DNA, 75 bp, Artificial Sequence
  Synthetic
cataaaaagagaagcacacagcactgaaatagcaagagaatttacacaaaatccactctcactaaaactaaaaat

SEQ ID NO: 341074 - DNA, 75 bp, Artificial Sequence
  Synthetic
gaaatagcaagagaatttacacaaaatccactctcactaaaactaaaaataggagtagtaggatgggcatcatca

SEQ ID NO: 341075 - DNA, 75 bp, Artificial Sequence
  Synthetic
aaaacacaggaggaacaacatcagccatacaaggaggatacgtagcatgggcaggaggagcaggaaaatataact

SEQ ID NO: 341076 - DNA, 75 bp, Artificial Sequence
  Synthetic
catacaaggaggatacgtagcatgggcaggaggagcaggaaaatataacttaggagcgggatccatagataattt

SEQ ID NO: 341077 - DNA, 75 bp, Artificial Sequence
  Synthetic
caaaactggcctaacactaatgcagacgaaacaaactttaactggggattaagagcactctgcatacttagagat

SEQ ID NO: 341078 - DNA, 75 bp, Artificial Sequence
  Synthetic
acgaaacaaactttaactggggattaagagcactctgcatacttagagataacatgcacttaggaactcaagaaa

SEQ ID NO: 341079 - DNA, 75 bp, Artificial Sequence
  Synthetic
tagacgatgaaacaaccatgttaagcctcttcggacccttcgtagaaaaagctaacacagcactagcaacaacag

SEQ ID NO: 341080 - DNA, 75 bp, Artificial Sequence
  Synthetic
accctaaatactttagaccagaactaaaagactacaatttaacaatgaaatatgcctttaaattccagtggggag

SEQ ID NO: 341081 - DNA, 75 bp, Artificial Sequence
  Synthetic
agagccattatcagactccgaagaagagagcgttatctcaagcacgagcagtggatccagtcaagaagaggagac

SEQ ID NO: 341082 - DNA, 75 bp, Artificial Sequence
  Synthetic
aaataagagctaaaaatgctaaaaaatccctcaataaactttacttatctgattaaatagcggcctcctgtgtcc

SEQ ID NO: 341083 - DNA, 75 bp, Artificial Sequence
  Synthetic
tacacttccgggttcaggaggctcaatttggctcgcttcgctcgcaccacgtttgctgccaagcggacctgattg

SEQ ID NO: 341084 - DNA, 75 bp, Artificial Sequence
  Synthetic
atttggctcgcttcgctcgcaccacgtttgctgccaagcggacctgattgaggactgaaaaccgttaggttcaaa

SEQ ID NO: 341085 - DNA, 75 bp, Artificial Sequence
  Synthetic
gacagagggcggggtttatgcaaattaatttatgcaaagtaggaggagctggattttaatttatgcaaagtagga

SEQ ID NO: 341086 - DNA, 75 bp, Artificial Sequence
  Synthetic
ggagtcaaatctgattggtcgggaactcaagtcctcatttgcatagggtgtaaccaatcagaattaaggcgttcc

SEQ ID NO: 341087 - DNA, 75 bp, Artificial Sequence
  Synthetic
ctatgccggaacactgggaggaggcctggttagaagctaccaaaggctggcacgatctagactgccgctgcggta

SEQ ID NO: 341088 - DNA, 75 bp, Artificial Sequence
  Synthetic
aaggcggcgttccgtctaccgtagaggtggacgtagagcgcgcccctaccgtatttctgcctttaaccctaaaat

SEQ ID NO: 341089 - DNA, 75 bp, Artificial Sequence
  Synthetic
tggtggccgataatacagtgccttaaaggacaagaatccttaagatacagaccactgcagtgggatactgaaaaa

SEQ ID NO: 341090 - DNA, 75 bp, Artificial Sequence
  Synthetic
aaggacaagaatccttaagatacagaccactgcagtgggatactgaaaaacagtggagagtgagaaatgatttcg

SEQ ID NO: 341091 - DNA, 75 bp, Artificial Sequence
  Synthetic
gtacggagggggatggggaagtggagaagtgacactggaaaatctataccaggaacaccttctgtggcgaaactc

SEQ ID NO: 341092 - DNA, 75 bp, Artificial Sequence
  Synthetic
gaagtgacactggaaaatctataccaggaacaccttctgtggcgaaactcctggtcaaaaggaaatgatggaatg

SEQ ID NO: 341093 - DNA, 75 bp, Artificial Sequence
  Synthetic
tagtatacctgtaccctctaaaagacgcagactactggttttggtgggacacagacttcaaagaactatacgcag

SEQ ID NO: 341094 - DNA, 75 bp, Artificial Sequence
  Synthetic
cgcagactactggttttggtgggacacagacttcaaagaactatacgcagaaatgattaaagaatactcacagcc

SEQ ID NO: 341095 - DNA, 75 bp, Artificial Sequence
  Synthetic
acaaaaattataattgcaagagaaagggcgccccacagaaggaaagtgagaaaaatattcataccaccaccaagt

SEQ ID NO: 341096 - DNA, 75 bp, Artificial Sequence
  Synthetic
gggcgccccacagaaggaaagtgagaaaaatattcataccaccaccaagtagagacactactcagtggcaattcc

SEQ ID NO: 341097 - DNA, 75 bp, Artificial Sequence
  Synthetic
attcacacgggcagcaggactaatagagatgcaaaaacccttcgatgcaaatggtgcttttagaaatgcgtggtg

SEQ ID NO: 341098 - DNA, 75 bp, Artificial Sequence
  Synthetic
gagatgcaaaaacccttcgatgcaaatggtgcttttagaaatgcgtggtggctggaacaaagaacagaccaggga

SEQ ID NO: 341099 - DNA, 75 bp, Artificial Sequence
  Synthetic
gcagagtaccaccacagggagacagtgagttacctaaaaagtcagacttttctaaaagcggtgacaacccaaact

SEQ ID NO: 341100 - DNA, 75 bp, Artificial Sequence
  Synthetic
aaacatctaccccattatcatatacgtagatcagaaggaccaacaggcacgtaaaaaatactgcgtttgctacaa

SEQ ID NO: 341101 - DNA, 75 bp, Artificial Sequence
  Synthetic
gtaaaaaatactgcgtttgctacaataaaaccctgaataggtggaggagaacacaaggcagtactcttaatatag

SEQ ID NO: 341102 - DNA, 75 bp, Artificial Sequence
  Synthetic
taaaaccctgaataggtggaggagaacacaaggcagtactcttaatataggacccgtgcgaggactagtactgcg

SEQ ID NO: 341103 - DNA, 75 bp, Artificial Sequence
  Synthetic
tacacttggaaaggacaggaatactcgggtgtgtttctgcagagatggagaggtagtagactagtagtaatagac

SEQ ID NO: 341104 - DNA, 75 bp, Artificial Sequence
  Synthetic
aggtagtagactagtagtaatagacgcgagacaggcagatacacaaaacccgaaagtgctatcatggccagtaga

SEQ ID NO: 341105 - DNA, 75 bp, Artificial Sequence
  Synthetic
gcgagacaggcagatacacaaaacccgaaagtgctatcatggccagtagaaggaaactggaccacgagtggcaca

SEQ ID NO: 341106 - DNA, 75 bp, Artificial Sequence
  Synthetic
ccaaaatcgccacatgacattgactttggccaccacagtcgcttcgggcccttctgtgttaaatcagaacctcta

SEQ ID NO: 341107 - DNA, 75 bp, Artificial Sequence
  Synthetic
ctgttaacctgtggttccagtacaaatttctctttcagtttggcggtgaataccaaccaccaacaggaatcaggg

SEQ ID NO: 341108 - DNA, 75 bp, Artificial Sequence
  Synthetic
atccctgcactgatacaccagcctatcctgtgccgcagtcaggaagtgttacacaccccaaattcgccggaaaag

SEQ ID NO: 341109 - DNA, 75 bp, Artificial Sequence
  Synthetic
ttggggtatcactgctgcctcttccagagccctctgtgcagatacacccacggaagcagcgcaaagtgcacttct

SEQ ID NO: 341110 - DNA, 75 bp, Artificial Sequence
  Synthetic
agagccctctgtgcagatacacccacggaagcagcgcaaagtgcacttctcagaggggacccgccggaggaaaga

SEQ ID NO: 341111 - DNA, 75 bp, Artificial Sequence
  Synthetic
cgtccagtatcacgagtgccgaaagctcttctgaaggagatggatcgtctgatgatgaagagacagtcagacgca

SEQ ID NO: 341112 - DNA, 75 bp, Artificial Sequence
  Synthetic
gaaggaggcaatggaagcgactcagacacatggtccgagagcagcttgaccgacgcctgggacacaagcgacagc

SEQ ID NO: 341113 - DNA, 75 bp, Artificial Sequence
  Synthetic
cgacgcctgggacacaagcgacagcgacttcattgacatgcccattagacaaagatgcctgaataaaaagcttaa

SEQ ID NO: 341114 - DNA, 75 bp, Artificial Sequence
  Synthetic
ggggtccgggggggcttgcccccccgtaagctgggttaccgcactaactccctgccaagtgaaactcggggacga

SEQ ID NO: 341115 - DNA, 75 bp, Artificial Sequence
  Synthetic
cctgccaagtgaaactcggggacgagtgagtgcgggacatcccgtgtaatggctacataactacccggctttgct

SEQ ID NO: 341116 - DNA, 75 bp, Artificial Sequence
  Synthetic
tcatgacagggttcaccggaagggctgcaaaattacagctaaaaccacaaaactaacacaataaaccacaaacta

SEQ ID NO: 341117 - DNA, 75 bp, Artificial Sequence
  Synthetic
aaagatggctgacggtagcgtactgcgcgcacggattattctgcgactgtaaagacccgaaaaaacatcttgaaa

SEQ ID NO: 341118 - DNA, 75 bp, Artificial Sequence
  Synthetic
aaagacccgaaaaaacatcttgaaaaatgccttacagacgctatcgcagacgccgaaggagaccgacaagaagat

SEQ ID NO: 341119 - DNA, 75 bp, Artificial Sequence
  Synthetic
ttagcaaaaatgcctttaattagattaggagtcagcttcatagacttaacagaaccatggctagaaggctgggga

SEQ ID NO: 341120 - DNA, 75 bp, Artificial Sequence
  Synthetic
acgaagcaacaaaaacacagggaagaatatcaaaccgggcccaaattaaatactattggatatatgacactggcg

SEQ ID NO: 341121 - DNA, 75 bp, Artificial Sequence
  Synthetic
aatatcaaaccgggcccaaattaaatactattggatatatgacactggcgtaggaaatgcagtatatgttattat

SEQ ID NO: 341122 - DNA, 75 bp, Artificial Sequence
  Synthetic
ccaggacaaatggttgttgattatccagcagaaagcggaagacatccagatgccattgaccatatagaattaata

SEQ ID NO: 341123 - DNA, 75 bp, Artificial Sequence
  Synthetic
cagcagaaagcggaagacatccagatgccattgaccatatagaattaataaacgaaggatggccatactggctat

SEQ ID NO: 341124 - DNA, 75 bp, Artificial Sequence
  Synthetic
cattaaaaaagaagcacatagcacagaaatagcaagagaatatgctcaaaatccaaactctttaaaattgaaaat

SEQ ID NO: 341125 - DNA, 75 bp, Artificial Sequence
  Synthetic
aactacacaacacaaggcagcgtacaaaatgatagtggaaacatagcagctatacaaggaggatacgtagcatgg

SEQ ID NO: 341126 - DNA, 75 bp, Artificial Sequence
  Synthetic
acaccaaaaaggctggccaaataatcaaaactggcctaacacaaatgcagatgaaacaaactttaactggggact

SEQ ID NO: 341127 - DNA, 75 bp, Artificial Sequence
  Synthetic
aacatgctattaggaacacaagaattagacgatgaaactactatgttatccctcttcgggcccttcgtagaaaaa

SEQ ID NO: 341128 - DNA, 75 bp, Artificial Sequence
  Synthetic
agcaagcgacgactcctcaagcacctccagcgggtggtaaagaggatgaaaacactgtgatagataaatatagaa

SEQ ID NO: 341129 - DNA, 75 bp, Artificial Sequence
  Synthetic
tccagcgggtggtaaagaggatgaaaacactgtgatagataaatatagaaacttagcagacccctcactcaatgt

SEQ ID NO: 341130 - DNA, 75 bp, Artificial Sequence
  Synthetic
ccccccaccccccatgcgggggctccgccccctgcacccccttgctaagtcacaaaatggcggcgcggctaggac

SEQ ID NO: 341131 - DNA, 75 bp, Artificial Sequence
  Synthetic
taatgacagggttcaccggaaaggctgcaaaattacagctaaaaccacaactctaacacaataaaccacaaaata

SEQ ID NO: 341132 - DNA, 75 bp, Artificial Sequence
  Synthetic
ctatcgggcaggcggtaatccagcggaaccgggcccccctcgatggaagaaagatggctgacggtagcgtactgc

SEQ ID NO: 341133 - DNA, 75 bp, Artificial Sequence
  Synthetic
gaaccgggcccccctcgatggaagaaagatggctgacggtagcgtactgcgcccacggattattctgcggctgta

SEQ ID NO: 341134 - DNA, 75 bp, Artificial Sequence
  Synthetic
tggagtaagctttatagacctaacagaaccatgggtagaagggtggggaaatgcattttattccgtgctaggata

SEQ ID NO: 341135 - DNA, 75 bp, Artificial Sequence
  Synthetic
atacaaggtggatatgtagcatatgcagggtccggggtcataggagcagggtcaataggaaatttatatcaacaa

SEQ ID NO: 341136 - DNA, 75 bp, Artificial Sequence
  Synthetic
gtcaataggaaatttatatcaacaaggatggccatctaatcaaaactggcctaatacaaacagagaccaaacaaa

SEQ ID NO: 341137 - DNA, 75 bp, Artificial Sequence
  Synthetic
ctaatacaaacagagaccaaacaaactttgactggggaatacgaggactatgtatactcagagataacatgcact

SEQ ID NO: 341138 - DNA, 75 bp, Artificial Sequence
  Synthetic
tcaagaagaagagacgcagagacgaaagcaccacaagccaagcaagcgacgactcctcaagcacctccagcgggt

SEQ ID NO: 341139 - DNA, 75 bp, Artificial Sequence
  Synthetic
aagcaccacaagccaagcaagcgacgactcctcaagcacctccagcgggtggtaaagaggatgaaaacactgtga

SEQ ID NO: 341140 - DNA, 75 bp, Artificial Sequence
  Synthetic
ccccatgcgggggctccgccccctgcacccccactaaagtcacaaaatggcggcgcggctgggacacaaaatggc

SEQ ID NO: 341141 - DNA, 75 bp, Artificial Sequence
  Synthetic
agacgcaggagatgaaccaggagatttaataacaaatcaaaatagtataacagatatagaacaaataggagaagg

SEQ ID NO: 341142 - DNA, 75 bp, Artificial Sequence
  Synthetic
aacagcaaaaaactaaaaataggcataataggatgggcatcaagtgattatacagccctaaactcatcacaaaca

SEQ ID NO: 341143 - DNA, 75 bp, Artificial Sequence
  Synthetic
agagctaaaaatgctaaaagaaacctcaataaacaatacttttctgattaatagcggcctcctgtgtccaatcta

SEQ ID NO: 341144 - DNA, 75 bp, Artificial Sequence
  Synthetic
tcatgacagggttcaccggaaaggctgcaaaattacagctaaaaccacaagtataacacaataaaccacaaagta

SEQ ID NO: 341145 - DNA, 75 bp, Artificial Sequence
  Synthetic
ccacaggaaacctacacataaccaccaaaccacaggaaacataaccaccaaaccacaggaaactttgcaaaaaag

SEQ ID NO: 341146 - DNA, 75 bp, Artificial Sequence
  Synthetic
tttagagtatataagtaagtgcgcagacgaatggctgagtttatgccgctggtggtagacacgaacagagctgag

SEQ ID NO: 341147 - DNA, 75 bp, Artificial Sequence
  Synthetic
aaatgccttacagacgctatcgcagacgccgaaggagaccgacacggagatggaggcaccggaggtggagacgct

SEQ ID NO: 341148 - DNA, 75 bp, Artificial Sequence
  Synthetic
tcctcgccgccgccgcacaaaggtaaggagacggaggagaaaagctccggtcatacaatggttccctcctagccg

SEQ ID NO: 341149 - DNA, 75 bp, Artificial Sequence
  Synthetic
ggcggttgtgactggacacagtggagtttacaaaacttataccatgaaaaacttaactggagaaatatatggaca

SEQ ID NO: 341150 - DNA, 75 bp, Artificial Sequence
  Synthetic
gtttacaaaacttataccatgaaaaacttaactggagaaatatatggacagcttctaatgtaggcatgaaatttg

SEQ ID NO: 341151 - DNA, 75 bp, Artificial Sequence
  Synthetic
cttcttcagacacccatggagaagctatatcattacttgggaccaagatattccctgcaagcctttaccatacca

SEQ ID NO: 341152 - DNA, 75 bp, Artificial Sequence
  Synthetic
tatatcattacttgggaccaagatattccctgcaagcctttaccataccaaaatttacatcctctacttatgcta

SEQ ID NO: 341153 - DNA, 75 bp, Artificial Sequence
  Synthetic
tatctcaaaaagactgcaatccaaacagaaaacaaaaacctgtaactttaaaaataagacctccaccaaaattaa

SEQ ID NO: 341154 - DNA, 75 bp, Artificial Sequence
  Synthetic
cagaaaacaaaaacctgtaactttaaaaataagacctccaccaaaattaacatcacagtggagattaagcagaga

SEQ ID NO: 341155 - DNA, 75 bp, Artificial Sequence
  Synthetic
ctaggaatcagtctcacagacctgtcagaaccatggttagaaggctggggaaatgctttttacagcgtactagga

SEQ ID NO: 341156 - DNA, 75 bp, Artificial Sequence
  Synthetic
cagaaccatggttagaaggctggggaaatgctttttacagcgtactaggatatgaagctagtaaacactcgggca

SEQ ID NO: 341157 - DNA, 75 bp, Artificial Sequence
  Synthetic
atatttctggatctatgacacaggagttggaaatgcagtttatgtcattttattaaaacaagaagtagaagacaa

SEQ ID NO: 341158 - DNA, 75 bp, Artificial Sequence
  Synthetic
gttggaaatgcagtttatgtcattttattaaaacaagaagtagaagacaatccaggagatatggcacaaaaattt

SEQ ID NO: 341159 - DNA, 75 bp, Artificial Sequence
  Synthetic
atgctatagacagaatagaactaataaatgagggatggccctattggcttttcttttacggacagtcagaacaag

SEQ ID NO: 341160 - DNA, 75 bp, Artificial Sequence
  Synthetic
aaatgagggatggccctattggcttttcttttacggacagtcagaacaagacataaaaaaattagcacacgacca

SEQ ID NO: 341161 - DNA, 75 bp, Artificial Sequence
  Synthetic
aatccaaaatctaaaaaactaaaaataggggtaataggatgggccagcagtaactttacaacagcaggtagctca

SEQ ID NO: 341162 - DNA, 75 bp, Artificial Sequence
  Synthetic
taggggtaataggatgggccagcagtaactttacaacagcaggtagctcacaaaatcaaacaccacaaacaccag

SEQ ID NO: 341163 - DNA, 75 bp, Artificial Sequence
  Synthetic
atacgcaggcgcaaaaataccaggagcaggatcaattacaaacttatatagagatgcatggccaggagatcaaaa

SEQ ID NO: 341164 - DNA, 75 bp, Artificial Sequence
  Synthetic
gagatgcatggccaggagatcaaaactggccacctataaatgcagaccaaacaaattttaactggggattaagag

SEQ ID NO: 341165 - DNA, 75 bp, Artificial Sequence
  Synthetic
gaaattaggagctcaagaactagacgatgaatgtacaatgctaacactttttggaccttttgtggaaaaagcaaa

SEQ ID NO: 341166 - DNA, 75 bp, Artificial Sequence
  Synthetic
ttgggactatgactgtgacaggattgttagaacagatactctcaaaagacttctcgaactccccacagagacgga

SEQ ID NO: 341167 - DNA, 75 bp, Artificial Sequence
  Synthetic
gactaaggggggggcaagcccccccccgggggttgagggggggtttccccccctccccccggtgcagggggcgga

SEQ ID NO: 341168 - DNA, 75 bp, Artificial Sequence
  Synthetic
gcccccgcaccccccatgcgggggctccgccccctgcacccccgggagggggggaaaccccccctcaaccccccg

SEQ ID NO: 341169 - DNA, 75 bp, Artificial Sequence
  Synthetic
ggagtcaattctgattggtcgggagctcaagtcctcatttgcatagggtgtaaccaatcagatttaaggcgttcc

SEQ ID NO: 341170 - DNA, 75 bp, Artificial Sequence
  Synthetic
ctgcggtagctggagagaccacctgtggacgctatgcgctttagacgacgcagatttggccgccgccgcagatat

SEQ ID NO: 341171 - DNA, 75 bp, Artificial Sequence
  Synthetic
tacaagcctatggacttaagagtcgaggcaaactggatattcaataaacaggacagtaaaatagagacagaacag

SEQ ID NO: 341172 - DNA, 75 bp, Artificial Sequence
  Synthetic
gagggtggtcaagcggagtaatcagcttagagggactattcaatgaaaacagactgtggagaaatatatggtcaa

SEQ ID NO: 341173 - DNA, 75 bp, Artificial Sequence
  Synthetic
cttagagggactattcaatgaaaacagactgtggagaaatatatggtcaaaaagcaatgacgggatggacttggt

SEQ ID NO: 341174 - DNA, 75 bp, Artificial Sequence
  Synthetic
aatagtgtgtaaacagaagatgccaattagacgcagagtaaaaagtatttttataccgccgcctgcacagttaac

SEQ ID NO: 341175 - DNA, 75 bp, Artificial Sequence
  Synthetic
attagacgcagagtaaaaagtatttttataccgccgcctgcacagttaacaactcagtggaaatttcaacaggaa

SEQ ID NO: 341176 - DNA, 75 bp, Artificial Sequence
  Synthetic
tggcgaaatgcctggtggctaatgagaaggctgcaaaacggaaacatggagtacatagaaagatggggcagaata

SEQ ID NO: 341177 - DNA, 75 bp, Artificial Sequence
  Synthetic
caccagcagacgacttcaaggcaggaggggtgaacaaaaacttcaaaccgacaggtattcaaagaatatacccga

SEQ ID NO: 341178 - DNA, 75 bp, Artificial Sequence
  Synthetic
gatggagaaaaaaacagacaggaactttaaagctctctaacctgagaggcctagtactgagagtatgctcagaga

SEQ ID NO: 341179 - DNA, 75 bp, Artificial Sequence
  Synthetic
gtgaaacatactataagtggacaggatcagaatttacaggggcatttcaacaagactggtggccagtaggcggaa

SEQ ID NO: 341180 - DNA, 75 bp, Artificial Sequence
  Synthetic
caagactggtggccagtaggcggaacagaatacccgctttgtaccattaaaatggacccagaatatgaaaaccct

SEQ ID NO: 341181 - DNA, 75 bp, Artificial Sequence
  Synthetic
acagtagaggtatggtcctggaaagcaaatataccgacatcagggactcttaaagactacttcggactgagtaca

SEQ ID NO: 341182 - DNA, 75 bp, Artificial Sequence
  Synthetic
aaagctagatttgggccattttgcgttaaaaagcctccagtagagttcagagatacagccccaaacccactaaat

SEQ ID NO: 341183 - DNA, 75 bp, Artificial Sequence
  Synthetic
acgcgctgccagaaagcgagtcatcaagttacttctcaagcgactcgctgacagacccgtggacaacaagcgacg

SEQ ID NO: 341184 - DNA, 75 bp, Artificial Sequence
  Synthetic
acagacccgtggacaacaagcgacgacgattttcagagtgaccctgaccccctcaccaataaacgcaaaaaacgc

SEQ ID NO: 341185 - DNA, 75 bp, Artificial Sequence
  Synthetic
gctcgaccctcacacaacactgcagatagggggcgcaattgggatcgttagaaaactatggccgagcatgggggg

SEQ ID NO: 341186 - DNA, 75 bp, Artificial Sequence
  Synthetic
gaaaactatggccgagcatggggggggctccgccccccccaacccccccggtgggggggccaaggccccccctac

SEQ ID NO: 341187 - DNA, 75 bp, Artificial Sequence
  Synthetic
tacacttccgggttcaggaggctcaatttggctcgcgttcgctcgcaccacgtttgctgccaggcggacctgatt

SEQ ID NO: 341188 - DNA, 75 bp, Artificial Sequence
  Synthetic
atttggctcgcgttcgctcgcaccacgtttgctgccaggcggacctgattgaagactgaaaaccgttagattcaa

SEQ ID NO: 341189 - DNA, 75 bp, Artificial Sequence
  Synthetic
cggaggggggcggagtttatgcaaattaatttatgcaaagtaggaggagctccattttaatttatgcaaagtagg

SEQ ID NO: 341190 - DNA, 75 bp, Artificial Sequence
  Synthetic
gttcaagtcctcatttgcatagggtgtaaccaatcaacattaaggcgttcccactaaagtgaatataagtgagtg

SEQ ID NO: 341191 - DNA, 75 bp, Artificial Sequence
  Synthetic
cgccagcggtagacagaactgtctagcgagggtgccggaggatccctgatccggagtcaaggggcctatcgggca

SEQ ID NO: 341192 - DNA, 75 bp, Artificial Sequence
  Synthetic
gcgagggtgccggaggatccctgatccggagtcaaggggcctatcgggcaggagcagctgagcggagggcctaat

SEQ ID NO: 341193 - DNA, 75 bp, Artificial Sequence
  Synthetic
tggctgaccagctgtacatctatacacgaccactgcaactgcgctagctggagacactggacgctatgcgcttta

SEQ ID NO: 341194 - DNA, 75 bp, Artificial Sequence
  Synthetic
acgaccactgcaactgcgctagctggagacactggacgctatgcgctttagacgacgatgccgccgccgcagata

SEQ ID NO: 341195 - DNA, 75 bp, Artificial Sequence
  Synthetic
aagaggagaggatggagtcgatatgggaggcgttggagacggactgcctggagacgtcggcgggtaaggagatgc

SEQ ID NO: 341196 - DNA, 75 bp, Artificial Sequence
  Synthetic
ggaggcgttggagacggactgcctggagacgtcggcgggtaaggagatgcggcgttccgtcttccgtcccctact

SEQ ID NO: 341197 - DNA, 75 bp, Artificial Sequence
  Synthetic
gtgatcaagggatggtggccacttattcagtgtatgcagggaatggagtacctacgatacagaccaatgaataac

SEQ ID NO: 341198 - DNA, 75 bp, Artificial Sequence
  Synthetic
ttcagtgtatgcagggaatggagtacctacgatacagaccaatgaataacatagaaaaaagatggatatacaaga

SEQ ID NO: 341199 - DNA, 75 bp, Artificial Sequence
  Synthetic
ggacatgggctacctgatgcagtatggaggaggatgggcatcaggaactatttcgctgaaagggctctttaatga

SEQ ID NO: 341200 - DNA, 75 bp, Artificial Sequence
  Synthetic
ggaggaggatgggcatcaggaactatttcgctgaaagggctctttaatgagcaccagttatggagaaatgtttgg

SEQ ID NO: 341201 - DNA, 75 bp, Artificial Sequence
  Synthetic
tagccaggtacttcgggtgttcaatctcactatacccggaggacaaccaggactacttattctggtttgacacag

SEQ ID NO: 341202 - DNA, 75 bp, Artificial Sequence
  Synthetic
ctcactatacccggaggacaaccaggactacttattctggtttgacacagaattcgacgagacacagttattaaa

SEQ ID NO: 341203 - DNA, 75 bp, Artificial Sequence
  Synthetic
gtaatgttacaggcaaaaaactccagactaatagtagcaaaatccagaatgcctataagacgcagaataagaaaa

SEQ ID NO: 341204 - DNA, 75 bp, Artificial Sequence
  Synthetic
tgaccacacagtggcagtttcaaaaagacttggctgactatccgttgtttaactgggcatgcatatgcatagaca

SEQ ID NO: 341205 - DNA, 75 bp, Artificial Sequence
  Synthetic
agacttggctgactatccgttgtttaactgggcatgcatatgcatagacatggaaaaaccatttgactacacggg

SEQ ID NO: 341206 - DNA, 75 bp, Artificial Sequence
  Synthetic
aactgggcatgcatatgcatagacatggaaaaaccatttgactacacgggggcatggcgaaatgcatggtggttg

SEQ ID NO: 341207 - DNA, 75 bp, Artificial Sequence
  Synthetic
tggaatatatagaaaaatggggaagaataccacccacaggagactttaaactgccctcaaaaagttcaatgacag

SEQ ID NO: 341208 - DNA, 75 bp, Artificial Sequence
  Synthetic
aataccacccacaggagactttaaactgccctcaaaaagttcaatgacaggcaaccaggacaatcccaattggca

SEQ ID NO: 341209 - DNA, 75 bp, Artificial Sequence
  Synthetic
cccatagtggcatattgggtgacagaagaaggtaaaaacgtctgttactggtgcacaatacacaatgcaccgata

SEQ ID NO: 341210 - DNA, 75 bp, Artificial Sequence
  Synthetic
gcgcaagaaacatactatagatggcaaagggcagaattcacagacacctttaagcagcgctggtttccacagaat

SEQ ID NO: 341211 - DNA, 75 bp, Artificial Sequence
  Synthetic
aaagggcagaattcacagacacctttaagcagcgctggtttccacagaatgggacagatcacagcttagtagtga

SEQ ID NO: 341212 - DNA, 75 bp, Artificial Sequence
  Synthetic
gggaaacccagatgtatggaacttcctatggaattcctcaataaacacacaaacaactccagttttaaaatactg

SEQ ID NO: 341213 - DNA, 75 bp, Artificial Sequence
  Synthetic
agacagtggcaggacacagactttgccaaacttcaactgccaaaaacagctcatgatatagactttgggcacaaa

SEQ ID NO: 341214 - DNA, 75 bp, Artificial Sequence
  Synthetic
ccaaacttcaactgccaaaaacagctcatgatatagactttgggcacaaaaccagattcgggccattctgtgtaa

SEQ ID NO: 341215 - DNA, 75 bp, Artificial Sequence
  Synthetic
aaaacccaccatgtgagttcagagaaacaccgccacaaccaattaatatatgggtaaaatacaagttctttttcc

SEQ ID NO: 341216 - DNA, 75 bp, Artificial Sequence
  Synthetic
caaaagaagagacagaggcgagagaggaaaccgaggacaccacgagtgagagctccattacgagtgccgaaagct

SEQ ID NO: 341217 - DNA, 75 bp, Artificial Sequence
  Synthetic
ggaaaccgaggacaccacgagtgagagctccattacgagtgccgaaagctcttctgaaggagatggatcgtctga

SEQ ID NO: 341218 - DNA, 75 bp, Artificial Sequence
  Synthetic
atccctggaccacaagcgacgaagattttcagagtgaccccgaccccctgcacaataaacgcaaaaaacgcttgc

SEQ ID NO: 341219 - DNA, 75 bp, Artificial Sequence
  Synthetic
cacaataaacgcaaaaaacgcttgcaattctaacactgcctccgcgtaatcattgggggggtccgggggggcttg

SEQ ID NO: 341220 - DNA, 75 bp, Artificial Sequence
  Synthetic
aattctaacactgcctccgcgtaatcattgggggggtccgggggggcttgcccctgggttaccgcactaactccc

SEQ ID NO: 341221 - DNA, 75 bp, Artificial Sequence
  Synthetic
atcccgtgtaataactacccggctttgcggccgaccctcacacaacactgcagatagggggcgcaattgggatcg

SEQ ID NO: 341222 - DNA, 75 bp, Artificial Sequence
  Synthetic
caattgggatcgttaaacactgcagatagggggcgcaattgggatcgttagaaaactatggccgagcatgggggg

SEQ ID NO: 341223 - DNA, 75 bp, Artificial Sequence
  Synthetic
tacacttccgggttcagaaggctcaatttggctcgcttcgctcgcaccacggttgctgccaggcggacctgattg

SEQ ID NO: 341224 - DNA, 75 bp, Artificial Sequence
  Synthetic
atttggctcgcttcgctcgcaccacggttgctgccaggcggacctgattgaagactgaaaaccgttaagttcaaa

SEQ ID NO: 341225 - DNA, 75 bp, Artificial Sequence
  Synthetic
ggttgctgccaggcggacctgattgaagactgaaaaccgttaagttcaaatttgaaaatggcgcccaaacatggc

SEQ ID NO: 341226 - DNA, 75 bp, Artificial Sequence
  Synthetic
taatttatgcaaactaggaggagctccattttaatttatgcaaagtaggaggagtcaactctgattggacggcag

SEQ ID NO: 341227 - DNA, 75 bp, Artificial Sequence
  Synthetic
taaccaatcagaattaaggcgttcccactaaagtgaatataagtaagtgcagtggcgaatggctgagtttatgcc

SEQ ID NO: 341228 - DNA, 75 bp, Artificial Sequence
  Synthetic
ctatgccggaacactgggaagaagcctggttagaagctaccaagggctggcacgacttagactgccgctgcggta

SEQ ID NO: 341229 - DNA, 75 bp, Artificial Sequence
  Synthetic
gctcgccgatggagacgccgctttggccgccgccgtagacgctatagaaagagacgctatggctggagaagacgc

SEQ ID NO: 341230 - DNA, 75 bp, Artificial Sequence
  Synthetic
gccgccgccgtagacgctatagaaagagacgctatggctggagaagacgctactaccgctacagaccgcgttact

SEQ ID NO: 341231 - DNA, 75 bp, Artificial Sequence
  Synthetic
tactaccgctacagaccgcgttactatcggagacgatggctggtaaggagaaggcggcgttccgtctaccgtaga

SEQ ID NO: 341232 - DNA, 75 bp, Artificial Sequence
  Synthetic
atcggagacgatggctggtaaggagaaggcggcgttccgtctaccgtagaggtggacgtagagcgcgcccctacc

SEQ ID NO: 341233 - DNA, 75 bp, Artificial Sequence
  Synthetic
aaggcggcgttccgtctaccgtagaggtggacgtagagcgcgcccctaccgggtatctgcctttaaccccaaagt

SEQ ID NO: 341234 - DNA, 75 bp, Artificial Sequence
  Synthetic
tggtggccaatactacaatgcttaaaaggacaggaatcgctgagatatagaccacttcagtgggacacagaaaga

SEQ ID NO: 341235 - DNA, 75 bp, Artificial Sequence
  Synthetic
aaggacaggaatcgctgagatatagaccacttcagtgggacacagaaagacagtggagagtgagatcagacttcg

SEQ ID NO: 341236 - DNA, 75 bp, Artificial Sequence
  Synthetic
atacggtggaggttggggaagtggtgatgtgacactagagggactataccaggaacacttactatggagaaattc

SEQ ID NO: 341237 - DNA, 75 bp, Artificial Sequence
  Synthetic
gatgtgacactagagggactataccaggaacacttactatggagaaattcctggtcaaaaggaaatgatggcatg

SEQ ID NO: 341238 - DNA, 75 bp, Artificial Sequence
  Synthetic
tagtatacctctacccgcttaaagatcaggactattggttctggtgggacacggactttaaagagctatacgcag

SEQ ID NO: 341239 - DNA, 75 bp, Artificial Sequence
  Synthetic
tcaggactattggttctggtgggacacggactttaaagagctatacgcagaaaacataaaagaatacagccaacc

SEQ ID NO: 341240 - DNA, 75 bp, Artificial Sequence
  Synthetic
actagaatagtaatagcgagagacagagctccacatagaagaaaagtgagaaaaatattcatcccaccaccatca

SEQ ID NO: 341241 - DNA, 75 bp, Artificial Sequence
  Synthetic
gagctccacatagaagaaaagtgagaaaaatattcatcccaccaccatcaagagacactacgcagtggcagtttc

SEQ ID NO: 341242 - DNA, 75 bp, Artificial Sequence
  Synthetic
atttacctgggcggcaggactaatagacatgcaaaaaccctttgatgccaacggagcttttagaaacgcgtggtg

SEQ ID NO: 341243 - DNA, 75 bp, Artificial Sequence
  Synthetic
gacatgcaaaaaccctttgatgccaacggagcttttagaaacgcgtggtggctggagcagagaacggaacagggt

SEQ ID NO: 341244 - DNA, 75 bp, Artificial Sequence
  Synthetic
gaagagtacccccacaaggagactcagaactacccaagaaaagtgaattcacaacaaatacagacaataaaaact

SEQ ID NO: 341245 - DNA, 75 bp, Artificial Sequence
  Synthetic
agaactacccaagaaaagtgaattcacaacaaatacagacaataaaaactacaatgtgaatgacggggaggaaaa

SEQ ID NO: 341246 - DNA, 75 bp, Artificial Sequence
  Synthetic
gtagaccaaaaagaccaaaaaccaaggaaaaagtactgtgtatgttacaacaaaactctgaacaggtggagatta

SEQ ID NO: 341247 - DNA, 75 bp, Artificial Sequence
  Synthetic
ggaaaaagtactgtgtatgttacaacaaaactctgaacaggtggagattagggcaggccagtactctaaaaatag

SEQ ID NO: 341248 - DNA, 75 bp, Artificial Sequence
  Synthetic
acagttgatgaaccaagagatgacttacatatggaaggaaggagagtacagctcaccatttgtacaaaggtggag

SEQ ID NO: 341249 - DNA, 75 bp, Artificial Sequence
  Synthetic
tacatatggaaggaaggagagtacagctcaccatttgtacaaaggtggagaggaagcagatttgtcgtgatagac

SEQ ID NO: 341250 - DNA, 75 bp, Artificial Sequence
  Synthetic
ccaaagtatctacatggccaatagagggagtgtggaacacacagggtacagtacttaaggacgtattccagattg

SEQ ID NO: 341251 - DNA, 75 bp, Artificial Sequence
  Synthetic
gggagtgtggaacacacagggtacagtacttaaggacgtattccagattgacttacaaagtagtaatttcagagc

SEQ ID NO: 341252 - DNA, 75 bp, Artificial Sequence
  Synthetic
ccaaaatcaccgcacgacttagacttcggacatcacagtagattcggaccattctgtgtgaaaaatgaaccactg

SEQ ID NO: 341253 - DNA, 75 bp, Artificial Sequence
  Synthetic
tcggacatcacagtagattcggaccattctgtgtgaaaaatgaaccactggaatttcaggtatacccgccagaac

SEQ ID NO: 341254 - DNA, 75 bp, Artificial Sequence
  Synthetic
atttttctttcagtttggaggtgaataccaaccccccacaggaatccgcgatccatgcgttgatacaccagccta

SEQ ID NO: 341255 - DNA, 75 bp, Artificial Sequence
  Synthetic
tcctgtgccgcagtcaggaagtattacacaccccaaattcgccggaaaaggcggaatgctcacggaaacagaccg

SEQ ID NO: 341256 - DNA, 75 bp, Artificial Sequence
  Synthetic
gcggaatgctcacggaaacagaccgttggggtatcactgctgcctctaccagagccctctgtgcagatacaccca

SEQ ID NO: 341257 - DNA, 75 bp, Artificial Sequence
  Synthetic
gaaggaggacctggaagcgactcagacgaatggtccgagagcagcttgaccgacgaatggaccacaagcgacagc

SEQ ID NO: 341258 - DNA, 75 bp, Artificial Sequence
  Synthetic
cgacgaatggaccacaagcgacagcgacttcattgacacccccattagagacagatgcctcaataaaaagcaaaa

SEQ ID NO: 341259 - DNA, 75 bp, Artificial Sequence
  Synthetic
taatgacagggttcaccggaaaggctgcaaaattacagctaaaaccacaatgctaacacaataaaccacaaaata

SEQ ID NO: 341260 - DNA, 75 bp, Artificial Sequence
  Synthetic
ttacaggaaactgcaataaatttagaaataaattacacataaccaccaaaccacaggaaactctgcaaaaaagag

SEQ ID NO: 341261 - DNA, 75 bp, Artificial Sequence
  Synthetic
aaataaattacacataaccaccaaaccacaggaaactctgcaaaaaagaggaaataaatttcattggctgcgcca

SEQ ID NO: 341262 - DNA, 75 bp, Artificial Sequence
  Synthetic
gaagtcctcattagaataagaaatggaccaatcagaaacacttccccttttagagtatataagtgaatgcgcaga

SEQ ID NO: 341263 - DNA, 75 bp, Artificial Sequence
  Synthetic
gaaccgggcccccctccatggaagaaagatggctgacggtagcgtactgcgcccacggattattctgcgactgta

SEQ ID NO: 341264 - DNA, 75 bp, Artificial Sequence
  Synthetic
gccgttgagctacggacactggttccgtacctgtctcccctttaggcggttaaacggactagtgttcccgggagg

SEQ ID NO: 341265 - DNA, 75 bp, Artificial Sequence
  Synthetic
cgtacctgtctcccctttaggcggttaaacggactagtgttcccgggaggaggttgtgaccggactcaatggagt

SEQ ID NO: 341266 - DNA, 75 bp, Artificial Sequence
  Synthetic
taaactggagaaatatatggacagctagtaatgttggaatggaaatcgctagattcttaagaggaaaattctact

SEQ ID NO: 341267 - DNA, 75 bp, Artificial Sequence
  Synthetic
ccttgtaaaccgctaccatatcaaaacttacatccactattaatgctactaaaaaaacagcataaactcgtacta

SEQ ID NO: 341268 - DNA, 75 bp, Artificial Sequence
  Synthetic
tctcaacaaaactgtaacccaaaccgaaagcaaaatccagtaacattaaaattcaaaccaccaccgaaattaact

SEQ ID NO: 341269 - DNA, 75 bp, Artificial Sequence
  Synthetic
tcacaatggagactaagcagggaattagctaaaacgccactcattagactaggaataagctttatagacctctca

SEQ ID NO: 341270 - DNA, 75 bp, Artificial Sequence
  Synthetic
attattggatgtatgatacaggggtgggaaatgctgtatatgtagtactattaaaacaagatgtagaggacaatc

SEQ ID NO: 341271 - DNA, 75 bp, Artificial Sequence
  Synthetic
aggaacttcaggacaacacccagatgcaattgatcacatagaattaataaatgaaggatggccatactggttata

SEQ ID NO: 341272 - DNA, 75 bp, Artificial Sequence
  Synthetic
tccaaaatcaaaaaaacttaaaataggagttgtaggatgggctagctctaattacacagcaacaaacagttctca

SEQ ID NO: 341273 - DNA, 75 bp, Artificial Sequence
  Synthetic
atacagggaggatacctagcttgggcaggaggaggaggaaaatttaacttaggtgcaggatctatagataatcta

SEQ ID NO: 341274 - DNA, 75 bp, Artificial Sequence
  Synthetic
agagcactatgcctattaagagataatatgaaactgggcacccaagacttagatgatgaatgcacaatgttaact

SEQ ID NO: 341275 - DNA, 75 bp, Artificial Sequence
  Synthetic
atatgaaactgggcacccaagacttagatgatgaatgcacaatgttaactctatttggaccgtttgtagaaaaag

SEQ ID NO: 341276 - DNA, 75 bp, Artificial Sequence
  Synthetic
cagagacgaaagcaccacaagccaagcaagcgacgactcctcaagcacctccagcgggtggtaaagaaaatgaaa

SEQ ID NO: 341277 - DNA, 75 bp, Artificial Sequence
  Synthetic
agcagacccctcactcaatgtcacaggacacatggaaaacttcaagagactacacctacaaaacatcacagaaat

SEQ ID NO: 341278 - DNA, 75 bp, Artificial Sequence
  Synthetic
tacacctacaaaacatcacagaaataagagctaaaaatgctaaagaatccctcaataaaatgtacttttctgatt

SEQ ID NO: 341279 - DNA, 75 bp, Artificial Sequence
  Synthetic
cccccatgcgggggctccgccccctgcacccccgggagggggggaaaccccccctcaaccccccgcggggggcaa

SEQ ID NO: 341280 - DNA, 75 bp, Artificial Sequence
  Synthetic
taatgacagggttcaccggaagggctgcaaaattacagctaaaaccacaacactaacacaataaaccacaagaaa

SEQ ID NO: 341281 - DNA, 75 bp, Artificial Sequence
  Synthetic
tgcaaaattacagctaaaaccacaacactaacacaataaaccacaagaaatttcaggaaactgcaataatttaag

SEQ ID NO: 341282 - DNA, 75 bp, Artificial Sequence
  Synthetic
tatcacaaggtaaggagacggagggtaaaaaaagctccggtcattcaatggttcccaccaacaataagaaactgt

SEQ ID NO: 341283 - DNA, 75 bp, Artificial Sequence
  Synthetic
actggactgtatggagtttacaaaatttatatcatgaaaaactaaactggagaaatatctggacagcttctaatg

SEQ ID NO: 341284 - DNA, 75 bp, Artificial Sequence
  Synthetic
atatgctaaatttaagttttttagacatgaattcagatcttatattgtaacatgggatcaggacataccatgtaa

SEQ ID NO: 341285 - DNA, 75 bp, Artificial Sequence
  Synthetic
ccatttgtaatgttactaaaaaaacaacacaaagtaattctaagcaaaagagaatgtaacccgagaaaaaaagac

SEQ ID NO: 341286 - DNA, 75 bp, Artificial Sequence
  Synthetic
agaatgtaacccgagaaaaaaagacaagcctgtaattttaaaaataaaacctccacctaaactaacatcacaatg

SEQ ID NO: 341287 - DNA, 75 bp, Artificial Sequence
  Synthetic
atgccacttgtaagactaggaataagtctaatagacttcaaagaaccatggctagaaggtttcggaaatgcattt

SEQ ID NO: 341288 - DNA, 75 bp, Artificial Sequence
  Synthetic
gtctaatagacttcaaagaaccatggctagaaggtttcggaaatgcattttacagtacactaggatatgaggcag

SEQ ID NO: 341289 - DNA, 75 bp, Artificial Sequence
  Synthetic
attttgtcaaataaaatatttctggatatatgacacaggtcaaggaaatcatgtatacgtagtaatgctgtcagc

SEQ ID NO: 341290 - DNA, 75 bp, Artificial Sequence
  Synthetic
ctagtacacaaacaaataacgataaaagaaatagaacatgtaggagaaggatggccctattggctatatttcttc

SEQ ID NO: 341291 - DNA, 75 bp, Artificial Sequence
  Synthetic
cattagcaacaacaaactcaaatattagagcagaattcaatgcaaatccaaacagcaaaaaactcaaaatagctg

SEQ ID NO: 341292 - DNA, 75 bp, Artificial Sequence
  Synthetic
tagagcagaattcaatgcaaatccaaacagcaaaaaactcaaaatagctgtaattggatgggcctctagcaataa

SEQ ID NO: 341293 - DNA, 75 bp, Artificial Sequence
  Synthetic
gcaaatcaaccaatacaaggaacatacttcataagttctaaactattaacatcaggtcacacagcaggcgctaca

SEQ ID NO: 341294 - DNA, 75 bp, Artificial Sequence
  Synthetic
tttaattggggcctaagagctctatgcatactaagaaataacataccattaaataaagcagcattagatgatgaa

SEQ ID NO: 341295 - DNA, 75 bp, Artificial Sequence
  Synthetic
ccttagtagaaaaagcaaactgggaaggaatagaaacagcaccacaatttaaagaagaattaaaagactacaatt

SEQ ID NO: 341296 - DNA, 75 bp, Artificial Sequence
  Synthetic
tactgatgagatacatgtttaaatttcagtggggcggacacgggacagaacaattcaaaaccagcgtcggagacc

SEQ ID NO: 341297 - DNA, 75 bp, Artificial Sequence
  Synthetic
tcagtggggcggacacgggacagaacaattcaaaaccagcgtcggagaccctagcaccattccctgcccctacgg

SEQ ID NO: 341298 - DNA, 75 bp, Artificial Sequence
  Synthetic
gtgcgagacccctccaaggtacacgaaggggtcctcaatgcgtgggattatgactatgatggaattgttagaaaa

SEQ ID NO: 341299 - DNA, 75 bp, Artificial Sequence
  Synthetic
tgactatgatggaattgttagaaaagacactctcaaaaaactccttgaaatcccaacagactcggaaacggagaa

SEQ ID NO: 341300 - DNA, 75 bp, Artificial Sequence
  Synthetic
acagagaaattgccctcctcagacgaagaaggagagagcgatatcagttcttcgagcaactcatcgagcgaagaa

SEQ ID NO: 341301 - DNA, 75 bp, Artificial Sequence
  Synthetic
aagaaggagagagcgatatcagttcttcgagcaactcatcgagcgaagaaagcgaggaagaaaagagacacagaa

SEQ ID NO: 341302 - DNA, 75 bp, Artificial Sequence
  Synthetic
gtaaagagattcaagaccctatagacaaatataaaaacttagcagacccctcactcaatgttacaggacatatgg

SEQ ID NO: 341303 - DNA, 75 bp, Artificial Sequence
  Synthetic
aaacataacagaaataagagctaaaaatgctaaaaaaaacctcaataaaatttactattcagactaatagcggcc

SEQ ID NO: 341304 - DNA, 75 bp, Artificial Sequence
  Synthetic
caaaatggcggagggactaaggggggggcaagccccccccaccccccatgcgggggctgcgccccctgcaccccc

SEQ ID NO: 341305 - DNA, 75 bp, Artificial Sequence
  Synthetic
cgggggctgcgccccctgcacccccctggcgaagtcacaaaatggcgggcgcggctgagacacaaaatggcggcg

SEQ ID NO: 341306 - DNA, 75 bp, Artificial Sequence
  Synthetic
tcatgacagggttcaccggaagggctgcaaaattacagctaaaaccacaagtctaacacaataaaccacaaagta

SEQ ID NO: 341307 - DNA, 75 bp, Artificial Sequence
  Synthetic
tgcaaaattacagctaaaaccacaagtctaacacaataaaccacaaagtattacaggaaactgcaataaatttag

SEQ ID NO: 341308 - DNA, 75 bp, Artificial Sequence
  Synthetic
gaagtcctcattagaataataaaagaaccaatcagaagaacttcctcttttagagtatataagtaagtgcgcaga

SEQ ID NO: 341309 - DNA, 75 bp, Artificial Sequence
  Synthetic
gaaaacaaaaacctgtcacattaaaattcaaacctccgccaaaactaacatcacaatggagactaagtagagaat

SEQ ID NO: 341310 - DNA, 75 bp, Artificial Sequence
  Synthetic
atgcacaatgctcacattgttcggaccctttgtagaaaaagcaaatccaatatttgcaacaacagaccctaaatt

SEQ ID NO: 341311 - DNA, 75 bp, Artificial Sequence
  Synthetic
ttcaaaacgtacaagaaataagagctaaaaatgctaaaaaatccctcaataaactttacttttctgattaatagc

SEQ ID NO: 341312 - DNA, 75 bp, Artificial Sequence
  Synthetic
gggcgacccccccgcacccccccctgcgggggctccgccccctgcacccccgggagggggggaaaccccccctca

SEQ ID NO: 341313 - DNA, 75 bp, Artificial Sequence
  Synthetic
tttttcctaaaccccttcaaaatggcgggcgggacacaaaatggcggagggactaaggggggggcaagcccccct

SEQ ID NO: 341314 - DNA, 75 bp, Artificial Sequence
  Synthetic
taatgacagggctcaaggaagtgctgcaaaattacagctaaaaccacaaagctaacacaataaaccacaagaaat

SEQ ID NO: 341315 - DNA, 75 bp, Artificial Sequence
  Synthetic
gcaaaattacagctaaaaccacaaagctaacacaataaaccacaagaaatttcaggaaactgcaataaatttaga

SEQ ID NO: 341316 - DNA, 75 bp, Artificial Sequence
  Synthetic
gctaacacaataaaccacaagaaatttcaggaaactgcaataaatttagaaatacattacacataaccacaagat

SEQ ID NO: 341317 - DNA, 75 bp, Artificial Sequence
  Synthetic
cttccccttttagagtatataagtaagtgcgcagacgaatggctgagtttatgccgcaggtggtagacacgaaca

SEQ ID NO: 341318 - DNA, 75 bp, Artificial Sequence
  Synthetic
cgggtgccggagctcctgagagcggagtcaaggggcctatcgggcgggcggtaacctgcggaaccgggcccccct

SEQ ID NO: 341319 - DNA, 75 bp, Artificial Sequence
  Synthetic
agcgtactgcgcgcacggattattctgcggctgtaaagatccgaaaaaacatcttgaaaaatgcctttcagacgc

SEQ ID NO: 341320 - DNA, 75 bp, Artificial Sequence
  Synthetic
cacggagatggaggcaccggagatggaggcgctactttcgatattggcatcgacgccctactcgccgccgcagac

SEQ ID NO: 341321 - DNA, 75 bp, Artificial Sequence
  Synthetic
gaggcgctactttcgatattggcatcgacgccctactcgccgccgcagacactataaggtaaggagacggaggag

SEQ ID NO: 341322 - DNA, 75 bp, Artificial Sequence
  Synthetic
ctatactcagtggagtttacagaacttttttcatgaaaaattaaactggagagatatctggacagcctcaaatgt

SEQ ID NO: 341323 - DNA, 75 bp, Artificial Sequence
  Synthetic
ttttttcatgaaaaattaaactggagagatatctggacagcctcaaatgtaggaatggaatacgctagattttta

SEQ ID NO: 341324 - DNA, 75 bp, Artificial Sequence
  Synthetic
atgaatggagatcctatataataacatgggatcaggacattccttgtaaacctctaccatatacaaacttacatc

SEQ ID NO: 341325 - DNA, 75 bp, Artificial Sequence
  Synthetic
atgggatcaggacattccttgtaaacctctaccatatacaaacttacatcctttactaatgttacttaaaagaca

SEQ ID NO: 341326 - DNA, 75 bp, Artificial Sequence
  Synthetic
gactgtaaccctagcaaaaaagcaaaaccagtaacattaagaataaaacctcctccaaaactaaccagtcaatgg

SEQ ID NO: 341327 - DNA, 75 bp, Artificial Sequence
  Synthetic
aaccagtaacattaagaataaaacctcctccaaaactaaccagtcaatggagactagcaggagaattatcaaaaa

SEQ ID NO: 341328 - DNA, 75 bp, Artificial Sequence
  Synthetic
cttcatagacttgtcagaaccctggctagaaggttggggaaatgcattttatagcttactaggatatgaagcacc

SEQ ID NO: 341329 - DNA, 75 bp, Artificial Sequence
  Synthetic
ctagaaggttggggaaatgcattttatagcttactaggatatgaagcaccatatcaacaaggtagaaactgttat

SEQ ID NO: 341330 - DNA, 75 bp, Artificial Sequence
  Synthetic
tatatgacacgggagtaaataatgctgtatatgtactattactacagcaagatatagaagataatccaggagatt

SEQ ID NO: 341331 - DNA, 75 bp, Artificial Sequence
  Synthetic
tgtatatgtactattactacagcaagatatagaagataatccaggagatttagcaaaaaactactatgaaggacc

SEQ ID NO: 341332 - DNA, 75 bp, Artificial Sequence
  Synthetic
gaaaaagtgtcagaaaattggccttactggctatacttttttggaaggtcagaactaggcattaaaaacttagca

SEQ ID NO: 341333 - DNA, 75 bp, Artificial Sequence
  Synthetic
actggctatacttttttggaaggtcagaactaggcattaaaaacttagcaacaaacacacaaataagaaatgaac

SEQ ID NO: 341334 - DNA, 75 bp, Artificial Sequence
  Synthetic
attaaaaataggtgtaataggatgggcatcaagcaactacacagacaaagatagctcacaaaatacacaaacagg

SEQ ID NO: 341335 - DNA, 75 bp, Artificial Sequence
  Synthetic
tatacatattaccacacaggaggaataataggagcaggagccatagacaatttgtatgaaaaaggatggagacaa

SEQ ID NO: 341336 - DNA, 75 bp, Artificial Sequence
  Synthetic
ccgatggaacaaactttgactggggaaccagagcactatgcatactaagacaaaacatgaaactaggcccacaac

SEQ ID NO: 341337 - DNA, 75 bp, Artificial Sequence
  Synthetic
aaagcaaacacagcactaataacatcagtaccaaaagactatagacctgaactaaaggactataacctagccatg

SEQ ID NO: 341338 - DNA, 75 bp, Artificial Sequence
  Synthetic
actaaaggactataacctagccatgaaatatgtttttaaatttcagtggggaggacacggcaccgaaagattcaa

SEQ ID NO: 341339 - DNA, 75 bp, Artificial Sequence
  Synthetic
gaggacacggcaccgaaagattcaaaacagacatcggtgaccccagcaccataccctgccccttccaacaaggag

SEQ ID NO: 341340 - DNA, 75 bp, Artificial Sequence
  Synthetic
aacagacatcggtgaccccagcaccataccctgccccttccaacaaggagacaccagctttaccgggatacaaga

SEQ ID NO: 341341 - DNA, 75 bp, Artificial Sequence
  Synthetic
cttaacccctgggactatgactgtgacgggattgttagaacagatactctcaaaaaactcctcgaactccccaca

SEQ ID NO: 341342 - DNA, 75 bp, Artificial Sequence
  Synthetic
acgggattgttagaacagatactctcaaaaaactcctcgaactccccacagaaacggaggaggaggagagagcgt

SEQ ID NO: 341343 - DNA, 75 bp, Artificial Sequence
  Synthetic
gagaaggcccttatccgaagacgacgacgagagcgttatctcttctacgagcagctgtaccagcgaagaagaaga

SEQ ID NO: 341344 - DNA, 75 bp, Artificial Sequence
  Synthetic
gaaaaaaaagagacacaagcagcagcccagcaagcgaagactcctcaagcacctccagcgagtggtaaagagaat

SEQ ID NO: 341345 - DNA, 75 bp, Artificial Sequence
  Synthetic
aaaccttaataaaaactacttctctgaataaaaactacggtctcctgtgtccaatctatttttcctacaccccta

SEQ ID NO: 341346 - DNA, 75 bp, Artificial Sequence
  Synthetic
gggcaagccccccccaccccccatgcgggggctccgccccctgcaccccctggctaagtcacaaaatggcgggcg

SEQ ID NO: 341347 - DNA, 75 bp, Artificial Sequence
  Synthetic
taatgacagggttcaccggaaaggctgcaaaaattacagctaaaaccacaatcataacacaataaaccacaaact

SEQ ID NO: 341348 - DNA, 75 bp, Artificial Sequence
  Synthetic
tgtaaagaccccaaaaaacatcttgaaaaatgccttacagacgctatcgcagacgccgaaggagaccgagaagga

SEQ ID NO: 341349 - DNA, 75 bp, Artificial Sequence
  Synthetic
gctcctcgccgccgccgcgcaaaggtaaggagacggaggaggaaagctccggttatacaatggttccctccaagc

SEQ ID NO: 341350 - DNA, 75 bp, Artificial Sequence
  Synthetic
tctggccgttgagctacggacactggttccgtacctgtctcccctttaggcggttaaatggactagtattcccgg

SEQ ID NO: 341351 - DNA, 75 bp, Artificial Sequence
  Synthetic
gttccgtacctgtctcccctttaggcggttaaatggactagtattcccgggaggaggttgtgactggacccaatg

SEQ ID NO: 341352 - DNA, 75 bp, Artificial Sequence
  Synthetic
aaacttaactggagaaatatatggacagctagtaatgtgggcatggaatacgctaggtttttaaaaggaaaattt

SEQ ID NO: 341353 - DNA, 75 bp, Artificial Sequence
  Synthetic
cagctagtaatgtgggcatggaatacgctaggtttttaaaaggaaaattttacttctttagacatccttggcgaa

SEQ ID NO: 341354 - DNA, 75 bp, Artificial Sequence
  Synthetic
tataccgtgtaaaccgctaccatatcaaaacctgcacccacttttaatgctgttaaaaaaacagcacaaactcga

SEQ ID NO: 341355 - DNA, 75 bp, Artificial Sequence
  Synthetic
caaaacctgcacccacttttaatgctgttaaaaaaacagcacaaactcgaactgtcacagcaaaactgtaatcct

SEQ ID NO: 341356 - DNA, 75 bp, Artificial Sequence
  Synthetic
taaaaattaaaccacctccaaaattaacatcacaatggagactaagcagagaactagcaaaaataccattagtaa

SEQ ID NO: 341357 - DNA, 75 bp, Artificial Sequence
  Synthetic
aacatcacaatggagactaagcagagaactagcaaaaataccattagtaagactaggaataagtttcatagactt

SEQ ID NO: 341358 - DNA, 75 bp, Artificial Sequence
  Synthetic
ggaaatgctttttactctgtattaggatacgaagcaactaaaacacaaggtcattggtctaactgggcacaaatg

SEQ ID NO: 341359 - DNA, 75 bp, Artificial Sequence
  Synthetic
gatacgaagcaactaaaacacaaggtcattggtctaactgggcacaaatgaaatactattggatctatgacacag

SEQ ID NO: 341360 - DNA, 75 bp, Artificial Sequence
  Synthetic
tttattaaaacaagatgtacaggacaacccaggagatatggcacaaaaatggccaggacaagcaggccaacatcc

SEQ ID NO: 341361 - DNA, 75 bp, Artificial Sequence
  Synthetic
aacccaggagatatggcacaaaaatggccaggacaagcaggccaacatccggacgctatagatcatatagaatta

SEQ ID NO: 341362 - DNA, 75 bp, Artificial Sequence
  Synthetic
tttacttttatggaaaaagtgaaagagacatcaagacagaagcacacacaacagaaatagcaagagaattcgcta

SEQ ID NO: 341363 - DNA, 75 bp, Artificial Sequence
  Synthetic
aataggagtggtaggatgggcaagctcaaattatacagcaaacaatagctcacaaggagcaacaactgctataca

SEQ ID NO: 341364 - DNA, 75 bp, Artificial Sequence
  Synthetic
tcaaattatacagcaaacaatagctcacaaggagcaacaactgctatacaaggaggttatttagcctgggcagga

SEQ ID NO: 341365 - DNA, 75 bp, Artificial Sequence
  Synthetic
caggatcaatagataatttacaccttagagcatggcctcaagaccaaaactggccaaacacaaacagagaccaaa

SEQ ID NO: 341366 - DNA, 75 bp, Artificial Sequence
  Synthetic
gctatgtatactaagagataatatgaaattacgagatcaagacttagacgatgaaacaacaatgctatcactatt

SEQ ID NO: 341367 - DNA, 75 bp, Artificial Sequence
  Synthetic
aaattacgagatcaagacttagacgatgaaacaacaatgctatcactatttggaccatttgtagagaaagctaac

SEQ ID NO: 341368 - DNA, 75 bp, Artificial Sequence
  Synthetic
aatactttagagcagaactaaaagactataatctaatcatgaaatatgcctttaaattccagtggggaggacacg

SEQ ID NO: 341369 - DNA, 75 bp, Artificial Sequence
  Synthetic
gggtggtaaagaggatgaaaacactgtgatagataaatatagaaacctagcagacccctcactaaatgtcactgg

SEQ ID NO: 341370 - DNA, 75 bp, Artificial Sequence
  Synthetic
accccccatgcgggggctccgccccctgcacccccctgctaagtcacaaaatggcggcgcggctgggacacaaaa

SEQ ID NO: 341371 - DNA, 75 bp, Artificial Sequence
  Synthetic
aggggggggcaagccccccccaccccccatgcgggggctccgccccctgcacccccttgctaagtcacaaaatgg

SEQ ID NO: 341372 - DNA, 75 bp, Artificial Sequence
  Synthetic
taatgacagggttcaccggaaaggctgcaaagattacagctaaaaccacaattataacacaataaaccacaaaat

SEQ ID NO: 341373 - DNA, 75 bp, Artificial Sequence
  Synthetic
gacgccgaaggagaccgacaagacgatggaggcaccggaggtggagacgctactttcgatatcggtatcgacgcg

SEQ ID NO: 341374 - DNA, 75 bp, Artificial Sequence
  Synthetic
tactttcgatatcggtatcgacgcgctcctcgccgccgccgcccaaaggtaaggagacggaggagaaaagctccg

SEQ ID NO: 341375 - DNA, 75 bp, Artificial Sequence
  Synthetic
aggaggttgtgactggactcaatggagcttacaaaatttgtaccatgaaaaacttaactggagaaatatctggac

SEQ ID NO: 341376 - DNA, 75 bp, Artificial Sequence
  Synthetic
agcttacaaaatttgtaccatgaaaaacttaactggagaaatatctggacagcaagtaatgtaggaatggagttc

SEQ ID NO: 341377 - DNA, 75 bp, Artificial Sequence
  Synthetic
acttttttagacacccatggagaaattatatagtaacttgggatcaggacattccttgtaaaccattaccttatc

SEQ ID NO: 341378 - DNA, 75 bp, Artificial Sequence
  Synthetic
ttatatagtaacttgggatcaggacattccttgtaaaccattaccttatcaaaacttacacccactgctaatgct

SEQ ID NO: 341379 - DNA, 75 bp, Artificial Sequence
  Synthetic
ctatctcaacaaaactgtaacccaaacagaaaacagaaacctgtcactttaaaattcagaccgccacctaaacta

SEQ ID NO: 341380 - DNA, 75 bp, Artificial Sequence
  Synthetic
acagaaaacagaaacctgtcactttaaaattcagaccgccacctaaactaacatcacaatggagattaagcagag

SEQ ID NO: 341381 - DNA, 75 bp, Artificial Sequence
  Synthetic
attaggagtaagctttatagacttaacagaaccatggttagaaggttggggaaatgctttctactctatattagg

SEQ ID NO: 341382 - DNA, 75 bp, Artificial Sequence
  Synthetic
acagaaccatggttagaaggttggggaaatgctttctactctatattaggatacgaagcaactaaacaacaagga

SEQ ID NO: 341383 - DNA, 75 bp, Artificial Sequence
  Synthetic
aatattactggatatatgacaccggagtaggaaatgcagtatatgttgtaatgttaaaacaagagacacaatcaa

SEQ ID NO: 341384 - DNA, 75 bp, Artificial Sequence
  Synthetic
agtaggaaatgcagtatatgttgtaatgttaaaacaagagacacaatcaaatccaggacaaatggtaaaaaactt

SEQ ID NO: 341385 - DNA, 75 bp, Artificial Sequence
  Synthetic
cagaaatagcaagagaatatgcacaaaacccaaactctttaaaattaaaaataggaattgtaggatgggcctcat

SEQ ID NO: 341386 - DNA, 75 bp, Artificial Sequence
  Synthetic
gctatacaaggaggatacgtagcatgggcaggaggagcaggaaaatataatttaggagcaggatccatagataat

SEQ ID NO: 341387 - DNA, 75 bp, Artificial Sequence
  Synthetic
gggcaggaggagcaggaaaatataatttaggagcaggatccatagataatttacaccaaaaaggctggccaaata

SEQ ID NO: 341388 - DNA, 75 bp, Artificial Sequence
  Synthetic
ataacatgactttaggaactcaagaattagacgatgaaactacaatgttaagcttattcggacccttcgtagaaa

SEQ ID NO: 341389 - DNA, 75 bp, Artificial Sequence
  Synthetic
tcaacccctgggactatgactgtgatgggattgttagaaaagatactctcaaaagacttctcgaactccccacag

SEQ ID NO: 341390 - DNA, 75 bp, Artificial Sequence
  Synthetic
gtcacaaaatggcggcgcggctgggacacaaaatggcgacgtagcggggggggaacccccccgcaccccccatgc

SEQ ID NO: 341391 - DNA, 75 bp, Artificial Sequence
  Synthetic
atagaaaatggcggacaaaatggcggacagggggcggagcttatgcaaattaatttatgcaaagtaggaggagct

SEQ ID NO: 341392 - DNA, 75 bp, Artificial Sequence
  Synthetic
ctatgccggaacactgggaagaagcctggttggaagctaccaagggctggcacgatctcgactgtcgctgcggta

SEQ ID NO: 341393 - DNA, 75 bp, Artificial Sequence
  Synthetic
tactaccgctacaggccgcgttactatcggcgacgatggctggtaaggagaaggcggcgttccgtctaccgtaga

SEQ ID NO: 341394 - DNA, 75 bp, Artificial Sequence
  Synthetic
aaggcggcgttccgtctaccgtagaggtggacgtagagcgcgcccctaccgcattagtacctttaaccctaaagt

SEQ ID NO: 341395 - DNA, 75 bp, Artificial Sequence
  Synthetic
tggtggccaatactacaatgtctcaaaggccaggaatcattaagatataggccactgcagtgggacgctgaaaag

SEQ ID NO: 341396 - DNA, 75 bp, Artificial Sequence
  Synthetic
aaggccaggaatcattaagatataggccactgcagtgggacgctgaaaagcagtggagagtgaaaaaggactacg

SEQ ID NO: 341397 - DNA, 75 bp, Artificial Sequence
  Synthetic
atacggaggaggttgggggagtggggaagtaacactggagggactataccaggaacacttactatggagaaactc

SEQ ID NO: 341398 - DNA, 75 bp, Artificial Sequence
  Synthetic
gaagtaacactggagggactataccaggaacacttactatggagaaactcctggtcaaagggaaacgatggaatg

SEQ ID NO: 341399 - DNA, 75 bp, Artificial Sequence
  Synthetic
tagtatatctatacccactacaagaccaagactactggttttggtgggacacagacttcaaggaactatacgctg

SEQ ID NO: 341400 - DNA, 75 bp, Artificial Sequence
  Synthetic
ccaagactactggttttggtgggacacagacttcaaggaactatacgctgagagcattaaagaatactctcaacc

SEQ ID NO: 341401 - DNA, 75 bp, Artificial Sequence
  Synthetic
acgagactagtaatagccagagacagagcaccacatagaagaagagtgagaaagatattcattccaccaccaagt

SEQ ID NO: 341402 - DNA, 75 bp, Artificial Sequence
  Synthetic
gagcaccacatagaagaagagtgagaaagatattcattccaccaccaagtagagacacaacacagtggcagtttc

SEQ ID NO: 341403 - DNA, 75 bp, Artificial Sequence
  Synthetic
attcacatgggcggcgggacttatagacatgcaaaaaccatttgatgcaaacggagcgtttagaaacgcatggtg

SEQ ID NO: 341404 - DNA, 75 bp, Artificial Sequence
  Synthetic
gacatgcaaaaaccatttgatgcaaacggagcgtttagaaacgcatggtggcttgaaactagaaacgaccaggga

SEQ ID NO: 341405 - DNA, 75 bp, Artificial Sequence
  Synthetic
gaagagttccgccacagggtgacacagaattaccaaaacagagtgagtttaaaaagggagataataaccctaact

SEQ ID NO: 341406 - DNA, 75 bp, Artificial Sequence
  Synthetic
agaattaccaaaacagagtgagtttaaaaagggagataataaccctaactacagcatacaagagggtcatgaaaa

SEQ ID NO: 341407 - DNA, 75 bp, Artificial Sequence
  Synthetic
gtggaccagaaagaccagaaaacaagaaaaaaatactgtgtatgttataacaaaaccttaaatagatggcgaaaa

SEQ ID NO: 341408 - DNA, 75 bp, Artificial Sequence
  Synthetic
gaaaaaaatactgtgtatgttataacaaaaccttaaatagatggcgaaaagcacaggcaagtacattagccatag

SEQ ID NO: 341409 - DNA, 75 bp, Artificial Sequence
  Synthetic
acagctcatgaatcaggagatgacatactactggaaatcaggagaattctcttcaccattcatgcaaagatggaa

SEQ ID NO: 341410 - DNA, 75 bp, Artificial Sequence
  Synthetic
tactactggaaatcaggagaattctcttcaccattcatgcaaagatggaaaggaactagactaataaccattgac

SEQ ID NO: 341411 - DNA, 75 bp, Artificial Sequence
  Synthetic
ctaaagtgagtgcgtgggaatgggggcaaaactggaacactagtggaacagtactgcaagaggtgttcaatatta

SEQ ID NO: 341412 - DNA, 75 bp, Artificial Sequence
  Synthetic
agacgacttcgcaaaacttacacttccaaagtcgccacatgacatagactttgggcaccacagtagatttggccc

SEQ ID NO: 341413 - DNA, 75 bp, Artificial Sequence
  Synthetic
ccaaagtcgccacatgacatagactttgggcaccacagtagatttggcccgttctgtgtgaagaacgaaccacta

SEQ ID NO: 341414 - DNA, 75 bp, Artificial Sequence
  Synthetic
cgactaacctatggtttcagtacaaatttctctttcagtttggcggtgaataccagccaccaacaggtatccgcg

SEQ ID NO: 341415 - DNA, 75 bp, Artificial Sequence
  Synthetic
taccagccaccaacaggtatccgcgatccctgcattgatacaccagcctatcctgtgccacagtcaggaagtgtt

SEQ ID NO: 341416 - DNA, 75 bp, Artificial Sequence
  Synthetic
gcggaatgctcacggaaacagaccgttggggtatcactactgcctcttccagaaccctcagtgcagatacaccca

SEQ ID NO: 341417 - DNA, 75 bp, Artificial Sequence
  Synthetic
ttggggtatcactactgcctcttccagaaccctcagtgcagatacacccacggaagcagcgcaaagtgcacttct

SEQ ID NO: 341418 - DNA, 75 bp, Artificial Sequence
  Synthetic
gaggaaaccgaggaaaccgcgtcatcgtccagtatcacgagtgccgaaagctctactgagggagatggatcgtct

SEQ ID NO: 341419 - DNA, 75 bp, Artificial Sequence
  Synthetic
ctctactgagggagatggatcgtctgatgatgaagagacaatcagacgcagaaggaggacctggaagcgactcag

SEQ ID NO: 341420 - DNA, 75 bp, Artificial Sequence
  Synthetic
cgacgaatggaccacaagcgacagcgacttcattgacacccccataagagagagatgcctgaataaaaaacaaaa

SEQ ID NO: 341421 - DNA, 75 bp, Artificial Sequence
  Synthetic
caaaccccccgcgtcggatgggggggctgcgccccccccaaaccccccttgcccggggctgtgccccggaccccc

SEQ ID NO: 341422 - DNA, 75 bp, Artificial Sequence
  Synthetic
tttaaaaatggcgcccaaacatggcggaggagggcggagtttatgcaaattaatttatgcaaagtaggaggagct

SEQ ID NO: 341423 - DNA, 75 bp, Artificial Sequence
  Synthetic
ctcaagtcctcatttgcatagggtgtaaccaatcagaattagggcgttcccagtaaagtgaatataagtaagtgc

SEQ ID NO: 341424 - DNA, 75 bp, Artificial Sequence
  Synthetic
gaggagagggggatggagacgtcgatatgggaggcgttggagacggactgcctggagacgtcggcgggtaaggag

SEQ ID NO: 341425 - DNA, 75 bp, Artificial Sequence
  Synthetic
agttaggcgtgtagtgatcaagggatggtggccacttattcagtgtatgcagggaatggagtatctaagatacag

SEQ ID NO: 341426 - DNA, 75 bp, Artificial Sequence
  Synthetic
tggtggccacttattcagtgtatgcagggaatggagtatctaagatacagaccaatgaataacatagaaaaaaga

SEQ ID NO: 341427 - DNA, 75 bp, Artificial Sequence
  Synthetic
caatgcaccgataaaccgatggagaaagagagaggcaatggcaatacaagtgagagacctgagagggctatgtct

SEQ ID NO: 341428 - DNA, 75 bp, Artificial Sequence
  Synthetic
gctcgaccctcacacaacactgcagatagggggcgcaattgggatcgttagaaaactatggccgagcatgggaca

SEQ ID NO: 341429 - DNA, 75 bp, Artificial Sequence
  Synthetic
tgcaaaattacagctaaaaccacaatactaacacaataaaccacaaagtattacaggaaactgcaataaattaag

SEQ ID NO: 341430 - DNA, 75 bp, Artificial Sequence
  Synthetic
ttacaggaaactgcaataaattaagacataaattacacataaccaccaaaccacaggaaactctgcaaaaaagag

SEQ ID NO: 341431 - DNA, 75 bp, Artificial Sequence
  Synthetic
ccgttgagctacggacactggttccgtacctgtctcccctttagaagaaaaaatggactagtatttacgggagga

SEQ ID NO: 341432 - DNA, 75 bp, Artificial Sequence
  Synthetic
gattcttaagaggaaaattctacttttttagacatccttggagaaactatattgtgacttgggatcaggacattc

SEQ ID NO: 341433 - DNA, 75 bp, Artificial Sequence
  Synthetic
tctgcatccgctgctaatgctactaaaaaaacaacacaaattagtactttcgcagcaaaattgcaaccctaacag

SEQ ID NO: 341434 - DNA, 75 bp, Artificial Sequence
  Synthetic
aaccatggctagaaggttggggaaatgcattttattcaatattaggatacgaagcagaaaaaactcaaggacgtg

SEQ ID NO: 341435 - DNA, 75 bp, Artificial Sequence
  Synthetic
tgcattttattcaatattaggatacgaagcagaaaaaactcaaggacgtgtttctaattgggcacagatcaaata

SEQ ID NO: 341436 - DNA, 75 bp, Artificial Sequence
  Synthetic
ggaaacgcagtatatgttataatgttaaaaaaagaaacacaatcaaatccaggacaaatggtaaaaaactttcca

SEQ ID NO: 341437 - DNA, 75 bp, Artificial Sequence
  Synthetic
aggacaaatggtaaaaaactttccagcagacagtggaagacatccagatgctatagaccatatagaattaataaa

SEQ ID NO: 341438 - DNA, 75 bp, Artificial Sequence
  Synthetic
ttctatggaaagagcgaacaagacataaaaaaagaagcacacagtacagaaatagcaagagaatatgcacaaaac

SEQ ID NO: 341439 - DNA, 75 bp, Artificial Sequence
  Synthetic
ccaaactccttaaagctaaaaataggcatagtaggatgggcatcatcaaactatacaacaccaggtagtgttcaa
